United States Patent 11,421,016 (CANCER NEOEPITOPES) - sequence listing, part 6

SEQ ID NO: 230966 - protein, 9 aa, Homo Sapiens
CSEIFMDEW

SEQ ID NO: 230967 - protein, 9 aa, Homo Sapiens
QPQTTVTAG

SEQ ID NO: 230968 - protein, 9 aa, Homo Sapiens
KTFHMKCFL

SEQ ID NO: 230969 - protein, 9 aa, Homo Sapiens
WNGFSNLVR

SEQ ID NO: 230970 - protein, 9 aa, Homo Sapiens
DRELWPWCF

SEQ ID NO: 230971 - protein, 9 aa, Homo Sapiens
STTPWTRAN

SEQ ID NO: 230972 - protein, 9 aa, Homo Sapiens
KCAQCWPSD

SEQ ID NO: 230973 - protein, 9 aa, Homo Sapiens
GRQCGPCGS

SEQ ID NO: 230974 - protein, 9 aa, Homo Sapiens
VGVVLSPWC

SEQ ID NO: 230975 - protein, 9 aa, Homo Sapiens
DWVDDQRSE

SEQ ID NO: 230976 - protein, 9 aa, Homo Sapiens
GLYPVLCSP

SEQ ID NO: 230977 - protein, 9 aa, Homo Sapiens
HAPEGRGLA

SEQ ID NO: 230978 - protein, 9 aa, Homo Sapiens
LAIMWLTMS

SEQ ID NO: 230979 - protein, 9 aa, Homo Sapiens
LRLAYLISA

SEQ ID NO: 230980 - protein, 9 aa, Homo Sapiens
SASGRNEPS

SEQ ID NO: 230981 - protein, 9 aa, Homo Sapiens
SFFPASAVS

SEQ ID NO: 230982 - protein, 9 aa, Homo Sapiens
RCQRRDTTH

SEQ ID NO: 230983 - protein, 9 aa, Homo Sapiens
TPSKKKLKL

SEQ ID NO: 230984 - protein, 9 aa, Homo Sapiens
PGPGVHGLV

SEQ ID NO: 230985 - protein, 9 aa, Homo Sapiens
AQMYLWPQL

SEQ ID NO: 230986 - protein, 9 aa, Homo Sapiens
HAPVGFSAG

SEQ ID NO: 230987 - protein, 9 aa, Homo Sapiens
QEEQLKLKD

SEQ ID NO: 230988 - protein, 9 aa, Homo Sapiens
GAGVVLARL

SEQ ID NO: 230989 - protein, 9 aa, Homo Sapiens
SKLWPEVLQ

SEQ ID NO: 230990 - protein, 9 aa, Homo Sapiens
PGSPLFKIV

SEQ ID NO: 230991 - protein, 9 aa, Homo Sapiens
LQFTPDREE

SEQ ID NO: 230992 - protein, 9 aa, Homo Sapiens
CCTPTCAPR

SEQ ID NO: 230993 - protein, 9 aa, Homo Sapiens
SSRIPRRTH

SEQ ID NO: 230994 - protein, 9 aa, Homo Sapiens
LVVFFCICG

SEQ ID NO: 230995 - protein, 9 aa, Homo Sapiens
EIREKGSAY

SEQ ID NO: 230996 - protein, 9 aa, Homo Sapiens
GSWWAPSRS

SEQ ID NO: 230997 - protein, 9 aa, Homo Sapiens
NTLEFTLER

SEQ ID NO: 230998 - protein, 9 aa, Homo Sapiens
SRLRSWRTN

SEQ ID NO: 230999 - protein, 9 aa, Homo Sapiens
SLGYVASLE

SEQ ID NO: 231000 - protein, 9 aa, Homo Sapiens
PTIVQGHYR

SEQ ID NO: 231001 - protein, 9 aa, Homo Sapiens
QTAALAAEV

SEQ ID NO: 231002 - protein, 9 aa, Homo Sapiens
SPLSTTPWT

SEQ ID NO: 231003 - protein, 9 aa, Homo Sapiens
FVDLKNGKF

SEQ ID NO: 231004 - protein, 9 aa, Homo Sapiens
SIYNRRTMK

SEQ ID NO: 231005 - protein, 9 aa, Homo Sapiens
QVTAHTGGQ

SEQ ID NO: 231006 - protein, 9 aa, Homo Sapiens
QGRRKRRCR

SEQ ID NO: 231007 - protein, 9 aa, Homo Sapiens
ISLHMSYAP

SEQ ID NO: 231008 - protein, 9 aa, Homo Sapiens
ECTKHDRQF

SEQ ID NO: 231009 - protein, 9 aa, Homo Sapiens
AIFLIMLLV

SEQ ID NO: 231010 - protein, 9 aa, Homo Sapiens
ARPQNGPQW

SEQ ID NO: 231011 - protein, 9 aa, Homo Sapiens
DEKSLLEKE

SEQ ID NO: 231012 - protein, 9 aa, Homo Sapiens
KPYIYRPTS

SEQ ID NO: 231013 - protein, 9 aa, Homo Sapiens
LSSLQAETK

SEQ ID NO: 231014 - protein, 9 aa, Homo Sapiens
SHQIFVTKN

SEQ ID NO: 231015 - protein, 9 aa, Homo Sapiens
KVFSRDGLS

SEQ ID NO: 231016 - protein, 9 aa, Homo Sapiens
VTRGASTCP

SEQ ID NO: 231017 - protein, 9 aa, Homo Sapiens
SCDPPSSMG

SEQ ID NO: 231018 - protein, 9 aa, Homo Sapiens
SGSGWLSKI

SEQ ID NO: 231019 - protein, 9 aa, Homo Sapiens
QDLGIGQLS

SEQ ID NO: 231020 - protein, 9 aa, Homo Sapiens
CYTKNEKTD

SEQ ID NO: 231021 - protein, 9 aa, Homo Sapiens
QHCYDACVF

SEQ ID NO: 231022 - protein, 9 aa, Homo Sapiens
PMKFKLLGD

SEQ ID NO: 231023 - protein, 9 aa, Homo Sapiens
CTHKEGETP

SEQ ID NO: 231024 - protein, 9 aa, Homo Sapiens
GLIDELTAL

SEQ ID NO: 231025 - protein, 9 aa, Homo Sapiens
EEKDPCSPR

SEQ ID NO: 231026 - protein, 9 aa, Homo Sapiens
SLLSPCNAS

SEQ ID NO: 231027 - protein, 9 aa, Homo Sapiens
RTPQAPSPA

SEQ ID NO: 231028 - protein, 9 aa, Homo Sapiens
GMPEEHGIG

SEQ ID NO: 231029 - protein, 9 aa, Homo Sapiens
LLLGVPQTA

SEQ ID NO: 231030 - protein, 9 aa, Homo Sapiens
IKAGPRRPH

SEQ ID NO: 231031 - protein, 9 aa, Homo Sapiens
PVGFSAGEV

SEQ ID NO: 231032 - protein, 9 aa, Homo Sapiens
LVNHHQQMG

SEQ ID NO: 231033 - protein, 9 aa, Homo Sapiens
LLFLAVGGP

SEQ ID NO: 231034 - protein, 9 aa, Homo Sapiens
HKDILLSPV

SEQ ID NO: 231035 - protein, 9 aa, Homo Sapiens
RARSRGLGR

SEQ ID NO: 231036 - protein, 9 aa, Homo Sapiens
TKIYQLIHK

SEQ ID NO: 231037 - protein, 9 aa, Homo Sapiens
STSLTFKSV

SEQ ID NO: 231038 - protein, 9 aa, Homo Sapiens
GLDFQYSHL

SEQ ID NO: 231039 - protein, 9 aa, Homo Sapiens
AAIAEKNHA

SEQ ID NO: 231040 - protein, 9 aa, Homo Sapiens
AMLPKLLCR

SEQ ID NO: 231041 - protein, 9 aa, Homo Sapiens
RDDNHPKGR

SEQ ID NO: 231042 - protein, 9 aa, Homo Sapiens
SFKVPPVAN

SEQ ID NO: 231043 - protein, 9 aa, Homo Sapiens
EKMMDRIKL

SEQ ID NO: 231044 - protein, 9 aa, Homo Sapiens
VMPHHSLKM

SEQ ID NO: 231045 - protein, 9 aa, Homo Sapiens
GLEKTGMAV

SEQ ID NO: 231046 - protein, 9 aa, Homo Sapiens
NLMRGWERA

SEQ ID NO: 231047 - protein, 9 aa, Homo Sapiens
CMSLQEKLL

SEQ ID NO: 231048 - protein, 9 aa, Homo Sapiens
ECQSKGKIK

SEQ ID NO: 231049 - protein, 9 aa, Homo Sapiens
LDYLKNKKE

SEQ ID NO: 231050 - protein, 9 aa, Homo Sapiens
SIAAALKRH

SEQ ID NO: 231051 - protein, 9 aa, Homo Sapiens
KHRAACLIQ

SEQ ID NO: 231052 - protein, 9 aa, Homo Sapiens
SPATGPTSS

SEQ ID NO: 231053 - protein, 9 aa, Homo Sapiens
LTPCSHSLA

SEQ ID NO: 231054 - protein, 9 aa, Homo Sapiens
CQTAICDPD

SEQ ID NO: 231055 - protein, 9 aa, Homo Sapiens
LIYFFFFLL

SEQ ID NO: 231056 - protein, 9 aa, Homo Sapiens
GTRRFRMRM

SEQ ID NO: 231057 - protein, 9 aa, Homo Sapiens
IPRLPTGLY

SEQ ID NO: 231058 - protein, 9 aa, Homo Sapiens
LGDKGLKKM

SEQ ID NO: 231059 - protein, 9 aa, Homo Sapiens
VSDVPKSCR

SEQ ID NO: 231060 - protein, 9 aa, Homo Sapiens
VTKFLVANQ

SEQ ID NO: 231061 - protein, 9 aa, Homo Sapiens
PSSDEIRYR

SEQ ID NO: 231062 - protein, 9 aa, Homo Sapiens
SDVTLMISI

SEQ ID NO: 231063 - protein, 9 aa, Homo Sapiens
EEGAAWAPG

SEQ ID NO: 231064 - protein, 9 aa, Homo Sapiens
PRSPASPAH

SEQ ID NO: 231065 - protein, 9 aa, Homo Sapiens
TLPPIVNPD

SEQ ID NO: 231066 - protein, 9 aa, Homo Sapiens
RMFPPSRCE

SEQ ID NO: 231067 - protein, 9 aa, Homo Sapiens
IQSLVNLLV

SEQ ID NO: 231068 - protein, 9 aa, Homo Sapiens
RTQHQINGR

SEQ ID NO: 231069 - protein, 9 aa, Homo Sapiens
SWDIIIDPN

SEQ ID NO: 231070 - protein, 9 aa, Homo Sapiens
RCPWRTAPS

SEQ ID NO: 231071 - protein, 9 aa, Homo Sapiens
SNSSDSLEG

SEQ ID NO: 231072 - protein, 9 aa, Homo Sapiens
LKKMTLKAL

SEQ ID NO: 231073 - protein, 9 aa, Homo Sapiens
ENSSEQLGV

SEQ ID NO: 231074 - protein, 9 aa, Homo Sapiens
HSFLVKSKK

SEQ ID NO: 231075 - protein, 9 aa, Homo Sapiens
RERIQMLLS

SEQ ID NO: 231076 - protein, 9 aa, Homo Sapiens
TSCFCMAGT

SEQ ID NO: 231077 - protein, 9 aa, Homo Sapiens
HDRDQSEAS

SEQ ID NO: 231078 - protein, 9 aa, Homo Sapiens
YRFTEGPPC

SEQ ID NO: 231079 - protein, 9 aa, Homo Sapiens
QAAQQRFHL

SEQ ID NO: 231080 - protein, 9 aa, Homo Sapiens
VGRGGGGRT

SEQ ID NO: 231081 - protein, 9 aa, Homo Sapiens
QEGHGSHHQ

SEQ ID NO: 231082 - protein, 9 aa, Homo Sapiens
RARPRARRG

SEQ ID NO: 231083 - protein, 9 aa, Homo Sapiens
DCPRTMAGP

SEQ ID NO: 231084 - protein, 9 aa, Homo Sapiens
QDLVSGSVK

SEQ ID NO: 231085 - protein, 9 aa, Homo Sapiens
LSCPPRSST

SEQ ID NO: 231086 - protein, 9 aa, Homo Sapiens
RRVASRVWP

SEQ ID NO: 231087 - protein, 9 aa, Homo Sapiens
LSTTWIFGV

SEQ ID NO: 231088 - protein, 9 aa, Homo Sapiens
SSDISCVGI

SEQ ID NO: 231089 - protein, 9 aa, Homo Sapiens
TQEHLEAAT

SEQ ID NO: 231090 - protein, 9 aa, Homo Sapiens
RRQRMEAAA

SEQ ID NO: 231091 - protein, 9 aa, Homo Sapiens
CQSAECQPH

SEQ ID NO: 231092 - protein, 9 aa, Homo Sapiens
RARRSRVPR

SEQ ID NO: 231093 - protein, 9 aa, Homo Sapiens
FLSKKGNFQ

SEQ ID NO: 231094 - protein, 9 aa, Homo Sapiens
VCPDCEVAT

SEQ ID NO: 231095 - protein, 9 aa, Homo Sapiens
AVVASSSGG

SEQ ID NO: 231096 - protein, 9 aa, Homo Sapiens
RVVEELESY

SEQ ID NO: 231097 - protein, 9 aa, Homo Sapiens
DIPPASHVC

SEQ ID NO: 231098 - protein, 9 aa, Homo Sapiens
GLSEDQVLH

SEQ ID NO: 231099 - protein, 9 aa, Homo Sapiens
PRAEVSQRA

SEQ ID NO: 231100 - protein, 9 aa, Homo Sapiens
KHRRDFIKE

SEQ ID NO: 231101 - protein, 9 aa, Homo Sapiens
PLRVTDFEV

SEQ ID NO: 231102 - protein, 9 aa, Homo Sapiens
EEVHHKPKL

SEQ ID NO: 231103 - protein, 9 aa, Homo Sapiens
MVTKLTRGG

SEQ ID NO: 231104 - protein, 9 aa, Homo Sapiens
HSTPVPAAP

SEQ ID NO: 231105 - protein, 9 aa, Homo Sapiens
NKLELYEEV

SEQ ID NO: 231106 - protein, 9 aa, Homo Sapiens
LPPPPPCPA

SEQ ID NO: 231107 - protein, 9 aa, Homo Sapiens
SMDVNLLCV

SEQ ID NO: 231108 - protein, 9 aa, Homo Sapiens
QPTVSTGGH

SEQ ID NO: 231109 - protein, 9 aa, Homo Sapiens
SKGTSLYDL

SEQ ID NO: 231110 - protein, 9 aa, Homo Sapiens
CPVGKQQMM

SEQ ID NO: 231111 - protein, 9 aa, Homo Sapiens
WPPLTLQQR

SEQ ID NO: 231112 - protein, 9 aa, Homo Sapiens
LLKLLVHWV

SEQ ID NO: 231113 - protein, 9 aa, Homo Sapiens
KSRSMLREW

SEQ ID NO: 231114 - protein, 9 aa, Homo Sapiens
LYNPPTIHY

SEQ ID NO: 231115 - protein, 9 aa, Homo Sapiens
GDVVHPQFK

SEQ ID NO: 231116 - protein, 9 aa, Homo Sapiens
KKELAASLT

SEQ ID NO: 231117 - protein, 9 aa, Homo Sapiens
SSAGTAGML

SEQ ID NO: 231118 - protein, 9 aa, Homo Sapiens
GILSPMASE

SEQ ID NO: 231119 - protein, 9 aa, Homo Sapiens
TTAFCRPTT

SEQ ID NO: 231120 - protein, 9 aa, Homo Sapiens
QGRPELSFA

SEQ ID NO: 231121 - protein, 9 aa, Homo Sapiens
SPVISRWDS

SEQ ID NO: 231122 - protein, 9 aa, Homo Sapiens
GLPRLMSGV

SEQ ID NO: 231123 - protein, 9 aa, Homo Sapiens
EQVHRHVDQ

SEQ ID NO: 231124 - protein, 9 aa, Homo Sapiens
GNRLRLQGM

SEQ ID NO: 231125 - protein, 9 aa, Homo Sapiens
HNCYHEGKS

SEQ ID NO: 231126 - protein, 9 aa, Homo Sapiens
VEPRELLTK

SEQ ID NO: 231127 - protein, 9 aa, Homo Sapiens
SIPDILQEF

SEQ ID NO: 231128 - protein, 9 aa, Homo Sapiens
RCSAPPTKG

SEQ ID NO: 231129 - protein, 9 aa, Homo Sapiens
LVEMYEESV

SEQ ID NO: 231130 - protein, 9 aa, Homo Sapiens
QVRSSGSAL

SEQ ID NO: 231131 - protein, 9 aa, Homo Sapiens
GPRDIKAFQ

SEQ ID NO: 231132 - protein, 9 aa, Homo Sapiens
IGGCGRVCY

SEQ ID NO: 231133 - protein, 9 aa, Homo Sapiens
EAEAEVNVV

SEQ ID NO: 231134 - protein, 9 aa, Homo Sapiens
EMVTAKRPW

SEQ ID NO: 231135 - protein, 9 aa, Homo Sapiens
ARNLLTSGA

SEQ ID NO: 231136 - protein, 9 aa, Homo Sapiens
KQYSRDEGF

SEQ ID NO: 231137 - protein, 9 aa, Homo Sapiens
KTHPCTMLL

SEQ ID NO: 231138 - protein, 9 aa, Homo Sapiens
RQKRCMRHA

SEQ ID NO: 231139 - protein, 9 aa, Homo Sapiens
IDFCDAPEA

SEQ ID NO: 231140 - protein, 9 aa, Homo Sapiens
HFLSLPETA

SEQ ID NO: 231141 - protein, 9 aa, Homo Sapiens
PDSVLFRPC

SEQ ID NO: 231142 - protein, 9 aa, Homo Sapiens
CITQDGWVA

SEQ ID NO: 231143 - protein, 9 aa, Homo Sapiens
CHKKTSQLD

SEQ ID NO: 231144 - protein, 9 aa, Homo Sapiens
KGGNKKFFG

SEQ ID NO: 231145 - protein, 9 aa, Homo Sapiens
RYGVEDFWE

SEQ ID NO: 231146 - protein, 9 aa, Homo Sapiens
TKVWKMNWK

SEQ ID NO: 231147 - protein, 9 aa, Homo Sapiens
GGAMQLTFH

SEQ ID NO: 231148 - protein, 9 aa, Homo Sapiens
ALPASMRWR

SEQ ID NO: 231149 - protein, 9 aa, Homo Sapiens
ADGLFMVTM

SEQ ID NO: 231150 - protein, 9 aa, Homo Sapiens
ISINKVNGL

SEQ ID NO: 231151 - protein, 9 aa, Homo Sapiens
EDERRRATH

SEQ ID NO: 231152 - protein, 9 aa, Homo Sapiens
EILGSVDQY

SEQ ID NO: 231153 - protein, 9 aa, Homo Sapiens
RWEGTCFSE

SEQ ID NO: 231154 - protein, 9 aa, Homo Sapiens
QMCVDARTF

SEQ ID NO: 231155 - protein, 9 aa, Homo Sapiens
PGAEEVGVV

SEQ ID NO: 231156 - protein, 9 aa, Homo Sapiens
PVCGARGWG

SEQ ID NO: 231157 - protein, 9 aa, Homo Sapiens
FLGLLMVLA

SEQ ID NO: 231158 - protein, 9 aa, Homo Sapiens
SSEQLGVDG

SEQ ID NO: 231159 - protein, 9 aa, Homo Sapiens
KRREGVKSE

SEQ ID NO: 231160 - protein, 9 aa, Homo Sapiens
PRGPGMPNS

SEQ ID NO: 231161 - protein, 9 aa, Homo Sapiens
GLSSPPLWA

SEQ ID NO: 231162 - protein, 9 aa, Homo Sapiens
MKCFLNLSQ

SEQ ID NO: 231163 - protein, 9 aa, Homo Sapiens
YRAKRRNHF

SEQ ID NO: 231164 - protein, 9 aa, Homo Sapiens
EAAGSALQI

SEQ ID NO: 231165 - protein, 9 aa, Homo Sapiens
DPKTDPRAA

SEQ ID NO: 231166 - protein, 9 aa, Homo Sapiens
LLTTVRRKK

SEQ ID NO: 231167 - protein, 9 aa, Homo Sapiens
RGHCAGAAC

SEQ ID NO: 231168 - protein, 9 aa, Homo Sapiens
TVSFVGQIS

SEQ ID NO: 231169 - protein, 9 aa, Homo Sapiens
RFSRVDATT

SEQ ID NO: 231170 - protein, 9 aa, Homo Sapiens
KSGTHQMRT

SEQ ID NO: 231171 - protein, 9 aa, Homo Sapiens
ADVPVATDD

SEQ ID NO: 231172 - protein, 9 aa, Homo Sapiens
GSQPIYRSS

SEQ ID NO: 231173 - protein, 9 aa, Homo Sapiens
ITGICWLLG

SEQ ID NO: 231174 - protein, 9 aa, Homo Sapiens
VSASRAVEG

SEQ ID NO: 231175 - protein, 9 aa, Homo Sapiens
CAGPGPPTR

SEQ ID NO: 231176 - protein, 9 aa, Homo Sapiens
LRTTSPMTF

SEQ ID NO: 231177 - protein, 9 aa, Homo Sapiens
KIMQLMEKL

SEQ ID NO: 231178 - protein, 9 aa, Homo Sapiens
DFVFDNTED

SEQ ID NO: 231179 - protein, 9 aa, Homo Sapiens
RPPLRRQTS

SEQ ID NO: 231180 - protein, 9 aa, Homo Sapiens
MFLFSEFCC

SEQ ID NO: 231181 - protein, 9 aa, Homo Sapiens
HVPAVHAPR

SEQ ID NO: 231182 - protein, 9 aa, Homo Sapiens
LLYHTPHAQ

SEQ ID NO: 231183 - protein, 9 aa, Homo Sapiens
TAGLKLTGT

SEQ ID NO: 231184 - protein, 9 aa, Homo Sapiens
FHILTWPSW

SEQ ID NO: 231185 - protein, 9 aa, Homo Sapiens
RLPGNCCSY

SEQ ID NO: 231186 - protein, 9 aa, Homo Sapiens
MVTGAGATR

SEQ ID NO: 231187 - protein, 9 aa, Homo Sapiens
VGCPVSARS

SEQ ID NO: 231188 - protein, 9 aa, Homo Sapiens
CLKYDHHKR

SEQ ID NO: 231189 - protein, 9 aa, Homo Sapiens
VHRRLAGSV

SEQ ID NO: 231190 - protein, 9 aa, Homo Sapiens
RWGADDTMH

SEQ ID NO: 231191 - protein, 9 aa, Homo Sapiens
IAAAITVVG

SEQ ID NO: 231192 - protein, 9 aa, Homo Sapiens
SEASKRELE

SEQ ID NO: 231193 - protein, 9 aa, Homo Sapiens
HDQRHWRPW

SEQ ID NO: 231194 - protein, 9 aa, Homo Sapiens
CFLNLSQME

SEQ ID NO: 231195 - protein, 9 aa, Homo Sapiens
CWLIRVASI

SEQ ID NO: 231196 - protein, 9 aa, Homo Sapiens
NCTAALCRK

SEQ ID NO: 231197 - protein, 9 aa, Homo Sapiens
ARGRCGTWA

SEQ ID NO: 231198 - protein, 9 aa, Homo Sapiens
LLCYILFLV

SEQ ID NO: 231199 - protein, 9 aa, Homo Sapiens
GCLCGRCGA

SEQ ID NO: 231200 - protein, 9 aa, Homo Sapiens
PCQSAECQP

SEQ ID NO: 231201 - protein, 9 aa, Homo Sapiens
LDTGKSDPE

SEQ ID NO: 231202 - protein, 9 aa, Homo Sapiens
GAPGGRARP

SEQ ID NO: 231203 - protein, 9 aa, Homo Sapiens
TKVNMDIPR

SEQ ID NO: 231204 - protein, 9 aa, Homo Sapiens
SAPTAPASA

SEQ ID NO: 231205 - protein, 9 aa, Homo Sapiens
RGKLASGVL

SEQ ID NO: 231206 - protein, 9 aa, Homo Sapiens
CWRCPWRTA

SEQ ID NO: 231207 - protein, 9 aa, Homo Sapiens
LKRKIQKRS

SEQ ID NO: 231208 - protein, 9 aa, Homo Sapiens
VSTQSLPRL

SEQ ID NO: 231209 - protein, 9 aa, Homo Sapiens
WTPRTWQDR

SEQ ID NO: 231210 - protein, 9 aa, Homo Sapiens
LHTVGRLGL

SEQ ID NO: 231211 - protein, 9 aa, Homo Sapiens
TSALASCAR

SEQ ID NO: 231212 - protein, 9 aa, Homo Sapiens
RKQKEKITK

SEQ ID NO: 231213 - protein, 9 aa, Homo Sapiens
LGKETNSGY

SEQ ID NO: 231214 - protein, 9 aa, Homo Sapiens
GSHLHFIVE

SEQ ID NO: 231215 - protein, 9 aa, Homo Sapiens
ILRLPFVAQ

SEQ ID NO: 231216 - protein, 9 aa, Homo Sapiens
STEPGDEES

SEQ ID NO: 231217 - protein, 9 aa, Homo Sapiens
GAAPLSPLG

SEQ ID NO: 231218 - protein, 9 aa, Homo Sapiens
MQTNYDLLS

SEQ ID NO: 231219 - protein, 9 aa, Homo Sapiens
VGWNEALGT

SEQ ID NO: 231220 - protein, 9 aa, Homo Sapiens
FCDAPEAHV

SEQ ID NO: 231221 - protein, 9 aa, Homo Sapiens
FLTHLSLIY

SEQ ID NO: 231222 - protein, 9 aa, Homo Sapiens
SWKGKGASA

SEQ ID NO: 231223 - protein, 9 aa, Homo Sapiens
TAICDPDCK

SEQ ID NO: 231224 - protein, 9 aa, Homo Sapiens
MRGSFWCSC

SEQ ID NO: 231225 - protein, 9 aa, Homo Sapiens
FNLAYLYEH

SEQ ID NO: 231226 - protein, 9 aa, Homo Sapiens
PRQLRWKPL

SEQ ID NO: 231227 - protein, 9 aa, Homo Sapiens
FSNVGTVIS

SEQ ID NO: 231228 - protein, 9 aa, Homo Sapiens
AWPAIFFMT

SEQ ID NO: 231229 - protein, 9 aa, Homo Sapiens
PRQPATRPT

SEQ ID NO: 231230 - protein, 9 aa, Homo Sapiens
HLGPDCLPS

SEQ ID NO: 231231 - protein, 9 aa, Homo Sapiens
LNDQDRRIV

SEQ ID NO: 231232 - protein, 9 aa, Homo Sapiens
LGKEVACES

SEQ ID NO: 231233 - protein, 9 aa, Homo Sapiens
LQVHCNDFL

SEQ ID NO: 231234 - protein, 9 aa, Homo Sapiens
QRRDTTHVQ

SEQ ID NO: 231235 - protein, 9 aa, Homo Sapiens
RRLVSYPRR

SEQ ID NO: 231236 - protein, 9 aa, Homo Sapiens
VGGRGQSAK

SEQ ID NO: 231237 - protein, 9 aa, Homo Sapiens
EMCPPGITG

SEQ ID NO: 231238 - protein, 9 aa, Homo Sapiens
KNRHTIEVN

SEQ ID NO: 231239 - protein, 9 aa, Homo Sapiens
RDSDSELEQ

SEQ ID NO: 231240 - protein, 9 aa, Homo Sapiens
KENDGSLKN

SEQ ID NO: 231241 - protein, 9 aa, Homo Sapiens
ADASSHGVG

SEQ ID NO: 231242 - protein, 9 aa, Homo Sapiens
YELAMSTHL

SEQ ID NO: 231243 - protein, 9 aa, Homo Sapiens
PTSQCHCLP

SEQ ID NO: 231244 - protein, 9 aa, Homo Sapiens
GIEVTSWTV

SEQ ID NO: 231245 - protein, 9 aa, Homo Sapiens
SEGTKVSAH

SEQ ID NO: 231246 - protein, 9 aa, Homo Sapiens
VIRLCLCCA

SEQ ID NO: 231247 - protein, 9 aa, Homo Sapiens
SEELDNTLN

SEQ ID NO: 231248 - protein, 9 aa, Homo Sapiens
PKAAWQFLL

SEQ ID NO: 231249 - protein, 9 aa, Homo Sapiens
HWGQRDVSV

SEQ ID NO: 231250 - protein, 9 aa, Homo Sapiens
SWAASRRRA

SEQ ID NO: 231251 - protein, 9 aa, Homo Sapiens
EHLKLQETA

SEQ ID NO: 231252 - protein, 9 aa, Homo Sapiens
PRSSTPSRL

SEQ ID NO: 231253 - protein, 9 aa, Homo Sapiens
AMLSVELGP

SEQ ID NO: 231254 - protein, 9 aa, Homo Sapiens
FFFELDVMD

SEQ ID NO: 231255 - protein, 9 aa, Homo Sapiens
WGLPRLMSG

SEQ ID NO: 231256 - protein, 9 aa, Homo Sapiens
GDPAGGGCL

SEQ ID NO: 231257 - protein, 9 aa, Homo Sapiens
LARGLKRSS

SEQ ID NO: 231258 - protein, 9 aa, Homo Sapiens
TGSSSSLSV

SEQ ID NO: 231259 - protein, 9 aa, Homo Sapiens
HRRMRHKNI

SEQ ID NO: 231260 - protein, 9 aa, Homo Sapiens
PPMPPPANP

SEQ ID NO: 231261 - protein, 9 aa, Homo Sapiens
VGHKSGSET

SEQ ID NO: 231262 - protein, 9 aa, Homo Sapiens
GSGLRLGPS

SEQ ID NO: 231263 - protein, 9 aa, Homo Sapiens
TCTHKEGET

SEQ ID NO: 231264 - protein, 9 aa, Homo Sapiens
LSWPARCDQ

SEQ ID NO: 231265 - protein, 9 aa, Homo Sapiens
ASTFEQGIK

SEQ ID NO: 231266 - protein, 9 aa, Homo Sapiens
PILGHSLLF

SEQ ID NO: 231267 - protein, 9 aa, Homo Sapiens
MNEEMDRAQ

SEQ ID NO: 231268 - protein, 9 aa, Homo Sapiens
TEVVNILWS

SEQ ID NO: 231269 - protein, 9 aa, Homo Sapiens
ATIIGAFVA

SEQ ID NO: 231270 - protein, 9 aa, Homo Sapiens
SYCSTRQTS

SEQ ID NO: 231271 - protein, 9 aa, Homo Sapiens
GIIGPESPS

SEQ ID NO: 231272 - protein, 9 aa, Homo Sapiens
TEPGDEESV

SEQ ID NO: 231273 - protein, 9 aa, Homo Sapiens
VWGGGNKCV

SEQ ID NO: 231274 - protein, 9 aa, Homo Sapiens
SPLLGSCNG

SEQ ID NO: 231275 - protein, 9 aa, Homo Sapiens
VFCWRSINS

SEQ ID NO: 231276 - protein, 9 aa, Homo Sapiens
QPPHSAMGP

SEQ ID NO: 231277 - protein, 9 aa, Homo Sapiens
PNSCVLRET

SEQ ID NO: 231278 - protein, 9 aa, Homo Sapiens
RNSHPSPRW

SEQ ID NO: 231279 - protein, 9 aa, Homo Sapiens
VGKTSSAHS

SEQ ID NO: 231280 - protein, 9 aa, Homo Sapiens
ERIAILRGN

SEQ ID NO: 231281 - protein, 9 aa, Homo Sapiens
CDGRLYASE

SEQ ID NO: 231282 - protein, 9 aa, Homo Sapiens
QHRRLVSYP

SEQ ID NO: 231283 - protein, 9 aa, Homo Sapiens
MQDGTWRTV

SEQ ID NO: 231284 - protein, 9 aa, Homo Sapiens
AGEDAPRAV

SEQ ID NO: 231285 - protein, 9 aa, Homo Sapiens
IDTSQYSKC

SEQ ID NO: 231286 - protein, 9 aa, Homo Sapiens
PPPHRCCLP

SEQ ID NO: 231287 - protein, 9 aa, Homo Sapiens
VVFFCICGA

SEQ ID NO: 231288 - protein, 9 aa, Homo Sapiens
TLCRRYWLD

SEQ ID NO: 231289 - protein, 9 aa, Homo Sapiens
YQGAVPCQD

SEQ ID NO: 231290 - protein, 9 aa, Homo Sapiens
QRLWQSPCP

SEQ ID NO: 231291 - protein, 9 aa, Homo Sapiens
SALQDLCWE

SEQ ID NO: 231292 - protein, 9 aa, Homo Sapiens
GEEAPRPWM

SEQ ID NO: 231293 - protein, 9 aa, Homo Sapiens
EIFALESAQ

SEQ ID NO: 231294 - protein, 9 aa, Homo Sapiens
ARMEGQPMR

SEQ ID NO: 231295 - protein, 9 aa, Homo Sapiens
ARLISSPNN

SEQ ID NO: 231296 - protein, 9 aa, Homo Sapiens
LKVRVVKDL

SEQ ID NO: 231297 - protein, 9 aa, Homo Sapiens
FRQDFLWTQ

SEQ ID NO: 231298 - protein, 9 aa, Homo Sapiens
GQLGAEVPQ

SEQ ID NO: 231299 - protein, 9 aa, Homo Sapiens
MLSATSTPH

SEQ ID NO: 231300 - protein, 9 aa, Homo Sapiens
LPRLVECPV

SEQ ID NO: 231301 - protein, 9 aa, Homo Sapiens
GVVALQLPR

SEQ ID NO: 231302 - protein, 9 aa, Homo Sapiens
EAPERGFPA

SEQ ID NO: 231303 - protein, 9 aa, Homo Sapiens
NICKKFSNP

SEQ ID NO: 231304 - protein, 9 aa, Homo Sapiens
CGGLRQSPI

SEQ ID NO: 231305 - protein, 9 aa, Homo Sapiens
WTEKKQCRK

SEQ ID NO: 231306 - protein, 9 aa, Homo Sapiens
TSEECTKHD

SEQ ID NO: 231307 - protein, 9 aa, Homo Sapiens
ANQSKEVTE

SEQ ID NO: 231308 - protein, 9 aa, Homo Sapiens
GGDRSRGAM

SEQ ID NO: 231309 - protein, 9 aa, Homo Sapiens
HGLLALSSS

SEQ ID NO: 231310 - protein, 9 aa, Homo Sapiens
EWSPYKRDN

SEQ ID NO: 231311 - protein, 9 aa, Homo Sapiens
PWMAACAGI

SEQ ID NO: 231312 - protein, 9 aa, Homo Sapiens
KTYENAQSI

SEQ ID NO: 231313 - protein, 9 aa, Homo Sapiens
LVHGYRGSR

SEQ ID NO: 231314 - protein, 9 aa, Homo Sapiens
KSNTSQVKA

SEQ ID NO: 231315 - protein, 9 aa, Homo Sapiens
ERLDATRQA

SEQ ID NO: 231316 - protein, 9 aa, Homo Sapiens
SQPVSLASA

SEQ ID NO: 231317 - protein, 9 aa, Homo Sapiens
HVYGNGYSN

SEQ ID NO: 231318 - protein, 9 aa, Homo Sapiens
CQHNVRKDC

SEQ ID NO: 231319 - protein, 9 aa, Homo Sapiens
SSRTPRRQR

SEQ ID NO: 231320 - protein, 9 aa, Homo Sapiens
KVLKVEHTS

SEQ ID NO: 231321 - protein, 9 aa, Homo Sapiens
SHQSAPPIR

SEQ ID NO: 231322 - protein, 9 aa, Homo Sapiens
PGARIPWKG

SEQ ID NO: 231323 - protein, 9 aa, Homo Sapiens
ELSTTTRMV

SEQ ID NO: 231324 - protein, 9 aa, Homo Sapiens
KKRNSYRMD

SEQ ID NO: 231325 - protein, 9 aa, Homo Sapiens
PKTASSTRM

SEQ ID NO: 231326 - protein, 9 aa, Homo Sapiens
QEALSDSLQ

SEQ ID NO: 231327 - protein, 9 aa, Homo Sapiens
PGEPGLSGL

SEQ ID NO: 231328 - protein, 9 aa, Homo Sapiens
LRVGNGLLM

SEQ ID NO: 231329 - protein, 9 aa, Homo Sapiens
LGGFLGNIV

SEQ ID NO: 231330 - protein, 9 aa, Homo Sapiens
NGKGLLKKR

SEQ ID NO: 231331 - protein, 9 aa, Homo Sapiens
PLMGSGFGF

SEQ ID NO: 231332 - protein, 9 aa, Homo Sapiens
DVVHPQFKE

SEQ ID NO: 231333 - protein, 9 aa, Homo Sapiens
LCDPGVPIG

SEQ ID NO: 231334 - protein, 9 aa, Homo Sapiens
PPEPGDPDA

SEQ ID NO: 231335 - protein, 9 aa, Homo Sapiens
ARKIGARIH

SEQ ID NO: 231336 - protein, 9 aa, Homo Sapiens
LMKISERYV

SEQ ID NO: 231337 - protein, 9 aa, Homo Sapiens
SELQFTPDR

SEQ ID NO: 231338 - protein, 9 aa, Homo Sapiens
ARPALLLQP

SEQ ID NO: 231339 - protein, 9 aa, Homo Sapiens
ELHQARRDA

SEQ ID NO: 231340 - protein, 9 aa, Homo Sapiens
KSRLCMSLQ

SEQ ID NO: 231341 - protein, 9 aa, Homo Sapiens
PRTTAFCRP

SEQ ID NO: 231342 - protein, 9 aa, Homo Sapiens
KELKRSKNL

SEQ ID NO: 231343 - protein, 9 aa, Homo Sapiens
HCGHGAEEG

SEQ ID NO: 231344 - protein, 9 aa, Homo Sapiens
EDSESVQRA

SEQ ID NO: 231345 - protein, 9 aa, Homo Sapiens
HTHTPLPFS

SEQ ID NO: 231346 - protein, 9 aa, Homo Sapiens
LLCRQMLPT

SEQ ID NO: 231347 - protein, 9 aa, Homo Sapiens
YCDDTHRSE

SEQ ID NO: 231348 - protein, 9 aa, Homo Sapiens
PRLRLFPNC

SEQ ID NO: 231349 - protein, 9 aa, Homo Sapiens
TTHRLYKVQ

SEQ ID NO: 231350 - protein, 9 aa, Homo Sapiens
DSESISEES

SEQ ID NO: 231351 - protein, 9 aa, Homo Sapiens
NNRCVPSRW

SEQ ID NO: 231352 - protein, 9 aa, Homo Sapiens
SWRTNSSST

SEQ ID NO: 231353 - protein, 9 aa, Homo Sapiens
CSVEVDECA

SEQ ID NO: 231354 - protein, 9 aa, Homo Sapiens
RATLFATGK

SEQ ID NO: 231355 - protein, 9 aa, Homo Sapiens
SALFDMVSR

SEQ ID NO: 231356 - protein, 9 aa, Homo Sapiens
CGGKRNAYL

SEQ ID NO: 231357 - protein, 9 aa, Homo Sapiens
RPAPARAQK

SEQ ID NO: 231358 - protein, 9 aa, Homo Sapiens
QEEERRRCE

SEQ ID NO: 231359 - protein, 9 aa, Homo Sapiens
SSSSAARGR

SEQ ID NO: 231360 - protein, 9 aa, Homo Sapiens
TLDRYGRTA

SEQ ID NO: 231361 - protein, 9 aa, Homo Sapiens
PRLVGCPVS

SEQ ID NO: 231362 - protein, 9 aa, Homo Sapiens
QDRVQVHGL

SEQ ID NO: 231363 - protein, 9 aa, Homo Sapiens
PVQHQPDVV

SEQ ID NO: 231364 - protein, 9 aa, Homo Sapiens
ISNTWIVTA

SEQ ID NO: 231365 - protein, 9 aa, Homo Sapiens
QAQMYLWPQ

SEQ ID NO: 231366 - protein, 9 aa, Homo Sapiens
KHYPINMDF

SEQ ID NO: 231367 - protein, 9 aa, Homo Sapiens
IVCHNQVDP

SEQ ID NO: 231368 - protein, 9 aa, Homo Sapiens
GSTVMRETR

SEQ ID NO: 231369 - protein, 9 aa, Homo Sapiens
YAREWSPYK

SEQ ID NO: 231370 - protein, 9 aa, Homo Sapiens
IGIQFQNSH

SEQ ID NO: 231371 - protein, 9 aa, Homo Sapiens
KQWIAIARA

SEQ ID NO: 231372 - protein, 9 aa, Homo Sapiens
FRGLRGHCA

SEQ ID NO: 231373 - protein, 9 aa, Homo Sapiens
WWQLLGLLP

SEQ ID NO: 231374 - protein, 9 aa, Homo Sapiens
TSLRFHLDA

SEQ ID NO: 231375 - protein, 9 aa, Homo Sapiens
SLRSRVTVH

SEQ ID NO: 231376 - protein, 9 aa, Homo Sapiens
IAEEEPPRL

SEQ ID NO: 231377 - protein, 9 aa, Homo Sapiens
REELLKKCS

SEQ ID NO: 231378 - protein, 9 aa, Homo Sapiens
KNVTKFLVA

SEQ ID NO: 231379 - protein, 9 aa, Homo Sapiens
TGGHHGSVS

SEQ ID NO: 231380 - protein, 9 aa, Homo Sapiens
HFFLQIIWL

SEQ ID NO: 231381 - protein, 9 aa, Homo Sapiens
SQLCAGPGP

SEQ ID NO: 231382 - protein, 9 aa, Homo Sapiens
TFILYKFLI

SEQ ID NO: 231383 - protein, 9 aa, Homo Sapiens
LCGTEDSRR

SEQ ID NO: 231384 - protein, 9 aa, Homo Sapiens
HLNQIMKRM

SEQ ID NO: 231385 - protein, 9 aa, Homo Sapiens
FENPEVSRE

SEQ ID NO: 231386 - protein, 9 aa, Homo Sapiens
EHHTEPSSE

SEQ ID NO: 231387 - protein, 9 aa, Homo Sapiens
HSNSSGFAE

SEQ ID NO: 231388 - protein, 9 aa, Homo Sapiens
GRRGGTCAS

SEQ ID NO: 231389 - protein, 9 aa, Homo Sapiens
CGATSSRPL

SEQ ID NO: 231390 - protein, 9 aa, Homo Sapiens
SCSTAATAS

SEQ ID NO: 231391 - protein, 9 aa, Homo Sapiens
QDRPVCEGT

SEQ ID NO: 231392 - protein, 9 aa, Homo Sapiens
ICWLLGTRC

SEQ ID NO: 231393 - protein, 9 aa, Homo Sapiens
SPPMRSPSR

SEQ ID NO: 231394 - protein, 9 aa, Homo Sapiens
NRVEGLLPC

SEQ ID NO: 231395 - protein, 9 aa, Homo Sapiens
VAPAVLLVV

SEQ ID NO: 231396 - protein, 9 aa, Homo Sapiens
ILSNQAGGP

SEQ ID NO: 231397 - protein, 9 aa, Homo Sapiens
LSSAGTAGM

SEQ ID NO: 231398 - protein, 9 aa, Homo Sapiens
FPLPRASLR

SEQ ID NO: 231399 - protein, 9 aa, Homo Sapiens
NCTWSIITG

SEQ ID NO: 231400 - protein, 9 aa, Homo Sapiens
QPTGTQQDA

SEQ ID NO: 231401 - protein, 9 aa, Homo Sapiens
QVRLQQSFP

SEQ ID NO: 231402 - protein, 9 aa, Homo Sapiens
AQTPSPVSG

SEQ ID NO: 231403 - protein, 9 aa, Homo Sapiens
RGYRALQLH

SEQ ID NO: 231404 - protein, 9 aa, Homo Sapiens
PTHMLTAIT

SEQ ID NO: 231405 - protein, 9 aa, Homo Sapiens
LQVADEQYQ

SEQ ID NO: 231406 - protein, 9 aa, Homo Sapiens
TTLRTTSPM

SEQ ID NO: 231407 - protein, 9 aa, Homo Sapiens
LDADGFFIQ

SEQ ID NO: 231408 - protein, 9 aa, Homo Sapiens
KKERKVTLM

SEQ ID NO: 231409 - protein, 9 aa, Homo Sapiens
TVERMGLMN

SEQ ID NO: 231410 - protein, 9 aa, Homo Sapiens
EGVGPRDIK

SEQ ID NO: 231411 - protein, 9 aa, Homo Sapiens
MAITIMKVH

SEQ ID NO: 231412 - protein, 9 aa, Homo Sapiens
KTVTKYTSS

SEQ ID NO: 231413 - protein, 9 aa, Homo Sapiens
YSHNGVSLH

SEQ ID NO: 231414 - protein, 9 aa, Homo Sapiens
SLYRQANII

SEQ ID NO: 231415 - protein, 9 aa, Homo Sapiens
ASPGTHPTL

SEQ ID NO: 231416 - protein, 9 aa, Homo Sapiens
TLRTTSPMT

SEQ ID NO: 231417 - protein, 9 aa, Homo Sapiens
FSVGLGASS

SEQ ID NO: 231418 - protein, 9 aa, Homo Sapiens
LLEKSFLFF

SEQ ID NO: 231419 - protein, 9 aa, Homo Sapiens
TWIGNQRRK

SEQ ID NO: 231420 - protein, 9 aa, Homo Sapiens
LSTELGFTL

SEQ ID NO: 231421 - protein, 9 aa, Homo Sapiens
LSGAGGPPS

SEQ ID NO: 231422 - protein, 9 aa, Homo Sapiens
VLALGAGVL

SEQ ID NO: 231423 - protein, 9 aa, Homo Sapiens
VQANTGPPR

SEQ ID NO: 231424 - protein, 9 aa, Homo Sapiens
ELLKKCSLY

SEQ ID NO: 231425 - protein, 9 aa, Homo Sapiens
PARSGNPTR

SEQ ID NO: 231426 - protein, 9 aa, Homo Sapiens
DVREEAMLF

SEQ ID NO: 231427 - protein, 9 aa, Homo Sapiens
GLHGLLALS

SEQ ID NO: 231428 - protein, 9 aa, Homo Sapiens
LCYLGNRLR

SEQ ID NO: 231429 - protein, 9 aa, Homo Sapiens
ICMPVGGQT

SEQ ID NO: 231430 - protein, 9 aa, Homo Sapiens
RLEEECGKN

SEQ ID NO: 231431 - protein, 9 aa, Homo Sapiens
VRFVQGAPW

SEQ ID NO: 231432 - protein, 9 aa, Homo Sapiens
YCVWFVIFL

SEQ ID NO: 231433 - protein, 9 aa, Homo Sapiens
NPCCRLTWM

SEQ ID NO: 231434 - protein, 9 aa, Homo Sapiens
PGSYAVATA

SEQ ID NO: 231435 - protein, 9 aa, Homo Sapiens
RSHRKRNQP

SEQ ID NO: 231436 - protein, 9 aa, Homo Sapiens
EEAPSIFWM

SEQ ID NO: 231437 - protein, 9 aa, Homo Sapiens
NIQMKKDLA

SEQ ID NO: 231438 - protein, 9 aa, Homo Sapiens
FLRCIANSN

SEQ ID NO: 231439 - protein, 9 aa, Homo Sapiens
CIIVADSRN

SEQ ID NO: 231440 - protein, 9 aa, Homo Sapiens
LLQPRRGRL

SEQ ID NO: 231441 - protein, 9 aa, Homo Sapiens
EEKKCYINL

SEQ ID NO: 231442 - protein, 9 aa, Homo Sapiens
LEHLKLQET

SEQ ID NO: 231443 - protein, 9 aa, Homo Sapiens
LILADMSIK

SEQ ID NO: 231444 - protein, 9 aa, Homo Sapiens
QNLSLMNRF

SEQ ID NO: 231445 - protein, 9 aa, Homo Sapiens
KIPLPVGAS

SEQ ID NO: 231446 - protein, 9 aa, Homo Sapiens
FIFQKYLAP

SEQ ID NO: 231447 - protein, 9 aa, Homo Sapiens
IRWKALIVI

SEQ ID NO: 231448 - protein, 9 aa, Homo Sapiens
PCAEVIPCS

SEQ ID NO: 231449 - protein, 9 aa, Homo Sapiens
LAHQPGPEA

SEQ ID NO: 231450 - protein, 9 aa, Homo Sapiens
AVDNKKTHP

SEQ ID NO: 231451 - protein, 9 aa, Homo Sapiens
AAQDGARCP

SEQ ID NO: 231452 - protein, 9 aa, Homo Sapiens
EPLSSTAKR

SEQ ID NO: 231453 - protein, 9 aa, Homo Sapiens
RSRAPRRRK

SEQ ID NO: 231454 - protein, 9 aa, Homo Sapiens
KSTKKILKL

SEQ ID NO: 231455 - protein, 9 aa, Homo Sapiens
HQFQVENRR

SEQ ID NO: 231456 - protein, 9 aa, Homo Sapiens
VQDGPPRAL

SEQ ID NO: 231457 - protein, 9 aa, Homo Sapiens
YSRDEGFMT

SEQ ID NO: 231458 - protein, 9 aa, Homo Sapiens
ILILADMSI

SEQ ID NO: 231459 - protein, 9 aa, Homo Sapiens
SCVLCVRCG

SEQ ID NO: 231460 - protein, 9 aa, Homo Sapiens
TSPKGEVVP

SEQ ID NO: 231461 - protein, 9 aa, Homo Sapiens
RVGVFLDYV

SEQ ID NO: 231462 - protein, 9 aa, Homo Sapiens
THPTLKDLT

SEQ ID NO: 231463 - protein, 9 aa, Homo Sapiens
LPPPEYSLF

SEQ ID NO: 231464 - protein, 9 aa, Homo Sapiens
HILTWPSWM

SEQ ID NO: 231465 - protein, 9 aa, Homo Sapiens
PPHGFNRQP

SEQ ID NO: 231466 - protein, 9 aa, Homo Sapiens
PSLGYPVST

SEQ ID NO: 231467 - protein, 9 aa, Homo Sapiens
FYRPFYLQL

SEQ ID NO: 231468 - protein, 9 aa, Homo Sapiens
VWPPTAARP

SEQ ID NO: 231469 - protein, 9 aa, Homo Sapiens
LLRSHQRKL

SEQ ID NO: 231470 - protein, 9 aa, Homo Sapiens
LLGSCNGTQ

SEQ ID NO: 231471 - protein, 9 aa, Homo Sapiens
WTLVPMPVC

SEQ ID NO: 231472 - protein, 9 aa, Homo Sapiens
GDGQGRGRG

SEQ ID NO: 231473 - protein, 9 aa, Homo Sapiens
TWSSALCVR

SEQ ID NO: 231474 - protein, 9 aa, Homo Sapiens
GHGDVCKVL

SEQ ID NO: 231475 - protein, 9 aa, Homo Sapiens
RPDDLTLIS

SEQ ID NO: 231476 - protein, 9 aa, Homo Sapiens
CQPHQAGSP

SEQ ID NO: 231477 - protein, 9 aa, Homo Sapiens
SFICSQTGK

SEQ ID NO: 231478 - protein, 9 aa, Homo Sapiens
INSSLKQCR

SEQ ID NO: 231479 - protein, 9 aa, Homo Sapiens
SASINPNPL

SEQ ID NO: 231480 - protein, 9 aa, Homo Sapiens
LRGFGLRGL

SEQ ID NO: 231481 - protein, 9 aa, Homo Sapiens
AAPPPAPPA

SEQ ID NO: 231482 - protein, 9 aa, Homo Sapiens
IHQLEGHLV

SEQ ID NO: 231483 - protein, 9 aa, Homo Sapiens
RFRHLALMF

SEQ ID NO: 231484 - protein, 9 aa, Homo Sapiens
EDPMPIQIS

SEQ ID NO: 231485 - protein, 9 aa, Homo Sapiens
SDHMIDRSE

SEQ ID NO: 231486 - protein, 9 aa, Homo Sapiens
FSQSTKQIT

SEQ ID NO: 231487 - protein, 9 aa, Homo Sapiens
LTAARLGRT

SEQ ID NO: 231488 - protein, 9 aa, Homo Sapiens
DRSADQAGI

SEQ ID NO: 231489 - protein, 9 aa, Homo Sapiens
VLDYDKEKK

SEQ ID NO: 231490 - protein, 9 aa, Homo Sapiens
GGCPLSLWK

SEQ ID NO: 231491 - protein, 9 aa, Homo Sapiens
HWCKYHNLC

SEQ ID NO: 231492 - protein, 9 aa, Homo Sapiens
LLDAEPPYS

SEQ ID NO: 231493 - protein, 9 aa, Homo Sapiens
WSKVLPDAP

SEQ ID NO: 231494 - protein, 9 aa, Homo Sapiens
LLYLRTSGE

SEQ ID NO: 231495 - protein, 9 aa, Homo Sapiens
GSGLNAWNG

SEQ ID NO: 231496 - protein, 9 aa, Homo Sapiens
ANQILKDIG

SEQ ID NO: 231497 - protein, 9 aa, Homo Sapiens
PLALLIFVP

SEQ ID NO: 231498 - protein, 9 aa, Homo Sapiens
SSPARSPAP

SEQ ID NO: 231499 - protein, 9 aa, Homo Sapiens
KALYPGGKE

SEQ ID NO: 231500 - protein, 9 aa, Homo Sapiens
YVRATLFAT

SEQ ID NO: 231501 - protein, 9 aa, Homo Sapiens
DILQEFVQL

SEQ ID NO: 231502 - protein, 9 aa, Homo Sapiens
QVLCVVRQV

SEQ ID NO: 231503 - protein, 9 aa, Homo Sapiens
LLRLECPVS

SEQ ID NO: 231504 - protein, 9 aa, Homo Sapiens
RQPAKPPTR

SEQ ID NO: 231505 - protein, 9 aa, Homo Sapiens
GIGQLSAPT

SEQ ID NO: 231506 - protein, 9 aa, Homo Sapiens
ISCFWSIPL

SEQ ID NO: 231507 - protein, 9 aa, Homo Sapiens
KPYVYTTLP

SEQ ID NO: 231508 - protein, 9 aa, Homo Sapiens
SSNVCVIKD

SEQ ID NO: 231509 - protein, 9 aa, Homo Sapiens
GTKTVTKYT

SEQ ID NO: 231510 - protein, 9 aa, Homo Sapiens
FMASGPIQA

SEQ ID NO: 231511 - protein, 9 aa, Homo Sapiens
TGTHTEDWQ

SEQ ID NO: 231512 - protein, 9 aa, Homo Sapiens
TREVLVEMY

SEQ ID NO: 231513 - protein, 9 aa, Homo Sapiens
NGQPIPFQQ

SEQ ID NO: 231514 - protein, 9 aa, Homo Sapiens
SAWGSASCF

SEQ ID NO: 231515 - protein, 9 aa, Homo Sapiens
LQSCWRPLA

SEQ ID NO: 231516 - protein, 9 aa, Homo Sapiens
ALCGMTTEK

SEQ ID NO: 231517 - protein, 9 aa, Homo Sapiens
RNQPKKPKP

SEQ ID NO: 231518 - protein, 9 aa, Homo Sapiens
LWPISKQLY

SEQ ID NO: 231519 - protein, 9 aa, Homo Sapiens
HRGWRLPKA

SEQ ID NO: 231520 - protein, 9 aa, Homo Sapiens
TEETEVAME

SEQ ID NO: 231521 - protein, 9 aa, Homo Sapiens
EDKKNGIWE

SEQ ID NO: 231522 - protein, 9 aa, Homo Sapiens
AASLTLGLE

SEQ ID NO: 231523 - protein, 9 aa, Homo Sapiens
NPTRSSRLR

SEQ ID NO: 231524 - protein, 9 aa, Homo Sapiens
VHAIVPNKS

SEQ ID NO: 231525 - protein, 9 aa, Homo Sapiens
LEAVDCGNT

SEQ ID NO: 231526 - protein, 9 aa, Homo Sapiens
RAIEAQCYV

SEQ ID NO: 231527 - protein, 9 aa, Homo Sapiens
PEYSLFMFP

SEQ ID NO: 231528 - protein, 9 aa, Homo Sapiens
LRIHGPTHI

SEQ ID NO: 231529 - protein, 9 aa, Homo Sapiens
PGFSPRGRE

SEQ ID NO: 231530 - protein, 9 aa, Homo Sapiens
VNCAIAHPY

SEQ ID NO: 231531 - protein, 9 aa, Homo Sapiens
MNDKKRQKP

SEQ ID NO: 231532 - protein, 9 aa, Homo Sapiens
RLLHFFSGF

SEQ ID NO: 231533 - protein, 9 aa, Homo Sapiens
VLVAVASLP

SEQ ID NO: 231534 - protein, 9 aa, Homo Sapiens
SLLSLYSVA

SEQ ID NO: 231535 - protein, 9 aa, Homo Sapiens
SRRVCENRR

SEQ ID NO: 231536 - protein, 9 aa, Homo Sapiens
QEFWPRQSA

SEQ ID NO: 231537 - protein, 9 aa, Homo Sapiens
NAMCKLLKG

SEQ ID NO: 231538 - protein, 9 aa, Homo Sapiens
AVATVETEV

SEQ ID NO: 231539 - protein, 9 aa, Homo Sapiens
VQGSLQTSS

SEQ ID NO: 231540 - protein, 9 aa, Homo Sapiens
RTRAWRTRC

SEQ ID NO: 231541 - protein, 9 aa, Homo Sapiens
ASSHGVGRV

SEQ ID NO: 231542 - protein, 9 aa, Homo Sapiens
VKKQSQLYL

SEQ ID NO: 231543 - protein, 9 aa, Homo Sapiens
WVDDQRSEN

SEQ ID NO: 231544 - protein, 9 aa, Homo Sapiens
FELDVMDHL

SEQ ID NO: 231545 - protein, 9 aa, Homo Sapiens
PLQIFTYEE

SEQ ID NO: 231546 - protein, 9 aa, Homo Sapiens
APRRGPAQR

SEQ ID NO: 231547 - protein, 9 aa, Homo Sapiens
YDHVIDFDE

SEQ ID NO: 231548 - protein, 9 aa, Homo Sapiens
QSQRKMKQR

SEQ ID NO: 231549 - protein, 9 aa, Homo Sapiens
HSWGPMQPS

SEQ ID NO: 231550 - protein, 9 aa, Homo Sapiens
PEEITTIMV

SEQ ID NO: 231551 - protein, 9 aa, Homo Sapiens
GTWRGRRRE

SEQ ID NO: 231552 - protein, 9 aa, Homo Sapiens
IFTRVTEFI

SEQ ID NO: 231553 - protein, 9 aa, Homo Sapiens
RNGPGLVAT

SEQ ID NO: 231554 - protein, 9 aa, Homo Sapiens
PSPVSGSWC

SEQ ID NO: 231555 - protein, 9 aa, Homo Sapiens
ATPPFGLIP

SEQ ID NO: 231556 - protein, 9 aa, Homo Sapiens
WRKSGSGSG

SEQ ID NO: 231557 - protein, 9 aa, Homo Sapiens
EKDCWAATL

SEQ ID NO: 231558 - protein, 9 aa, Homo Sapiens
TPHAQAPQL

SEQ ID NO: 231559 - protein, 9 aa, Homo Sapiens
ANLTGLPPQ

SEQ ID NO: 231560 - protein, 9 aa, Homo Sapiens
TPVCTNRLL

SEQ ID NO: 231561 - protein, 9 aa, Homo Sapiens
VMPRTLEGC

SEQ ID NO: 231562 - protein, 9 aa, Homo Sapiens
TNSLKSSGI

SEQ ID NO: 231563 - protein, 9 aa, Homo Sapiens
SATTANRAM

SEQ ID NO: 231564 - protein, 9 aa, Homo Sapiens
QPDVPAVTS

SEQ ID NO: 231565 - protein, 9 aa, Homo Sapiens
ETTNNNNHH

SEQ ID NO: 231566 - protein, 9 aa, Homo Sapiens
AWNGSDGVI

SEQ ID NO: 231567 - protein, 9 aa, Homo Sapiens
PPGNWKSHL

SEQ ID NO: 231568 - protein, 9 aa, Homo Sapiens
AAWPSRRAQ

SEQ ID NO: 231569 - protein, 9 aa, Homo Sapiens
CGKSFSCVS

SEQ ID NO: 231570 - protein, 9 aa, Homo Sapiens
ICPLPPCSL

SEQ ID NO: 231571 - protein, 9 aa, Homo Sapiens
VLDYFLFLQ

SEQ ID NO: 231572 - protein, 9 aa, Homo Sapiens
LDLPSAWDI

SEQ ID NO: 231573 - protein, 9 aa, Homo Sapiens
QLSAPTAPA

SEQ ID NO: 231574 - protein, 9 aa, Homo Sapiens
KERKVTLMI

SEQ ID NO: 231575 - protein, 9 aa, Homo Sapiens
VVHPQFKEI

SEQ ID NO: 231576 - protein, 9 aa, Homo Sapiens
TTTEMISAT

SEQ ID NO: 231577 - protein, 9 aa, Homo Sapiens
LLLHGEATQ

SEQ ID NO: 231578 - protein, 9 aa, Homo Sapiens
LGGGAPRAL

SEQ ID NO: 231579 - protein, 9 aa, Homo Sapiens
TLTQGPSST

SEQ ID NO: 231580 - protein, 9 aa, Homo Sapiens
PPMPTGLRK

SEQ ID NO: 231581 - protein, 9 aa, Homo Sapiens
ARAGRLNVM

SEQ ID NO: 231582 - protein, 9 aa, Homo Sapiens
FLILGDLLL

SEQ ID NO: 231583 - protein, 9 aa, Homo Sapiens
RRGPAQRAE

SEQ ID NO: 231584 - protein, 9 aa, Homo Sapiens
TSSVMSHRS

SEQ ID NO: 231585 - protein, 9 aa, Homo Sapiens
GVFLMVGIG

SEQ ID NO: 231586 - protein, 9 aa, Homo Sapiens
PASPAHSPT

SEQ ID NO: 231587 - protein, 9 aa, Homo Sapiens
KKVLKVEHT

SEQ ID NO: 231588 - protein, 9 aa, Homo Sapiens
THTVALIGL

SEQ ID NO: 231589 - protein, 9 aa, Homo Sapiens
GLTRRVGGR

SEQ ID NO: 231590 - protein, 9 aa, Homo Sapiens
RDTNRHRKI

SEQ ID NO: 231591 - protein, 9 aa, Homo Sapiens
SDTCSPGMQ

SEQ ID NO: 231592 - protein, 9 aa, Homo Sapiens
DSRTLGSLP

SEQ ID NO: 231593 - protein, 9 aa, Homo Sapiens
CPENSRYEV

SEQ ID NO: 231594 - protein, 9 aa, Homo Sapiens
YSIPSMILP

SEQ ID NO: 231595 - protein, 9 aa, Homo Sapiens
FLGNIVKSA

SEQ ID NO: 231596 - protein, 9 aa, Homo Sapiens
REPNPSVTD

SEQ ID NO: 231597 - protein, 9 aa, Homo Sapiens
FSGFSFFPA

SEQ ID NO: 231598 - protein, 9 aa, Homo Sapiens
VCSIPRNLP

SEQ ID NO: 231599 - protein, 9 aa, Homo Sapiens
DRDQSEASK

SEQ ID NO: 231600 - protein, 9 aa, Homo Sapiens
KMSPEDRVK

SEQ ID NO: 231601 - protein, 9 aa, Homo Sapiens
RQAPRTTAF

SEQ ID NO: 231602 - protein, 9 aa, Homo Sapiens
QIPKFAIAT

SEQ ID NO: 231603 - protein, 9 aa, Homo Sapiens
EEYVAGNFC

SEQ ID NO: 231604 - protein, 9 aa, Homo Sapiens
PGDCPRTMA

SEQ ID NO: 231605 - protein, 9 aa, Homo Sapiens
GHPRTGRHE

SEQ ID NO: 231606 - protein, 9 aa, Homo Sapiens
KWDLPVFPL

SEQ ID NO: 231607 - protein, 9 aa, Homo Sapiens
GKVLINNQT

SEQ ID NO: 231608 - protein, 9 aa, Homo Sapiens
TVPRHSSVL

SEQ ID NO: 231609 - protein, 9 aa, Homo Sapiens
SKGKIKELF

SEQ ID NO: 231610 - protein, 9 aa, Homo Sapiens
SRRPLPWTR

SEQ ID NO: 231611 - protein, 9 aa, Homo Sapiens
EVKLPEVKL

SEQ ID NO: 231612 - protein, 9 aa, Homo Sapiens
KDNLAPSYP

SEQ ID NO: 231613 - protein, 9 aa, Homo Sapiens
HKLTLEFHT

SEQ ID NO: 231614 - protein, 9 aa, Homo Sapiens
ATAVGDVVN

SEQ ID NO: 231615 - protein, 9 aa, Homo Sapiens
CGTWAWRAA

SEQ ID NO: 231616 - protein, 9 aa, Homo Sapiens
ASMRWRSSR

SEQ ID NO: 231617 - protein, 9 aa, Homo Sapiens
TKGTFQQAA

SEQ ID NO: 231618 - protein, 9 aa, Homo Sapiens
LRLLRALCM

SEQ ID NO: 231619 - protein, 9 aa, Homo Sapiens
QEMLGMYRR

SEQ ID NO: 231620 - protein, 9 aa, Homo Sapiens
RGGGCLPPE

SEQ ID NO: 231621 - protein, 9 aa, Homo Sapiens
VHGALQGHG

SEQ ID NO: 231622 - protein, 9 aa, Homo Sapiens
GCRTQLVDT

SEQ ID NO: 231623 - protein, 9 aa, Homo Sapiens
DCSVEVDEC

SEQ ID NO: 231624 - protein, 9 aa, Homo Sapiens
AGTGAQRVC

SEQ ID NO: 231625 - protein, 9 aa, Homo Sapiens
DDKIRSLEE

SEQ ID NO: 231626 - protein, 9 aa, Homo Sapiens
MTTSNEGSK

SEQ ID NO: 231627 - protein, 9 aa, Homo Sapiens
VDQEGCIIV

SEQ ID NO: 231628 - protein, 9 aa, Homo Sapiens
GLVHGYRGS

SEQ ID NO: 231629 - protein, 9 aa, Homo Sapiens
HVKFWTLTG

SEQ ID NO: 231630 - protein, 9 aa, Homo Sapiens
TSLKKTYEN

SEQ ID NO: 231631 - protein, 9 aa, Homo Sapiens
KDLRGKKTA

SEQ ID NO: 231632 - protein, 9 aa, Homo Sapiens
WGPEVSDTG

SEQ ID NO: 231633 - protein, 9 aa, Homo Sapiens
HQPLPGQHL

SEQ ID NO: 231634 - protein, 9 aa, Homo Sapiens
KSVFHTGWI

SEQ ID NO: 231635 - protein, 9 aa, Homo Sapiens
CQAEVQEGH

SEQ ID NO: 231636 - protein, 9 aa, Homo Sapiens
VYSTPLRRQ

SEQ ID NO: 231637 - protein, 9 aa, Homo Sapiens
LLHSPVPRL

SEQ ID NO: 231638 - protein, 9 aa, Homo Sapiens
EDEMNDKKR

SEQ ID NO: 231639 - protein, 9 aa, Homo Sapiens
LMSVKPSDM

SEQ ID NO: 231640 - protein, 9 aa, Homo Sapiens
LLLLLVPCA

SEQ ID NO: 231641 - protein, 9 aa, Homo Sapiens
RVVAAYQPI

SEQ ID NO: 231642 - protein, 9 aa, Homo Sapiens
TVDHCHSYE

SEQ ID NO: 231643 - protein, 9 aa, Homo Sapiens
DNIISKELR

SEQ ID NO: 231644 - protein, 9 aa, Homo Sapiens
LQEGEAEAE

SEQ ID NO: 231645 - protein, 9 aa, Homo Sapiens
VSSLGDDPP

SEQ ID NO: 231646 - protein, 9 aa, Homo Sapiens
PQGPLPGCP

SEQ ID NO: 231647 - protein, 9 aa, Homo Sapiens
AGPAATSSL

SEQ ID NO: 231648 - protein, 9 aa, Homo Sapiens
GAYTLLVQL

SEQ ID NO: 231649 - protein, 9 aa, Homo Sapiens
ELQFTPDRE

SEQ ID NO: 231650 - protein, 9 aa, Homo Sapiens
QTTHRLYKV

SEQ ID NO: 231651 - protein, 9 aa, Homo Sapiens
IRGLGVDVL

SEQ ID NO: 231652 - protein, 9 aa, Homo Sapiens
PIHSWVLQA

SEQ ID NO: 231653 - protein, 9 aa, Homo Sapiens
ARGAPSLLL

SEQ ID NO: 231654 - protein, 9 aa, Homo Sapiens
HHSLKMRNL

SEQ ID NO: 231655 - protein, 9 aa, Homo Sapiens
LVIFYFLRG

SEQ ID NO: 231656 - protein, 9 aa, Homo Sapiens
DYREVCQQG

SEQ ID NO: 231657 - protein, 9 aa, Homo Sapiens
KFIPFIDVV

SEQ ID NO: 231658 - protein, 9 aa, Homo Sapiens
KKLTSTDGP

SEQ ID NO: 231659 - protein, 9 aa, Homo Sapiens
QFLDRQLSY

SEQ ID NO: 231660 - protein, 9 aa, Homo Sapiens
DKDGPAQQL

SEQ ID NO: 231661 - protein, 9 aa, Homo Sapiens
GVIHTSHNT

SEQ ID NO: 231662 - protein, 9 aa, Homo Sapiens
PVSAWSLPR

SEQ ID NO: 231663 - protein, 9 aa, Homo Sapiens
VTTTLKLIL

SEQ ID NO: 231664 - protein, 9 aa, Homo Sapiens
PPPRGRGGR

SEQ ID NO: 231665 - protein, 9 aa, Homo Sapiens
KKPEEFSVE

SEQ ID NO: 231666 - protein, 9 aa, Homo Sapiens
WGSHLTFNH

SEQ ID NO: 231667 - protein, 9 aa, Homo Sapiens
QLPQMSKVK

SEQ ID NO: 231668 - protein, 9 aa, Homo Sapiens
EEEDPMPIQ

SEQ ID NO: 231669 - protein, 9 aa, Homo Sapiens
FYGYTYCVW

SEQ ID NO: 231670 - protein, 9 aa, Homo Sapiens
PVSQHPGSS

SEQ ID NO: 231671 - protein, 9 aa, Homo Sapiens
PLMMPLDVN

SEQ ID NO: 231672 - protein, 9 aa, Homo Sapiens
QQMCYPIWL

SEQ ID NO: 231673 - protein, 9 aa, Homo Sapiens
RRFSATDSV

SEQ ID NO: 231674 - protein, 9 aa, Homo Sapiens
GGLRRASGT

SEQ ID NO: 231675 - protein, 9 aa, Homo Sapiens
QWSVPIREC

SEQ ID NO: 231676 - protein, 9 aa, Homo Sapiens
CFSEVQALP

SEQ ID NO: 231677 - protein, 9 aa, Homo Sapiens
GSPYVSWTS

SEQ ID NO: 231678 - protein, 9 aa, Homo Sapiens
ALSGSTPTA

SEQ ID NO: 231679 - protein, 9 aa, Homo Sapiens
SEIMGMVWK

SEQ ID NO: 231680 - protein, 9 aa, Homo Sapiens
VKLVWTEVL

SEQ ID NO: 231681 - protein, 9 aa, Homo Sapiens
LLLAFGLPL

SEQ ID NO: 231682 - protein, 9 aa, Homo Sapiens
HSGGGGGGS

SEQ ID NO: 231683 - protein, 9 aa, Homo Sapiens
LPKKLTSTD

SEQ ID NO: 231684 - protein, 9 aa, Homo Sapiens
LIVLCALAA

SEQ ID NO: 231685 - protein, 9 aa, Homo Sapiens
QAQDTAQRQ

SEQ ID NO: 231686 - protein, 9 aa, Homo Sapiens
CLSCSLTAT

SEQ ID NO: 231687 - protein, 9 aa, Homo Sapiens
VKTWTQFRN

SEQ ID NO: 231688 - protein, 9 aa, Homo Sapiens
YLSGDWAKP

SEQ ID NO: 231689 - protein, 9 aa, Homo Sapiens
DVCCGTSTI

SEQ ID NO: 231690 - protein, 9 aa, Homo Sapiens
QWLKCQDSK

SEQ ID NO: 231691 - protein, 9 aa, Homo Sapiens
ISVYPGYDV

SEQ ID NO: 231692 - protein, 9 aa, Homo Sapiens
QRVHLEEHA

SEQ ID NO: 231693 - protein, 9 aa, Homo Sapiens
SGRNEPSRC

SEQ ID NO: 231694 - protein, 9 aa, Homo Sapiens
RRDAGLTRR

SEQ ID NO: 231695 - protein, 9 aa, Homo Sapiens
PLTPQQVQE

SEQ ID NO: 231696 - protein, 9 aa, Homo Sapiens
SSDEIRYRV

SEQ ID NO: 231697 - protein, 9 aa, Homo Sapiens
GLKLRCERV

SEQ ID NO: 231698 - protein, 9 aa, Homo Sapiens
SLRPVRLQK

SEQ ID NO: 231699 - protein, 9 aa, Homo Sapiens
ATAATGPGC

SEQ ID NO: 231700 - protein, 9 aa, Homo Sapiens
FKLDLSLNF

SEQ ID NO: 231701 - protein, 9 aa, Homo Sapiens
VPQGAVIRL

SEQ ID NO: 231702 - protein, 9 aa, Homo Sapiens
HHESFPLSC

SEQ ID NO: 231703 - protein, 9 aa, Homo Sapiens
PLNTGGGPW

SEQ ID NO: 231704 - protein, 9 aa, Homo Sapiens
AHHLVPGPC

SEQ ID NO: 231705 - protein, 9 aa, Homo Sapiens
RWCWRCPWR

SEQ ID NO: 231706 - protein, 9 aa, Homo Sapiens
CVHNESTGS

SEQ ID NO: 231707 - protein, 9 aa, Homo Sapiens
DLLYLRTSG

SEQ ID NO: 231708 - protein, 9 aa, Homo Sapiens
SVFKAEFVS

SEQ ID NO: 231709 - protein, 9 aa, Homo Sapiens
HYDKLHVDP

SEQ ID NO: 231710 - protein, 9 aa, Homo Sapiens
AEEDHVDMS

SEQ ID NO: 231711 - protein, 9 aa, Homo Sapiens
PEKLALKED

SEQ ID NO: 231712 - protein, 9 aa, Homo Sapiens
ARRCLHDTA

SEQ ID NO: 231713 - protein, 9 aa, Homo Sapiens
ADGFFIQSN

SEQ ID NO: 231714 - protein, 9 aa, Homo Sapiens
DELIIKTVM

SEQ ID NO: 231715 - protein, 9 aa, Homo Sapiens
CGTSQTYFG

SEQ ID NO: 231716 - protein, 9 aa, Homo Sapiens
PLPPTRPRP

SEQ ID NO: 231717 - protein, 9 aa, Homo Sapiens
TCSPGMQRR

SEQ ID NO: 231718 - protein, 9 aa, Homo Sapiens
RPRGGPARS

SEQ ID NO: 231719 - protein, 9 aa, Homo Sapiens
PHKINPSHH

SEQ ID NO: 231720 - protein, 9 aa, Homo Sapiens
SVLATGLHL

SEQ ID NO: 231721 - protein, 9 aa, Homo Sapiens
RRQISHTSK

SEQ ID NO: 231722 - protein, 9 aa, Homo Sapiens
VRQSTSQPW

SEQ ID NO: 231723 - protein, 9 aa, Homo Sapiens
ENLVDFIKH

SEQ ID NO: 231724 - protein, 9 aa, Homo Sapiens
LGIGQLSAP

SEQ ID NO: 231725 - protein, 9 aa, Homo Sapiens
LLSGGQKQW

SEQ ID NO: 231726 - protein, 9 aa, Homo Sapiens
AQHRRLVSY

SEQ ID NO: 231727 - protein, 9 aa, Homo Sapiens
PRLTRERAA

SEQ ID NO: 231728 - protein, 9 aa, Homo Sapiens
VKPISKAPE

SEQ ID NO: 231729 - protein, 9 aa, Homo Sapiens
LTSGTLSAS

SEQ ID NO: 231730 - protein, 9 aa, Homo Sapiens
ERDRQMPSF

SEQ ID NO: 231731 - protein, 9 aa, Homo Sapiens
GKGSFGQAV

SEQ ID NO: 231732 - protein, 9 aa, Homo Sapiens
SHPSPSTGD

SEQ ID NO: 231733 - protein, 9 aa, Homo Sapiens
EETLPLEDV

SEQ ID NO: 231734 - protein, 9 aa, Homo Sapiens
KEVTENPNY

SEQ ID NO: 231735 - protein, 9 aa, Homo Sapiens
AVLETIKTY

SEQ ID NO: 231736 - protein, 9 aa, Homo Sapiens
GNEEIPQIS

SEQ ID NO: 231737 - protein, 9 aa, Homo Sapiens
PNPVEEIFI

SEQ ID NO: 231738 - protein, 9 aa, Homo Sapiens
KRSKKVSTR

SEQ ID NO: 231739 - protein, 9 aa, Homo Sapiens
AESNIALRS

SEQ ID NO: 231740 - protein, 9 aa, Homo Sapiens
SSAHSSDIS

SEQ ID NO: 231741 - protein, 9 aa, Homo Sapiens
GWLRRHMIP

SEQ ID NO: 231742 - protein, 9 aa, Homo Sapiens
FVYVEPREL

SEQ ID NO: 231743 - protein, 9 aa, Homo Sapiens
IRVCICISV

SEQ ID NO: 231744 - protein, 9 aa, Homo Sapiens
KKEKRREKK

SEQ ID NO: 231745 - protein, 9 aa, Homo Sapiens
IIIDPNLKH

SEQ ID NO: 231746 - protein, 9 aa, Homo Sapiens
CVCYQQVPW

SEQ ID NO: 231747 - protein, 9 aa, Homo Sapiens
EHTQKELQK

SEQ ID NO: 231748 - protein, 9 aa, Homo Sapiens
ILNVHSKLE

SEQ ID NO: 231749 - protein, 9 aa, Homo Sapiens
PINPNTLKE

SEQ ID NO: 231750 - protein, 9 aa, Homo Sapiens
RVPRCRTPQ

SEQ ID NO: 231751 - protein, 9 aa, Homo Sapiens
WEEETTTEM

SEQ ID NO: 231752 - protein, 9 aa, Homo Sapiens
DGLSEDQVL

SEQ ID NO: 231753 - protein, 9 aa, Homo Sapiens
APPPRMAAR

SEQ ID NO: 231754 - protein, 9 aa, Homo Sapiens
HFFSGFSFF

SEQ ID NO: 231755 - protein, 9 aa, Homo Sapiens
LVDFIKHNQ

SEQ ID NO: 231756 - protein, 9 aa, Homo Sapiens
TMQWNNKKM

SEQ ID NO: 231757 - protein, 9 aa, Homo Sapiens
CHLWGSYTL

SEQ ID NO: 231758 - protein, 9 aa, Homo Sapiens
KPKISQNMI

SEQ ID NO: 231759 - protein, 9 aa, Homo Sapiens
SNLGQDLPN

SEQ ID NO: 231760 - protein, 9 aa, Homo Sapiens
TCPPVFSYS

SEQ ID NO: 231761 - protein, 9 aa, Homo Sapiens
KLCHYSQKS

SEQ ID NO: 231762 - protein, 9 aa, Homo Sapiens
EIRVTPLGT

SEQ ID NO: 231763 - protein, 9 aa, Homo Sapiens
SRLPHQSPG

SEQ ID NO: 231764 - protein, 9 aa, Homo Sapiens
ETRCLAEYH

SEQ ID NO: 231765 - protein, 9 aa, Homo Sapiens
LKELGFCIH

SEQ ID NO: 231766 - protein, 9 aa, Homo Sapiens
DPPAVNLAT

SEQ ID NO: 231767 - protein, 9 aa, Homo Sapiens
KMGMPEEHG

SEQ ID NO: 231768 - protein, 9 aa, Homo Sapiens
GSGMGVLSV

SEQ ID NO: 231769 - protein, 9 aa, Homo Sapiens
TKTCRKPAL

SEQ ID NO: 231770 - protein, 9 aa, Homo Sapiens
RTGRPPKTA

SEQ ID NO: 231771 - protein, 9 aa, Homo Sapiens
GPPQAPPSG

SEQ ID NO: 231772 - protein, 9 aa, Homo Sapiens
KFLIVIGGV

SEQ ID NO: 231773 - protein, 9 aa, Homo Sapiens
RIRLHRLIL

SEQ ID NO: 231774 - protein, 9 aa, Homo Sapiens
SPAHSPTPT

SEQ ID NO: 231775 - protein, 9 aa, Homo Sapiens
FLIVIGGVQ

SEQ ID NO: 231776 - protein, 9 aa, Homo Sapiens
HRKGGCDSK

SEQ ID NO: 231777 - protein, 9 aa, Homo Sapiens
SMINREGIP

SEQ ID NO: 231778 - protein, 9 aa, Homo Sapiens
LMAMDFSGQ

SEQ ID NO: 231779 - protein, 9 aa, Homo Sapiens
LGNVLAELT

SEQ ID NO: 231780 - protein, 9 aa, Homo Sapiens
FLFAIFLIM

SEQ ID NO: 231781 - protein, 9 aa, Homo Sapiens
NFILTSTNS

SEQ ID NO: 231782 - protein, 9 aa, Homo Sapiens
GVKKGAPGP

SEQ ID NO: 231783 - protein, 9 aa, Homo Sapiens
RQDFLWTQL

SEQ ID NO: 231784 - protein, 9 aa, Homo Sapiens
KPMAYTSRM

SEQ ID NO: 231785 - protein, 9 aa, Homo Sapiens
TAAGGQPSR

SEQ ID NO: 231786 - protein, 9 aa, Homo Sapiens
GRPQNMSVA

SEQ ID NO: 231787 - protein, 9 aa, Homo Sapiens
TCPENSRYE

SEQ ID NO: 231788 - protein, 9 aa, Homo Sapiens
YKKTYMEMH

SEQ ID NO: 231789 - protein, 9 aa, Homo Sapiens
SRRGVRSFY

SEQ ID NO: 231790 - protein, 9 aa, Homo Sapiens
PLHSHLSWK

SEQ ID NO: 231791 - protein, 9 aa, Homo Sapiens
KSGSTASRA

SEQ ID NO: 231792 - protein, 9 aa, Homo Sapiens
GIKAYHMMN

SEQ ID NO: 231793 - protein, 9 aa, Homo Sapiens
HESFPLSCP

SEQ ID NO: 231794 - protein, 9 aa, Homo Sapiens
NRWEPEENI

SEQ ID NO: 231795 - protein, 9 aa, Homo Sapiens
AHSSDISCV

SEQ ID NO: 231796 - protein, 9 aa, Homo Sapiens
YSFIHMTFK

SEQ ID NO: 231797 - protein, 9 aa, Homo Sapiens
ALWPISKQL

SEQ ID NO: 231798 - protein, 9 aa, Homo Sapiens
QPRRGRLPA

SEQ ID NO: 231799 - protein, 9 aa, Homo Sapiens
GYHFLGERD

SEQ ID NO: 231800 - protein, 9 aa, Homo Sapiens
IWSAEVFKE

SEQ ID NO: 231801 - protein, 9 aa, Homo Sapiens
VDRSVHSGS

SEQ ID NO: 231802 - protein, 9 aa, Homo Sapiens
GPWSCVTRG

SEQ ID NO: 231803 - protein, 9 aa, Homo Sapiens
IPLVPLISL

SEQ ID NO: 231804 - protein, 9 aa, Homo Sapiens
LQGCVQVTF

SEQ ID NO: 231805 - protein, 9 aa, Homo Sapiens
RREKKRHCD

SEQ ID NO: 231806 - protein, 9 aa, Homo Sapiens
TLAFQQACY

SEQ ID NO: 231807 - protein, 9 aa, Homo Sapiens
ERLARPALL

SEQ ID NO: 231808 - protein, 9 aa, Homo Sapiens
NGPDVNHEY

SEQ ID NO: 231809 - protein, 9 aa, Homo Sapiens
SPEPPRPHA

SEQ ID NO: 231810 - protein, 9 aa, Homo Sapiens
IECIKQELM

SEQ ID NO: 231811 - protein, 9 aa, Homo Sapiens
QNSHSLLNF

SEQ ID NO: 231812 - protein, 9 aa, Homo Sapiens
PGPCWSLSE

SEQ ID NO: 231813 - protein, 9 aa, Homo Sapiens
FLVVFFCIC

SEQ ID NO: 231814 - protein, 9 aa, Homo Sapiens
KNTLWIEGA

SEQ ID NO: 231815 - protein, 9 aa, Homo Sapiens
TYIVFVLTL

SEQ ID NO: 231816 - protein, 9 aa, Homo Sapiens
KESEVTMGG

SEQ ID NO: 231817 - protein, 9 aa, Homo Sapiens
VETNGPDVN

SEQ ID NO: 231818 - protein, 9 aa, Homo Sapiens
YAGNKYAKC

SEQ ID NO: 231819 - protein, 9 aa, Homo Sapiens
ADQVRRYCT

SEQ ID NO: 231820 - protein, 9 aa, Homo Sapiens
VAQTSWTTS

SEQ ID NO: 231821 - protein, 9 aa, Homo Sapiens
LAVAPAVLL

SEQ ID NO: 231822 - protein, 9 aa, Homo Sapiens
LECPISTQS

SEQ ID NO: 231823 - protein, 9 aa, Homo Sapiens
ASPTTAASS

SEQ ID NO: 231824 - protein, 9 aa, Homo Sapiens
AGYTVLWIL

SEQ ID NO: 231825 - protein, 9 aa, Homo Sapiens
SYRPLCALT

SEQ ID NO: 231826 - protein, 9 aa, Homo Sapiens
IDQLMSHSH

SEQ ID NO: 231827 - protein, 9 aa, Homo Sapiens
VGIIKKMKK

SEQ ID NO: 231828 - protein, 9 aa, Homo Sapiens
GAGPGLSGH

SEQ ID NO: 231829 - protein, 9 aa, Homo Sapiens
RKFGDPSAA

SEQ ID NO: 231830 - protein, 9 aa, Homo Sapiens
GSQCRWLLC

SEQ ID NO: 231831 - protein, 9 aa, Homo Sapiens
QDVKTKRNW

SEQ ID NO: 231832 - protein, 9 aa, Homo Sapiens
LASGLVIWE

SEQ ID NO: 231833 - protein, 9 aa, Homo Sapiens
ETPCGCYVL

SEQ ID NO: 231834 - protein, 9 aa, Homo Sapiens
LPAWTLTSL

SEQ ID NO: 231835 - protein, 9 aa, Homo Sapiens
EALEKIRTT

SEQ ID NO: 231836 - protein, 9 aa, Homo Sapiens
GSTPAPWAG

SEQ ID NO: 231837 - protein, 9 aa, Homo Sapiens
PTNHVSASR

SEQ ID NO: 231838 - protein, 9 aa, Homo Sapiens
TTTSSTGTA

SEQ ID NO: 231839 - protein, 9 aa, Homo Sapiens
PPVAEEAAA

SEQ ID NO: 231840 - protein, 9 aa, Homo Sapiens
PPPTKKRGK

SEQ ID NO: 231841 - protein, 9 aa, Homo Sapiens
EDSPCESVQ

SEQ ID NO: 231842 - protein, 9 aa, Homo Sapiens
VHSTEQGTL

SEQ ID NO: 231843 - protein, 9 aa, Homo Sapiens
PALEEMEGI

SEQ ID NO: 231844 - protein, 9 aa, Homo Sapiens
QSAGTTSPW

SEQ ID NO: 231845 - protein, 9 aa, Homo Sapiens
TCSRRPLPW

SEQ ID NO: 231846 - protein, 9 aa, Homo Sapiens
KNSPFGSSC

SEQ ID NO: 231847 - protein, 9 aa, Homo Sapiens
TERIAALLQ

SEQ ID NO: 231848 - protein, 9 aa, Homo Sapiens
GLGGKRSLG

SEQ ID NO: 231849 - protein, 9 aa, Homo Sapiens
LNAWNGFSN

SEQ ID NO: 231850 - protein, 9 aa, Homo Sapiens
RVEGLLPCN

SEQ ID NO: 231851 - protein, 9 aa, Homo Sapiens
AHCSWGLPR

SEQ ID NO: 231852 - protein, 9 aa, Homo Sapiens
SVMSHRSSS

SEQ ID NO: 231853 - protein, 9 aa, Homo Sapiens
GDVFVVNGP

SEQ ID NO: 231854 - protein, 9 aa, Homo Sapiens
ASSATAATG

SEQ ID NO: 231855 - protein, 9 aa, Homo Sapiens
ESEVTMGGL

SEQ ID NO: 231856 - protein, 9 aa, Homo Sapiens
GGPWSCVTR

SEQ ID NO: 231857 - protein, 9 aa, Homo Sapiens
RARVPGLLE

SEQ ID NO: 231858 - protein, 9 aa, Homo Sapiens
EWPQLLQGS

SEQ ID NO: 231859 - protein, 9 aa, Homo Sapiens
QANKLKKMC

SEQ ID NO: 231860 - protein, 9 aa, Homo Sapiens
VSTSLKKTY

SEQ ID NO: 231861 - protein, 9 aa, Homo Sapiens
DNENHMEES

SEQ ID NO: 231862 - protein, 9 aa, Homo Sapiens
WGPMQPSST

SEQ ID NO: 231863 - protein, 9 aa, Homo Sapiens
NQVVEMLGH

SEQ ID NO: 231864 - protein, 9 aa, Homo Sapiens
PAVHAPRAL

SEQ ID NO: 231865 - protein, 9 aa, Homo Sapiens
VDRCALDNL

SEQ ID NO: 231866 - protein, 9 aa, Homo Sapiens
PVVLGADGQ

SEQ ID NO: 231867 - protein, 9 aa, Homo Sapiens
RKVADGLIK

SEQ ID NO: 231868 - protein, 9 aa, Homo Sapiens
TATPAAVVA

SEQ ID NO: 231869 - protein, 9 aa, Homo Sapiens
HACECDVNE

SEQ ID NO: 231870 - protein, 9 aa, Homo Sapiens
AIPLPLPGV

SEQ ID NO: 231871 - protein, 9 aa, Homo Sapiens
YCVEKDRQI

SEQ ID NO: 231872 - protein, 9 aa, Homo Sapiens
LKLNTEVCS

SEQ ID NO: 231873 - protein, 9 aa, Homo Sapiens
LEGRDVGAG

SEQ ID NO: 231874 - protein, 9 aa, Homo Sapiens
APPSGSRAE

SEQ ID NO: 231875 - protein, 9 aa, Homo Sapiens
LQRSARLAI

SEQ ID NO: 231876 - protein, 9 aa, Homo Sapiens
KTPWVFIGG

SEQ ID NO: 231877 - protein, 9 aa, Homo Sapiens
QACKRREQW

SEQ ID NO: 231878 - protein, 9 aa, Homo Sapiens
AEPQQQRRA

SEQ ID NO: 231879 - protein, 9 aa, Homo Sapiens
HSTRPAHKY

SEQ ID NO: 231880 - protein, 9 aa, Homo Sapiens
ADPVAPTPV

SEQ ID NO: 231881 - protein, 9 aa, Homo Sapiens
FIWTPWRKS

SEQ ID NO: 231882 - protein, 9 aa, Homo Sapiens
PTGTQQDAW

SEQ ID NO: 231883 - protein, 9 aa, Homo Sapiens
RRQPPHWLQ

SEQ ID NO: 231884 - protein, 9 aa, Homo Sapiens
PLSSTAKRC

SEQ ID NO: 231885 - protein, 9 aa, Homo Sapiens
HDDTALTLV

SEQ ID NO: 231886 - protein, 9 aa, Homo Sapiens
GVSLVGVHS

SEQ ID NO: 231887 - protein, 9 aa, Homo Sapiens
TTTGSCCWR

SEQ ID NO: 231888 - protein, 9 aa, Homo Sapiens
VSDTGGLTL

SEQ ID NO: 231889 - protein, 9 aa, Homo Sapiens
LVGSQHLFT

SEQ ID NO: 231890 - protein, 9 aa, Homo Sapiens
LLLSHKSCK

SEQ ID NO: 231891 - protein, 9 aa, Homo Sapiens
LAIRLNNKI

SEQ ID NO: 231892 - protein, 9 aa, Homo Sapiens
TTAASSPPG

SEQ ID NO: 231893 - protein, 9 aa, Homo Sapiens
DTSVNVKSA

SEQ ID NO: 231894 - protein, 9 aa, Homo Sapiens
TEMISATDH

SEQ ID NO: 231895 - protein, 9 aa, Homo Sapiens
VRKTTSPKG

SEQ ID NO: 231896 - protein, 9 aa, Homo Sapiens
MSPEDRVKC

SEQ ID NO: 231897 - protein, 9 aa, Homo Sapiens
DPVKVIEKN

SEQ ID NO: 231898 - protein, 9 aa, Homo Sapiens
EVPQGAVIR

SEQ ID NO: 231899 - protein, 9 aa, Homo Sapiens
SFSRKSTPF

SEQ ID NO: 231900 - protein, 9 aa, Homo Sapiens
LDAELELKA

SEQ ID NO: 231901 - protein, 9 aa, Homo Sapiens
PPRLAPGGL

SEQ ID NO: 231902 - protein, 9 aa, Homo Sapiens
KERFMMLYK

SEQ ID NO: 231903 - protein, 9 aa, Homo Sapiens
SRARCCRPA

SEQ ID NO: 231904 - protein, 9 aa, Homo Sapiens
SPTPGRAAS

SEQ ID NO: 231905 - protein, 9 aa, Homo Sapiens
PGAPGLLPS

SEQ ID NO: 231906 - protein, 9 aa, Homo Sapiens
KSDVSDSWP

SEQ ID NO: 231907 - protein, 9 aa, Homo Sapiens
KWWPSTSMR

SEQ ID NO: 231908 - protein, 9 aa, Homo Sapiens
AERSHDQRH

SEQ ID NO: 231909 - protein, 9 aa, Homo Sapiens
SCGTCPTAS

SEQ ID NO: 231910 - protein, 9 aa, Homo Sapiens
GSRRGVRSF

SEQ ID NO: 231911 - protein, 9 aa, Homo Sapiens
LDHQDVGVG

SEQ ID NO: 231912 - protein, 9 aa, Homo Sapiens
ARESRAGHG

SEQ ID NO: 231913 - protein, 9 aa, Homo Sapiens
TPEEKCARR

SEQ ID NO: 231914 - protein, 9 aa, Homo Sapiens
VDVVKQVQG

SEQ ID NO: 231915 - protein, 9 aa, Homo Sapiens
NGSWWAPSR

SEQ ID NO: 231916 - protein, 9 aa, Homo Sapiens
LRRHMIPET

SEQ ID NO: 231917 - protein, 9 aa, Homo Sapiens
NDRNILTLS

SEQ ID NO: 231918 - protein, 9 aa, Homo Sapiens
LSRRVCENR

SEQ ID NO: 231919 - protein, 9 aa, Homo Sapiens
DTTANRTQS

SEQ ID NO: 231920 - protein, 9 aa, Homo Sapiens
ISARSLQRL

SEQ ID NO: 231921 - protein, 9 aa, Homo Sapiens
NPTSLTGTT

SEQ ID NO: 231922 - protein, 9 aa, Homo Sapiens
WDLEQMVTK

SEQ ID NO: 231923 - protein, 9 aa, Homo Sapiens
SQVSGMVES

SEQ ID NO: 231924 - protein, 9 aa, Homo Sapiens
PSMLCVEDP

SEQ ID NO: 231925 - protein, 9 aa, Homo Sapiens
LFTTHFLEA

SEQ ID NO: 231926 - protein, 9 aa, Homo Sapiens
VKVLQEMLG

SEQ ID NO: 231927 - protein, 9 aa, Homo Sapiens
STPPRSWRR

SEQ ID NO: 231928 - protein, 9 aa, Homo Sapiens
PYLGYHFLG

SEQ ID NO: 231929 - protein, 9 aa, Homo Sapiens
CNDVDECND

SEQ ID NO: 231930 - protein, 9 aa, Homo Sapiens
NRIRLHRLI

SEQ ID NO: 231931 - protein, 9 aa, Homo Sapiens
RGRRRERSW

SEQ ID NO: 231932 - protein, 9 aa, Homo Sapiens
RRSPRAPGS

SEQ ID NO: 231933 - protein, 9 aa, Homo Sapiens
TASGSWNYR

SEQ ID NO: 231934 - protein, 9 aa, Homo Sapiens
KKQSQLYLL

SEQ ID NO: 231935 - protein, 9 aa, Homo Sapiens
CYPIWLITP

SEQ ID NO: 231936 - protein, 9 aa, Homo Sapiens
QLCYCETKH

SEQ ID NO: 231937 - protein, 9 aa, Homo Sapiens
QSQQSLSLQ

SEQ ID NO: 231938 - protein, 9 aa, Homo Sapiens
LSDSLQLEV

SEQ ID NO: 231939 - protein, 9 aa, Homo Sapiens
ERRFIFQKY

SEQ ID NO: 231940 - protein, 9 aa, Homo Sapiens
LLQGSLLLP

SEQ ID NO: 231941 - protein, 9 aa, Homo Sapiens
TQRVPGASN

SEQ ID NO: 231942 - protein, 9 aa, Homo Sapiens
QQRHLGVVF

SEQ ID NO: 231943 - protein, 9 aa, Homo Sapiens
FVWGKLSTW

SEQ ID NO: 231944 - protein, 9 aa, Homo Sapiens
ARTRAWRTR

SEQ ID NO: 231945 - protein, 9 aa, Homo Sapiens
GYVASLEAS

SEQ ID NO: 231946 - protein, 9 aa, Homo Sapiens
AYPQNPWLR

SEQ ID NO: 231947 - protein, 9 aa, Homo Sapiens
PQAPSPAFS

SEQ ID NO: 231948 - protein, 9 aa, Homo Sapiens
TTCSRRPLP

SEQ ID NO: 231949 - protein, 9 aa, Homo Sapiens
NKCVACGRT

SEQ ID NO: 231950 - protein, 9 aa, Homo Sapiens
PEGQEAADM

SEQ ID NO: 231951 - protein, 9 aa, Homo Sapiens
PSRLGGPKR

SEQ ID NO: 231952 - protein, 9 aa, Homo Sapiens
SFGKTSSCQ

SEQ ID NO: 231953 - protein, 9 aa, Homo Sapiens
VVDMAITEH

SEQ ID NO: 231954 - protein, 9 aa, Homo Sapiens
RVLALGAGV

SEQ ID NO: 231955 - protein, 9 aa, Homo Sapiens
YLRTSGEPW

SEQ ID NO: 231956 - protein, 9 aa, Homo Sapiens
PSQLCAGPG

SEQ ID NO: 231957 - protein, 9 aa, Homo Sapiens
CPISTQSFP

SEQ ID NO: 231958 - protein, 9 aa, Homo Sapiens
SKKEKKEKR

SEQ ID NO: 231959 - protein, 9 aa, Homo Sapiens
NPLTTVEDL

SEQ ID NO: 231960 - protein, 9 aa, Homo Sapiens
GKGASAPRG

SEQ ID NO: 231961 - protein, 9 aa, Homo Sapiens
WPLYWKGGE

SEQ ID NO: 231962 - protein, 9 aa, Homo Sapiens
LIYTVYSSS

SEQ ID NO: 231963 - protein, 9 aa, Homo Sapiens
KHFLSLPET

SEQ ID NO: 231964 - protein, 9 aa, Homo Sapiens
SRCGSGSPE

SEQ ID NO: 231965 - protein, 9 aa, Homo Sapiens
GNRAENFTK

SEQ ID NO: 231966 - protein, 9 aa, Homo Sapiens
PPQSRTTTH

SEQ ID NO: 231967 - protein, 9 aa, Homo Sapiens
GNKMTSLNS

SEQ ID NO: 231968 - protein, 9 aa, Homo Sapiens
ETLNPPGCA

SEQ ID NO: 231969 - protein, 9 aa, Homo Sapiens
KGQLEDLGK

SEQ ID NO: 231970 - protein, 9 aa, Homo Sapiens
GEKNQLTRD

SEQ ID NO: 231971 - protein, 9 aa, Homo Sapiens
HKTFNLKMT

SEQ ID NO: 231972 - protein, 9 aa, Homo Sapiens
LDYDKEKKL

SEQ ID NO: 231973 - protein, 9 aa, Homo Sapiens
FGFCLANYV

SEQ ID NO: 231974 - protein, 9 aa, Homo Sapiens
LIDFCDAPE

SEQ ID NO: 231975 - protein, 9 aa, Homo Sapiens
FAPFFVPMS

SEQ ID NO: 231976 - protein, 9 aa, Homo Sapiens
TFLLFFSFI

SEQ ID NO: 231977 - protein, 9 aa, Homo Sapiens
LLFFSFIHV

SEQ ID NO: 231978 - protein, 9 aa, Homo Sapiens
EAGPGLRAR

SEQ ID NO: 231979 - protein, 9 aa, Homo Sapiens
LVDLSYDST

SEQ ID NO: 231980 - protein, 9 aa, Homo Sapiens
DNKTNQPIT

SEQ ID NO: 231981 - protein, 9 aa, Homo Sapiens
SLLDPPETL

SEQ ID NO: 231982 - protein, 9 aa, Homo Sapiens
CCWRGWPGG

SEQ ID NO: 231983 - protein, 9 aa, Homo Sapiens
SYVGITLTL

SEQ ID NO: 231984 - protein, 9 aa, Homo Sapiens
KSRDTNRHR

SEQ ID NO: 231985 - protein, 9 aa, Homo Sapiens
QFLRILFCM

SEQ ID NO: 231986 - protein, 9 aa, Homo Sapiens
IGGMYAAAM

SEQ ID NO: 231987 - protein, 9 aa, Homo Sapiens
TFVFIVEKE

SEQ ID NO: 231988 - protein, 9 aa, Homo Sapiens
DSSSEKNSS

SEQ ID NO: 231989 - protein, 9 aa, Homo Sapiens
WGRLHSHCP

SEQ ID NO: 231990 - protein, 9 aa, Homo Sapiens
MRRCPHHER

SEQ ID NO: 231991 - protein, 9 aa, Homo Sapiens
DWIYHQLKK

SEQ ID NO: 231992 - protein, 9 aa, Homo Sapiens
AMLASDPAS

SEQ ID NO: 231993 - protein, 9 aa, Homo Sapiens
TLLKVLLNF

SEQ ID NO: 231994 - protein, 9 aa, Homo Sapiens
LIRERVHQV

SEQ ID NO: 231995 - protein, 9 aa, Homo Sapiens
RDSPIPQNY

SEQ ID NO: 231996 - protein, 9 aa, Homo Sapiens
VTPKSMVDL

SEQ ID NO: 231997 - protein, 9 aa, Homo Sapiens
ILFLIKQID

SEQ ID NO: 231998 - protein, 9 aa, Homo Sapiens
RSLCSQFLP

SEQ ID NO: 231999 - protein, 9 aa, Homo Sapiens
SQKLCVLLL

SEQ ID NO: 232000 - protein, 9 aa, Homo Sapiens
LIKCQRLAK

SEQ ID NO: 232001 - protein, 9 aa, Homo Sapiens
KCFSTFLSL

SEQ ID NO: 232002 - protein, 9 aa, Homo Sapiens
EVSSCPSTP

SEQ ID NO: 232003 - protein, 9 aa, Homo Sapiens
HLVDKLLLP

SEQ ID NO: 232004 - protein, 9 aa, Homo Sapiens
ILAIAEPCW

SEQ ID NO: 232005 - protein, 9 aa, Homo Sapiens
VLVILILFS

SEQ ID NO: 232006 - protein, 9 aa, Homo Sapiens
RCLMTTMLK

SEQ ID NO: 232007 - protein, 9 aa, Homo Sapiens
SHMNPLPTG

SEQ ID NO: 232008 - protein, 9 aa, Homo Sapiens
VKSLQNTSA

SEQ ID NO: 232009 - protein, 9 aa, Homo Sapiens
LRPETPRNG

SEQ ID NO: 232010 - protein, 9 aa, Homo Sapiens
VSASDAGVP

SEQ ID NO: 232011 - protein, 9 aa, Homo Sapiens
PWGRLHSHC

SEQ ID NO: 232012 - protein, 9 aa, Homo Sapiens
LVWPMWMVL

SEQ ID NO: 232013 - protein, 9 aa, Homo Sapiens
LGLMVMAYF

SEQ ID NO: 232014 - protein, 9 aa, Homo Sapiens
VDSSNKLIC

SEQ ID NO: 232015 - protein, 9 aa, Homo Sapiens
LKQDKCFST

SEQ ID NO: 232016 - protein, 9 aa, Homo Sapiens
YFQEVREIL

SEQ ID NO: 232017 - protein, 9 aa, Homo Sapiens
TSTVTPKSM

SEQ ID NO: 232018 - protein, 9 aa, Homo Sapiens
PSPDGNNGA

SEQ ID NO: 232019 - protein, 9 aa, Homo Sapiens
SASDAGVPP

SEQ ID NO: 232020 - protein, 9 aa, Homo Sapiens
TRSSSKSWK

SEQ ID NO: 232021 - protein, 9 aa, Homo Sapiens
PLSEITAQE

SEQ ID NO: 232022 - protein, 9 aa, Homo Sapiens
ANIAASPQS

SEQ ID NO: 232023 - protein, 9 aa, Homo Sapiens
QISSRTLHM

SEQ ID NO: 232024 - protein, 9 aa, Homo Sapiens
KTPPPLLKQ

SEQ ID NO: 232025 - protein, 9 aa, Homo Sapiens
RPATLTVTI

SEQ ID NO: 232026 - protein, 9 aa, Homo Sapiens
PAKHDPQRP

SEQ ID NO: 232027 - protein, 9 aa, Homo Sapiens
AGANIVLST

SEQ ID NO: 232028 - protein, 9 aa, Homo Sapiens
SDPVTLNLI

SEQ ID NO: 232029 - protein, 9 aa, Homo Sapiens
VLTFILSVL

SEQ ID NO: 232030 - protein, 9 aa, Homo Sapiens
GTECYCGHK

SEQ ID NO: 232031 - protein, 9 aa, Homo Sapiens
CFEWHFLEP

SEQ ID NO: 232032 - protein, 9 aa, Homo Sapiens
GAFGNMCCG

SEQ ID NO: 232033 - protein, 9 aa, Homo Sapiens
EPCWVCRKR

SEQ ID NO: 232034 - protein, 9 aa, Homo Sapiens
SQPSTLRLS

SEQ ID NO: 232035 - protein, 9 aa, Homo Sapiens
RVFYFICDT

SEQ ID NO: 232036 - protein, 9 aa, Homo Sapiens
ELIRERVHQ

SEQ ID NO: 232037 - protein, 9 aa, Homo Sapiens
LDPSAKPSR

SEQ ID NO: 232038 - protein, 9 aa, Homo Sapiens
KLIKCQRLA

SEQ ID NO: 232039 - protein, 9 aa, Homo Sapiens
VAFNKHGEI

SEQ ID NO: 232040 - protein, 9 aa, Homo Sapiens
TLTVTIFFK

SEQ ID NO: 232041 - protein, 9 aa, Homo Sapiens
SPGSTASPL

SEQ ID NO: 232042 - protein, 9 aa, Homo Sapiens
SMQTLFQGN

SEQ ID NO: 232043 - protein, 9 aa, Homo Sapiens
DRPRQIHFH

SEQ ID NO: 232044 - protein, 9 aa, Homo Sapiens
LLVDLKNKI

SEQ ID NO: 232045 - protein, 9 aa, Homo Sapiens
GETSVDSSN

SEQ ID NO: 232046 - protein, 9 aa, Homo Sapiens
RDQMLPEPN

SEQ ID NO: 232047 - protein, 9 aa, Homo Sapiens
RSPTAPAVS

SEQ ID NO: 232048 - protein, 9 aa, Homo Sapiens
DSLLRHTQF

SEQ ID NO: 232049 - protein, 9 aa, Homo Sapiens
TQAEACPLI

SEQ ID NO: 232050 - protein, 9 aa, Homo Sapiens
PVTLNLIPK

SEQ ID NO: 232051 - protein, 9 aa, Homo Sapiens
QFISEHVDT

SEQ ID NO: 232052 - protein, 9 aa, Homo Sapiens
AFSQISSRT

SEQ ID NO: 232053 - protein, 9 aa, Homo Sapiens
KDLELEQYT

SEQ ID NO: 232054 - protein, 9 aa, Homo Sapiens
CRKRTAHGQ

SEQ ID NO: 232055 - protein, 9 aa, Homo Sapiens
FEWHFLEPL

SEQ ID NO: 232056 - protein, 9 aa, Homo Sapiens
GVCAGLKRT

SEQ ID NO: 232057 - protein, 9 aa, Homo Sapiens
EDADRKPLE

SEQ ID NO: 232058 - protein, 9 aa, Homo Sapiens
DRKPLETKS

SEQ ID NO: 232059 - protein, 9 aa, Homo Sapiens
QKGRKPPAV

SEQ ID NO: 232060 - protein, 9 aa, Homo Sapiens
TSAIESILK

SEQ ID NO: 232061 - protein, 9 aa, Homo Sapiens
PRGHSAKLR

SEQ ID NO: 232062 - protein, 9 aa, Homo Sapiens
VNSLVLYGN

SEQ ID NO: 232063 - protein, 9 aa, Homo Sapiens
AATAIVTTT

SEQ ID NO: 232064 - protein, 9 aa, Homo Sapiens
CWVCRKRTA

SEQ ID NO: 232065 - protein, 9 aa, Homo Sapiens
DLLRRIICI

SEQ ID NO: 232066 - protein, 9 aa, Homo Sapiens
GPWVTTVAT

SEQ ID NO: 232067 - protein, 9 aa, Homo Sapiens
ATLTVTIFF

SEQ ID NO: 232068 - protein, 9 aa, Homo Sapiens
AIIPDLLQG

SEQ ID NO: 232069 - protein, 9 aa, Homo Sapiens
SRCLMTTML

SEQ ID NO: 232070 - protein, 9 aa, Homo Sapiens
EELIRERVH

SEQ ID NO: 232071 - protein, 9 aa, Homo Sapiens
PTAPAVSQA

SEQ ID NO: 232072 - protein, 9 aa, Homo Sapiens
MVIGYVGQN

SEQ ID NO: 232073 - protein, 9 aa, Homo Sapiens
IRTFNSEHK

SEQ ID NO: 232074 - protein, 9 aa, Homo Sapiens
NGRDLQFGF

SEQ ID NO: 232075 - protein, 9 aa, Homo Sapiens
ETISLQTWY

SEQ ID NO: 232076 - protein, 9 aa, Homo Sapiens
LQFLRILFC

SEQ ID NO: 232077 - protein, 9 aa, Homo Sapiens
LRILFCMLI

SEQ ID NO: 232078 - protein, 9 aa, Homo Sapiens
VNEKLSDRP

SEQ ID NO: 232079 - protein, 9 aa, Homo Sapiens
RKRLVRGRN

SEQ ID NO: 232080 - protein, 9 aa, Homo Sapiens
GDIEVDLND

SEQ ID NO: 232081 - protein, 9 aa, Homo Sapiens
LGTLLCACS

SEQ ID NO: 232082 - protein, 9 aa, Homo Sapiens
APSPDGNNG

SEQ ID NO: 232083 - protein, 9 aa, Homo Sapiens
CPSGFPGPE

SEQ ID NO: 232084 - protein, 9 aa, Homo Sapiens
KSLQNTSAI

SEQ ID NO: 232085 - protein, 9 aa, Homo Sapiens
IPDLLQGRL

SEQ ID NO: 232086 - protein, 9 aa, Homo Sapiens
NPRGHSAKL

SEQ ID NO: 232087 - protein, 9 aa, Homo Sapiens
LRLSPTFPE

SEQ ID NO: 232088 - protein, 9 aa, Homo Sapiens
GADNFMLLG

SEQ ID NO: 232089 - protein, 9 aa, Homo Sapiens
KLREQPSDP

SEQ ID NO: 232090 - protein, 9 aa, Homo Sapiens
FQGLRSVNS

SEQ ID NO: 232091 - protein, 9 aa, Homo Sapiens
QQQQQQEQQ

SEQ ID NO: 232092 - protein, 9 aa, Homo Sapiens
LHRQLTYNL

SEQ ID NO: 232093 - protein, 9 aa, Homo Sapiens
MIGGMYAAA

SEQ ID NO: 232094 - protein, 9 aa, Homo Sapiens
WVCRKRTAH

SEQ ID NO: 232095 - protein, 9 aa, Homo Sapiens
LYVLLLDFC

SEQ ID NO: 232096 - protein, 9 aa, Homo Sapiens
RHTQFVVEQ

SEQ ID NO: 232097 - protein, 9 aa, Homo Sapiens
LEFGTECYC

SEQ ID NO: 232098 - protein, 9 aa, Homo Sapiens
PEQLLYELS

SEQ ID NO: 232099 - protein, 9 aa, Homo Sapiens
IDMEPQFDF

SEQ ID NO: 232100 - protein, 9 aa, Homo Sapiens
SGFPGPELG

SEQ ID NO: 232101 - protein, 9 aa, Homo Sapiens
TEEGETSVD

SEQ ID NO: 232102 - protein, 9 aa, Homo Sapiens
SEHVDTQQL

SEQ ID NO: 232103 - protein, 9 aa, Homo Sapiens
PILAIAEPC

SEQ ID NO: 232104 - protein, 9 aa, Homo Sapiens
LVDARRSPT

SEQ ID NO: 232105 - protein, 9 aa, Homo Sapiens
SSPGSTASP

SEQ ID NO: 232106 - protein, 9 aa, Homo Sapiens
GSTYAGHGK

SEQ ID NO: 232107 - protein, 9 aa, Homo Sapiens
LEAQVLVIL

SEQ ID NO: 232108 - protein, 9 aa, Homo Sapiens
EEDVNEALS

SEQ ID NO: 232109 - protein, 9 aa, Homo Sapiens
FSQISSRTL

SEQ ID NO: 232110 - protein, 9 aa, Homo Sapiens
LHSHCPRHC

SEQ ID NO: 232111 - protein, 9 aa, Homo Sapiens
LADTTEKLY

SEQ ID NO: 232112 - protein, 9 aa, Homo Sapiens
PSPLASASP

SEQ ID NO: 232113 - protein, 9 aa, Homo Sapiens
SADEIRWRR

SEQ ID NO: 232114 - protein, 9 aa, Homo Sapiens
TSQVWDVGM

SEQ ID NO: 232115 - protein, 9 aa, Homo Sapiens
WYSKHMTQS

SEQ ID NO: 232116 - protein, 9 aa, Homo Sapiens
MLAGANIVL

SEQ ID NO: 232117 - protein, 9 aa, Homo Sapiens
ADRKPLETK

SEQ ID NO: 232118 - protein, 9 aa, Homo Sapiens
ERLGLAGGP

SEQ ID NO: 232119 - protein, 9 aa, Homo Sapiens
ASHQGLVKM

SEQ ID NO: 232120 - protein, 9 aa, Homo Sapiens
DADRKPLET

SEQ ID NO: 232121 - protein, 9 aa, Homo Sapiens
AVAFTFDKN

SEQ ID NO: 232122 - protein, 9 aa, Homo Sapiens
PSEKYLKIK

SEQ ID NO: 232123 - protein, 9 aa, Homo Sapiens
LEQYTRSSS

SEQ ID NO: 232124 - protein, 9 aa, Homo Sapiens
IGYVGQNIR

SEQ ID NO: 232125 - protein, 9 aa, Homo Sapiens
QDKCFSTFL

SEQ ID NO: 232126 - protein, 9 aa, Homo Sapiens
PPWGRLHSH

SEQ ID NO: 232127 - protein, 9 aa, Homo Sapiens
VTVTAVAFT

SEQ ID NO: 232128 - protein, 9 aa, Homo Sapiens
MWMVLTFMW

SEQ ID NO: 232129 - protein, 9 aa, Homo Sapiens
AQEKDFLWS

SEQ ID NO: 232130 - protein, 9 aa, Homo Sapiens
QSQHMTEVM

SEQ ID NO: 232131 - protein, 9 aa, Homo Sapiens
WMVLTFMWP

SEQ ID NO: 232132 - protein, 9 aa, Homo Sapiens
QRTFVFIVE

SEQ ID NO: 232133 - protein, 9 aa, Homo Sapiens
SEKYLKIKH

SEQ ID NO: 232134 - protein, 9 aa, Homo Sapiens
PGSLDTAPS

SEQ ID NO: 232135 - protein, 9 aa, Homo Sapiens
WMIGGMYAA

SEQ ID NO: 232136 - protein, 9 aa, Homo Sapiens
QQQQEQQQQ

SEQ ID NO: 232137 - protein, 9 aa, Homo Sapiens
TYAGHGKCD

SEQ ID NO: 232138 - protein, 9 aa, Homo Sapiens
GDREEDVNE

SEQ ID NO: 232139 - protein, 9 aa, Homo Sapiens
LDAAVYSPQ

SEQ ID NO: 232140 - protein, 9 aa, Homo Sapiens
GMCKESVNR

SEQ ID NO: 232141 - protein, 9 aa, Homo Sapiens
HTWALGATF

SEQ ID NO: 232142 - protein, 9 aa, Homo Sapiens
TDVREVSSC

SEQ ID NO: 232143 - protein, 9 aa, Homo Sapiens
LVDLKNKIL

SEQ ID NO: 232144 - protein, 9 aa, Homo Sapiens
SSEKNSSAS

SEQ ID NO: 232145 - protein, 9 aa, Homo Sapiens
SQHMTEVMR

SEQ ID NO: 232146 - protein, 9 aa, Homo Sapiens
TLVQPIPAM

SEQ ID NO: 232147 - protein, 9 aa, Homo Sapiens
ELREYPEPP

SEQ ID NO: 232148 - protein, 9 aa, Homo Sapiens
RQLTYNLLP

SEQ ID NO: 232149 - protein, 9 aa, Homo Sapiens
SPQTQWIHF

SEQ ID NO: 232150 - protein, 9 aa, Homo Sapiens
FTSASNVWS

SEQ ID NO: 232151 - protein, 9 aa, Homo Sapiens
NVWSYGIVM

SEQ ID NO: 232152 - protein, 9 aa, Homo Sapiens
HTQFVVEQV

SEQ ID NO: 232153 - protein, 9 aa, Homo Sapiens
LATQAEACP

SEQ ID NO: 232154 - protein, 9 aa, Homo Sapiens
IPKLPKPYI

SEQ ID NO: 232155 - protein, 9 aa, Homo Sapiens
TPNGRDLQF

SEQ ID NO: 232156 - protein, 9 aa, Homo Sapiens
DEQHTATII

SEQ ID NO: 232157 - protein, 9 aa, Homo Sapiens
KPLFSLGLG

SEQ ID NO: 232158 - protein, 9 aa, Homo Sapiens
PPLLKQLKP

SEQ ID NO: 232159 - protein, 9 aa, Homo Sapiens
TVLTFILSV

SEQ ID NO: 232160 - protein, 9 aa, Homo Sapiens
TATVAATAI

SEQ ID NO: 232161 - protein, 9 aa, Homo Sapiens
SASNVWSYG

SEQ ID NO: 232162 - protein, 9 aa, Homo Sapiens
PPTGHTWAL

SEQ ID NO: 232163 - protein, 9 aa, Homo Sapiens
PGSTASPLH

SEQ ID NO: 232164 - protein, 9 aa, Homo Sapiens
QQQEQQQQQ

SEQ ID NO: 232165 - protein, 9 aa, Homo Sapiens
DVTPDMISI

SEQ ID NO: 232166 - protein, 9 aa, Homo Sapiens
SRSKTPPPL

SEQ ID NO: 232167 - protein, 9 aa, Homo Sapiens
IKHLLLKRE

SEQ ID NO: 232168 - protein, 9 aa, Homo Sapiens
SPDGNNGAQ

SEQ ID NO: 232169 - protein, 9 aa, Homo Sapiens
LDLERLGLA

SEQ ID NO: 232170 - protein, 9 aa, Homo Sapiens
RAVKSLQNT

SEQ ID NO: 232171 - protein, 9 aa, Homo Sapiens
PSTLRLSPT

SEQ ID NO: 232172 - protein, 9 aa, Homo Sapiens
KPSEKYLKI

SEQ ID NO: 232173 - protein, 9 aa, Homo Sapiens
LRLAVLSQL

SEQ ID NO: 232174 - protein, 9 aa, Homo Sapiens
TEIIPELRE

SEQ ID NO: 232175 - protein, 9 aa, Homo Sapiens
RAILIPDSL

SEQ ID NO: 232176 - protein, 9 aa, Homo Sapiens
DVREVSSCP

SEQ ID NO: 232177 - protein, 9 aa, Homo Sapiens
KHLLLKRER

SEQ ID NO: 232178 - protein, 9 aa, Homo Sapiens
KKLFARKMK

SEQ ID NO: 232179 - protein, 9 aa, Homo Sapiens
PSRWKREAV

SEQ ID NO: 232180 - protein, 9 aa, Homo Sapiens
KFARLTWAL

SEQ ID NO: 232181 - protein, 9 aa, Homo Sapiens
LENLRLAVL

SEQ ID NO: 232182 - protein, 9 aa, Homo Sapiens
RPRQIHFHW

SEQ ID NO: 232183 - protein, 9 aa, Homo Sapiens
LFSTTWCFE

SEQ ID NO: 232184 - protein, 9 aa, Homo Sapiens
SVEDPANKR

SEQ ID NO: 232185 - protein, 9 aa, Homo Sapiens
PTGHTWALG

SEQ ID NO: 232186 - protein, 9 aa, Homo Sapiens
CTQMYHYSC

SEQ ID NO: 232187 - protein, 9 aa, Homo Sapiens
KWKEEKGDW

SEQ ID NO: 232188 - protein, 9 aa, Homo Sapiens
AAVYSPQTQ

SEQ ID NO: 232189 - protein, 9 aa, Homo Sapiens
QREQHSGAS

SEQ ID NO: 232190 - protein, 9 aa, Homo Sapiens
NLNEQVARS

SEQ ID NO: 232191 - protein, 9 aa, Homo Sapiens
IICILNLSK

SEQ ID NO: 232192 - protein, 9 aa, Homo Sapiens
TVTAVAFTF

SEQ ID NO: 232193 - protein, 9 aa, Homo Sapiens
ADEIRWRRL

SEQ ID NO: 232194 - protein, 9 aa, Homo Sapiens
VEDPANKRR

SEQ ID NO: 232195 - protein, 9 aa, Homo Sapiens
EAQVLVILI

SEQ ID NO: 232196 - protein, 9 aa, Homo Sapiens
PIPAMLASD

SEQ ID NO: 232197 - protein, 9 aa, Homo Sapiens
KFANLNEQV

SEQ ID NO: 232198 - protein, 9 aa, Homo Sapiens
ACSHRLREG

SEQ ID NO: 232199 - protein, 9 aa, Homo Sapiens
GGFGRGRGR

SEQ ID NO: 232200 - protein, 9 aa, Homo Sapiens
VLSQLGFTS

SEQ ID NO: 232201 - protein, 9 aa, Homo Sapiens
LMVMAYFQI

SEQ ID NO: 232202 - protein, 9 aa, Homo Sapiens
TVTPKSMVD

SEQ ID NO: 232203 - protein, 9 aa, Homo Sapiens
RGSQPSTLR

SEQ ID NO: 232204 - protein, 9 aa, Homo Sapiens
TQMYHYSCA

SEQ ID NO: 232205 - protein, 9 aa, Homo Sapiens
FIVEKEEER

SEQ ID NO: 232206 - protein, 9 aa, Homo Sapiens
PLKKLFARK

SEQ ID NO: 232207 - protein, 9 aa, Homo Sapiens
RSKTPPPLL

SEQ ID NO: 232208 - protein, 9 aa, Homo Sapiens
DISLEAQVL

SEQ ID NO: 232209 - protein, 9 aa, Homo Sapiens
DEGKEEAEV

SEQ ID NO: 232210 - protein, 9 aa, Homo Sapiens
WPMWMVLTF

SEQ ID NO: 232211 - protein, 9 aa, Homo Sapiens
DPSAKPSRW

SEQ ID NO: 232212 - protein, 9 aa, Homo Sapiens
TLNLIPKLP

SEQ ID NO: 232213 - protein, 9 aa, Homo Sapiens
ISRGRMQLF

SEQ ID NO: 232214 - protein, 9 aa, Homo Sapiens
ESQVHLQSP

SEQ ID NO: 232215 - protein, 9 aa, Homo Sapiens
INEAQNFRT

SEQ ID NO: 232216 - protein, 9 aa, Homo Sapiens
TAQEKDFLW

SEQ ID NO: 232217 - protein, 9 aa, Homo Sapiens
LAPLGLMVM

SEQ ID NO: 232218 - protein, 9 aa, Homo Sapiens
TARRVPAKH

SEQ ID NO: 232219 - protein, 9 aa, Homo Sapiens
QVWDVGMCK

SEQ ID NO: 232220 - protein, 9 aa, Homo Sapiens
FMGSLQAGG

SEQ ID NO: 232221 - protein, 9 aa, Homo Sapiens
YRCVAFNKH

SEQ ID NO: 232222 - protein, 9 aa, Homo Sapiens
NNNPPNIDL

SEQ ID NO: 232223 - protein, 9 aa, Homo Sapiens
YCKRTPVME

SEQ ID NO: 232224 - protein, 9 aa, Homo Sapiens
PCPSGFPGP

SEQ ID NO: 232225 - protein, 9 aa, Homo Sapiens
SQISSRTLH

SEQ ID NO: 232226 - protein, 9 aa, Homo Sapiens
NLNRVFYFI

SEQ ID NO: 232227 - protein, 9 aa, Homo Sapiens
ELETPDVFK

SEQ ID NO: 232228 - protein, 9 aa, Homo Sapiens
VTLNLIPKL

SEQ ID NO: 232229 - protein, 9 aa, Homo Sapiens
FIRDSPIPQ

SEQ ID NO: 232230 - protein, 9 aa, Homo Sapiens
NNPPNIDLR

SEQ ID NO: 232231 - protein, 9 aa, Homo Sapiens
RTKPLFSLG

SEQ ID NO: 232232 - protein, 9 aa, Homo Sapiens
DEMVIGYVG

SEQ ID NO: 232233 - protein, 9 aa, Homo Sapiens
PAMLASDPA

SEQ ID NO: 232234 - protein, 9 aa, Homo Sapiens
PHYVQQVLT

SEQ ID NO: 232235 - protein, 9 aa, Homo Sapiens
EKGDWIYHQ

SEQ ID NO: 232236 - protein, 9 aa, Homo Sapiens
LSQPQKGRK

SEQ ID NO: 232237 - protein, 9 aa, Homo Sapiens
YSCAAGAGT

SEQ ID NO: 232238 - protein, 9 aa, Homo Sapiens
AFTFDKNQA

SEQ ID NO: 232239 - protein, 9 aa, Homo Sapiens
QPIPAMLAS

SEQ ID NO: 232240 - protein, 9 aa, Homo Sapiens
ISLQTWYSC

SEQ ID NO: 232241 - protein, 9 aa, Homo Sapiens
IVINEAQNF

SEQ ID NO: 232242 - protein, 9 aa, Homo Sapiens
TLIYIGSGP

SEQ ID NO: 232243 - protein, 9 aa, Homo Sapiens
LMTTMLKMK

SEQ ID NO: 232244 - protein, 9 aa, Homo Sapiens
SCAAGAGTF

SEQ ID NO: 232245 - protein, 9 aa, Homo Sapiens
DAAVYSPQT

SEQ ID NO: 232246 - protein, 9 aa, Homo Sapiens
RTLLQDLTN

SEQ ID NO: 232247 - protein, 9 aa, Homo Sapiens
ARRSPTAPA

SEQ ID NO: 232248 - protein, 9 aa, Homo Sapiens
PVHLVDKLL

SEQ ID NO: 232249 - protein, 9 aa, Homo Sapiens
FILSVLWHG

SEQ ID NO: 232250 - protein, 9 aa, Homo Sapiens
MVAIIPDLL

SEQ ID NO: 232251 - protein, 9 aa, Homo Sapiens
WVTTVATGN

SEQ ID NO: 232252 - protein, 9 aa, Homo Sapiens
VQQVLTNVL

SEQ ID NO: 232253 - protein, 9 aa, Homo Sapiens
LLDFCACAV

SEQ ID NO: 232254 - protein, 9 aa, Homo Sapiens
FLLYVLLLD

SEQ ID NO: 232255 - protein, 9 aa, Homo Sapiens
HGQQSRCLM

SEQ ID NO: 232256 - protein, 9 aa, Homo Sapiens
DTAPSPLAS

SEQ ID NO: 232257 - protein, 9 aa, Homo Sapiens
QSPLKKLFA

SEQ ID NO: 232258 - protein, 9 aa, Homo Sapiens
LKRERVDLS

SEQ ID NO: 232259 - protein, 9 aa, Homo Sapiens
KEEKGDWIY

SEQ ID NO: 232260 - protein, 9 aa, Homo Sapiens
MKHNGPNNA

SEQ ID NO: 232261 - protein, 9 aa, Homo Sapiens
TTPASSSSD

SEQ ID NO: 232262 - protein, 9 aa, Homo Sapiens
DVGMCKESV

SEQ ID NO: 232263 - protein, 9 aa, Homo Sapiens
MLASDPASC

SEQ ID NO: 232264 - protein, 9 aa, Homo Sapiens
SLQTWYSCV

SEQ ID NO: 232265 - protein, 9 aa, Homo Sapiens
GMYAAAMAW

SEQ ID NO: 232266 - protein, 9 aa, Homo Sapiens
VDKLLLPIA

SEQ ID NO: 232267 - protein, 9 aa, Homo Sapiens
DGVREDLAP

SEQ ID NO: 232268 - protein, 9 aa, Homo Sapiens
CHMVAIIPD

SEQ ID NO: 232269 - protein, 9 aa, Homo Sapiens
GGLELETPD

SEQ ID NO: 232270 - protein, 9 aa, Homo Sapiens
QVHLQSPLC

SEQ ID NO: 232271 - protein, 9 aa, Homo Sapiens
RWRRLARLA

SEQ ID NO: 232272 - protein, 9 aa, Homo Sapiens
GKEEAEVEL

SEQ ID NO: 232273 - protein, 9 aa, Homo Sapiens
CVLLLVGSY

SEQ ID NO: 232274 - protein, 9 aa, Homo Sapiens
TASPLHEEP

SEQ ID NO: 232275 - protein, 9 aa, Homo Sapiens
EGVFQYFQE

SEQ ID NO: 232276 - protein, 9 aa, Homo Sapiens
VLYKQVMLE

SEQ ID NO: 232277 - protein, 9 aa, Homo Sapiens
VGMCKESVN

SEQ ID NO: 232278 - protein, 9 aa, Homo Sapiens
TFMWPILAI

SEQ ID NO: 232279 - protein, 9 aa, Homo Sapiens
DREEDVNEA

SEQ ID NO: 232280 - protein, 9 aa, Homo Sapiens
SLDTAPSPL

SEQ ID NO: 232281 - protein, 9 aa, Homo Sapiens
ITGIIGKWH

SEQ ID NO: 232282 - protein, 9 aa, Homo Sapiens
EDPANKRRS

SEQ ID NO: 232283 - protein, 9 aa, Homo Sapiens
VAATAIVTT

SEQ ID NO: 232284 - protein, 9 aa, Homo Sapiens
RERVDLSKL

SEQ ID NO: 232285 - protein, 9 aa, Homo Sapiens
LTFMWPILA

SEQ ID NO: 232286 - protein, 9 aa, Homo Sapiens
CCGGRMFAP

SEQ ID NO: 232287 - protein, 9 aa, Homo Sapiens
VMAYFQIFR

SEQ ID NO: 232288 - protein, 9 aa, Homo Sapiens
LANLNRVFY

SEQ ID NO: 232289 - protein, 9 aa, Homo Sapiens
HFLEPLLVW

SEQ ID NO: 232290 - protein, 9 aa, Homo Sapiens
YTRSSSKSW

SEQ ID NO: 232291 - protein, 9 aa, Homo Sapiens
CLMTTMLKM

SEQ ID NO: 232292 - protein, 9 aa, Homo Sapiens
EVLQQAGYI

SEQ ID NO: 232293 - protein, 9 aa, Homo Sapiens
LGCHMVAII

SEQ ID NO: 232294 - protein, 9 aa, Homo Sapiens
GGGCSCCGR

SEQ ID NO: 232295 - protein, 9 aa, Homo Sapiens
SVNEKLSDR

SEQ ID NO: 232296 - protein, 9 aa, Homo Sapiens
KENQSIRTF

SEQ ID NO: 232297 - protein, 9 aa, Homo Sapiens
ENQSIRTFN

SEQ ID NO: 232298 - protein, 9 aa, Homo Sapiens
LSTYCKRTP

SEQ ID NO: 232299 - protein, 9 aa, Homo Sapiens
EQVARSTEA

SEQ ID NO: 232300 - protein, 9 aa, Homo Sapiens
EMVIGYVGQ

SEQ ID NO: 232301 - protein, 9 aa, Homo Sapiens
WRRLARLAG

SEQ ID NO: 232302 - protein, 9 aa, Homo Sapiens
FLEDADRKP

SEQ ID NO: 232303 - protein, 9 aa, Homo Sapiens
KQIDVLKAL

SEQ ID NO: 232304 - protein, 9 aa, Homo Sapiens
WYSCVAGQP

SEQ ID NO: 232305 - protein, 9 aa, Homo Sapiens
QGAFGNMCC

SEQ ID NO: 232306 - protein, 9 aa, Homo Sapiens
NQETQSSTL

SEQ ID NO: 232307 - protein, 9 aa, Homo Sapiens
QAEACPLIK

SEQ ID NO: 232308 - protein, 9 aa, Homo Sapiens
DSDRTKPLF

SEQ ID NO: 232309 - protein, 9 aa, Homo Sapiens
QGLVKMRIW

SEQ ID NO: 232310 - protein, 9 aa, Homo Sapiens
TTMLKMKEN

SEQ ID NO: 232311 - protein, 9 aa, Homo Sapiens
NIAASPQSP

SEQ ID NO: 232312 - protein, 9 aa, Homo Sapiens
EHIQHIVIN

SEQ ID NO: 232313 - protein, 9 aa, Homo Sapiens
GCSCCGRLR

SEQ ID NO: 232314 - protein, 9 aa, Homo Sapiens
ILSVLWHGV

SEQ ID NO: 232315 - protein, 9 aa, Homo Sapiens
ARGAPSPDG

SEQ ID NO: 232316 - protein, 9 aa, Homo Sapiens
KGEEEGGWE

SEQ ID NO: 232317 - protein, 9 aa, Homo Sapiens
GEDYYSVED

SEQ ID NO: 232318 - protein, 9 aa, Homo Sapiens
FCMLIRLLE

SEQ ID NO: 232319 - protein, 9 aa, Homo Sapiens
ADEMVIGYV

SEQ ID NO: 232320 - protein, 9 aa, Homo Sapiens
DQASQVGFF

SEQ ID NO: 232321 - protein, 9 aa, Homo Sapiens
LTKTVSFSV

SEQ ID NO: 232322 - protein, 9 aa, Homo Sapiens
SLDKPEQLL

SEQ ID NO: 232323 - protein, 9 aa, Homo Sapiens
PLETKSLEV

SEQ ID NO: 232324 - protein, 9 aa, Homo Sapiens
KYLKIKHLL

SEQ ID NO: 232325 - protein, 9 aa, Homo Sapiens
IAADEMVIG

SEQ ID NO: 232326 - protein, 9 aa, Homo Sapiens
EGETSVDSS

SEQ ID NO: 232327 - protein, 9 aa, Homo Sapiens
ADTTEKLYS

SEQ ID NO: 232328 - protein, 9 aa, Homo Sapiens
DIPPPTGHT

SEQ ID NO: 232329 - protein, 9 aa, Homo Sapiens
GRDLQFGFD

SEQ ID NO: 232330 - protein, 9 aa, Homo Sapiens
LPEPNSFEA

SEQ ID NO: 232331 - protein, 9 aa, Homo Sapiens
GLMVMAYFQ

SEQ ID NO: 232332 - protein, 9 aa, Homo Sapiens
RGAPSPDGN

SEQ ID NO: 232333 - protein, 9 aa, Homo Sapiens
LVQPIPAML

SEQ ID NO: 232334 - protein, 9 aa, Homo Sapiens
AFQGLRSVN

SEQ ID NO: 232335 - protein, 9 aa, Homo Sapiens
ASQVGFFGP

SEQ ID NO: 232336 - protein, 9 aa, Homo Sapiens
VQPIPAMLA

SEQ ID NO: 232337 - protein, 9 aa, Homo Sapiens
VTTVATGNQ

SEQ ID NO: 232338 - protein, 9 aa, Homo Sapiens
PCWVCRKRT

SEQ ID NO: 232339 - protein, 9 aa, Homo Sapiens
AIAEPCWVC

SEQ ID NO: 232340 - protein, 9 aa, Homo Sapiens
ERVDLSKLQ

SEQ ID NO: 232341 - protein, 9 aa, Homo Sapiens
TISLQTWYS

SEQ ID NO: 232342 - protein, 9 aa, Homo Sapiens
TVATGNQPT

SEQ ID NO: 232343 - protein, 9 aa, Homo Sapiens
CMFWMIGGM

SEQ ID NO: 232344 - protein, 9 aa, Homo Sapiens
QVLVILILF

SEQ ID NO: 232345 - protein, 9 aa, Homo Sapiens
NEQVARSTE

SEQ ID NO: 232346 - protein, 9 aa, Homo Sapiens
QMYHYSCAA

SEQ ID NO: 232347 - protein, 9 aa, Homo Sapiens
VQSLELDDW

SEQ ID NO: 232348 - protein, 9 aa, Homo Sapiens
PLGLMVMAY

SEQ ID NO: 232349 - protein, 9 aa, Homo Sapiens
AVLSQLGFT

SEQ ID NO: 232350 - protein, 9 aa, Homo Sapiens
KDPHYVQQV

SEQ ID NO: 232351 - protein, 9 aa, Homo Sapiens
YSPQTQWIH

SEQ ID NO: 232352 - protein, 9 aa, Homo Sapiens
LCMLAGANI

SEQ ID NO: 232353 - protein, 9 aa, Homo Sapiens
LVGSYAWGV

SEQ ID NO: 232354 - protein, 9 aa, Homo Sapiens
TAPAVSQAL

SEQ ID NO: 232355 - protein, 9 aa, Homo Sapiens
TEDSLLRHT

SEQ ID NO: 232356 - protein, 9 aa, Homo Sapiens
VHLVDKLLL

SEQ ID NO: 232357 - protein, 9 aa, Homo Sapiens
IFFKQEGDR

SEQ ID NO: 232358 - protein, 9 aa, Homo Sapiens
ASPQSPLMQ

SEQ ID NO: 232359 - protein, 9 aa, Homo Sapiens
ISSPGSTAS

SEQ ID NO: 232360 - protein, 9 aa, Homo Sapiens
DNPRGHSAK

SEQ ID NO: 232361 - protein, 9 aa, Homo Sapiens
CACSHRLRE

SEQ ID NO: 232362 - protein, 9 aa, Homo Sapiens
MVMAYFQIF

SEQ ID NO: 232363 - protein, 9 aa, Homo Sapiens
HQGLVKMRI

SEQ ID NO: 232364 - protein, 9 aa, Homo Sapiens
REYPEPPPE

SEQ ID NO: 232365 - protein, 9 aa, Homo Sapiens
LREYPEPPP

SEQ ID NO: 232366 - protein, 9 aa, Homo Sapiens
HSSSRALTL

SEQ ID NO: 232367 - protein, 9 aa, Homo Sapiens
GDSDRTKPL

SEQ ID NO: 232368 - protein, 9 aa, Homo Sapiens
AHGQQSRCL

SEQ ID NO: 232369 - protein, 9 aa, Homo Sapiens
TRLSRVQSL

SEQ ID NO: 232370 - protein, 9 aa, Homo Sapiens
LELETPDVF

SEQ ID NO: 232371 - protein, 9 aa, Homo Sapiens
ILFSTTWCF

SEQ ID NO: 232372 - protein, 9 aa, Homo Sapiens
SHGDREEDV

SEQ ID NO: 232373 - protein, 9 aa, Homo Sapiens
YCNIASVCK

SEQ ID NO: 232374 - protein, 9 aa, Homo Sapiens
DLELEQYTR

SEQ ID NO: 232375 - protein, 9 aa, Homo Sapiens
VREDLAPFS

SEQ ID NO: 232376 - protein, 9 aa, Homo Sapiens
KLDEQHTAT

SEQ ID NO: 232377 - protein, 9 aa, Homo Sapiens
LSEITAQEK

SEQ ID NO: 232378 - protein, 9 aa, Homo Sapiens
LLLDFCACA

SEQ ID NO: 232379 - protein, 9 aa, Homo Sapiens
PRQIHFHWN

SEQ ID NO: 232380 - protein, 9 aa, Homo Sapiens
VARSTEAIR

SEQ ID NO: 232381 - protein, 9 aa, Homo Sapiens
EFGTECYCG

SEQ ID NO: 232382 - protein, 9 aa, Homo Sapiens
QTLFQGNSL

SEQ ID NO: 232383 - protein, 9 aa, Homo Sapiens
PFPDMLSLG

SEQ ID NO: 232384 - protein, 9 aa, Homo Sapiens
ASNVWSYGI

SEQ ID NO: 232385 - protein, 9 aa, Homo Sapiens
KHGEIESNV

SEQ ID NO: 232386 - protein, 9 aa, Homo Sapiens
DQMLPEPNS

SEQ ID NO: 232387 - protein, 9 aa, Homo Sapiens
LANIAASPQ

SEQ ID NO: 232388 - protein, 9 aa, Homo Sapiens
PGKEEFRKL

SEQ ID NO: 232389 - protein, 9 aa, Homo Sapiens
RPSMGRYRS

SEQ ID NO: 232390 - protein, 9 aa, Homo Sapiens
LSMEIKLCL

SEQ ID NO: 232391 - protein, 9 aa, Homo Sapiens
HTATIIEEL

SEQ ID NO: 232392 - protein, 9 aa, Homo Sapiens
NTTPASSSS

SEQ ID NO: 232393 - protein, 9 aa, Homo Sapiens
CPSTPGLSV

SEQ ID NO: 232394 - protein, 9 aa, Homo Sapiens
RLAVLSQLG

SEQ ID NO: 232395 - protein, 9 aa, Homo Sapiens
DMEPQFDFL

SEQ ID NO: 232396 - protein, 9 aa, Homo Sapiens
TYDGSTYAG

SEQ ID NO: 232397 - protein, 9 aa, Homo Sapiens
GNMCCGGRM

SEQ ID NO: 232398 - protein, 9 aa, Homo Sapiens
SLQNTSAIE

SEQ ID NO: 232399 - protein, 9 aa, Homo Sapiens
YKQVMLENY

SEQ ID NO: 232400 - protein, 9 aa, Homo Sapiens
RVGRSLCSQ

SEQ ID NO: 232401 - protein, 9 aa, Homo Sapiens
EPNSFEAAA

SEQ ID NO: 232402 - protein, 9 aa, Homo Sapiens
GCHMVAIIP

SEQ ID NO: 232403 - protein, 9 aa, Homo Sapiens
LEEKKEGEK

SEQ ID NO: 232404 - protein, 9 aa, Homo Sapiens
SSSEKNSSA

SEQ ID NO: 232405 - protein, 9 aa, Homo Sapiens
SLEAQVLVI

SEQ ID NO: 232406 - protein, 9 aa, Homo Sapiens
NEPPQGVCA

SEQ ID NO: 232407 - protein, 9 aa, Homo Sapiens
LKDQASQVG

SEQ ID NO: 232408 - protein, 9 aa, Homo Sapiens
DSMQTLFQG

SEQ ID NO: 232409 - protein, 9 aa, Homo Sapiens
KQLKPSEKY

SEQ ID NO: 232410 - protein, 9 aa, Homo Sapiens
GRNAKDLLV

SEQ ID NO: 232411 - protein, 9 aa, Homo Sapiens
PFLDSDSSS

SEQ ID NO: 232412 - protein, 9 aa, Homo Sapiens
FTFDKNQAL

SEQ ID NO: 232413 - protein, 9 aa, Homo Sapiens
RTLHMRKHT

SEQ ID NO: 232414 - protein, 9 aa, Homo Sapiens
SLLRHTQFV

SEQ ID NO: 232415 - protein, 9 aa, Homo Sapiens
STLRLSPTF

SEQ ID NO: 232416 - protein, 9 aa, Homo Sapiens
VHGYFKGIM

SEQ ID NO: 232417 - protein, 9 aa, Homo Sapiens
ENQETQSST

SEQ ID NO: 232418 - protein, 9 aa, Homo Sapiens
WPILAIAEP

SEQ ID NO: 232419 - protein, 9 aa, Homo Sapiens
EQLLYELSL

SEQ ID NO: 232420 - protein, 9 aa, Homo Sapiens
FGNMCCGGR

SEQ ID NO: 232421 - protein, 9 aa, Homo Sapiens
EHGVRIISR

SEQ ID NO: 232422 - protein, 9 aa, Homo Sapiens
SSRTLHMRK

SEQ ID NO: 232423 - protein, 9 aa, Homo Sapiens
LQFQVSASD

SEQ ID NO: 232424 - protein, 9 aa, Homo Sapiens
GYVGQNIRQ

SEQ ID NO: 232425 - protein, 9 aa, Homo Sapiens
QQEQQQQQQ

SEQ ID NO: 232426 - protein, 9 aa, Homo Sapiens
RNGVSPLFP

SEQ ID NO: 232427 - protein, 9 aa, Homo Sapiens
QAGYITGII

SEQ ID NO: 232428 - protein, 9 aa, Homo Sapiens
VDLSQPQKG

SEQ ID NO: 232429 - protein, 9 aa, Homo Sapiens
LRSVNSLVL

SEQ ID NO: 232430 - protein, 9 aa, Homo Sapiens
MDGVREDLA

SEQ ID NO: 232431 - protein, 9 aa, Homo Sapiens
AADEMVIGY

SEQ ID NO: 232432 - protein, 9 aa, Homo Sapiens
PNSFEAAAI

SEQ ID NO: 232433 - protein, 9 aa, Homo Sapiens
ITIESQVHL

SEQ ID NO: 232434 - protein, 9 aa, Homo Sapiens
VFIVEKEEE

SEQ ID NO: 232435 - protein, 9 aa, Homo Sapiens
LLLKRERVD

SEQ ID NO: 232436 - protein, 9 aa, Homo Sapiens
YSKHMTQSQ

SEQ ID NO: 232437 - protein, 9 aa, Homo Sapiens
EKLKQDKCF

SEQ ID NO: 232438 - protein, 9 aa, Homo Sapiens
LWWDRASHQ

SEQ ID NO: 232439 - protein, 9 aa, Homo Sapiens
SSTLSDSEE

SEQ ID NO: 232440 - protein, 9 aa, Homo Sapiens
FANLNEQVA

SEQ ID NO: 232441 - protein, 9 aa, Homo Sapiens
LLYVLLLDF

SEQ ID NO: 232442 - protein, 9 aa, Homo Sapiens
LYKQVMLEN

SEQ ID NO: 232443 - protein, 9 aa, Homo Sapiens
RLSRVQSLE

SEQ ID NO: 232444 - protein, 9 aa, Homo Sapiens
WQFISEHVD

SEQ ID NO: 232445 - protein, 9 aa, Homo Sapiens
ETPDVFKAP

SEQ ID NO: 232446 - protein, 9 aa, Homo Sapiens
KDPSPWAGC

SEQ ID NO: 232447 - protein, 9 aa, Homo Sapiens
PNNASDGTV

SEQ ID NO: 232448 - protein, 9 aa, Homo Sapiens
QLFIRDSPI

SEQ ID NO: 232449 - protein, 9 aa, Homo Sapiens
TYCKRTPVM

SEQ ID NO: 232450 - protein, 9 aa, Homo Sapiens
MQTLFQGNS

SEQ ID NO: 232451 - protein, 9 aa, Homo Sapiens
KIRIVQREQ

SEQ ID NO: 232452 - protein, 9 aa, Homo Sapiens
QQVLTNVLL

SEQ ID NO: 232453 - protein, 9 aa, Homo Sapiens
SHCKSLTLH

SEQ ID NO: 232454 - protein, 9 aa, Homo Sapiens
GLDLERLGL

SEQ ID NO: 232455 - protein, 9 aa, Homo Sapiens
LIKQIDVLK

SEQ ID NO: 232456 - protein, 9 aa, Homo Sapiens
IPAMLASDP

SEQ ID NO: 232457 - protein, 9 aa, Homo Sapiens
DLERLGLAG

SEQ ID NO: 232458 - protein, 9 aa, Homo Sapiens
TTVATGNQP

SEQ ID NO: 232459 - protein, 9 aa, Homo Sapiens
ATVAATAIV

SEQ ID NO: 232460 - protein, 9 aa, Homo Sapiens
SMVDLLAER

SEQ ID NO: 232461 - protein, 9 aa, Homo Sapiens
TLFHNSHMN

SEQ ID NO: 232462 - protein, 9 aa, Homo Sapiens
SSSSDSALH

SEQ ID NO: 232463 - protein, 9 aa, Homo Sapiens
PSGFPGPEL

SEQ ID NO: 232464 - protein, 9 aa, Homo Sapiens
RIICILNLS

SEQ ID NO: 232465 - protein, 9 aa, Homo Sapiens
MCKESVNRQ

SEQ ID NO: 232466 - protein, 9 aa, Homo Sapiens
LGQRNNVHG

SEQ ID NO: 232467 - protein, 9 aa, Homo Sapiens
QKLCVLLLV

SEQ ID NO: 232468 - protein, 9 aa, Homo Sapiens
QVARSTEAI

SEQ ID NO: 232469 - protein, 9 aa, Homo Sapiens
HDPQRPYEL

SEQ ID NO: 232470 - protein, 9 aa, Homo Sapiens
CMLIRLLEV

SEQ ID NO: 232471 - protein, 9 aa, Homo Sapiens
HGVRIISRG

SEQ ID NO: 232472 - protein, 9 aa, Homo Sapiens
FQYFQEVRE

SEQ ID NO: 232473 - protein, 9 aa, Homo Sapiens
SVKIRIVQR

SEQ ID NO: 232474 - protein, 9 aa, Homo Sapiens
HRQLTYNLL

SEQ ID NO: 232475 - protein, 9 aa, Homo Sapiens
LYGGLEFGT

SEQ ID NO: 232476 - protein, 9 aa, Homo Sapiens
YAGHGKCDC

SEQ ID NO: 232477 - protein, 9 aa, Homo Sapiens
AFLQYCNIA

SEQ ID NO: 232478 - protein, 9 aa, Homo Sapiens
RNNVHGYFK

SEQ ID NO: 232479 - protein, 9 aa, Homo Sapiens
LSVLWHGVY

SEQ ID NO: 232480 - protein, 9 aa, Homo Sapiens
NGEGVFQYF

SEQ ID NO: 232481 - protein, 9 aa, Homo Sapiens
RTLIYIGSG

SEQ ID NO: 232482 - protein, 9 aa, Homo Sapiens
SEKLDEQHT

SEQ ID NO: 232483 - protein, 9 aa, Homo Sapiens
HIVINEAQN

SEQ ID NO: 232484 - protein, 9 aa, Homo Sapiens
EVMRRCPHH

SEQ ID NO: 232485 - protein, 9 aa, Homo Sapiens
CAGLKRTFA

SEQ ID NO: 232486 - protein, 9 aa, Homo Sapiens
SNVWSYGIV

SEQ ID NO: 232487 - protein, 9 aa, Homo Sapiens
QYTRSSSKS

SEQ ID NO: 232488 - protein, 9 aa, Homo Sapiens
MYHYSCAAG

SEQ ID NO: 232489 - protein, 9 aa, Homo Sapiens
LLPIALRSH

SEQ ID NO: 232490 - protein, 9 aa, Homo Sapiens
PLLKQLKPS

SEQ ID NO: 232491 - protein, 9 aa, Homo Sapiens
LELEQYTRS

SEQ ID NO: 232492 - protein, 9 aa, Homo Sapiens
SVNSLVLYG

SEQ ID NO: 232493 - protein, 9 aa, Homo Sapiens
STPNGRDLQ

SEQ ID NO: 232494 - protein, 9 aa, Homo Sapiens
CNIASVCKA

SEQ ID NO: 232495 - protein, 9 aa, Homo Sapiens
LAGANIVLS

SEQ ID NO: 232496 - protein, 9 aa, Homo Sapiens
EITAQEKDF

SEQ ID NO: 232497 - protein, 9 aa, Homo Sapiens
NVHGYFKGI

SEQ ID NO: 232498 - protein, 9 aa, Homo Sapiens
AAALRDEGK

SEQ ID NO: 232499 - protein, 9 aa, Homo Sapiens
RLHRQLTYN

SEQ ID NO: 232500 - protein, 9 aa, Homo Sapiens
GQPGSGGGC

SEQ ID NO: 232501 - protein, 9 aa, Homo Sapiens
PPPTGHTWA

SEQ ID NO: 232502 - protein, 9 aa, Homo Sapiens
ISLEAQVLV

SEQ ID NO: 232503 - protein, 9 aa, Homo Sapiens
AEPCWVCRK

SEQ ID NO: 232504 - protein, 9 aa, Homo Sapiens
EKLDEQHTA

SEQ ID NO: 232505 - protein, 9 aa, Homo Sapiens
AFNKHGEIE

SEQ ID NO: 232506 - protein, 9 aa, Homo Sapiens
GQRNNVHGY

SEQ ID NO: 232507 - protein, 9 aa, Homo Sapiens
HTLFHNSHM

SEQ ID NO: 232508 - protein, 9 aa, Homo Sapiens
HLAFNDIDM

SEQ ID NO: 232509 - protein, 9 aa, Homo Sapiens
NLIPKLPKP

SEQ ID NO: 232510 - protein, 9 aa, Homo Sapiens
AALRDEGKE

SEQ ID NO: 232511 - protein, 9 aa, Homo Sapiens
LQYCNIASV

SEQ ID NO: 232512 - protein, 9 aa, Homo Sapiens
QNTSAIESI

SEQ ID NO: 232513 - protein, 9 aa, Homo Sapiens
CETYDGSTY

SEQ ID NO: 232514 - protein, 9 aa, Homo Sapiens
QRNNVHGYF

SEQ ID NO: 232515 - protein, 9 aa, Homo Sapiens
RRIICILNL

SEQ ID NO: 232516 - protein, 9 aa, Homo Sapiens
APLGLMVMA

SEQ ID NO: 232517 - protein, 9 aa, Homo Sapiens
TLATQAEAC

SEQ ID NO: 232518 - protein, 9 aa, Homo Sapiens
NFMLLGKPL

SEQ ID NO: 232519 - protein, 9 aa, Homo Sapiens
TKTVSFSVY

SEQ ID NO: 232520 - protein, 9 aa, Homo Sapiens
FLDSDSSSE

SEQ ID NO: 232521 - protein, 9 aa, Homo Sapiens
KFTSASNVW

SEQ ID NO: 232522 - protein, 9 aa, Homo Sapiens
QSLELDDWP

SEQ ID NO: 232523 - protein, 9 aa, Homo Sapiens
EIKLCLLDL

SEQ ID NO: 232524 - protein, 9 aa, Homo Sapiens
DLTKTVSFS

SEQ ID NO: 232525 - protein, 9 aa, Homo Sapiens
NGPNNASDG

SEQ ID NO: 232526 - protein, 9 aa, Homo Sapiens
EDVNEALSP

SEQ ID NO: 232527 - protein, 9 aa, Homo Sapiens
DKPEQLLYE

SEQ ID NO: 232528 - protein, 9 aa, Homo Sapiens
ILSTYCKRT

SEQ ID NO: 232529 - protein, 9 aa, Homo Sapiens
TYNLLPTDS

SEQ ID NO: 232530 - protein, 9 aa, Homo Sapiens
GEEEGGWEY

SEQ ID NO: 232531 - protein, 9 aa, Homo Sapiens
DPVTLNLIP

SEQ ID NO: 232532 - protein, 9 aa, Homo Sapiens
QSRCLMTTM

SEQ ID NO: 232533 - protein, 9 aa, Homo Sapiens
QILFLIKQI

SEQ ID NO: 232534 - protein, 9 aa, Homo Sapiens
EPLLVWPMW

SEQ ID NO: 232535 - protein, 9 aa, Homo Sapiens
IRDSPIPQN

SEQ ID NO: 232536 - protein, 9 aa, Homo Sapiens
LLVGSYAWG

SEQ ID NO: 232537 - protein, 9 aa, Homo Sapiens
TQSPLKKLF

SEQ ID NO: 232538 - protein, 9 aa, Homo Sapiens
HMTEVMRRC

SEQ ID NO: 232539 - protein, 9 aa, Homo Sapiens
GAPSPDGNN

SEQ ID NO: 232540 - protein, 9 aa, Homo Sapiens
IAASPQSPL

SEQ ID NO: 232541 - protein, 9 aa, Homo Sapiens
PNGRDLQFG

SEQ ID NO: 232542 - protein, 9 aa, Homo Sapiens
TINVTDVNN

SEQ ID NO: 232543 - protein, 9 aa, Homo Sapiens
LDSDSSSEK

SEQ ID NO: 232544 - protein, 9 aa, Homo Sapiens
QPQKGRKPP

SEQ ID NO: 232545 - protein, 9 aa, Homo Sapiens
IISRGRMQL

SEQ ID NO: 232546 - protein, 9 aa, Homo Sapiens
TPPPLLKQL

SEQ ID NO: 232547 - protein, 9 aa, Homo Sapiens
VWPMWMVLT

SEQ ID NO: 232548 - protein, 9 aa, Homo Sapiens
KEEFRKLRE

SEQ ID NO: 232549 - protein, 9 aa, Homo Sapiens
KSMVDLLAE

SEQ ID NO: 232550 - protein, 9 aa, Homo Sapiens
SKTPPPLLK

SEQ ID NO: 232551 - protein, 9 aa, Homo Sapiens
KVLYKQVML

SEQ ID NO: 232552 - protein, 9 aa, Homo Sapiens
CFSTFLSLL

SEQ ID NO: 232553 - protein, 9 aa, Homo Sapiens
LKPSEKYLK

SEQ ID NO: 232554 - protein, 9 aa, Homo Sapiens
GLRSVNSLV

SEQ ID NO: 232555 - protein, 9 aa, Homo Sapiens
KPEQLLYEL

SEQ ID NO: 232556 - protein, 9 aa, Homo Sapiens
TLFQGNSLA

SEQ ID NO: 232557 - protein, 9 aa, Homo Sapiens
NEKLSDRPS

SEQ ID NO: 232558 - protein, 9 aa, Homo Sapiens
SQVWDVGMC

SEQ ID NO: 232559 - protein, 9 aa, Homo Sapiens
QASQVGFFG

SEQ ID NO: 232560 - protein, 9 aa, Homo Sapiens
QVSASDAGV

SEQ ID NO: 232561 - protein, 9 aa, Homo Sapiens
RGQPGSGGG

SEQ ID NO: 232562 - protein, 9 aa, Homo Sapiens
YIGSGPTVY

SEQ ID NO: 232563 - protein, 9 aa, Homo Sapiens
QLKPSEKYL

SEQ ID NO: 232564 - protein, 9 aa, Homo Sapiens
LTELANIAA

SEQ ID NO: 232565 - protein, 9 aa, Homo Sapiens
TTEKLYSLT

SEQ ID NO: 232566 - protein, 9 aa, Homo Sapiens
MAEYRTLLQ

SEQ ID NO: 232567 - protein, 9 aa, Homo Sapiens
EKYLKIKHL

SEQ ID NO: 232568 - protein, 9 aa, Homo Sapiens
IKQIDVLKA

SEQ ID NO: 232569 - protein, 9 aa, Homo Sapiens
SLCSQFLPE

SEQ ID NO: 232570 - protein, 9 aa, Homo Sapiens
DFCACAVGL

SEQ ID NO: 232571 - protein, 9 aa, Homo Sapiens
VGADNFMLL

SEQ ID NO: 232572 - protein, 9 aa, Homo Sapiens
WWDRASHQG

SEQ ID NO: 232573 - protein, 9 aa, Homo Sapiens
GVREDLAPF

SEQ ID NO: 232574 - protein, 9 aa, Homo Sapiens
SEITAQEKD

SEQ ID NO: 232575 - protein, 9 aa, Homo Sapiens
VQREQHSGA

SEQ ID NO: 232576 - protein, 9 aa, Homo Sapiens
GSQPSTLRL

SEQ ID NO: 232577 - protein, 9 aa, Homo Sapiens
SAPCPSGFP

SEQ ID NO: 232578 - protein, 9 aa, Homo Sapiens
VRIISRGRM

SEQ ID NO: 232579 - protein, 9 aa, Homo Sapiens
CSHRLREGL

SEQ ID NO: 232580 - protein, 9 aa, Homo Sapiens
PLFSLGLGA

SEQ ID NO: 232581 - protein, 9 aa, Homo Sapiens
PSAKPSRWK

SEQ ID NO: 232582 - protein, 9 aa, Homo Sapiens
WMYVGTRGL

SEQ ID NO: 232583 - protein, 9 aa, Homo Sapiens
PQGVCAGLK

SEQ ID NO: 232584 - protein, 9 aa, Homo Sapiens
MISIAKADL

SEQ ID NO: 232585 - protein, 9 aa, Homo Sapiens
VTIFFKQEG

SEQ ID NO: 232586 - protein, 9 aa, Homo Sapiens
AKPSRWKRE

SEQ ID NO: 232587 - protein, 9 aa, Homo Sapiens
HLLLKRERV

SEQ ID NO: 232588 - protein, 9 aa, Homo Sapiens
LIPDSLGRL

SEQ ID NO: 232589 - protein, 9 aa, Homo Sapiens
NQSIRTFNS

SEQ ID NO: 232590 - protein, 9 aa, Homo Sapiens
TFMGSLQAG

SEQ ID NO: 232591 - protein, 9 aa, Homo Sapiens
EDYYSVEDP

SEQ ID NO: 232592 - protein, 9 aa, Homo Sapiens
LERLGLAGG

SEQ ID NO: 232593 - protein, 9 aa, Homo Sapiens
KRLVRGRNS

SEQ ID NO: 232594 - protein, 9 aa, Homo Sapiens
QVGFFGPVF

SEQ ID NO: 232595 - protein, 9 aa, Homo Sapiens
RIISRGRMQ

SEQ ID NO: 232596 - protein, 9 aa, Homo Sapiens
LAEHGVRII

SEQ ID NO: 232597 - protein, 9 aa, Homo Sapiens
LAFNDIDME

SEQ ID NO: 232598 - protein, 9 aa, Homo Sapiens
VKIRIVQRE

SEQ ID NO: 232599 - protein, 9 aa, Homo Sapiens
LIPKLPKPY

SEQ ID NO: 232600 - protein, 9 aa, Homo Sapiens
LGTRLSRVQ

SEQ ID NO: 232601 - protein, 9 aa, Homo Sapiens
AGYITGIIG

SEQ ID NO: 232602 - protein, 9 aa, Homo Sapiens
TPDLTKTVS

SEQ ID NO: 232603 - protein, 9 aa, Homo Sapiens
KSEKLDEQH

SEQ ID NO: 232604 - protein, 9 aa, Homo Sapiens
TAPSPLASA

SEQ ID NO: 232605 - protein, 9 aa, Homo Sapiens
SALSVLISA

SEQ ID NO: 232606 - protein, 9 aa, Homo Sapiens
LILFSTTWC

SEQ ID NO: 232607 - protein, 9 aa, Homo Sapiens
VDLNDTDKS

SEQ ID NO: 232608 - protein, 9 aa, Homo Sapiens
AVYSPQTQW

SEQ ID NO: 232609 - protein, 9 aa, Homo Sapiens
CMLAGANIV

SEQ ID NO: 232610 - protein, 9 aa, Homo Sapiens
GEGVFQYFQ

SEQ ID NO: 232611 - protein, 9 aa, Homo Sapiens
LRQKVLYKQ

SEQ ID NO: 232612 - protein, 9 aa, Homo Sapiens
LLVGADNFM

SEQ ID NO: 232613 - protein, 9 aa, Homo Sapiens
GTLLCACSH

SEQ ID NO: 232614 - protein, 9 aa, Homo Sapiens
SGGGCSCCG

SEQ ID NO: 232615 - protein, 9 aa, Homo Sapiens
EEGETSVDS

SEQ ID NO: 232616 - protein, 9 aa, Homo Sapiens
CGGRMFAPT

SEQ ID NO: 232617 - protein, 9 aa, Homo Sapiens
KAFSHCKSL

SEQ ID NO: 232618 - protein, 9 aa, Homo Sapiens
SMEIKLCLL

SEQ ID NO: 232619 - protein, 9 aa, Homo Sapiens
EEKGDWIYH

SEQ ID NO: 232620 - protein, 9 aa, Homo Sapiens
DLSQPQKGR

SEQ ID NO: 232621 - protein, 9 aa, Homo Sapiens
EFRKLREQP

SEQ ID NO: 232622 - protein, 9 aa, Homo Sapiens
PTEEGETSV

SEQ ID NO: 232623 - protein, 9 aa, Homo Sapiens
MYVGTRGLE

SEQ ID NO: 232624 - protein, 9 aa, Homo Sapiens
MNPLPTGYE

SEQ ID NO: 232625 - protein, 9 aa, Homo Sapiens
RKPLETKSL

SEQ ID NO: 232626 - protein, 9 aa, Homo Sapiens
GYITGIIGK

SEQ ID NO: 232627 - protein, 9 aa, Homo Sapiens
FMTPDLTKT

SEQ ID NO: 232628 - protein, 9 aa, Homo Sapiens
HEKLKQDKC

SEQ ID NO: 232629 - protein, 9 aa, Homo Sapiens
DSDSSSEKN

SEQ ID NO: 232630 - protein, 9 aa, Homo Sapiens
GRNSNNLKG

SEQ ID NO: 232631 - protein, 9 aa, Homo Sapiens
SEKNSSASE

SEQ ID NO: 232632 - protein, 9 aa, Homo Sapiens
IIPELREYP

SEQ ID NO: 232633 - protein, 9 aa, Homo Sapiens
TEVMRRCPH

SEQ ID NO: 232634 - protein, 9 aa, Homo Sapiens
MCCGGRMFA

SEQ ID NO: 232635 - protein, 9 aa, Homo Sapiens
IESQVHLQS

SEQ ID NO: 232636 - protein, 9 aa, Homo Sapiens
ELANIAASP

SEQ ID NO: 232637 - protein, 9 aa, Homo Sapiens
TMGKDPSPW

SEQ ID NO: 232638 - protein, 9 aa, Homo Sapiens
SDRPSMGRY

SEQ ID NO: 232639 - protein, 9 aa, Homo Sapiens
ETYDGSTYA

SEQ ID NO: 232640 - protein, 9 aa, Homo Sapiens
DEIRWRRLA

SEQ ID NO: 232641 - protein, 9 aa, Homo Sapiens
LQGKLIKCQ

SEQ ID NO: 232642 - protein, 9 aa, Homo Sapiens
FHNSHMNPL

SEQ ID NO: 232643 - protein, 9 aa, Homo Sapiens
RNAKDLLVD

SEQ ID NO: 232644 - protein, 9 aa, Homo Sapiens
KLCLLDLEN

SEQ ID NO: 232645 - protein, 9 aa, Homo Sapiens
FNDIDMEPQ

SEQ ID NO: 232646 - protein, 9 aa, Homo Sapiens
RTFNSEHKI

SEQ ID NO: 232647 - protein, 9 aa, Homo Sapiens
RTFVFIVEK

SEQ ID NO: 232648 - protein, 9 aa, Homo Sapiens
RSLADTTEK

SEQ ID NO: 232649 - protein, 9 aa, Homo Sapiens
HQVVAHVRA

SEQ ID NO: 232650 - protein, 9 aa, Homo Sapiens
DIDMEPQFD

SEQ ID NO: 232651 - protein, 9 aa, Homo Sapiens
LSDRPSMGR

SEQ ID NO: 232652 - protein, 9 aa, Homo Sapiens
GKAFSHCKS

SEQ ID NO: 232653 - protein, 9 aa, Homo Sapiens
LKIKHLLLK

SEQ ID NO: 232654 - protein, 9 aa, Homo Sapiens
FLRILFCML

SEQ ID NO: 232655 - protein, 9 aa, Homo Sapiens
LLCACSHRL

SEQ ID NO: 232656 - protein, 9 aa, Homo Sapiens
FNKHGEIES

SEQ ID NO: 232657 - protein, 9 aa, Homo Sapiens
NDIDMEPQF

SEQ ID NO: 232658 - protein, 9 aa, Homo Sapiens
SVDSSNKLI

SEQ ID NO: 232659 - protein, 9 aa, Homo Sapiens
SIRTFNSEH

SEQ ID NO: 232660 - protein, 9 aa, Homo Sapiens
TAVAFTFDK

SEQ ID NO: 232661 - protein, 9 aa, Homo Sapiens
MLLGKPLLG

SEQ ID NO: 232662 - protein, 9 aa, Homo Sapiens
ENLRLAVLS

SEQ ID NO: 232663 - protein, 9 aa, Homo Sapiens
GGCSCCGRL

SEQ ID NO: 232664 - protein, 9 aa, Homo Sapiens
VSSCPSTPG

SEQ ID NO: 232665 - protein, 9 aa, Homo Sapiens
VPAKHDPQR

SEQ ID NO: 232666 - protein, 9 aa, Homo Sapiens
LVDKLLLPI

SEQ ID NO: 232667 - protein, 9 aa, Homo Sapiens
FVFIVEKEE

SEQ ID NO: 232668 - protein, 9 aa, Homo Sapiens
DVNNNPPNI

SEQ ID NO: 232669 - protein, 9 aa, Homo Sapiens
RGRGRGGGF

SEQ ID NO: 232670 - protein, 9 aa, Homo Sapiens
YDGSTYAGH

SEQ ID NO: 232671 - protein, 9 aa, Homo Sapiens
SCPSTPGLS

SEQ ID NO: 232672 - protein, 9 aa, Homo Sapiens
GANIVLSTC

SEQ ID NO: 232673 - protein, 9 aa, Homo Sapiens
AKDLLVDLK

SEQ ID NO: 232674 - protein, 9 aa, Homo Sapiens
PELREYPEP

SEQ ID NO: 232675 - protein, 9 aa, Homo Sapiens
SDRTKPLFS

SEQ ID NO: 232676 - protein, 9 aa, Homo Sapiens
TGNQPTLIA

SEQ ID NO: 232677 - protein, 9 aa, Homo Sapiens
DMLSLGSSG

SEQ ID NO: 232678 - protein, 9 aa, Homo Sapiens
QTWYSCVAG

SEQ ID NO: 232679 - protein, 9 aa, Homo Sapiens
SVLWHGVYP

SEQ ID NO: 232680 - protein, 9 aa, Homo Sapiens
LEPLLVWPM

SEQ ID NO: 232681 - protein, 9 aa, Homo Sapiens
LNTTPASSS

SEQ ID NO: 232682 - protein, 9 aa, Homo Sapiens
SISSPGSTA

SEQ ID NO: 232683 - protein, 9 aa, Homo Sapiens
QGLRSVNSL

SEQ ID NO: 232684 - protein, 9 aa, Homo Sapiens
LLLPIALRS

SEQ ID NO: 232685 - protein, 9 aa, Homo Sapiens
CDLLRRIIC

SEQ ID NO: 232686 - protein, 9 aa, Homo Sapiens
YLAPLGLMV

SEQ ID NO: 232687 - protein, 9 aa, Homo Sapiens
TEMQLFIRD

SEQ ID NO: 232688 - protein, 9 aa, Homo Sapiens
AILIPDSLG

SEQ ID NO: 232689 - protein, 9 aa, Homo Sapiens
WHFLEPLLV

SEQ ID NO: 232690 - protein, 9 aa, Homo Sapiens
VTAVAFTFD

SEQ ID NO: 232691 - protein, 9 aa, Homo Sapiens
RPETPRNGV

SEQ ID NO: 232692 - protein, 9 aa, Homo Sapiens
HIQHIVINE

SEQ ID NO: 232693 - protein, 9 aa, Homo Sapiens
KIKHLLLKR

SEQ ID NO: 232694 - protein, 9 aa, Homo Sapiens
LGLAGGPLG

SEQ ID NO: 232695 - protein, 9 aa, Homo Sapiens
MTQSQAEQL

SEQ ID NO: 232696 - protein, 9 aa, Homo Sapiens
LFIRDSPIP

SEQ ID NO: 232697 - protein, 9 aa, Homo Sapiens
MEPQFDFLV

SEQ ID NO: 232698 - protein, 9 aa, Homo Sapiens
WTKFARLTW

SEQ ID NO: 232699 - protein, 9 aa, Homo Sapiens
SPLKKLFAR

SEQ ID NO: 232700 - protein, 9 aa, Homo Sapiens
KQDKCFSTF

SEQ ID NO: 232701 - protein, 9 aa, Homo Sapiens
IRERVHQVV

SEQ ID NO: 232702 - protein, 9 aa, Homo Sapiens
RCVAFNKHG

SEQ ID NO: 232703 - protein, 9 aa, Homo Sapiens
STQSPLKKL

SEQ ID NO: 232704 - protein, 9 aa, Homo Sapiens
PGSGGGCSC

SEQ ID NO: 232705 - protein, 9 aa, Homo Sapiens
TQRTFVFIV

SEQ ID NO: 232706 - protein, 9 aa, Homo Sapiens
GKEEFRKLR

SEQ ID NO: 232707 - protein, 9 aa, Homo Sapiens
TLANLNRVF

SEQ ID NO: 232708 - protein, 9 aa, Homo Sapiens
VCGKAFSHC

SEQ ID NO: 232709 - protein, 9 aa, Homo Sapiens
TECYCGHKI

SEQ ID NO: 232710 - protein, 9 aa, Homo Sapiens
RRVPAKHDP

SEQ ID NO: 232711 - protein, 9 aa, Homo Sapiens
QVMLENYSH

SEQ ID NO: 232712 - protein, 9 aa, Homo Sapiens
HMVAIIPDL

SEQ ID NO: 232713 - protein, 9 aa, Homo Sapiens
LFCMLIRLL

SEQ ID NO: 232714 - protein, 9 aa, Homo Sapiens
CLLDLENIQ

SEQ ID NO: 232715 - protein, 9 aa, Homo Sapiens
QPGSGGGCS

SEQ ID NO: 232716 - protein, 9 aa, Homo Sapiens
RAILSTYCK

SEQ ID NO: 232717 - protein, 9 aa, Homo Sapiens
LVILILFST

SEQ ID NO: 232718 - protein, 9 aa, Homo Sapiens
RERVHQVVA

SEQ ID NO: 232719 - protein, 9 aa, Homo Sapiens
HLQSPLCPL

SEQ ID NO: 232720 - protein, 9 aa, Homo Sapiens
TFNSEHKIP

SEQ ID NO: 232721 - protein, 9 aa, Homo Sapiens
FSHCKSLTL

SEQ ID NO: 232722 - protein, 9 aa, Homo Sapiens
LQQAGYITG

SEQ ID NO: 232723 - protein, 9 aa, Homo Sapiens
DLQFGFDPL

SEQ ID NO: 232724 - protein, 9 aa, Homo Sapiens
EFMTPDLTK

SEQ ID NO: 232725 - protein, 9 aa, Homo Sapiens
PQTQWIHFF

SEQ ID NO: 232726 - protein, 9 aa, Homo Sapiens
FLCMLAGAN

SEQ ID NO: 232727 - protein, 9 aa, Homo Sapiens
TFSQKSSLT

SEQ ID NO: 232728 - protein, 9 aa, Homo Sapiens
LLRHTQFVV

SEQ ID NO: 232729 - protein, 9 aa, Homo Sapiens
TQSQAEQLL

SEQ ID NO: 232730 - protein, 9 aa, Homo Sapiens
RVQSLELDD

SEQ ID NO: 232731 - protein, 9 aa, Homo Sapiens
DRASHQGLV

SEQ ID NO: 232732 - protein, 9 aa, Homo Sapiens
ILQGKLIKC

SEQ ID NO: 232733 - protein, 9 aa, Homo Sapiens
LNLIPKLPK

SEQ ID NO: 232734 - protein, 9 aa, Homo Sapiens
ELEQYTRSS

SEQ ID NO: 232735 - protein, 9 aa, Homo Sapiens
IPELREYPE

SEQ ID NO: 232736 - protein, 9 aa, Homo Sapiens
LNDTDKSST

SEQ ID NO: 232737 - protein, 9 aa, Homo Sapiens
TVAATAIVT

SEQ ID NO: 232738 - protein, 9 aa, Homo Sapiens
GRGGFGRGR

SEQ ID NO: 232739 - protein, 9 aa, Homo Sapiens
EQYTRSSSK

SEQ ID NO: 232740 - protein, 9 aa, Homo Sapiens
VGTRGLEEK

SEQ ID NO: 232741 - protein, 9 aa, Homo Sapiens
TKFARLTWA

SEQ ID NO: 232742 - protein, 9 aa, Homo Sapiens
LTWALTNSR

SEQ ID NO: 232743 - protein, 9 aa, Homo Sapiens
LKQLKPSEK

SEQ ID NO: 232744 - protein, 9 aa, Homo Sapiens
ERVHQVVAH

SEQ ID NO: 232745 - protein, 9 aa, Homo Sapiens
MVLTFMWPI

SEQ ID NO: 232746 - protein, 9 aa, Homo Sapiens
QAGGVAQAN

SEQ ID NO: 232747 - protein, 9 aa, Homo Sapiens
TTQRTFVFI

SEQ ID NO: 232748 - protein, 9 aa, Homo Sapiens
ATGNQPTLI

SEQ ID NO: 232749 - protein, 9 aa, Homo Sapiens
FWLGQRNNV

SEQ ID NO: 232750 - protein, 9 aa, Homo Sapiens
APSPLASAS

SEQ ID NO: 232751 - protein, 9 aa, Homo Sapiens
HNGPNNASD

SEQ ID NO: 232752 - protein, 9 aa, Homo Sapiens
LAIAEPCWV

SEQ ID NO: 232753 - protein, 9 aa, Homo Sapiens
AIATATVAA

SEQ ID NO: 232754 - protein, 9 aa, Homo Sapiens
VILILFSTT

SEQ ID NO: 232755 - protein, 9 aa, Homo Sapiens
VAIIPDLLQ

SEQ ID NO: 232756 - protein, 9 aa, Homo Sapiens
RWKREAVGN

SEQ ID NO: 232757 - protein, 9 aa, Homo Sapiens
VDLKNKILA

SEQ ID NO: 232758 - protein, 9 aa, Homo Sapiens
QGKLIKCQR

SEQ ID NO: 232759 - protein, 9 aa, Homo Sapiens
STYCKRTPV

SEQ ID NO: 232760 - protein, 9 aa, Homo Sapiens
ELSADEIRW

SEQ ID NO: 232761 - protein, 9 aa, Homo Sapiens
NRVFYFICD

SEQ ID NO: 232762 - protein, 9 aa, Homo Sapiens
VCRKRTAHG

SEQ ID NO: 232763 - protein, 9 aa, Homo Sapiens
LCACSHRLR

SEQ ID NO: 232764 - protein, 9 aa, Homo Sapiens
LDTAPSPLA

SEQ ID NO: 232765 - protein, 9 aa, Homo Sapiens
AEACPLIKV

SEQ ID NO: 232766 - protein, 9 aa, Homo Sapiens
LLLVGSYAW

SEQ ID NO: 232767 - protein, 9 aa, Homo Sapiens
DKCFSTFLS

SEQ ID NO: 232768 - protein, 9 aa, Homo Sapiens
STASPLHEE

SEQ ID NO: 232769 - protein, 9 aa, Homo Sapiens
YRKYPTLLK

SEQ ID NO: 232770 - protein, 9 aa, Homo Sapiens
RDPLSEITA

SEQ ID NO: 232771 - protein, 9 aa, Homo Sapiens
NAKDLLVDL

SEQ ID NO: 232772 - protein, 9 aa, Homo Sapiens
CGKAFSHCK

SEQ ID NO: 232773 - protein, 9 aa, Homo Sapiens
TTWCFEWHF

SEQ ID NO: 232774 - protein, 9 aa, Homo Sapiens
ILILFSTTW

SEQ ID NO: 232775 - protein, 9 aa, Homo Sapiens
AILSTYCKR

SEQ ID NO: 232776 - protein, 9 aa, Homo Sapiens
LAKGEEEGG

SEQ ID NO: 232777 - protein, 9 aa, Homo Sapiens
LEDADRKPL

SEQ ID NO: 232778 - protein, 9 aa, Homo Sapiens
ISSRTLHMR

SEQ ID NO: 232779 - protein, 9 aa, Homo Sapiens
CQRLAKNDR

SEQ ID NO: 232780 - protein, 9 aa, Homo Sapiens
HLGGLELET

SEQ ID NO: 232781 - protein, 9 aa, Homo Sapiens
FRKLREQPS

SEQ ID NO: 232782 - protein, 9 aa, Homo Sapiens
QTQWIHFFK

SEQ ID NO: 232783 - protein, 9 aa, Homo Sapiens
RENQETQSS

SEQ ID NO: 232784 - protein, 9 aa, Homo Sapiens
CVAFNKHGE

SEQ ID NO: 232785 - protein, 9 aa, Homo Sapiens
VMRRCPHHE

SEQ ID NO: 232786 - protein, 9 aa, Homo Sapiens
MEIKLCLLD

SEQ ID NO: 232787 - protein, 9 aa, Homo Sapiens
SLADTTEKL

SEQ ID NO: 232788 - protein, 9 aa, Homo Sapiens
LFQGNSLAS

SEQ ID NO: 232789 - protein, 9 aa, Homo Sapiens
ANLNRVFYF

SEQ ID NO: 232790 - protein, 9 aa, Homo Sapiens
REVSSCPST

SEQ ID NO: 232791 - protein, 9 aa, Homo Sapiens
RSVNSLVLY

SEQ ID NO: 232792 - protein, 9 aa, Homo Sapiens
VLKPFPDML

SEQ ID NO: 232793 - protein, 9 aa, Homo Sapiens
PTFMGSLQA

SEQ ID NO: 232794 - protein, 9 aa, Homo Sapiens
NIVLSTCTI

SEQ ID NO: 232795 - protein, 9 aa, Homo Sapiens
LFSLGLGAP

SEQ ID NO: 232796 - protein, 9 aa, Homo Sapiens
MTEVMRRCP

SEQ ID NO: 232797 - protein, 9 aa, Homo Sapiens
VAFTFDKNQ

SEQ ID NO: 232798 - protein, 9 aa, Homo Sapiens
GARGAPSPD

SEQ ID NO: 232799 - protein, 9 aa, Homo Sapiens
GSTASPLHE

SEQ ID NO: 232800 - protein, 9 aa, Homo Sapiens
GKDPSPWAG

SEQ ID NO: 232801 - protein, 9 aa, Homo Sapiens
QKVLYKQVM

SEQ ID NO: 232802 - protein, 9 aa, Homo Sapiens
PTVLKPFPD

SEQ ID NO: 232803 - protein, 9 aa, Homo Sapiens
ANLNEQVAR

SEQ ID NO: 232804 - protein, 9 aa, Homo Sapiens
NLRLAVLSQ

SEQ ID NO: 232805 - protein, 9 aa, Homo Sapiens
GTRGLEEKK

SEQ ID NO: 232806 - protein, 9 aa, Homo Sapiens
EMQLFIRDS

SEQ ID NO: 232807 - protein, 9 aa, Homo Sapiens
FGTECYCGH

SEQ ID NO: 232808 - protein, 9 aa, Homo Sapiens
LVGADNFML

SEQ ID NO: 232809 - protein, 9 aa, Homo Sapiens
DPLSEITAQ

SEQ ID NO: 232810 - protein, 9 aa, Homo Sapiens
VGRSLCSQF

SEQ ID NO: 232811 - protein, 9 aa, Homo Sapiens
TNEPPQGVC

SEQ ID NO: 232812 - protein, 9 aa, Homo Sapiens
SHSSSRALT

SEQ ID NO: 232813 - protein, 9 aa, Homo Sapiens
HNSHMNPLP

SEQ ID NO: 232814 - protein, 9 aa, Homo Sapiens
KPSRWKREA

SEQ ID NO: 232815 - protein, 9 aa, Homo Sapiens
VMKHNGPNN

SEQ ID NO: 232816 - protein, 9 aa, Homo Sapiens
PDMLSLGSS

SEQ ID NO: 232817 - protein, 9 aa, Homo Sapiens
QHIVINEAQ

SEQ ID NO: 232818 - protein, 9 aa, Homo Sapiens
APCPSGFPG

SEQ ID NO: 232819 - protein, 9 aa, Homo Sapiens
HGDREEDVN

SEQ ID NO: 232820 - protein, 9 aa, Homo Sapiens
ETSVDSSNK

SEQ ID NO: 232821 - protein, 9 aa, Homo Sapiens
VLQQAGYIT

SEQ ID NO: 232822 - protein, 9 aa, Homo Sapiens
YSCVAGQPI

SEQ ID NO: 232823 - protein, 9 aa, Homo Sapiens
THLGGLELE

SEQ ID NO: 232824 - protein, 9 aa, Homo Sapiens
TELANIAAS

SEQ ID NO: 232825 - protein, 9 aa, Homo Sapiens
SSCPSTPGL

SEQ ID NO: 232826 - protein, 9 aa, Homo Sapiens
YKWDRRAIL

SEQ ID NO: 232827 - protein, 9 aa, Homo Sapiens
YLKIKHLLL

SEQ ID NO: 232828 - protein, 9 aa, Homo Sapiens
AVKSLQNTS

SEQ ID NO: 232829 - protein, 9 aa, Homo Sapiens
NNVHGYFKG

SEQ ID NO: 232830 - protein, 9 aa, Homo Sapiens
RKRTAHGQQ

SEQ ID NO: 232831 - protein, 9 aa, Homo Sapiens
FQGNSLASK

SEQ ID NO: 232832 - protein, 9 aa, Homo Sapiens
LLKVLLNFL

SEQ ID NO: 232833 - protein, 9 aa, Homo Sapiens
WIYHQLKKL

SEQ ID NO: 232834 - protein, 9 aa, Homo Sapiens
TGHTWALGA

SEQ ID NO: 232835 - protein, 9 aa, Homo Sapiens
PTLLKVLLN

SEQ ID NO: 232836 - protein, 9 aa, Homo Sapiens
FISEHVDTQ

SEQ ID NO: 232837 - protein, 9 aa, Homo Sapiens
GLELETPDV

SEQ ID NO: 232838 - protein, 9 aa, Homo Sapiens
AFNDIDMEP

SEQ ID NO: 232839 - protein, 9 aa, Homo Sapiens
QHMTEVMRR

SEQ ID NO: 232840 - protein, 9 aa, Homo Sapiens
TRGLEEKKE

SEQ ID NO: 232841 - protein, 9 aa, Homo Sapiens
EIIPELREY

SEQ ID NO: 232842 - protein, 9 aa, Homo Sapiens
RLGLAGGPL

SEQ ID NO: 232843 - protein, 9 aa, Homo Sapiens
EWHFLEPLL

SEQ ID NO: 232844 - protein, 9 aa, Homo Sapiens
WKEEKGDWI

SEQ ID NO: 232845 - protein, 9 aa, Homo Sapiens
KHMTQSQAE

SEQ ID NO: 232846 - protein, 9 aa, Homo Sapiens
KGDWIYHQL

SEQ ID NO: 232847 - protein, 9 aa, Homo Sapiens
DRPSMGRYR

SEQ ID NO: 232848 - protein, 9 aa, Homo Sapiens
STVTPKSMV

SEQ ID NO: 232849 - protein, 9 aa, Homo Sapiens
ITAQEKDFL

SEQ ID NO: 232850 - protein, 9 aa, Homo Sapiens
EVSGRTLIY

SEQ ID NO: 232851 - protein, 9 aa, Homo Sapiens
NVTDVNNNP

SEQ ID NO: 232852 - protein, 9 aa, Homo Sapiens
LLYELSLIP

SEQ ID NO: 232853 - protein, 9 aa, Homo Sapiens
FPGPELGPA

SEQ ID NO: 232854 - protein, 9 aa, Homo Sapiens
LRDEGKEEA

SEQ ID NO: 232855 - protein, 9 aa, Homo Sapiens
ARRVPAKHD

SEQ ID NO: 232856 - protein, 9 aa, Homo Sapiens
RLVRGRNSN

SEQ ID NO: 232857 - protein, 9 aa, Homo Sapiens
LRSLADTTE

SEQ ID NO: 232858 - protein, 9 aa, Homo Sapiens
YNLLPTDSA

SEQ ID NO: 232859 - protein, 9 aa, Homo Sapiens
QYCNIASVC

SEQ ID NO: 232860 - protein, 9 aa, Homo Sapiens
LIYIGSGPT

SEQ ID NO: 232861 - protein, 9 aa, Homo Sapiens
LSADEIRWR

SEQ ID NO: 232862 - protein, 9 aa, Homo Sapiens
PWVTTVATG

SEQ ID NO: 232863 - protein, 9 aa, Homo Sapiens
DMISIAKAD

SEQ ID NO: 232864 - protein, 9 aa, Homo Sapiens
IIPDLLQGR

SEQ ID NO: 232865 - protein, 9 aa, Homo Sapiens
SHQGLVKMR

SEQ ID NO: 232866 - protein, 9 aa, Homo Sapiens
PMWMVLTFM

SEQ ID NO: 232867 - protein, 9 aa, Homo Sapiens
PRNGVSPLF

SEQ ID NO: 232868 - protein, 9 aa, Homo Sapiens
EEEGGWEYD

SEQ ID NO: 232869 - protein, 9 aa, Homo Sapiens
SQVGFFGPV

SEQ ID NO: 232870 - protein, 9 aa, Homo Sapiens
GTRLSRVQS

SEQ ID NO: 232871 - protein, 9 aa, Homo Sapiens
QKSSLTCHH

SEQ ID NO: 232872 - protein, 9 aa, Homo Sapiens
TEKLYSLTS

SEQ ID NO: 232873 - protein, 9 aa, Homo Sapiens
NEAQNFRTE

SEQ ID NO: 232874 - protein, 9 aa, Homo Sapiens
VTDVNNNPP

SEQ ID NO: 232875 - protein, 9 aa, Homo Sapiens
RLTWALTNS

SEQ ID NO: 232876 - protein, 9 aa, Homo Sapiens
VTEMQLFIR

SEQ ID NO: 232877 - protein, 9 aa, Homo Sapiens
QYFQEVREI

SEQ ID NO: 232878 - protein, 9 aa, Homo Sapiens
YGGLEFGTE

SEQ ID NO: 232879 - protein, 9 aa, Homo Sapiens
VSGRTLIYI

SEQ ID NO: 232880 - protein, 9 aa, Homo Sapiens
MLPEPNSFE

SEQ ID NO: 232881 - protein, 9 aa, Homo Sapiens
YYSVEDPAN

SEQ ID NO: 232882 - protein, 9 aa, Homo Sapiens
TSASNVWSY

SEQ ID NO: 232883 - protein, 9 aa, Homo Sapiens
KCTQMYHYS

SEQ ID NO: 232884 - protein, 9 aa, Homo Sapiens
GHTWALGAT

SEQ ID NO: 232885 - protein, 9 aa, Homo Sapiens
EGGWEYDTF

SEQ ID NO: 232886 - protein, 9 aa, Homo Sapiens
YSVEDPANK

SEQ ID NO: 232887 - protein, 9 aa, Homo Sapiens
VDARRSPTA

SEQ ID NO: 232888 - protein, 9 aa, Homo Sapiens
ILIPDSLGR

SEQ ID NO: 232889 - protein, 9 aa, Homo Sapiens
YRTLLQDLT

SEQ ID NO: 232890 - protein, 9 aa, Homo Sapiens
EWYSKHMTQ

SEQ ID NO: 232891 - protein, 9 aa, Homo Sapiens
HCKSLTLHQ

SEQ ID NO: 232892 - protein, 9 aa, Homo Sapiens
NTSAIESIL

SEQ ID NO: 232893 - protein, 9 aa, Homo Sapiens
QGVCAGLKR

SEQ ID NO: 232894 - protein, 9 aa, Homo Sapiens
DIEVDLNDT

SEQ ID NO: 232895 - protein, 9 aa, Homo Sapiens
GLAGGPLGL

SEQ ID NO: 232896 - protein, 9 aa, Homo Sapiens
HMTQSQAEQ

SEQ ID NO: 232897 - protein, 9 aa, Homo Sapiens
QQSRCLMTT

SEQ ID NO: 232898 - protein, 9 aa, Homo Sapiens
FRQILFLIK

SEQ ID NO: 232899 - protein, 9 aa, Homo Sapiens
YITGIIGKW

SEQ ID NO: 232900 - protein, 9 aa, Homo Sapiens
VHQVVAHVR

SEQ ID NO: 232901 - protein, 9 aa, Homo Sapiens
KYPTLLKVL

SEQ ID NO: 232902 - protein, 9 aa, Homo Sapiens
IAEPCWVCR

SEQ ID NO: 232903 - protein, 9 aa, Homo Sapiens
KLCVLLLVG

SEQ ID NO: 232904 - protein, 9 aa, Homo Sapiens
RRAILIPDS

SEQ ID NO: 232905 - protein, 9 aa, Homo Sapiens
REEDVNEAL

SEQ ID NO: 232906 - protein, 9 aa, Homo Sapiens
EEGGWEYDT

SEQ ID NO: 232907 - protein, 9 aa, Homo Sapiens
LYRCVAFNK

SEQ ID NO: 232908 - protein, 9 aa, Homo Sapiens
YRKFTSASN

SEQ ID NO: 232909 - protein, 9 aa, Homo Sapiens
YHYSCAAGA

SEQ ID NO: 232910 - protein, 9 aa, Homo Sapiens
KTVSFSVYL

SEQ ID NO: 232911 - protein, 9 aa, Homo Sapiens
VLTFMWPIL

SEQ ID NO: 232912 - protein, 9 aa, Homo Sapiens
LRHTQFVVE

SEQ ID NO: 232913 - protein, 9 aa, Homo Sapiens
EDSLLRHTQ

SEQ ID NO: 232914 - protein, 9 aa, Homo Sapiens
QYAFLQYCN

SEQ ID NO: 232915 - protein, 9 aa, Homo Sapiens
ETQSSTLSD

SEQ ID NO: 232916 - protein, 9 aa, Homo Sapiens
SDAGVPPLG

SEQ ID NO: 232917 - protein, 9 aa, Homo Sapiens
PATLTVTIF

SEQ ID NO: 232918 - protein, 9 aa, Homo Sapiens
DAFQGLRSV

SEQ ID NO: 232919 - protein, 9 aa, Homo Sapiens
LTYNLLPTD

SEQ ID NO: 232920 - protein, 9 aa, Homo Sapiens
FYFICDTIL

SEQ ID NO: 232921 - protein, 9 aa, Homo Sapiens
DPANKRRST

SEQ ID NO: 232922 - protein, 9 aa, Homo Sapiens
GSLQAGGVA

SEQ ID NO: 232923 - protein, 9 aa, Homo Sapiens
AQVLVILIL

SEQ ID NO: 232924 - protein, 9 aa, Homo Sapiens
NNASDGTVR

SEQ ID NO: 232925 - protein, 9 aa, Homo Sapiens
PPPLLKQLK

SEQ ID NO: 232926 - protein, 9 aa, Homo Sapiens
DVDLSQPQK

SEQ ID NO: 232927 - protein, 9 aa, Homo Sapiens
LCLLDLENI

SEQ ID NO: 232928 - protein, 9 aa, Homo Sapiens
VNNNPPNID

SEQ ID NO: 232929 - protein, 9 aa, Homo Sapiens
LKVLLNFLK

SEQ ID NO: 232930 - protein, 9 aa, Homo Sapiens
RKLREQPSD

SEQ ID NO: 232931 - protein, 9 aa, Homo Sapiens
QFGFDPLAF

SEQ ID NO: 232932 - protein, 9 aa, Homo Sapiens
LLVWPMWMV

SEQ ID NO: 232933 - protein, 9 aa, Homo Sapiens
TDVNNNPPN

SEQ ID NO: 232934 - protein, 9 aa, Homo Sapiens
TVTIFFKQE

SEQ ID NO: 232935 - protein, 9 aa, Homo Sapiens
DTTEKLYSL

SEQ ID NO: 232936 - protein, 9 aa, Homo Sapiens
VINEAQNFR

SEQ ID NO: 232937 - protein, 9 aa, Homo Sapiens
EPPQGVCAG

SEQ ID NO: 232938 - protein, 9 aa, Homo Sapiens
MWPILAIAE

SEQ ID NO: 232939 - protein, 9 aa, Homo Sapiens
TKPLFSLGL

SEQ ID NO: 232940 - protein, 9 aa, Homo Sapiens
SPTAPAVSQ

SEQ ID NO: 232941 - protein, 9 aa, Homo Sapiens
EQHTATIIE

SEQ ID NO: 232942 - protein, 9 aa, Homo Sapiens
VLWHGVYPG

SEQ ID NO: 232943 - protein, 9 aa, Homo Sapiens
GRLHSHCPR

SEQ ID NO: 232944 - protein, 9 aa, Homo Sapiens
YVQQVLTNV

SEQ ID NO: 232945 - protein, 9 aa, Homo Sapiens
VLRSLADTT

SEQ ID NO: 232946 - protein, 9 aa, Homo Sapiens
ATEIIPELR

SEQ ID NO: 232947 - protein, 9 aa, Homo Sapiens
GSGGGCSCC

SEQ ID NO: 232948 - protein, 9 aa, Homo Sapiens
QFQVSASDA

SEQ ID NO: 232949 - protein, 9 aa, Homo Sapiens
ILFCMLIRL

SEQ ID NO: 232950 - protein, 9 aa, Homo Sapiens
RGLEEKKEG

SEQ ID NO: 232951 - protein, 9 aa, Homo Sapiens
RSHGDREED

SEQ ID NO: 232952 - protein, 9 aa, Homo Sapiens
VREVSSCPS

SEQ ID NO: 232953 - protein, 9 aa, Homo Sapiens
QLTYNLLPT

SEQ ID NO: 232954 - protein, 9 aa, Homo Sapiens
QDNPRGHSA

SEQ ID NO: 232955 - protein, 9 aa, Homo Sapiens
IKLCLLDLE

SEQ ID NO: 232956 - protein, 9 aa, Homo Sapiens
TPRNGVSPL

SEQ ID NO: 232957 - protein, 9 aa, Homo Sapiens
QQQQQEQQQ

SEQ ID NO: 232958 - protein, 9 aa, Homo Sapiens
VTMDGVRED

SEQ ID NO: 232959 - protein, 9 aa, Homo Sapiens
LAGARGAPS

SEQ ID NO: 232960 - protein, 9 aa, Homo Sapiens
IRIVQREQH

SEQ ID NO: 232961 - protein, 9 aa, Homo Sapiens
FSTQSPLKK

SEQ ID NO: 232962 - protein, 9 aa, Homo Sapiens
FLIKQIDVL

SEQ ID NO: 232963 - protein, 9 aa, Homo Sapiens
WLGQRNNVH

SEQ ID NO: 232964 - protein, 9 aa, Homo Sapiens
RASHQGLVK

SEQ ID NO: 232965 - protein, 9 aa, Homo Sapiens
EKLSDRPSM

SEQ ID NO: 232966 - protein, 9 aa, Homo Sapiens
IKCQRLAKN

SEQ ID NO: 232967 - protein, 9 aa, Homo Sapiens
LQAGGVAQA

SEQ ID NO: 232968 - protein, 9 aa, Homo Sapiens
NSFEAAAIP

SEQ ID NO: 232969 - protein, 9 aa, Homo Sapiens
DVNEALSPD

SEQ ID NO: 232970 - protein, 9 aa, Homo Sapiens
GRTLIYIGS

SEQ ID NO: 232971 - protein, 9 aa, Homo Sapiens
KRTAHGQQS

SEQ ID NO: 232972 - protein, 9 aa, Homo Sapiens
IQHIVINEA

SEQ ID NO: 232973 - protein, 9 aa, Homo Sapiens
TFSTQSPLK

SEQ ID NO: 232974 - protein, 9 aa, Homo Sapiens
MYAAAMAWA

SEQ ID NO: 232975 - protein, 9 aa, Homo Sapiens
DKLLLPIAL

SEQ ID NO: 232976 - protein, 9 aa, Homo Sapiens
ACPLIKVKQ

SEQ ID NO: 232977 - protein, 9 aa, Homo Sapiens
RKYPTLLKV

SEQ ID NO: 232978 - protein, 9 aa, Homo Sapiens
AEHGVRIIS

SEQ ID NO: 232979 - protein, 9 aa, Homo Sapiens
RRSPTAPAV

SEQ ID NO: 232980 - protein, 9 aa, Homo Sapiens
KHNGPNNAS

SEQ ID NO: 232981 - protein, 9 aa, Homo Sapiens
TLRLSPTFP

SEQ ID NO: 232982 - protein, 9 aa, Homo Sapiens
PPQGVCAGL

SEQ ID NO: 232983 - protein, 9 aa, Homo Sapiens
PDLTKTVSF

SEQ ID NO: 232984 - protein, 9 aa, Homo Sapiens
KLSDRPSMG

SEQ ID NO: 232985 - protein, 9 aa, Homo Sapiens
ALSVLISAG

SEQ ID NO: 232986 - protein, 9 aa, Homo Sapiens
FQEVREILH

SEQ ID NO: 232987 - protein, 9 aa, Homo Sapiens
KAFSQISSR

SEQ ID NO: 232988 - protein, 9 aa, Homo Sapiens
KLLLPIALR

SEQ ID NO: 232989 - protein, 9 aa, Homo Sapiens
VFQYFQEVR

SEQ ID NO: 232990 - protein, 9 aa, Homo Sapiens
EYRTLLQDL

SEQ ID NO: 232991 - protein, 9 aa, Homo Sapiens
ISEHVDTQQ

SEQ ID NO: 232992 - protein, 9 aa, Homo Sapiens
SDSSSEKNS

SEQ ID NO: 232993 - protein, 9 aa, Homo Sapiens
SAKPSRWKR

SEQ ID NO: 232994 - protein, 9 aa, Homo Sapiens
TGDVTPDMI

SEQ ID NO: 232995 - protein, 9 aa, Homo Sapiens
CKRTPVMEG

SEQ ID NO: 232996 - protein, 9 aa, Homo Sapiens
EIRWRRLAR

SEQ ID NO: 232997 - protein, 9 aa, Homo Sapiens
KDVDLSQPQ

SEQ ID NO: 232998 - protein, 9 aa, Homo Sapiens
IRWRRLARL

SEQ ID NO: 232999 - protein, 9 aa, Homo Sapiens
IYIGSGPTV

SEQ ID NO: 233000 - protein, 9 aa, Homo Sapiens
LQNTSAIES

SEQ ID NO: 233001 - protein, 9 aa, Homo Sapiens
RVPAKHDPQ

SEQ ID NO: 233002 - protein, 9 aa, Homo Sapiens
HSHCPRHCP

SEQ ID NO: 233003 - protein, 9 aa, Homo Sapiens
SRVQSLELD

SEQ ID NO: 233004 - protein, 9 aa, Homo Sapiens
AASPQSPLM

SEQ ID NO: 233005 - protein, 9 aa, Homo Sapiens
TAHGQQSRC

SEQ ID NO: 233006 - protein, 9 aa, Homo Sapiens
LNRVFYFIC

SEQ ID NO: 233007 - protein, 9 aa, Homo Sapiens
ASSSSDSAL

SEQ ID NO: 233008 - protein, 9 aa, Homo Sapiens
MTTMLKMKE

SEQ ID NO: 233009 - protein, 9 aa, Homo Sapiens
FLEPLLVWP

SEQ ID NO: 233010 - protein, 9 aa, Homo Sapiens
RQILFLIKQ

SEQ ID NO: 233011 - protein, 9 aa, Homo Sapiens
TWCFEWHFL

SEQ ID NO: 233012 - protein, 9 aa, Homo Sapiens
DNFMLLGKP

SEQ ID NO: 233013 - protein, 9 aa, Homo Sapiens
ATQAEACPL

SEQ ID NO: 233014 - protein, 9 aa, Homo Sapiens
HYVQQVLTN

SEQ ID NO: 233015 - protein, 9 aa, Homo Sapiens
AEYRTLLQD

SEQ ID NO: 233016 - protein, 9 aa, Homo Sapiens
LQSPLCPLP

SEQ ID NO: 233017 - protein, 9 aa, Homo Sapiens
GHSAKLRAA

SEQ ID NO: 233018 - protein, 9 aa, Homo Sapiens
GLEFGTECY

SEQ ID NO: 233019 - protein, 9 aa, Homo Sapiens
LKKLFARKM

SEQ ID NO: 233020 - protein, 9 aa, Homo Sapiens
QPSTLRLSP

SEQ ID NO: 233021 - protein, 9 aa, Homo Sapiens
GRSLCSQFL

SEQ ID NO: 233022 - protein, 9 aa, Homo Sapiens
SRWKREAVG

SEQ ID NO: 233023 - protein, 9 aa, Homo Sapiens
WDRASHQGL

SEQ ID NO: 233024 - protein, 9 aa, Homo Sapiens
IVEKEEERN

SEQ ID NO: 233025 - protein, 9 aa, Homo Sapiens
REDLAPFSL

SEQ ID NO: 233026 - protein, 9 aa, Homo Sapiens
LLRRIICIL

SEQ ID NO: 233027 - protein, 9 aa, Homo Sapiens
PKSMVDLLA

SEQ ID NO: 233028 - protein, 9 aa, Homo Sapiens
LKPFPDMLS

SEQ ID NO: 233029 - protein, 9 aa, Homo Sapiens
LTVTIFFKQ

SEQ ID NO: 233030 - protein, 9 aa, Homo Sapiens
LTFILSVLW

SEQ ID NO: 233031 - protein, 9 aa, Homo Sapiens
PLRPETPRN

SEQ ID NO: 233032 - protein, 9 aa, Homo Sapiens
LSQLGFTSV

SEQ ID NO: 233033 - protein, 9 aa, Homo Sapiens
NASDGTVRL

SEQ ID NO: 233034 - protein, 9 aa, Homo Sapiens
LCVLLLVGS

SEQ ID NO: 233035 - protein, 9 aa, Homo Sapiens
TIFFKQEGD

SEQ ID NO: 233036 - protein, 9 aa, Homo Sapiens
FWMIGGMYA

SEQ ID NO: 233037 - protein, 9 aa, Homo Sapiens
GDVTPDMIS

SEQ ID NO: 233038 - protein, 9 aa, Homo Sapiens
EACPLIKVK

SEQ ID NO: 233039 - protein, 9 aa, Homo Sapiens
KPLETKSLE

SEQ ID NO: 233040 - protein, 9 aa, Homo Sapiens
MQLFIRDSP

SEQ ID NO: 233041 - protein, 9 aa, Homo Sapiens
GDWIYHQLK

SEQ ID NO: 233042 - protein, 9 aa, Homo Sapiens
YPTLLKVLL

SEQ ID NO: 233043 - protein, 9 aa, Homo Sapiens
HMNPLPTGY

SEQ ID NO: 233044 - protein, 9 aa, Homo Sapiens
CKSLTLHQR

SEQ ID NO: 233045 - protein, 9 aa, Homo Sapiens
PASSSSDSA

SEQ ID NO: 233046 - protein, 9 aa, Homo Sapiens
CPLIKVKQL

SEQ ID NO: 233047 - protein, 9 aa, Homo Sapiens
STYAGHGKC

SEQ ID NO: 233048 - protein, 9 aa, Homo Sapiens
MSHSSSRAL

SEQ ID NO: 233049 - protein, 9 aa, Homo Sapiens
KQVMLENYS

SEQ ID NO: 233050 - protein, 9 aa, Homo Sapiens
KRERVDLSK

SEQ ID NO: 233051 - protein, 9 aa, Homo Sapiens
PETPRNGVS

SEQ ID NO: 233052 - protein, 9 aa, Homo Sapiens
MTPDLTKTV

SEQ ID NO: 233053 - protein, 9 aa, Homo Sapiens
TIESQVHLQ

SEQ ID NO: 233054 - protein, 9 aa, Homo Sapiens
ISIAKADLI

SEQ ID NO: 233055 - protein, 9 aa, Homo Sapiens
KEEAEVELA

SEQ ID NO: 233056 - protein, 9 aa, Homo Sapiens
FARLTWALT

SEQ ID NO: 233057 - protein, 9 aa, Homo Sapiens
DYYSVEDPA

SEQ ID NO: 233058 - protein, 9 aa, Homo Sapiens
QETQSSTLS

SEQ ID NO: 233059 - protein, 9 aa, Homo Sapiens
DLLVDLKNK

SEQ ID NO: 233060 - protein, 9 aa, Homo Sapiens
SQVHLQSPL

SEQ ID NO: 233061 - protein, 9 aa, Homo Sapiens
TQFVVEQVE

SEQ ID NO: 233062 - protein, 9 aa, Homo Sapiens
KHDPQRPYE

SEQ ID NO: 233063 - protein, 9 aa, Homo Sapiens
WALTNSRSV

SEQ ID NO: 233064 - protein, 9 aa, Homo Sapiens
PLLVWPMWM

SEQ ID NO: 233065 - protein, 9 aa, Homo Sapiens
IPPPTGHTW

SEQ ID NO: 233066 - protein, 9 aa, Homo Sapiens
RGRNSNNLK

SEQ ID NO: 233067 - protein, 9 aa, Homo Sapiens
GYRKRLVRG

SEQ ID NO: 233068 - protein, 9 aa, Homo Sapiens
VATGNQPTL

SEQ ID NO: 233069 - protein, 9 aa, Homo Sapiens
ATATVAATA

SEQ ID NO: 233070 - protein, 9 aa, Homo Sapiens
IATATVAAT

SEQ ID NO: 233071 - protein, 9 aa, Homo Sapiens
GFPGPELGP

SEQ ID NO: 233072 - protein, 9 aa, Homo Sapiens
GSLDTAPSP

SEQ ID NO: 233073 - protein, 9 aa, Homo Sapiens
DLNDTDKSS

SEQ ID NO: 233074 - protein, 9 aa, Homo Sapiens
DVQDNPRGH

SEQ ID NO: 233075 - protein, 9 aa, Homo Sapiens
INVTDVNNN

SEQ ID NO: 233076 - protein, 9 aa, Homo Sapiens
VFYFICDTI

SEQ ID NO: 233077 - protein, 9 aa, Homo Sapiens
ETPRNGVSP

SEQ ID NO: 233078 - protein, 9 aa, Homo Sapiens
IEVDLNDTD

SEQ ID NO: 233079 - protein, 9 aa, Homo Sapiens
RGGRGGFGR

SEQ ID NO: 233080 - protein, 9 aa, Homo Sapiens
RVHQVVAHV

SEQ ID NO: 233081 - protein, 9 aa, Homo Sapiens
SPGSLDTAP

SEQ ID NO: 233082 - protein, 9 aa, Homo Sapiens
SGRTLIYIG

SEQ ID NO: 233083 - protein, 9 aa, Homo Sapiens
GPNNASDGT

SEQ ID NO: 233084 - protein, 9 aa, Homo Sapiens
QQAGYITGI

SEQ ID NO: 233085 - protein, 9 aa, Homo Sapiens
TPASSSSDS

SEQ ID NO: 233086 - protein, 9 aa, Homo Sapiens
YVGTRGLEE

SEQ ID NO: 233087 - protein, 9 aa, Homo Sapiens
LFHNSHMNP

SEQ ID NO: 233088 - protein, 9 aa, Homo Sapiens
HVDTQQLMQ

SEQ ID NO: 233089 - protein, 9 aa, Homo Sapiens
TPKSMVDLL

SEQ ID NO: 233090 - protein, 9 aa, Homo Sapiens
LLQFQVSAS

SEQ ID NO: 233091 - protein, 9 aa, Homo Sapiens
RSRVGRSLC

SEQ ID NO: 233092 - protein, 9 aa, Homo Sapiens
KPFPDMLSL

SEQ ID NO: 233093 - protein, 9 aa, Homo Sapiens
SRENQETQS

SEQ ID NO: 233094 - protein, 9 aa, Homo Sapiens
SRVGRSLCS

SEQ ID NO: 233095 - protein, 9 aa, Homo Sapiens
QGNSLASKI

SEQ ID NO: 233096 - protein, 9 aa, Homo Sapiens
LDEQHTATI

SEQ ID NO: 233097 - protein, 9 aa, Homo Sapiens
EGKEEAEVE

SEQ ID NO: 233098 - protein, 9 aa, Homo Sapiens
SKHMTQSQA

SEQ ID NO: 233099 - protein, 9 aa, Homo Sapiens
YGDIEVDLN

SEQ ID NO: 233100 - protein, 9 aa, Homo Sapiens
EEFRKLREQ

SEQ ID NO: 233101 - protein, 9 aa, Homo Sapiens
ICILNLSKR

SEQ ID NO: 233102 - protein, 9 aa, Homo Sapiens
ASDAGVPPL

SEQ ID NO: 233103 - protein, 9 aa, Homo Sapiens
WDRRAILIP

SEQ ID NO: 233104 - protein, 9 aa, Homo Sapiens
LDFCACAVG

SEQ ID NO: 233105 - protein, 9 aa, Homo Sapiens
MGSLQAGGV

SEQ ID NO: 233106 - protein, 9 aa, Homo Sapiens
VGFFGPVFN

SEQ ID NO: 233107 - protein, 9 aa, Homo Sapiens
TAIATATVA

SEQ ID NO: 233108 - protein, 9 aa, Homo Sapiens
LAVLSQLGF

SEQ ID NO: 233109 - protein, 9 aa, Homo Sapiens
ADSMQTLFQ

SEQ ID NO: 233110 - protein, 9 aa, Homo Sapiens
FLQYCNIAS

SEQ ID NO: 233111 - protein, 9 aa, Homo Sapiens
YVLLLDFCA

SEQ ID NO: 233112 - protein, 9 aa, Homo Sapiens
RLHSHCPRH

SEQ ID NO: 233113 - protein, 9 aa, Homo Sapiens
LLSMEIKLC

SEQ ID NO: 233114 - protein, 9 aa, Homo Sapiens
NIASVCKAI

SEQ ID NO: 233115 - protein, 9 aa, Homo Sapiens
VRGRNSNNL

SEQ ID NO: 233116 - protein, 9 aa, Homo Sapiens
HCPRHCPPW

SEQ ID NO: 233117 - protein, 9 aa, Homo Sapiens
EVDLNDTDK

SEQ ID NO: 233118 - protein, 9 aa, Homo Sapiens
PLKDQASQV

SEQ ID NO: 233119 - protein, 9 aa, Homo Sapiens
MDIPPPTGH

SEQ ID NO: 233120 - protein, 9 aa, Homo Sapiens
EHVDTQQLM

SEQ ID NO: 233121 - protein, 9 aa, Homo Sapiens
FGRGRGRGG

SEQ ID NO: 233122 - protein, 9 aa, Homo Sapiens
GLEEKKEGE

SEQ ID NO: 233123 - protein, 9 aa, Homo Sapiens
LLKRERVDL

SEQ ID NO: 233124 - protein, 9 aa, Homo Sapiens
GVFQYFQEV

SEQ ID NO: 233125 - protein, 9 aa, Homo Sapiens
ADNFMLLGK

SEQ ID NO: 233126 - protein, 9 aa, Homo Sapiens
PQKGRKPPA

SEQ ID NO: 233127 - protein, 9 aa, Homo Sapiens
STTWCFEWH

SEQ ID NO: 233128 - protein, 9 aa, Homo Sapiens
GSAPCPSGF

SEQ ID NO: 233129 - protein, 9 aa, Homo Sapiens
AGARGAPSP

SEQ ID NO: 233130 - protein, 9 aa, Homo Sapiens
AFSHCKSLT

SEQ ID NO: 233131 - protein, 9 aa, Homo Sapiens
HSAKLRAAI

SEQ ID NO: 233132 - protein, 9 aa, Homo Sapiens
QSQAEQLLK

SEQ ID NO: 233133 - protein, 9 aa, Homo Sapiens
NSHMNPLPT

SEQ ID NO: 233134 - protein, 9 aa, Homo Sapiens
GQQSRCLMT

SEQ ID NO: 233135 - protein, 9 aa, Homo Sapiens
QSIRTFNSE

SEQ ID NO: 233136 - protein, 9 aa, Homo Sapiens
KLKQDKCFS

SEQ ID NO: 233137 - protein, 9 aa, Homo Sapiens
AFGNMCCGG

SEQ ID NO: 233138 - protein, 9 aa, Homo Sapiens
GGMYAAAMA

SEQ ID NO: 233139 - protein, 9 aa, Homo Sapiens
DGSTYAGHG

SEQ ID NO: 233140 - protein, 9 aa, Homo Sapiens
LETPDVFKA

SEQ ID NO: 233141 - protein, 9 aa, Homo Sapiens
CILNLSKRL

SEQ ID NO: 233142 - protein, 9 aa, Homo Sapiens
YRKRLVRGR

SEQ ID NO: 233143 - protein, 9 aa, Homo Sapiens
ARLTWALTN

SEQ ID NO: 233144 - protein, 9 aa, Homo Sapiens
GGLEFGTEC

SEQ ID NO: 233145 - protein, 9 aa, Homo Sapiens
GKLIKCQRL

SEQ ID NO: 233146 - protein, 9 aa, Homo Sapiens
VLLLDFCAC

SEQ ID NO: 233147 - protein, 9 aa, Homo Sapiens
KCQRLAKND

SEQ ID NO: 233148 - protein, 9 aa, Homo Sapiens
TWYSCVAGQ

SEQ ID NO: 233149 - protein, 9 aa, Homo Sapiens
SLQAGGVAQ

SEQ ID NO: 233150 - protein, 9 aa, Homo Sapiens
NDTDKSSTY

SEQ ID NO: 233151 - protein, 9 aa, Homo Sapiens
RGHSAKLRA

SEQ ID NO: 233152 - protein, 9 aa, Homo Sapiens
QILNTTPAS

SEQ ID NO: 233153 - protein, 9 aa, Homo Sapiens
LFLIKQIDV

SEQ ID NO: 233154 - protein, 9 aa, Homo Sapiens
PEPNSFEAA

SEQ ID NO: 233155 - protein, 9 aa, Homo Sapiens
QLLYELSLI

SEQ ID NO: 233156 - protein, 9 aa, Homo Sapiens
FMWPILAIA

SEQ ID NO: 233157 - protein, 9 aa, Homo Sapiens
TMDGVREDL

SEQ ID NO: 233158 - protein, 9 aa, Homo Sapiens
LSRVQSLEL

SEQ ID NO: 233159 - protein, 9 aa, Homo Sapiens
AKENQSIRT

SEQ ID NO: 233160 - protein, 9 aa, Homo Sapiens
TWALTNSRS

SEQ ID NO: 233161 - protein, 9 aa, Homo Sapiens
ILNTTPASS

SEQ ID NO: 233162 - protein, 9 aa, Homo Sapiens
IVQREQHSG

SEQ ID NO: 233163 - protein, 9 aa, Homo Sapiens
SGLDLERLG

SEQ ID NO: 233164 - protein, 9 aa, Homo Sapiens
LQFGFDPLA

SEQ ID NO: 233165 - protein, 9 aa, Homo Sapiens
SHRLREGLL

SEQ ID NO: 233166 - protein, 9 aa, Homo Sapiens
WCFEWHFLE

SEQ ID NO: 233167 - protein, 9 aa, Homo Sapiens
MWQFISEHV

SEQ ID NO: 233168 - protein, 9 aa, Homo Sapiens
NMCCGGRMF

SEQ ID NO: 233169 - protein, 9 aa, Homo Sapiens
VDTQQLMQQ

SEQ ID NO: 233170 - protein, 9 aa, Homo Sapiens
KDLLVDLKN

SEQ ID NO: 233171 - protein, 9 aa, Homo Sapiens
NKHGEIESN

SEQ ID NO: 233172 - protein, 9 aa, Homo Sapiens
SRTLHMRKH

SEQ ID NO: 233173 - protein, 9 aa, Homo Sapiens
LSVLISAGA

SEQ ID NO: 233174 - protein, 9 aa, Homo Sapiens
VQDNPRGHS

SEQ ID NO: 233175 - protein, 9 aa, Homo Sapiens
VYSPQTQWI

SEQ ID NO: 233176 - protein, 9 aa, Homo Sapiens
VIGYVGQNI

SEQ ID NO: 233177 - protein, 9 aa, Homo Sapiens
KSLDKPEQL

SEQ ID NO: 233178 - protein, 9 aa, Homo Sapiens
LQTWYSCVA

SEQ ID NO: 233179 - protein, 9 aa, Homo Sapiens
VLTNVLLMD

SEQ ID NO: 233180 - protein, 9 aa, Homo Sapiens
RRGSQPSTL

SEQ ID NO: 233181 - protein, 9 aa, Homo Sapiens
HYSCAAGAG

SEQ ID NO: 233182 - protein, 9 aa, Homo Sapiens
GPTFMGSLQ

SEQ ID NO: 233183 - protein, 9 aa, Homo Sapiens
QMLPEPNSF

SEQ ID NO: 233184 - protein, 9 aa, Homo Sapiens
LNEQVARST

SEQ ID NO: 233185 - protein, 9 aa, Homo Sapiens
IRAILSTYC

SEQ ID NO: 233186 - protein, 9 aa, Homo Sapiens
VHLQSPLCP

SEQ ID NO: 233187 - protein, 9 aa, Homo Sapiens
QVLTNVLLM

SEQ ID NO: 233188 - protein, 9 aa, Homo Sapiens
AKGEEEGGW

SEQ ID NO: 233189 - protein, 9 aa, Homo Sapiens
QHTATIIEE

SEQ ID NO: 233190 - protein, 9 aa, Homo Sapiens
RTAHGQQSR

SEQ ID NO: 233191 - protein, 9 aa, Homo Sapiens
LRRIICILN

SEQ ID NO: 233192 - protein, 9 aa, Homo Sapiens
ANIVLSTCT

SEQ ID NO: 233193 - protein, 9 aa, Homo Sapiens
MFWMIGGMY

SEQ ID NO: 233194 - protein, 9 aa, Homo Sapiens
DPHYVQQVL

SEQ ID NO: 233195 - protein, 9 aa, Homo Sapiens
PPLRPETPR

SEQ ID NO: 233196 - protein, 9 aa, Homo Sapiens
YTSTVTPKS

SEQ ID NO: 233197 - protein, 9 aa, Homo Sapiens
VTPDMISIA

SEQ ID NO: 233198 - protein, 9 aa, Homo Sapiens
LGGLELETP

SEQ ID NO: 233199 - protein, 9 aa, Homo Sapiens
VCAGLKRTF

SEQ ID NO: 233200 - protein, 9 aa, Homo Sapiens
QSSTLSDSE

SEQ ID NO: 233201 - protein, 9 aa, Homo Sapiens
RQKVLYKQV

SEQ ID NO: 233202 - protein, 9 aa, Homo Sapiens
RDLQFGFDP

SEQ ID NO: 233203 - protein, 9 aa, Homo Sapiens
SHCPRHCPP

SEQ ID NO: 233204 - protein, 9 aa, Homo Sapiens
LDKPEQLLY

SEQ ID NO: 233205 - protein, 9 aa, Homo Sapiens
FQVSASDAG

SEQ ID NO: 233206 - protein, 9 aa, Homo Sapiens
ASPLHEEPS

SEQ ID NO: 233207 - protein, 9 aa, Homo Sapiens
TLLCACSHR

SEQ ID NO: 233208 - protein, 9 aa, Homo Sapiens
REQHSGASQ

SEQ ID NO: 233209 - protein, 9 aa, Homo Sapiens
ALRDEGKEE

SEQ ID NO: 233210 - protein, 9 aa, Homo Sapiens
MGKDPSPWA

SEQ ID NO: 233211 - protein, 9 aa, Homo Sapiens
VPGKEEFRK

SEQ ID NO: 233212 - protein, 9 aa, Homo Sapiens
LVRGRNSNN

SEQ ID NO: 233213 - protein, 9 aa, Homo Sapiens
FMLLGKPLL

SEQ ID NO: 233214 - protein, 9 aa, Homo Sapiens
TPDMISIAK

SEQ ID NO: 233215 - protein, 9 aa, Homo Sapiens
TQSSTLSDS

SEQ ID NO: 233216 - protein, 9 aa, Homo Sapiens
KVLLNFLKT

SEQ ID NO: 233217 - protein, 9 aa, Homo Sapiens
SSSRALTLL

SEQ ID NO: 233218 - protein, 9 aa, Homo Sapiens
DRRAILIPD

SEQ ID NO: 233219 - protein, 9 aa, Homo Sapiens
RDEGKEEAE

SEQ ID NO: 233220 - protein, 9 aa, Homo Sapiens
FPDMLSLGS

SEQ ID NO: 233221 - protein, 9 aa, Homo Sapiens
PDMISIAKA

SEQ ID NO: 233222 - protein, 9 aa, Homo Sapiens
WDVGMCKES

SEQ ID NO: 233223 - protein, 9 aa, Homo Sapiens
VWDVGMCKE

SEQ ID NO: 233224 - protein, 9 aa, Homo Sapiens
VLLLVGSYA

SEQ ID NO: 233225 - protein, 9 aa, Homo Sapiens
TFILSVLWH

SEQ ID NO: 233226 - protein, 9 aa, Homo Sapiens
LLKQLKPSE

SEQ ID NO: 233227 - protein, 9 aa, Homo Sapiens
NLLPTDSAQ

SEQ ID NO: 233228 - protein, 9 aa, Homo Sapiens
DARRSPTAP

SEQ ID NO: 233229 - protein, 9 aa, Homo Sapiens
DRTKPLFSL

SEQ ID NO: 233230 - protein, 9 aa, Homo Sapiens
RILFCMLIR

SEQ ID NO: 233231 - protein, 9 aa, Homo Sapiens
YAFLQYCNI

SEQ ID NO: 233232 - protein, 9 aa, Homo Sapiens
FSTTWCFEW

SEQ ID NO: 233233 - protein, 9 aa, Homo Sapiens
AKHDPQRPY

SEQ ID NO: 233234 - protein, 9 aa, Homo Sapiens
LCSQFLPEE

SEQ ID NO: 233235 - protein, 9 aa, Homo Sapiens
KWDRRAILI

SEQ ID NO: 233236 - protein, 9 aa, Homo Sapiens
TVLKPFPDM

SEQ ID NO: 233237 - protein, 9 aa, Homo Sapiens
RIVQREQHS

SEQ ID NO: 233238 - protein, 9 aa, Homo Sapiens
TSVDSSNKL

SEQ ID NO: 233239 - protein, 9 aa, Homo Sapiens
QVTVTAVAF

SEQ ID NO: 233240 - protein, 9 aa, Homo Sapiens
SRSRVGRSL

SEQ ID NO: 233241 - protein, 9 aa, Homo Sapiens
RKFTSASNV

SEQ ID NO: 233242 - protein, 9 aa, Homo Sapiens
KDQASQVGF

SEQ ID NO: 233243 - protein, 9 aa, Homo Sapiens
TPVELGCIP

SEQ ID NO: 233244 - protein, 9 aa, Homo Sapiens
MYQEPSLHD

SEQ ID NO: 233245 - protein, 9 aa, Homo Sapiens
SAYIKDFDL

SEQ ID NO: 233246 - protein, 9 aa, Homo Sapiens
KGKKAESSQ

SEQ ID NO: 233247 - protein, 9 aa, Homo Sapiens
PRNCNSHGE

SEQ ID NO: 233248 - protein, 9 aa, Homo Sapiens
LYAACAICF

SEQ ID NO: 233249 - protein, 9 aa, Homo Sapiens
LDILDTAGK

SEQ ID NO: 233250 - protein, 9 aa, Homo Sapiens
CVKKMNKIQ

SEQ ID NO: 233251 - protein, 9 aa, Homo Sapiens
TTVPALMNS

SEQ ID NO: 233252 - protein, 9 aa, Homo Sapiens
INVTYANET

SEQ ID NO: 233253 - protein, 9 aa, Homo Sapiens
CDQSAPCLL

SEQ ID NO: 233254 - protein, 9 aa, Homo Sapiens
DLRHYLNVR

SEQ ID NO: 233255 - protein, 9 aa, Homo Sapiens
QQDVLTVRV

SEQ ID NO: 233256 - protein, 9 aa, Homo Sapiens
YKRGFSSLN

SEQ ID NO: 233257 - protein, 9 aa, Homo Sapiens
LCLHFLGLT

SEQ ID NO: 233258 - protein, 9 aa, Homo Sapiens
QGVNVIDAL

SEQ ID NO: 233259 - protein, 9 aa, Homo Sapiens
MLETFTLIS

SEQ ID NO: 233260 - protein, 9 aa, Homo Sapiens
VKIVAQYRP

SEQ ID NO: 233261 - protein, 9 aa, Homo Sapiens
SFAESCFST

SEQ ID NO: 233262 - protein, 9 aa, Homo Sapiens
QYILEKGTY

SEQ ID NO: 233263 - protein, 9 aa, Homo Sapiens
PEAVTHIPY

SEQ ID NO: 233264 - protein, 9 aa, Homo Sapiens
EFFPEATGS

SEQ ID NO: 233265 - protein, 9 aa, Homo Sapiens
TMPLSVTAA

SEQ ID NO: 233266 - protein, 9 aa, Homo Sapiens
RTNEQWKPS

SEQ ID NO: 233267 - protein, 9 aa, Homo Sapiens
LNVRFQKGS

SEQ ID NO: 233268 - protein, 9 aa, Homo Sapiens
YNMLNSAIR

SEQ ID NO: 233269 - protein, 9 aa, Homo Sapiens
LLRRWFGDE

SEQ ID NO: 233270 - protein, 9 aa, Homo Sapiens
TVSEDRDSL

SEQ ID NO: 233271 - protein, 9 aa, Homo Sapiens
EEIYGTIST

SEQ ID NO: 233272 - protein, 9 aa, Homo Sapiens
VELIDEGRT

SEQ ID NO: 233273 - protein, 9 aa, Homo Sapiens
AESCFSTST

SEQ ID NO: 233274 - protein, 9 aa, Homo Sapiens
HSTLIIHDR

SEQ ID NO: 233275 - protein, 9 aa, Homo Sapiens
MIQGNAKKA

SEQ ID NO: 233276 - protein, 9 aa, Homo Sapiens
LVELIDEGR

SEQ ID NO: 233277 - protein, 9 aa, Homo Sapiens
MLGLGDRHP

SEQ ID NO: 233278 - protein, 9 aa, Homo Sapiens
LEKGTYKCF

SEQ ID NO: 233279 - protein, 9 aa, Homo Sapiens
EVNEDSQSM

SEQ ID NO: 233280 - protein, 9 aa, Homo Sapiens
MQIESDFLA

SEQ ID NO: 233281 - protein, 9 aa, Homo Sapiens
NSVLLCWLE

SEQ ID NO: 233282 - protein, 9 aa, Homo Sapiens
LCWLEPPDP

SEQ ID NO: 233283 - protein, 9 aa, Homo Sapiens
KRRWRTNEQ

SEQ ID NO: 233284 - protein, 9 aa, Homo Sapiens
HFNSRTKAI

SEQ ID NO: 233285 - protein, 9 aa, Homo Sapiens
TTSQLRPRA

SEQ ID NO: 233286 - protein, 9 aa, Homo Sapiens
VDSKEDYRI

SEQ ID NO: 233287 - protein, 9 aa, Homo Sapiens
YYCRKFPAW

SEQ ID NO: 233288 - protein, 9 aa, Homo Sapiens
PMVKRPRNC

SEQ ID NO: 233289 - protein, 9 aa, Homo Sapiens
LTVHPQNPG

SEQ ID NO: 233290 - protein, 9 aa, Homo Sapiens
YAVNVSKRR

SEQ ID NO: 233291 - protein, 9 aa, Homo Sapiens
ELIDEGRTG

SEQ ID NO: 233292 - protein, 9 aa, Homo Sapiens
FVDAHRPKL

SEQ ID NO: 233293 - protein, 9 aa, Homo Sapiens
IRNPIEHSH

SEQ ID NO: 233294 - protein, 9 aa, Homo Sapiens
GQAVKIVAQ

SEQ ID NO: 233295 - protein, 9 aa, Homo Sapiens
ESWCYTQVN

SEQ ID NO: 233296 - protein, 9 aa, Homo Sapiens
EEKMHFHYG

SEQ ID NO: 233297 - protein, 9 aa, Homo Sapiens
VTTMIQGNA

SEQ ID NO: 233298 - protein, 9 aa, Homo Sapiens
PGIPHTPSF

SEQ ID NO: 233299 - protein, 9 aa, Homo Sapiens
PWSIPFTLN

SEQ ID NO: 233300 - protein, 9 aa, Homo Sapiens
QPNTLTLDH

SEQ ID NO: 233301 - protein, 9 aa, Homo Sapiens
QLRLTDPVP

SEQ ID NO: 233302 - protein, 9 aa, Homo Sapiens
FYSCEPGYN

SEQ ID NO: 233303 - protein, 9 aa, Homo Sapiens
KISVNSTVL

SEQ ID NO: 233304 - protein, 9 aa, Homo Sapiens
ALEALKEFN

SEQ ID NO: 233305 - protein, 9 aa, Homo Sapiens
MNKIQKYRN

SEQ ID NO: 233306 - protein, 9 aa, Homo Sapiens
GQSPSPSCG

SEQ ID NO: 233307 - protein, 9 aa, Homo Sapiens
SQNGVPLLR

SEQ ID NO: 233308 - protein, 9 aa, Homo Sapiens
AQNFQLQRP

SEQ ID NO: 233309 - protein, 9 aa, Homo Sapiens
HPSKKAPVQ

SEQ ID NO: 233310 - protein, 9 aa, Homo Sapiens
PHKLGGKQR

SEQ ID NO: 233311 - protein, 9 aa, Homo Sapiens
MLNSAIREL

SEQ ID NO: 233312 - protein, 9 aa, Homo Sapiens
HDRIHTGEK

SEQ ID NO: 233313 - protein, 9 aa, Homo Sapiens
DWKCDKRED

SEQ ID NO: 233314 - protein, 9 aa, Homo Sapiens
DLDERALEA

SEQ ID NO: 233315 - protein, 9 aa, Homo Sapiens
VPLLTVIYG

SEQ ID NO: 233316 - protein, 9 aa, Homo Sapiens
MVVHEASAA

SEQ ID NO: 233317 - protein, 9 aa, Homo Sapiens
MLCLLTILG

SEQ ID NO: 233318 - protein, 9 aa, Homo Sapiens
CKQQCPQGH

SEQ ID NO: 233319 - protein, 9 aa, Homo Sapiens
KQLPATEKE

SEQ ID NO: 233320 - protein, 9 aa, Homo Sapiens
VPEDSVNDV

SEQ ID NO: 233321 - protein, 9 aa, Homo Sapiens
LLGPEAVTH

SEQ ID NO: 233322 - protein, 9 aa, Homo Sapiens
RSTKSAHAA

SEQ ID NO: 233323 - protein, 9 aa, Homo Sapiens
LKQPTPVEL

SEQ ID NO: 233324 - protein, 9 aa, Homo Sapiens
PQKPTGKFP

SEQ ID NO: 233325 - protein, 9 aa, Homo Sapiens
IPFTLNPEL

SEQ ID NO: 233326 - protein, 9 aa, Homo Sapiens
EDLVGLQMF

SEQ ID NO: 233327 - protein, 9 aa, Homo Sapiens
YGTISTKPN

SEQ ID NO: 233328 - protein, 9 aa, Homo Sapiens
TLTVPEATE

SEQ ID NO: 233329 - protein, 9 aa, Homo Sapiens
ESTCGDIPD

SEQ ID NO: 233330 - protein, 9 aa, Homo Sapiens
MMATTYAVL

SEQ ID NO: 233331 - protein, 9 aa, Homo Sapiens
AGEVTFVDA

SEQ ID NO: 233332 - protein, 9 aa, Homo Sapiens
LKVKCHASD

SEQ ID NO: 233333 - protein, 9 aa, Homo Sapiens
TIQVTHEQQ

SEQ ID NO: 233334 - protein, 9 aa, Homo Sapiens
QVTHEQQLI

SEQ ID NO: 233335 - protein, 9 aa, Homo Sapiens
GLKQPTPVE

SEQ ID NO: 233336 - protein, 9 aa, Homo Sapiens
NGSVKCVSE

SEQ ID NO: 233337 - protein, 9 aa, Homo Sapiens
TVPALMNST

SEQ ID NO: 233338 - protein, 9 aa, Homo Sapiens
QMNKYVINV

SEQ ID NO: 233339 - protein, 9 aa, Homo Sapiens
PSQWFLPRK

SEQ ID NO: 233340 - protein, 9 aa, Homo Sapiens
KTYQGSYGC

SEQ ID NO: 233341 - protein, 9 aa, Homo Sapiens
GDTMMATTY

SEQ ID NO: 233342 - protein, 9 aa, Homo Sapiens
NMLNSAIRE

SEQ ID NO: 233343 - protein, 9 aa, Homo Sapiens
PEATEKDSG

SEQ ID NO: 233344 - protein, 9 aa, Homo Sapiens
SDNEDPVVL

SEQ ID NO: 233345 - protein, 9 aa, Homo Sapiens
SATLDTLLA

SEQ ID NO: 233346 - protein, 9 aa, Homo Sapiens
AGKEEYSAM

SEQ ID NO: 233347 - protein, 9 aa, Homo Sapiens
PLLETLYHL

SEQ ID NO: 233348 - protein, 9 aa, Homo Sapiens
SSQTVSEDR

SEQ ID NO: 233349 - protein, 9 aa, Homo Sapiens
MASFLVFYI

SEQ ID NO: 233350 - protein, 9 aa, Homo Sapiens
VVPLLNPDG

SEQ ID NO: 233351 - protein, 9 aa, Homo Sapiens
NKIQKYRNG

SEQ ID NO: 233352 - protein, 9 aa, Homo Sapiens
TEFLLSCVE

SEQ ID NO: 233353 - protein, 9 aa, Homo Sapiens
AQKTDAEYS

SEQ ID NO: 233354 - protein, 9 aa, Homo Sapiens
WQDYKRGFS

SEQ ID NO: 233355 - protein, 9 aa, Homo Sapiens
QEKLVKQFA

SEQ ID NO: 233356 - protein, 9 aa, Homo Sapiens
EIYGTISTK

SEQ ID NO: 233357 - protein, 9 aa, Homo Sapiens
KDLRHYLNV

SEQ ID NO: 233358 - protein, 9 aa, Homo Sapiens
NVVKFSYMW

SEQ ID NO: 233359 - protein, 9 aa, Homo Sapiens
PKAFSTLAS

SEQ ID NO: 233360 - protein, 9 aa, Homo Sapiens
VIYGSYLIA

SEQ ID NO: 233361 - protein, 9 aa, Homo Sapiens
NFEKFQSYE

SEQ ID NO: 233362 - protein, 9 aa, Homo Sapiens
GLPPGIPHT

SEQ ID NO: 233363 - protein, 9 aa, Homo Sapiens
SWDVDITNK

SEQ ID NO: 233364 - protein, 9 aa, Homo Sapiens
CEHCNAAFS

SEQ ID NO: 233365 - protein, 9 aa, Homo Sapiens
CRDILFAFT

SEQ ID NO: 233366 - protein, 9 aa, Homo Sapiens
PRCKQQCPQ

SEQ ID NO: 233367 - protein, 9 aa, Homo Sapiens
EKQLPATEK

SEQ ID NO: 233368 - protein, 9 aa, Homo Sapiens
LKSSAAMPK

SEQ ID NO: 233369 - protein, 9 aa, Homo Sapiens
QLNFEKFQS

SEQ ID NO: 233370 - protein, 9 aa, Homo Sapiens
CGNKISVNS

SEQ ID NO: 233371 - protein, 9 aa, Homo Sapiens
LHFLGLTHM

SEQ ID NO: 233372 - protein, 9 aa, Homo Sapiens
NDPLWTVLT

SEQ ID NO: 233373 - protein, 9 aa, Homo Sapiens
EDYRILNGE

SEQ ID NO: 233374 - protein, 9 aa, Homo Sapiens
MPLSVTAAL

SEQ ID NO: 233375 - protein, 9 aa, Homo Sapiens
RKVTTMIQG

SEQ ID NO: 233376 - protein, 9 aa, Homo Sapiens
DFTGGVAQN

SEQ ID NO: 233377 - protein, 9 aa, Homo Sapiens
HELYVSFWD

SEQ ID NO: 233378 - protein, 9 aa, Homo Sapiens
FCCISDRKL

SEQ ID NO: 233379 - protein, 9 aa, Homo Sapiens
DSVNDVYLT

SEQ ID NO: 233380 - protein, 9 aa, Homo Sapiens
ELYVSFWDL

SEQ ID NO: 233381 - protein, 9 aa, Homo Sapiens
PLWTVLTQD

SEQ ID NO: 233382 - protein, 9 aa, Homo Sapiens
FTGGVAQNF

SEQ ID NO: 233383 - protein, 9 aa, Homo Sapiens
GQGQQFLTV

SEQ ID NO: 233384 - protein, 9 aa, Homo Sapiens
AETNFLLAP

SEQ ID NO: 233385 - protein, 9 aa, Homo Sapiens
PPHKLGGKQ

SEQ ID NO: 233386 - protein, 9 aa, Homo Sapiens
AMSYDRCLA

SEQ ID NO: 233387 - protein, 9 aa, Homo Sapiens
TLIRFGKKK

SEQ ID NO: 233388 - protein, 9 aa, Homo Sapiens
TMMATTYAV

SEQ ID NO: 233389 - protein, 9 aa, Homo Sapiens
KQSDTHAVQ

SEQ ID NO: 233390 - protein, 9 aa, Homo Sapiens
YVINVTYAN

SEQ ID NO: 233391 - protein, 9 aa, Homo Sapiens
ENQEKGRKN

SEQ ID NO: 233392 - protein, 9 aa, Homo Sapiens
HTPSFTASQ

SEQ ID NO: 233393 - protein, 9 aa, Homo Sapiens
DDQEVPFDQ

SEQ ID NO: 233394 - protein, 9 aa, Homo Sapiens
WDLGWQDWI

SEQ ID NO: 233395 - protein, 9 aa, Homo Sapiens
DRRKMQTVH

SEQ ID NO: 233396 - protein, 9 aa, Homo Sapiens
KSCIRYINL

SEQ ID NO: 233397 - protein, 9 aa, Homo Sapiens
CSKNFCCIS

SEQ ID NO: 233398 - protein, 9 aa, Homo Sapiens
KKEMQIESD

SEQ ID NO: 233399 - protein, 9 aa, Homo Sapiens
AITLIRFGK

SEQ ID NO: 233400 - protein, 9 aa, Homo Sapiens
PADVPYQTR

SEQ ID NO: 233401 - protein, 9 aa, Homo Sapiens
HASDNEDPV

SEQ ID NO: 233402 - protein, 9 aa, Homo Sapiens
HCNAAFSTN

SEQ ID NO: 233403 - protein, 9 aa, Homo Sapiens
GDAKCARLT

SEQ ID NO: 233404 - protein, 9 aa, Homo Sapiens
NKISVNSTV

SEQ ID NO: 233405 - protein, 9 aa, Homo Sapiens
RNDPLWTVL

SEQ ID NO: 233406 - protein, 9 aa, Homo Sapiens
KSCARLSAR

SEQ ID NO: 233407 - protein, 9 aa, Homo Sapiens
FLLAPWKNL

SEQ ID NO: 233408 - protein, 9 aa, Homo Sapiens
DNEDPVVLW

SEQ ID NO: 233409 - protein, 9 aa, Homo Sapiens
EHSHFNSRT

SEQ ID NO: 233410 - protein, 9 aa, Homo Sapiens
FLFYLSFAE

SEQ ID NO: 233411 - protein, 9 aa, Homo Sapiens
QAVKIVAQY

SEQ ID NO: 233412 - protein, 9 aa, Homo Sapiens
YMLGLGDRH

SEQ ID NO: 233413 - protein, 9 aa, Homo Sapiens
DFTSVRSET

SEQ ID NO: 233414 - protein, 9 aa, Homo Sapiens
EDSQSMDQD

SEQ ID NO: 233415 - protein, 9 aa, Homo Sapiens
TSQLRPRAN

SEQ ID NO: 233416 - protein, 9 aa, Homo Sapiens
LQGKAQLRA

SEQ ID NO: 233417 - protein, 9 aa, Homo Sapiens
QFLTVHPQN

SEQ ID NO: 233418 - protein, 9 aa, Homo Sapiens
KGTYKCFFD

SEQ ID NO: 233419 - protein, 9 aa, Homo Sapiens
LRSKVQSPH

SEQ ID NO: 233420 - protein, 9 aa, Homo Sapiens
DHRMADQSE

SEQ ID NO: 233421 - protein, 9 aa, Homo Sapiens
FAHTDEWGT

SEQ ID NO: 233422 - protein, 9 aa, Homo Sapiens
FLAKYLSTT

SEQ ID NO: 233423 - protein, 9 aa, Homo Sapiens
SKNFCCISD

SEQ ID NO: 233424 - protein, 9 aa, Homo Sapiens
KERDKAKGF

SEQ ID NO: 233425 - protein, 9 aa, Homo Sapiens
YNEVKRDLP

SEQ ID NO: 233426 - protein, 9 aa, Homo Sapiens
VNEDSQSMD

SEQ ID NO: 233427 - protein, 9 aa, Homo Sapiens
NKYVINVTY

SEQ ID NO: 233428 - protein, 9 aa, Homo Sapiens
NDNSLRFPR

SEQ ID NO: 233429 - protein, 9 aa, Homo Sapiens
QLRPRANWQ

SEQ ID NO: 233430 - protein, 9 aa, Homo Sapiens
LAKYLSTTP

SEQ ID NO: 233431 - protein, 9 aa, Homo Sapiens
PPLCLHFLG

SEQ ID NO: 233432 - protein, 9 aa, Homo Sapiens
PNTLTLDHP

SEQ ID NO: 233433 - protein, 9 aa, Homo Sapiens
YSKLFDLAL

SEQ ID NO: 233434 - protein, 9 aa, Homo Sapiens
KKTCGNKIS

SEQ ID NO: 233435 - protein, 9 aa, Homo Sapiens
KRGFSSLND

SEQ ID NO: 233436 - protein, 9 aa, Homo Sapiens
TTTPAPPHK

SEQ ID NO: 233437 - protein, 9 aa, Homo Sapiens
ILEKGTYKC

SEQ ID NO: 233438 - protein, 9 aa, Homo Sapiens
KTIQVTHEQ

SEQ ID NO: 233439 - protein, 9 aa, Homo Sapiens
AVYGELILW

SEQ ID NO: 233440 - protein, 9 aa, Homo Sapiens
QERLYNEVK

SEQ ID NO: 233441 - protein, 9 aa, Homo Sapiens
TNKLESGGI

SEQ ID NO: 233442 - protein, 9 aa, Homo Sapiens
DLQGHTKDR

SEQ ID NO: 233443 - protein, 9 aa, Homo Sapiens
KSSAAMPKA

SEQ ID NO: 233444 - protein, 9 aa, Homo Sapiens
NEVKRDLPH

SEQ ID NO: 233445 - protein, 9 aa, Homo Sapiens
LTTTPAPPH

SEQ ID NO: 233446 - protein, 9 aa, Homo Sapiens
VTYANETKL

SEQ ID NO: 233447 - protein, 9 aa, Homo Sapiens
AMPKAFSTL

SEQ ID NO: 233448 - protein, 9 aa, Homo Sapiens
RSKVQSPHL

SEQ ID NO: 233449 - protein, 9 aa, Homo Sapiens
DSQSMDQDQ

SEQ ID NO: 233450 - protein, 9 aa, Homo Sapiens
HKKWVTHLV

SEQ ID NO: 233451 - protein, 9 aa, Homo Sapiens
EELEAITLI

SEQ ID NO: 233452 - protein, 9 aa, Homo Sapiens
KDFDLRQCH

SEQ ID NO: 233453 - protein, 9 aa, Homo Sapiens
YQEPSLHDV

SEQ ID NO: 233454 - protein, 9 aa, Homo Sapiens
CAICFVFMA

SEQ ID NO: 233455 - protein, 9 aa, Homo Sapiens
AGGLHKQSD

SEQ ID NO: 233456 - protein, 9 aa, Homo Sapiens
DQSAPCLLN

SEQ ID NO: 233457 - protein, 9 aa, Homo Sapiens
NAAFSTNYH

SEQ ID NO: 233458 - protein, 9 aa, Homo Sapiens
HDLSLTFYR

SEQ ID NO: 233459 - protein, 9 aa, Homo Sapiens
FLTVHPQNP

SEQ ID NO: 233460 - protein, 9 aa, Homo Sapiens
DVYLTPSVH

SEQ ID NO: 233461 - protein, 9 aa, Homo Sapiens
YQTRQLHPA

SEQ ID NO: 233462 - protein, 9 aa, Homo Sapiens
GTYKCFFDW

SEQ ID NO: 233463 - protein, 9 aa, Homo Sapiens
PTQQDVLTV

SEQ ID NO: 233464 - protein, 9 aa, Homo Sapiens
EDFTSVRSE

SEQ ID NO: 233465 - protein, 9 aa, Homo Sapiens
SPSCGRHGS

SEQ ID NO: 233466 - protein, 9 aa, Homo Sapiens
LIIHDRIHT

SEQ ID NO: 233467 - protein, 9 aa, Homo Sapiens
ELCDQSAPC

SEQ ID NO: 233468 - protein, 9 aa, Homo Sapiens
VVHDLSLTF

SEQ ID NO: 233469 - protein, 9 aa, Homo Sapiens
WKCDKREDF

SEQ ID NO: 233470 - protein, 9 aa, Homo Sapiens
QPCFCKYAR

SEQ ID NO: 233471 - protein, 9 aa, Homo Sapiens
IIHDRIHTG

SEQ ID NO: 233472 - protein, 9 aa, Homo Sapiens
LGPEGGHVA

SEQ ID NO: 233473 - protein, 9 aa, Homo Sapiens
QGKAQLRAR

SEQ ID NO: 233474 - protein, 9 aa, Homo Sapiens
PEATGSEED

SEQ ID NO: 233475 - protein, 9 aa, Homo Sapiens
VMSMVGYML

SEQ ID NO: 233476 - protein, 9 aa, Homo Sapiens
CCISDRKLD

SEQ ID NO: 233477 - protein, 9 aa, Homo Sapiens
RFPYYCRKF

SEQ ID NO: 233478 - protein, 9 aa, Homo Sapiens
HMTYNLASA

SEQ ID NO: 233479 - protein, 9 aa, Homo Sapiens
FPEATGSEE

SEQ ID NO: 233480 - protein, 9 aa, Homo Sapiens
EELVPCLFR

SEQ ID NO: 233481 - protein, 9 aa, Homo Sapiens
LASAPLPAS

SEQ ID NO: 233482 - protein, 9 aa, Homo Sapiens
YEFFPEATG

SEQ ID NO: 233483 - protein, 9 aa, Homo Sapiens
GYMLGLGDR

SEQ ID NO: 233484 - protein, 9 aa, Homo Sapiens
TLTLDHPSK

SEQ ID NO: 233485 - protein, 9 aa, Homo Sapiens
RELFEYIRV

SEQ ID NO: 233486 - protein, 9 aa, Homo Sapiens
KMQTVHCAT

SEQ ID NO: 233487 - protein, 9 aa, Homo Sapiens
HSHLALSEA

SEQ ID NO: 233488 - protein, 9 aa, Homo Sapiens
CSQDEHKKW

SEQ ID NO: 233489 - protein, 9 aa, Homo Sapiens
PLLNPDGVI

SEQ ID NO: 233490 - protein, 9 aa, Homo Sapiens
LPTQQDVLT

SEQ ID NO: 233491 - protein, 9 aa, Homo Sapiens
HTKDRKESL

SEQ ID NO: 233492 - protein, 9 aa, Homo Sapiens
STCGDIPDL

SEQ ID NO: 233493 - protein, 9 aa, Homo Sapiens
LRPRANWQS

SEQ ID NO: 233494 - protein, 9 aa, Homo Sapiens
LNGSVKCVS

SEQ ID NO: 233495 - protein, 9 aa, Homo Sapiens
SWCYTQVNV

SEQ ID NO: 233496 - protein, 9 aa, Homo Sapiens
IQVTHEQQL

SEQ ID NO: 233497 - protein, 9 aa, Homo Sapiens
QTDHRMADQ

SEQ ID NO: 233498 - protein, 9 aa, Homo Sapiens
NFQLQRPPQ

SEQ ID NO: 233499 - protein, 9 aa, Homo Sapiens
EHKKWVTHL

SEQ ID NO: 233500 - protein, 9 aa, Homo Sapiens
NCASRRDHC

SEQ ID NO: 233501 - protein, 9 aa, Homo Sapiens
TTMIQGNAK

SEQ ID NO: 233502 - protein, 9 aa, Homo Sapiens
VPDVKYNEP

SEQ ID NO: 233503 - protein, 9 aa, Homo Sapiens
PSKRKVTTM

SEQ ID NO: 233504 - protein, 9 aa, Homo Sapiens
SASLGDAKC

SEQ ID NO: 233505 - protein, 9 aa, Homo Sapiens
PSPSCGRHG

SEQ ID NO: 233506 - protein, 9 aa, Homo Sapiens
LEQQQQLVS

SEQ ID NO: 233507 - protein, 9 aa, Homo Sapiens
ATEKDSGDY

SEQ ID NO: 233508 - protein, 9 aa, Homo Sapiens
LKNYSICGK

SEQ ID NO: 233509 - protein, 9 aa, Homo Sapiens
MSKKKSRQE

SEQ ID NO: 233510 - protein, 9 aa, Homo Sapiens
IPMVKRPRN

SEQ ID NO: 233511 - protein, 9 aa, Homo Sapiens
KSAHAATLP

SEQ ID NO: 233512 - protein, 9 aa, Homo Sapiens
DIPDLEHGW

SEQ ID NO: 233513 - protein, 9 aa, Homo Sapiens
VTHEQQLIL

SEQ ID NO: 233514 - protein, 9 aa, Homo Sapiens
KKKSRQEKL

SEQ ID NO: 233515 - protein, 9 aa, Homo Sapiens
VINVTYANE

SEQ ID NO: 233516 - protein, 9 aa, Homo Sapiens
PIEHSHFNS

SEQ ID NO: 233517 - protein, 9 aa, Homo Sapiens
KCARLTAEG

SEQ ID NO: 233518 - protein, 9 aa, Homo Sapiens
PDVKYNEPY

SEQ ID NO: 233519 - protein, 9 aa, Homo Sapiens
AVNVSKRRW

SEQ ID NO: 233520 - protein, 9 aa, Homo Sapiens
KNAGQAVKI

SEQ ID NO: 233521 - protein, 9 aa, Homo Sapiens
NLASAVVRI

SEQ ID NO: 233522 - protein, 9 aa, Homo Sapiens
ALQQFHQLS

SEQ ID NO: 233523 - protein, 9 aa, Homo Sapiens
GSYGCRLGF

SEQ ID NO: 233524 - protein, 9 aa, Homo Sapiens
ICFVFMAGE

SEQ ID NO: 233525 - protein, 9 aa, Homo Sapiens
PYQTRQLHP

SEQ ID NO: 233526 - protein, 9 aa, Homo Sapiens
DINDNSLRF

SEQ ID NO: 233527 - protein, 9 aa, Homo Sapiens
RNPIEHSHF

SEQ ID NO: 233528 - protein, 9 aa, Homo Sapiens
GSEEDLKKY

SEQ ID NO: 233529 - protein, 9 aa, Homo Sapiens
YPSAYIKDF

SEQ ID NO: 233530 - protein, 9 aa, Homo Sapiens
STNYHLQRH

SEQ ID NO: 233531 - protein, 9 aa, Homo Sapiens
AKCARLTAE

SEQ ID NO: 233532 - protein, 9 aa, Homo Sapiens
SKKDSEEIE

SEQ ID NO: 233533 - protein, 9 aa, Homo Sapiens
SHLALSEAK

SEQ ID NO: 233534 - protein, 9 aa, Homo Sapiens
KSRQEKLVK

SEQ ID NO: 233535 - protein, 9 aa, Homo Sapiens
HCRDILFAF

SEQ ID NO: 233536 - protein, 9 aa, Homo Sapiens
SQTVSEDRD

SEQ ID NO: 233537 - protein, 9 aa, Homo Sapiens
RQLHPAIRV

SEQ ID NO: 233538 - protein, 9 aa, Homo Sapiens
CDKREDFTS

SEQ ID NO: 233539 - protein, 9 aa, Homo Sapiens
FKVVPLLNP

SEQ ID NO: 233540 - protein, 9 aa, Homo Sapiens
DRDSLCCNC

SEQ ID NO: 233541 - protein, 9 aa, Homo Sapiens
VETDENETL

SEQ ID NO: 233542 - protein, 9 aa, Homo Sapiens
NVIDALKNY

SEQ ID NO: 233543 - protein, 9 aa, Homo Sapiens
YVSFWDLGW

SEQ ID NO: 233544 - protein, 9 aa, Homo Sapiens
VLLCWLEPP

SEQ ID NO: 233545 - protein, 9 aa, Homo Sapiens
SLDEKKEMQ

SEQ ID NO: 233546 - protein, 9 aa, Homo Sapiens
TLLAALRRI

SEQ ID NO: 233547 - protein, 9 aa, Homo Sapiens
CLLTILGRY

SEQ ID NO: 233548 - protein, 9 aa, Homo Sapiens
TVHCATARE

SEQ ID NO: 233549 - protein, 9 aa, Homo Sapiens
LWAETNFLL

SEQ ID NO: 233550 - protein, 9 aa, Homo Sapiens
TFTLISSLG

SEQ ID NO: 233551 - protein, 9 aa, Homo Sapiens
GNKISVNST

SEQ ID NO: 233552 - protein, 9 aa, Homo Sapiens
CWCRQALQQ

SEQ ID NO: 233553 - protein, 9 aa, Homo Sapiens
HFENLLKAC

SEQ ID NO: 233554 - protein, 9 aa, Homo Sapiens
AKYLSTTPF

SEQ ID NO: 233555 - protein, 9 aa, Homo Sapiens
QGVNCASRR

SEQ ID NO: 233556 - protein, 9 aa, Homo Sapiens
MNKYVINVT

SEQ ID NO: 233557 - protein, 9 aa, Homo Sapiens
EKGTYKCFF

SEQ ID NO: 233558 - protein, 9 aa, Homo Sapiens
HRMADQSER

SEQ ID NO: 233559 - protein, 9 aa, Homo Sapiens
AELGLVLGT

SEQ ID NO: 233560 - protein, 9 aa, Homo Sapiens
RDSLCCNCK

SEQ ID NO: 233561 - protein, 9 aa, Homo Sapiens
SGTNTQVNY

SEQ ID NO: 233562 - protein, 9 aa, Homo Sapiens
TTPAPPHKL

SEQ ID NO: 233563 - protein, 9 aa, Homo Sapiens
QNFQLQRPP

SEQ ID NO: 233564 - protein, 9 aa, Homo Sapiens
DLEHGWAQL

SEQ ID NO: 233565 - protein, 9 aa, Homo Sapiens
HTDEWGTGL

SEQ ID NO: 233566 - protein, 9 aa, Homo Sapiens
PPGIPHTPS

SEQ ID NO: 233567 - protein, 9 aa, Homo Sapiens
DREELCDQS

SEQ ID NO: 233568 - protein, 9 aa, Homo Sapiens
SVLLCWLEP

SEQ ID NO: 233569 - protein, 9 aa, Homo Sapiens
CAELGLVLG

SEQ ID NO: 233570 - protein, 9 aa, Homo Sapiens
EPYISFLFV

SEQ ID NO: 233571 - protein, 9 aa, Homo Sapiens
DKREDFTSV

SEQ ID NO: 233572 - protein, 9 aa, Homo Sapiens
RQRLLRRWF

SEQ ID NO: 233573 - protein, 9 aa, Homo Sapiens
QRSKKDSEE

SEQ ID NO: 233574 - protein, 9 aa, Homo Sapiens
AICFVFMAG

SEQ ID NO: 233575 - protein, 9 aa, Homo Sapiens
DVLTVRVPT

SEQ ID NO: 233576 - protein, 9 aa, Homo Sapiens
NFCCISDRK

SEQ ID NO: 233577 - protein, 9 aa, Homo Sapiens
RQALQQFHQ

SEQ ID NO: 233578 - protein, 9 aa, Homo Sapiens
LNFEKFQSY

SEQ ID NO: 233579 - protein, 9 aa, Homo Sapiens
VAFAHTDEW

SEQ ID NO: 233580 - protein, 9 aa, Homo Sapiens
VSFWDLGWQ

SEQ ID NO: 233581 - protein, 9 aa, Homo Sapiens
AGYVGPRCK

SEQ ID NO: 233582 - protein, 9 aa, Homo Sapiens
PEEKQLPAT

SEQ ID NO: 233583 - protein, 9 aa, Homo Sapiens
FHMTYNLAS

SEQ ID NO: 233584 - protein, 9 aa, Homo Sapiens
KRKVTTMIQ

SEQ ID NO: 233585 - protein, 9 aa, Homo Sapiens
YVGPRCKQQ

SEQ ID NO: 233586 - protein, 9 aa, Homo Sapiens
RLSARYLIQ

SEQ ID NO: 233587 - protein, 9 aa, Homo Sapiens
EPVINSSNI

SEQ ID NO: 233588 - protein, 9 aa, Homo Sapiens
WSWDVDITN

SEQ ID NO: 233589 - protein, 9 aa, Homo Sapiens
ERALEALKE

SEQ ID NO: 233590 - protein, 9 aa, Homo Sapiens
IYGTISTKP

SEQ ID NO: 233591 - protein, 9 aa, Homo Sapiens
AGFLTFRRG

SEQ ID NO: 233592 - protein, 9 aa, Homo Sapiens
NVTYANETK

SEQ ID NO: 233593 - protein, 9 aa, Homo Sapiens
LLTILGRYF

SEQ ID NO: 233594 - protein, 9 aa, Homo Sapiens
GTTVPALMN

SEQ ID NO: 233595 - protein, 9 aa, Homo Sapiens
PLASAPLPA

SEQ ID NO: 233596 - protein, 9 aa, Homo Sapiens
SPSQWFLPR

SEQ ID NO: 233597 - protein, 9 aa, Homo Sapiens
KGLSNYAVN

SEQ ID NO: 233598 - protein, 9 aa, Homo Sapiens
KAGFLTFRR

SEQ ID NO: 233599 - protein, 9 aa, Homo Sapiens
EEELPEVTV

SEQ ID NO: 233600 - protein, 9 aa, Homo Sapiens
KTCGNKISV

SEQ ID NO: 233601 - protein, 9 aa, Homo Sapiens
SPHLWNNGR

SEQ ID NO: 233602 - protein, 9 aa, Homo Sapiens
AKTKSCARL

SEQ ID NO: 233603 - protein, 9 aa, Homo Sapiens
MHFHYGHIK

SEQ ID NO: 233604 - protein, 9 aa, Homo Sapiens
AIRELFEYI

SEQ ID NO: 233605 - protein, 9 aa, Homo Sapiens
FAESCFSTS

SEQ ID NO: 233606 - protein, 9 aa, Homo Sapiens
LDHPSKKAP

SEQ ID NO: 233607 - protein, 9 aa, Homo Sapiens
WAETNFLLA

SEQ ID NO: 233608 - protein, 9 aa, Homo Sapiens
MSMVGYMLG

SEQ ID NO: 233609 - protein, 9 aa, Homo Sapiens
FQLRLTDPV

SEQ ID NO: 233610 - protein, 9 aa, Homo Sapiens
NPELLAPLQ

SEQ ID NO: 233611 - protein, 9 aa, Homo Sapiens
QEGDTMMAT

SEQ ID NO: 233612 - protein, 9 aa, Homo Sapiens
EEIFHMTYN

SEQ ID NO: 233613 - protein, 9 aa, Homo Sapiens
ELGLVLGTE

SEQ ID NO: 233614 - protein, 9 aa, Homo Sapiens
EELCDQSAP

SEQ ID NO: 233615 - protein, 9 aa, Homo Sapiens
KTLIQTLKK

SEQ ID NO: 233616 - protein, 9 aa, Homo Sapiens
PLEVAMYQE

SEQ ID NO: 233617 - protein, 9 aa, Homo Sapiens
EAVTHIPYL

SEQ ID NO: 233618 - protein, 9 aa, Homo Sapiens
VTHIPYLPA

SEQ ID NO: 233619 - protein, 9 aa, Homo Sapiens
TLEDLVGLQ

SEQ ID NO: 233620 - protein, 9 aa, Homo Sapiens
NEQWKPSRS

SEQ ID NO: 233621 - protein, 9 aa, Homo Sapiens
LPATEKEST

SEQ ID NO: 233622 - protein, 9 aa, Homo Sapiens
RLKKQLNFE

SEQ ID NO: 233623 - protein, 9 aa, Homo Sapiens
CVETDENET

SEQ ID NO: 233624 - protein, 9 aa, Homo Sapiens
LVVKSCIRY

SEQ ID NO: 233625 - protein, 9 aa, Homo Sapiens
QEVPFDQIL

SEQ ID NO: 233626 - protein, 9 aa, Homo Sapiens
TLIIHDRIH

SEQ ID NO: 233627 - protein, 9 aa, Homo Sapiens
YGSYLIAHG

SEQ ID NO: 233628 - protein, 9 aa, Homo Sapiens
VNVVKFSYM

SEQ ID NO: 233629 - protein, 9 aa, Homo Sapiens
QEPSLHDVG

SEQ ID NO: 233630 - protein, 9 aa, Homo Sapiens
GFLTFRRGV

SEQ ID NO: 233631 - protein, 9 aa, Homo Sapiens
KCHASDNED

SEQ ID NO: 233632 - protein, 9 aa, Homo Sapiens
TVIYGSYLI

SEQ ID NO: 233633 - protein, 9 aa, Homo Sapiens
KPTGKFPRT

SEQ ID NO: 233634 - protein, 9 aa, Homo Sapiens
DHPSKKAPV

SEQ ID NO: 233635 - protein, 9 aa, Homo Sapiens
FFPEATGSE

SEQ ID NO: 233636 - protein, 9 aa, Homo Sapiens
PCLFRVASK

SEQ ID NO: 233637 - protein, 9 aa, Homo Sapiens
SKVQSPHLW

SEQ ID NO: 233638 - protein, 9 aa, Homo Sapiens
TPAPPHKLG

SEQ ID NO: 233639 - protein, 9 aa, Homo Sapiens
MSYDRCLAI

SEQ ID NO: 233640 - protein, 9 aa, Homo Sapiens
WVAFAHTDE

SEQ ID NO: 233641 - protein, 9 aa, Homo Sapiens
IEHSHFNSR

SEQ ID NO: 233642 - protein, 9 aa, Homo Sapiens
DAKCARLTA

SEQ ID NO: 233643 - protein, 9 aa, Homo Sapiens
LSNYAVNVS

SEQ ID NO: 233644 - protein, 9 aa, Homo Sapiens
REDFTSVRS

SEQ ID NO: 233645 - protein, 9 aa, Homo Sapiens
SVKCVSENN

SEQ ID NO: 233646 - protein, 9 aa, Homo Sapiens
CASRRDHCH

SEQ ID NO: 233647 - protein, 9 aa, Homo Sapiens
GSPSQWFLP

SEQ ID NO: 233648 - protein, 9 aa, Homo Sapiens
HKLGGKQRA

SEQ ID NO: 233649 - protein, 9 aa, Homo Sapiens
DSEEIEMGV

SEQ ID NO: 233650 - protein, 9 aa, Homo Sapiens
ITNKLESGG

SEQ ID NO: 233651 - protein, 9 aa, Homo Sapiens
RRWFGDEPL

SEQ ID NO: 233652 - protein, 9 aa, Homo Sapiens
HSHFNSRTK

SEQ ID NO: 233653 - protein, 9 aa, Homo Sapiens
GQAIPLVVK

SEQ ID NO: 233654 - protein, 9 aa, Homo Sapiens
TPLDVLKTL

SEQ ID NO: 233655 - protein, 9 aa, Homo Sapiens
QTVHCATAR

SEQ ID NO: 233656 - protein, 9 aa, Homo Sapiens
GRFPYYCRK

SEQ ID NO: 233657 - protein, 9 aa, Homo Sapiens
DERALEALK

SEQ ID NO: 233658 - protein, 9 aa, Homo Sapiens
ASLGDAKCA

SEQ ID NO: 233659 - protein, 9 aa, Homo Sapiens
AVVHDLSLT

SEQ ID NO: 233660 - protein, 9 aa, Homo Sapiens
QDPSAVYGE

SEQ ID NO: 233661 - protein, 9 aa, Homo Sapiens
RYSADKDVV

SEQ ID NO: 233662 - protein, 9 aa, Homo Sapiens
ATLDTLLAA

SEQ ID NO: 233663 - protein, 9 aa, Homo Sapiens
PSAYIKDFD

SEQ ID NO: 233664 - protein, 9 aa, Homo Sapiens
QLPATEKES

SEQ ID NO: 233665 - protein, 9 aa, Homo Sapiens
KKTIQVTHE

SEQ ID NO: 233666 - protein, 9 aa, Homo Sapiens
AAMSYDRCL

SEQ ID NO: 233667 - protein, 9 aa, Homo Sapiens
DVMLETFTL

SEQ ID NO: 233668 - protein, 9 aa, Homo Sapiens
NENQEKGRK

SEQ ID NO: 233669 - protein, 9 aa, Homo Sapiens
EDLQGHTKD

SEQ ID NO: 233670 - protein, 9 aa, Homo Sapiens
PLCLHFLGL

SEQ ID NO: 233671 - protein, 9 aa, Homo Sapiens
NVRFQKGSV

SEQ ID NO: 233672 - protein, 9 aa, Homo Sapiens
RNCNSHGED

SEQ ID NO: 233673 - protein, 9 aa, Homo Sapiens
EFLAKYLST

SEQ ID NO: 233674 - protein, 9 aa, Homo Sapiens
TMIQGNAKK

SEQ ID NO: 233675 - protein, 9 aa, Homo Sapiens
RGHSHLALS

SEQ ID NO: 233676 - protein, 9 aa, Homo Sapiens
EQYILEKGT

SEQ ID NO: 233677 - protein, 9 aa, Homo Sapiens
DQSERRASE

SEQ ID NO: 233678 - protein, 9 aa, Homo Sapiens
ARLSARYLI

SEQ ID NO: 233679 - protein, 9 aa, Homo Sapiens
YNLRGAASM

SEQ ID NO: 233680 - protein, 9 aa, Homo Sapiens
VKKTCGNKI

SEQ ID NO: 233681 - protein, 9 aa, Homo Sapiens
SFWDLGWQD

SEQ ID NO: 233682 - protein, 9 aa, Homo Sapiens
YLSFAESCF

SEQ ID NO: 233683 - protein, 9 aa, Homo Sapiens
GEVTFVDAH

SEQ ID NO: 233684 - protein, 9 aa, Homo Sapiens
CYTQVNVVK

SEQ ID NO: 233685 - protein, 9 aa, Homo Sapiens
EIEMGVAGS

SEQ ID NO: 233686 - protein, 9 aa, Homo Sapiens
LNPELLAPL

SEQ ID NO: 233687 - protein, 9 aa, Homo Sapiens
KQPTPVELG

SEQ ID NO: 233688 - protein, 9 aa, Homo Sapiens
TGKFPRTPE

SEQ ID NO: 233689 - protein, 9 aa, Homo Sapiens
KKQLNFEKF

SEQ ID NO: 233690 - protein, 9 aa, Homo Sapiens
HCATARETS

SEQ ID NO: 233691 - protein, 9 aa, Homo Sapiens
RQSQNGVPL

SEQ ID NO: 233692 - protein, 9 aa, Homo Sapiens
SKGKKAESS

SEQ ID NO: 233693 - protein, 9 aa, Homo Sapiens
SYGCRLGFL

SEQ ID NO: 233694 - protein, 9 aa, Homo Sapiens
QNFVDSKED

SEQ ID NO: 233695 - protein, 9 aa, Homo Sapiens
DILDTAGKE

SEQ ID NO: 233696 - protein, 9 aa, Homo Sapiens
FPYYCRKFP

SEQ ID NO: 233697 - protein, 9 aa, Homo Sapiens
DEHKKWVTH

SEQ ID NO: 233698 - protein, 9 aa, Homo Sapiens
LPASTSASV

SEQ ID NO: 233699 - protein, 9 aa, Homo Sapiens
QQFHQLSQV

SEQ ID NO: 233700 - protein, 9 aa, Homo Sapiens
NAGQAVKIV

SEQ ID NO: 233701 - protein, 9 aa, Homo Sapiens
RWFGDEPLL

SEQ ID NO: 233702 - protein, 9 aa, Homo Sapiens
QAIPLVVKS

SEQ ID NO: 233703 - protein, 9 aa, Homo Sapiens
FCKYARGAD

SEQ ID NO: 233704 - protein, 9 aa, Homo Sapiens
LPPGIPHTP

SEQ ID NO: 233705 - protein, 9 aa, Homo Sapiens
QTVSEDRDS

SEQ ID NO: 233706 - protein, 9 aa, Homo Sapiens
SCGRHGSGS

SEQ ID NO: 233707 - protein, 9 aa, Homo Sapiens
EKDSGDYEC

SEQ ID NO: 233708 - protein, 9 aa, Homo Sapiens
VIDALKNYS

SEQ ID NO: 233709 - protein, 9 aa, Homo Sapiens
QWASLAYIH

SEQ ID NO: 233710 - protein, 9 aa, Homo Sapiens
PLPASTSAS

SEQ ID NO: 233711 - protein, 9 aa, Homo Sapiens
EIFHMTYNL

SEQ ID NO: 233712 - protein, 9 aa, Homo Sapiens
KQQCPQGHF

SEQ ID NO: 233713 - protein, 9 aa, Homo Sapiens
ERLYNEVKR

SEQ ID NO: 233714 - protein, 9 aa, Homo Sapiens
TKSKGKKAE

SEQ ID NO: 233715 - protein, 9 aa, Homo Sapiens
VFKVVPLLN

SEQ ID NO: 233716 - protein, 9 aa, Homo Sapiens
WSIPFTLNP

SEQ ID NO: 233717 - protein, 9 aa, Homo Sapiens
VKSCIRYIN

SEQ ID NO: 233718 - protein, 9 aa, Homo Sapiens
IDALKNYSI

SEQ ID NO: 233719 - protein, 9 aa, Homo Sapiens
RCAEFQLRL

SEQ ID NO: 233720 - protein, 9 aa, Homo Sapiens
VLGTESLLL

SEQ ID NO: 233721 - protein, 9 aa, Homo Sapiens
SHCVLILFH

SEQ ID NO: 233722 - protein, 9 aa, Homo Sapiens
KQLNFEKFQ

SEQ ID NO: 233723 - protein, 9 aa, Homo Sapiens
YEGHKAVVH

SEQ ID NO: 233724 - protein, 9 aa, Homo Sapiens
VPFDQILMG

SEQ ID NO: 233725 - protein, 9 aa, Homo Sapiens
TQVNVVKFS

SEQ ID NO: 233726 - protein, 9 aa, Homo Sapiens
AGQAVKIVA

SEQ ID NO: 233727 - protein, 9 aa, Homo Sapiens
RCKQQCPQG

SEQ ID NO: 233728 - protein, 9 aa, Homo Sapiens
KAVVHDLSL

SEQ ID NO: 233729 - protein, 9 aa, Homo Sapiens
KREDFTSVR

SEQ ID NO: 233730 - protein, 9 aa, Homo Sapiens
SNYAVNVSK

SEQ ID NO: 233731 - protein, 9 aa, Homo Sapiens
ELVPCLFRV

SEQ ID NO: 233732 - protein, 9 aa, Homo Sapiens
VKKMNKIQK

SEQ ID NO: 233733 - protein, 9 aa, Homo Sapiens
HFLGLTHMD

SEQ ID NO: 233734 - protein, 9 aa, Homo Sapiens
LYNEVKRDL

SEQ ID NO: 233735 - protein, 9 aa, Homo Sapiens
SVNDVYLTP

SEQ ID NO: 233736 - protein, 9 aa, Homo Sapiens
KVVPLLNPD

SEQ ID NO: 233737 - protein, 9 aa, Homo Sapiens
KEDYRILNG

SEQ ID NO: 233738 - protein, 9 aa, Homo Sapiens
CKYARGADS

SEQ ID NO: 233739 - protein, 9 aa, Homo Sapiens
TFVFKVVPL

SEQ ID NO: 233740 - protein, 9 aa, Homo Sapiens
GGHVAMDGL

SEQ ID NO: 233741 - protein, 9 aa, Homo Sapiens
STLIIHDRI

SEQ ID NO: 233742 - protein, 9 aa, Homo Sapiens
QWKPSRSSQ

SEQ ID NO: 233743 - protein, 9 aa, Homo Sapiens
AFADEHEMG

SEQ ID NO: 233744 - protein, 9 aa, Homo Sapiens
TKPNAKNVR

SEQ ID NO: 233745 - protein, 9 aa, Homo Sapiens
IRLKKQLNF

SEQ ID NO: 233746 - protein, 9 aa, Homo Sapiens
TDEWGTGLP

SEQ ID NO: 233747 - protein, 9 aa, Homo Sapiens
VGLQMFMDC

SEQ ID NO: 233748 - protein, 9 aa, Homo Sapiens
RLTPPLCLH

SEQ ID NO: 233749 - protein, 9 aa, Homo Sapiens
GVNVIDALK

SEQ ID NO: 233750 - protein, 9 aa, Homo Sapiens
IPHTPSFTA

SEQ ID NO: 233751 - protein, 9 aa, Homo Sapiens
QLYAACAIC

SEQ ID NO: 233752 - protein, 9 aa, Homo Sapiens
ADEHEMGKP

SEQ ID NO: 233753 - protein, 9 aa, Homo Sapiens
ELGQGLQWA

SEQ ID NO: 233754 - protein, 9 aa, Homo Sapiens
RDKAKGFKQ

SEQ ID NO: 233755 - protein, 9 aa, Homo Sapiens
EEEKMHFHY

SEQ ID NO: 233756 - protein, 9 aa, Homo Sapiens
GDRIHCRDI

SEQ ID NO: 233757 - protein, 9 aa, Homo Sapiens
EPGYNLRGA

SEQ ID NO: 233758 - protein, 9 aa, Homo Sapiens
SQSMDQDQT

SEQ ID NO: 233759 - protein, 9 aa, Homo Sapiens
TNSGSKAEL

SEQ ID NO: 233760 - protein, 9 aa, Homo Sapiens
NSLRFPRPN

SEQ ID NO: 233761 - protein, 9 aa, Homo Sapiens
CRLGFLHSG

SEQ ID NO: 233762 - protein, 9 aa, Homo Sapiens
LTVIYGSYL

SEQ ID NO: 233763 - protein, 9 aa, Homo Sapiens
FTLNPELLA

SEQ ID NO: 233764 - protein, 9 aa, Homo Sapiens
KNFCCISDR

SEQ ID NO: 233765 - protein, 9 aa, Homo Sapiens
GELILWRVD

SEQ ID NO: 233766 - protein, 9 aa, Homo Sapiens
PATEKESTR

SEQ ID NO: 233767 - protein, 9 aa, Homo Sapiens
EELPEVTVR

SEQ ID NO: 233768 - protein, 9 aa, Homo Sapiens
IFHMTYNLA

SEQ ID NO: 233769 - protein, 9 aa, Homo Sapiens
FWDLGWQDW

SEQ ID NO: 233770 - protein, 9 aa, Homo Sapiens
SGDRIHCRD

SEQ ID NO: 233771 - protein, 9 aa, Homo Sapiens
IDRSEKERD

SEQ ID NO: 233772 - protein, 9 aa, Homo Sapiens
SAVYGELIL

SEQ ID NO: 233773 - protein, 9 aa, Homo Sapiens
IHDRIHTGE

SEQ ID NO: 233774 - protein, 9 aa, Homo Sapiens
QVNVVKFSY

SEQ ID NO: 233775 - protein, 9 aa, Homo Sapiens
ISGRFPYYC

SEQ ID NO: 233776 - protein, 9 aa, Homo Sapiens
QQQQLVSTL

SEQ ID NO: 233777 - protein, 9 aa, Homo Sapiens
PCFCKYARG

SEQ ID NO: 233778 - protein, 9 aa, Homo Sapiens
WRTNEQWKP

SEQ ID NO: 233779 - protein, 9 aa, Homo Sapiens
PGKKTIQVT

SEQ ID NO: 233780 - protein, 9 aa, Homo Sapiens
LTVPEATEK

SEQ ID NO: 233781 - protein, 9 aa, Homo Sapiens
VDAHRPKLN

SEQ ID NO: 233782 - protein, 9 aa, Homo Sapiens
INDNSLRFP

SEQ ID NO: 233783 - protein, 9 aa, Homo Sapiens
DAEYSKLFD

SEQ ID NO: 233784 - protein, 9 aa, Homo Sapiens
YCRKFPAWQ

SEQ ID NO: 233785 - protein, 9 aa, Homo Sapiens
VPLLNPDGV

SEQ ID NO: 233786 - protein, 9 aa, Homo Sapiens
NEPYISFLF

SEQ ID NO: 233787 - protein, 9 aa, Homo Sapiens
GFSSLNDEG

SEQ ID NO: 233788 - protein, 9 aa, Homo Sapiens
KMNKIQKYR

SEQ ID NO: 233789 - protein, 9 aa, Homo Sapiens
WTVLTQDSM

SEQ ID NO: 233790 - protein, 9 aa, Homo Sapiens
RLYNEVKRD

SEQ ID NO: 233791 - protein, 9 aa, Homo Sapiens
VQSPHLWNN

SEQ ID NO: 233792 - protein, 9 aa, Homo Sapiens
VKYNEPYIS

SEQ ID NO: 233793 - protein, 9 aa, Homo Sapiens
RITEEFLAK

SEQ ID NO: 233794 - protein, 9 aa, Homo Sapiens
HFHYGHIKL

SEQ ID NO: 233795 - protein, 9 aa, Homo Sapiens
EDSVNDVYL

SEQ ID NO: 233796 - protein, 9 aa, Homo Sapiens
LPEVTVRLG

SEQ ID NO: 233797 - protein, 9 aa, Homo Sapiens
ISVNSTVLV

SEQ ID NO: 233798 - protein, 9 aa, Homo Sapiens
EKMHFHYGH

SEQ ID NO: 233799 - protein, 9 aa, Homo Sapiens
HIFYFHFEN

SEQ ID NO: 233800 - protein, 9 aa, Homo Sapiens
ASRRDHCHH

SEQ ID NO: 233801 - protein, 9 aa, Homo Sapiens
PFTLNPELL

SEQ ID NO: 233802 - protein, 9 aa, Homo Sapiens
KKQPTGTMP

SEQ ID NO: 233803 - protein, 9 aa, Homo Sapiens
VSKRRWRTN

SEQ ID NO: 233804 - protein, 9 aa, Homo Sapiens
SPSPSCGRH

SEQ ID NO: 233805 - protein, 9 aa, Homo Sapiens
HYGHIKLPG

SEQ ID NO: 233806 - protein, 9 aa, Homo Sapiens
VNVSKRRWR

SEQ ID NO: 233807 - protein, 9 aa, Homo Sapiens
ELWAETNFL

SEQ ID NO: 233808 - protein, 9 aa, Homo Sapiens
GYNLRGAAS

SEQ ID NO: 233809 - protein, 9 aa, Homo Sapiens
VKCHASDNE

SEQ ID NO: 233810 - protein, 9 aa, Homo Sapiens
QSDTHAVQI

SEQ ID NO: 233811 - protein, 9 aa, Homo Sapiens
ETNFLLAPW

SEQ ID NO: 233812 - protein, 9 aa, Homo Sapiens
ETFTLISSL

SEQ ID NO: 233813 - protein, 9 aa, Homo Sapiens
NFLLAPWKN

SEQ ID NO: 233814 - protein, 9 aa, Homo Sapiens
DEKKEMQIE

SEQ ID NO: 233815 - protein, 9 aa, Homo Sapiens
YTQVNVVKF

SEQ ID NO: 233816 - protein, 9 aa, Homo Sapiens
SCARLSARY

SEQ ID NO: 233817 - protein, 9 aa, Homo Sapiens
PTGTMPLSV

SEQ ID NO: 233818 - protein, 9 aa, Homo Sapiens
PAPPHKLGG

SEQ ID NO: 233819 - protein, 9 aa, Homo Sapiens
RRKMQTVHC

SEQ ID NO: 233820 - protein, 9 aa, Homo Sapiens
FQSSLHKEK

SEQ ID NO: 233821 - protein, 9 aa, Homo Sapiens
DVDITNKLE

SEQ ID NO: 233822 - protein, 9 aa, Homo Sapiens
MFLGIPATP

SEQ ID NO: 233823 - protein, 9 aa, Homo Sapiens
GKEEYSAMR

SEQ ID NO: 233824 - protein, 9 aa, Homo Sapiens
KYVINVTYA

SEQ ID NO: 233825 - protein, 9 aa, Homo Sapiens
VVKSCIRYI

SEQ ID NO: 233826 - protein, 9 aa, Homo Sapiens
LLETLYHLG

SEQ ID NO: 233827 - protein, 9 aa, Homo Sapiens
LHTPQKPTG

SEQ ID NO: 233828 - protein, 9 aa, Homo Sapiens
YILEKGTYK

SEQ ID NO: 233829 - protein, 9 aa, Homo Sapiens
LELEELVPC

SEQ ID NO: 233830 - protein, 9 aa, Homo Sapiens
ISGSPSQWF

SEQ ID NO: 233831 - protein, 9 aa, Homo Sapiens
QLRARDVVC

SEQ ID NO: 233832 - protein, 9 aa, Homo Sapiens
VTEEELPEV

SEQ ID NO: 233833 - protein, 9 aa, Homo Sapiens
SQWFLPRKR

SEQ ID NO: 233834 - protein, 9 aa, Homo Sapiens
TLNPELLAP

SEQ ID NO: 233835 - protein, 9 aa, Homo Sapiens
PLDVLKTLI

SEQ ID NO: 233836 - protein, 9 aa, Homo Sapiens
WFGDEPLLR

SEQ ID NO: 233837 - protein, 9 aa, Homo Sapiens
TQSHCVLIL

SEQ ID NO: 233838 - protein, 9 aa, Homo Sapiens
LLCWLEPPD

SEQ ID NO: 233839 - protein, 9 aa, Homo Sapiens
DLEQQQQLV

SEQ ID NO: 233840 - protein, 9 aa, Homo Sapiens
VHDLSLTFY

SEQ ID NO: 233841 - protein, 9 aa, Homo Sapiens
LLAPWKNLT

SEQ ID NO: 233842 - protein, 9 aa, Homo Sapiens
GPRCKQQCP

SEQ ID NO: 233843 - protein, 9 aa, Homo Sapiens
GRITEEFLA

SEQ ID NO: 233844 - protein, 9 aa, Homo Sapiens
EGGHVAMDG

SEQ ID NO: 233845 - protein, 9 aa, Homo Sapiens
IYPSAYIKD

SEQ ID NO: 233846 - protein, 9 aa, Homo Sapiens
GDIPDLEHG

SEQ ID NO: 233847 - protein, 9 aa, Homo Sapiens
PRRNDPLWT

SEQ ID NO: 233848 - protein, 9 aa, Homo Sapiens
QHFQSSLHK

SEQ ID NO: 233849 - protein, 9 aa, Homo Sapiens
DEHEMGKPA

SEQ ID NO: 233850 - protein, 9 aa, Homo Sapiens
EVTFVDAHR

SEQ ID NO: 233851 - protein, 9 aa, Homo Sapiens
VAQNFQLQR

SEQ ID NO: 233852 - protein, 9 aa, Homo Sapiens
TKSCARLSA

SEQ ID NO: 233853 - protein, 9 aa, Homo Sapiens
GNEALSQHF

SEQ ID NO: 233854 - protein, 9 aa, Homo Sapiens
AWEDLQGHT

SEQ ID NO: 233855 - protein, 9 aa, Homo Sapiens
TDRDSGTNT

SEQ ID NO: 233856 - protein, 9 aa, Homo Sapiens
SSNIHVGSR

SEQ ID NO: 233857 - protein, 9 aa, Homo Sapiens
NFVDSKEDY

SEQ ID NO: 233858 - protein, 9 aa, Homo Sapiens
PDLEHGWAQ

SEQ ID NO: 233859 - protein, 9 aa, Homo Sapiens
RRAEAPTNE

SEQ ID NO: 233860 - protein, 9 aa, Homo Sapiens
YFHFENLLK

SEQ ID NO: 233861 - protein, 9 aa, Homo Sapiens
LTPPLCLHF

SEQ ID NO: 233862 - protein, 9 aa, Homo Sapiens
VKCVSENNG

SEQ ID NO: 233863 - protein, 9 aa, Homo Sapiens
MADQSERRA

SEQ ID NO: 233864 - protein, 9 aa, Homo Sapiens
LRRAEAPTN

SEQ ID NO: 233865 - protein, 9 aa, Homo Sapiens
ERYSADKDV

SEQ ID NO: 233866 - protein, 9 aa, Homo Sapiens
NPIEHSHFN

SEQ ID NO: 233867 - protein, 9 aa, Homo Sapiens
CEPGYNLRG

SEQ ID NO: 233868 - protein, 9 aa, Homo Sapiens
QQFLTVHPQ

SEQ ID NO: 233869 - protein, 9 aa, Homo Sapiens
LLSCVETDE

SEQ ID NO: 233870 - protein, 9 aa, Homo Sapiens
CFCKYARGA

SEQ ID NO: 233871 - protein, 9 aa, Homo Sapiens
WKPSRSSQC

SEQ ID NO: 233872 - protein, 9 aa, Homo Sapiens
FADEHEMGK

SEQ ID NO: 233873 - protein, 9 aa, Homo Sapiens
APLPASTSA

SEQ ID NO: 233874 - protein, 9 aa, Homo Sapiens
HLRCAEFQL

SEQ ID NO: 233875 - protein, 9 aa, Homo Sapiens
SKEDYRILN

SEQ ID NO: 233876 - protein, 9 aa, Homo Sapiens
RQAGEVTFV

SEQ ID NO: 233877 - protein, 9 aa, Homo Sapiens
AVKIVAQYR

SEQ ID NO: 233878 - protein, 9 aa, Homo Sapiens
EFLLSCVET

SEQ ID NO: 233879 - protein, 9 aa, Homo Sapiens
RGFSSLNDE

SEQ ID NO: 233880 - protein, 9 aa, Homo Sapiens
LKKQLNFEK

SEQ ID NO: 233881 - protein, 9 aa, Homo Sapiens
AKAGFLTFR

SEQ ID NO: 233882 - protein, 9 aa, Homo Sapiens
VWSWDVDIT

SEQ ID NO: 233883 - protein, 9 aa, Homo Sapiens
EHCNAAFST

SEQ ID NO: 233884 - protein, 9 aa, Homo Sapiens
YHLGMLVPG

SEQ ID NO: 233885 - protein, 9 aa, Homo Sapiens
SELQGKAQL

SEQ ID NO: 233886 - protein, 9 aa, Homo Sapiens
QSPSPSCGR

SEQ ID NO: 233887 - protein, 9 aa, Homo Sapiens
VMLETFTLI

SEQ ID NO: 233888 - protein, 9 aa, Homo Sapiens
ILDINDNSL

SEQ ID NO: 233889 - protein, 9 aa, Homo Sapiens
KSTADRNID

SEQ ID NO: 233890 - protein, 9 aa, Homo Sapiens
LDERALEAL

SEQ ID NO: 233891 - protein, 9 aa, Homo Sapiens
QPTGTMPLS

SEQ ID NO: 233892 - protein, 9 aa, Homo Sapiens
HKQSDTHAV

SEQ ID NO: 233893 - protein, 9 aa, Homo Sapiens
YNEPYISFL

SEQ ID NO: 233894 - protein, 9 aa, Homo Sapiens
NSAIRELFE

SEQ ID NO: 233895 - protein, 9 aa, Homo Sapiens
QDYKRGFSS

SEQ ID NO: 233896 - protein, 9 aa, Homo Sapiens
RKMQTVHCA

SEQ ID NO: 233897 - protein, 9 aa, Homo Sapiens
NEALSQHFQ

SEQ ID NO: 233898 - protein, 9 aa, Homo Sapiens
TGSEEDLKK

SEQ ID NO: 233899 - protein, 9 aa, Homo Sapiens
QQQLVSTLE

SEQ ID NO: 233900 - protein, 9 aa, Homo Sapiens
HFQSSLHKE

SEQ ID NO: 233901 - protein, 9 aa, Homo Sapiens
ELPEVTVRL

SEQ ID NO: 233902 - protein, 9 aa, Homo Sapiens
EPISTQSHC

SEQ ID NO: 233903 - protein, 9 aa, Homo Sapiens
NLRGAASMR

SEQ ID NO: 233904 - protein, 9 aa, Homo Sapiens
VAGGLHKQS

SEQ ID NO: 233905 - protein, 9 aa, Homo Sapiens
DYKRGFSSL

SEQ ID NO: 233906 - protein, 9 aa, Homo Sapiens
CHASDNEDP

SEQ ID NO: 233907 - protein, 9 aa, Homo Sapiens
ELEELVPCL

SEQ ID NO: 233908 - protein, 9 aa, Homo Sapiens
VINSSNIHV

SEQ ID NO: 233909 - protein, 9 aa, Homo Sapiens
TCGNKISVN

SEQ ID NO: 233910 - protein, 9 aa, Homo Sapiens
WGIKSTADR

SEQ ID NO: 233911 - protein, 9 aa, Homo Sapiens
ESNENQEKG

SEQ ID NO: 233912 - protein, 9 aa, Homo Sapiens
FAMLCLLTI

SEQ ID NO: 233913 - protein, 9 aa, Homo Sapiens
NEDSQSMDQ

SEQ ID NO: 233914 - protein, 9 aa, Homo Sapiens
WDVDITNKL

SEQ ID NO: 233915 - protein, 9 aa, Homo Sapiens
QSHCVLILF

SEQ ID NO: 233916 - protein, 9 aa, Homo Sapiens
REELCDQSA

SEQ ID NO: 233917 - protein, 9 aa, Homo Sapiens
GDDQEVPFD

SEQ ID NO: 233918 - protein, 9 aa, Homo Sapiens
QHEVNEDSQ

SEQ ID NO: 233919 - protein, 9 aa, Homo Sapiens
ETLYHLGML

SEQ ID NO: 233920 - protein, 9 aa, Homo Sapiens
WVPLLTVIY

SEQ ID NO: 233921 - protein, 9 aa, Homo Sapiens
FIDRSEKER

SEQ ID NO: 233922 - protein, 9 aa, Homo Sapiens
LQWASLAYI

SEQ ID NO: 233923 - protein, 9 aa, Homo Sapiens
EQQQQLVST

SEQ ID NO: 233924 - protein, 9 aa, Homo Sapiens
SNENQEKGR

SEQ ID NO: 233925 - protein, 9 aa, Homo Sapiens
ARQRLLRRW

SEQ ID NO: 233926 - protein, 9 aa, Homo Sapiens
KCDKREDFT

SEQ ID NO: 233927 - protein, 9 aa, Homo Sapiens
DVKYNEPYI

SEQ ID NO: 233928 - protein, 9 aa, Homo Sapiens
VVHEASAAQ

SEQ ID NO: 233929 - protein, 9 aa, Homo Sapiens
TYKCFFDWG

SEQ ID NO: 233930 - protein, 9 aa, Homo Sapiens
KVQSPHLWN

SEQ ID NO: 233931 - protein, 9 aa, Homo Sapiens
GECAELGLV

SEQ ID NO: 233932 - protein, 9 aa, Homo Sapiens
VELGCIPAI

SEQ ID NO: 233933 - protein, 9 aa, Homo Sapiens
ASAPLPAST

SEQ ID NO: 233934 - protein, 9 aa, Homo Sapiens
FVDSKEDYR

SEQ ID NO: 233935 - protein, 9 aa, Homo Sapiens
EHEMGKPAD

SEQ ID NO: 233936 - protein, 9 aa, Homo Sapiens
AEFQLRLTD

SEQ ID NO: 233937 - protein, 9 aa, Homo Sapiens
LSQHFQSSL

SEQ ID NO: 233938 - protein, 9 aa, Homo Sapiens
RRWRTNEQW

SEQ ID NO: 233939 - protein, 9 aa, Homo Sapiens
GHVAMDGLG

SEQ ID NO: 233940 - protein, 9 aa, Homo Sapiens
EATGSEEDL

SEQ ID NO: 233941 - protein, 9 aa, Homo Sapiens
SAAMPKAFS

SEQ ID NO: 233942 - protein, 9 aa, Homo Sapiens
GSGDDQEVP

SEQ ID NO: 233943 - protein, 9 aa, Homo Sapiens
LDTLLAALR

SEQ ID NO: 233944 - protein, 9 aa, Homo Sapiens
PYYCRKFPA

SEQ ID NO: 233945 - protein, 9 aa, Homo Sapiens
FSGKYVRLR

SEQ ID NO: 233946 - protein, 9 aa, Homo Sapiens
INSSNIHVG

SEQ ID NO: 233947 - protein, 9 aa, Homo Sapiens
RANWQSEMG

SEQ ID NO: 233948 - protein, 9 aa, Homo Sapiens
TPQKPTGKF

SEQ ID NO: 233949 - protein, 9 aa, Homo Sapiens
SRSTKSAHA

SEQ ID NO: 233950 - protein, 9 aa, Homo Sapiens
QKTDAEYSK

SEQ ID NO: 233951 - protein, 9 aa, Homo Sapiens
LLTVIYGSY

SEQ ID NO: 233952 - protein, 9 aa, Homo Sapiens
YSADKDVVV

SEQ ID NO: 233953 - protein, 9 aa, Homo Sapiens
KTKSCARLS

SEQ ID NO: 233954 - protein, 9 aa, Homo Sapiens
MPQSRSTKS

SEQ ID NO: 233955 - protein, 9 aa, Homo Sapiens
QPTPVELGC

SEQ ID NO: 233956 - protein, 9 aa, Homo Sapiens
LETFTLISS

SEQ ID NO: 233957 - protein, 9 aa, Homo Sapiens
ADRNIDGSI

SEQ ID NO: 233958 - protein, 9 aa, Homo Sapiens
IKDFDLRQC

SEQ ID NO: 233959 - protein, 9 aa, Homo Sapiens
VKRDLPHFV

SEQ ID NO: 233960 - protein, 9 aa, Homo Sapiens
HSELQGKAQ

SEQ ID NO: 233961 - protein, 9 aa, Homo Sapiens
LVPCLFRVA

SEQ ID NO: 233962 - protein, 9 aa, Homo Sapiens
KRPRNCNSH

SEQ ID NO: 233963 - protein, 9 aa, Homo Sapiens
VGYMLGLGD

SEQ ID NO: 233964 - protein, 9 aa, Homo Sapiens
DITNKLESG

SEQ ID NO: 233965 - protein, 9 aa, Homo Sapiens
LSFAESCFS

SEQ ID NO: 233966 - protein, 9 aa, Homo Sapiens
TNFLLAPWK

SEQ ID NO: 233967 - protein, 9 aa, Homo Sapiens
GPEAVTHIP

SEQ ID NO: 233968 - protein, 9 aa, Homo Sapiens
MVKRPRNCN

SEQ ID NO: 233969 - protein, 9 aa, Homo Sapiens
HVAMDGLGL

SEQ ID NO: 233970 - protein, 9 aa, Homo Sapiens
KSKGKKAES

SEQ ID NO: 233971 - protein, 9 aa, Homo Sapiens
QSRSTKSAH

SEQ ID NO: 233972 - protein, 9 aa, Homo Sapiens
EKERDKAKG

SEQ ID NO: 233973 - protein, 9 aa, Homo Sapiens
LLNPDGVIV

SEQ ID NO: 233974 - protein, 9 aa, Homo Sapiens
LEALKEFNE

SEQ ID NO: 233975 - protein, 9 aa, Homo Sapiens
HEASAAQAS

SEQ ID NO: 233976 - protein, 9 aa, Homo Sapiens
DYRILNGEM

SEQ ID NO: 233977 - protein, 9 aa, Homo Sapiens
EFQLRLTDP

SEQ ID NO: 233978 - protein, 9 aa, Homo Sapiens
VLGERYSAD

SEQ ID NO: 233979 - protein, 9 aa, Homo Sapiens
FSSLNDEGE

SEQ ID NO: 233980 - protein, 9 aa, Homo Sapiens
CWLEPPDPN

SEQ ID NO: 233981 - protein, 9 aa, Homo Sapiens
EDRDSLCCN

SEQ ID NO: 233982 - protein, 9 aa, Homo Sapiens
KIQKYRNGP

SEQ ID NO: 233983 - protein, 9 aa, Homo Sapiens
LNSAIRELF

SEQ ID NO: 233984 - protein, 9 aa, Homo Sapiens
PALMNSTSN

SEQ ID NO: 233985 - protein, 9 aa, Homo Sapiens
GIKSTADRN

SEQ ID NO: 233986 - protein, 9 aa, Homo Sapiens
NIHVGSRGS

SEQ ID NO: 233987 - protein, 9 aa, Homo Sapiens
FQDPSAVYG

SEQ ID NO: 233988 - protein, 9 aa, Homo Sapiens
TTNSGSKAE

SEQ ID NO: 233989 - protein, 9 aa, Homo Sapiens
YARGADSVE

SEQ ID NO: 233990 - protein, 9 aa, Homo Sapiens
KQPTGTMPL

SEQ ID NO: 233991 - protein, 9 aa, Homo Sapiens
TNTQVNYSL

SEQ ID NO: 233992 - protein, 9 aa, Homo Sapiens
QAGEVTFVD

SEQ ID NO: 233993 - protein, 9 aa, Homo Sapiens
YAACAICFV

SEQ ID NO: 233994 - protein, 9 aa, Homo Sapiens
YVRLRRAEA

SEQ ID NO: 233995 - protein, 9 aa, Homo Sapiens
KDSEEIEMG

SEQ ID NO: 233996 - protein, 9 aa, Homo Sapiens
FLTFRRGVM

SEQ ID NO: 233997 - protein, 9 aa, Homo Sapiens
LGERYSADK

SEQ ID NO: 233998 - protein, 9 aa, Homo Sapiens
HSDLDERAL

SEQ ID NO: 233999 - protein, 9 aa, Homo Sapiens
HSQEGDTMM

SEQ ID NO: 234000 - protein, 9 aa, Homo Sapiens
GQQFLTVHP

SEQ ID NO: 234001 - protein, 9 aa, Homo Sapiens
AACAICFVF

SEQ ID NO: 234002 - protein, 9 aa, Homo Sapiens
CARLSARYL

SEQ ID NO: 234003 - protein, 9 aa, Homo Sapiens
DQEVPFDQI

SEQ ID NO: 234004 - protein, 9 aa, Homo Sapiens
SCVETDENE

SEQ ID NO: 234005 - protein, 9 aa, Homo Sapiens
ACSQDEHKK

SEQ ID NO: 234006 - protein, 9 aa, Homo Sapiens
DLVGLQMFM

SEQ ID NO: 234007 - protein, 9 aa, Homo Sapiens
EVPEDSVND

SEQ ID NO: 234008 - protein, 9 aa, Homo Sapiens
GQGLQWASL

SEQ ID NO: 234009 - protein, 9 aa, Homo Sapiens
SLGDAKCAR

SEQ ID NO: 234010 - protein, 9 aa, Homo Sapiens
IKSTADRNI

SEQ ID NO: 234011 - protein, 9 aa, Homo Sapiens
THIPYLPAA

SEQ ID NO: 234012 - protein, 9 aa, Homo Sapiens
FHYGHIKLP

SEQ ID NO: 234013 - protein, 9 aa, Homo Sapiens
DRIHCRDIL

SEQ ID NO: 234014 - protein, 9 aa, Homo Sapiens
PLVVKSCIR

SEQ ID NO: 234015 - protein, 9 aa, Homo Sapiens
PFDQILMGQ

SEQ ID NO: 234016 - protein, 9 aa, Homo Sapiens
GLQMFMDCS

SEQ ID NO: 234017 - protein, 9 aa, Homo Sapiens
YQGSYGCRL

SEQ ID NO: 234018 - protein, 9 aa, Homo Sapiens
ETEFLLSCV

SEQ ID NO: 234019 - protein, 9 aa, Homo Sapiens
RQEKLVKQF

SEQ ID NO: 234020 - protein, 9 aa, Homo Sapiens
TEKDSGDYE

SEQ ID NO: 234021 - protein, 9 aa, Homo Sapiens
DDILVELID

SEQ ID NO: 234022 - protein, 9 aa, Homo Sapiens
GLVLGTESL

SEQ ID NO: 234023 - protein, 9 aa, Homo Sapiens
FRRGVMLVI

SEQ ID NO: 234024 - protein, 9 aa, Homo Sapiens
LRHYLNVRF

SEQ ID NO: 234025 - protein, 9 aa, Homo Sapiens
GLSNYAVNV

SEQ ID NO: 234026 - protein, 9 aa, Homo Sapiens
TYQGSYGCR

SEQ ID NO: 234027 - protein, 9 aa, Homo Sapiens
GTMPLSVTA

SEQ ID NO: 234028 - protein, 9 aa, Homo Sapiens
EVTVRLGVS

SEQ ID NO: 234029 - protein, 9 aa, Homo Sapiens
EATEKDSGD

SEQ ID NO: 234030 - protein, 9 aa, Homo Sapiens
MVGYMLGLG

SEQ ID NO: 234031 - protein, 9 aa, Homo Sapiens
TDAEYSKLF

SEQ ID NO: 234032 - protein, 9 aa, Homo Sapiens
TKSAHAATL

SEQ ID NO: 234033 - protein, 9 aa, Homo Sapiens
AAMPKAFST

SEQ ID NO: 234034 - protein, 9 aa, Homo Sapiens
IQKYRNGPD

SEQ ID NO: 234035 - protein, 9 aa, Homo Sapiens
SADKDVVVL

SEQ ID NO: 234036 - protein, 9 aa, Homo Sapiens
FYLSFAESC

SEQ ID NO: 234037 - protein, 9 aa, Homo Sapiens
LDDILVELI

SEQ ID NO: 234038 - protein, 9 aa, Homo Sapiens
KIVAQYRPE

SEQ ID NO: 234039 - protein, 9 aa, Homo Sapiens
DNSLRFPRP

SEQ ID NO: 234040 - protein, 9 aa, Homo Sapiens
LACSQDEHK

SEQ ID NO: 234041 - protein, 9 aa, Homo Sapiens
SDLDERALE

SEQ ID NO: 234042 - protein, 9 aa, Homo Sapiens
CGDIPDLEH

SEQ ID NO: 234043 - protein, 9 aa, Homo Sapiens
ALMNSTSNQ

SEQ ID NO: 234044 - protein, 9 aa, Homo Sapiens
AVTHIPYLP

SEQ ID NO: 234045 - protein, 9 aa, Homo Sapiens
DRNIDGSIN

SEQ ID NO: 234046 - protein, 9 aa, Homo Sapiens
RQTDHRMAD

SEQ ID NO: 234047 - protein, 9 aa, Homo Sapiens
VTVRLGVSK

SEQ ID NO: 234048 - protein, 9 aa, Homo Sapiens
ATEKESTRI

SEQ ID NO: 234049 - protein, 9 aa, Homo Sapiens
VSGDRIHCR

SEQ ID NO: 234050 - protein, 9 aa, Homo Sapiens
QIESDFLAT

SEQ ID NO: 234051 - protein, 9 aa, Homo Sapiens
LTILGRYFA

SEQ ID NO: 234052 - protein, 9 aa, Homo Sapiens
DEWGTGLPA

SEQ ID NO: 234053 - protein, 9 aa, Homo Sapiens
PSCGRHGSG

SEQ ID NO: 234054 - protein, 9 aa, Homo Sapiens
AEYSKLFDL

SEQ ID NO: 234055 - protein, 9 aa, Homo Sapiens
EGHKAVVHD

SEQ ID NO: 234056 - protein, 9 aa, Homo Sapiens
QGLQWASLA

SEQ ID NO: 234057 - protein, 9 aa, Homo Sapiens
EEFLAKYLS

SEQ ID NO: 234058 - protein, 9 aa, Homo Sapiens
ASFLVFYII

SEQ ID NO: 234059 - protein, 9 aa, Homo Sapiens
SSAAMPKAF

SEQ ID NO: 234060 - protein, 9 aa, Homo Sapiens
EYFLLAAMS

SEQ ID NO: 234061 - protein, 9 aa, Homo Sapiens
RLRRAEAPT

SEQ ID NO: 234062 - protein, 9 aa, Homo Sapiens
AEELEAITL

SEQ ID NO: 234063 - protein, 9 aa, Homo Sapiens
ALSEAKAAD

SEQ ID NO: 234064 - protein, 9 aa, Homo Sapiens
LLNGSVKCV

SEQ ID NO: 234065 - protein, 9 aa, Homo Sapiens
PEDSVNDVY

SEQ ID NO: 234066 - protein, 9 aa, Homo Sapiens
SMVGYMLGL

SEQ ID NO: 234067 - protein, 9 aa, Homo Sapiens
EKLVKQFAK

SEQ ID NO: 234068 - protein, 9 aa, Homo Sapiens
ILDTAGKEE

SEQ ID NO: 234069 - protein, 9 aa, Homo Sapiens
YSCEPGYNL

SEQ ID NO: 234070 - protein, 9 aa, Homo Sapiens
FVFKVVPLL

SEQ ID NO: 234071 - protein, 9 aa, Homo Sapiens
PRANWQSEM

SEQ ID NO: 234072 - protein, 9 aa, Homo Sapiens
SQHFQSSLH

SEQ ID NO: 234073 - protein, 9 aa, Homo Sapiens
ACAICFVFM

SEQ ID NO: 234074 - protein, 9 aa, Homo Sapiens
LIQTLKKGL

SEQ ID NO: 234075 - protein, 9 aa, Homo Sapiens
TQQDVLTVR

SEQ ID NO: 234076 - protein, 9 aa, Homo Sapiens
LALSEAKAA

SEQ ID NO: 234077 - protein, 9 aa, Homo Sapiens
TLLNGSVKC

SEQ ID NO: 234078 - protein, 9 aa, Homo Sapiens
TADRNIDGS

SEQ ID NO: 234079 - protein, 9 aa, Homo Sapiens
TEEFLAKYL

SEQ ID NO: 234080 - protein, 9 aa, Homo Sapiens
VNDVYLTPS

SEQ ID NO: 234081 - protein, 9 aa, Homo Sapiens
MGKPADEKL

SEQ ID NO: 234082 - protein, 9 aa, Homo Sapiens
GHSHLALSE

SEQ ID NO: 234083 - protein, 9 aa, Homo Sapiens
ISTKPNAKN

SEQ ID NO: 234084 - protein, 9 aa, Homo Sapiens
RSEKERDKA

SEQ ID NO: 234085 - protein, 9 aa, Homo Sapiens
LETLYHLGM

SEQ ID NO: 234086 - protein, 9 aa, Homo Sapiens
YWTLKRQSQ

SEQ ID NO: 234087 - protein, 9 aa, Homo Sapiens
HTPQKPTGK

SEQ ID NO: 234088 - protein, 9 aa, Homo Sapiens
PASTSASVP

SEQ ID NO: 234089 - protein, 9 aa, Homo Sapiens
ESCFSTSTA

SEQ ID NO: 234090 - protein, 9 aa, Homo Sapiens
LVGLQMFMD

SEQ ID NO: 234091 - protein, 9 aa, Homo Sapiens
RQLYAACAI

SEQ ID NO: 234092 - protein, 9 aa, Homo Sapiens
NGGCSKNFC

SEQ ID NO: 234093 - protein, 9 aa, Homo Sapiens
VLKTLIQTL

SEQ ID NO: 234094 - protein, 9 aa, Homo Sapiens
KYNEPYISF

SEQ ID NO: 234095 - protein, 9 aa, Homo Sapiens
LELGQGLQW

SEQ ID NO: 234096 - protein, 9 aa, Homo Sapiens
MPKAFSTLA

SEQ ID NO: 234097 - protein, 9 aa, Homo Sapiens
PHSQEGDTM

SEQ ID NO: 234098 - protein, 9 aa, Homo Sapiens
LWGIKSTAD

SEQ ID NO: 234099 - protein, 9 aa, Homo Sapiens
LQGHTKDRK

SEQ ID NO: 234100 - protein, 9 aa, Homo Sapiens
ANWQSEMGR

SEQ ID NO: 234101 - protein, 9 aa, Homo Sapiens
IHVGSRGSK

SEQ ID NO: 234102 - protein, 9 aa, Homo Sapiens
EQWKPSRSS

SEQ ID NO: 234103 - protein, 9 aa, Homo Sapiens
TLYHLGMLV

SEQ ID NO: 234104 - protein, 9 aa, Homo Sapiens
YLNVRFQKG

SEQ ID NO: 234105 - protein, 9 aa, Homo Sapiens
KPSRSSQCW

SEQ ID NO: 234106 - protein, 9 aa, Homo Sapiens
QKPTGKFPR

SEQ ID NO: 234107 - protein, 9 aa, Homo Sapiens
KTDAEYSKL

SEQ ID NO: 234108 - protein, 9 aa, Homo Sapiens
ILVELIDEG

SEQ ID NO: 234109 - protein, 9 aa, Homo Sapiens
LRRWFGDEP

SEQ ID NO: 234110 - protein, 9 aa, Homo Sapiens
QDVLTVRVP

SEQ ID NO: 234111 - protein, 9 aa, Homo Sapiens
DRDSGTNTQ

SEQ ID NO: 234112 - protein, 9 aa, Homo Sapiens
AALGPEGGH

SEQ ID NO: 234113 - protein, 9 aa, Homo Sapiens
TNEQWKPSR

SEQ ID NO: 234114 - protein, 9 aa, Homo Sapiens
HEMGKPADE

SEQ ID NO: 234115 - protein, 9 aa, Homo Sapiens
RPRNCNSHG

SEQ ID NO: 234116 - protein, 9 aa, Homo Sapiens
QTRQLHPAI

SEQ ID NO: 234117 - protein, 9 aa, Homo Sapiens
EMGKPADEK

SEQ ID NO: 234118 - protein, 9 aa, Homo Sapiens
ASTSASVPA

SEQ ID NO: 234119 - protein, 9 aa, Homo Sapiens
RMADQSERR

SEQ ID NO: 234120 - protein, 9 aa, Homo Sapiens
VDITNKLES

SEQ ID NO: 234121 - protein, 9 aa, Homo Sapiens
TKKQPTGTM

SEQ ID NO: 234122 - protein, 9 aa, Homo Sapiens
SAIRELFEY

SEQ ID NO: 234123 - protein, 9 aa, Homo Sapiens
TFRRGVMLV

SEQ ID NO: 234124 - protein, 9 aa, Homo Sapiens
FTLISSLGC

SEQ ID NO: 234125 - protein, 9 aa, Homo Sapiens
WEDLQGHTK

SEQ ID NO: 234126 - protein, 9 aa, Homo Sapiens
ASDNEDPVV

SEQ ID NO: 234127 - protein, 9 aa, Homo Sapiens
LIDEGRTGL

SEQ ID NO: 234128 - protein, 9 aa, Homo Sapiens
DRSEKERDK

SEQ ID NO: 234129 - protein, 9 aa, Homo Sapiens
YGHIKLPGV

SEQ ID NO: 234130 - protein, 9 aa, Homo Sapiens
AQLRARDVV

SEQ ID NO: 234131 - protein, 9 aa, Homo Sapiens
RRDHCHHPL

SEQ ID NO: 234132 - protein, 9 aa, Homo Sapiens
GKPADEKLE

SEQ ID NO: 234133 - protein, 9 aa, Homo Sapiens
TILGRYFAR

SEQ ID NO: 234134 - protein, 9 aa, Homo Sapiens
LMNSTSNQL

SEQ ID NO: 234135 - protein, 9 aa, Homo Sapiens
PTGKFPRTP

SEQ ID NO: 234136 - protein, 9 aa, Homo Sapiens
TPPLCLHFL

SEQ ID NO: 234137 - protein, 9 aa, Homo Sapiens
KHELYVSFW

SEQ ID NO: 234138 - protein, 9 aa, Homo Sapiens
GYVGPRCKQ

SEQ ID NO: 234139 - protein, 9 aa, Homo Sapiens
LTVRVPTTG

SEQ ID NO: 234140 - protein, 9 aa, Homo Sapiens
STKPNAKNV

SEQ ID NO: 234141 - protein, 9 aa, Homo Sapiens
QALQQFHQL

SEQ ID NO: 234142 - protein, 9 aa, Homo Sapiens
PIDLTKSKG

SEQ ID NO: 234143 - protein, 9 aa, Homo Sapiens
LTKSKGKKA

SEQ ID NO: 234144 - protein, 9 aa, Homo Sapiens
RDHCHHPLN

SEQ ID NO: 234145 - protein, 9 aa, Homo Sapiens
TMDLEQQQQ

SEQ ID NO: 234146 - protein, 9 aa, Homo Sapiens
SKNSVLLCW

SEQ ID NO: 234147 - protein, 9 aa, Homo Sapiens
WASLAYIHS

SEQ ID NO: 234148 - protein, 9 aa, Homo Sapiens
QWFLPRKRN

SEQ ID NO: 234149 - protein, 9 aa, Homo Sapiens
YGCRLGFLH

SEQ ID NO: 234150 - protein, 9 aa, Homo Sapiens
HEVNEDSQS

SEQ ID NO: 234151 - protein, 9 aa, Homo Sapiens
DSKEDYRIL

SEQ ID NO: 234152 - protein, 9 aa, Homo Sapiens
WTLKRQSQN

SEQ ID NO: 234153 - protein, 9 aa, Homo Sapiens
DSATLDTLL

SEQ ID NO: 234154 - protein, 9 aa, Homo Sapiens
MQTVHCATA

SEQ ID NO: 234155 - protein, 9 aa, Homo Sapiens
VPCLFRVAS

SEQ ID NO: 234156 - protein, 9 aa, Homo Sapiens
FENLLKACG

SEQ ID NO: 234157 - protein, 9 aa, Homo Sapiens
KEEYSAMRD

SEQ ID NO: 234158 - protein, 9 aa, Homo Sapiens
ERDKAKGFK

SEQ ID NO: 234159 - protein, 9 aa, Homo Sapiens
SFLVFYIIP

SEQ ID NO: 234160 - protein, 9 aa, Homo Sapiens
EAWEDLQGH

SEQ ID NO: 234161 - protein, 9 aa, Homo Sapiens
KVKCHASDN

SEQ ID NO: 234162 - protein, 9 aa, Homo Sapiens
LSEAKAADS

SEQ ID NO: 234163 - protein, 9 aa, Homo Sapiens
QSMDQDQTS

SEQ ID NO: 234164 - protein, 9 aa, Homo Sapiens
GTISTKPNA

SEQ ID NO: 234165 - protein, 9 aa, Homo Sapiens
SAPLPASTS

SEQ ID NO: 234166 - protein, 9 aa, Homo Sapiens
AIPLVVKSC

SEQ ID NO: 234167 - protein, 9 aa, Homo Sapiens
LQQFHQLSQ

SEQ ID NO: 234168 - protein, 9 aa, Homo Sapiens
SKRRWRTNE

SEQ ID NO: 234169 - protein, 9 aa, Homo Sapiens
VSEDRDSLC

SEQ ID NO: 234170 - protein, 9 aa, Homo Sapiens
DPLWTVLTQ

SEQ ID NO: 234171 - protein, 9 aa, Homo Sapiens
EKKEMQIES

SEQ ID NO: 234172 - protein, 9 aa, Homo Sapiens
IDLTKSKGK

SEQ ID NO: 234173 - protein, 9 aa, Homo Sapiens
CRKFPAWQN

SEQ ID NO: 234174 - protein, 9 aa, Homo Sapiens
GKYVRLRRA

SEQ ID NO: 234175 - protein, 9 aa, Homo Sapiens
MTYNLASAV

SEQ ID NO: 234176 - protein, 9 aa, Homo Sapiens
STKSAHAAT

SEQ ID NO: 234177 - protein, 9 aa, Homo Sapiens
GLQWASLAY

SEQ ID NO: 234178 - protein, 9 aa, Homo Sapiens
PSAVYGELI

SEQ ID NO: 234179 - protein, 9 aa, Homo Sapiens
RGADSVEPM

SEQ ID NO: 234180 - protein, 9 aa, Homo Sapiens
YNLASAVVR

SEQ ID NO: 234181 - protein, 9 aa, Homo Sapiens
SQDEHKKWV

SEQ ID NO: 234182 - protein, 9 aa, Homo Sapiens
GIPHTPSFT

SEQ ID NO: 234183 - protein, 9 aa, Homo Sapiens
FSTNYHLQR

SEQ ID NO: 234184 - protein, 9 aa, Homo Sapiens
ITLIRFGKK

SEQ ID NO: 234185 - protein, 9 aa, Homo Sapiens
LSCVETDEN

SEQ ID NO: 234186 - protein, 9 aa, Homo Sapiens
QGSYGCRLG

SEQ ID NO: 234187 - protein, 9 aa, Homo Sapiens
HGLPPGIPH

SEQ ID NO: 234188 - protein, 9 aa, Homo Sapiens
ADQSERRAS

SEQ ID NO: 234189 - protein, 9 aa, Homo Sapiens
GGLHKQSDT

SEQ ID NO: 234190 - protein, 9 aa, Homo Sapiens
WCRQALQQF

SEQ ID NO: 234191 - protein, 9 aa, Homo Sapiens
LTLDHPSKK

SEQ ID NO: 234192 - protein, 9 aa, Homo Sapiens
HLALSEAKA

SEQ ID NO: 234193 - protein, 9 aa, Homo Sapiens
AAFSTNYHL

SEQ ID NO: 234194 - protein, 9 aa, Homo Sapiens
VNVIDALKN

SEQ ID NO: 234195 - protein, 9 aa, Homo Sapiens
LCDQSAPCL

SEQ ID NO: 234196 - protein, 9 aa, Homo Sapiens
IRELFEYIR

SEQ ID NO: 234197 - protein, 9 aa, Homo Sapiens
KYVRLRRAE

SEQ ID NO: 234198 - protein, 9 aa, Homo Sapiens
KPLLETLYH

SEQ ID NO: 234199 - protein, 9 aa, Homo Sapiens
RWRTNEQWK

SEQ ID NO: 234200 - protein, 9 aa, Homo Sapiens
GHTKDRKES

SEQ ID NO: 234201 - protein, 9 aa, Homo Sapiens
LRFPRPNYQ

SEQ ID NO: 234202 - protein, 9 aa, Homo Sapiens
HIPYLPAAG

SEQ ID NO: 234203 - protein, 9 aa, Homo Sapiens
ELGCIPAIL

SEQ ID NO: 234204 - protein, 9 aa, Homo Sapiens
QRLLRRWFG

SEQ ID NO: 234205 - protein, 9 aa, Homo Sapiens
ATMDLEQQQ

SEQ ID NO: 234206 - protein, 9 aa, Homo Sapiens
TVHPQNPGF

SEQ ID NO: 234207 - protein, 9 aa, Homo Sapiens
ECAELGLVL

SEQ ID NO: 234208 - protein, 9 aa, Homo Sapiens
KMHFHYGHI

SEQ ID NO: 234209 - protein, 9 aa, Homo Sapiens
CVAGGLHKQ

SEQ ID NO: 234210 - protein, 9 aa, Homo Sapiens
RDILFAFTK

SEQ ID NO: 234211 - protein, 9 aa, Homo Sapiens
VLTVRVPTT

SEQ ID NO: 234212 - protein, 9 aa, Homo Sapiens
HYLNVRFQK

SEQ ID NO: 234213 - protein, 9 aa, Homo Sapiens
GLHKQSDTH

SEQ ID NO: 234214 - protein, 9 aa, Homo Sapiens
KVTTMIQGN

SEQ ID NO: 234215 - protein, 9 aa, Homo Sapiens
EYSKLFDLA

SEQ ID NO: 234216 - protein, 9 aa, Homo Sapiens
ALSQHFQSS

SEQ ID NO: 234217 - protein, 9 aa, Homo Sapiens
SSKNSVLLC

SEQ ID NO: 234218 - protein, 9 aa, Homo Sapiens
THLRCAEFQ

SEQ ID NO: 234219 - protein, 9 aa, Homo Sapiens
YGELILWRV

SEQ ID NO: 234220 - protein, 9 aa, Homo Sapiens
RPRANWQSE

SEQ ID NO: 234221 - protein, 9 aa, Homo Sapiens
YISGSPSQW

SEQ ID NO: 234222 - protein, 9 aa, Homo Sapiens
RSKKDSEEI

SEQ ID NO: 234223 - protein, 9 aa, Homo Sapiens
TVRVPTTGI

SEQ ID NO: 234224 - protein, 9 aa, Homo Sapiens
IFYFHFENL

SEQ ID NO: 234225 - protein, 9 aa, Homo Sapiens
VRLRRAEAP

SEQ ID NO: 234226 - protein, 9 aa, Homo Sapiens
CLFRVASKR

SEQ ID NO: 234227 - protein, 9 aa, Homo Sapiens
EAITLIRFG

SEQ ID NO: 234228 - protein, 9 aa, Homo Sapiens
QCWCRQALQ

SEQ ID NO: 234229 - protein, 9 aa, Homo Sapiens
PEVTVRLGV

SEQ ID NO: 234230 - protein, 9 aa, Homo Sapiens
VGPRCKQQC

SEQ ID NO: 234231 - protein, 9 aa, Homo Sapiens
TYNLASAVV

SEQ ID NO: 234232 - protein, 9 aa, Homo Sapiens
TRQLHPAIR

SEQ ID NO: 234233 - protein, 9 aa, Homo Sapiens
PLLTVIYGS

SEQ ID NO: 234234 - protein, 9 aa, Homo Sapiens
LQMFMDCSP

SEQ ID NO: 234235 - protein, 9 aa, Homo Sapiens
YIKDFDLRQ

SEQ ID NO: 234236 - protein, 9 aa, Homo Sapiens
TVPEATEKD

SEQ ID NO: 234237 - protein, 9 aa, Homo Sapiens
PHIFYFHFE

SEQ ID NO: 234238 - protein, 9 aa, Homo Sapiens
APPHKLGGK

SEQ ID NO: 234239 - protein, 9 aa, Homo Sapiens
RDVMLETFT

SEQ ID NO: 234240 - protein, 9 aa, Homo Sapiens
NTLTLDHPS

SEQ ID NO: 234241 - protein, 9 aa, Homo Sapiens
EVKRDLPHF

SEQ ID NO: 234242 - protein, 9 aa, Homo Sapiens
CRQALQQFH

SEQ ID NO: 234243 - protein, 9 aa, Homo Sapiens
PHLWNNGRN

SEQ ID NO: 234244 - protein, 9 aa, Homo Sapiens
LGQGLQWAS

SEQ ID NO: 234245 - protein, 9 aa, Homo Sapiens
LLACSQDEH

SEQ ID NO: 234246 - protein, 9 aa, Homo Sapiens
GHKAVVHDL

SEQ ID NO: 234247 - protein, 9 aa, Homo Sapiens
QVLGERYSA

SEQ ID NO: 234248 - protein, 9 aa, Homo Sapiens
QGHTKDRKE

SEQ ID NO: 234249 - protein, 9 aa, Homo Sapiens
SIPMVKRPR

SEQ ID NO: 234250 - protein, 9 aa, Homo Sapiens
QDEHKKWVT

SEQ ID NO: 234251 - protein, 9 aa, Homo Sapiens
MTTNSGSKA

SEQ ID NO: 234252 - protein, 9 aa, Homo Sapiens
SEDRDSLCC

SEQ ID NO: 234253 - protein, 9 aa, Homo Sapiens
GTNTQVNYS

SEQ ID NO: 234254 - protein, 9 aa, Homo Sapiens
CNAAFSTNY

SEQ ID NO: 234255 - protein, 9 aa, Homo Sapiens
FHFENLLKA

SEQ ID NO: 234256 - protein, 9 aa, Homo Sapiens
ISTQSHCVL

SEQ ID NO: 234257 - protein, 9 aa, Homo Sapiens
TLDHPSKKA

SEQ ID NO: 234258 - protein, 9 aa, Homo Sapiens
ITEEFLAKY

SEQ ID NO: 234259 - protein, 9 aa, Homo Sapiens
TQDSATLDT

SEQ ID NO: 234260 - protein, 9 aa, Homo Sapiens
EEKQLPATE

SEQ ID NO: 234261 - protein, 9 aa, Homo Sapiens
LGPEAVTHI

SEQ ID NO: 234262 - protein, 9 aa, Homo Sapiens
LDEKKEMQI

SEQ ID NO: 234263 - protein, 9 aa, Homo Sapiens
LGLVLGTES

SEQ ID NO: 234264 - protein, 9 aa, Homo Sapiens
CGRHGSGSG

SEQ ID NO: 234265 - protein, 9 aa, Homo Sapiens
SNIHVGSRG

SEQ ID NO: 234266 - protein, 9 aa, Homo Sapiens
KYARGADSV

SEQ ID NO: 234267 - protein, 9 aa, Homo Sapiens
KCVKKMNKI

SEQ ID NO: 234268 - protein, 9 aa, Homo Sapiens
KNSVLLCWL

SEQ ID NO: 234269 - protein, 9 aa, Homo Sapiens
RALEALKEF

SEQ ID NO: 234270 - protein, 9 aa, Homo Sapiens
CARLTAEGR

SEQ ID NO: 234271 - protein, 9 aa, Homo Sapiens
GSVKCVSEN

SEQ ID NO: 234272 - protein, 9 aa, Homo Sapiens
HCVLILFHS

SEQ ID NO: 234273 - protein, 9 aa, Homo Sapiens
DQERLYNEV

SEQ ID NO: 234274 - protein, 9 aa, Homo Sapiens
WLKSSAAMP

SEQ ID NO: 234275 - protein, 9 aa, Homo Sapiens
RHYLNVRFQ

SEQ ID NO: 234276 - protein, 9 aa, Homo Sapiens
QDSATLDTL

SEQ ID NO: 234277 - protein, 9 aa, Homo Sapiens
ELQGKAQLR

SEQ ID NO: 234278 - protein, 9 aa, Homo Sapiens
DVPYQTRQL

SEQ ID NO: 234279 - protein, 9 aa, Homo Sapiens
RRGVMLVIP

SEQ ID NO: 234280 - protein, 9 aa, Homo Sapiens
AFSTNYHLQ

SEQ ID NO: 234281 - protein, 9 aa, Homo Sapiens
RDSGTNTQV

SEQ ID NO: 234282 - protein, 9 aa, Homo Sapiens
LFYLSFAES

SEQ ID NO: 234283 - protein, 9 aa, Homo Sapiens
AYIKDFDLR

SEQ ID NO: 234284 - protein, 9 aa, Homo Sapiens
TISTKPNAK

SEQ ID NO: 234285 - protein, 9 aa, Homo Sapiens
IHCRDILFA

SEQ ID NO: 234286 - protein, 9 aa, Homo Sapiens
IPDLEHGWA

SEQ ID NO: 234287 - protein, 9 aa, Homo Sapiens
TLDTLLAAL

SEQ ID NO: 234288 - protein, 9 aa, Homo Sapiens
GGVAQNFQL

SEQ ID NO: 234289 - protein, 9 aa, Homo Sapiens
KEMQIESDF

SEQ ID NO: 234290 - protein, 9 aa, Homo Sapiens
QSPHLWNNG

SEQ ID NO: 234291 - protein, 9 aa, Homo Sapiens
MDLEQQQQL

SEQ ID NO: 234292 - protein, 9 aa, Homo Sapiens
QSQNGVPLL

SEQ ID NO: 234293 - protein, 9 aa, Homo Sapiens
DPSAVYGEL

SEQ ID NO: 234294 - protein, 9 aa, Homo Sapiens
DTLLAALRR

SEQ ID NO: 234295 - protein, 9 aa, Homo Sapiens
GGCSKNFCC

SEQ ID NO: 234296 - protein, 9 aa, Homo Sapiens
GCRLGFLHS

SEQ ID NO: 234297 - protein, 9 aa, Homo Sapiens
DVLKTLIQT

SEQ ID NO: 234298 - protein, 9 aa, Homo Sapiens
QQLVSTLEK

SEQ ID NO: 234299 - protein, 9 aa, Homo Sapiens
SSLNDEGEG

SEQ ID NO: 234300 - protein, 9 aa, Homo Sapiens
TAGKEEYSA

SEQ ID NO: 234301 - protein, 9 aa, Homo Sapiens
WFLPRKRNK

SEQ ID NO: 234302 - protein, 9 aa, Homo Sapiens
CLHFLGLTH

SEQ ID NO: 234303 - protein, 9 aa, Homo Sapiens
GKKAESSQA

SEQ ID NO: 234304 - protein, 9 aa, Homo Sapiens
LKRQSQNGV

SEQ ID NO: 234305 - protein, 9 aa, Homo Sapiens
PHTPSFTAS

SEQ ID NO: 234306 - protein, 9 aa, Homo Sapiens
NQEKGRKNY

SEQ ID NO: 234307 - protein, 9 aa, Homo Sapiens
QGQQFLTVH

SEQ ID NO: 234308 - protein, 9 aa, Homo Sapiens
LDVLKTLIQ

SEQ ID NO: 234309 - protein, 9 aa, Homo Sapiens
DALKNYSIC

SEQ ID NO: 234310 - protein, 9 aa, Homo Sapiens
NLRSKVQSP

SEQ ID NO: 234311 - protein, 9 aa, Homo Sapiens
KRQSQNGVP

SEQ ID NO: 234312 - protein, 9 aa, Homo Sapiens
DTMMATTYA

SEQ ID NO: 234313 - protein, 9 aa, Homo Sapiens
VPYQTRQLH

SEQ ID NO: 234314 - protein, 9 aa, Homo Sapiens
VPEATEKDS

SEQ ID NO: 234315 - protein, 9 aa, Homo Sapiens
DTAGKEEYS

SEQ ID NO: 234316 - protein, 9 aa, Homo Sapiens
STQSHCVLI

SEQ ID NO: 234317 - protein, 9 aa, Homo Sapiens
SYDRCLAIC

SEQ ID NO: 234318 - protein, 9 aa, Homo Sapiens
VHEASAAQA

SEQ ID NO: 234319 - protein, 9 aa, Homo Sapiens
LCLLTILGR

SEQ ID NO: 234320 - protein, 9 aa, Homo Sapiens
LKNAGQAVK

SEQ ID NO: 234321 - protein, 9 aa, Homo Sapiens
DILVELIDE

SEQ ID NO: 234322 - protein, 9 aa, Homo Sapiens
IDREELCDQ

SEQ ID NO: 234323 - protein, 9 aa, Homo Sapiens
LEAITLIRF

SEQ ID NO: 234324 - protein, 9 aa, Homo Sapiens
VPEEKQLPA

SEQ ID NO: 234325 - protein, 9 aa, Homo Sapiens
EMQIESDFL

SEQ ID NO: 234326 - protein, 9 aa, Homo Sapiens
EEIEMGVAG

SEQ ID NO: 234327 - protein, 9 aa, Homo Sapiens
SAEELEAIT

SEQ ID NO: 234328 - protein, 9 aa, Homo Sapiens
QNGVPLLRR

SEQ ID NO: 234329 - protein, 9 aa, Homo Sapiens
TLIQTLKKG

SEQ ID NO: 234330 - protein, 9 aa, Homo Sapiens
SQEGDTMMA

SEQ ID NO: 234331 - protein, 9 aa, Homo Sapiens
NYAVNVSKR

SEQ ID NO: 234332 - protein, 9 aa, Homo Sapiens
LTLEDLVGL

SEQ ID NO: 234333 - protein, 9 aa, Homo Sapiens
SRRDHCHHP

SEQ ID NO: 234334 - protein, 9 aa, Homo Sapiens
CAEFQLRLT

SEQ ID NO: 234335 - protein, 9 aa, Homo Sapiens
SLRFPRPNY

SEQ ID NO: 234336 - protein, 9 aa, Homo Sapiens
EIRLKKQLN

SEQ ID NO: 234337 - protein, 9 aa, Homo Sapiens
DRIHTGEKP

SEQ ID NO: 234338 - protein, 9 aa, Homo Sapiens
CVLILFHSD

SEQ ID NO: 234339 - protein, 9 aa, Homo Sapiens
LVLGTESLL

SEQ ID NO: 234340 - protein, 9 aa, Homo Sapiens
VKRPRNCNS

SEQ ID NO: 234341 - protein, 9 aa, Homo Sapiens
SHFNSRTKA

SEQ ID NO: 234342 - protein, 9 aa, Homo Sapiens
SKLFDLALQ

SEQ ID NO: 234343 - protein, 9 aa, Homo Sapiens
LYHLGMLVP

SEQ ID NO: 234344 - protein, 9 aa, Homo Sapiens
LKTLIQTLK

SEQ ID NO: 234345 - protein, 9 aa, Homo Sapiens
LRCAEFQLR

SEQ ID NO: 234346 - protein, 9 aa, Homo Sapiens
PEGGHVAMD

SEQ ID NO: 234347 - protein, 9 aa, Homo Sapiens
SGDDQEVPF

SEQ ID NO: 234348 - protein, 9 aa, Homo Sapiens
TFVDAHRPK

SEQ ID NO: 234349 - protein, 9 aa, Homo Sapiens
EVPFDQILM

SEQ ID NO: 234350 - protein, 9 aa, Homo Sapiens
TEEELPEVT

SEQ ID NO: 234351 - protein, 9 aa, Homo Sapiens
YFLLAAMSY

SEQ ID NO: 234352 - protein, 9 aa, Homo Sapiens
KKSRQEKLV

SEQ ID NO: 234353 - protein, 9 aa, Homo Sapiens
VHCATARET

SEQ ID NO: 234354 - protein, 9 aa, Homo Sapiens
KKDSEEIEM

SEQ ID NO: 234355 - protein, 9 aa, Homo Sapiens
CVSENNGNG

SEQ ID NO: 234356 - protein, 9 aa, Homo Sapiens
RLLRRWFGD

SEQ ID NO: 234357 - protein, 9 aa, Homo Sapiens
SHSTLIIHD

SEQ ID NO: 234358 - protein, 9 aa, Homo Sapiens
GKAQLRARD

SEQ ID NO: 234359 - protein, 9 aa, Homo Sapiens
SWVAFAHTD

SEQ ID NO: 234360 - protein, 9 aa, Homo Sapiens
FLGIPATPG

SEQ ID NO: 234361 - protein, 9 aa, Homo Sapiens
NDVYLTPSV

SEQ ID NO: 234362 - protein, 9 aa, Homo Sapiens
SQLRPRANW

SEQ ID NO: 234363 - protein, 9 aa, Homo Sapiens
EGDTMMATT

SEQ ID NO: 234364 - protein, 9 aa, Homo Sapiens
WCYTQVNVV

SEQ ID NO: 234365 - protein, 9 aa, Homo Sapiens
PGYNLRGAA

SEQ ID NO: 234366 - protein, 9 aa, Homo Sapiens
VPALMNSTS

SEQ ID NO: 234367 - protein, 9 aa, Homo Sapiens
WPGKKTIQV

SEQ ID NO: 234368 - protein, 9 aa, Homo Sapiens
GVAQNFQLQ

SEQ ID NO: 234369 - protein, 9 aa, Homo Sapiens
EALSQHFQS

SEQ ID NO: 234370 - protein, 9 aa, Homo Sapiens
VYGELILWR

SEQ ID NO: 234371 - protein, 9 aa, Homo Sapiens
ELEAITLIR

SEQ ID NO: 234372 - protein, 9 aa, Homo Sapiens
GKKTIQVTH

SEQ ID NO: 234373 - protein, 9 aa, Homo Sapiens
GKFPRTPEN

SEQ ID NO: 234374 - protein, 9 aa, Homo Sapiens
LYVSFWDLG

SEQ ID NO: 234375 - protein, 9 aa, Homo Sapiens
NSSNIHVGS

SEQ ID NO: 234376 - protein, 9 aa, Homo Sapiens
ATGSEEDLK

SEQ ID NO: 234377 - protein, 9 aa, Homo Sapiens
VFAMLCLLT

SEQ ID NO: 234378 - protein, 9 aa, Homo Sapiens
KKMNKIQKY

SEQ ID NO: 234379 - protein, 9 aa, Homo Sapiens
LGDAKCARL

SEQ ID NO: 234380 - protein, 9 aa, Homo Sapiens
RRGHSHLAL

SEQ ID NO: 234381 - protein, 9 aa, Homo Sapiens
SEKERDKAK

SEQ ID NO: 234382 - protein, 9 aa, Homo Sapiens
SRQEKLVKQ

SEQ ID NO: 234383 - protein, 9 aa, Homo Sapiens
LWTVLTQDS

SEQ ID NO: 234384 - protein, 9 aa, Homo Sapiens
FGQGQQFLT

SEQ ID NO: 234385 - protein, 9 aa, Homo Sapiens
LEDLVGLQM

SEQ ID NO: 234386 - protein, 9 aa, Homo Sapiens
NTQVNYSLL

SEQ ID NO: 234387 - protein, 9 aa, Homo Sapiens
SKKKSRQEK

SEQ ID NO: 234388 - protein, 9 aa, Homo Sapiens
GCSKNFCCI

SEQ ID NO: 234389 - protein, 9 aa, Homo Sapiens
KPRRNDPLW

SEQ ID NO: 234390 - protein, 9 aa, Homo Sapiens
LEELVPCLF

SEQ ID NO: 234391 - protein, 9 aa, Homo Sapiens
VNCASRRDH

SEQ ID NO: 234392 - protein, 9 aa, Homo Sapiens
GVNCASRRD

SEQ ID NO: 234393 - protein, 9 aa, Homo Sapiens
ALDDILVEL

SEQ ID NO: 234394 - protein, 9 aa, Homo Sapiens
AVMSMVGYM

SEQ ID NO: 234395 - protein, 9 aa, Homo Sapiens
STADRNIDG

SEQ ID NO: 234396 - protein, 9 aa, Homo Sapiens
ENLLKACGR

SEQ ID NO: 234397 - protein, 9 aa, Homo Sapiens
AMLCLLTIL

SEQ ID NO: 234398 - protein, 9 aa, Homo Sapiens
PYISFLFVH

SEQ ID NO: 234399 - protein, 9 aa, Homo Sapiens
NVSKRRWRT

SEQ ID NO: 234400 - protein, 9 aa, Homo Sapiens
PQSRSTKSA

SEQ ID NO: 234401 - protein, 9 aa, Homo Sapiens
LTFRRGVML

SEQ ID NO: 234402 - protein, 9 aa, Homo Sapiens
PVELGCIPA

SEQ ID NO: 234403 - protein, 9 aa, Homo Sapiens
VTFVDAHRP

SEQ ID NO: 234404 - protein, 9 aa, Homo Sapiens
SGKYVRLRR

SEQ ID NO: 234405 - protein, 9 aa, Homo Sapiens
LGIPATPGI

SEQ ID NO: 234406 - protein, 9 aa, Homo Sapiens
SGTTVPALM

SEQ ID NO: 234407 - protein, 9 aa, Homo Sapiens
LHKQSDTHA

SEQ ID NO: 234408 - protein, 9 aa, Homo Sapiens
TCGDIPDLE

SEQ ID NO: 234409 - protein, 9 aa, Homo Sapiens
FYFHFENLL

SEQ ID NO: 234410 - protein, 9 aa, Homo Sapiens
ARGADSVEP

SEQ ID NO: 234411 - protein, 9 aa, Homo Sapiens
KCVSENNGN

SEQ ID NO: 234412 - protein, 9 aa, Homo Sapiens
SIPFTLNPE

SEQ ID NO: 234413 - protein, 9 aa, Homo Sapiens
MNSTSNQLY

SEQ ID NO: 234414 - protein, 9 aa, Homo Sapiens
ALGPEGGHV

SEQ ID NO: 234415 - protein, 9 aa, Homo Sapiens
GERYSADKD

SEQ ID NO: 234416 - protein, 9 aa, Homo Sapiens
RIHCRDILF

SEQ ID NO: 234417 - protein, 9 aa, Homo Sapiens
LAKTKSCAR

SEQ ID NO: 234418 - protein, 9 aa, Homo Sapiens
TGTMPLSVT

SEQ ID NO: 234419 - protein, 9 aa, Homo Sapiens
ADVPYQTRQ

SEQ ID NO: 234420 - protein, 9 aa, Homo Sapiens
SGRFPYYCR

SEQ ID NO: 234421 - protein, 9 aa, Homo Sapiens
AMPQSRSTK

SEQ ID NO: 234422 - protein, 9 aa, Homo Sapiens
TLKRQSQNG

SEQ ID NO: 234423 - protein, 9 aa, Homo Sapiens
TQVNYSLLP

SEQ ID NO: 234424 - protein, 9 aa, Homo Sapiens
PVINSSNIH

SEQ ID NO: 234425 - protein, 9 aa, Homo Sapiens
SEEIEMGVA

SEQ ID NO: 234426 - protein, 9 aa, Homo Sapiens
IYGSYLIAH

SEQ ID NO: 234427 - protein, 9 aa, Homo Sapiens
RRNDPLWTV

SEQ ID NO: 234428 - protein, 9 aa, Homo Sapiens
DFDLRQCHR

SEQ ID NO: 234429 - protein, 9 aa, Homo Sapiens
GPEGGHVAM

SEQ ID NO: 234430 - protein, 9 aa, Homo Sapiens
ALKNYSICG

SEQ ID NO: 234431 - protein, 9 aa, Homo Sapiens
LDTAGKEEY

SEQ ID NO: 234432 - protein, 9 aa, Homo Sapiens
AHTDEWGTG

SEQ ID NO: 234433 - protein, 9 aa, Homo Sapiens
PISTQSHCV

SEQ ID NO: 234434 - protein, 9 aa, Homo Sapiens
HKAVVHDLS

SEQ ID NO: 234435 - protein, 9 aa, Homo Sapiens
HLGMLVPGG

SEQ ID NO: 234436 - protein, 9 aa, Homo Sapiens
VRFQKGSVD

SEQ ID NO: 234437 - protein, 9 aa, Homo Sapiens
AFAHTDEWG

SEQ ID NO: 234438 - protein, 9 aa, Homo Sapiens
SGSPSQWFL

SEQ ID NO: 234439 - protein, 9 aa, Homo Sapiens
PQVLGERYS

SEQ ID NO: 234440 - protein, 9 aa, Homo Sapiens
TGGVAQNFQ

SEQ ID NO: 234441 - protein, 9 aa, Homo Sapiens
KAQLRARDV

SEQ ID NO: 234442 - protein, 9 aa, Homo Sapiens
PTPVELGCI

SEQ ID NO: 234443 - protein, 9 aa, Homo Sapiens
SKRKVTTMI

SEQ ID NO: 234444 - protein, 9 aa, Homo Sapiens
DSGTNTQVN

SEQ ID NO: 234445 - protein, 9 aa, Homo Sapiens
SCEPGYNLR

SEQ ID NO: 234446 - protein, 9 aa, Homo Sapiens
LDINDNSLR

SEQ ID NO: 234447 - protein, 9 aa, Homo Sapiens
SGQSPSPSC

SEQ ID NO: 234448 - protein, 9 aa, Homo Sapiens
IPLVVKSCI

SEQ ID NO: 234449 - protein, 9 aa, Homo Sapiens
DLTKSKGKK

SEQ ID NO: 234450 - protein, 9 aa, Homo Sapiens
TDHRMADQS

SEQ ID NO: 234451 - protein, 9 aa, Homo Sapiens
FLLSCVETD

SEQ ID NO: 234452 - protein, 9 aa, Homo Sapiens
KPLEVAMYQ

SEQ ID NO: 234453 - protein, 9 aa, Homo Sapiens
SFARHQKIH

SEQ ID NO: 234454 - protein, 9 aa, Homo Sapiens
RFSNAGQKK

SEQ ID NO: 234455 - protein, 9 aa, Homo Sapiens
SKPYINSIC

SEQ ID NO: 234456 - protein, 9 aa, Homo Sapiens
DAVFKGFLD

SEQ ID NO: 234457 - protein, 9 aa, Homo Sapiens
CDPTEPCIL

SEQ ID NO: 234458 - protein, 9 aa, Homo Sapiens
GLTKEDTQD

SEQ ID NO: 234459 - protein, 9 aa, Homo Sapiens
ESFFQDKGR

SEQ ID NO: 234460 - protein, 9 aa, Homo Sapiens
ENVLSLSLV

SEQ ID NO: 234461 - protein, 9 aa, Homo Sapiens
TIVKLMEQI

SEQ ID NO: 234462 - protein, 9 aa, Homo Sapiens
CEACIELLP

SEQ ID NO: 234463 - protein, 9 aa, Homo Sapiens
HYLTDAWNT

SEQ ID NO: 234464 - protein, 9 aa, Homo Sapiens
SFQPTNEML

SEQ ID NO: 234465 - protein, 9 aa, Homo Sapiens
ITDPSAVKP

SEQ ID NO: 234466 - protein, 9 aa, Homo Sapiens
LEGSTITGS

SEQ ID NO: 234467 - protein, 9 aa, Homo Sapiens
YGLSDQLTQ

SEQ ID NO: 234468 - protein, 9 aa, Homo Sapiens
MHDEILQAV

SEQ ID NO: 234469 - protein, 9 aa, Homo Sapiens
GVTKADLSF

SEQ ID NO: 234470 - protein, 9 aa, Homo Sapiens
WVQFIYPHI

SEQ ID NO: 234471 - protein, 9 aa, Homo Sapiens
PDSQEDEFG

SEQ ID NO: 234472 - protein, 9 aa, Homo Sapiens
KNVCSGENN

SEQ ID NO: 234473 - protein, 9 aa, Homo Sapiens
PPDNLRVMV

SEQ ID NO: 234474 - protein, 9 aa, Homo Sapiens
RLSQILRIK

SEQ ID NO: 234475 - protein, 9 aa, Homo Sapiens
TTMEEVFLW

SEQ ID NO: 234476 - protein, 9 aa, Homo Sapiens
EQGYIEVKM

SEQ ID NO: 234477 - protein, 9 aa, Homo Sapiens
SPDKLDKKE

SEQ ID NO: 234478 - protein, 9 aa, Homo Sapiens
PWKHLICVL

SEQ ID NO: 234479 - protein, 9 aa, Homo Sapiens
DPKWFGDEH

SEQ ID NO: 234480 - protein, 9 aa, Homo Sapiens
MFTGGMRES

SEQ ID NO: 234481 - protein, 9 aa, Homo Sapiens
LCVAEVWMD

SEQ ID NO: 234482 - protein, 9 aa, Homo Sapiens
IYIQVSEVD

SEQ ID NO: 234483 - protein, 9 aa, Homo Sapiens
ARLQQLPFV

SEQ ID NO: 234484 - protein, 9 aa, Homo Sapiens
CEHFGVREE

SEQ ID NO: 234485 - protein, 9 aa, Homo Sapiens
GPPICSSLQ

SEQ ID NO: 234486 - protein, 9 aa, Homo Sapiens
LPTFDPTEV

SEQ ID NO: 234487 - protein, 9 aa, Homo Sapiens
IYIYHFAHW

SEQ ID NO: 234488 - protein, 9 aa, Homo Sapiens
MNLSENAST

SEQ ID NO: 234489 - protein, 9 aa, Homo Sapiens
TLGNYKNFF

SEQ ID NO: 234490 - protein, 9 aa, Homo Sapiens
LHDPKKNRH

SEQ ID NO: 234491 - protein, 9 aa, Homo Sapiens
QPTSSQANP

SEQ ID NO: 234492 - protein, 9 aa, Homo Sapiens
IWMPGQFAP

SEQ ID NO: 234493 - protein, 9 aa, Homo Sapiens
VSVVLQLHS

SEQ ID NO: 234494 - protein, 9 aa, Homo Sapiens
KCKECDKTL

SEQ ID NO: 234495 - protein, 9 aa, Homo Sapiens
FWIISITAS

SEQ ID NO: 234496 - protein, 9 aa, Homo Sapiens
LYQVMFMCC

SEQ ID NO: 234497 - protein, 9 aa, Homo Sapiens
HAFAKLLAE

SEQ ID NO: 234498 - protein, 9 aa, Homo Sapiens
RPSRMMFYP

SEQ ID NO: 234499 - protein, 9 aa, Homo Sapiens
DSDDINFEP

SEQ ID NO: 234500 - protein, 9 aa, Homo Sapiens
LDLHGVVFP

SEQ ID NO: 234501 - protein, 9 aa, Homo Sapiens
GTCANIKHQ

SEQ ID NO: 234502 - protein, 9 aa, Homo Sapiens
FKFIDKKYP

SEQ ID NO: 234503 - protein, 9 aa, Homo Sapiens
CHIPVTNAS

SEQ ID NO: 234504 - protein, 9 aa, Homo Sapiens
YRSIVNPMD

SEQ ID NO: 234505 - protein, 9 aa, Homo Sapiens
APPLHLEYR

SEQ ID NO: 234506 - protein, 9 aa, Homo Sapiens
KLNLMESSS

SEQ ID NO: 234507 - protein, 9 aa, Homo Sapiens
MCKLGSANG

SEQ ID NO: 234508 - protein, 9 aa, Homo Sapiens
LELEKGVFM

SEQ ID NO: 234509 - protein, 9 aa, Homo Sapiens
AKQLEGSTI

SEQ ID NO: 234510 - protein, 9 aa, Homo Sapiens
VGCHRQLDK

SEQ ID NO: 234511 - protein, 9 aa, Homo Sapiens
VVQMTFLWL

SEQ ID NO: 234512 - protein, 9 aa, Homo Sapiens
YTMLVDWMY

SEQ ID NO: 234513 - protein, 9 aa, Homo Sapiens
PCAIQISKS

SEQ ID NO: 234514 - protein, 9 aa, Homo Sapiens
KEKNVLQKI

SEQ ID NO: 234515 - protein, 9 aa, Homo Sapiens
SEPQMHLGT

SEQ ID NO: 234516 - protein, 9 aa, Homo Sapiens
IRKSTFKNA

SEQ ID NO: 234517 - protein, 9 aa, Homo Sapiens
WVDIFPKKR

SEQ ID NO: 234518 - protein, 9 aa, Homo Sapiens
PNCLSEVPI

SEQ ID NO: 234519 - protein, 9 aa, Homo Sapiens
VWYFQINYR

SEQ ID NO: 234520 - protein, 9 aa, Homo Sapiens
MWSKRVIYL

SEQ ID NO: 234521 - protein, 9 aa, Homo Sapiens
ELCPELRVN

SEQ ID NO: 234522 - protein, 9 aa, Homo Sapiens
ADAYSYFRS

SEQ ID NO: 234523 - protein, 9 aa, Homo Sapiens
LLGKAQQLP

SEQ ID NO: 234524 - protein, 9 aa, Homo Sapiens
RDLTNRASF

SEQ ID NO: 234525 - protein, 9 aa, Homo Sapiens
DKCDCIIIS

SEQ ID NO: 234526 - protein, 9 aa, Homo Sapiens
NDARRIGKD

SEQ ID NO: 234527 - protein, 9 aa, Homo Sapiens
SLNANFNTQ

SEQ ID NO: 234528 - protein, 9 aa, Homo Sapiens
ESLASCAKA

SEQ ID NO: 234529 - protein, 9 aa, Homo Sapiens
LTQIDLDDN

SEQ ID NO: 234530 - protein, 9 aa, Homo Sapiens
SPSAEHSQG

SEQ ID NO: 234531 - protein, 9 aa, Homo Sapiens
LMKLIIFSW

SEQ ID NO: 234532 - protein, 9 aa, Homo Sapiens
RAREEEKGL

SEQ ID NO: 234533 - protein, 9 aa, Homo Sapiens
SFPVFVVVT

SEQ ID NO: 234534 - protein, 9 aa, Homo Sapiens
SSQKVDVET

SEQ ID NO: 234535 - protein, 9 aa, Homo Sapiens
PGGKACPHR

SEQ ID NO: 234536 - protein, 9 aa, Homo Sapiens
YEATTGNRH

SEQ ID NO: 234537 - protein, 9 aa, Homo Sapiens
RDKASRVCI

SEQ ID NO: 234538 - protein, 9 aa, Homo Sapiens
WSGLYAETE

SEQ ID NO: 234539 - protein, 9 aa, Homo Sapiens
SRDKKKGTV

SEQ ID NO: 234540 - protein, 9 aa, Homo Sapiens
LKALYNSIN

SEQ ID NO: 234541 - protein, 9 aa, Homo Sapiens
SCLSDHFQI

SEQ ID NO: 234542 - protein, 9 aa, Homo Sapiens
INWAQIIND

SEQ ID NO: 234543 - protein, 9 aa, Homo Sapiens
TSPNKYYLA

SEQ ID NO: 234544 - protein, 9 aa, Homo Sapiens
ALHWYCPVL

SEQ ID NO: 234545 - protein, 9 aa, Homo Sapiens
ENPLETNNI

SEQ ID NO: 234546 - protein, 9 aa, Homo Sapiens
NYLPICATR

SEQ ID NO: 234547 - protein, 9 aa, Homo Sapiens
GEYMDDERL

SEQ ID NO: 234548 - protein, 9 aa, Homo Sapiens
EYNAANLRN

SEQ ID NO: 234549 - protein, 9 aa, Homo Sapiens
KDTRCLGVT

SEQ ID NO: 234550 - protein, 9 aa, Homo Sapiens
QIQVNDDDV

SEQ ID NO: 234551 - protein, 9 aa, Homo Sapiens
RKFSAKYSA

SEQ ID NO: 234552 - protein, 9 aa, Homo Sapiens
EQLTANTLY

SEQ ID NO: 234553 - protein, 9 aa, Homo Sapiens
SALHAIGVE

SEQ ID NO: 234554 - protein, 9 aa, Homo Sapiens
DELQKRVPQ

SEQ ID NO: 234555 - protein, 9 aa, Homo Sapiens
FWKTFFLYN

SEQ ID NO: 234556 - protein, 9 aa, Homo Sapiens
TFISMQNDF

SEQ ID NO: 234557 - protein, 9 aa, Homo Sapiens
LGVPVFYHN

SEQ ID NO: 234558 - protein, 9 aa, Homo Sapiens
RRVFIVDSC

SEQ ID NO: 234559 - protein, 9 aa, Homo Sapiens
PDLQRNQKR

SEQ ID NO: 234560 - protein, 9 aa, Homo Sapiens
NAFLYKDCV

SEQ ID NO: 234561 - protein, 9 aa, Homo Sapiens
ESGVLKLNK

SEQ ID NO: 234562 - protein, 9 aa, Homo Sapiens
ADECHQQVH

SEQ ID NO: 234563 - protein, 9 aa, Homo Sapiens
IIGFAAEQL

SEQ ID NO: 234564 - protein, 9 aa, Homo Sapiens
EEYPDKDKE

SEQ ID NO: 234565 - protein, 9 aa, Homo Sapiens
YYRPRKISS

SEQ ID NO: 234566 - protein, 9 aa, Homo Sapiens
DVITLMGTL

SEQ ID NO: 234567 - protein, 9 aa, Homo Sapiens
HQTCCPDLN

SEQ ID NO: 234568 - protein, 9 aa, Homo Sapiens
HLNKLLEKS

SEQ ID NO: 234569 - protein, 9 aa, Homo Sapiens
DTALFDIYA

SEQ ID NO: 234570 - protein, 9 aa, Homo Sapiens
ISMHGKIPT

SEQ ID NO: 234571 - protein, 9 aa, Homo Sapiens
HDYVYLRSS

SEQ ID NO: 234572 - protein, 9 aa, Homo Sapiens
GQHEAALEC

SEQ ID NO: 234573 - protein, 9 aa, Homo Sapiens
SEKVPHNQR

SEQ ID NO: 234574 - protein, 9 aa, Homo Sapiens
KNGALSQGI

SEQ ID NO: 234575 - protein, 9 aa, Homo Sapiens
HEAVLQSKE

SEQ ID NO: 234576 - protein, 9 aa, Homo Sapiens
QFCSLRNVQ

SEQ ID NO: 234577 - protein, 9 aa, Homo Sapiens
CSLVAQIAL

SEQ ID NO: 234578 - protein, 9 aa, Homo Sapiens
TSVGKVKLT

SEQ ID NO: 234579 - protein, 9 aa, Homo Sapiens
VYKNASFQV

SEQ ID NO: 234580 - protein, 9 aa, Homo Sapiens
DYPAILMHL

SEQ ID NO: 234581 - protein, 9 aa, Homo Sapiens
RQNSAENFS

SEQ ID NO: 234582 - protein, 9 aa, Homo Sapiens
SDPQTETLG

SEQ ID NO: 234583 - protein, 9 aa, Homo Sapiens
HETQVGICQ

SEQ ID NO: 234584 - protein, 9 aa, Homo Sapiens
KEDTTSMNG

SEQ ID NO: 234585 - protein, 9 aa, Homo Sapiens
EMRANEKTT

SEQ ID NO: 234586 - protein, 9 aa, Homo Sapiens
GGPGIPGMN

SEQ ID NO: 234587 - protein, 9 aa, Homo Sapiens
GASPEGFKK

SEQ ID NO: 234588 - protein, 9 aa, Homo Sapiens
IECLQTNTD

SEQ ID NO: 234589 - protein, 9 aa, Homo Sapiens
FSAKYSAPS

SEQ ID NO: 234590 - protein, 9 aa, Homo Sapiens
LKSQFQTAP

SEQ ID NO: 234591 - protein, 9 aa, Homo Sapiens
LWFGLVTSP

SEQ ID NO: 234592 - protein, 9 aa, Homo Sapiens
LDKSWLRHP

SEQ ID NO: 234593 - protein, 9 aa, Homo Sapiens
LEEAKIIGI

SEQ ID NO: 234594 - protein, 9 aa, Homo Sapiens
IIHHDQPVK

SEQ ID NO: 234595 - protein, 9 aa, Homo Sapiens
TMFSSVCSR

SEQ ID NO: 234596 - protein, 9 aa, Homo Sapiens
PHLPLTVPF

SEQ ID NO: 234597 - protein, 9 aa, Homo Sapiens
LTFQNPPIT

SEQ ID NO: 234598 - protein, 9 aa, Homo Sapiens
MSTNIVSEN

SEQ ID NO: 234599 - protein, 9 aa, Homo Sapiens
CTVLDQPIS

SEQ ID NO: 234600 - protein, 9 aa, Homo Sapiens
NHHCAHFTD

SEQ ID NO: 234601 - protein, 9 aa, Homo Sapiens
NESVGVLAE

SEQ ID NO: 234602 - protein, 9 aa, Homo Sapiens
TVPQHQEVW

SEQ ID NO: 234603 - protein, 9 aa, Homo Sapiens
KDELLNEFS

SEQ ID NO: 234604 - protein, 9 aa, Homo Sapiens
YYFVNNLPL

SEQ ID NO: 234605 - protein, 9 aa, Homo Sapiens
WHRAVSTNV

SEQ ID NO: 234606 - protein, 9 aa, Homo Sapiens
TALNLTAPG

SEQ ID NO: 234607 - protein, 9 aa, Homo Sapiens
LRQLVKVDG

SEQ ID NO: 234608 - protein, 9 aa, Homo Sapiens
PNNVATVLE

SEQ ID NO: 234609 - protein, 9 aa, Homo Sapiens
PKKNRHWHW

SEQ ID NO: 234610 - protein, 9 aa, Homo Sapiens
KVCVNIHGI

SEQ ID NO: 234611 - protein, 9 aa, Homo Sapiens
EEFLKEKEQ

SEQ ID NO: 234612 - protein, 9 aa, Homo Sapiens
LSVKCWLRY

SEQ ID NO: 234613 - protein, 9 aa, Homo Sapiens
PGLIAFEWL

SEQ ID NO: 234614 - protein, 9 aa, Homo Sapiens
CLWEVSEGT

SEQ ID NO: 234615 - protein, 9 aa, Homo Sapiens
LLKNKQKKE

SEQ ID NO: 234616 - protein, 9 aa, Homo Sapiens
VVKLLNAKL

SEQ ID NO: 234617 - protein, 9 aa, Homo Sapiens
KHHTTSTSK

SEQ ID NO: 234618 - protein, 9 aa, Homo Sapiens
LKTTTSLEK

SEQ ID NO: 234619 - protein, 9 aa, Homo Sapiens
TVKYQIHTG

SEQ ID NO: 234620 - protein, 9 aa, Homo Sapiens
DEVLAFADS

SEQ ID NO: 234621 - protein, 9 aa, Homo Sapiens
LFLVPSQLR

SEQ ID NO: 234622 - protein, 9 aa, Homo Sapiens
INAQNQNNY

SEQ ID NO: 234623 - protein, 9 aa, Homo Sapiens
KSGQLSLIF

SEQ ID NO: 234624 - protein, 9 aa, Homo Sapiens
THNGTPQNA

SEQ ID NO: 234625 - protein, 9 aa, Homo Sapiens
NVKDTICIN

SEQ ID NO: 234626 - protein, 9 aa, Homo Sapiens
SRFSIYTTL

SEQ ID NO: 234627 - protein, 9 aa, Homo Sapiens
IMNSGFQNT

SEQ ID NO: 234628 - protein, 9 aa, Homo Sapiens
TSESESNIF

SEQ ID NO: 234629 - protein, 9 aa, Homo Sapiens
ASDYFNLAA

SEQ ID NO: 234630 - protein, 9 aa, Homo Sapiens
TLAEISDHY

SEQ ID NO: 234631 - protein, 9 aa, Homo Sapiens
NAKRLRRKR

SEQ ID NO: 234632 - protein, 9 aa, Homo Sapiens
FTVSSFFQK

SEQ ID NO: 234633 - protein, 9 aa, Homo Sapiens
ETIEKGKDD

SEQ ID NO: 234634 - protein, 9 aa, Homo Sapiens
TTCKKGGCK

SEQ ID NO: 234635 - protein, 9 aa, Homo Sapiens
LDDQRAIVG

SEQ ID NO: 234636 - protein, 9 aa, Homo Sapiens
EKTEKLEKE

SEQ ID NO: 234637 - protein, 9 aa, Homo Sapiens
INLNVDVPI

SEQ ID NO: 234638 - protein, 9 aa, Homo Sapiens
ATCVLKKKL

SEQ ID NO: 234639 - protein, 9 aa, Homo Sapiens
TELYVQNEN

SEQ ID NO: 234640 - protein, 9 aa, Homo Sapiens
YPETKHSAK

SEQ ID NO: 234641 - protein, 9 aa, Homo Sapiens
LLQGLNLLH

SEQ ID NO: 234642 - protein, 9 aa, Homo Sapiens
EVDNFHLDK

SEQ ID NO: 234643 - protein, 9 aa, Homo Sapiens
EKINASLLP

SEQ ID NO: 234644 - protein, 9 aa, Homo Sapiens
PEKVKKAEN

SEQ ID NO: 234645 - protein, 9 aa, Homo Sapiens
LLLLCPSIS

SEQ ID NO: 234646 - protein, 9 aa, Homo Sapiens
CYEPSIYRS

SEQ ID NO: 234647 - protein, 9 aa, Homo Sapiens
WSADTQHSR

SEQ ID NO: 234648 - protein, 9 aa, Homo Sapiens
GANCDQIAT

SEQ ID NO: 234649 - protein, 9 aa, Homo Sapiens
INASLLPQN

SEQ ID NO: 234650 - protein, 9 aa, Homo Sapiens
KEQFHYFII

SEQ ID NO: 234651 - protein, 9 aa, Homo Sapiens
PPTPKRWRV

SEQ ID NO: 234652 - protein, 9 aa, Homo Sapiens
QPEIFKNYD

SEQ ID NO: 234653 - protein, 9 aa, Homo Sapiens
DTTPNQGRK

SEQ ID NO: 234654 - protein, 9 aa, Homo Sapiens
ETVSATFIN

SEQ ID NO: 234655 - protein, 9 aa, Homo Sapiens
TCSTVSPVS

SEQ ID NO: 234656 - protein, 9 aa, Homo Sapiens
EEETIKSQG

SEQ ID NO: 234657 - protein, 9 aa, Homo Sapiens
CLVANFLRV

SEQ ID NO: 234658 - protein, 9 aa, Homo Sapiens
MQAPPSLPT

SEQ ID NO: 234659 - protein, 9 aa, Homo Sapiens
HRIIKQPMD

SEQ ID NO: 234660 - protein, 9 aa, Homo Sapiens
INRNNTFQT

SEQ ID NO: 234661 - protein, 9 aa, Homo Sapiens
KNLEEAKII

SEQ ID NO: 234662 - protein, 9 aa, Homo Sapiens
EDSDKTNEL

SEQ ID NO: 234663 - protein, 9 aa, Homo Sapiens
EVTFDIYAN

SEQ ID NO: 234664 - protein, 9 aa, Homo Sapiens
DYKNRYEVE

SEQ ID NO: 234665 - protein, 9 aa, Homo Sapiens
TLHNITGNP

SEQ ID NO: 234666 - protein, 9 aa, Homo Sapiens
SANSTHADT

SEQ ID NO: 234667 - protein, 9 aa, Homo Sapiens
RDLFLPKGT

SEQ ID NO: 234668 - protein, 9 aa, Homo Sapiens
EDAEDDCEN

SEQ ID NO: 234669 - protein, 9 aa, Homo Sapiens
VSSFFQKHG

SEQ ID NO: 234670 - protein, 9 aa, Homo Sapiens
NKEDVTGQF

SEQ ID NO: 234671 - protein, 9 aa, Homo Sapiens
SKGFQLTQQ

SEQ ID NO: 234672 - protein, 9 aa, Homo Sapiens
FSKQYKATI

SEQ ID NO: 234673 - protein, 9 aa, Homo Sapiens
HFNSESESG

SEQ ID NO: 234674 - protein, 9 aa, Homo Sapiens
LGNKSFQRS

SEQ ID NO: 234675 - protein, 9 aa, Homo Sapiens
SIKYSFQEI

SEQ ID NO: 234676 - protein, 9 aa, Homo Sapiens
HSLGPSHTQ

SEQ ID NO: 234677 - protein, 9 aa, Homo Sapiens
LPCAPGTSS

SEQ ID NO: 234678 - protein, 9 aa, Homo Sapiens
CASPVVVVA

SEQ ID NO: 234679 - protein, 9 aa, Homo Sapiens
VLHNKGNQG

SEQ ID NO: 234680 - protein, 9 aa, Homo Sapiens
PPGRQVMEG

SEQ ID NO: 234681 - protein, 9 aa, Homo Sapiens
ETFGDSKEI

SEQ ID NO: 234682 - protein, 9 aa, Homo Sapiens
TSIHQILER

SEQ ID NO: 234683 - protein, 9 aa, Homo Sapiens
PFWESGNWS

SEQ ID NO: 234684 - protein, 9 aa, Homo Sapiens
VGSEDKNIT

SEQ ID NO: 234685 - protein, 9 aa, Homo Sapiens
FTSGSLLLV

SEQ ID NO: 234686 - protein, 9 aa, Homo Sapiens
NSLSYDADV

SEQ ID NO: 234687 - protein, 9 aa, Homo Sapiens
KSTTERFDM

SEQ ID NO: 234688 - protein, 9 aa, Homo Sapiens
ASVIALESL

SEQ ID NO: 234689 - protein, 9 aa, Homo Sapiens
EQWLEQYTQ

SEQ ID NO: 234690 - protein, 9 aa, Homo Sapiens
NLMEFNLLI

SEQ ID NO: 234691 - protein, 9 aa, Homo Sapiens
SVCSRNRHS

SEQ ID NO: 234692 - protein, 9 aa, Homo Sapiens
ICVSHTEVQ

SEQ ID NO: 234693 - protein, 9 aa, Homo Sapiens
RMHSQNIDA

SEQ ID NO: 234694 - protein, 9 aa, Homo Sapiens
VSVPDQITG

SEQ ID NO: 234695 - protein, 9 aa, Homo Sapiens
IDNDHENVK

SEQ ID NO: 234696 - protein, 9 aa, Homo Sapiens
KERDNRRRV

SEQ ID NO: 234697 - protein, 9 aa, Homo Sapiens
GIHSQMDGL

SEQ ID NO: 234698 - protein, 9 aa, Homo Sapiens
DAPTGFPCV

SEQ ID NO: 234699 - protein, 9 aa, Homo Sapiens
VESLYSRFH

SEQ ID NO: 234700 - protein, 9 aa, Homo Sapiens
SMQTHATRM

SEQ ID NO: 234701 - protein, 9 aa, Homo Sapiens
NFLYIKSVF

SEQ ID NO: 234702 - protein, 9 aa, Homo Sapiens
VGLYQRQTE

SEQ ID NO: 234703 - protein, 9 aa, Homo Sapiens
KKKKKNKSQ

SEQ ID NO: 234704 - protein, 9 aa, Homo Sapiens
TSIISFQAV

SEQ ID NO: 234705 - protein, 9 aa, Homo Sapiens
SVKNQERII

SEQ ID NO: 234706 - protein, 9 aa, Homo Sapiens
VVRYPIKRN

SEQ ID NO: 234707 - protein, 9 aa, Homo Sapiens
VLLQWHEKT

SEQ ID NO: 234708 - protein, 9 aa, Homo Sapiens
LSDRPQMKI

SEQ ID NO: 234709 - protein, 9 aa, Homo Sapiens
HAQGDYPKY

SEQ ID NO: 234710 - protein, 9 aa, Homo Sapiens
RISNISLMH

SEQ ID NO: 234711 - protein, 9 aa, Homo Sapiens
SCMKKKRLR

SEQ ID NO: 234712 - protein, 9 aa, Homo Sapiens
PVNTGQKGK

SEQ ID NO: 234713 - protein, 9 aa, Homo Sapiens
HTASSAWGT

SEQ ID NO: 234714 - protein, 9 aa, Homo Sapiens
VKVRAPTVN

SEQ ID NO: 234715 - protein, 9 aa, Homo Sapiens
NCEQNSPDG

SEQ ID NO: 234716 - protein, 9 aa, Homo Sapiens
AAAKSKYST

SEQ ID NO: 234717 - protein, 9 aa, Homo Sapiens
NELHKFLET

SEQ ID NO: 234718 - protein, 9 aa, Homo Sapiens
GADARAVML

SEQ ID NO: 234719 - protein, 9 aa, Homo Sapiens
HMDEILLEK

SEQ ID NO: 234720 - protein, 9 aa, Homo Sapiens
LSNEEQNLL

SEQ ID NO: 234721 - protein, 9 aa, Homo Sapiens
DPQSNDNML

SEQ ID NO: 234722 - protein, 9 aa, Homo Sapiens
HATVEDSGT

SEQ ID NO: 234723 - protein, 9 aa, Homo Sapiens
CRVRFDNVI

SEQ ID NO: 234724 - protein, 9 aa, Homo Sapiens
LIGLDAGLY

SEQ ID NO: 234725 - protein, 9 aa, Homo Sapiens
FMCCCCCCC

SEQ ID NO: 234726 - protein, 9 aa, Homo Sapiens
EGIKGQHLI

SEQ ID NO: 234727 - protein, 9 aa, Homo Sapiens
DFMSTVSYM

SEQ ID NO: 234728 - protein, 9 aa, Homo Sapiens
LHFMNTSRM

SEQ ID NO: 234729 - protein, 9 aa, Homo Sapiens
DLMPKLTEG

SEQ ID NO: 234730 - protein, 9 aa, Homo Sapiens
FLGFKHIPD

SEQ ID NO: 234731 - protein, 9 aa, Homo Sapiens
QLKELETEY

SEQ ID NO: 234732 - protein, 9 aa, Homo Sapiens
YIYWVHSYT

SEQ ID NO: 234733 - protein, 9 aa, Homo Sapiens
LSGCSTPSP

SEQ ID NO: 234734 - protein, 9 aa, Homo Sapiens
PGWSVVTQS

SEQ ID NO: 234735 - protein, 9 aa, Homo Sapiens
RRNYPMAQT

SEQ ID NO: 234736 - protein, 9 aa, Homo Sapiens
REEKSLYII

SEQ ID NO: 234737 - protein, 9 aa, Homo Sapiens
IMPVRNVSK

SEQ ID NO: 234738 - protein, 9 aa, Homo Sapiens
IAWYCRWIY

SEQ ID NO: 234739 - protein, 9 aa, Homo Sapiens
FDVLIYGDP

SEQ ID NO: 234740 - protein, 9 aa, Homo Sapiens
RPPVCPMSG

SEQ ID NO: 234741 - protein, 9 aa, Homo Sapiens
NIKAGEQSV

SEQ ID NO: 234742 - protein, 9 aa, Homo Sapiens
SLAFALAVL

SEQ ID NO: 234743 - protein, 9 aa, Homo Sapiens
CEVPTMIKL

SEQ ID NO: 234744 - protein, 9 aa, Homo Sapiens
TLLGLGNKS

SEQ ID NO: 234745 - protein, 9 aa, Homo Sapiens
LNAEKRRTS

SEQ ID NO: 234746 - protein, 9 aa, Homo Sapiens
KLYFADYEL

SEQ ID NO: 234747 - protein, 9 aa, Homo Sapiens
RIGNLWQFE

SEQ ID NO: 234748 - protein, 9 aa, Homo Sapiens
ALNGIHFDP

SEQ ID NO: 234749 - protein, 9 aa, Homo Sapiens
FITGTFLVK

SEQ ID NO: 234750 - protein, 9 aa, Homo Sapiens
QRLWREEHL

SEQ ID NO: 234751 - protein, 9 aa, Homo Sapiens
RLNFTGNLI

SEQ ID NO: 234752 - protein, 9 aa, Homo Sapiens
FICSYQLTL

SEQ ID NO: 234753 - protein, 9 aa, Homo Sapiens
YVIFEYRAA

SEQ ID NO: 234754 - protein, 9 aa, Homo Sapiens
KNSEESAAP

SEQ ID NO: 234755 - protein, 9 aa, Homo Sapiens
YPSVTNYIY

SEQ ID NO: 234756 - protein, 9 aa, Homo Sapiens
SPISGQLEG

SEQ ID NO: 234757 - protein, 9 aa, Homo Sapiens
FFNEPEDNF

SEQ ID NO: 234758 - protein, 9 aa, Homo Sapiens
MNVNKIFMA

SEQ ID NO: 234759 - protein, 9 aa, Homo Sapiens
SDYSVPRRD

SEQ ID NO: 234760 - protein, 9 aa, Homo Sapiens
NDLYKNPAS

SEQ ID NO: 234761 - protein, 9 aa, Homo Sapiens
VRLLPWPFF

SEQ ID NO: 234762 - protein, 9 aa, Homo Sapiens
SAIAPNGAL

SEQ ID NO: 234763 - protein, 9 aa, Homo Sapiens
WKRVEANPR

SEQ ID NO: 234764 - protein, 9 aa, Homo Sapiens
SQNTLIALV

SEQ ID NO: 234765 - protein, 9 aa, Homo Sapiens
TSHTRHICM

SEQ ID NO: 234766 - protein, 9 aa, Homo Sapiens
LTYKEVARY

SEQ ID NO: 234767 - protein, 9 aa, Homo Sapiens
KKKTNNFNP

SEQ ID NO: 234768 - protein, 9 aa, Homo Sapiens
ESIIKSRDN

SEQ ID NO: 234769 - protein, 9 aa, Homo Sapiens
KRRHQTFPS

SEQ ID NO: 234770 - protein, 9 aa, Homo Sapiens
CCENLGSSG

SEQ ID NO: 234771 - protein, 9 aa, Homo Sapiens
EDFVRIVDE

SEQ ID NO: 234772 - protein, 9 aa, Homo Sapiens
NMPKKSADN

SEQ ID NO: 234773 - protein, 9 aa, Homo Sapiens
QNNSVIIKC

SEQ ID NO: 234774 - protein, 9 aa, Homo Sapiens
PPQSPDLVG

SEQ ID NO: 234775 - protein, 9 aa, Homo Sapiens
FAKLQTDIH

SEQ ID NO: 234776 - protein, 9 aa, Homo Sapiens
LPMLTPWIV

SEQ ID NO: 234777 - protein, 9 aa, Homo Sapiens
LNQTLLETL

SEQ ID NO: 234778 - protein, 9 aa, Homo Sapiens
THCHYKAPA

SEQ ID NO: 234779 - protein, 9 aa, Homo Sapiens
ADKPYKCNE

SEQ ID NO: 234780 - protein, 9 aa, Homo Sapiens
NTNGSHFFI

SEQ ID NO: 234781 - protein, 9 aa, Homo Sapiens
DDFVWGLIC

SEQ ID NO: 234782 - protein, 9 aa, Homo Sapiens
NKIYRYVYH

SEQ ID NO: 234783 - protein, 9 aa, Homo Sapiens
MVDGEDTTL

SEQ ID NO: 234784 - protein, 9 aa, Homo Sapiens
ESSHLHLSK

SEQ ID NO: 234785 - protein, 9 aa, Homo Sapiens
DRKAFAAHK

SEQ ID NO: 234786 - protein, 9 aa, Homo Sapiens
PLPMDGHAM

SEQ ID NO: 234787 - protein, 9 aa, Homo Sapiens
WYCNYASKG

SEQ ID NO: 234788 - protein, 9 aa, Homo Sapiens
FGDPAGKHW

SEQ ID NO: 234789 - protein, 9 aa, Homo Sapiens
DLKIKLAVQ

SEQ ID NO: 234790 - protein, 9 aa, Homo Sapiens
IYYLTNMEG

SEQ ID NO: 234791 - protein, 9 aa, Homo Sapiens
MFIGSANFG

SEQ ID NO: 234792 - protein, 9 aa, Homo Sapiens
RLMSVLELL

SEQ ID NO: 234793 - protein, 9 aa, Homo Sapiens
KSKRYEDLP

SEQ ID NO: 234794 - protein, 9 aa, Homo Sapiens
GIVKQESLV

SEQ ID NO: 234795 - protein, 9 aa, Homo Sapiens
LFGNGPPVN

SEQ ID NO: 234796 - protein, 9 aa, Homo Sapiens
CLGPFLTSP

SEQ ID NO: 234797 - protein, 9 aa, Homo Sapiens
LSPRQTAPR

SEQ ID NO: 234798 - protein, 9 aa, Homo Sapiens
INVTQQSFN

SEQ ID NO: 234799 - protein, 9 aa, Homo Sapiens
IDPEMLNSC

SEQ ID NO: 234800 - protein, 9 aa, Homo Sapiens
LIVVAAFLV

SEQ ID NO: 234801 - protein, 9 aa, Homo Sapiens
TFRDVTIEL

SEQ ID NO: 234802 - protein, 9 aa, Homo Sapiens
KTLMEITVS

SEQ ID NO: 234803 - protein, 9 aa, Homo Sapiens
EVVSDKPLS

SEQ ID NO: 234804 - protein, 9 aa, Homo Sapiens
SNRDELRRH

SEQ ID NO: 234805 - protein, 9 aa, Homo Sapiens
ATNTKKKKI

SEQ ID NO: 234806 - protein, 9 aa, Homo Sapiens
QCQAWKGSV

SEQ ID NO: 234807 - protein, 9 aa, Homo Sapiens
SASILESKY

SEQ ID NO: 234808 - protein, 9 aa, Homo Sapiens
KEHNLNMQL

SEQ ID NO: 234809 - protein, 9 aa, Homo Sapiens
FRGKAMAPH

SEQ ID NO: 234810 - protein, 9 aa, Homo Sapiens
RHAEMVAIN

SEQ ID NO: 234811 - protein, 9 aa, Homo Sapiens
SSSIPCLSP

SEQ ID NO: 234812 - protein, 9 aa, Homo Sapiens
TCGNVSNRF

SEQ ID NO: 234813 - protein, 9 aa, Homo Sapiens
YGVSLCWPG

SEQ ID NO: 234814 - protein, 9 aa, Homo Sapiens
IDEKKNDHA

SEQ ID NO: 234815 - protein, 9 aa, Homo Sapiens
SLYAELQRA

SEQ ID NO: 234816 - protein, 9 aa, Homo Sapiens
NQVRLCKRK

SEQ ID NO: 234817 - protein, 9 aa, Homo Sapiens
LQRIVKSIE

SEQ ID NO: 234818 - protein, 9 aa, Homo Sapiens
CGKPFIYVN

SEQ ID NO: 234819 - protein, 9 aa, Homo Sapiens
QSIKYSFQE

SEQ ID NO: 234820 - protein, 9 aa, Homo Sapiens
TDISRLQQR

SEQ ID NO: 234821 - protein, 9 aa, Homo Sapiens
LDNPTPLPN

SEQ ID NO: 234822 - protein, 9 aa, Homo Sapiens
EIMAYYSGN

SEQ ID NO: 234823 - protein, 9 aa, Homo Sapiens
LCVTGNFFI

SEQ ID NO: 234824 - protein, 9 aa, Homo Sapiens
PHMAEPSVP

SEQ ID NO: 234825 - protein, 9 aa, Homo Sapiens
FVVSDPNKL

SEQ ID NO: 234826 - protein, 9 aa, Homo Sapiens
VKPRLEGEI

SEQ ID NO: 234827 - protein, 9 aa, Homo Sapiens
SFYVFSTHP

SEQ ID NO: 234828 - protein, 9 aa, Homo Sapiens
KELTYHNTD

SEQ ID NO: 234829 - protein, 9 aa, Homo Sapiens
CTLDDSANR

SEQ ID NO: 234830 - protein, 9 aa, Homo Sapiens
CLCHVGQEG

SEQ ID NO: 234831 - protein, 9 aa, Homo Sapiens
IYVKGQWEN

SEQ ID NO: 234832 - protein, 9 aa, Homo Sapiens
DRISIKFVS

SEQ ID NO: 234833 - protein, 9 aa, Homo Sapiens
VVSYRAQQG

SEQ ID NO: 234834 - protein, 9 aa, Homo Sapiens
ALKLYQYLS

SEQ ID NO: 234835 - protein, 9 aa, Homo Sapiens
LWSVCVYGG

SEQ ID NO: 234836 - protein, 9 aa, Homo Sapiens
ELETEYAAS

SEQ ID NO: 234837 - protein, 9 aa, Homo Sapiens
IMAYYSGNE

SEQ ID NO: 234838 - protein, 9 aa, Homo Sapiens
WDVKMLLGQ

SEQ ID NO: 234839 - protein, 9 aa, Homo Sapiens
LWPQDEPRQ

SEQ ID NO: 234840 - protein, 9 aa, Homo Sapiens
RVPDHQNIA

SEQ ID NO: 234841 - protein, 9 aa, Homo Sapiens
PRDVVNCST

SEQ ID NO: 234842 - protein, 9 aa, Homo Sapiens
RVVSYRAQQ

SEQ ID NO: 234843 - protein, 9 aa, Homo Sapiens
DYAFSYLMR

SEQ ID NO: 234844 - protein, 9 aa, Homo Sapiens
MLGSETPSS

SEQ ID NO: 234845 - protein, 9 aa, Homo Sapiens
IIACFDVIV

SEQ ID NO: 234846 - protein, 9 aa, Homo Sapiens
AGPAHNSCG

SEQ ID NO: 234847 - protein, 9 aa, Homo Sapiens
SRLPSTQTG

SEQ ID NO: 234848 - protein, 9 aa, Homo Sapiens
EHKTSNADI

SEQ ID NO: 234849 - protein, 9 aa, Homo Sapiens
FQHVKRGWV

SEQ ID NO: 234850 - protein, 9 aa, Homo Sapiens
VGGVNYLFD

SEQ ID NO: 234851 - protein, 9 aa, Homo Sapiens
PALQREQQV

SEQ ID NO: 234852 - protein, 9 aa, Homo Sapiens
PKKRQEVME

SEQ ID NO: 234853 - protein, 9 aa, Homo Sapiens
TAFYLLKSI

SEQ ID NO: 234854 - protein, 9 aa, Homo Sapiens
EQSEHKTSN

SEQ ID NO: 234855 - protein, 9 aa, Homo Sapiens
MKCDINIRK

SEQ ID NO: 234856 - protein, 9 aa, Homo Sapiens
QSMFEIICV

SEQ ID NO: 234857 - protein, 9 aa, Homo Sapiens
SIWDEPEGL

SEQ ID NO: 234858 - protein, 9 aa, Homo Sapiens
FWLSWCLLY

SEQ ID NO: 234859 - protein, 9 aa, Homo Sapiens
SYNGGYGLS

SEQ ID NO: 234860 - protein, 9 aa, Homo Sapiens
SRHSLNAGL

SEQ ID NO: 234861 - protein, 9 aa, Homo Sapiens
QTTSQASKQ

SEQ ID NO: 234862 - protein, 9 aa, Homo Sapiens
SKLEITPQK

SEQ ID NO: 234863 - protein, 9 aa, Homo Sapiens
QTSLELFSK

SEQ ID NO: 234864 - protein, 9 aa, Homo Sapiens
FKVAGEAEK

SEQ ID NO: 234865 - protein, 9 aa, Homo Sapiens
RFCDNIIVS

SEQ ID NO: 234866 - protein, 9 aa, Homo Sapiens
YYLLCDVLP

SEQ ID NO: 234867 - protein, 9 aa, Homo Sapiens
NEFPAPEQF

SEQ ID NO: 234868 - protein, 9 aa, Homo Sapiens
KGRKYALLG

SEQ ID NO: 234869 - protein, 9 aa, Homo Sapiens
GSLLVIIHA

SEQ ID NO: 234870 - protein, 9 aa, Homo Sapiens
ALTESVNAS

SEQ ID NO: 234871 - protein, 9 aa, Homo Sapiens
SNYPKRNDL

SEQ ID NO: 234872 - protein, 9 aa, Homo Sapiens
VLQAANIIL

SEQ ID NO: 234873 - protein, 9 aa, Homo Sapiens
KKGEKELAE

SEQ ID NO: 234874 - protein, 9 aa, Homo Sapiens
RRLNFTGNL

SEQ ID NO: 234875 - protein, 9 aa, Homo Sapiens
SASVSHYEL

SEQ ID NO: 234876 - protein, 9 aa, Homo Sapiens
IDIKEYWMD

SEQ ID NO: 234877 - protein, 9 aa, Homo Sapiens
AEGGKQKKH

SEQ ID NO: 234878 - protein, 9 aa, Homo Sapiens
AVVSERSLQ

SEQ ID NO: 234879 - protein, 9 aa, Homo Sapiens
TQRMKHSSH

SEQ ID NO: 234880 - protein, 9 aa, Homo Sapiens
RHYLVSSLT

SEQ ID NO: 234881 - protein, 9 aa, Homo Sapiens
ALLLLKDIY

SEQ ID NO: 234882 - protein, 9 aa, Homo Sapiens
ALLITYLNT

SEQ ID NO: 234883 - protein, 9 aa, Homo Sapiens
THNSAFECG

SEQ ID NO: 234884 - protein, 9 aa, Homo Sapiens
PWHSRNKNY

SEQ ID NO: 234885 - protein, 9 aa, Homo Sapiens
VDSIIEDYA

SEQ ID NO: 234886 - protein, 9 aa, Homo Sapiens
VASSYLGMG

SEQ ID NO: 234887 - protein, 9 aa, Homo Sapiens
PGGHSTLRV

SEQ ID NO: 234888 - protein, 9 aa, Homo Sapiens
RRQKNKNKL

SEQ ID NO: 234889 - protein, 9 aa, Homo Sapiens
SWSSNLAKD

SEQ ID NO: 234890 - protein, 9 aa, Homo Sapiens
QTISNKQRA

SEQ ID NO: 234891 - protein, 9 aa, Homo Sapiens
LLGLCPSET

SEQ ID NO: 234892 - protein, 9 aa, Homo Sapiens
VTEGAVGAT

SEQ ID NO: 234893 - protein, 9 aa, Homo Sapiens
LRLLAGAAT

SEQ ID NO: 234894 - protein, 9 aa, Homo Sapiens
KSFGRSPSI

SEQ ID NO: 234895 - protein, 9 aa, Homo Sapiens
FHQTKAMAH

SEQ ID NO: 234896 - protein, 9 aa, Homo Sapiens
SWKHPEPGI

SEQ ID NO: 234897 - protein, 9 aa, Homo Sapiens
VNELAPVGT

SEQ ID NO: 234898 - protein, 9 aa, Homo Sapiens
GSYGDVYGI

SEQ ID NO: 234899 - protein, 9 aa, Homo Sapiens
FPLLKKCHA

SEQ ID NO: 234900 - protein, 9 aa, Homo Sapiens
QESMKVQGS

SEQ ID NO: 234901 - protein, 9 aa, Homo Sapiens
VPISVKQDI

SEQ ID NO: 234902 - protein, 9 aa, Homo Sapiens
QLRQSDPHK

SEQ ID NO: 234903 - protein, 9 aa, Homo Sapiens
IKGTPLPHT

SEQ ID NO: 234904 - protein, 9 aa, Homo Sapiens
VPAKEVLNA

SEQ ID NO: 234905 - protein, 9 aa, Homo Sapiens
EADGLVWKS

SEQ ID NO: 234906 - protein, 9 aa, Homo Sapiens
LGKLTGSTS

SEQ ID NO: 234907 - protein, 9 aa, Homo Sapiens
ITSCNWTKD

SEQ ID NO: 234908 - protein, 9 aa, Homo Sapiens
RHRFNNCML

SEQ ID NO: 234909 - protein, 9 aa, Homo Sapiens
VKTNIQSST

SEQ ID NO: 234910 - protein, 9 aa, Homo Sapiens
CVCMSGGLC

SEQ ID NO: 234911 - protein, 9 aa, Homo Sapiens
FWEKSNPTK

SEQ ID NO: 234912 - protein, 9 aa, Homo Sapiens
LKLNSHPIT

SEQ ID NO: 234913 - protein, 9 aa, Homo Sapiens
TNGSHFFIC

SEQ ID NO: 234914 - protein, 9 aa, Homo Sapiens
SHWTLCMNV

SEQ ID NO: 234915 - protein, 9 aa, Homo Sapiens
LYFSRYGVS

SEQ ID NO: 234916 - protein, 9 aa, Homo Sapiens
DEYEMESPT

SEQ ID NO: 234917 - protein, 9 aa, Homo Sapiens
FLLEGVRSL

SEQ ID NO: 234918 - protein, 9 aa, Homo Sapiens
QVLKIYNKR

SEQ ID NO: 234919 - protein, 9 aa, Homo Sapiens
KEHIKYRHK

SEQ ID NO: 234920 - protein, 9 aa, Homo Sapiens
AKNEFMQIP

SEQ ID NO: 234921 - protein, 9 aa, Homo Sapiens
ARKITSMET

SEQ ID NO: 234922 - protein, 9 aa, Homo Sapiens
VTELYVQNE

SEQ ID NO: 234923 - protein, 9 aa, Homo Sapiens
VNISDEPEV

SEQ ID NO: 234924 - protein, 9 aa, Homo Sapiens
KYPNLSHIY

SEQ ID NO: 234925 - protein, 9 aa, Homo Sapiens
YNQEIESME

SEQ ID NO: 234926 - protein, 9 aa, Homo Sapiens
KAFFSPSLL

SEQ ID NO: 234927 - protein, 9 aa, Homo Sapiens
HCKAGQSTE

SEQ ID NO: 234928 - protein, 9 aa, Homo Sapiens
GVIGQRMPQ

SEQ ID NO: 234929 - protein, 9 aa, Homo Sapiens
DLEPEQSFI

SEQ ID NO: 234930 - protein, 9 aa, Homo Sapiens
TPDPSGGFQ

SEQ ID NO: 234931 - protein, 9 aa, Homo Sapiens
DKTGVCLSN

SEQ ID NO: 234932 - protein, 9 aa, Homo Sapiens
PPDIQKMKH

SEQ ID NO: 234933 - protein, 9 aa, Homo Sapiens
KIYEDFSTF

SEQ ID NO: 234934 - protein, 9 aa, Homo Sapiens
QKACACAEE

SEQ ID NO: 234935 - protein, 9 aa, Homo Sapiens
HFTANVQGD

SEQ ID NO: 234936 - protein, 9 aa, Homo Sapiens
HRNSAMIPF

SEQ ID NO: 234937 - protein, 9 aa, Homo Sapiens
VLPSGQRNE

SEQ ID NO: 234938 - protein, 9 aa, Homo Sapiens
KGPITSSEK

SEQ ID NO: 234939 - protein, 9 aa, Homo Sapiens
ELDTVVEKH

SEQ ID NO: 234940 - protein, 9 aa, Homo Sapiens
GVHHAFAKL

SEQ ID NO: 234941 - protein, 9 aa, Homo Sapiens
GHQLFDLYH

SEQ ID NO: 234942 - protein, 9 aa, Homo Sapiens
VYNFRAKVC

SEQ ID NO: 234943 - protein, 9 aa, Homo Sapiens
SRLHSAINS

SEQ ID NO: 234944 - protein, 9 aa, Homo Sapiens
VQLYNTESQ

SEQ ID NO: 234945 - protein, 9 aa, Homo Sapiens
SSLCEHFGV

SEQ ID NO: 234946 - protein, 9 aa, Homo Sapiens
AKAKMKQPK

SEQ ID NO: 234947 - protein, 9 aa, Homo Sapiens
NNDTKSIYY

SEQ ID NO: 234948 - protein, 9 aa, Homo Sapiens
CVYIPQVMI

SEQ ID NO: 234949 - protein, 9 aa, Homo Sapiens
ENIMLCGMG

SEQ ID NO: 234950 - protein, 9 aa, Homo Sapiens
TELLFGGHK

SEQ ID NO: 234951 - protein, 9 aa, Homo Sapiens
ERALQYTLG

SEQ ID NO: 234952 - protein, 9 aa, Homo Sapiens
FTIFFSFPH

SEQ ID NO: 234953 - protein, 9 aa, Homo Sapiens
IAPDKSVPD

SEQ ID NO: 234954 - protein, 9 aa, Homo Sapiens
PKFSHRQVR

SEQ ID NO: 234955 - protein, 9 aa, Homo Sapiens
KIHGEKTKT

SEQ ID NO: 234956 - protein, 9 aa, Homo Sapiens
REFSVPERI

SEQ ID NO: 234957 - protein, 9 aa, Homo Sapiens
VLVLPVSLH

SEQ ID NO: 234958 - protein, 9 aa, Homo Sapiens
DLNISKRVL

SEQ ID NO: 234959 - protein, 9 aa, Homo Sapiens
VINGRYLQN

SEQ ID NO: 234960 - protein, 9 aa, Homo Sapiens
LMDVCATSQ

SEQ ID NO: 234961 - protein, 9 aa, Homo Sapiens
CAAVGVGLY

SEQ ID NO: 234962 - protein, 9 aa, Homo Sapiens
AAQFTLGSP

SEQ ID NO: 234963 - protein, 9 aa, Homo Sapiens
YFIQGPSGV

SEQ ID NO: 234964 - protein, 9 aa, Homo Sapiens
NHVQIRGNL

SEQ ID NO: 234965 - protein, 9 aa, Homo Sapiens
NISGTATSS

SEQ ID NO: 234966 - protein, 9 aa, Homo Sapiens
GISVLSVTH

SEQ ID NO: 234967 - protein, 9 aa, Homo Sapiens
ERKKEGKET

SEQ ID NO: 234968 - protein, 9 aa, Homo Sapiens
IVEISYYNI

SEQ ID NO: 234969 - protein, 9 aa, Homo Sapiens
EDAKPKKKT

SEQ ID NO: 234970 - protein, 9 aa, Homo Sapiens
QTAVGSSEK

SEQ ID NO: 234971 - protein, 9 aa, Homo Sapiens
LSEVLESEK

SEQ ID NO: 234972 - protein, 9 aa, Homo Sapiens
TKCNVQKTR

SEQ ID NO: 234973 - protein, 9 aa, Homo Sapiens
TKGCVPQLE

SEQ ID NO: 234974 - protein, 9 aa, Homo Sapiens
PDVYAFGIV

SEQ ID NO: 234975 - protein, 9 aa, Homo Sapiens
KDSDNVELN

SEQ ID NO: 234976 - protein, 9 aa, Homo Sapiens
IVDHSHLEE

SEQ ID NO: 234977 - protein, 9 aa, Homo Sapiens
LLEICWSGS

SEQ ID NO: 234978 - protein, 9 aa, Homo Sapiens
KILFKAKNL

SEQ ID NO: 234979 - protein, 9 aa, Homo Sapiens
IHKHISIED

SEQ ID NO: 234980 - protein, 9 aa, Homo Sapiens
KLENQDSDS

SEQ ID NO: 234981 - protein, 9 aa, Homo Sapiens
VVINFEMQP

SEQ ID NO: 234982 - protein, 9 aa, Homo Sapiens
RNSAMIPFI

SEQ ID NO: 234983 - protein, 9 aa, Homo Sapiens
ARIQQRISI

SEQ ID NO: 234984 - protein, 9 aa, Homo Sapiens
IQQHQRQHI

SEQ ID NO: 234985 - protein, 9 aa, Homo Sapiens
KFLKDTFVE

SEQ ID NO: 234986 - protein, 9 aa, Homo Sapiens
MVQIEEDED

SEQ ID NO: 234987 - protein, 9 aa, Homo Sapiens
KLFDEESEE

SEQ ID NO: 234988 - protein, 9 aa, Homo Sapiens
YFSPILTVL

SEQ ID NO: 234989 - protein, 9 aa, Homo Sapiens
TKVHRKTIN

SEQ ID NO: 234990 - protein, 9 aa, Homo Sapiens
AILLSCLPY

SEQ ID NO: 234991 - protein, 9 aa, Homo Sapiens
FPISLNWNH

SEQ ID NO: 234992 - protein, 9 aa, Homo Sapiens
VEQTQIKGL

SEQ ID NO: 234993 - protein, 9 aa, Homo Sapiens
GGVVLGGYS

SEQ ID NO: 234994 - protein, 9 aa, Homo Sapiens
RSDTCEYRG

SEQ ID NO: 234995 - protein, 9 aa, Homo Sapiens
KIRTSPTFQ

SEQ ID NO: 234996 - protein, 9 aa, Homo Sapiens
NWCQDNIIR

SEQ ID NO: 234997 - protein, 9 aa, Homo Sapiens
KIHGDLLEV

SEQ ID NO: 234998 - protein, 9 aa, Homo Sapiens
HAETDVRRV

SEQ ID NO: 234999 - protein, 9 aa, Homo Sapiens
SSLMIVLLS

SEQ ID NO: 235000 - protein, 9 aa, Homo Sapiens
SPIMADLSS

SEQ ID NO: 235001 - protein, 9 aa, Homo Sapiens
NHAAPFSKA

SEQ ID NO: 235002 - protein, 9 aa, Homo Sapiens
VPLPNKSIQ

SEQ ID NO: 235003 - protein, 9 aa, Homo Sapiens
DTFRKVIQT

SEQ ID NO: 235004 - protein, 9 aa, Homo Sapiens
ESELEPLPF

SEQ ID NO: 235005 - protein, 9 aa, Homo Sapiens
NSSTSLSNG

SEQ ID NO: 235006 - protein, 9 aa, Homo Sapiens
KALGITEMF

SEQ ID NO: 235007 - protein, 9 aa, Homo Sapiens
WAGHPCSPD

SEQ ID NO: 235008 - protein, 9 aa, Homo Sapiens
ALYSSLPRN

SEQ ID NO: 235009 - protein, 9 aa, Homo Sapiens
SMAKMTFNP

SEQ ID NO: 235010 - protein, 9 aa, Homo Sapiens
CHSYSVIID

SEQ ID NO: 235011 - protein, 9 aa, Homo Sapiens
AAWKVLSRE

SEQ ID NO: 235012 - protein, 9 aa, Homo Sapiens
GIEMKFNNM

SEQ ID NO: 235013 - protein, 9 aa, Homo Sapiens
ATMDTICTS

SEQ ID NO: 235014 - protein, 9 aa, Homo Sapiens
YNVIKDIKP

SEQ ID NO: 235015 - protein, 9 aa, Homo Sapiens
VSFFVLMTS

SEQ ID NO: 235016 - protein, 9 aa, Homo Sapiens
QRLRAEAAQ

SEQ ID NO: 235017 - protein, 9 aa, Homo Sapiens
GLVCMVTVC

SEQ ID NO: 235018 - protein, 9 aa, Homo Sapiens
ALSMVLVLL

SEQ ID NO: 235019 - protein, 9 aa, Homo Sapiens
EVVSDSELH

SEQ ID NO: 235020 - protein, 9 aa, Homo Sapiens
VTSQLGRCS

SEQ ID NO: 235021 - protein, 9 aa, Homo Sapiens
GESIAVKTR

SEQ ID NO: 235022 - protein, 9 aa, Homo Sapiens
HMGGVYWIC

SEQ ID NO: 235023 - protein, 9 aa, Homo Sapiens
VKDPKSKHH

SEQ ID NO: 235024 - protein, 9 aa, Homo Sapiens
HDQRHDGNK

SEQ ID NO: 235025 - protein, 9 aa, Homo Sapiens
YLSLFFRKV

SEQ ID NO: 235026 - protein, 9 aa, Homo Sapiens
SWILVLELV

SEQ ID NO: 235027 - protein, 9 aa, Homo Sapiens
PESSSDSDP

SEQ ID NO: 235028 - protein, 9 aa, Homo Sapiens
EERKQNREK

SEQ ID NO: 235029 - protein, 9 aa, Homo Sapiens
SAVDEGHVS

SEQ ID NO: 235030 - protein, 9 aa, Homo Sapiens
FRKEAGYFY

SEQ ID NO: 235031 - protein, 9 aa, Homo Sapiens
VSLNSDFIA

SEQ ID NO: 235032 - protein, 9 aa, Homo Sapiens
VYLSSDTTR

SEQ ID NO: 235033 - protein, 9 aa, Homo Sapiens
DADSESDHE

SEQ ID NO: 235034 - protein, 9 aa, Homo Sapiens
DDKLLHNVL

SEQ ID NO: 235035 - protein, 9 aa, Homo Sapiens
NKGGLNKKP

SEQ ID NO: 235036 - protein, 9 aa, Homo Sapiens
AQQSSTEQS

SEQ ID NO: 235037 - protein, 9 aa, Homo Sapiens
SGLELKKDK

SEQ ID NO: 235038 - protein, 9 aa, Homo Sapiens
EWKRVEANP

SEQ ID NO: 235039 - protein, 9 aa, Homo Sapiens
KIKGKLIYI

SEQ ID NO: 235040 - protein, 9 aa, Homo Sapiens
LGCNKLASF

SEQ ID NO: 235041 - protein, 9 aa, Homo Sapiens
YDADGNGYI

SEQ ID NO: 235042 - protein, 9 aa, Homo Sapiens
VLQAVMKDI

SEQ ID NO: 235043 - protein, 9 aa, Homo Sapiens
SYMFRHVDI

SEQ ID NO: 235044 - protein, 9 aa, Homo Sapiens
QPTAGNVFV

SEQ ID NO: 235045 - protein, 9 aa, Homo Sapiens
RHLDVLFAE

SEQ ID NO: 235046 - protein, 9 aa, Homo Sapiens
SNRTPQNLH

SEQ ID NO: 235047 - protein, 9 aa, Homo Sapiens
SKLLWSQDS

SEQ ID NO: 235048 - protein, 9 aa, Homo Sapiens
CRKIDYSWI

SEQ ID NO: 235049 - protein, 9 aa, Homo Sapiens
GLLHIIPYL

SEQ ID NO: 235050 - protein, 9 aa, Homo Sapiens
DAPWGKAAC

SEQ ID NO: 235051 - protein, 9 aa, Homo Sapiens
KQYKATIGA

SEQ ID NO: 235052 - protein, 9 aa, Homo Sapiens
NPFNLKVGH

SEQ ID NO: 235053 - protein, 9 aa, Homo Sapiens
CSNFDKELL

SEQ ID NO: 235054 - protein, 9 aa, Homo Sapiens
RKYVADYYE

SEQ ID NO: 235055 - protein, 9 aa, Homo Sapiens
ISSGYLRYS

SEQ ID NO: 235056 - protein, 9 aa, Homo Sapiens
VRCLTDVYL

SEQ ID NO: 235057 - protein, 9 aa, Homo Sapiens
KEQQPSTYV

SEQ ID NO: 235058 - protein, 9 aa, Homo Sapiens
VTSVQVSQL

SEQ ID NO: 235059 - protein, 9 aa, Homo Sapiens
EFNLLISFL

SEQ ID NO: 235060 - protein, 9 aa, Homo Sapiens
HNGTPQNAI

SEQ ID NO: 235061 - protein, 9 aa, Homo Sapiens
GILHKCMTK

SEQ ID NO: 235062 - protein, 9 aa, Homo Sapiens
NKEKKRIKK

SEQ ID NO: 235063 - protein, 9 aa, Homo Sapiens
VDWMYPTYL

SEQ ID NO: 235064 - protein, 9 aa, Homo Sapiens
QLVKELVTF

SEQ ID NO: 235065 - protein, 9 aa, Homo Sapiens
FYTKRNALC

SEQ ID NO: 235066 - protein, 9 aa, Homo Sapiens
ADPYSKRAI

SEQ ID NO: 235067 - protein, 9 aa, Homo Sapiens
SSYHNNEKY

SEQ ID NO: 235068 - protein, 9 aa, Homo Sapiens
TCISRETEK

SEQ ID NO: 235069 - protein, 9 aa, Homo Sapiens
QVCLTKNST

SEQ ID NO: 235070 - protein, 9 aa, Homo Sapiens
HTENRDPLP

SEQ ID NO: 235071 - protein, 9 aa, Homo Sapiens
SPQEDPFIF

SEQ ID NO: 235072 - protein, 9 aa, Homo Sapiens
TAVLRSNGV

SEQ ID NO: 235073 - protein, 9 aa, Homo Sapiens
DFFVERNII

SEQ ID NO: 235074 - protein, 9 aa, Homo Sapiens
RPQKINGIC

SEQ ID NO: 235075 - protein, 9 aa, Homo Sapiens
KPRRNVEDN

SEQ ID NO: 235076 - protein, 9 aa, Homo Sapiens
FTEDPHLVN

SEQ ID NO: 235077 - protein, 9 aa, Homo Sapiens
KCNSYCFKT

SEQ ID NO: 235078 - protein, 9 aa, Homo Sapiens
DSASSNSEE

SEQ ID NO: 235079 - protein, 9 aa, Homo Sapiens
LCHVGQEGP

SEQ ID NO: 235080 - protein, 9 aa, Homo Sapiens
LYIMNQVNS

SEQ ID NO: 235081 - protein, 9 aa, Homo Sapiens
VDFNEMSVI

SEQ ID NO: 235082 - protein, 9 aa, Homo Sapiens
ITPSAQTQE

SEQ ID NO: 235083 - protein, 9 aa, Homo Sapiens
ECDHLKESF

SEQ ID NO: 235084 - protein, 9 aa, Homo Sapiens
RQEVMEWNG

SEQ ID NO: 235085 - protein, 9 aa, Homo Sapiens
NDKVSENFR

SEQ ID NO: 235086 - protein, 9 aa, Homo Sapiens
QKEELDYVI

SEQ ID NO: 235087 - protein, 9 aa, Homo Sapiens
RLIMVARIS

SEQ ID NO: 235088 - protein, 9 aa, Homo Sapiens
KEGFVTEMC

SEQ ID NO: 235089 - protein, 9 aa, Homo Sapiens
RFQLGTCRL

SEQ ID NO: 235090 - protein, 9 aa, Homo Sapiens
ADMDAEIRR

SEQ ID NO: 235091 - protein, 9 aa, Homo Sapiens
RIQYCTQEL

SEQ ID NO: 235092 - protein, 9 aa, Homo Sapiens
TYQEYKESA

SEQ ID NO: 235093 - protein, 9 aa, Homo Sapiens
KRVLGHYVT

SEQ ID NO: 235094 - protein, 9 aa, Homo Sapiens
AEICLYRKD

SEQ ID NO: 235095 - protein, 9 aa, Homo Sapiens
TKSFNYSPN

SEQ ID NO: 235096 - protein, 9 aa, Homo Sapiens
LMEITIRHD

SEQ ID NO: 235097 - protein, 9 aa, Homo Sapiens
VLGKLLRDS

SEQ ID NO: 235098 - protein, 9 aa, Homo Sapiens
PIKDFQGCM

SEQ ID NO: 235099 - protein, 9 aa, Homo Sapiens
NHIALGSRW

SEQ ID NO: 235100 - protein, 9 aa, Homo Sapiens
PDNSEQLEL

SEQ ID NO: 235101 - protein, 9 aa, Homo Sapiens
PTLQYYLSY

SEQ ID NO: 235102 - protein, 9 aa, Homo Sapiens
YIETSQLQS

SEQ ID NO: 235103 - protein, 9 aa, Homo Sapiens
RDCFLEGDQ

SEQ ID NO: 235104 - protein, 9 aa, Homo Sapiens
PEHSLETAK

SEQ ID NO: 235105 - protein, 9 aa, Homo Sapiens
SCETMMEHK

SEQ ID NO: 235106 - protein, 9 aa, Homo Sapiens
QHLISTENT

SEQ ID NO: 235107 - protein, 9 aa, Homo Sapiens
QSIQAVPDL

SEQ ID NO: 235108 - protein, 9 aa, Homo Sapiens
PSSADVEFY

SEQ ID NO: 235109 - protein, 9 aa, Homo Sapiens
LGSPQIPLP

SEQ ID NO: 235110 - protein, 9 aa, Homo Sapiens
AALEGRLPM

SEQ ID NO: 235111 - protein, 9 aa, Homo Sapiens
AINQVLDWC

SEQ ID NO: 235112 - protein, 9 aa, Homo Sapiens
DEIPTGMTC

SEQ ID NO: 235113 - protein, 9 aa, Homo Sapiens
YSDSPTEKQ

SEQ ID NO: 235114 - protein, 9 aa, Homo Sapiens
EEELIHKKR

SEQ ID NO: 235115 - protein, 9 aa, Homo Sapiens
FSKQTIEFN

SEQ ID NO: 235116 - protein, 9 aa, Homo Sapiens
TNDFAHEMI

SEQ ID NO: 235117 - protein, 9 aa, Homo Sapiens
AFSHTSYLS

SEQ ID NO: 235118 - protein, 9 aa, Homo Sapiens
KARANNTFY

SEQ ID NO: 235119 - protein, 9 aa, Homo Sapiens
EPRPSSCSK

SEQ ID NO: 235120 - protein, 9 aa, Homo Sapiens
DAIATLHGN

SEQ ID NO: 235121 - protein, 9 aa, Homo Sapiens
KAAGLCGEY

SEQ ID NO: 235122 - protein, 9 aa, Homo Sapiens
NTLPKYYIL

SEQ ID NO: 235123 - protein, 9 aa, Homo Sapiens
FLCRDISIS

SEQ ID NO: 235124 - protein, 9 aa, Homo Sapiens
EEMGIKPSK

SEQ ID NO: 235125 - protein, 9 aa, Homo Sapiens
VGIPPEHSL

SEQ ID NO: 235126 - protein, 9 aa, Homo Sapiens
ISLSTVKSQ

SEQ ID NO: 235127 - protein, 9 aa, Homo Sapiens
SQNTSRKEN

SEQ ID NO: 235128 - protein, 9 aa, Homo Sapiens
LFCDVPQVI

SEQ ID NO: 235129 - protein, 9 aa, Homo Sapiens
RLLKLSREK

SEQ ID NO: 235130 - protein, 9 aa, Homo Sapiens
AFLRPEWSG

SEQ ID NO: 235131 - protein, 9 aa, Homo Sapiens
VQIAGNQDG

SEQ ID NO: 235132 - protein, 9 aa, Homo Sapiens
NYIEKEGIK

SEQ ID NO: 235133 - protein, 9 aa, Homo Sapiens
GIINTQPPL

SEQ ID NO: 235134 - protein, 9 aa, Homo Sapiens
PCKESETCV

SEQ ID NO: 235135 - protein, 9 aa, Homo Sapiens
TGSSKQMRH

SEQ ID NO: 235136 - protein, 9 aa, Homo Sapiens
EGNRFIQDD

SEQ ID NO: 235137 - protein, 9 aa, Homo Sapiens
HLAHHQQIH

SEQ ID NO: 235138 - protein, 9 aa, Homo Sapiens
NDGSGAESG

SEQ ID NO: 235139 - protein, 9 aa, Homo Sapiens
PVFLSQSKL

SEQ ID NO: 235140 - protein, 9 aa, Homo Sapiens
INFNIHSSI

SEQ ID NO: 235141 - protein, 9 aa, Homo Sapiens
LGPTPVRRH

SEQ ID NO: 235142 - protein, 9 aa, Homo Sapiens
GLVQFKYLN

SEQ ID NO: 235143 - protein, 9 aa, Homo Sapiens
FSEEAANED

SEQ ID NO: 235144 - protein, 9 aa, Homo Sapiens
CGTGTDRCA

SEQ ID NO: 235145 - protein, 9 aa, Homo Sapiens
TLLALMYGL

SEQ ID NO: 235146 - protein, 9 aa, Homo Sapiens
PNKYELQYV

SEQ ID NO: 235147 - protein, 9 aa, Homo Sapiens
KGQHEAALE

SEQ ID NO: 235148 - protein, 9 aa, Homo Sapiens
IQFRALRWY

SEQ ID NO: 235149 - protein, 9 aa, Homo Sapiens
YLGWAIMHV

SEQ ID NO: 235150 - protein, 9 aa, Homo Sapiens
HGCLEHLYY

SEQ ID NO: 235151 - protein, 9 aa, Homo Sapiens
GRGGTCVNV

SEQ ID NO: 235152 - protein, 9 aa, Homo Sapiens
LVNWIIKQE

SEQ ID NO: 235153 - protein, 9 aa, Homo Sapiens
KNWLDIFCC

SEQ ID NO: 235154 - protein, 9 aa, Homo Sapiens
GSDFLRFQG

SEQ ID NO: 235155 - protein, 9 aa, Homo Sapiens
WTSVSRFVL

SEQ ID NO: 235156 - protein, 9 aa, Homo Sapiens
LNNLTPYVA

SEQ ID NO: 235157 - protein, 9 aa, Homo Sapiens
TKNLLKAAM

SEQ ID NO: 235158 - protein, 9 aa, Homo Sapiens
RPLIYFLRE

SEQ ID NO: 235159 - protein, 9 aa, Homo Sapiens
GDRIHCIDI

SEQ ID NO: 235160 - protein, 9 aa, Homo Sapiens
EWQYYHNKI

SEQ ID NO: 235161 - protein, 9 aa, Homo Sapiens
SFFQKHGKM

SEQ ID NO: 235162 - protein, 9 aa, Homo Sapiens
RETVDKNGR

SEQ ID NO: 235163 - protein, 9 aa, Homo Sapiens
DDQIRGLTK

SEQ ID NO: 235164 - protein, 9 aa, Homo Sapiens
ENVMATKYG

SEQ ID NO: 235165 - protein, 9 aa, Homo Sapiens
YFRVPVRAF

SEQ ID NO: 235166 - protein, 9 aa, Homo Sapiens
PGRLTSHAI

SEQ ID NO: 235167 - protein, 9 aa, Homo Sapiens
QMSYLVETF

SEQ ID NO: 235168 - protein, 9 aa, Homo Sapiens
LHQMGKAFY

SEQ ID NO: 235169 - protein, 9 aa, Homo Sapiens
NYPSTRVMR

SEQ ID NO: 235170 - protein, 9 aa, Homo Sapiens
VDTTPPALA

SEQ ID NO: 235171 - protein, 9 aa, Homo Sapiens
CVASVGVRW

SEQ ID NO: 235172 - protein, 9 aa, Homo Sapiens
VMVIDTNYN

SEQ ID NO: 235173 - protein, 9 aa, Homo Sapiens
NYTHDVVMN

SEQ ID NO: 235174 - protein, 9 aa, Homo Sapiens
FPVNYPTDP

SEQ ID NO: 235175 - protein, 9 aa, Homo Sapiens
VTCSQIIYN

SEQ ID NO: 235176 - protein, 9 aa, Homo Sapiens
FERMNVDKV

SEQ ID NO: 235177 - protein, 9 aa, Homo Sapiens
RNNYKGYAW

SEQ ID NO: 235178 - protein, 9 aa, Homo Sapiens
TAPSGVSIF

SEQ ID NO: 235179 - protein, 9 aa, Homo Sapiens
ISFTMLINN

SEQ ID NO: 235180 - protein, 9 aa, Homo Sapiens
RQVGVSRPG

SEQ ID NO: 235181 - protein, 9 aa, Homo Sapiens
ETMSLYDLD

SEQ ID NO: 235182 - protein, 9 aa, Homo Sapiens
VEWIPPQAK

SEQ ID NO: 235183 - protein, 9 aa, Homo Sapiens
VVDTAVLFL

SEQ ID NO: 235184 - protein, 9 aa, Homo Sapiens
FLKSDIYLH

SEQ ID NO: 235185 - protein, 9 aa, Homo Sapiens
DYSEQYQIR

SEQ ID NO: 235186 - protein, 9 aa, Homo Sapiens
GVCMYHTAK

SEQ ID NO: 235187 - protein, 9 aa, Homo Sapiens
NQKMRPGYG

SEQ ID NO: 235188 - protein, 9 aa, Homo Sapiens
HQCVQLNDG

SEQ ID NO: 235189 - protein, 9 aa, Homo Sapiens
NIDPQPPIE

SEQ ID NO: 235190 - protein, 9 aa, Homo Sapiens
ENKCIHTSS

SEQ ID NO: 235191 - protein, 9 aa, Homo Sapiens
RFLVTYISL

SEQ ID NO: 235192 - protein, 9 aa, Homo Sapiens
LFLTCVSAH

SEQ ID NO: 235193 - protein, 9 aa, Homo Sapiens
TSCSTMYLP

SEQ ID NO: 235194 - protein, 9 aa, Homo Sapiens
HWFRFSTDN

SEQ ID NO: 235195 - protein, 9 aa, Homo Sapiens
HLMQLNMAK

SEQ ID NO: 235196 - protein, 9 aa, Homo Sapiens
REVQDLAGD

SEQ ID NO: 235197 - protein, 9 aa, Homo Sapiens
IPGNLNKVV

SEQ ID NO: 235198 - protein, 9 aa, Homo Sapiens
EKNSHHIRK

SEQ ID NO: 235199 - protein, 9 aa, Homo Sapiens
AGSWKFTKG

SEQ ID NO: 235200 - protein, 9 aa, Homo Sapiens
DPKSKHHTT

SEQ ID NO: 235201 - protein, 9 aa, Homo Sapiens
VLQQMPNFT

SEQ ID NO: 235202 - protein, 9 aa, Homo Sapiens
CTWRQNTNS

SEQ ID NO: 235203 - protein, 9 aa, Homo Sapiens
QTKLECESA

SEQ ID NO: 235204 - protein, 9 aa, Homo Sapiens
GEWVFGGPP

SEQ ID NO: 235205 - protein, 9 aa, Homo Sapiens
VNLKHLDLA

SEQ ID NO: 235206 - protein, 9 aa, Homo Sapiens
YCAFYDKCG

SEQ ID NO: 235207 - protein, 9 aa, Homo Sapiens
IEVECIKAE

SEQ ID NO: 235208 - protein, 9 aa, Homo Sapiens
SLPFIIFGA

SEQ ID NO: 235209 - protein, 9 aa, Homo Sapiens
FIGGVPWDI

SEQ ID NO: 235210 - protein, 9 aa, Homo Sapiens
TCELVRTLN

SEQ ID NO: 235211 - protein, 9 aa, Homo Sapiens
ILTGLCLTL

SEQ ID NO: 235212 - protein, 9 aa, Homo Sapiens
TRKLSTYIQ

SEQ ID NO: 235213 - protein, 9 aa, Homo Sapiens
TLLGRVTIA

SEQ ID NO: 235214 - protein, 9 aa, Homo Sapiens
PPGYQSRYI

SEQ ID NO: 235215 - protein, 9 aa, Homo Sapiens
TPAKINKGG

SEQ ID NO: 235216 - protein, 9 aa, Homo Sapiens
RTEQYLYVR

SEQ ID NO: 235217 - protein, 9 aa, Homo Sapiens
SVAEVVIGL

SEQ ID NO: 235218 - protein, 9 aa, Homo Sapiens
NITDMYKSN

SEQ ID NO: 235219 - protein, 9 aa, Homo Sapiens
ELCRQEVNA

SEQ ID NO: 235220 - protein, 9 aa, Homo Sapiens
AQKGHDTPR

SEQ ID NO: 235221 - protein, 9 aa, Homo Sapiens
FDYYSKLKA

SEQ ID NO: 235222 - protein, 9 aa, Homo Sapiens
GALSQGITA

SEQ ID NO: 235223 - protein, 9 aa, Homo Sapiens
QHISLSTRF

SEQ ID NO: 235224 - protein, 9 aa, Homo Sapiens
WASTIESGY

SEQ ID NO: 235225 - protein, 9 aa, Homo Sapiens
EQQPSTYVG

SEQ ID NO: 235226 - protein, 9 aa, Homo Sapiens
LTCEIKIKQ

SEQ ID NO: 235227 - protein, 9 aa, Homo Sapiens
DKLELFVEE

SEQ ID NO: 235228 - protein, 9 aa, Homo Sapiens
RSHSGKAMR

SEQ ID NO: 235229 - protein, 9 aa, Homo Sapiens
KYPKEDSDI

SEQ ID NO: 235230 - protein, 9 aa, Homo Sapiens
LAGQATPDI

SEQ ID NO: 235231 - protein, 9 aa, Homo Sapiens
GSEDCKLPS

SEQ ID NO: 235232 - protein, 9 aa, Homo Sapiens
LLSFYFGII

SEQ ID NO: 235233 - protein, 9 aa, Homo Sapiens
KSNLDQADV

SEQ ID NO: 235234 - protein, 9 aa, Homo Sapiens
KYAVNSLQL

SEQ ID NO: 235235 - protein, 9 aa, Homo Sapiens
FLLVGDLRA

SEQ ID NO: 235236 - protein, 9 aa, Homo Sapiens
QTLEIHWLS

SEQ ID NO: 235237 - protein, 9 aa, Homo Sapiens
EGNGGYFHP

SEQ ID NO: 235238 - protein, 9 aa, Homo Sapiens
NGVLLFMER

SEQ ID NO: 235239 - protein, 9 aa, Homo Sapiens
LQVCLTKNS

SEQ ID NO: 235240 - protein, 9 aa, Homo Sapiens
RKVLGIKDS

SEQ ID NO: 235241 - protein, 9 aa, Homo Sapiens
AWRSSALYI

SEQ ID NO: 235242 - protein, 9 aa, Homo Sapiens
AKSRKNEEY

SEQ ID NO: 235243 - protein, 9 aa, Homo Sapiens
VAICKQEIE

SEQ ID NO: 235244 - protein, 9 aa, Homo Sapiens
ILTDTSVKI

SEQ ID NO: 235245 - protein, 9 aa, Homo Sapiens
RLVVLQGMQ

SEQ ID NO: 235246 - protein, 9 aa, Homo Sapiens
RAFHYNVNS

SEQ ID NO: 235247 - protein, 9 aa, Homo Sapiens
HDCIIDEDH

SEQ ID NO: 235248 - protein, 9 aa, Homo Sapiens
PPKQAKAVL

SEQ ID NO: 235249 - protein, 9 aa, Homo Sapiens
VGCDHDYVY

SEQ ID NO: 235250 - protein, 9 aa, Homo Sapiens
RDTMPKKGG

SEQ ID NO: 235251 - protein, 9 aa, Homo Sapiens
YLKKNKIHS

SEQ ID NO: 235252 - protein, 9 aa, Homo Sapiens
YNRASSENC

SEQ ID NO: 235253 - protein, 9 aa, Homo Sapiens
GIGIFSVIT

SEQ ID NO: 235254 - protein, 9 aa, Homo Sapiens
VDVETSGIA

SEQ ID NO: 235255 - protein, 9 aa, Homo Sapiens
VLRGFFTIC

SEQ ID NO: 235256 - protein, 9 aa, Homo Sapiens
IPNSMTPAH

SEQ ID NO: 235257 - protein, 9 aa, Homo Sapiens
NPQQLQPGA

SEQ ID NO: 235258 - protein, 9 aa, Homo Sapiens
DLPMQAIKC

SEQ ID NO: 235259 - protein, 9 aa, Homo Sapiens
DKDKEIKAS

SEQ ID NO: 235260 - protein, 9 aa, Homo Sapiens
EQERHKQLE

SEQ ID NO: 235261 - protein, 9 aa, Homo Sapiens
CSLTHLSLA

SEQ ID NO: 235262 - protein, 9 aa, Homo Sapiens
TGFQLNEQL

SEQ ID NO: 235263 - protein, 9 aa, Homo Sapiens
KIQSLMYPA

SEQ ID NO: 235264 - protein, 9 aa, Homo Sapiens
WKARHQHDG

SEQ ID NO: 235265 - protein, 9 aa, Homo Sapiens
QYFNNFIDG

SEQ ID NO: 235266 - protein, 9 aa, Homo Sapiens
SLRISNISL

SEQ ID NO: 235267 - protein, 9 aa, Homo Sapiens
LGVYLLWFL

SEQ ID NO: 235268 - protein, 9 aa, Homo Sapiens
SKCPYLNLF

SEQ ID NO: 235269 - protein, 9 aa, Homo Sapiens
LFRSAQPWI

SEQ ID NO: 235270 - protein, 9 aa, Homo Sapiens
SEGVFKRKK

SEQ ID NO: 235271 - protein, 9 aa, Homo Sapiens
EFMQIPCVD

SEQ ID NO: 235272 - protein, 9 aa, Homo Sapiens
ARRKRRSFS

SEQ ID NO: 235273 - protein, 9 aa, Homo Sapiens
TGVCLSNQG

SEQ ID NO: 235274 - protein, 9 aa, Homo Sapiens
AAVTYLNQC

SEQ ID NO: 235275 - protein, 9 aa, Homo Sapiens
VVERLAKAQ

SEQ ID NO: 235276 - protein, 9 aa, Homo Sapiens
KHAGKISTE

SEQ ID NO: 235277 - protein, 9 aa, Homo Sapiens
EELCDPTEP

SEQ ID NO: 235278 - protein, 9 aa, Homo Sapiens
GYISNYAYA

SEQ ID NO: 235279 - protein, 9 aa, Homo Sapiens
PYSPAGRII

SEQ ID NO: 235280 - protein, 9 aa, Homo Sapiens
RKELRKDKR

SEQ ID NO: 235281 - protein, 9 aa, Homo Sapiens
LKALDPKIY

SEQ ID NO: 235282 - protein, 9 aa, Homo Sapiens
SKGSDLELK

SEQ ID NO: 235283 - protein, 9 aa, Homo Sapiens
HFCLGQLSN

SEQ ID NO: 235284 - protein, 9 aa, Homo Sapiens
QIVKIYVQK

SEQ ID NO: 235285 - protein, 9 aa, Homo Sapiens
VPPPAPQSF

SEQ ID NO: 235286 - protein, 9 aa, Homo Sapiens
KHYLTDAWN

SEQ ID NO: 235287 - protein, 9 aa, Homo Sapiens
KYDADLESK

SEQ ID NO: 235288 - protein, 9 aa, Homo Sapiens
DLINFGRFD

SEQ ID NO: 235289 - protein, 9 aa, Homo Sapiens
KYLFRDFDI

SEQ ID NO: 235290 - protein, 9 aa, Homo Sapiens
DLRRNIQVL

SEQ ID NO: 235291 - protein, 9 aa, Homo Sapiens
NIFVPSSYP

SEQ ID NO: 235292 - protein, 9 aa, Homo Sapiens
SYDSVIALV

SEQ ID NO: 235293 - protein, 9 aa, Homo Sapiens
KFQEEIRQR

SEQ ID NO: 235294 - protein, 9 aa, Homo Sapiens
YDADVTVSI

SEQ ID NO: 235295 - protein, 9 aa, Homo Sapiens
EVDRLLGIL

SEQ ID NO: 235296 - protein, 9 aa, Homo Sapiens
IKWQTSGIF

SEQ ID NO: 235297 - protein, 9 aa, Homo Sapiens
SLPPNTVFK

SEQ ID NO: 235298 - protein, 9 aa, Homo Sapiens
LRVLDQVQV

SEQ ID NO: 235299 - protein, 9 aa, Homo Sapiens
PTLPAGFQN

SEQ ID NO: 235300 - protein, 9 aa, Homo Sapiens
GDACGLQDL

SEQ ID NO: 235301 - protein, 9 aa, Homo Sapiens
FVAELIMNN

SEQ ID NO: 235302 - protein, 9 aa, Homo Sapiens
SVANHQVRT

SEQ ID NO: 235303 - protein, 9 aa, Homo Sapiens
NEQSIRIES

SEQ ID NO: 235304 - protein, 9 aa, Homo Sapiens
DQIIVSYLW

SEQ ID NO: 235305 - protein, 9 aa, Homo Sapiens
SILLGGYLL

SEQ ID NO: 235306 - protein, 9 aa, Homo Sapiens
DASDLKTLL

SEQ ID NO: 235307 - protein, 9 aa, Homo Sapiens
ALIIFNISN

SEQ ID NO: 235308 - protein, 9 aa, Homo Sapiens
SFSSSFQMH

SEQ ID NO: 235309 - protein, 9 aa, Homo Sapiens
KPPTPKRWR

SEQ ID NO: 235310 - protein, 9 aa, Homo Sapiens
IKCDGFYLI

SEQ ID NO: 235311 - protein, 9 aa, Homo Sapiens
GIWIQLDHY

SEQ ID NO: 235312 - protein, 9 aa, Homo Sapiens
LVDEGLVKV

SEQ ID NO: 235313 - protein, 9 aa, Homo Sapiens
EEEKVLEKE

SEQ ID NO: 235314 - protein, 9 aa, Homo Sapiens
WRCCPDFRG

SEQ ID NO: 235315 - protein, 9 aa, Homo Sapiens
HCFVAENSS

SEQ ID NO: 235316 - protein, 9 aa, Homo Sapiens
ENIFQAFLS

SEQ ID NO: 235317 - protein, 9 aa, Homo Sapiens
RSRSKLVSI

SEQ ID NO: 235318 - protein, 9 aa, Homo Sapiens
AVVTAVQRV

SEQ ID NO: 235319 - protein, 9 aa, Homo Sapiens
INVLIAVNM

SEQ ID NO: 235320 - protein, 9 aa, Homo Sapiens
SEHVFLGSE

SEQ ID NO: 235321 - protein, 9 aa, Homo Sapiens
AKIPQKVMW

SEQ ID NO: 235322 - protein, 9 aa, Homo Sapiens
FIHGLIKHF

SEQ ID NO: 235323 - protein, 9 aa, Homo Sapiens
IQVAGAPLI

SEQ ID NO: 235324 - protein, 9 aa, Homo Sapiens
VYALQPLNH

SEQ ID NO: 235325 - protein, 9 aa, Homo Sapiens
EGFVQLYNT

SEQ ID NO: 235326 - protein, 9 aa, Homo Sapiens
HDPSISFSG

SEQ ID NO: 235327 - protein, 9 aa, Homo Sapiens
LISLENFRR

SEQ ID NO: 235328 - protein, 9 aa, Homo Sapiens
VQGNLEIEC

SEQ ID NO: 235329 - protein, 9 aa, Homo Sapiens
LGLLSQTAG

SEQ ID NO: 235330 - protein, 9 aa, Homo Sapiens
FKYSVGVSG

SEQ ID NO: 235331 - protein, 9 aa, Homo Sapiens
ESESNIFER

SEQ ID NO: 235332 - protein, 9 aa, Homo Sapiens
FKIHERTHT

SEQ ID NO: 235333 - protein, 9 aa, Homo Sapiens
SQRLKNGGG

SEQ ID NO: 235334 - protein, 9 aa, Homo Sapiens
GHKIKHFLM

SEQ ID NO: 235335 - protein, 9 aa, Homo Sapiens
LGFTPADTV

SEQ ID NO: 235336 - protein, 9 aa, Homo Sapiens
HKKTFSGAT

SEQ ID NO: 235337 - protein, 9 aa, Homo Sapiens
NYKYFSKEQ

SEQ ID NO: 235338 - protein, 9 aa, Homo Sapiens
TEKKDNAAA

SEQ ID NO: 235339 - protein, 9 aa, Homo Sapiens
GGDDSKLCP

SEQ ID NO: 235340 - protein, 9 aa, Homo Sapiens
TSCNWTKDE

SEQ ID NO: 235341 - protein, 9 aa, Homo Sapiens
VPAWESCRQ

SEQ ID NO: 235342 - protein, 9 aa, Homo Sapiens
FRTCHENTN

SEQ ID NO: 235343 - protein, 9 aa, Homo Sapiens
ASSLQLHQN

SEQ ID NO: 235344 - protein, 9 aa, Homo Sapiens
EEDKGEKEE

SEQ ID NO: 235345 - protein, 9 aa, Homo Sapiens
IPSIITKNL

SEQ ID NO: 235346 - protein, 9 aa, Homo Sapiens
GPAHNSCGI

SEQ ID NO: 235347 - protein, 9 aa, Homo Sapiens
DDCLEWPEY

SEQ ID NO: 235348 - protein, 9 aa, Homo Sapiens
VNHATLAGN

SEQ ID NO: 235349 - protein, 9 aa, Homo Sapiens
NMVKYWKDQ

SEQ ID NO: 235350 - protein, 9 aa, Homo Sapiens
RAPSFLALT

SEQ ID NO: 235351 - protein, 9 aa, Homo Sapiens
SYTCNDCGK

SEQ ID NO: 235352 - protein, 9 aa, Homo Sapiens
VCKKRVEAD

SEQ ID NO: 235353 - protein, 9 aa, Homo Sapiens
NIHTGVKSY

SEQ ID NO: 235354 - protein, 9 aa, Homo Sapiens
LTDPYTIST

SEQ ID NO: 235355 - protein, 9 aa, Homo Sapiens
NGLRRVPDE

SEQ ID NO: 235356 - protein, 9 aa, Homo Sapiens
HRLLKRTPC

SEQ ID NO: 235357 - protein, 9 aa, Homo Sapiens
CCLCRGDSS

SEQ ID NO: 235358 - protein, 9 aa, Homo Sapiens
YSLHRITIK

SEQ ID NO: 235359 - protein, 9 aa, Homo Sapiens
ELVNLIPEY

SEQ ID NO: 235360 - protein, 9 aa, Homo Sapiens
WLDINGNHD

SEQ ID NO: 235361 - protein, 9 aa, Homo Sapiens
ANSMNGRHP

SEQ ID NO: 235362 - protein, 9 aa, Homo Sapiens
VINEGLMDD

SEQ ID NO: 235363 - protein, 9 aa, Homo Sapiens
SVSHLSDLN

SEQ ID NO: 235364 - protein, 9 aa, Homo Sapiens
IAPSQVQHI

SEQ ID NO: 235365 - protein, 9 aa, Homo Sapiens
LIRECQRQQ

SEQ ID NO: 235366 - protein, 9 aa, Homo Sapiens
RLCKLLFCR

SEQ ID NO: 235367 - protein, 9 aa, Homo Sapiens
ESTNLILQF

SEQ ID NO: 235368 - protein, 9 aa, Homo Sapiens
LATGIPSSQ

SEQ ID NO: 235369 - protein, 9 aa, Homo Sapiens
IQNCCGRSR

SEQ ID NO: 235370 - protein, 9 aa, Homo Sapiens
SCIRIHKVM

SEQ ID NO: 235371 - protein, 9 aa, Homo Sapiens
DTNQDDADR

SEQ ID NO: 235372 - protein, 9 aa, Homo Sapiens
KNNDLVCKK

SEQ ID NO: 235373 - protein, 9 aa, Homo Sapiens
LDGTLFHKS

SEQ ID NO: 235374 - protein, 9 aa, Homo Sapiens
SNKKSISYV

SEQ ID NO: 235375 - protein, 9 aa, Homo Sapiens
FRLATRGEI

SEQ ID NO: 235376 - protein, 9 aa, Homo Sapiens
TTTVLNSQA

SEQ ID NO: 235377 - protein, 9 aa, Homo Sapiens
TIVLLLLGL

SEQ ID NO: 235378 - protein, 9 aa, Homo Sapiens
RTGNKSHLR

SEQ ID NO: 235379 - protein, 9 aa, Homo Sapiens
SESVSDHLG

SEQ ID NO: 235380 - protein, 9 aa, Homo Sapiens
PQEDPFIFT

SEQ ID NO: 235381 - protein, 9 aa, Homo Sapiens
HQLFDLYHR

SEQ ID NO: 235382 - protein, 9 aa, Homo Sapiens
YMLPLVLCA

SEQ ID NO: 235383 - protein, 9 aa, Homo Sapiens
DEDYGRDLG

SEQ ID NO: 235384 - protein, 9 aa, Homo Sapiens
FIPTYASTY

SEQ ID NO: 235385 - protein, 9 aa, Homo Sapiens
GCRSREIFA

SEQ ID NO: 235386 - protein, 9 aa, Homo Sapiens
NCLSEVPII

SEQ ID NO: 235387 - protein, 9 aa, Homo Sapiens
QISMCKLGS

SEQ ID NO: 235388 - protein, 9 aa, Homo Sapiens
QLAKEKTQR

SEQ ID NO: 235389 - protein, 9 aa, Homo Sapiens
TLAMCARGG

SEQ ID NO: 235390 - protein, 9 aa, Homo Sapiens
NELAPVGTT

SEQ ID NO: 235391 - protein, 9 aa, Homo Sapiens
ALGFKNVSI

SEQ ID NO: 235392 - protein, 9 aa, Homo Sapiens
PRSPAGPDK

SEQ ID NO: 235393 - protein, 9 aa, Homo Sapiens
GEGFQTVCV

SEQ ID NO: 235394 - protein, 9 aa, Homo Sapiens
LDTKRLSKE

SEQ ID NO: 235395 - protein, 9 aa, Homo Sapiens
YEVNKNVKC

SEQ ID NO: 235396 - protein, 9 aa, Homo Sapiens
KRAKIKEDI

SEQ ID NO: 235397 - protein, 9 aa, Homo Sapiens
FTAQVDKAS

SEQ ID NO: 235398 - protein, 9 aa, Homo Sapiens
PENVETCPA

SEQ ID NO: 235399 - protein, 9 aa, Homo Sapiens
VVKKKTGEC

SEQ ID NO: 235400 - protein, 9 aa, Homo Sapiens
RTRYPEKKI

SEQ ID NO: 235401 - protein, 9 aa, Homo Sapiens
NNFILKVWN

SEQ ID NO: 235402 - protein, 9 aa, Homo Sapiens
IHTGNKPYE

SEQ ID NO: 235403 - protein, 9 aa, Homo Sapiens
NAKEELSAA

SEQ ID NO: 235404 - protein, 9 aa, Homo Sapiens
VISGKQELI

SEQ ID NO: 235405 - protein, 9 aa, Homo Sapiens
LFRTLNPQV

SEQ ID NO: 235406 - protein, 9 aa, Homo Sapiens
ELSRVREFV

SEQ ID NO: 235407 - protein, 9 aa, Homo Sapiens
AFPISLIGY

SEQ ID NO: 235408 - protein, 9 aa, Homo Sapiens
NAPHWSKIG

SEQ ID NO: 235409 - protein, 9 aa, Homo Sapiens
CHRSRLRVP

SEQ ID NO: 235410 - protein, 9 aa, Homo Sapiens
VVTAVQRVA

SEQ ID NO: 235411 - protein, 9 aa, Homo Sapiens
SECGAPRWN

SEQ ID NO: 235412 - protein, 9 aa, Homo Sapiens
TRLLCLLVL

SEQ ID NO: 235413 - protein, 9 aa, Homo Sapiens
FSQRFEFET

SEQ ID NO: 235414 - protein, 9 aa, Homo Sapiens
FYGRILLAV

SEQ ID NO: 235415 - protein, 9 aa, Homo Sapiens
GNFFIFLKI

SEQ ID NO: 235416 - protein, 9 aa, Homo Sapiens
DIYLAKRSV

SEQ ID NO: 235417 - protein, 9 aa, Homo Sapiens
QQVPRLFEE

SEQ ID NO: 235418 - protein, 9 aa, Homo Sapiens
SPGQTSASF

SEQ ID NO: 235419 - protein, 9 aa, Homo Sapiens
NAKIDEKTA

SEQ ID NO: 235420 - protein, 9 aa, Homo Sapiens
QKKVIASRQ

SEQ ID NO: 235421 - protein, 9 aa, Homo Sapiens
SESLCCLCR

SEQ ID NO: 235422 - protein, 9 aa, Homo Sapiens
GPQYSPEVD

SEQ ID NO: 235423 - protein, 9 aa, Homo Sapiens
IKKKIHNFD

SEQ ID NO: 235424 - protein, 9 aa, Homo Sapiens
TVQHLEMVV

SEQ ID NO: 235425 - protein, 9 aa, Homo Sapiens
AFNLRKPVE

SEQ ID NO: 235426 - protein, 9 aa, Homo Sapiens
MFSVCDMSF

SEQ ID NO: 235427 - protein, 9 aa, Homo Sapiens
HKHISIEDI

SEQ ID NO: 235428 - protein, 9 aa, Homo Sapiens
DPFQLDGAE

SEQ ID NO: 235429 - protein, 9 aa, Homo Sapiens
FHPCKKLFY

SEQ ID NO: 235430 - protein, 9 aa, Homo Sapiens
YRRAQRLWP

SEQ ID NO: 235431 - protein, 9 aa, Homo Sapiens
GDSSASSLA

SEQ ID NO: 235432 - protein, 9 aa, Homo Sapiens
PEQIQALHW

SEQ ID NO: 235433 - protein, 9 aa, Homo Sapiens
IKIVKEKNA

SEQ ID NO: 235434 - protein, 9 aa, Homo Sapiens
NTLIALVTS

SEQ ID NO: 235435 - protein, 9 aa, Homo Sapiens
ANMWRQEEK

SEQ ID NO: 235436 - protein, 9 aa, Homo Sapiens
GDFTTSTGS

SEQ ID NO: 235437 - protein, 9 aa, Homo Sapiens
IFRRSKIAV

SEQ ID NO: 235438 - protein, 9 aa, Homo Sapiens
EVQRWKDSW

SEQ ID NO: 235439 - protein, 9 aa, Homo Sapiens
SSKCMMKDF

SEQ ID NO: 235440 - protein, 9 aa, Homo Sapiens
CTQVAKWPV

SEQ ID NO: 235441 - protein, 9 aa, Homo Sapiens
LQPKVRRYF

SEQ ID NO: 235442 - protein, 9 aa, Homo Sapiens
LWDAERAKA

SEQ ID NO: 235443 - protein, 9 aa, Homo Sapiens
SPHIPRFSP

SEQ ID NO: 235444 - protein, 9 aa, Homo Sapiens
VKFLINKKA

SEQ ID NO: 235445 - protein, 9 aa, Homo Sapiens
ENADGRFKG

SEQ ID NO: 235446 - protein, 9 aa, Homo Sapiens
GKPGHYQYT

SEQ ID NO: 235447 - protein, 9 aa, Homo Sapiens
IYSIRDEWI

SEQ ID NO: 235448 - protein, 9 aa, Homo Sapiens
DYIYMNKVT

SEQ ID NO: 235449 - protein, 9 aa, Homo Sapiens
NKSMKGAGT

SEQ ID NO: 235450 - protein, 9 aa, Homo Sapiens
VAIFYTIVI

SEQ ID NO: 235451 - protein, 9 aa, Homo Sapiens
KAKIIMIIG

SEQ ID NO: 235452 - protein, 9 aa, Homo Sapiens
YSLQIQKVD

SEQ ID NO: 235453 - protein, 9 aa, Homo Sapiens
QRYKLGVCL

SEQ ID NO: 235454 - protein, 9 aa, Homo Sapiens
TIGQAKENI

SEQ ID NO: 235455 - protein, 9 aa, Homo Sapiens
RLCGQDLNT

SEQ ID NO: 235456 - protein, 9 aa, Homo Sapiens
KDVLNCNLF

SEQ ID NO: 235457 - protein, 9 aa, Homo Sapiens
SYMELPFRN

SEQ ID NO: 235458 - protein, 9 aa, Homo Sapiens
RASPLSSDY

SEQ ID NO: 235459 - protein, 9 aa, Homo Sapiens
SAIVAVIAR

SEQ ID NO: 235460 - protein, 9 aa, Homo Sapiens
LNKINELTG

SEQ ID NO: 235461 - protein, 9 aa, Homo Sapiens
GTSSTIEAT

SEQ ID NO: 235462 - protein, 9 aa, Homo Sapiens
SYLVQYALL

SEQ ID NO: 235463 - protein, 9 aa, Homo Sapiens
VMPNEMVPL

SEQ ID NO: 235464 - protein, 9 aa, Homo Sapiens
DKAIANVLK

SEQ ID NO: 235465 - protein, 9 aa, Homo Sapiens
CRWDPGWEG

SEQ ID NO: 235466 - protein, 9 aa, Homo Sapiens
EWRCCPDFR

SEQ ID NO: 235467 - protein, 9 aa, Homo Sapiens
QTCFISPYL

SEQ ID NO: 235468 - protein, 9 aa, Homo Sapiens
LGLALCHIA

SEQ ID NO: 235469 - protein, 9 aa, Homo Sapiens
LKEEEASKS

SEQ ID NO: 235470 - protein, 9 aa, Homo Sapiens
CEICNKRYI

SEQ ID NO: 235471 - protein, 9 aa, Homo Sapiens
TEELDLRRN

SEQ ID NO: 235472 - protein, 9 aa, Homo Sapiens
EDPCSLSVD

SEQ ID NO: 235473 - protein, 9 aa, Homo Sapiens
QRNAMYLNN

SEQ ID NO: 235474 - protein, 9 aa, Homo Sapiens
GEQCDNMNK

SEQ ID NO: 235475 - protein, 9 aa, Homo Sapiens
IKKLLKSSQ

SEQ ID NO: 235476 - protein, 9 aa, Homo Sapiens
PAGRIILNI

SEQ ID NO: 235477 - protein, 9 aa, Homo Sapiens
ANSCANPIF

SEQ ID NO: 235478 - protein, 9 aa, Homo Sapiens
KLTTQPKRQ

SEQ ID NO: 235479 - protein, 9 aa, Homo Sapiens
GKKYLMLEE

SEQ ID NO: 235480 - protein, 9 aa, Homo Sapiens
FCCMYIIAV

SEQ ID NO: 235481 - protein, 9 aa, Homo Sapiens
DRRKCQARF

SEQ ID NO: 235482 - protein, 9 aa, Homo Sapiens
DSRYLCSDG

SEQ ID NO: 235483 - protein, 9 aa, Homo Sapiens
TSAVLQDSE

SEQ ID NO: 235484 - protein, 9 aa, Homo Sapiens
IVNSGGLHE

SEQ ID NO: 235485 - protein, 9 aa, Homo Sapiens
ADVTYEKHN

SEQ ID NO: 235486 - protein, 9 aa, Homo Sapiens
NIPKYNVDN

SEQ ID NO: 235487 - protein, 9 aa, Homo Sapiens
SKGESVWLN

SEQ ID NO: 235488 - protein, 9 aa, Homo Sapiens
PQPKPNTRS

SEQ ID NO: 235489 - protein, 9 aa, Homo Sapiens
IIHASFIVA

SEQ ID NO: 235490 - protein, 9 aa, Homo Sapiens
TQKHNTDTV

SEQ ID NO: 235491 - protein, 9 aa, Homo Sapiens
FCGRRNKYM

SEQ ID NO: 235492 - protein, 9 aa, Homo Sapiens
APSEERVYV

SEQ ID NO: 235493 - protein, 9 aa, Homo Sapiens
RMDDEDEGR

SEQ ID NO: 235494 - protein, 9 aa, Homo Sapiens
RIEKQFILY

SEQ ID NO: 235495 - protein, 9 aa, Homo Sapiens
EKEQDMISP

SEQ ID NO: 235496 - protein, 9 aa, Homo Sapiens
CLLGQKRKV

SEQ ID NO: 235497 - protein, 9 aa, Homo Sapiens
RIVKSIEIA

SEQ ID NO: 235498 - protein, 9 aa, Homo Sapiens
AGQAMEIGS

SEQ ID NO: 235499 - protein, 9 aa, Homo Sapiens
PGEWNLNML

SEQ ID NO: 235500 - protein, 9 aa, Homo Sapiens
KPTPKHKEQ

SEQ ID NO: 235501 - protein, 9 aa, Homo Sapiens
VPIYCQCKI

SEQ ID NO: 235502 - protein, 9 aa, Homo Sapiens
HHPEMANKL

SEQ ID NO: 235503 - protein, 9 aa, Homo Sapiens
ILIQTDSHL

SEQ ID NO: 235504 - protein, 9 aa, Homo Sapiens
NKAYRWLSD

SEQ ID NO: 235505 - protein, 9 aa, Homo Sapiens
DPFIFTYAS

SEQ ID NO: 235506 - protein, 9 aa, Homo Sapiens
PALPFMLAD

SEQ ID NO: 235507 - protein, 9 aa, Homo Sapiens
LQNKFYLDQ

SEQ ID NO: 235508 - protein, 9 aa, Homo Sapiens
SKCLSYQGQ

SEQ ID NO: 235509 - protein, 9 aa, Homo Sapiens
SKDKLVCWV

SEQ ID NO: 235510 - protein, 9 aa, Homo Sapiens
SSLNNSANP

SEQ ID NO: 235511 - protein, 9 aa, Homo Sapiens
VIHDWADGK

SEQ ID NO: 235512 - protein, 9 aa, Homo Sapiens
IRWHDNVFT

SEQ ID NO: 235513 - protein, 9 aa, Homo Sapiens
TPRVENQTN

SEQ ID NO: 235514 - protein, 9 aa, Homo Sapiens
SLIIDAATF

SEQ ID NO: 235515 - protein, 9 aa, Homo Sapiens
RMLEKKITS

SEQ ID NO: 235516 - protein, 9 aa, Homo Sapiens
IQKETSHSY

SEQ ID NO: 235517 - protein, 9 aa, Homo Sapiens
NDVDCYLTE

SEQ ID NO: 235518 - protein, 9 aa, Homo Sapiens
KENLELPED

SEQ ID NO: 235519 - protein, 9 aa, Homo Sapiens
SQGLPHPFT

SEQ ID NO: 235520 - protein, 9 aa, Homo Sapiens
QKATKKGEK

SEQ ID NO: 235521 - protein, 9 aa, Homo Sapiens
WWTLPKNFH

SEQ ID NO: 235522 - protein, 9 aa, Homo Sapiens
EAVVTAVQR

SEQ ID NO: 235523 - protein, 9 aa, Homo Sapiens
FYIVPAILM

SEQ ID NO: 235524 - protein, 9 aa, Homo Sapiens
DNLPEALQN

SEQ ID NO: 235525 - protein, 9 aa, Homo Sapiens
KDQDKTDPL

SEQ ID NO: 235526 - protein, 9 aa, Homo Sapiens
DEDTSCSTM

SEQ ID NO: 235527 - protein, 9 aa, Homo Sapiens
RIWMCNTFR

SEQ ID NO: 235528 - protein, 9 aa, Homo Sapiens
EDLAMFQSI

SEQ ID NO: 235529 - protein, 9 aa, Homo Sapiens
KWKVMPLVY

SEQ ID NO: 235530 - protein, 9 aa, Homo Sapiens
DADIHSAIP

SEQ ID NO: 235531 - protein, 9 aa, Homo Sapiens
ILINFLICI

SEQ ID NO: 235532 - protein, 9 aa, Homo Sapiens
DQATAQEIF

SEQ ID NO: 235533 - protein, 9 aa, Homo Sapiens
HRFSNAGQK

SEQ ID NO: 235534 - protein, 9 aa, Homo Sapiens
FQGPDICCR

SEQ ID NO: 235535 - protein, 9 aa, Homo Sapiens
SRLAALQVT

SEQ ID NO: 235536 - protein, 9 aa, Homo Sapiens
LTDREVQLG

SEQ ID NO: 235537 - protein, 9 aa, Homo Sapiens
RWWSPTEGL

SEQ ID NO: 235538 - protein, 9 aa, Homo Sapiens
ENFYHVANW

SEQ ID NO: 235539 - protein, 9 aa, Homo Sapiens
ALICNCDRN

SEQ ID NO: 235540 - protein, 9 aa, Homo Sapiens
HLMKHGYPL

SEQ ID NO: 235541 - protein, 9 aa, Homo Sapiens
FPPSWIAVG

SEQ ID NO: 235542 - protein, 9 aa, Homo Sapiens
IGKQQEKIE

SEQ ID NO: 235543 - protein, 9 aa, Homo Sapiens
RGDSEKLVW

SEQ ID NO: 235544 - protein, 9 aa, Homo Sapiens
ALNTPGENI

SEQ ID NO: 235545 - protein, 9 aa, Homo Sapiens
KNNIMENEY

SEQ ID NO: 235546 - protein, 9 aa, Homo Sapiens
INSICYRMI

SEQ ID NO: 235547 - protein, 9 aa, Homo Sapiens
EQEKQEIAE

SEQ ID NO: 235548 - protein, 9 aa, Homo Sapiens
TARSGGQGG

SEQ ID NO: 235549 - protein, 9 aa, Homo Sapiens
MEDGNIKII

SEQ ID NO: 235550 - protein, 9 aa, Homo Sapiens
DYPLDVNQE

SEQ ID NO: 235551 - protein, 9 aa, Homo Sapiens
EDIWESLEN

SEQ ID NO: 235552 - protein, 9 aa, Homo Sapiens
KEPWWTLPK

SEQ ID NO: 235553 - protein, 9 aa, Homo Sapiens
WLQVALKDV

SEQ ID NO: 235554 - protein, 9 aa, Homo Sapiens
IDNLKDVQN

SEQ ID NO: 235555 - protein, 9 aa, Homo Sapiens
DLEEAVQLQ

SEQ ID NO: 235556 - protein, 9 aa, Homo Sapiens
KPYINSICY

SEQ ID NO: 235557 - protein, 9 aa, Homo Sapiens
NNLTRVTKF

SEQ ID NO: 235558 - protein, 9 aa, Homo Sapiens
IKEYWMDPE

SEQ ID NO: 235559 - protein, 9 aa, Homo Sapiens
APKLQRQYC

SEQ ID NO: 235560 - protein, 9 aa, Homo Sapiens
AHFRAKLAS

SEQ ID NO: 235561 - protein, 9 aa, Homo Sapiens
WTETLILSE

SEQ ID NO: 235562 - protein, 9 aa, Homo Sapiens
FVWSLISEE

SEQ ID NO: 235563 - protein, 9 aa, Homo Sapiens
GNSFGSTPT

SEQ ID NO: 235564 - protein, 9 aa, Homo Sapiens
LNRPDDTAF

SEQ ID NO: 235565 - protein, 9 aa, Homo Sapiens
HIALGSRWL

SEQ ID NO: 235566 - protein, 9 aa, Homo Sapiens
QDSRRRKTE

SEQ ID NO: 235567 - protein, 9 aa, Homo Sapiens
CTAQEIYDC

SEQ ID NO: 235568 - protein, 9 aa, Homo Sapiens
LSMVLVLLL

SEQ ID NO: 235569 - protein, 9 aa, Homo Sapiens
NTFALASHF

SEQ ID NO: 235570 - protein, 9 aa, Homo Sapiens
KTNHDNTPA

SEQ ID NO: 235571 - protein, 9 aa, Homo Sapiens
NGINISPNG

SEQ ID NO: 235572 - protein, 9 aa, Homo Sapiens
MMVPPLPSE

SEQ ID NO: 235573 - protein, 9 aa, Homo Sapiens
IQYKLLDED

SEQ ID NO: 235574 - protein, 9 aa, Homo Sapiens
QKELDSLQN

SEQ ID NO: 235575 - protein, 9 aa, Homo Sapiens
ERSHMPDTR

SEQ ID NO: 235576 - protein, 9 aa, Homo Sapiens
NMLVKLQTA

SEQ ID NO: 235577 - protein, 9 aa, Homo Sapiens
SPTDPKWFG

SEQ ID NO: 235578 - protein, 9 aa, Homo Sapiens
DKAAAWKVL

SEQ ID NO: 235579 - protein, 9 aa, Homo Sapiens
RGPQPSTRK

SEQ ID NO: 235580 - protein, 9 aa, Homo Sapiens
NAVLQQLVV

SEQ ID NO: 235581 - protein, 9 aa, Homo Sapiens
SRCLVIELE

SEQ ID NO: 235582 - protein, 9 aa, Homo Sapiens
LQVYRWVRE

SEQ ID NO: 235583 - protein, 9 aa, Homo Sapiens
VKTRTWSFL

SEQ ID NO: 235584 - protein, 9 aa, Homo Sapiens
REMKRLKKE

SEQ ID NO: 235585 - protein, 9 aa, Homo Sapiens
EKAAEDSNA

SEQ ID NO: 235586 - protein, 9 aa, Homo Sapiens
MVQKMIFYL

SEQ ID NO: 235587 - protein, 9 aa, Homo Sapiens
FRFAPSSAQ

SEQ ID NO: 235588 - protein, 9 aa, Homo Sapiens
YSAYPETKH

SEQ ID NO: 235589 - protein, 9 aa, Homo Sapiens
MSQAKKLLK

SEQ ID NO: 235590 - protein, 9 aa, Homo Sapiens
LNIAQNEQD

SEQ ID NO: 235591 - protein, 9 aa, Homo Sapiens
YLGCNKLAS

SEQ ID NO: 235592 - protein, 9 aa, Homo Sapiens
RRLPRIHAL

SEQ ID NO: 235593 - protein, 9 aa, Homo Sapiens
VYTGGRERT

SEQ ID NO: 235594 - protein, 9 aa, Homo Sapiens
GTNYLANVF

SEQ ID NO: 235595 - protein, 9 aa, Homo Sapiens
RPIQQRVYS

SEQ ID NO: 235596 - protein, 9 aa, Homo Sapiens
IEAIHTFPY

SEQ ID NO: 235597 - protein, 9 aa, Homo Sapiens
VFPALVARL

SEQ ID NO: 235598 - protein, 9 aa, Homo Sapiens
LEGVRSLVR

SEQ ID NO: 235599 - protein, 9 aa, Homo Sapiens
PYTEWNQQL

SEQ ID NO: 235600 - protein, 9 aa, Homo Sapiens
GRQGEKEEY

SEQ ID NO: 235601 - protein, 9 aa, Homo Sapiens
QARDDYKTL

SEQ ID NO: 235602 - protein, 9 aa, Homo Sapiens
NNHNLTSTK

SEQ ID NO: 235603 - protein, 9 aa, Homo Sapiens
VSLTVTPEN

SEQ ID NO: 235604 - protein, 9 aa, Homo Sapiens
LDQADVDHD

SEQ ID NO: 235605 - protein, 9 aa, Homo Sapiens
QSDIKEDTS

SEQ ID NO: 235606 - protein, 9 aa, Homo Sapiens
LMAPTPVSP

SEQ ID NO: 235607 - protein, 9 aa, Homo Sapiens
TEQGKSQRN

SEQ ID NO: 235608 - protein, 9 aa, Homo Sapiens
VLVNGTTIE

SEQ ID NO: 235609 - protein, 9 aa, Homo Sapiens
FNGCRSREI

SEQ ID NO: 235610 - protein, 9 aa, Homo Sapiens
GLLDYINKE

SEQ ID NO: 235611 - protein, 9 aa, Homo Sapiens
TTLGKLMPN

SEQ ID NO: 235612 - protein, 9 aa, Homo Sapiens
KTVSSEGIF

SEQ ID NO: 235613 - protein, 9 aa, Homo Sapiens
VCMYHTAKT

SEQ ID NO: 235614 - protein, 9 aa, Homo Sapiens
GMAVWKTLI

SEQ ID NO: 235615 - protein, 9 aa, Homo Sapiens
KTAMNVNKI

SEQ ID NO: 235616 - protein, 9 aa, Homo Sapiens
GGHFKKSNY

SEQ ID NO: 235617 - protein, 9 aa, Homo Sapiens
NIIGVVGGT

SEQ ID NO: 235618 - protein, 9 aa, Homo Sapiens
VCKSHSKFM

SEQ ID NO: 235619 - protein, 9 aa, Homo Sapiens
TVSATFINS

SEQ ID NO: 235620 - protein, 9 aa, Homo Sapiens
PTQAAVRAA

SEQ ID NO: 235621 - protein, 9 aa, Homo Sapiens
TLILSENYL

SEQ ID NO: 235622 - protein, 9 aa, Homo Sapiens
SITKNCLKH

SEQ ID NO: 235623 - protein, 9 aa, Homo Sapiens
ISVIFSDCQ

SEQ ID NO: 235624 - protein, 9 aa, Homo Sapiens
SNIFERATS

SEQ ID NO: 235625 - protein, 9 aa, Homo Sapiens
LSLAQKYNC

SEQ ID NO: 235626 - protein, 9 aa, Homo Sapiens
NLEQVTHQH

SEQ ID NO: 235627 - protein, 9 aa, Homo Sapiens
FSAFSLIRE

SEQ ID NO: 235628 - protein, 9 aa, Homo Sapiens
QLNAEHAET

SEQ ID NO: 235629 - protein, 9 aa, Homo Sapiens
QPSKVSEGK

SEQ ID NO: 235630 - protein, 9 aa, Homo Sapiens
SYLVETFVS

SEQ ID NO: 235631 - protein, 9 aa, Homo Sapiens
SEAAYHKGR

SEQ ID NO: 235632 - protein, 9 aa, Homo Sapiens
TYSDGGTCQ

SEQ ID NO: 235633 - protein, 9 aa, Homo Sapiens
EQRDAHIFE

SEQ ID NO: 235634 - protein, 9 aa, Homo Sapiens
KNGGGFMFP

SEQ ID NO: 235635 - protein, 9 aa, Homo Sapiens
FGFVLKPKW

SEQ ID NO: 235636 - protein, 9 aa, Homo Sapiens
QIEAKFDEE

SEQ ID NO: 235637 - protein, 9 aa, Homo Sapiens
RVWQLAHQF

SEQ ID NO: 235638 - protein, 9 aa, Homo Sapiens
DKYPKEDSD

SEQ ID NO: 235639 - protein, 9 aa, Homo Sapiens
CFIHDVGLY

SEQ ID NO: 235640 - protein, 9 aa, Homo Sapiens
ASAHLTEPG

SEQ ID NO: 235641 - protein, 9 aa, Homo Sapiens
GVDVMLISL

SEQ ID NO: 235642 - protein, 9 aa, Homo Sapiens
KAAIFCLSA

SEQ ID NO: 235643 - protein, 9 aa, Homo Sapiens
KSCPRVIHL

SEQ ID NO: 235644 - protein, 9 aa, Homo Sapiens
HLLMDQAFW

SEQ ID NO: 235645 - protein, 9 aa, Homo Sapiens
EDWKSKEMQ

SEQ ID NO: 235646 - protein, 9 aa, Homo Sapiens
HSILANIGP

SEQ ID NO: 235647 - protein, 9 aa, Homo Sapiens
TKTLMEITV

SEQ ID NO: 235648 - protein, 9 aa, Homo Sapiens
IQGYPLHLE

SEQ ID NO: 235649 - protein, 9 aa, Homo Sapiens
SVVAYQGFQ

SEQ ID NO: 235650 - protein, 9 aa, Homo Sapiens
PEFEEAYRF

SEQ ID NO: 235651 - protein, 9 aa, Homo Sapiens
VTIPAVMLI

SEQ ID NO: 235652 - protein, 9 aa, Homo Sapiens
TRAAVKNKV

SEQ ID NO: 235653 - protein, 9 aa, Homo Sapiens
SNVQFRWSW

SEQ ID NO: 235654 - protein, 9 aa, Homo Sapiens
VVVFGESIT

SEQ ID NO: 235655 - protein, 9 aa, Homo Sapiens
YALARAFGE

SEQ ID NO: 235656 - protein, 9 aa, Homo Sapiens
AEYSSNWEK

SEQ ID NO: 235657 - protein, 9 aa, Homo Sapiens
KHTGKPSTI

SEQ ID NO: 235658 - protein, 9 aa, Homo Sapiens
QSHFYRSPE

SEQ ID NO: 235659 - protein, 9 aa, Homo Sapiens
LCAATPPAV

SEQ ID NO: 235660 - protein, 9 aa, Homo Sapiens
NKGTVQSKL

SEQ ID NO: 235661 - protein, 9 aa, Homo Sapiens
NGKNHVSNV

SEQ ID NO: 235662 - protein, 9 aa, Homo Sapiens
SSSVTTSEA

SEQ ID NO: 235663 - protein, 9 aa, Homo Sapiens
NSHPITEDE

SEQ ID NO: 235664 - protein, 9 aa, Homo Sapiens
NKRGRRTRQ

SEQ ID NO: 235665 - protein, 9 aa, Homo Sapiens
NVSIKKKMS

SEQ ID NO: 235666 - protein, 9 aa, Homo Sapiens
NPMAEDSDG

SEQ ID NO: 235667 - protein, 9 aa, Homo Sapiens
EARLTNLKY

SEQ ID NO: 235668 - protein, 9 aa, Homo Sapiens
AAMMNITFQ

SEQ ID NO: 235669 - protein, 9 aa, Homo Sapiens
LAEPPHNLI

SEQ ID NO: 235670 - protein, 9 aa, Homo Sapiens
IDECMIMSG

SEQ ID NO: 235671 - protein, 9 aa, Homo Sapiens
IVARCRQPS

SEQ ID NO: 235672 - protein, 9 aa, Homo Sapiens
KFKLLHPDV

SEQ ID NO: 235673 - protein, 9 aa, Homo Sapiens
EPEDNFWMV

SEQ ID NO: 235674 - protein, 9 aa, Homo Sapiens
PLWRVLSFS

SEQ ID NO: 235675 - protein, 9 aa, Homo Sapiens
AINKKFYRK

SEQ ID NO: 235676 - protein, 9 aa, Homo Sapiens
YEQFYSPNI

SEQ ID NO: 235677 - protein, 9 aa, Homo Sapiens
IYKQGKRKN

SEQ ID NO: 235678 - protein, 9 aa, Homo Sapiens
DSNAKIDEK

SEQ ID NO: 235679 - protein, 9 aa, Homo Sapiens
SVKTNIQSS

SEQ ID NO: 235680 - protein, 9 aa, Homo Sapiens
SCVKITILK

SEQ ID NO: 235681 - protein, 9 aa, Homo Sapiens
FFCKTTIVP

SEQ ID NO: 235682 - protein, 9 aa, Homo Sapiens
CQQKKKRLL

SEQ ID NO: 235683 - protein, 9 aa, Homo Sapiens
KTFRLNYQL

SEQ ID NO: 235684 - protein, 9 aa, Homo Sapiens
MKDLKDMLG

SEQ ID NO: 235685 - protein, 9 aa, Homo Sapiens
GEYFQKAAQ

SEQ ID NO: 235686 - protein, 9 aa, Homo Sapiens
EALQSNDTI

SEQ ID NO: 235687 - protein, 9 aa, Homo Sapiens
QAFSLLQSR

SEQ ID NO: 235688 - protein, 9 aa, Homo Sapiens
QGHIFALNW

SEQ ID NO: 235689 - protein, 9 aa, Homo Sapiens
PPYQISMCK

SEQ ID NO: 235690 - protein, 9 aa, Homo Sapiens
PASNRTWTD

SEQ ID NO: 235691 - protein, 9 aa, Homo Sapiens
TIILPLTGG

SEQ ID NO: 235692 - protein, 9 aa, Homo Sapiens
MFQKEQREL

SEQ ID NO: 235693 - protein, 9 aa, Homo Sapiens
LIPVNYVKI

SEQ ID NO: 235694 - protein, 9 aa, Homo Sapiens
AFSQEMSQL

SEQ ID NO: 235695 - protein, 9 aa, Homo Sapiens
PGYLQIVRF

SEQ ID NO: 235696 - protein, 9 aa, Homo Sapiens
KITNLRLKF

SEQ ID NO: 235697 - protein, 9 aa, Homo Sapiens
RCDPKPGAK

SEQ ID NO: 235698 - protein, 9 aa, Homo Sapiens
FKSCSQSSD

SEQ ID NO: 235699 - protein, 9 aa, Homo Sapiens
RPNSGPAWG

SEQ ID NO: 235700 - protein, 9 aa, Homo Sapiens
AEPDGSNQT

SEQ ID NO: 235701 - protein, 9 aa, Homo Sapiens
QLMEPVNRD

SEQ ID NO: 235702 - protein, 9 aa, Homo Sapiens
GIGWHLDEK

SEQ ID NO: 235703 - protein, 9 aa, Homo Sapiens
PDFVPNEKK

SEQ ID NO: 235704 - protein, 9 aa, Homo Sapiens
AARIIDSND

SEQ ID NO: 235705 - protein, 9 aa, Homo Sapiens
RTPIFGGQP

SEQ ID NO: 235706 - protein, 9 aa, Homo Sapiens
VLRVVQNFE

SEQ ID NO: 235707 - protein, 9 aa, Homo Sapiens
LTKVVVYGS

SEQ ID NO: 235708 - protein, 9 aa, Homo Sapiens
DAFNNFPFL

SEQ ID NO: 235709 - protein, 9 aa, Homo Sapiens
MVVPDLSEL

SEQ ID NO: 235710 - protein, 9 aa, Homo Sapiens
YSGQILTCL

SEQ ID NO: 235711 - protein, 9 aa, Homo Sapiens
ENYSQQLQV

SEQ ID NO: 235712 - protein, 9 aa, Homo Sapiens
LNLSLTTRT

SEQ ID NO: 235713 - protein, 9 aa, Homo Sapiens
SKHHTTSTS

SEQ ID NO: 235714 - protein, 9 aa, Homo Sapiens
SGLEDVSRV

SEQ ID NO: 235715 - protein, 9 aa, Homo Sapiens
INNCINALK

SEQ ID NO: 235716 - protein, 9 aa, Homo Sapiens
NISGSIEVV

SEQ ID NO: 235717 - protein, 9 aa, Homo Sapiens
AGDLGTEQP

SEQ ID NO: 235718 - protein, 9 aa, Homo Sapiens
ALAYHVARI

SEQ ID NO: 235719 - protein, 9 aa, Homo Sapiens
LEKFFLRSG

SEQ ID NO: 235720 - protein, 9 aa, Homo Sapiens
NKEGKRSIR

SEQ ID NO: 235721 - protein, 9 aa, Homo Sapiens
AANLRNLAT

SEQ ID NO: 235722 - protein, 9 aa, Homo Sapiens
AIQRWYMRF

SEQ ID NO: 235723 - protein, 9 aa, Homo Sapiens
IQFLSKLSE

SEQ ID NO: 235724 - protein, 9 aa, Homo Sapiens
KFQEIKMCG

SEQ ID NO: 235725 - protein, 9 aa, Homo Sapiens
HQHGYRIQI

SEQ ID NO: 235726 - protein, 9 aa, Homo Sapiens
LIPEEPRKK

SEQ ID NO: 235727 - protein, 9 aa, Homo Sapiens
IDNTLNPDC

SEQ ID NO: 235728 - protein, 9 aa, Homo Sapiens
LVVVKLLNA

SEQ ID NO: 235729 - protein, 9 aa, Homo Sapiens
TEVQSLCTI

SEQ ID NO: 235730 - protein, 9 aa, Homo Sapiens
FRNAIFPNG

SEQ ID NO: 235731 - protein, 9 aa, Homo Sapiens
TKKGEWPPA

SEQ ID NO: 235732 - protein, 9 aa, Homo Sapiens
RTAFRVFDK

SEQ ID NO: 235733 - protein, 9 aa, Homo Sapiens
YQHLLSCSF

SEQ ID NO: 235734 - protein, 9 aa, Homo Sapiens
WFECTLDDS

SEQ ID NO: 235735 - protein, 9 aa, Homo Sapiens
GHFSDTPEF

SEQ ID NO: 235736 - protein, 9 aa, Homo Sapiens
SQLGRCSVS

SEQ ID NO: 235737 - protein, 9 aa, Homo Sapiens
AIKILDREE

SEQ ID NO: 235738 - protein, 9 aa, Homo Sapiens
SEDPEAEVK

SEQ ID NO: 235739 - protein, 9 aa, Homo Sapiens
METLCKNDS

SEQ ID NO: 235740 - protein, 9 aa, Homo Sapiens
SQPKELFER

SEQ ID NO: 235741 - protein, 9 aa, Homo Sapiens
WGSKEMGTS

SEQ ID NO: 235742 - protein, 9 aa, Homo Sapiens
KEAGLKCAT

SEQ ID NO: 235743 - protein, 9 aa, Homo Sapiens
NLQKGVRRK

SEQ ID NO: 235744 - protein, 9 aa, Homo Sapiens
ALRSRIRFI

SEQ ID NO: 235745 - protein, 9 aa, Homo Sapiens
APAHANTGS

SEQ ID NO: 235746 - protein, 9 aa, Homo Sapiens
APLCLYVVA

SEQ ID NO: 235747 - protein, 9 aa, Homo Sapiens
FYALLFISS

SEQ ID NO: 235748 - protein, 9 aa, Homo Sapiens
KQEIAERVR

SEQ ID NO: 235749 - protein, 9 aa, Homo Sapiens
LDYLDFARY

SEQ ID NO: 235750 - protein, 9 aa, Homo Sapiens
EGNKSRSAQ

SEQ ID NO: 235751 - protein, 9 aa, Homo Sapiens
ISVKDHRTS

SEQ ID NO: 235752 - protein, 9 aa, Homo Sapiens
VDNLNDTRK

SEQ ID NO: 235753 - protein, 9 aa, Homo Sapiens
TVALACSLA

SEQ ID NO: 235754 - protein, 9 aa, Homo Sapiens
KEQTETHKS

SEQ ID NO: 235755 - protein, 9 aa, Homo Sapiens
MFIKDANLT

SEQ ID NO: 235756 - protein, 9 aa, Homo Sapiens
ASWGQRLET

SEQ ID NO: 235757 - protein, 9 aa, Homo Sapiens
TPGSHNLET

SEQ ID NO: 235758 - protein, 9 aa, Homo Sapiens
NQIYRIFEQ

SEQ ID NO: 235759 - protein, 9 aa, Homo Sapiens
IIGNNTIRG

SEQ ID NO: 235760 - protein, 9 aa, Homo Sapiens
WITQGQPLE

SEQ ID NO: 235761 - protein, 9 aa, Homo Sapiens
LLGRTLHQS

SEQ ID NO: 235762 - protein, 9 aa, Homo Sapiens
SQNDLAVAY

SEQ ID NO: 235763 - protein, 9 aa, Homo Sapiens
TCYSSTLTF

SEQ ID NO: 235764 - protein, 9 aa, Homo Sapiens
FGGSGSKQL

SEQ ID NO: 235765 - protein, 9 aa, Homo Sapiens
KNDGDMHSS

SEQ ID NO: 235766 - protein, 9 aa, Homo Sapiens
QQSLSWWPL

SEQ ID NO: 235767 - protein, 9 aa, Homo Sapiens
PNSYYELYM

SEQ ID NO: 235768 - protein, 9 aa, Homo Sapiens
HFNLYMFRN

SEQ ID NO: 235769 - protein, 9 aa, Homo Sapiens
KRNMLNAGQ

SEQ ID NO: 235770 - protein, 9 aa, Homo Sapiens
GLWNNNEKD

SEQ ID NO: 235771 - protein, 9 aa, Homo Sapiens
SNESAEYSS

SEQ ID NO: 235772 - protein, 9 aa, Homo Sapiens
DPNLFKMIK

SEQ ID NO: 235773 - protein, 9 aa, Homo Sapiens
VFPDILDPQ

SEQ ID NO: 235774 - protein, 9 aa, Homo Sapiens
DNLEAVKSK

SEQ ID NO: 235775 - protein, 9 aa, Homo Sapiens
PWGKAACLS

SEQ ID NO: 235776 - protein, 9 aa, Homo Sapiens
NSATGIFAG

SEQ ID NO: 235777 - protein, 9 aa, Homo Sapiens
ISKDVLAGR

SEQ ID NO: 235778 - protein, 9 aa, Homo Sapiens
KVMQHILNP

SEQ ID NO: 235779 - protein, 9 aa, Homo Sapiens
RETAIMDDL

SEQ ID NO: 235780 - protein, 9 aa, Homo Sapiens
AVSIHQVKT

SEQ ID NO: 235781 - protein, 9 aa, Homo Sapiens
DEPFQSTEN

SEQ ID NO: 235782 - protein, 9 aa, Homo Sapiens
LPATKLPLE

SEQ ID NO: 235783 - protein, 9 aa, Homo Sapiens
YMSYDSYPH

SEQ ID NO: 235784 - protein, 9 aa, Homo Sapiens
GVFLAIYPI

SEQ ID NO: 235785 - protein, 9 aa, Homo Sapiens
TRKKRERHL

SEQ ID NO: 235786 - protein, 9 aa, Homo Sapiens
LCFILDKSG

SEQ ID NO: 235787 - protein, 9 aa, Homo Sapiens
EDKPSQISV

SEQ ID NO: 235788 - protein, 9 aa, Homo Sapiens
LQIQQQTPQ

SEQ ID NO: 235789 - protein, 9 aa, Homo Sapiens
DYNSGNYGD

SEQ ID NO: 235790 - protein, 9 aa, Homo Sapiens
TLVKMNRII

SEQ ID NO: 235791 - protein, 9 aa, Homo Sapiens
VPPATIWTS

SEQ ID NO: 235792 - protein, 9 aa, Homo Sapiens
LCNWMMCVR

SEQ ID NO: 235793 - protein, 9 aa, Homo Sapiens
VARISDPKL

SEQ ID NO: 235794 - protein, 9 aa, Homo Sapiens
KVKCASCIL

SEQ ID NO: 235795 - protein, 9 aa, Homo Sapiens
TKAKLFIKE

SEQ ID NO: 235796 - protein, 9 aa, Homo Sapiens
ENYSKLVSM

SEQ ID NO: 235797 - protein, 9 aa, Homo Sapiens
RSRLDKSLQ

SEQ ID NO: 235798 - protein, 9 aa, Homo Sapiens
MLPNDPLPR

SEQ ID NO: 235799 - protein, 9 aa, Homo Sapiens
QQEEDGLEF

SEQ ID NO: 235800 - protein, 9 aa, Homo Sapiens
ILDQKSNGL

SEQ ID NO: 235801 - protein, 9 aa, Homo Sapiens
QEESERATS

SEQ ID NO: 235802 - protein, 9 aa, Homo Sapiens
LVLPEEAHC

SEQ ID NO: 235803 - protein, 9 aa, Homo Sapiens
YDIVNNMFF

SEQ ID NO: 235804 - protein, 9 aa, Homo Sapiens
SLESIRPSS

SEQ ID NO: 235805 - protein, 9 aa, Homo Sapiens
RIKKLLVSI

SEQ ID NO: 235806 - protein, 9 aa, Homo Sapiens
RTNSGEKPY

SEQ ID NO: 235807 - protein, 9 aa, Homo Sapiens
SSEKPTLQA

SEQ ID NO: 235808 - protein, 9 aa, Homo Sapiens
KELRKCRKI

SEQ ID NO: 235809 - protein, 9 aa, Homo Sapiens
GCMIQTYLY

SEQ ID NO: 235810 - protein, 9 aa, Homo Sapiens
IDWLHVKNV

SEQ ID NO: 235811 - protein, 9 aa, Homo Sapiens
VCSGKAPPK

SEQ ID NO: 235812 - protein, 9 aa, Homo Sapiens
DNCRLVPSP

SEQ ID NO: 235813 - protein, 9 aa, Homo Sapiens
SFNSAFRPS

SEQ ID NO: 235814 - protein, 9 aa, Homo Sapiens
KSFGCNSTI

SEQ ID NO: 235815 - protein, 9 aa, Homo Sapiens
IHGEKTKTP

SEQ ID NO: 235816 - protein, 9 aa, Homo Sapiens
ELVPDINLL

SEQ ID NO: 235817 - protein, 9 aa, Homo Sapiens
DWKRANIIF

SEQ ID NO: 235818 - protein, 9 aa, Homo Sapiens
TKTQMDDKK

SEQ ID NO: 235819 - protein, 9 aa, Homo Sapiens
KVLFRFCVV

SEQ ID NO: 235820 - protein, 9 aa, Homo Sapiens
QLAKDFKDI

SEQ ID NO: 235821 - protein, 9 aa, Homo Sapiens
TTELKLSPF

SEQ ID NO: 235822 - protein, 9 aa, Homo Sapiens
AFIQWLRRK

SEQ ID NO: 235823 - protein, 9 aa, Homo Sapiens
SGAQRSASE

SEQ ID NO: 235824 - protein, 9 aa, Homo Sapiens
CGTSFSHKR

SEQ ID NO: 235825 - protein, 9 aa, Homo Sapiens
TVALNQLKK

SEQ ID NO: 235826 - protein, 9 aa, Homo Sapiens
NKKRPPQRP

SEQ ID NO: 235827 - protein, 9 aa, Homo Sapiens
DAEINKIIS

SEQ ID NO: 235828 - protein, 9 aa, Homo Sapiens
SLYKHFNSP

SEQ ID NO: 235829 - protein, 9 aa, Homo Sapiens
INKKANLNA

SEQ ID NO: 235830 - protein, 9 aa, Homo Sapiens
NYDTNLTHL

SEQ ID NO: 235831 - protein, 9 aa, Homo Sapiens
SAAYLVCLA

SEQ ID NO: 235832 - protein, 9 aa, Homo Sapiens
QEVAWQGLE

SEQ ID NO: 235833 - protein, 9 aa, Homo Sapiens
DLNDLIMEG

SEQ ID NO: 235834 - protein, 9 aa, Homo Sapiens
TTTSLEKVY

SEQ ID NO: 235835 - protein, 9 aa, Homo Sapiens
RCQTADADS

SEQ ID NO: 235836 - protein, 9 aa, Homo Sapiens
GKVLIDIKE

SEQ ID NO: 235837 - protein, 9 aa, Homo Sapiens
VFRSGSKLI

SEQ ID NO: 235838 - protein, 9 aa, Homo Sapiens
KVVDLLSNI

SEQ ID NO: 235839 - protein, 9 aa, Homo Sapiens
PHGCVSGPS

SEQ ID NO: 235840 - protein, 9 aa, Homo Sapiens
MKKLPLLNG

SEQ ID NO: 235841 - protein, 9 aa, Homo Sapiens
GLVTSPLFI

SEQ ID NO: 235842 - protein, 9 aa, Homo Sapiens
FWESGNWSH

SEQ ID NO: 235843 - protein, 9 aa, Homo Sapiens
TSARRKLLV

SEQ ID NO: 235844 - protein, 9 aa, Homo Sapiens
EGTGNATGE

SEQ ID NO: 235845 - protein, 9 aa, Homo Sapiens
FGESITASL

SEQ ID NO: 235846 - protein, 9 aa, Homo Sapiens
AGKKCRILA

SEQ ID NO: 235847 - protein, 9 aa, Homo Sapiens
AFCDLVWSA

SEQ ID NO: 235848 - protein, 9 aa, Homo Sapiens
EATEMLQNN

SEQ ID NO: 235849 - protein, 9 aa, Homo Sapiens
GCNSTIIKH

SEQ ID NO: 235850 - protein, 9 aa, Homo Sapiens
GVALSDLST

SEQ ID NO: 235851 - protein, 9 aa, Homo Sapiens
KIKGSVYET

SEQ ID NO: 235852 - protein, 9 aa, Homo Sapiens
MALEEHLIL

SEQ ID NO: 235853 - protein, 9 aa, Homo Sapiens
GSLHFAVQT

SEQ ID NO: 235854 - protein, 9 aa, Homo Sapiens
EQVKRFKAN

SEQ ID NO: 235855 - protein, 9 aa, Homo Sapiens
LSNPLSGSR

SEQ ID NO: 235856 - protein, 9 aa, Homo Sapiens
HLKYFVNMN

SEQ ID NO: 235857 - protein, 9 aa, Homo Sapiens
LGWAIMHVS

SEQ ID NO: 235858 - protein, 9 aa, Homo Sapiens
LHQKDTFHD

SEQ ID NO: 235859 - protein, 9 aa, Homo Sapiens
PTPVCGREA

SEQ ID NO: 235860 - protein, 9 aa, Homo Sapiens
IVMQIIDVS

SEQ ID NO: 235861 - protein, 9 aa, Homo Sapiens
SDAKENFYH

SEQ ID NO: 235862 - protein, 9 aa, Homo Sapiens
AVWKTLIPP

SEQ ID NO: 235863 - protein, 9 aa, Homo Sapiens
HALQDKKAH

SEQ ID NO: 235864 - protein, 9 aa, Homo Sapiens
ELLRKHNLI

SEQ ID NO: 235865 - protein, 9 aa, Homo Sapiens
GEEEKYATV

SEQ ID NO: 235866 - protein, 9 aa, Homo Sapiens
YLNYSNPMN

SEQ ID NO: 235867 - protein, 9 aa, Homo Sapiens
NVVTLSGTR

SEQ ID NO: 235868 - protein, 9 aa, Homo Sapiens
YMRHLAGLL

SEQ ID NO: 235869 - protein, 9 aa, Homo Sapiens
APAMTSHLI

SEQ ID NO: 235870 - protein, 9 aa, Homo Sapiens
LQNSFNSAF

SEQ ID NO: 235871 - protein, 9 aa, Homo Sapiens
VMMEAFLLA

SEQ ID NO: 235872 - protein, 9 aa, Homo Sapiens
KQIKEGCLK

SEQ ID NO: 235873 - protein, 9 aa, Homo Sapiens
MGYHVSQQQ

SEQ ID NO: 235874 - protein, 9 aa, Homo Sapiens
VPVLHLISS

SEQ ID NO: 235875 - protein, 9 aa, Homo Sapiens
QLPPKPALE

SEQ ID NO: 235876 - protein, 9 aa, Homo Sapiens
IKDTFISNE

SEQ ID NO: 235877 - protein, 9 aa, Homo Sapiens
SQCLNPIKD

SEQ ID NO: 235878 - protein, 9 aa, Homo Sapiens
NTALLNKAE

SEQ ID NO: 235879 - protein, 9 aa, Homo Sapiens
YQESCVDTT

SEQ ID NO: 235880 - protein, 9 aa, Homo Sapiens
YTGLMGETK

SEQ ID NO: 235881 - protein, 9 aa, Homo Sapiens
RYVSPEDIK

SEQ ID NO: 235882 - protein, 9 aa, Homo Sapiens
THSSPEMPT

SEQ ID NO: 235883 - protein, 9 aa, Homo Sapiens
ILFFVALGG

SEQ ID NO: 235884 - protein, 9 aa, Homo Sapiens
PIIPKLLDL

SEQ ID NO: 235885 - protein, 9 aa, Homo Sapiens
SLENSLSYD

SEQ ID NO: 235886 - protein, 9 aa, Homo Sapiens
DICCREHDR

SEQ ID NO: 235887 - protein, 9 aa, Homo Sapiens
VQLITGVNF

SEQ ID NO: 235888 - protein, 9 aa, Homo Sapiens
KEQDMISPV

SEQ ID NO: 235889 - protein, 9 aa, Homo Sapiens
KRYPGIQLT

SEQ ID NO: 235890 - protein, 9 aa, Homo Sapiens
NSVASGSSV

SEQ ID NO: 235891 - protein, 9 aa, Homo Sapiens
VEARRFFSK

SEQ ID NO: 235892 - protein, 9 aa, Homo Sapiens
NNTTVIYNS

SEQ ID NO: 235893 - protein, 9 aa, Homo Sapiens
TKVTLAKSR

SEQ ID NO: 235894 - protein, 9 aa, Homo Sapiens
FKVLMLAYA

SEQ ID NO: 235895 - protein, 9 aa, Homo Sapiens
AVNDEIEAN

SEQ ID NO: 235896 - protein, 9 aa, Homo Sapiens
SQRLEEENG

SEQ ID NO: 235897 - protein, 9 aa, Homo Sapiens
TGLMGETKV

SEQ ID NO: 235898 - protein, 9 aa, Homo Sapiens
TLGNTVYFT

SEQ ID NO: 235899 - protein, 9 aa, Homo Sapiens
EKEHAHLKE

SEQ ID NO: 235900 - protein, 9 aa, Homo Sapiens
EAQSNRGIL

SEQ ID NO: 235901 - protein, 9 aa, Homo Sapiens
KIWSVTRRD

SEQ ID NO: 235902 - protein, 9 aa, Homo Sapiens
LRWRSDSAQ

SEQ ID NO: 235903 - protein, 9 aa, Homo Sapiens
GFPCVRLLP

SEQ ID NO: 235904 - protein, 9 aa, Homo Sapiens
NSPWAVKKI

SEQ ID NO: 235905 - protein, 9 aa, Homo Sapiens
AVQMDKPQN

SEQ ID NO: 235906 - protein, 9 aa, Homo Sapiens
VALGTSIIC

SEQ ID NO: 235907 - protein, 9 aa, Homo Sapiens
KTDNMVNHR

SEQ ID NO: 235908 - protein, 9 aa, Homo Sapiens
ISGPGFKLL

SEQ ID NO: 235909 - protein, 9 aa, Homo Sapiens
LSLKNDHNS

SEQ ID NO: 235910 - protein, 9 aa, Homo Sapiens
IFGGQPLDI

SEQ ID NO: 235911 - protein, 9 aa, Homo Sapiens
LPFSARPCV

SEQ ID NO: 235912 - protein, 9 aa, Homo Sapiens
TDHLQSQVE

SEQ ID NO: 235913 - protein, 9 aa, Homo Sapiens
DNKCKVLGI

SEQ ID NO: 235914 - protein, 9 aa, Homo Sapiens
LKATKLGLF

SEQ ID NO: 235915 - protein, 9 aa, Homo Sapiens
YSDCGIGEV

SEQ ID NO: 235916 - protein, 9 aa, Homo Sapiens
GTSIICNKI

SEQ ID NO: 235917 - protein, 9 aa, Homo Sapiens
NKSSNEDKI

SEQ ID NO: 235918 - protein, 9 aa, Homo Sapiens
WSVVTQSLL

SEQ ID NO: 235919 - protein, 9 aa, Homo Sapiens
TGIIDYGIC

SEQ ID NO: 235920 - protein, 9 aa, Homo Sapiens
IMCWECCEY

SEQ ID NO: 235921 - protein, 9 aa, Homo Sapiens
EFNHNYRIR

SEQ ID NO: 235922 - protein, 9 aa, Homo Sapiens
ARLIPHGPM

SEQ ID NO: 235923 - protein, 9 aa, Homo Sapiens
RERKKLLDI

SEQ ID NO: 235924 - protein, 9 aa, Homo Sapiens
HIRKNADDS

SEQ ID NO: 235925 - protein, 9 aa, Homo Sapiens
QVSEGVSAL

SEQ ID NO: 235926 - protein, 9 aa, Homo Sapiens
LCKAGLEAQ

SEQ ID NO: 235927 - protein, 9 aa, Homo Sapiens
YDEQSTYDQ

SEQ ID NO: 235928 - protein, 9 aa, Homo Sapiens
LFDNLVYYI

SEQ ID NO: 235929 - protein, 9 aa, Homo Sapiens
QIIATCNHS

SEQ ID NO: 235930 - protein, 9 aa, Homo Sapiens
NMWRQEEKI

SEQ ID NO: 235931 - protein, 9 aa, Homo Sapiens
HPYKCKECG

SEQ ID NO: 235932 - protein, 9 aa, Homo Sapiens
GNIMQTLKK

SEQ ID NO: 235933 - protein, 9 aa, Homo Sapiens
LTQIFFFHC

SEQ ID NO: 235934 - protein, 9 aa, Homo Sapiens
NALQNQSQK

SEQ ID NO: 235935 - protein, 9 aa, Homo Sapiens
IAVGVHKVG

SEQ ID NO: 235936 - protein, 9 aa, Homo Sapiens
VERDLKKSE

SEQ ID NO: 235937 - protein, 9 aa, Homo Sapiens
KHSGVDNMV

SEQ ID NO: 235938 - protein, 9 aa, Homo Sapiens
QEPDPGVHY

SEQ ID NO: 235939 - protein, 9 aa, Homo Sapiens
HAWKLHNKS

SEQ ID NO: 235940 - protein, 9 aa, Homo Sapiens
NLGFTPADT

SEQ ID NO: 235941 - protein, 9 aa, Homo Sapiens
ICKYNADLL

SEQ ID NO: 235942 - protein, 9 aa, Homo Sapiens
YFKAGNCFF

SEQ ID NO: 235943 - protein, 9 aa, Homo Sapiens
KSDMYLEYT

SEQ ID NO: 235944 - protein, 9 aa, Homo Sapiens
VLAHPPQDG

SEQ ID NO: 235945 - protein, 9 aa, Homo Sapiens
TLTDDFSYG

SEQ ID NO: 235946 - protein, 9 aa, Homo Sapiens
LGAMDVSEF

SEQ ID NO: 235947 - protein, 9 aa, Homo Sapiens
KRMNISPAK

SEQ ID NO: 235948 - protein, 9 aa, Homo Sapiens
NLFQSVRKV

SEQ ID NO: 235949 - protein, 9 aa, Homo Sapiens
TDMYKSNNY

SEQ ID NO: 235950 - protein, 9 aa, Homo Sapiens
IPSEDFITP

SEQ ID NO: 235951 - protein, 9 aa, Homo Sapiens
CKWCTNCPK

SEQ ID NO: 235952 - protein, 9 aa, Homo Sapiens
KKGPQVTAC

SEQ ID NO: 235953 - protein, 9 aa, Homo Sapiens
IRSFPLLRY

SEQ ID NO: 235954 - protein, 9 aa, Homo Sapiens
TSIQTGYMP

SEQ ID NO: 235955 - protein, 9 aa, Homo Sapiens
YFAILRKET

SEQ ID NO: 235956 - protein, 9 aa, Homo Sapiens
SGDAGPIVA

SEQ ID NO: 235957 - protein, 9 aa, Homo Sapiens
VSSVEALQE

SEQ ID NO: 235958 - protein, 9 aa, Homo Sapiens
LLEGEVDDE

SEQ ID NO: 235959 - protein, 9 aa, Homo Sapiens
PKNVPPDIQ

SEQ ID NO: 235960 - protein, 9 aa, Homo Sapiens
AKIIMIIGN

SEQ ID NO: 235961 - protein, 9 aa, Homo Sapiens
LSEDGDGHM

SEQ ID NO: 235962 - protein, 9 aa, Homo Sapiens
ACVLLFSIS

SEQ ID NO: 235963 - protein, 9 aa, Homo Sapiens
LLPAVLHTL

SEQ ID NO: 235964 - protein, 9 aa, Homo Sapiens
LKGKSERSP

SEQ ID NO: 235965 - protein, 9 aa, Homo Sapiens
MKLPDISAT

SEQ ID NO: 235966 - protein, 9 aa, Homo Sapiens
CKEQRDAHI

SEQ ID NO: 235967 - protein, 9 aa, Homo Sapiens
SILYNKFFD

SEQ ID NO: 235968 - protein, 9 aa, Homo Sapiens
SVKKNISEY

SEQ ID NO: 235969 - protein, 9 aa, Homo Sapiens
GVDKITQFW

SEQ ID NO: 235970 - protein, 9 aa, Homo Sapiens
EIIDLYKMK

SEQ ID NO: 235971 - protein, 9 aa, Homo Sapiens
KMKDLQDLM

SEQ ID NO: 235972 - protein, 9 aa, Homo Sapiens
IYPITLAGN

SEQ ID NO: 235973 - protein, 9 aa, Homo Sapiens
VSTVLLKKE

SEQ ID NO: 235974 - protein, 9 aa, Homo Sapiens
EKTPNRLKH

SEQ ID NO: 235975 - protein, 9 aa, Homo Sapiens
FITLLDVNY

SEQ ID NO: 235976 - protein, 9 aa, Homo Sapiens
SLRLLAGAA

SEQ ID NO: 235977 - protein, 9 aa, Homo Sapiens
QYRYARIYI

SEQ ID NO: 235978 - protein, 9 aa, Homo Sapiens
ALRRGYSFL

SEQ ID NO: 235979 - protein, 9 aa, Homo Sapiens
KLTSNELDD

SEQ ID NO: 235980 - protein, 9 aa, Homo Sapiens
DEILQAVSK

SEQ ID NO: 235981 - protein, 9 aa, Homo Sapiens
NMKTQFKET

SEQ ID NO: 235982 - protein, 9 aa, Homo Sapiens
ALQATGFQL

SEQ ID NO: 235983 - protein, 9 aa, Homo Sapiens
WQLERLVSH

SEQ ID NO: 235984 - protein, 9 aa, Homo Sapiens
LSPFGQWWA

SEQ ID NO: 235985 - protein, 9 aa, Homo Sapiens
PPATIWTSS

SEQ ID NO: 235986 - protein, 9 aa, Homo Sapiens
PPPRYKQFS

SEQ ID NO: 235987 - protein, 9 aa, Homo Sapiens
PSVHEYYDP

SEQ ID NO: 235988 - protein, 9 aa, Homo Sapiens
AKIVYLPEC

SEQ ID NO: 235989 - protein, 9 aa, Homo Sapiens
VKRLEWKNK

SEQ ID NO: 235990 - protein, 9 aa, Homo Sapiens
YPVVIKLSD

SEQ ID NO: 235991 - protein, 9 aa, Homo Sapiens
KMMKLLKNK

SEQ ID NO: 235992 - protein, 9 aa, Homo Sapiens
GGNVEDQLR

SEQ ID NO: 235993 - protein, 9 aa, Homo Sapiens
ERGIGDINI

SEQ ID NO: 235994 - protein, 9 aa, Homo Sapiens
HCILLRCVS

SEQ ID NO: 235995 - protein, 9 aa, Homo Sapiens
VCIPRFLLT

SEQ ID NO: 235996 - protein, 9 aa, Homo Sapiens
KVLNKRILN

SEQ ID NO: 235997 - protein, 9 aa, Homo Sapiens
KDAQEYASK

SEQ ID NO: 235998 - protein, 9 aa, Homo Sapiens
LTKAKIIMI

SEQ ID NO: 235999 - protein, 9 aa, Homo Sapiens
GYRTLPINS

SEQ ID NO: 236000 - protein, 9 aa, Homo Sapiens
LSPTPKEVV

SEQ ID NO: 236001 - protein, 9 aa, Homo Sapiens
AETDLEKRD

SEQ ID NO: 236002 - protein, 9 aa, Homo Sapiens
ALSDVVNYT

SEQ ID NO: 236003 - protein, 9 aa, Homo Sapiens
VLWGLLDQG

SEQ ID NO: 236004 - protein, 9 aa, Homo Sapiens
CMFCHPSFR

SEQ ID NO: 236005 - protein, 9 aa, Homo Sapiens
CIVSRNFGS

SEQ ID NO: 236006 - protein, 9 aa, Homo Sapiens
VISYLTERF

SEQ ID NO: 236007 - protein, 9 aa, Homo Sapiens
LRSAESDQL

SEQ ID NO: 236008 - protein, 9 aa, Homo Sapiens
QIFFFHCIW

SEQ ID NO: 236009 - protein, 9 aa, Homo Sapiens
STEGSDITT

SEQ ID NO: 236010 - protein, 9 aa, Homo Sapiens
MLFNRRRKR

SEQ ID NO: 236011 - protein, 9 aa, Homo Sapiens
INPTEKSRQ

SEQ ID NO: 236012 - protein, 9 aa, Homo Sapiens
DLESEIPED

SEQ ID NO: 236013 - protein, 9 aa, Homo Sapiens
LYKDVMLDN

SEQ ID NO: 236014 - protein, 9 aa, Homo Sapiens
SLLEENETL

SEQ ID NO: 236015 - protein, 9 aa, Homo Sapiens
QKLDLPGHL

SEQ ID NO: 236016 - protein, 9 aa, Homo Sapiens
RNRITVTGS

SEQ ID NO: 236017 - protein, 9 aa, Homo Sapiens
VYRLDDYDR

SEQ ID NO: 236018 - protein, 9 aa, Homo Sapiens
GQRMPQYCL

SEQ ID NO: 236019 - protein, 9 aa, Homo Sapiens
TDILGITQA

SEQ ID NO: 236020 - protein, 9 aa, Homo Sapiens
PISVKQDIT

SEQ ID NO: 236021 - protein, 9 aa, Homo Sapiens
PQNAQLVYN

SEQ ID NO: 236022 - protein, 9 aa, Homo Sapiens
HEKQVYNAA

SEQ ID NO: 236023 - protein, 9 aa, Homo Sapiens
NSASPEQNK

SEQ ID NO: 236024 - protein, 9 aa, Homo Sapiens
EMKRLKKEK

SEQ ID NO: 236025 - protein, 9 aa, Homo Sapiens
LPLPVPPSK

SEQ ID NO: 236026 - protein, 9 aa, Homo Sapiens
ENGEEHTLA

SEQ ID NO: 236027 - protein, 9 aa, Homo Sapiens
GPPCTIITS

SEQ ID NO: 236028 - protein, 9 aa, Homo Sapiens
SDRATKNTA

SEQ ID NO: 236029 - protein, 9 aa, Homo Sapiens
DRIIVCYLV

SEQ ID NO: 236030 - protein, 9 aa, Homo Sapiens
VTQQSFNFA

SEQ ID NO: 236031 - protein, 9 aa, Homo Sapiens
VLGLVHAFK

SEQ ID NO: 236032 - protein, 9 aa, Homo Sapiens
DLMERKLAQ

SEQ ID NO: 236033 - protein, 9 aa, Homo Sapiens
KIIQSIIHQ

SEQ ID NO: 236034 - protein, 9 aa, Homo Sapiens
MITNVGKKQ

SEQ ID NO: 236035 - protein, 9 aa, Homo Sapiens
GERVEQYSR

SEQ ID NO: 236036 - protein, 9 aa, Homo Sapiens
EGTSQRDDA

SEQ ID NO: 236037 - protein, 9 aa, Homo Sapiens
RIILNIKWL

SEQ ID NO: 236038 - protein, 9 aa, Homo Sapiens
DMYGECTMQ

SEQ ID NO: 236039 - protein, 9 aa, Homo Sapiens
GMGVIPRIV

SEQ ID NO: 236040 - protein, 9 aa, Homo Sapiens
MNREYTRNA

SEQ ID NO: 236041 - protein, 9 aa, Homo Sapiens
YQAKDVIEE

SEQ ID NO: 236042 - protein, 9 aa, Homo Sapiens
IAAAKILWD

SEQ ID NO: 236043 - protein, 9 aa, Homo Sapiens
LKSWWATTY

SEQ ID NO: 236044 - protein, 9 aa, Homo Sapiens
SKRVIYLQG

SEQ ID NO: 236045 - protein, 9 aa, Homo Sapiens
DLTSIYEIK

SEQ ID NO: 236046 - protein, 9 aa, Homo Sapiens
ELLLDVNED

SEQ ID NO: 236047 - protein, 9 aa, Homo Sapiens
FKITEDGRS

SEQ ID NO: 236048 - protein, 9 aa, Homo Sapiens
VLQGLLHII

SEQ ID NO: 236049 - protein, 9 aa, Homo Sapiens
GVPQLSLYK

SEQ ID NO: 236050 - protein, 9 aa, Homo Sapiens
TEQYLYVRL

SEQ ID NO: 236051 - protein, 9 aa, Homo Sapiens
HGMDMSVIL

SEQ ID NO: 236052 - protein, 9 aa, Homo Sapiens
TQEWERILY

SEQ ID NO: 236053 - protein, 9 aa, Homo Sapiens
NSRYSRCHS

SEQ ID NO: 236054 - protein, 9 aa, Homo Sapiens
RSTYLSALV

SEQ ID NO: 236055 - protein, 9 aa, Homo Sapiens
RSLLGHPDN

SEQ ID NO: 236056 - protein, 9 aa, Homo Sapiens
LISCPGRDS

SEQ ID NO: 236057 - protein, 9 aa, Homo Sapiens
ENITPERDS

SEQ ID NO: 236058 - protein, 9 aa, Homo Sapiens
KDETDKEKD

SEQ ID NO: 236059 - protein, 9 aa, Homo Sapiens
SQIKNEEIA

SEQ ID NO: 236060 - protein, 9 aa, Homo Sapiens
GIFGGLSQV

SEQ ID NO: 236061 - protein, 9 aa, Homo Sapiens
KPASESPSS

SEQ ID NO: 236062 - protein, 9 aa, Homo Sapiens
KLADASESE

SEQ ID NO: 236063 - protein, 9 aa, Homo Sapiens
GSDTFTYVF

SEQ ID NO: 236064 - protein, 9 aa, Homo Sapiens
AVELRRNSR

SEQ ID NO: 236065 - protein, 9 aa, Homo Sapiens
ERLRRRKVH

SEQ ID NO: 236066 - protein, 9 aa, Homo Sapiens
PNTVFKDKV

SEQ ID NO: 236067 - protein, 9 aa, Homo Sapiens
SLSPTSSFS

SEQ ID NO: 236068 - protein, 9 aa, Homo Sapiens
SLLYLFPLL

SEQ ID NO: 236069 - protein, 9 aa, Homo Sapiens
SKLLYIYGA

SEQ ID NO: 236070 - protein, 9 aa, Homo Sapiens
NPTSTQTSN

SEQ ID NO: 236071 - protein, 9 aa, Homo Sapiens
QKYSVTSKT

SEQ ID NO: 236072 - protein, 9 aa, Homo Sapiens
PARWTPIGM

SEQ ID NO: 236073 - protein, 9 aa, Homo Sapiens
NITLHCEAR

SEQ ID NO: 236074 - protein, 9 aa, Homo Sapiens
EINIFLQQL

SEQ ID NO: 236075 - protein, 9 aa, Homo Sapiens
TCAESMATE

SEQ ID NO: 236076 - protein, 9 aa, Homo Sapiens
PPEGRRGVT

SEQ ID NO: 236077 - protein, 9 aa, Homo Sapiens
HMLVALGEC

SEQ ID NO: 236078 - protein, 9 aa, Homo Sapiens
ENALIGQYV

SEQ ID NO: 236079 - protein, 9 aa, Homo Sapiens
MERKVEESL

SEQ ID NO: 236080 - protein, 9 aa, Homo Sapiens
QCGKAFRYL

SEQ ID NO: 236081 - protein, 9 aa, Homo Sapiens
NAKLQQQLP

SEQ ID NO: 236082 - protein, 9 aa, Homo Sapiens
LLSPSAVEL

SEQ ID NO: 236083 - protein, 9 aa, Homo Sapiens
ALSVCNSAP

SEQ ID NO: 236084 - protein, 9 aa, Homo Sapiens
KPSKVEEDE

SEQ ID NO: 236085 - protein, 9 aa, Homo Sapiens
NAPFWTIKL

SEQ ID NO: 236086 - protein, 9 aa, Homo Sapiens
QREERISEF

SEQ ID NO: 236087 - protein, 9 aa, Homo Sapiens
QPMLIEYFT

SEQ ID NO: 236088 - protein, 9 aa, Homo Sapiens
NEDDDVFFG

SEQ ID NO: 236089 - protein, 9 aa, Homo Sapiens
HSSTNELTT

SEQ ID NO: 236090 - protein, 9 aa, Homo Sapiens
VEIRKQVLK

SEQ ID NO: 236091 - protein, 9 aa, Homo Sapiens
EKGMDYEVY

SEQ ID NO: 236092 - protein, 9 aa, Homo Sapiens
NHTHVLYHT

SEQ ID NO: 236093 - protein, 9 aa, Homo Sapiens
EPNLSQKPR

SEQ ID NO: 236094 - protein, 9 aa, Homo Sapiens
TLHVIGGTD

SEQ ID NO: 236095 - protein, 9 aa, Homo Sapiens
LVLYVVIAK

SEQ ID NO: 236096 - protein, 9 aa, Homo Sapiens
SRFIFQLKA

SEQ ID NO: 236097 - protein, 9 aa, Homo Sapiens
WANRPYVPY

SEQ ID NO: 236098 - protein, 9 aa, Homo Sapiens
AEKGRKALE

SEQ ID NO: 236099 - protein, 9 aa, Homo Sapiens
NLDCRERVV

SEQ ID NO: 236100 - protein, 9 aa, Homo Sapiens
VLEQVAEFE

SEQ ID NO: 236101 - protein, 9 aa, Homo Sapiens
FQTLLFKRV

SEQ ID NO: 236102 - protein, 9 aa, Homo Sapiens
ERVEQYSRK

SEQ ID NO: 236103 - protein, 9 aa, Homo Sapiens
EYGLGNPPP

SEQ ID NO: 236104 - protein, 9 aa, Homo Sapiens
KFKLENQDS

SEQ ID NO: 236105 - protein, 9 aa, Homo Sapiens
LPPVTDFRE

SEQ ID NO: 236106 - protein, 9 aa, Homo Sapiens
TAPEICTSP

SEQ ID NO: 236107 - protein, 9 aa, Homo Sapiens
MVLPFSAIY

SEQ ID NO: 236108 - protein, 9 aa, Homo Sapiens
CSDKLLSLQ

SEQ ID NO: 236109 - protein, 9 aa, Homo Sapiens
SPHENEYDN

SEQ ID NO: 236110 - protein, 9 aa, Homo Sapiens
MMFYPPPRE

SEQ ID NO: 236111 - protein, 9 aa, Homo Sapiens
SLLIDTFQN

SEQ ID NO: 236112 - protein, 9 aa, Homo Sapiens
NIGMKGLIF

SEQ ID NO: 236113 - protein, 9 aa, Homo Sapiens
DVKMLLGQF

SEQ ID NO: 236114 - protein, 9 aa, Homo Sapiens
GLCPSETPI

SEQ ID NO: 236115 - protein, 9 aa, Homo Sapiens
SSPTSRMEP

SEQ ID NO: 236116 - protein, 9 aa, Homo Sapiens
NVSTSKPEV

SEQ ID NO: 236117 - protein, 9 aa, Homo Sapiens
HVQAGQSLE

SEQ ID NO: 236118 - protein, 9 aa, Homo Sapiens
YIQYLKSVQ

SEQ ID NO: 236119 - protein, 9 aa, Homo Sapiens
HISQLELTP

SEQ ID NO: 236120 - protein, 9 aa, Homo Sapiens
NLNQETSNF

SEQ ID NO: 236121 - protein, 9 aa, Homo Sapiens
DLNDNYPSF

SEQ ID NO: 236122 - protein, 9 aa, Homo Sapiens
DENNVFGSK

SEQ ID NO: 236123 - protein, 9 aa, Homo Sapiens
GLHAFLLAS

SEQ ID NO: 236124 - protein, 9 aa, Homo Sapiens
ICYTVVVVP

SEQ ID NO: 236125 - protein, 9 aa, Homo Sapiens
GEKMVLNFT

SEQ ID NO: 236126 - protein, 9 aa, Homo Sapiens
EFLPRHNSD

SEQ ID NO: 236127 - protein, 9 aa, Homo Sapiens
WQTSLTIPL

SEQ ID NO: 236128 - protein, 9 aa, Homo Sapiens
IILAVAKKA

SEQ ID NO: 236129 - protein, 9 aa, Homo Sapiens
AVKEAIAAG

SEQ ID NO: 236130 - protein, 9 aa, Homo Sapiens
KLAQYVGSF

SEQ ID NO: 236131 - protein, 9 aa, Homo Sapiens
NILNMVFNL

SEQ ID NO: 236132 - protein, 9 aa, Homo Sapiens
HPTLLAGHP

SEQ ID NO: 236133 - protein, 9 aa, Homo Sapiens
FAEIYDPSL

SEQ ID NO: 236134 - protein, 9 aa, Homo Sapiens
SRLLKRSFS

SEQ ID NO: 236135 - protein, 9 aa, Homo Sapiens
GLLAGPSSD

SEQ ID NO: 236136 - protein, 9 aa, Homo Sapiens
FNKNFVPVS

SEQ ID NO: 236137 - protein, 9 aa, Homo Sapiens
KYAFELFDT

SEQ ID NO: 236138 - protein, 9 aa, Homo Sapiens
KVTYMEAST

SEQ ID NO: 236139 - protein, 9 aa, Homo Sapiens
PPSLYMSPE

SEQ ID NO: 236140 - protein, 9 aa, Homo Sapiens
LLKRTPCPA

SEQ ID NO: 236141 - protein, 9 aa, Homo Sapiens
MVKYWKDQH

SEQ ID NO: 236142 - protein, 9 aa, Homo Sapiens
TNAFSAFVG

SEQ ID NO: 236143 - protein, 9 aa, Homo Sapiens
DAHIFEKIS

SEQ ID NO: 236144 - protein, 9 aa, Homo Sapiens
IKELETLLE

SEQ ID NO: 236145 - protein, 9 aa, Homo Sapiens
NEIHKNGKG

SEQ ID NO: 236146 - protein, 9 aa, Homo Sapiens
HSEEVKTQE

SEQ ID NO: 236147 - protein, 9 aa, Homo Sapiens
IVLIFLLNF

SEQ ID NO: 236148 - protein, 9 aa, Homo Sapiens
QRLSFDYRV

SEQ ID NO: 236149 - protein, 9 aa, Homo Sapiens
SYPNYDALV

SEQ ID NO: 236150 - protein, 9 aa, Homo Sapiens
PTKQEMKKA

SEQ ID NO: 236151 - protein, 9 aa, Homo Sapiens
ENKEKKRIK

SEQ ID NO: 236152 - protein, 9 aa, Homo Sapiens
LLILGKLFL

SEQ ID NO: 236153 - protein, 9 aa, Homo Sapiens
IQWLRRKRM

SEQ ID NO: 236154 - protein, 9 aa, Homo Sapiens
SKSPKTMKT

SEQ ID NO: 236155 - protein, 9 aa, Homo Sapiens
GQEVAVLET

SEQ ID NO: 236156 - protein, 9 aa, Homo Sapiens
VSNVIKKVK

SEQ ID NO: 236157 - protein, 9 aa, Homo Sapiens
PDVMLDKII

SEQ ID NO: 236158 - protein, 9 aa, Homo Sapiens
HIHEISCKS

SEQ ID NO: 236159 - protein, 9 aa, Homo Sapiens
GNDFLQLLL

SEQ ID NO: 236160 - protein, 9 aa, Homo Sapiens
FGGTDIFLL

SEQ ID NO: 236161 - protein, 9 aa, Homo Sapiens
AKFKKMCDL

SEQ ID NO: 236162 - protein, 9 aa, Homo Sapiens
LKQKGVKVS

SEQ ID NO: 236163 - protein, 9 aa, Homo Sapiens
CTESQSCKL

SEQ ID NO: 236164 - protein, 9 aa, Homo Sapiens
SLASCAKAK

SEQ ID NO: 236165 - protein, 9 aa, Homo Sapiens
RFLAAVQQP

SEQ ID NO: 236166 - protein, 9 aa, Homo Sapiens
QPPFLYPGP

SEQ ID NO: 236167 - protein, 9 aa, Homo Sapiens
RVHTADKPY

SEQ ID NO: 236168 - protein, 9 aa, Homo Sapiens
AALDNKLPV

SEQ ID NO: 236169 - protein, 9 aa, Homo Sapiens
GNGSETTGV

SEQ ID NO: 236170 - protein, 9 aa, Homo Sapiens
SENSKVFDG

SEQ ID NO: 236171 - protein, 9 aa, Homo Sapiens
QEYRTLSGI

SEQ ID NO: 236172 - protein, 9 aa, Homo Sapiens
QEYEKGKQN

SEQ ID NO: 236173 - protein, 9 aa, Homo Sapiens
HIQEIQHDQ

SEQ ID NO: 236174 - protein, 9 aa, Homo Sapiens
GGQHRNGIN

SEQ ID NO: 236175 - protein, 9 aa, Homo Sapiens
EIFDNINFQ

SEQ ID NO: 236176 - protein, 9 aa, Homo Sapiens
IVGILTYRG

SEQ ID NO: 236177 - protein, 9 aa, Homo Sapiens
EEVKTQEER

SEQ ID NO: 236178 - protein, 9 aa, Homo Sapiens
SSFQRHMIT

SEQ ID NO: 236179 - protein, 9 aa, Homo Sapiens
SQASKQPPP

SEQ ID NO: 236180 - protein, 9 aa, Homo Sapiens
FASHFSLGF

SEQ ID NO: 236181 - protein, 9 aa, Homo Sapiens
IREVCRVLR

SEQ ID NO: 236182 - protein, 9 aa, Homo Sapiens
AQVAPIMSP

SEQ ID NO: 236183 - protein, 9 aa, Homo Sapiens
PLGDIMPIS

SEQ ID NO: 236184 - protein, 9 aa, Homo Sapiens
FFCETNLDT

SEQ ID NO: 236185 - protein, 9 aa, Homo Sapiens
REQIVKIYV

SEQ ID NO: 236186 - protein, 9 aa, Homo Sapiens
SAVTDRCLQ

SEQ ID NO: 236187 - protein, 9 aa, Homo Sapiens
HALRWRSDS

SEQ ID NO: 236188 - protein, 9 aa, Homo Sapiens
GGNIIRVSA

SEQ ID NO: 236189 - protein, 9 aa, Homo Sapiens
EKKNDHAYR

SEQ ID NO: 236190 - protein, 9 aa, Homo Sapiens
QWDNIYHAL

SEQ ID NO: 236191 - protein, 9 aa, Homo Sapiens
DLSATVRTV

SEQ ID NO: 236192 - protein, 9 aa, Homo Sapiens
VHEDEVLAF

SEQ ID NO: 236193 - protein, 9 aa, Homo Sapiens
KPPLPCAPG

SEQ ID NO: 236194 - protein, 9 aa, Homo Sapiens
KRFLARVSP

SEQ ID NO: 236195 - protein, 9 aa, Homo Sapiens
CSGPFMGQR

SEQ ID NO: 236196 - protein, 9 aa, Homo Sapiens
SFKVLQGCW

SEQ ID NO: 236197 - protein, 9 aa, Homo Sapiens
SESQKIEIR

SEQ ID NO: 236198 - protein, 9 aa, Homo Sapiens
KYIYIGSEA

SEQ ID NO: 236199 - protein, 9 aa, Homo Sapiens
NKMYKDKYT

SEQ ID NO: 236200 - protein, 9 aa, Homo Sapiens
DFDSKPHLP

SEQ ID NO: 236201 - protein, 9 aa, Homo Sapiens
LLCYQLQKW

SEQ ID NO: 236202 - protein, 9 aa, Homo Sapiens
SYIKDFLSK

SEQ ID NO: 236203 - protein, 9 aa, Homo Sapiens
STEMQLMAI

SEQ ID NO: 236204 - protein, 9 aa, Homo Sapiens
SGQQQSDYG

SEQ ID NO: 236205 - protein, 9 aa, Homo Sapiens
LEKNFNNFP

SEQ ID NO: 236206 - protein, 9 aa, Homo Sapiens
QFRAVLGKV

SEQ ID NO: 236207 - protein, 9 aa, Homo Sapiens
SGTDEERPD

SEQ ID NO: 236208 - protein, 9 aa, Homo Sapiens
YTGGRERTE

SEQ ID NO: 236209 - protein, 9 aa, Homo Sapiens
LSYLTKHKI

SEQ ID NO: 236210 - protein, 9 aa, Homo Sapiens
NKRCARHYK

SEQ ID NO: 236211 - protein, 9 aa, Homo Sapiens
SKPKASLNI

SEQ ID NO: 236212 - protein, 9 aa, Homo Sapiens
GRWQQSLSW

SEQ ID NO: 236213 - protein, 9 aa, Homo Sapiens
LLNIIKLKE

SEQ ID NO: 236214 - protein, 9 aa, Homo Sapiens
QKHSEEVKT

SEQ ID NO: 236215 - protein, 9 aa, Homo Sapiens
RPAGNRLGD

SEQ ID NO: 236216 - protein, 9 aa, Homo Sapiens
QTKNVYIEL

SEQ ID NO: 236217 - protein, 9 aa, Homo Sapiens
STPAKNIDT

SEQ ID NO: 236218 - protein, 9 aa, Homo Sapiens
DFHLSHVIS

SEQ ID NO: 236219 - protein, 9 aa, Homo Sapiens
DFKKKYGDE

SEQ ID NO: 236220 - protein, 9 aa, Homo Sapiens
NFEYLTRNS

SEQ ID NO: 236221 - protein, 9 aa, Homo Sapiens
DNEHGVASM

SEQ ID NO: 236222 - protein, 9 aa, Homo Sapiens
LVRLLLNNL

SEQ ID NO: 236223 - protein, 9 aa, Homo Sapiens
YRFSGSPLH

SEQ ID NO: 236224 - protein, 9 aa, Homo Sapiens
EIKVLQGCN

SEQ ID NO: 236225 - protein, 9 aa, Homo Sapiens
CLTLWAAYR

SEQ ID NO: 236226 - protein, 9 aa, Homo Sapiens
CLQYISLGF

SEQ ID NO: 236227 - protein, 9 aa, Homo Sapiens
LLQTATLIE

SEQ ID NO: 236228 - protein, 9 aa, Homo Sapiens
LKDAQEYAS

SEQ ID NO: 236229 - protein, 9 aa, Homo Sapiens
VPRLLTEEI

SEQ ID NO: 236230 - protein, 9 aa, Homo Sapiens
SQRFEFETT

SEQ ID NO: 236231 - protein, 9 aa, Homo Sapiens
ISTFQQALK

SEQ ID NO: 236232 - protein, 9 aa, Homo Sapiens
DKLGEDDKT

SEQ ID NO: 236233 - protein, 9 aa, Homo Sapiens
VPVIRYKDV

SEQ ID NO: 236234 - protein, 9 aa, Homo Sapiens
ELVERLERA

SEQ ID NO: 236235 - protein, 9 aa, Homo Sapiens
NAANLRNLA

SEQ ID NO: 236236 - protein, 9 aa, Homo Sapiens
TGIPSSQVK

SEQ ID NO: 236237 - protein, 9 aa, Homo Sapiens
LSLEMKCQK

SEQ ID NO: 236238 - protein, 9 aa, Homo Sapiens
FARGKRNGK

SEQ ID NO: 236239 - protein, 9 aa, Homo Sapiens
PKANTPVHL

SEQ ID NO: 236240 - protein, 9 aa, Homo Sapiens
ITDDWDRKR

SEQ ID NO: 236241 - protein, 9 aa, Homo Sapiens
SVINKVTDK

SEQ ID NO: 236242 - protein, 9 aa, Homo Sapiens
EKPTLQAKS

SEQ ID NO: 236243 - protein, 9 aa, Homo Sapiens
LFKESTCIN

SEQ ID NO: 236244 - protein, 9 aa, Homo Sapiens
IFTPCFNYM

SEQ ID NO: 236245 - protein, 9 aa, Homo Sapiens
VMFTLGGSE

SEQ ID NO: 236246 - protein, 9 aa, Homo Sapiens
RLILTVAQH

SEQ ID NO: 236247 - protein, 9 aa, Homo Sapiens
VRIYISRLK

SEQ ID NO: 236248 - protein, 9 aa, Homo Sapiens
KPENILCVQ

SEQ ID NO: 236249 - protein, 9 aa, Homo Sapiens
LIQSQVQQL

SEQ ID NO: 236250 - protein, 9 aa, Homo Sapiens
IQLSLKNDH

SEQ ID NO: 236251 - protein, 9 aa, Homo Sapiens
KKAMMEAGW

SEQ ID NO: 236252 - protein, 9 aa, Homo Sapiens
EQLVKAERK

SEQ ID NO: 236253 - protein, 9 aa, Homo Sapiens
QRSQTALSK

SEQ ID NO: 236254 - protein, 9 aa, Homo Sapiens
WFGHIKGWL

SEQ ID NO: 236255 - protein, 9 aa, Homo Sapiens
TDGSYRCQC

SEQ ID NO: 236256 - protein, 9 aa, Homo Sapiens
IILSALVQF

SEQ ID NO: 236257 - protein, 9 aa, Homo Sapiens
KVVAQSLVF

SEQ ID NO: 236258 - protein, 9 aa, Homo Sapiens
RYWQNILVD

SEQ ID NO: 236259 - protein, 9 aa, Homo Sapiens
NTMIENLKR

SEQ ID NO: 236260 - protein, 9 aa, Homo Sapiens
WNTLPKYYI

SEQ ID NO: 236261 - protein, 9 aa, Homo Sapiens
TLFASHFSL

SEQ ID NO: 236262 - protein, 9 aa, Homo Sapiens
WLVAFAHGN

SEQ ID NO: 236263 - protein, 9 aa, Homo Sapiens
EPSSHPDKP

SEQ ID NO: 236264 - protein, 9 aa, Homo Sapiens
GGAVEGRVA

SEQ ID NO: 236265 - protein, 9 aa, Homo Sapiens
ANDIKWQTS

SEQ ID NO: 236266 - protein, 9 aa, Homo Sapiens
LNSIHFIIL

SEQ ID NO: 236267 - protein, 9 aa, Homo Sapiens
SRQPTGPKD

SEQ ID NO: 236268 - protein, 9 aa, Homo Sapiens
EVIKGREKT

SEQ ID NO: 236269 - protein, 9 aa, Homo Sapiens
KAVKLCPSK

SEQ ID NO: 236270 - protein, 9 aa, Homo Sapiens
ELPLCSRCH

SEQ ID NO: 236271 - protein, 9 aa, Homo Sapiens
IKKGPQVTA

SEQ ID NO: 236272 - protein, 9 aa, Homo Sapiens
SLLEAKQTT

SEQ ID NO: 236273 - protein, 9 aa, Homo Sapiens
PALRKSNSP

SEQ ID NO: 236274 - protein, 9 aa, Homo Sapiens
ISDRLQIPW

SEQ ID NO: 236275 - protein, 9 aa, Homo Sapiens
GSSGCCENL

SEQ ID NO: 236276 - protein, 9 aa, Homo Sapiens
QIVDHSHLE

SEQ ID NO: 236277 - protein, 9 aa, Homo Sapiens
GQHRNGINT

SEQ ID NO: 236278 - protein, 9 aa, Homo Sapiens
VSGALISDF

SEQ ID NO: 236279 - protein, 9 aa, Homo Sapiens
LKGQHEAAL

SEQ ID NO: 236280 - protein, 9 aa, Homo Sapiens
EIYGDTISL

SEQ ID NO: 236281 - protein, 9 aa, Homo Sapiens
LIAGGNVED

SEQ ID NO: 236282 - protein, 9 aa, Homo Sapiens
GTGLRMMIF

SEQ ID NO: 236283 - protein, 9 aa, Homo Sapiens
PLEDIKARP

SEQ ID NO: 236284 - protein, 9 aa, Homo Sapiens
YSSKTELLF

SEQ ID NO: 236285 - protein, 9 aa, Homo Sapiens
SKEREKTRE

SEQ ID NO: 236286 - protein, 9 aa, Homo Sapiens
KKLELTKMR

SEQ ID NO: 236287 - protein, 9 aa, Homo Sapiens
EDELVNEAL

SEQ ID NO: 236288 - protein, 9 aa, Homo Sapiens
IPRCIKEED

SEQ ID NO: 236289 - protein, 9 aa, Homo Sapiens
LLLTSTEKA

SEQ ID NO: 236290 - protein, 9 aa, Homo Sapiens
ETDERDLTN

SEQ ID NO: 236291 - protein, 9 aa, Homo Sapiens
MYDLSTNTQ

SEQ ID NO: 236292 - protein, 9 aa, Homo Sapiens
VLEFDFLTV

SEQ ID NO: 236293 - protein, 9 aa, Homo Sapiens
LTPAHVSRV

SEQ ID NO: 236294 - protein, 9 aa, Homo Sapiens
GKSTHQAAI

SEQ ID NO: 236295 - protein, 9 aa, Homo Sapiens
LPWRTHDSE

SEQ ID NO: 236296 - protein, 9 aa, Homo Sapiens
LNISGTATS

SEQ ID NO: 236297 - protein, 9 aa, Homo Sapiens
SSGYISNYA

SEQ ID NO: 236298 - protein, 9 aa, Homo Sapiens
TKAMLNKPV

SEQ ID NO: 236299 - protein, 9 aa, Homo Sapiens
SWADDGKAI

SEQ ID NO: 236300 - protein, 9 aa, Homo Sapiens
RVNTVYDVD

SEQ ID NO: 236301 - protein, 9 aa, Homo Sapiens
LLSNTGAAS

SEQ ID NO: 236302 - protein, 9 aa, Homo Sapiens
SGQLEGIFF

SEQ ID NO: 236303 - protein, 9 aa, Homo Sapiens
RGTGMKYRD

SEQ ID NO: 236304 - protein, 9 aa, Homo Sapiens
DVTRRLPED

SEQ ID NO: 236305 - protein, 9 aa, Homo Sapiens
LGYPGYQAT

SEQ ID NO: 236306 - protein, 9 aa, Homo Sapiens
FSVTEGAVG

SEQ ID NO: 236307 - protein, 9 aa, Homo Sapiens
TNNRIHYRL

SEQ ID NO: 236308 - protein, 9 aa, Homo Sapiens
KANTPVHLS

SEQ ID NO: 236309 - protein, 9 aa, Homo Sapiens
LVGPFTTPA

SEQ ID NO: 236310 - protein, 9 aa, Homo Sapiens
LVLLLLQVP

SEQ ID NO: 236311 - protein, 9 aa, Homo Sapiens
DILIPTHFF

SEQ ID NO: 236312 - protein, 9 aa, Homo Sapiens
TGSCYCGKI

SEQ ID NO: 236313 - protein, 9 aa, Homo Sapiens
EFLISLYLA

SEQ ID NO: 236314 - protein, 9 aa, Homo Sapiens
ESSDMEQIS

SEQ ID NO: 236315 - protein, 9 aa, Homo Sapiens
KKPLYLHLR

SEQ ID NO: 236316 - protein, 9 aa, Homo Sapiens
NLQILNINT

SEQ ID NO: 236317 - protein, 9 aa, Homo Sapiens
TGLLECEVY

SEQ ID NO: 236318 - protein, 9 aa, Homo Sapiens
VQISDRIIV

SEQ ID NO: 236319 - protein, 9 aa, Homo Sapiens
EHNLNMQLF

SEQ ID NO: 236320 - protein, 9 aa, Homo Sapiens
FYIFELEAA

SEQ ID NO: 236321 - protein, 9 aa, Homo Sapiens
LIQEVIVGE

SEQ ID NO: 236322 - protein, 9 aa, Homo Sapiens
KQELRQKSK

SEQ ID NO: 236323 - protein, 9 aa, Homo Sapiens
EDNLEAVKS

SEQ ID NO: 236324 - protein, 9 aa, Homo Sapiens
FMFVAWMTT

SEQ ID NO: 236325 - protein, 9 aa, Homo Sapiens
IKKFCEACI

SEQ ID NO: 236326 - protein, 9 aa, Homo Sapiens
QISSKENED

SEQ ID NO: 236327 - protein, 9 aa, Homo Sapiens
AGRKEAGRP

SEQ ID NO: 236328 - protein, 9 aa, Homo Sapiens
YSYISYSNS

SEQ ID NO: 236329 - protein, 9 aa, Homo Sapiens
LRACKESRP

SEQ ID NO: 236330 - protein, 9 aa, Homo Sapiens
YYNGLNQCS

SEQ ID NO: 236331 - protein, 9 aa, Homo Sapiens
RTSLQSAVS

SEQ ID NO: 236332 - protein, 9 aa, Homo Sapiens
NPPVITAAI

SEQ ID NO: 236333 - protein, 9 aa, Homo Sapiens
DGDRLRILP

SEQ ID NO: 236334 - protein, 9 aa, Homo Sapiens
KKTYFKNRE

SEQ ID NO: 236335 - protein, 9 aa, Homo Sapiens
VQKTSNLIV

SEQ ID NO: 236336 - protein, 9 aa, Homo Sapiens
QQIHTGRKP

SEQ ID NO: 236337 - protein, 9 aa, Homo Sapiens
GDKGEIGLP

SEQ ID NO: 236338 - protein, 9 aa, Homo Sapiens
LEQPERICQ

SEQ ID NO: 236339 - protein, 9 aa, Homo Sapiens
IANRAMENM

SEQ ID NO: 236340 - protein, 9 aa, Homo Sapiens
EVPPPAPQS

SEQ ID NO: 236341 - protein, 9 aa, Homo Sapiens
ELRDQSVSV

SEQ ID NO: 236342 - protein, 9 aa, Homo Sapiens
DCQNNSFPY

SEQ ID NO: 236343 - protein, 9 aa, Homo Sapiens
NMKKFQIPV

SEQ ID NO: 236344 - protein, 9 aa, Homo Sapiens
VSIHQVKTQ

SEQ ID NO: 236345 - protein, 9 aa, Homo Sapiens
TQVAKWPVD

SEQ ID NO: 236346 - protein, 9 aa, Homo Sapiens
HVMVAKPPV

SEQ ID NO: 236347 - protein, 9 aa, Homo Sapiens
SVCKDLQLP

SEQ ID NO: 236348 - protein, 9 aa, Homo Sapiens
ESKTLQVSN

SEQ ID NO: 236349 - protein, 9 aa, Homo Sapiens
RIITPYTLP

SEQ ID NO: 236350 - protein, 9 aa, Homo Sapiens
TAFNVEEAF

SEQ ID NO: 236351 - protein, 9 aa, Homo Sapiens
DEKRKWTLD

SEQ ID NO: 236352 - protein, 9 aa, Homo Sapiens
VIICVTTVP

SEQ ID NO: 236353 - protein, 9 aa, Homo Sapiens
VLKFGMTPS

SEQ ID NO: 236354 - protein, 9 aa, Homo Sapiens
SGGFGKELF

SEQ ID NO: 236355 - protein, 9 aa, Homo Sapiens
TLREKSQRL

SEQ ID NO: 236356 - protein, 9 aa, Homo Sapiens
SEFPNTCTN

SEQ ID NO: 236357 - protein, 9 aa, Homo Sapiens
CNMKRHVMV

SEQ ID NO: 236358 - protein, 9 aa, Homo Sapiens
WSRLHTNVN

SEQ ID NO: 236359 - protein, 9 aa, Homo Sapiens
IIRSKKSPR

SEQ ID NO: 236360 - protein, 9 aa, Homo Sapiens
AENKENDLR

SEQ ID NO: 236361 - protein, 9 aa, Homo Sapiens
LTGFPGLET

SEQ ID NO: 236362 - protein, 9 aa, Homo Sapiens
LLQPTWDVD

SEQ ID NO: 236363 - protein, 9 aa, Homo Sapiens
TPGEKMVLN

SEQ ID NO: 236364 - protein, 9 aa, Homo Sapiens
AAIEIFEKI

SEQ ID NO: 236365 - protein, 9 aa, Homo Sapiens
SLAFPVNTG

SEQ ID NO: 236366 - protein, 9 aa, Homo Sapiens
GMLVMLHFD

SEQ ID NO: 236367 - protein, 9 aa, Homo Sapiens
DVVEILNGE

SEQ ID NO: 236368 - protein, 9 aa, Homo Sapiens
QSIRIESIT

SEQ ID NO: 236369 - protein, 9 aa, Homo Sapiens
ESHNWRYAT

SEQ ID NO: 236370 - protein, 9 aa, Homo Sapiens
NLTAPGTPC

SEQ ID NO: 236371 - protein, 9 aa, Homo Sapiens
ERLQLDEEL

SEQ ID NO: 236372 - protein, 9 aa, Homo Sapiens
VRLQESDYL

SEQ ID NO: 236373 - protein, 9 aa, Homo Sapiens
VGGQSYTCP

SEQ ID NO: 236374 - protein, 9 aa, Homo Sapiens
KTREKEEKK

SEQ ID NO: 236375 - protein, 9 aa, Homo Sapiens
DNIYTPKKY

SEQ ID NO: 236376 - protein, 9 aa, Homo Sapiens
QMMVHLLSN

SEQ ID NO: 236377 - protein, 9 aa, Homo Sapiens
KCRILATMN

SEQ ID NO: 236378 - protein, 9 aa, Homo Sapiens
RKRKYLEDV

SEQ ID NO: 236379 - protein, 9 aa, Homo Sapiens
EREQLVKAE

SEQ ID NO: 236380 - protein, 9 aa, Homo Sapiens
IIFSYGHCQ

SEQ ID NO: 236381 - protein, 9 aa, Homo Sapiens
EVVLKTQET

SEQ ID NO: 236382 - protein, 9 aa, Homo Sapiens
ATYDRRTQE

SEQ ID NO: 236383 - protein, 9 aa, Homo Sapiens
SSVWPNLTS

SEQ ID NO: 236384 - protein, 9 aa, Homo Sapiens
YENRFIVQE

SEQ ID NO: 236385 - protein, 9 aa, Homo Sapiens
PMCHLTVQI

SEQ ID NO: 236386 - protein, 9 aa, Homo Sapiens
RTLILESHN

SEQ ID NO: 236387 - protein, 9 aa, Homo Sapiens
MRKAASTCT

SEQ ID NO: 236388 - protein, 9 aa, Homo Sapiens
AEETAQKTA

SEQ ID NO: 236389 - protein, 9 aa, Homo Sapiens
MTNEDNSFG

SEQ ID NO: 236390 - protein, 9 aa, Homo Sapiens
HQQFMDRTH

SEQ ID NO: 236391 - protein, 9 aa, Homo Sapiens
SDYLLSSTE

SEQ ID NO: 236392 - protein, 9 aa, Homo Sapiens
WGKKKKKNK

SEQ ID NO: 236393 - protein, 9 aa, Homo Sapiens
SGILNQSDI

SEQ ID NO: 236394 - protein, 9 aa, Homo Sapiens
THSMVESIK

SEQ ID NO: 236395 - protein, 9 aa, Homo Sapiens
HLLYGDIIQ

SEQ ID NO: 236396 - protein, 9 aa, Homo Sapiens
GDVGSLALE

SEQ ID NO: 236397 - protein, 9 aa, Homo Sapiens
NAIVDFSSQ

SEQ ID NO: 236398 - protein, 9 aa, Homo Sapiens
RTPELSNRR

SEQ ID NO: 236399 - protein, 9 aa, Homo Sapiens
ETSIEVELT

SEQ ID NO: 236400 - protein, 9 aa, Homo Sapiens
IRLMSVLEL

SEQ ID NO: 236401 - protein, 9 aa, Homo Sapiens
FVSGTGLRM

SEQ ID NO: 236402 - protein, 9 aa, Homo Sapiens
LFLTKKRRE

SEQ ID NO: 236403 - protein, 9 aa, Homo Sapiens
REKDKVDLE

SEQ ID NO: 236404 - protein, 9 aa, Homo Sapiens
IFFQAELQI

SEQ ID NO: 236405 - protein, 9 aa, Homo Sapiens
IIININPKF

SEQ ID NO: 236406 - protein, 9 aa, Homo Sapiens
GFTPEDKVS

SEQ ID NO: 236407 - protein, 9 aa, Homo Sapiens
VTAVQRVAG

SEQ ID NO: 236408 - protein, 9 aa, Homo Sapiens
DPHSHNDKT

SEQ ID NO: 236409 - protein, 9 aa, Homo Sapiens
DLGTPVLTP

SEQ ID NO: 236410 - protein, 9 aa, Homo Sapiens
GQAESIITK

SEQ ID NO: 236411 - protein, 9 aa, Homo Sapiens
GQKFCIAGF

SEQ ID NO: 236412 - protein, 9 aa, Homo Sapiens
FDMARALPK

SEQ ID NO: 236413 - protein, 9 aa, Homo Sapiens
DIGPEFIQV

SEQ ID NO: 236414 - protein, 9 aa, Homo Sapiens
STLTSCQML

SEQ ID NO: 236415 - protein, 9 aa, Homo Sapiens
EARRFFSKE

SEQ ID NO: 236416 - protein, 9 aa, Homo Sapiens
QKLGCWNPV

SEQ ID NO: 236417 - protein, 9 aa, Homo Sapiens
TKLHLMNVT

SEQ ID NO: 236418 - protein, 9 aa, Homo Sapiens
SSTQSRMDW

SEQ ID NO: 236419 - protein, 9 aa, Homo Sapiens
QAVNDEIEA

SEQ ID NO: 236420 - protein, 9 aa, Homo Sapiens
SAAENAVLQ

SEQ ID NO: 236421 - protein, 9 aa, Homo Sapiens
AQEKMHKVS

SEQ ID NO: 236422 - protein, 9 aa, Homo Sapiens
YMSTRTNKD

SEQ ID NO: 236423 - protein, 9 aa, Homo Sapiens
SIKLIPVST

SEQ ID NO: 236424 - protein, 9 aa, Homo Sapiens
KSHFREWLY

SEQ ID NO: 236425 - protein, 9 aa, Homo Sapiens
VCQEVKTLV

SEQ ID NO: 236426 - protein, 9 aa, Homo Sapiens
FLIVYIVAF

SEQ ID NO: 236427 - protein, 9 aa, Homo Sapiens
KEQNTPRRL

SEQ ID NO: 236428 - protein, 9 aa, Homo Sapiens
QWRCDQEPC

SEQ ID NO: 236429 - protein, 9 aa, Homo Sapiens
YPDLILIDY

SEQ ID NO: 236430 - protein, 9 aa, Homo Sapiens
VIFHDQFDY

SEQ ID NO: 236431 - protein, 9 aa, Homo Sapiens
ELQDLLLDY

SEQ ID NO: 236432 - protein, 9 aa, Homo Sapiens
FLHPHCKIA

SEQ ID NO: 236433 - protein, 9 aa, Homo Sapiens
LAFPVNTGQ

SEQ ID NO: 236434 - protein, 9 aa, Homo Sapiens
NGTVFAIMS

SEQ ID NO: 236435 - protein, 9 aa, Homo Sapiens
VTVIGLYLC

SEQ ID NO: 236436 - protein, 9 aa, Homo Sapiens
FQKAAQGGH

SEQ ID NO: 236437 - protein, 9 aa, Homo Sapiens
RFEESDDKE

SEQ ID NO: 236438 - protein, 9 aa, Homo Sapiens
TCSFPSSNL

SEQ ID NO: 236439 - protein, 9 aa, Homo Sapiens
KRLRRKRAR

SEQ ID NO: 236440 - protein, 9 aa, Homo Sapiens
EYNAVGAMT

SEQ ID NO: 236441 - protein, 9 aa, Homo Sapiens
YKILFKAKN

SEQ ID NO: 236442 - protein, 9 aa, Homo Sapiens
IQHDQELQR

SEQ ID NO: 236443 - protein, 9 aa, Homo Sapiens
VSILVHANT

SEQ ID NO: 236444 - protein, 9 aa, Homo Sapiens
CHDPDLHMH

SEQ ID NO: 236445 - protein, 9 aa, Homo Sapiens
LSRNTSFRR

SEQ ID NO: 236446 - protein, 9 aa, Homo Sapiens
KLQAELSQP

SEQ ID NO: 236447 - protein, 9 aa, Homo Sapiens
AQKYNCGFF

SEQ ID NO: 236448 - protein, 9 aa, Homo Sapiens
PFRNSVASG

SEQ ID NO: 236449 - protein, 9 aa, Homo Sapiens
QERNYAQKQ

SEQ ID NO: 236450 - protein, 9 aa, Homo Sapiens
PHFFCDFVA

SEQ ID NO: 236451 - protein, 9 aa, Homo Sapiens
FSNLEALLV

SEQ ID NO: 236452 - protein, 9 aa, Homo Sapiens
ANWWKGEHH

SEQ ID NO: 236453 - protein, 9 aa, Homo Sapiens
DGSKSLGED

SEQ ID NO: 236454 - protein, 9 aa, Homo Sapiens
RGPISMTKN

SEQ ID NO: 236455 - protein, 9 aa, Homo Sapiens
GEELWPGSS

SEQ ID NO: 236456 - protein, 9 aa, Homo Sapiens
PVFVVVTNV

SEQ ID NO: 236457 - protein, 9 aa, Homo Sapiens
KAVRDIGRC

SEQ ID NO: 236458 - protein, 9 aa, Homo Sapiens
ISMCKLGSA

SEQ ID NO: 236459 - protein, 9 aa, Homo Sapiens
IIEGVLLFN

SEQ ID NO: 236460 - protein, 9 aa, Homo Sapiens
FREISKAQL

SEQ ID NO: 236461 - protein, 9 aa, Homo Sapiens
PLVDNSAEK

SEQ ID NO: 236462 - protein, 9 aa, Homo Sapiens
EIECMEEKC

SEQ ID NO: 236463 - protein, 9 aa, Homo Sapiens
LKEALDPID

SEQ ID NO: 236464 - protein, 9 aa, Homo Sapiens
ATPPAVKLH

SEQ ID NO: 236465 - protein, 9 aa, Homo Sapiens
SSKGSDLEL

SEQ ID NO: 236466 - protein, 9 aa, Homo Sapiens
TGTKTQMDD

SEQ ID NO: 236467 - protein, 9 aa, Homo Sapiens
CGLQQVKDP

SEQ ID NO: 236468 - protein, 9 aa, Homo Sapiens
SNIHKSVQI

SEQ ID NO: 236469 - protein, 9 aa, Homo Sapiens
SLVNEQWIL

SEQ ID NO: 236470 - protein, 9 aa, Homo Sapiens
VEDKPSQIS

SEQ ID NO: 236471 - protein, 9 aa, Homo Sapiens
ISLEEENQC

SEQ ID NO: 236472 - protein, 9 aa, Homo Sapiens
NSEESEERD

SEQ ID NO: 236473 - protein, 9 aa, Homo Sapiens
ERLTPQEIS

SEQ ID NO: 236474 - protein, 9 aa, Homo Sapiens
HPNLYRIGR

SEQ ID NO: 236475 - protein, 9 aa, Homo Sapiens
CRDKEICAD

SEQ ID NO: 236476 - protein, 9 aa, Homo Sapiens
PTVYRMLMQ

SEQ ID NO: 236477 - protein, 9 aa, Homo Sapiens
ENACEITSF

SEQ ID NO: 236478 - protein, 9 aa, Homo Sapiens
MPVKEEHEK

SEQ ID NO: 236479 - protein, 9 aa, Homo Sapiens
PRICNWVSA

SEQ ID NO: 236480 - protein, 9 aa, Homo Sapiens
LRESNKLAD

SEQ ID NO: 236481 - protein, 9 aa, Homo Sapiens
LYFSPILTV

SEQ ID NO: 236482 - protein, 9 aa, Homo Sapiens
LYILSFFTI

SEQ ID NO: 236483 - protein, 9 aa, Homo Sapiens
IKQLCSGAA

SEQ ID NO: 236484 - protein, 9 aa, Homo Sapiens
WNNNEKDMA

SEQ ID NO: 236485 - protein, 9 aa, Homo Sapiens
GYIHVESKL

SEQ ID NO: 236486 - protein, 9 aa, Homo Sapiens
YRNNLNGIL

SEQ ID NO: 236487 - protein, 9 aa, Homo Sapiens
PHLHIPMHL

SEQ ID NO: 236488 - protein, 9 aa, Homo Sapiens
TYPKFLANA

SEQ ID NO: 236489 - protein, 9 aa, Homo Sapiens
KETPEVLHF

SEQ ID NO: 236490 - protein, 9 aa, Homo Sapiens
MQGAPEILD

SEQ ID NO: 236491 - protein, 9 aa, Homo Sapiens
GMTPGFIDK

SEQ ID NO: 236492 - protein, 9 aa, Homo Sapiens
CCGNIMQTL

SEQ ID NO: 236493 - protein, 9 aa, Homo Sapiens
HLDLNSNAI

SEQ ID NO: 236494 - protein, 9 aa, Homo Sapiens
EVKYEKDDM

SEQ ID NO: 236495 - protein, 9 aa, Homo Sapiens
QLLLPTQDE

SEQ ID NO: 236496 - protein, 9 aa, Homo Sapiens
YIARVKDPQ

SEQ ID NO: 236497 - protein, 9 aa, Homo Sapiens
DMMVYVFYT

SEQ ID NO: 236498 - protein, 9 aa, Homo Sapiens
RANEKTTLF

SEQ ID NO: 236499 - protein, 9 aa, Homo Sapiens
IINKYLDEI

SEQ ID NO: 236500 - protein, 9 aa, Homo Sapiens
LTGQPFNTI

SEQ ID NO: 236501 - protein, 9 aa, Homo Sapiens
LKTTLFMVL

SEQ ID NO: 236502 - protein, 9 aa, Homo Sapiens
CKYNADLLS

SEQ ID NO: 236503 - protein, 9 aa, Homo Sapiens
VSGPQHTEL

SEQ ID NO: 236504 - protein, 9 aa, Homo Sapiens
DVSRNELPE

SEQ ID NO: 236505 - protein, 9 aa, Homo Sapiens
QIDNQTRTT

SEQ ID NO: 236506 - protein, 9 aa, Homo Sapiens
VMLDKIIKI

SEQ ID NO: 236507 - protein, 9 aa, Homo Sapiens
HQIKIRDRE

SEQ ID NO: 236508 - protein, 9 aa, Homo Sapiens
EVIVESGNF

SEQ ID NO: 236509 - protein, 9 aa, Homo Sapiens
DDLAIATYP

SEQ ID NO: 236510 - protein, 9 aa, Homo Sapiens
VKTIMNSGF

SEQ ID NO: 236511 - protein, 9 aa, Homo Sapiens
VLLFMERED

SEQ ID NO: 236512 - protein, 9 aa, Homo Sapiens
QSLTKRNAV

SEQ ID NO: 236513 - protein, 9 aa, Homo Sapiens
PPHLQWDVL

SEQ ID NO: 236514 - protein, 9 aa, Homo Sapiens
NKAEENCLQ

SEQ ID NO: 236515 - protein, 9 aa, Homo Sapiens
EKILSEVTP

SEQ ID NO: 236516 - protein, 9 aa, Homo Sapiens
VLGPQSECS

SEQ ID NO: 236517 - protein, 9 aa, Homo Sapiens
SRYILLRPT

SEQ ID NO: 236518 - protein, 9 aa, Homo Sapiens
TWVGTNKYL

SEQ ID NO: 236519 - protein, 9 aa, Homo Sapiens
QDADIEDLK

SEQ ID NO: 236520 - protein, 9 aa, Homo Sapiens
EVSVKGAPE

SEQ ID NO: 236521 - protein, 9 aa, Homo Sapiens
EAKRDDKRM

SEQ ID NO: 236522 - protein, 9 aa, Homo Sapiens
KFYLDQVAL

SEQ ID NO: 236523 - protein, 9 aa, Homo Sapiens
TNYNRPTIP

SEQ ID NO: 236524 - protein, 9 aa, Homo Sapiens
RVCVKKSTR

SEQ ID NO: 236525 - protein, 9 aa, Homo Sapiens
LQTCRLRLS

SEQ ID NO: 236526 - protein, 9 aa, Homo Sapiens
DLNQTKLEC

SEQ ID NO: 236527 - protein, 9 aa, Homo Sapiens
TEAVWAARW

SEQ ID NO: 236528 - protein, 9 aa, Homo Sapiens
DIYVKTRSS

SEQ ID NO: 236529 - protein, 9 aa, Homo Sapiens
IPKYNVDNV

SEQ ID NO: 236530 - protein, 9 aa, Homo Sapiens
RICSLQRSV

SEQ ID NO: 236531 - protein, 9 aa, Homo Sapiens
LQSPQFYNS

SEQ ID NO: 236532 - protein, 9 aa, Homo Sapiens
NSGSKVLVH

SEQ ID NO: 236533 - protein, 9 aa, Homo Sapiens
ENDKEIKDV

SEQ ID NO: 236534 - protein, 9 aa, Homo Sapiens
SASPEQNKN

SEQ ID NO: 236535 - protein, 9 aa, Homo Sapiens
WMNYTAIRF

SEQ ID NO: 236536 - protein, 9 aa, Homo Sapiens
LVNAIYVKG

SEQ ID NO: 236537 - protein, 9 aa, Homo Sapiens
DEANLELLN

SEQ ID NO: 236538 - protein, 9 aa, Homo Sapiens
GGQTPGARF

SEQ ID NO: 236539 - protein, 9 aa, Homo Sapiens
GLCVNKGTE

SEQ ID NO: 236540 - protein, 9 aa, Homo Sapiens
DKKKKEPAI

SEQ ID NO: 236541 - protein, 9 aa, Homo Sapiens
SDSQAVAHY

SEQ ID NO: 236542 - protein, 9 aa, Homo Sapiens
HAIQKELTC

SEQ ID NO: 236543 - protein, 9 aa, Homo Sapiens
ILSWDPLHV

SEQ ID NO: 236544 - protein, 9 aa, Homo Sapiens
TDRNYLIKL

SEQ ID NO: 236545 - protein, 9 aa, Homo Sapiens
WANSFDPSK

SEQ ID NO: 236546 - protein, 9 aa, Homo Sapiens
INVGGKYVN

SEQ ID NO: 236547 - protein, 9 aa, Homo Sapiens
FKERDPLKD

SEQ ID NO: 236548 - protein, 9 aa, Homo Sapiens
WTVRPFSKT

SEQ ID NO: 236549 - protein, 9 aa, Homo Sapiens
RDVDNGLSP

SEQ ID NO: 236550 - protein, 9 aa, Homo Sapiens
LQDAATYNS

SEQ ID NO: 236551 - protein, 9 aa, Homo Sapiens
RQPSPVSAM

SEQ ID NO: 236552 - protein, 9 aa, Homo Sapiens
NLSLTTRTD

SEQ ID NO: 236553 - protein, 9 aa, Homo Sapiens
DCDNLAPTA

SEQ ID NO: 236554 - protein, 9 aa, Homo Sapiens
PFNPLAKSH

SEQ ID NO: 236555 - protein, 9 aa, Homo Sapiens
HFSDTPEFF

SEQ ID NO: 236556 - protein, 9 aa, Homo Sapiens
SLARNCMWL

SEQ ID NO: 236557 - protein, 9 aa, Homo Sapiens
TLRFPAEPL

SEQ ID NO: 236558 - protein, 9 aa, Homo Sapiens
RLLTEEINV

SEQ ID NO: 236559 - protein, 9 aa, Homo Sapiens
CDVESNPRI

SEQ ID NO: 236560 - protein, 9 aa, Homo Sapiens
SKNKECEAL

SEQ ID NO: 236561 - protein, 9 aa, Homo Sapiens
KDVKTAFMK

SEQ ID NO: 236562 - protein, 9 aa, Homo Sapiens
SRQCQGDRV

SEQ ID NO: 236563 - protein, 9 aa, Homo Sapiens
TVNKKNKIK

SEQ ID NO: 236564 - protein, 9 aa, Homo Sapiens
YHAMAGNDD

SEQ ID NO: 236565 - protein, 9 aa, Homo Sapiens
PQCGECKLC

SEQ ID NO: 236566 - protein, 9 aa, Homo Sapiens
LGASESIST

SEQ ID NO: 236567 - protein, 9 aa, Homo Sapiens
VSPTGLLLT

SEQ ID NO: 236568 - protein, 9 aa, Homo Sapiens
DNTLYYYNK

SEQ ID NO: 236569 - protein, 9 aa, Homo Sapiens
NYLRKIIGV

SEQ ID NO: 236570 - protein, 9 aa, Homo Sapiens
VVSEWGLWS

SEQ ID NO: 236571 - protein, 9 aa, Homo Sapiens
RMIADGAPE

SEQ ID NO: 236572 - protein, 9 aa, Homo Sapiens
TGFRATDCF

SEQ ID NO: 236573 - protein, 9 aa, Homo Sapiens
KNLIYHMLQ

SEQ ID NO: 236574 - protein, 9 aa, Homo Sapiens
DELEEEVNT

SEQ ID NO: 236575 - protein, 9 aa, Homo Sapiens
TGSGATGSK

SEQ ID NO: 236576 - protein, 9 aa, Homo Sapiens
SSSFCLAGR

SEQ ID NO: 236577 - protein, 9 aa, Homo Sapiens
MKVLQNHLQ

SEQ ID NO: 236578 - protein, 9 aa, Homo Sapiens
RARPPRPRP

SEQ ID NO: 236579 - protein, 9 aa, Homo Sapiens
NLVSITKDY

SEQ ID NO: 236580 - protein, 9 aa, Homo Sapiens
KFKRRHQTF

SEQ ID NO: 236581 - protein, 9 aa, Homo Sapiens
ENNQITALG

SEQ ID NO: 236582 - protein, 9 aa, Homo Sapiens
KKLNIAQNE

SEQ ID NO: 236583 - protein, 9 aa, Homo Sapiens
QITPWLFMP

SEQ ID NO: 236584 - protein, 9 aa, Homo Sapiens
AVFGVIGSL

SEQ ID NO: 236585 - protein, 9 aa, Homo Sapiens
ALDADIHSA

SEQ ID NO: 236586 - protein, 9 aa, Homo Sapiens
GKALASIYY

SEQ ID NO: 236587 - protein, 9 aa, Homo Sapiens
DDVICDETN

SEQ ID NO: 236588 - protein, 9 aa, Homo Sapiens
EDYHTDIQD

SEQ ID NO: 236589 - protein, 9 aa, Homo Sapiens
MPRPVSYRG

SEQ ID NO: 236590 - protein, 9 aa, Homo Sapiens
VIKKVKCIL

SEQ ID NO: 236591 - protein, 9 aa, Homo Sapiens
GLLIVHKPS

SEQ ID NO: 236592 - protein, 9 aa, Homo Sapiens
VLCYWFNRN

SEQ ID NO: 236593 - protein, 9 aa, Homo Sapiens
VKCMDYGFI

SEQ ID NO: 236594 - protein, 9 aa, Homo Sapiens
RQKKIQKET

SEQ ID NO: 236595 - protein, 9 aa, Homo Sapiens
TAKEKEFQS

SEQ ID NO: 236596 - protein, 9 aa, Homo Sapiens
DDVPVENYV

SEQ ID NO: 236597 - protein, 9 aa, Homo Sapiens
DCFGGILMN

SEQ ID NO: 236598 - protein, 9 aa, Homo Sapiens
LHYLSKMLE

SEQ ID NO: 236599 - protein, 9 aa, Homo Sapiens
IGKRIASQS

SEQ ID NO: 236600 - protein, 9 aa, Homo Sapiens
IVSGLCAIV

SEQ ID NO: 236601 - protein, 9 aa, Homo Sapiens
SSSQVTEIS

SEQ ID NO: 236602 - protein, 9 aa, Homo Sapiens
NKSGRLSSI

SEQ ID NO: 236603 - protein, 9 aa, Homo Sapiens
EHEGRPLCD

SEQ ID NO: 236604 - protein, 9 aa, Homo Sapiens
ATPPVAPVM

SEQ ID NO: 236605 - protein, 9 aa, Homo Sapiens
NTAGISLPT

SEQ ID NO: 236606 - protein, 9 aa, Homo Sapiens
GSHNLETAL

SEQ ID NO: 236607 - protein, 9 aa, Homo Sapiens
PTCISRRGH

SEQ ID NO: 236608 - protein, 9 aa, Homo Sapiens
GRKLSDASD

SEQ ID NO: 236609 - protein, 9 aa, Homo Sapiens
EQEKKEIEL

SEQ ID NO: 236610 - protein, 9 aa, Homo Sapiens
GDDFVWGLI

SEQ ID NO: 236611 - protein, 9 aa, Homo Sapiens
KLIKKCKPE

SEQ ID NO: 236612 - protein, 9 aa, Homo Sapiens
PKPNTRSSQ

SEQ ID NO: 236613 - protein, 9 aa, Homo Sapiens
IKARPDMQL

SEQ ID NO: 236614 - protein, 9 aa, Homo Sapiens
CGKAFRYLS

SEQ ID NO: 236615 - protein, 9 aa, Homo Sapiens
SLQKVSMDN

SEQ ID NO: 236616 - protein, 9 aa, Homo Sapiens
LTCRDKEIC

SEQ ID NO: 236617 - protein, 9 aa, Homo Sapiens
IDFIGMFTD

SEQ ID NO: 236618 - protein, 9 aa, Homo Sapiens
GANGSEIYI

SEQ ID NO: 236619 - protein, 9 aa, Homo Sapiens
PVYRFVIPS

SEQ ID NO: 236620 - protein, 9 aa, Homo Sapiens
CPVYLREAG

SEQ ID NO: 236621 - protein, 9 aa, Homo Sapiens
LRLSYGCDP

SEQ ID NO: 236622 - protein, 9 aa, Homo Sapiens
LYRFWIHTE

SEQ ID NO: 236623 - protein, 9 aa, Homo Sapiens
DDYVFIEFL

SEQ ID NO: 236624 - protein, 9 aa, Homo Sapiens
YTDDPEAAR

SEQ ID NO: 236625 - protein, 9 aa, Homo Sapiens
RVNLVLSRE

SEQ ID NO: 236626 - protein, 9 aa, Homo Sapiens
ALIFSIRPL

SEQ ID NO: 236627 - protein, 9 aa, Homo Sapiens
KYSVTSKTT

SEQ ID NO: 236628 - protein, 9 aa, Homo Sapiens
DRPADSRDT

SEQ ID NO: 236629 - protein, 9 aa, Homo Sapiens
MLLKFYSFY

SEQ ID NO: 236630 - protein, 9 aa, Homo Sapiens
RGEYNAANL

SEQ ID NO: 236631 - protein, 9 aa, Homo Sapiens
PNQLVQPAW

SEQ ID NO: 236632 - protein, 9 aa, Homo Sapiens
GEIILGLGD

SEQ ID NO: 236633 - protein, 9 aa, Homo Sapiens
VKTNYGKIQ

SEQ ID NO: 236634 - protein, 9 aa, Homo Sapiens
SEKSKRDYT

SEQ ID NO: 236635 - protein, 9 aa, Homo Sapiens
QNQKKPASC

SEQ ID NO: 236636 - protein, 9 aa, Homo Sapiens
KPGGILIMD

SEQ ID NO: 236637 - protein, 9 aa, Homo Sapiens
RVHFLVNAA

SEQ ID NO: 236638 - protein, 9 aa, Homo Sapiens
CVVLVIWGE

SEQ ID NO: 236639 - protein, 9 aa, Homo Sapiens
IITKNLLKA

SEQ ID NO: 236640 - protein, 9 aa, Homo Sapiens
KLIRKSTFK

SEQ ID NO: 236641 - protein, 9 aa, Homo Sapiens
VQRCVVQIR

SEQ ID NO: 236642 - protein, 9 aa, Homo Sapiens
DEPEVDFNE

SEQ ID NO: 236643 - protein, 9 aa, Homo Sapiens
SHLKIENVY

SEQ ID NO: 236644 - protein, 9 aa, Homo Sapiens
NPSILSWDP

SEQ ID NO: 236645 - protein, 9 aa, Homo Sapiens
DPHKRNLDL

SEQ ID NO: 236646 - protein, 9 aa, Homo Sapiens
QQFKDSGLS

SEQ ID NO: 236647 - protein, 9 aa, Homo Sapiens
VEAYKHFKP

SEQ ID NO: 236648 - protein, 9 aa, Homo Sapiens
SPAIQMLQQ

SEQ ID NO: 236649 - protein, 9 aa, Homo Sapiens
LQKLKNVLP

SEQ ID NO: 236650 - protein, 9 aa, Homo Sapiens
GLSPGQTSA

SEQ ID NO: 236651 - protein, 9 aa, Homo Sapiens
QDKGRGMVQ

SEQ ID NO: 236652 - protein, 9 aa, Homo Sapiens
TPEDKVSIY

SEQ ID NO: 236653 - protein, 9 aa, Homo Sapiens
FIRLSYNKL

SEQ ID NO: 236654 - protein, 9 aa, Homo Sapiens
SGEFSHSPA

SEQ ID NO: 236655 - protein, 9 aa, Homo Sapiens
DFASQVTHT

SEQ ID NO: 236656 - protein, 9 aa, Homo Sapiens
HESLTLPWR

SEQ ID NO: 236657 - protein, 9 aa, Homo Sapiens
KIKLGSTET

SEQ ID NO: 236658 - protein, 9 aa, Homo Sapiens
VTDFVDLGN

SEQ ID NO: 236659 - protein, 9 aa, Homo Sapiens
QNLHIDDQI

SEQ ID NO: 236660 - protein, 9 aa, Homo Sapiens
DVRRIPCMH

SEQ ID NO: 236661 - protein, 9 aa, Homo Sapiens
NTSQTCDWK

SEQ ID NO: 236662 - protein, 9 aa, Homo Sapiens
RLFRVASKI

SEQ ID NO: 236663 - protein, 9 aa, Homo Sapiens
FIIHVYQNI

SEQ ID NO: 236664 - protein, 9 aa, Homo Sapiens
CETNLDTYD

SEQ ID NO: 236665 - protein, 9 aa, Homo Sapiens
SEGQKYSVT

SEQ ID NO: 236666 - protein, 9 aa, Homo Sapiens
RKRFHFNSE

SEQ ID NO: 236667 - protein, 9 aa, Homo Sapiens
GRSEGDPMR

SEQ ID NO: 236668 - protein, 9 aa, Homo Sapiens
AMDEIGLPT

SEQ ID NO: 236669 - protein, 9 aa, Homo Sapiens
IKSILDIVT

SEQ ID NO: 236670 - protein, 9 aa, Homo Sapiens
NINPKFHTP

SEQ ID NO: 236671 - protein, 9 aa, Homo Sapiens
KYFSKEQQT

SEQ ID NO: 236672 - protein, 9 aa, Homo Sapiens
CSQSLSKNV

SEQ ID NO: 236673 - protein, 9 aa, Homo Sapiens
WIGGAPSVI

SEQ ID NO: 236674 - protein, 9 aa, Homo Sapiens
DFERLHQNL

SEQ ID NO: 236675 - protein, 9 aa, Homo Sapiens
YIIYMPGTV

SEQ ID NO: 236676 - protein, 9 aa, Homo Sapiens
DLSAEPPSK

SEQ ID NO: 236677 - protein, 9 aa, Homo Sapiens
LPLIDMLVY

SEQ ID NO: 236678 - protein, 9 aa, Homo Sapiens
PRVVLNMQF

SEQ ID NO: 236679 - protein, 9 aa, Homo Sapiens
GYKPVWNRR

SEQ ID NO: 236680 - protein, 9 aa, Homo Sapiens
EAIHTFPYR

SEQ ID NO: 236681 - protein, 9 aa, Homo Sapiens
AAETKFEAS

SEQ ID NO: 236682 - protein, 9 aa, Homo Sapiens
VLMLAYAVC

SEQ ID NO: 236683 - protein, 9 aa, Homo Sapiens
HPNMAARLA

SEQ ID NO: 236684 - protein, 9 aa, Homo Sapiens
TLCNWMMCV

SEQ ID NO: 236685 - protein, 9 aa, Homo Sapiens
EISSLLINS

SEQ ID NO: 236686 - protein, 9 aa, Homo Sapiens
DSSKKNLLE

SEQ ID NO: 236687 - protein, 9 aa, Homo Sapiens
YTSSQGSKK

SEQ ID NO: 236688 - protein, 9 aa, Homo Sapiens
GELFMEIRK

SEQ ID NO: 236689 - protein, 9 aa, Homo Sapiens
CLKNNSKER

SEQ ID NO: 236690 - protein, 9 aa, Homo Sapiens
VPVFSLQLF

SEQ ID NO: 236691 - protein, 9 aa, Homo Sapiens
MSGQVVEHL

SEQ ID NO: 236692 - protein, 9 aa, Homo Sapiens
FWLDGSTPA

SEQ ID NO: 236693 - protein, 9 aa, Homo Sapiens
WVGKLVDSS

SEQ ID NO: 236694 - protein, 9 aa, Homo Sapiens
SPVIQRLQG

SEQ ID NO: 236695 - protein, 9 aa, Homo Sapiens
ASNIYSDSS

SEQ ID NO: 236696 - protein, 9 aa, Homo Sapiens
MAFESTMYK

SEQ ID NO: 236697 - protein, 9 aa, Homo Sapiens
ESFGPLQIL

SEQ ID NO: 236698 - protein, 9 aa, Homo Sapiens
EYQMTSGSW

SEQ ID NO: 236699 - protein, 9 aa, Homo Sapiens
LVDNSAEKQ

SEQ ID NO: 236700 - protein, 9 aa, Homo Sapiens
SGYPEIDKK

SEQ ID NO: 236701 - protein, 9 aa, Homo Sapiens
NLNGQHFRS

SEQ ID NO: 236702 - protein, 9 aa, Homo Sapiens
SSSLASSES

SEQ ID NO: 236703 - protein, 9 aa, Homo Sapiens
LLELGQCKK

SEQ ID NO: 236704 - protein, 9 aa, Homo Sapiens
SSVGMLVPD

SEQ ID NO: 236705 - protein, 9 aa, Homo Sapiens
GPNQIDHFV

SEQ ID NO: 236706 - protein, 9 aa, Homo Sapiens
AIGFGDYVA

SEQ ID NO: 236707 - protein, 9 aa, Homo Sapiens
LWEIEEKYP

SEQ ID NO: 236708 - protein, 9 aa, Homo Sapiens
YEKIAETDL

SEQ ID NO: 236709 - protein, 9 aa, Homo Sapiens
RGKVFKNCS

SEQ ID NO: 236710 - protein, 9 aa, Homo Sapiens
WNCCPIDWI

SEQ ID NO: 236711 - protein, 9 aa, Homo Sapiens
EESPSALQV

SEQ ID NO: 236712 - protein, 9 aa, Homo Sapiens
VLEANRLWD

SEQ ID NO: 236713 - protein, 9 aa, Homo Sapiens
MLFTSGQSE

SEQ ID NO: 236714 - protein, 9 aa, Homo Sapiens
VVGDYFGKE

SEQ ID NO: 236715 - protein, 9 aa, Homo Sapiens
HREHGLCGH

SEQ ID NO: 236716 - protein, 9 aa, Homo Sapiens
EFVQEAVSH

SEQ ID NO: 236717 - protein, 9 aa, Homo Sapiens
ESTRAAVKN

SEQ ID NO: 236718 - protein, 9 aa, Homo Sapiens
VGDEAQSNR

SEQ ID NO: 236719 - protein, 9 aa, Homo Sapiens
KLFKRDVCG

SEQ ID NO: 236720 - protein, 9 aa, Homo Sapiens
NMVPRAAEP

SEQ ID NO: 236721 - protein, 9 aa, Homo Sapiens
DRVVHQRTH

SEQ ID NO: 236722 - protein, 9 aa, Homo Sapiens
SNIILLGES

SEQ ID NO: 236723 - protein, 9 aa, Homo Sapiens
ASIMLKFWI

SEQ ID NO: 236724 - protein, 9 aa, Homo Sapiens
CAGYLNGKV

SEQ ID NO: 236725 - protein, 9 aa, Homo Sapiens
AVAQVLRHL

SEQ ID NO: 236726 - protein, 9 aa, Homo Sapiens
ALFMLFFSA

SEQ ID NO: 236727 - protein, 9 aa, Homo Sapiens
HRQTISVPV

SEQ ID NO: 236728 - protein, 9 aa, Homo Sapiens
WSVCRASNL

SEQ ID NO: 236729 - protein, 9 aa, Homo Sapiens
TFLKAALDN

SEQ ID NO: 236730 - protein, 9 aa, Homo Sapiens
RNNLGFTPA

SEQ ID NO: 236731 - protein, 9 aa, Homo Sapiens
QQCEDIDEC

SEQ ID NO: 236732 - protein, 9 aa, Homo Sapiens
ELYPHIVST

SEQ ID NO: 236733 - protein, 9 aa, Homo Sapiens
AGIDFCSEA

SEQ ID NO: 236734 - protein, 9 aa, Homo Sapiens
LNLVIAVIA

SEQ ID NO: 236735 - protein, 9 aa, Homo Sapiens
SSILNANNR

SEQ ID NO: 236736 - protein, 9 aa, Homo Sapiens
MQSNNTFNL

SEQ ID NO: 236737 - protein, 9 aa, Homo Sapiens
DADECHQQV

SEQ ID NO: 236738 - protein, 9 aa, Homo Sapiens
EEASKSVSS

SEQ ID NO: 236739 - protein, 9 aa, Homo Sapiens
TWGEEIEGF

SEQ ID NO: 236740 - protein, 9 aa, Homo Sapiens
GSCISMYVK

SEQ ID NO: 236741 - protein, 9 aa, Homo Sapiens
GALQEGRTA

SEQ ID NO: 236742 - protein, 9 aa, Homo Sapiens
KTQRGAGSN

SEQ ID NO: 236743 - protein, 9 aa, Homo Sapiens
AFIRLSYNK

SEQ ID NO: 236744 - protein, 9 aa, Homo Sapiens
FCCHKGPKK

SEQ ID NO: 236745 - protein, 9 aa, Homo Sapiens
ASYFSLLQG

SEQ ID NO: 236746 - protein, 9 aa, Homo Sapiens
SISIYTSSQ

SEQ ID NO: 236747 - protein, 9 aa, Homo Sapiens
LVTCWGDEF

SEQ ID NO: 236748 - protein, 9 aa, Homo Sapiens
KIDYFPNEL

SEQ ID NO: 236749 - protein, 9 aa, Homo Sapiens
CTSVNSVLC

SEQ ID NO: 236750 - protein, 9 aa, Homo Sapiens
LLEMTCYQQ

SEQ ID NO: 236751 - protein, 9 aa, Homo Sapiens
HFQIHTGIK

SEQ ID NO: 236752 - protein, 9 aa, Homo Sapiens
RLDPSTRTY

SEQ ID NO: 236753 - protein, 9 aa, Homo Sapiens
HPDGGLMAQ

SEQ ID NO: 236754 - protein, 9 aa, Homo Sapiens
RPREDLGAT

SEQ ID NO: 236755 - protein, 9 aa, Homo Sapiens
ITYKANPNR

SEQ ID NO: 236756 - protein, 9 aa, Homo Sapiens
DIEDLKAKK

SEQ ID NO: 236757 - protein, 9 aa, Homo Sapiens
EEKPVRMNM

SEQ ID NO: 236758 - protein, 9 aa, Homo Sapiens
TDEQLVAVQ

SEQ ID NO: 236759 - protein, 9 aa, Homo Sapiens
VPTDIKTEF

SEQ ID NO: 236760 - protein, 9 aa, Homo Sapiens
VSLQINITD

SEQ ID NO: 236761 - protein, 9 aa, Homo Sapiens
GQIIFSLAA

SEQ ID NO: 236762 - protein, 9 aa, Homo Sapiens
LPFYNQDHD

SEQ ID NO: 236763 - protein, 9 aa, Homo Sapiens
IVFIILLTI

SEQ ID NO: 236764 - protein, 9 aa, Homo Sapiens
VPFDLPEIL

SEQ ID NO: 236765 - protein, 9 aa, Homo Sapiens
NTTYLKTIA

SEQ ID NO: 236766 - protein, 9 aa, Homo Sapiens
SEEKELRKC

SEQ ID NO: 236767 - protein, 9 aa, Homo Sapiens
SFGSTPTLD

SEQ ID NO: 236768 - protein, 9 aa, Homo Sapiens
INILQNYDN

SEQ ID NO: 236769 - protein, 9 aa, Homo Sapiens
LAPIFPPMP

SEQ ID NO: 236770 - protein, 9 aa, Homo Sapiens
IATNALKDH

SEQ ID NO: 236771 - protein, 9 aa, Homo Sapiens
CHQQVHGLL

SEQ ID NO: 236772 - protein, 9 aa, Homo Sapiens
NNYLQFLKT

SEQ ID NO: 236773 - protein, 9 aa, Homo Sapiens
RCSDSVILN

SEQ ID NO: 236774 - protein, 9 aa, Homo Sapiens
YNRPTIPQP

SEQ ID NO: 236775 - protein, 9 aa, Homo Sapiens
RFHEVPIPP

SEQ ID NO: 236776 - protein, 9 aa, Homo Sapiens
SNPLSGSRT

SEQ ID NO: 236777 - protein, 9 aa, Homo Sapiens
LDARRKRRS

SEQ ID NO: 236778 - protein, 9 aa, Homo Sapiens
FQLSVDYLL

SEQ ID NO: 236779 - protein, 9 aa, Homo Sapiens
DIYLQNGPD

SEQ ID NO: 236780 - protein, 9 aa, Homo Sapiens
HLKTQIQKL

SEQ ID NO: 236781 - protein, 9 aa, Homo Sapiens
EEAHCFIPQ

SEQ ID NO: 236782 - protein, 9 aa, Homo Sapiens
WKHGIPFAL

SEQ ID NO: 236783 - protein, 9 aa, Homo Sapiens
LSGGQEASG

SEQ ID NO: 236784 - protein, 9 aa, Homo Sapiens
PLVLPYTNS

SEQ ID NO: 236785 - protein, 9 aa, Homo Sapiens
AWGLEVDSV

SEQ ID NO: 236786 - protein, 9 aa, Homo Sapiens
QNLIQEVIV

SEQ ID NO: 236787 - protein, 9 aa, Homo Sapiens
KSNGLNEEI

SEQ ID NO: 236788 - protein, 9 aa, Homo Sapiens
RKGRKWKVP

SEQ ID NO: 236789 - protein, 9 aa, Homo Sapiens
SQKARRKGH

SEQ ID NO: 236790 - protein, 9 aa, Homo Sapiens
HSQMDGLIP

SEQ ID NO: 236791 - protein, 9 aa, Homo Sapiens
HKNEQYCIF

SEQ ID NO: 236792 - protein, 9 aa, Homo Sapiens
QYPQQSLEP

SEQ ID NO: 236793 - protein, 9 aa, Homo Sapiens
KKVKRVLNN

SEQ ID NO: 236794 - protein, 9 aa, Homo Sapiens
TIIVDGKMM

SEQ ID NO: 236795 - protein, 9 aa, Homo Sapiens
LATGLDDSY

SEQ ID NO: 236796 - protein, 9 aa, Homo Sapiens
TVESLPCDI

SEQ ID NO: 236797 - protein, 9 aa, Homo Sapiens
SDIVIVEDD

SEQ ID NO: 236798 - protein, 9 aa, Homo Sapiens
SLHLGAADR

SEQ ID NO: 236799 - protein, 9 aa, Homo Sapiens
SQSKLLWSQ

SEQ ID NO: 236800 - protein, 9 aa, Homo Sapiens
ITKSEQKRN

SEQ ID NO: 236801 - protein, 9 aa, Homo Sapiens
VLHEVEVDV

SEQ ID NO: 236802 - protein, 9 aa, Homo Sapiens
KLHLMNVTA

SEQ ID NO: 236803 - protein, 9 aa, Homo Sapiens
PNSMTPAHI

SEQ ID NO: 236804 - protein, 9 aa, Homo Sapiens
PTSALKSET

SEQ ID NO: 236805 - protein, 9 aa, Homo Sapiens
DLHHYMEQI

SEQ ID NO: 236806 - protein, 9 aa, Homo Sapiens
IIGLSIHIC

SEQ ID NO: 236807 - protein, 9 aa, Homo Sapiens
ALLQAGPPI

SEQ ID NO: 236808 - protein, 9 aa, Homo Sapiens
WISKLVSGN

SEQ ID NO: 236809 - protein, 9 aa, Homo Sapiens
PDLPISKIE

SEQ ID NO: 236810 - protein, 9 aa, Homo Sapiens
GTEKLGLIA

SEQ ID NO: 236811 - protein, 9 aa, Homo Sapiens
QLAIEHPAV

SEQ ID NO: 236812 - protein, 9 aa, Homo Sapiens
KAPLQKFTP

SEQ ID NO: 236813 - protein, 9 aa, Homo Sapiens
DSCFLTINI

SEQ ID NO: 236814 - protein, 9 aa, Homo Sapiens
ETRVLGVYL

SEQ ID NO: 236815 - protein, 9 aa, Homo Sapiens
YSMAKMTFN

SEQ ID NO: 236816 - protein, 9 aa, Homo Sapiens
HGDLIQFFK

SEQ ID NO: 236817 - protein, 9 aa, Homo Sapiens
TFSYEKSNT

SEQ ID NO: 236818 - protein, 9 aa, Homo Sapiens
RALLLVTKD

SEQ ID NO: 236819 - protein, 9 aa, Homo Sapiens
NFVPVSVCS

SEQ ID NO: 236820 - protein, 9 aa, Homo Sapiens
VKRKDLLCH

SEQ ID NO: 236821 - protein, 9 aa, Homo Sapiens
PHLRIISLN

SEQ ID NO: 236822 - protein, 9 aa, Homo Sapiens
GSIGSAIVA

SEQ ID NO: 236823 - protein, 9 aa, Homo Sapiens
STSRVFQSP

SEQ ID NO: 236824 - protein, 9 aa, Homo Sapiens
LPVRALNVL

SEQ ID NO: 236825 - protein, 9 aa, Homo Sapiens
SKCEVQVTN

SEQ ID NO: 236826 - protein, 9 aa, Homo Sapiens
IQGTRTQQI

SEQ ID NO: 236827 - protein, 9 aa, Homo Sapiens
EMMDNLFDS

SEQ ID NO: 236828 - protein, 9 aa, Homo Sapiens
DEDDEFLKG

SEQ ID NO: 236829 - protein, 9 aa, Homo Sapiens
EDDVAKKGA

SEQ ID NO: 236830 - protein, 9 aa, Homo Sapiens
ILDREEKAE

SEQ ID NO: 236831 - protein, 9 aa, Homo Sapiens
LRKLGLHYF

SEQ ID NO: 236832 - protein, 9 aa, Homo Sapiens
HYQHLLSCS

SEQ ID NO: 236833 - protein, 9 aa, Homo Sapiens
GLTEELLSQ

SEQ ID NO: 236834 - protein, 9 aa, Homo Sapiens
CNMSEEEKL

SEQ ID NO: 236835 - protein, 9 aa, Homo Sapiens
KCSQTMGHD

SEQ ID NO: 236836 - protein, 9 aa, Homo Sapiens
WKLDYKAVP

SEQ ID NO: 236837 - protein, 9 aa, Homo Sapiens
ERSGVNSER

SEQ ID NO: 236838 - protein, 9 aa, Homo Sapiens
QGIADYIPK

SEQ ID NO: 236839 - protein, 9 aa, Homo Sapiens
VTGMGWDGS

SEQ ID NO: 236840 - protein, 9 aa, Homo Sapiens
SDFENSMKI

SEQ ID NO: 236841 - protein, 9 aa, Homo Sapiens
EIDKIVQYM

SEQ ID NO: 236842 - protein, 9 aa, Homo Sapiens
PKLTFSCLG

SEQ ID NO: 236843 - protein, 9 aa, Homo Sapiens
MSQFKMDTY

SEQ ID NO: 236844 - protein, 9 aa, Homo Sapiens
LAHHQVQSF

SEQ ID NO: 236845 - protein, 9 aa, Homo Sapiens
VYSGIFFIS

SEQ ID NO: 236846 - protein, 9 aa, Homo Sapiens
PSPSFMTSQ

SEQ ID NO: 236847 - protein, 9 aa, Homo Sapiens
IQGGDPTGA

SEQ ID NO: 236848 - protein, 9 aa, Homo Sapiens
FRLNYQLIY

SEQ ID NO: 236849 - protein, 9 aa, Homo Sapiens
KNHNYFPVN

SEQ ID NO: 236850 - protein, 9 aa, Homo Sapiens
GPKDTDTLV

SEQ ID NO: 236851 - protein, 9 aa, Homo Sapiens
PDDVVRVIF

SEQ ID NO: 236852 - protein, 9 aa, Homo Sapiens
HRVWQYESE

SEQ ID NO: 236853 - protein, 9 aa, Homo Sapiens
VYIRVFTCT

SEQ ID NO: 236854 - protein, 9 aa, Homo Sapiens
RMEGMLFPP

SEQ ID NO: 236855 - protein, 9 aa, Homo Sapiens
YGRPQAEVE

SEQ ID NO: 236856 - protein, 9 aa, Homo Sapiens
KLANYRYGR

SEQ ID NO: 236857 - protein, 9 aa, Homo Sapiens
LIFEGRPNV

SEQ ID NO: 236858 - protein, 9 aa, Homo Sapiens
FDTAPSRTC

SEQ ID NO: 236859 - protein, 9 aa, Homo Sapiens
VKNNYRRVP

SEQ ID NO: 236860 - protein, 9 aa, Homo Sapiens
NSFSLNSYI

SEQ ID NO: 236861 - protein, 9 aa, Homo Sapiens
NPDYFFKEV

SEQ ID NO: 236862 - protein, 9 aa, Homo Sapiens
PAGPDKPRG

SEQ ID NO: 236863 - protein, 9 aa, Homo Sapiens
RGWVWNQLF

SEQ ID NO: 236864 - protein, 9 aa, Homo Sapiens
KKCGKAFSK

SEQ ID NO: 236865 - protein, 9 aa, Homo Sapiens
PESKTLQVS

SEQ ID NO: 236866 - protein, 9 aa, Homo Sapiens
AHCFIPQEA

SEQ ID NO: 236867 - protein, 9 aa, Homo Sapiens
VNKKFSKQY

SEQ ID NO: 236868 - protein, 9 aa, Homo Sapiens
FRKAITLIL

SEQ ID NO: 236869 - protein, 9 aa, Homo Sapiens
TIHNRIHTG

SEQ ID NO: 236870 - protein, 9 aa, Homo Sapiens
SQKTGDVVE

SEQ ID NO: 236871 - protein, 9 aa, Homo Sapiens
EAPNDQGCL

SEQ ID NO: 236872 - protein, 9 aa, Homo Sapiens
TVTIIVDGK

SEQ ID NO: 236873 - protein, 9 aa, Homo Sapiens
QPLNVKHHG

SEQ ID NO: 236874 - protein, 9 aa, Homo Sapiens
RLFCLNLPS

SEQ ID NO: 236875 - protein, 9 aa, Homo Sapiens
QFQWSVCRA

SEQ ID NO: 236876 - protein, 9 aa, Homo Sapiens
PASAPTVSQ

SEQ ID NO: 236877 - protein, 9 aa, Homo Sapiens
RPYKCNGCG

SEQ ID NO: 236878 - protein, 9 aa, Homo Sapiens
GNVQNIHTE

SEQ ID NO: 236879 - protein, 9 aa, Homo Sapiens
FDKFLVGPD

SEQ ID NO: 236880 - protein, 9 aa, Homo Sapiens
TKIKDGDFK

SEQ ID NO: 236881 - protein, 9 aa, Homo Sapiens
TSEAQPCTP

SEQ ID NO: 236882 - protein, 9 aa, Homo Sapiens
SIPGARWIV

SEQ ID NO: 236883 - protein, 9 aa, Homo Sapiens
VLLTKIHLS

SEQ ID NO: 236884 - protein, 9 aa, Homo Sapiens
YSVIIDIIA

SEQ ID NO: 236885 - protein, 9 aa, Homo Sapiens
PQNLLFDNT

SEQ ID NO: 236886 - protein, 9 aa, Homo Sapiens
HFISAFEAN

SEQ ID NO: 236887 - protein, 9 aa, Homo Sapiens
VKEEPETIE

SEQ ID NO: 236888 - protein, 9 aa, Homo Sapiens
DTLVISAMV

SEQ ID NO: 236889 - protein, 9 aa, Homo Sapiens
HIVERLASV

SEQ ID NO: 236890 - protein, 9 aa, Homo Sapiens
IVNLLERSP

SEQ ID NO: 236891 - protein, 9 aa, Homo Sapiens
PFTTPELVH

SEQ ID NO: 236892 - protein, 9 aa, Homo Sapiens
DIPGLKAAM

SEQ ID NO: 236893 - protein, 9 aa, Homo Sapiens
GKGRFDENE

SEQ ID NO: 236894 - protein, 9 aa, Homo Sapiens
LHGSLGKLT

SEQ ID NO: 236895 - protein, 9 aa, Homo Sapiens
LEARQATRK

SEQ ID NO: 236896 - protein, 9 aa, Homo Sapiens
PVASEDGAV

SEQ ID NO: 236897 - protein, 9 aa, Homo Sapiens
LGGDSFWVS

SEQ ID NO: 236898 - protein, 9 aa, Homo Sapiens
CLKGAAAEI

SEQ ID NO: 236899 - protein, 9 aa, Homo Sapiens
SFTYRLDPG

SEQ ID NO: 236900 - protein, 9 aa, Homo Sapiens
LLYLDMQTI

SEQ ID NO: 236901 - protein, 9 aa, Homo Sapiens
DIHSAIPTE

SEQ ID NO: 236902 - protein, 9 aa, Homo Sapiens
YSDHPHSPL

SEQ ID NO: 236903 - protein, 9 aa, Homo Sapiens
LTSQIISCS

SEQ ID NO: 236904 - protein, 9 aa, Homo Sapiens
TASTEGSDI

SEQ ID NO: 236905 - protein, 9 aa, Homo Sapiens
RSDRYKNLS

SEQ ID NO: 236906 - protein, 9 aa, Homo Sapiens
LTSILYIGE

SEQ ID NO: 236907 - protein, 9 aa, Homo Sapiens
HVHAENGDL

SEQ ID NO: 236908 - protein, 9 aa, Homo Sapiens
CDLIFDFED

SEQ ID NO: 236909 - protein, 9 aa, Homo Sapiens
KGRKLEELS

SEQ ID NO: 236910 - protein, 9 aa, Homo Sapiens
SAILASVSV

SEQ ID NO: 236911 - protein, 9 aa, Homo Sapiens
CGLAWGLES

SEQ ID NO: 236912 - protein, 9 aa, Homo Sapiens
RCNKCGKSF

SEQ ID NO: 236913 - protein, 9 aa, Homo Sapiens
EEEETIKSQ

SEQ ID NO: 236914 - protein, 9 aa, Homo Sapiens
KIKHFLMEN

SEQ ID NO: 236915 - protein, 9 aa, Homo Sapiens
GGNCFNCGT

SEQ ID NO: 236916 - protein, 9 aa, Homo Sapiens
ELGCLNAYR

SEQ ID NO: 236917 - protein, 9 aa, Homo Sapiens
TEDVKPYQV

SEQ ID NO: 236918 - protein, 9 aa, Homo Sapiens
ITKHLLKWI

SEQ ID NO: 236919 - protein, 9 aa, Homo Sapiens
STEDGEESP

SEQ ID NO: 236920 - protein, 9 aa, Homo Sapiens
LYPVAFGFG

SEQ ID NO: 236921 - protein, 9 aa, Homo Sapiens
SKKTVYCFV

SEQ ID NO: 236922 - protein, 9 aa, Homo Sapiens
NTKCYKCPP

SEQ ID NO: 236923 - protein, 9 aa, Homo Sapiens
AQVMKPPLI

SEQ ID NO: 236924 - protein, 9 aa, Homo Sapiens
FLLKFQEIK

SEQ ID NO: 236925 - protein, 9 aa, Homo Sapiens
NQNVVWSKC

SEQ ID NO: 236926 - protein, 9 aa, Homo Sapiens
SLLATKHPL

SEQ ID NO: 236927 - protein, 9 aa, Homo Sapiens
ANKFFVEES

SEQ ID NO: 236928 - protein, 9 aa, Homo Sapiens
CLTTSDKFG

SEQ ID NO: 236929 - protein, 9 aa, Homo Sapiens
LGLFVLGIT

SEQ ID NO: 236930 - protein, 9 aa, Homo Sapiens
TLKRHKAAE

SEQ ID NO: 236931 - protein, 9 aa, Homo Sapiens
EVQIYVGEV

SEQ ID NO: 236932 - protein, 9 aa, Homo Sapiens
RNSNLVARR

SEQ ID NO: 236933 - protein, 9 aa, Homo Sapiens
RVNLDQLKA

SEQ ID NO: 236934 - protein, 9 aa, Homo Sapiens
LDTYDPYLI

SEQ ID NO: 236935 - protein, 9 aa, Homo Sapiens
VVGMTVQWT

SEQ ID NO: 236936 - protein, 9 aa, Homo Sapiens
GRSPSIKQN

SEQ ID NO: 236937 - protein, 9 aa, Homo Sapiens
SCSKSLHIS

SEQ ID NO: 236938 - protein, 9 aa, Homo Sapiens
FRDVAIELS

SEQ ID NO: 236939 - protein, 9 aa, Homo Sapiens
SWLLAKALW

SEQ ID NO: 236940 - protein, 9 aa, Homo Sapiens
FLIWAVIHS

SEQ ID NO: 236941 - protein, 9 aa, Homo Sapiens
LREHMQQLD

SEQ ID NO: 236942 - protein, 9 aa, Homo Sapiens
KETEHLFIP

SEQ ID NO: 236943 - protein, 9 aa, Homo Sapiens
GSPTLCPSI

SEQ ID NO: 236944 - protein, 9 aa, Homo Sapiens
KAASQGRQD

SEQ ID NO: 236945 - protein, 9 aa, Homo Sapiens
SETTLGNYK

SEQ ID NO: 236946 - protein, 9 aa, Homo Sapiens
QIVHTREKP

SEQ ID NO: 236947 - protein, 9 aa, Homo Sapiens
LSHREPKKL

SEQ ID NO: 236948 - protein, 9 aa, Homo Sapiens
NLVPFPQRH

SEQ ID NO: 236949 - protein, 9 aa, Homo Sapiens
KRNWKCPVK

SEQ ID NO: 236950 - protein, 9 aa, Homo Sapiens
DALYEALNN

SEQ ID NO: 236951 - protein, 9 aa, Homo Sapiens
GTGLTDCIL

SEQ ID NO: 236952 - protein, 9 aa, Homo Sapiens
CLSNQGSQE

SEQ ID NO: 236953 - protein, 9 aa, Homo Sapiens
PFVIFLLLY

SEQ ID NO: 236954 - protein, 9 aa, Homo Sapiens
ELVIFVFGI

SEQ ID NO: 236955 - protein, 9 aa, Homo Sapiens
KGREHIANR

SEQ ID NO: 236956 - protein, 9 aa, Homo Sapiens
PGKVATWLI

SEQ ID NO: 236957 - protein, 9 aa, Homo Sapiens
LDLSAFKFN

SEQ ID NO: 236958 - protein, 9 aa, Homo Sapiens
LTDVANKQL

SEQ ID NO: 236959 - protein, 9 aa, Homo Sapiens
MSNLIRHQI

SEQ ID NO: 236960 - protein, 9 aa, Homo Sapiens
YVNKKFSKQ

SEQ ID NO: 236961 - protein, 9 aa, Homo Sapiens
INDKHFPFW

SEQ ID NO: 236962 - protein, 9 aa, Homo Sapiens
EMMKHARNN

SEQ ID NO: 236963 - protein, 9 aa, Homo Sapiens
IDNSICVQE

SEQ ID NO: 236964 - protein, 9 aa, Homo Sapiens
TEAKRDDKR

SEQ ID NO: 236965 - protein, 9 aa, Homo Sapiens
ALNNLTPYV

SEQ ID NO: 236966 - protein, 9 aa, Homo Sapiens
HTISEGQKY

SEQ ID NO: 236967 - protein, 9 aa, Homo Sapiens
GDLKGRGRD

SEQ ID NO: 236968 - protein, 9 aa, Homo Sapiens
IFIYARSKA

SEQ ID NO: 236969 - protein, 9 aa, Homo Sapiens
FLGMSLVIL

SEQ ID NO: 236970 - protein, 9 aa, Homo Sapiens
WFDTAPSRT

SEQ ID NO: 236971 - protein, 9 aa, Homo Sapiens
CLLPLLLPS

SEQ ID NO: 236972 - protein, 9 aa, Homo Sapiens
NVNKIFMAI

SEQ ID NO: 236973 - protein, 9 aa, Homo Sapiens
QPSTNMFGR

SEQ ID NO: 236974 - protein, 9 aa, Homo Sapiens
VCKVLLTME

SEQ ID NO: 236975 - protein, 9 aa, Homo Sapiens
PKPALEAGV

SEQ ID NO: 236976 - protein, 9 aa, Homo Sapiens
DITKNERLW

SEQ ID NO: 236977 - protein, 9 aa, Homo Sapiens
LKLTTQPKR

SEQ ID NO: 236978 - protein, 9 aa, Homo Sapiens
KQFLDFGFS

SEQ ID NO: 236979 - protein, 9 aa, Homo Sapiens
LLYFVILCE

SEQ ID NO: 236980 - protein, 9 aa, Homo Sapiens
VPELQDSLY

SEQ ID NO: 236981 - protein, 9 aa, Homo Sapiens
GFKNVSIVA

SEQ ID NO: 236982 - protein, 9 aa, Homo Sapiens
FDEIILDIA

SEQ ID NO: 236983 - protein, 9 aa, Homo Sapiens
ENSKVFDGT

SEQ ID NO: 236984 - protein, 9 aa, Homo Sapiens
LLRCPLQRL

SEQ ID NO: 236985 - protein, 9 aa, Homo Sapiens
INRCQNRDV

SEQ ID NO: 236986 - protein, 9 aa, Homo Sapiens
VGSLLKGRV

SEQ ID NO: 236987 - protein, 9 aa, Homo Sapiens
DSYIWVQFI

SEQ ID NO: 236988 - protein, 9 aa, Homo Sapiens
KSKRDYTPS

SEQ ID NO: 236989 - protein, 9 aa, Homo Sapiens
VDKPDDKSI

SEQ ID NO: 236990 - protein, 9 aa, Homo Sapiens
RWYMRFVTV

SEQ ID NO: 236991 - protein, 9 aa, Homo Sapiens
IEMDGSIGA

SEQ ID NO: 236992 - protein, 9 aa, Homo Sapiens
VMLGGEPYT

SEQ ID NO: 236993 - protein, 9 aa, Homo Sapiens
TVTLDQVWN

SEQ ID NO: 236994 - protein, 9 aa, Homo Sapiens
MLEQRDVEV

SEQ ID NO: 236995 - protein, 9 aa, Homo Sapiens
LVATSVQNL

SEQ ID NO: 236996 - protein, 9 aa, Homo Sapiens
TTASTEGSD

SEQ ID NO: 236997 - protein, 9 aa, Homo Sapiens
NGGVCQEGW

SEQ ID NO: 236998 - protein, 9 aa, Homo Sapiens
LPVTSFGCA

SEQ ID NO: 236999 - protein, 9 aa, Homo Sapiens
MQIPCVDAG

SEQ ID NO: 237000 - protein, 9 aa, Homo Sapiens
YGTVGAVSG

SEQ ID NO: 237001 - protein, 9 aa, Homo Sapiens
STTFPNNSA

SEQ ID NO: 237002 - protein, 9 aa, Homo Sapiens
YSSMMDKYE

SEQ ID NO: 237003 - protein, 9 aa, Homo Sapiens
GTHIDTLLC

SEQ ID NO: 237004 - protein, 9 aa, Homo Sapiens
NKVTDKSRQ

SEQ ID NO: 237005 - protein, 9 aa, Homo Sapiens
PGEYSVHIC

SEQ ID NO: 237006 - protein, 9 aa, Homo Sapiens
RKNQATDFQ

SEQ ID NO: 237007 - protein, 9 aa, Homo Sapiens
AEEYDLLCT

SEQ ID NO: 237008 - protein, 9 aa, Homo Sapiens
DPTEPCILH

SEQ ID NO: 237009 - protein, 9 aa, Homo Sapiens
YHNKPPGTP

SEQ ID NO: 237010 - protein, 9 aa, Homo Sapiens
SLTKYMTGK

SEQ ID NO: 237011 - protein, 9 aa, Homo Sapiens
SKSLHISNW

SEQ ID NO: 237012 - protein, 9 aa, Homo Sapiens
LHFFGGTDI

SEQ ID NO: 237013 - protein, 9 aa, Homo Sapiens
SHFCPHVKL

SEQ ID NO: 237014 - protein, 9 aa, Homo Sapiens
VMFVSVSAF

SEQ ID NO: 237015 - protein, 9 aa, Homo Sapiens
MIMWLQLDR

SEQ ID NO: 237016 - protein, 9 aa, Homo Sapiens
IMSSLTSIF

SEQ ID NO: 237017 - protein, 9 aa, Homo Sapiens
LLLKKILLR

SEQ ID NO: 237018 - protein, 9 aa, Homo Sapiens
YFVIIPLHT

SEQ ID NO: 237019 - protein, 9 aa, Homo Sapiens
RAPAGPVGT

SEQ ID NO: 237020 - protein, 9 aa, Homo Sapiens
YHKHGSTFI

SEQ ID NO: 237021 - protein, 9 aa, Homo Sapiens
WPSISHLTK

SEQ ID NO: 237022 - protein, 9 aa, Homo Sapiens
NTFIKEIPP

SEQ ID NO: 237023 - protein, 9 aa, Homo Sapiens
LSCLPYGHT

SEQ ID NO: 237024 - protein, 9 aa, Homo Sapiens
PAFRRLFEL

SEQ ID NO: 237025 - protein, 9 aa, Homo Sapiens
TIRTGFMLR

SEQ ID NO: 237026 - protein, 9 aa, Homo Sapiens
WNSISSGYL

SEQ ID NO: 237027 - protein, 9 aa, Homo Sapiens
TIISQHENI

SEQ ID NO: 237028 - protein, 9 aa, Homo Sapiens
ARNMSCQGF

SEQ ID NO: 237029 - protein, 9 aa, Homo Sapiens
HLFLTDFFR

SEQ ID NO: 237030 - protein, 9 aa, Homo Sapiens
CIFIWFCIV

SEQ ID NO: 237031 - protein, 9 aa, Homo Sapiens
ESLLNYAVT

SEQ ID NO: 237032 - protein, 9 aa, Homo Sapiens
KVGGQKMSC

SEQ ID NO: 237033 - protein, 9 aa, Homo Sapiens
LELAYLEQL

SEQ ID NO: 237034 - protein, 9 aa, Homo Sapiens
LNSRPQAED

SEQ ID NO: 237035 - protein, 9 aa, Homo Sapiens
NVAITFSHS

SEQ ID NO: 237036 - protein, 9 aa, Homo Sapiens
QITGRAGLK

SEQ ID NO: 237037 - protein, 9 aa, Homo Sapiens
QRKQRYCVN

SEQ ID NO: 237038 - protein, 9 aa, Homo Sapiens
LKCKMSLEI

SEQ ID NO: 237039 - protein, 9 aa, Homo Sapiens
HLATDNQKE

SEQ ID NO: 237040 - protein, 9 aa, Homo Sapiens
VFSVVRHHQ

SEQ ID NO: 237041 - protein, 9 aa, Homo Sapiens
PPRRDDHGG

SEQ ID NO: 237042 - protein, 9 aa, Homo Sapiens
SQVIQHKII

SEQ ID NO: 237043 - protein, 9 aa, Homo Sapiens
KVRDMNRTY

SEQ ID NO: 237044 - protein, 9 aa, Homo Sapiens
PCPGEFLCY

SEQ ID NO: 237045 - protein, 9 aa, Homo Sapiens
LRVAICKQE

SEQ ID NO: 237046 - protein, 9 aa, Homo Sapiens
DAPPQNRIP

SEQ ID NO: 237047 - protein, 9 aa, Homo Sapiens
FLSVTRVVS

SEQ ID NO: 237048 - protein, 9 aa, Homo Sapiens
EMASCQQQQ

SEQ ID NO: 237049 - protein, 9 aa, Homo Sapiens
NRMFQKEQR

SEQ ID NO: 237050 - protein, 9 aa, Homo Sapiens
QENLARNLG

SEQ ID NO: 237051 - protein, 9 aa, Homo Sapiens
QKANETILA

SEQ ID NO: 237052 - protein, 9 aa, Homo Sapiens
FHNTYLEDM

SEQ ID NO: 237053 - protein, 9 aa, Homo Sapiens
DTVVEKHKE

SEQ ID NO: 237054 - protein, 9 aa, Homo Sapiens
HITFENMIV

SEQ ID NO: 237055 - protein, 9 aa, Homo Sapiens
CLSPNCPNQ

SEQ ID NO: 237056 - protein, 9 aa, Homo Sapiens
EFSSSRAGK

SEQ ID NO: 237057 - protein, 9 aa, Homo Sapiens
TESTNLILQ

SEQ ID NO: 237058 - protein, 9 aa, Homo Sapiens
MKRYLHQNR

SEQ ID NO: 237059 - protein, 9 aa, Homo Sapiens
IYIRIHEII

SEQ ID NO: 237060 - protein, 9 aa, Homo Sapiens
LFASHFSLG

SEQ ID NO: 237061 - protein, 9 aa, Homo Sapiens
EQKIKQSVS

SEQ ID NO: 237062 - protein, 9 aa, Homo Sapiens
DFIGMFTDP

SEQ ID NO: 237063 - protein, 9 aa, Homo Sapiens
DEEAVVDFG

SEQ ID NO: 237064 - protein, 9 aa, Homo Sapiens
QGSQRRCPL

SEQ ID NO: 237065 - protein, 9 aa, Homo Sapiens
SSCAPPPTP

SEQ ID NO: 237066 - protein, 9 aa, Homo Sapiens
YGTVYSISS

SEQ ID NO: 237067 - protein, 9 aa, Homo Sapiens
DTFKWNLTT

SEQ ID NO: 237068 - protein, 9 aa, Homo Sapiens
ITLTAIGFG

SEQ ID NO: 237069 - protein, 9 aa, Homo Sapiens
AHKEKIQTV

SEQ ID NO: 237070 - protein, 9 aa, Homo Sapiens
QEANNFTFN

SEQ ID NO: 237071 - protein, 9 aa, Homo Sapiens
DIFPKKRGP

SEQ ID NO: 237072 - protein, 9 aa, Homo Sapiens
QQYVRADVE

SEQ ID NO: 237073 - protein, 9 aa, Homo Sapiens
DRFACTEEL

SEQ ID NO: 237074 - protein, 9 aa, Homo Sapiens
FKKMCDLLF

SEQ ID NO: 237075 - protein, 9 aa, Homo Sapiens
PVPAGFFNM

SEQ ID NO: 237076 - protein, 9 aa, Homo Sapiens
SILYHNLMN

SEQ ID NO: 237077 - protein, 9 aa, Homo Sapiens
TTDPITNSA

SEQ ID NO: 237078 - protein, 9 aa, Homo Sapiens
GKKKKKNKS

SEQ ID NO: 237079 - protein, 9 aa, Homo Sapiens
TNELWNKYK

SEQ ID NO: 237080 - protein, 9 aa, Homo Sapiens
AMGFMLMYD

SEQ ID NO: 237081 - protein, 9 aa, Homo Sapiens
QSLIKFASQ

SEQ ID NO: 237082 - protein, 9 aa, Homo Sapiens
VFGESITAS

SEQ ID NO: 237083 - protein, 9 aa, Homo Sapiens
DAIRSRLIN

SEQ ID NO: 237084 - protein, 9 aa, Homo Sapiens
VKNMDIIVL

SEQ ID NO: 237085 - protein, 9 aa, Homo Sapiens
TAQAPLALT

SEQ ID NO: 237086 - protein, 9 aa, Homo Sapiens
PYNYPVPIR

SEQ ID NO: 237087 - protein, 9 aa, Homo Sapiens
TNPELRRHR

SEQ ID NO: 237088 - protein, 9 aa, Homo Sapiens
EPFNTDLQL

SEQ ID NO: 237089 - protein, 9 aa, Homo Sapiens
LKNFKKIPM

SEQ ID NO: 237090 - protein, 9 aa, Homo Sapiens
LTNRASFKC

SEQ ID NO: 237091 - protein, 9 aa, Homo Sapiens
ENLPPIQNG

SEQ ID NO: 237092 - protein, 9 aa, Homo Sapiens
VRGVYSFWF

SEQ ID NO: 237093 - protein, 9 aa, Homo Sapiens
MASAWCLWR

SEQ ID NO: 237094 - protein, 9 aa, Homo Sapiens
TVEESFKNL

SEQ ID NO: 237095 - protein, 9 aa, Homo Sapiens
RDNVNSRLL

SEQ ID NO: 237096 - protein, 9 aa, Homo Sapiens
SFILVFCVA

SEQ ID NO: 237097 - protein, 9 aa, Homo Sapiens
SYNSSCYIS

SEQ ID NO: 237098 - protein, 9 aa, Homo Sapiens
GFGRSGRLV

SEQ ID NO: 237099 - protein, 9 aa, Homo Sapiens
YESSHFCPH

SEQ ID NO: 237100 - protein, 9 aa, Homo Sapiens
INKKFYRKF

SEQ ID NO: 237101 - protein, 9 aa, Homo Sapiens
ILCVGPSDL

SEQ ID NO: 237102 - protein, 9 aa, Homo Sapiens
EKIELEDLR

SEQ ID NO: 237103 - protein, 9 aa, Homo Sapiens
FTGILGKCL

SEQ ID NO: 237104 - protein, 9 aa, Homo Sapiens
FRKPYIFTL

SEQ ID NO: 237105 - protein, 9 aa, Homo Sapiens
PSYSSCFPR

SEQ ID NO: 237106 - protein, 9 aa, Homo Sapiens
INSAEQGPV

SEQ ID NO: 237107 - protein, 9 aa, Homo Sapiens
NSSHYGDFL

SEQ ID NO: 237108 - protein, 9 aa, Homo Sapiens
QFQTAPPGK

SEQ ID NO: 237109 - protein, 9 aa, Homo Sapiens
TTTRRAVNS

SEQ ID NO: 237110 - protein, 9 aa, Homo Sapiens
DNKPQFLQR

SEQ ID NO: 237111 - protein, 9 aa, Homo Sapiens
ILLTLQHIP

SEQ ID NO: 237112 - protein, 9 aa, Homo Sapiens
GSTITGSHQ

SEQ ID NO: 237113 - protein, 9 aa, Homo Sapiens
DALALHYFP

SEQ ID NO: 237114 - protein, 9 aa, Homo Sapiens
HSIFQINMI

SEQ ID NO: 237115 - protein, 9 aa, Homo Sapiens
EQHEEKPVR

SEQ ID NO: 237116 - protein, 9 aa, Homo Sapiens
KESRETCSI

SEQ ID NO: 237117 - protein, 9 aa, Homo Sapiens
YHNKILKGK

SEQ ID NO: 237118 - protein, 9 aa, Homo Sapiens
FLSVDDILM

SEQ ID NO: 237119 - protein, 9 aa, Homo Sapiens
LEVCDLPEE

SEQ ID NO: 237120 - protein, 9 aa, Homo Sapiens
GRKDVTFNT

SEQ ID NO: 237121 - protein, 9 aa, Homo Sapiens
QPVTSTIPV

SEQ ID NO: 237122 - protein, 9 aa, Homo Sapiens
GHIFALNWC

SEQ ID NO: 237123 - protein, 9 aa, Homo Sapiens
PDVATLLNI

SEQ ID NO: 237124 - protein, 9 aa, Homo Sapiens
VHKMLRQQQ

SEQ ID NO: 237125 - protein, 9 aa, Homo Sapiens
FTICKREPG

SEQ ID NO: 237126 - protein, 9 aa, Homo Sapiens
EQLVAVQAI

SEQ ID NO: 237127 - protein, 9 aa, Homo Sapiens
RIKVSREEI

SEQ ID NO: 237128 - protein, 9 aa, Homo Sapiens
SYTAQDYGA

SEQ ID NO: 237129 - protein, 9 aa, Homo Sapiens
VAQTAIRSL

SEQ ID NO: 237130 - protein, 9 aa, Homo Sapiens
TYFCAADKY

SEQ ID NO: 237131 - protein, 9 aa, Homo Sapiens
RYTGEFDET

SEQ ID NO: 237132 - protein, 9 aa, Homo Sapiens
HMLLRPHVL

SEQ ID NO: 237133 - protein, 9 aa, Homo Sapiens
VVGMLTITD

SEQ ID NO: 237134 - protein, 9 aa, Homo Sapiens
LARLTGIND

SEQ ID NO: 237135 - protein, 9 aa, Homo Sapiens
FNNIFYIVP

SEQ ID NO: 237136 - protein, 9 aa, Homo Sapiens
WSPTEGLGS

SEQ ID NO: 237137 - protein, 9 aa, Homo Sapiens
ESLGLHSRE

SEQ ID NO: 237138 - protein, 9 aa, Homo Sapiens
PPPQKVRIH

SEQ ID NO: 237139 - protein, 9 aa, Homo Sapiens
RLSRRLNTQ

SEQ ID NO: 237140 - protein, 9 aa, Homo Sapiens
YKQGKRKNA

SEQ ID NO: 237141 - protein, 9 aa, Homo Sapiens
VQDCRSPFI

SEQ ID NO: 237142 - protein, 9 aa, Homo Sapiens
FSLSYIISW

SEQ ID NO: 237143 - protein, 9 aa, Homo Sapiens
LISVKPLYN

SEQ ID NO: 237144 - protein, 9 aa, Homo Sapiens
SRKKTRRMG

SEQ ID NO: 237145 - protein, 9 aa, Homo Sapiens
QSRSNLPLP

SEQ ID NO: 237146 - protein, 9 aa, Homo Sapiens
TYQDTKASE

SEQ ID NO: 237147 - protein, 9 aa, Homo Sapiens
LGLEIKEEE

SEQ ID NO: 237148 - protein, 9 aa, Homo Sapiens
LANVFEKKD

SEQ ID NO: 237149 - protein, 9 aa, Homo Sapiens
LLGLMVLPF

SEQ ID NO: 237150 - protein, 9 aa, Homo Sapiens
LSAELKNAV

SEQ ID NO: 237151 - protein, 9 aa, Homo Sapiens
ENYDGGNYE

SEQ ID NO: 237152 - protein, 9 aa, Homo Sapiens
QQIIHTRER

SEQ ID NO: 237153 - protein, 9 aa, Homo Sapiens
TRVVSYRAQ

SEQ ID NO: 237154 - protein, 9 aa, Homo Sapiens
QKARRKGHR

SEQ ID NO: 237155 - protein, 9 aa, Homo Sapiens
LKEVKIEGA

SEQ ID NO: 237156 - protein, 9 aa, Homo Sapiens
NDPLPRICN

SEQ ID NO: 237157 - protein, 9 aa, Homo Sapiens
IEDSTLSKY

SEQ ID NO: 237158 - protein, 9 aa, Homo Sapiens
RTMIRYFTL

SEQ ID NO: 237159 - protein, 9 aa, Homo Sapiens
SQIDREELC

SEQ ID NO: 237160 - protein, 9 aa, Homo Sapiens
QEMKEAAKI

SEQ ID NO: 237161 - protein, 9 aa, Homo Sapiens
GILNQSDIK

SEQ ID NO: 237162 - protein, 9 aa, Homo Sapiens
GRSGRLVTR

SEQ ID NO: 237163 - protein, 9 aa, Homo Sapiens
DSLQNSFNS

SEQ ID NO: 237164 - protein, 9 aa, Homo Sapiens
AWGPPTAFY

SEQ ID NO: 237165 - protein, 9 aa, Homo Sapiens
SPISGLQAT

SEQ ID NO: 237166 - protein, 9 aa, Homo Sapiens
SRVDAGWIG

SEQ ID NO: 237167 - protein, 9 aa, Homo Sapiens
ERRGRPDIS

SEQ ID NO: 237168 - protein, 9 aa, Homo Sapiens
RTIEKLAGK

SEQ ID NO: 237169 - protein, 9 aa, Homo Sapiens
LPTTNMAQT

SEQ ID NO: 237170 - protein, 9 aa, Homo Sapiens
LAHPPQDGE

SEQ ID NO: 237171 - protein, 9 aa, Homo Sapiens
KLIAEQLQQ

SEQ ID NO: 237172 - protein, 9 aa, Homo Sapiens
KNLNHNSDL

SEQ ID NO: 237173 - protein, 9 aa, Homo Sapiens
NLVDGVYCI

SEQ ID NO: 237174 - protein, 9 aa, Homo Sapiens
KRVLNNLSP

SEQ ID NO: 237175 - protein, 9 aa, Homo Sapiens
HCEHLKKVD

SEQ ID NO: 237176 - protein, 9 aa, Homo Sapiens
TAISGIRPE

SEQ ID NO: 237177 - protein, 9 aa, Homo Sapiens
NTVALNADI

SEQ ID NO: 237178 - protein, 9 aa, Homo Sapiens
IPVNYVKIL

SEQ ID NO: 237179 - protein, 9 aa, Homo Sapiens
NGEYIYAFA

SEQ ID NO: 237180 - protein, 9 aa, Homo Sapiens
SKLVDWIIL

SEQ ID NO: 237181 - protein, 9 aa, Homo Sapiens
EAEEKACLA

SEQ ID NO: 237182 - protein, 9 aa, Homo Sapiens
EYKWGMEQG

SEQ ID NO: 237183 - protein, 9 aa, Homo Sapiens
KTEFINRLS

SEQ ID NO: 237184 - protein, 9 aa, Homo Sapiens
VFLRQAVNL

SEQ ID NO: 237185 - protein, 9 aa, Homo Sapiens
LYVVIAKKV

SEQ ID NO: 237186 - protein, 9 aa, Homo Sapiens
VQRESEGDK

SEQ ID NO: 237187 - protein, 9 aa, Homo Sapiens
CKECGKYFT

SEQ ID NO: 237188 - protein, 9 aa, Homo Sapiens
VGQHQELRD

SEQ ID NO: 237189 - protein, 9 aa, Homo Sapiens
GHPDNSVRA

SEQ ID NO: 237190 - protein, 9 aa, Homo Sapiens
IFSVLSLTS

SEQ ID NO: 237191 - protein, 9 aa, Homo Sapiens
ALIILNSER

SEQ ID NO: 237192 - protein, 9 aa, Homo Sapiens
AVSHAGSKS

SEQ ID NO: 237193 - protein, 9 aa, Homo Sapiens
KLRYEIYTG

SEQ ID NO: 237194 - protein, 9 aa, Homo Sapiens
VSGVAILMT

SEQ ID NO: 237195 - protein, 9 aa, Homo Sapiens
RRISSLESI

SEQ ID NO: 237196 - protein, 9 aa, Homo Sapiens
DLTGAIKVF

SEQ ID NO: 237197 - protein, 9 aa, Homo Sapiens
VRMGKKVWE

SEQ ID NO: 237198 - protein, 9 aa, Homo Sapiens
NVKGTQICA

SEQ ID NO: 237199 - protein, 9 aa, Homo Sapiens
TERFDMARA

SEQ ID NO: 237200 - protein, 9 aa, Homo Sapiens
DAFGNIVFT

SEQ ID NO: 237201 - protein, 9 aa, Homo Sapiens
RKRWKRSSK

SEQ ID NO: 237202 - protein, 9 aa, Homo Sapiens
KHNRNEEQR

SEQ ID NO: 237203 - protein, 9 aa, Homo Sapiens
RLLPQYMCE

SEQ ID NO: 237204 - protein, 9 aa, Homo Sapiens
PSNLQLQRM

SEQ ID NO: 237205 - protein, 9 aa, Homo Sapiens
LSDSRLHSA

SEQ ID NO: 237206 - protein, 9 aa, Homo Sapiens
LMPTPNLDM

SEQ ID NO: 237207 - protein, 9 aa, Homo Sapiens
STLYTINVY

SEQ ID NO: 237208 - protein, 9 aa, Homo Sapiens
TDSSNEPPN

SEQ ID NO: 237209 - protein, 9 aa, Homo Sapiens
PEENNDTKS

SEQ ID NO: 237210 - protein, 9 aa, Homo Sapiens
FRLYLLSMA

SEQ ID NO: 237211 - protein, 9 aa, Homo Sapiens
QVMHGSLGA

SEQ ID NO: 237212 - protein, 9 aa, Homo Sapiens
AFCLLKAAA

SEQ ID NO: 237213 - protein, 9 aa, Homo Sapiens
TTPRVENQT

SEQ ID NO: 237214 - protein, 9 aa, Homo Sapiens
HFTSDSNHQ

SEQ ID NO: 237215 - protein, 9 aa, Homo Sapiens
YLSLLHANE

SEQ ID NO: 237216 - protein, 9 aa, Homo Sapiens
TVGEPGVPV

SEQ ID NO: 237217 - protein, 9 aa, Homo Sapiens
PGLIPYLVA

SEQ ID NO: 237218 - protein, 9 aa, Homo Sapiens
TAQKTAQLL

SEQ ID NO: 237219 - protein, 9 aa, Homo Sapiens
FFQSLTYAL

SEQ ID NO: 237220 - protein, 9 aa, Homo Sapiens
TMESRKVKK

SEQ ID NO: 237221 - protein, 9 aa, Homo Sapiens
AVAEANQHT

SEQ ID NO: 237222 - protein, 9 aa, Homo Sapiens
NPKTDNMVN

SEQ ID NO: 237223 - protein, 9 aa, Homo Sapiens
DKASKYISL

SEQ ID NO: 237224 - protein, 9 aa, Homo Sapiens
DRSHIKKTL

SEQ ID NO: 237225 - protein, 9 aa, Homo Sapiens
LSRDKKKGT

SEQ ID NO: 237226 - protein, 9 aa, Homo Sapiens
TAEDLTAQR

SEQ ID NO: 237227 - protein, 9 aa, Homo Sapiens
TLLYLKKNK

SEQ ID NO: 237228 - protein, 9 aa, Homo Sapiens
YSFEKVTLR

SEQ ID NO: 237229 - protein, 9 aa, Homo Sapiens
EDEKKEIEN

SEQ ID NO: 237230 - protein, 9 aa, Homo Sapiens
LVYGKKQPH

SEQ ID NO: 237231 - protein, 9 aa, Homo Sapiens
HVMCTDATL

SEQ ID NO: 237232 - protein, 9 aa, Homo Sapiens
DNEMCKLDP

SEQ ID NO: 237233 - protein, 9 aa, Homo Sapiens
EENKTGPTK

SEQ ID NO: 237234 - protein, 9 aa, Homo Sapiens
DTYQEYKES

SEQ ID NO: 237235 - protein, 9 aa, Homo Sapiens
CLGGKLWSI

SEQ ID NO: 237236 - protein, 9 aa, Homo Sapiens
TLFTLDYFG

SEQ ID NO: 237237 - protein, 9 aa, Homo Sapiens
PKDHREDVY

SEQ ID NO: 237238 - protein, 9 aa, Homo Sapiens
WQEEEKKKQ

SEQ ID NO: 237239 - protein, 9 aa, Homo Sapiens
QETMQEKAF

SEQ ID NO: 237240 - protein, 9 aa, Homo Sapiens
GLKAAMPYT

SEQ ID NO: 237241 - protein, 9 aa, Homo Sapiens
NGTLGWIPI

SEQ ID NO: 237242 - protein, 9 aa, Homo Sapiens
ATFISMQND

SEQ ID NO: 237243 - protein, 9 aa, Homo Sapiens
TDITPGPSQ

SEQ ID NO: 237244 - protein, 9 aa, Homo Sapiens
PKSSGKKCL

SEQ ID NO: 237245 - protein, 9 aa, Homo Sapiens
DLRHVRVFE

SEQ ID NO: 237246 - protein, 9 aa, Homo Sapiens
WVLAVAAVL

SEQ ID NO: 237247 - protein, 9 aa, Homo Sapiens
EQSNDGKND

SEQ ID NO: 237248 - protein, 9 aa, Homo Sapiens
KPEQVHQYS

SEQ ID NO: 237249 - protein, 9 aa, Homo Sapiens
LFTLEVYDL

SEQ ID NO: 237250 - protein, 9 aa, Homo Sapiens
MINSHLPSG

SEQ ID NO: 237251 - protein, 9 aa, Homo Sapiens
ESHLKAASN

SEQ ID NO: 237252 - protein, 9 aa, Homo Sapiens
DMSLFGDVL

SEQ ID NO: 237253 - protein, 9 aa, Homo Sapiens
DGLDKVHLE

SEQ ID NO: 237254 - protein, 9 aa, Homo Sapiens
TSTRTHHLE

SEQ ID NO: 237255 - protein, 9 aa, Homo Sapiens
GTGQCHCHQ

SEQ ID NO: 237256 - protein, 9 aa, Homo Sapiens
SHHLSNVQF

SEQ ID NO: 237257 - protein, 9 aa, Homo Sapiens
MCPYERRAF

SEQ ID NO: 237258 - protein, 9 aa, Homo Sapiens
SGTTRSRKP

SEQ ID NO: 237259 - protein, 9 aa, Homo Sapiens
FVIPSKAFA

SEQ ID NO: 237260 - protein, 9 aa, Homo Sapiens
TRVTANLSL

SEQ ID NO: 237261 - protein, 9 aa, Homo Sapiens
VFCNTNQIN

SEQ ID NO: 237262 - protein, 9 aa, Homo Sapiens
PEQIIATEQ

SEQ ID NO: 237263 - protein, 9 aa, Homo Sapiens
DTTHFSKEK

SEQ ID NO: 237264 - protein, 9 aa, Homo Sapiens
LYAWPFLET

SEQ ID NO: 237265 - protein, 9 aa, Homo Sapiens
RQFITQVKN

SEQ ID NO: 237266 - protein, 9 aa, Homo Sapiens
KSCFQNMGI

SEQ ID NO: 237267 - protein, 9 aa, Homo Sapiens
IHGLVQSVV

SEQ ID NO: 237268 - protein, 9 aa, Homo Sapiens
LTDCILSGI

SEQ ID NO: 237269 - protein, 9 aa, Homo Sapiens
QTTTMCIYV

SEQ ID NO: 237270 - protein, 9 aa, Homo Sapiens
GLRYFSGIK

SEQ ID NO: 237271 - protein, 9 aa, Homo Sapiens
TQKVPSGKH

SEQ ID NO: 237272 - protein, 9 aa, Homo Sapiens
NFEDRILLS

SEQ ID NO: 237273 - protein, 9 aa, Homo Sapiens
CKLSFGYVH

SEQ ID NO: 237274 - protein, 9 aa, Homo Sapiens
EDLISDATE

SEQ ID NO: 237275 - protein, 9 aa, Homo Sapiens
DPGFKRLAW

SEQ ID NO: 237276 - protein, 9 aa, Homo Sapiens
GACKAFFKR

SEQ ID NO: 237277 - protein, 9 aa, Homo Sapiens
FLLGKYIYI

SEQ ID NO: 237278 - protein, 9 aa, Homo Sapiens
HQGPQEQWF

SEQ ID NO: 237279 - protein, 9 aa, Homo Sapiens
HEGSWFYIH

SEQ ID NO: 237280 - protein, 9 aa, Homo Sapiens
FYPNTINVP

SEQ ID NO: 237281 - protein, 9 aa, Homo Sapiens
HNDNLYLGV

SEQ ID NO: 237282 - protein, 9 aa, Homo Sapiens
WEDRRKCQA

SEQ ID NO: 237283 - protein, 9 aa, Homo Sapiens
MHLLLGNLA

SEQ ID NO: 237284 - protein, 9 aa, Homo Sapiens
NTNNLWIYL

SEQ ID NO: 237285 - protein, 9 aa, Homo Sapiens
RIKDLAADL

SEQ ID NO: 237286 - protein, 9 aa, Homo Sapiens
KPSSSVSLT

SEQ ID NO: 237287 - protein, 9 aa, Homo Sapiens
MIPRCIKEE

SEQ ID NO: 237288 - protein, 9 aa, Homo Sapiens
AFQKFYERG

SEQ ID NO: 237289 - protein, 9 aa, Homo Sapiens
VEVALAEIP

SEQ ID NO: 237290 - protein, 9 aa, Homo Sapiens
ATAMGKNYG

SEQ ID NO: 237291 - protein, 9 aa, Homo Sapiens
PELRVNLDQ

SEQ ID NO: 237292 - protein, 9 aa, Homo Sapiens
GVQVTTIPA

SEQ ID NO: 237293 - protein, 9 aa, Homo Sapiens
KISNLMRKY

SEQ ID NO: 237294 - protein, 9 aa, Homo Sapiens
MKKYIKTNP

SEQ ID NO: 237295 - protein, 9 aa, Homo Sapiens
KLSKYFSKY

SEQ ID NO: 237296 - protein, 9 aa, Homo Sapiens
RYSHLTQHK

SEQ ID NO: 237297 - protein, 9 aa, Homo Sapiens
NITEFQHML

SEQ ID NO: 237298 - protein, 9 aa, Homo Sapiens
FSAVTASVT

SEQ ID NO: 237299 - protein, 9 aa, Homo Sapiens
MKYRRGPHV

SEQ ID NO: 237300 - protein, 9 aa, Homo Sapiens
LECEPPQRP

SEQ ID NO: 237301 - protein, 9 aa, Homo Sapiens
EQYSRKVFV

SEQ ID NO: 237302 - protein, 9 aa, Homo Sapiens
SAKSFQIHE

SEQ ID NO: 237303 - protein, 9 aa, Homo Sapiens
PQPMIKKAH

SEQ ID NO: 237304 - protein, 9 aa, Homo Sapiens
SNLDGTNWQ

SEQ ID NO: 237305 - protein, 9 aa, Homo Sapiens
IDSHNFAIR

SEQ ID NO: 237306 - protein, 9 aa, Homo Sapiens
CIYVSLSGF

SEQ ID NO: 237307 - protein, 9 aa, Homo Sapiens
WLFGHIQEI

SEQ ID NO: 237308 - protein, 9 aa, Homo Sapiens
ESNEAEDSE

SEQ ID NO: 237309 - protein, 9 aa, Homo Sapiens
NINYQIKEL

SEQ ID NO: 237310 - protein, 9 aa, Homo Sapiens
SFYKEYPGG

SEQ ID NO: 237311 - protein, 9 aa, Homo Sapiens
ILSNNKISG

SEQ ID NO: 237312 - protein, 9 aa, Homo Sapiens
SLSGLHKFC

SEQ ID NO: 237313 - protein, 9 aa, Homo Sapiens
RYFTLNPAS

SEQ ID NO: 237314 - protein, 9 aa, Homo Sapiens
CVIYCKRQL

SEQ ID NO: 237315 - protein, 9 aa, Homo Sapiens
LQRFLVTYI

SEQ ID NO: 237316 - protein, 9 aa, Homo Sapiens
HFSFRAGQH

SEQ ID NO: 237317 - protein, 9 aa, Homo Sapiens
ELTYHNTDL

SEQ ID NO: 237318 - protein, 9 aa, Homo Sapiens
THESLTLPW

SEQ ID NO: 237319 - protein, 9 aa, Homo Sapiens
EEQASINNR

SEQ ID NO: 237320 - protein, 9 aa, Homo Sapiens
FGKIRSLTI

SEQ ID NO: 237321 - protein, 9 aa, Homo Sapiens
DKLQSPQFY

SEQ ID NO: 237322 - protein, 9 aa, Homo Sapiens
YSTLMSRRF

SEQ ID NO: 237323 - protein, 9 aa, Homo Sapiens
WDAERAKAI

SEQ ID NO: 237324 - protein, 9 aa, Homo Sapiens
AIIISGTKM

SEQ ID NO: 237325 - protein, 9 aa, Homo Sapiens
PLRQEQAKL

SEQ ID NO: 237326 - protein, 9 aa, Homo Sapiens
ASSLPMLTP

SEQ ID NO: 237327 - protein, 9 aa, Homo Sapiens
VFLNAKTFY

SEQ ID NO: 237328 - protein, 9 aa, Homo Sapiens
KKTAELYVK

SEQ ID NO: 237329 - protein, 9 aa, Homo Sapiens
VFIHERPQK

SEQ ID NO: 237330 - protein, 9 aa, Homo Sapiens
CITECVRTA

SEQ ID NO: 237331 - protein, 9 aa, Homo Sapiens
NVSSSAVLC

SEQ ID NO: 237332 - protein, 9 aa, Homo Sapiens
SSCSISEDS

SEQ ID NO: 237333 - protein, 9 aa, Homo Sapiens
SVTRVVSYR

SEQ ID NO: 237334 - protein, 9 aa, Homo Sapiens
QAVPTTTVL

SEQ ID NO: 237335 - protein, 9 aa, Homo Sapiens
LRKHQIHIE

SEQ ID NO: 237336 - protein, 9 aa, Homo Sapiens
HESSQMSYL

SEQ ID NO: 237337 - protein, 9 aa, Homo Sapiens
GAECPGWAS

SEQ ID NO: 237338 - protein, 9 aa, Homo Sapiens
GIIGNNTIR

SEQ ID NO: 237339 - protein, 9 aa, Homo Sapiens
KTLEGAEEF

SEQ ID NO: 237340 - protein, 9 aa, Homo Sapiens
NFCEDPNGI

SEQ ID NO: 237341 - protein, 9 aa, Homo Sapiens
ASESPSSLD

SEQ ID NO: 237342 - protein, 9 aa, Homo Sapiens
EVKEEIINE

SEQ ID NO: 237343 - protein, 9 aa, Homo Sapiens
IVENLSPNQ

SEQ ID NO: 237344 - protein, 9 aa, Homo Sapiens
DGIGSRGDG

SEQ ID NO: 237345 - protein, 9 aa, Homo Sapiens
PVRSRVHTF

SEQ ID NO: 237346 - protein, 9 aa, Homo Sapiens
ILSVKLSPF

SEQ ID NO: 237347 - protein, 9 aa, Homo Sapiens
VILNLWKAR

SEQ ID NO: 237348 - protein, 9 aa, Homo Sapiens
RMMIFSWIV

SEQ ID NO: 237349 - protein, 9 aa, Homo Sapiens
WECNCTLLG

SEQ ID NO: 237350 - protein, 9 aa, Homo Sapiens
RPQIQRREV

SEQ ID NO: 237351 - protein, 9 aa, Homo Sapiens
PAHLSPSGA

SEQ ID NO: 237352 - protein, 9 aa, Homo Sapiens
VSWQDLKEF

SEQ ID NO: 237353 - protein, 9 aa, Homo Sapiens
KEIHYRKDS

SEQ ID NO: 237354 - protein, 9 aa, Homo Sapiens
FACFKEVNY

SEQ ID NO: 237355 - protein, 9 aa, Homo Sapiens
VLVNAIYVK

SEQ ID NO: 237356 - protein, 9 aa, Homo Sapiens
CETKLEAIA

SEQ ID NO: 237357 - protein, 9 aa, Homo Sapiens
SGANGSEIY

SEQ ID NO: 237358 - protein, 9 aa, Homo Sapiens
PSWIAVGVH

SEQ ID NO: 237359 - protein, 9 aa, Homo Sapiens
PLASECEAP

SEQ ID NO: 237360 - protein, 9 aa, Homo Sapiens
QCLNCSASQ

SEQ ID NO: 237361 - protein, 9 aa, Homo Sapiens
HRRVRLSRR

SEQ ID NO: 237362 - protein, 9 aa, Homo Sapiens
LSGCFDMFV

SEQ ID NO: 237363 - protein, 9 aa, Homo Sapiens
DEVFGIFDT

SEQ ID NO: 237364 - protein, 9 aa, Homo Sapiens
FFSNLSFLD

SEQ ID NO: 237365 - protein, 9 aa, Homo Sapiens
IKKAHKVFI

SEQ ID NO: 237366 - protein, 9 aa, Homo Sapiens
WSRVWQLAH

SEQ ID NO: 237367 - protein, 9 aa, Homo Sapiens
SFQCLCHVG

SEQ ID NO: 237368 - protein, 9 aa, Homo Sapiens
SHMPDTRFS

SEQ ID NO: 237369 - protein, 9 aa, Homo Sapiens
QRVHTADKP

SEQ ID NO: 237370 - protein, 9 aa, Homo Sapiens
INKAIHTGE

SEQ ID NO: 237371 - protein, 9 aa, Homo Sapiens
MLYGKTPFY

SEQ ID NO: 237372 - protein, 9 aa, Homo Sapiens
HDTRDPSSH

SEQ ID NO: 237373 - protein, 9 aa, Homo Sapiens
QDSSSSAAF

SEQ ID NO: 237374 - protein, 9 aa, Homo Sapiens
LSSLPFIYQ

SEQ ID NO: 237375 - protein, 9 aa, Homo Sapiens
DNDWFQLES

SEQ ID NO: 237376 - protein, 9 aa, Homo Sapiens
LDQHATSPF

SEQ ID NO: 237377 - protein, 9 aa, Homo Sapiens
MDRRRTALR

SEQ ID NO: 237378 - protein, 9 aa, Homo Sapiens
NGSHFFICT

SEQ ID NO: 237379 - protein, 9 aa, Homo Sapiens
LGTGLTDCI

SEQ ID NO: 237380 - protein, 9 aa, Homo Sapiens
DTITDEINF

SEQ ID NO: 237381 - protein, 9 aa, Homo Sapiens
ALAINSGGI

SEQ ID NO: 237382 - protein, 9 aa, Homo Sapiens
SGYKWCPTT

SEQ ID NO: 237383 - protein, 9 aa, Homo Sapiens
KSKYSTPNL

SEQ ID NO: 237384 - protein, 9 aa, Homo Sapiens
KEEIINENE

SEQ ID NO: 237385 - protein, 9 aa, Homo Sapiens
TGVSHSQKF

SEQ ID NO: 237386 - protein, 9 aa, Homo Sapiens
VQEAVSHGK

SEQ ID NO: 237387 - protein, 9 aa, Homo Sapiens
MEMYPAVFC

SEQ ID NO: 237388 - protein, 9 aa, Homo Sapiens
QPNMVVFVV

SEQ ID NO: 237389 - protein, 9 aa, Homo Sapiens
ACSYNQSRE

SEQ ID NO: 237390 - protein, 9 aa, Homo Sapiens
KKTFSGATM

SEQ ID NO: 237391 - protein, 9 aa, Homo Sapiens
LFTNRNRLS

SEQ ID NO: 237392 - protein, 9 aa, Homo Sapiens
TTSPNKYYL

SEQ ID NO: 237393 - protein, 9 aa, Homo Sapiens
KNNFVPYRD

SEQ ID NO: 237394 - protein, 9 aa, Homo Sapiens
LERRIKPFT

SEQ ID NO: 237395 - protein, 9 aa, Homo Sapiens
EVKTIMNSG

SEQ ID NO: 237396 - protein, 9 aa, Homo Sapiens
FLKEKEQQK

SEQ ID NO: 237397 - protein, 9 aa, Homo Sapiens
EKPAVTTAP

SEQ ID NO: 237398 - protein, 9 aa, Homo Sapiens
IDLLIVGSK

SEQ ID NO: 237399 - protein, 9 aa, Homo Sapiens
RHHYSNKWH

SEQ ID NO: 237400 - protein, 9 aa, Homo Sapiens
NYQVFPMNP

SEQ ID NO: 237401 - protein, 9 aa, Homo Sapiens
NRQIHTGKK

SEQ ID NO: 237402 - protein, 9 aa, Homo Sapiens
QITHSINNI

SEQ ID NO: 237403 - protein, 9 aa, Homo Sapiens
KPMELIVGK

SEQ ID NO: 237404 - protein, 9 aa, Homo Sapiens
ISYGSCISM

SEQ ID NO: 237405 - protein, 9 aa, Homo Sapiens
RHCNVTPLS

SEQ ID NO: 237406 - protein, 9 aa, Homo Sapiens
DLPGHLPGS

SEQ ID NO: 237407 - protein, 9 aa, Homo Sapiens
TVSQPTAPA

SEQ ID NO: 237408 - protein, 9 aa, Homo Sapiens
QAPDLRHFR

SEQ ID NO: 237409 - protein, 9 aa, Homo Sapiens
CVTSDEMYK

SEQ ID NO: 237410 - protein, 9 aa, Homo Sapiens
GAPDPQRCT

SEQ ID NO: 237411 - protein, 9 aa, Homo Sapiens
LTSTPNVHM

SEQ ID NO: 237412 - protein, 9 aa, Homo Sapiens
HTSPFPGIQ

SEQ ID NO: 237413 - protein, 9 aa, Homo Sapiens
IDTNYNRPT

SEQ ID NO: 237414 - protein, 9 aa, Homo Sapiens
SEGNRFIQD

SEQ ID NO: 237415 - protein, 9 aa, Homo Sapiens
VLHDLRQKS

SEQ ID NO: 237416 - protein, 9 aa, Homo Sapiens
YQSGGKIWR

SEQ ID NO: 237417 - protein, 9 aa, Homo Sapiens
GDEYEYEDM

SEQ ID NO: 237418 - protein, 9 aa, Homo Sapiens
EVAMQCLET

SEQ ID NO: 237419 - protein, 9 aa, Homo Sapiens
DQKALERDG

SEQ ID NO: 237420 - protein, 9 aa, Homo Sapiens
ELQDAATYN

SEQ ID NO: 237421 - protein, 9 aa, Homo Sapiens
LATLLHRKD

SEQ ID NO: 237422 - protein, 9 aa, Homo Sapiens
ILFSAVTAS

SEQ ID NO: 237423 - protein, 9 aa, Homo Sapiens
NASSQLAGR

SEQ ID NO: 237424 - protein, 9 aa, Homo Sapiens
KNLEVLMHV

SEQ ID NO: 237425 - protein, 9 aa, Homo Sapiens
FGPLQILLG

SEQ ID NO: 237426 - protein, 9 aa, Homo Sapiens
LKKPVAFSY

SEQ ID NO: 237427 - protein, 9 aa, Homo Sapiens
SSSITLQAT

SEQ ID NO: 237428 - protein, 9 aa, Homo Sapiens
CARYMPQNP

SEQ ID NO: 237429 - protein, 9 aa, Homo Sapiens
TGSKGESVW

SEQ ID NO: 237430 - protein, 9 aa, Homo Sapiens
MKKESKLEI

SEQ ID NO: 237431 - protein, 9 aa, Homo Sapiens
KDAEDEGED

SEQ ID NO: 237432 - protein, 9 aa, Homo Sapiens
VTLRRGLIS

SEQ ID NO: 237433 - protein, 9 aa, Homo Sapiens
IPEEEKRED

SEQ ID NO: 237434 - protein, 9 aa, Homo Sapiens
CFVCGIFFS

SEQ ID NO: 237435 - protein, 9 aa, Homo Sapiens
NRARPLHAL

SEQ ID NO: 237436 - protein, 9 aa, Homo Sapiens
MKCQKIQRE

SEQ ID NO: 237437 - protein, 9 aa, Homo Sapiens
VRGEEPMFV

SEQ ID NO: 237438 - protein, 9 aa, Homo Sapiens
LNKTSGLKN

SEQ ID NO: 237439 - protein, 9 aa, Homo Sapiens
EWDKMKMGQ

SEQ ID NO: 237440 - protein, 9 aa, Homo Sapiens
REVVQRGRM

SEQ ID NO: 237441 - protein, 9 aa, Homo Sapiens
PTWDVDLIL

SEQ ID NO: 237442 - protein, 9 aa, Homo Sapiens
YYLVFTVGL

SEQ ID NO: 237443 - protein, 9 aa, Homo Sapiens
TEELCEYVS

SEQ ID NO: 237444 - protein, 9 aa, Homo Sapiens
QSLLRTNTS

SEQ ID NO: 237445 - protein, 9 aa, Homo Sapiens
KDIESTKGE

SEQ ID NO: 237446 - protein, 9 aa, Homo Sapiens
CKKGFQRPS

SEQ ID NO: 237447 - protein, 9 aa, Homo Sapiens
SHRRVRLSR

SEQ ID NO: 237448 - protein, 9 aa, Homo Sapiens
NPCSNIPYF

SEQ ID NO: 237449 - protein, 9 aa, Homo Sapiens
GMFIAIVFS

SEQ ID NO: 237450 - protein, 9 aa, Homo Sapiens
PSQERLWAL

SEQ ID NO: 237451 - protein, 9 aa, Homo Sapiens
RWRRETTRL

SEQ ID NO: 237452 - protein, 9 aa, Homo Sapiens
WSKRVIYLQ

SEQ ID NO: 237453 - protein, 9 aa, Homo Sapiens
KLSWLLAKA

SEQ ID NO: 237454 - protein, 9 aa, Homo Sapiens
RTVKISDPN

SEQ ID NO: 237455 - protein, 9 aa, Homo Sapiens
IKCMLRNER

SEQ ID NO: 237456 - protein, 9 aa, Homo Sapiens
TYYHKHGST

SEQ ID NO: 237457 - protein, 9 aa, Homo Sapiens
KECAKTLIS

SEQ ID NO: 237458 - protein, 9 aa, Homo Sapiens
PWRLQMALE

SEQ ID NO: 237459 - protein, 9 aa, Homo Sapiens
AKLLKKFAS

SEQ ID NO: 237460 - protein, 9 aa, Homo Sapiens
DSQDVCIPV

SEQ ID NO: 237461 - protein, 9 aa, Homo Sapiens
LNPIHGLVQ

SEQ ID NO: 237462 - protein, 9 aa, Homo Sapiens
SEKGNLYKF

SEQ ID NO: 237463 - protein, 9 aa, Homo Sapiens
LNGEPGGGP

SEQ ID NO: 237464 - protein, 9 aa, Homo Sapiens
HDCFNSYHS

SEQ ID NO: 237465 - protein, 9 aa, Homo Sapiens
QEYASKLKR

SEQ ID NO: 237466 - protein, 9 aa, Homo Sapiens
QDEAEIYYL

SEQ ID NO: 237467 - protein, 9 aa, Homo Sapiens
GSGAESGYT

SEQ ID NO: 237468 - protein, 9 aa, Homo Sapiens
AYLSGDVPV

SEQ ID NO: 237469 - protein, 9 aa, Homo Sapiens
GQSEGNGGY

SEQ ID NO: 237470 - protein, 9 aa, Homo Sapiens
CKRCHPSVY

SEQ ID NO: 237471 - protein, 9 aa, Homo Sapiens
EIRRWDIID

SEQ ID NO: 237472 - protein, 9 aa, Homo Sapiens
RNKIRSELD

SEQ ID NO: 237473 - protein, 9 aa, Homo Sapiens
FAHSYIDVE

SEQ ID NO: 237474 - protein, 9 aa, Homo Sapiens
KIADMQGKL

SEQ ID NO: 237475 - protein, 9 aa, Homo Sapiens
LVMCPYERR

SEQ ID NO: 237476 - protein, 9 aa, Homo Sapiens
LKGPDVKGE

SEQ ID NO: 237477 - protein, 9 aa, Homo Sapiens
QQCAFDQKE

SEQ ID NO: 237478 - protein, 9 aa, Homo Sapiens
TASMSLMAP

SEQ ID NO: 237479 - protein, 9 aa, Homo Sapiens
QKSRTEMQE

SEQ ID NO: 237480 - protein, 9 aa, Homo Sapiens
THSRNITCI

SEQ ID NO: 237481 - protein, 9 aa, Homo Sapiens
FVQLYNTES

SEQ ID NO: 237482 - protein, 9 aa, Homo Sapiens
HNWSRENIQ

SEQ ID NO: 237483 - protein, 9 aa, Homo Sapiens
GFHSVKPTG

SEQ ID NO: 237484 - protein, 9 aa, Homo Sapiens
INHQCVHTG

SEQ ID NO: 237485 - protein, 9 aa, Homo Sapiens
VVQSVNHTK

SEQ ID NO: 237486 - protein, 9 aa, Homo Sapiens
RLGEPEDYL

SEQ ID NO: 237487 - protein, 9 aa, Homo Sapiens
RRVAVRPKP

SEQ ID NO: 237488 - protein, 9 aa, Homo Sapiens
KILFEESNL

SEQ ID NO: 237489 - protein, 9 aa, Homo Sapiens
GLLLLLFVE

SEQ ID NO: 237490 - protein, 9 aa, Homo Sapiens
RLGQLRRIQ

SEQ ID NO: 237491 - protein, 9 aa, Homo Sapiens
IPAYTMPLI

SEQ ID NO: 237492 - protein, 9 aa, Homo Sapiens
KNQECKGVS

SEQ ID NO: 237493 - protein, 9 aa, Homo Sapiens
YPTDPALPT

SEQ ID NO: 237494 - protein, 9 aa, Homo Sapiens
EPGVPVPRG

SEQ ID NO: 237495 - protein, 9 aa, Homo Sapiens
SDVPVHISA

SEQ ID NO: 237496 - protein, 9 aa, Homo Sapiens
SLDNFIPGH

SEQ ID NO: 237497 - protein, 9 aa, Homo Sapiens
YHFVNLMQE

SEQ ID NO: 237498 - protein, 9 aa, Homo Sapiens
VALPMSLLN

SEQ ID NO: 237499 - protein, 9 aa, Homo Sapiens
YEKIELEDL

SEQ ID NO: 237500 - protein, 9 aa, Homo Sapiens
NGLIKGQSA

SEQ ID NO: 237501 - protein, 9 aa, Homo Sapiens
NRSILALGN

SEQ ID NO: 237502 - protein, 9 aa, Homo Sapiens
IAHVHAENG

SEQ ID NO: 237503 - protein, 9 aa, Homo Sapiens
KFIDKKYPN

SEQ ID NO: 237504 - protein, 9 aa, Homo Sapiens
GANILRNSA

SEQ ID NO: 237505 - protein, 9 aa, Homo Sapiens
DNRIVAARL

SEQ ID NO: 237506 - protein, 9 aa, Homo Sapiens
QRTNSGEKP

SEQ ID NO: 237507 - protein, 9 aa, Homo Sapiens
TEHLFIPLP

SEQ ID NO: 237508 - protein, 9 aa, Homo Sapiens
ARNGSVVRT

SEQ ID NO: 237509 - protein, 9 aa, Homo Sapiens
ETPGELPSH

SEQ ID NO: 237510 - protein, 9 aa, Homo Sapiens
HLFSYYLIC

SEQ ID NO: 237511 - protein, 9 aa, Homo Sapiens
MQELVERLE

SEQ ID NO: 237512 - protein, 9 aa, Homo Sapiens
RCARHYKKS

SEQ ID NO: 237513 - protein, 9 aa, Homo Sapiens
YCTIRGCDK

SEQ ID NO: 237514 - protein, 9 aa, Homo Sapiens
HRFEYKEHG

SEQ ID NO: 237515 - protein, 9 aa, Homo Sapiens
AEDLTAQRK

SEQ ID NO: 237516 - protein, 9 aa, Homo Sapiens
PSSAQPFIT

SEQ ID NO: 237517 - protein, 9 aa, Homo Sapiens
LTDSEKGNL

SEQ ID NO: 237518 - protein, 9 aa, Homo Sapiens
AILFLSQKA

SEQ ID NO: 237519 - protein, 9 aa, Homo Sapiens
STRAAVKNK

SEQ ID NO: 237520 - protein, 9 aa, Homo Sapiens
KKGIFYHQA

SEQ ID NO: 237521 - protein, 9 aa, Homo Sapiens
LRSPAEYKI

SEQ ID NO: 237522 - protein, 9 aa, Homo Sapiens
RLQQLPFVI

SEQ ID NO: 237523 - protein, 9 aa, Homo Sapiens
VPMNGFAKL

SEQ ID NO: 237524 - protein, 9 aa, Homo Sapiens
SAHELENPE

SEQ ID NO: 237525 - protein, 9 aa, Homo Sapiens
TENLNGFIE

SEQ ID NO: 237526 - protein, 9 aa, Homo Sapiens
IHSAIPTEK

SEQ ID NO: 237527 - protein, 9 aa, Homo Sapiens
IELSLEEWH

SEQ ID NO: 237528 - protein, 9 aa, Homo Sapiens
EFILVGYVD

SEQ ID NO: 237529 - protein, 9 aa, Homo Sapiens
CERMNEEKE

SEQ ID NO: 237530 - protein, 9 aa, Homo Sapiens
FPGAPCAIQ

SEQ ID NO: 237531 - protein, 9 aa, Homo Sapiens
QGVKNMDII

SEQ ID NO: 237532 - protein, 9 aa, Homo Sapiens
AMLNKPVVT

SEQ ID NO: 237533 - protein, 9 aa, Homo Sapiens
IELSLEEWE

SEQ ID NO: 237534 - protein, 9 aa, Homo Sapiens
LLEHRDSIG

SEQ ID NO: 237535 - protein, 9 aa, Homo Sapiens
INPMAEDSD

SEQ ID NO: 237536 - protein, 9 aa, Homo Sapiens
VAESSTNNV

SEQ ID NO: 237537 - protein, 9 aa, Homo Sapiens
VDGNFILRD

SEQ ID NO: 237538 - protein, 9 aa, Homo Sapiens
AKEAMKSNH

SEQ ID NO: 237539 - protein, 9 aa, Homo Sapiens
SQSRLSQIL

SEQ ID NO: 237540 - protein, 9 aa, Homo Sapiens
KICHVDAHA

SEQ ID NO: 237541 - protein, 9 aa, Homo Sapiens
SPGKTEDKS

SEQ ID NO: 237542 - protein, 9 aa, Homo Sapiens
VLYLLDIPK

SEQ ID NO: 237543 - protein, 9 aa, Homo Sapiens
IGSLKGNIV

SEQ ID NO: 237544 - protein, 9 aa, Homo Sapiens
LVFGFIDHT

SEQ ID NO: 237545 - protein, 9 aa, Homo Sapiens
ALEQQNIQS

SEQ ID NO: 237546 - protein, 9 aa, Homo Sapiens
GVVQMTFLW

SEQ ID NO: 237547 - protein, 9 aa, Homo Sapiens
DHQDYCKVC

SEQ ID NO: 237548 - protein, 9 aa, Homo Sapiens
EGMSVGSPY

SEQ ID NO: 237549 - protein, 9 aa, Homo Sapiens
NEDGKRRTP

SEQ ID NO: 237550 - protein, 9 aa, Homo Sapiens
RLSALLDWR

SEQ ID NO: 237551 - protein, 9 aa, Homo Sapiens
DCILSGIMS

SEQ ID NO: 237552 - protein, 9 aa, Homo Sapiens
PGAGRFINY

SEQ ID NO: 237553 - protein, 9 aa, Homo Sapiens
HRCSTKYWM

SEQ ID NO: 237554 - protein, 9 aa, Homo Sapiens
QKDDVPVEN

SEQ ID NO: 237555 - protein, 9 aa, Homo Sapiens
TYAIELYER

SEQ ID NO: 237556 - protein, 9 aa, Homo Sapiens
IQYYMMFKV

SEQ ID NO: 237557 - protein, 9 aa, Homo Sapiens
ISYFWLDGS

SEQ ID NO: 237558 - protein, 9 aa, Homo Sapiens
EACKIYARA

SEQ ID NO: 237559 - protein, 9 aa, Homo Sapiens
QISSQRNCG

SEQ ID NO: 237560 - protein, 9 aa, Homo Sapiens
HENTNNLLC

SEQ ID NO: 237561 - protein, 9 aa, Homo Sapiens
YEQQQENLA

SEQ ID NO: 237562 - protein, 9 aa, Homo Sapiens
ILEQDIFHR

SEQ ID NO: 237563 - protein, 9 aa, Homo Sapiens
AIIIINGEI

SEQ ID NO: 237564 - protein, 9 aa, Homo Sapiens
CLAPIQDPK

SEQ ID NO: 237565 - protein, 9 aa, Homo Sapiens
NPQVLQKKF

SEQ ID NO: 237566 - protein, 9 aa, Homo Sapiens
MEEIKQLTT

SEQ ID NO: 237567 - protein, 9 aa, Homo Sapiens
IRIWVAIPL

SEQ ID NO: 237568 - protein, 9 aa, Homo Sapiens
LFMEREDKV

SEQ ID NO: 237569 - protein, 9 aa, Homo Sapiens
SYIWVQFIY

SEQ ID NO: 237570 - protein, 9 aa, Homo Sapiens
SKRINSSDE

SEQ ID NO: 237571 - protein, 9 aa, Homo Sapiens
DRLDQRHSK

SEQ ID NO: 237572 - protein, 9 aa, Homo Sapiens
YKESASSYQ

SEQ ID NO: 237573 - protein, 9 aa, Homo Sapiens
VAICIHYCD

SEQ ID NO: 237574 - protein, 9 aa, Homo Sapiens
EKDKGTARA

SEQ ID NO: 237575 - protein, 9 aa, Homo Sapiens
NFIPGHLQS

SEQ ID NO: 237576 - protein, 9 aa, Homo Sapiens
DFQLSVDYL

SEQ ID NO: 237577 - protein, 9 aa, Homo Sapiens
PGCSSNSFK

SEQ ID NO: 237578 - protein, 9 aa, Homo Sapiens
LWEVGTGAE

SEQ ID NO: 237579 - protein, 9 aa, Homo Sapiens
YLYRFLPNI

SEQ ID NO: 237580 - protein, 9 aa, Homo Sapiens
ETTSLPPNT

SEQ ID NO: 237581 - protein, 9 aa, Homo Sapiens
RICQRTHFV

SEQ ID NO: 237582 - protein, 9 aa, Homo Sapiens
LESEKVPHN

SEQ ID NO: 237583 - protein, 9 aa, Homo Sapiens
LPLLQSNKD

SEQ ID NO: 237584 - protein, 9 aa, Homo Sapiens
GNKMLRASS

SEQ ID NO: 237585 - protein, 9 aa, Homo Sapiens
EQVKRVKET

SEQ ID NO: 237586 - protein, 9 aa, Homo Sapiens
CCAAVGVGL

SEQ ID NO: 237587 - protein, 9 aa, Homo Sapiens
NKCIHTSST

SEQ ID NO: 237588 - protein, 9 aa, Homo Sapiens
LEVIIKDTS

SEQ ID NO: 237589 - protein, 9 aa, Homo Sapiens
CNQLGKQEP

SEQ ID NO: 237590 - protein, 9 aa, Homo Sapiens
LERERSYDL

SEQ ID NO: 237591 - protein, 9 aa, Homo Sapiens
PLGDYMVKT

SEQ ID NO: 237592 - protein, 9 aa, Homo Sapiens
LEVTNGTNS

SEQ ID NO: 237593 - protein, 9 aa, Homo Sapiens
DICGNNFGQ

SEQ ID NO: 237594 - protein, 9 aa, Homo Sapiens
RPFSKTPLH

SEQ ID NO: 237595 - protein, 9 aa, Homo Sapiens
LHCCDEEIR

SEQ ID NO: 237596 - protein, 9 aa, Homo Sapiens
SRVVKVVKP

SEQ ID NO: 237597 - protein, 9 aa, Homo Sapiens
LVKIYKHEG

SEQ ID NO: 237598 - protein, 9 aa, Homo Sapiens
YILGPEEEG

SEQ ID NO: 237599 - protein, 9 aa, Homo Sapiens
AMAGNDDED

SEQ ID NO: 237600 - protein, 9 aa, Homo Sapiens
YLYFKDSLG

SEQ ID NO: 237601 - protein, 9 aa, Homo Sapiens
IMQEKQIKA

SEQ ID NO: 237602 - protein, 9 aa, Homo Sapiens
QHCQQGSQR

SEQ ID NO: 237603 - protein, 9 aa, Homo Sapiens
TPELSFFNP

SEQ ID NO: 237604 - protein, 9 aa, Homo Sapiens
ETSLRESKS

SEQ ID NO: 237605 - protein, 9 aa, Homo Sapiens
VKNAQVQIN

SEQ ID NO: 237606 - protein, 9 aa, Homo Sapiens
EPEDYLGIV

SEQ ID NO: 237607 - protein, 9 aa, Homo Sapiens
TRKNKEVFA

SEQ ID NO: 237608 - protein, 9 aa, Homo Sapiens
WRSSALYII

SEQ ID NO: 237609 - protein, 9 aa, Homo Sapiens
IVPPATIWT

SEQ ID NO: 237610 - protein, 9 aa, Homo Sapiens
MSYLVETFV

SEQ ID NO: 237611 - protein, 9 aa, Homo Sapiens
VSKAQADSS

SEQ ID NO: 237612 - protein, 9 aa, Homo Sapiens
IIHLKRFHF

SEQ ID NO: 237613 - protein, 9 aa, Homo Sapiens
HRLLKDPLC

SEQ ID NO: 237614 - protein, 9 aa, Homo Sapiens
ERQLRKGDK

SEQ ID NO: 237615 - protein, 9 aa, Homo Sapiens
KNPYSFQPD

SEQ ID NO: 237616 - protein, 9 aa, Homo Sapiens
WRTEIIEDL

SEQ ID NO: 237617 - protein, 9 aa, Homo Sapiens
KPFTLEEKQ

SEQ ID NO: 237618 - protein, 9 aa, Homo Sapiens
LLRKDKDIL

SEQ ID NO: 237619 - protein, 9 aa, Homo Sapiens
PFREISKAQ

SEQ ID NO: 237620 - protein, 9 aa, Homo Sapiens
DFLGHVGGV

SEQ ID NO: 237621 - protein, 9 aa, Homo Sapiens
TFSKAAQQT

SEQ ID NO: 237622 - protein, 9 aa, Homo Sapiens
DSVEAVGAP

SEQ ID NO: 237623 - protein, 9 aa, Homo Sapiens
ISGLQATVD

SEQ ID NO: 237624 - protein, 9 aa, Homo Sapiens
TLASYKRIA

SEQ ID NO: 237625 - protein, 9 aa, Homo Sapiens
VKIYCQVEA

SEQ ID NO: 237626 - protein, 9 aa, Homo Sapiens
THVYTEYTL

SEQ ID NO: 237627 - protein, 9 aa, Homo Sapiens
QLLFCIFSR

SEQ ID NO: 237628 - protein, 9 aa, Homo Sapiens
AGDVAFVRD

SEQ ID NO: 237629 - protein, 9 aa, Homo Sapiens
IPPTARLTF

SEQ ID NO: 237630 - protein, 9 aa, Homo Sapiens
DLFGNGPPV

SEQ ID NO: 237631 - protein, 9 aa, Homo Sapiens
DNSGLTLYL

SEQ ID NO: 237632 - protein, 9 aa, Homo Sapiens
LLLQHLSQL

SEQ ID NO: 237633 - protein, 9 aa, Homo Sapiens
TAELYVKEY

SEQ ID NO: 237634 - protein, 9 aa, Homo Sapiens
EAGGQFRPK

SEQ ID NO: 237635 - protein, 9 aa, Homo Sapiens
ANQNKEDTT

SEQ ID NO: 237636 - protein, 9 aa, Homo Sapiens
ALSEQSPVA

SEQ ID NO: 237637 - protein, 9 aa, Homo Sapiens
LSYYSLEYL

SEQ ID NO: 237638 - protein, 9 aa, Homo Sapiens
LQSFQKELP

SEQ ID NO: 237639 - protein, 9 aa, Homo Sapiens
RRRMEMIVF

SEQ ID NO: 237640 - protein, 9 aa, Homo Sapiens
LPPCPFPLP

SEQ ID NO: 237641 - protein, 9 aa, Homo Sapiens
GTVQVLKWS

SEQ ID NO: 237642 - protein, 9 aa, Homo Sapiens
YGSLEEDDD

SEQ ID NO: 237643 - protein, 9 aa, Homo Sapiens
TNRIDENWY

SEQ ID NO: 237644 - protein, 9 aa, Homo Sapiens
FIMDNKRCA

SEQ ID NO: 237645 - protein, 9 aa, Homo Sapiens
DKCQTSMDE

SEQ ID NO: 237646 - protein, 9 aa, Homo Sapiens
AILLDRYVA

SEQ ID NO: 237647 - protein, 9 aa, Homo Sapiens
TKLGLFGVW

SEQ ID NO: 237648 - protein, 9 aa, Homo Sapiens
LGDYRFSGS

SEQ ID NO: 237649 - protein, 9 aa, Homo Sapiens
SCSSSSQTI

SEQ ID NO: 237650 - protein, 9 aa, Homo Sapiens
YHSRVKLAQ

SEQ ID NO: 237651 - protein, 9 aa, Homo Sapiens
SKMQPDEVF

SEQ ID NO: 237652 - protein, 9 aa, Homo Sapiens
YTLSHVNLP

SEQ ID NO: 237653 - protein, 9 aa, Homo Sapiens
DKMENFDYS

SEQ ID NO: 237654 - protein, 9 aa, Homo Sapiens
CIYVDAVIN

SEQ ID NO: 237655 - protein, 9 aa, Homo Sapiens
AFSFKLNLE

SEQ ID NO: 237656 - protein, 9 aa, Homo Sapiens
ANILRNSAG

SEQ ID NO: 237657 - protein, 9 aa, Homo Sapiens
LRNLERSAT

SEQ ID NO: 237658 - protein, 9 aa, Homo Sapiens
EVKPEKISN

SEQ ID NO: 237659 - protein, 9 aa, Homo Sapiens
YYLKNTSAE

SEQ ID NO: 237660 - protein, 9 aa, Homo Sapiens
QKEEGRRKV

SEQ ID NO: 237661 - protein, 9 aa, Homo Sapiens
ERDFIKLTL

SEQ ID NO: 237662 - protein, 9 aa, Homo Sapiens
DKEACVHKM

SEQ ID NO: 237663 - protein, 9 aa, Homo Sapiens
TDRCAQVPA

SEQ ID NO: 237664 - protein, 9 aa, Homo Sapiens
LLSDAACIV

SEQ ID NO: 237665 - protein, 9 aa, Homo Sapiens
KNKGKAEYN

SEQ ID NO: 237666 - protein, 9 aa, Homo Sapiens
SLKSHGIIR

SEQ ID NO: 237667 - protein, 9 aa, Homo Sapiens
DIKPLTFDA

SEQ ID NO: 237668 - protein, 9 aa, Homo Sapiens
KQSNSKARQ

SEQ ID NO: 237669 - protein, 9 aa, Homo Sapiens
EDNSKISHK

SEQ ID NO: 237670 - protein, 9 aa, Homo Sapiens
RAKAYLGEE

SEQ ID NO: 237671 - protein, 9 aa, Homo Sapiens
PFIIFGATG

SEQ ID NO: 237672 - protein, 9 aa, Homo Sapiens
EPGSLSRNT

SEQ ID NO: 237673 - protein, 9 aa, Homo Sapiens
NLDKLMYNA

SEQ ID NO: 237674 - protein, 9 aa, Homo Sapiens
CVPIYCQCK

SEQ ID NO: 237675 - protein, 9 aa, Homo Sapiens
YNINRIRLQ

SEQ ID NO: 237676 - protein, 9 aa, Homo Sapiens
KYETEEEKI

SEQ ID NO: 237677 - protein, 9 aa, Homo Sapiens
DTTPNKLVQ

SEQ ID NO: 237678 - protein, 9 aa, Homo Sapiens
LPNLGPSEN

SEQ ID NO: 237679 - protein, 9 aa, Homo Sapiens
LESMVAIAR

SEQ ID NO: 237680 - protein, 9 aa, Homo Sapiens
VKSYPGAQL

SEQ ID NO: 237681 - protein, 9 aa, Homo Sapiens
RSKRKVLGI

SEQ ID NO: 237682 - protein, 9 aa, Homo Sapiens
FVKPKGACK

SEQ ID NO: 237683 - protein, 9 aa, Homo Sapiens
WALLGPSQN

SEQ ID NO: 237684 - protein, 9 aa, Homo Sapiens
KASLNIDLR

SEQ ID NO: 237685 - protein, 9 aa, Homo Sapiens
GAGGLHVLL

SEQ ID NO: 237686 - protein, 9 aa, Homo Sapiens
QTYTTSSEQ

SEQ ID NO: 237687 - protein, 9 aa, Homo Sapiens
VQEKDYLAS

SEQ ID NO: 237688 - protein, 9 aa, Homo Sapiens
KKILNKEKS

SEQ ID NO: 237689 - protein, 9 aa, Homo Sapiens
SLQNLILGR

SEQ ID NO: 237690 - protein, 9 aa, Homo Sapiens
ASIYYPDHT

SEQ ID NO: 237691 - protein, 9 aa, Homo Sapiens
IQLPSNNRQ

SEQ ID NO: 237692 - protein, 9 aa, Homo Sapiens
LFLKGNISL

SEQ ID NO: 237693 - protein, 9 aa, Homo Sapiens
NDIYLTPNT

SEQ ID NO: 237694 - protein, 9 aa, Homo Sapiens
HIKEEKLFT

SEQ ID NO: 237695 - protein, 9 aa, Homo Sapiens
NAIESLEHV

SEQ ID NO: 237696 - protein, 9 aa, Homo Sapiens
RLNIHLKKG

SEQ ID NO: 237697 - protein, 9 aa, Homo Sapiens
SHHSGVDIC

SEQ ID NO: 237698 - protein, 9 aa, Homo Sapiens
AILDQKSNG

SEQ ID NO: 237699 - protein, 9 aa, Homo Sapiens
AGDGNKPSI

SEQ ID NO: 237700 - protein, 9 aa, Homo Sapiens
GSDPLQLVR

SEQ ID NO: 237701 - protein, 9 aa, Homo Sapiens
SRNTKLEFS

SEQ ID NO: 237702 - protein, 9 aa, Homo Sapiens
ERLVQLPCH

SEQ ID NO: 237703 - protein, 9 aa, Homo Sapiens
SSVSLLEEI

SEQ ID NO: 237704 - protein, 9 aa, Homo Sapiens
CIGAAIGFF

SEQ ID NO: 237705 - protein, 9 aa, Homo Sapiens
VINKAIHTG

SEQ ID NO: 237706 - protein, 9 aa, Homo Sapiens
GILIIHFLV

SEQ ID NO: 237707 - protein, 9 aa, Homo Sapiens
AQEYEKGKQ

SEQ ID NO: 237708 - protein, 9 aa, Homo Sapiens
EAISVVCRE

SEQ ID NO: 237709 - protein, 9 aa, Homo Sapiens
AEGAKVEED

SEQ ID NO: 237710 - protein, 9 aa, Homo Sapiens
HLKRFHFVN

SEQ ID NO: 237711 - protein, 9 aa, Homo Sapiens
DHGIPITGR

SEQ ID NO: 237712 - protein, 9 aa, Homo Sapiens
SSESMRKIK

SEQ ID NO: 237713 - protein, 9 aa, Homo Sapiens
GLELKKDKK

SEQ ID NO: 237714 - protein, 9 aa, Homo Sapiens
KPSKGVILY

SEQ ID NO: 237715 - protein, 9 aa, Homo Sapiens
GSYDEQSTY

SEQ ID NO: 237716 - protein, 9 aa, Homo Sapiens
LITELCKRS

SEQ ID NO: 237717 - protein, 9 aa, Homo Sapiens
TRDPSSHEM

SEQ ID NO: 237718 - protein, 9 aa, Homo Sapiens
HNNGGLIKG

SEQ ID NO: 237719 - protein, 9 aa, Homo Sapiens
DFVERRLIG

SEQ ID NO: 237720 - protein, 9 aa, Homo Sapiens
VLFNSKLPV

SEQ ID NO: 237721 - protein, 9 aa, Homo Sapiens
RLQGNDLLE

SEQ ID NO: 237722 - protein, 9 aa, Homo Sapiens
ANGSEIYIW

SEQ ID NO: 237723 - protein, 9 aa, Homo Sapiens
IRVHSANKF

SEQ ID NO: 237724 - protein, 9 aa, Homo Sapiens
AKNALNGIH

SEQ ID NO: 237725 - protein, 9 aa, Homo Sapiens
ICAIISVSS

SEQ ID NO: 237726 - protein, 9 aa, Homo Sapiens
RSRALSRNP

SEQ ID NO: 237727 - protein, 9 aa, Homo Sapiens
TENDMERKV

SEQ ID NO: 237728 - protein, 9 aa, Homo Sapiens
QHLDNLSNQ

SEQ ID NO: 237729 - protein, 9 aa, Homo Sapiens
GSGTTAENK

SEQ ID NO: 237730 - protein, 9 aa, Homo Sapiens
FQYQIIHAG

SEQ ID NO: 237731 - protein, 9 aa, Homo Sapiens
WLCRHVHRN

SEQ ID NO: 237732 - protein, 9 aa, Homo Sapiens
PLTAIIVSI

SEQ ID NO: 237733 - protein, 9 aa, Homo Sapiens
SAGLHKHRI

SEQ ID NO: 237734 - protein, 9 aa, Homo Sapiens
DIATYRSLL

SEQ ID NO: 237735 - protein, 9 aa, Homo Sapiens
KSSAQFMGS

SEQ ID NO: 237736 - protein, 9 aa, Homo Sapiens
EKSVEQTQI

SEQ ID NO: 237737 - protein, 9 aa, Homo Sapiens
LSNEEINLL

SEQ ID NO: 237738 - protein, 9 aa, Homo Sapiens
GNLLKVLAC

SEQ ID NO: 237739 - protein, 9 aa, Homo Sapiens
NQEECKGFS

SEQ ID NO: 237740 - protein, 9 aa, Homo Sapiens
KMKLRKEAK

SEQ ID NO: 237741 - protein, 9 aa, Homo Sapiens
NKGDGLSNR

SEQ ID NO: 237742 - protein, 9 aa, Homo Sapiens
PGPGIKLYP

SEQ ID NO: 237743 - protein, 9 aa, Homo Sapiens
TDKGRDSSS

SEQ ID NO: 237744 - protein, 9 aa, Homo Sapiens
FTYVFLRQA

SEQ ID NO: 237745 - protein, 9 aa, Homo Sapiens
LKINENIYQ

SEQ ID NO: 237746 - protein, 9 aa, Homo Sapiens
TGLATIASL

SEQ ID NO: 237747 - protein, 9 aa, Homo Sapiens
SKEGVEREV

SEQ ID NO: 237748 - protein, 9 aa, Homo Sapiens
SDFLPSQPR

SEQ ID NO: 237749 - protein, 9 aa, Homo Sapiens
KLFFRKLTY

SEQ ID NO: 237750 - protein, 9 aa, Homo Sapiens
PPQQVSFPH

SEQ ID NO: 237751 - protein, 9 aa, Homo Sapiens
KKSCSGTTR

SEQ ID NO: 237752 - protein, 9 aa, Homo Sapiens
RHDTFSDSP

SEQ ID NO: 237753 - protein, 9 aa, Homo Sapiens
VIYVYVQDC

SEQ ID NO: 237754 - protein, 9 aa, Homo Sapiens
YDSVIALVC

SEQ ID NO: 237755 - protein, 9 aa, Homo Sapiens
SPASSCSIS

SEQ ID NO: 237756 - protein, 9 aa, Homo Sapiens
DLKEFMRQA

SEQ ID NO: 237757 - protein, 9 aa, Homo Sapiens
NLVASGANG

SEQ ID NO: 237758 - protein, 9 aa, Homo Sapiens
VPILVRLGS

SEQ ID NO: 237759 - protein, 9 aa, Homo Sapiens
LPHFVRSEF

SEQ ID NO: 237760 - protein, 9 aa, Homo Sapiens
ETILISKAG

SEQ ID NO: 237761 - protein, 9 aa, Homo Sapiens
GIQKDFVDI

SEQ ID NO: 237762 - protein, 9 aa, Homo Sapiens
GESSLERPK

SEQ ID NO: 237763 - protein, 9 aa, Homo Sapiens
NGVLEANRL

SEQ ID NO: 237764 - protein, 9 aa, Homo Sapiens
QTILRKLLE

SEQ ID NO: 237765 - protein, 9 aa, Homo Sapiens
SAAHAIVLV

SEQ ID NO: 237766 - protein, 9 aa, Homo Sapiens
VWNTSTCEL

SEQ ID NO: 237767 - protein, 9 aa, Homo Sapiens
ERHNERKRK

SEQ ID NO: 237768 - protein, 9 aa, Homo Sapiens
KNKLVEELA

SEQ ID NO: 237769 - protein, 9 aa, Homo Sapiens
PTCYLAPQN

SEQ ID NO: 237770 - protein, 9 aa, Homo Sapiens
GVKDPEARK

SEQ ID NO: 237771 - protein, 9 aa, Homo Sapiens
SRPVSQETE

SEQ ID NO: 237772 - protein, 9 aa, Homo Sapiens
HDEILQAVS

SEQ ID NO: 237773 - protein, 9 aa, Homo Sapiens
SVNGLFAFL

SEQ ID NO: 237774 - protein, 9 aa, Homo Sapiens
NKTSGLKNI

SEQ ID NO: 237775 - protein, 9 aa, Homo Sapiens
FPLNAIYVK

SEQ ID NO: 237776 - protein, 9 aa, Homo Sapiens
LLTKIHLSP

SEQ ID NO: 237777 - protein, 9 aa, Homo Sapiens
RVLGKDCNK

SEQ ID NO: 237778 - protein, 9 aa, Homo Sapiens
TWKEVCFTC

SEQ ID NO: 237779 - protein, 9 aa, Homo Sapiens
AKLLLGQVG

SEQ ID NO: 237780 - protein, 9 aa, Homo Sapiens
PLNHEELEL

SEQ ID NO: 237781 - protein, 9 aa, Homo Sapiens
ACLTINQLL

SEQ ID NO: 237782 - protein, 9 aa, Homo Sapiens
SKKLRSGSY

SEQ ID NO: 237783 - protein, 9 aa, Homo Sapiens
SGSSFKMTT

SEQ ID NO: 237784 - protein, 9 aa, Homo Sapiens
SPPTQAPTQ

SEQ ID NO: 237785 - protein, 9 aa, Homo Sapiens
PQLSLYKHF

SEQ ID NO: 237786 - protein, 9 aa, Homo Sapiens
QDHNMALLQ

SEQ ID NO: 237787 - protein, 9 aa, Homo Sapiens
QCGECKLCL

SEQ ID NO: 237788 - protein, 9 aa, Homo Sapiens
TRYRLVPSR

SEQ ID NO: 237789 - protein, 9 aa, Homo Sapiens
GATLFTLDY

SEQ ID NO: 237790 - protein, 9 aa, Homo Sapiens
SILHQLFIA

SEQ ID NO: 237791 - protein, 9 aa, Homo Sapiens
TFPRENKPC

SEQ ID NO: 237792 - protein, 9 aa, Homo Sapiens
GPHTTAAPV

SEQ ID NO: 237793 - protein, 9 aa, Homo Sapiens
GILQCFIHD

SEQ ID NO: 237794 - protein, 9 aa, Homo Sapiens
SQSSSVDSL

SEQ ID NO: 237795 - protein, 9 aa, Homo Sapiens
ETLKYLGRY

SEQ ID NO: 237796 - protein, 9 aa, Homo Sapiens
TDPSDKKEK

SEQ ID NO: 237797 - protein, 9 aa, Homo Sapiens
KLCIHKRKS

SEQ ID NO: 237798 - protein, 9 aa, Homo Sapiens
ENAGDIPCC

SEQ ID NO: 237799 - protein, 9 aa, Homo Sapiens
GNAFIHSSA

SEQ ID NO: 237800 - protein, 9 aa, Homo Sapiens
TFNLFSTNN

SEQ ID NO: 237801 - protein, 9 aa, Homo Sapiens
LAEISDHYG

SEQ ID NO: 237802 - protein, 9 aa, Homo Sapiens
QIDVKGICK

SEQ ID NO: 237803 - protein, 9 aa, Homo Sapiens
IDQYSQILF

SEQ ID NO: 237804 - protein, 9 aa, Homo Sapiens
QSIGIQKPV

SEQ ID NO: 237805 - protein, 9 aa, Homo Sapiens
VLAVHYCHQ

SEQ ID NO: 237806 - protein, 9 aa, Homo Sapiens
FYTCDICGN

SEQ ID NO: 237807 - protein, 9 aa, Homo Sapiens
RSHHSPARR

SEQ ID NO: 237808 - protein, 9 aa, Homo Sapiens
PYGHTVTVV

SEQ ID NO: 237809 - protein, 9 aa, Homo Sapiens
NPELRRHRS

SEQ ID NO: 237810 - protein, 9 aa, Homo Sapiens
VQAKVLTWG

SEQ ID NO: 237811 - protein, 9 aa, Homo Sapiens
FGTVSQEPI

SEQ ID NO: 237812 - protein, 9 aa, Homo Sapiens
DPYSKRAIL

SEQ ID NO: 237813 - protein, 9 aa, Homo Sapiens
YVGRPFMTA

SEQ ID NO: 237814 - protein, 9 aa, Homo Sapiens
MSTRTNKDG

SEQ ID NO: 237815 - protein, 9 aa, Homo Sapiens
KKLINAAKL

SEQ ID NO: 237816 - protein, 9 aa, Homo Sapiens
PMAKHLMKH

SEQ ID NO: 237817 - protein, 9 aa, Homo Sapiens
RHGARVDKY

SEQ ID NO: 237818 - protein, 9 aa, Homo Sapiens
SHLTKDFID

SEQ ID NO: 237819 - protein, 9 aa, Homo Sapiens
AGDDSQDVC

SEQ ID NO: 237820 - protein, 9 aa, Homo Sapiens
GVFLYKMLV

SEQ ID NO: 237821 - protein, 9 aa, Homo Sapiens
DQLETEKKV

SEQ ID NO: 237822 - protein, 9 aa, Homo Sapiens
FDKAIKQCL

SEQ ID NO: 237823 - protein, 9 aa, Homo Sapiens
RINVCNAPH

SEQ ID NO: 237824 - protein, 9 aa, Homo Sapiens
LTEELLSQM

SEQ ID NO: 237825 - protein, 9 aa, Homo Sapiens
DTFISNEEP

SEQ ID NO: 237826 - protein, 9 aa, Homo Sapiens
LLHQHHELC

SEQ ID NO: 237827 - protein, 9 aa, Homo Sapiens
WPKANPGSW

SEQ ID NO: 237828 - protein, 9 aa, Homo Sapiens
LGPPTKKIR

SEQ ID NO: 237829 - protein, 9 aa, Homo Sapiens
IRQFLQWTE

SEQ ID NO: 237830 - protein, 9 aa, Homo Sapiens
TLTLHQQNH

SEQ ID NO: 237831 - protein, 9 aa, Homo Sapiens
LDKDNENFL

SEQ ID NO: 237832 - protein, 9 aa, Homo Sapiens
SRSVSDYSV

SEQ ID NO: 237833 - protein, 9 aa, Homo Sapiens
VQFKYLNMN

SEQ ID NO: 237834 - protein, 9 aa, Homo Sapiens
LISCELYLG

SEQ ID NO: 237835 - protein, 9 aa, Homo Sapiens
IFGATGLTS

SEQ ID NO: 237836 - protein, 9 aa, Homo Sapiens
HYKNLKYYR

SEQ ID NO: 237837 - protein, 9 aa, Homo Sapiens
MMISLSECM

SEQ ID NO: 237838 - protein, 9 aa, Homo Sapiens
HHRGIGLFP

SEQ ID NO: 237839 - protein, 9 aa, Homo Sapiens
SDNVELNCA

SEQ ID NO: 237840 - protein, 9 aa, Homo Sapiens
EKGKGQASQ

SEQ ID NO: 237841 - protein, 9 aa, Homo Sapiens
NPEYLSAND

SEQ ID NO: 237842 - protein, 9 aa, Homo Sapiens
TDRPSRMMF

SEQ ID NO: 237843 - protein, 9 aa, Homo Sapiens
ISITASTYY

SEQ ID NO: 237844 - protein, 9 aa, Homo Sapiens
IHILEAMLY

SEQ ID NO: 237845 - protein, 9 aa, Homo Sapiens
EFQMKEFLR

SEQ ID NO: 237846 - protein, 9 aa, Homo Sapiens
EEGSISIYT

SEQ ID NO: 237847 - protein, 9 aa, Homo Sapiens
PNQLDNLFC

SEQ ID NO: 237848 - protein, 9 aa, Homo Sapiens
IKYSFQEII

SEQ ID NO: 237849 - protein, 9 aa, Homo Sapiens
EYLFKRLTL

SEQ ID NO: 237850 - protein, 9 aa, Homo Sapiens
FLSETKTIY

SEQ ID NO: 237851 - protein, 9 aa, Homo Sapiens
TSGALSRLP

SEQ ID NO: 237852 - protein, 9 aa, Homo Sapiens
GAHFQVQLE

SEQ ID NO: 237853 - protein, 9 aa, Homo Sapiens
LTSSKIMAA

SEQ ID NO: 237854 - protein, 9 aa, Homo Sapiens
KNYCKVSSS

SEQ ID NO: 237855 - protein, 9 aa, Homo Sapiens
MQIHKHISI

SEQ ID NO: 237856 - protein, 9 aa, Homo Sapiens
NEAKFVTFS

SEQ ID NO: 237857 - protein, 9 aa, Homo Sapiens
SHFQHVKRG

SEQ ID NO: 237858 - protein, 9 aa, Homo Sapiens
LAGGNIYLD

SEQ ID NO: 237859 - protein, 9 aa, Homo Sapiens
KKMKPEVIS

SEQ ID NO: 237860 - protein, 9 aa, Homo Sapiens
QSFATPRAK

SEQ ID NO: 237861 - protein, 9 aa, Homo Sapiens
EEGISPLVK

SEQ ID NO: 237862 - protein, 9 aa, Homo Sapiens
NLELLNNGE

SEQ ID NO: 237863 - protein, 9 aa, Homo Sapiens
LYGTVCFGQ

SEQ ID NO: 237864 - protein, 9 aa, Homo Sapiens
NIDIEQDVN

SEQ ID NO: 237865 - protein, 9 aa, Homo Sapiens
SSERGPQMC

SEQ ID NO: 237866 - protein, 9 aa, Homo Sapiens
QEIDRYASD

SEQ ID NO: 237867 - protein, 9 aa, Homo Sapiens
LYEKRMQQH

SEQ ID NO: 237868 - protein, 9 aa, Homo Sapiens
VVERELGAL

SEQ ID NO: 237869 - protein, 9 aa, Homo Sapiens
QIVRFLDNS

SEQ ID NO: 237870 - protein, 9 aa, Homo Sapiens
RGWAIKETP

SEQ ID NO: 237871 - protein, 9 aa, Homo Sapiens
RRIQRQTPR

SEQ ID NO: 237872 - protein, 9 aa, Homo Sapiens
NSAFPPAVC

SEQ ID NO: 237873 - protein, 9 aa, Homo Sapiens
NIKKFTLGR

SEQ ID NO: 237874 - protein, 9 aa, Homo Sapiens
SVPNKDLEW

SEQ ID NO: 237875 - protein, 9 aa, Homo Sapiens
LEISGAQRS

SEQ ID NO: 237876 - protein, 9 aa, Homo Sapiens
TLLHFWLPF

SEQ ID NO: 237877 - protein, 9 aa, Homo Sapiens
FQVVKYAVL

SEQ ID NO: 237878 - protein, 9 aa, Homo Sapiens
CPWQVMLLV

SEQ ID NO: 237879 - protein, 9 aa, Homo Sapiens
CSLSYIVGA

SEQ ID NO: 237880 - protein, 9 aa, Homo Sapiens
PDVISYLTE

SEQ ID NO: 237881 - protein, 9 aa, Homo Sapiens
TAVLQQANE

SEQ ID NO: 237882 - protein, 9 aa, Homo Sapiens
PRRELGSKD

SEQ ID NO: 237883 - protein, 9 aa, Homo Sapiens
GFNEPKQSR

SEQ ID NO: 237884 - protein, 9 aa, Homo Sapiens
KRSPAALRH

SEQ ID NO: 237885 - protein, 9 aa, Homo Sapiens
LESESRSTY

SEQ ID NO: 237886 - protein, 9 aa, Homo Sapiens
GCGVLASAK

SEQ ID NO: 237887 - protein, 9 aa, Homo Sapiens
NDVDLWPAP

SEQ ID NO: 237888 - protein, 9 aa, Homo Sapiens
CILALPQFY

SEQ ID NO: 237889 - protein, 9 aa, Homo Sapiens
MDFDSKPHL

SEQ ID NO: 237890 - protein, 9 aa, Homo Sapiens
LSLQVCLTK

SEQ ID NO: 237891 - protein, 9 aa, Homo Sapiens
SYDEQSTYD

SEQ ID NO: 237892 - protein, 9 aa, Homo Sapiens
TKKTYFKNR

SEQ ID NO: 237893 - protein, 9 aa, Homo Sapiens
YEMFPASYS

SEQ ID NO: 237894 - protein, 9 aa, Homo Sapiens
NKSQDQWDG

SEQ ID NO: 237895 - protein, 9 aa, Homo Sapiens
NLNKDIEST

SEQ ID NO: 237896 - protein, 9 aa, Homo Sapiens
TVKISDPNL

SEQ ID NO: 237897 - protein, 9 aa, Homo Sapiens
LPSKPPFQF

SEQ ID NO: 237898 - protein, 9 aa, Homo Sapiens
VSYGQRLSF

SEQ ID NO: 237899 - protein, 9 aa, Homo Sapiens
QGKSQRNSL

SEQ ID NO: 237900 - protein, 9 aa, Homo Sapiens
RGYHGDQGS

SEQ ID NO: 237901 - protein, 9 aa, Homo Sapiens
NNFYTLVTE

SEQ ID NO: 237902 - protein, 9 aa, Homo Sapiens
HHIKNLKIH

SEQ ID NO: 237903 - protein, 9 aa, Homo Sapiens
KKIHTGEMP

SEQ ID NO: 237904 - protein, 9 aa, Homo Sapiens
VCSRNRHSQ

SEQ ID NO: 237905 - protein, 9 aa, Homo Sapiens
ITGVNFTGT

SEQ ID NO: 237906 - protein, 9 aa, Homo Sapiens
YPEVKDTLR

SEQ ID NO: 237907 - protein, 9 aa, Homo Sapiens
KLSDLLRKM

SEQ ID NO: 237908 - protein, 9 aa, Homo Sapiens
HIIHTGEKS

SEQ ID NO: 237909 - protein, 9 aa, Homo Sapiens
ACDLPEWCN

SEQ ID NO: 237910 - protein, 9 aa, Homo Sapiens
SSTLTFQAG

SEQ ID NO: 237911 - protein, 9 aa, Homo Sapiens
CDRKLLSRE

SEQ ID NO: 237912 - protein, 9 aa, Homo Sapiens
EDDEFLKGE

SEQ ID NO: 237913 - protein, 9 aa, Homo Sapiens
TSIIIRNTK

SEQ ID NO: 237914 - protein, 9 aa, Homo Sapiens
IQAVCCEND

SEQ ID NO: 237915 - protein, 9 aa, Homo Sapiens
ARRQLPASQ

SEQ ID NO: 237916 - protein, 9 aa, Homo Sapiens
TLAKQLEGS

SEQ ID NO: 237917 - protein, 9 aa, Homo Sapiens
PLFQYQIIH

SEQ ID NO: 237918 - protein, 9 aa, Homo Sapiens
SPYDGLCIA

SEQ ID NO: 237919 - protein, 9 aa, Homo Sapiens
AVPTSSSRQ

SEQ ID NO: 237920 - protein, 9 aa, Homo Sapiens
ANWRTEIIE

SEQ ID NO: 237921 - protein, 9 aa, Homo Sapiens
CVLQQCLAP

SEQ ID NO: 237922 - protein, 9 aa, Homo Sapiens
LYSGQILTC

SEQ ID NO: 237923 - protein, 9 aa, Homo Sapiens
TLYSTGSLD

SEQ ID NO: 237924 - protein, 9 aa, Homo Sapiens
RLNVNARER

SEQ ID NO: 237925 - protein, 9 aa, Homo Sapiens
DNKRCARHY

SEQ ID NO: 237926 - protein, 9 aa, Homo Sapiens
IRVFTCTHV

SEQ ID NO: 237927 - protein, 9 aa, Homo Sapiens
QEALDLCTV

SEQ ID NO: 237928 - protein, 9 aa, Homo Sapiens
KHKSSLKQV

SEQ ID NO: 237929 - protein, 9 aa, Homo Sapiens
YSSPSRGAP

SEQ ID NO: 237930 - protein, 9 aa, Homo Sapiens
CGAWSKSET

SEQ ID NO: 237931 - protein, 9 aa, Homo Sapiens
RNDLCFLKR

SEQ ID NO: 237932 - protein, 9 aa, Homo Sapiens
LGKSVVMRH

SEQ ID NO: 237933 - protein, 9 aa, Homo Sapiens
IICDDELIL

SEQ ID NO: 237934 - protein, 9 aa, Homo Sapiens
ASKEREKTR

SEQ ID NO: 237935 - protein, 9 aa, Homo Sapiens
DLCTVFGET

SEQ ID NO: 237936 - protein, 9 aa, Homo Sapiens
AAVLVSFMP

SEQ ID NO: 237937 - protein, 9 aa, Homo Sapiens
GIQLTAYLP

SEQ ID NO: 237938 - protein, 9 aa, Homo Sapiens
DSGSTKEIF

SEQ ID NO: 237939 - protein, 9 aa, Homo Sapiens
HYLSKMLED

SEQ ID NO: 237940 - protein, 9 aa, Homo Sapiens
KQSVSDITL

SEQ ID NO: 237941 - protein, 9 aa, Homo Sapiens
LNNLSPDSL

SEQ ID NO: 237942 - protein, 9 aa, Homo Sapiens
KYWKKERNE

SEQ ID NO: 237943 - protein, 9 aa, Homo Sapiens
ANKTNRGRR

SEQ ID NO: 237944 - protein, 9 aa, Homo Sapiens
TDREVQLGR

SEQ ID NO: 237945 - protein, 9 aa, Homo Sapiens
LKKGHSVVH

SEQ ID NO: 237946 - protein, 9 aa, Homo Sapiens
GEISAYQRL

SEQ ID NO: 237947 - protein, 9 aa, Homo Sapiens
TTTSRVTST

SEQ ID NO: 237948 - protein, 9 aa, Homo Sapiens
DKIIILYDT

SEQ ID NO: 237949 - protein, 9 aa, Homo Sapiens
FILFITWCR

SEQ ID NO: 237950 - protein, 9 aa, Homo Sapiens
MLEAQFAKI

SEQ ID NO: 237951 - protein, 9 aa, Homo Sapiens
SHPGNKSLV

SEQ ID NO: 237952 - protein, 9 aa, Homo Sapiens
PDHQNIAFG

SEQ ID NO: 237953 - protein, 9 aa, Homo Sapiens
YLCIAFYRY

SEQ ID NO: 237954 - protein, 9 aa, Homo Sapiens
QAESIITKT

SEQ ID NO: 237955 - protein, 9 aa, Homo Sapiens
GDADEKRFE

SEQ ID NO: 237956 - protein, 9 aa, Homo Sapiens
KAMLNKPVV

SEQ ID NO: 237957 - protein, 9 aa, Homo Sapiens
GGGDDLKLC

SEQ ID NO: 237958 - protein, 9 aa, Homo Sapiens
IPVINGRYL

SEQ ID NO: 237959 - protein, 9 aa, Homo Sapiens
GQLKEALDP

SEQ ID NO: 237960 - protein, 9 aa, Homo Sapiens
KTIVKLSDE

SEQ ID NO: 237961 - protein, 9 aa, Homo Sapiens
SRHLMVHQR

SEQ ID NO: 237962 - protein, 9 aa, Homo Sapiens
QVITAQVHP

SEQ ID NO: 237963 - protein, 9 aa, Homo Sapiens
LAAVQQPDG

SEQ ID NO: 237964 - protein, 9 aa, Homo Sapiens
QGGRAGDRA

SEQ ID NO: 237965 - protein, 9 aa, Homo Sapiens
DYGKFVIKD

SEQ ID NO: 237966 - protein, 9 aa, Homo Sapiens
QSVEGEFSE

SEQ ID NO: 237967 - protein, 9 aa, Homo Sapiens
LTKYMTGKE

SEQ ID NO: 237968 - protein, 9 aa, Homo Sapiens
ISCLFCGRF

SEQ ID NO: 237969 - protein, 9 aa, Homo Sapiens
IASLASYMP

SEQ ID NO: 237970 - protein, 9 aa, Homo Sapiens
IILPLTGGR

SEQ ID NO: 237971 - protein, 9 aa, Homo Sapiens
GLIPEEPRK

SEQ ID NO: 237972 - protein, 9 aa, Homo Sapiens
ELHLGGDSF

SEQ ID NO: 237973 - protein, 9 aa, Homo Sapiens
CTCGLEGNG

SEQ ID NO: 237974 - protein, 9 aa, Homo Sapiens
ISFQAVCRE

SEQ ID NO: 237975 - protein, 9 aa, Homo Sapiens
IKLKEDNIS

SEQ ID NO: 237976 - protein, 9 aa, Homo Sapiens
EAKKKDQAT

SEQ ID NO: 237977 - protein, 9 aa, Homo Sapiens
KKPPVTFAK

SEQ ID NO: 237978 - protein, 9 aa, Homo Sapiens
MCPNECVVS

SEQ ID NO: 237979 - protein, 9 aa, Homo Sapiens
ARFLGSMEV

SEQ ID NO: 237980 - protein, 9 aa, Homo Sapiens
RSKANIAFG

SEQ ID NO: 237981 - protein, 9 aa, Homo Sapiens
KIAVIRALQ

SEQ ID NO: 237982 - protein, 9 aa, Homo Sapiens
QTKPQMQEE

SEQ ID NO: 237983 - protein, 9 aa, Homo Sapiens
GHLLLLALL

SEQ ID NO: 237984 - protein, 9 aa, Homo Sapiens
NFFKQEFII

SEQ ID NO: 237985 - protein, 9 aa, Homo Sapiens
YGRDLGPPT

SEQ ID NO: 237986 - protein, 9 aa, Homo Sapiens
LSLSLVFLV

SEQ ID NO: 237987 - protein, 9 aa, Homo Sapiens
SSSCSQKYA

SEQ ID NO: 237988 - protein, 9 aa, Homo Sapiens
IMSVKNNYR

SEQ ID NO: 237989 - protein, 9 aa, Homo Sapiens
HLHIPMHLL

SEQ ID NO: 237990 - protein, 9 aa, Homo Sapiens
KPKLTFSCL

SEQ ID NO: 237991 - protein, 9 aa, Homo Sapiens
SCFLTINIM

SEQ ID NO: 237992 - protein, 9 aa, Homo Sapiens
VLKSQFQTA

SEQ ID NO: 237993 - protein, 9 aa, Homo Sapiens
EHCVHTLGS

SEQ ID NO: 237994 - protein, 9 aa, Homo Sapiens
RVHPDVRVV

SEQ ID NO: 237995 - protein, 9 aa, Homo Sapiens
QSECSGASS

SEQ ID NO: 237996 - protein, 9 aa, Homo Sapiens
VPDELTLAR

SEQ ID NO: 237997 - protein, 9 aa, Homo Sapiens
HMYEQGGGL

SEQ ID NO: 237998 - protein, 9 aa, Homo Sapiens
QNSPDGALE

SEQ ID NO: 237999 - protein, 9 aa, Homo Sapiens
SDSDMVSQA

SEQ ID NO: 238000 - protein, 9 aa, Homo Sapiens
PHCKIALFN

SEQ ID NO: 238001 - protein, 9 aa, Homo Sapiens
RFVIEDIPG

SEQ ID NO: 238002 - protein, 9 aa, Homo Sapiens
PVFLNGNYF

SEQ ID NO: 238003 - protein, 9 aa, Homo Sapiens
DMGYKTNFY

SEQ ID NO: 238004 - protein, 9 aa, Homo Sapiens
LLNLSLTTR

SEQ ID NO: 238005 - protein, 9 aa, Homo Sapiens
DYIPKDGET

SEQ ID NO: 238006 - protein, 9 aa, Homo Sapiens
NFILRDSES

SEQ ID NO: 238007 - protein, 9 aa, Homo Sapiens
CKVVNVLAV

SEQ ID NO: 238008 - protein, 9 aa, Homo Sapiens
TKKGCNDCC

SEQ ID NO: 238009 - protein, 9 aa, Homo Sapiens
IEGARLGLP

SEQ ID NO: 238010 - protein, 9 aa, Homo Sapiens
AYIVKNMAT

SEQ ID NO: 238011 - protein, 9 aa, Homo Sapiens
MSLYDLDIE

SEQ ID NO: 238012 - protein, 9 aa, Homo Sapiens
DKSTKGSTF

SEQ ID NO: 238013 - protein, 9 aa, Homo Sapiens
VWQNVSMAN

SEQ ID NO: 238014 - protein, 9 aa, Homo Sapiens
VSVNLLSKS

SEQ ID NO: 238015 - protein, 9 aa, Homo Sapiens
LLAAADLVM

SEQ ID NO: 238016 - protein, 9 aa, Homo Sapiens
AIRKIGERA

SEQ ID NO: 238017 - protein, 9 aa, Homo Sapiens
NVDFRIPTS

SEQ ID NO: 238018 - protein, 9 aa, Homo Sapiens
FCLLKAAAS

SEQ ID NO: 238019 - protein, 9 aa, Homo Sapiens
PELNIVPRT

SEQ ID NO: 238020 - protein, 9 aa, Homo Sapiens
VSYTVEVII

SEQ ID NO: 238021 - protein, 9 aa, Homo Sapiens
YNVFPRTRK

SEQ ID NO: 238022 - protein, 9 aa, Homo Sapiens
CQRIVGDCW

SEQ ID NO: 238023 - protein, 9 aa, Homo Sapiens
ERREDGSAD

SEQ ID NO: 238024 - protein, 9 aa, Homo Sapiens
RRNIAHQQH

SEQ ID NO: 238025 - protein, 9 aa, Homo Sapiens
TQFKETIEK

SEQ ID NO: 238026 - protein, 9 aa, Homo Sapiens
TVVVALDLH

SEQ ID NO: 238027 - protein, 9 aa, Homo Sapiens
KLVGVGEEV

SEQ ID NO: 238028 - protein, 9 aa, Homo Sapiens
EASRIMTLY

SEQ ID NO: 238029 - protein, 9 aa, Homo Sapiens
LIYGDPNFT

SEQ ID NO: 238030 - protein, 9 aa, Homo Sapiens
EKTVTKLGN

SEQ ID NO: 238031 - protein, 9 aa, Homo Sapiens
DLEEELVCR

SEQ ID NO: 238032 - protein, 9 aa, Homo Sapiens
TWQDEDGKK

SEQ ID NO: 238033 - protein, 9 aa, Homo Sapiens
APRPTQFLR

SEQ ID NO: 238034 - protein, 9 aa, Homo Sapiens
NIALMNSVF

SEQ ID NO: 238035 - protein, 9 aa, Homo Sapiens
FQWRNVGPN

SEQ ID NO: 238036 - protein, 9 aa, Homo Sapiens
WMKEKILSE

SEQ ID NO: 238037 - protein, 9 aa, Homo Sapiens
DSGTLARAS

SEQ ID NO: 238038 - protein, 9 aa, Homo Sapiens
DVVNCSTLP

SEQ ID NO: 238039 - protein, 9 aa, Homo Sapiens
VTEWYKLRK

SEQ ID NO: 238040 - protein, 9 aa, Homo Sapiens
TFLHEPFAS

SEQ ID NO: 238041 - protein, 9 aa, Homo Sapiens
QTQSGKDKE

SEQ ID NO: 238042 - protein, 9 aa, Homo Sapiens
TRGSPGQSI

SEQ ID NO: 238043 - protein, 9 aa, Homo Sapiens
AGLPRNEIA

SEQ ID NO: 238044 - protein, 9 aa, Homo Sapiens
PGLDEGHVQ

SEQ ID NO: 238045 - protein, 9 aa, Homo Sapiens
LLSTIPPGA

SEQ ID NO: 238046 - protein, 9 aa, Homo Sapiens
RELGSKDLK

SEQ ID NO: 238047 - protein, 9 aa, Homo Sapiens
SVDVSKVNR

SEQ ID NO: 238048 - protein, 9 aa, Homo Sapiens
QKIRELDSC

SEQ ID NO: 238049 - protein, 9 aa, Homo Sapiens
IYKVISRML

SEQ ID NO: 238050 - protein, 9 aa, Homo Sapiens
MLPQINLSK

SEQ ID NO: 238051 - protein, 9 aa, Homo Sapiens
NLFWSIFGL

SEQ ID NO: 238052 - protein, 9 aa, Homo Sapiens
EQEELAQQY

SEQ ID NO: 238053 - protein, 9 aa, Homo Sapiens
EGANYAVAV

SEQ ID NO: 238054 - protein, 9 aa, Homo Sapiens
AAENAVLQQ

SEQ ID NO: 238055 - protein, 9 aa, Homo Sapiens
LNGRYKCDL

SEQ ID NO: 238056 - protein, 9 aa, Homo Sapiens
RSGVNSERV

SEQ ID NO: 238057 - protein, 9 aa, Homo Sapiens
KDLSATVRT

SEQ ID NO: 238058 - protein, 9 aa, Homo Sapiens
DLTTLLNRN

SEQ ID NO: 238059 - protein, 9 aa, Homo Sapiens
YSQNTLIAL

SEQ ID NO: 238060 - protein, 9 aa, Homo Sapiens
DVIVMAWLK

SEQ ID NO: 238061 - protein, 9 aa, Homo Sapiens
VVRAEIMIS

SEQ ID NO: 238062 - protein, 9 aa, Homo Sapiens
NDPVLFATK

SEQ ID NO: 238063 - protein, 9 aa, Homo Sapiens
ITMIKIMLI

SEQ ID NO: 238064 - protein, 9 aa, Homo Sapiens
VNDSSSDVT

SEQ ID NO: 238065 - protein, 9 aa, Homo Sapiens
PITLAGNLC

SEQ ID NO: 238066 - protein, 9 aa, Homo Sapiens
EEALPVFNP

SEQ ID NO: 238067 - protein, 9 aa, Homo Sapiens
LKKEKGIHI

SEQ ID NO: 238068 - protein, 9 aa, Homo Sapiens
PIRGPGGKM

SEQ ID NO: 238069 - protein, 9 aa, Homo Sapiens
EVLQLIQPL

SEQ ID NO: 238070 - protein, 9 aa, Homo Sapiens
KKFLIWLSD

SEQ ID NO: 238071 - protein, 9 aa, Homo Sapiens
IHFLVIFPE

SEQ ID NO: 238072 - protein, 9 aa, Homo Sapiens
ACIEAHEKY

SEQ ID NO: 238073 - protein, 9 aa, Homo Sapiens
MLMRKRWKR

SEQ ID NO: 238074 - protein, 9 aa, Homo Sapiens
SNRPRKTSY

SEQ ID NO: 238075 - protein, 9 aa, Homo Sapiens
MLFEKMEEK

SEQ ID NO: 238076 - protein, 9 aa, Homo Sapiens
SSETAIMNN

SEQ ID NO: 238077 - protein, 9 aa, Homo Sapiens
IVATAGFCG

SEQ ID NO: 238078 - protein, 9 aa, Homo Sapiens
LISFIDHHG

SEQ ID NO: 238079 - protein, 9 aa, Homo Sapiens
VAARYPHIT

SEQ ID NO: 238080 - protein, 9 aa, Homo Sapiens
DLQSPNQQS

SEQ ID NO: 238081 - protein, 9 aa, Homo Sapiens
KQGSRLMDT

SEQ ID NO: 238082 - protein, 9 aa, Homo Sapiens
CKVLLTMER

SEQ ID NO: 238083 - protein, 9 aa, Homo Sapiens
DIQQLLNKI

SEQ ID NO: 238084 - protein, 9 aa, Homo Sapiens
DNENYARHW

SEQ ID NO: 238085 - protein, 9 aa, Homo Sapiens
LCSTFTQAS

SEQ ID NO: 238086 - protein, 9 aa, Homo Sapiens
VQHQVSEGV

SEQ ID NO: 238087 - protein, 9 aa, Homo Sapiens
KISMFLSVC

SEQ ID NO: 238088 - protein, 9 aa, Homo Sapiens
LSKLPKAEH

SEQ ID NO: 238089 - protein, 9 aa, Homo Sapiens
RSSTSPDCI

SEQ ID NO: 238090 - protein, 9 aa, Homo Sapiens
HLVNDPATD

SEQ ID NO: 238091 - protein, 9 aa, Homo Sapiens
IELENVFIG

SEQ ID NO: 238092 - protein, 9 aa, Homo Sapiens
LWTWRYQEK

SEQ ID NO: 238093 - protein, 9 aa, Homo Sapiens
PIMADLSSQ

SEQ ID NO: 238094 - protein, 9 aa, Homo Sapiens
IRNQDILIP

SEQ ID NO: 238095 - protein, 9 aa, Homo Sapiens
ASASSSNHS

SEQ ID NO: 238096 - protein, 9 aa, Homo Sapiens
CSKHHLNSL

SEQ ID NO: 238097 - protein, 9 aa, Homo Sapiens
MSRRFCIQL

SEQ ID NO: 238098 - protein, 9 aa, Homo Sapiens
LFVVLFAIY

SEQ ID NO: 238099 - protein, 9 aa, Homo Sapiens
IKYETEEEK

SEQ ID NO: 238100 - protein, 9 aa, Homo Sapiens
VWVMNLHWK

SEQ ID NO: 238101 - protein, 9 aa, Homo Sapiens
AIHADKQDC

SEQ ID NO: 238102 - protein, 9 aa, Homo Sapiens
KRSPIINVK

SEQ ID NO: 238103 - protein, 9 aa, Homo Sapiens
THKERSTYL

SEQ ID NO: 238104 - protein, 9 aa, Homo Sapiens
AMCARGGQV

SEQ ID NO: 238105 - protein, 9 aa, Homo Sapiens
RRTLEDHIK

SEQ ID NO: 238106 - protein, 9 aa, Homo Sapiens
KESKRLTIS

SEQ ID NO: 238107 - protein, 9 aa, Homo Sapiens
FKEEGRKHE

SEQ ID NO: 238108 - protein, 9 aa, Homo Sapiens
ECINPQYYK

SEQ ID NO: 238109 - protein, 9 aa, Homo Sapiens
LIVHQIIHT

SEQ ID NO: 238110 - protein, 9 aa, Homo Sapiens
KALTSKINL

SEQ ID NO: 238111 - protein, 9 aa, Homo Sapiens
IIILYDTSS

SEQ ID NO: 238112 - protein, 9 aa, Homo Sapiens
VHEYYDPND

SEQ ID NO: 238113 - protein, 9 aa, Homo Sapiens
LSLAYQTDN

SEQ ID NO: 238114 - protein, 9 aa, Homo Sapiens
NGEFYLRQP

SEQ ID NO: 238115 - protein, 9 aa, Homo Sapiens
IPVAIFYTI

SEQ ID NO: 238116 - protein, 9 aa, Homo Sapiens
VDENFRPQN

SEQ ID NO: 238117 - protein, 9 aa, Homo Sapiens
AVVGQYTQL

SEQ ID NO: 238118 - protein, 9 aa, Homo Sapiens
AKSHPLIDE

SEQ ID NO: 238119 - protein, 9 aa, Homo Sapiens
FSLLQSRLG

SEQ ID NO: 238120 - protein, 9 aa, Homo Sapiens
SCNPSYRNS

SEQ ID NO: 238121 - protein, 9 aa, Homo Sapiens
VALIKLKTK

SEQ ID NO: 238122 - protein, 9 aa, Homo Sapiens
KLKLTSNEL

SEQ ID NO: 238123 - protein, 9 aa, Homo Sapiens
DSLYFDFKD

SEQ ID NO: 238124 - protein, 9 aa, Homo Sapiens
RYKIKSDEQ

SEQ ID NO: 238125 - protein, 9 aa, Homo Sapiens
WIVSHIMEM

SEQ ID NO: 238126 - protein, 9 aa, Homo Sapiens
LTLCHILNL

SEQ ID NO: 238127 - protein, 9 aa, Homo Sapiens
NSYCFKTSV

SEQ ID NO: 238128 - protein, 9 aa, Homo Sapiens
ITPLHNDNS

SEQ ID NO: 238129 - protein, 9 aa, Homo Sapiens
VQIYHRKAK

SEQ ID NO: 238130 - protein, 9 aa, Homo Sapiens
ASVEETADL

SEQ ID NO: 238131 - protein, 9 aa, Homo Sapiens
PVLSLNTSL

SEQ ID NO: 238132 - protein, 9 aa, Homo Sapiens
NLSDLWEIE

SEQ ID NO: 238133 - protein, 9 aa, Homo Sapiens
YCYYQLHRV

SEQ ID NO: 238134 - protein, 9 aa, Homo Sapiens
VWEKRITKL

SEQ ID NO: 238135 - protein, 9 aa, Homo Sapiens
ASGPNNVPY

SEQ ID NO: 238136 - protein, 9 aa, Homo Sapiens
PATQQSPLM

SEQ ID NO: 238137 - protein, 9 aa, Homo Sapiens
RDLAACNIL

SEQ ID NO: 238138 - protein, 9 aa, Homo Sapiens
ILALGNVIN

SEQ ID NO: 238139 - protein, 9 aa, Homo Sapiens
IHHSENNWN

SEQ ID NO: 238140 - protein, 9 aa, Homo Sapiens
CGKYFSRKG

SEQ ID NO: 238141 - protein, 9 aa, Homo Sapiens
CSFKVLQGC

SEQ ID NO: 238142 - protein, 9 aa, Homo Sapiens
SLEVDLIQS

SEQ ID NO: 238143 - protein, 9 aa, Homo Sapiens
VAARIIDSN

SEQ ID NO: 238144 - protein, 9 aa, Homo Sapiens
GFPGAQEGG

SEQ ID NO: 238145 - protein, 9 aa, Homo Sapiens
GEITEKSLH

SEQ ID NO: 238146 - protein, 9 aa, Homo Sapiens
CPGEFLCYV

SEQ ID NO: 238147 - protein, 9 aa, Homo Sapiens
TRGSKTKKL

SEQ ID NO: 238148 - protein, 9 aa, Homo Sapiens
ISPAKQFNI

SEQ ID NO: 238149 - protein, 9 aa, Homo Sapiens
VMAIPPRDT

SEQ ID NO: 238150 - protein, 9 aa, Homo Sapiens
EKRIALEAR

SEQ ID NO: 238151 - protein, 9 aa, Homo Sapiens
GNYFIQGPS

SEQ ID NO: 238152 - protein, 9 aa, Homo Sapiens
PNVTVPSTT

SEQ ID NO: 238153 - protein, 9 aa, Homo Sapiens
RQVPLEGQA

SEQ ID NO: 238154 - protein, 9 aa, Homo Sapiens
PTYMAPEII

SEQ ID NO: 238155 - protein, 9 aa, Homo Sapiens
IKVPPSVGQ

SEQ ID NO: 238156 - protein, 9 aa, Homo Sapiens
ELSCRELEA

SEQ ID NO: 238157 - protein, 9 aa, Homo Sapiens
QRKYEETQK

SEQ ID NO: 238158 - protein, 9 aa, Homo Sapiens
SYAFPKSIN

SEQ ID NO: 238159 - protein, 9 aa, Homo Sapiens
DDDLLKINE

SEQ ID NO: 238160 - protein, 9 aa, Homo Sapiens
GQGTFYGEE

SEQ ID NO: 238161 - protein, 9 aa, Homo Sapiens
QVQTHFSTA

SEQ ID NO: 238162 - protein, 9 aa, Homo Sapiens
SPLQQSEAF

SEQ ID NO: 238163 - protein, 9 aa, Homo Sapiens
ESTGSLGMQ

SEQ ID NO: 238164 - protein, 9 aa, Homo Sapiens
RQHQQFMDR

SEQ ID NO: 238165 - protein, 9 aa, Homo Sapiens
SGAYIVFGE

SEQ ID NO: 238166 - protein, 9 aa, Homo Sapiens
GVQHFESEE

SEQ ID NO: 238167 - protein, 9 aa, Homo Sapiens
PGNKSLVSQ

SEQ ID NO: 238168 - protein, 9 aa, Homo Sapiens
HLEEGIRFL

SEQ ID NO: 238169 - protein, 9 aa, Homo Sapiens
RVKRILNFL

SEQ ID NO: 238170 - protein, 9 aa, Homo Sapiens
ENKSGRLSS

SEQ ID NO: 238171 - protein, 9 aa, Homo Sapiens
SLVAQQEAL

SEQ ID NO: 238172 - protein, 9 aa, Homo Sapiens
RGHKRARKI

SEQ ID NO: 238173 - protein, 9 aa, Homo Sapiens
LVTADSLPP

SEQ ID NO: 238174 - protein, 9 aa, Homo Sapiens
NPHLQAPMY

SEQ ID NO: 238175 - protein, 9 aa, Homo Sapiens
HYRFIKCCC

SEQ ID NO: 238176 - protein, 9 aa, Homo Sapiens
QEIAERVRK

SEQ ID NO: 238177 - protein, 9 aa, Homo Sapiens
KWKKYNKLK

SEQ ID NO: 238178 - protein, 9 aa, Homo Sapiens
KDFLSKCSK

SEQ ID NO: 238179 - protein, 9 aa, Homo Sapiens
RSLQSWVEF

SEQ ID NO: 238180 - protein, 9 aa, Homo Sapiens
LTKDGSNET

SEQ ID NO: 238181 - protein, 9 aa, Homo Sapiens
EAPVREEYA

SEQ ID NO: 238182 - protein, 9 aa, Homo Sapiens
YLANNHIKA

SEQ ID NO: 238183 - protein, 9 aa, Homo Sapiens
PSLPLFTPA

SEQ ID NO: 238184 - protein, 9 aa, Homo Sapiens
AAEDPVRAD

SEQ ID NO: 238185 - protein, 9 aa, Homo Sapiens
DSFLKSYFP

SEQ ID NO: 238186 - protein, 9 aa, Homo Sapiens
PLDTTHFSK

SEQ ID NO: 238187 - protein, 9 aa, Homo Sapiens
NPLIADPFL

SEQ ID NO: 238188 - protein, 9 aa, Homo Sapiens
LHSNSIAIV

SEQ ID NO: 238189 - protein, 9 aa, Homo Sapiens
TKALGNQQP

SEQ ID NO: 238190 - protein, 9 aa, Homo Sapiens
MTAGDFQDI

SEQ ID NO: 238191 - protein, 9 aa, Homo Sapiens
LLSCSFPDF

SEQ ID NO: 238192 - protein, 9 aa, Homo Sapiens
YVELVTVAD

SEQ ID NO: 238193 - protein, 9 aa, Homo Sapiens
HAIGKQQEK

SEQ ID NO: 238194 - protein, 9 aa, Homo Sapiens
RVKMHFKVN

SEQ ID NO: 238195 - protein, 9 aa, Homo Sapiens
TKDILKLNA

SEQ ID NO: 238196 - protein, 9 aa, Homo Sapiens
ALLRCRRTG

SEQ ID NO: 238197 - protein, 9 aa, Homo Sapiens
CPMSGVSVR

SEQ ID NO: 238198 - protein, 9 aa, Homo Sapiens
NWKMGHTMD

SEQ ID NO: 238199 - protein, 9 aa, Homo Sapiens
LCSELVEGQ

SEQ ID NO: 238200 - protein, 9 aa, Homo Sapiens
NMMKLLFDN

SEQ ID NO: 238201 - protein, 9 aa, Homo Sapiens
YLICVLLHG

SEQ ID NO: 238202 - protein, 9 aa, Homo Sapiens
IGQIIFSLA

SEQ ID NO: 238203 - protein, 9 aa, Homo Sapiens
ELKNAINKK

SEQ ID NO: 238204 - protein, 9 aa, Homo Sapiens
KQTNIEYGA

SEQ ID NO: 238205 - protein, 9 aa, Homo Sapiens
KTCGLAWGL

SEQ ID NO: 238206 - protein, 9 aa, Homo Sapiens
QRNQKRIAE

SEQ ID NO: 238207 - protein, 9 aa, Homo Sapiens
MEEVFLWVG

SEQ ID NO: 238208 - protein, 9 aa, Homo Sapiens
INKKIEKAL

SEQ ID NO: 238209 - protein, 9 aa, Homo Sapiens
DMDKIVSTL

SEQ ID NO: 238210 - protein, 9 aa, Homo Sapiens
SLAVSYNRL

SEQ ID NO: 238211 - protein, 9 aa, Homo Sapiens
KVQQSFATP

SEQ ID NO: 238212 - protein, 9 aa, Homo Sapiens
LSNVQFRWS

SEQ ID NO: 238213 - protein, 9 aa, Homo Sapiens
ELQKLLNFY

SEQ ID NO: 238214 - protein, 9 aa, Homo Sapiens
KVKRVLNNL

SEQ ID NO: 238215 - protein, 9 aa, Homo Sapiens
LIKFASQKS

SEQ ID NO: 238216 - protein, 9 aa, Homo Sapiens
QSNGGSPCT

SEQ ID NO: 238217 - protein, 9 aa, Homo Sapiens
SSRDSYSSP

SEQ ID NO: 238218 - protein, 9 aa, Homo Sapiens
EYIFHQCKD

SEQ ID NO: 238219 - protein, 9 aa, Homo Sapiens
IDKIVQYMI

SEQ ID NO: 238220 - protein, 9 aa, Homo Sapiens
GKARQQWCF

SEQ ID NO: 238221 - protein, 9 aa, Homo Sapiens
LRAGLCDHC

SEQ ID NO: 238222 - protein, 9 aa, Homo Sapiens
NEYQSNEME

SEQ ID NO: 238223 - protein, 9 aa, Homo Sapiens
NKRKKYPQM

SEQ ID NO: 238224 - protein, 9 aa, Homo Sapiens
YIKPHVRPI

SEQ ID NO: 238225 - protein, 9 aa, Homo Sapiens
IYEYKSKRY

SEQ ID NO: 238226 - protein, 9 aa, Homo Sapiens
NLALVDFCC

SEQ ID NO: 238227 - protein, 9 aa, Homo Sapiens
QEGPLEGEI

SEQ ID NO: 238228 - protein, 9 aa, Homo Sapiens
KGTLVFFLN

SEQ ID NO: 238229 - protein, 9 aa, Homo Sapiens
SPLGTVKEA

SEQ ID NO: 238230 - protein, 9 aa, Homo Sapiens
QDKIIHTGE

SEQ ID NO: 238231 - protein, 9 aa, Homo Sapiens
LPLPPKKWI

SEQ ID NO: 238232 - protein, 9 aa, Homo Sapiens
LAMETWLRL

SEQ ID NO: 238233 - protein, 9 aa, Homo Sapiens
KILWGVAVV

SEQ ID NO: 238234 - protein, 9 aa, Homo Sapiens
LCEHFGVRE

SEQ ID NO: 238235 - protein, 9 aa, Homo Sapiens
MALNSIFDS

SEQ ID NO: 238236 - protein, 9 aa, Homo Sapiens
HLTGECKNL

SEQ ID NO: 238237 - protein, 9 aa, Homo Sapiens
VQKAPLQKF

SEQ ID NO: 238238 - protein, 9 aa, Homo Sapiens
MNSGGGPSK

SEQ ID NO: 238239 - protein, 9 aa, Homo Sapiens
FDEPTSLLE

SEQ ID NO: 238240 - protein, 9 aa, Homo Sapiens
EEDDDYDNS

SEQ ID NO: 238241 - protein, 9 aa, Homo Sapiens
STWNYQNST

SEQ ID NO: 238242 - protein, 9 aa, Homo Sapiens
TLTSCQMLP

SEQ ID NO: 238243 - protein, 9 aa, Homo Sapiens
ILRKLLENS

SEQ ID NO: 238244 - protein, 9 aa, Homo Sapiens
EILISRLYN

SEQ ID NO: 238245 - protein, 9 aa, Homo Sapiens
NIAFGALQQ

SEQ ID NO: 238246 - protein, 9 aa, Homo Sapiens
KYKRVRLCF

SEQ ID NO: 238247 - protein, 9 aa, Homo Sapiens
DTNGVITLY

SEQ ID NO: 238248 - protein, 9 aa, Homo Sapiens
YYTKCKCFH

SEQ ID NO: 238249 - protein, 9 aa, Homo Sapiens
MTTENSVAV

SEQ ID NO: 238250 - protein, 9 aa, Homo Sapiens
SETYAIELY

SEQ ID NO: 238251 - protein, 9 aa, Homo Sapiens
KAKREENKK

SEQ ID NO: 238252 - protein, 9 aa, Homo Sapiens
EIGLVEEKD

SEQ ID NO: 238253 - protein, 9 aa, Homo Sapiens
ITAQVHPGE

SEQ ID NO: 238254 - protein, 9 aa, Homo Sapiens
PLLNGRYKC

SEQ ID NO: 238255 - protein, 9 aa, Homo Sapiens
PDDLAIATY

SEQ ID NO: 238256 - protein, 9 aa, Homo Sapiens
KKDLVMPNE

SEQ ID NO: 238257 - protein, 9 aa, Homo Sapiens
ILGSCASDR

SEQ ID NO: 238258 - protein, 9 aa, Homo Sapiens
FYLSLTQYE

SEQ ID NO: 238259 - protein, 9 aa, Homo Sapiens
LKCATGDII

SEQ ID NO: 238260 - protein, 9 aa, Homo Sapiens
LHLKGPDVK

SEQ ID NO: 238261 - protein, 9 aa, Homo Sapiens
SDALMTINR

SEQ ID NO: 238262 - protein, 9 aa, Homo Sapiens
ALSETSESH

SEQ ID NO: 238263 - protein, 9 aa, Homo Sapiens
LCSTHASND

SEQ ID NO: 238264 - protein, 9 aa, Homo Sapiens
AIHFGAFTI

SEQ ID NO: 238265 - protein, 9 aa, Homo Sapiens
ILKEVEYQM

SEQ ID NO: 238266 - protein, 9 aa, Homo Sapiens
YPSMAMIHS

SEQ ID NO: 238267 - protein, 9 aa, Homo Sapiens
KGLVPQNKG

SEQ ID NO: 238268 - protein, 9 aa, Homo Sapiens
KYLMLEESD

SEQ ID NO: 238269 - protein, 9 aa, Homo Sapiens
EEIQAREQR

SEQ ID NO: 238270 - protein, 9 aa, Homo Sapiens
TPALISWLE

SEQ ID NO: 238271 - protein, 9 aa, Homo Sapiens
GHSYLFKGA

SEQ ID NO: 238272 - protein, 9 aa, Homo Sapiens
NTFFPLLGN

SEQ ID NO: 238273 - protein, 9 aa, Homo Sapiens
TKAMAHLIQ

SEQ ID NO: 238274 - protein, 9 aa, Homo Sapiens
GKGILAIFQ

SEQ ID NO: 238275 - protein, 9 aa, Homo Sapiens
SKDDCSDVE

SEQ ID NO: 238276 - protein, 9 aa, Homo Sapiens
PVTPVIRAG

SEQ ID NO: 238277 - protein, 9 aa, Homo Sapiens
PTSNLYPSG

SEQ ID NO: 238278 - protein, 9 aa, Homo Sapiens
KGDGRYVSN

SEQ ID NO: 238279 - protein, 9 aa, Homo Sapiens
TGEKTINLN

SEQ ID NO: 238280 - protein, 9 aa, Homo Sapiens
QPGNTKSPE

SEQ ID NO: 238281 - protein, 9 aa, Homo Sapiens
LATKEKEVK

SEQ ID NO: 238282 - protein, 9 aa, Homo Sapiens
VKKIEARDG

SEQ ID NO: 238283 - protein, 9 aa, Homo Sapiens
IQQNIPKSS

SEQ ID NO: 238284 - protein, 9 aa, Homo Sapiens
YLKALEGLI

SEQ ID NO: 238285 - protein, 9 aa, Homo Sapiens
WTPLSGRKL

SEQ ID NO: 238286 - protein, 9 aa, Homo Sapiens
LDADTCPEV

SEQ ID NO: 238287 - protein, 9 aa, Homo Sapiens
LDSGSTKEI

SEQ ID NO: 238288 - protein, 9 aa, Homo Sapiens
DSYSKFNRS

SEQ ID NO: 238289 - protein, 9 aa, Homo Sapiens
QGNSHTETS

SEQ ID NO: 238290 - protein, 9 aa, Homo Sapiens
AASIYNISK

SEQ ID NO: 238291 - protein, 9 aa, Homo Sapiens
TFDRVSRLH

SEQ ID NO: 238292 - protein, 9 aa, Homo Sapiens
VLIRLSHPN

SEQ ID NO: 238293 - protein, 9 aa, Homo Sapiens
VRSDSKLEI

SEQ ID NO: 238294 - protein, 9 aa, Homo Sapiens
HDDQSLVKS

SEQ ID NO: 238295 - protein, 9 aa, Homo Sapiens
RDMNRTYVI

SEQ ID NO: 238296 - protein, 9 aa, Homo Sapiens
KMCWGGMIT

SEQ ID NO: 238297 - protein, 9 aa, Homo Sapiens
PVWLRSKFG

SEQ ID NO: 238298 - protein, 9 aa, Homo Sapiens
IWLQKQGKY

SEQ ID NO: 238299 - protein, 9 aa, Homo Sapiens
TEVTPELSF

SEQ ID NO: 238300 - protein, 9 aa, Homo Sapiens
NDLTYVTEE

SEQ ID NO: 238301 - protein, 9 aa, Homo Sapiens
YCTYLDKST

SEQ ID NO: 238302 - protein, 9 aa, Homo Sapiens
SENACEITS

SEQ ID NO: 238303 - protein, 9 aa, Homo Sapiens
YLMAGISDD

SEQ ID NO: 238304 - protein, 9 aa, Homo Sapiens
AFAGVGERT

SEQ ID NO: 238305 - protein, 9 aa, Homo Sapiens
HFSFSQKSD

SEQ ID NO: 238306 - protein, 9 aa, Homo Sapiens
HILINDAGV

SEQ ID NO: 238307 - protein, 9 aa, Homo Sapiens
GYPGETEDK

SEQ ID NO: 238308 - protein, 9 aa, Homo Sapiens
GNRHVQINA

SEQ ID NO: 238309 - protein, 9 aa, Homo Sapiens
AIKTDLTDP

SEQ ID NO: 238310 - protein, 9 aa, Homo Sapiens
NNEESNEAE

SEQ ID NO: 238311 - protein, 9 aa, Homo Sapiens
DSDFSHAIQ

SEQ ID NO: 238312 - protein, 9 aa, Homo Sapiens
VAQVLRHLF

SEQ ID NO: 238313 - protein, 9 aa, Homo Sapiens
NETPSVVSA

SEQ ID NO: 238314 - protein, 9 aa, Homo Sapiens
TRELANQLA

SEQ ID NO: 238315 - protein, 9 aa, Homo Sapiens
KKRGPPGPQ

SEQ ID NO: 238316 - protein, 9 aa, Homo Sapiens
DFGYHTAFA

SEQ ID NO: 238317 - protein, 9 aa, Homo Sapiens
GDNYIINCA

SEQ ID NO: 238318 - protein, 9 aa, Homo Sapiens
LLSYAILGF

SEQ ID NO: 238319 - protein, 9 aa, Homo Sapiens
VEAKVGQDS

SEQ ID NO: 238320 - protein, 9 aa, Homo Sapiens
KLSCNNTLL

SEQ ID NO: 238321 - protein, 9 aa, Homo Sapiens
KSAIVRQLL

SEQ ID NO: 238322 - protein, 9 aa, Homo Sapiens
NAKSCGEYI

SEQ ID NO: 238323 - protein, 9 aa, Homo Sapiens
TQPKRQKHL

SEQ ID NO: 238324 - protein, 9 aa, Homo Sapiens
QVRLCKRKE

SEQ ID NO: 238325 - protein, 9 aa, Homo Sapiens
VVVTNVISL

SEQ ID NO: 238326 - protein, 9 aa, Homo Sapiens
SGNFKNSER

SEQ ID NO: 238327 - protein, 9 aa, Homo Sapiens
EICKTFNIK

SEQ ID NO: 238328 - protein, 9 aa, Homo Sapiens
RCFYVDITT

SEQ ID NO: 238329 - protein, 9 aa, Homo Sapiens
TEKNIPKYN

SEQ ID NO: 238330 - protein, 9 aa, Homo Sapiens
QWCFDQINA

SEQ ID NO: 238331 - protein, 9 aa, Homo Sapiens
FLQPLWEHL

SEQ ID NO: 238332 - protein, 9 aa, Homo Sapiens
HPLECSLTE

SEQ ID NO: 238333 - protein, 9 aa, Homo Sapiens
ENELPNFPH

SEQ ID NO: 238334 - protein, 9 aa, Homo Sapiens
CALKKASTR

SEQ ID NO: 238335 - protein, 9 aa, Homo Sapiens
FEKMLNIGH

SEQ ID NO: 238336 - protein, 9 aa, Homo Sapiens
DILGFTPED

SEQ ID NO: 238337 - protein, 9 aa, Homo Sapiens
YIPENAGDI

SEQ ID NO: 238338 - protein, 9 aa, Homo Sapiens
QPPPPRYKQ

SEQ ID NO: 238339 - protein, 9 aa, Homo Sapiens
VVRDRPDTQ

SEQ ID NO: 238340 - protein, 9 aa, Homo Sapiens
QWSFACEQI

SEQ ID NO: 238341 - protein, 9 aa, Homo Sapiens
NASRFSQVF

SEQ ID NO: 238342 - protein, 9 aa, Homo Sapiens
LDNCINTMV

SEQ ID NO: 238343 - protein, 9 aa, Homo Sapiens
SLAHQSVEG

SEQ ID NO: 238344 - protein, 9 aa, Homo Sapiens
TEKSLHSIA

SEQ ID NO: 238345 - protein, 9 aa, Homo Sapiens
DPEVCKTMC

SEQ ID NO: 238346 - protein, 9 aa, Homo Sapiens
PSKGFQLTQ

SEQ ID NO: 238347 - protein, 9 aa, Homo Sapiens
QHFRSIPQQ

SEQ ID NO: 238348 - protein, 9 aa, Homo Sapiens
REEGTKYRY

SEQ ID NO: 238349 - protein, 9 aa, Homo Sapiens
EGALNEIAS

SEQ ID NO: 238350 - protein, 9 aa, Homo Sapiens
DSTGGPVPN

SEQ ID NO: 238351 - protein, 9 aa, Homo Sapiens
TTSIQNHVS

SEQ ID NO: 238352 - protein, 9 aa, Homo Sapiens
YSSLPRNIE

SEQ ID NO: 238353 - protein, 9 aa, Homo Sapiens
PFQPCEHLL

SEQ ID NO: 238354 - protein, 9 aa, Homo Sapiens
LSVEEAAKQ

SEQ ID NO: 238355 - protein, 9 aa, Homo Sapiens
ARYPHITFE

SEQ ID NO: 238356 - protein, 9 aa, Homo Sapiens
YFADYELAV

SEQ ID NO: 238357 - protein, 9 aa, Homo Sapiens
ELDITKNER

SEQ ID NO: 238358 - protein, 9 aa, Homo Sapiens
TIIALSHRK

SEQ ID NO: 238359 - protein, 9 aa, Homo Sapiens
IPYQLGRVV

SEQ ID NO: 238360 - protein, 9 aa, Homo Sapiens
LQVDFLRLS

SEQ ID NO: 238361 - protein, 9 aa, Homo Sapiens
SQLARHRII

SEQ ID NO: 238362 - protein, 9 aa, Homo Sapiens
TPASYAAPG

SEQ ID NO: 238363 - protein, 9 aa, Homo Sapiens
GLGAWAEVA

SEQ ID NO: 238364 - protein, 9 aa, Homo Sapiens
AVTYLNQCL

SEQ ID NO: 238365 - protein, 9 aa, Homo Sapiens
CCRRRKISD

SEQ ID NO: 238366 - protein, 9 aa, Homo Sapiens
AEEFEEKAC

SEQ ID NO: 238367 - protein, 9 aa, Homo Sapiens
VALKDVSSC

SEQ ID NO: 238368 - protein, 9 aa, Homo Sapiens
SLVMKHLPG

SEQ ID NO: 238369 - protein, 9 aa, Homo Sapiens
HCIVSRNFG

SEQ ID NO: 238370 - protein, 9 aa, Homo Sapiens
SWVNTFPVE

SEQ ID NO: 238371 - protein, 9 aa, Homo Sapiens
FLMHWKKRL

SEQ ID NO: 238372 - protein, 9 aa, Homo Sapiens
VMFMCCCCC

SEQ ID NO: 238373 - protein, 9 aa, Homo Sapiens
KAMRKAAST

SEQ ID NO: 238374 - protein, 9 aa, Homo Sapiens
ENIYSRHKM

SEQ ID NO: 238375 - protein, 9 aa, Homo Sapiens
IQKLDDQGD

SEQ ID NO: 238376 - protein, 9 aa, Homo Sapiens
WTPIGMPPP

SEQ ID NO: 238377 - protein, 9 aa, Homo Sapiens
TEELGVLAS

SEQ ID NO: 238378 - protein, 9 aa, Homo Sapiens
PSQVQHIHI

SEQ ID NO: 238379 - protein, 9 aa, Homo Sapiens
QYLVLEPTQ

SEQ ID NO: 238380 - protein, 9 aa, Homo Sapiens
DFRGGDCQE

SEQ ID NO: 238381 - protein, 9 aa, Homo Sapiens
IITGENNLP

SEQ ID NO: 238382 - protein, 9 aa, Homo Sapiens
SPKPHMVPH

SEQ ID NO: 238383 - protein, 9 aa, Homo Sapiens
RTGGSTTFC

SEQ ID NO: 238384 - protein, 9 aa, Homo Sapiens
LTGPYGFIK

SEQ ID NO: 238385 - protein, 9 aa, Homo Sapiens
GSEVFPDIL

SEQ ID NO: 238386 - protein, 9 aa, Homo Sapiens
QRLKLLCER

SEQ ID NO: 238387 - protein, 9 aa, Homo Sapiens
LFIFLRQSI

SEQ ID NO: 238388 - protein, 9 aa, Homo Sapiens
INYQIKELG

SEQ ID NO: 238389 - protein, 9 aa, Homo Sapiens
EVANDAPHF

SEQ ID NO: 238390 - protein, 9 aa, Homo Sapiens
GIDLNQTKL

SEQ ID NO: 238391 - protein, 9 aa, Homo Sapiens
TNHSVIVNP

SEQ ID NO: 238392 - protein, 9 aa, Homo Sapiens
VCQFSNVIR

SEQ ID NO: 238393 - protein, 9 aa, Homo Sapiens
LCLEQNNTT

SEQ ID NO: 238394 - protein, 9 aa, Homo Sapiens
TICYLAASV

SEQ ID NO: 238395 - protein, 9 aa, Homo Sapiens
VVQERNYAQ

SEQ ID NO: 238396 - protein, 9 aa, Homo Sapiens
PNEIPTKNI

SEQ ID NO: 238397 - protein, 9 aa, Homo Sapiens
CKVFIGGVP

SEQ ID NO: 238398 - protein, 9 aa, Homo Sapiens
FTESSKYGS

SEQ ID NO: 238399 - protein, 9 aa, Homo Sapiens
VILSVKLSP

SEQ ID NO: 238400 - protein, 9 aa, Homo Sapiens
KYIDLEPDN

SEQ ID NO: 238401 - protein, 9 aa, Homo Sapiens
GEARIQQRI

SEQ ID NO: 238402 - protein, 9 aa, Homo Sapiens
SMCMPPPSA

SEQ ID NO: 238403 - protein, 9 aa, Homo Sapiens
VLYDKIKEL

SEQ ID NO: 238404 - protein, 9 aa, Homo Sapiens
ILAAMIAKD

SEQ ID NO: 238405 - protein, 9 aa, Homo Sapiens
FLCWFPLYY

SEQ ID NO: 238406 - protein, 9 aa, Homo Sapiens
KRVRLCFVE

SEQ ID NO: 238407 - protein, 9 aa, Homo Sapiens
VYSISSLLI

SEQ ID NO: 238408 - protein, 9 aa, Homo Sapiens
LSQVGHEFS

SEQ ID NO: 238409 - protein, 9 aa, Homo Sapiens
VPEIIEMDG

SEQ ID NO: 238410 - protein, 9 aa, Homo Sapiens
SNIFIRNPR

SEQ ID NO: 238411 - protein, 9 aa, Homo Sapiens
GTMVVQHTP

SEQ ID NO: 238412 - protein, 9 aa, Homo Sapiens
LAVSATYPK

SEQ ID NO: 238413 - protein, 9 aa, Homo Sapiens
DKFKTPATV

SEQ ID NO: 238414 - protein, 9 aa, Homo Sapiens
YFPNELEKL

SEQ ID NO: 238415 - protein, 9 aa, Homo Sapiens
LTNISSSLS

SEQ ID NO: 238416 - protein, 9 aa, Homo Sapiens
GLDIRKDKA

SEQ ID NO: 238417 - protein, 9 aa, Homo Sapiens
HDQTVIRRG

SEQ ID NO: 238418 - protein, 9 aa, Homo Sapiens
SSTSPDCIF

SEQ ID NO: 238419 - protein, 9 aa, Homo Sapiens
CHPGWSTMA

SEQ ID NO: 238420 - protein, 9 aa, Homo Sapiens
PKTHPHGDE

SEQ ID NO: 238421 - protein, 9 aa, Homo Sapiens
LSYIVGAPR

SEQ ID NO: 238422 - protein, 9 aa, Homo Sapiens
FLETVFSEV

SEQ ID NO: 238423 - protein, 9 aa, Homo Sapiens
TCNPCFRVW

SEQ ID NO: 238424 - protein, 9 aa, Homo Sapiens
EYILPALLH

SEQ ID NO: 238425 - protein, 9 aa, Homo Sapiens
EKYPRAGSP

SEQ ID NO: 238426 - protein, 9 aa, Homo Sapiens
EMQVRQRAV

SEQ ID NO: 238427 - protein, 9 aa, Homo Sapiens
TSSRAFHYD

SEQ ID NO: 238428 - protein, 9 aa, Homo Sapiens
YSPAIQMLQ

SEQ ID NO: 238429 - protein, 9 aa, Homo Sapiens
VLNNLKNIR

SEQ ID NO: 238430 - protein, 9 aa, Homo Sapiens
HKLAKAVNY

SEQ ID NO: 238431 - protein, 9 aa, Homo Sapiens
KQVGTSQSG

SEQ ID NO: 238432 - protein, 9 aa, Homo Sapiens
MTHLAHKFF

SEQ ID NO: 238433 - protein, 9 aa, Homo Sapiens
NPPLRNVSS

SEQ ID NO: 238434 - protein, 9 aa, Homo Sapiens
CIKAESAEA

SEQ ID NO: 238435 - protein, 9 aa, Homo Sapiens
RTALRPGSR

SEQ ID NO: 238436 - protein, 9 aa, Homo Sapiens
LIIHLKIFR

SEQ ID NO: 238437 - protein, 9 aa, Homo Sapiens
ATDSFNHKK

SEQ ID NO: 238438 - protein, 9 aa, Homo Sapiens
HPLKKWPMQ

SEQ ID NO: 238439 - protein, 9 aa, Homo Sapiens
VSEVDKTKE

SEQ ID NO: 238440 - protein, 9 aa, Homo Sapiens
LPGFQNLHI

SEQ ID NO: 238441 - protein, 9 aa, Homo Sapiens
PLAPSKGRP

SEQ ID NO: 238442 - protein, 9 aa, Homo Sapiens
TGSDYQYIG

SEQ ID NO: 238443 - protein, 9 aa, Homo Sapiens
VPGPLTPEL

SEQ ID NO: 238444 - protein, 9 aa, Homo Sapiens
IEAKFDEEV

SEQ ID NO: 238445 - protein, 9 aa, Homo Sapiens
SGIINTQPP

SEQ ID NO: 238446 - protein, 9 aa, Homo Sapiens
ELQVKISDL

SEQ ID NO: 238447 - protein, 9 aa, Homo Sapiens
ERGDQGVPE

SEQ ID NO: 238448 - protein, 9 aa, Homo Sapiens
LEADANVEG

SEQ ID NO: 238449 - protein, 9 aa, Homo Sapiens
AQVDKASKY

SEQ ID NO: 238450 - protein, 9 aa, Homo Sapiens
LKSKPPKEE

SEQ ID NO: 238451 - protein, 9 aa, Homo Sapiens
PYQISMCKL

SEQ ID NO: 238452 - protein, 9 aa, Homo Sapiens
NISEASERS

SEQ ID NO: 238453 - protein, 9 aa, Homo Sapiens
YSPFKPINY

SEQ ID NO: 238454 - protein, 9 aa, Homo Sapiens
KYLHLEGDP

SEQ ID NO: 238455 - protein, 9 aa, Homo Sapiens
VNTLHCQLG

SEQ ID NO: 238456 - protein, 9 aa, Homo Sapiens
SDNISEASE

SEQ ID NO: 238457 - protein, 9 aa, Homo Sapiens
PYRHERRKR

SEQ ID NO: 238458 - protein, 9 aa, Homo Sapiens
QKKKTNNFN

SEQ ID NO: 238459 - protein, 9 aa, Homo Sapiens
NIEEHCAKN

SEQ ID NO: 238460 - protein, 9 aa, Homo Sapiens
NTTEVWERS

SEQ ID NO: 238461 - protein, 9 aa, Homo Sapiens
DINVTQQSF

SEQ ID NO: 238462 - protein, 9 aa, Homo Sapiens
LRYSYILTS

SEQ ID NO: 238463 - protein, 9 aa, Homo Sapiens
LTCLCNIVF

SEQ ID NO: 238464 - protein, 9 aa, Homo Sapiens
STSDAFWLD

SEQ ID NO: 238465 - protein, 9 aa, Homo Sapiens
KPPALRKSN

SEQ ID NO: 238466 - protein, 9 aa, Homo Sapiens
CYFPDEKDS

SEQ ID NO: 238467 - protein, 9 aa, Homo Sapiens
EMANKLSQM

SEQ ID NO: 238468 - protein, 9 aa, Homo Sapiens
INIYIYHFA

SEQ ID NO: 238469 - protein, 9 aa, Homo Sapiens
GLKESSHLH

SEQ ID NO: 238470 - protein, 9 aa, Homo Sapiens
DNFHLDKYK

SEQ ID NO: 238471 - protein, 9 aa, Homo Sapiens
ASDSKDKTY

SEQ ID NO: 238472 - protein, 9 aa, Homo Sapiens
MGLNLVIAV

SEQ ID NO: 238473 - protein, 9 aa, Homo Sapiens
VSSVAEVVI

SEQ ID NO: 238474 - protein, 9 aa, Homo Sapiens
LSMDRMVLL

SEQ ID NO: 238475 - protein, 9 aa, Homo Sapiens
VKYEKDDMK

SEQ ID NO: 238476 - protein, 9 aa, Homo Sapiens
LGKYIYIGS

SEQ ID NO: 238477 - protein, 9 aa, Homo Sapiens
PDTYAHPLF

SEQ ID NO: 238478 - protein, 9 aa, Homo Sapiens
SRADNFQEL

SEQ ID NO: 238479 - protein, 9 aa, Homo Sapiens
ADMIRKSPD

SEQ ID NO: 238480 - protein, 9 aa, Homo Sapiens
IEHQPVLHC

SEQ ID NO: 238481 - protein, 9 aa, Homo Sapiens
EMDKRLQEM

SEQ ID NO: 238482 - protein, 9 aa, Homo Sapiens
SDLQSLIKF

SEQ ID NO: 238483 - protein, 9 aa, Homo Sapiens
PPIEPITAA

SEQ ID NO: 238484 - protein, 9 aa, Homo Sapiens
PGHYQYTVF

SEQ ID NO: 238485 - protein, 9 aa, Homo Sapiens
QVAGLQLKL

SEQ ID NO: 238486 - protein, 9 aa, Homo Sapiens
QIPSLEEPM

SEQ ID NO: 238487 - protein, 9 aa, Homo Sapiens
DVFFGPFGH

SEQ ID NO: 238488 - protein, 9 aa, Homo Sapiens
KLLSPRQTA

SEQ ID NO: 238489 - protein, 9 aa, Homo Sapiens
EMDLRCVEM

SEQ ID NO: 238490 - protein, 9 aa, Homo Sapiens
NRYFPVFEK

SEQ ID NO: 238491 - protein, 9 aa, Homo Sapiens
YSEPKLTPK

SEQ ID NO: 238492 - protein, 9 aa, Homo Sapiens
NGNNSVQYK

SEQ ID NO: 238493 - protein, 9 aa, Homo Sapiens
ENFSAFSLI

SEQ ID NO: 238494 - protein, 9 aa, Homo Sapiens
YPNGQFVRV

SEQ ID NO: 238495 - protein, 9 aa, Homo Sapiens
RMEEMETYQ

SEQ ID NO: 238496 - protein, 9 aa, Homo Sapiens
YMNESQNPL

SEQ ID NO: 238497 - protein, 9 aa, Homo Sapiens
FKHIHEISC

SEQ ID NO: 238498 - protein, 9 aa, Homo Sapiens
KLINAAKLN

SEQ ID NO: 238499 - protein, 9 aa, Homo Sapiens
IAFFPAFSY

SEQ ID NO: 238500 - protein, 9 aa, Homo Sapiens
HNYRIRYRC

SEQ ID NO: 238501 - protein, 9 aa, Homo Sapiens
AVPQGQQPP

SEQ ID NO: 238502 - protein, 9 aa, Homo Sapiens
TRIASSLDS

SEQ ID NO: 238503 - protein, 9 aa, Homo Sapiens
TDLLEEKVH

SEQ ID NO: 238504 - protein, 9 aa, Homo Sapiens
YTSRSEQLT

SEQ ID NO: 238505 - protein, 9 aa, Homo Sapiens
YETLDAKEM

SEQ ID NO: 238506 - protein, 9 aa, Homo Sapiens
GRKWKVPDE

SEQ ID NO: 238507 - protein, 9 aa, Homo Sapiens
SENRAQKKR

SEQ ID NO: 238508 - protein, 9 aa, Homo Sapiens
QNIHIRERS

SEQ ID NO: 238509 - protein, 9 aa, Homo Sapiens
ARGGGELDL

SEQ ID NO: 238510 - protein, 9 aa, Homo Sapiens
SDFLSKCDN

SEQ ID NO: 238511 - protein, 9 aa, Homo Sapiens
SFGYVHSFV

SEQ ID NO: 238512 - protein, 9 aa, Homo Sapiens
LLTLAEKDR

SEQ ID NO: 238513 - protein, 9 aa, Homo Sapiens
AGWIGGAPS

SEQ ID NO: 238514 - protein, 9 aa, Homo Sapiens
NVHDIMVYF

SEQ ID NO: 238515 - protein, 9 aa, Homo Sapiens
DYPMVSPPP

SEQ ID NO: 238516 - protein, 9 aa, Homo Sapiens
NHLIYSLRQ

SEQ ID NO: 238517 - protein, 9 aa, Homo Sapiens
DIHAIKILD

SEQ ID NO: 238518 - protein, 9 aa, Homo Sapiens
SNEEINLLS

SEQ ID NO: 238519 - protein, 9 aa, Homo Sapiens
SNSEESEER

SEQ ID NO: 238520 - protein, 9 aa, Homo Sapiens
WVRKVCIDT

SEQ ID NO: 238521 - protein, 9 aa, Homo Sapiens
GDKNIENVT

SEQ ID NO: 238522 - protein, 9 aa, Homo Sapiens
FIDISIIDD

SEQ ID NO: 238523 - protein, 9 aa, Homo Sapiens
RKKAAIFCL

SEQ ID NO: 238524 - protein, 9 aa, Homo Sapiens
VAVQAIRRY

SEQ ID NO: 238525 - protein, 9 aa, Homo Sapiens
KVLGIKDSG

SEQ ID NO: 238526 - protein, 9 aa, Homo Sapiens
WTFRHSEAT

SEQ ID NO: 238527 - protein, 9 aa, Homo Sapiens
SQVGPNQAQ

SEQ ID NO: 238528 - protein, 9 aa, Homo Sapiens
PRFNYVNHE

SEQ ID NO: 238529 - protein, 9 aa, Homo Sapiens
KKKDQATAQ

SEQ ID NO: 238530 - protein, 9 aa, Homo Sapiens
ICSLQRSVQ

SEQ ID NO: 238531 - protein, 9 aa, Homo Sapiens
KKGELRKSI

SEQ ID NO: 238532 - protein, 9 aa, Homo Sapiens
PLNAEKRRT

SEQ ID NO: 238533 - protein, 9 aa, Homo Sapiens
PMPFRTGTG

SEQ ID NO: 238534 - protein, 9 aa, Homo Sapiens
LVASGANGS

SEQ ID NO: 238535 - protein, 9 aa, Homo Sapiens
GIPVYRFVI

SEQ ID NO: 238536 - protein, 9 aa, Homo Sapiens
FEYDIDNCH

SEQ ID NO: 238537 - protein, 9 aa, Homo Sapiens
ITLFVKVKR

SEQ ID NO: 238538 - protein, 9 aa, Homo Sapiens
DLLLGLMVL

SEQ ID NO: 238539 - protein, 9 aa, Homo Sapiens
DAILSLNAR

SEQ ID NO: 238540 - protein, 9 aa, Homo Sapiens
GYLNGKVDS

SEQ ID NO: 238541 - protein, 9 aa, Homo Sapiens
FLAAVQQPD

SEQ ID NO: 238542 - protein, 9 aa, Homo Sapiens
AFHHQVHAD

SEQ ID NO: 238543 - protein, 9 aa, Homo Sapiens
DSVLNTATT

SEQ ID NO: 238544 - protein, 9 aa, Homo Sapiens
LDHTGLTAV

SEQ ID NO: 238545 - protein, 9 aa, Homo Sapiens
LGMIIIINI

SEQ ID NO: 238546 - protein, 9 aa, Homo Sapiens
HQIIHFLEN

SEQ ID NO: 238547 - protein, 9 aa, Homo Sapiens
SKVMCTSPP

SEQ ID NO: 238548 - protein, 9 aa, Homo Sapiens
TIECLQTNT

SEQ ID NO: 238549 - protein, 9 aa, Homo Sapiens
TDFGMRKEN

SEQ ID NO: 238550 - protein, 9 aa, Homo Sapiens
YQYLSLLHA

SEQ ID NO: 238551 - protein, 9 aa, Homo Sapiens
IDKTFVVQG

SEQ ID NO: 238552 - protein, 9 aa, Homo Sapiens
PKNSEESAA

SEQ ID NO: 238553 - protein, 9 aa, Homo Sapiens
ENFRPQNEL

SEQ ID NO: 238554 - protein, 9 aa, Homo Sapiens
PRPVSYRGC

SEQ ID NO: 238555 - protein, 9 aa, Homo Sapiens
FVTGKCWVI

SEQ ID NO: 238556 - protein, 9 aa, Homo Sapiens
KIEEACKIY

SEQ ID NO: 238557 - protein, 9 aa, Homo Sapiens
NAKKTAELY

SEQ ID NO: 238558 - protein, 9 aa, Homo Sapiens
GKFTAATEK

SEQ ID NO: 238559 - protein, 9 aa, Homo Sapiens
TSPDCIFFH

SEQ ID NO: 238560 - protein, 9 aa, Homo Sapiens
LSLALATNS

SEQ ID NO: 238561 - protein, 9 aa, Homo Sapiens
LEPVTEPPL

SEQ ID NO: 238562 - protein, 9 aa, Homo Sapiens
GLALTLVGT

SEQ ID NO: 238563 - protein, 9 aa, Homo Sapiens
EECGKYFSS

SEQ ID NO: 238564 - protein, 9 aa, Homo Sapiens
YIDVEGPFA

SEQ ID NO: 238565 - protein, 9 aa, Homo Sapiens
SALQVLPDS

SEQ ID NO: 238566 - protein, 9 aa, Homo Sapiens
PHLGTTSTI

SEQ ID NO: 238567 - protein, 9 aa, Homo Sapiens
QLVQPAWQI

SEQ ID NO: 238568 - protein, 9 aa, Homo Sapiens
LTPIQITHS

SEQ ID NO: 238569 - protein, 9 aa, Homo Sapiens
LIFGVVGNL

SEQ ID NO: 238570 - protein, 9 aa, Homo Sapiens
KSRKEKKKK

SEQ ID NO: 238571 - protein, 9 aa, Homo Sapiens
IALESLNSG

SEQ ID NO: 238572 - protein, 9 aa, Homo Sapiens
PVDSALSTR

SEQ ID NO: 238573 - protein, 9 aa, Homo Sapiens
CMTLDPVSQ

SEQ ID NO: 238574 - protein, 9 aa, Homo Sapiens
TEGNKEKKS

SEQ ID NO: 238575 - protein, 9 aa, Homo Sapiens
PFNPYEPKC

SEQ ID NO: 238576 - protein, 9 aa, Homo Sapiens
LINNSRFYN

SEQ ID NO: 238577 - protein, 9 aa, Homo Sapiens
GELPPVTDF

SEQ ID NO: 238578 - protein, 9 aa, Homo Sapiens
KLFSLAATY

SEQ ID NO: 238579 - protein, 9 aa, Homo Sapiens
FRFCIHHLT

SEQ ID NO: 238580 - protein, 9 aa, Homo Sapiens
MEPNTQKNV

SEQ ID NO: 238581 - protein, 9 aa, Homo Sapiens
DRVNLVLSR

SEQ ID NO: 238582 - protein, 9 aa, Homo Sapiens
HQQVHGLLS

SEQ ID NO: 238583 - protein, 9 aa, Homo Sapiens
EELWPGSSS

SEQ ID NO: 238584 - protein, 9 aa, Homo Sapiens
NASSRQCQG

SEQ ID NO: 238585 - protein, 9 aa, Homo Sapiens
VTIGLDKII

SEQ ID NO: 238586 - protein, 9 aa, Homo Sapiens
MGPWGLLLC

SEQ ID NO: 238587 - protein, 9 aa, Homo Sapiens
SVRLLKLSR

SEQ ID NO: 238588 - protein, 9 aa, Homo Sapiens
DYLLSSTES

SEQ ID NO: 238589 - protein, 9 aa, Homo Sapiens
NLRRAAEEA

SEQ ID NO: 238590 - protein, 9 aa, Homo Sapiens
IKIIQTLSG

SEQ ID NO: 238591 - protein, 9 aa, Homo Sapiens
LNKDIESTK

SEQ ID NO: 238592 - protein, 9 aa, Homo Sapiens
TSILYIGEK

SEQ ID NO: 238593 - protein, 9 aa, Homo Sapiens
LDILQHDPD

SEQ ID NO: 238594 - protein, 9 aa, Homo Sapiens
VDQLYSFQD

SEQ ID NO: 238595 - protein, 9 aa, Homo Sapiens
EVFGIFDTF

SEQ ID NO: 238596 - protein, 9 aa, Homo Sapiens
KVSPLQQSE

SEQ ID NO: 238597 - protein, 9 aa, Homo Sapiens
LRTSMLSPN

SEQ ID NO: 238598 - protein, 9 aa, Homo Sapiens
IIWSYLMHV

SEQ ID NO: 238599 - protein, 9 aa, Homo Sapiens
FVCDKHYYG

SEQ ID NO: 238600 - protein, 9 aa, Homo Sapiens
KNYHSEMLA

SEQ ID NO: 238601 - protein, 9 aa, Homo Sapiens
ADKTRQSKR

SEQ ID NO: 238602 - protein, 9 aa, Homo Sapiens
ITFDPFIYL

SEQ ID NO: 238603 - protein, 9 aa, Homo Sapiens
MLQSGVDPS

SEQ ID NO: 238604 - protein, 9 aa, Homo Sapiens
TAYVAMIPR

SEQ ID NO: 238605 - protein, 9 aa, Homo Sapiens
LLRSIEELK

SEQ ID NO: 238606 - protein, 9 aa, Homo Sapiens
PIKNIMDSW

SEQ ID NO: 238607 - protein, 9 aa, Homo Sapiens
QTCGTQPGL

SEQ ID NO: 238608 - protein, 9 aa, Homo Sapiens
PLWFKDMYT

SEQ ID NO: 238609 - protein, 9 aa, Homo Sapiens
GIADYIPKD

SEQ ID NO: 238610 - protein, 9 aa, Homo Sapiens
DSSSFCLAG

SEQ ID NO: 238611 - protein, 9 aa, Homo Sapiens
LICIRILGI

SEQ ID NO: 238612 - protein, 9 aa, Homo Sapiens
QHYHGMCLN

SEQ ID NO: 238613 - protein, 9 aa, Homo Sapiens
KKSEVKYLG

SEQ ID NO: 238614 - protein, 9 aa, Homo Sapiens
GGLRLPFQK

SEQ ID NO: 238615 - protein, 9 aa, Homo Sapiens
LTVVNKLDR

SEQ ID NO: 238616 - protein, 9 aa, Homo Sapiens
TGKKITLKC

SEQ ID NO: 238617 - protein, 9 aa, Homo Sapiens
HNSCGITLE

SEQ ID NO: 238618 - protein, 9 aa, Homo Sapiens
PNSGPAWGS

SEQ ID NO: 238619 - protein, 9 aa, Homo Sapiens
KWIKDADPR

SEQ ID NO: 238620 - protein, 9 aa, Homo Sapiens
RRWQPPDFL

SEQ ID NO: 238621 - protein, 9 aa, Homo Sapiens
HNGYIHVES

SEQ ID NO: 238622 - protein, 9 aa, Homo Sapiens
STLLALMYG

SEQ ID NO: 238623 - protein, 9 aa, Homo Sapiens
SLKRAEVEV

SEQ ID NO: 238624 - protein, 9 aa, Homo Sapiens
SLIKFASQK

SEQ ID NO: 238625 - protein, 9 aa, Homo Sapiens
CHENTNNLL

SEQ ID NO: 238626 - protein, 9 aa, Homo Sapiens
SAFANTGGG

SEQ ID NO: 238627 - protein, 9 aa, Homo Sapiens
HKIKHFLME

SEQ ID NO: 238628 - protein, 9 aa, Homo Sapiens
PSLNLEKYE

SEQ ID NO: 238629 - protein, 9 aa, Homo Sapiens
ESFTATAKF

SEQ ID NO: 238630 - protein, 9 aa, Homo Sapiens
ENANKGREL

SEQ ID NO: 238631 - protein, 9 aa, Homo Sapiens
FNKEITRQA

SEQ ID NO: 238632 - protein, 9 aa, Homo Sapiens
NFLKKHKKT

SEQ ID NO: 238633 - protein, 9 aa, Homo Sapiens
EELSQRLQV

SEQ ID NO: 238634 - protein, 9 aa, Homo Sapiens
QNQHQDKDQ

SEQ ID NO: 238635 - protein, 9 aa, Homo Sapiens
PIQITHSIN

SEQ ID NO: 238636 - protein, 9 aa, Homo Sapiens
PVVAGIKPT

SEQ ID NO: 238637 - protein, 9 aa, Homo Sapiens
PRVSPRYTQ

SEQ ID NO: 238638 - protein, 9 aa, Homo Sapiens
SCRWDPGWE

SEQ ID NO: 238639 - protein, 9 aa, Homo Sapiens
QETFAPRLS

SEQ ID NO: 238640 - protein, 9 aa, Homo Sapiens
PDSLEPRRE

SEQ ID NO: 238641 - protein, 9 aa, Homo Sapiens
CPDFRGGDC

SEQ ID NO: 238642 - protein, 9 aa, Homo Sapiens
VRTEQYLYV

SEQ ID NO: 238643 - protein, 9 aa, Homo Sapiens
THADTCTPK

SEQ ID NO: 238644 - protein, 9 aa, Homo Sapiens
FVGTWKVVS

SEQ ID NO: 238645 - protein, 9 aa, Homo Sapiens
KPKFDVLKN

SEQ ID NO: 238646 - protein, 9 aa, Homo Sapiens
KIWDSQERA

SEQ ID NO: 238647 - protein, 9 aa, Homo Sapiens
LSIPTFLLQ

SEQ ID NO: 238648 - protein, 9 aa, Homo Sapiens
ILWGVAVVL

SEQ ID NO: 238649 - protein, 9 aa, Homo Sapiens
NLDSSKKNL

SEQ ID NO: 238650 - protein, 9 aa, Homo Sapiens
QANERVNDA

SEQ ID NO: 238651 - protein, 9 aa, Homo Sapiens
NLKSEVMVP

SEQ ID NO: 238652 - protein, 9 aa, Homo Sapiens
KAGLEAQVE

SEQ ID NO: 238653 - protein, 9 aa, Homo Sapiens
RGHPDVATL

SEQ ID NO: 238654 - protein, 9 aa, Homo Sapiens
LQCLIQWFD

SEQ ID NO: 238655 - protein, 9 aa, Homo Sapiens
QIPFSKTYS

SEQ ID NO: 238656 - protein, 9 aa, Homo Sapiens
KGTSAFLQR

SEQ ID NO: 238657 - protein, 9 aa, Homo Sapiens
KHSYEQKAK

SEQ ID NO: 238658 - protein, 9 aa, Homo Sapiens
STQGNVGKL

SEQ ID NO: 238659 - protein, 9 aa, Homo Sapiens
KRKNAIENA

SEQ ID NO: 238660 - protein, 9 aa, Homo Sapiens
NVSSCEIFR

SEQ ID NO: 238661 - protein, 9 aa, Homo Sapiens
IRKDKADVL

SEQ ID NO: 238662 - protein, 9 aa, Homo Sapiens
HFSCPLCPK

SEQ ID NO: 238663 - protein, 9 aa, Homo Sapiens
YTTSSEQMQ

SEQ ID NO: 238664 - protein, 9 aa, Homo Sapiens
KDYYSSRCL

SEQ ID NO: 238665 - protein, 9 aa, Homo Sapiens
EDVRRIPCM

SEQ ID NO: 238666 - protein, 9 aa, Homo Sapiens
PLEVSSEYH

SEQ ID NO: 238667 - protein, 9 aa, Homo Sapiens
QTRVENSEP

SEQ ID NO: 238668 - protein, 9 aa, Homo Sapiens
CGIFFSILG

SEQ ID NO: 238669 - protein, 9 aa, Homo Sapiens
PHHSNQNSS

SEQ ID NO: 238670 - protein, 9 aa, Homo Sapiens
HLCGKTFQT

SEQ ID NO: 238671 - protein, 9 aa, Homo Sapiens
NMDSSVPWK

SEQ ID NO: 238672 - protein, 9 aa, Homo Sapiens
LAGNGLGSA

SEQ ID NO: 238673 - protein, 9 aa, Homo Sapiens
RQIFHPEYG

SEQ ID NO: 238674 - protein, 9 aa, Homo Sapiens
EEDREAVRS

SEQ ID NO: 238675 - protein, 9 aa, Homo Sapiens
EKFFLRSGS

SEQ ID NO: 238676 - protein, 9 aa, Homo Sapiens
NISSSLSCH

SEQ ID NO: 238677 - protein, 9 aa, Homo Sapiens
SENKCIHTS

SEQ ID NO: 238678 - protein, 9 aa, Homo Sapiens
GIFYHQALL

SEQ ID NO: 238679 - protein, 9 aa, Homo Sapiens
VTRIMGHAV

SEQ ID NO: 238680 - protein, 9 aa, Homo Sapiens
SDEPEVDFN

SEQ ID NO: 238681 - protein, 9 aa, Homo Sapiens
LEPELPLIS

SEQ ID NO: 238682 - protein, 9 aa, Homo Sapiens
GGCEIVLLV

SEQ ID NO: 238683 - protein, 9 aa, Homo Sapiens
PKAEHWYME

SEQ ID NO: 238684 - protein, 9 aa, Homo Sapiens
SFASGQRTV

SEQ ID NO: 238685 - protein, 9 aa, Homo Sapiens
HGCSYTAIS

SEQ ID NO: 238686 - protein, 9 aa, Homo Sapiens
SLSQSPPTF

SEQ ID NO: 238687 - protein, 9 aa, Homo Sapiens
FIAGFRVRL

SEQ ID NO: 238688 - protein, 9 aa, Homo Sapiens
KSKSVAISV

SEQ ID NO: 238689 - protein, 9 aa, Homo Sapiens
FDLNNTTGL

SEQ ID NO: 238690 - protein, 9 aa, Homo Sapiens
PIDWIAFQS

SEQ ID NO: 238691 - protein, 9 aa, Homo Sapiens
SCVFASCRI

SEQ ID NO: 238692 - protein, 9 aa, Homo Sapiens
LSRCPRLPE

SEQ ID NO: 238693 - protein, 9 aa, Homo Sapiens
AKEALDIFE

SEQ ID NO: 238694 - protein, 9 aa, Homo Sapiens
NSLYTVGMK

SEQ ID NO: 238695 - protein, 9 aa, Homo Sapiens
VEELSRTKF

SEQ ID NO: 238696 - protein, 9 aa, Homo Sapiens
YIINCAYSN

SEQ ID NO: 238697 - protein, 9 aa, Homo Sapiens
LWNDILRKL

SEQ ID NO: 238698 - protein, 9 aa, Homo Sapiens
TLLPAPPFG

SEQ ID NO: 238699 - protein, 9 aa, Homo Sapiens
EFIALGLCN

SEQ ID NO: 238700 - protein, 9 aa, Homo Sapiens
FNIKKFTLG

SEQ ID NO: 238701 - protein, 9 aa, Homo Sapiens
GSLAVSDFL

SEQ ID NO: 238702 - protein, 9 aa, Homo Sapiens
PQDGAEVMS

SEQ ID NO: 238703 - protein, 9 aa, Homo Sapiens
VFARLSTNV

SEQ ID NO: 238704 - protein, 9 aa, Homo Sapiens
KVYLYPLSL

SEQ ID NO: 238705 - protein, 9 aa, Homo Sapiens
LVYFNFFKA

SEQ ID NO: 238706 - protein, 9 aa, Homo Sapiens
FYGFLSDNF

SEQ ID NO: 238707 - protein, 9 aa, Homo Sapiens
PDKDKHFSL

SEQ ID NO: 238708 - protein, 9 aa, Homo Sapiens
QRHRIIHTG

SEQ ID NO: 238709 - protein, 9 aa, Homo Sapiens
ENLGSSGCC

SEQ ID NO: 238710 - protein, 9 aa, Homo Sapiens
VDNSELADE

SEQ ID NO: 238711 - protein, 9 aa, Homo Sapiens
KSLPIRRKA

SEQ ID NO: 238712 - protein, 9 aa, Homo Sapiens
NTFLLLLSS

SEQ ID NO: 238713 - protein, 9 aa, Homo Sapiens
NLTKIKQLC

SEQ ID NO: 238714 - protein, 9 aa, Homo Sapiens
LMIWAIILK

SEQ ID NO: 238715 - protein, 9 aa, Homo Sapiens
PLETLIIGT

SEQ ID NO: 238716 - protein, 9 aa, Homo Sapiens
VTDVTFGKI

SEQ ID NO: 238717 - protein, 9 aa, Homo Sapiens
EKKKTYFCA

SEQ ID NO: 238718 - protein, 9 aa, Homo Sapiens
DETFGPNIP

SEQ ID NO: 238719 - protein, 9 aa, Homo Sapiens
FTEYRLMIF

SEQ ID NO: 238720 - protein, 9 aa, Homo Sapiens
RSKGRKFPE

SEQ ID NO: 238721 - protein, 9 aa, Homo Sapiens
SEEPSEDPE

SEQ ID NO: 238722 - protein, 9 aa, Homo Sapiens
NEPKQSRFG

SEQ ID NO: 238723 - protein, 9 aa, Homo Sapiens
SEHLPYLSP

SEQ ID NO: 238724 - protein, 9 aa, Homo Sapiens
RSRKGRGWR

SEQ ID NO: 238725 - protein, 9 aa, Homo Sapiens
PKTVILFKV

SEQ ID NO: 238726 - protein, 9 aa, Homo Sapiens
GGYRGSGGV

SEQ ID NO: 238727 - protein, 9 aa, Homo Sapiens
DVTLGNTVY

SEQ ID NO: 238728 - protein, 9 aa, Homo Sapiens
VRQLHVIDN

SEQ ID NO: 238729 - protein, 9 aa, Homo Sapiens
KSSQKVDVE

SEQ ID NO: 238730 - protein, 9 aa, Homo Sapiens
LPHLKNKDP

SEQ ID NO: 238731 - protein, 9 aa, Homo Sapiens
VANSLVTLQ

SEQ ID NO: 238732 - protein, 9 aa, Homo Sapiens
CSEQQEEDG

SEQ ID NO: 238733 - protein, 9 aa, Homo Sapiens
KKSIRKNYC

SEQ ID NO: 238734 - protein, 9 aa, Homo Sapiens
RQTLLDWLF

SEQ ID NO: 238735 - protein, 9 aa, Homo Sapiens
TSFLCLTLK

SEQ ID NO: 238736 - protein, 9 aa, Homo Sapiens
LMATSLDDK

SEQ ID NO: 238737 - protein, 9 aa, Homo Sapiens
QTFDLLIGK

SEQ ID NO: 238738 - protein, 9 aa, Homo Sapiens
QPSTYVGFK

SEQ ID NO: 238739 - protein, 9 aa, Homo Sapiens
EKGVVLCYW

SEQ ID NO: 238740 - protein, 9 aa, Homo Sapiens
YLSFLIVQC

SEQ ID NO: 238741 - protein, 9 aa, Homo Sapiens
KGSLMTKVI

SEQ ID NO: 238742 - protein, 9 aa, Homo Sapiens
NGELPLCSR

SEQ ID NO: 238743 - protein, 9 aa, Homo Sapiens
NSIITTHTT

SEQ ID NO: 238744 - protein, 9 aa, Homo Sapiens
LITQATPPV

SEQ ID NO: 238745 - protein, 9 aa, Homo Sapiens
CDKTFIFIC

SEQ ID NO: 238746 - protein, 9 aa, Homo Sapiens
LKAAMPYTV

SEQ ID NO: 238747 - protein, 9 aa, Homo Sapiens
RHLPHARQL

SEQ ID NO: 238748 - protein, 9 aa, Homo Sapiens
RSLNSKLWK

SEQ ID NO: 238749 - protein, 9 aa, Homo Sapiens
EAEFLISLY

SEQ ID NO: 238750 - protein, 9 aa, Homo Sapiens
KENKDLLGE

SEQ ID NO: 238751 - protein, 9 aa, Homo Sapiens
PTFGKGLNL

SEQ ID NO: 238752 - protein, 9 aa, Homo Sapiens
QAFCLLKAA

SEQ ID NO: 238753 - protein, 9 aa, Homo Sapiens
RRWMRDNVP

SEQ ID NO: 238754 - protein, 9 aa, Homo Sapiens
IYACFSVKG

SEQ ID NO: 238755 - protein, 9 aa, Homo Sapiens
LRNQSWSWC

SEQ ID NO: 238756 - protein, 9 aa, Homo Sapiens
GLSSTENLN

SEQ ID NO: 238757 - protein, 9 aa, Homo Sapiens
GGIPNIDYS

SEQ ID NO: 238758 - protein, 9 aa, Homo Sapiens
KMTFNPPVE

SEQ ID NO: 238759 - protein, 9 aa, Homo Sapiens
VDRLDQRHS

SEQ ID NO: 238760 - protein, 9 aa, Homo Sapiens
SSADVEFYL

SEQ ID NO: 238761 - protein, 9 aa, Homo Sapiens
HFDPENPQT

SEQ ID NO: 238762 - protein, 9 aa, Homo Sapiens
PVGELFLWQ

SEQ ID NO: 238763 - protein, 9 aa, Homo Sapiens
NDHAYRVFK

SEQ ID NO: 238764 - protein, 9 aa, Homo Sapiens
KQSVVGMLT

SEQ ID NO: 238765 - protein, 9 aa, Homo Sapiens
GNKCEEFNQ

SEQ ID NO: 238766 - protein, 9 aa, Homo Sapiens
VKEIPCNCH

SEQ ID NO: 238767 - protein, 9 aa, Homo Sapiens
QTQTSLVQE

SEQ ID NO: 238768 - protein, 9 aa, Homo Sapiens
EADKTRQSK

SEQ ID NO: 238769 - protein, 9 aa, Homo Sapiens
TDVNNSKAR

SEQ ID NO: 238770 - protein, 9 aa, Homo Sapiens
YQMTSGSWT

SEQ ID NO: 238771 - protein, 9 aa, Homo Sapiens
VKDYGKEYQ

SEQ ID NO: 238772 - protein, 9 aa, Homo Sapiens
SDLGAMDVS

SEQ ID NO: 238773 - protein, 9 aa, Homo Sapiens
KENETVVLS

SEQ ID NO: 238774 - protein, 9 aa, Homo Sapiens
LWRLNSSEA

SEQ ID NO: 238775 - protein, 9 aa, Homo Sapiens
TLHQQNHTG

SEQ ID NO: 238776 - protein, 9 aa, Homo Sapiens
LKKESRETC

SEQ ID NO: 238777 - protein, 9 aa, Homo Sapiens
FILKVWNSI

SEQ ID NO: 238778 - protein, 9 aa, Homo Sapiens
VHLSKVRSL

SEQ ID NO: 238779 - protein, 9 aa, Homo Sapiens
ARVQAVVMT

SEQ ID NO: 238780 - protein, 9 aa, Homo Sapiens
ITNLNYDTN

SEQ ID NO: 238781 - protein, 9 aa, Homo Sapiens
HDGNKHIKD

SEQ ID NO: 238782 - protein, 9 aa, Homo Sapiens
RVKSLKSHA

SEQ ID NO: 238783 - protein, 9 aa, Homo Sapiens
KTRRMGTYS

SEQ ID NO: 238784 - protein, 9 aa, Homo Sapiens
TVTVITRYR

SEQ ID NO: 238785 - protein, 9 aa, Homo Sapiens
TAKFREQIL

SEQ ID NO: 238786 - protein, 9 aa, Homo Sapiens
SENEAYHPA

SEQ ID NO: 238787 - protein, 9 aa, Homo Sapiens
KLSLLIDTF

SEQ ID NO: 238788 - protein, 9 aa, Homo Sapiens
KNTVVRYPI

SEQ ID NO: 238789 - protein, 9 aa, Homo Sapiens
YSSYLSSSC

SEQ ID NO: 238790 - protein, 9 aa, Homo Sapiens
FLQGKRKGQ

SEQ ID NO: 238791 - protein, 9 aa, Homo Sapiens
QGMQEEQNK

SEQ ID NO: 238792 - protein, 9 aa, Homo Sapiens
LLHFQVLFE

SEQ ID NO: 238793 - protein, 9 aa, Homo Sapiens
PVTKTPLPN

SEQ ID NO: 238794 - protein, 9 aa, Homo Sapiens
GLPTNCLTL

SEQ ID NO: 238795 - protein, 9 aa, Homo Sapiens
TVVRYEKLF

SEQ ID NO: 238796 - protein, 9 aa, Homo Sapiens
ISQATAQIN

SEQ ID NO: 238797 - protein, 9 aa, Homo Sapiens
CDKHYYGEG

SEQ ID NO: 238798 - protein, 9 aa, Homo Sapiens
DDYDNSTPP

SEQ ID NO: 238799 - protein, 9 aa, Homo Sapiens
PDNKINRIL

SEQ ID NO: 238800 - protein, 9 aa, Homo Sapiens
LKVHGAFMF

SEQ ID NO: 238801 - protein, 9 aa, Homo Sapiens
DTIGQAKEN

SEQ ID NO: 238802 - protein, 9 aa, Homo Sapiens
SCTENEASQ

SEQ ID NO: 238803 - protein, 9 aa, Homo Sapiens
YIDKAKKFR

SEQ ID NO: 238804 - protein, 9 aa, Homo Sapiens
HNPGTVKIP

SEQ ID NO: 238805 - protein, 9 aa, Homo Sapiens
QEDAHDFLQ

SEQ ID NO: 238806 - protein, 9 aa, Homo Sapiens
RDGDCSKGL

SEQ ID NO: 238807 - protein, 9 aa, Homo Sapiens
PEYGLGNPP

SEQ ID NO: 238808 - protein, 9 aa, Homo Sapiens
SVVMRHSWK

SEQ ID NO: 238809 - protein, 9 aa, Homo Sapiens
HHFTQMQEL

SEQ ID NO: 238810 - protein, 9 aa, Homo Sapiens
PDDKSIMTY

SEQ ID NO: 238811 - protein, 9 aa, Homo Sapiens
FQRERSDCE

SEQ ID NO: 238812 - protein, 9 aa, Homo Sapiens
DIIDNLKDV

SEQ ID NO: 238813 - protein, 9 aa, Homo Sapiens
MLNQTLLET

SEQ ID NO: 238814 - protein, 9 aa, Homo Sapiens
VKTNTSQES

SEQ ID NO: 238815 - protein, 9 aa, Homo Sapiens
DPSNGIPKL

SEQ ID NO: 238816 - protein, 9 aa, Homo Sapiens
KWCHGLGPR

SEQ ID NO: 238817 - protein, 9 aa, Homo Sapiens
CFIDTDTLI

SEQ ID NO: 238818 - protein, 9 aa, Homo Sapiens
TTAVWHQNG

SEQ ID NO: 238819 - protein, 9 aa, Homo Sapiens
CPDFTPQKF

SEQ ID NO: 238820 - protein, 9 aa, Homo Sapiens
SRRFCIQLV

SEQ ID NO: 238821 - protein, 9 aa, Homo Sapiens
PLTFRTLCD

SEQ ID NO: 238822 - protein, 9 aa, Homo Sapiens
QNSTIGAYF

SEQ ID NO: 238823 - protein, 9 aa, Homo Sapiens
PEIFKNYDA

SEQ ID NO: 238824 - protein, 9 aa, Homo Sapiens
IENLAAMDL

SEQ ID NO: 238825 - protein, 9 aa, Homo Sapiens
ATMNEQDFC

SEQ ID NO: 238826 - protein, 9 aa, Homo Sapiens
CRLYTKLSA

SEQ ID NO: 238827 - protein, 9 aa, Homo Sapiens
LFIGGKINR

SEQ ID NO: 238828 - protein, 9 aa, Homo Sapiens
LKEKTKETK

SEQ ID NO: 238829 - protein, 9 aa, Homo Sapiens
SIYEGDESV

SEQ ID NO: 238830 - protein, 9 aa, Homo Sapiens
ANSITFCNA

SEQ ID NO: 238831 - protein, 9 aa, Homo Sapiens
ATAQEIFQD

SEQ ID NO: 238832 - protein, 9 aa, Homo Sapiens
DSPTQISEH

SEQ ID NO: 238833 - protein, 9 aa, Homo Sapiens
KVIKSLQKN

SEQ ID NO: 238834 - protein, 9 aa, Homo Sapiens
SGLSNGDKS

SEQ ID NO: 238835 - protein, 9 aa, Homo Sapiens
GAMSGGGAL

SEQ ID NO: 238836 - protein, 9 aa, Homo Sapiens
KIKEDIEAR

SEQ ID NO: 238837 - protein, 9 aa, Homo Sapiens
EELRSQHNK

SEQ ID NO: 238838 - protein, 9 aa, Homo Sapiens
QLGRYQVSG

SEQ ID NO: 238839 - protein, 9 aa, Homo Sapiens
SGDVSNVIK

SEQ ID NO: 238840 - protein, 9 aa, Homo Sapiens
MAILSLTFL

SEQ ID NO: 238841 - protein, 9 aa, Homo Sapiens
AKKAKREEN

SEQ ID NO: 238842 - protein, 9 aa, Homo Sapiens
MNTFKWTKK

SEQ ID NO: 238843 - protein, 9 aa, Homo Sapiens
ILTSQIISC

SEQ ID NO: 238844 - protein, 9 aa, Homo Sapiens
KAALVGMYG

SEQ ID NO: 238845 - protein, 9 aa, Homo Sapiens
NDHPEITYQ

SEQ ID NO: 238846 - protein, 9 aa, Homo Sapiens
NAFPFYSSY

SEQ ID NO: 238847 - protein, 9 aa, Homo Sapiens
LSTYIQLYG

SEQ ID NO: 238848 - protein, 9 aa, Homo Sapiens
ISEDSEQRG

SEQ ID NO: 238849 - protein, 9 aa, Homo Sapiens
VDLLSNINN

SEQ ID NO: 238850 - protein, 9 aa, Homo Sapiens
QMDYLALSQ

SEQ ID NO: 238851 - protein, 9 aa, Homo Sapiens
HVEKETQPG

SEQ ID NO: 238852 - protein, 9 aa, Homo Sapiens
IIGTGFFIG

SEQ ID NO: 238853 - protein, 9 aa, Homo Sapiens
TSQIISCSP

SEQ ID NO: 238854 - protein, 9 aa, Homo Sapiens
VNKYQYLLP

SEQ ID NO: 238855 - protein, 9 aa, Homo Sapiens
AQTQAEERE

SEQ ID NO: 238856 - protein, 9 aa, Homo Sapiens
IEITFDGKK

SEQ ID NO: 238857 - protein, 9 aa, Homo Sapiens
LLQAEGAKV

SEQ ID NO: 238858 - protein, 9 aa, Homo Sapiens
LENNQITAL

SEQ ID NO: 238859 - protein, 9 aa, Homo Sapiens
LVMEVDERD

SEQ ID NO: 238860 - protein, 9 aa, Homo Sapiens
RHQNIHIRE

SEQ ID NO: 238861 - protein, 9 aa, Homo Sapiens
KVLTSSRHL

SEQ ID NO: 238862 - protein, 9 aa, Homo Sapiens
RTWKEVCFT

SEQ ID NO: 238863 - protein, 9 aa, Homo Sapiens
SRPERDMHY

SEQ ID NO: 238864 - protein, 9 aa, Homo Sapiens
VRIITGENN

SEQ ID NO: 238865 - protein, 9 aa, Homo Sapiens
LNLMESSSV

SEQ ID NO: 238866 - protein, 9 aa, Homo Sapiens
KDSKPRSLW

SEQ ID NO: 238867 - protein, 9 aa, Homo Sapiens
AADRERIEA

SEQ ID NO: 238868 - protein, 9 aa, Homo Sapiens
MLKARQLEG

SEQ ID NO: 238869 - protein, 9 aa, Homo Sapiens
SCSHFVPAL

SEQ ID NO: 238870 - protein, 9 aa, Homo Sapiens
QEVFKAFCL

SEQ ID NO: 238871 - protein, 9 aa, Homo Sapiens
NWCEKPIQD

SEQ ID NO: 238872 - protein, 9 aa, Homo Sapiens
DIYANGILN

SEQ ID NO: 238873 - protein, 9 aa, Homo Sapiens
ILMHLNATW

SEQ ID NO: 238874 - protein, 9 aa, Homo Sapiens
TFSNSEVAI

SEQ ID NO: 238875 - protein, 9 aa, Homo Sapiens
TFIILGFSE

SEQ ID NO: 238876 - protein, 9 aa, Homo Sapiens
VWSAPEDVD

SEQ ID NO: 238877 - protein, 9 aa, Homo Sapiens
GTKHYSLIV

SEQ ID NO: 238878 - protein, 9 aa, Homo Sapiens
GALKKLINA

SEQ ID NO: 238879 - protein, 9 aa, Homo Sapiens
QSLSKNVGI

SEQ ID NO: 238880 - protein, 9 aa, Homo Sapiens
INNHVFCLI

SEQ ID NO: 238881 - protein, 9 aa, Homo Sapiens
METWLRLAV

SEQ ID NO: 238882 - protein, 9 aa, Homo Sapiens
ENSVAVPRL

SEQ ID NO: 238883 - protein, 9 aa, Homo Sapiens
IATHSRNIT

SEQ ID NO: 238884 - protein, 9 aa, Homo Sapiens
SISSDRGRT

SEQ ID NO: 238885 - protein, 9 aa, Homo Sapiens
DPYRHERRK

SEQ ID NO: 238886 - protein, 9 aa, Homo Sapiens
LIDFFVERN

SEQ ID NO: 238887 - protein, 9 aa, Homo Sapiens
YIISWLIFG

SEQ ID NO: 238888 - protein, 9 aa, Homo Sapiens
LTVTWKADV

SEQ ID NO: 238889 - protein, 9 aa, Homo Sapiens
YFQKAAQGG

SEQ ID NO: 238890 - protein, 9 aa, Homo Sapiens
NTRLCGARL

SEQ ID NO: 238891 - protein, 9 aa, Homo Sapiens
KLSWQEPEH

SEQ ID NO: 238892 - protein, 9 aa, Homo Sapiens
TPYTSSNSC

SEQ ID NO: 238893 - protein, 9 aa, Homo Sapiens
CEQILASLL

SEQ ID NO: 238894 - protein, 9 aa, Homo Sapiens
LLERRIKPF

SEQ ID NO: 238895 - protein, 9 aa, Homo Sapiens
CEAALPKVS

SEQ ID NO: 238896 - protein, 9 aa, Homo Sapiens
RQLHVIDNQ

SEQ ID NO: 238897 - protein, 9 aa, Homo Sapiens
ATLPQCSLT

SEQ ID NO: 238898 - protein, 9 aa, Homo Sapiens
SDYPEHVCK

SEQ ID NO: 238899 - protein, 9 aa, Homo Sapiens
TELQLESIS

SEQ ID NO: 238900 - protein, 9 aa, Homo Sapiens
PIIRFCHPN

SEQ ID NO: 238901 - protein, 9 aa, Homo Sapiens
CMGQGMGAI

SEQ ID NO: 238902 - protein, 9 aa, Homo Sapiens
GLCGHWGRQ

SEQ ID NO: 238903 - protein, 9 aa, Homo Sapiens
PETFTEDPH

SEQ ID NO: 238904 - protein, 9 aa, Homo Sapiens
CEDLKLPEG

SEQ ID NO: 238905 - protein, 9 aa, Homo Sapiens
LQDLMLASG

SEQ ID NO: 238906 - protein, 9 aa, Homo Sapiens
NEHKKIHIA

SEQ ID NO: 238907 - protein, 9 aa, Homo Sapiens
TISDEESHD

SEQ ID NO: 238908 - protein, 9 aa, Homo Sapiens
FENSMKIYL

SEQ ID NO: 238909 - protein, 9 aa, Homo Sapiens
HSKSSVSSS

SEQ ID NO: 238910 - protein, 9 aa, Homo Sapiens
CDICGNNFG

SEQ ID NO: 238911 - protein, 9 aa, Homo Sapiens
SLLLLVISS

SEQ ID NO: 238912 - protein, 9 aa, Homo Sapiens
MLVSPLKYG

SEQ ID NO: 238913 - protein, 9 aa, Homo Sapiens
MVLPEVEVA

SEQ ID NO: 238914 - protein, 9 aa, Homo Sapiens
TKAKIIMII

SEQ ID NO: 238915 - protein, 9 aa, Homo Sapiens
QQLSSSAAP

SEQ ID NO: 238916 - protein, 9 aa, Homo Sapiens
EGDNLPEAL

SEQ ID NO: 238917 - protein, 9 aa, Homo Sapiens
SSPQISSEA

SEQ ID NO: 238918 - protein, 9 aa, Homo Sapiens
STYIQLYGR

SEQ ID NO: 238919 - protein, 9 aa, Homo Sapiens
KDLSTLTAH

SEQ ID NO: 238920 - protein, 9 aa, Homo Sapiens
QNGRLYAIS

SEQ ID NO: 238921 - protein, 9 aa, Homo Sapiens
GPSTRTPVS

SEQ ID NO: 238922 - protein, 9 aa, Homo Sapiens
SATFINSSG

SEQ ID NO: 238923 - protein, 9 aa, Homo Sapiens
DIKTEFINR

SEQ ID NO: 238924 - protein, 9 aa, Homo Sapiens
ETLPTTNMA

SEQ ID NO: 238925 - protein, 9 aa, Homo Sapiens
LLPLSEKER

SEQ ID NO: 238926 - protein, 9 aa, Homo Sapiens
SVLIAKASV

SEQ ID NO: 238927 - protein, 9 aa, Homo Sapiens
NITYVPQNP

SEQ ID NO: 238928 - protein, 9 aa, Homo Sapiens
DQISVSELI

SEQ ID NO: 238929 - protein, 9 aa, Homo Sapiens
CNLEFNLDI

SEQ ID NO: 238930 - protein, 9 aa, Homo Sapiens
PDKLDKKEK

SEQ ID NO: 238931 - protein, 9 aa, Homo Sapiens
ATPGVDHVP

SEQ ID NO: 238932 - protein, 9 aa, Homo Sapiens
NGRHPYKCK

SEQ ID NO: 238933 - protein, 9 aa, Homo Sapiens
HGCVSGPSA

SEQ ID NO: 238934 - protein, 9 aa, Homo Sapiens
MMGPLAQQM

SEQ ID NO: 238935 - protein, 9 aa, Homo Sapiens
KKLWHQLAL

SEQ ID NO: 238936 - protein, 9 aa, Homo Sapiens
VARRRGIPE

SEQ ID NO: 238937 - protein, 9 aa, Homo Sapiens
ATVLESLET

SEQ ID NO: 238938 - protein, 9 aa, Homo Sapiens
EIFKNYDAE

SEQ ID NO: 238939 - protein, 9 aa, Homo Sapiens
LNSIFDSFP

SEQ ID NO: 238940 - protein, 9 aa, Homo Sapiens
RFIVQEVNI

SEQ ID NO: 238941 - protein, 9 aa, Homo Sapiens
NNFSGRIEG

SEQ ID NO: 238942 - protein, 9 aa, Homo Sapiens
SLITLPITM

SEQ ID NO: 238943 - protein, 9 aa, Homo Sapiens
LEKEGFVTE

SEQ ID NO: 238944 - protein, 9 aa, Homo Sapiens
MLQGQVLKT

SEQ ID NO: 238945 - protein, 9 aa, Homo Sapiens
NILRFFFHL

SEQ ID NO: 238946 - protein, 9 aa, Homo Sapiens
KEEQRARYL

SEQ ID NO: 238947 - protein, 9 aa, Homo Sapiens
VMKPPLIFV

SEQ ID NO: 238948 - protein, 9 aa, Homo Sapiens
STNLTAHKI

SEQ ID NO: 238949 - protein, 9 aa, Homo Sapiens
FRCHSSLSH

SEQ ID NO: 238950 - protein, 9 aa, Homo Sapiens
IKTRLEQDI

SEQ ID NO: 238951 - protein, 9 aa, Homo Sapiens
SRTNIIKIL

SEQ ID NO: 238952 - protein, 9 aa, Homo Sapiens
DYFRAMFSI

SEQ ID NO: 238953 - protein, 9 aa, Homo Sapiens
NSSPSAEHS

SEQ ID NO: 238954 - protein, 9 aa, Homo Sapiens
GIEFVKHFC

SEQ ID NO: 238955 - protein, 9 aa, Homo Sapiens
RIRGHLYPT

SEQ ID NO: 238956 - protein, 9 aa, Homo Sapiens
LACSDTYNN

SEQ ID NO: 238957 - protein, 9 aa, Homo Sapiens
DVNCLSPEY

SEQ ID NO: 238958 - protein, 9 aa, Homo Sapiens
HSTDKGPSS

SEQ ID NO: 238959 - protein, 9 aa, Homo Sapiens
NDHNSGLIR

SEQ ID NO: 238960 - protein, 9 aa, Homo Sapiens
EPDKPIDRE

SEQ ID NO: 238961 - protein, 9 aa, Homo Sapiens
VFFQQKWKD

SEQ ID NO: 238962 - protein, 9 aa, Homo Sapiens
QMDLSADSS

SEQ ID NO: 238963 - protein, 9 aa, Homo Sapiens
YAIELYERR

SEQ ID NO: 238964 - protein, 9 aa, Homo Sapiens
LRNIPLFEG

SEQ ID NO: 238965 - protein, 9 aa, Homo Sapiens
SQKFSKCSI

SEQ ID NO: 238966 - protein, 9 aa, Homo Sapiens
EAIYFIDCV

SEQ ID NO: 238967 - protein, 9 aa, Homo Sapiens
NYYLLCDVL

SEQ ID NO: 238968 - protein, 9 aa, Homo Sapiens
MSGVSVRAG

SEQ ID NO: 238969 - protein, 9 aa, Homo Sapiens
FRDFDFLDA

SEQ ID NO: 238970 - protein, 9 aa, Homo Sapiens
TEAKNEAKN

SEQ ID NO: 238971 - protein, 9 aa, Homo Sapiens
VKLMILSYS

SEQ ID NO: 238972 - protein, 9 aa, Homo Sapiens
DSYFSQKAC

SEQ ID NO: 238973 - protein, 9 aa, Homo Sapiens
TIGFYCQNV

SEQ ID NO: 238974 - protein, 9 aa, Homo Sapiens
KEKKRNIPS

SEQ ID NO: 238975 - protein, 9 aa, Homo Sapiens
VDKYGPGPM

SEQ ID NO: 238976 - protein, 9 aa, Homo Sapiens
YELWETRVL

SEQ ID NO: 238977 - protein, 9 aa, Homo Sapiens
GGNKSHIRT

SEQ ID NO: 238978 - protein, 9 aa, Homo Sapiens
PPHQASISG

SEQ ID NO: 238979 - protein, 9 aa, Homo Sapiens
TFLTSDNNI

SEQ ID NO: 238980 - protein, 9 aa, Homo Sapiens
QIKAKIEDL

SEQ ID NO: 238981 - protein, 9 aa, Homo Sapiens
SCEQNIEEA

SEQ ID NO: 238982 - protein, 9 aa, Homo Sapiens
WGSMGEISA

SEQ ID NO: 238983 - protein, 9 aa, Homo Sapiens
ELQLYSVAS

SEQ ID NO: 238984 - protein, 9 aa, Homo Sapiens
NCFNCGTWM

SEQ ID NO: 238985 - protein, 9 aa, Homo Sapiens
EEVFQPMLI

SEQ ID NO: 238986 - protein, 9 aa, Homo Sapiens
TVSYEVRGT

SEQ ID NO: 238987 - protein, 9 aa, Homo Sapiens
TTAEREIVQ

SEQ ID NO: 238988 - protein, 9 aa, Homo Sapiens
YHALEKQNT

SEQ ID NO: 238989 - protein, 9 aa, Homo Sapiens
YWQNILVDR

SEQ ID NO: 238990 - protein, 9 aa, Homo Sapiens
VFQPMLIEY

SEQ ID NO: 238991 - protein, 9 aa, Homo Sapiens
EVCKTMCKR

SEQ ID NO: 238992 - protein, 9 aa, Homo Sapiens
CKLADQCTG

SEQ ID NO: 238993 - protein, 9 aa, Homo Sapiens
QEEGKLWND

SEQ ID NO: 238994 - protein, 9 aa, Homo Sapiens
ENVTFTYHT

SEQ ID NO: 238995 - protein, 9 aa, Homo Sapiens
ETYGFGQHG

SEQ ID NO: 238996 - protein, 9 aa, Homo Sapiens
VKELYVPEH

SEQ ID NO: 238997 - protein, 9 aa, Homo Sapiens
KSQQMPQAA

SEQ ID NO: 238998 - protein, 9 aa, Homo Sapiens
TKKNYNNLI

SEQ ID NO: 238999 - protein, 9 aa, Homo Sapiens
KDKEIKASS

SEQ ID NO: 239000 - protein, 9 aa, Homo Sapiens
TFQAGFLNT

SEQ ID NO: 239001 - protein, 9 aa, Homo Sapiens
TNLQTAPTL

SEQ ID NO: 239002 - protein, 9 aa, Homo Sapiens
SHVHYTDDP

SEQ ID NO: 239003 - protein, 9 aa, Homo Sapiens
SSHPDKPLP

SEQ ID NO: 239004 - protein, 9 aa, Homo Sapiens
GIPKIHEFE

SEQ ID NO: 239005 - protein, 9 aa, Homo Sapiens
YKLRKAPSD

SEQ ID NO: 239006 - protein, 9 aa, Homo Sapiens
DTIGKTTKT

SEQ ID NO: 239007 - protein, 9 aa, Homo Sapiens
SCDVESNPR

SEQ ID NO: 239008 - protein, 9 aa, Homo Sapiens
PTKPTAFQK

SEQ ID NO: 239009 - protein, 9 aa, Homo Sapiens
VLETKWELR

SEQ ID NO: 239010 - protein, 9 aa, Homo Sapiens
DAPHFLEKQ

SEQ ID NO: 239011 - protein, 9 aa, Homo Sapiens
RVPDELTLA

SEQ ID NO: 239012 - protein, 9 aa, Homo Sapiens
YLVFDEADQ

SEQ ID NO: 239013 - protein, 9 aa, Homo Sapiens
FELIVFSQV

SEQ ID NO: 239014 - protein, 9 aa, Homo Sapiens
ISYFVAELI

SEQ ID NO: 239015 - protein, 9 aa, Homo Sapiens
VHLKKELFT

SEQ ID NO: 239016 - protein, 9 aa, Homo Sapiens
VMLHFDLRI

SEQ ID NO: 239017 - protein, 9 aa, Homo Sapiens
LGRRDCLVE

SEQ ID NO: 239018 - protein, 9 aa, Homo Sapiens
AIINVSFCV

SEQ ID NO: 239019 - protein, 9 aa, Homo Sapiens
KAREDKSFD

SEQ ID NO: 239020 - protein, 9 aa, Homo Sapiens
AVVDFGKTS

SEQ ID NO: 239021 - protein, 9 aa, Homo Sapiens
FHERGNNHK

SEQ ID NO: 239022 - protein, 9 aa, Homo Sapiens
GQVMAKRIH

SEQ ID NO: 239023 - protein, 9 aa, Homo Sapiens
SSSWVKHYC

SEQ ID NO: 239024 - protein, 9 aa, Homo Sapiens
KSRTEMQEL

SEQ ID NO: 239025 - protein, 9 aa, Homo Sapiens
EDIIEAIHT

SEQ ID NO: 239026 - protein, 9 aa, Homo Sapiens
FTLGGSEHL

SEQ ID NO: 239027 - protein, 9 aa, Homo Sapiens
HSGDVTLVT

SEQ ID NO: 239028 - protein, 9 aa, Homo Sapiens
QDLAGDFQM

SEQ ID NO: 239029 - protein, 9 aa, Homo Sapiens
QILGDILNS

SEQ ID NO: 239030 - protein, 9 aa, Homo Sapiens
LCEVPTMIK

SEQ ID NO: 239031 - protein, 9 aa, Homo Sapiens
QVKRFKANL

SEQ ID NO: 239032 - protein, 9 aa, Homo Sapiens
GQNLSFIDI

SEQ ID NO: 239033 - protein, 9 aa, Homo Sapiens
RKEEWDKMK

SEQ ID NO: 239034 - protein, 9 aa, Homo Sapiens
EERCTDVNN

SEQ ID NO: 239035 - protein, 9 aa, Homo Sapiens
TEVGRCSGD

SEQ ID NO: 239036 - protein, 9 aa, Homo Sapiens
KSPASGAYI

SEQ ID NO: 239037 - protein, 9 aa, Homo Sapiens
KMVLNFTTM

SEQ ID NO: 239038 - protein, 9 aa, Homo Sapiens
KVPLSDENS

SEQ ID NO: 239039 - protein, 9 aa, Homo Sapiens
TICINYSRG

SEQ ID NO: 239040 - protein, 9 aa, Homo Sapiens
DKEIIRGQV

SEQ ID NO: 239041 - protein, 9 aa, Homo Sapiens
LEFQLWDAE

SEQ ID NO: 239042 - protein, 9 aa, Homo Sapiens
SSGLLVSLT

SEQ ID NO: 239043 - protein, 9 aa, Homo Sapiens
AIELSLEEW

SEQ ID NO: 239044 - protein, 9 aa, Homo Sapiens
QECLLNLHS

SEQ ID NO: 239045 - protein, 9 aa, Homo Sapiens
WGDSEKYQR

SEQ ID NO: 239046 - protein, 9 aa, Homo Sapiens
PATVGLPIG

SEQ ID NO: 239047 - protein, 9 aa, Homo Sapiens
GTFLVRDNS

SEQ ID NO: 239048 - protein, 9 aa, Homo Sapiens
ANDVFPCSV

SEQ ID NO: 239049 - protein, 9 aa, Homo Sapiens
RTLILVATS

SEQ ID NO: 239050 - protein, 9 aa, Homo Sapiens
ASKSVSSTN

SEQ ID NO: 239051 - protein, 9 aa, Homo Sapiens
PTGFPCVRL

SEQ ID NO: 239052 - protein, 9 aa, Homo Sapiens
QVWQMADNI

SEQ ID NO: 239053 - protein, 9 aa, Homo Sapiens
IFVPSSYPG

SEQ ID NO: 239054 - protein, 9 aa, Homo Sapiens
FTSQCLKNN

SEQ ID NO: 239055 - protein, 9 aa, Homo Sapiens
SLNMEQANY

SEQ ID NO: 239056 - protein, 9 aa, Homo Sapiens
IGQYVITVA

SEQ ID NO: 239057 - protein, 9 aa, Homo Sapiens
PEEHPSVHE

SEQ ID NO: 239058 - protein, 9 aa, Homo Sapiens
TYQTAIVQN

SEQ ID NO: 239059 - protein, 9 aa, Homo Sapiens
GKYVVSGFN

SEQ ID NO: 239060 - protein, 9 aa, Homo Sapiens
WCTNCPKGA

SEQ ID NO: 239061 - protein, 9 aa, Homo Sapiens
VNLDQLKAG

SEQ ID NO: 239062 - protein, 9 aa, Homo Sapiens
ISDHYGAPN

SEQ ID NO: 239063 - protein, 9 aa, Homo Sapiens
EYEREHVDT

SEQ ID NO: 239064 - protein, 9 aa, Homo Sapiens
HGQETTDPS

SEQ ID NO: 239065 - protein, 9 aa, Homo Sapiens
LDRLWTTTN

SEQ ID NO: 239066 - protein, 9 aa, Homo Sapiens
ETSIPAYTM

SEQ ID NO: 239067 - protein, 9 aa, Homo Sapiens
CDEGHGLKV

SEQ ID NO: 239068 - protein, 9 aa, Homo Sapiens
NVQLITGVN

SEQ ID NO: 239069 - protein, 9 aa, Homo Sapiens
HRGGYKPVW

SEQ ID NO: 239070 - protein, 9 aa, Homo Sapiens
DIDPSNGIP

SEQ ID NO: 239071 - protein, 9 aa, Homo Sapiens
QLGRVVDEW

SEQ ID NO: 239072 - protein, 9 aa, Homo Sapiens
LNGLDESLC

SEQ ID NO: 239073 - protein, 9 aa, Homo Sapiens
SNYPFPSRV

SEQ ID NO: 239074 - protein, 9 aa, Homo Sapiens
FAIMSPGQK

SEQ ID NO: 239075 - protein, 9 aa, Homo Sapiens
PEGTKSYKD

SEQ ID NO: 239076 - protein, 9 aa, Homo Sapiens
WEAFELLGL

SEQ ID NO: 239077 - protein, 9 aa, Homo Sapiens
LDLIWYNTI

SEQ ID NO: 239078 - protein, 9 aa, Homo Sapiens
PQHQEVWGK

SEQ ID NO: 239079 - protein, 9 aa, Homo Sapiens
VQGDQDKTD

SEQ ID NO: 239080 - protein, 9 aa, Homo Sapiens
MVLDFVNAM

SEQ ID NO: 239081 - protein, 9 aa, Homo Sapiens
FSPGAQSQY

SEQ ID NO: 239082 - protein, 9 aa, Homo Sapiens
ILGFSEYPE

SEQ ID NO: 239083 - protein, 9 aa, Homo Sapiens
KHVWLGEII

SEQ ID NO: 239084 - protein, 9 aa, Homo Sapiens
AASTRLEKD

SEQ ID NO: 239085 - protein, 9 aa, Homo Sapiens
LLSKLIRQS

SEQ ID NO: 239086 - protein, 9 aa, Homo Sapiens
VGDSTLADS

SEQ ID NO: 239087 - protein, 9 aa, Homo Sapiens
ERIEERNEE

SEQ ID NO: 239088 - protein, 9 aa, Homo Sapiens
GPFTTPALI

SEQ ID NO: 239089 - protein, 9 aa, Homo Sapiens
FQDKWERAF

SEQ ID NO: 239090 - protein, 9 aa, Homo Sapiens
KKTTIPFSE

SEQ ID NO: 239091 - protein, 9 aa, Homo Sapiens
PERRGRPDI

SEQ ID NO: 239092 - protein, 9 aa, Homo Sapiens
VGLAENITP

SEQ ID NO: 239093 - protein, 9 aa, Homo Sapiens
YFFMLFVMM

SEQ ID NO: 239094 - protein, 9 aa, Homo Sapiens
SYSSCFPRY

SEQ ID NO: 239095 - protein, 9 aa, Homo Sapiens
EEEVNTLDL

SEQ ID NO: 239096 - protein, 9 aa, Homo Sapiens
EYSLQIQKV

SEQ ID NO: 239097 - protein, 9 aa, Homo Sapiens
SEDPPWSRN

SEQ ID NO: 239098 - protein, 9 aa, Homo Sapiens
LLRYLALCC

SEQ ID NO: 239099 - protein, 9 aa, Homo Sapiens
VESGNFKNS

SEQ ID NO: 239100 - protein, 9 aa, Homo Sapiens
GSWREGDKV

SEQ ID NO: 239101 - protein, 9 aa, Homo Sapiens
TQNPVSARC

SEQ ID NO: 239102 - protein, 9 aa, Homo Sapiens
HYWLCDNCL

SEQ ID NO: 239103 - protein, 9 aa, Homo Sapiens
HLARGTIQT

SEQ ID NO: 239104 - protein, 9 aa, Homo Sapiens
LNDLEKQYN

SEQ ID NO: 239105 - protein, 9 aa, Homo Sapiens
KEIDSHNFA

SEQ ID NO: 239106 - protein, 9 aa, Homo Sapiens
YSATYDRRT

SEQ ID NO: 239107 - protein, 9 aa, Homo Sapiens
QIKQLLGKG

SEQ ID NO: 239108 - protein, 9 aa, Homo Sapiens
INAFISVDH

SEQ ID NO: 239109 - protein, 9 aa, Homo Sapiens
ISGGFGKEL

SEQ ID NO: 239110 - protein, 9 aa, Homo Sapiens
RSAIFGGEQ

SEQ ID NO: 239111 - protein, 9 aa, Homo Sapiens
VPVPPGPPG

SEQ ID NO: 239112 - protein, 9 aa, Homo Sapiens
ILDPFQYLL

SEQ ID NO: 239113 - protein, 9 aa, Homo Sapiens
LGELTVTYA

SEQ ID NO: 239114 - protein, 9 aa, Homo Sapiens
NEEDKNVIS

SEQ ID NO: 239115 - protein, 9 aa, Homo Sapiens
EITYQLRND

SEQ ID NO: 239116 - protein, 9 aa, Homo Sapiens
QPKPQMSLE

SEQ ID NO: 239117 - protein, 9 aa, Homo Sapiens
AKEPRVTLD

SEQ ID NO: 239118 - protein, 9 aa, Homo Sapiens
YQDYAPQPY

SEQ ID NO: 239119 - protein, 9 aa, Homo Sapiens
LFFTESSKY

SEQ ID NO: 239120 - protein, 9 aa, Homo Sapiens
SPILTVLQA

SEQ ID NO: 239121 - protein, 9 aa, Homo Sapiens
ADRFACTEE

SEQ ID NO: 239122 - protein, 9 aa, Homo Sapiens
GCSLIHINY

SEQ ID NO: 239123 - protein, 9 aa, Homo Sapiens
LNTQKVTFE

SEQ ID NO: 239124 - protein, 9 aa, Homo Sapiens
GTTRSRKPL

SEQ ID NO: 239125 - protein, 9 aa, Homo Sapiens
WPWTKNRMW

SEQ ID NO: 239126 - protein, 9 aa, Homo Sapiens
SLKTCDCFS

SEQ ID NO: 239127 - protein, 9 aa, Homo Sapiens
HVSGRPPVI

SEQ ID NO: 239128 - protein, 9 aa, Homo Sapiens
DRPDTQKLS

SEQ ID NO: 239129 - protein, 9 aa, Homo Sapiens
IAYFIPFLP

SEQ ID NO: 239130 - protein, 9 aa, Homo Sapiens
PLFGDQPES

SEQ ID NO: 239131 - protein, 9 aa, Homo Sapiens
VVSQPQFTA

SEQ ID NO: 239132 - protein, 9 aa, Homo Sapiens
AYSQSAEER

SEQ ID NO: 239133 - protein, 9 aa, Homo Sapiens
QMCRCLREE

SEQ ID NO: 239134 - protein, 9 aa, Homo Sapiens
YHFEQLSQR

SEQ ID NO: 239135 - protein, 9 aa, Homo Sapiens
GMLQPQVKE

SEQ ID NO: 239136 - protein, 9 aa, Homo Sapiens
ISDGVQHLG

SEQ ID NO: 239137 - protein, 9 aa, Homo Sapiens
CVLGLIWGQ

SEQ ID NO: 239138 - protein, 9 aa, Homo Sapiens
SSTIEATTS

SEQ ID NO: 239139 - protein, 9 aa, Homo Sapiens
DVMLDNYRN

SEQ ID NO: 239140 - protein, 9 aa, Homo Sapiens
HLKESFFQY

SEQ ID NO: 239141 - protein, 9 aa, Homo Sapiens
NSLYWLSTH

SEQ ID NO: 239142 - protein, 9 aa, Homo Sapiens
KQEGRQQYL

SEQ ID NO: 239143 - protein, 9 aa, Homo Sapiens
GNIYLDFFY

SEQ ID NO: 239144 - protein, 9 aa, Homo Sapiens
AHRLWRWHK

SEQ ID NO: 239145 - protein, 9 aa, Homo Sapiens
HREKYPRAG

SEQ ID NO: 239146 - protein, 9 aa, Homo Sapiens
DPPDSGENR

SEQ ID NO: 239147 - protein, 9 aa, Homo Sapiens
HHLNSLGQN

SEQ ID NO: 239148 - protein, 9 aa, Homo Sapiens
IDTISQAAF

SEQ ID NO: 239149 - protein, 9 aa, Homo Sapiens
AEFDCHEIQ

SEQ ID NO: 239150 - protein, 9 aa, Homo Sapiens
PSAIKVEVA

SEQ ID NO: 239151 - protein, 9 aa, Homo Sapiens
SDKGSLVFQ

SEQ ID NO: 239152 - protein, 9 aa, Homo Sapiens
QLNLTKIKQ

SEQ ID NO: 239153 - protein, 9 aa, Homo Sapiens
RMFFTSGSL

SEQ ID NO: 239154 - protein, 9 aa, Homo Sapiens
ACHHTQLLF

SEQ ID NO: 239155 - protein, 9 aa, Homo Sapiens
GSLTTASLM

SEQ ID NO: 239156 - protein, 9 aa, Homo Sapiens
SRMDWGKVA

SEQ ID NO: 239157 - protein, 9 aa, Homo Sapiens
EEYAHFRAK

SEQ ID NO: 239158 - protein, 9 aa, Homo Sapiens
DEILAFYNN

SEQ ID NO: 239159 - protein, 9 aa, Homo Sapiens
QDLTTRLQE

SEQ ID NO: 239160 - protein, 9 aa, Homo Sapiens
LNKSMKGAG

SEQ ID NO: 239161 - protein, 9 aa, Homo Sapiens
DKKCMTLDP

SEQ ID NO: 239162 - protein, 9 aa, Homo Sapiens
KIQFSRKTY

SEQ ID NO: 239163 - protein, 9 aa, Homo Sapiens
QATPPVAPV

SEQ ID NO: 239164 - protein, 9 aa, Homo Sapiens
LTKLINAYK

SEQ ID NO: 239165 - protein, 9 aa, Homo Sapiens
QGQVLKTAL

SEQ ID NO: 239166 - protein, 9 aa, Homo Sapiens
TTTQKHNTD

SEQ ID NO: 239167 - protein, 9 aa, Homo Sapiens
RSFSKQATE

SEQ ID NO: 239168 - protein, 9 aa, Homo Sapiens
SPTSQPLER

SEQ ID NO: 239169 - protein, 9 aa, Homo Sapiens
LPVRWVVKV

SEQ ID NO: 239170 - protein, 9 aa, Homo Sapiens
KEFNHNYRI

SEQ ID NO: 239171 - protein, 9 aa, Homo Sapiens
CSMELFERY

SEQ ID NO: 239172 - protein, 9 aa, Homo Sapiens
FQNISNIIT

SEQ ID NO: 239173 - protein, 9 aa, Homo Sapiens
ILLGKAQQL

SEQ ID NO: 239174 - protein, 9 aa, Homo Sapiens
QCAFDQKEE

SEQ ID NO: 239175 - protein, 9 aa, Homo Sapiens
VFYTMVTSM

SEQ ID NO: 239176 - protein, 9 aa, Homo Sapiens
IDTFIITLL

SEQ ID NO: 239177 - protein, 9 aa, Homo Sapiens
ADNDGSGAE

SEQ ID NO: 239178 - protein, 9 aa, Homo Sapiens
GKLYQLRHP

SEQ ID NO: 239179 - protein, 9 aa, Homo Sapiens
SIYPRVQTA

SEQ ID NO: 239180 - protein, 9 aa, Homo Sapiens
SEFVQEAVS

SEQ ID NO: 239181 - protein, 9 aa, Homo Sapiens
HDALSLAYQ

SEQ ID NO: 239182 - protein, 9 aa, Homo Sapiens
LVDGAHCLR

SEQ ID NO: 239183 - protein, 9 aa, Homo Sapiens
ESISYILAG

SEQ ID NO: 239184 - protein, 9 aa, Homo Sapiens
ELRTAFRVF

SEQ ID NO: 239185 - protein, 9 aa, Homo Sapiens
LQRHASYHI

SEQ ID NO: 239186 - protein, 9 aa, Homo Sapiens
SDGVQHLGA

SEQ ID NO: 239187 - protein, 9 aa, Homo Sapiens
SFLCKLQDT

SEQ ID NO: 239188 - protein, 9 aa, Homo Sapiens
DYLIPPMDL

SEQ ID NO: 239189 - protein, 9 aa, Homo Sapiens
ADDDSDSTS

SEQ ID NO: 239190 - protein, 9 aa, Homo Sapiens
ACKAVQETM

SEQ ID NO: 239191 - protein, 9 aa, Homo Sapiens
SRYLCSDGR

SEQ ID NO: 239192 - protein, 9 aa, Homo Sapiens
RDNWKGTWP

SEQ ID NO: 239193 - protein, 9 aa, Homo Sapiens
GPRAHLPCV

SEQ ID NO: 239194 - protein, 9 aa, Homo Sapiens
PPARWTPIG

SEQ ID NO: 239195 - protein, 9 aa, Homo Sapiens
MARALPKPT

SEQ ID NO: 239196 - protein, 9 aa, Homo Sapiens
ADSPSAARG

SEQ ID NO: 239197 - protein, 9 aa, Homo Sapiens
PVNYPTDPA

SEQ ID NO: 239198 - protein, 9 aa, Homo Sapiens
CNSTIIKHQ

SEQ ID NO: 239199 - protein, 9 aa, Homo Sapiens
VVIKLSDLT

SEQ ID NO: 239200 - protein, 9 aa, Homo Sapiens
FKFNTDELN

SEQ ID NO: 239201 - protein, 9 aa, Homo Sapiens
KPPRAAENM

SEQ ID NO: 239202 - protein, 9 aa, Homo Sapiens
PKQSRFGGS

SEQ ID NO: 239203 - protein, 9 aa, Homo Sapiens
KKGRPQIQR

SEQ ID NO: 239204 - protein, 9 aa, Homo Sapiens
QKPGTDEAE

SEQ ID NO: 239205 - protein, 9 aa, Homo Sapiens
SLPVRALNV

SEQ ID NO: 239206 - protein, 9 aa, Homo Sapiens
CLCYEGKST

SEQ ID NO: 239207 - protein, 9 aa, Homo Sapiens
PPDVLKSQF

SEQ ID NO: 239208 - protein, 9 aa, Homo Sapiens
QRHSKLRVA

SEQ ID NO: 239209 - protein, 9 aa, Homo Sapiens
DCINQAQGF

SEQ ID NO: 239210 - protein, 9 aa, Homo Sapiens
KVNCLDMYG

SEQ ID NO: 239211 - protein, 9 aa, Homo Sapiens
KMAKHIQKE

SEQ ID NO: 239212 - protein, 9 aa, Homo Sapiens
QIPWLRGAK

SEQ ID NO: 239213 - protein, 9 aa, Homo Sapiens
GKAPPKTDL

SEQ ID NO: 239214 - protein, 9 aa, Homo Sapiens
GLDPYCGLG

SEQ ID NO: 239215 - protein, 9 aa, Homo Sapiens
QYKKFKVGD

SEQ ID NO: 239216 - protein, 9 aa, Homo Sapiens
SNNKISGLK

SEQ ID NO: 239217 - protein, 9 aa, Homo Sapiens
ACFSVKGKK

SEQ ID NO: 239218 - protein, 9 aa, Homo Sapiens
EHELYGEKH

SEQ ID NO: 239219 - protein, 9 aa, Homo Sapiens
LQSNLEVPP

SEQ ID NO: 239220 - protein, 9 aa, Homo Sapiens
GGEFNPHSE

SEQ ID NO: 239221 - protein, 9 aa, Homo Sapiens
GQGAPFIPI

SEQ ID NO: 239222 - protein, 9 aa, Homo Sapiens
EVVLALEHL

SEQ ID NO: 239223 - protein, 9 aa, Homo Sapiens
ELPVTSFGC

SEQ ID NO: 239224 - protein, 9 aa, Homo Sapiens
GFHCESSVH

SEQ ID NO: 239225 - protein, 8 aa, Homo Sapiens
RRFLRPGH

SEQ ID NO: 239226 - protein, 9 aa, Homo Sapiens
SVLSLTSEC

SEQ ID NO: 239227 - protein, 9 aa, Homo Sapiens
LTGSKVGVH

SEQ ID NO: 239228 - protein, 9 aa, Homo Sapiens
VTFGKIRSL

SEQ ID NO: 239229 - protein, 9 aa, Homo Sapiens
DIYRTMNIS

SEQ ID NO: 239230 - protein, 9 aa, Homo Sapiens
GKWNGLSKV

SEQ ID NO: 239231 - protein, 9 aa, Homo Sapiens
HAAVPSGNI

SEQ ID NO: 239232 - protein, 9 aa, Homo Sapiens
QNIEEANQV

SEQ ID NO: 239233 - protein, 9 aa, Homo Sapiens
GICHSKESG

SEQ ID NO: 239234 - protein, 9 aa, Homo Sapiens
SGNELEYFY

SEQ ID NO: 239235 - protein, 9 aa, Homo Sapiens
CNHSLLFLL

SEQ ID NO: 239236 - protein, 9 aa, Homo Sapiens
GLGADERIL

SEQ ID NO: 239237 - protein, 9 aa, Homo Sapiens
FKFDNLLIN

SEQ ID NO: 239238 - protein, 9 aa, Homo Sapiens
VDEFWLLGN

SEQ ID NO: 239239 - protein, 9 aa, Homo Sapiens
GFSNACEKT

SEQ ID NO: 239240 - protein, 9 aa, Homo Sapiens
ISASKLSPG

SEQ ID NO: 239241 - protein, 9 aa, Homo Sapiens
GDEAQSNRG

SEQ ID NO: 239242 - protein, 9 aa, Homo Sapiens
AHPPQDGED

SEQ ID NO: 239243 - protein, 9 aa, Homo Sapiens
KGANILRNS

SEQ ID NO: 239244 - protein, 9 aa, Homo Sapiens
HMQQLDREN

SEQ ID NO: 239245 - protein, 9 aa, Homo Sapiens
DKFFLVAGL

SEQ ID NO: 239246 - protein, 9 aa, Homo Sapiens
SEAFLSQSI

SEQ ID NO: 239247 - protein, 9 aa, Homo Sapiens
TTTPSLPLF

SEQ ID NO: 239248 - protein, 9 aa, Homo Sapiens
AFTVSSFFQ

SEQ ID NO: 239249 - protein, 9 aa, Homo Sapiens
LRYKATMNI

SEQ ID NO: 239250 - protein, 9 aa, Homo Sapiens
VVTQGMSHG

SEQ ID NO: 239251 - protein, 9 aa, Homo Sapiens
SLKGNIVFV

SEQ ID NO: 239252 - protein, 9 aa, Homo Sapiens
LVLELVPDI

SEQ ID NO: 239253 - protein, 9 aa, Homo Sapiens
QLEFQLWDA

SEQ ID NO: 239254 - protein, 9 aa, Homo Sapiens
KKKKKKNKG

SEQ ID NO: 239255 - protein, 9 aa, Homo Sapiens
MDEMVAPRI

SEQ ID NO: 239256 - protein, 9 aa, Homo Sapiens
DSKPKASLN

SEQ ID NO: 239257 - protein, 9 aa, Homo Sapiens
EKKSVARLQ

SEQ ID NO: 239258 - protein, 9 aa, Homo Sapiens
ERPVIPSSE

SEQ ID NO: 239259 - protein, 9 aa, Homo Sapiens
KTFVMGLNL

SEQ ID NO: 239260 - protein, 9 aa, Homo Sapiens
PGGFRILPQ

SEQ ID NO: 239261 - protein, 9 aa, Homo Sapiens
SDTCEYRGK

SEQ ID NO: 239262 - protein, 9 aa, Homo Sapiens
VIALSLVDM

SEQ ID NO: 239263 - protein, 9 aa, Homo Sapiens
NGRLYAISA

SEQ ID NO: 239264 - protein, 9 aa, Homo Sapiens
RYSDHGEDE

SEQ ID NO: 239265 - protein, 9 aa, Homo Sapiens
GSILFLTCV

SEQ ID NO: 239266 - protein, 9 aa, Homo Sapiens
TFCIFIRDG

SEQ ID NO: 239267 - protein, 9 aa, Homo Sapiens
HVYTEYTLQ

SEQ ID NO: 239268 - protein, 9 aa, Homo Sapiens
PYYNQAYLL

SEQ ID NO: 239269 - protein, 9 aa, Homo Sapiens
ETFAPRLSR

SEQ ID NO: 239270 - protein, 9 aa, Homo Sapiens
VSSDGLGSS

SEQ ID NO: 239271 - protein, 9 aa, Homo Sapiens
ECPHSKKKN

SEQ ID NO: 239272 - protein, 9 aa, Homo Sapiens
PQTPSECSY

SEQ ID NO: 239273 - protein, 9 aa, Homo Sapiens
ILSPTYPQA

SEQ ID NO: 239274 - protein, 9 aa, Homo Sapiens
TGHEMEKEY

SEQ ID NO: 239275 - protein, 9 aa, Homo Sapiens
KQAGDDSQD

SEQ ID NO: 239276 - protein, 9 aa, Homo Sapiens
LGSTIRTGF

SEQ ID NO: 239277 - protein, 9 aa, Homo Sapiens
IQALQTVIF

SEQ ID NO: 239278 - protein, 9 aa, Homo Sapiens
RSLPVRALN

SEQ ID NO: 239279 - protein, 9 aa, Homo Sapiens
LSNSPWAVK

SEQ ID NO: 239280 - protein, 9 aa, Homo Sapiens
ISFLLDENY

SEQ ID NO: 239281 - protein, 9 aa, Homo Sapiens
SSISTVEPK

SEQ ID NO: 239282 - protein, 9 aa, Homo Sapiens
IIPREMKRL

SEQ ID NO: 239283 - protein, 9 aa, Homo Sapiens
KTPFYAESL

SEQ ID NO: 239284 - protein, 9 aa, Homo Sapiens
CLDWDENTS

SEQ ID NO: 239285 - protein, 9 aa, Homo Sapiens
AHVGSDDEG

SEQ ID NO: 239286 - protein, 9 aa, Homo Sapiens
DDMAFRLDR

SEQ ID NO: 239287 - protein, 9 aa, Homo Sapiens
LYLEEDDSS

SEQ ID NO: 239288 - protein, 9 aa, Homo Sapiens
GEIMFQYDT

SEQ ID NO: 239289 - protein, 9 aa, Homo Sapiens
LRESKSKLL

SEQ ID NO: 239290 - protein, 9 aa, Homo Sapiens
PIVATAGFC

SEQ ID NO: 239291 - protein, 9 aa, Homo Sapiens
ITVQQLSNQ

SEQ ID NO: 239292 - protein, 9 aa, Homo Sapiens
LENTLKAAS

SEQ ID NO: 239293 - protein, 9 aa, Homo Sapiens
RITVSHLWF

SEQ ID NO: 239294 - protein, 9 aa, Homo Sapiens
YLLEKSRFI

SEQ ID NO: 239295 - protein, 9 aa, Homo Sapiens
EHIGHAINS

SEQ ID NO: 239296 - protein, 9 aa, Homo Sapiens
FFLPSLSQS

SEQ ID NO: 239297 - protein, 9 aa, Homo Sapiens
ETDKSKSNI

SEQ ID NO: 239298 - protein, 9 aa, Homo Sapiens
MESLNGGRP

SEQ ID NO: 239299 - protein, 9 aa, Homo Sapiens
LHLMNVTAT

SEQ ID NO: 239300 - protein, 9 aa, Homo Sapiens
YVLVIPMIG

SEQ ID NO: 239301 - protein, 9 aa, Homo Sapiens
NYVVRFITR

SEQ ID NO: 239302 - protein, 9 aa, Homo Sapiens
LSCDLQESP

SEQ ID NO: 239303 - protein, 9 aa, Homo Sapiens
HGARVDKYG

SEQ ID NO: 239304 - protein, 9 aa, Homo Sapiens
SQLETLCPQ

SEQ ID NO: 239305 - protein, 9 aa, Homo Sapiens
YTEWNQQLL

SEQ ID NO: 239306 - protein, 9 aa, Homo Sapiens
TDLRMTFTT

SEQ ID NO: 239307 - protein, 9 aa, Homo Sapiens
GTLIVVGVG

SEQ ID NO: 239308 - protein, 9 aa, Homo Sapiens
ELKKLEKYL

SEQ ID NO: 239309 - protein, 9 aa, Homo Sapiens
DVAFVRDVT

SEQ ID NO: 239310 - protein, 9 aa, Homo Sapiens
HITEFTIIR

SEQ ID NO: 239311 - protein, 9 aa, Homo Sapiens
GHPCSPDSP

SEQ ID NO: 239312 - protein, 9 aa, Homo Sapiens
SDFHQTKAM

SEQ ID NO: 239313 - protein, 9 aa, Homo Sapiens
GDSLYFDFK

SEQ ID NO: 239314 - protein, 9 aa, Homo Sapiens
LTLNYVQER

SEQ ID NO: 239315 - protein, 9 aa, Homo Sapiens
HGEKYKPFK

SEQ ID NO: 239316 - protein, 9 aa, Homo Sapiens
VPSKDKLVC

SEQ ID NO: 239317 - protein, 9 aa, Homo Sapiens
NFVPYRDSV

SEQ ID NO: 239318 - protein, 9 aa, Homo Sapiens
TLGKLMPNL

SEQ ID NO: 239319 - protein, 9 aa, Homo Sapiens
QIRYSVWEE

SEQ ID NO: 239320 - protein, 9 aa, Homo Sapiens
NLFVKDVPQ

SEQ ID NO: 239321 - protein, 9 aa, Homo Sapiens
GQHDQRHDG

SEQ ID NO: 239322 - protein, 9 aa, Homo Sapiens
QTPSECSYY

SEQ ID NO: 239323 - protein, 9 aa, Homo Sapiens
TLRCLGLGT

SEQ ID NO: 239324 - protein, 9 aa, Homo Sapiens
GQILTCLSC

SEQ ID NO: 239325 - protein, 9 aa, Homo Sapiens
QYYGLSHTV

SEQ ID NO: 239326 - protein, 9 aa, Homo Sapiens
IPPGMLASY

SEQ ID NO: 239327 - protein, 9 aa, Homo Sapiens
LLTKTNQIY

SEQ ID NO: 239328 - protein, 9 aa, Homo Sapiens
GFWSRLHTN

SEQ ID NO: 239329 - protein, 9 aa, Homo Sapiens
QIINKCCED

SEQ ID NO: 239330 - protein, 9 aa, Homo Sapiens
DLFSLSQYY

SEQ ID NO: 239331 - protein, 9 aa, Homo Sapiens
SLTSLYGFS

SEQ ID NO: 239332 - protein, 9 aa, Homo Sapiens
KFNKPCITD

SEQ ID NO: 239333 - protein, 9 aa, Homo Sapiens
TSALDIKEF

SEQ ID NO: 239334 - protein, 9 aa, Homo Sapiens
EAKIIGIKK

SEQ ID NO: 239335 - protein, 9 aa, Homo Sapiens
SIQTGYMPR

SEQ ID NO: 239336 - protein, 9 aa, Homo Sapiens
DDALSHLTK

SEQ ID NO: 239337 - protein, 9 aa, Homo Sapiens
LLEENETLQ

SEQ ID NO: 239338 - protein, 9 aa, Homo Sapiens
HPGILENAS

SEQ ID NO: 239339 - protein, 9 aa, Homo Sapiens
IGFNVVTLS

SEQ ID NO: 239340 - protein, 9 aa, Homo Sapiens
RGLEERKKQ

SEQ ID NO: 239341 - protein, 9 aa, Homo Sapiens
CECSLLGSM

SEQ ID NO: 239342 - protein, 9 aa, Homo Sapiens
HISPNRHKI

SEQ ID NO: 239343 - protein, 9 aa, Homo Sapiens
PLATSKDKL

SEQ ID NO: 239344 - protein, 9 aa, Homo Sapiens
GQNGRAEGG

SEQ ID NO: 239345 - protein, 9 aa, Homo Sapiens
MFPVLGPQS

SEQ ID NO: 239346 - protein, 9 aa, Homo Sapiens
ADIEQMYGR

SEQ ID NO: 239347 - protein, 9 aa, Homo Sapiens
RYPSMAMIH

SEQ ID NO: 239348 - protein, 9 aa, Homo Sapiens
ECGNTFSVS

SEQ ID NO: 239349 - protein, 9 aa, Homo Sapiens
LSVMLASIM

SEQ ID NO: 239350 - protein, 9 aa, Homo Sapiens
KLPKAEHWY

SEQ ID NO: 239351 - protein, 9 aa, Homo Sapiens
SGENNVIFI

SEQ ID NO: 239352 - protein, 9 aa, Homo Sapiens
FVFPSKSFW

SEQ ID NO: 239353 - protein, 9 aa, Homo Sapiens
DLILIDYGH

SEQ ID NO: 239354 - protein, 9 aa, Homo Sapiens
GNNGTLVDR

SEQ ID NO: 239355 - protein, 9 aa, Homo Sapiens
KFSAKYSAP

SEQ ID NO: 239356 - protein, 9 aa, Homo Sapiens
TLYYYNKQR

SEQ ID NO: 239357 - protein, 9 aa, Homo Sapiens
DLTYVTEEA

SEQ ID NO: 239358 - protein, 9 aa, Homo Sapiens
ATPVDLWIV

SEQ ID NO: 239359 - protein, 9 aa, Homo Sapiens
SSRTLHAFS

SEQ ID NO: 239360 - protein, 9 aa, Homo Sapiens
FFHCIWMPG

SEQ ID NO: 239361 - protein, 9 aa, Homo Sapiens
TDPSAVKPE

SEQ ID NO: 239362 - protein, 9 aa, Homo Sapiens
PVFNPMSQD

SEQ ID NO: 239363 - protein, 9 aa, Homo Sapiens
DELSGIVSK

SEQ ID NO: 239364 - protein, 9 aa, Homo Sapiens
HEITHTGEK

SEQ ID NO: 239365 - protein, 9 aa, Homo Sapiens
KHSILITAC

SEQ ID NO: 239366 - protein, 9 aa, Homo Sapiens
VKLSPFGQW

SEQ ID NO: 239367 - protein, 9 aa, Homo Sapiens
SQSAEERLR

SEQ ID NO: 239368 - protein, 9 aa, Homo Sapiens
YLMRDRSAA

SEQ ID NO: 239369 - protein, 9 aa, Homo Sapiens
AVRDKEVGA

SEQ ID NO: 239370 - protein, 9 aa, Homo Sapiens
KILSEVTPK

SEQ ID NO: 239371 - protein, 9 aa, Homo Sapiens
LLIDTFQNN

SEQ ID NO: 239372 - protein, 9 aa, Homo Sapiens
DRICKLADQ

SEQ ID NO: 239373 - protein, 9 aa, Homo Sapiens
GYGFAKPYN

SEQ ID NO: 239374 - protein, 9 aa, Homo Sapiens
NSLSLVGAL

SEQ ID NO: 239375 - protein, 9 aa, Homo Sapiens
LAVAAVLDQ

SEQ ID NO: 239376 - protein, 9 aa, Homo Sapiens
QDILIPTHF

SEQ ID NO: 239377 - protein, 9 aa, Homo Sapiens
YICIVATIL

SEQ ID NO: 239378 - protein, 9 aa, Homo Sapiens
SGQRNEEFD

SEQ ID NO: 239379 - protein, 9 aa, Homo Sapiens
LKEFMRQAG

SEQ ID NO: 239380 - protein, 9 aa, Homo Sapiens
MIKIMLINS

SEQ ID NO: 239381 - protein, 9 aa, Homo Sapiens
NNTSSFSCE

SEQ ID NO: 239382 - protein, 9 aa, Homo Sapiens
SKTHGTSPE

SEQ ID NO: 239383 - protein, 9 aa, Homo Sapiens
PKVRDGMEL

SEQ ID NO: 239384 - protein, 9 aa, Homo Sapiens
LKKAKALMG

SEQ ID NO: 239385 - protein, 9 aa, Homo Sapiens
EQKALRLNV

SEQ ID NO: 239386 - protein, 9 aa, Homo Sapiens
VCTSVNSVL

SEQ ID NO: 239387 - protein, 9 aa, Homo Sapiens
AESGYTTPK

SEQ ID NO: 239388 - protein, 9 aa, Homo Sapiens
QFFKTLQDL

SEQ ID NO: 239389 - protein, 9 aa, Homo Sapiens
NPNKTMIAL

SEQ ID NO: 239390 - protein, 9 aa, Homo Sapiens
KRIRKKQAK

SEQ ID NO: 239391 - protein, 9 aa, Homo Sapiens
TATKMFLIV

SEQ ID NO: 239392 - protein, 9 aa, Homo Sapiens
KACPHRCAC

SEQ ID NO: 239393 - protein, 9 aa, Homo Sapiens
NSLGQNRSY

SEQ ID NO: 239394 - protein, 9 aa, Homo Sapiens
VPCINQVTE

SEQ ID NO: 239395 - protein, 9 aa, Homo Sapiens
ALRALPKAS

SEQ ID NO: 239396 - protein, 9 aa, Homo Sapiens
SGDTMKLPD

SEQ ID NO: 239397 - protein, 9 aa, Homo Sapiens
LICHHRSHT

SEQ ID NO: 239398 - protein, 9 aa, Homo Sapiens
YQNFRLNWT

SEQ ID NO: 239399 - protein, 9 aa, Homo Sapiens
VSHSQKFSK

SEQ ID NO: 239400 - protein, 9 aa, Homo Sapiens
STEMESGLE

SEQ ID NO: 239401 - protein, 9 aa, Homo Sapiens
CENDFQCST

SEQ ID NO: 239402 - protein, 9 aa, Homo Sapiens
MKRLKKEKP

SEQ ID NO: 239403 - protein, 9 aa, Homo Sapiens
KVLLTMERT

SEQ ID NO: 239404 - protein, 9 aa, Homo Sapiens
DEERPDLLV

SEQ ID NO: 239405 - protein, 9 aa, Homo Sapiens
SLTCLCNIV

SEQ ID NO: 239406 - protein, 9 aa, Homo Sapiens
SGFPEAGGG

SEQ ID NO: 239407 - protein, 9 aa, Homo Sapiens
FKDMYTPLS

SEQ ID NO: 239408 - protein, 9 aa, Homo Sapiens
RDNLAQQSL

SEQ ID NO: 239409 - protein, 9 aa, Homo Sapiens
KKIINQVFQ

SEQ ID NO: 239410 - protein, 9 aa, Homo Sapiens
NHNLTSTKK

SEQ ID NO: 239411 - protein, 9 aa, Homo Sapiens
PTLDEFLNK

SEQ ID NO: 239412 - protein, 9 aa, Homo Sapiens
VRLGSSPPV

SEQ ID NO: 239413 - protein, 9 aa, Homo Sapiens
DLTLCHILN

SEQ ID NO: 239414 - protein, 9 aa, Homo Sapiens
GSGKLQDFT

SEQ ID NO: 239415 - protein, 9 aa, Homo Sapiens
LCDNHFHAR

SEQ ID NO: 239416 - protein, 9 aa, Homo Sapiens
FLFGLANKK

SEQ ID NO: 239417 - protein, 9 aa, Homo Sapiens
IMFQYDTES

SEQ ID NO: 239418 - protein, 9 aa, Homo Sapiens
SQMELLPDT

SEQ ID NO: 239419 - protein, 9 aa, Homo Sapiens
VSGTGLRMM

SEQ ID NO: 239420 - protein, 9 aa, Homo Sapiens
NVTGQLGAG

SEQ ID NO: 239421 - protein, 9 aa, Homo Sapiens
SRSQRDVFG

SEQ ID NO: 239422 - protein, 9 aa, Homo Sapiens
LKLKLLVLE

SEQ ID NO: 239423 - protein, 9 aa, Homo Sapiens
KVPSGKHKR

SEQ ID NO: 239424 - protein, 9 aa, Homo Sapiens
GEPRPYRPK

SEQ ID NO: 239425 - protein, 9 aa, Homo Sapiens
FLHSNKLSK

SEQ ID NO: 239426 - protein, 9 aa, Homo Sapiens
ATERETQRG

SEQ ID NO: 239427 - protein, 9 aa, Homo Sapiens
EERPDLLVN

SEQ ID NO: 239428 - protein, 9 aa, Homo Sapiens
RSSALYIIY

SEQ ID NO: 239429 - protein, 9 aa, Homo Sapiens
INTQPPLPF

SEQ ID NO: 239430 - protein, 9 aa, Homo Sapiens
MSKETCPKG

SEQ ID NO: 239431 - protein, 9 aa, Homo Sapiens
GEARLTNLK

SEQ ID NO: 239432 - protein, 9 aa, Homo Sapiens
EDIITYREQ

SEQ ID NO: 239433 - protein, 9 aa, Homo Sapiens
TTRNAEFDC

SEQ ID NO: 239434 - protein, 9 aa, Homo Sapiens
CGYGELLGT

SEQ ID NO: 239435 - protein, 9 aa, Homo Sapiens
ESVKYQNQH

SEQ ID NO: 239436 - protein, 9 aa, Homo Sapiens
GKQLSESAD

SEQ ID NO: 239437 - protein, 9 aa, Homo Sapiens
CCVPIYCQC

SEQ ID NO: 239438 - protein, 9 aa, Homo Sapiens
MDQGQNYNQ

SEQ ID NO: 239439 - protein, 9 aa, Homo Sapiens
GTFLVKIAR

SEQ ID NO: 239440 - protein, 9 aa, Homo Sapiens
LEKDPEKCL

SEQ ID NO: 239441 - protein, 9 aa, Homo Sapiens
WVASQEDTH

SEQ ID NO: 239442 - protein, 9 aa, Homo Sapiens
TQLRLVALP

SEQ ID NO: 239443 - protein, 9 aa, Homo Sapiens
PVREEYADF

SEQ ID NO: 239444 - protein, 9 aa, Homo Sapiens
SALFLLLFA

SEQ ID NO: 239445 - protein, 9 aa, Homo Sapiens
LREITENLM

SEQ ID NO: 239446 - protein, 9 aa, Homo Sapiens
AQTAIRSLN

SEQ ID NO: 239447 - protein, 9 aa, Homo Sapiens
KFNSYIHRN

SEQ ID NO: 239448 - protein, 9 aa, Homo Sapiens
CPNDQTCCL

SEQ ID NO: 239449 - protein, 9 aa, Homo Sapiens
PMLTPWIVA

SEQ ID NO: 239450 - protein, 9 aa, Homo Sapiens
IFKPRSAMR

SEQ ID NO: 239451 - protein, 9 aa, Homo Sapiens
QSISQNHAV

SEQ ID NO: 239452 - protein, 9 aa, Homo Sapiens
LSIHICTTI

SEQ ID NO: 239453 - protein, 9 aa, Homo Sapiens
NSLIDLRRQ

SEQ ID NO: 239454 - protein, 9 aa, Homo Sapiens
NRIEHAGAN

SEQ ID NO: 239455 - protein, 9 aa, Homo Sapiens
VNAAILKKG

SEQ ID NO: 239456 - protein, 9 aa, Homo Sapiens
MANMQELVE

SEQ ID NO: 239457 - protein, 9 aa, Homo Sapiens
NTSKLLFKK

SEQ ID NO: 239458 - protein, 9 aa, Homo Sapiens
QAAPEEECA

SEQ ID NO: 239459 - protein, 9 aa, Homo Sapiens
FVDKAAAWK

SEQ ID NO: 239460 - protein, 9 aa, Homo Sapiens
EDYVLTKCN

SEQ ID NO: 239461 - protein, 9 aa, Homo Sapiens
SLLYPVAFG

SEQ ID NO: 239462 - protein, 9 aa, Homo Sapiens
DCWPYLEIR

SEQ ID NO: 239463 - protein, 9 aa, Homo Sapiens
YCKVCQQGG

SEQ ID NO: 239464 - protein, 9 aa, Homo Sapiens
YVKASTTLT

SEQ ID NO: 239465 - protein, 9 aa, Homo Sapiens
CFYGKTDFA

SEQ ID NO: 239466 - protein, 9 aa, Homo Sapiens
SDCINQAQG

SEQ ID NO: 239467 - protein, 9 aa, Homo Sapiens
KLNSSTVEP

SEQ ID NO: 239468 - protein, 9 aa, Homo Sapiens
PMLLATVEF

SEQ ID NO: 239469 - protein, 9 aa, Homo Sapiens
MGVDVMLIS

SEQ ID NO: 239470 - protein, 9 aa, Homo Sapiens
LKERGVISY

SEQ ID NO: 239471 - protein, 9 aa, Homo Sapiens
NKEDTTSMN

SEQ ID NO: 239472 - protein, 9 aa, Homo Sapiens
SVQVSQLLC

SEQ ID NO: 239473 - protein, 9 aa, Homo Sapiens
LVARLPIHM

SEQ ID NO: 239474 - protein, 9 aa, Homo Sapiens
SERSLQSWV

SEQ ID NO: 239475 - protein, 9 aa, Homo Sapiens
PKSHVEKET

SEQ ID NO: 239476 - protein, 9 aa, Homo Sapiens
TLQKAIQET

SEQ ID NO: 239477 - protein, 9 aa, Homo Sapiens
ISHKRSECP

SEQ ID NO: 239478 - protein, 9 aa, Homo Sapiens
LSLTRNTNI

SEQ ID NO: 239479 - protein, 9 aa, Homo Sapiens
PTLNNFYTL

SEQ ID NO: 239480 - protein, 9 aa, Homo Sapiens
PSPGPFQPC

SEQ ID NO: 239481 - protein, 9 aa, Homo Sapiens
SKCRQIVSA

SEQ ID NO: 239482 - protein, 9 aa, Homo Sapiens
ASTRRKRRK

SEQ ID NO: 239483 - protein, 9 aa, Homo Sapiens
SPQLAKPSI

SEQ ID NO: 239484 - protein, 9 aa, Homo Sapiens
KGKGDGRYV

SEQ ID NO: 239485 - protein, 9 aa, Homo Sapiens
VITDMRTKH

SEQ ID NO: 239486 - protein, 9 aa, Homo Sapiens
NVKHHGNGT

SEQ ID NO: 239487 - protein, 9 aa, Homo Sapiens
GSRKYAVNS

SEQ ID NO: 239488 - protein, 9 aa, Homo Sapiens
ISQLDTRLP

SEQ ID NO: 239489 - protein, 9 aa, Homo Sapiens
QHVPVCLVT

SEQ ID NO: 239490 - protein, 9 aa, Homo Sapiens
SESEASENK

SEQ ID NO: 239491 - protein, 9 aa, Homo Sapiens
GTAPKSSPR

SEQ ID NO: 239492 - protein, 9 aa, Homo Sapiens
HYGPGARFI

SEQ ID NO: 239493 - protein, 9 aa, Homo Sapiens
KISGLKNGS

SEQ ID NO: 239494 - protein, 9 aa, Homo Sapiens
RRPCAAGDN

SEQ ID NO: 239495 - protein, 9 aa, Homo Sapiens
ENSMKIYLV

SEQ ID NO: 239496 - protein, 9 aa, Homo Sapiens
QLALQVLDF

SEQ ID NO: 239497 - protein, 9 aa, Homo Sapiens
VSRNFGSYV

SEQ ID NO: 239498 - protein, 9 aa, Homo Sapiens
WSLPFIIFG

SEQ ID NO: 239499 - protein, 9 aa, Homo Sapiens
GLKGDKGEI

SEQ ID NO: 239500 - protein, 9 aa, Homo Sapiens
LRNTVALNA

SEQ ID NO: 239501 - protein, 9 aa, Homo Sapiens
DVAFVQLLA

SEQ ID NO: 239502 - protein, 9 aa, Homo Sapiens
DGSMSVTRI

SEQ ID NO: 239503 - protein, 9 aa, Homo Sapiens
KLWSILRDR

SEQ ID NO: 239504 - protein, 9 aa, Homo Sapiens
ASESISTNK

SEQ ID NO: 239505 - protein, 9 aa, Homo Sapiens
DFKKEGKMY

SEQ ID NO: 239506 - protein, 9 aa, Homo Sapiens
KACLAAEEQ

SEQ ID NO: 239507 - protein, 9 aa, Homo Sapiens
AKELGLPPV

SEQ ID NO: 239508 - protein, 9 aa, Homo Sapiens
FLVPSQLRA

SEQ ID NO: 239509 - protein, 9 aa, Homo Sapiens
RGAFLGMSL

SEQ ID NO: 239510 - protein, 9 aa, Homo Sapiens
CLLPKLDEI

SEQ ID NO: 239511 - protein, 9 aa, Homo Sapiens
IYNQEIESM

SEQ ID NO: 239512 - protein, 9 aa, Homo Sapiens
EMETYQESV

SEQ ID NO: 239513 - protein, 9 aa, Homo Sapiens
SQVIFAFTL

SEQ ID NO: 239514 - protein, 9 aa, Homo Sapiens
TPVIANKTN

SEQ ID NO: 239515 - protein, 9 aa, Homo Sapiens
TVRDTLDAG

SEQ ID NO: 239516 - protein, 9 aa, Homo Sapiens
VRVKPTNDF

SEQ ID NO: 239517 - protein, 9 aa, Homo Sapiens
GSHKASFLS

SEQ ID NO: 239518 - protein, 9 aa, Homo Sapiens
CGLPAAGSL

SEQ ID NO: 239519 - protein, 9 aa, Homo Sapiens
MIVLLSYLL

SEQ ID NO: 239520 - protein, 9 aa, Homo Sapiens
WTAFKDFKA

SEQ ID NO: 239521 - protein, 9 aa, Homo Sapiens
MKPPLIFVD

SEQ ID NO: 239522 - protein, 9 aa, Homo Sapiens
VAAMMNITF

SEQ ID NO: 239523 - protein, 9 aa, Homo Sapiens
FAMKYRRGP

SEQ ID NO: 239524 - protein, 9 aa, Homo Sapiens
LVYCSLRLL

SEQ ID NO: 239525 - protein, 9 aa, Homo Sapiens
HRYSDGWCE

SEQ ID NO: 239526 - protein, 9 aa, Homo Sapiens
HEYLTLISC

SEQ ID NO: 239527 - protein, 9 aa, Homo Sapiens
PNHDGNDLC

SEQ ID NO: 239528 - protein, 9 aa, Homo Sapiens
LIPLSGCFD

SEQ ID NO: 239529 - protein, 9 aa, Homo Sapiens
VAKLKPPPE

SEQ ID NO: 239530 - protein, 9 aa, Homo Sapiens
LCKHSFAFT

SEQ ID NO: 239531 - protein, 9 aa, Homo Sapiens
ADSEIMFAK

SEQ ID NO: 239532 - protein, 9 aa, Homo Sapiens
GEPEDYLGI

SEQ ID NO: 239533 - protein, 9 aa, Homo Sapiens
ELYHCFLPA

SEQ ID NO: 239534 - protein, 9 aa, Homo Sapiens
KLGNQLEGK

SEQ ID NO: 239535 - protein, 9 aa, Homo Sapiens
RCHTGNTPF

SEQ ID NO: 239536 - protein, 9 aa, Homo Sapiens
FLINKKANL

SEQ ID NO: 239537 - protein, 9 aa, Homo Sapiens
TMSLYDLDI

SEQ ID NO: 239538 - protein, 9 aa, Homo Sapiens
IIFLAFAFS

SEQ ID NO: 239539 - protein, 9 aa, Homo Sapiens
TLLDWLFSF

SEQ ID NO: 239540 - protein, 9 aa, Homo Sapiens
AVFLASKAN

SEQ ID NO: 239541 - protein, 9 aa, Homo Sapiens
SISLATAWL

SEQ ID NO: 239542 - protein, 9 aa, Homo Sapiens
PSLKQQLLS

SEQ ID NO: 239543 - protein, 9 aa, Homo Sapiens
YVQDCRSPF

SEQ ID NO: 239544 - protein, 9 aa, Homo Sapiens
HQPTSYRPH

SEQ ID NO: 239545 - protein, 9 aa, Homo Sapiens
LRIYVYVLD

SEQ ID NO: 239546 - protein, 9 aa, Homo Sapiens
RIKDFMSTV

SEQ ID NO: 239547 - protein, 9 aa, Homo Sapiens
LVLVNAIYV

SEQ ID NO: 239548 - protein, 9 aa, Homo Sapiens
MQCCLCASC

SEQ ID NO: 239549 - protein, 9 aa, Homo Sapiens
VGVFLYKML

SEQ ID NO: 239550 - protein, 9 aa, Homo Sapiens
FIKPEKFTK

SEQ ID NO: 239551 - protein, 9 aa, Homo Sapiens
RRSSTQLQG

SEQ ID NO: 239552 - protein, 9 aa, Homo Sapiens
LEGRHFPRR

SEQ ID NO: 239553 - protein, 9 aa, Homo Sapiens
FGSKHKSSL

SEQ ID NO: 239554 - protein, 9 aa, Homo Sapiens
PIAGMGYHV

SEQ ID NO: 239555 - protein, 9 aa, Homo Sapiens
PVTIPAVML

SEQ ID NO: 239556 - protein, 9 aa, Homo Sapiens
PVSYRGCVT

SEQ ID NO: 239557 - protein, 9 aa, Homo Sapiens
KCERILYVD

SEQ ID NO: 239558 - protein, 9 aa, Homo Sapiens
SPAVFVYTG

SEQ ID NO: 239559 - protein, 9 aa, Homo Sapiens
RMLPPANSL

SEQ ID NO: 239560 - protein, 9 aa, Homo Sapiens
HEVEVDVAQ

SEQ ID NO: 239561 - protein, 9 aa, Homo Sapiens
EGVSALKEE

SEQ ID NO: 239562 - protein, 9 aa, Homo Sapiens
WLTFSLGKH

SEQ ID NO: 239563 - protein, 9 aa, Homo Sapiens
DIFAQQRDS

SEQ ID NO: 239564 - protein, 9 aa, Homo Sapiens
KAAESELLA

SEQ ID NO: 239565 - protein, 9 aa, Homo Sapiens
NHVCNASDN

SEQ ID NO: 239566 - protein, 9 aa, Homo Sapiens
TNEDNSFGC

SEQ ID NO: 239567 - protein, 9 aa, Homo Sapiens
LFRKPSPFI

SEQ ID NO: 239568 - protein, 9 aa, Homo Sapiens
RDLEPEQSF

SEQ ID NO: 239569 - protein, 9 aa, Homo Sapiens
AASGDGVRV

SEQ ID NO: 239570 - protein, 9 aa, Homo Sapiens
RPFLQAFYV

SEQ ID NO: 239571 - protein, 9 aa, Homo Sapiens
VSSVNSVAT

SEQ ID NO: 239572 - protein, 9 aa, Homo Sapiens
PKENLELPE

SEQ ID NO: 239573 - protein, 9 aa, Homo Sapiens
IHLHEVYEN

SEQ ID NO: 239574 - protein, 9 aa, Homo Sapiens
IFSVITNAF

SEQ ID NO: 239575 - protein, 9 aa, Homo Sapiens
VAGCAVATE

SEQ ID NO: 239576 - protein, 9 aa, Homo Sapiens
IRFGAVSCN

SEQ ID NO: 239577 - protein, 9 aa, Homo Sapiens
SSCFPRYRS

SEQ ID NO: 239578 - protein, 9 aa, Homo Sapiens
EIFFQAELQ

SEQ ID NO: 239579 - protein, 9 aa, Homo Sapiens
DKLGELSDR

SEQ ID NO: 239580 - protein, 9 aa, Homo Sapiens
KIPLYLQPH

SEQ ID NO: 239581 - protein, 9 aa, Homo Sapiens
NQAYLLLEE

SEQ ID NO: 239582 - protein, 9 aa, Homo Sapiens
YTIDVFFQQ

SEQ ID NO: 239583 - protein, 9 aa, Homo Sapiens
NWGYQVALR

SEQ ID NO: 239584 - protein, 9 aa, Homo Sapiens
LCIALLVEE

SEQ ID NO: 239585 - protein, 9 aa, Homo Sapiens
EDPFQTDNL

SEQ ID NO: 239586 - protein, 9 aa, Homo Sapiens
QASNIYSDS

SEQ ID NO: 239587 - protein, 9 aa, Homo Sapiens
LEKYEKFFQ

SEQ ID NO: 239588 - protein, 9 aa, Homo Sapiens
NEFTFLKPI

SEQ ID NO: 239589 - protein, 9 aa, Homo Sapiens
STFTYHKIT

SEQ ID NO: 239590 - protein, 9 aa, Homo Sapiens
DVPIYMSYD

SEQ ID NO: 239591 - protein, 9 aa, Homo Sapiens
AVSLRHRDN

SEQ ID NO: 239592 - protein, 9 aa, Homo Sapiens
VPFLNSYTV

SEQ ID NO: 239593 - protein, 9 aa, Homo Sapiens
TVHSSETAI

SEQ ID NO: 239594 - protein, 9 aa, Homo Sapiens
KQEMDKRLQ

SEQ ID NO: 239595 - protein, 9 aa, Homo Sapiens
QLESAGIAR

SEQ ID NO: 239596 - protein, 9 aa, Homo Sapiens
VLVRVMDPS

SEQ ID NO: 239597 - protein, 9 aa, Homo Sapiens
LHCAVIAHS

SEQ ID NO: 239598 - protein, 9 aa, Homo Sapiens
PAPEQFKTL

SEQ ID NO: 239599 - protein, 9 aa, Homo Sapiens
LILWLPFCG

SEQ ID NO: 239600 - protein, 9 aa, Homo Sapiens
PGSPQMLTK

SEQ ID NO: 239601 - protein, 9 aa, Homo Sapiens
ACPSIGSGR

SEQ ID NO: 239602 - protein, 9 aa, Homo Sapiens
DSPFWLPEP

SEQ ID NO: 239603 - protein, 9 aa, Homo Sapiens
LWLPFCGNH

SEQ ID NO: 239604 - protein, 9 aa, Homo Sapiens
ESPESIKVD

SEQ ID NO: 239605 - protein, 9 aa, Homo Sapiens
SAKFLKDTF

SEQ ID NO: 239606 - protein, 9 aa, Homo Sapiens
EQKIRELDS

SEQ ID NO: 239607 - protein, 9 aa, Homo Sapiens
QSTDITQLK

SEQ ID NO: 239608 - protein, 9 aa, Homo Sapiens
RQLMEKKPS

SEQ ID NO: 239609 - protein, 9 aa, Homo Sapiens
PDLRSTIHN

SEQ ID NO: 239610 - protein, 9 aa, Homo Sapiens
PVPIRDDGN

SEQ ID NO: 239611 - protein, 9 aa, Homo Sapiens
PYIFTLHKK

SEQ ID NO: 239612 - protein, 9 aa, Homo Sapiens
EGHVQAGQS

SEQ ID NO: 239613 - protein, 9 aa, Homo Sapiens
NSYIHRNSA

SEQ ID NO: 239614 - protein, 9 aa, Homo Sapiens
LLQKVEAGK

SEQ ID NO: 239615 - protein, 9 aa, Homo Sapiens
LKYLTKKHL

SEQ ID NO: 239616 - protein, 9 aa, Homo Sapiens
SMTLLHATL

SEQ ID NO: 239617 - protein, 9 aa, Homo Sapiens
EPSSSGGSE

SEQ ID NO: 239618 - protein, 9 aa, Homo Sapiens
GDQTALKSP

SEQ ID NO: 239619 - protein, 9 aa, Homo Sapiens
EQAQASAGD

SEQ ID NO: 239620 - protein, 9 aa, Homo Sapiens
CKYCRKSFR

SEQ ID NO: 239621 - protein, 9 aa, Homo Sapiens
ASHQSYSQN

SEQ ID NO: 239622 - protein, 9 aa, Homo Sapiens
QLTGDLPGT

SEQ ID NO: 239623 - protein, 9 aa, Homo Sapiens
KQFSCLTLP

SEQ ID NO: 239624 - protein, 9 aa, Homo Sapiens
INIQKELDF

SEQ ID NO: 239625 - protein, 9 aa, Homo Sapiens
PSFVFADMI

SEQ ID NO: 239626 - protein, 9 aa, Homo Sapiens
THPVYCVNG

SEQ ID NO: 239627 - protein, 9 aa, Homo Sapiens
MLVGNRIDK

SEQ ID NO: 239628 - protein, 9 aa, Homo Sapiens
NGPAKEPRV

SEQ ID NO: 239629 - protein, 9 aa, Homo Sapiens
SLTIPLPQA

SEQ ID NO: 239630 - protein, 9 aa, Homo Sapiens
ALEAGVAIA

SEQ ID NO: 239631 - protein, 9 aa, Homo Sapiens
GILTNKKII

SEQ ID NO: 239632 - protein, 9 aa, Homo Sapiens
IRSILYKEN

SEQ ID NO: 239633 - protein, 9 aa, Homo Sapiens
GKFVIKDPD

SEQ ID NO: 239634 - protein, 9 aa, Homo Sapiens
LDLPPYTSY

SEQ ID NO: 239635 - protein, 9 aa, Homo Sapiens
GKSMFVFVC

SEQ ID NO: 239636 - protein, 9 aa, Homo Sapiens
AAMSYSLCK

SEQ ID NO: 239637 - protein, 9 aa, Homo Sapiens
PQNKKVSLL

SEQ ID NO: 239638 - protein, 9 aa, Homo Sapiens
SWNLPPCPF

SEQ ID NO: 239639 - protein, 9 aa, Homo Sapiens
VWEEIDRGS

SEQ ID NO: 239640 - protein, 9 aa, Homo Sapiens
ELKYLFRDF

SEQ ID NO: 239641 - protein, 9 aa, Homo Sapiens
RYNGSVLPC

SEQ ID NO: 239642 - protein, 9 aa, Homo Sapiens
MQEKQIKAK

SEQ ID NO: 239643 - protein, 9 aa, Homo Sapiens
YECSECGTA

SEQ ID NO: 239644 - protein, 9 aa, Homo Sapiens
ENGDPVHPG

SEQ ID NO: 239645 - protein, 9 aa, Homo Sapiens
SFKFIDKKY

SEQ ID NO: 239646 - protein, 9 aa, Homo Sapiens
KFREQILRV

SEQ ID NO: 239647 - protein, 9 aa, Homo Sapiens
AMFSICMVE

SEQ ID NO: 239648 - protein, 9 aa, Homo Sapiens
FCCACAITP

SEQ ID NO: 239649 - protein, 9 aa, Homo Sapiens
HRGLVNKWT

SEQ ID NO: 239650 - protein, 9 aa, Homo Sapiens
EEIANTCNA

SEQ ID NO: 239651 - protein, 9 aa, Homo Sapiens
DLAMFQSIP

SEQ ID NO: 239652 - protein, 9 aa, Homo Sapiens
FRHQTTKLL

SEQ ID NO: 239653 - protein, 9 aa, Homo Sapiens
HTGLTAVSH

SEQ ID NO: 239654 - protein, 9 aa, Homo Sapiens
SQMLEDRDL

SEQ ID NO: 239655 - protein, 9 aa, Homo Sapiens
KCMLRNERQ

SEQ ID NO: 239656 - protein, 9 aa, Homo Sapiens
VELLLLTDP

SEQ ID NO: 239657 - protein, 9 aa, Homo Sapiens
NMLGIFWFN

SEQ ID NO: 239658 - protein, 9 aa, Homo Sapiens
SAFIFFIAS

SEQ ID NO: 239659 - protein, 9 aa, Homo Sapiens
APSTSSTVQ

SEQ ID NO: 239660 - protein, 9 aa, Homo Sapiens
SLISEEDKR

SEQ ID NO: 239661 - protein, 9 aa, Homo Sapiens
GLVEEKDKG

SEQ ID NO: 239662 - protein, 9 aa, Homo Sapiens
NQEDAHDFL

SEQ ID NO: 239663 - protein, 9 aa, Homo Sapiens
VKSEQSCGK

SEQ ID NO: 239664 - protein, 9 aa, Homo Sapiens
RHFPRRPKH

SEQ ID NO: 239665 - protein, 9 aa, Homo Sapiens
TLAVEILPR

SEQ ID NO: 239666 - protein, 9 aa, Homo Sapiens
SSLLTSNMF

SEQ ID NO: 239667 - protein, 9 aa, Homo Sapiens
LQAGPPICS

SEQ ID NO: 239668 - protein, 9 aa, Homo Sapiens
KRFIFLGKS

SEQ ID NO: 239669 - protein, 9 aa, Homo Sapiens
QGTAFNLRK

SEQ ID NO: 239670 - protein, 9 aa, Homo Sapiens
AATANNCFE

SEQ ID NO: 239671 - protein, 9 aa, Homo Sapiens
DTISSSQFS

SEQ ID NO: 239672 - protein, 9 aa, Homo Sapiens
NIVAISEDY

SEQ ID NO: 239673 - protein, 9 aa, Homo Sapiens
NTGSKHLPD

SEQ ID NO: 239674 - protein, 9 aa, Homo Sapiens
MPGAAHGIS

SEQ ID NO: 239675 - protein, 9 aa, Homo Sapiens
KLEEETENI

SEQ ID NO: 239676 - protein, 9 aa, Homo Sapiens
TYIQLYGRK

SEQ ID NO: 239677 - protein, 9 aa, Homo Sapiens
FFVVVISVE

SEQ ID NO: 239678 - protein, 9 aa, Homo Sapiens
LLLKVHGAF

SEQ ID NO: 239679 - protein, 9 aa, Homo Sapiens
FFFHIFSGY

SEQ ID NO: 239680 - protein, 9 aa, Homo Sapiens
DKASRVCID

SEQ ID NO: 239681 - protein, 9 aa, Homo Sapiens
MRKKIYDRK

SEQ ID NO: 239682 - protein, 9 aa, Homo Sapiens
QKETSHSYR

SEQ ID NO: 239683 - protein, 9 aa, Homo Sapiens
DNHPVFNET

SEQ ID NO: 239684 - protein, 9 aa, Homo Sapiens
VMLNGQKGL

SEQ ID NO: 239685 - protein, 9 aa, Homo Sapiens
DYDREGSVK

SEQ ID NO: 239686 - protein, 9 aa, Homo Sapiens
GANWRTEII

SEQ ID NO: 239687 - protein, 9 aa, Homo Sapiens
KSVQKSSGG

SEQ ID NO: 239688 - protein, 9 aa, Homo Sapiens
RVSAFTNVG

SEQ ID NO: 239689 - protein, 9 aa, Homo Sapiens
CLLLRSIEE

SEQ ID NO: 239690 - protein, 9 aa, Homo Sapiens
LYEKSLEFG

SEQ ID NO: 239691 - protein, 9 aa, Homo Sapiens
EIAPDKSVP

SEQ ID NO: 239692 - protein, 9 aa, Homo Sapiens
KRKSIAVAT

SEQ ID NO: 239693 - protein, 9 aa, Homo Sapiens
GLDKIIILY

SEQ ID NO: 239694 - protein, 9 aa, Homo Sapiens
GYFFWKNMT

SEQ ID NO: 239695 - protein, 9 aa, Homo Sapiens
KPKRQKLRA

SEQ ID NO: 239696 - protein, 9 aa, Homo Sapiens
QGTSSTIEA

SEQ ID NO: 239697 - protein, 9 aa, Homo Sapiens
PYLQKDGAK

SEQ ID NO: 239698 - protein, 9 aa, Homo Sapiens
LAGRKLSDA

SEQ ID NO: 239699 - protein, 9 aa, Homo Sapiens
INSEAITLT

SEQ ID NO: 239700 - protein, 9 aa, Homo Sapiens
KEELDYVIA

SEQ ID NO: 239701 - protein, 9 aa, Homo Sapiens
RYVSNDDPG

SEQ ID NO: 239702 - protein, 9 aa, Homo Sapiens
LGVPISGPG

SEQ ID NO: 239703 - protein, 9 aa, Homo Sapiens
VELDNTPNN

SEQ ID NO: 239704 - protein, 9 aa, Homo Sapiens
IIEMDGSIG

SEQ ID NO: 239705 - protein, 9 aa, Homo Sapiens
TKNIDVKGS

SEQ ID NO: 239706 - protein, 9 aa, Homo Sapiens
ITLDELMAH

SEQ ID NO: 239707 - protein, 9 aa, Homo Sapiens
SAYASAHLT

SEQ ID NO: 239708 - protein, 9 aa, Homo Sapiens
TQTALNLTA

SEQ ID NO: 239709 - protein, 9 aa, Homo Sapiens
LPKQGSPLE

SEQ ID NO: 239710 - protein, 9 aa, Homo Sapiens
RTLHQSGSF

SEQ ID NO: 239711 - protein, 9 aa, Homo Sapiens
LLLLLWPHG

SEQ ID NO: 239712 - protein, 9 aa, Homo Sapiens
SGSFFLPIL

SEQ ID NO: 239713 - protein, 9 aa, Homo Sapiens
RNWHQKEDH

SEQ ID NO: 239714 - protein, 9 aa, Homo Sapiens
ENMDKTIIV

SEQ ID NO: 239715 - protein, 9 aa, Homo Sapiens
KVSENFRVI

SEQ ID NO: 239716 - protein, 9 aa, Homo Sapiens
DTLCHFGFE

SEQ ID NO: 239717 - protein, 9 aa, Homo Sapiens
QEDHGSWMT

SEQ ID NO: 239718 - protein, 9 aa, Homo Sapiens
IYKYQPGKS

SEQ ID NO: 239719 - protein, 9 aa, Homo Sapiens
RVYFGRCSL

SEQ ID NO: 239720 - protein, 9 aa, Homo Sapiens
GHPMYQRQM

SEQ ID NO: 239721 - protein, 9 aa, Homo Sapiens
LKKILWGVA

SEQ ID NO: 239722 - protein, 9 aa, Homo Sapiens
YLNNKYLYI

SEQ ID NO: 239723 - protein, 9 aa, Homo Sapiens
AGPPICSSL

SEQ ID NO: 239724 - protein, 9 aa, Homo Sapiens
EKAKICLWE

SEQ ID NO: 239725 - protein, 9 aa, Homo Sapiens
TMPESSESP

SEQ ID NO: 239726 - protein, 9 aa, Homo Sapiens
LCQGKTSEC

SEQ ID NO: 239727 - protein, 9 aa, Homo Sapiens
EQNIRCLEK

SEQ ID NO: 239728 - protein, 9 aa, Homo Sapiens
SKYLYDEVA

SEQ ID NO: 239729 - protein, 9 aa, Homo Sapiens
PKWFGDEHI

SEQ ID NO: 239730 - protein, 9 aa, Homo Sapiens
HQNIHTGVK

SEQ ID NO: 239731 - protein, 9 aa, Homo Sapiens
FFQDHNMAL

SEQ ID NO: 239732 - protein, 9 aa, Homo Sapiens
VGPNQAQLV

SEQ ID NO: 239733 - protein, 9 aa, Homo Sapiens
HYTDDPEAA

SEQ ID NO: 239734 - protein, 9 aa, Homo Sapiens
LNDSFIDDE

SEQ ID NO: 239735 - protein, 9 aa, Homo Sapiens
SSNAPISQR

SEQ ID NO: 239736 - protein, 9 aa, Homo Sapiens
YMYWRTALL

SEQ ID NO: 239737 - protein, 9 aa, Homo Sapiens
QQRVYSLLL

SEQ ID NO: 239738 - protein, 9 aa, Homo Sapiens
VRNVSKFSD

SEQ ID NO: 239739 - protein, 9 aa, Homo Sapiens
EECGKAFYQ

SEQ ID NO: 239740 - protein, 9 aa, Homo Sapiens
QAGDDSQDV

SEQ ID NO: 239741 - protein, 9 aa, Homo Sapiens
MEHVVFLVT

SEQ ID NO: 239742 - protein, 9 aa, Homo Sapiens
DCYDPTVDV

SEQ ID NO: 239743 - protein, 9 aa, Homo Sapiens
TSWGRGGTC

SEQ ID NO: 239744 - protein, 9 aa, Homo Sapiens
LTQHQNIHT

SEQ ID NO: 239745 - protein, 9 aa, Homo Sapiens
KRFCRSPCT

SEQ ID NO: 239746 - protein, 9 aa, Homo Sapiens
PLLTAIVST

SEQ ID NO: 239747 - protein, 9 aa, Homo Sapiens
KLDHFQSEK

SEQ ID NO: 239748 - protein, 9 aa, Homo Sapiens
LLGILKEVE

SEQ ID NO: 239749 - protein, 9 aa, Homo Sapiens
FAYVTDFVD

SEQ ID NO: 239750 - protein, 9 aa, Homo Sapiens
LLLEMWKPH

SEQ ID NO: 239751 - protein, 9 aa, Homo Sapiens
CSTKYWMSQ

SEQ ID NO: 239752 - protein, 9 aa, Homo Sapiens
DPCSLSVDN

SEQ ID NO: 239753 - protein, 9 aa, Homo Sapiens
NRHWHWSSG

SEQ ID NO: 239754 - protein, 9 aa, Homo Sapiens
DRYRSIVNP

SEQ ID NO: 239755 - protein, 9 aa, Homo Sapiens
RALSVLRMI

SEQ ID NO: 239756 - protein, 9 aa, Homo Sapiens
IEMEMKELL

SEQ ID NO: 239757 - protein, 9 aa, Homo Sapiens
SEKQTKWKH

SEQ ID NO: 239758 - protein, 9 aa, Homo Sapiens
GNGLGSALT

SEQ ID NO: 239759 - protein, 9 aa, Homo Sapiens
GGKQKKHEQ

SEQ ID NO: 239760 - protein, 9 aa, Homo Sapiens
VIVCLYIIC

SEQ ID NO: 239761 - protein, 9 aa, Homo Sapiens
DQTVIRRGP

SEQ ID NO: 239762 - protein, 9 aa, Homo Sapiens
YDIASKEQD

SEQ ID NO: 239763 - protein, 9 aa, Homo Sapiens
VKKVKRVLN

SEQ ID NO: 239764 - protein, 9 aa, Homo Sapiens
KNFNNFPRQ

SEQ ID NO: 239765 - protein, 9 aa, Homo Sapiens
FPEENNDTK

SEQ ID NO: 239766 - protein, 9 aa, Homo Sapiens
ARQKNISFN

SEQ ID NO: 239767 - protein, 9 aa, Homo Sapiens
GENNLPCAN

SEQ ID NO: 239768 - protein, 9 aa, Homo Sapiens
LLQGIADYI

SEQ ID NO: 239769 - protein, 9 aa, Homo Sapiens
HSPARRSHR

SEQ ID NO: 239770 - protein, 9 aa, Homo Sapiens
ASSWKHPEP

SEQ ID NO: 239771 - protein, 9 aa, Homo Sapiens
HSKKKNFER

SEQ ID NO: 239772 - protein, 9 aa, Homo Sapiens
PKAASTATE

SEQ ID NO: 239773 - protein, 9 aa, Homo Sapiens
FVPSAWRSR

SEQ ID NO: 239774 - protein, 9 aa, Homo Sapiens
FIKAIHADK

SEQ ID NO: 239775 - protein, 9 aa, Homo Sapiens
TGNKSHLRK

SEQ ID NO: 239776 - protein, 9 aa, Homo Sapiens
RKAISSASL

SEQ ID NO: 239777 - protein, 9 aa, Homo Sapiens
PLVPVQVKQ

SEQ ID NO: 239778 - protein, 9 aa, Homo Sapiens
RFFSKEFLS

SEQ ID NO: 239779 - protein, 9 aa, Homo Sapiens
GALVMEVDE

SEQ ID NO: 239780 - protein, 9 aa, Homo Sapiens
IFVSSVTIP

SEQ ID NO: 239781 - protein, 9 aa, Homo Sapiens
EVQFGSWFG

SEQ ID NO: 239782 - protein, 9 aa, Homo Sapiens
ANASRFSQV

SEQ ID NO: 239783 - protein, 9 aa, Homo Sapiens
ADTFDLQII

SEQ ID NO: 239784 - protein, 9 aa, Homo Sapiens
QLKEALDPI

SEQ ID NO: 239785 - protein, 9 aa, Homo Sapiens
LRSQHNKKV

SEQ ID NO: 239786 - protein, 9 aa, Homo Sapiens
FSFLMTKAL

SEQ ID NO: 239787 - protein, 9 aa, Homo Sapiens
EEAVQLQCG

SEQ ID NO: 239788 - protein, 9 aa, Homo Sapiens
CQSHPGLHH

SEQ ID NO: 239789 - protein, 9 aa, Homo Sapiens
GSNNSSEIS

SEQ ID NO: 239790 - protein, 9 aa, Homo Sapiens
LTSKINLHQ

SEQ ID NO: 239791 - protein, 9 aa, Homo Sapiens
FRDLHHYME

SEQ ID NO: 239792 - protein, 9 aa, Homo Sapiens
YVGDEAQSN

SEQ ID NO: 239793 - protein, 9 aa, Homo Sapiens
HTLDSLQGC

SEQ ID NO: 239794 - protein, 9 aa, Homo Sapiens
SNMDCFWKI

SEQ ID NO: 239795 - protein, 9 aa, Homo Sapiens
TGSLTGNTL

SEQ ID NO: 239796 - protein, 9 aa, Homo Sapiens
NITPERDSL

SEQ ID NO: 239797 - protein, 9 aa, Homo Sapiens
AACVAGPEN

SEQ ID NO: 239798 - protein, 9 aa, Homo Sapiens
QSACDALND

SEQ ID NO: 239799 - protein, 9 aa, Homo Sapiens
KDKLVCWVV

SEQ ID NO: 239800 - protein, 9 aa, Homo Sapiens
CSQSSDNKF

SEQ ID NO: 239801 - protein, 9 aa, Homo Sapiens
SRSKKFLIW

SEQ ID NO: 239802 - protein, 9 aa, Homo Sapiens
FGNTALLNK

SEQ ID NO: 239803 - protein, 9 aa, Homo Sapiens
LESKYLYDE

SEQ ID NO: 239804 - protein, 9 aa, Homo Sapiens
ADVTRRLPE

SEQ ID NO: 239805 - protein, 9 aa, Homo Sapiens
RLDMHGEKY

SEQ ID NO: 239806 - protein, 9 aa, Homo Sapiens
AANAYTIPL

SEQ ID NO: 239807 - protein, 9 aa, Homo Sapiens
HSLSVPCRG

SEQ ID NO: 239808 - protein, 9 aa, Homo Sapiens
QAMNGFQSG

SEQ ID NO: 239809 - protein, 9 aa, Homo Sapiens
CEKNKWSHN

SEQ ID NO: 239810 - protein, 9 aa, Homo Sapiens
MTGACMPVL

SEQ ID NO: 239811 - protein, 9 aa, Homo Sapiens
ARWIQMTHG

SEQ ID NO: 239812 - protein, 9 aa, Homo Sapiens
FKKLFDANY

SEQ ID NO: 239813 - protein, 9 aa, Homo Sapiens
ACLAAEEQQ

SEQ ID NO: 239814 - protein, 9 aa, Homo Sapiens
ETVNEDAST

SEQ ID NO: 239815 - protein, 9 aa, Homo Sapiens
LCRIHYNTM

SEQ ID NO: 239816 - protein, 9 aa, Homo Sapiens
KASYVLRLN

SEQ ID NO: 239817 - protein, 9 aa, Homo Sapiens
FVPVSVCST

SEQ ID NO: 239818 - protein, 9 aa, Homo Sapiens
IHKRKSIAV

SEQ ID NO: 239819 - protein, 9 aa, Homo Sapiens
PAGNRLGDK

SEQ ID NO: 239820 - protein, 9 aa, Homo Sapiens
FHHQVHADD

SEQ ID NO: 239821 - protein, 9 aa, Homo Sapiens
PECYFPDEK

SEQ ID NO: 239822 - protein, 9 aa, Homo Sapiens
SLYLEEDDS

SEQ ID NO: 239823 - protein, 9 aa, Homo Sapiens
GGTDKGRIH

SEQ ID NO: 239824 - protein, 9 aa, Homo Sapiens
SLITNNIML

SEQ ID NO: 239825 - protein, 9 aa, Homo Sapiens
RAILNVMGK

SEQ ID NO: 239826 - protein, 9 aa, Homo Sapiens
PVPMPSEYT

SEQ ID NO: 239827 - protein, 9 aa, Homo Sapiens
FGRRKDMLA

SEQ ID NO: 239828 - protein, 9 aa, Homo Sapiens
RPGSHTIDF

SEQ ID NO: 239829 - protein, 9 aa, Homo Sapiens
SDADLRPSK

SEQ ID NO: 239830 - protein, 9 aa, Homo Sapiens
GLLERRIKP

SEQ ID NO: 239831 - protein, 9 aa, Homo Sapiens
KINYQIKID

SEQ ID NO: 239832 - protein, 9 aa, Homo Sapiens
LISIKMRLE

SEQ ID NO: 239833 - protein, 9 aa, Homo Sapiens
TAQINNLMS

SEQ ID NO: 239834 - protein, 9 aa, Homo Sapiens
AENCESRAD

SEQ ID NO: 239835 - protein, 9 aa, Homo Sapiens
RARKITSME

SEQ ID NO: 239836 - protein, 9 aa, Homo Sapiens
QIYCGQIYI

SEQ ID NO: 239837 - protein, 9 aa, Homo Sapiens
HVPRRLRLA

SEQ ID NO: 239838 - protein, 9 aa, Homo Sapiens
KQEIKYAFE

SEQ ID NO: 239839 - protein, 9 aa, Homo Sapiens
SPLQALDLF

SEQ ID NO: 239840 - protein, 9 aa, Homo Sapiens
YEQYKKEDD

SEQ ID NO: 239841 - protein, 9 aa, Homo Sapiens
SSKTTAAHY

SEQ ID NO: 239842 - protein, 9 aa, Homo Sapiens
SSMAELQDI

SEQ ID NO: 239843 - protein, 9 aa, Homo Sapiens
EQNLIQEVI

SEQ ID NO: 239844 - protein, 9 aa, Homo Sapiens
MHLCAILLD

SEQ ID NO: 239845 - protein, 9 aa, Homo Sapiens
DSKTAQAPL

SEQ ID NO: 239846 - protein, 9 aa, Homo Sapiens
LSGSLHFAV

SEQ ID NO: 239847 - protein, 9 aa, Homo Sapiens
YDDDRLRDG

SEQ ID NO: 239848 - protein, 9 aa, Homo Sapiens
LVWIIFVMW

SEQ ID NO: 239849 - protein, 9 aa, Homo Sapiens
LYEMFSLVM

SEQ ID NO: 239850 - protein, 9 aa, Homo Sapiens
SDQLTQAIS

SEQ ID NO: 239851 - protein, 9 aa, Homo Sapiens
TQVSSLVLY

SEQ ID NO: 239852 - protein, 9 aa, Homo Sapiens
ENEDLISDA

SEQ ID NO: 239853 - protein, 9 aa, Homo Sapiens
ALISDFETD

SEQ ID NO: 239854 - protein, 9 aa, Homo Sapiens
VGGDVGSLA

SEQ ID NO: 239855 - protein, 9 aa, Homo Sapiens
VVAVTFFSV

SEQ ID NO: 239856 - protein, 9 aa, Homo Sapiens
IQVTIMLYL

SEQ ID NO: 239857 - protein, 9 aa, Homo Sapiens
EELVNPEPS

SEQ ID NO: 239858 - protein, 9 aa, Homo Sapiens
YDWKRMEVG

SEQ ID NO: 239859 - protein, 9 aa, Homo Sapiens
QVLFIQKTG

SEQ ID NO: 239860 - protein, 9 aa, Homo Sapiens
TYHNTDLSE

SEQ ID NO: 239861 - protein, 9 aa, Homo Sapiens
LRYEIYTGE

SEQ ID NO: 239862 - protein, 9 aa, Homo Sapiens
SWQDLKEFM

SEQ ID NO: 239863 - protein, 9 aa, Homo Sapiens
KIVLGKQLS

SEQ ID NO: 239864 - protein, 9 aa, Homo Sapiens
QPDQEYFSL

SEQ ID NO: 239865 - protein, 9 aa, Homo Sapiens
EPPVILSMA

SEQ ID NO: 239866 - protein, 9 aa, Homo Sapiens
ASVAATCQT

SEQ ID NO: 239867 - protein, 9 aa, Homo Sapiens
FKKHIQYKL

SEQ ID NO: 239868 - protein, 9 aa, Homo Sapiens
NFHLDKYKT

SEQ ID NO: 239869 - protein, 9 aa, Homo Sapiens
VYNITLAFS

SEQ ID NO: 239870 - protein, 9 aa, Homo Sapiens
QLSLYKHFN

SEQ ID NO: 239871 - protein, 9 aa, Homo Sapiens
LEVDSVELA

SEQ ID NO: 239872 - protein, 9 aa, Homo Sapiens
TLCPQVINA

SEQ ID NO: 239873 - protein, 9 aa, Homo Sapiens
EQNSPDGAL

SEQ ID NO: 239874 - protein, 9 aa, Homo Sapiens
LKNQECKGV

SEQ ID NO: 239875 - protein, 9 aa, Homo Sapiens
RRATAERVK

SEQ ID NO: 239876 - protein, 9 aa, Homo Sapiens
KAMLQGQVL

SEQ ID NO: 239877 - protein, 9 aa, Homo Sapiens
DGSDLTEDL

SEQ ID NO: 239878 - protein, 9 aa, Homo Sapiens
QCLIQWFDT

SEQ ID NO: 239879 - protein, 9 aa, Homo Sapiens
EALEENKTG

SEQ ID NO: 239880 - protein, 9 aa, Homo Sapiens
LYLFPLLFI

SEQ ID NO: 239881 - protein, 9 aa, Homo Sapiens
ILVQGRIVK

SEQ ID NO: 239882 - protein, 9 aa, Homo Sapiens
PTVDVWNSI

SEQ ID NO: 239883 - protein, 9 aa, Homo Sapiens
SHTRHICMV

SEQ ID NO: 239884 - protein, 9 aa, Homo Sapiens
NTPVHLSVN

SEQ ID NO: 239885 - protein, 9 aa, Homo Sapiens
GTPTYMAPE

SEQ ID NO: 239886 - protein, 9 aa, Homo Sapiens
RQPTGPKDT

SEQ ID NO: 239887 - protein, 9 aa, Homo Sapiens
LKGCDDYVF

SEQ ID NO: 239888 - protein, 9 aa, Homo Sapiens
LPSGMEIYF

SEQ ID NO: 239889 - protein, 9 aa, Homo Sapiens
LKGLRNCAS

SEQ ID NO: 239890 - protein, 9 aa, Homo Sapiens
KLCPSKTSF

SEQ ID NO: 239891 - protein, 9 aa, Homo Sapiens
PRSSTSPDC

SEQ ID NO: 239892 - protein, 9 aa, Homo Sapiens
GSENACEIT

SEQ ID NO: 239893 - protein, 9 aa, Homo Sapiens
GLEAQVESL

SEQ ID NO: 239894 - protein, 9 aa, Homo Sapiens
QMKNLEVLM

SEQ ID NO: 239895 - protein, 9 aa, Homo Sapiens
WKTLIPPQP

SEQ ID NO: 239896 - protein, 9 aa, Homo Sapiens
LNQCLPPEH

SEQ ID NO: 239897 - protein, 9 aa, Homo Sapiens
ALLALSSAH

SEQ ID NO: 239898 - protein, 9 aa, Homo Sapiens
NMVLLSKIT

SEQ ID NO: 239899 - protein, 9 aa, Homo Sapiens
VVKKIEARD

SEQ ID NO: 239900 - protein, 9 aa, Homo Sapiens
YKDYSAFHL

SEQ ID NO: 239901 - protein, 9 aa, Homo Sapiens
YTVVVVPHI

SEQ ID NO: 239902 - protein, 9 aa, Homo Sapiens
INVYSGIFF

SEQ ID NO: 239903 - protein, 9 aa, Homo Sapiens
RESGSKLLE

SEQ ID NO: 239904 - protein, 9 aa, Homo Sapiens
CHPKYIYAT

SEQ ID NO: 239905 - protein, 9 aa, Homo Sapiens
IQSSTRDWK

SEQ ID NO: 239906 - protein, 9 aa, Homo Sapiens
DQIKVCRDK

SEQ ID NO: 239907 - protein, 9 aa, Homo Sapiens
NSTFRNSFV

SEQ ID NO: 239908 - protein, 9 aa, Homo Sapiens
TPEGILRYF

SEQ ID NO: 239909 - protein, 9 aa, Homo Sapiens
HQTTKLLYR

SEQ ID NO: 239910 - protein, 9 aa, Homo Sapiens
SANIQQHQR

SEQ ID NO: 239911 - protein, 9 aa, Homo Sapiens
TPYTLPRSQ

SEQ ID NO: 239912 - protein, 9 aa, Homo Sapiens
RRQCRHSPG

SEQ ID NO: 239913 - protein, 9 aa, Homo Sapiens
DKKHRNGTK

SEQ ID NO: 239914 - protein, 9 aa, Homo Sapiens
GEIKWIYFV

SEQ ID NO: 239915 - protein, 9 aa, Homo Sapiens
MIITESMEN

SEQ ID NO: 239916 - protein, 9 aa, Homo Sapiens
DAQVLEYLN

SEQ ID NO: 239917 - protein, 9 aa, Homo Sapiens
SPLFTFELP

SEQ ID NO: 239918 - protein, 9 aa, Homo Sapiens
SALQRHRII

SEQ ID NO: 239919 - protein, 9 aa, Homo Sapiens
VHMEFPGVD

SEQ ID NO: 239920 - protein, 9 aa, Homo Sapiens
DREMQINEA

SEQ ID NO: 239921 - protein, 9 aa, Homo Sapiens
KASLFDEST

SEQ ID NO: 239922 - protein, 9 aa, Homo Sapiens
DLDDNPWDC

SEQ ID NO: 239923 - protein, 9 aa, Homo Sapiens
KKVEENSTL

SEQ ID NO: 239924 - protein, 9 aa, Homo Sapiens
PERDSLMCL

SEQ ID NO: 239925 - protein, 9 aa, Homo Sapiens
ALEEALPVF

SEQ ID NO: 239926 - protein, 9 aa, Homo Sapiens
PPLSITKTL

SEQ ID NO: 239927 - protein, 9 aa, Homo Sapiens
QDSSLPNIT

SEQ ID NO: 239928 - protein, 9 aa, Homo Sapiens
SKAKTITPL

SEQ ID NO: 239929 - protein, 9 aa, Homo Sapiens
EDVTMGKIS

SEQ ID NO: 239930 - protein, 9 aa, Homo Sapiens
GNRFIQDDQ

SEQ ID NO: 239931 - protein, 9 aa, Homo Sapiens
TCSQIIYNY

SEQ ID NO: 239932 - protein, 9 aa, Homo Sapiens
RMLMQKDLK

SEQ ID NO: 239933 - protein, 9 aa, Homo Sapiens
PVSRSCRVH

SEQ ID NO: 239934 - protein, 9 aa, Homo Sapiens
SSVTTSEAQ

SEQ ID NO: 239935 - protein, 9 aa, Homo Sapiens
NRLKVIFYR

SEQ ID NO: 239936 - protein, 9 aa, Homo Sapiens
SCSTWNYQN

SEQ ID NO: 239937 - protein, 9 aa, Homo Sapiens
MSEDVRQHH

SEQ ID NO: 239938 - protein, 9 aa, Homo Sapiens
QRLFGHGAE

SEQ ID NO: 239939 - protein, 9 aa, Homo Sapiens
TVERFKDNK

SEQ ID NO: 239940 - protein, 9 aa, Homo Sapiens
PGIPGMNMG

SEQ ID NO: 239941 - protein, 9 aa, Homo Sapiens
EKVIMVELF

SEQ ID NO: 239942 - protein, 9 aa, Homo Sapiens
VLGKQLSES

SEQ ID NO: 239943 - protein, 9 aa, Homo Sapiens
SKKLNNDLV

SEQ ID NO: 239944 - protein, 9 aa, Homo Sapiens
ADIRWFEND

SEQ ID NO: 239945 - protein, 9 aa, Homo Sapiens
SRVQESFQA

SEQ ID NO: 239946 - protein, 9 aa, Homo Sapiens
SVLLHPNMA

SEQ ID NO: 239947 - protein, 9 aa, Homo Sapiens
AFSFSSSFQ

SEQ ID NO: 239948 - protein, 9 aa, Homo Sapiens
VCDLFCNPS

SEQ ID NO: 239949 - protein, 9 aa, Homo Sapiens
VELVYFEPK

SEQ ID NO: 239950 - protein, 9 aa, Homo Sapiens
PDLINFGRF

SEQ ID NO: 239951 - protein, 9 aa, Homo Sapiens
MPMDSEEAM

SEQ ID NO: 239952 - protein, 9 aa, Homo Sapiens
TRKESKVMC

SEQ ID NO: 239953 - protein, 9 aa, Homo Sapiens
SQRAVSDAL

SEQ ID NO: 239954 - protein, 9 aa, Homo Sapiens
DDTPELCAA

SEQ ID NO: 239955 - protein, 9 aa, Homo Sapiens
PKWPNAYFR

SEQ ID NO: 239956 - protein, 9 aa, Homo Sapiens
LVEKDKDNI

SEQ ID NO: 239957 - protein, 9 aa, Homo Sapiens
MSNSYPRDV

SEQ ID NO: 239958 - protein, 9 aa, Homo Sapiens
DRMLTLNNY

SEQ ID NO: 239959 - protein, 9 aa, Homo Sapiens
AEVYFSAIR

SEQ ID NO: 239960 - protein, 9 aa, Homo Sapiens
TICSDKTGA

SEQ ID NO: 239961 - protein, 9 aa, Homo Sapiens
VSSYDIGNV

SEQ ID NO: 239962 - protein, 9 aa, Homo Sapiens
QNFRLNWTW

SEQ ID NO: 239963 - protein, 9 aa, Homo Sapiens
LCLVAVHEL

SEQ ID NO: 239964 - protein, 9 aa, Homo Sapiens
ESLRRQVPA

SEQ ID NO: 239965 - protein, 9 aa, Homo Sapiens
KVIFYRGML

SEQ ID NO: 239966 - protein, 9 aa, Homo Sapiens
PRGEGTALP

SEQ ID NO: 239967 - protein, 9 aa, Homo Sapiens
LKSDIYLHL

SEQ ID NO: 239968 - protein, 9 aa, Homo Sapiens
PTSFLCLTL

SEQ ID NO: 239969 - protein, 9 aa, Homo Sapiens
DLPLLTAIV

SEQ ID NO: 239970 - protein, 9 aa, Homo Sapiens
IQMWLCKRR

SEQ ID NO: 239971 - protein, 9 aa, Homo Sapiens
WRFRIQKQL

SEQ ID NO: 239972 - protein, 9 aa, Homo Sapiens
LIHINYYLQ

SEQ ID NO: 239973 - protein, 9 aa, Homo Sapiens
GIPEWVYEE

SEQ ID NO: 239974 - protein, 9 aa, Homo Sapiens
SYFSQRAGS

SEQ ID NO: 239975 - protein, 9 aa, Homo Sapiens
NWEASIWKL

SEQ ID NO: 239976 - protein, 9 aa, Homo Sapiens
LMKKFAEAF

SEQ ID NO: 239977 - protein, 9 aa, Homo Sapiens
EACVHKMLR

SEQ ID NO: 239978 - protein, 9 aa, Homo Sapiens
EGTGQCHCH

SEQ ID NO: 239979 - protein, 9 aa, Homo Sapiens
HSVCEDKFD

SEQ ID NO: 239980 - protein, 9 aa, Homo Sapiens
QAPPPGLTP

SEQ ID NO: 239981 - protein, 9 aa, Homo Sapiens
SSTAIVIRC

SEQ ID NO: 239982 - protein, 9 aa, Homo Sapiens
GQLEGIFFS

SEQ ID NO: 239983 - protein, 9 aa, Homo Sapiens
EVKTQEERV

SEQ ID NO: 239984 - protein, 9 aa, Homo Sapiens
NIEHEKQVY

SEQ ID NO: 239985 - protein, 9 aa, Homo Sapiens
TNTLLLEHK

SEQ ID NO: 239986 - protein, 9 aa, Homo Sapiens
YSFIQCLLS

SEQ ID NO: 239987 - protein, 9 aa, Homo Sapiens
MRTSCLIKY

SEQ ID NO: 239988 - protein, 9 aa, Homo Sapiens
EVEFTTLDF

SEQ ID NO: 239989 - protein, 9 aa, Homo Sapiens
NNVATVLES

SEQ ID NO: 239990 - protein, 9 aa, Homo Sapiens
NMDKTIIVK

SEQ ID NO: 239991 - protein, 9 aa, Homo Sapiens
PEQKVGLYQ

SEQ ID NO: 239992 - protein, 9 aa, Homo Sapiens
DKYEKIGKI

SEQ ID NO: 239993 - protein, 9 aa, Homo Sapiens
SGNNFFKQE

SEQ ID NO: 239994 - protein, 9 aa, Homo Sapiens
NEYDNSPTA

SEQ ID NO: 239995 - protein, 9 aa, Homo Sapiens
KVLWKNNHN

SEQ ID NO: 239996 - protein, 9 aa, Homo Sapiens
LEGRKSNIH

SEQ ID NO: 239997 - protein, 9 aa, Homo Sapiens
LSQKSLQLK

SEQ ID NO: 239998 - protein, 9 aa, Homo Sapiens
HPVERDIKS

SEQ ID NO: 239999 - protein, 9 aa, Homo Sapiens
TWLRLAVSL

SEQ ID NO: 240000 - protein, 9 aa, Homo Sapiens
HLTGLQTFY

SEQ ID NO: 240001 - protein, 9 aa, Homo Sapiens
MLWLFALAW

SEQ ID NO: 240002 - protein, 9 aa, Homo Sapiens
SVRELSPVS

SEQ ID NO: 240003 - protein, 9 aa, Homo Sapiens
EGSAKGKLQ

SEQ ID NO: 240004 - protein, 9 aa, Homo Sapiens
YAFSYLMRD

SEQ ID NO: 240005 - protein, 9 aa, Homo Sapiens
LNLWKARHQ

SEQ ID NO: 240006 - protein, 9 aa, Homo Sapiens
EFQVVKYAV

SEQ ID NO: 240007 - protein, 9 aa, Homo Sapiens
TFAPRLSRG

SEQ ID NO: 240008 - protein, 9 aa, Homo Sapiens
QPTSARRKL

SEQ ID NO: 240009 - protein, 9 aa, Homo Sapiens
GNDDEDGAP

SEQ ID NO: 240010 - protein, 9 aa, Homo Sapiens
NIFYIVPAI

SEQ ID NO: 240011 - protein, 9 aa, Homo Sapiens
FLWRGEVFW

SEQ ID NO: 240012 - protein, 9 aa, Homo Sapiens
KAAASPILK

SEQ ID NO: 240013 - protein, 9 aa, Homo Sapiens
ASKYISLFI

SEQ ID NO: 240014 - protein, 9 aa, Homo Sapiens
RNISYFWLD

SEQ ID NO: 240015 - protein, 9 aa, Homo Sapiens
NRIPLNVRY

SEQ ID NO: 240016 - protein, 9 aa, Homo Sapiens
PHVSNTVSG

SEQ ID NO: 240017 - protein, 9 aa, Homo Sapiens
IIDAGQIRF

SEQ ID NO: 240018 - protein, 9 aa, Homo Sapiens
GIWEVMPRT

SEQ ID NO: 240019 - protein, 9 aa, Homo Sapiens
VPEFILVGY

SEQ ID NO: 240020 - protein, 9 aa, Homo Sapiens
FNPYEPKCH

SEQ ID NO: 240021 - protein, 9 aa, Homo Sapiens
YDTNGNLDP

SEQ ID NO: 240022 - protein, 9 aa, Homo Sapiens
IKKNKKLSL

SEQ ID NO: 240023 - protein, 9 aa, Homo Sapiens
ETPAAYRAI

SEQ ID NO: 240024 - protein, 9 aa, Homo Sapiens
KWRFRIQKQ

SEQ ID NO: 240025 - protein, 9 aa, Homo Sapiens
ETGEVCEDL

SEQ ID NO: 240026 - protein, 9 aa, Homo Sapiens
YTLLKKASE

SEQ ID NO: 240027 - protein, 9 aa, Homo Sapiens
NTDLQLWQM

SEQ ID NO: 240028 - protein, 9 aa, Homo Sapiens
DEEQLTANT

SEQ ID NO: 240029 - protein, 9 aa, Homo Sapiens
SRETYGFGQ

SEQ ID NO: 240030 - protein, 9 aa, Homo Sapiens
NLVVGMTVQ

SEQ ID NO: 240031 - protein, 9 aa, Homo Sapiens
LSNNSLIVK

SEQ ID NO: 240032 - protein, 9 aa, Homo Sapiens
CKNLIYHML

SEQ ID NO: 240033 - protein, 9 aa, Homo Sapiens
VLPYTNSKV

SEQ ID NO: 240034 - protein, 9 aa, Homo Sapiens
DQLLQNQIV

SEQ ID NO: 240035 - protein, 9 aa, Homo Sapiens
TGGRERTEE

SEQ ID NO: 240036 - protein, 9 aa, Homo Sapiens
GDVALKNFA

SEQ ID NO: 240037 - protein, 9 aa, Homo Sapiens
TYDFIKENN

SEQ ID NO: 240038 - protein, 9 aa, Homo Sapiens
IEALQKRCI

SEQ ID NO: 240039 - protein, 9 aa, Homo Sapiens
NWTVRSDSK

SEQ ID NO: 240040 - protein, 9 aa, Homo Sapiens
VNRLDMHGE

SEQ ID NO: 240041 - protein, 9 aa, Homo Sapiens
CHLCGKTFQ

SEQ ID NO: 240042 - protein, 9 aa, Homo Sapiens
NDSAWRKQI

SEQ ID NO: 240043 - protein, 9 aa, Homo Sapiens
LSRMSRSDA

SEQ ID NO: 240044 - protein, 9 aa, Homo Sapiens
RCPGGFRIL

SEQ ID NO: 240045 - protein, 9 aa, Homo Sapiens
SRALSRNPQ

SEQ ID NO: 240046 - protein, 9 aa, Homo Sapiens
NEAADPQAL

SEQ ID NO: 240047 - protein, 9 aa, Homo Sapiens
SVAMYGGVV

SEQ ID NO: 240048 - protein, 9 aa, Homo Sapiens
QDYLVGDKL

SEQ ID NO: 240049 - protein, 9 aa, Homo Sapiens
CDLSIEKLS

SEQ ID NO: 240050 - protein, 9 aa, Homo Sapiens
LQIDVKGIC

SEQ ID NO: 240051 - protein, 9 aa, Homo Sapiens
LDIYGRTAL

SEQ ID NO: 240052 - protein, 9 aa, Homo Sapiens
KCWYCNYAS

SEQ ID NO: 240053 - protein, 9 aa, Homo Sapiens
IRAKAIDRK

SEQ ID NO: 240054 - protein, 9 aa, Homo Sapiens
SGIVFIILL

SEQ ID NO: 240055 - protein, 9 aa, Homo Sapiens
HSQTRLDRA

SEQ ID NO: 240056 - protein, 9 aa, Homo Sapiens
NSSSVWPNL

SEQ ID NO: 240057 - protein, 9 aa, Homo Sapiens
VQMDKPQNM

SEQ ID NO: 240058 - protein, 9 aa, Homo Sapiens
ADGLVWKSL

SEQ ID NO: 240059 - protein, 9 aa, Homo Sapiens
AHVCNPRTL

SEQ ID NO: 240060 - protein, 9 aa, Homo Sapiens
RSKKLDHFQ

SEQ ID NO: 240061 - protein, 9 aa, Homo Sapiens
SPTITDTMK

SEQ ID NO: 240062 - protein, 9 aa, Homo Sapiens
CINQAQGFA

SEQ ID NO: 240063 - protein, 9 aa, Homo Sapiens
QHPPEAFHL

SEQ ID NO: 240064 - protein, 9 aa, Homo Sapiens
TFSDDMAFR

SEQ ID NO: 240065 - protein, 9 aa, Homo Sapiens
NGEEVEETK

SEQ ID NO: 240066 - protein, 9 aa, Homo Sapiens
NIFNTDKAI

SEQ ID NO: 240067 - protein, 9 aa, Homo Sapiens
PVGCTQGSE

SEQ ID NO: 240068 - protein, 9 aa, Homo Sapiens
MHQTQMKGV

SEQ ID NO: 240069 - protein, 9 aa, Homo Sapiens
IIIANVEEI

SEQ ID NO: 240070 - protein, 9 aa, Homo Sapiens
SDLNIEHEK

SEQ ID NO: 240071 - protein, 9 aa, Homo Sapiens
SDNKDSVSN

SEQ ID NO: 240072 - protein, 9 aa, Homo Sapiens
LKRAEVEVY

SEQ ID NO: 240073 - protein, 9 aa, Homo Sapiens
SYIFFPDAP

SEQ ID NO: 240074 - protein, 9 aa, Homo Sapiens
RRMKWKKYN

SEQ ID NO: 240075 - protein, 9 aa, Homo Sapiens
FNCDIQVHY

SEQ ID NO: 240076 - protein, 9 aa, Homo Sapiens
DRMQFGAPL

SEQ ID NO: 240077 - protein, 9 aa, Homo Sapiens
NIQYKSGKT

SEQ ID NO: 240078 - protein, 9 aa, Homo Sapiens
LSIPPGMLA

SEQ ID NO: 240079 - protein, 9 aa, Homo Sapiens
AGWKNSIHH

SEQ ID NO: 240080 - protein, 9 aa, Homo Sapiens
VKEEHEKRI

SEQ ID NO: 240081 - protein, 9 aa, Homo Sapiens
FLDQIKVCR

SEQ ID NO: 240082 - protein, 9 aa, Homo Sapiens
DCGFIQRFE

SEQ ID NO: 240083 - protein, 9 aa, Homo Sapiens
CLVIELEEL

SEQ ID NO: 240084 - protein, 9 aa, Homo Sapiens
KNPMHNWSP

SEQ ID NO: 240085 - protein, 9 aa, Homo Sapiens
QPLQLLQVD

SEQ ID NO: 240086 - protein, 9 aa, Homo Sapiens
AIVGVNDFC

SEQ ID NO: 240087 - protein, 9 aa, Homo Sapiens
YMQIINLFK

SEQ ID NO: 240088 - protein, 9 aa, Homo Sapiens
YANGILNVT

SEQ ID NO: 240089 - protein, 9 aa, Homo Sapiens
AVCTLRCLG

SEQ ID NO: 240090 - protein, 9 aa, Homo Sapiens
SHYSELLET

SEQ ID NO: 240091 - protein, 9 aa, Homo Sapiens
LEKWLTQVR

SEQ ID NO: 240092 - protein, 9 aa, Homo Sapiens
AHVKKRNML

SEQ ID NO: 240093 - protein, 9 aa, Homo Sapiens
RNELDNPHT

SEQ ID NO: 240094 - protein, 9 aa, Homo Sapiens
RCGFSDSKI

SEQ ID NO: 240095 - protein, 9 aa, Homo Sapiens
MAPEALHFS

SEQ ID NO: 240096 - protein, 9 aa, Homo Sapiens
GQLLDIQVD

SEQ ID NO: 240097 - protein, 9 aa, Homo Sapiens
NNQIKTFQG

SEQ ID NO: 240098 - protein, 9 aa, Homo Sapiens
KYCEHDFKM

SEQ ID NO: 240099 - protein, 9 aa, Homo Sapiens
KTLRLCRFF

SEQ ID NO: 240100 - protein, 9 aa, Homo Sapiens
HRFGMTRNY

SEQ ID NO: 240101 - protein, 9 aa, Homo Sapiens
AAFSDAQMH

SEQ ID NO: 240102 - protein, 9 aa, Homo Sapiens
LSIYPRVQT

SEQ ID NO: 240103 - protein, 9 aa, Homo Sapiens
TMEEVFLWV

SEQ ID NO: 240104 - protein, 9 aa, Homo Sapiens
IRWNFDKFL

SEQ ID NO: 240105 - protein, 9 aa, Homo Sapiens
CLVELECFR

SEQ ID NO: 240106 - protein, 9 aa, Homo Sapiens
VEKPEERQQ

SEQ ID NO: 240107 - protein, 9 aa, Homo Sapiens
RHFRAVFMA

SEQ ID NO: 240108 - protein, 9 aa, Homo Sapiens
QIPTVTFSY

SEQ ID NO: 240109 - protein, 9 aa, Homo Sapiens
HYGNNKYRK

SEQ ID NO: 240110 - protein, 9 aa, Homo Sapiens
TKEEMIQII

SEQ ID NO: 240111 - protein, 9 aa, Homo Sapiens
NSGVMLINL

SEQ ID NO: 240112 - protein, 9 aa, Homo Sapiens
STHSSPEMP

SEQ ID NO: 240113 - protein, 9 aa, Homo Sapiens
MDILNIKMS

SEQ ID NO: 240114 - protein, 9 aa, Homo Sapiens
NIAVRKSRG

SEQ ID NO: 240115 - protein, 9 aa, Homo Sapiens
LYKNPASSS

SEQ ID NO: 240116 - protein, 9 aa, Homo Sapiens
TTHPLSLLL

SEQ ID NO: 240117 - protein, 9 aa, Homo Sapiens
PAPLYHINL

SEQ ID NO: 240118 - protein, 9 aa, Homo Sapiens
LFAVELLDG

SEQ ID NO: 240119 - protein, 9 aa, Homo Sapiens
PGKKEKEHG

SEQ ID NO: 240120 - protein, 9 aa, Homo Sapiens
GQSFSYKSS

SEQ ID NO: 240121 - protein, 9 aa, Homo Sapiens
FAPSSAQHS

SEQ ID NO: 240122 - protein, 9 aa, Homo Sapiens
WMVCKKIFM

SEQ ID NO: 240123 - protein, 9 aa, Homo Sapiens
CVFWTDAIT

SEQ ID NO: 240124 - protein, 9 aa, Homo Sapiens
PLWFDVCDA

SEQ ID NO: 240125 - protein, 9 aa, Homo Sapiens
KRITKLNED

SEQ ID NO: 240126 - protein, 9 aa, Homo Sapiens
SLRWYKQDT

SEQ ID NO: 240127 - protein, 9 aa, Homo Sapiens
ENEDKHARQ

SEQ ID NO: 240128 - protein, 9 aa, Homo Sapiens
LEQNFQTIL

SEQ ID NO: 240129 - protein, 9 aa, Homo Sapiens
MHTCPRWIG

SEQ ID NO: 240130 - protein, 9 aa, Homo Sapiens
IIDSNDQAT

SEQ ID NO: 240131 - protein, 9 aa, Homo Sapiens
YPGSQRSCI

SEQ ID NO: 240132 - protein, 9 aa, Homo Sapiens
DLCFTMSCV

SEQ ID NO: 240133 - protein, 9 aa, Homo Sapiens
VFQSQGLGR

SEQ ID NO: 240134 - protein, 9 aa, Homo Sapiens
SWDLLIPQS

SEQ ID NO: 240135 - protein, 9 aa, Homo Sapiens
QQGKTFIRA

SEQ ID NO: 240136 - protein, 9 aa, Homo Sapiens
ITGENNLPC

SEQ ID NO: 240137 - protein, 9 aa, Homo Sapiens
RKCERILYV

SEQ ID NO: 240138 - protein, 9 aa, Homo Sapiens
FVSTLVFLV

SEQ ID NO: 240139 - protein, 9 aa, Homo Sapiens
NYPFPSRVF

SEQ ID NO: 240140 - protein, 9 aa, Homo Sapiens
RIHEIIHTG

SEQ ID NO: 240141 - protein, 9 aa, Homo Sapiens
AVSEHLPYL

SEQ ID NO: 240142 - protein, 9 aa, Homo Sapiens
PPQNKKVSL

SEQ ID NO: 240143 - protein, 9 aa, Homo Sapiens
NEEYVSWWW

SEQ ID NO: 240144 - protein, 9 aa, Homo Sapiens
RWGCYPGSQ

SEQ ID NO: 240145 - protein, 9 aa, Homo Sapiens
SIQYSKDSY

SEQ ID NO: 240146 - protein, 9 aa, Homo Sapiens
PIHYTTAMS

SEQ ID NO: 240147 - protein, 9 aa, Homo Sapiens
SGATMLIHS

SEQ ID NO: 240148 - protein, 9 aa, Homo Sapiens
DPVFTEVDN

SEQ ID NO: 240149 - protein, 9 aa, Homo Sapiens
HIIQWLEAE

SEQ ID NO: 240150 - protein, 9 aa, Homo Sapiens
TTIVPVEDW

SEQ ID NO: 240151 - protein, 9 aa, Homo Sapiens
CGNNFGQSS

SEQ ID NO: 240152 - protein, 9 aa, Homo Sapiens
EGEAKKDSL

SEQ ID NO: 240153 - protein, 9 aa, Homo Sapiens
ALDPSPFNV

SEQ ID NO: 240154 - protein, 9 aa, Homo Sapiens
PRAHLPCVG

SEQ ID NO: 240155 - protein, 9 aa, Homo Sapiens
HKKERRMRL

SEQ ID NO: 240156 - protein, 9 aa, Homo Sapiens
FTSSSFDTT

SEQ ID NO: 240157 - protein, 9 aa, Homo Sapiens
GEEIYCYYG

SEQ ID NO: 240158 - protein, 9 aa, Homo Sapiens
KFTAATEKQ

SEQ ID NO: 240159 - protein, 9 aa, Homo Sapiens
SIRIESITS

SEQ ID NO: 240160 - protein, 9 aa, Homo Sapiens
DDGFSSYLD

SEQ ID NO: 240161 - protein, 9 aa, Homo Sapiens
SRNELPEIP

SEQ ID NO: 240162 - protein, 9 aa, Homo Sapiens
AIIGLLIVH

SEQ ID NO: 240163 - protein, 9 aa, Homo Sapiens
ATPRTRGVF

SEQ ID NO: 240164 - protein, 9 aa, Homo Sapiens
AEYVKVLQE

SEQ ID NO: 240165 - protein, 9 aa, Homo Sapiens
IWYNTIFLF

SEQ ID NO: 240166 - protein, 9 aa, Homo Sapiens
TLAAFTLRT

SEQ ID NO: 240167 - protein, 9 aa, Homo Sapiens
DRKRCRVYL

SEQ ID NO: 240168 - protein, 9 aa, Homo Sapiens
TAIMNNSQG

SEQ ID NO: 240169 - protein, 9 aa, Homo Sapiens
HSSHKHNSS

SEQ ID NO: 240170 - protein, 9 aa, Homo Sapiens
LKYTESRKY

SEQ ID NO: 240171 - protein, 9 aa, Homo Sapiens
LIYFLREPN

SEQ ID NO: 240172 - protein, 9 aa, Homo Sapiens
GISDEDVLG

SEQ ID NO: 240173 - protein, 9 aa, Homo Sapiens
QESPDKLDK

SEQ ID NO: 240174 - protein, 9 aa, Homo Sapiens
VLKLNKKSL

SEQ ID NO: 240175 - protein, 9 aa, Homo Sapiens
KEKEARSKC

SEQ ID NO: 240176 - protein, 9 aa, Homo Sapiens
YFYALLFIS

SEQ ID NO: 240177 - protein, 9 aa, Homo Sapiens
MWVKLLYIV

SEQ ID NO: 240178 - protein, 9 aa, Homo Sapiens
HPLYLTGLF

SEQ ID NO: 240179 - protein, 9 aa, Homo Sapiens
AYQYTALTS

SEQ ID NO: 240180 - protein, 9 aa, Homo Sapiens
PLLKNQECK

SEQ ID NO: 240181 - protein, 9 aa, Homo Sapiens
KALLVFSPE

SEQ ID NO: 240182 - protein, 9 aa, Homo Sapiens
VNIETKDVP

SEQ ID NO: 240183 - protein, 9 aa, Homo Sapiens
GKQIVENLS

SEQ ID NO: 240184 - protein, 9 aa, Homo Sapiens
IPPKKEASK

SEQ ID NO: 240185 - protein, 9 aa, Homo Sapiens
QQTFLRPDP

SEQ ID NO: 240186 - protein, 9 aa, Homo Sapiens
VKEAIAAGY

SEQ ID NO: 240187 - protein, 9 aa, Homo Sapiens
NELVIFVFG

SEQ ID NO: 240188 - protein, 9 aa, Homo Sapiens
KLSLVNTVC

SEQ ID NO: 240189 - protein, 9 aa, Homo Sapiens
LGATVTTAE

SEQ ID NO: 240190 - protein, 9 aa, Homo Sapiens
SIDEDCKLN

SEQ ID NO: 240191 - protein, 9 aa, Homo Sapiens
MLCVTGNFF

SEQ ID NO: 240192 - protein, 9 aa, Homo Sapiens
ENTSGALSR

SEQ ID NO: 240193 - protein, 9 aa, Homo Sapiens
NHEQTKAFK

SEQ ID NO: 240194 - protein, 9 aa, Homo Sapiens
YDAEKYGPH

SEQ ID NO: 240195 - protein, 9 aa, Homo Sapiens
LTYSSDKAY

SEQ ID NO: 240196 - protein, 9 aa, Homo Sapiens
PVCGREAEV

SEQ ID NO: 240197 - protein, 9 aa, Homo Sapiens
FFGGTDIFL

SEQ ID NO: 240198 - protein, 9 aa, Homo Sapiens
DILDPQVPA

SEQ ID NO: 240199 - protein, 9 aa, Homo Sapiens
RLGQMGQDE

SEQ ID NO: 240200 - protein, 9 aa, Homo Sapiens
YYCKGITLF

SEQ ID NO: 240201 - protein, 9 aa, Homo Sapiens
PEQNIKYSF

SEQ ID NO: 240202 - protein, 9 aa, Homo Sapiens
GFPEAGGGA

SEQ ID NO: 240203 - protein, 9 aa, Homo Sapiens
YMISAYGAA

SEQ ID NO: 240204 - protein, 9 aa, Homo Sapiens
TNNLWIYLA

SEQ ID NO: 240205 - protein, 9 aa, Homo Sapiens
DNFWMVMVV

SEQ ID NO: 240206 - protein, 9 aa, Homo Sapiens
RLLGEKLQY

SEQ ID NO: 240207 - protein, 9 aa, Homo Sapiens
SGSSKDLST

SEQ ID NO: 240208 - protein, 9 aa, Homo Sapiens
NGCGKAFSQ

SEQ ID NO: 240209 - protein, 9 aa, Homo Sapiens
GNIKPTSFL

SEQ ID NO: 240210 - protein, 9 aa, Homo Sapiens
ALISLVLMA

SEQ ID NO: 240211 - protein, 9 aa, Homo Sapiens
KEVDYSDSP

SEQ ID NO: 240212 - protein, 9 aa, Homo Sapiens
GLDAGLYYV

SEQ ID NO: 240213 - protein, 9 aa, Homo Sapiens
ALTFYRKEP

SEQ ID NO: 240214 - protein, 9 aa, Homo Sapiens
MGKGRFDEN

SEQ ID NO: 240215 - protein, 9 aa, Homo Sapiens
LLISFRLKP

SEQ ID NO: 240216 - protein, 9 aa, Homo Sapiens
DIVLWNNST

SEQ ID NO: 240217 - protein, 9 aa, Homo Sapiens
GSSCAPPPT

SEQ ID NO: 240218 - protein, 9 aa, Homo Sapiens
QIADAYSYF

SEQ ID NO: 240219 - protein, 9 aa, Homo Sapiens
SEYLGAIYR

SEQ ID NO: 240220 - protein, 9 aa, Homo Sapiens
AYSPAIQML

SEQ ID NO: 240221 - protein, 9 aa, Homo Sapiens
RCVVQIRSD

SEQ ID NO: 240222 - protein, 9 aa, Homo Sapiens
NSTHADTCT

SEQ ID NO: 240223 - protein, 9 aa, Homo Sapiens
GTYSEPKLT

SEQ ID NO: 240224 - protein, 9 aa, Homo Sapiens
TPRTRGVFS

SEQ ID NO: 240225 - protein, 9 aa, Homo Sapiens
LCLRYAAAA

SEQ ID NO: 240226 - protein, 9 aa, Homo Sapiens
RDRLSPYFY

SEQ ID NO: 240227 - protein, 9 aa, Homo Sapiens
QIVKQLKEQ

SEQ ID NO: 240228 - protein, 9 aa, Homo Sapiens
NSCSSSSQT

SEQ ID NO: 240229 - protein, 9 aa, Homo Sapiens
PMHLLLGNL

SEQ ID NO: 240230 - protein, 9 aa, Homo Sapiens
PASLNGHLP

SEQ ID NO: 240231 - protein, 9 aa, Homo Sapiens
DGLVWKSLD

SEQ ID NO: 240232 - protein, 9 aa, Homo Sapiens
SMFSAIRSH

SEQ ID NO: 240233 - protein, 9 aa, Homo Sapiens
WREWLGLIN

SEQ ID NO: 240234 - protein, 9 aa, Homo Sapiens
DSFNHKKFF

SEQ ID NO: 240235 - protein, 9 aa, Homo Sapiens
GECPWQVML

SEQ ID NO: 240236 - protein, 9 aa, Homo Sapiens
LISLAHVDS

SEQ ID NO: 240237 - protein, 9 aa, Homo Sapiens
LAAMIAKDK

SEQ ID NO: 240238 - protein, 9 aa, Homo Sapiens
MAVQRCVVQ

SEQ ID NO: 240239 - protein, 9 aa, Homo Sapiens
GPKDAGRRI

SEQ ID NO: 240240 - protein, 9 aa, Homo Sapiens
FGRHRFSGR

SEQ ID NO: 240241 - protein, 9 aa, Homo Sapiens
DNNGRKYDT

SEQ ID NO: 240242 - protein, 9 aa, Homo Sapiens
NFLDFAESD

SEQ ID NO: 240243 - protein, 9 aa, Homo Sapiens
NSQFQMLFT

SEQ ID NO: 240244 - protein, 9 aa, Homo Sapiens
PCPASTHDS

SEQ ID NO: 240245 - protein, 9 aa, Homo Sapiens
YWLSTHKFC

SEQ ID NO: 240246 - protein, 9 aa, Homo Sapiens
ETQEGIINI

SEQ ID NO: 240247 - protein, 9 aa, Homo Sapiens
GYQATTYAS

SEQ ID NO: 240248 - protein, 9 aa, Homo Sapiens
RRVIHRDLK

SEQ ID NO: 240249 - protein, 9 aa, Homo Sapiens
HEEDCQELL

SEQ ID NO: 240250 - protein, 9 aa, Homo Sapiens
SQNHSKCIT

SEQ ID NO: 240251 - protein, 9 aa, Homo Sapiens
KRKGRKWKV

SEQ ID NO: 240252 - protein, 9 aa, Homo Sapiens
DGKAILDSK

SEQ ID NO: 240253 - protein, 9 aa, Homo Sapiens
QQNYTYNVS

SEQ ID NO: 240254 - protein, 9 aa, Homo Sapiens
SLQINITDV

SEQ ID NO: 240255 - protein, 9 aa, Homo Sapiens
LSSILTNIS

SEQ ID NO: 240256 - protein, 9 aa, Homo Sapiens
SETKNLCFL

SEQ ID NO: 240257 - protein, 9 aa, Homo Sapiens
QHTPEEERN

SEQ ID NO: 240258 - protein, 9 aa, Homo Sapiens
SASESLGEL

SEQ ID NO: 240259 - protein, 9 aa, Homo Sapiens
SANEDDDVF

SEQ ID NO: 240260 - protein, 9 aa, Homo Sapiens
PLDFISKRD

SEQ ID NO: 240261 - protein, 9 aa, Homo Sapiens
AKVPSGISD

SEQ ID NO: 240262 - protein, 9 aa, Homo Sapiens
HVPQDGAEV

SEQ ID NO: 240263 - protein, 9 aa, Homo Sapiens
PFMKHGGLH

SEQ ID NO: 240264 - protein, 9 aa, Homo Sapiens
PSMSLLSFY

SEQ ID NO: 240265 - protein, 9 aa, Homo Sapiens
KWVESIVLI

SEQ ID NO: 240266 - protein, 9 aa, Homo Sapiens
QESLHQNFM

SEQ ID NO: 240267 - protein, 9 aa, Homo Sapiens
PSPAEYVKV

SEQ ID NO: 240268 - protein, 9 aa, Homo Sapiens
LFRHYRINT

SEQ ID NO: 240269 - protein, 9 aa, Homo Sapiens
MENHINSKK

SEQ ID NO: 240270 - protein, 9 aa, Homo Sapiens
EHSLLVAAK

SEQ ID NO: 240271 - protein, 9 aa, Homo Sapiens
FSRKTYKMP

SEQ ID NO: 240272 - protein, 9 aa, Homo Sapiens
IPENAGDIP

SEQ ID NO: 240273 - protein, 9 aa, Homo Sapiens
NINRSILAL

SEQ ID NO: 240274 - protein, 9 aa, Homo Sapiens
CHAGIDTDP

SEQ ID NO: 240275 - protein, 9 aa, Homo Sapiens
DRKFVIFDL

SEQ ID NO: 240276 - protein, 9 aa, Homo Sapiens
SSLSPTSSF

SEQ ID NO: 240277 - protein, 9 aa, Homo Sapiens
DQLKHIMEV

SEQ ID NO: 240278 - protein, 9 aa, Homo Sapiens
RLDRAQIDL

SEQ ID NO: 240279 - protein, 9 aa, Homo Sapiens
DLSLAVSYN

SEQ ID NO: 240280 - protein, 9 aa, Homo Sapiens
RTNIKAKLH

SEQ ID NO: 240281 - protein, 9 aa, Homo Sapiens
EVPYVLVIP

SEQ ID NO: 240282 - protein, 9 aa, Homo Sapiens
SSVDINSAE

SEQ ID NO: 240283 - protein, 9 aa, Homo Sapiens
EDDIMNDEG

SEQ ID NO: 240284 - protein, 9 aa, Homo Sapiens
GPQGIGGPP

SEQ ID NO: 240285 - protein, 9 aa, Homo Sapiens
SYTYFKAGN

SEQ ID NO: 240286 - protein, 9 aa, Homo Sapiens
KLSPFGQWW

SEQ ID NO: 240287 - protein, 9 aa, Homo Sapiens
FRTDKGRDS

SEQ ID NO: 240288 - protein, 9 aa, Homo Sapiens
NYHPPQFGK

SEQ ID NO: 240289 - protein, 9 aa, Homo Sapiens
TDCFGGILM

SEQ ID NO: 240290 - protein, 9 aa, Homo Sapiens
HLKLKDWKS

SEQ ID NO: 240291 - protein, 9 aa, Homo Sapiens
SLGFAGMDE

SEQ ID NO: 240292 - protein, 9 aa, Homo Sapiens
IENVLSLSL

SEQ ID NO: 240293 - protein, 9 aa, Homo Sapiens
TCHENTNNL

SEQ ID NO: 240294 - protein, 9 aa, Homo Sapiens
VRNISYFWL

SEQ ID NO: 240295 - protein, 9 aa, Homo Sapiens
NGKYVYIAE

SEQ ID NO: 240296 - protein, 9 aa, Homo Sapiens
AKRLQEEKG

SEQ ID NO: 240297 - protein, 9 aa, Homo Sapiens
TKDNSQNQD

SEQ ID NO: 240298 - protein, 9 aa, Homo Sapiens
TSFSHKRSL

SEQ ID NO: 240299 - protein, 9 aa, Homo Sapiens
EVVGDYFGK

SEQ ID NO: 240300 - protein, 9 aa, Homo Sapiens
QRNKIRPNW

SEQ ID NO: 240301 - protein, 9 aa, Homo Sapiens
ESEIDKIVQ

SEQ ID NO: 240302 - protein, 9 aa, Homo Sapiens
QGASMYEQF

SEQ ID NO: 240303 - protein, 9 aa, Homo Sapiens
CCGPSVTVD

SEQ ID NO: 240304 - protein, 9 aa, Homo Sapiens
NLTINTEST

SEQ ID NO: 240305 - protein, 9 aa, Homo Sapiens
TVADNREFQ

SEQ ID NO: 240306 - protein, 9 aa, Homo Sapiens
KKEKGIHIL

SEQ ID NO: 240307 - protein, 9 aa, Homo Sapiens
KRAEVEVYK

SEQ ID NO: 240308 - protein, 9 aa, Homo Sapiens
GEKEEYKWG

SEQ ID NO: 240309 - protein, 9 aa, Homo Sapiens
EYLPKTPIF

SEQ ID NO: 240310 - protein, 9 aa, Homo Sapiens
DDYPDKDKK

SEQ ID NO: 240311 - protein, 9 aa, Homo Sapiens
LTRKNKEVF

SEQ ID NO: 240312 - protein, 9 aa, Homo Sapiens
DSLDNMTCI

SEQ ID NO: 240313 - protein, 9 aa, Homo Sapiens
EGEIIDLYK

SEQ ID NO: 240314 - protein, 9 aa, Homo Sapiens
PGLPWLLLL

SEQ ID NO: 240315 - protein, 9 aa, Homo Sapiens
PLSDENSQV

SEQ ID NO: 240316 - protein, 9 aa, Homo Sapiens
DFLTDTQLF

SEQ ID NO: 240317 - protein, 9 aa, Homo Sapiens
LKFAIPSEV

SEQ ID NO: 240318 - protein, 9 aa, Homo Sapiens
NASKNHQDD

SEQ ID NO: 240319 - protein, 9 aa, Homo Sapiens
AALYFSPIL

SEQ ID NO: 240320 - protein, 9 aa, Homo Sapiens
DVKTAFMKV

SEQ ID NO: 240321 - protein, 9 aa, Homo Sapiens
HTSESESNI

SEQ ID NO: 240322 - protein, 9 aa, Homo Sapiens
PKANPGSWF

SEQ ID NO: 240323 - protein, 9 aa, Homo Sapiens
PTRIASSLD

SEQ ID NO: 240324 - protein, 9 aa, Homo Sapiens
YLTQHKIIH

SEQ ID NO: 240325 - protein, 9 aa, Homo Sapiens
RTMPESSES

SEQ ID NO: 240326 - protein, 9 aa, Homo Sapiens
DGKISFQEF

SEQ ID NO: 240327 - protein, 9 aa, Homo Sapiens
VFPQSLPKY

SEQ ID NO: 240328 - protein, 9 aa, Homo Sapiens
LLILISDGF

SEQ ID NO: 240329 - protein, 9 aa, Homo Sapiens
FLNAKTFYT

SEQ ID NO: 240330 - protein, 9 aa, Homo Sapiens
SWMAPEALH

SEQ ID NO: 240331 - protein, 9 aa, Homo Sapiens
IMNSVVPSD

SEQ ID NO: 240332 - protein, 9 aa, Homo Sapiens
FILANALLE

SEQ ID NO: 240333 - protein, 9 aa, Homo Sapiens
LSSQEESIV

SEQ ID NO: 240334 - protein, 9 aa, Homo Sapiens
SYQEQKPEH

SEQ ID NO: 240335 - protein, 9 aa, Homo Sapiens
HGVVLSESM

SEQ ID NO: 240336 - protein, 9 aa, Homo Sapiens
PRKWIRPIK

SEQ ID NO: 240337 - protein, 9 aa, Homo Sapiens
CKALSHSDR

SEQ ID NO: 240338 - protein, 9 aa, Homo Sapiens
YSFQDCYFE

SEQ ID NO: 240339 - protein, 9 aa, Homo Sapiens
NKSLSRSFE

SEQ ID NO: 240340 - protein, 9 aa, Homo Sapiens
DYPDKDKKR

SEQ ID NO: 240341 - protein, 9 aa, Homo Sapiens
HKERSTYLS

SEQ ID NO: 240342 - protein, 9 aa, Homo Sapiens
FYSSSASMC

SEQ ID NO: 240343 - protein, 9 aa, Homo Sapiens
SSWKRVYFG

SEQ ID NO: 240344 - protein, 9 aa, Homo Sapiens
SQGQAQVMH

SEQ ID NO: 240345 - protein, 9 aa, Homo Sapiens
FGQPSPDQS

SEQ ID NO: 240346 - protein, 9 aa, Homo Sapiens
CALLMSESQ

SEQ ID NO: 240347 - protein, 9 aa, Homo Sapiens
GIYTSESLV

SEQ ID NO: 240348 - protein, 9 aa, Homo Sapiens
TTGNRHVQI

SEQ ID NO: 240349 - protein, 9 aa, Homo Sapiens
KDIFKPIQS

SEQ ID NO: 240350 - protein, 9 aa, Homo Sapiens
SISYICIVA

SEQ ID NO: 240351 - protein, 9 aa, Homo Sapiens
INPTSTQTS

SEQ ID NO: 240352 - protein, 9 aa, Homo Sapiens
LLYDEIEAE

SEQ ID NO: 240353 - protein, 9 aa, Homo Sapiens
TSNLIVLGL

SEQ ID NO: 240354 - protein, 9 aa, Homo Sapiens
ACSILLTNV

SEQ ID NO: 240355 - protein, 9 aa, Homo Sapiens
EFFIKIAAI

SEQ ID NO: 240356 - protein, 9 aa, Homo Sapiens
GRLLFRECC

SEQ ID NO: 240357 - protein, 9 aa, Homo Sapiens
LYAIFVIFT

SEQ ID NO: 240358 - protein, 9 aa, Homo Sapiens
LRNCASDPR

SEQ ID NO: 240359 - protein, 9 aa, Homo Sapiens
EINQLRGEL

SEQ ID NO: 240360 - protein, 9 aa, Homo Sapiens
TSLVLTPSH

SEQ ID NO: 240361 - protein, 9 aa, Homo Sapiens
DSKLCPSLC

SEQ ID NO: 240362 - protein, 9 aa, Homo Sapiens
LQNNKITKI

SEQ ID NO: 240363 - protein, 9 aa, Homo Sapiens
IMKCDINIR

SEQ ID NO: 240364 - protein, 9 aa, Homo Sapiens
DYFLNVCFK

SEQ ID NO: 240365 - protein, 9 aa, Homo Sapiens
KVHDMLKKG

SEQ ID NO: 240366 - protein, 9 aa, Homo Sapiens
CEVDKEAIS

SEQ ID NO: 240367 - protein, 9 aa, Homo Sapiens
NMNSAISMT

SEQ ID NO: 240368 - protein, 9 aa, Homo Sapiens
ANNKEDSNI

SEQ ID NO: 240369 - protein, 9 aa, Homo Sapiens
AMNTFKWTK

SEQ ID NO: 240370 - protein, 9 aa, Homo Sapiens
LNKAALEMC

SEQ ID NO: 240371 - protein, 9 aa, Homo Sapiens
VGKWNGLSK

SEQ ID NO: 240372 - protein, 9 aa, Homo Sapiens
KNKNNFVPY

SEQ ID NO: 240373 - protein, 9 aa, Homo Sapiens
PQGNSHTET

SEQ ID NO: 240374 - protein, 9 aa, Homo Sapiens
SDKYQYFLS

SEQ ID NO: 240375 - protein, 9 aa, Homo Sapiens
LAPEPRLKK

SEQ ID NO: 240376 - protein, 9 aa, Homo Sapiens
HVCKVLLTM

SEQ ID NO: 240377 - protein, 9 aa, Homo Sapiens
IGIWAIGCI

SEQ ID NO: 240378 - protein, 9 aa, Homo Sapiens
GVTAQQFHR

SEQ ID NO: 240379 - protein, 9 aa, Homo Sapiens
KDSGLSHVQ

SEQ ID NO: 240380 - protein, 9 aa, Homo Sapiens
CQILEQKIR

SEQ ID NO: 240381 - protein, 9 aa, Homo Sapiens
VNLPATKLP

SEQ ID NO: 240382 - protein, 9 aa, Homo Sapiens
APDGSCRWD

SEQ ID NO: 240383 - protein, 9 aa, Homo Sapiens
SCEEQAVLL

SEQ ID NO: 240384 - protein, 9 aa, Homo Sapiens
KLAPALACG

SEQ ID NO: 240385 - protein, 9 aa, Homo Sapiens
LANFASLSG

SEQ ID NO: 240386 - protein, 9 aa, Homo Sapiens
VQKLSAPRE

SEQ ID NO: 240387 - protein, 9 aa, Homo Sapiens
FQEEIEFRN

SEQ ID NO: 240388 - protein, 9 aa, Homo Sapiens
GRVHFLVNA

SEQ ID NO: 240389 - protein, 9 aa, Homo Sapiens
KVFKEGYND

SEQ ID NO: 240390 - protein, 9 aa, Homo Sapiens
LSAIPSVVS

SEQ ID NO: 240391 - protein, 9 aa, Homo Sapiens
PKQETSIEV

SEQ ID NO: 240392 - protein, 9 aa, Homo Sapiens
TCQENRQWR

SEQ ID NO: 240393 - protein, 9 aa, Homo Sapiens
AKVMQHILN

SEQ ID NO: 240394 - protein, 9 aa, Homo Sapiens
EAYHPAERI

SEQ ID NO: 240395 - protein, 9 aa, Homo Sapiens
NYSNPMNPY

SEQ ID NO: 240396 - protein, 9 aa, Homo Sapiens
MKMFSESHK

SEQ ID NO: 240397 - protein, 9 aa, Homo Sapiens
AQVGKSMFV

SEQ ID NO: 240398 - protein, 9 aa, Homo Sapiens
PQQPAPAMT

SEQ ID NO: 240399 - protein, 9 aa, Homo Sapiens
YCEHDFKML

SEQ ID NO: 240400 - protein, 9 aa, Homo Sapiens
ERNYAQKQL

SEQ ID NO: 240401 - protein, 9 aa, Homo Sapiens
DTPELCAAL

SEQ ID NO: 240402 - protein, 9 aa, Homo Sapiens
IHTSESESN

SEQ ID NO: 240403 - protein, 9 aa, Homo Sapiens
DTICTSSIM

SEQ ID NO: 240404 - protein, 9 aa, Homo Sapiens
LGKKNISFL

SEQ ID NO: 240405 - protein, 9 aa, Homo Sapiens
LGSIRICVS

SEQ ID NO: 240406 - protein, 9 aa, Homo Sapiens
NRIVAARLN

SEQ ID NO: 240407 - protein, 9 aa, Homo Sapiens
LDPPLRSQF

SEQ ID NO: 240408 - protein, 9 aa, Homo Sapiens
TQFLRSQQE

SEQ ID NO: 240409 - protein, 9 aa, Homo Sapiens
ITASTYYGN

SEQ ID NO: 240410 - protein, 9 aa, Homo Sapiens
RLKMFQEDH

SEQ ID NO: 240411 - protein, 9 aa, Homo Sapiens
ILELELPSS

SEQ ID NO: 240412 - protein, 9 aa, Homo Sapiens
SQTALSKGK

SEQ ID NO: 240413 - protein, 9 aa, Homo Sapiens
TSGKWTSLN

SEQ ID NO: 240414 - protein, 9 aa, Homo Sapiens
YQIKELGTL

SEQ ID NO: 240415 - protein, 9 aa, Homo Sapiens
IFWINFDHY

SEQ ID NO: 240416 - protein, 9 aa, Homo Sapiens
RSSALTIHN

SEQ ID NO: 240417 - protein, 9 aa, Homo Sapiens
LCDLIFDFE

SEQ ID NO: 240418 - protein, 9 aa, Homo Sapiens
VFGLGIGAS

SEQ ID NO: 240419 - protein, 9 aa, Homo Sapiens
IYAITSAIL

SEQ ID NO: 240420 - protein, 9 aa, Homo Sapiens
HQILERMCE

SEQ ID NO: 240421 - protein, 9 aa, Homo Sapiens
HLDNLSNQI

SEQ ID NO: 240422 - protein, 9 aa, Homo Sapiens
GCISVKDHR

SEQ ID NO: 240423 - protein, 9 aa, Homo Sapiens
MFCSKKKLR

SEQ ID NO: 240424 - protein, 9 aa, Homo Sapiens
ICLGETIAQ

SEQ ID NO: 240425 - protein, 9 aa, Homo Sapiens
RKRCRVYLE

SEQ ID NO: 240426 - protein, 9 aa, Homo Sapiens
LLALPQYLQ

SEQ ID NO: 240427 - protein, 9 aa, Homo Sapiens
YSEQYQIRK

SEQ ID NO: 240428 - protein, 9 aa, Homo Sapiens
MMNITFQNI

SEQ ID NO: 240429 - protein, 9 aa, Homo Sapiens
ELVYFEPKD

SEQ ID NO: 240430 - protein, 9 aa, Homo Sapiens
DTYAHPLFY

SEQ ID NO: 240431 - protein, 9 aa, Homo Sapiens
QGGGLENLG

SEQ ID NO: 240432 - protein, 9 aa, Homo Sapiens
HPEYGMFTY

SEQ ID NO: 240433 - protein, 9 aa, Homo Sapiens
DTTVAGCAV

SEQ ID NO: 240434 - protein, 9 aa, Homo Sapiens
MAGRHQHRS

SEQ ID NO: 240435 - protein, 9 aa, Homo Sapiens
FNSKLPVDI

SEQ ID NO: 240436 - protein, 9 aa, Homo Sapiens
LRGDPDFEG

SEQ ID NO: 240437 - protein, 9 aa, Homo Sapiens
PPQKEVITL

SEQ ID NO: 240438 - protein, 9 aa, Homo Sapiens
STDKGPSSA

SEQ ID NO: 240439 - protein, 9 aa, Homo Sapiens
RRNLILSLG

SEQ ID NO: 240440 - protein, 9 aa, Homo Sapiens
DPQMDYLAL

SEQ ID NO: 240441 - protein, 9 aa, Homo Sapiens
VFADMIRKS

SEQ ID NO: 240442 - protein, 9 aa, Homo Sapiens
VFSPLRKLQ

SEQ ID NO: 240443 - protein, 9 aa, Homo Sapiens
VTRKRFNAF

SEQ ID NO: 240444 - protein, 9 aa, Homo Sapiens
VHEEDCQEL

SEQ ID NO: 240445 - protein, 9 aa, Homo Sapiens
GVCHAGIDT

SEQ ID NO: 240446 - protein, 9 aa, Homo Sapiens
HDSGIVMQI

SEQ ID NO: 240447 - protein, 9 aa, Homo Sapiens
SVVCRESRS

SEQ ID NO: 240448 - protein, 9 aa, Homo Sapiens
IIKHQRIHT

SEQ ID NO: 240449 - protein, 9 aa, Homo Sapiens
AHYLVGTPY

SEQ ID NO: 240450 - protein, 9 aa, Homo Sapiens
SPVIFSDWY

SEQ ID NO: 240451 - protein, 9 aa, Homo Sapiens
LDLCFTMSC

SEQ ID NO: 240452 - protein, 9 aa, Homo Sapiens
LSPHENEYD

SEQ ID NO: 240453 - protein, 9 aa, Homo Sapiens
SDAEFDKGF

SEQ ID NO: 240454 - protein, 9 aa, Homo Sapiens
SPFFHMAAD

SEQ ID NO: 240455 - protein, 9 aa, Homo Sapiens
ILKVTPEIQ

SEQ ID NO: 240456 - protein, 9 aa, Homo Sapiens
QVAKLKPPP

SEQ ID NO: 240457 - protein, 9 aa, Homo Sapiens
KFSKQYKAT

SEQ ID NO: 240458 - protein, 9 aa, Homo Sapiens
NLRQLVKVD

SEQ ID NO: 240459 - protein, 9 aa, Homo Sapiens
LFEQILKVE

SEQ ID NO: 240460 - protein, 9 aa, Homo Sapiens
LGKLLRDSH

SEQ ID NO: 240461 - protein, 9 aa, Homo Sapiens
NGLKDNNHL

SEQ ID NO: 240462 - protein, 9 aa, Homo Sapiens
HEPSSHPDK

SEQ ID NO: 240463 - protein, 9 aa, Homo Sapiens
NELPEIPES

SEQ ID NO: 240464 - protein, 9 aa, Homo Sapiens
KEDSEQWDN

SEQ ID NO: 240465 - protein, 9 aa, Homo Sapiens
HEKLSQICL

SEQ ID NO: 240466 - protein, 9 aa, Homo Sapiens
VGHQQIIHT

SEQ ID NO: 240467 - protein, 9 aa, Homo Sapiens
QTQAEEREM

SEQ ID NO: 240468 - protein, 9 aa, Homo Sapiens
LLGKRISKR

SEQ ID NO: 240469 - protein, 9 aa, Homo Sapiens
NTTTSKDVC

SEQ ID NO: 240470 - protein, 9 aa, Homo Sapiens
ATASCHIVP

SEQ ID NO: 240471 - protein, 9 aa, Homo Sapiens
DPSYKRNIC

SEQ ID NO: 240472 - protein, 9 aa, Homo Sapiens
VKHSRHRRE

SEQ ID NO: 240473 - protein, 9 aa, Homo Sapiens
QVTTIPAVA

SEQ ID NO: 240474 - protein, 9 aa, Homo Sapiens
KTEDKSRQR

SEQ ID NO: 240475 - protein, 9 aa, Homo Sapiens
KENIMKLSI

SEQ ID NO: 240476 - protein, 9 aa, Homo Sapiens
GQFVRVLGR

SEQ ID NO: 240477 - protein, 9 aa, Homo Sapiens
LLGLWEVGT

SEQ ID NO: 240478 - protein, 9 aa, Homo Sapiens
DLYILARVI

SEQ ID NO: 240479 - protein, 9 aa, Homo Sapiens
NTSDSISAR

SEQ ID NO: 240480 - protein, 9 aa, Homo Sapiens
EEQNEQTLG

SEQ ID NO: 240481 - protein, 9 aa, Homo Sapiens
CSEDCCKKC

SEQ ID NO: 240482 - protein, 9 aa, Homo Sapiens
TSGNGSETT

SEQ ID NO: 240483 - protein, 9 aa, Homo Sapiens
SLLVVHQQT

SEQ ID NO: 240484 - protein, 9 aa, Homo Sapiens
HKFCRCYCT

SEQ ID NO: 240485 - protein, 9 aa, Homo Sapiens
ALKEKYMEF

SEQ ID NO: 240486 - protein, 9 aa, Homo Sapiens
PQFYNSEGY

SEQ ID NO: 240487 - protein, 9 aa, Homo Sapiens
GKTFIRAPQ

SEQ ID NO: 240488 - protein, 9 aa, Homo Sapiens
CVQSDYTEA

SEQ ID NO: 240489 - protein, 9 aa, Homo Sapiens
YFVAELIMN

SEQ ID NO: 240490 - protein, 9 aa, Homo Sapiens
ANSLVTLQD

SEQ ID NO: 240491 - protein, 9 aa, Homo Sapiens
LKELQSNLE

SEQ ID NO: 240492 - protein, 9 aa, Homo Sapiens
DVIKGKPIH

SEQ ID NO: 240493 - protein, 9 aa, Homo Sapiens
TSKNCIHRD

SEQ ID NO: 240494 - protein, 9 aa, Homo Sapiens
KKCKEDFPR

SEQ ID NO: 240495 - protein, 9 aa, Homo Sapiens
GQSAGGINT

SEQ ID NO: 240496 - protein, 9 aa, Homo Sapiens
ETSAKTAFN

SEQ ID NO: 240497 - protein, 9 aa, Homo Sapiens
TAREKRAFM

SEQ ID NO: 240498 - protein, 9 aa, Homo Sapiens
EKVYCVVLV

SEQ ID NO: 240499 - protein, 9 aa, Homo Sapiens
KHCMCRNLQ

SEQ ID NO: 240500 - protein, 9 aa, Homo Sapiens
DEQLVAVQA

SEQ ID NO: 240501 - protein, 9 aa, Homo Sapiens
LAAGVIVCL

SEQ ID NO: 240502 - protein, 9 aa, Homo Sapiens
QLKRFRQAD

SEQ ID NO: 240503 - protein, 9 aa, Homo Sapiens
KSSWKRVYF

SEQ ID NO: 240504 - protein, 9 aa, Homo Sapiens
YRVLLTGVQ

SEQ ID NO: 240505 - protein, 9 aa, Homo Sapiens
SNNIHTIEE

SEQ ID NO: 240506 - protein, 9 aa, Homo Sapiens
LISHSNVGI

SEQ ID NO: 240507 - protein, 9 aa, Homo Sapiens
CQGQWQAGK

SEQ ID NO: 240508 - protein, 9 aa, Homo Sapiens
MCKRILVEL

SEQ ID NO: 240509 - protein, 9 aa, Homo Sapiens
KNELRTTKS

SEQ ID NO: 240510 - protein, 9 aa, Homo Sapiens
SRSAQSPPG

SEQ ID NO: 240511 - protein, 9 aa, Homo Sapiens
FDNINFQFK

SEQ ID NO: 240512 - protein, 9 aa, Homo Sapiens
TSSQANPGR

SEQ ID NO: 240513 - protein, 9 aa, Homo Sapiens
ASLSGLHKF

SEQ ID NO: 240514 - protein, 9 aa, Homo Sapiens
PTGEVLETS

SEQ ID NO: 240515 - protein, 9 aa, Homo Sapiens
VLKEIDSHC

SEQ ID NO: 240516 - protein, 9 aa, Homo Sapiens
VAFSYYIHP

SEQ ID NO: 240517 - protein, 9 aa, Homo Sapiens
ASNHVQELP

SEQ ID NO: 240518 - protein, 9 aa, Homo Sapiens
HAEKASKMT

SEQ ID NO: 240519 - protein, 9 aa, Homo Sapiens
YQVLLDVKP

SEQ ID NO: 240520 - protein, 9 aa, Homo Sapiens
LKENLDCRE

SEQ ID NO: 240521 - protein, 9 aa, Homo Sapiens
PKKLDPIVT

SEQ ID NO: 240522 - protein, 9 aa, Homo Sapiens
LDAGLYYVR

SEQ ID NO: 240523 - protein, 9 aa, Homo Sapiens
WEASIWKLF

SEQ ID NO: 240524 - protein, 9 aa, Homo Sapiens
RVIAIDRYY

SEQ ID NO: 240525 - protein, 9 aa, Homo Sapiens
LTAGNEAVL

SEQ ID NO: 240526 - protein, 9 aa, Homo Sapiens
EDVIHKLNN

SEQ ID NO: 240527 - protein, 9 aa, Homo Sapiens
HPFTITVFE

SEQ ID NO: 240528 - protein, 9 aa, Homo Sapiens
IEFVKHFCS

SEQ ID NO: 240529 - protein, 9 aa, Homo Sapiens
ISSLLINSR

SEQ ID NO: 240530 - protein, 9 aa, Homo Sapiens
RNKSWLCFT

SEQ ID NO: 240531 - protein, 9 aa, Homo Sapiens
NMQFLDEMK

SEQ ID NO: 240532 - protein, 9 aa, Homo Sapiens
IIQASKKLK

SEQ ID NO: 240533 - protein, 9 aa, Homo Sapiens
MYTLFGLQA

SEQ ID NO: 240534 - protein, 9 aa, Homo Sapiens
ADEGMLQPQ

SEQ ID NO: 240535 - protein, 9 aa, Homo Sapiens
QTTKLLYRL

SEQ ID NO: 240536 - protein, 9 aa, Homo Sapiens
HHLQPLNVK

SEQ ID NO: 240537 - protein, 9 aa, Homo Sapiens
QSDYGPMKG

SEQ ID NO: 240538 - protein, 9 aa, Homo Sapiens
VPGSYYCTC

SEQ ID NO: 240539 - protein, 9 aa, Homo Sapiens
ENQFKKMKN

SEQ ID NO: 240540 - protein, 9 aa, Homo Sapiens
AFNKVSIVP

SEQ ID NO: 240541 - protein, 9 aa, Homo Sapiens
SVLQGLLHI

SEQ ID NO: 240542 - protein, 9 aa, Homo Sapiens
SNKLADMEE

SEQ ID NO: 240543 - protein, 9 aa, Homo Sapiens
DFILMNKMG

SEQ ID NO: 240544 - protein, 9 aa, Homo Sapiens
PCAAGDNKK

SEQ ID NO: 240545 - protein, 9 aa, Homo Sapiens
PQLAKPSIT

SEQ ID NO: 240546 - protein, 9 aa, Homo Sapiens
SLIAKLATA

SEQ ID NO: 240547 - protein, 9 aa, Homo Sapiens
TENKYSPCA

SEQ ID NO: 240548 - protein, 9 aa, Homo Sapiens
WVREKRRNA

SEQ ID NO: 240549 - protein, 9 aa, Homo Sapiens
KRGSVCGGA

SEQ ID NO: 240550 - protein, 9 aa, Homo Sapiens
VSVSEAINK

SEQ ID NO: 240551 - protein, 9 aa, Homo Sapiens
MMVHLLSNK

SEQ ID NO: 240552 - protein, 9 aa, Homo Sapiens
NQCFGNFFS

SEQ ID NO: 240553 - protein, 9 aa, Homo Sapiens
ILQTLKRHK

SEQ ID NO: 240554 - protein, 9 aa, Homo Sapiens
TSKDKLFDE

SEQ ID NO: 240555 - protein, 9 aa, Homo Sapiens
EQELKKRQE

SEQ ID NO: 240556 - protein, 9 aa, Homo Sapiens
TSATERETQ

SEQ ID NO: 240557 - protein, 9 aa, Homo Sapiens
NHPVFNETE

SEQ ID NO: 240558 - protein, 9 aa, Homo Sapiens
HVVDLFNRV

SEQ ID NO: 240559 - protein, 9 aa, Homo Sapiens
IDMLVYFNF

SEQ ID NO: 240560 - protein, 9 aa, Homo Sapiens
FGYDYLWCV

SEQ ID NO: 240561 - protein, 9 aa, Homo Sapiens
HLKEVKIEG

SEQ ID NO: 240562 - protein, 9 aa, Homo Sapiens
VVICYFGKG

SEQ ID NO: 240563 - protein, 9 aa, Homo Sapiens
VCVGTVGTP

SEQ ID NO: 240564 - protein, 9 aa, Homo Sapiens
SALFRDNLN

SEQ ID NO: 240565 - protein, 9 aa, Homo Sapiens
LNANFNTQK

SEQ ID NO: 240566 - protein, 9 aa, Homo Sapiens
ENNIENYPL

SEQ ID NO: 240567 - protein, 9 aa, Homo Sapiens
ECCATRPEL

SEQ ID NO: 240568 - protein, 9 aa, Homo Sapiens
PCNHVFHTS

SEQ ID NO: 240569 - protein, 9 aa, Homo Sapiens
QNTLTRFVR

SEQ ID NO: 240570 - protein, 9 aa, Homo Sapiens
CKPRLSFAL

SEQ ID NO: 240571 - protein, 9 aa, Homo Sapiens
WTVPAMDPN

SEQ ID NO: 240572 - protein, 9 aa, Homo Sapiens
IHYTTAMSP

SEQ ID NO: 240573 - protein, 9 aa, Homo Sapiens
DNYTHDVVM

SEQ ID NO: 240574 - protein, 9 aa, Homo Sapiens
KHIKCLESQ

SEQ ID NO: 240575 - protein, 9 aa, Homo Sapiens
QNIHTEDKP

SEQ ID NO: 240576 - protein, 9 aa, Homo Sapiens
LRGLCSLTH

SEQ ID NO: 240577 - protein, 9 aa, Homo Sapiens
RLESLQEIK

SEQ ID NO: 240578 - protein, 9 aa, Homo Sapiens
KVIMVELFM

SEQ ID NO: 240579 - protein, 9 aa, Homo Sapiens
EDRNSMTSQ

SEQ ID NO: 240580 - protein, 9 aa, Homo Sapiens
NRENYPAGR

SEQ ID NO: 240581 - protein, 9 aa, Homo Sapiens
TCPNDQTCC

SEQ ID NO: 240582 - protein, 9 aa, Homo Sapiens
ADLEEELVC

SEQ ID NO: 240583 - protein, 9 aa, Homo Sapiens
NYNNLIIKY

SEQ ID NO: 240584 - protein, 9 aa, Homo Sapiens
EGIVEYPIC

SEQ ID NO: 240585 - protein, 9 aa, Homo Sapiens
FIAAAKILW

SEQ ID NO: 240586 - protein, 9 aa, Homo Sapiens
VGPQRCPVY

SEQ ID NO: 240587 - protein, 9 aa, Homo Sapiens
LYWLSTHKF

SEQ ID NO: 240588 - protein, 9 aa, Homo Sapiens
CRFIMSVKN

SEQ ID NO: 240589 - protein, 9 aa, Homo Sapiens
ELQDIIGKA

SEQ ID NO: 240590 - protein, 9 aa, Homo Sapiens
YAFPKSINV

SEQ ID NO: 240591 - protein, 9 aa, Homo Sapiens
YNWLLIYTR

SEQ ID NO: 240592 - protein, 9 aa, Homo Sapiens
VPSDFHQTK

SEQ ID NO: 240593 - protein, 9 aa, Homo Sapiens
EQTLGHFMS

SEQ ID NO: 240594 - protein, 9 aa, Homo Sapiens
ESKDLSATV

SEQ ID NO: 240595 - protein, 9 aa, Homo Sapiens
TSKREHWFR

SEQ ID NO: 240596 - protein, 9 aa, Homo Sapiens
PLRDRSHIK

SEQ ID NO: 240597 - protein, 9 aa, Homo Sapiens
KPASPKNNI

SEQ ID NO: 240598 - protein, 9 aa, Homo Sapiens
NVPLPNKSI

SEQ ID NO: 240599 - protein, 9 aa, Homo Sapiens
KQHKKNILE

SEQ ID NO: 240600 - protein, 9 aa, Homo Sapiens
VRIHLQQQP

SEQ ID NO: 240601 - protein, 9 aa, Homo Sapiens
IQALKEDFH

SEQ ID NO: 240602 - protein, 9 aa, Homo Sapiens
KIYLVQSVL

SEQ ID NO: 240603 - protein, 9 aa, Homo Sapiens
QLQRMIRYS

SEQ ID NO: 240604 - protein, 9 aa, Homo Sapiens
NRRSALEKN

SEQ ID NO: 240605 - protein, 9 aa, Homo Sapiens
LRTMPESSE

SEQ ID NO: 240606 - protein, 9 aa, Homo Sapiens
FGAPLARNQ

SEQ ID NO: 240607 - protein, 9 aa, Homo Sapiens
ELSYYSLEY

SEQ ID NO: 240608 - protein, 9 aa, Homo Sapiens
PRYKQFSCL

SEQ ID NO: 240609 - protein, 9 aa, Homo Sapiens
QLTFCDSNV

SEQ ID NO: 240610 - protein, 9 aa, Homo Sapiens
VLAQTCGTQ

SEQ ID NO: 240611 - protein, 9 aa, Homo Sapiens
YLGAIYRST

SEQ ID NO: 240612 - protein, 9 aa, Homo Sapiens
RPRKTSYLS

SEQ ID NO: 240613 - protein, 9 aa, Homo Sapiens
KYDTNGNLD

SEQ ID NO: 240614 - protein, 9 aa, Homo Sapiens
GRRSTFQAH

SEQ ID NO: 240615 - protein, 9 aa, Homo Sapiens
LASYKRIAP

SEQ ID NO: 240616 - protein, 9 aa, Homo Sapiens
AVILASYAV

SEQ ID NO: 240617 - protein, 9 aa, Homo Sapiens
TKFEASRGW

SEQ ID NO: 240618 - protein, 9 aa, Homo Sapiens
LEVVSDKPL

SEQ ID NO: 240619 - protein, 9 aa, Homo Sapiens
NSRRQSQKF

SEQ ID NO: 240620 - protein, 9 aa, Homo Sapiens
WKNNHNLTS

SEQ ID NO: 240621 - protein, 9 aa, Homo Sapiens
VTQGMSHGE

SEQ ID NO: 240622 - protein, 9 aa, Homo Sapiens
SAAGLPRNE

SEQ ID NO: 240623 - protein, 9 aa, Homo Sapiens
CREYPCSGS

SEQ ID NO: 240624 - protein, 9 aa, Homo Sapiens
TYNLINEGS

SEQ ID NO: 240625 - protein, 9 aa, Homo Sapiens
ENLDKLMYN

SEQ ID NO: 240626 - protein, 9 aa, Homo Sapiens
NILRNSAGN

SEQ ID NO: 240627 - protein, 9 aa, Homo Sapiens
TSLQIAHMV

SEQ ID NO: 240628 - protein, 9 aa, Homo Sapiens
TKYQPEKWD

SEQ ID NO: 240629 - protein, 9 aa, Homo Sapiens
WERNITSHL

SEQ ID NO: 240630 - protein, 9 aa, Homo Sapiens
TTFTHLRFQ

SEQ ID NO: 240631 - protein, 9 aa, Homo Sapiens
FLDEGGHFK

SEQ ID NO: 240632 - protein, 9 aa, Homo Sapiens
LDKFFLVAG

SEQ ID NO: 240633 - protein, 9 aa, Homo Sapiens
AIDLSSDIR

SEQ ID NO: 240634 - protein, 9 aa, Homo Sapiens
QPTSYRPHL

SEQ ID NO: 240635 - protein, 9 aa, Homo Sapiens
SQTRLDRAQ

SEQ ID NO: 240636 - protein, 9 aa, Homo Sapiens
VSVKGAPES

SEQ ID NO: 240637 - protein, 9 aa, Homo Sapiens
QNSFNSAFR

SEQ ID NO: 240638 - protein, 9 aa, Homo Sapiens
FILMNKMGI

SEQ ID NO: 240639 - protein, 9 aa, Homo Sapiens
PVRADSMRN

SEQ ID NO: 240640 - protein, 9 aa, Homo Sapiens
DYIKRIMLR

SEQ ID NO: 240641 - protein, 9 aa, Homo Sapiens
VLKPKWRSD

SEQ ID NO: 240642 - protein, 9 aa, Homo Sapiens
ECTQFLTPL

SEQ ID NO: 240643 - protein, 9 aa, Homo Sapiens
DINDNVPRL

SEQ ID NO: 240644 - protein, 9 aa, Homo Sapiens
YNGSVLPCL

SEQ ID NO: 240645 - protein, 9 aa, Homo Sapiens
LKSLLEAKQ

SEQ ID NO: 240646 - protein, 9 aa, Homo Sapiens
HFLFGLANK

SEQ ID NO: 240647 - protein, 9 aa, Homo Sapiens
VFTLVVIAV

SEQ ID NO: 240648 - protein, 9 aa, Homo Sapiens
SRLTSSPPL

SEQ ID NO: 240649 - protein, 9 aa, Homo Sapiens
EGEVNCARY

SEQ ID NO: 240650 - protein, 9 aa, Homo Sapiens
YSLLTCKIT

SEQ ID NO: 240651 - protein, 9 aa, Homo Sapiens
PHENEYDNS

SEQ ID NO: 240652 - protein, 9 aa, Homo Sapiens
RQQLDLNNC

SEQ ID NO: 240653 - protein, 9 aa, Homo Sapiens
KIEAKEPEQ

SEQ ID NO: 240654 - protein, 9 aa, Homo Sapiens
DLHLKGPDV

SEQ ID NO: 240655 - protein, 9 aa, Homo Sapiens
IIQGAKLIW

SEQ ID NO: 240656 - protein, 9 aa, Homo Sapiens
AGCMIQTYL

SEQ ID NO: 240657 - protein, 9 aa, Homo Sapiens
GRYSDHGED

SEQ ID NO: 240658 - protein, 9 aa, Homo Sapiens
VKKGNQTKN

SEQ ID NO: 240659 - protein, 9 aa, Homo Sapiens
KMEDYFHCK

SEQ ID NO: 240660 - protein, 9 aa, Homo Sapiens
PNNYWDKCV

SEQ ID NO: 240661 - protein, 9 aa, Homo Sapiens
TLKNAIIIG

SEQ ID NO: 240662 - protein, 9 aa, Homo Sapiens
RKKLHDRLW

SEQ ID NO: 240663 - protein, 9 aa, Homo Sapiens
LVPDINLLD

SEQ ID NO: 240664 - protein, 9 aa, Homo Sapiens
IIHFLVIFP

SEQ ID NO: 240665 - protein, 9 aa, Homo Sapiens
LSNKKSISY

SEQ ID NO: 240666 - protein, 9 aa, Homo Sapiens
KRTKTLMEI

SEQ ID NO: 240667 - protein, 9 aa, Homo Sapiens
DIYKSELRK

SEQ ID NO: 240668 - protein, 9 aa, Homo Sapiens
GSSEFVQEA

SEQ ID NO: 240669 - protein, 9 aa, Homo Sapiens
QQLETQLRL

SEQ ID NO: 240670 - protein, 9 aa, Homo Sapiens
QTLNSSGAV

SEQ ID NO: 240671 - protein, 9 aa, Homo Sapiens
EDDLLGEYL

SEQ ID NO: 240672 - protein, 9 aa, Homo Sapiens
LLCHDPDLH

SEQ ID NO: 240673 - protein, 9 aa, Homo Sapiens
PRGNEVCRK

SEQ ID NO: 240674 - protein, 9 aa, Homo Sapiens
NYLANVFEK

SEQ ID NO: 240675 - protein, 9 aa, Homo Sapiens
LGAVATKVQ

SEQ ID NO: 240676 - protein, 9 aa, Homo Sapiens
LSRIIIGDH

SEQ ID NO: 240677 - protein, 9 aa, Homo Sapiens
RRRTTKLEH

SEQ ID NO: 240678 - protein, 9 aa, Homo Sapiens
FNERIEERN

SEQ ID NO: 240679 - protein, 9 aa, Homo Sapiens
GLEDGTLIV

SEQ ID NO: 240680 - protein, 9 aa, Homo Sapiens
ASEIMAYYS

SEQ ID NO: 240681 - protein, 9 aa, Homo Sapiens
CMVTVCAES

SEQ ID NO: 240682 - protein, 9 aa, Homo Sapiens
ISCTLARSY

SEQ ID NO: 240683 - protein, 9 aa, Homo Sapiens
NRYSHLTQH

SEQ ID NO: 240684 - protein, 9 aa, Homo Sapiens
MDQTLPLMQ

SEQ ID NO: 240685 - protein, 9 aa, Homo Sapiens
KEMQVRQRA

SEQ ID NO: 240686 - protein, 9 aa, Homo Sapiens
KQTKWKHYK

SEQ ID NO: 240687 - protein, 9 aa, Homo Sapiens
ILPFMKHGG

SEQ ID NO: 240688 - protein, 9 aa, Homo Sapiens
YFDAHTLAM

SEQ ID NO: 240689 - protein, 9 aa, Homo Sapiens
VDLFAVELL

SEQ ID NO: 240690 - protein, 9 aa, Homo Sapiens
NERKALKVL

SEQ ID NO: 240691 - protein, 9 aa, Homo Sapiens
MEDGNKQDT

SEQ ID NO: 240692 - protein, 9 aa, Homo Sapiens
IGANCDQIA

SEQ ID NO: 240693 - protein, 9 aa, Homo Sapiens
DYLGIVSFL

SEQ ID NO: 240694 - protein, 9 aa, Homo Sapiens
LQGKRKGQE

SEQ ID NO: 240695 - protein, 9 aa, Homo Sapiens
KGQDDYIYL

SEQ ID NO: 240696 - protein, 9 aa, Homo Sapiens
AQLDILIDQ

SEQ ID NO: 240697 - protein, 9 aa, Homo Sapiens
LRIAHGTEK

SEQ ID NO: 240698 - protein, 9 aa, Homo Sapiens
SSDDGRGFV

SEQ ID NO: 240699 - protein, 9 aa, Homo Sapiens
TATVNAMIA

SEQ ID NO: 240700 - protein, 9 aa, Homo Sapiens
KNAEALEEN

SEQ ID NO: 240701 - protein, 9 aa, Homo Sapiens
DGGIPNIDY

SEQ ID NO: 240702 - protein, 9 aa, Homo Sapiens
ATLVGGTTM

SEQ ID NO: 240703 - protein, 9 aa, Homo Sapiens
RHYGPGARF

SEQ ID NO: 240704 - protein, 9 aa, Homo Sapiens
FKGSLMTKV

SEQ ID NO: 240705 - protein, 9 aa, Homo Sapiens
EPEVDFNEM

SEQ ID NO: 240706 - protein, 9 aa, Homo Sapiens
FKFDQFKRR

SEQ ID NO: 240707 - protein, 9 aa, Homo Sapiens
RVETPEERE

SEQ ID NO: 240708 - protein, 9 aa, Homo Sapiens
ILDFQICGY

SEQ ID NO: 240709 - protein, 9 aa, Homo Sapiens
RTKTLMEIT

SEQ ID NO: 240710 - protein, 9 aa, Homo Sapiens
LLSLGLVAC

SEQ ID NO: 240711 - protein, 9 aa, Homo Sapiens
GDNETPSVV

SEQ ID NO: 240712 - protein, 9 aa, Homo Sapiens
FQLDGNKTC

SEQ ID NO: 240713 - protein, 9 aa, Homo Sapiens
ITHSINNII

SEQ ID NO: 240714 - protein, 9 aa, Homo Sapiens
FRHYGPGAR

SEQ ID NO: 240715 - protein, 9 aa, Homo Sapiens
FAYIAGLLG

SEQ ID NO: 240716 - protein, 9 aa, Homo Sapiens
LPEYKIFFV

SEQ ID NO: 240717 - protein, 9 aa, Homo Sapiens
DKEVGAVSV

SEQ ID NO: 240718 - protein, 9 aa, Homo Sapiens
IRELDSCLV

SEQ ID NO: 240719 - protein, 9 aa, Homo Sapiens
LIEVSRPGY

SEQ ID NO: 240720 - protein, 9 aa, Homo Sapiens
LDALRALPK

SEQ ID NO: 240721 - protein, 9 aa, Homo Sapiens
GDLIEVSRP

SEQ ID NO: 240722 - protein, 9 aa, Homo Sapiens
WGREKQDLT

SEQ ID NO: 240723 - protein, 9 aa, Homo Sapiens
MYGGVVLFS

SEQ ID NO: 240724 - protein, 9 aa, Homo Sapiens
GLRNCASDP

SEQ ID NO: 240725 - protein, 9 aa, Homo Sapiens
DINGLRRVP

SEQ ID NO: 240726 - protein, 9 aa, Homo Sapiens
MQSDNLCSY

SEQ ID NO: 240727 - protein, 9 aa, Homo Sapiens
FHCIWMPGQ

SEQ ID NO: 240728 - protein, 9 aa, Homo Sapiens
IGTGNAKQQ

SEQ ID NO: 240729 - protein, 9 aa, Homo Sapiens
FKDKASVNY

SEQ ID NO: 240730 - protein, 9 aa, Homo Sapiens
DTLESPFKY

SEQ ID NO: 240731 - protein, 9 aa, Homo Sapiens
TQDFFLIVK

SEQ ID NO: 240732 - protein, 9 aa, Homo Sapiens
ATRRGYFGR

SEQ ID NO: 240733 - protein, 9 aa, Homo Sapiens
RSKVELEVC

SEQ ID NO: 240734 - protein, 9 aa, Homo Sapiens
IFICKRPYV

SEQ ID NO: 240735 - protein, 9 aa, Homo Sapiens
QRLNINPDR

SEQ ID NO: 240736 - protein, 9 aa, Homo Sapiens
DEIARQQYR

SEQ ID NO: 240737 - protein, 9 aa, Homo Sapiens
FSSLRWYKQ

SEQ ID NO: 240738 - protein, 9 aa, Homo Sapiens
ELNTLLGRV

SEQ ID NO: 240739 - protein, 9 aa, Homo Sapiens
EVRKKFSKD

SEQ ID NO: 240740 - protein, 9 aa, Homo Sapiens
KSNDLTAAD

SEQ ID NO: 240741 - protein, 9 aa, Homo Sapiens
EYVKVLQEL

SEQ ID NO: 240742 - protein, 9 aa, Homo Sapiens
TTEAKRDDK

SEQ ID NO: 240743 - protein, 9 aa, Homo Sapiens
PSALQVLPD

SEQ ID NO: 240744 - protein, 9 aa, Homo Sapiens
ILHDALSLA

SEQ ID NO: 240745 - protein, 9 aa, Homo Sapiens
NVLKKIAEF

SEQ ID NO: 240746 - protein, 9 aa, Homo Sapiens
QTKIFEEHV

SEQ ID NO: 240747 - protein, 9 aa, Homo Sapiens
KVWGSIQGL

SEQ ID NO: 240748 - protein, 9 aa, Homo Sapiens
AEASGAPEK

SEQ ID NO: 240749 - protein, 9 aa, Homo Sapiens
IDLVVKELW

SEQ ID NO: 240750 - protein, 9 aa, Homo Sapiens
TLMEITVSL

SEQ ID NO: 240751 - protein, 9 aa, Homo Sapiens
QPGLHRFAV

SEQ ID NO: 240752 - protein, 9 aa, Homo Sapiens
TLIFGGHQG

SEQ ID NO: 240753 - protein, 9 aa, Homo Sapiens
PLTMTELSR

SEQ ID NO: 240754 - protein, 9 aa, Homo Sapiens
KLANLPYRT

SEQ ID NO: 240755 - protein, 9 aa, Homo Sapiens
ASTTGSRQS

SEQ ID NO: 240756 - protein, 9 aa, Homo Sapiens
MPQERIEAS

SEQ ID NO: 240757 - protein, 9 aa, Homo Sapiens
VPEKPNKVK

SEQ ID NO: 240758 - protein, 9 aa, Homo Sapiens
NDSSSEVKR

SEQ ID NO: 240759 - protein, 9 aa, Homo Sapiens
ATTYVSDWW

SEQ ID NO: 240760 - protein, 9 aa, Homo Sapiens
LSQTAGFSP

SEQ ID NO: 240761 - protein, 9 aa, Homo Sapiens
SKSSKLNYK

SEQ ID NO: 240762 - protein, 9 aa, Homo Sapiens
RDVAIELSL

SEQ ID NO: 240763 - protein, 9 aa, Homo Sapiens
YVSAFANTG

SEQ ID NO: 240764 - protein, 9 aa, Homo Sapiens
HFCPPNHWL

SEQ ID NO: 240765 - protein, 9 aa, Homo Sapiens
KQTIEFNKM

SEQ ID NO: 240766 - protein, 9 aa, Homo Sapiens
LLHCSLQRL

SEQ ID NO: 240767 - protein, 9 aa, Homo Sapiens
SVKGIIYSI

SEQ ID NO: 240768 - protein, 9 aa, Homo Sapiens
EQYLYVRLI

SEQ ID NO: 240769 - protein, 9 aa, Homo Sapiens
TVTTDGSII

SEQ ID NO: 240770 - protein, 9 aa, Homo Sapiens
EEEEGEGGS

SEQ ID NO: 240771 - protein, 9 aa, Homo Sapiens
SVVYVATLL

SEQ ID NO: 240772 - protein, 9 aa, Homo Sapiens
DGGLMAQEA

SEQ ID NO: 240773 - protein, 9 aa, Homo Sapiens
SLLINSRRM

SEQ ID NO: 240774 - protein, 9 aa, Homo Sapiens
RPVQIEKEL

SEQ ID NO: 240775 - protein, 9 aa, Homo Sapiens
NPLSISCLF

SEQ ID NO: 240776 - protein, 9 aa, Homo Sapiens
FKRCIRTAA

SEQ ID NO: 240777 - protein, 9 aa, Homo Sapiens
ADFDGVVGM

SEQ ID NO: 240778 - protein, 9 aa, Homo Sapiens
FPQSLPKYL

SEQ ID NO: 240779 - protein, 9 aa, Homo Sapiens
DSLEKEASD

SEQ ID NO: 240780 - protein, 9 aa, Homo Sapiens
ILLTNVLCT

SEQ ID NO: 240781 - protein, 9 aa, Homo Sapiens
CVGTVGTPV

SEQ ID NO: 240782 - protein, 9 aa, Homo Sapiens
RTVSTVLPQ

SEQ ID NO: 240783 - protein, 9 aa, Homo Sapiens
ECTKEELSI

SEQ ID NO: 240784 - protein, 9 aa, Homo Sapiens
SHLEEGIRF

SEQ ID NO: 240785 - protein, 9 aa, Homo Sapiens
HIPYCQPRA

SEQ ID NO: 240786 - protein, 9 aa, Homo Sapiens
HRSRLRVPL

SEQ ID NO: 240787 - protein, 9 aa, Homo Sapiens
KLLFKKNIL

SEQ ID NO: 240788 - protein, 9 aa, Homo Sapiens
IVIKYKYYF

SEQ ID NO: 240789 - protein, 9 aa, Homo Sapiens
TQIQKLDDQ

SEQ ID NO: 240790 - protein, 9 aa, Homo Sapiens
SLQNSFNSA

SEQ ID NO: 240791 - protein, 9 aa, Homo Sapiens
QLAQIQVQI

SEQ ID NO: 240792 - protein, 9 aa, Homo Sapiens
VLPINVGVL

SEQ ID NO: 240793 - protein, 9 aa, Homo Sapiens
IDNIKINHN

SEQ ID NO: 240794 - protein, 9 aa, Homo Sapiens
AADPQALTV

SEQ ID NO: 240795 - protein, 9 aa, Homo Sapiens
KENVKMATD

SEQ ID NO: 240796 - protein, 9 aa, Homo Sapiens
QVLGQPHNK

SEQ ID NO: 240797 - protein, 9 aa, Homo Sapiens
LKRFRQADE

SEQ ID NO: 240798 - protein, 9 aa, Homo Sapiens
LFKVDYSQF

SEQ ID NO: 240799 - protein, 9 aa, Homo Sapiens
LKIFRQEGD

SEQ ID NO: 240800 - protein, 9 aa, Homo Sapiens
YYHNKILKG

SEQ ID NO: 240801 - protein, 9 aa, Homo Sapiens
STATEEKLV

SEQ ID NO: 240802 - protein, 9 aa, Homo Sapiens
FQTVTFKGP

SEQ ID NO: 240803 - protein, 9 aa, Homo Sapiens
DHRSSSYHS

SEQ ID NO: 240804 - protein, 9 aa, Homo Sapiens
YYMMFKVME

SEQ ID NO: 240805 - protein, 9 aa, Homo Sapiens
IDISIIDDN

SEQ ID NO: 240806 - protein, 9 aa, Homo Sapiens
KYFQMDFGH

SEQ ID NO: 240807 - protein, 9 aa, Homo Sapiens
EIKPFPKIT

SEQ ID NO: 240808 - protein, 9 aa, Homo Sapiens
NKGNKTQEK

SEQ ID NO: 240809 - protein, 9 aa, Homo Sapiens
GERLTPQEI

SEQ ID NO: 240810 - protein, 9 aa, Homo Sapiens
NFEPVVQMP

SEQ ID NO: 240811 - protein, 9 aa, Homo Sapiens
TVVVYMPDV

SEQ ID NO: 240812 - protein, 9 aa, Homo Sapiens
KSEDKTLAE

SEQ ID NO: 240813 - protein, 9 aa, Homo Sapiens
SVSSEFIVN

SEQ ID NO: 240814 - protein, 9 aa, Homo Sapiens
QVWFQKHWA

SEQ ID NO: 240815 - protein, 9 aa, Homo Sapiens
NWSDSDSST

SEQ ID NO: 240816 - protein, 9 aa, Homo Sapiens
GKTFQTQAS

SEQ ID NO: 240817 - protein, 9 aa, Homo Sapiens
ILQNDLVDA

SEQ ID NO: 240818 - protein, 9 aa, Homo Sapiens
YLTNKNENY

SEQ ID NO: 240819 - protein, 9 aa, Homo Sapiens
PESFVKVLM

SEQ ID NO: 240820 - protein, 9 aa, Homo Sapiens
GTFYGEENA

SEQ ID NO: 240821 - protein, 9 aa, Homo Sapiens
NQHTFHLEA

SEQ ID NO: 240822 - protein, 9 aa, Homo Sapiens
CISCKTETH

SEQ ID NO: 240823 - protein, 9 aa, Homo Sapiens
GKGKKNEGL

SEQ ID NO: 240824 - protein, 9 aa, Homo Sapiens
ALILATQKQ

SEQ ID NO: 240825 - protein, 9 aa, Homo Sapiens
TMEFGKTNF

SEQ ID NO: 240826 - protein, 9 aa, Homo Sapiens
AKEYIKPHV

SEQ ID NO: 240827 - protein, 9 aa, Homo Sapiens
EELIHKKRI

SEQ ID NO: 240828 - protein, 9 aa, Homo Sapiens
HSWADDGKA

SEQ ID NO: 240829 - protein, 9 aa, Homo Sapiens
KAIQDKDRA

SEQ ID NO: 240830 - protein, 9 aa, Homo Sapiens
GRHDTAFVE

SEQ ID NO: 240831 - protein, 9 aa, Homo Sapiens
LYLDNNQIK

SEQ ID NO: 240832 - protein, 9 aa, Homo Sapiens
EPMLCSELV

SEQ ID NO: 240833 - protein, 9 aa, Homo Sapiens
GCDHDYVYL

SEQ ID NO: 240834 - protein, 9 aa, Homo Sapiens
KDKDILRLR

SEQ ID NO: 240835 - protein, 9 aa, Homo Sapiens
CKLDKTQRK

SEQ ID NO: 240836 - protein, 9 aa, Homo Sapiens
FTRENSEKI

SEQ ID NO: 240837 - protein, 9 aa, Homo Sapiens
QTSHTRHIC

SEQ ID NO: 240838 - protein, 9 aa, Homo Sapiens
ASRPNFLAT

SEQ ID NO: 240839 - protein, 9 aa, Homo Sapiens
TEGSDITTV

SEQ ID NO: 240840 - protein, 9 aa, Homo Sapiens
SKHNRNEEQ

SEQ ID NO: 240841 - protein, 9 aa, Homo Sapiens
AYNVTSKGA

SEQ ID NO: 240842 - protein, 9 aa, Homo Sapiens
QAKKMNISL

SEQ ID NO: 240843 - protein, 9 aa, Homo Sapiens
FPSRFQPFR

SEQ ID NO: 240844 - protein, 9 aa, Homo Sapiens
GVSFHIGSD

SEQ ID NO: 240845 - protein, 9 aa, Homo Sapiens
RICVSHTEV

SEQ ID NO: 240846 - protein, 9 aa, Homo Sapiens
CTFGFYEVF

SEQ ID NO: 240847 - protein, 9 aa, Homo Sapiens
RAFNYYPQN

SEQ ID NO: 240848 - protein, 9 aa, Homo Sapiens
SQGLGRLVW

SEQ ID NO: 240849 - protein, 9 aa, Homo Sapiens
LVKELVTFK

SEQ ID NO: 240850 - protein, 9 aa, Homo Sapiens
LLEVTNGTN

SEQ ID NO: 240851 - protein, 9 aa, Homo Sapiens
VCLYIICAV

SEQ ID NO: 240852 - protein, 9 aa, Homo Sapiens
CKDSLDNMT

SEQ ID NO: 240853 - protein, 9 aa, Homo Sapiens
PSYVSQTRI

SEQ ID NO: 240854 - protein, 9 aa, Homo Sapiens
SAHNAANQG

SEQ ID NO: 240855 - protein, 9 aa, Homo Sapiens
ITPQKNVQG

SEQ ID NO: 240856 - protein, 9 aa, Homo Sapiens
ELEEAIRIS

SEQ ID NO: 240857 - protein, 9 aa, Homo Sapiens
TMASESKFI

SEQ ID NO: 240858 - protein, 9 aa, Homo Sapiens
EETADLTLC

SEQ ID NO: 240859 - protein, 9 aa, Homo Sapiens
HKRKGLPCD

SEQ ID NO: 240860 - protein, 9 aa, Homo Sapiens
HVARITGAC

SEQ ID NO: 240861 - protein, 9 aa, Homo Sapiens
KSFDSVLKP

SEQ ID NO: 240862 - protein, 9 aa, Homo Sapiens
PALDPTDCG

SEQ ID NO: 240863 - protein, 9 aa, Homo Sapiens
KKESFELMQ

SEQ ID NO: 240864 - protein, 9 aa, Homo Sapiens
ENVFLQATN

SEQ ID NO: 240865 - protein, 9 aa, Homo Sapiens
NVDGEEVAM

SEQ ID NO: 240866 - protein, 9 aa, Homo Sapiens
SRGMFIAIV

SEQ ID NO: 240867 - protein, 9 aa, Homo Sapiens
INQSIKDTF

SEQ ID NO: 240868 - protein, 9 aa, Homo Sapiens
APNTLHLEI

SEQ ID NO: 240869 - protein, 9 aa, Homo Sapiens
PEGQFTQLI

SEQ ID NO: 240870 - protein, 9 aa, Homo Sapiens
LLTNVLCTL

SEQ ID NO: 240871 - protein, 9 aa, Homo Sapiens
NYSSSRTLF

SEQ ID NO: 240872 - protein, 9 aa, Homo Sapiens
TDPYTISTL

SEQ ID NO: 240873 - protein, 9 aa, Homo Sapiens
AVEDKPSQI

SEQ ID NO: 240874 - protein, 9 aa, Homo Sapiens
AFELIVFSQ

SEQ ID NO: 240875 - protein, 9 aa, Homo Sapiens
QRAKAYLGE

SEQ ID NO: 240876 - protein, 9 aa, Homo Sapiens
YNKFFDYYS

SEQ ID NO: 240877 - protein, 9 aa, Homo Sapiens
RLQTLGLKG

SEQ ID NO: 240878 - protein, 9 aa, Homo Sapiens
KALKVLGIV

SEQ ID NO: 240879 - protein, 9 aa, Homo Sapiens
KYMLESEDR

SEQ ID NO: 240880 - protein, 9 aa, Homo Sapiens
HLPGSKRWP

SEQ ID NO: 240881 - protein, 9 aa, Homo Sapiens
KYLDDRYKM

SEQ ID NO: 240882 - protein, 9 aa, Homo Sapiens
LSGDVPVMD

SEQ ID NO: 240883 - protein, 9 aa, Homo Sapiens
RTLLTYVKG

SEQ ID NO: 240884 - protein, 9 aa, Homo Sapiens
SLKHLVDGA

SEQ ID NO: 240885 - protein, 9 aa, Homo Sapiens
LDDSSSFCL

SEQ ID NO: 240886 - protein, 9 aa, Homo Sapiens
KQRLFATKP

SEQ ID NO: 240887 - protein, 9 aa, Homo Sapiens
KEKPNEIPT

SEQ ID NO: 240888 - protein, 9 aa, Homo Sapiens
PSNMNAFMV

SEQ ID NO: 240889 - protein, 9 aa, Homo Sapiens
VSDKPLSER

SEQ ID NO: 240890 - protein, 9 aa, Homo Sapiens
EGAPDPQRC

SEQ ID NO: 240891 - protein, 9 aa, Homo Sapiens
HKYFPGVKL

SEQ ID NO: 240892 - protein, 9 aa, Homo Sapiens
EGRRGVTQI

SEQ ID NO: 240893 - protein, 9 aa, Homo Sapiens
VGGKYVNLQ

SEQ ID NO: 240894 - protein, 9 aa, Homo Sapiens
YKSSCKPST

SEQ ID NO: 240895 - protein, 9 aa, Homo Sapiens
RMLASSCCS

SEQ ID NO: 240896 - protein, 9 aa, Homo Sapiens
LWVESDNYF

SEQ ID NO: 240897 - protein, 9 aa, Homo Sapiens
RLTGINDKM

SEQ ID NO: 240898 - protein, 9 aa, Homo Sapiens
GPNHIQHVF

SEQ ID NO: 240899 - protein, 9 aa, Homo Sapiens
YPQQNYTYN

SEQ ID NO: 240900 - protein, 9 aa, Homo Sapiens
NDNVPRLLT

SEQ ID NO: 240901 - protein, 9 aa, Homo Sapiens
GEEEPPVAS

SEQ ID NO: 240902 - protein, 9 aa, Homo Sapiens
VLRAEHHGL

SEQ ID NO: 240903 - protein, 9 aa, Homo Sapiens
FQNKIISNI

SEQ ID NO: 240904 - protein, 9 aa, Homo Sapiens
KQLRHPKYN

SEQ ID NO: 240905 - protein, 9 aa, Homo Sapiens
KLLESDDDK

SEQ ID NO: 240906 - protein, 9 aa, Homo Sapiens
LTKHKTRHT

SEQ ID NO: 240907 - protein, 9 aa, Homo Sapiens
LQKKDFLEP

SEQ ID NO: 240908 - protein, 9 aa, Homo Sapiens
GVCLLLNHF

SEQ ID NO: 240909 - protein, 9 aa, Homo Sapiens
RLRSSKKRT

SEQ ID NO: 240910 - protein, 9 aa, Homo Sapiens
SDTEEVFRG

SEQ ID NO: 240911 - protein, 9 aa, Homo Sapiens
HYQYTVFLR

SEQ ID NO: 240912 - protein, 9 aa, Homo Sapiens
GIYVMTVTA

SEQ ID NO: 240913 - protein, 9 aa, Homo Sapiens
VSGTDEERP

SEQ ID NO: 240914 - protein, 9 aa, Homo Sapiens
EIDAALGFK

SEQ ID NO: 240915 - protein, 9 aa, Homo Sapiens
QTSAVLQDS

SEQ ID NO: 240916 - protein, 9 aa, Homo Sapiens
FLVIEASLA

SEQ ID NO: 240917 - protein, 9 aa, Homo Sapiens
GAFMFVAWM

SEQ ID NO: 240918 - protein, 9 aa, Homo Sapiens
FHNPASLES

SEQ ID NO: 240919 - protein, 9 aa, Homo Sapiens
LLGPSQNNL

SEQ ID NO: 240920 - protein, 9 aa, Homo Sapiens
IMNQVNSQK

SEQ ID NO: 240921 - protein, 9 aa, Homo Sapiens
GEKELAEVK

SEQ ID NO: 240922 - protein, 9 aa, Homo Sapiens
GYDCGYDRY

SEQ ID NO: 240923 - protein, 9 aa, Homo Sapiens
EMLDLEKQL

SEQ ID NO: 240924 - protein, 9 aa, Homo Sapiens
SECGNAFIH

SEQ ID NO: 240925 - protein, 9 aa, Homo Sapiens
IRRGPISMT

SEQ ID NO: 240926 - protein, 9 aa, Homo Sapiens
NNSSEISSE

SEQ ID NO: 240927 - protein, 9 aa, Homo Sapiens
THKIIHTGD

SEQ ID NO: 240928 - protein, 9 aa, Homo Sapiens
TRVHPDGGL

SEQ ID NO: 240929 - protein, 9 aa, Homo Sapiens
NPYYNQAYL

SEQ ID NO: 240930 - protein, 9 aa, Homo Sapiens
SKREHWFRF

SEQ ID NO: 240931 - protein, 9 aa, Homo Sapiens
QSSSVDSLP

SEQ ID NO: 240932 - protein, 9 aa, Homo Sapiens
DILGIPSDT

SEQ ID NO: 240933 - protein, 9 aa, Homo Sapiens
AAAAGGVVL

SEQ ID NO: 240934 - protein, 9 aa, Homo Sapiens
YLVQIRQKK

SEQ ID NO: 240935 - protein, 9 aa, Homo Sapiens
SSGVRLNQD

SEQ ID NO: 240936 - protein, 9 aa, Homo Sapiens
LKHICRFLD

SEQ ID NO: 240937 - protein, 9 aa, Homo Sapiens
DTEHSDIYL

SEQ ID NO: 240938 - protein, 9 aa, Homo Sapiens
AAEHGNIPV

SEQ ID NO: 240939 - protein, 9 aa, Homo Sapiens
YEGDESVRE

SEQ ID NO: 240940 - protein, 9 aa, Homo Sapiens
EIQAQNFLS

SEQ ID NO: 240941 - protein, 9 aa, Homo Sapiens
LSSDYPVKT

SEQ ID NO: 240942 - protein, 9 aa, Homo Sapiens
VPYSHPELF

SEQ ID NO: 240943 - protein, 9 aa, Homo Sapiens
DFETDVADD

SEQ ID NO: 240944 - protein, 9 aa, Homo Sapiens
PAFEEFLDR

SEQ ID NO: 240945 - protein, 9 aa, Homo Sapiens
LGARRKIFL

SEQ ID NO: 240946 - protein, 9 aa, Homo Sapiens
MTPGFIDKT

SEQ ID NO: 240947 - protein, 9 aa, Homo Sapiens
EDSEQWDNI

SEQ ID NO: 240948 - protein, 9 aa, Homo Sapiens
EHHGTSQDK

SEQ ID NO: 240949 - protein, 9 aa, Homo Sapiens
CDVAFEWKT

SEQ ID NO: 240950 - protein, 9 aa, Homo Sapiens
CIENPKHLN

SEQ ID NO: 240951 - protein, 9 aa, Homo Sapiens
PCILIYLRA

SEQ ID NO: 240952 - protein, 9 aa, Homo Sapiens
STRQVEKEE

SEQ ID NO: 240953 - protein, 9 aa, Homo Sapiens
KSARAVTVL

SEQ ID NO: 240954 - protein, 9 aa, Homo Sapiens
DLRDELLVK

SEQ ID NO: 240955 - protein, 9 aa, Homo Sapiens
GKDIFKPIQ

SEQ ID NO: 240956 - protein, 9 aa, Homo Sapiens
LQLNLTKIK

SEQ ID NO: 240957 - protein, 9 aa, Homo Sapiens
TFSPGAQSQ

SEQ ID NO: 240958 - protein, 9 aa, Homo Sapiens
LEQNIRCLE

SEQ ID NO: 240959 - protein, 9 aa, Homo Sapiens
YQSHQSLVA

SEQ ID NO: 240960 - protein, 9 aa, Homo Sapiens
FKDKERTRV

SEQ ID NO: 240961 - protein, 9 aa, Homo Sapiens
DGALLDEDV

SEQ ID NO: 240962 - protein, 9 aa, Homo Sapiens
IIEDYANYK

SEQ ID NO: 240963 - protein, 9 aa, Homo Sapiens
GDKLSRADI

SEQ ID NO: 240964 - protein, 9 aa, Homo Sapiens
NIYGGSQGL

SEQ ID NO: 240965 - protein, 9 aa, Homo Sapiens
KRYLQAGKL

SEQ ID NO: 240966 - protein, 9 aa, Homo Sapiens
SSSDSDPHE

SEQ ID NO: 240967 - protein, 9 aa, Homo Sapiens
FSTENDMER

SEQ ID NO: 240968 - protein, 9 aa, Homo Sapiens
QEKNWLDIF

SEQ ID NO: 240969 - protein, 9 aa, Homo Sapiens
CIAFYRYAI

SEQ ID NO: 240970 - protein, 9 aa, Homo Sapiens
HNPLRYSYI

SEQ ID NO: 240971 - protein, 9 aa, Homo Sapiens
SCLFCGRFS

SEQ ID NO: 240972 - protein, 9 aa, Homo Sapiens
VQLDLTGIS

SEQ ID NO: 240973 - protein, 9 aa, Homo Sapiens
NLETALRRL

SEQ ID NO: 240974 - protein, 9 aa, Homo Sapiens
MAIPPRDTA

SEQ ID NO: 240975 - protein, 9 aa, Homo Sapiens
AQDNPMNPN

SEQ ID NO: 240976 - protein, 9 aa, Homo Sapiens
EEKPKVFIL

SEQ ID NO: 240977 - protein, 9 aa, Homo Sapiens
GRYHRGGYK

SEQ ID NO: 240978 - protein, 9 aa, Homo Sapiens
NPQSDKGAL

SEQ ID NO: 240979 - protein, 9 aa, Homo Sapiens
RGKRNGKNH

SEQ ID NO: 240980 - protein, 9 aa, Homo Sapiens
LSYYTIVTS

SEQ ID NO: 240981 - protein, 9 aa, Homo Sapiens
HQTQMKGVL

SEQ ID NO: 240982 - protein, 9 aa, Homo Sapiens
QAQSIGAQK

SEQ ID NO: 240983 - protein, 9 aa, Homo Sapiens
SLSQLWRLN

SEQ ID NO: 240984 - protein, 9 aa, Homo Sapiens
PLDNLELTY

SEQ ID NO: 240985 - protein, 9 aa, Homo Sapiens
QQQLSSSAA

SEQ ID NO: 240986 - protein, 9 aa, Homo Sapiens
TNLVTGSPR

SEQ ID NO: 240987 - protein, 9 aa, Homo Sapiens
SNKRNISFS

SEQ ID NO: 240988 - protein, 9 aa, Homo Sapiens
INPGAHFMT

SEQ ID NO: 240989 - protein, 9 aa, Homo Sapiens
PWIHELPVG

SEQ ID NO: 240990 - protein, 9 aa, Homo Sapiens
PAKPTVEEL

SEQ ID NO: 240991 - protein, 9 aa, Homo Sapiens
YQIRKRGNR

SEQ ID NO: 240992 - protein, 9 aa, Homo Sapiens
MKANSGYKW

SEQ ID NO: 240993 - protein, 9 aa, Homo Sapiens
EFDMIRGKL

SEQ ID NO: 240994 - protein, 9 aa, Homo Sapiens
IVPVFSLQL

SEQ ID NO: 240995 - protein, 9 aa, Homo Sapiens
YELQYVQRP

SEQ ID NO: 240996 - protein, 9 aa, Homo Sapiens
NECGQSFSY

SEQ ID NO: 240997 - protein, 9 aa, Homo Sapiens
VYGGNCFNC

SEQ ID NO: 240998 - protein, 9 aa, Homo Sapiens
ALPKASLFD

SEQ ID NO: 240999 - protein, 9 aa, Homo Sapiens
GADSEIMFA

SEQ ID NO: 241000 - protein, 9 aa, Homo Sapiens
EDVHHQILA

SEQ ID NO: 241001 - protein, 9 aa, Homo Sapiens
LVSQLDCLN

SEQ ID NO: 241002 - protein, 9 aa, Homo Sapiens
PQSECSGAS

SEQ ID NO: 241003 - protein, 9 aa, Homo Sapiens
DFVPILKDF

SEQ ID NO: 241004 - protein, 9 aa, Homo Sapiens
FGHIKGWLR

SEQ ID NO: 241005 - protein, 9 aa, Homo Sapiens
QWRNVGPNT

SEQ ID NO: 241006 - protein, 9 aa, Homo Sapiens
WPVKIIGEY

SEQ ID NO: 241007 - protein, 9 aa, Homo Sapiens
IETSLRESK

SEQ ID NO: 241008 - protein, 9 aa, Homo Sapiens
EVEIRKQVL

SEQ ID NO: 241009 - protein, 9 aa, Homo Sapiens
QHPYLHRHL

SEQ ID NO: 241010 - protein, 9 aa, Homo Sapiens
QQQENLARN

SEQ ID NO: 241011 - protein, 9 aa, Homo Sapiens
TISNKQRAS

SEQ ID NO: 241012 - protein, 9 aa, Homo Sapiens
GIIFSHNSP

SEQ ID NO: 241013 - protein, 9 aa, Homo Sapiens
RNVTVIPNS

SEQ ID NO: 241014 - protein, 9 aa, Homo Sapiens
LEYFYLNHF

SEQ ID NO: 241015 - protein, 9 aa, Homo Sapiens
FCETNLDTY

SEQ ID NO: 241016 - protein, 9 aa, Homo Sapiens
TITCVQPLG

SEQ ID NO: 241017 - protein, 9 aa, Homo Sapiens
LDREELCDP

SEQ ID NO: 241018 - protein, 9 aa, Homo Sapiens
PEEYIKQRG

SEQ ID NO: 241019 - protein, 9 aa, Homo Sapiens
DRRRTALRP

SEQ ID NO: 241020 - protein, 9 aa, Homo Sapiens
HKLEEFRAK

SEQ ID NO: 241021 - protein, 9 aa, Homo Sapiens
QKIEIRAQV

SEQ ID NO: 241022 - protein, 9 aa, Homo Sapiens
AGTAPKSSP

SEQ ID NO: 241023 - protein, 9 aa, Homo Sapiens
QPSTRKAQA

SEQ ID NO: 241024 - protein, 9 aa, Homo Sapiens
VDSDGDGKI

SEQ ID NO: 241025 - protein, 9 aa, Homo Sapiens
SNLYALHWY

SEQ ID NO: 241026 - protein, 9 aa, Homo Sapiens
LRRIFERLR

SEQ ID NO: 241027 - protein, 9 aa, Homo Sapiens
VDKITQFWL

SEQ ID NO: 241028 - protein, 9 aa, Homo Sapiens
NISFNFSEI

SEQ ID NO: 241029 - protein, 9 aa, Homo Sapiens
LGTPLPPGW

SEQ ID NO: 241030 - protein, 9 aa, Homo Sapiens
EKHFYVVTA

SEQ ID NO: 241031 - protein, 9 aa, Homo Sapiens
TLIIHMRIH

SEQ ID NO: 241032 - protein, 9 aa, Homo Sapiens
NLTRVTKFI

SEQ ID NO: 241033 - protein, 9 aa, Homo Sapiens
HAFKEGKDE

SEQ ID NO: 241034 - protein, 9 aa, Homo Sapiens
LSTLFNVGG

SEQ ID NO: 241035 - protein, 9 aa, Homo Sapiens
NIYKEFYRS

SEQ ID NO: 241036 - protein, 9 aa, Homo Sapiens
HPILKILTT

SEQ ID NO: 241037 - protein, 9 aa, Homo Sapiens
PDTNQDDAD

SEQ ID NO: 241038 - protein, 9 aa, Homo Sapiens
SNKSYVHSA

SEQ ID NO: 241039 - protein, 9 aa, Homo Sapiens
LRNSNLVAR

SEQ ID NO: 241040 - protein, 9 aa, Homo Sapiens
LNVLRLVQS

SEQ ID NO: 241041 - protein, 9 aa, Homo Sapiens
KQKCRDSYQ

SEQ ID NO: 241042 - protein, 9 aa, Homo Sapiens
ELEELRQIV

SEQ ID NO: 241043 - protein, 9 aa, Homo Sapiens
RGPLDSTAI

SEQ ID NO: 241044 - protein, 9 aa, Homo Sapiens
YGELLGTLS

SEQ ID NO: 241045 - protein, 9 aa, Homo Sapiens
WDEVLQLIQ

SEQ ID NO: 241046 - protein, 9 aa, Homo Sapiens
DEEDIGAGD

SEQ ID NO: 241047 - protein, 9 aa, Homo Sapiens
KDKEKEKIP

SEQ ID NO: 241048 - protein, 9 aa, Homo Sapiens
FVKMLPVNL

SEQ ID NO: 241049 - protein, 9 aa, Homo Sapiens
KEVARYQHQ

SEQ ID NO: 241050 - protein, 9 aa, Homo Sapiens
QRYLYFKDS

SEQ ID NO: 241051 - protein, 9 aa, Homo Sapiens
GEDDKPHDI

SEQ ID NO: 241052 - protein, 9 aa, Homo Sapiens
LAQTCGTQP

SEQ ID NO: 241053 - protein, 9 aa, Homo Sapiens
ERFVFMATP

SEQ ID NO: 241054 - protein, 9 aa, Homo Sapiens
KYVEYFWWP

SEQ ID NO: 241055 - protein, 9 aa, Homo Sapiens
HEGRPLCDN

SEQ ID NO: 241056 - protein, 9 aa, Homo Sapiens
GYSFLILFL

SEQ ID NO: 241057 - protein, 9 aa, Homo Sapiens
WADPDNLSE

SEQ ID NO: 241058 - protein, 9 aa, Homo Sapiens
HLIKHVQTV

SEQ ID NO: 241059 - protein, 9 aa, Homo Sapiens
VPPLYYLVF

SEQ ID NO: 241060 - protein, 9 aa, Homo Sapiens
LNAIYVKPA

SEQ ID NO: 241061 - protein, 9 aa, Homo Sapiens
VVFTDEELG

SEQ ID NO: 241062 - protein, 9 aa, Homo Sapiens
KLFIKEVDM

SEQ ID NO: 241063 - protein, 9 aa, Homo Sapiens
FIVDSCDEL

SEQ ID NO: 241064 - protein, 9 aa, Homo Sapiens
LAYIDNAGN

SEQ ID NO: 241065 - protein, 9 aa, Homo Sapiens
LNTQENDIP

SEQ ID NO: 241066 - protein, 9 aa, Homo Sapiens
VAILMTIVL

SEQ ID NO: 241067 - protein, 9 aa, Homo Sapiens
LLALSSAHN

SEQ ID NO: 241068 - protein, 9 aa, Homo Sapiens
WRGEVFWDD

SEQ ID NO: 241069 - protein, 9 aa, Homo Sapiens
ENHHDKLSV

SEQ ID NO: 241070 - protein, 9 aa, Homo Sapiens
TANNCFELW

SEQ ID NO: 241071 - protein, 9 aa, Homo Sapiens
LQRRDNTLY

SEQ ID NO: 241072 - protein, 9 aa, Homo Sapiens
SSAHNLNED

SEQ ID NO: 241073 - protein, 9 aa, Homo Sapiens
LQMQKRVLG

SEQ ID NO: 241074 - protein, 9 aa, Homo Sapiens
ADSRDTVRL

SEQ ID NO: 241075 - protein, 9 aa, Homo Sapiens
RGYFGRSQF

SEQ ID NO: 241076 - protein, 9 aa, Homo Sapiens
CLVRYIYYG

SEQ ID NO: 241077 - protein, 9 aa, Homo Sapiens
ITVFGLGIG

SEQ ID NO: 241078 - protein, 9 aa, Homo Sapiens
LYFVILCEN

SEQ ID NO: 241079 - protein, 9 aa, Homo Sapiens
FCRVRFDNV

SEQ ID NO: 241080 - protein, 9 aa, Homo Sapiens
LEYHEGCTW

SEQ ID NO: 241081 - protein, 9 aa, Homo Sapiens
TKVHIQALQ

SEQ ID NO: 241082 - protein, 9 aa, Homo Sapiens
TGPRTESKG

SEQ ID NO: 241083 - protein, 9 aa, Homo Sapiens
SQSCSSYEL

SEQ ID NO: 241084 - protein, 9 aa, Homo Sapiens
PNNSSVSTL

SEQ ID NO: 241085 - protein, 9 aa, Homo Sapiens
YASDNVNKL

SEQ ID NO: 241086 - protein, 9 aa, Homo Sapiens
CRASNYPKR

SEQ ID NO: 241087 - protein, 9 aa, Homo Sapiens
TNVFVTLLA

SEQ ID NO: 241088 - protein, 9 aa, Homo Sapiens
IAGQAMEIG

SEQ ID NO: 241089 - protein, 9 aa, Homo Sapiens
SPVDSALST

SEQ ID NO: 241090 - protein, 9 aa, Homo Sapiens
CLLCLQDPN

SEQ ID NO: 241091 - protein, 9 aa, Homo Sapiens
QIQQEVDEE

SEQ ID NO: 241092 - protein, 9 aa, Homo Sapiens
EQEMMDNLF

SEQ ID NO: 241093 - protein, 9 aa, Homo Sapiens
SLSRNTSFR

SEQ ID NO: 241094 - protein, 9 aa, Homo Sapiens
VYIPQVMIE

SEQ ID NO: 241095 - protein, 9 aa, Homo Sapiens
IYEDFSTFL

SEQ ID NO: 241096 - protein, 9 aa, Homo Sapiens
DDENSILYH

SEQ ID NO: 241097 - protein, 9 aa, Homo Sapiens
GNKSFQRSE

SEQ ID NO: 241098 - protein, 9 aa, Homo Sapiens
VFRMYEVKG

SEQ ID NO: 241099 - protein, 9 aa, Homo Sapiens
LLVGIIEEL

SEQ ID NO: 241100 - protein, 9 aa, Homo Sapiens
TNPSKMRKF

SEQ ID NO: 241101 - protein, 9 aa, Homo Sapiens
LFSISADPW

SEQ ID NO: 241102 - protein, 9 aa, Homo Sapiens
FSIHKTQCA

SEQ ID NO: 241103 - protein, 9 aa, Homo Sapiens
HFVSDHSSI

SEQ ID NO: 241104 - protein, 9 aa, Homo Sapiens
QPTTDISTD

SEQ ID NO: 241105 - protein, 9 aa, Homo Sapiens
YRLTHAEII

SEQ ID NO: 241106 - protein, 9 aa, Homo Sapiens
ETKNLCFLE

SEQ ID NO: 241107 - protein, 9 aa, Homo Sapiens
LHFIMDSYS

SEQ ID NO: 241108 - protein, 9 aa, Homo Sapiens
KWLPSGMKG

SEQ ID NO: 241109 - protein, 9 aa, Homo Sapiens
SQLAGRKLS

SEQ ID NO: 241110 - protein, 9 aa, Homo Sapiens
VSGDRIHCI

SEQ ID NO: 241111 - protein, 9 aa, Homo Sapiens
WPMQSRLYA

SEQ ID NO: 241112 - protein, 9 aa, Homo Sapiens
CSYQLTLHQ

SEQ ID NO: 241113 - protein, 9 aa, Homo Sapiens
YKEAFDKMK

SEQ ID NO: 241114 - protein, 9 aa, Homo Sapiens
SDKRHCARN

SEQ ID NO: 241115 - protein, 9 aa, Homo Sapiens
PLFQPNENT

SEQ ID NO: 241116 - protein, 9 aa, Homo Sapiens
AAGRDSTNA

SEQ ID NO: 241117 - protein, 9 aa, Homo Sapiens
SIYAALYFS

SEQ ID NO: 241118 - protein, 9 aa, Homo Sapiens
LNGRPIYPN

SEQ ID NO: 241119 - protein, 9 aa, Homo Sapiens
GKSIMKEDV

SEQ ID NO: 241120 - protein, 9 aa, Homo Sapiens
GGVDKITQF

SEQ ID NO: 241121 - protein, 9 aa, Homo Sapiens
YNDALFQYN

SEQ ID NO: 241122 - protein, 9 aa, Homo Sapiens
GQIISDSVP

SEQ ID NO: 241123 - protein, 9 aa, Homo Sapiens
VAFKISKDV

SEQ ID NO: 241124 - protein, 9 aa, Homo Sapiens
DHNPKVFPG

SEQ ID NO: 241125 - protein, 9 aa, Homo Sapiens
VIDRLEEVD

SEQ ID NO: 241126 - protein, 9 aa, Homo Sapiens
EESEEEVEK

SEQ ID NO: 241127 - protein, 9 aa, Homo Sapiens
GKNKNNFVP

SEQ ID NO: 241128 - protein, 9 aa, Homo Sapiens
CRCPTGFPG

SEQ ID NO: 241129 - protein, 9 aa, Homo Sapiens
QIKVCRDKG

SEQ ID NO: 241130 - protein, 9 aa, Homo Sapiens
LALAPHKEQ

SEQ ID NO: 241131 - protein, 9 aa, Homo Sapiens
PYCTVALNC

SEQ ID NO: 241132 - protein, 9 aa, Homo Sapiens
NNLTPYVAI

SEQ ID NO: 241133 - protein, 9 aa, Homo Sapiens
FKRLPYSEL

SEQ ID NO: 241134 - protein, 9 aa, Homo Sapiens
HHHWISQME

SEQ ID NO: 241135 - protein, 9 aa, Homo Sapiens
REKEQNTPR

SEQ ID NO: 241136 - protein, 9 aa, Homo Sapiens
DPVTECIAH

SEQ ID NO: 241137 - protein, 9 aa, Homo Sapiens
LQPLNHEEL

SEQ ID NO: 241138 - protein, 9 aa, Homo Sapiens
ETKLMGFVD

SEQ ID NO: 241139 - protein, 9 aa, Homo Sapiens
KGADWPTPI

SEQ ID NO: 241140 - protein, 9 aa, Homo Sapiens
EATGLSKTF

SEQ ID NO: 241141 - protein, 9 aa, Homo Sapiens
MEIRKFDLL

SEQ ID NO: 241142 - protein, 9 aa, Homo Sapiens
LYSQPQPSG

SEQ ID NO: 241143 - protein, 9 aa, Homo Sapiens
HLLLGVVQI

SEQ ID NO: 241144 - protein, 9 aa, Homo Sapiens
SLISACMAE

SEQ ID NO: 241145 - protein, 9 aa, Homo Sapiens
VLRGATQHI

SEQ ID NO: 241146 - protein, 9 aa, Homo Sapiens
SIPPGMLAS

SEQ ID NO: 241147 - protein, 9 aa, Homo Sapiens
QEDSQAFTP

SEQ ID NO: 241148 - protein, 9 aa, Homo Sapiens
ELGALLEQQ

SEQ ID NO: 241149 - protein, 9 aa, Homo Sapiens
NPPSYLLIL

SEQ ID NO: 241150 - protein, 9 aa, Homo Sapiens
EIAISLFFL

SEQ ID NO: 241151 - protein, 9 aa, Homo Sapiens
AVSSPQISS

SEQ ID NO: 241152 - protein, 9 aa, Homo Sapiens
EHRAKIIIT

SEQ ID NO: 241153 - protein, 9 aa, Homo Sapiens
VGGFSQPYL

SEQ ID NO: 241154 - protein, 9 aa, Homo Sapiens
DIQDIQKSM

SEQ ID NO: 241155 - protein, 9 aa, Homo Sapiens
TATAKFREQ

SEQ ID NO: 241156 - protein, 9 aa, Homo Sapiens
HKEKIQTVF

SEQ ID NO: 241157 - protein, 9 aa, Homo Sapiens
SYVVMNHGC

SEQ ID NO: 241158 - protein, 9 aa, Homo Sapiens
QIKEVQRWK

SEQ ID NO: 241159 - protein, 9 aa, Homo Sapiens
WTWRYQEKK

SEQ ID NO: 241160 - protein, 9 aa, Homo Sapiens
ASPTSIQTG

SEQ ID NO: 241161 - protein, 9 aa, Homo Sapiens
STENDMERK

SEQ ID NO: 241162 - protein, 9 aa, Homo Sapiens
MKGLIFDRK

SEQ ID NO: 241163 - protein, 9 aa, Homo Sapiens
SNEEQNLLS

SEQ ID NO: 241164 - protein, 9 aa, Homo Sapiens
TPISEGRSG

SEQ ID NO: 241165 - protein, 9 aa, Homo Sapiens
AYKHFKPED

SEQ ID NO: 241166 - protein, 9 aa, Homo Sapiens
QSTENSAGS

SEQ ID NO: 241167 - protein, 9 aa, Homo Sapiens
EEGGLATYQ

SEQ ID NO: 241168 - protein, 9 aa, Homo Sapiens
ISNKQRASK

SEQ ID NO: 241169 - protein, 9 aa, Homo Sapiens
DIPVLFKIM

SEQ ID NO: 241170 - protein, 9 aa, Homo Sapiens
ANYVVRFIT

SEQ ID NO: 241171 - protein, 9 aa, Homo Sapiens
RGKSISIET

SEQ ID NO: 241172 - protein, 9 aa, Homo Sapiens
ITMKRSRNH

SEQ ID NO: 241173 - protein, 9 aa, Homo Sapiens
NCSTVSKSI

SEQ ID NO: 241174 - protein, 9 aa, Homo Sapiens
NIPHQQTRD

SEQ ID NO: 241175 - protein, 9 aa, Homo Sapiens
DVGYPALQR

SEQ ID NO: 241176 - protein, 9 aa, Homo Sapiens
PRMEGMLFP

SEQ ID NO: 241177 - protein, 9 aa, Homo Sapiens
SVVTQSLLT

SEQ ID NO: 241178 - protein, 9 aa, Homo Sapiens
TVLIQTRGG

SEQ ID NO: 241179 - protein, 9 aa, Homo Sapiens
NTCNAVIQK

SEQ ID NO: 241180 - protein, 9 aa, Homo Sapiens
RTETIIQFA

SEQ ID NO: 241181 - protein, 9 aa, Homo Sapiens
GECSDKLLS

SEQ ID NO: 241182 - protein, 9 aa, Homo Sapiens
STAGHNMQN

SEQ ID NO: 241183 - protein, 9 aa, Homo Sapiens
DAASSDNIM

SEQ ID NO: 241184 - protein, 9 aa, Homo Sapiens
KCIKLLGEI

SEQ ID NO: 241185 - protein, 9 aa, Homo Sapiens
KWDLLKLKS

SEQ ID NO: 241186 - protein, 9 aa, Homo Sapiens
SVEEAAKQK

SEQ ID NO: 241187 - protein, 9 aa, Homo Sapiens
PKEHHRVVI

SEQ ID NO: 241188 - protein, 9 aa, Homo Sapiens
QNPQRKALL

SEQ ID NO: 241189 - protein, 9 aa, Homo Sapiens
TLLIQAAKN

SEQ ID NO: 241190 - protein, 9 aa, Homo Sapiens
PPKEELLKM

SEQ ID NO: 241191 - protein, 9 aa, Homo Sapiens
VWFQKHWAK

SEQ ID NO: 241192 - protein, 9 aa, Homo Sapiens
GKQQTFPWF

SEQ ID NO: 241193 - protein, 9 aa, Homo Sapiens
VAYYHSRVK

SEQ ID NO: 241194 - protein, 9 aa, Homo Sapiens
DIKKNKKLS

SEQ ID NO: 241195 - protein, 9 aa, Homo Sapiens
LGLQRYVSP

SEQ ID NO: 241196 - protein, 9 aa, Homo Sapiens
DDSLAKRQR

SEQ ID NO: 241197 - protein, 9 aa, Homo Sapiens
ESSQDVIEL

SEQ ID NO: 241198 - protein, 9 aa, Homo Sapiens
KRWINEAQD

SEQ ID NO: 241199 - protein, 9 aa, Homo Sapiens
TGSYDGDIV

SEQ ID NO: 241200 - protein, 9 aa, Homo Sapiens
MLNGQKGLV

SEQ ID NO: 241201 - protein, 9 aa, Homo Sapiens
FRILPQVIT

SEQ ID NO: 241202 - protein, 9 aa, Homo Sapiens
LPWGGGLKR

SEQ ID NO: 241203 - protein, 9 aa, Homo Sapiens
ALQPLNHEE

SEQ ID NO: 241204 - protein, 9 aa, Homo Sapiens
QSNDTIRMI

SEQ ID NO: 241205 - protein, 9 aa, Homo Sapiens
QIPMWSKRV

SEQ ID NO: 241206 - protein, 9 aa, Homo Sapiens
DTISLASEQ

SEQ ID NO: 241207 - protein, 9 aa, Homo Sapiens
MRNQLSVKC

SEQ ID NO: 241208 - protein, 9 aa, Homo Sapiens
LFLHYLGFP

SEQ ID NO: 241209 - protein, 9 aa, Homo Sapiens
KKNKSQDQW

SEQ ID NO: 241210 - protein, 9 aa, Homo Sapiens
LEAQKQQMD

SEQ ID NO: 241211 - protein, 9 aa, Homo Sapiens
VMEQTFDLL

SEQ ID NO: 241212 - protein, 9 aa, Homo Sapiens
AALVGMYGR

SEQ ID NO: 241213 - protein, 9 aa, Homo Sapiens
VHTGDKPYE

SEQ ID NO: 241214 - protein, 9 aa, Homo Sapiens
SKTAQAPLA

SEQ ID NO: 241215 - protein, 9 aa, Homo Sapiens
VPGPRSHPS

SEQ ID NO: 241216 - protein, 9 aa, Homo Sapiens
GLPRNEIAA

SEQ ID NO: 241217 - protein, 9 aa, Homo Sapiens
VSPSPMRID

SEQ ID NO: 241218 - protein, 9 aa, Homo Sapiens
WPSQRGTLT

SEQ ID NO: 241219 - protein, 9 aa, Homo Sapiens
GPASMSCAS

SEQ ID NO: 241220 - protein, 9 aa, Homo Sapiens
AWSINGTQI

SEQ ID NO: 241221 - protein, 9 aa, Homo Sapiens
QDPTMYLAL

SEQ ID NO: 241222 - protein, 9 aa, Homo Sapiens
SPTEKQWLK

SEQ ID NO: 241223 - protein, 9 aa, Homo Sapiens
LPYTNSKVT

SEQ ID NO: 241224 - protein, 9 aa, Homo Sapiens
RKHNLISPE

SEQ ID NO: 241225 - protein, 9 aa, Homo Sapiens
AKFIQEMAL

SEQ ID NO: 241226 - protein, 9 aa, Homo Sapiens
RFSIYTTLF

SEQ ID NO: 241227 - protein, 9 aa, Homo Sapiens
INESNDRGK

SEQ ID NO: 241228 - protein, 9 aa, Homo Sapiens
VHRFCVEKG

SEQ ID NO: 241229 - protein, 9 aa, Homo Sapiens
GETVIFHAR

SEQ ID NO: 241230 - protein, 9 aa, Homo Sapiens
LVESSTNVD

SEQ ID NO: 241231 - protein, 9 aa, Homo Sapiens
LKYLGRYRL

SEQ ID NO: 241232 - protein, 9 aa, Homo Sapiens
ERLIMVARI

SEQ ID NO: 241233 - protein, 9 aa, Homo Sapiens
TNINRSILA

SEQ ID NO: 241234 - protein, 9 aa, Homo Sapiens
RTTKLEHIL

SEQ ID NO: 241235 - protein, 9 aa, Homo Sapiens
RPGVVESYE

SEQ ID NO: 241236 - protein, 9 aa, Homo Sapiens
RCRMQLVRG

SEQ ID NO: 241237 - protein, 9 aa, Homo Sapiens
PPLTDIDST

SEQ ID NO: 241238 - protein, 9 aa, Homo Sapiens
GSLIYDKLG

SEQ ID NO: 241239 - protein, 9 aa, Homo Sapiens
KIVKEKNAE

SEQ ID NO: 241240 - protein, 9 aa, Homo Sapiens
RIAPRYRWQ

SEQ ID NO: 241241 - protein, 9 aa, Homo Sapiens
AIKFVLSCM

SEQ ID NO: 241242 - protein, 9 aa, Homo Sapiens
FKSDETEDI

SEQ ID NO: 241243 - protein, 9 aa, Homo Sapiens
GRTPGSSAR

SEQ ID NO: 241244 - protein, 9 aa, Homo Sapiens
SDWLDGRGW

SEQ ID NO: 241245 - protein, 9 aa, Homo Sapiens
VLQRSVKLS

SEQ ID NO: 241246 - protein, 9 aa, Homo Sapiens
VVTQSLLTS

SEQ ID NO: 241247 - protein, 9 aa, Homo Sapiens
TFLWLLSAS

SEQ ID NO: 241248 - protein, 9 aa, Homo Sapiens
RRNVEDNDY

SEQ ID NO: 241249 - protein, 9 aa, Homo Sapiens
TGSTLDTTV

SEQ ID NO: 241250 - protein, 9 aa, Homo Sapiens
LKEVEYQMT

SEQ ID NO: 241251 - protein, 9 aa, Homo Sapiens
DAVLICFDS

SEQ ID NO: 241252 - protein, 9 aa, Homo Sapiens
QSGGKIWRP

SEQ ID NO: 241253 - protein, 9 aa, Homo Sapiens
PSPALTLDF

SEQ ID NO: 241254 - protein, 9 aa, Homo Sapiens
CTKRTNRKK

SEQ ID NO: 241255 - protein, 9 aa, Homo Sapiens
WEINIFLQQ

SEQ ID NO: 241256 - protein, 9 aa, Homo Sapiens
LWERNITSH

SEQ ID NO: 241257 - protein, 9 aa, Homo Sapiens
YQLQVFMVI

SEQ ID NO: 241258 - protein, 9 aa, Homo Sapiens
GQVLKTALV

SEQ ID NO: 241259 - protein, 9 aa, Homo Sapiens
NEEIAFRVL

SEQ ID NO: 241260 - protein, 9 aa, Homo Sapiens
PSMKQVGTS

SEQ ID NO: 241261 - protein, 9 aa, Homo Sapiens
IKEPLHLFE

SEQ ID NO: 241262 - protein, 9 aa, Homo Sapiens
LNDQNSKLL

SEQ ID NO: 241263 - protein, 9 aa, Homo Sapiens
FGLEDDVAK

SEQ ID NO: 241264 - protein, 9 aa, Homo Sapiens
DFPFPTRIA

SEQ ID NO: 241265 - protein, 9 aa, Homo Sapiens
IEKVIEELQ

SEQ ID NO: 241266 - protein, 9 aa, Homo Sapiens
AKNHNYFPV

SEQ ID NO: 241267 - protein, 9 aa, Homo Sapiens
VQDVIKVPD

SEQ ID NO: 241268 - protein, 9 aa, Homo Sapiens
KEETSKEAN

SEQ ID NO: 241269 - protein, 9 aa, Homo Sapiens
LVATSKKNV

SEQ ID NO: 241270 - protein, 9 aa, Homo Sapiens
IYWKLDYKA

SEQ ID NO: 241271 - protein, 9 aa, Homo Sapiens
QRLFATKPG

SEQ ID NO: 241272 - protein, 9 aa, Homo Sapiens
VLGIYSKKK

SEQ ID NO: 241273 - protein, 9 aa, Homo Sapiens
SHNDKTKGQ

SEQ ID NO: 241274 - protein, 9 aa, Homo Sapiens
HNNSPIIWR

SEQ ID NO: 241275 - protein, 9 aa, Homo Sapiens
VMPKRGLNV

SEQ ID NO: 241276 - protein, 9 aa, Homo Sapiens
DAKEMQIVL

SEQ ID NO: 241277 - protein, 9 aa, Homo Sapiens
THTIIDNTD

SEQ ID NO: 241278 - protein, 9 aa, Homo Sapiens
ATKEIISPG

SEQ ID NO: 241279 - protein, 9 aa, Homo Sapiens
GRLQKKLYA

SEQ ID NO: 241280 - protein, 9 aa, Homo Sapiens
TFFRVHILY

SEQ ID NO: 241281 - protein, 9 aa, Homo Sapiens
LKLFLRYRP

SEQ ID NO: 241282 - protein, 9 aa, Homo Sapiens
KHLYFRVIT

SEQ ID NO: 241283 - protein, 9 aa, Homo Sapiens
INVGVLNGG

SEQ ID NO: 241284 - protein, 9 aa, Homo Sapiens
KHFNSPHPT

SEQ ID NO: 241285 - protein, 9 aa, Homo Sapiens
TEIVKLMIL

SEQ ID NO: 241286 - protein, 9 aa, Homo Sapiens
TGKKEEASR

SEQ ID NO: 241287 - protein, 9 aa, Homo Sapiens
RDLPRPQAP

SEQ ID NO: 241288 - protein, 9 aa, Homo Sapiens
GRDRLSPYF

SEQ ID NO: 241289 - protein, 9 aa, Homo Sapiens
YISNPLLNG

SEQ ID NO: 241290 - protein, 9 aa, Homo Sapiens
TTHNSAFEC

SEQ ID NO: 241291 - protein, 9 aa, Homo Sapiens
RLHAMARYP

SEQ ID NO: 241292 - protein, 9 aa, Homo Sapiens
GNKQDTNSQ

SEQ ID NO: 241293 - protein, 9 aa, Homo Sapiens
PAPGKPGHY

SEQ ID NO: 241294 - protein, 9 aa, Homo Sapiens
KKNEENFSC

SEQ ID NO: 241295 - protein, 9 aa, Homo Sapiens
MLINNFYFL

SEQ ID NO: 241296 - protein, 9 aa, Homo Sapiens
LLGLSDLKA

SEQ ID NO: 241297 - protein, 9 aa, Homo Sapiens
KKNVDSIIE

SEQ ID NO: 241298 - protein, 9 aa, Homo Sapiens
CPYLNLFQL

SEQ ID NO: 241299 - protein, 9 aa, Homo Sapiens
QETHDSIVN

SEQ ID NO: 241300 - protein, 9 aa, Homo Sapiens
FHIWRNKTE

SEQ ID NO: 241301 - protein, 9 aa, Homo Sapiens
NTLHLEIHG

SEQ ID NO: 241302 - protein, 9 aa, Homo Sapiens
VIVESGNFK

SEQ ID NO: 241303 - protein, 9 aa, Homo Sapiens
LFATKVRNL

SEQ ID NO: 241304 - protein, 9 aa, Homo Sapiens
LLNGRYKCD

SEQ ID NO: 241305 - protein, 9 aa, Homo Sapiens
NKPQFLQRF

SEQ ID NO: 241306 - protein, 9 aa, Homo Sapiens
RIYQYIQSH

SEQ ID NO: 241307 - protein, 9 aa, Homo Sapiens
FSYLMRDRS

SEQ ID NO: 241308 - protein, 9 aa, Homo Sapiens
GSAQLLFNT

SEQ ID NO: 241309 - protein, 9 aa, Homo Sapiens
LQGGGHSYL

SEQ ID NO: 241310 - protein, 9 aa, Homo Sapiens
PKDAGRRIN

SEQ ID NO: 241311 - protein, 9 aa, Homo Sapiens
GKIWRPANV

SEQ ID NO: 241312 - protein, 9 aa, Homo Sapiens
CQNGQLKEA

SEQ ID NO: 241313 - protein, 9 aa, Homo Sapiens
NFEEVVSDS

SEQ ID NO: 241314 - protein, 9 aa, Homo Sapiens
LPNDPLPRI

SEQ ID NO: 241315 - protein, 9 aa, Homo Sapiens
PKRGLNVSS

SEQ ID NO: 241316 - protein, 9 aa, Homo Sapiens
TKSEQKRNP

SEQ ID NO: 241317 - protein, 9 aa, Homo Sapiens
LHLTQHKII

SEQ ID NO: 241318 - protein, 9 aa, Homo Sapiens
ESMATEGLH

SEQ ID NO: 241319 - protein, 9 aa, Homo Sapiens
QGGGHSYLF

SEQ ID NO: 241320 - protein, 9 aa, Homo Sapiens
HVGWEGANY

SEQ ID NO: 241321 - protein, 9 aa, Homo Sapiens
FERALYLAE

SEQ ID NO: 241322 - protein, 9 aa, Homo Sapiens
WKCPGPIIT

SEQ ID NO: 241323 - protein, 9 aa, Homo Sapiens
HGMCLNIAV

SEQ ID NO: 241324 - protein, 9 aa, Homo Sapiens
DPWKSAYSS

SEQ ID NO: 241325 - protein, 9 aa, Homo Sapiens
VSVAAGLPN

SEQ ID NO: 241326 - protein, 9 aa, Homo Sapiens
LFQIQQEVD

SEQ ID NO: 241327 - protein, 9 aa, Homo Sapiens
ATKLSDYFL

SEQ ID NO: 241328 - protein, 9 aa, Homo Sapiens
ASRIMTLYQ

SEQ ID NO: 241329 - protein, 9 aa, Homo Sapiens
GGRAGDRAR

SEQ ID NO: 241330 - protein, 9 aa, Homo Sapiens
FATKLSDYF

SEQ ID NO: 241331 - protein, 9 aa, Homo Sapiens
GLKLQRFLV

SEQ ID NO: 241332 - protein, 9 aa, Homo Sapiens
MLHFDLRIP

SEQ ID NO: 241333 - protein, 9 aa, Homo Sapiens
EAILNQKIE

SEQ ID NO: 241334 - protein, 9 aa, Homo Sapiens
KSVQKKQSE

SEQ ID NO: 241335 - protein, 9 aa, Homo Sapiens
TMIEINPMA

SEQ ID NO: 241336 - protein, 9 aa, Homo Sapiens
QYLQAARAL

SEQ ID NO: 241337 - protein, 9 aa, Homo Sapiens
KETSHSYRT

SEQ ID NO: 241338 - protein, 9 aa, Homo Sapiens
NHQITLFVV

SEQ ID NO: 241339 - protein, 9 aa, Homo Sapiens
PLTDRGKKT

SEQ ID NO: 241340 - protein, 9 aa, Homo Sapiens
SMLQLTFCD

SEQ ID NO: 241341 - protein, 9 aa, Homo Sapiens
IRGIYIHAL

SEQ ID NO: 241342 - protein, 9 aa, Homo Sapiens
ILSFLTHRF

SEQ ID NO: 241343 - protein, 9 aa, Homo Sapiens
KHARNNYKG

SEQ ID NO: 241344 - protein, 9 aa, Homo Sapiens
GTEIAPDKS

SEQ ID NO: 241345 - protein, 9 aa, Homo Sapiens
THPPKEVVP

SEQ ID NO: 241346 - protein, 9 aa, Homo Sapiens
LDSKLVPPS

SEQ ID NO: 241347 - protein, 9 aa, Homo Sapiens
LDYVKITLR

SEQ ID NO: 241348 - protein, 9 aa, Homo Sapiens
LGMTPGFID

SEQ ID NO: 241349 - protein, 9 aa, Homo Sapiens
LLNLGRHTL

SEQ ID NO: 241350 - protein, 9 aa, Homo Sapiens
IENINLDLK

SEQ ID NO: 241351 - protein, 9 aa, Homo Sapiens
IVSCNPSYR

SEQ ID NO: 241352 - protein, 9 aa, Homo Sapiens
ISKIHEKVF

SEQ ID NO: 241353 - protein, 9 aa, Homo Sapiens
NWSSLRNFP

SEQ ID NO: 241354 - protein, 9 aa, Homo Sapiens
TLYTINVYS

SEQ ID NO: 241355 - protein, 9 aa, Homo Sapiens
PPPLLAMRR

SEQ ID NO: 241356 - protein, 9 aa, Homo Sapiens
TEPGLIAFE

SEQ ID NO: 241357 - protein, 9 aa, Homo Sapiens
GNTKCYKCP

SEQ ID NO: 241358 - protein, 9 aa, Homo Sapiens
EEKSLYIIR

SEQ ID NO: 241359 - protein, 9 aa, Homo Sapiens
IEVTFDIYA

SEQ ID NO: 241360 - protein, 9 aa, Homo Sapiens
DCGIGEVPV

SEQ ID NO: 241361 - protein, 9 aa, Homo Sapiens
RSEGDPMRH

SEQ ID NO: 241362 - protein, 9 aa, Homo Sapiens
ATGYGFAKP

SEQ ID NO: 241363 - protein, 9 aa, Homo Sapiens
LCVNKGTET

SEQ ID NO: 241364 - protein, 9 aa, Homo Sapiens
IVGVSVFAN

SEQ ID NO: 241365 - protein, 9 aa, Homo Sapiens
ESLEHVQFE

SEQ ID NO: 241366 - protein, 9 aa, Homo Sapiens
IQSKLFQCN

SEQ ID NO: 241367 - protein, 9 aa, Homo Sapiens
KEQKKRNDL

SEQ ID NO: 241368 - protein, 9 aa, Homo Sapiens
DIKEYWMDP

SEQ ID NO: 241369 - protein, 9 aa, Homo Sapiens
SITKTLSPS

SEQ ID NO: 241370 - protein, 9 aa, Homo Sapiens
PDFLLVHDS

SEQ ID NO: 241371 - protein, 9 aa, Homo Sapiens
CDETNNCPG

SEQ ID NO: 241372 - protein, 9 aa, Homo Sapiens
LSYSGSVDI

SEQ ID NO: 241373 - protein, 9 aa, Homo Sapiens
RAEEIAIIL

SEQ ID NO: 241374 - protein, 9 aa, Homo Sapiens
TNISSSLSC

SEQ ID NO: 241375 - protein, 9 aa, Homo Sapiens
GAFNKVSIV

SEQ ID NO: 241376 - protein, 9 aa, Homo Sapiens
KSCDSRYLC

SEQ ID NO: 241377 - protein, 9 aa, Homo Sapiens
RVVVEDSVF

SEQ ID NO: 241378 - protein, 9 aa, Homo Sapiens
SVIVNPPVI

SEQ ID NO: 241379 - protein, 9 aa, Homo Sapiens
GAHCLRLDA

SEQ ID NO: 241380 - protein, 9 aa, Homo Sapiens
SADQMLTYY

SEQ ID NO: 241381 - protein, 9 aa, Homo Sapiens
CGKRFTDNS

SEQ ID NO: 241382 - protein, 9 aa, Homo Sapiens
PPLPCAPGT

SEQ ID NO: 241383 - protein, 9 aa, Homo Sapiens
YVVTVMGNI

SEQ ID NO: 241384 - protein, 9 aa, Homo Sapiens
KMANYAKFK

SEQ ID NO: 241385 - protein, 9 aa, Homo Sapiens
TVVNKLDRE

SEQ ID NO: 241386 - protein, 9 aa, Homo Sapiens
SMDRMVLLV

SEQ ID NO: 241387 - protein, 9 aa, Homo Sapiens
PAFTQENYT

SEQ ID NO: 241388 - protein, 9 aa, Homo Sapiens
RNPTIVTYV

SEQ ID NO: 241389 - protein, 9 aa, Homo Sapiens
KKKPPVENR

SEQ ID NO: 241390 - protein, 9 aa, Homo Sapiens
KQKHLPRFK

SEQ ID NO: 241391 - protein, 9 aa, Homo Sapiens
VPHDFGNQG

SEQ ID NO: 241392 - protein, 9 aa, Homo Sapiens
DYCPHSKKA

SEQ ID NO: 241393 - protein, 9 aa, Homo Sapiens
TQAEKLEAQ

SEQ ID NO: 241394 - protein, 9 aa, Homo Sapiens
SKFRLATRG

SEQ ID NO: 241395 - protein, 9 aa, Homo Sapiens
EEVFLWVGK

SEQ ID NO: 241396 - protein, 9 aa, Homo Sapiens
PILIIVNVS

SEQ ID NO: 241397 - protein, 9 aa, Homo Sapiens
MFTDCYIYN

SEQ ID NO: 241398 - protein, 9 aa, Homo Sapiens
LSCKPRLSF

SEQ ID NO: 241399 - protein, 9 aa, Homo Sapiens
FLNKPARTQ

SEQ ID NO: 241400 - protein, 9 aa, Homo Sapiens
LQTVVVYMP

SEQ ID NO: 241401 - protein, 9 aa, Homo Sapiens
FFVEASMSV

SEQ ID NO: 241402 - protein, 9 aa, Homo Sapiens
RVKPTNDFA

SEQ ID NO: 241403 - protein, 9 aa, Homo Sapiens
LEASVKNVI

SEQ ID NO: 241404 - protein, 9 aa, Homo Sapiens
PLLKKCHAP

SEQ ID NO: 241405 - protein, 9 aa, Homo Sapiens
VQIPNKPDV

SEQ ID NO: 241406 - protein, 9 aa, Homo Sapiens
PIVHSQTYT

SEQ ID NO: 241407 - protein, 9 aa, Homo Sapiens
PKLGNIVKT

SEQ ID NO: 241408 - protein, 9 aa, Homo Sapiens
HANNGRFSL

SEQ ID NO: 241409 - protein, 9 aa, Homo Sapiens
NLNFSVIAD

SEQ ID NO: 241410 - protein, 9 aa, Homo Sapiens
ATLSYGTPS

SEQ ID NO: 241411 - protein, 9 aa, Homo Sapiens
IIYMPGTVS

SEQ ID NO: 241412 - protein, 9 aa, Homo Sapiens
LADFDGVVG

SEQ ID NO: 241413 - protein, 9 aa, Homo Sapiens
TEWYKLRKA

SEQ ID NO: 241414 - protein, 9 aa, Homo Sapiens
PSIFWINFD

SEQ ID NO: 241415 - protein, 9 aa, Homo Sapiens
YYSSRCLVI

SEQ ID NO: 241416 - protein, 9 aa, Homo Sapiens
SALFNMVPR

SEQ ID NO: 241417 - protein, 9 aa, Homo Sapiens
CVLYYYLTN

SEQ ID NO: 241418 - protein, 9 aa, Homo Sapiens
EFTKHLLTS

SEQ ID NO: 241419 - protein, 9 aa, Homo Sapiens
TWLENKWGH

SEQ ID NO: 241420 - protein, 9 aa, Homo Sapiens
FRLQTLGLK

SEQ ID NO: 241421 - protein, 9 aa, Homo Sapiens
RVMDPSLCL

SEQ ID NO: 241422 - protein, 9 aa, Homo Sapiens
HSQNIDAYH

SEQ ID NO: 241423 - protein, 9 aa, Homo Sapiens
ILILPSVTK

SEQ ID NO: 241424 - protein, 9 aa, Homo Sapiens
WSEQSIKDY

SEQ ID NO: 241425 - protein, 9 aa, Homo Sapiens
TGSRQSSTV

SEQ ID NO: 241426 - protein, 9 aa, Homo Sapiens
DGNGYIDKN

SEQ ID NO: 241427 - protein, 9 aa, Homo Sapiens
EAALDEGRQ

SEQ ID NO: 241428 - protein, 9 aa, Homo Sapiens
FGYHTAFAQ

SEQ ID NO: 241429 - protein, 9 aa, Homo Sapiens
YDDKDYRKI

SEQ ID NO: 241430 - protein, 9 aa, Homo Sapiens
VIAKHRIKE

SEQ ID NO: 241431 - protein, 9 aa, Homo Sapiens
QSFIRQFLQ

SEQ ID NO: 241432 - protein, 9 aa, Homo Sapiens
ELIRDAPTL

SEQ ID NO: 241433 - protein, 9 aa, Homo Sapiens
NASFEKDKH

SEQ ID NO: 241434 - protein, 9 aa, Homo Sapiens
QNGERVEQY

SEQ ID NO: 241435 - protein, 9 aa, Homo Sapiens
TVVVVPHIL

SEQ ID NO: 241436 - protein, 9 aa, Homo Sapiens
RRWHAARKP

SEQ ID NO: 241437 - protein, 9 aa, Homo Sapiens
DLYHDIVSR

SEQ ID NO: 241438 - protein, 9 aa, Homo Sapiens
SYYCTCNPG

SEQ ID NO: 241439 - protein, 9 aa, Homo Sapiens
NCAIRLKTE

SEQ ID NO: 241440 - protein, 9 aa, Homo Sapiens
YTGEETKFV

SEQ ID NO: 241441 - protein, 9 aa, Homo Sapiens
LTTRLQEQE

SEQ ID NO: 241442 - protein, 9 aa, Homo Sapiens
TFSDLQSLI

SEQ ID NO: 241443 - protein, 9 aa, Homo Sapiens
GGFQGTMEA

SEQ ID NO: 241444 - protein, 9 aa, Homo Sapiens
LLILDAVRL

SEQ ID NO: 241445 - protein, 9 aa, Homo Sapiens
TGQMFAMKM

SEQ ID NO: 241446 - protein, 9 aa, Homo Sapiens
TLPRSQPMN

SEQ ID NO: 241447 - protein, 9 aa, Homo Sapiens
VVKRYTGEF

SEQ ID NO: 241448 - protein, 9 aa, Homo Sapiens
LSVSGALLG

SEQ ID NO: 241449 - protein, 9 aa, Homo Sapiens
SWKINYFSG

SEQ ID NO: 241450 - protein, 9 aa, Homo Sapiens
LSDLLRKME

SEQ ID NO: 241451 - protein, 9 aa, Homo Sapiens
HGFFGRHRF

SEQ ID NO: 241452 - protein, 9 aa, Homo Sapiens
TAFRTDNGN

SEQ ID NO: 241453 - protein, 9 aa, Homo Sapiens
NSVASKTYE

SEQ ID NO: 241454 - protein, 9 aa, Homo Sapiens
SEQMTNEDN

SEQ ID NO: 241455 - protein, 9 aa, Homo Sapiens
LTKDNSQNQ

SEQ ID NO: 241456 - protein, 9 aa, Homo Sapiens
IDPQPPIED

SEQ ID NO: 241457 - protein, 9 aa, Homo Sapiens
QKQGIVCFY

SEQ ID NO: 241458 - protein, 9 aa, Homo Sapiens
CDNKCKVLG

SEQ ID NO: 241459 - protein, 9 aa, Homo Sapiens
GVKVSPLQQ

SEQ ID NO: 241460 - protein, 9 aa, Homo Sapiens
LRDELLVKI

SEQ ID NO: 241461 - protein, 9 aa, Homo Sapiens
PLPKQGSPL

SEQ ID NO: 241462 - protein, 9 aa, Homo Sapiens
LQQFKDSGL

SEQ ID NO: 241463 - protein, 9 aa, Homo Sapiens
LCAILLDRY

SEQ ID NO: 241464 - protein, 9 aa, Homo Sapiens
RKVQQSFAT

SEQ ID NO: 241465 - protein, 9 aa, Homo Sapiens
KTISPQMNT

SEQ ID NO: 241466 - protein, 9 aa, Homo Sapiens
EYKLQKEHN

SEQ ID NO: 241467 - protein, 9 aa, Homo Sapiens
LMVSSTSWT

SEQ ID NO: 241468 - protein, 9 aa, Homo Sapiens
VPEYSKAAA

SEQ ID NO: 241469 - protein, 9 aa, Homo Sapiens
NSICYRMIT

SEQ ID NO: 241470 - protein, 9 aa, Homo Sapiens
STPTFIILG

SEQ ID NO: 241471 - protein, 9 aa, Homo Sapiens
AIIIGERTG

SEQ ID NO: 241472 - protein, 9 aa, Homo Sapiens
MRVVQSVNH

SEQ ID NO: 241473 - protein, 9 aa, Homo Sapiens
KYFLDQIKV

SEQ ID NO: 241474 - protein, 9 aa, Homo Sapiens
LIYEYKSKR

SEQ ID NO: 241475 - protein, 9 aa, Homo Sapiens
EESLESTRA

SEQ ID NO: 241476 - protein, 9 aa, Homo Sapiens
FPKSINVFF

SEQ ID NO: 241477 - protein, 9 aa, Homo Sapiens
KAVSLLYPV

SEQ ID NO: 241478 - protein, 9 aa, Homo Sapiens
MSYKGSTLN

SEQ ID NO: 241479 - protein, 9 aa, Homo Sapiens
NGALSQGIT

SEQ ID NO: 241480 - protein, 9 aa, Homo Sapiens
RKLLENSGW

SEQ ID NO: 241481 - protein, 9 aa, Homo Sapiens
IISAWNNGK

SEQ ID NO: 241482 - protein, 9 aa, Homo Sapiens
TQKNVSEEL

SEQ ID NO: 241483 - protein, 9 aa, Homo Sapiens
ALTFVSRYD

SEQ ID NO: 241484 - protein, 9 aa, Homo Sapiens
VSEETMESR

SEQ ID NO: 241485 - protein, 9 aa, Homo Sapiens
KKAKREENK

SEQ ID NO: 241486 - protein, 9 aa, Homo Sapiens
PLITATTTA

SEQ ID NO: 241487 - protein, 9 aa, Homo Sapiens
STKEEMIQI

SEQ ID NO: 241488 - protein, 9 aa, Homo Sapiens
GTARSGGQG

SEQ ID NO: 241489 - protein, 9 aa, Homo Sapiens
RIPYQLGRV

SEQ ID NO: 241490 - protein, 9 aa, Homo Sapiens
SQIQTSRNI

SEQ ID NO: 241491 - protein, 9 aa, Homo Sapiens
SYHSPGSPP

SEQ ID NO: 241492 - protein, 9 aa, Homo Sapiens
SYSKQRMPQ

SEQ ID NO: 241493 - protein, 9 aa, Homo Sapiens
YFNNILNSF

SEQ ID NO: 241494 - protein, 9 aa, Homo Sapiens
PDQISVSEL

SEQ ID NO: 241495 - protein, 9 aa, Homo Sapiens
GHELSNEEI

SEQ ID NO: 241496 - protein, 9 aa, Homo Sapiens
NSNWTSVSR

SEQ ID NO: 241497 - protein, 9 aa, Homo Sapiens
IININPKFH

SEQ ID NO: 241498 - protein, 9 aa, Homo Sapiens
FLPILAPCE

SEQ ID NO: 241499 - protein, 9 aa, Homo Sapiens
LKQERINRF

SEQ ID NO: 241500 - protein, 9 aa, Homo Sapiens
VSQPQFTAM

SEQ ID NO: 241501 - protein, 9 aa, Homo Sapiens
LLVGGFSQP

SEQ ID NO: 241502 - protein, 9 aa, Homo Sapiens
HASFIVARC

SEQ ID NO: 241503 - protein, 9 aa, Homo Sapiens
LIASWGQRL

SEQ ID NO: 241504 - protein, 9 aa, Homo Sapiens
LENSLSYDA

SEQ ID NO: 241505 - protein, 9 aa, Homo Sapiens
ATSDNKDSV

SEQ ID NO: 241506 - protein, 9 aa, Homo Sapiens
WLLLDFKRE

SEQ ID NO: 241507 - protein, 9 aa, Homo Sapiens
FNLDIDPNI

SEQ ID NO: 241508 - protein, 9 aa, Homo Sapiens
FQYPESSEE

SEQ ID NO: 241509 - protein, 9 aa, Homo Sapiens
CVEVVKTCN

SEQ ID NO: 241510 - protein, 9 aa, Homo Sapiens
PIQQRVYSL

SEQ ID NO: 241511 - protein, 9 aa, Homo Sapiens
KLQRQYCSP

SEQ ID NO: 241512 - protein, 9 aa, Homo Sapiens
EAKFDEEVH

SEQ ID NO: 241513 - protein, 9 aa, Homo Sapiens
SSSFVRNPA

SEQ ID NO: 241514 - protein, 9 aa, Homo Sapiens
LPSVLLFRK

SEQ ID NO: 241515 - protein, 9 aa, Homo Sapiens
LCDEGHGLK

SEQ ID NO: 241516 - protein, 9 aa, Homo Sapiens
IQEIQHDQE

SEQ ID NO: 241517 - protein, 9 aa, Homo Sapiens
IGDSLYFDF

SEQ ID NO: 241518 - protein, 9 aa, Homo Sapiens
ERCTDVNNS

SEQ ID NO: 241519 - protein, 9 aa, Homo Sapiens
LATAWLVGE

SEQ ID NO: 241520 - protein, 9 aa, Homo Sapiens
DVLDGLLAQ

SEQ ID NO: 241521 - protein, 9 aa, Homo Sapiens
QVSELNTQK

SEQ ID NO: 241522 - protein, 9 aa, Homo Sapiens
GYYTKCKCF

SEQ ID NO: 241523 - protein, 9 aa, Homo Sapiens
ISGTTAINY

SEQ ID NO: 241524 - protein, 9 aa, Homo Sapiens
AARNAVIHI

SEQ ID NO: 241525 - protein, 9 aa, Homo Sapiens
PGSFFFFNL

SEQ ID NO: 241526 - protein, 9 aa, Homo Sapiens
PEDRSVKPH

SEQ ID NO: 241527 - protein, 9 aa, Homo Sapiens
VGTWKVVSS

SEQ ID NO: 241528 - protein, 9 aa, Homo Sapiens
VHKLRELQT

SEQ ID NO: 241529 - protein, 9 aa, Homo Sapiens
QIHIEKYQR

SEQ ID NO: 241530 - protein, 9 aa, Homo Sapiens
YNSGNYGDK

SEQ ID NO: 241531 - protein, 9 aa, Homo Sapiens
PGALSVCNS

SEQ ID NO: 241532 - protein, 9 aa, Homo Sapiens
MNTFQASLS

SEQ ID NO: 241533 - protein, 9 aa, Homo Sapiens
NSCISALFM

SEQ ID NO: 241534 - protein, 9 aa, Homo Sapiens
LPSNNRQLI

SEQ ID NO: 241535 - protein, 9 aa, Homo Sapiens
VTACHSAPG

SEQ ID NO: 241536 - protein, 9 aa, Homo Sapiens
FNTDELNFP

SEQ ID NO: 241537 - protein, 9 aa, Homo Sapiens
QNEKQIATT

SEQ ID NO: 241538 - protein, 9 aa, Homo Sapiens
YFSVKTNIQ

SEQ ID NO: 241539 - protein, 9 aa, Homo Sapiens
LRPWIRELM

SEQ ID NO: 241540 - protein, 9 aa, Homo Sapiens
VGLPTNCLT

SEQ ID NO: 241541 - protein, 9 aa, Homo Sapiens
VQTFRLESE

SEQ ID NO: 241542 - protein, 9 aa, Homo Sapiens
MPCSFKVLQ

SEQ ID NO: 241543 - protein, 9 aa, Homo Sapiens
GSKSLGEDN

SEQ ID NO: 241544 - protein, 9 aa, Homo Sapiens
ADRYRSIVN

SEQ ID NO: 241545 - protein, 9 aa, Homo Sapiens
RERIEASRN

SEQ ID NO: 241546 - protein, 9 aa, Homo Sapiens
VSERSLQSW

SEQ ID NO: 241547 - protein, 9 aa, Homo Sapiens
DVAIELSLE

SEQ ID NO: 241548 - protein, 9 aa, Homo Sapiens
SISTLDYLD

SEQ ID NO: 241549 - protein, 9 aa, Homo Sapiens
ARHCRIHTG

SEQ ID NO: 241550 - protein, 9 aa, Homo Sapiens
PDLQNKVLI

SEQ ID NO: 241551 - protein, 9 aa, Homo Sapiens
TSLEKVYDL

SEQ ID NO: 241552 - protein, 9 aa, Homo Sapiens
SIYITCEPS

SEQ ID NO: 241553 - protein, 9 aa, Homo Sapiens
GVIALSLVD

SEQ ID NO: 241554 - protein, 9 aa, Homo Sapiens
ETKEALASN

SEQ ID NO: 241555 - protein, 9 aa, Homo Sapiens
FAFTLPFCG

SEQ ID NO: 241556 - protein, 9 aa, Homo Sapiens
EELQVKISD

SEQ ID NO: 241557 - protein, 9 aa, Homo Sapiens
QFFGHNVED

SEQ ID NO: 241558 - protein, 9 aa, Homo Sapiens
FLDAELDND

SEQ ID NO: 241559 - protein, 9 aa, Homo Sapiens
EDSITPSAQ

SEQ ID NO: 241560 - protein, 9 aa, Homo Sapiens
NIPDTYAHP

SEQ ID NO: 241561 - protein, 9 aa, Homo Sapiens
KIQKETSHS

SEQ ID NO: 241562 - protein, 9 aa, Homo Sapiens
SSSTEMQLM

SEQ ID NO: 241563 - protein, 9 aa, Homo Sapiens
RMNISPAKQ

SEQ ID NO: 241564 - protein, 9 aa, Homo Sapiens
SPSKHTQTG

SEQ ID NO: 241565 - protein, 9 aa, Homo Sapiens
TEDEAYLRQ

SEQ ID NO: 241566 - protein, 9 aa, Homo Sapiens
MPNWVRKVC

SEQ ID NO: 241567 - protein, 9 aa, Homo Sapiens
GVEFTKHLL

SEQ ID NO: 241568 - protein, 9 aa, Homo Sapiens
QKSHTFLPK

SEQ ID NO: 241569 - protein, 9 aa, Homo Sapiens
IIEELEDVL

SEQ ID NO: 241570 - protein, 9 aa, Homo Sapiens
ESNKRKSNL

SEQ ID NO: 241571 - protein, 9 aa, Homo Sapiens
KQCESTVRT

SEQ ID NO: 241572 - protein, 9 aa, Homo Sapiens
LSSSDRNDL

SEQ ID NO: 241573 - protein, 9 aa, Homo Sapiens
LVAFAHGNI

SEQ ID NO: 241574 - protein, 9 aa, Homo Sapiens
TFLKPIIPN

SEQ ID NO: 241575 - protein, 9 aa, Homo Sapiens
PDHPHPREG

SEQ ID NO: 241576 - protein, 9 aa, Homo Sapiens
PKGEQGYPG

SEQ ID NO: 241577 - protein, 9 aa, Homo Sapiens
DPHESFTCS

SEQ ID NO: 241578 - protein, 9 aa, Homo Sapiens
ASLERVSAL

SEQ ID NO: 241579 - protein, 9 aa, Homo Sapiens
ANSLSLVGA

SEQ ID NO: 241580 - protein, 9 aa, Homo Sapiens
GNWANRPYV

SEQ ID NO: 241581 - protein, 9 aa, Homo Sapiens
GIGGPPGLP

SEQ ID NO: 241582 - protein, 9 aa, Homo Sapiens
GFVCLLPLL

SEQ ID NO: 241583 - protein, 9 aa, Homo Sapiens
LLQVTSPVI

SEQ ID NO: 241584 - protein, 9 aa, Homo Sapiens
KPSADPDNS

SEQ ID NO: 241585 - protein, 9 aa, Homo Sapiens
IRIIIARSE

SEQ ID NO: 241586 - protein, 9 aa, Homo Sapiens
TSALHAAVP

SEQ ID NO: 241587 - protein, 9 aa, Homo Sapiens
QIEVCKSHS

SEQ ID NO: 241588 - protein, 9 aa, Homo Sapiens
IAFLQGKRK

SEQ ID NO: 241589 - protein, 9 aa, Homo Sapiens
EIRQRSQEG

SEQ ID NO: 241590 - protein, 9 aa, Homo Sapiens
HAGSKSSVM

SEQ ID NO: 241591 - protein, 9 aa, Homo Sapiens
MEIYFAPAT

SEQ ID NO: 241592 - protein, 9 aa, Homo Sapiens
TTPSCNRAR

SEQ ID NO: 241593 - protein, 9 aa, Homo Sapiens
LTQNRITVS

SEQ ID NO: 241594 - protein, 9 aa, Homo Sapiens
GHGRFQTAR

SEQ ID NO: 241595 - protein, 9 aa, Homo Sapiens
RQLPASQEE

SEQ ID NO: 241596 - protein, 9 aa, Homo Sapiens
LTHAEIIAW

SEQ ID NO: 241597 - protein, 9 aa, Homo Sapiens
KRHPQPELF

SEQ ID NO: 241598 - protein, 9 aa, Homo Sapiens
YFWWPMLLN

SEQ ID NO: 241599 - protein, 9 aa, Homo Sapiens
CAPTIRGIY

SEQ ID NO: 241600 - protein, 9 aa, Homo Sapiens
KNVCVSLVF

SEQ ID NO: 241601 - protein, 9 aa, Homo Sapiens
GLSAFIFFI

SEQ ID NO: 241602 - protein, 9 aa, Homo Sapiens
MSRPGVVES

SEQ ID NO: 241603 - protein, 9 aa, Homo Sapiens
KKLFSLAAT

SEQ ID NO: 241604 - protein, 9 aa, Homo Sapiens
IVPVDNKIY

SEQ ID NO: 241605 - protein, 9 aa, Homo Sapiens
VHPDTNQDD

SEQ ID NO: 241606 - protein, 9 aa, Homo Sapiens
NVGPNATRD

SEQ ID NO: 241607 - protein, 9 aa, Homo Sapiens
LNIHQIRSP

SEQ ID NO: 241608 - protein, 9 aa, Homo Sapiens
NKGKAEYNV

SEQ ID NO: 241609 - protein, 9 aa, Homo Sapiens
GSCINKIEN

SEQ ID NO: 241610 - protein, 9 aa, Homo Sapiens
YEKSLEFGP

SEQ ID NO: 241611 - protein, 9 aa, Homo Sapiens
SSNEPPNTF

SEQ ID NO: 241612 - protein, 9 aa, Homo Sapiens
DITTLIREC

SEQ ID NO: 241613 - protein, 9 aa, Homo Sapiens
FVVVLSILL

SEQ ID NO: 241614 - protein, 9 aa, Homo Sapiens
KPEAQRLNI

SEQ ID NO: 241615 - protein, 9 aa, Homo Sapiens
DLLRRTDRN

SEQ ID NO: 241616 - protein, 9 aa, Homo Sapiens
GVSALKEEC

SEQ ID NO: 241617 - protein, 9 aa, Homo Sapiens
ACPRMDDED

SEQ ID NO: 241618 - protein, 9 aa, Homo Sapiens
KKAVSLLYP

SEQ ID NO: 241619 - protein, 9 aa, Homo Sapiens
EGLRYFSGI

SEQ ID NO: 241620 - protein, 9 aa, Homo Sapiens
PDIVNSGGL

SEQ ID NO: 241621 - protein, 9 aa, Homo Sapiens
AIKHVKAAN

SEQ ID NO: 241622 - protein, 9 aa, Homo Sapiens
ISTEALENI

SEQ ID NO: 241623 - protein, 9 aa, Homo Sapiens
IKRSHSRSP

SEQ ID NO: 241624 - protein, 9 aa, Homo Sapiens
AWKLHNKSS

SEQ ID NO: 241625 - protein, 9 aa, Homo Sapiens
KTITPLRQR

SEQ ID NO: 241626 - protein, 9 aa, Homo Sapiens
FSKYWKKER

SEQ ID NO: 241627 - protein, 9 aa, Homo Sapiens
VDVDKPDDK

SEQ ID NO: 241628 - protein, 9 aa, Homo Sapiens
QDLKEFMRQ

SEQ ID NO: 241629 - protein, 9 aa, Homo Sapiens
ALGVELEPV

SEQ ID NO: 241630 - protein, 9 aa, Homo Sapiens
QMLEDGPHS

SEQ ID NO: 241631 - protein, 9 aa, Homo Sapiens
ETNELQQLQ

SEQ ID NO: 241632 - protein, 9 aa, Homo Sapiens
DNEIILFKG

SEQ ID NO: 241633 - protein, 9 aa, Homo Sapiens
RLEKDKWML

SEQ ID NO: 241634 - protein, 9 aa, Homo Sapiens
EITIRHDTF

SEQ ID NO: 241635 - protein, 9 aa, Homo Sapiens
EDSSLPTKE

SEQ ID NO: 241636 - protein, 9 aa, Homo Sapiens
VPVNLELQD

SEQ ID NO: 241637 - protein, 9 aa, Homo Sapiens
TSRHLRNFF

SEQ ID NO: 241638 - protein, 9 aa, Homo Sapiens
PGPKEPALD

SEQ ID NO: 241639 - protein, 9 aa, Homo Sapiens
VSEHLPYLS

SEQ ID NO: 241640 - protein, 9 aa, Homo Sapiens
VVAYQGFQA

SEQ ID NO: 241641 - protein, 9 aa, Homo Sapiens
GQTQSGKDK

SEQ ID NO: 241642 - protein, 9 aa, Homo Sapiens
NKSHLRKTT

SEQ ID NO: 241643 - protein, 9 aa, Homo Sapiens
DAEVCLNVL

SEQ ID NO: 241644 - protein, 9 aa, Homo Sapiens
INEAQDAAS

SEQ ID NO: 241645 - protein, 9 aa, Homo Sapiens
PSYNGGYGL

SEQ ID NO: 241646 - protein, 9 aa, Homo Sapiens
RSVNSREFS

SEQ ID NO: 241647 - protein, 9 aa, Homo Sapiens
PEQTSNVKM

SEQ ID NO: 241648 - protein, 9 aa, Homo Sapiens
LAPALACGN

SEQ ID NO: 241649 - protein, 9 aa, Homo Sapiens
RNKYMPQPP

SEQ ID NO: 241650 - protein, 9 aa, Homo Sapiens
SVKPHLCSL

SEQ ID NO: 241651 - protein, 9 aa, Homo Sapiens
KMYKDKYTK

SEQ ID NO: 241652 - protein, 9 aa, Homo Sapiens
ISCTYFIRT

SEQ ID NO: 241653 - protein, 9 aa, Homo Sapiens
PCSQEWHWM

SEQ ID NO: 241654 - protein, 9 aa, Homo Sapiens
NVTFKDQQK

SEQ ID NO: 241655 - protein, 9 aa, Homo Sapiens
KRVMEHDDQ

SEQ ID NO: 241656 - protein, 9 aa, Homo Sapiens
ELESLTDPP

SEQ ID NO: 241657 - protein, 9 aa, Homo Sapiens
TNIIKILFA

SEQ ID NO: 241658 - protein, 9 aa, Homo Sapiens
SGGRISLKH

SEQ ID NO: 241659 - protein, 9 aa, Homo Sapiens
GYTNGHNET

SEQ ID NO: 241660 - protein, 9 aa, Homo Sapiens
LEKRDFRKV

SEQ ID NO: 241661 - protein, 9 aa, Homo Sapiens
KCSLASSLR

SEQ ID NO: 241662 - protein, 9 aa, Homo Sapiens
MITNAKRLR

SEQ ID NO: 241663 - protein, 9 aa, Homo Sapiens
GPNATRDGV

SEQ ID NO: 241664 - protein, 9 aa, Homo Sapiens
SSSASMCMP

SEQ ID NO: 241665 - protein, 9 aa, Homo Sapiens
YILVYRQFL

SEQ ID NO: 241666 - protein, 9 aa, Homo Sapiens
GFDPFQLDG

SEQ ID NO: 241667 - protein, 9 aa, Homo Sapiens
TAVSTISYI

SEQ ID NO: 241668 - protein, 9 aa, Homo Sapiens
EKNGGGFMF

SEQ ID NO: 241669 - protein, 9 aa, Homo Sapiens
DTAFVEFEN

SEQ ID NO: 241670 - protein, 9 aa, Homo Sapiens
LSVFYCKNI

SEQ ID NO: 241671 - protein, 9 aa, Homo Sapiens
SKVQASLYG

SEQ ID NO: 241672 - protein, 9 aa, Homo Sapiens
WHSRNKNYK

SEQ ID NO: 241673 - protein, 9 aa, Homo Sapiens
ISQNHAVLT

SEQ ID NO: 241674 - protein, 9 aa, Homo Sapiens
SSPAAGSPQ

SEQ ID NO: 241675 - protein, 9 aa, Homo Sapiens
DYKYKEAFD

SEQ ID NO: 241676 - protein, 9 aa, Homo Sapiens
GMDMSVILE

SEQ ID NO: 241677 - protein, 9 aa, Homo Sapiens
QDFFDEPTS

SEQ ID NO: 241678 - protein, 9 aa, Homo Sapiens
LFPPVEAGK

SEQ ID NO: 241679 - protein, 9 aa, Homo Sapiens
WVAWLFLFS

SEQ ID NO: 241680 - protein, 9 aa, Homo Sapiens
KITDPSAVK

SEQ ID NO: 241681 - protein, 9 aa, Homo Sapiens
LLRRTDRNH

SEQ ID NO: 241682 - protein, 9 aa, Homo Sapiens
LESKPKQEC

SEQ ID NO: 241683 - protein, 9 aa, Homo Sapiens
EYEDMEHED

SEQ ID NO: 241684 - protein, 9 aa, Homo Sapiens
QKHLPRFKP

SEQ ID NO: 241685 - protein, 9 aa, Homo Sapiens
YDSDKSCRM

SEQ ID NO: 241686 - protein, 9 aa, Homo Sapiens
FLRPDPQRP

SEQ ID NO: 241687 - protein, 9 aa, Homo Sapiens
TPSLLSDSR

SEQ ID NO: 241688 - protein, 9 aa, Homo Sapiens
VSSEYHMDD

SEQ ID NO: 241689 - protein, 9 aa, Homo Sapiens
SVIRVLWGL

SEQ ID NO: 241690 - protein, 9 aa, Homo Sapiens
EEICKTFNI

SEQ ID NO: 241691 - protein, 9 aa, Homo Sapiens
LSANVMYTI

SEQ ID NO: 241692 - protein, 9 aa, Homo Sapiens
TRNSSILGP

SEQ ID NO: 241693 - protein, 9 aa, Homo Sapiens
NTLIEDSGY

SEQ ID NO: 241694 - protein, 9 aa, Homo Sapiens
RSSFNSCLD

SEQ ID NO: 241695 - protein, 9 aa, Homo Sapiens
QVNNVNEYA

SEQ ID NO: 241696 - protein, 9 aa, Homo Sapiens
GYSAFAGVG

SEQ ID NO: 241697 - protein, 9 aa, Homo Sapiens
NNVTQALSR

SEQ ID NO: 241698 - protein, 9 aa, Homo Sapiens
KKDSPFWLP

SEQ ID NO: 241699 - protein, 9 aa, Homo Sapiens
DPVLFATKV

SEQ ID NO: 241700 - protein, 9 aa, Homo Sapiens
GLIWGQNGR

SEQ ID NO: 241701 - protein, 9 aa, Homo Sapiens
YLENLDKLM

SEQ ID NO: 241702 - protein, 9 aa, Homo Sapiens
QYSLSFTKN

SEQ ID NO: 241703 - protein, 9 aa, Homo Sapiens
VDGDNETPS

SEQ ID NO: 241704 - protein, 9 aa, Homo Sapiens
REVGIPPEH

SEQ ID NO: 241705 - protein, 9 aa, Homo Sapiens
EVQAKSSNY

SEQ ID NO: 241706 - protein, 9 aa, Homo Sapiens
GSKPGIYVM

SEQ ID NO: 241707 - protein, 9 aa, Homo Sapiens
NIMKLSIIH

SEQ ID NO: 241708 - protein, 9 aa, Homo Sapiens
PHRCACYMP

SEQ ID NO: 241709 - protein, 9 aa, Homo Sapiens
NDIKWQTSG

SEQ ID NO: 241710 - protein, 9 aa, Homo Sapiens
DSDGDGKIS

SEQ ID NO: 241711 - protein, 9 aa, Homo Sapiens
EQDKKTEEL

SEQ ID NO: 241712 - protein, 9 aa, Homo Sapiens
LEWGDSEKY

SEQ ID NO: 241713 - protein, 9 aa, Homo Sapiens
QMFQALNRP

SEQ ID NO: 241714 - protein, 9 aa, Homo Sapiens
YFPVIQFKG

SEQ ID NO: 241715 - protein, 9 aa, Homo Sapiens
HVDTFEASV

SEQ ID NO: 241716 - protein, 9 aa, Homo Sapiens
KKYGDEINK

SEQ ID NO: 241717 - protein, 9 aa, Homo Sapiens
GLAQPTSAR

SEQ ID NO: 241718 - protein, 9 aa, Homo Sapiens
SNVIRKQGI

SEQ ID NO: 241719 - protein, 9 aa, Homo Sapiens
IISFQAVCR

SEQ ID NO: 241720 - protein, 9 aa, Homo Sapiens
ICQDCIRNK

SEQ ID NO: 241721 - protein, 9 aa, Homo Sapiens
HNKPPGTPP

SEQ ID NO: 241722 - protein, 9 aa, Homo Sapiens
MAKHLMKHG

SEQ ID NO: 241723 - protein, 9 aa, Homo Sapiens
HPDVATLLN

SEQ ID NO: 241724 - protein, 9 aa, Homo Sapiens
LFMLFFVLY

SEQ ID NO: 241725 - protein, 9 aa, Homo Sapiens
VVAGVSLLL

SEQ ID NO: 241726 - protein, 9 aa, Homo Sapiens
WFKKLFDAN

SEQ ID NO: 241727 - protein, 9 aa, Homo Sapiens
RVQTEKHVV

SEQ ID NO: 241728 - protein, 9 aa, Homo Sapiens
NAINKKFYR

SEQ ID NO: 241729 - protein, 9 aa, Homo Sapiens
SMSQVIFAF

SEQ ID NO: 241730 - protein, 9 aa, Homo Sapiens
EIGVLIRLS

SEQ ID NO: 241731 - protein, 9 aa, Homo Sapiens
IVHQIIHTG

SEQ ID NO: 241732 - protein, 9 aa, Homo Sapiens
VPSEEPSED

SEQ ID NO: 241733 - protein, 9 aa, Homo Sapiens
CGKQISKQL

SEQ ID NO: 241734 - protein, 9 aa, Homo Sapiens
VDASDLKTL

SEQ ID NO: 241735 - protein, 9 aa, Homo Sapiens
SAISMTMRS

SEQ ID NO: 241736 - protein, 9 aa, Homo Sapiens
GQCHCHQHM

SEQ ID NO: 241737 - protein, 9 aa, Homo Sapiens
HKFPKEKKR

SEQ ID NO: 241738 - protein, 9 aa, Homo Sapiens
MFEELRLVT

SEQ ID NO: 241739 - protein, 9 aa, Homo Sapiens
LRQIKMELQ

SEQ ID NO: 241740 - protein, 9 aa, Homo Sapiens
SFKLQSVAP

SEQ ID NO: 241741 - protein, 9 aa, Homo Sapiens
ILVFCVASV

SEQ ID NO: 241742 - protein, 9 aa, Homo Sapiens
FGDVLSEQD

SEQ ID NO: 241743 - protein, 9 aa, Homo Sapiens
ATKHPLECS

SEQ ID NO: 241744 - protein, 9 aa, Homo Sapiens
ALSYICRDG

SEQ ID NO: 241745 - protein, 9 aa, Homo Sapiens
FSVLSLTSE

SEQ ID NO: 241746 - protein, 9 aa, Homo Sapiens
PYDYEIIEV

SEQ ID NO: 241747 - protein, 9 aa, Homo Sapiens
SRNIDPQPP

SEQ ID NO: 241748 - protein, 9 aa, Homo Sapiens
FFCDCWPYL

SEQ ID NO: 241749 - protein, 9 aa, Homo Sapiens
PKKEASKCQ

SEQ ID NO: 241750 - protein, 9 aa, Homo Sapiens
REEQKRMNI

SEQ ID NO: 241751 - protein, 9 aa, Homo Sapiens
TLLTYVKGR

SEQ ID NO: 241752 - protein, 9 aa, Homo Sapiens
VVQNFEHLN

SEQ ID NO: 241753 - protein, 9 aa, Homo Sapiens
TNLKYMLES

SEQ ID NO: 241754 - protein, 9 aa, Homo Sapiens
FSNVIRKQG

SEQ ID NO: 241755 - protein, 9 aa, Homo Sapiens
ITKRAQDIY

SEQ ID NO: 241756 - protein, 9 aa, Homo Sapiens
NAYRRHDLS

SEQ ID NO: 241757 - protein, 9 aa, Homo Sapiens
KLLGRTLHQ

SEQ ID NO: 241758 - protein, 9 aa, Homo Sapiens
HVVFLVTFL

SEQ ID NO: 241759 - protein, 9 aa, Homo Sapiens
HCIFTIHVS

SEQ ID NO: 241760 - protein, 9 aa, Homo Sapiens
LKVIFYRGM

SEQ ID NO: 241761 - protein, 9 aa, Homo Sapiens
KKRTQKLKE

SEQ ID NO: 241762 - protein, 9 aa, Homo Sapiens
QLEGEIIDL

SEQ ID NO: 241763 - protein, 9 aa, Homo Sapiens
PNPGSNKPE

SEQ ID NO: 241764 - protein, 9 aa, Homo Sapiens
WSDSDSSTL

SEQ ID NO: 241765 - protein, 9 aa, Homo Sapiens
KSHLIIHQI

SEQ ID NO: 241766 - protein, 9 aa, Homo Sapiens
APIQDPKTE

SEQ ID NO: 241767 - protein, 9 aa, Homo Sapiens
GESHILLVG

SEQ ID NO: 241768 - protein, 9 aa, Homo Sapiens
IPILIIEGV

SEQ ID NO: 241769 - protein, 9 aa, Homo Sapiens
DDGIDLNQT

SEQ ID NO: 241770 - protein, 9 aa, Homo Sapiens
LEWRCCPDF

SEQ ID NO: 241771 - protein, 9 aa, Homo Sapiens
PLPPLLAQE

SEQ ID NO: 241772 - protein, 9 aa, Homo Sapiens
PTQISEHVF

SEQ ID NO: 241773 - protein, 9 aa, Homo Sapiens
LERHNERKR

SEQ ID NO: 241774 - protein, 9 aa, Homo Sapiens
LDRICKLAD

SEQ ID NO: 241775 - protein, 9 aa, Homo Sapiens
LQFLTAVQN

SEQ ID NO: 241776 - protein, 9 aa, Homo Sapiens
VSVTPGEKM

SEQ ID NO: 241777 - protein, 9 aa, Homo Sapiens
CRHVHRNIL

SEQ ID NO: 241778 - protein, 9 aa, Homo Sapiens
EEPMFVVTG

SEQ ID NO: 241779 - protein, 9 aa, Homo Sapiens
IVESGNFKN

SEQ ID NO: 241780 - protein, 9 aa, Homo Sapiens
KFKKMCDLL

SEQ ID NO: 241781 - protein, 9 aa, Homo Sapiens
QLRKGDKFV

SEQ ID NO: 241782 - protein, 9 aa, Homo Sapiens
MLFFSAFLV

SEQ ID NO: 241783 - protein, 9 aa, Homo Sapiens
IPLFEGCIW

SEQ ID NO: 241784 - protein, 9 aa, Homo Sapiens
FQERISHSY

SEQ ID NO: 241785 - protein, 9 aa, Homo Sapiens
EELVQVVDN

SEQ ID NO: 241786 - protein, 9 aa, Homo Sapiens
MEMKDQGAQ

SEQ ID NO: 241787 - protein, 9 aa, Homo Sapiens
QKKCKLTRN

SEQ ID NO: 241788 - protein, 9 aa, Homo Sapiens
SLLGSGTTA

SEQ ID NO: 241789 - protein, 9 aa, Homo Sapiens
VDKEAISVV

SEQ ID NO: 241790 - protein, 9 aa, Homo Sapiens
NNVIFITNP

SEQ ID NO: 241791 - protein, 9 aa, Homo Sapiens
AEGLPTPIM

SEQ ID NO: 241792 - protein, 9 aa, Homo Sapiens
LLESDDDKM

SEQ ID NO: 241793 - protein, 9 aa, Homo Sapiens
ECDECGTSF

SEQ ID NO: 241794 - protein, 9 aa, Homo Sapiens
SFRLKPGTT

SEQ ID NO: 241795 - protein, 9 aa, Homo Sapiens
ESLTQVPNS

SEQ ID NO: 241796 - protein, 9 aa, Homo Sapiens
RENELPNFP

SEQ ID NO: 241797 - protein, 9 aa, Homo Sapiens
TRPQDTISS

SEQ ID NO: 241798 - protein, 9 aa, Homo Sapiens
NSTLQGTYQ

SEQ ID NO: 241799 - protein, 9 aa, Homo Sapiens
EYSNKNAVV

SEQ ID NO: 241800 - protein, 9 aa, Homo Sapiens
FTGTTEAQN

SEQ ID NO: 241801 - protein, 9 aa, Homo Sapiens
DDVPESILL

SEQ ID NO: 241802 - protein, 9 aa, Homo Sapiens
YYIHPVCLP

SEQ ID NO: 241803 - protein, 9 aa, Homo Sapiens
ISACMAEIL

SEQ ID NO: 241804 - protein, 9 aa, Homo Sapiens
KEIELEMAK

SEQ ID NO: 241805 - protein, 9 aa, Homo Sapiens
FSIWSLELS

SEQ ID NO: 241806 - protein, 9 aa, Homo Sapiens
TLFHKSGVI

SEQ ID NO: 241807 - protein, 9 aa, Homo Sapiens
VPSAWRSRD

SEQ ID NO: 241808 - protein, 9 aa, Homo Sapiens
DSQYCTYLD

SEQ ID NO: 241809 - protein, 9 aa, Homo Sapiens
NIEEANQVL

SEQ ID NO: 241810 - protein, 9 aa, Homo Sapiens
SQLRLNPHF

SEQ ID NO: 241811 - protein, 9 aa, Homo Sapiens
QEELKISRS

SEQ ID NO: 241812 - protein, 9 aa, Homo Sapiens
IFQALLQNN

SEQ ID NO: 241813 - protein, 9 aa, Homo Sapiens
TVCHPKYIY

SEQ ID NO: 241814 - protein, 9 aa, Homo Sapiens
AAHYLVGTP

SEQ ID NO: 241815 - protein, 9 aa, Homo Sapiens
LIIGIYCAV

SEQ ID NO: 241816 - protein, 9 aa, Homo Sapiens
TVQSKLHNT

SEQ ID NO: 241817 - protein, 9 aa, Homo Sapiens
LLLGQVGAL

SEQ ID NO: 241818 - protein, 9 aa, Homo Sapiens
ARLNESHFI

SEQ ID NO: 241819 - protein, 9 aa, Homo Sapiens
EVDAYVMVI

SEQ ID NO: 241820 - protein, 9 aa, Homo Sapiens
AEGVSMRTN

SEQ ID NO: 241821 - protein, 9 aa, Homo Sapiens
IDDEEFFIK

SEQ ID NO: 241822 - protein, 9 aa, Homo Sapiens
KHLKGQHEA

SEQ ID NO: 241823 - protein, 9 aa, Homo Sapiens
TFTYVFLRQ

SEQ ID NO: 241824 - protein, 9 aa, Homo Sapiens
ALVNFLDID

SEQ ID NO: 241825 - protein, 9 aa, Homo Sapiens
SKDVSDKYQ

SEQ ID NO: 241826 - protein, 9 aa, Homo Sapiens
LIYDKLGEK

SEQ ID NO: 241827 - protein, 9 aa, Homo Sapiens
PSPDQKDSD

SEQ ID NO: 241828 - protein, 9 aa, Homo Sapiens
AISGIRPEN

SEQ ID NO: 241829 - protein, 9 aa, Homo Sapiens
RNMLNAGQD

SEQ ID NO: 241830 - protein, 9 aa, Homo Sapiens
RKKHRKHFK

SEQ ID NO: 241831 - protein, 9 aa, Homo Sapiens
IEARDGKLV

SEQ ID NO: 241832 - protein, 9 aa, Homo Sapiens
GFRKEAGYF

SEQ ID NO: 241833 - protein, 9 aa, Homo Sapiens
RVMLFEKME

SEQ ID NO: 241834 - protein, 9 aa, Homo Sapiens
LVGDIGDNV

SEQ ID NO: 241835 - protein, 9 aa, Homo Sapiens
LNKRPDEGM

SEQ ID NO: 241836 - protein, 9 aa, Homo Sapiens
TFLSEIQWE

SEQ ID NO: 241837 - protein, 9 aa, Homo Sapiens
FLLVGFAGV

SEQ ID NO: 241838 - protein, 9 aa, Homo Sapiens
ELPLPQFCS

SEQ ID NO: 241839 - protein, 9 aa, Homo Sapiens
RQVVQGLEV

SEQ ID NO: 241840 - protein, 9 aa, Homo Sapiens
LELQRRVHG

SEQ ID NO: 241841 - protein, 9 aa, Homo Sapiens
EKVLEKEEN

SEQ ID NO: 241842 - protein, 9 aa, Homo Sapiens
GTRHRALIR

SEQ ID NO: 241843 - protein, 9 aa, Homo Sapiens
EVKANAFHS

SEQ ID NO: 241844 - protein, 9 aa, Homo Sapiens
GARVFLRQN

SEQ ID NO: 241845 - protein, 9 aa, Homo Sapiens
NCFELWKLG

SEQ ID NO: 241846 - protein, 9 aa, Homo Sapiens
TADIYLAKR

SEQ ID NO: 241847 - protein, 9 aa, Homo Sapiens
NVCQLESEE

SEQ ID NO: 241848 - protein, 9 aa, Homo Sapiens
CSLSAGDLG

SEQ ID NO: 241849 - protein, 9 aa, Homo Sapiens
SLTATTKSE

SEQ ID NO: 241850 - protein, 9 aa, Homo Sapiens
RPEPTVTWI

SEQ ID NO: 241851 - protein, 9 aa, Homo Sapiens
PENAGDIPC

SEQ ID NO: 241852 - protein, 9 aa, Homo Sapiens
KKLDPIVTR

SEQ ID NO: 241853 - protein, 9 aa, Homo Sapiens
LTKKRREIT

SEQ ID NO: 241854 - protein, 9 aa, Homo Sapiens
LLDRRNYPM

SEQ ID NO: 241855 - protein, 9 aa, Homo Sapiens
DIIEAIHTF

SEQ ID NO: 241856 - protein, 9 aa, Homo Sapiens
ADLSSQIRS

SEQ ID NO: 241857 - protein, 9 aa, Homo Sapiens
LDEIYGDTI

SEQ ID NO: 241858 - protein, 9 aa, Homo Sapiens
LRKADKRSQ

SEQ ID NO: 241859 - protein, 9 aa, Homo Sapiens
FECGTYAEE

SEQ ID NO: 241860 - protein, 9 aa, Homo Sapiens
DWQWQYDAN

SEQ ID NO: 241861 - protein, 9 aa, Homo Sapiens
LKAKWLTSK

SEQ ID NO: 241862 - protein, 9 aa, Homo Sapiens
QAKAVLKTL

SEQ ID NO: 241863 - protein, 9 aa, Homo Sapiens
RFHPYSKDN

SEQ ID NO: 241864 - protein, 9 aa, Homo Sapiens
EEEKREDKL

SEQ ID NO: 241865 - protein, 9 aa, Homo Sapiens
LMYGLDSRG

SEQ ID NO: 241866 - protein, 9 aa, Homo Sapiens
LLTDHMNLL

SEQ ID NO: 241867 - protein, 9 aa, Homo Sapiens
GHPPLSGCS

SEQ ID NO: 241868 - protein, 9 aa, Homo Sapiens
AVVVKKIEA

SEQ ID NO: 241869 - protein, 9 aa, Homo Sapiens
HLLSCSFPD

SEQ ID NO: 241870 - protein, 9 aa, Homo Sapiens
RPSFTSIHQ

SEQ ID NO: 241871 - protein, 9 aa, Homo Sapiens
CALHEQPEL

SEQ ID NO: 241872 - protein, 9 aa, Homo Sapiens
RKALKVLGI

SEQ ID NO: 241873 - protein, 9 aa, Homo Sapiens
KITQFWLYF

SEQ ID NO: 241874 - protein, 9 aa, Homo Sapiens
QAAKNLAKA

SEQ ID NO: 241875 - protein, 9 aa, Homo Sapiens
KEQKANETI

SEQ ID NO: 241876 - protein, 9 aa, Homo Sapiens
NHFSRAVAD

SEQ ID NO: 241877 - protein, 9 aa, Homo Sapiens
GPRERREDG

SEQ ID NO: 241878 - protein, 9 aa, Homo Sapiens
DFLEPESVI

SEQ ID NO: 241879 - protein, 9 aa, Homo Sapiens
HIANRAMEN

SEQ ID NO: 241880 - protein, 9 aa, Homo Sapiens
ESSNKGTVQ

SEQ ID NO: 241881 - protein, 9 aa, Homo Sapiens
RWINEAQDA

SEQ ID NO: 241882 - protein, 9 aa, Homo Sapiens
FNKVVPHHC

SEQ ID NO: 241883 - protein, 9 aa, Homo Sapiens
MAAYQESCV

SEQ ID NO: 241884 - protein, 9 aa, Homo Sapiens
EGVRSLVRR

SEQ ID NO: 241885 - protein, 9 aa, Homo Sapiens
IRDLESGVE

SEQ ID NO: 241886 - protein, 9 aa, Homo Sapiens
FNNILNSFI

SEQ ID NO: 241887 - protein, 9 aa, Homo Sapiens
TLPVVAGIK

SEQ ID NO: 241888 - protein, 9 aa, Homo Sapiens
CAIQISKSP

SEQ ID NO: 241889 - protein, 9 aa, Homo Sapiens
KYEKDDMKM

SEQ ID NO: 241890 - protein, 9 aa, Homo Sapiens
LLFGGHKTT

SEQ ID NO: 241891 - protein, 9 aa, Homo Sapiens
YFVNMNIST

SEQ ID NO: 241892 - protein, 9 aa, Homo Sapiens
RIHYNTMIE

SEQ ID NO: 241893 - protein, 9 aa, Homo Sapiens
QLSQRLKNG

SEQ ID NO: 241894 - protein, 9 aa, Homo Sapiens
SNQMAEKTD

SEQ ID NO: 241895 - protein, 9 aa, Homo Sapiens
VVQIVEKLI

SEQ ID NO: 241896 - protein, 9 aa, Homo Sapiens
LIYVDKDNG

SEQ ID NO: 241897 - protein, 9 aa, Homo Sapiens
KAAFLCQPS

SEQ ID NO: 241898 - protein, 9 aa, Homo Sapiens
GLRTAGLFR

SEQ ID NO: 241899 - protein, 9 aa, Homo Sapiens
ERLFLHSNK

SEQ ID NO: 241900 - protein, 9 aa, Homo Sapiens
MKHLYFRVI

SEQ ID NO: 241901 - protein, 9 aa, Homo Sapiens
TDFSGLWRA

SEQ ID NO: 241902 - protein, 9 aa, Homo Sapiens
LVHVQDVIK

SEQ ID NO: 241903 - protein, 9 aa, Homo Sapiens
THKNKDCFE

SEQ ID NO: 241904 - protein, 9 aa, Homo Sapiens
REKYPRAGS

SEQ ID NO: 241905 - protein, 9 aa, Homo Sapiens
WMGIKSEDE

SEQ ID NO: 241906 - protein, 9 aa, Homo Sapiens
INQVFQSLR

SEQ ID NO: 241907 - protein, 9 aa, Homo Sapiens
LIQAQSIGA

SEQ ID NO: 241908 - protein, 9 aa, Homo Sapiens
SQSCKLDKT

SEQ ID NO: 241909 - protein, 9 aa, Homo Sapiens
MSLESLLSN

SEQ ID NO: 241910 - protein, 9 aa, Homo Sapiens
GTVIYLPLS

SEQ ID NO: 241911 - protein, 9 aa, Homo Sapiens
SPLKWSVCY

SEQ ID NO: 241912 - protein, 9 aa, Homo Sapiens
ENLARNLGK

SEQ ID NO: 241913 - protein, 9 aa, Homo Sapiens
CERILYVDL

SEQ ID NO: 241914 - protein, 9 aa, Homo Sapiens
PFFGWSWFI

SEQ ID NO: 241915 - protein, 9 aa, Homo Sapiens
VLMKLIIFS

SEQ ID NO: 241916 - protein, 9 aa, Homo Sapiens
HLTATHPAN

SEQ ID NO: 241917 - protein, 9 aa, Homo Sapiens
NTQDPFLTG

SEQ ID NO: 241918 - protein, 9 aa, Homo Sapiens
NQEKEDILK

SEQ ID NO: 241919 - protein, 9 aa, Homo Sapiens
GGDHFCLGQ

SEQ ID NO: 241920 - protein, 9 aa, Homo Sapiens
LEDLNDLIM

SEQ ID NO: 241921 - protein, 9 aa, Homo Sapiens
SSGQMEFLE

SEQ ID NO: 241922 - protein, 9 aa, Homo Sapiens
TKLSCDDIR

SEQ ID NO: 241923 - protein, 9 aa, Homo Sapiens
QRSVKLSWQ

SEQ ID NO: 241924 - protein, 9 aa, Homo Sapiens
ERAGRKEAG

SEQ ID NO: 241925 - protein, 9 aa, Homo Sapiens
LYHAMAGND

SEQ ID NO: 241926 - protein, 9 aa, Homo Sapiens
MLVYFNFFK

SEQ ID NO: 241927 - protein, 9 aa, Homo Sapiens
KVEDSERKA

SEQ ID NO: 241928 - protein, 9 aa, Homo Sapiens
ATGIIIVMS

SEQ ID NO: 241929 - protein, 9 aa, Homo Sapiens
FLFQNPDNK

SEQ ID NO: 241930 - protein, 9 aa, Homo Sapiens
CTEELGVLA

SEQ ID NO: 241931 - protein, 9 aa, Homo Sapiens
VIFPLRNPI

SEQ ID NO: 241932 - protein, 9 aa, Homo Sapiens
VLYLGSIST

SEQ ID NO: 241933 - protein, 9 aa, Homo Sapiens
KLFLYFSYL

SEQ ID NO: 241934 - protein, 9 aa, Homo Sapiens
FSAIRSHHS

SEQ ID NO: 241935 - protein, 9 aa, Homo Sapiens
GPFNPYEPK

SEQ ID NO: 241936 - protein, 9 aa, Homo Sapiens
ETTCPQCHQ

SEQ ID NO: 241937 - protein, 9 aa, Homo Sapiens
YQMAVRLTT

SEQ ID NO: 241938 - protein, 9 aa, Homo Sapiens
PLKVYHQQY

SEQ ID NO: 241939 - protein, 9 aa, Homo Sapiens
QEDTHCILL

SEQ ID NO: 241940 - protein, 9 aa, Homo Sapiens
LGSTETKIL

SEQ ID NO: 241941 - protein, 9 aa, Homo Sapiens
LNEEVTHVI

SEQ ID NO: 241942 - protein, 9 aa, Homo Sapiens
LEHRDSIGL

SEQ ID NO: 241943 - protein, 9 aa, Homo Sapiens
DEFLNKPAR

SEQ ID NO: 241944 - protein, 9 aa, Homo Sapiens
RLTNLKYML

SEQ ID NO: 241945 - protein, 9 aa, Homo Sapiens
TFTEDPHLV

SEQ ID NO: 241946 - protein, 9 aa, Homo Sapiens
FIKICDELC

SEQ ID NO: 241947 - protein, 9 aa, Homo Sapiens
NTSQESKAQ

SEQ ID NO: 241948 - protein, 9 aa, Homo Sapiens
VVHLGEWWS

SEQ ID NO: 241949 - protein, 9 aa, Homo Sapiens
TKEIISPGI

SEQ ID NO: 241950 - protein, 9 aa, Homo Sapiens
VGFGTQSRN

SEQ ID NO: 241951 - protein, 9 aa, Homo Sapiens
SLQMFQALN

SEQ ID NO: 241952 - protein, 9 aa, Homo Sapiens
QTFSPGAQS

SEQ ID NO: 241953 - protein, 9 aa, Homo Sapiens
DSCETMMEH

SEQ ID NO: 241954 - protein, 9 aa, Homo Sapiens
IKRIMLRIP

SEQ ID NO: 241955 - protein, 9 aa, Homo Sapiens
VSVHFLDSK

SEQ ID NO: 241956 - protein, 9 aa, Homo Sapiens
YPPDNLRVM

SEQ ID NO: 241957 - protein, 9 aa, Homo Sapiens
EKEGFVTEM

SEQ ID NO: 241958 - protein, 9 aa, Homo Sapiens
KTGECSDKL

SEQ ID NO: 241959 - protein, 9 aa, Homo Sapiens
VKQEMIEAL

SEQ ID NO: 241960 - protein, 9 aa, Homo Sapiens
ALQVTKPYL

SEQ ID NO: 241961 - protein, 9 aa, Homo Sapiens
TTSEAQPCT

SEQ ID NO: 241962 - protein, 9 aa, Homo Sapiens
CRSREIFAI

SEQ ID NO: 241963 - protein, 9 aa, Homo Sapiens
FMSKALGIG

SEQ ID NO: 241964 - protein, 9 aa, Homo Sapiens
FIECFIIYA

SEQ ID NO: 241965 - protein, 9 aa, Homo Sapiens
DRLERGSLK

SEQ ID NO: 241966 - protein, 9 aa, Homo Sapiens
AGDLGDSSA

SEQ ID NO: 241967 - protein, 9 aa, Homo Sapiens
FLTSRRPHL

SEQ ID NO: 241968 - protein, 9 aa, Homo Sapiens
VPQENGLED

SEQ ID NO: 241969 - protein, 9 aa, Homo Sapiens
TNLRLKFVK

SEQ ID NO: 241970 - protein, 9 aa, Homo Sapiens
VKTSVKPSQ

SEQ ID NO: 241971 - protein, 9 aa, Homo Sapiens
FIRKNKDKC

SEQ ID NO: 241972 - protein, 9 aa, Homo Sapiens
LQSMFEIIC

SEQ ID NO: 241973 - protein, 9 aa, Homo Sapiens
QDAASQSCC

SEQ ID NO: 241974 - protein, 9 aa, Homo Sapiens
AIMESMLNT

SEQ ID NO: 241975 - protein, 9 aa, Homo Sapiens
HDPKKNRHW

SEQ ID NO: 241976 - protein, 9 aa, Homo Sapiens
LSDRLERGS

SEQ ID NO: 241977 - protein, 9 aa, Homo Sapiens
IVHKPSYFW

SEQ ID NO: 241978 - protein, 9 aa, Homo Sapiens
YKDGDIDSY

SEQ ID NO: 241979 - protein, 9 aa, Homo Sapiens
TDTSVKIND

SEQ ID NO: 241980 - protein, 9 aa, Homo Sapiens
VQNKSKSLS

SEQ ID NO: 241981 - protein, 9 aa, Homo Sapiens
RKSGSLALL

SEQ ID NO: 241982 - protein, 9 aa, Homo Sapiens
FWWPMLLNM

SEQ ID NO: 241983 - protein, 9 aa, Homo Sapiens
SMKVQGSPL

SEQ ID NO: 241984 - protein, 9 aa, Homo Sapiens
YLNMNVNSF

SEQ ID NO: 241985 - protein, 9 aa, Homo Sapiens
KLKEMSPGF

SEQ ID NO: 241986 - protein, 9 aa, Homo Sapiens
VALSMVLVL

SEQ ID NO: 241987 - protein, 9 aa, Homo Sapiens
LIKILTTSN

SEQ ID NO: 241988 - protein, 9 aa, Homo Sapiens
IIQTYFIWV

SEQ ID NO: 241989 - protein, 9 aa, Homo Sapiens
QLRNDSNFA

SEQ ID NO: 241990 - protein, 9 aa, Homo Sapiens
TSRSEQLTD

SEQ ID NO: 241991 - protein, 9 aa, Homo Sapiens
ELWRLETQV

SEQ ID NO: 241992 - protein, 9 aa, Homo Sapiens
VVVVPHILA

SEQ ID NO: 241993 - protein, 9 aa, Homo Sapiens
PQKVRIHLQ

SEQ ID NO: 241994 - protein, 9 aa, Homo Sapiens
KFIFKDKER

SEQ ID NO: 241995 - protein, 9 aa, Homo Sapiens
LIRKSTFKN

SEQ ID NO: 241996 - protein, 9 aa, Homo Sapiens
DDVSGTDEE

SEQ ID NO: 241997 - protein, 9 aa, Homo Sapiens
AGSPTLFNC

SEQ ID NO: 241998 - protein, 9 aa, Homo Sapiens
QSWRNHHCA

SEQ ID NO: 241999 - protein, 9 aa, Homo Sapiens
NYLRTSTGR

SEQ ID NO: 242000 - protein, 9 aa, Homo Sapiens
VDFLGHVGG

SEQ ID NO: 242001 - protein, 9 aa, Homo Sapiens
DIHYFPTEI

SEQ ID NO: 242002 - protein, 9 aa, Homo Sapiens
EVKYLGPLE

SEQ ID NO: 242003 - protein, 9 aa, Homo Sapiens
FLPFSSYHN

SEQ ID NO: 242004 - protein, 9 aa, Homo Sapiens
KHTTSAEKN

SEQ ID NO: 242005 - protein, 9 aa, Homo Sapiens
AMVIHATWR

SEQ ID NO: 242006 - protein, 9 aa, Homo Sapiens
KLSDEYLTK

SEQ ID NO: 242007 - protein, 9 aa, Homo Sapiens
RLFCPQPKE

SEQ ID NO: 242008 - protein, 9 aa, Homo Sapiens
KIHEKVFSP

SEQ ID NO: 242009 - protein, 9 aa, Homo Sapiens
QQVGADTTP

SEQ ID NO: 242010 - protein, 9 aa, Homo Sapiens
IGVCSNNVE

SEQ ID NO: 242011 - protein, 9 aa, Homo Sapiens
VEDFKKKYG

SEQ ID NO: 242012 - protein, 9 aa, Homo Sapiens
TTLLNRNRK

SEQ ID NO: 242013 - protein, 9 aa, Homo Sapiens
VNSREFSRI

SEQ ID NO: 242014 - protein, 9 aa, Homo Sapiens
KTELKKLEK

SEQ ID NO: 242015 - protein, 9 aa, Homo Sapiens
GLGEYLFKR

SEQ ID NO: 242016 - protein, 9 aa, Homo Sapiens
DIDSTLDSS

SEQ ID NO: 242017 - protein, 9 aa, Homo Sapiens
SNPLLNGRY

SEQ ID NO: 242018 - protein, 9 aa, Homo Sapiens
EDIKARPDM

SEQ ID NO: 242019 - protein, 9 aa, Homo Sapiens
LTWPFCVLT

SEQ ID NO: 242020 - protein, 9 aa, Homo Sapiens
KHYGNNKYR

SEQ ID NO: 242021 - protein, 9 aa, Homo Sapiens
STVSTKSQS

SEQ ID NO: 242022 - protein, 9 aa, Homo Sapiens
FNSAFRPSQ

SEQ ID NO: 242023 - protein, 9 aa, Homo Sapiens
IKAGEQSVL

SEQ ID NO: 242024 - protein, 9 aa, Homo Sapiens
VAWVSAQAC

SEQ ID NO: 242025 - protein, 9 aa, Homo Sapiens
KGCDDYVFI

SEQ ID NO: 242026 - protein, 9 aa, Homo Sapiens
LFCQKCSHF

SEQ ID NO: 242027 - protein, 9 aa, Homo Sapiens
LKYGSQMES

SEQ ID NO: 242028 - protein, 9 aa, Homo Sapiens
RTVHLYDKW

SEQ ID NO: 242029 - protein, 9 aa, Homo Sapiens
FQKPDSCPP

SEQ ID NO: 242030 - protein, 9 aa, Homo Sapiens
MATDISRLQ

SEQ ID NO: 242031 - protein, 9 aa, Homo Sapiens
LEGAEKGRK

SEQ ID NO: 242032 - protein, 9 aa, Homo Sapiens
LAGPITTRE

SEQ ID NO: 242033 - protein, 9 aa, Homo Sapiens
RVVKVVKPK

SEQ ID NO: 242034 - protein, 9 aa, Homo Sapiens
DLSSDYLIP

SEQ ID NO: 242035 - protein, 9 aa, Homo Sapiens
GIPKFSHRQ

SEQ ID NO: 242036 - protein, 9 aa, Homo Sapiens
TGDLPGTSY

SEQ ID NO: 242037 - protein, 9 aa, Homo Sapiens
GRDADECHQ

SEQ ID NO: 242038 - protein, 9 aa, Homo Sapiens
CRSRVPVIR

SEQ ID NO: 242039 - protein, 9 aa, Homo Sapiens
MTFLWLLSA

SEQ ID NO: 242040 - protein, 9 aa, Homo Sapiens
RRFFSKEFL

SEQ ID NO: 242041 - protein, 9 aa, Homo Sapiens
NAEFDCHEI

SEQ ID NO: 242042 - protein, 9 aa, Homo Sapiens
ADGPTYGSS

SEQ ID NO: 242043 - protein, 9 aa, Homo Sapiens
KASTRRKRR

SEQ ID NO: 242044 - protein, 9 aa, Homo Sapiens
AEYSIYITC

SEQ ID NO: 242045 - protein, 9 aa, Homo Sapiens
QGYPGIPGM

SEQ ID NO: 242046 - protein, 9 aa, Homo Sapiens
IPTGMTCLE

SEQ ID NO: 242047 - protein, 9 aa, Homo Sapiens
VSHLAQHQK

SEQ ID NO: 242048 - protein, 9 aa, Homo Sapiens
LCHPGWSTM

SEQ ID NO: 242049 - protein, 9 aa, Homo Sapiens
KYNCGFFET

SEQ ID NO: 242050 - protein, 9 aa, Homo Sapiens
VNKIFMAIA

SEQ ID NO: 242051 - protein, 9 aa, Homo Sapiens
DACLNGNFR

SEQ ID NO: 242052 - protein, 9 aa, Homo Sapiens
FRDVTIELS

SEQ ID NO: 242053 - protein, 9 aa, Homo Sapiens
VKVKVNLSD

SEQ ID NO: 242054 - protein, 9 aa, Homo Sapiens
VMFIKAIHA

SEQ ID NO: 242055 - protein, 9 aa, Homo Sapiens
ITNYYYGNT

SEQ ID NO: 242056 - protein, 9 aa, Homo Sapiens
SQYRYARIY

SEQ ID NO: 242057 - protein, 9 aa, Homo Sapiens
YDIDPSNGI

SEQ ID NO: 242058 - protein, 9 aa, Homo Sapiens
FEYKEHGPF

SEQ ID NO: 242059 - protein, 9 aa, Homo Sapiens
ECKQCSNAF

SEQ ID NO: 242060 - protein, 9 aa, Homo Sapiens
GEKHFSCPL

SEQ ID NO: 242061 - protein, 9 aa, Homo Sapiens
CAMKKYIKT

SEQ ID NO: 242062 - protein, 9 aa, Homo Sapiens
IPRFSPATH

SEQ ID NO: 242063 - protein, 9 aa, Homo Sapiens
QSDISFQNT

SEQ ID NO: 242064 - protein, 9 aa, Homo Sapiens
VYLANTQPR

SEQ ID NO: 242065 - protein, 9 aa, Homo Sapiens
FSPPTQAPT

SEQ ID NO: 242066 - protein, 9 aa, Homo Sapiens
KFDRQASLR

SEQ ID NO: 242067 - protein, 9 aa, Homo Sapiens
GNQGRIGVV

SEQ ID NO: 242068 - protein, 9 aa, Homo Sapiens
QCSLTELYA

SEQ ID NO: 242069 - protein, 9 aa, Homo Sapiens
VTSKCELYT

SEQ ID NO: 242070 - protein, 9 aa, Homo Sapiens
CLFIYVKPK

SEQ ID NO: 242071 - protein, 9 aa, Homo Sapiens
ILFEESNLR

SEQ ID NO: 242072 - protein, 9 aa, Homo Sapiens
MRKFFSFTP

SEQ ID NO: 242073 - protein, 9 aa, Homo Sapiens
VFAIMSPGQ

SEQ ID NO: 242074 - protein, 9 aa, Homo Sapiens
SPWDPRTVV

SEQ ID NO: 242075 - protein, 9 aa, Homo Sapiens
GKLPVHRFC

SEQ ID NO: 242076 - protein, 9 aa, Homo Sapiens
GGGEGGVTW

SEQ ID NO: 242077 - protein, 9 aa, Homo Sapiens
RVDRLDQRH

SEQ ID NO: 242078 - protein, 9 aa, Homo Sapiens
LRALLGEKI

SEQ ID NO: 242079 - protein, 9 aa, Homo Sapiens
NLIGDSLYF

SEQ ID NO: 242080 - protein, 9 aa, Homo Sapiens
QNTMKFGKN

SEQ ID NO: 242081 - protein, 9 aa, Homo Sapiens
TERIMQGAP

SEQ ID NO: 242082 - protein, 9 aa, Homo Sapiens
YIMNQVNSQ

SEQ ID NO: 242083 - protein, 9 aa, Homo Sapiens
FQMVRTQRQ

SEQ ID NO: 242084 - protein, 9 aa, Homo Sapiens
FFFHCIWMP

SEQ ID NO: 242085 - protein, 9 aa, Homo Sapiens
HPSPAEYVK

SEQ ID NO: 242086 - protein, 9 aa, Homo Sapiens
ANPKYIIHF

SEQ ID NO: 242087 - protein, 9 aa, Homo Sapiens
ILHTNAKVG

SEQ ID NO: 242088 - protein, 9 aa, Homo Sapiens
LLLASGAPR

SEQ ID NO: 242089 - protein, 9 aa, Homo Sapiens
AWINRCQNR

SEQ ID NO: 242090 - protein, 9 aa, Homo Sapiens
PHGPMPQNK

SEQ ID NO: 242091 - protein, 9 aa, Homo Sapiens
NLKAQEYEK

SEQ ID NO: 242092 - protein, 9 aa, Homo Sapiens
AADTLLQQD

SEQ ID NO: 242093 - protein, 9 aa, Homo Sapiens
GSYESVFKA

SEQ ID NO: 242094 - protein, 9 aa, Homo Sapiens
SLPHSAVSH

SEQ ID NO: 242095 - protein, 9 aa, Homo Sapiens
SESADEVRR

SEQ ID NO: 242096 - protein, 9 aa, Homo Sapiens
IFTYASHPH

SEQ ID NO: 242097 - protein, 9 aa, Homo Sapiens
GKAALVGMY

SEQ ID NO: 242098 - protein, 9 aa, Homo Sapiens
QDEGILWNK

SEQ ID NO: 242099 - protein, 9 aa, Homo Sapiens
TGQCNFGSN

SEQ ID NO: 242100 - protein, 9 aa, Homo Sapiens
QKAAQGGHM

SEQ ID NO: 242101 - protein, 9 aa, Homo Sapiens
CATSQTDRE

SEQ ID NO: 242102 - protein, 9 aa, Homo Sapiens
ETHKSVPGY

SEQ ID NO: 242103 - protein, 9 aa, Homo Sapiens
TPVFVRCLT

SEQ ID NO: 242104 - protein, 9 aa, Homo Sapiens
KLLKNKQKK

SEQ ID NO: 242105 - protein, 9 aa, Homo Sapiens
ATYYLLQSF

SEQ ID NO: 242106 - protein, 9 aa, Homo Sapiens
GNLYSGQIL

SEQ ID NO: 242107 - protein, 9 aa, Homo Sapiens
LGITKKILN

SEQ ID NO: 242108 - protein, 9 aa, Homo Sapiens
KVDIPDIHE

SEQ ID NO: 242109 - protein, 9 aa, Homo Sapiens
STNLILQFL

SEQ ID NO: 242110 - protein, 9 aa, Homo Sapiens
DDLLLEVTN

SEQ ID NO: 242111 - protein, 9 aa, Homo Sapiens
EEIANPCSN

SEQ ID NO: 242112 - protein, 9 aa, Homo Sapiens
NTLLPAPPF

SEQ ID NO: 242113 - protein, 9 aa, Homo Sapiens
RGPEFAHSY

SEQ ID NO: 242114 - protein, 9 aa, Homo Sapiens
PLIGVLNVI

SEQ ID NO: 242115 - protein, 9 aa, Homo Sapiens
VSSRVENDY

SEQ ID NO: 242116 - protein, 9 aa, Homo Sapiens
GFQTVCVGT

SEQ ID NO: 242117 - protein, 9 aa, Homo Sapiens
ICIHYCDVN

SEQ ID NO: 242118 - protein, 9 aa, Homo Sapiens
RSWVTVLQL

SEQ ID NO: 242119 - protein, 9 aa, Homo Sapiens
QEELDEEVE

SEQ ID NO: 242120 - protein, 9 aa, Homo Sapiens
SEAERQAQA

SEQ ID NO: 242121 - protein, 9 aa, Homo Sapiens
KIIQTLSGE

SEQ ID NO: 242122 - protein, 9 aa, Homo Sapiens
IMEASTNFL

SEQ ID NO: 242123 - protein, 9 aa, Homo Sapiens
GSRQSSTVE

SEQ ID NO: 242124 - protein, 9 aa, Homo Sapiens
IVKIYVQKE

SEQ ID NO: 242125 - protein, 9 aa, Homo Sapiens
SFEDLNNDK

SEQ ID NO: 242126 - protein, 9 aa, Homo Sapiens
GVSTVLLKK

SEQ ID NO: 242127 - protein, 9 aa, Homo Sapiens
GLLAVLGPG

SEQ ID NO: 242128 - protein, 9 aa, Homo Sapiens
CPDERFVFM

SEQ ID NO: 242129 - protein, 9 aa, Homo Sapiens
SSNSEESEE

SEQ ID NO: 242130 - protein, 9 aa, Homo Sapiens
LAAQHVESQ

SEQ ID NO: 242131 - protein, 9 aa, Homo Sapiens
WPIKDPSKV

SEQ ID NO: 242132 - protein, 9 aa, Homo Sapiens
AFFPDDFKP

SEQ ID NO: 242133 - protein, 9 aa, Homo Sapiens
SLAPEDHIE

SEQ ID NO: 242134 - protein, 9 aa, Homo Sapiens
EREKTREKE

SEQ ID NO: 242135 - protein, 9 aa, Homo Sapiens
KEVIESVTE

SEQ ID NO: 242136 - protein, 9 aa, Homo Sapiens
QSRLSQILR

SEQ ID NO: 242137 - protein, 9 aa, Homo Sapiens
IKGREKTLA

SEQ ID NO: 242138 - protein, 9 aa, Homo Sapiens
QGDYPKYIF

SEQ ID NO: 242139 - protein, 9 aa, Homo Sapiens
GIHHWTPPR

SEQ ID NO: 242140 - protein, 9 aa, Homo Sapiens
CMRLFSEPV

SEQ ID NO: 242141 - protein, 9 aa, Homo Sapiens
SISPFMIKG

SEQ ID NO: 242142 - protein, 9 aa, Homo Sapiens
SAGYLQHPG

SEQ ID NO: 242143 - protein, 9 aa, Homo Sapiens
TASLIAKLA

SEQ ID NO: 242144 - protein, 9 aa, Homo Sapiens
HGLVQSVVY

SEQ ID NO: 242145 - protein, 9 aa, Homo Sapiens
SVATKTVEE

SEQ ID NO: 242146 - protein, 9 aa, Homo Sapiens
HFREWLYNS

SEQ ID NO: 242147 - protein, 9 aa, Homo Sapiens
HTLRDVIGL

SEQ ID NO: 242148 - protein, 9 aa, Homo Sapiens
IMRFAMKYR

SEQ ID NO: 242149 - protein, 9 aa, Homo Sapiens
NLQLSKNKR

SEQ ID NO: 242150 - protein, 9 aa, Homo Sapiens
RAKLCPRPD

SEQ ID NO: 242151 - protein, 9 aa, Homo Sapiens
FGPNIPKQF

SEQ ID NO: 242152 - protein, 9 aa, Homo Sapiens
GDNVEDPYT

SEQ ID NO: 242153 - protein, 9 aa, Homo Sapiens
IWNKIQCVS

SEQ ID NO: 242154 - protein, 9 aa, Homo Sapiens
SKNERFNCY

SEQ ID NO: 242155 - protein, 9 aa, Homo Sapiens
TWPFCVLTI

SEQ ID NO: 242156 - protein, 9 aa, Homo Sapiens
EDEIPTGMT

SEQ ID NO: 242157 - protein, 9 aa, Homo Sapiens
HKAYERELG

SEQ ID NO: 242158 - protein, 9 aa, Homo Sapiens
STNNSSAAW

SEQ ID NO: 242159 - protein, 9 aa, Homo Sapiens
VGQYTQLVW

SEQ ID NO: 242160 - protein, 9 aa, Homo Sapiens
VKSCFQNMG

SEQ ID NO: 242161 - protein, 9 aa, Homo Sapiens
FLGAALPNL

SEQ ID NO: 242162 - protein, 9 aa, Homo Sapiens
TIDVFFQQK

SEQ ID NO: 242163 - protein, 9 aa, Homo Sapiens
LAKAVNYHL

SEQ ID NO: 242164 - protein, 9 aa, Homo Sapiens
TMCIYVSLS

SEQ ID NO: 242165 - protein, 9 aa, Homo Sapiens
IKKQKKKRN

SEQ ID NO: 242166 - protein, 9 aa, Homo Sapiens
ISILYNKFF

SEQ ID NO: 242167 - protein, 9 aa, Homo Sapiens
PASWPHHPG

SEQ ID NO: 242168 - protein, 9 aa, Homo Sapiens
KFYKCTECA

SEQ ID NO: 242169 - protein, 9 aa, Homo Sapiens
PVRREIKRS

SEQ ID NO: 242170 - protein, 9 aa, Homo Sapiens
RGPPGPQVN

SEQ ID NO: 242171 - protein, 9 aa, Homo Sapiens
PTQSPLFTF

SEQ ID NO: 242172 - protein, 9 aa, Homo Sapiens
GDKPFKCEQ

SEQ ID NO: 242173 - protein, 9 aa, Homo Sapiens
YFNCDIQVH

SEQ ID NO: 242174 - protein, 9 aa, Homo Sapiens
SLTTRTDQE

SEQ ID NO: 242175 - protein, 9 aa, Homo Sapiens
LIAGYITYI

SEQ ID NO: 242176 - protein, 9 aa, Homo Sapiens
SHGDLIQFF

SEQ ID NO: 242177 - protein, 9 aa, Homo Sapiens
CLFCFILYL

SEQ ID NO: 242178 - protein, 9 aa, Homo Sapiens
SLLGSEDCK

SEQ ID NO: 242179 - protein, 9 aa, Homo Sapiens
WDGEKGFKD

SEQ ID NO: 242180 - protein, 9 aa, Homo Sapiens
VTRVVSYRA

SEQ ID NO: 242181 - protein, 9 aa, Homo Sapiens
GPHSANRGQ

SEQ ID NO: 242182 - protein, 9 aa, Homo Sapiens
GEVCEDLKL

SEQ ID NO: 242183 - protein, 9 aa, Homo Sapiens
IADFFNVID

SEQ ID NO: 242184 - protein, 9 aa, Homo Sapiens
HLEFTMLKA

SEQ ID NO: 242185 - protein, 9 aa, Homo Sapiens
QIHHLLFTF

SEQ ID NO: 242186 - protein, 9 aa, Homo Sapiens
LKLNSVNPT

SEQ ID NO: 242187 - protein, 9 aa, Homo Sapiens
MTQNYSTMF

SEQ ID NO: 242188 - protein, 9 aa, Homo Sapiens
TYNTGTFES

SEQ ID NO: 242189 - protein, 9 aa, Homo Sapiens
GDSTLADSL

SEQ ID NO: 242190 - protein, 9 aa, Homo Sapiens
PWILLGYLM

SEQ ID NO: 242191 - protein, 9 aa, Homo Sapiens
PQNPPQNKK

SEQ ID NO: 242192 - protein, 9 aa, Homo Sapiens
SPRIIPPKS

SEQ ID NO: 242193 - protein, 9 aa, Homo Sapiens
MLDLEKQLS

SEQ ID NO: 242194 - protein, 9 aa, Homo Sapiens
PLVPSEEPS

SEQ ID NO: 242195 - protein, 9 aa, Homo Sapiens
SRHLRNFFF

SEQ ID NO: 242196 - protein, 9 aa, Homo Sapiens
QEGTAPEIC

SEQ ID NO: 242197 - protein, 9 aa, Homo Sapiens
NAASPDNED

SEQ ID NO: 242198 - protein, 9 aa, Homo Sapiens
QKIEDTLCH

SEQ ID NO: 242199 - protein, 9 aa, Homo Sapiens
NLLYRFWIH

SEQ ID NO: 242200 - protein, 9 aa, Homo Sapiens
ERECKLPKI

SEQ ID NO: 242201 - protein, 9 aa, Homo Sapiens
VETEGNKEK

SEQ ID NO: 242202 - protein, 9 aa, Homo Sapiens
ESILLEMKA

SEQ ID NO: 242203 - protein, 9 aa, Homo Sapiens
IIHAGEASC

SEQ ID NO: 242204 - protein, 9 aa, Homo Sapiens
KYSEKEKDL

SEQ ID NO: 242205 - protein, 9 aa, Homo Sapiens
GDYGKFVIK

SEQ ID NO: 242206 - protein, 9 aa, Homo Sapiens
GRVMLFEKM

SEQ ID NO: 242207 - protein, 9 aa, Homo Sapiens
ILVPYSHPE

SEQ ID NO: 242208 - protein, 9 aa, Homo Sapiens
IALITDTYK

SEQ ID NO: 242209 - protein, 9 aa, Homo Sapiens
GSPSPLPGF

SEQ ID NO: 242210 - protein, 9 aa, Homo Sapiens
RNSFSIWSL

SEQ ID NO: 242211 - protein, 9 aa, Homo Sapiens
PGVTLVIYI

SEQ ID NO: 242212 - protein, 9 aa, Homo Sapiens
QLETLCPQV

SEQ ID NO: 242213 - protein, 9 aa, Homo Sapiens
RTEMQELER

SEQ ID NO: 242214 - protein, 9 aa, Homo Sapiens
TESQSCKLD

SEQ ID NO: 242215 - protein, 9 aa, Homo Sapiens
FMGLACSDP

SEQ ID NO: 242216 - protein, 9 aa, Homo Sapiens
QLFIARFLG

SEQ ID NO: 242217 - protein, 9 aa, Homo Sapiens
LFLYFSYLC

SEQ ID NO: 242218 - protein, 9 aa, Homo Sapiens
DCDIPIIQI

SEQ ID NO: 242219 - protein, 9 aa, Homo Sapiens
RKMEDYFHC

SEQ ID NO: 242220 - protein, 9 aa, Homo Sapiens
AWGSKEMGT

SEQ ID NO: 242221 - protein, 9 aa, Homo Sapiens
ERLAGTKSP

SEQ ID NO: 242222 - protein, 9 aa, Homo Sapiens
FCVLTITLR

SEQ ID NO: 242223 - protein, 9 aa, Homo Sapiens
HTEDKPLSL

SEQ ID NO: 242224 - protein, 9 aa, Homo Sapiens
YYTIVTSIL

SEQ ID NO: 242225 - protein, 9 aa, Homo Sapiens
VQREERISE

SEQ ID NO: 242226 - protein, 9 aa, Homo Sapiens
LSADLTGAI

SEQ ID NO: 242227 - protein, 9 aa, Homo Sapiens
SAFWLSWCL

SEQ ID NO: 242228 - protein, 9 aa, Homo Sapiens
LGAWAEVAE

SEQ ID NO: 242229 - protein, 9 aa, Homo Sapiens
STSIGKWRF

SEQ ID NO: 242230 - protein, 9 aa, Homo Sapiens
SNLSNSADD

SEQ ID NO: 242231 - protein, 9 aa, Homo Sapiens
MLSLSFFTT

SEQ ID NO: 242232 - protein, 9 aa, Homo Sapiens
PFGSSYIRI

SEQ ID NO: 242233 - protein, 9 aa, Homo Sapiens
WTRPKDLAD

SEQ ID NO: 242234 - protein, 9 aa, Homo Sapiens
TAFAQQSKI

SEQ ID NO: 242235 - protein, 9 aa, Homo Sapiens
GRDQTGMMK

SEQ ID NO: 242236 - protein, 9 aa, Homo Sapiens
CGNAFIHSS

SEQ ID NO: 242237 - protein, 9 aa, Homo Sapiens
PGLKAAMPY

SEQ ID NO: 242238 - protein, 9 aa, Homo Sapiens
QKKRNDLCF

SEQ ID NO: 242239 - protein, 9 aa, Homo Sapiens
PFVKMLPVN

SEQ ID NO: 242240 - protein, 9 aa, Homo Sapiens
DNIKINHNL

SEQ ID NO: 242241 - protein, 9 aa, Homo Sapiens
LAHQFVLLP

SEQ ID NO: 242242 - protein, 9 aa, Homo Sapiens
YESKNSFGQ

SEQ ID NO: 242243 - protein, 9 aa, Homo Sapiens
KQELKYLFR

SEQ ID NO: 242244 - protein, 9 aa, Homo Sapiens
NSSSIPCLS

SEQ ID NO: 242245 - protein, 9 aa, Homo Sapiens
YQGMQEEQN

SEQ ID NO: 242246 - protein, 9 aa, Homo Sapiens
AFNRLSYLT

SEQ ID NO: 242247 - protein, 9 aa, Homo Sapiens
IPVVRRPDQ

SEQ ID NO: 242248 - protein, 9 aa, Homo Sapiens
PLWEKNGSD

SEQ ID NO: 242249 - protein, 9 aa, Homo Sapiens
KKLMRNKMK

SEQ ID NO: 242250 - protein, 9 aa, Homo Sapiens
IDKFMKDLK

SEQ ID NO: 242251 - protein, 9 aa, Homo Sapiens
TGTDRCAQV

SEQ ID NO: 242252 - protein, 9 aa, Homo Sapiens
QKSPEVPEV

SEQ ID NO: 242253 - protein, 9 aa, Homo Sapiens
KCNWKMGHT

SEQ ID NO: 242254 - protein, 9 aa, Homo Sapiens
APKQETSIE

SEQ ID NO: 242255 - protein, 9 aa, Homo Sapiens
LLILWLPFC

SEQ ID NO: 242256 - protein, 9 aa, Homo Sapiens
VRTLKKCIK

SEQ ID NO: 242257 - protein, 9 aa, Homo Sapiens
EANRLWDNM

SEQ ID NO: 242258 - protein, 9 aa, Homo Sapiens
FITQTPGER

SEQ ID NO: 242259 - protein, 9 aa, Homo Sapiens
LLLWPHGCV

SEQ ID NO: 242260 - protein, 9 aa, Homo Sapiens
QMALEEHLI

SEQ ID NO: 242261 - protein, 9 aa, Homo Sapiens
NKWGHNITE

SEQ ID NO: 242262 - protein, 9 aa, Homo Sapiens
VDFCCACAI

SEQ ID NO: 242263 - protein, 9 aa, Homo Sapiens
IRPSSPLID

SEQ ID NO: 242264 - protein, 9 aa, Homo Sapiens
TDKEKDVRS

SEQ ID NO: 242265 - protein, 9 aa, Homo Sapiens
KKTLMLNED

SEQ ID NO: 242266 - protein, 9 aa, Homo Sapiens
DPTEVLEAG

SEQ ID NO: 242267 - protein, 9 aa, Homo Sapiens
KFEYDIDNC

SEQ ID NO: 242268 - protein, 9 aa, Homo Sapiens
KIASKPPPV

SEQ ID NO: 242269 - protein, 9 aa, Homo Sapiens
ENETLHNIT

SEQ ID NO: 242270 - protein, 9 aa, Homo Sapiens
TLQVSNTQQ

SEQ ID NO: 242271 - protein, 9 aa, Homo Sapiens
LSLENSLSY

SEQ ID NO: 242272 - protein, 9 aa, Homo Sapiens
KTLLQTATL

SEQ ID NO: 242273 - protein, 9 aa, Homo Sapiens
SCLFIYVKP

SEQ ID NO: 242274 - protein, 9 aa, Homo Sapiens
KTGRFVIED

SEQ ID NO: 242275 - protein, 9 aa, Homo Sapiens
LTWGEEIEG

SEQ ID NO: 242276 - protein, 9 aa, Homo Sapiens
FELHPQIKQ

SEQ ID NO: 242277 - protein, 9 aa, Homo Sapiens
KDKGIQKDF

SEQ ID NO: 242278 - protein, 9 aa, Homo Sapiens
NEMCKLDPG

SEQ ID NO: 242279 - protein, 9 aa, Homo Sapiens
NKKSVTEMQ

SEQ ID NO: 242280 - protein, 9 aa, Homo Sapiens
CLQPSLERD

SEQ ID NO: 242281 - protein, 9 aa, Homo Sapiens
TGDDDYPDK

SEQ ID NO: 242282 - protein, 9 aa, Homo Sapiens
TEVLKEKTK

SEQ ID NO: 242283 - protein, 9 aa, Homo Sapiens
KDLRAKLLE

SEQ ID NO: 242284 - protein, 9 aa, Homo Sapiens
CLTLNYVQE

SEQ ID NO: 242285 - protein, 9 aa, Homo Sapiens
QERIYLQWL

SEQ ID NO: 242286 - protein, 9 aa, Homo Sapiens
DGQFRKAEQ

SEQ ID NO: 242287 - protein, 9 aa, Homo Sapiens
SLHQKDTFH

SEQ ID NO: 242288 - protein, 9 aa, Homo Sapiens
HPHGDEFLP

SEQ ID NO: 242289 - protein, 9 aa, Homo Sapiens
NILLFYFNN

SEQ ID NO: 242290 - protein, 9 aa, Homo Sapiens
ISDGFIVNT

SEQ ID NO: 242291 - protein, 9 aa, Homo Sapiens
CYIANLFLI

SEQ ID NO: 242292 - protein, 9 aa, Homo Sapiens
NIGLYEKRM

SEQ ID NO: 242293 - protein, 9 aa, Homo Sapiens
SNCPFSWIR

SEQ ID NO: 242294 - protein, 9 aa, Homo Sapiens
ETSKEANIR

SEQ ID NO: 242295 - protein, 9 aa, Homo Sapiens
LLERRLMNR

SEQ ID NO: 242296 - protein, 9 aa, Homo Sapiens
SVCILTACF

SEQ ID NO: 242297 - protein, 9 aa, Homo Sapiens
ILNIIEIFD

SEQ ID NO: 242298 - protein, 9 aa, Homo Sapiens
SHKDVDKKA

SEQ ID NO: 242299 - protein, 9 aa, Homo Sapiens
NLKYYRPRK

SEQ ID NO: 242300 - protein, 9 aa, Homo Sapiens
LSSPDLINF

SEQ ID NO: 242301 - protein, 9 aa, Homo Sapiens
TRSSILNAN

SEQ ID NO: 242302 - protein, 9 aa, Homo Sapiens
GHIKIWDVY

SEQ ID NO: 242303 - protein, 9 aa, Homo Sapiens
GNTWSREHL

SEQ ID NO: 242304 - protein, 9 aa, Homo Sapiens
IKDIKPLTF

SEQ ID NO: 242305 - protein, 9 aa, Homo Sapiens
ELSNPLSGS

SEQ ID NO: 242306 - protein, 9 aa, Homo Sapiens
TVAQHSQAP

SEQ ID NO: 242307 - protein, 9 aa, Homo Sapiens
GVEYFMRIW

SEQ ID NO: 242308 - protein, 9 aa, Homo Sapiens
WCGHCQALV

SEQ ID NO: 242309 - protein, 9 aa, Homo Sapiens
SQIMGGMGL

SEQ ID NO: 242310 - protein, 9 aa, Homo Sapiens
RPVSLPWLR

SEQ ID NO: 242311 - protein, 9 aa, Homo Sapiens
FTTSTGSTS

SEQ ID NO: 242312 - protein, 9 aa, Homo Sapiens
TKSETKEIS

SEQ ID NO: 242313 - protein, 9 aa, Homo Sapiens
VLLSADLTG

SEQ ID NO: 242314 - protein, 9 aa, Homo Sapiens
NIIRLMSAG

SEQ ID NO: 242315 - protein, 9 aa, Homo Sapiens
RNEIAAQIC

SEQ ID NO: 242316 - protein, 9 aa, Homo Sapiens
DEAFSFKLN

SEQ ID NO: 242317 - protein, 9 aa, Homo Sapiens
ENLDCRERV

SEQ ID NO: 242318 - protein, 9 aa, Homo Sapiens
PRVENQTNK

SEQ ID NO: 242319 - protein, 9 aa, Homo Sapiens
EVFLWVGKL

SEQ ID NO: 242320 - protein, 9 aa, Homo Sapiens
GDSRAIIII

SEQ ID NO: 242321 - protein, 9 aa, Homo Sapiens
SPVNCFRQL

SEQ ID NO: 242322 - protein, 9 aa, Homo Sapiens
ASKQPPPSI

SEQ ID NO: 242323 - protein, 9 aa, Homo Sapiens
PSYLLILDA

SEQ ID NO: 242324 - protein, 9 aa, Homo Sapiens
LYLVTGFEL

SEQ ID NO: 242325 - protein, 9 aa, Homo Sapiens
VVTPPYPKI

SEQ ID NO: 242326 - protein, 9 aa, Homo Sapiens
AKVKLYDSD

SEQ ID NO: 242327 - protein, 9 aa, Homo Sapiens
DVISYLTER

SEQ ID NO: 242328 - protein, 9 aa, Homo Sapiens
SETISTLQQ

SEQ ID NO: 242329 - protein, 9 aa, Homo Sapiens
WRLRGPPPA

SEQ ID NO: 242330 - protein, 9 aa, Homo Sapiens
KSSCKPSTF

SEQ ID NO: 242331 - protein, 9 aa, Homo Sapiens
DKEQQVAGL

SEQ ID NO: 242332 - protein, 9 aa, Homo Sapiens
IAIVVYTAY

SEQ ID NO: 242333 - protein, 9 aa, Homo Sapiens
NKTVIRIII

SEQ ID NO: 242334 - protein, 9 aa, Homo Sapiens
KAKICLWEV

SEQ ID NO: 242335 - protein, 9 aa, Homo Sapiens
GFQGTMEAD

SEQ ID NO: 242336 - protein, 9 aa, Homo Sapiens
YPGIQLTAY

SEQ ID NO: 242337 - protein, 9 aa, Homo Sapiens
SVKLSWQEP

SEQ ID NO: 242338 - protein, 9 aa, Homo Sapiens
LYWTILGLS

SEQ ID NO: 242339 - protein, 9 aa, Homo Sapiens
LTKENKDLL

SEQ ID NO: 242340 - protein, 9 aa, Homo Sapiens
PPFQPQLTD

SEQ ID NO: 242341 - protein, 9 aa, Homo Sapiens
LIFVSSYVS

SEQ ID NO: 242342 - protein, 9 aa, Homo Sapiens
GPNHLIKHV

SEQ ID NO: 242343 - protein, 9 aa, Homo Sapiens
RPRRKKWCH

SEQ ID NO: 242344 - protein, 9 aa, Homo Sapiens
EEDKDSTLG

SEQ ID NO: 242345 - protein, 9 aa, Homo Sapiens
VVNAACKEN

SEQ ID NO: 242346 - protein, 9 aa, Homo Sapiens
FVPSSYPGN

SEQ ID NO: 242347 - protein, 9 aa, Homo Sapiens
EKQHKKNIL

SEQ ID NO: 242348 - protein, 9 aa, Homo Sapiens
PEVADLLSR

SEQ ID NO: 242349 - protein, 9 aa, Homo Sapiens
ENDYNDLFD

SEQ ID NO: 242350 - protein, 9 aa, Homo Sapiens
KSCGEYIQA

SEQ ID NO: 242351 - protein, 9 aa, Homo Sapiens
DKKEKPKIG

SEQ ID NO: 242352 - protein, 9 aa, Homo Sapiens
YCPHSKKAN

SEQ ID NO: 242353 - protein, 9 aa, Homo Sapiens
DLAQNFGYK

SEQ ID NO: 242354 - protein, 9 aa, Homo Sapiens
HAREQEQQQ

SEQ ID NO: 242355 - protein, 9 aa, Homo Sapiens
KLVDRTRIV

SEQ ID NO: 242356 - protein, 9 aa, Homo Sapiens
ALGPINFTM

SEQ ID NO: 242357 - protein, 9 aa, Homo Sapiens
CQWVDNLND

SEQ ID NO: 242358 - protein, 9 aa, Homo Sapiens
LLTLQHIPL

SEQ ID NO: 242359 - protein, 9 aa, Homo Sapiens
LEILNGRHP

SEQ ID NO: 242360 - protein, 9 aa, Homo Sapiens
HMVPHHSNQ

SEQ ID NO: 242361 - protein, 9 aa, Homo Sapiens
FNDAGNKKT

SEQ ID NO: 242362 - protein, 9 aa, Homo Sapiens
VPILIIVNV

SEQ ID NO: 242363 - protein, 9 aa, Homo Sapiens
SHNGKDIFK

SEQ ID NO: 242364 - protein, 9 aa, Homo Sapiens
LSEADHYLT

SEQ ID NO: 242365 - protein, 9 aa, Homo Sapiens
MKKLLAMIM

SEQ ID NO: 242366 - protein, 9 aa, Homo Sapiens
RPKSATHLV

SEQ ID NO: 242367 - protein, 9 aa, Homo Sapiens
YKWFILIYK

SEQ ID NO: 242368 - protein, 9 aa, Homo Sapiens
DKEKDVRSL

SEQ ID NO: 242369 - protein, 9 aa, Homo Sapiens
SFLGITKKI

SEQ ID NO: 242370 - protein, 9 aa, Homo Sapiens
NVDKVAFTG

SEQ ID NO: 242371 - protein, 9 aa, Homo Sapiens
PNRSHQPKK

SEQ ID NO: 242372 - protein, 9 aa, Homo Sapiens
GLATYQTAI

SEQ ID NO: 242373 - protein, 9 aa, Homo Sapiens
NLCQVIQIE

SEQ ID NO: 242374 - protein, 9 aa, Homo Sapiens
CYCGKIISS

SEQ ID NO: 242375 - protein, 9 aa, Homo Sapiens
PREPRQIVI

SEQ ID NO: 242376 - protein, 9 aa, Homo Sapiens
QSFNFAKKF

SEQ ID NO: 242377 - protein, 9 aa, Homo Sapiens
GERIQVILD

SEQ ID NO: 242378 - protein, 9 aa, Homo Sapiens
CISRETEKE

SEQ ID NO: 242379 - protein, 9 aa, Homo Sapiens
GGVKGMLHK

SEQ ID NO: 242380 - protein, 9 aa, Homo Sapiens
EKLSLVNTV

SEQ ID NO: 242381 - protein, 9 aa, Homo Sapiens
QTVCVGTVG

SEQ ID NO: 242382 - protein, 9 aa, Homo Sapiens
CTTFTHLRF

SEQ ID NO: 242383 - protein, 9 aa, Homo Sapiens
IYSDSSSMF

SEQ ID NO: 242384 - protein, 9 aa, Homo Sapiens
RWQQSLSWW

SEQ ID NO: 242385 - protein, 9 aa, Homo Sapiens
DPLRYKATM

SEQ ID NO: 242386 - protein, 9 aa, Homo Sapiens
TLVGHQQII

SEQ ID NO: 242387 - protein, 9 aa, Homo Sapiens
KEVCFTCVD

SEQ ID NO: 242388 - protein, 9 aa, Homo Sapiens
ISREKISLQ

SEQ ID NO: 242389 - protein, 9 aa, Homo Sapiens
GGKYVNLQI

SEQ ID NO: 242390 - protein, 9 aa, Homo Sapiens
IYPHIESHP

SEQ ID NO: 242391 - protein, 9 aa, Homo Sapiens
VKRFKANLE

SEQ ID NO: 242392 - protein, 9 aa, Homo Sapiens
NIIFRNFLR

SEQ ID NO: 242393 - protein, 9 aa, Homo Sapiens
AFQSPVPCI

SEQ ID NO: 242394 - protein, 9 aa, Homo Sapiens
AHTIGRKPP

SEQ ID NO: 242395 - protein, 9 aa, Homo Sapiens
DAVTSVQVS

SEQ ID NO: 242396 - protein, 9 aa, Homo Sapiens
LRAQEKMHK

SEQ ID NO: 242397 - protein, 9 aa, Homo Sapiens
RECCATRPE

SEQ ID NO: 242398 - protein, 9 aa, Homo Sapiens
YMPDVWTIM

SEQ ID NO: 242399 - protein, 9 aa, Homo Sapiens
SKVSSRVEN

SEQ ID NO: 242400 - protein, 9 aa, Homo Sapiens
SSYTAQDYG

SEQ ID NO: 242401 - protein, 9 aa, Homo Sapiens
LGFSSFGNH

SEQ ID NO: 242402 - protein, 9 aa, Homo Sapiens
QGSRLMDTF

SEQ ID NO: 242403 - protein, 9 aa, Homo Sapiens
LSRSFENLL

SEQ ID NO: 242404 - protein, 9 aa, Homo Sapiens
GDKVTLICS

SEQ ID NO: 242405 - protein, 9 aa, Homo Sapiens
YILSFFTIL

SEQ ID NO: 242406 - protein, 9 aa, Homo Sapiens
LYIVAEFCF

SEQ ID NO: 242407 - protein, 9 aa, Homo Sapiens
QCYGNKLGL

SEQ ID NO: 242408 - protein, 9 aa, Homo Sapiens
SAQLLFNTT

SEQ ID NO: 242409 - protein, 9 aa, Homo Sapiens
LDEYEDGDR

SEQ ID NO: 242410 - protein, 9 aa, Homo Sapiens
SMKIYLVQS

SEQ ID NO: 242411 - protein, 9 aa, Homo Sapiens
NKKLFSLAA

SEQ ID NO: 242412 - protein, 9 aa, Homo Sapiens
IMVGEGIFY

SEQ ID NO: 242413 - protein, 9 aa, Homo Sapiens
QVSEVDKTK

SEQ ID NO: 242414 - protein, 9 aa, Homo Sapiens
IILGFSEYP

SEQ ID NO: 242415 - protein, 9 aa, Homo Sapiens
NLEVKEEPE

SEQ ID NO: 242416 - protein, 9 aa, Homo Sapiens
AGVQMNKYV

SEQ ID NO: 242417 - protein, 9 aa, Homo Sapiens
KTKWLDING

SEQ ID NO: 242418 - protein, 9 aa, Homo Sapiens
EGRQQYLLI

SEQ ID NO: 242419 - protein, 9 aa, Homo Sapiens
DSSAIPQAK

SEQ ID NO: 242420 - protein, 9 aa, Homo Sapiens
TVLQLMERN

SEQ ID NO: 242421 - protein, 9 aa, Homo Sapiens
GCNDCCFGT

SEQ ID NO: 242422 - protein, 9 aa, Homo Sapiens
KYRDSTPTV

SEQ ID NO: 242423 - protein, 9 aa, Homo Sapiens
LLPPPLTDI

SEQ ID NO: 242424 - protein, 9 aa, Homo Sapiens
QSCPGDKLW

SEQ ID NO: 242425 - protein, 9 aa, Homo Sapiens
KNEEIAFRV

SEQ ID NO: 242426 - protein, 9 aa, Homo Sapiens
RIFQTQTSL

SEQ ID NO: 242427 - protein, 9 aa, Homo Sapiens
DVNQELIAL

SEQ ID NO: 242428 - protein, 9 aa, Homo Sapiens
HLERHRIIH

SEQ ID NO: 242429 - protein, 9 aa, Homo Sapiens
VKKSIRKNY

SEQ ID NO: 242430 - protein, 9 aa, Homo Sapiens
GLHKHRITH

SEQ ID NO: 242431 - protein, 9 aa, Homo Sapiens
GNQDGWEWI

SEQ ID NO: 242432 - protein, 9 aa, Homo Sapiens
FIRQFLQWT

SEQ ID NO: 242433 - protein, 9 aa, Homo Sapiens
LTSVLEAIA

SEQ ID NO: 242434 - protein, 9 aa, Homo Sapiens
DVAREWKSF

SEQ ID NO: 242435 - protein, 9 aa, Homo Sapiens
DVSNLDPNL

SEQ ID NO: 242436 - protein, 9 aa, Homo Sapiens
NKTPHNWSR

SEQ ID NO: 242437 - protein, 9 aa, Homo Sapiens
IATLHGNIL

SEQ ID NO: 242438 - protein, 9 aa, Homo Sapiens
VFYGFKHIF

SEQ ID NO: 242439 - protein, 9 aa, Homo Sapiens
HLYFRVITI

SEQ ID NO: 242440 - protein, 9 aa, Homo Sapiens
SIIVGRGII

SEQ ID NO: 242441 - protein, 9 aa, Homo Sapiens
CLLGFSLLL

SEQ ID NO: 242442 - protein, 9 aa, Homo Sapiens
NGRSTATFP

SEQ ID NO: 242443 - protein, 9 aa, Homo Sapiens
LVKIARPKK

SEQ ID NO: 242444 - protein, 9 aa, Homo Sapiens
SLNFVMEKV

SEQ ID NO: 242445 - protein, 9 aa, Homo Sapiens
IMVELFMRE

SEQ ID NO: 242446 - protein, 9 aa, Homo Sapiens
LWLFALAWP

SEQ ID NO: 242447 - protein, 9 aa, Homo Sapiens
VYQLCAAAG

SEQ ID NO: 242448 - protein, 9 aa, Homo Sapiens
AERLFALFD

SEQ ID NO: 242449 - protein, 9 aa, Homo Sapiens
TFCNAKVPS

SEQ ID NO: 242450 - protein, 9 aa, Homo Sapiens
PDVIAKHRI

SEQ ID NO: 242451 - protein, 9 aa, Homo Sapiens
AHTGSMLQL

SEQ ID NO: 242452 - protein, 9 aa, Homo Sapiens
KVPPSVGQW

SEQ ID NO: 242453 - protein, 9 aa, Homo Sapiens
YDFEDSSLP

SEQ ID NO: 242454 - protein, 9 aa, Homo Sapiens
QDYGAGTYG

SEQ ID NO: 242455 - protein, 9 aa, Homo Sapiens
APYVSSDGL

SEQ ID NO: 242456 - protein, 9 aa, Homo Sapiens
WERILYQFS

SEQ ID NO: 242457 - protein, 9 aa, Homo Sapiens
NRSETGHSP

SEQ ID NO: 242458 - protein, 9 aa, Homo Sapiens
TWAAALIIL

SEQ ID NO: 242459 - protein, 9 aa, Homo Sapiens
DPNHVCNAS

SEQ ID NO: 242460 - protein, 9 aa, Homo Sapiens
PPLYYLVFT

SEQ ID NO: 242461 - protein, 9 aa, Homo Sapiens
EICWSGSET

SEQ ID NO: 242462 - protein, 9 aa, Homo Sapiens
QLAAAVGLA

SEQ ID NO: 242463 - protein, 9 aa, Homo Sapiens
VHLEFTMLK

SEQ ID NO: 242464 - protein, 9 aa, Homo Sapiens
TTARNTSQE

SEQ ID NO: 242465 - protein, 9 aa, Homo Sapiens
VFKRKKEDF

SEQ ID NO: 242466 - protein, 9 aa, Homo Sapiens
TYASTYGKF

SEQ ID NO: 242467 - protein, 9 aa, Homo Sapiens
YYQLLEKKT

SEQ ID NO: 242468 - protein, 9 aa, Homo Sapiens
YVAGFDMIV

SEQ ID NO: 242469 - protein, 9 aa, Homo Sapiens
HRKLCLPSS

SEQ ID NO: 242470 - protein, 9 aa, Homo Sapiens
EGADGQAES

SEQ ID NO: 242471 - protein, 9 aa, Homo Sapiens
QMFLELEKG

SEQ ID NO: 242472 - protein, 9 aa, Homo Sapiens
LSGIIESLI

SEQ ID NO: 242473 - protein, 9 aa, Homo Sapiens
MPASLSQTC

SEQ ID NO: 242474 - protein, 9 aa, Homo Sapiens
VPNMLGDFL

SEQ ID NO: 242475 - protein, 9 aa, Homo Sapiens
IVFSQVVLG

SEQ ID NO: 242476 - protein, 9 aa, Homo Sapiens
STQLQGCLL

SEQ ID NO: 242477 - protein, 9 aa, Homo Sapiens
KEFLPEEYI

SEQ ID NO: 242478 - protein, 9 aa, Homo Sapiens
TQQSFNFAK

SEQ ID NO: 242479 - protein, 9 aa, Homo Sapiens
KIEGARLGL

SEQ ID NO: 242480 - protein, 9 aa, Homo Sapiens
NLRRLNFTG

SEQ ID NO: 242481 - protein, 9 aa, Homo Sapiens
DRSLINLHI

SEQ ID NO: 242482 - protein, 9 aa, Homo Sapiens
TYVTEEAES

SEQ ID NO: 242483 - protein, 9 aa, Homo Sapiens
ADAESWYRS

SEQ ID NO: 242484 - protein, 9 aa, Homo Sapiens
IYVMTVTAN

SEQ ID NO: 242485 - protein, 9 aa, Homo Sapiens
RGCDVAFEW

SEQ ID NO: 242486 - protein, 9 aa, Homo Sapiens
LIIVNVSLV

SEQ ID NO: 242487 - protein, 9 aa, Homo Sapiens
TIPLDFISK

SEQ ID NO: 242488 - protein, 9 aa, Homo Sapiens
GKKVWEYTM

SEQ ID NO: 242489 - protein, 9 aa, Homo Sapiens
TGFHYDVIS

SEQ ID NO: 242490 - protein, 9 aa, Homo Sapiens
ASLNFVMEK

SEQ ID NO: 242491 - protein, 9 aa, Homo Sapiens
RYSKIRYRE

SEQ ID NO: 242492 - protein, 9 aa, Homo Sapiens
VQYKSSCKP

SEQ ID NO: 242493 - protein, 9 aa, Homo Sapiens
INNTTVIYN

SEQ ID NO: 242494 - protein, 9 aa, Homo Sapiens
FIIYLLAKI

SEQ ID NO: 242495 - protein, 9 aa, Homo Sapiens
LSNDLVAFE

SEQ ID NO: 242496 - protein, 9 aa, Homo Sapiens
LYIIYMPGT

SEQ ID NO: 242497 - protein, 9 aa, Homo Sapiens
SQNYLTSLP

SEQ ID NO: 242498 - protein, 9 aa, Homo Sapiens
LIKHQIIHS

SEQ ID NO: 242499 - protein, 9 aa, Homo Sapiens
MYEVKGLQA

SEQ ID NO: 242500 - protein, 9 aa, Homo Sapiens
TVMLGGEPY

SEQ ID NO: 242501 - protein, 9 aa, Homo Sapiens
DQRHSKLRV

SEQ ID NO: 242502 - protein, 9 aa, Homo Sapiens
KSMCSHFSF

SEQ ID NO: 242503 - protein, 9 aa, Homo Sapiens
IQLTAYLPD

SEQ ID NO: 242504 - protein, 9 aa, Homo Sapiens
NHQRASDYF

SEQ ID NO: 242505 - protein, 9 aa, Homo Sapiens
WSLISEEDK

SEQ ID NO: 242506 - protein, 9 aa, Homo Sapiens
DLRVLGKLL

SEQ ID NO: 242507 - protein, 9 aa, Homo Sapiens
KELGLPPVK

SEQ ID NO: 242508 - protein, 9 aa, Homo Sapiens
PKEVRKKFS

SEQ ID NO: 242509 - protein, 9 aa, Homo Sapiens
INPQYYKKP

SEQ ID NO: 242510 - protein, 9 aa, Homo Sapiens
FHTVIFPLR

SEQ ID NO: 242511 - protein, 9 aa, Homo Sapiens
DPSGGDHFC

SEQ ID NO: 242512 - protein, 9 aa, Homo Sapiens
WHCIVSRNF

SEQ ID NO: 242513 - protein, 9 aa, Homo Sapiens
LLSMASSII

SEQ ID NO: 242514 - protein, 9 aa, Homo Sapiens
KKCQGIKHE

SEQ ID NO: 242515 - protein, 9 aa, Homo Sapiens
LYHINLHVR

SEQ ID NO: 242516 - protein, 9 aa, Homo Sapiens
EANQHTFHL

SEQ ID NO: 242517 - protein, 9 aa, Homo Sapiens
IKDYFQKVI

SEQ ID NO: 242518 - protein, 9 aa, Homo Sapiens
VQEGDNYII

SEQ ID NO: 242519 - protein, 9 aa, Homo Sapiens
IKSEDYMYW

SEQ ID NO: 242520 - protein, 9 aa, Homo Sapiens
SVILSVKLS

SEQ ID NO: 242521 - protein, 9 aa, Homo Sapiens
GRAGTAARQ

SEQ ID NO: 242522 - protein, 9 aa, Homo Sapiens
EGEDEGSGA

SEQ ID NO: 242523 - protein, 9 aa, Homo Sapiens
VNDDDVRLM

SEQ ID NO: 242524 - protein, 9 aa, Homo Sapiens
DLSECQGKL

SEQ ID NO: 242525 - protein, 9 aa, Homo Sapiens
LNTLTVASE

SEQ ID NO: 242526 - protein, 9 aa, Homo Sapiens
SAKALVFNK

SEQ ID NO: 242527 - protein, 9 aa, Homo Sapiens
MSVPTEFLP

SEQ ID NO: 242528 - protein, 9 aa, Homo Sapiens
FLLSKFRLA

SEQ ID NO: 242529 - protein, 9 aa, Homo Sapiens
GNGGYFHPS

SEQ ID NO: 242530 - protein, 9 aa, Homo Sapiens
QQFHIIVCG

SEQ ID NO: 242531 - protein, 9 aa, Homo Sapiens
IVKQLKEQL

SEQ ID NO: 242532 - protein, 9 aa, Homo Sapiens
ERLECQQKK

SEQ ID NO: 242533 - protein, 9 aa, Homo Sapiens
KDTFISNEE

SEQ ID NO: 242534 - protein, 9 aa, Homo Sapiens
LDTCLCKDS

SEQ ID NO: 242535 - protein, 9 aa, Homo Sapiens
LQQLETCID

SEQ ID NO: 242536 - protein, 9 aa, Homo Sapiens
SQSRVGCLE

SEQ ID NO: 242537 - protein, 9 aa, Homo Sapiens
LRDKASRVC

SEQ ID NO: 242538 - protein, 9 aa, Homo Sapiens
FNHNYRIRY

SEQ ID NO: 242539 - protein, 9 aa, Homo Sapiens
QTALSKGKD

SEQ ID NO: 242540 - protein, 9 aa, Homo Sapiens
VRAANIVSQ

SEQ ID NO: 242541 - protein, 9 aa, Homo Sapiens
LNPIKDFQG

SEQ ID NO: 242542 - protein, 9 aa, Homo Sapiens
EQIYTYVGS

SEQ ID NO: 242543 - protein, 9 aa, Homo Sapiens
LAENINTFL

SEQ ID NO: 242544 - protein, 9 aa, Homo Sapiens
NPMTNCSTV

SEQ ID NO: 242545 - protein, 9 aa, Homo Sapiens
HHGTSQDKA

SEQ ID NO: 242546 - protein, 9 aa, Homo Sapiens
TLVPPPWPS

SEQ ID NO: 242547 - protein, 9 aa, Homo Sapiens
LPHLTIPTV

SEQ ID NO: 242548 - protein, 9 aa, Homo Sapiens
QGLPWIFEE

SEQ ID NO: 242549 - protein, 9 aa, Homo Sapiens
ESSSVGMLV

SEQ ID NO: 242550 - protein, 9 aa, Homo Sapiens
EPKGADWPT

SEQ ID NO: 242551 - protein, 9 aa, Homo Sapiens
SFFTTSLLS

SEQ ID NO: 242552 - protein, 9 aa, Homo Sapiens
CNWTKDELL

SEQ ID NO: 242553 - protein, 9 aa, Homo Sapiens
CEEHVALFK

SEQ ID NO: 242554 - protein, 9 aa, Homo Sapiens
QEQSSKCLS

SEQ ID NO: 242555 - protein, 9 aa, Homo Sapiens
HQEFLSSLE

SEQ ID NO: 242556 - protein, 9 aa, Homo Sapiens
LVPYSHPEL

SEQ ID NO: 242557 - protein, 9 aa, Homo Sapiens
GELYRQNRF

SEQ ID NO: 242558 - protein, 9 aa, Homo Sapiens
CVCDHSWAL

SEQ ID NO: 242559 - protein, 9 aa, Homo Sapiens
EPGEEIYCY

SEQ ID NO: 242560 - protein, 9 aa, Homo Sapiens
GDAATANNC

SEQ ID NO: 242561 - protein, 9 aa, Homo Sapiens
RLYTKLSAR

SEQ ID NO: 242562 - protein, 9 aa, Homo Sapiens
IAFYRYAIH

SEQ ID NO: 242563 - protein, 9 aa, Homo Sapiens
QIQKLDDQG

SEQ ID NO: 242564 - protein, 9 aa, Homo Sapiens
WEHLEILQT

SEQ ID NO: 242565 - protein, 9 aa, Homo Sapiens
DMLSVEQVK

SEQ ID NO: 242566 - protein, 9 aa, Homo Sapiens
LQASFERMN

SEQ ID NO: 242567 - protein, 9 aa, Homo Sapiens
NTQLAIEHP

SEQ ID NO: 242568 - protein, 9 aa, Homo Sapiens
LTKIKGSVY

SEQ ID NO: 242569 - protein, 9 aa, Homo Sapiens
LGDECKNTV

SEQ ID NO: 242570 - protein, 9 aa, Homo Sapiens
QNLFQSVRK

SEQ ID NO: 242571 - protein, 9 aa, Homo Sapiens
LLTGQCNFG

SEQ ID NO: 242572 - protein, 9 aa, Homo Sapiens
SLGLKVFEY

SEQ ID NO: 242573 - protein, 9 aa, Homo Sapiens
SEQTFLIGL

SEQ ID NO: 242574 - protein, 9 aa, Homo Sapiens
GLICKAPCR

SEQ ID NO: 242575 - protein, 9 aa, Homo Sapiens
KTVIRIIIA

SEQ ID NO: 242576 - protein, 9 aa, Homo Sapiens
YFFSFTIFF

SEQ ID NO: 242577 - protein, 9 aa, Homo Sapiens
EPEPISFTP

SEQ ID NO: 242578 - protein, 9 aa, Homo Sapiens
KPTKVTLAK

SEQ ID NO: 242579 - protein, 9 aa, Homo Sapiens
LFRVASKIH

SEQ ID NO: 242580 - protein, 9 aa, Homo Sapiens
SIQGLTEGL

SEQ ID NO: 242581 - protein, 9 aa, Homo Sapiens
GVLNGGQRI

SEQ ID NO: 242582 - protein, 9 aa, Homo Sapiens
AVQGYVGSF

SEQ ID NO: 242583 - protein, 9 aa, Homo Sapiens
TAGISLPTA

SEQ ID NO: 242584 - protein, 9 aa, Homo Sapiens
GTQPGLHRF

SEQ ID NO: 242585 - protein, 9 aa, Homo Sapiens
LMELTNLQP

SEQ ID NO: 242586 - protein, 9 aa, Homo Sapiens
KNLCFLETA

SEQ ID NO: 242587 - protein, 9 aa, Homo Sapiens
PEFFRDCFL

SEQ ID NO: 242588 - protein, 9 aa, Homo Sapiens
VHWPIFKWS

SEQ ID NO: 242589 - protein, 9 aa, Homo Sapiens
TPKRWRVDE

SEQ ID NO: 242590 - protein, 9 aa, Homo Sapiens
TLAEKDRKF

SEQ ID NO: 242591 - protein, 9 aa, Homo Sapiens
ILYCLTLNP

SEQ ID NO: 242592 - protein, 9 aa, Homo Sapiens
LFQYNGTVG

SEQ ID NO: 242593 - protein, 9 aa, Homo Sapiens
PLDSTAIDG

SEQ ID NO: 242594 - protein, 9 aa, Homo Sapiens
PYLVSIWRG

SEQ ID NO: 242595 - protein, 9 aa, Homo Sapiens
VPDHQNIAF

SEQ ID NO: 242596 - protein, 9 aa, Homo Sapiens
GCMQDMVPY

SEQ ID NO: 242597 - protein, 9 aa, Homo Sapiens
DIKRQEKNW

SEQ ID NO: 242598 - protein, 9 aa, Homo Sapiens
LKREAENVC

SEQ ID NO: 242599 - protein, 9 aa, Homo Sapiens
SISFTMLIN

SEQ ID NO: 242600 - protein, 9 aa, Homo Sapiens
LSPVIFSDW

SEQ ID NO: 242601 - protein, 9 aa, Homo Sapiens
RADNFQELL

SEQ ID NO: 242602 - protein, 9 aa, Homo Sapiens
KLFLRYRPL

SEQ ID NO: 242603 - protein, 9 aa, Homo Sapiens
LKLNDFKAL

SEQ ID NO: 242604 - protein, 9 aa, Homo Sapiens
QNNLSSSAG

SEQ ID NO: 242605 - protein, 9 aa, Homo Sapiens
LLLGLSDLK

SEQ ID NO: 242606 - protein, 9 aa, Homo Sapiens
INLHIMHTS

SEQ ID NO: 242607 - protein, 9 aa, Homo Sapiens
LHESEIDKI

SEQ ID NO: 242608 - protein, 9 aa, Homo Sapiens
SLFGFVLKP

SEQ ID NO: 242609 - protein, 9 aa, Homo Sapiens
RTFRVETPE

SEQ ID NO: 242610 - protein, 9 aa, Homo Sapiens
GAPESHFLK

SEQ ID NO: 242611 - protein, 9 aa, Homo Sapiens
SLTYTDAGG

SEQ ID NO: 242612 - protein, 9 aa, Homo Sapiens
WILLGYLMI

SEQ ID NO: 242613 - protein, 9 aa, Homo Sapiens
EDSAIMLGK

SEQ ID NO: 242614 - protein, 9 aa, Homo Sapiens
LPLKFSDAE

SEQ ID NO: 242615 - protein, 9 aa, Homo Sapiens
QEIICDDEL

SEQ ID NO: 242616 - protein, 9 aa, Homo Sapiens
IYSSMMDKY

SEQ ID NO: 242617 - protein, 9 aa, Homo Sapiens
NDTFYQQFH

SEQ ID NO: 242618 - protein, 9 aa, Homo Sapiens
MELTNLQPK

SEQ ID NO: 242619 - protein, 9 aa, Homo Sapiens
AQQWLEYRV

SEQ ID NO: 242620 - protein, 9 aa, Homo Sapiens
GLRGDPDFE

SEQ ID NO: 242621 - protein, 9 aa, Homo Sapiens
NLQQDGLDK

SEQ ID NO: 242622 - protein, 9 aa, Homo Sapiens
IQRLQGVLR

SEQ ID NO: 242623 - protein, 9 aa, Homo Sapiens
SENLTELSK

SEQ ID NO: 242624 - protein, 9 aa, Homo Sapiens
TCTPMPSPY

SEQ ID NO: 242625 - protein, 9 aa, Homo Sapiens
GKLKCWYCN

SEQ ID NO: 242626 - protein, 9 aa, Homo Sapiens
AKPSITPVP

SEQ ID NO: 242627 - protein, 9 aa, Homo Sapiens
LVSLVLGMV

SEQ ID NO: 242628 - protein, 9 aa, Homo Sapiens
KLLNAKLQQ

SEQ ID NO: 242629 - protein, 9 aa, Homo Sapiens
LPRYVKAVY

SEQ ID NO: 242630 - protein, 9 aa, Homo Sapiens
AALKSARDA

SEQ ID NO: 242631 - protein, 9 aa, Homo Sapiens
YLRYVHSII

SEQ ID NO: 242632 - protein, 9 aa, Homo Sapiens
EHCFVAENS

SEQ ID NO: 242633 - protein, 9 aa, Homo Sapiens
DKAQQTKPQ

SEQ ID NO: 242634 - protein, 9 aa, Homo Sapiens
NKLFGFIPG

SEQ ID NO: 242635 - protein, 9 aa, Homo Sapiens
YKLLDEDFV

SEQ ID NO: 242636 - protein, 9 aa, Homo Sapiens
DPRLTPYQS

SEQ ID NO: 242637 - protein, 9 aa, Homo Sapiens
AFAKLLAEG

SEQ ID NO: 242638 - protein, 9 aa, Homo Sapiens
QTFLIGLGK

SEQ ID NO: 242639 - protein, 9 aa, Homo Sapiens
LHERPALMV

SEQ ID NO: 242640 - protein, 9 aa, Homo Sapiens
SFGRSNIFI

SEQ ID NO: 242641 - protein, 9 aa, Homo Sapiens
NLYKFQAGN

SEQ ID NO: 242642 - protein, 9 aa, Homo Sapiens
YGLWECVLP

SEQ ID NO: 242643 - protein, 9 aa, Homo Sapiens
LWEAFELLG

SEQ ID NO: 242644 - protein, 9 aa, Homo Sapiens
LQYTLGDKI

SEQ ID NO: 242645 - protein, 9 aa, Homo Sapiens
IMLINSFGA

SEQ ID NO: 242646 - protein, 9 aa, Homo Sapiens
GFIKSPGYP

SEQ ID NO: 242647 - protein, 9 aa, Homo Sapiens
SSNKGTVQS

SEQ ID NO: 242648 - protein, 9 aa, Homo Sapiens
TYALCILSH

SEQ ID NO: 242649 - protein, 9 aa, Homo Sapiens
VYLICKDEM

SEQ ID NO: 242650 - protein, 9 aa, Homo Sapiens
FINYFVKGR

SEQ ID NO: 242651 - protein, 9 aa, Homo Sapiens
GPPEYGLGN

SEQ ID NO: 242652 - protein, 9 aa, Homo Sapiens
NYRYGREEM

SEQ ID NO: 242653 - protein, 9 aa, Homo Sapiens
TGPPEPPYI

SEQ ID NO: 242654 - protein, 9 aa, Homo Sapiens
ESSTCSTVS

SEQ ID NO: 242655 - protein, 9 aa, Homo Sapiens
LAVEILPRV

SEQ ID NO: 242656 - protein, 9 aa, Homo Sapiens
MPQYCLFGN

SEQ ID NO: 242657 - protein, 9 aa, Homo Sapiens
PHTQKAWKI

SEQ ID NO: 242658 - protein, 9 aa, Homo Sapiens
GSEQISHKR

SEQ ID NO: 242659 - protein, 9 aa, Homo Sapiens
KKCEKDIAM

SEQ ID NO: 242660 - protein, 9 aa, Homo Sapiens
GMYGRKGLP

SEQ ID NO: 242661 - protein, 9 aa, Homo Sapiens
NRNRKENRN

SEQ ID NO: 242662 - protein, 9 aa, Homo Sapiens
RVALTLIRQ

SEQ ID NO: 242663 - protein, 9 aa, Homo Sapiens
HGAWLSPAP

SEQ ID NO: 242664 - protein, 9 aa, Homo Sapiens
EPPKPTPLT

SEQ ID NO: 242665 - protein, 9 aa, Homo Sapiens
SKKKNFERE

SEQ ID NO: 242666 - protein, 9 aa, Homo Sapiens
SGGSEFFRN

SEQ ID NO: 242667 - protein, 9 aa, Homo Sapiens
NECVVSEWG

SEQ ID NO: 242668 - protein, 9 aa, Homo Sapiens
LIQTDSHLH

SEQ ID NO: 242669 - protein, 9 aa, Homo Sapiens
DTRFSMEGI

SEQ ID NO: 242670 - protein, 9 aa, Homo Sapiens
DAGPIVATA

SEQ ID NO: 242671 - protein, 9 aa, Homo Sapiens
KHSRHRREM

SEQ ID NO: 242672 - protein, 9 aa, Homo Sapiens
ILNWNYHFV

SEQ ID NO: 242673 - protein, 9 aa, Homo Sapiens
TFSHSEGPL

SEQ ID NO: 242674 - protein, 9 aa, Homo Sapiens
FPRYRSRTS

SEQ ID NO: 242675 - protein, 9 aa, Homo Sapiens
ELPLISLST

SEQ ID NO: 242676 - protein, 9 aa, Homo Sapiens
KHQDPPDSG

SEQ ID NO: 242677 - protein, 9 aa, Homo Sapiens
EQEELQVKI

SEQ ID NO: 242678 - protein, 9 aa, Homo Sapiens
YQIGERIQV

SEQ ID NO: 242679 - protein, 9 aa, Homo Sapiens
VLGMVGCFG

SEQ ID NO: 242680 - protein, 9 aa, Homo Sapiens
FLPKETEHL

SEQ ID NO: 242681 - protein, 9 aa, Homo Sapiens
SFLAVSSQD

SEQ ID NO: 242682 - protein, 9 aa, Homo Sapiens
LPAGAQDAL

SEQ ID NO: 242683 - protein, 9 aa, Homo Sapiens
IVQYMIEVM

SEQ ID NO: 242684 - protein, 9 aa, Homo Sapiens
PEGAPLAGS

SEQ ID NO: 242685 - protein, 9 aa, Homo Sapiens
KGRPQIQRR

SEQ ID NO: 242686 - protein, 9 aa, Homo Sapiens
PDIYRPLDP

SEQ ID NO: 242687 - protein, 9 aa, Homo Sapiens
QPHEFWDVI

SEQ ID NO: 242688 - protein, 9 aa, Homo Sapiens
RLTSSPPLE

SEQ ID NO: 242689 - protein, 9 aa, Homo Sapiens
TEMRTSCLI

SEQ ID NO: 242690 - protein, 9 aa, Homo Sapiens
NEHGVASMV

SEQ ID NO: 242691 - protein, 9 aa, Homo Sapiens
PAKNIDTSP

SEQ ID NO: 242692 - protein, 9 aa, Homo Sapiens
NNIHDARFG

SEQ ID NO: 242693 - protein, 9 aa, Homo Sapiens
CNNTVGNDS

SEQ ID NO: 242694 - protein, 9 aa, Homo Sapiens
PESLLSEFD

SEQ ID NO: 242695 - protein, 9 aa, Homo Sapiens
KKEKTEKLE

SEQ ID NO: 242696 - protein, 9 aa, Homo Sapiens
LIAYFIPFL

SEQ ID NO: 242697 - protein, 9 aa, Homo Sapiens
IKPFTLEEK

SEQ ID NO: 242698 - protein, 9 aa, Homo Sapiens
CAQLAQIQV

SEQ ID NO: 242699 - protein, 9 aa, Homo Sapiens
PGHFLDVNG

SEQ ID NO: 242700 - protein, 9 aa, Homo Sapiens
VIEDIPGEF

SEQ ID NO: 242701 - protein, 9 aa, Homo Sapiens
YPEHVCKVL

SEQ ID NO: 242702 - protein, 9 aa, Homo Sapiens
SVMTKTVPC

SEQ ID NO: 242703 - protein, 9 aa, Homo Sapiens
QQEILLQEV

SEQ ID NO: 242704 - protein, 9 aa, Homo Sapiens
QSEHKTSNA

SEQ ID NO: 242705 - protein, 9 aa, Homo Sapiens
LWLQYQEET

SEQ ID NO: 242706 - protein, 9 aa, Homo Sapiens
IGKDCGDSP

SEQ ID NO: 242707 - protein, 9 aa, Homo Sapiens
NFDKELLNE

SEQ ID NO: 242708 - protein, 9 aa, Homo Sapiens
EVVLQAVMK

SEQ ID NO: 242709 - protein, 9 aa, Homo Sapiens
LYLTGLFGG

SEQ ID NO: 242710 - protein, 9 aa, Homo Sapiens
MKAGHFSDT

SEQ ID NO: 242711 - protein, 9 aa, Homo Sapiens
LIKRRDKTC

SEQ ID NO: 242712 - protein, 9 aa, Homo Sapiens
LAMIMWLQL

SEQ ID NO: 242713 - protein, 9 aa, Homo Sapiens
EAGGLMVFP

SEQ ID NO: 242714 - protein, 9 aa, Homo Sapiens
QWAQSFENV

SEQ ID NO: 242715 - protein, 9 aa, Homo Sapiens
FNALSSSSE

SEQ ID NO: 242716 - protein, 9 aa, Homo Sapiens
SATDYDYYS

SEQ ID NO: 242717 - protein, 9 aa, Homo Sapiens
SNKLVVATE

SEQ ID NO: 242718 - protein, 9 aa, Homo Sapiens
ELHDGCSEA

SEQ ID NO: 242719 - protein, 9 aa, Homo Sapiens
QCGYACCLQ

SEQ ID NO: 242720 - protein, 9 aa, Homo Sapiens
LIGYWVLQV

SEQ ID NO: 242721 - protein, 9 aa, Homo Sapiens
VFVVVTNVI

SEQ ID NO: 242722 - protein, 9 aa, Homo Sapiens
LPKASLFDE

SEQ ID NO: 242723 - protein, 9 aa, Homo Sapiens
AARKPLDVY

SEQ ID NO: 242724 - protein, 9 aa, Homo Sapiens
SVPVPPGPP

SEQ ID NO: 242725 - protein, 9 aa, Homo Sapiens
FNGIPEWVY

SEQ ID NO: 242726 - protein, 9 aa, Homo Sapiens
TYKEHLEGH

SEQ ID NO: 242727 - protein, 9 aa, Homo Sapiens
RSRLECHRQ

SEQ ID NO: 242728 - protein, 9 aa, Homo Sapiens
AASPVDSAL

SEQ ID NO: 242729 - protein, 9 aa, Homo Sapiens
ATLHVLLVG

SEQ ID NO: 242730 - protein, 9 aa, Homo Sapiens
SSFPYLQKD

SEQ ID NO: 242731 - protein, 9 aa, Homo Sapiens
GDYAVEDKP

SEQ ID NO: 242732 - protein, 9 aa, Homo Sapiens
CEQTLEACF

SEQ ID NO: 242733 - protein, 9 aa, Homo Sapiens
QYSAIAPNG

SEQ ID NO: 242734 - protein, 9 aa, Homo Sapiens
QIHEKTHSG

SEQ ID NO: 242735 - protein, 9 aa, Homo Sapiens
SVKQDITFT

SEQ ID NO: 242736 - protein, 9 aa, Homo Sapiens
RLEWKNKEN

SEQ ID NO: 242737 - protein, 9 aa, Homo Sapiens
HLMVHQRIH

SEQ ID NO: 242738 - protein, 9 aa, Homo Sapiens
KLSFGYVHS

SEQ ID NO: 242739 - protein, 9 aa, Homo Sapiens
TWNMHTCPR

SEQ ID NO: 242740 - protein, 9 aa, Homo Sapiens
WNPLQKDPQ

SEQ ID NO: 242741 - protein, 9 aa, Homo Sapiens
NKGFPPLAG

SEQ ID NO: 242742 - protein, 9 aa, Homo Sapiens
QKSQQMPQA

SEQ ID NO: 242743 - protein, 9 aa, Homo Sapiens
CYLELESYA

SEQ ID NO: 242744 - protein, 9 aa, Homo Sapiens
SSTVEPKEP

SEQ ID NO: 242745 - protein, 9 aa, Homo Sapiens
KHLPRFKPW

SEQ ID NO: 242746 - protein, 9 aa, Homo Sapiens
GRGCTKRTN

SEQ ID NO: 242747 - protein, 9 aa, Homo Sapiens
HNSVASKTY

SEQ ID NO: 242748 - protein, 9 aa, Homo Sapiens
QVDKASKYI

SEQ ID NO: 242749 - protein, 9 aa, Homo Sapiens
EGDLQKVLL

SEQ ID NO: 242750 - protein, 9 aa, Homo Sapiens
VENQTNKTI

SEQ ID NO: 242751 - protein, 9 aa, Homo Sapiens
SVHLHSFFV

SEQ ID NO: 242752 - protein, 9 aa, Homo Sapiens
KSLYIIRAK

SEQ ID NO: 242753 - protein, 9 aa, Homo Sapiens
LDLAFNAFD

SEQ ID NO: 242754 - protein, 9 aa, Homo Sapiens
LAKSRKNEE

SEQ ID NO: 242755 - protein, 9 aa, Homo Sapiens
DEGLVKVIG

SEQ ID NO: 242756 - protein, 9 aa, Homo Sapiens
SISGIQAEL

SEQ ID NO: 242757 - protein, 9 aa, Homo Sapiens
FESTMYKGK

SEQ ID NO: 242758 - protein, 9 aa, Homo Sapiens
NIAFGQSMD

SEQ ID NO: 242759 - protein, 9 aa, Homo Sapiens
SESEPDLFS

SEQ ID NO: 242760 - protein, 9 aa, Homo Sapiens
EDDFGVAGV

SEQ ID NO: 242761 - protein, 9 aa, Homo Sapiens
FEPWNTLPK

SEQ ID NO: 242762 - protein, 9 aa, Homo Sapiens
TWLSGSLHF

SEQ ID NO: 242763 - protein, 9 aa, Homo Sapiens
NAFSAFVGQ

SEQ ID NO: 242764 - protein, 9 aa, Homo Sapiens
DDDVRLMLW

SEQ ID NO: 242765 - protein, 9 aa, Homo Sapiens
VTKNETGPY

SEQ ID NO: 242766 - protein, 9 aa, Homo Sapiens
LQESDYLAT

SEQ ID NO: 242767 - protein, 9 aa, Homo Sapiens
KHGSTFICN

SEQ ID NO: 242768 - protein, 9 aa, Homo Sapiens
SSNYASMQA

SEQ ID NO: 242769 - protein, 9 aa, Homo Sapiens
TVGYGYMYP

SEQ ID NO: 242770 - protein, 9 aa, Homo Sapiens
LEEKVHIVS

SEQ ID NO: 242771 - protein, 9 aa, Homo Sapiens
ESSTNNVNN

SEQ ID NO: 242772 - protein, 9 aa, Homo Sapiens
YIVQLSYAL

SEQ ID NO: 242773 - protein, 9 aa, Homo Sapiens
SRQKTLLLA

SEQ ID NO: 242774 - protein, 9 aa, Homo Sapiens
YKEKGRKLE

SEQ ID NO: 242775 - protein, 9 aa, Homo Sapiens
CCPIHYTTA

SEQ ID NO: 242776 - protein, 9 aa, Homo Sapiens
MIIIININP

SEQ ID NO: 242777 - protein, 9 aa, Homo Sapiens
DDKKPRKCD

SEQ ID NO: 242778 - protein, 9 aa, Homo Sapiens
SQKVDVETS

SEQ ID NO: 242779 - protein, 9 aa, Homo Sapiens
DIFVSSVTI

SEQ ID NO: 242780 - protein, 9 aa, Homo Sapiens
SLEYSLQIQ

SEQ ID NO: 242781 - protein, 9 aa, Homo Sapiens
FNVVLLQEI

SEQ ID NO: 242782 - protein, 9 aa, Homo Sapiens
EAGGGAVEG

SEQ ID NO: 242783 - protein, 9 aa, Homo Sapiens
VRLPLISVA

SEQ ID NO: 242784 - protein, 9 aa, Homo Sapiens
RDNFLDFAE

SEQ ID NO: 242785 - protein, 9 aa, Homo Sapiens
LGKQEPGSN

SEQ ID NO: 242786 - protein, 9 aa, Homo Sapiens
YTCMVTNSV

SEQ ID NO: 242787 - protein, 9 aa, Homo Sapiens
GVNYLFDVE

SEQ ID NO: 242788 - protein, 9 aa, Homo Sapiens
CIVCPYANG

SEQ ID NO: 242789 - protein, 9 aa, Homo Sapiens
MKTLHLEPF

SEQ ID NO: 242790 - protein, 9 aa, Homo Sapiens
NDSCFCNPG

SEQ ID NO: 242791 - protein, 9 aa, Homo Sapiens
AKKTAELYV

SEQ ID NO: 242792 - protein, 9 aa, Homo Sapiens
SSKYGSLEE

SEQ ID NO: 242793 - protein, 9 aa, Homo Sapiens
GTYTVNIVA

SEQ ID NO: 242794 - protein, 9 aa, Homo Sapiens
HSNLNGQHF

SEQ ID NO: 242795 - protein, 9 aa, Homo Sapiens
GVLKLNKKS

SEQ ID NO: 242796 - protein, 9 aa, Homo Sapiens
ANNGRFSLC

SEQ ID NO: 242797 - protein, 9 aa, Homo Sapiens
DVATMNEQD

SEQ ID NO: 242798 - protein, 9 aa, Homo Sapiens
AKLATAQDD

SEQ ID NO: 242799 - protein, 9 aa, Homo Sapiens
LPSGQRNEE

SEQ ID NO: 242800 - protein, 9 aa, Homo Sapiens
SFNHKKFFQ

SEQ ID NO: 242801 - protein, 9 aa, Homo Sapiens
YFHTPEVTL

SEQ ID NO: 242802 - protein, 9 aa, Homo Sapiens
IYVKPKQTQ

SEQ ID NO: 242803 - protein, 9 aa, Homo Sapiens
QSWNPCPDF

SEQ ID NO: 242804 - protein, 9 aa, Homo Sapiens
IRFNPHLQA

SEQ ID NO: 242805 - protein, 9 aa, Homo Sapiens
MAEILYVPR

SEQ ID NO: 242806 - protein, 9 aa, Homo Sapiens
RLFALFDSD

SEQ ID NO: 242807 - protein, 9 aa, Homo Sapiens
SHSQKFSKC

SEQ ID NO: 242808 - protein, 9 aa, Homo Sapiens
TKKEGTARS

SEQ ID NO: 242809 - protein, 9 aa, Homo Sapiens
MDGTETGLL

SEQ ID NO: 242810 - protein, 9 aa, Homo Sapiens
GSVLNSEEI

SEQ ID NO: 242811 - protein, 9 aa, Homo Sapiens
VDGEEVAMR

SEQ ID NO: 242812 - protein, 9 aa, Homo Sapiens
LLAAIKEAI

SEQ ID NO: 242813 - protein, 9 aa, Homo Sapiens
VLSPEPPKP

SEQ ID NO: 242814 - protein, 9 aa, Homo Sapiens
GGLTCTIVF

SEQ ID NO: 242815 - protein, 9 aa, Homo Sapiens
VKYQIHTGL

SEQ ID NO: 242816 - protein, 9 aa, Homo Sapiens
SHPPQPSNR

SEQ ID NO: 242817 - protein, 9 aa, Homo Sapiens
NEEFQVVKY

SEQ ID NO: 242818 - protein, 9 aa, Homo Sapiens
CVVYENYSQ

SEQ ID NO: 242819 - protein, 9 aa, Homo Sapiens
SSTSNVSSL

SEQ ID NO: 242820 - protein, 9 aa, Homo Sapiens
WQNTGFHYD

SEQ ID NO: 242821 - protein, 9 aa, Homo Sapiens
PTESTWGWQ

SEQ ID NO: 242822 - protein, 9 aa, Homo Sapiens
CKMKNNFIC

SEQ ID NO: 242823 - protein, 9 aa, Homo Sapiens
QEPSTHDNR

SEQ ID NO: 242824 - protein, 9 aa, Homo Sapiens
LGALLEQQN

SEQ ID NO: 242825 - protein, 9 aa, Homo Sapiens
SQEAERLTL

SEQ ID NO: 242826 - protein, 9 aa, Homo Sapiens
HRSEPSNYY

SEQ ID NO: 242827 - protein, 9 aa, Homo Sapiens
IGNSHVHYT

SEQ ID NO: 242828 - protein, 9 aa, Homo Sapiens
AHMCTHHTD

SEQ ID NO: 242829 - protein, 9 aa, Homo Sapiens
FSRIIICNH

SEQ ID NO: 242830 - protein, 9 aa, Homo Sapiens
AVLRAEDIP

SEQ ID NO: 242831 - protein, 9 aa, Homo Sapiens
YQVITAQVH

SEQ ID NO: 242832 - protein, 9 aa, Homo Sapiens
FPCNQLGKQ

SEQ ID NO: 242833 - protein, 9 aa, Homo Sapiens
VNTVYDVDN

SEQ ID NO: 242834 - protein, 9 aa, Homo Sapiens
NSMIYCLCY

SEQ ID NO: 242835 - protein, 9 aa, Homo Sapiens
DWGTPAKIN

SEQ ID NO: 242836 - protein, 9 aa, Homo Sapiens
YFVRGAKEG

SEQ ID NO: 242837 - protein, 9 aa, Homo Sapiens
LSSFPYLQK

SEQ ID NO: 242838 - protein, 9 aa, Homo Sapiens
TRWWSPTEG

SEQ ID NO: 242839 - protein, 9 aa, Homo Sapiens
LLFRKPSPF

SEQ ID NO: 242840 - protein, 9 aa, Homo Sapiens
DSNKFLKIM

SEQ ID NO: 242841 - protein, 9 aa, Homo Sapiens
EADQMFDMG

SEQ ID NO: 242842 - protein, 9 aa, Homo Sapiens
ENKTGPTKK

SEQ ID NO: 242843 - protein, 9 aa, Homo Sapiens
WVLVFVPYL

SEQ ID NO: 242844 - protein, 9 aa, Homo Sapiens
FDKNRNYIL

SEQ ID NO: 242845 - protein, 9 aa, Homo Sapiens
FNHKKFFQM

SEQ ID NO: 242846 - protein, 9 aa, Homo Sapiens
IHVYQNIKY

SEQ ID NO: 242847 - protein, 9 aa, Homo Sapiens
DSDILCLEY

SEQ ID NO: 242848 - protein, 9 aa, Homo Sapiens
ERRLIGLEN

SEQ ID NO: 242849 - protein, 9 aa, Homo Sapiens
SMFEIICVI

SEQ ID NO: 242850 - protein, 9 aa, Homo Sapiens
IEHQIIHTG

SEQ ID NO: 242851 - protein, 9 aa, Homo Sapiens
VLAHSNLTE

SEQ ID NO: 242852 - protein, 9 aa, Homo Sapiens
VIIKCDGFY

SEQ ID NO: 242853 - protein, 9 aa, Homo Sapiens
KIQGSYGDV

SEQ ID NO: 242854 - protein, 9 aa, Homo Sapiens
PCVFWTDAI

SEQ ID NO: 242855 - protein, 9 aa, Homo Sapiens
AKADTITDE

SEQ ID NO: 242856 - protein, 9 aa, Homo Sapiens
KDFQKYFVK

SEQ ID NO: 242857 - protein, 9 aa, Homo Sapiens
FINARRRII

SEQ ID NO: 242858 - protein, 9 aa, Homo Sapiens
NLVIQERLK

SEQ ID NO: 242859 - protein, 9 aa, Homo Sapiens
RLITEKKDN

SEQ ID NO: 242860 - protein, 9 aa, Homo Sapiens
NINTSDEGI

SEQ ID NO: 242861 - protein, 9 aa, Homo Sapiens
LQQIAADEP

SEQ ID NO: 242862 - protein, 9 aa, Homo Sapiens
ENLQTLNVS

SEQ ID NO: 242863 - protein, 9 aa, Homo Sapiens
SPDCIFFHL

SEQ ID NO: 242864 - protein, 9 aa, Homo Sapiens
CYCKPHFIH

SEQ ID NO: 242865 - protein, 9 aa, Homo Sapiens
ELDDLVPEA

SEQ ID NO: 242866 - protein, 9 aa, Homo Sapiens
ISAFCEKTR

SEQ ID NO: 242867 - protein, 9 aa, Homo Sapiens
VVVKKIEAR

SEQ ID NO: 242868 - protein, 9 aa, Homo Sapiens
SWKRVYFGR

SEQ ID NO: 242869 - protein, 9 aa, Homo Sapiens
TDLEKRDFR

SEQ ID NO: 242870 - protein, 9 aa, Homo Sapiens
PYYCTIRGC

SEQ ID NO: 242871 - protein, 9 aa, Homo Sapiens
SGLLAAIKE

SEQ ID NO: 242872 - protein, 9 aa, Homo Sapiens
RQIVIHRGS

SEQ ID NO: 242873 - protein, 9 aa, Homo Sapiens
TSEKAKICL

SEQ ID NO: 242874 - protein, 9 aa, Homo Sapiens
HFGVREECF

SEQ ID NO: 242875 - protein, 9 aa, Homo Sapiens
KEEANFVIH

SEQ ID NO: 242876 - protein, 9 aa, Homo Sapiens
TNGNLDPWW

SEQ ID NO: 242877 - protein, 9 aa, Homo Sapiens
GSGEGEDEG

SEQ ID NO: 242878 - protein, 9 aa, Homo Sapiens
VRDKEVGAV

SEQ ID NO: 242879 - protein, 9 aa, Homo Sapiens
MPVSNQKPG

SEQ ID NO: 242880 - protein, 9 aa, Homo Sapiens
SLKGEEEPP

SEQ ID NO: 242881 - protein, 9 aa, Homo Sapiens
NNKAFLQPN

SEQ ID NO: 242882 - protein, 9 aa, Homo Sapiens
ILISDGFIV

SEQ ID NO: 242883 - protein, 9 aa, Homo Sapiens
DCEHSLSVP

SEQ ID NO: 242884 - protein, 9 aa, Homo Sapiens
MSAPKSHVE

SEQ ID NO: 242885 - protein, 9 aa, Homo Sapiens
DVAVYLIRK

SEQ ID NO: 242886 - protein, 9 aa, Homo Sapiens
LEEVQAKNP

SEQ ID NO: 242887 - protein, 9 aa, Homo Sapiens
PEYSGGNII

SEQ ID NO: 242888 - protein, 9 aa, Homo Sapiens
RSYVRQLHV

SEQ ID NO: 242889 - protein, 9 aa, Homo Sapiens
AGFNIIITS

SEQ ID NO: 242890 - protein, 9 aa, Homo Sapiens
MHAHMCTHH

SEQ ID NO: 242891 - protein, 9 aa, Homo Sapiens
LDLKQERIN

SEQ ID NO: 242892 - protein, 9 aa, Homo Sapiens
LNASSQLAG

SEQ ID NO: 242893 - protein, 9 aa, Homo Sapiens
YYGAHVGKQ

SEQ ID NO: 242894 - protein, 9 aa, Homo Sapiens
NNSDSIVSL

SEQ ID NO: 242895 - protein, 9 aa, Homo Sapiens
KSGLIKHQI

SEQ ID NO: 242896 - protein, 9 aa, Homo Sapiens
TITGFQSPI

SEQ ID NO: 242897 - protein, 9 aa, Homo Sapiens
FTCVDGKEF

SEQ ID NO: 242898 - protein, 9 aa, Homo Sapiens
KLAAMGCAF

SEQ ID NO: 242899 - protein, 9 aa, Homo Sapiens
MSGGGALHL

SEQ ID NO: 242900 - protein, 9 aa, Homo Sapiens
PQGDKGDQG

SEQ ID NO: 242901 - protein, 9 aa, Homo Sapiens
FNTKILHTA

SEQ ID NO: 242902 - protein, 9 aa, Homo Sapiens
AVNKGFPPL

SEQ ID NO: 242903 - protein, 9 aa, Homo Sapiens
VEAKEIMAS

SEQ ID NO: 242904 - protein, 9 aa, Homo Sapiens
IPLHHSRKV

SEQ ID NO: 242905 - protein, 9 aa, Homo Sapiens
IAGEYALVI

SEQ ID NO: 242906 - protein, 9 aa, Homo Sapiens
WVLVRVMDP

SEQ ID NO: 242907 - protein, 9 aa, Homo Sapiens
LASKSREEV

SEQ ID NO: 242908 - protein, 9 aa, Homo Sapiens
NQTKNVYIE

SEQ ID NO: 242909 - protein, 9 aa, Homo Sapiens
SLKEQKKRN

SEQ ID NO: 242910 - protein, 9 aa, Homo Sapiens
HVPEIIEMD

SEQ ID NO: 242911 - protein, 9 aa, Homo Sapiens
MEFGKTNFV

SEQ ID NO: 242912 - protein, 9 aa, Homo Sapiens
LDLCQRIVG

SEQ ID NO: 242913 - protein, 9 aa, Homo Sapiens
MLRQQQHLF

SEQ ID NO: 242914 - protein, 9 aa, Homo Sapiens
MDNLFDSLC

SEQ ID NO: 242915 - protein, 9 aa, Homo Sapiens
LMHLYFAQV

SEQ ID NO: 242916 - protein, 9 aa, Homo Sapiens
TFPVEMTHN

SEQ ID NO: 242917 - protein, 9 aa, Homo Sapiens
NQEYSLLIS

SEQ ID NO: 242918 - protein, 9 aa, Homo Sapiens
GSVENGTFI

SEQ ID NO: 242919 - protein, 9 aa, Homo Sapiens
SASSYQEAW

SEQ ID NO: 242920 - protein, 9 aa, Homo Sapiens
YMRLSKLPK

SEQ ID NO: 242921 - protein, 9 aa, Homo Sapiens
CDPTFLPDN

SEQ ID NO: 242922 - protein, 9 aa, Homo Sapiens
EIARQQYRR

SEQ ID NO: 242923 - protein, 9 aa, Homo Sapiens
FILPIFFLA

SEQ ID NO: 242924 - protein, 9 aa, Homo Sapiens
DFDGVVGMG

SEQ ID NO: 242925 - protein, 9 aa, Homo Sapiens
KLTSVLEAI

SEQ ID NO: 242926 - protein, 9 aa, Homo Sapiens
FSTFILPIF

SEQ ID NO: 242927 - protein, 9 aa, Homo Sapiens
KIALFNLSN

SEQ ID NO: 242928 - protein, 9 aa, Homo Sapiens
HFFCDFVAL

SEQ ID NO: 242929 - protein, 9 aa, Homo Sapiens
ISGGPTSVY

SEQ ID NO: 242930 - protein, 9 aa, Homo Sapiens
WKLHNKSSN

SEQ ID NO: 242931 - protein, 9 aa, Homo Sapiens
ICITSITTA

SEQ ID NO: 242932 - protein, 9 aa, Homo Sapiens
CNLFIFMEY

SEQ ID NO: 242933 - protein, 9 aa, Homo Sapiens
NNKLWYFEF

SEQ ID NO: 242934 - protein, 9 aa, Homo Sapiens
KVDLFAVEL

SEQ ID NO: 242935 - protein, 9 aa, Homo Sapiens
RRKQRRREI

SEQ ID NO: 242936 - protein, 9 aa, Homo Sapiens
ESDQLINRG

SEQ ID NO: 242937 - protein, 9 aa, Homo Sapiens
EAADPQALT

SEQ ID NO: 242938 - protein, 9 aa, Homo Sapiens
PDEEAVVDF

SEQ ID NO: 242939 - protein, 9 aa, Homo Sapiens
NLELQDLLL

SEQ ID NO: 242940 - protein, 9 aa, Homo Sapiens
ETSSKGSDL

SEQ ID NO: 242941 - protein, 9 aa, Homo Sapiens
PPPRLPAKR

SEQ ID NO: 242942 - protein, 9 aa, Homo Sapiens
PTVALNQLK

SEQ ID NO: 242943 - protein, 9 aa, Homo Sapiens
WIIFVMWTF

SEQ ID NO: 242944 - protein, 9 aa, Homo Sapiens
TLMSRRFCI

SEQ ID NO: 242945 - protein, 9 aa, Homo Sapiens
KKFASVQGF

SEQ ID NO: 242946 - protein, 9 aa, Homo Sapiens
LRETVDKNG

SEQ ID NO: 242947 - protein, 9 aa, Homo Sapiens
YSQILFPVA

SEQ ID NO: 242948 - protein, 9 aa, Homo Sapiens
DLQSSDLKT

SEQ ID NO: 242949 - protein, 9 aa, Homo Sapiens
KEKLADASE

SEQ ID NO: 242950 - protein, 9 aa, Homo Sapiens
LLKKCHAPE

SEQ ID NO: 242951 - protein, 9 aa, Homo Sapiens
FAPRLSRGP

SEQ ID NO: 242952 - protein, 9 aa, Homo Sapiens
MATSLDDKV

SEQ ID NO: 242953 - protein, 9 aa, Homo Sapiens
NLLESRLEL

SEQ ID NO: 242954 - protein, 9 aa, Homo Sapiens
DDDSLAKRQ

SEQ ID NO: 242955 - protein, 9 aa, Homo Sapiens
LEAIAGDLH

SEQ ID NO: 242956 - protein, 9 aa, Homo Sapiens
PETKNCCGP

SEQ ID NO: 242957 - protein, 9 aa, Homo Sapiens
SKALGIGRL

SEQ ID NO: 242958 - protein, 9 aa, Homo Sapiens
SHKKLELTK

SEQ ID NO: 242959 - protein, 9 aa, Homo Sapiens
VLQILLKLK

SEQ ID NO: 242960 - protein, 9 aa, Homo Sapiens
YCQPRAINH

SEQ ID NO: 242961 - protein, 9 aa, Homo Sapiens
SAIRSHHSG

SEQ ID NO: 242962 - protein, 9 aa, Homo Sapiens
ICGGNKSHI

SEQ ID NO: 242963 - protein, 9 aa, Homo Sapiens
KSFQIHEKT

SEQ ID NO: 242964 - protein, 9 aa, Homo Sapiens
PFQERISHS

SEQ ID NO: 242965 - protein, 9 aa, Homo Sapiens
KSLEIRRWD

SEQ ID NO: 242966 - protein, 9 aa, Homo Sapiens
MLLREAMHD

SEQ ID NO: 242967 - protein, 9 aa, Homo Sapiens
YLKTKKNYN

SEQ ID NO: 242968 - protein, 9 aa, Homo Sapiens
INPVFNEQF

SEQ ID NO: 242969 - protein, 9 aa, Homo Sapiens
DQKDLLGYL

SEQ ID NO: 242970 - protein, 9 aa, Homo Sapiens
DRNLDKALS

SEQ ID NO: 242971 - protein, 9 aa, Homo Sapiens
EAEKVKSYS

SEQ ID NO: 242972 - protein, 9 aa, Homo Sapiens
TDPLEHELR

SEQ ID NO: 242973 - protein, 9 aa, Homo Sapiens
QHSSETYAI

SEQ ID NO: 242974 - protein, 9 aa, Homo Sapiens
SPALELDKV

SEQ ID NO: 242975 - protein, 9 aa, Homo Sapiens
ADNDWFQLE

SEQ ID NO: 242976 - protein, 9 aa, Homo Sapiens
RVRLSRRLN

SEQ ID NO: 242977 - protein, 9 aa, Homo Sapiens
PAYTMPLIK

SEQ ID NO: 242978 - protein, 9 aa, Homo Sapiens
GGLREQEKH

SEQ ID NO: 242979 - protein, 9 aa, Homo Sapiens
EDKGEKEEE

SEQ ID NO: 242980 - protein, 9 aa, Homo Sapiens
QGVPEYPGK

SEQ ID NO: 242981 - protein, 9 aa, Homo Sapiens
APPIEPITA

SEQ ID NO: 242982 - protein, 9 aa, Homo Sapiens
PAIPMPPIQ

SEQ ID NO: 242983 - protein, 9 aa, Homo Sapiens
TVDLAHTIG

SEQ ID NO: 242984 - protein, 9 aa, Homo Sapiens
LGQLALLDY

SEQ ID NO: 242985 - protein, 9 aa, Homo Sapiens
EEQNIGKVV

SEQ ID NO: 242986 - protein, 9 aa, Homo Sapiens
SRQSSTVES

SEQ ID NO: 242987 - protein, 9 aa, Homo Sapiens
IGDNVEDPY

SEQ ID NO: 242988 - protein, 9 aa, Homo Sapiens
CIPRFLLTI

SEQ ID NO: 242989 - protein, 9 aa, Homo Sapiens
SKEDATVFA

SEQ ID NO: 242990 - protein, 9 aa, Homo Sapiens
GSIHARRTM

SEQ ID NO: 242991 - protein, 9 aa, Homo Sapiens
KKGTNYLAN

SEQ ID NO: 242992 - protein, 9 aa, Homo Sapiens
LCYSPKDEG

SEQ ID NO: 242993 - protein, 9 aa, Homo Sapiens
LDADIHSAI

SEQ ID NO: 242994 - protein, 9 aa, Homo Sapiens
PEAAKGKPE

SEQ ID NO: 242995 - protein, 9 aa, Homo Sapiens
ATYQTAIVQ

SEQ ID NO: 242996 - protein, 9 aa, Homo Sapiens
LDKIIILYD

SEQ ID NO: 242997 - protein, 9 aa, Homo Sapiens
FIWFCIVPP

SEQ ID NO: 242998 - protein, 9 aa, Homo Sapiens
WEYTMLRNI

SEQ ID NO: 242999 - protein, 9 aa, Homo Sapiens
VAALHLYLY

SEQ ID NO: 243000 - protein, 9 aa, Homo Sapiens
VFNETEIEV

SEQ ID NO: 243001 - protein, 9 aa, Homo Sapiens
QKKDFLEPE

SEQ ID NO: 243002 - protein, 9 aa, Homo Sapiens
DTFFRVHIL

SEQ ID NO: 243003 - protein, 9 aa, Homo Sapiens
KAYLGEECP

SEQ ID NO: 243004 - protein, 9 aa, Homo Sapiens
VLSSSNPWG

SEQ ID NO: 243005 - protein, 9 aa, Homo Sapiens
HQHMVGRRC

SEQ ID NO: 243006 - protein, 9 aa, Homo Sapiens
WAVIHSVKE

SEQ ID NO: 243007 - protein, 9 aa, Homo Sapiens
QITSGNTQN

SEQ ID NO: 243008 - protein, 9 aa, Homo Sapiens
SREMNAKEE

SEQ ID NO: 243009 - protein, 9 aa, Homo Sapiens
LVLPYTNSK

SEQ ID NO: 243010 - protein, 9 aa, Homo Sapiens
AKQQPDKVA

SEQ ID NO: 243011 - protein, 9 aa, Homo Sapiens
KVRSTNLNF

SEQ ID NO: 243012 - protein, 9 aa, Homo Sapiens
TEHVLGDGT

SEQ ID NO: 243013 - protein, 9 aa, Homo Sapiens
YIVAFLGNM

SEQ ID NO: 243014 - protein, 9 aa, Homo Sapiens
NTGQKGKYA

SEQ ID NO: 243015 - protein, 9 aa, Homo Sapiens
AALHDRMTE

SEQ ID NO: 243016 - protein, 9 aa, Homo Sapiens
QIRGNLANS

SEQ ID NO: 243017 - protein, 9 aa, Homo Sapiens
QVEQCVNET

SEQ ID NO: 243018 - protein, 9 aa, Homo Sapiens
HKIEAKEPE

SEQ ID NO: 243019 - protein, 9 aa, Homo Sapiens
TTLGNYKNF

SEQ ID NO: 243020 - protein, 9 aa, Homo Sapiens
IKMSSDKIS

SEQ ID NO: 243021 - protein, 9 aa, Homo Sapiens
SKPELTIIA

SEQ ID NO: 243022 - protein, 9 aa, Homo Sapiens
RNLTKDNSQ

SEQ ID NO: 243023 - protein, 9 aa, Homo Sapiens
VASFSLWRD

SEQ ID NO: 243024 - protein, 9 aa, Homo Sapiens
QIISCSPKT

SEQ ID NO: 243025 - protein, 9 aa, Homo Sapiens
SHGLSKALP

SEQ ID NO: 243026 - protein, 9 aa, Homo Sapiens
ARHRIIHTA

SEQ ID NO: 243027 - protein, 9 aa, Homo Sapiens
EWEEAECQA

SEQ ID NO: 243028 - protein, 9 aa, Homo Sapiens
RSQFITVKY

SEQ ID NO: 243029 - protein, 9 aa, Homo Sapiens
LLPGITTLE

SEQ ID NO: 243030 - protein, 9 aa, Homo Sapiens
LQEKKAMTA

SEQ ID NO: 243031 - protein, 9 aa, Homo Sapiens
SSASLLVRS

SEQ ID NO: 243032 - protein, 9 aa, Homo Sapiens
LTFSLGKHV

SEQ ID NO: 243033 - protein, 9 aa, Homo Sapiens
HILQAAFRL

SEQ ID NO: 243034 - protein, 9 aa, Homo Sapiens
TAQDYGAGT

SEQ ID NO: 243035 - protein, 9 aa, Homo Sapiens
ALMLCPQRD

SEQ ID NO: 243036 - protein, 9 aa, Homo Sapiens
LFNMVPRAA

SEQ ID NO: 243037 - protein, 9 aa, Homo Sapiens
HLSNVQFRW

SEQ ID NO: 243038 - protein, 9 aa, Homo Sapiens
PAFYSVELI

SEQ ID NO: 243039 - protein, 9 aa, Homo Sapiens
KKMHQTQMK

SEQ ID NO: 243040 - protein, 9 aa, Homo Sapiens
QFVVRRLFK

SEQ ID NO: 243041 - protein, 9 aa, Homo Sapiens
CSTQDFFLI

SEQ ID NO: 243042 - protein, 9 aa, Homo Sapiens
SEEKKALIY

SEQ ID NO: 243043 - protein, 9 aa, Homo Sapiens
ESRNGLEKT

SEQ ID NO: 243044 - protein, 9 aa, Homo Sapiens
DGALVMEVD

SEQ ID NO: 243045 - protein, 9 aa, Homo Sapiens
VLLTCRDKE

SEQ ID NO: 243046 - protein, 9 aa, Homo Sapiens
NDSSSDVTS

SEQ ID NO: 243047 - protein, 9 aa, Homo Sapiens
RMVCAGYLN

SEQ ID NO: 243048 - protein, 9 aa, Homo Sapiens
LAQPTSARR

SEQ ID NO: 243049 - protein, 9 aa, Homo Sapiens
PVAFSYYIH

SEQ ID NO: 243050 - protein, 9 aa, Homo Sapiens
DSNRSETGH

SEQ ID NO: 243051 - protein, 9 aa, Homo Sapiens
LSPSRRRKL

SEQ ID NO: 243052 - protein, 9 aa, Homo Sapiens
APWDLGMAG

SEQ ID NO: 243053 - protein, 9 aa, Homo Sapiens
SYRPHLLLS

SEQ ID NO: 243054 - protein, 9 aa, Homo Sapiens
AQLVYNITL

SEQ ID NO: 243055 - protein, 9 aa, Homo Sapiens
KESKLEITP

SEQ ID NO: 243056 - protein, 9 aa, Homo Sapiens
FRMYEVKGL

SEQ ID NO: 243057 - protein, 9 aa, Homo Sapiens
ARYPHSLWV

SEQ ID NO: 243058 - protein, 9 aa, Homo Sapiens
LISRASRCR

SEQ ID NO: 243059 - protein, 9 aa, Homo Sapiens
SPQSLLSDV

SEQ ID NO: 243060 - protein, 9 aa, Homo Sapiens
EEKGLELAY

SEQ ID NO: 243061 - protein, 9 aa, Homo Sapiens
RLWALLAKE

SEQ ID NO: 243062 - protein, 9 aa, Homo Sapiens
THPHGDEFL

SEQ ID NO: 243063 - protein, 9 aa, Homo Sapiens
TESLGLHSR

SEQ ID NO: 243064 - protein, 9 aa, Homo Sapiens
QSLNLMEFN

SEQ ID NO: 243065 - protein, 9 aa, Homo Sapiens
GTDKGRIHL

SEQ ID NO: 243066 - protein, 9 aa, Homo Sapiens
LFSPPTQAP

SEQ ID NO: 243067 - protein, 9 aa, Homo Sapiens
MVVRDEKRK

SEQ ID NO: 243068 - protein, 9 aa, Homo Sapiens
IIFVITHRL

SEQ ID NO: 243069 - protein, 9 aa, Homo Sapiens
ITSSEKPTL

SEQ ID NO: 243070 - protein, 9 aa, Homo Sapiens
SGHQELKQC

SEQ ID NO: 243071 - protein, 9 aa, Homo Sapiens
YGQKNKKIH

SEQ ID NO: 243072 - protein, 9 aa, Homo Sapiens
KYMYMSCGT

SEQ ID NO: 243073 - protein, 9 aa, Homo Sapiens
ENRFIVQEV

SEQ ID NO: 243074 - protein, 9 aa, Homo Sapiens
ALKDTFNKT

SEQ ID NO: 243075 - protein, 9 aa, Homo Sapiens
RKQIPFSKT

SEQ ID NO: 243076 - protein, 9 aa, Homo Sapiens
YLARLNESH

SEQ ID NO: 243077 - protein, 9 aa, Homo Sapiens
PLDPPLRSQ

SEQ ID NO: 243078 - protein, 9 aa, Homo Sapiens
LKVTGKSDA

SEQ ID NO: 243079 - protein, 9 aa, Homo Sapiens
GDKVKPVLF

SEQ ID NO: 243080 - protein, 9 aa, Homo Sapiens
ICKSRVSGK

SEQ ID NO: 243081 - protein, 9 aa, Homo Sapiens
ASIWKLFFR

SEQ ID NO: 243082 - protein, 9 aa, Homo Sapiens
STRTYCYKQ

SEQ ID NO: 243083 - protein, 9 aa, Homo Sapiens
IKRTSFVME

SEQ ID NO: 243084 - protein, 9 aa, Homo Sapiens
YIKRIMLRI

SEQ ID NO: 243085 - protein, 9 aa, Homo Sapiens
YIRIHEIIH

SEQ ID NO: 243086 - protein, 9 aa, Homo Sapiens
NFLRVNRVA

SEQ ID NO: 243087 - protein, 9 aa, Homo Sapiens
KQLEGSTIT

SEQ ID NO: 243088 - protein, 9 aa, Homo Sapiens
EQSPVADRK

SEQ ID NO: 243089 - protein, 9 aa, Homo Sapiens
QYQIIHAGE

SEQ ID NO: 243090 - protein, 9 aa, Homo Sapiens
IMVYFGRRV

SEQ ID NO: 243091 - protein, 9 aa, Homo Sapiens
EVMEWNGWG

SEQ ID NO: 243092 - protein, 9 aa, Homo Sapiens
RPQMKIFLF

SEQ ID NO: 243093 - protein, 9 aa, Homo Sapiens
TESTWGWQS

SEQ ID NO: 243094 - protein, 9 aa, Homo Sapiens
WLSHRPAFM

SEQ ID NO: 243095 - protein, 9 aa, Homo Sapiens
PFIYVNAFQ

SEQ ID NO: 243096 - protein, 9 aa, Homo Sapiens
GKKMKPEVI

SEQ ID NO: 243097 - protein, 9 aa, Homo Sapiens
MQLMAIFKR

SEQ ID NO: 243098 - protein, 9 aa, Homo Sapiens
DKYGPGPMG

SEQ ID NO: 243099 - protein, 9 aa, Homo Sapiens
TWHCIVSRN

SEQ ID NO: 243100 - protein, 9 aa, Homo Sapiens
HIKKPLNAL

SEQ ID NO: 243101 - protein, 9 aa, Homo Sapiens
SSTKHPGAS

SEQ ID NO: 243102 - protein, 9 aa, Homo Sapiens
VVIAVERFR

SEQ ID NO: 243103 - protein, 9 aa, Homo Sapiens
QTHTGEKPH

SEQ ID NO: 243104 - protein, 9 aa, Homo Sapiens
LEEAEFQMK

SEQ ID NO: 243105 - protein, 9 aa, Homo Sapiens
ELTDVANKQ

SEQ ID NO: 243106 - protein, 9 aa, Homo Sapiens
CLNRSERWD

SEQ ID NO: 243107 - protein, 9 aa, Homo Sapiens
GSWKFTKGN

SEQ ID NO: 243108 - protein, 9 aa, Homo Sapiens
IQLHKLIRK

SEQ ID NO: 243109 - protein, 9 aa, Homo Sapiens
TLHLEPFKA

SEQ ID NO: 243110 - protein, 9 aa, Homo Sapiens
ASRNSSSVW

SEQ ID NO: 243111 - protein, 9 aa, Homo Sapiens
KKYNKLKSM

SEQ ID NO: 243112 - protein, 9 aa, Homo Sapiens
STSVYPNGQ

SEQ ID NO: 243113 - protein, 9 aa, Homo Sapiens
VLEISSLLI

SEQ ID NO: 243114 - protein, 9 aa, Homo Sapiens
KEAIAAGYR

SEQ ID NO: 243115 - protein, 9 aa, Homo Sapiens
DRSRPGSHK

SEQ ID NO: 243116 - protein, 9 aa, Homo Sapiens
LDFILMNKM

SEQ ID NO: 243117 - protein, 9 aa, Homo Sapiens
KCTFINDVD

SEQ ID NO: 243118 - protein, 9 aa, Homo Sapiens
VNNSKARES

SEQ ID NO: 243119 - protein, 9 aa, Homo Sapiens
QSLKGLRNC

SEQ ID NO: 243120 - protein, 9 aa, Homo Sapiens
EGEGLRYFS

SEQ ID NO: 243121 - protein, 9 aa, Homo Sapiens
YNKTCNSFL

SEQ ID NO: 243122 - protein, 9 aa, Homo Sapiens
RSETGHSPP

SEQ ID NO: 243123 - protein, 9 aa, Homo Sapiens
EHLRTAIKH

SEQ ID NO: 243124 - protein, 9 aa, Homo Sapiens
NGKPKFDVL

SEQ ID NO: 243125 - protein, 9 aa, Homo Sapiens
PGFNALDQL

SEQ ID NO: 243126 - protein, 9 aa, Homo Sapiens
ERNAQFSTL

SEQ ID NO: 243127 - protein, 9 aa, Homo Sapiens
NCHRSRLRV

SEQ ID NO: 243128 - protein, 9 aa, Homo Sapiens
NMLFLLFLI

SEQ ID NO: 243129 - protein, 9 aa, Homo Sapiens
ILMLVLYVV

SEQ ID NO: 243130 - protein, 9 aa, Homo Sapiens
AGYLQHPGS

SEQ ID NO: 243131 - protein, 9 aa, Homo Sapiens
LLYNIVMPH

SEQ ID NO: 243132 - protein, 9 aa, Homo Sapiens
NKDTKFRDL

SEQ ID NO: 243133 - protein, 9 aa, Homo Sapiens
LASVIPASN

SEQ ID NO: 243134 - protein, 9 aa, Homo Sapiens
EQWSTVICA

SEQ ID NO: 243135 - protein, 9 aa, Homo Sapiens
FGKTSSTVN

SEQ ID NO: 243136 - protein, 9 aa, Homo Sapiens
RIDHTFEQI

SEQ ID NO: 243137 - protein, 9 aa, Homo Sapiens
ICLAVICNH

SEQ ID NO: 243138 - protein, 9 aa, Homo Sapiens
VVGTLLVAL

SEQ ID NO: 243139 - protein, 9 aa, Homo Sapiens
LAPIQDPKT

SEQ ID NO: 243140 - protein, 9 aa, Homo Sapiens
YFFQTLSLL

SEQ ID NO: 243141 - protein, 9 aa, Homo Sapiens
VTVPNMLGD

SEQ ID NO: 243142 - protein, 9 aa, Homo Sapiens
SEFFRNRSI

SEQ ID NO: 243143 - protein, 9 aa, Homo Sapiens
SQRKKMLDK

SEQ ID NO: 243144 - protein, 9 aa, Homo Sapiens
HTLAMDYRS

SEQ ID NO: 243145 - protein, 9 aa, Homo Sapiens
STFENGTDL

SEQ ID NO: 243146 - protein, 9 aa, Homo Sapiens
LRSNGVPVT

SEQ ID NO: 243147 - protein, 9 aa, Homo Sapiens
VVVTLFCCH

SEQ ID NO: 243148 - protein, 9 aa, Homo Sapiens
APSRTAYFS

SEQ ID NO: 243149 - protein, 9 aa, Homo Sapiens
ARITSWPKA

SEQ ID NO: 243150 - protein, 9 aa, Homo Sapiens
GSEDKNITL

SEQ ID NO: 243151 - protein, 9 aa, Homo Sapiens
KTNVVRVWF

SEQ ID NO: 243152 - protein, 9 aa, Homo Sapiens
VAEKVQKLS

SEQ ID NO: 243153 - protein, 9 aa, Homo Sapiens
SFQGPQGDK

SEQ ID NO: 243154 - protein, 9 aa, Homo Sapiens
KNLKYRMYE

SEQ ID NO: 243155 - protein, 9 aa, Homo Sapiens
PVERDIKSK

SEQ ID NO: 243156 - protein, 9 aa, Homo Sapiens
FFRSKKELN

SEQ ID NO: 243157 - protein, 9 aa, Homo Sapiens
KLERVYNLV

SEQ ID NO: 243158 - protein, 9 aa, Homo Sapiens
KVIVEAEDI

SEQ ID NO: 243159 - protein, 9 aa, Homo Sapiens
YSTGSLDPQ

SEQ ID NO: 243160 - protein, 9 aa, Homo Sapiens
TKEIFRRSK

SEQ ID NO: 243161 - protein, 9 aa, Homo Sapiens
ESVNASFKG

SEQ ID NO: 243162 - protein, 9 aa, Homo Sapiens
LEWGSWGPC

SEQ ID NO: 243163 - protein, 9 aa, Homo Sapiens
TSDKFGCSQ

SEQ ID NO: 243164 - protein, 9 aa, Homo Sapiens
RVQTAVGSS

SEQ ID NO: 243165 - protein, 9 aa, Homo Sapiens
CYLLGMLYI

SEQ ID NO: 243166 - protein, 9 aa, Homo Sapiens
FTQASPDQL

SEQ ID NO: 243167 - protein, 9 aa, Homo Sapiens
YQGSDFLRF

SEQ ID NO: 243168 - protein, 9 aa, Homo Sapiens
EDLFSLSQY

SEQ ID NO: 243169 - protein, 9 aa, Homo Sapiens
CQENDYSFE

SEQ ID NO: 243170 - protein, 9 aa, Homo Sapiens
CQTADADSE

SEQ ID NO: 243171 - protein, 9 aa, Homo Sapiens
YAPMITGFS

SEQ ID NO: 243172 - protein, 9 aa, Homo Sapiens
VSESHVVSA

SEQ ID NO: 243173 - protein, 9 aa, Homo Sapiens
IFEEEIMSY

SEQ ID NO: 243174 - protein, 9 aa, Homo Sapiens
FQNMGICKR

SEQ ID NO: 243175 - protein, 9 aa, Homo Sapiens
KLIDNPRHI

SEQ ID NO: 243176 - protein, 9 aa, Homo Sapiens
DSAWRKQIP

SEQ ID NO: 243177 - protein, 9 aa, Homo Sapiens
TVNELAPVG

SEQ ID NO: 243178 - protein, 9 aa, Homo Sapiens
MLFVMMEAF

SEQ ID NO: 243179 - protein, 9 aa, Homo Sapiens
TLPTFDPTE

SEQ ID NO: 243180 - protein, 9 aa, Homo Sapiens
PDILDPQVP

SEQ ID NO: 243181 - protein, 9 aa, Homo Sapiens
SELVEGQVP

SEQ ID NO: 243182 - protein, 9 aa, Homo Sapiens
RLQRITVAD

SEQ ID NO: 243183 - protein, 9 aa, Homo Sapiens
FQEEIRQRS

SEQ ID NO: 243184 - protein, 9 aa, Homo Sapiens
IPPEEIKQM

SEQ ID NO: 243185 - protein, 9 aa, Homo Sapiens
HKMLRQQQH

SEQ ID NO: 243186 - protein, 9 aa, Homo Sapiens
QRLWPQDEP

SEQ ID NO: 243187 - protein, 9 aa, Homo Sapiens
TAAVLVSFM

SEQ ID NO: 243188 - protein, 9 aa, Homo Sapiens
TVYCFVNFT

SEQ ID NO: 243189 - protein, 9 aa, Homo Sapiens
YCQVEAVPS

SEQ ID NO: 243190 - protein, 9 aa, Homo Sapiens
KAEYNVLPA

SEQ ID NO: 243191 - protein, 9 aa, Homo Sapiens
KKRCGSSKG

SEQ ID NO: 243192 - protein, 9 aa, Homo Sapiens
IVWKTNHVT

SEQ ID NO: 243193 - protein, 9 aa, Homo Sapiens
GDIPFEHDK

SEQ ID NO: 243194 - protein, 9 aa, Homo Sapiens
QETETLTQE

SEQ ID NO: 243195 - protein, 9 aa, Homo Sapiens
DQKEDDKQY

SEQ ID NO: 243196 - protein, 9 aa, Homo Sapiens
ANVVKSHKQ

SEQ ID NO: 243197 - protein, 9 aa, Homo Sapiens
DVLGLILRY

SEQ ID NO: 243198 - protein, 9 aa, Homo Sapiens
VKVQYLVLE

SEQ ID NO: 243199 - protein, 9 aa, Homo Sapiens
VNSHGCQLL

SEQ ID NO: 243200 - protein, 9 aa, Homo Sapiens
SLEYPREDE

SEQ ID NO: 243201 - protein, 9 aa, Homo Sapiens
SNPWECNCT

SEQ ID NO: 243202 - protein, 9 aa, Homo Sapiens
FLLTIVTRD

SEQ ID NO: 243203 - protein, 9 aa, Homo Sapiens
KGGRCRNGH

SEQ ID NO: 243204 - protein, 9 aa, Homo Sapiens
SHSGSLQIH

SEQ ID NO: 243205 - protein, 9 aa, Homo Sapiens
NAACKENTS

SEQ ID NO: 243206 - protein, 9 aa, Homo Sapiens
DVIKVPDFL

SEQ ID NO: 243207 - protein, 9 aa, Homo Sapiens
ALNRPDDTA

SEQ ID NO: 243208 - protein, 9 aa, Homo Sapiens
NLYLPRPEY

SEQ ID NO: 243209 - protein, 9 aa, Homo Sapiens
HCKIALFNL

SEQ ID NO: 243210 - protein, 9 aa, Homo Sapiens
LSEQGNLEK

SEQ ID NO: 243211 - protein, 9 aa, Homo Sapiens
AVFTEFLAT

SEQ ID NO: 243212 - protein, 9 aa, Homo Sapiens
SLILTSQII

SEQ ID NO: 243213 - protein, 9 aa, Homo Sapiens
NPRVSPRYT

SEQ ID NO: 243214 - protein, 9 aa, Homo Sapiens
KSPTSQPLE

SEQ ID NO: 243215 - protein, 9 aa, Homo Sapiens
PLCLYVVAG

SEQ ID NO: 243216 - protein, 9 aa, Homo Sapiens
LQKWTGDVE

SEQ ID NO: 243217 - protein, 9 aa, Homo Sapiens
ANNRRLSSQ

SEQ ID NO: 243218 - protein, 9 aa, Homo Sapiens
SNGLNEEIA

SEQ ID NO: 243219 - protein, 9 aa, Homo Sapiens
VCAAYAHKL

SEQ ID NO: 243220 - protein, 9 aa, Homo Sapiens
TYYLLQSFQ

SEQ ID NO: 243221 - protein, 9 aa, Homo Sapiens
LPQSLNLME

SEQ ID NO: 243222 - protein, 9 aa, Homo Sapiens
IRVLWGLLD

SEQ ID NO: 243223 - protein, 9 aa, Homo Sapiens
KAIKFVLSC

SEQ ID NO: 243224 - protein, 9 aa, Homo Sapiens
YPDHTNNSF

SEQ ID NO: 243225 - protein, 9 aa, Homo Sapiens
HVYIRVFTC

SEQ ID NO: 243226 - protein, 9 aa, Homo Sapiens
EARTRLERH

SEQ ID NO: 243227 - protein, 9 aa, Homo Sapiens
KQVIQREDS

SEQ ID NO: 243228 - protein, 9 aa, Homo Sapiens
ETYAIELYE

SEQ ID NO: 243229 - protein, 9 aa, Homo Sapiens
WIQLDHYCK

SEQ ID NO: 243230 - protein, 9 aa, Homo Sapiens
QPTQAAVRA

SEQ ID NO: 243231 - protein, 9 aa, Homo Sapiens
DKLSRADIH

SEQ ID NO: 243232 - protein, 9 aa, Homo Sapiens
KTKDPFLEV

SEQ ID NO: 243233 - protein, 9 aa, Homo Sapiens
TGSSQSCSS

SEQ ID NO: 243234 - protein, 9 aa, Homo Sapiens
NNSRFYNYT

SEQ ID NO: 243235 - protein, 9 aa, Homo Sapiens
ITNSASQVV

SEQ ID NO: 243236 - protein, 9 aa, Homo Sapiens
NSAENFSQI

SEQ ID NO: 243237 - protein, 9 aa, Homo Sapiens
VTTSEAQPC

SEQ ID NO: 243238 - protein, 9 aa, Homo Sapiens
LKINYQIKI

SEQ ID NO: 243239 - protein, 9 aa, Homo Sapiens
SQSEDSGGG

SEQ ID NO: 243240 - protein, 9 aa, Homo Sapiens
EKDKWMLDL

SEQ ID NO: 243241 - protein, 9 aa, Homo Sapiens
AREDKSFDI

SEQ ID NO: 243242 - protein, 9 aa, Homo Sapiens
TPGENILFS

SEQ ID NO: 243243 - protein, 9 aa, Homo Sapiens
VSIFQERDL

SEQ ID NO: 243244 - protein, 9 aa, Homo Sapiens
GIRAWVAWI

SEQ ID NO: 243245 - protein, 9 aa, Homo Sapiens
IGLIQPLGD

SEQ ID NO: 243246 - protein, 9 aa, Homo Sapiens
CLLPLIVKR

SEQ ID NO: 243247 - protein, 9 aa, Homo Sapiens
ASSSNAPIS

SEQ ID NO: 243248 - protein, 9 aa, Homo Sapiens
DIPNLRRLN

SEQ ID NO: 243249 - protein, 9 aa, Homo Sapiens
GRFKSMSPQ

SEQ ID NO: 243250 - protein, 9 aa, Homo Sapiens
KTLNNKFAP

SEQ ID NO: 243251 - protein, 9 aa, Homo Sapiens
TQSRMDWGK

SEQ ID NO: 243252 - protein, 9 aa, Homo Sapiens
KDYFQKVIL

SEQ ID NO: 243253 - protein, 9 aa, Homo Sapiens
LKQTCYIAN

SEQ ID NO: 243254 - protein, 9 aa, Homo Sapiens
ELVNEALKT

SEQ ID NO: 243255 - protein, 9 aa, Homo Sapiens
VCSGENNVI

SEQ ID NO: 243256 - protein, 9 aa, Homo Sapiens
SNVSSLSSK

SEQ ID NO: 243257 - protein, 9 aa, Homo Sapiens
MTFIKKPKS

SEQ ID NO: 243258 - protein, 9 aa, Homo Sapiens
ISDNSDDCQ

SEQ ID NO: 243259 - protein, 9 aa, Homo Sapiens
NEAQDAASS

SEQ ID NO: 243260 - protein, 9 aa, Homo Sapiens
INITKHLLK

SEQ ID NO: 243261 - protein, 9 aa, Homo Sapiens
PLNGRPIYP

SEQ ID NO: 243262 - protein, 9 aa, Homo Sapiens
RAVLQLYPD

SEQ ID NO: 243263 - protein, 9 aa, Homo Sapiens
QRVVAICIH

SEQ ID NO: 243264 - protein, 9 aa, Homo Sapiens
FYISANIQQ

SEQ ID NO: 243265 - protein, 9 aa, Homo Sapiens
QIQQVKSHF

SEQ ID NO: 243266 - protein, 9 aa, Homo Sapiens
FKRDVCGKE

SEQ ID NO: 243267 - protein, 9 aa, Homo Sapiens
SYIRIFCWF

SEQ ID NO: 243268 - protein, 9 aa, Homo Sapiens
LVGWPRNWH

SEQ ID NO: 243269 - protein, 9 aa, Homo Sapiens
EELLSVNFV

SEQ ID NO: 243270 - protein, 9 aa, Homo Sapiens
CSTHASNDY

SEQ ID NO: 243271 - protein, 9 aa, Homo Sapiens
AFVRDVTVL

SEQ ID NO: 243272 - protein, 9 aa, Homo Sapiens
KIEQWLEQY

SEQ ID NO: 243273 - protein, 9 aa, Homo Sapiens
KNIFSKKGE

SEQ ID NO: 243274 - protein, 9 aa, Homo Sapiens
CENHHDKLS

SEQ ID NO: 243275 - protein, 9 aa, Homo Sapiens
KKKNKSQDQ

SEQ ID NO: 243276 - protein, 9 aa, Homo Sapiens
APTSSRAFH

SEQ ID NO: 243277 - protein, 9 aa, Homo Sapiens
PGPSQLCSG

SEQ ID NO: 243278 - protein, 9 aa, Homo Sapiens
TNSFSKMNC

SEQ ID NO: 243279 - protein, 9 aa, Homo Sapiens
TLYLTENKY

SEQ ID NO: 243280 - protein, 9 aa, Homo Sapiens
FNKTENKEV

SEQ ID NO: 243281 - protein, 9 aa, Homo Sapiens
YQNSTIGAY

SEQ ID NO: 243282 - protein, 9 aa, Homo Sapiens
GPFMGQRRS

SEQ ID NO: 243283 - protein, 9 aa, Homo Sapiens
REQLVKAER

SEQ ID NO: 243284 - protein, 9 aa, Homo Sapiens
PENIYGGSQ

SEQ ID NO: 243285 - protein, 9 aa, Homo Sapiens
DECGTSFSH

SEQ ID NO: 243286 - protein, 9 aa, Homo Sapiens
FRLQGLDAL

SEQ ID NO: 243287 - protein, 9 aa, Homo Sapiens
NSLQKSRTE

SEQ ID NO: 243288 - protein, 9 aa, Homo Sapiens
GNLKYMALN

SEQ ID NO: 243289 - protein, 9 aa, Homo Sapiens
KEIFRRSKI

SEQ ID NO: 243290 - protein, 9 aa, Homo Sapiens
TLDCYDPTV

SEQ ID NO: 243291 - protein, 9 aa, Homo Sapiens
QLEEETKEA

SEQ ID NO: 243292 - protein, 9 aa, Homo Sapiens
TERETQRGL

SEQ ID NO: 243293 - protein, 9 aa, Homo Sapiens
QNHVHLMGD

SEQ ID NO: 243294 - protein, 9 aa, Homo Sapiens
HMQAAPEEE

SEQ ID NO: 243295 - protein, 9 aa, Homo Sapiens
CKKRDDCLE

SEQ ID NO: 243296 - protein, 9 aa, Homo Sapiens
LVRASYLDI

SEQ ID NO: 243297 - protein, 9 aa, Homo Sapiens
SSTGRHKAL

SEQ ID NO: 243298 - protein, 9 aa, Homo Sapiens
QYQEETTEL

SEQ ID NO: 243299 - protein, 9 aa, Homo Sapiens
KEGYNDLNQ

SEQ ID NO: 243300 - protein, 9 aa, Homo Sapiens
RNLKERGVI

SEQ ID NO: 243301 - protein, 9 aa, Homo Sapiens
EAAQAKRET

SEQ ID NO: 243302 - protein, 9 aa, Homo Sapiens
QDKMATNTV

SEQ ID NO: 243303 - protein, 9 aa, Homo Sapiens
NRMLASSCC

SEQ ID NO: 243304 - protein, 9 aa, Homo Sapiens
AQTCGTQPG

SEQ ID NO: 243305 - protein, 9 aa, Homo Sapiens
DFLFMSPME

SEQ ID NO: 243306 - protein, 9 aa, Homo Sapiens
KIIYVFYTV

SEQ ID NO: 243307 - protein, 9 aa, Homo Sapiens
LQETLKYLG

SEQ ID NO: 243308 - protein, 9 aa, Homo Sapiens
HANRVKPDV

SEQ ID NO: 243309 - protein, 9 aa, Homo Sapiens
DYLEKAMSL

SEQ ID NO: 243310 - protein, 9 aa, Homo Sapiens
RSHIKKTLM

SEQ ID NO: 243311 - protein, 9 aa, Homo Sapiens
HSPRIIPPK

SEQ ID NO: 243312 - protein, 9 aa, Homo Sapiens
PCHRRVLAA

SEQ ID NO: 243313 - protein, 9 aa, Homo Sapiens
ILLEKLPYA

SEQ ID NO: 243314 - protein, 9 aa, Homo Sapiens
FCCAVLCLL

SEQ ID NO: 243315 - protein, 9 aa, Homo Sapiens
TPAKNIDTS

SEQ ID NO: 243316 - protein, 9 aa, Homo Sapiens
PSEFVILGF

SEQ ID NO: 243317 - protein, 9 aa, Homo Sapiens
QVNGFKYLH

SEQ ID NO: 243318 - protein, 9 aa, Homo Sapiens
KKLSDCIFI

SEQ ID NO: 243319 - protein, 9 aa, Homo Sapiens
MLHKEKLEQ

SEQ ID NO: 243320 - protein, 9 aa, Homo Sapiens
TLHCQLGDR

SEQ ID NO: 243321 - protein, 9 aa, Homo Sapiens
VRVMDPSLC

SEQ ID NO: 243322 - protein, 9 aa, Homo Sapiens
VLQETLKYL

SEQ ID NO: 243323 - protein, 9 aa, Homo Sapiens
THSVMDSGQ

SEQ ID NO: 243324 - protein, 9 aa, Homo Sapiens
EAVVESSRR

SEQ ID NO: 243325 - protein, 9 aa, Homo Sapiens
LEESGFDPF

SEQ ID NO: 243326 - protein, 9 aa, Homo Sapiens
SGMEIYFAP

SEQ ID NO: 243327 - protein, 9 aa, Homo Sapiens
NNTLLTEFI

SEQ ID NO: 243328 - protein, 9 aa, Homo Sapiens
DACGLQDLL

SEQ ID NO: 243329 - protein, 9 aa, Homo Sapiens
NSLEQNIRC

SEQ ID NO: 243330 - protein, 9 aa, Homo Sapiens
HVPSSRKVE

SEQ ID NO: 243331 - protein, 9 aa, Homo Sapiens
RRPFRPRPH

SEQ ID NO: 243332 - protein, 9 aa, Homo Sapiens
MRKLTKTSN

SEQ ID NO: 243333 - protein, 9 aa, Homo Sapiens
LDPVEDALE

SEQ ID NO: 243334 - protein, 9 aa, Homo Sapiens
VDYRGRATG

SEQ ID NO: 243335 - protein, 9 aa, Homo Sapiens
HTGKPSTII

SEQ ID NO: 243336 - protein, 9 aa, Homo Sapiens
KDEIIQASK

SEQ ID NO: 243337 - protein, 9 aa, Homo Sapiens
ESSRRLVKE

SEQ ID NO: 243338 - protein, 9 aa, Homo Sapiens
FPCVRLLPW

SEQ ID NO: 243339 - protein, 9 aa, Homo Sapiens
EVKGLQAYI

SEQ ID NO: 243340 - protein, 9 aa, Homo Sapiens
HVLLVGGFS

SEQ ID NO: 243341 - protein, 9 aa, Homo Sapiens
MYKLSPETT

SEQ ID NO: 243342 - protein, 9 aa, Homo Sapiens
HIVYDIPTG

SEQ ID NO: 243343 - protein, 9 aa, Homo Sapiens
GSFFFFNLV

SEQ ID NO: 243344 - protein, 9 aa, Homo Sapiens
MFTDPAHTE

SEQ ID NO: 243345 - protein, 9 aa, Homo Sapiens
QDTLESPFK

SEQ ID NO: 243346 - protein, 9 aa, Homo Sapiens
CTNHQPAHF

SEQ ID NO: 243347 - protein, 9 aa, Homo Sapiens
GIKDSGDMS

SEQ ID NO: 243348 - protein, 9 aa, Homo Sapiens
GPHDPADAA

SEQ ID NO: 243349 - protein, 9 aa, Homo Sapiens
KDQATAQEI

SEQ ID NO: 243350 - protein, 9 aa, Homo Sapiens
LHSDIDSGG

SEQ ID NO: 243351 - protein, 9 aa, Homo Sapiens
DLLIPQSSS

SEQ ID NO: 243352 - protein, 9 aa, Homo Sapiens
ITKIKDGDF

SEQ ID NO: 243353 - protein, 9 aa, Homo Sapiens
KAFLQPNNI

SEQ ID NO: 243354 - protein, 9 aa, Homo Sapiens
KCDCSTANK

SEQ ID NO: 243355 - protein, 9 aa, Homo Sapiens
GCNKKAVTD

SEQ ID NO: 243356 - protein, 9 aa, Homo Sapiens
VNMLFLLFL

SEQ ID NO: 243357 - protein, 9 aa, Homo Sapiens
TALISLVLM

SEQ ID NO: 243358 - protein, 9 aa, Homo Sapiens
TLKYLGRYR

SEQ ID NO: 243359 - protein, 9 aa, Homo Sapiens
ITLSFTYIN

SEQ ID NO: 243360 - protein, 9 aa, Homo Sapiens
LGLIWGQNG

SEQ ID NO: 243361 - protein, 9 aa, Homo Sapiens
LRDDGKCGE

SEQ ID NO: 243362 - protein, 9 aa, Homo Sapiens
VLSLSLVFL

SEQ ID NO: 243363 - protein, 9 aa, Homo Sapiens
NMRKLTKTS

SEQ ID NO: 243364 - protein, 9 aa, Homo Sapiens
SLDFNTKIL

SEQ ID NO: 243365 - protein, 9 aa, Homo Sapiens
QFITVKYQI

SEQ ID NO: 243366 - protein, 9 aa, Homo Sapiens
EYRGKVFKN

SEQ ID NO: 243367 - protein, 9 aa, Homo Sapiens
NRESGSKLL

SEQ ID NO: 243368 - protein, 9 aa, Homo Sapiens
QENAIESLE

SEQ ID NO: 243369 - protein, 9 aa, Homo Sapiens
TQRVVVEDS

SEQ ID NO: 243370 - protein, 9 aa, Homo Sapiens
LVMPNEMVP

SEQ ID NO: 243371 - protein, 9 aa, Homo Sapiens
VARNCIEIT

SEQ ID NO: 243372 - protein, 9 aa, Homo Sapiens
AQEQIHRMN

SEQ ID NO: 243373 - protein, 9 aa, Homo Sapiens
DQRAIVGSL

SEQ ID NO: 243374 - protein, 9 aa, Homo Sapiens
MSVKNNYRR

SEQ ID NO: 243375 - protein, 9 aa, Homo Sapiens
TLLPQPPFL

SEQ ID NO: 243376 - protein, 9 aa, Homo Sapiens
DNWATVMLN

SEQ ID NO: 243377 - protein, 9 aa, Homo Sapiens
SACHVFWWP

SEQ ID NO: 243378 - protein, 9 aa, Homo Sapiens
CYEEDENII

SEQ ID NO: 243379 - protein, 9 aa, Homo Sapiens
FIKLTLENY

SEQ ID NO: 243380 - protein, 9 aa, Homo Sapiens
IKPEKFTKV

SEQ ID NO: 243381 - protein, 9 aa, Homo Sapiens
GWPVHREHG

SEQ ID NO: 243382 - protein, 9 aa, Homo Sapiens
GEFYESCCP

SEQ ID NO: 243383 - protein, 9 aa, Homo Sapiens
SGVTGAMHL

SEQ ID NO: 243384 - protein, 9 aa, Homo Sapiens
QTCCPDLNS

SEQ ID NO: 243385 - protein, 9 aa, Homo Sapiens
LHCDCYTGA

SEQ ID NO: 243386 - protein, 9 aa, Homo Sapiens
QAAGSYLNY

SEQ ID NO: 243387 - protein, 9 aa, Homo Sapiens
KQIEVCKSH

SEQ ID NO: 243388 - protein, 9 aa, Homo Sapiens
KGCNDCCFG

SEQ ID NO: 243389 - protein, 9 aa, Homo Sapiens
FQNMQNAEI

SEQ ID NO: 243390 - protein, 9 aa, Homo Sapiens
LKSTSREQK

SEQ ID NO: 243391 - protein, 9 aa, Homo Sapiens
AYKEDPKLL

SEQ ID NO: 243392 - protein, 9 aa, Homo Sapiens
YSYILTSNR

SEQ ID NO: 243393 - protein, 9 aa, Homo Sapiens
GKPSYYHRF

SEQ ID NO: 243394 - protein, 9 aa, Homo Sapiens
QLFGWLFCR

SEQ ID NO: 243395 - protein, 9 aa, Homo Sapiens
SNLVARRRG

SEQ ID NO: 243396 - protein, 9 aa, Homo Sapiens
DETNNCPGA

SEQ ID NO: 243397 - protein, 9 aa, Homo Sapiens
KDNPAPHLH

SEQ ID NO: 243398 - protein, 9 aa, Homo Sapiens
CVLYKLCYF

SEQ ID NO: 243399 - protein, 9 aa, Homo Sapiens
ANIKHQQNE

SEQ ID NO: 243400 - protein, 9 aa, Homo Sapiens
MAEKTDGFV

SEQ ID NO: 243401 - protein, 9 aa, Homo Sapiens
SEDVRQHHR

SEQ ID NO: 243402 - protein, 9 aa, Homo Sapiens
IHSLHKNIG

SEQ ID NO: 243403 - protein, 9 aa, Homo Sapiens
LHDLYHDIV

SEQ ID NO: 243404 - protein, 9 aa, Homo Sapiens
ENKGGLNKK

SEQ ID NO: 243405 - protein, 9 aa, Homo Sapiens
DGPHSANRG

SEQ ID NO: 243406 - protein, 9 aa, Homo Sapiens
KSFSRSTTL

SEQ ID NO: 243407 - protein, 9 aa, Homo Sapiens
NMNISTDKS

SEQ ID NO: 243408 - protein, 9 aa, Homo Sapiens
VNHEALEIL

SEQ ID NO: 243409 - protein, 9 aa, Homo Sapiens
QTTHLWNDC

SEQ ID NO: 243410 - protein, 9 aa, Homo Sapiens
QVLQKKFRG

SEQ ID NO: 243411 - protein, 9 aa, Homo Sapiens
GMAFLTSKN

SEQ ID NO: 243412 - protein, 9 aa, Homo Sapiens
SADNFIDKH

SEQ ID NO: 243413 - protein, 9 aa, Homo Sapiens
EACDQADLS

SEQ ID NO: 243414 - protein, 9 aa, Homo Sapiens
TYHTRPHTQ

SEQ ID NO: 243415 - protein, 9 aa, Homo Sapiens
KSLSRSFEN

SEQ ID NO: 243416 - protein, 9 aa, Homo Sapiens
KGGEYGSGA

SEQ ID NO: 243417 - protein, 9 aa, Homo Sapiens
VRRPDQKDL

SEQ ID NO: 243418 - protein, 9 aa, Homo Sapiens
KRLFDLNNT

SEQ ID NO: 243419 - protein, 9 aa, Homo Sapiens
KLWHQLALQ

SEQ ID NO: 243420 - protein, 9 aa, Homo Sapiens
NITTFDRPA

SEQ ID NO: 243421 - protein, 9 aa, Homo Sapiens
LKPSKVEED

SEQ ID NO: 243422 - protein, 9 aa, Homo Sapiens
AAEHLYDMN

SEQ ID NO: 243423 - protein, 9 aa, Homo Sapiens
CELVRTLNG

SEQ ID NO: 243424 - protein, 9 aa, Homo Sapiens
PHVRISPTV

SEQ ID NO: 243425 - protein, 9 aa, Homo Sapiens
DTPLVESYS

SEQ ID NO: 243426 - protein, 9 aa, Homo Sapiens
LHEYMGMCS

SEQ ID NO: 243427 - protein, 9 aa, Homo Sapiens
LSYICRDGT

SEQ ID NO: 243428 - protein, 9 aa, Homo Sapiens
AKRIDTISQ

SEQ ID NO: 243429 - protein, 9 aa, Homo Sapiens
SLKLCLNWI

SEQ ID NO: 243430 - protein, 9 aa, Homo Sapiens
FINHQIIHS

SEQ ID NO: 243431 - protein, 9 aa, Homo Sapiens
SVADIFDCL

SEQ ID NO: 243432 - protein, 9 aa, Homo Sapiens
LSFEGTKLD

SEQ ID NO: 243433 - protein, 9 aa, Homo Sapiens
SILLTNVLC

SEQ ID NO: 243434 - protein, 9 aa, Homo Sapiens
EHPRWEDNC

SEQ ID NO: 243435 - protein, 9 aa, Homo Sapiens
QNIQGYDAK

SEQ ID NO: 243436 - protein, 9 aa, Homo Sapiens
ILPAPIKNI

SEQ ID NO: 243437 - protein, 9 aa, Homo Sapiens
KSVARLQDE

SEQ ID NO: 243438 - protein, 9 aa, Homo Sapiens
LLTSALDIK

SEQ ID NO: 243439 - protein, 9 aa, Homo Sapiens
DRINASSRQ

SEQ ID NO: 243440 - protein, 9 aa, Homo Sapiens
HQDDGKMFI

SEQ ID NO: 243441 - protein, 9 aa, Homo Sapiens
RIHVNLEKA

SEQ ID NO: 243442 - protein, 9 aa, Homo Sapiens
SSQEESIVT

SEQ ID NO: 243443 - protein, 9 aa, Homo Sapiens
QQVLKHNRS

SEQ ID NO: 243444 - protein, 9 aa, Homo Sapiens
PHITFENMI

SEQ ID NO: 243445 - protein, 9 aa, Homo Sapiens
CIFVENLYR

SEQ ID NO: 243446 - protein, 9 aa, Homo Sapiens
HFCGRRNKY

SEQ ID NO: 243447 - protein, 9 aa, Homo Sapiens
KTFYTDLMN

SEQ ID NO: 243448 - protein, 9 aa, Homo Sapiens
TCFISPYLN

SEQ ID NO: 243449 - protein, 9 aa, Homo Sapiens
VGEKCACYK

SEQ ID NO: 243450 - protein, 9 aa, Homo Sapiens
LLDEPFQST

SEQ ID NO: 243451 - protein, 9 aa, Homo Sapiens
TKPTAFQKF

SEQ ID NO: 243452 - protein, 9 aa, Homo Sapiens
TMPKKGGRW

SEQ ID NO: 243453 - protein, 9 aa, Homo Sapiens
SHNLETALR

SEQ ID NO: 243454 - protein, 9 aa, Homo Sapiens
YTYNVSTST

SEQ ID NO: 243455 - protein, 9 aa, Homo Sapiens
SRAIIIING

SEQ ID NO: 243456 - protein, 9 aa, Homo Sapiens
LSNNMKVVK

SEQ ID NO: 243457 - protein, 9 aa, Homo Sapiens
RRKRRSISS

SEQ ID NO: 243458 - protein, 9 aa, Homo Sapiens
VSGDTMKLP

SEQ ID NO: 243459 - protein, 9 aa, Homo Sapiens
IVYVTGRLL

SEQ ID NO: 243460 - protein, 9 aa, Homo Sapiens
CSEAIGNLD

SEQ ID NO: 243461 - protein, 9 aa, Homo Sapiens
FIVARCRQP

SEQ ID NO: 243462 - protein, 9 aa, Homo Sapiens
EESSSVGML

SEQ ID NO: 243463 - protein, 9 aa, Homo Sapiens
KYIVIQVKR

SEQ ID NO: 243464 - protein, 9 aa, Homo Sapiens
LNAACCQDE

SEQ ID NO: 243465 - protein, 9 aa, Homo Sapiens
REAEENDLL

SEQ ID NO: 243466 - protein, 9 aa, Homo Sapiens
IRYFTLNPA

SEQ ID NO: 243467 - protein, 9 aa, Homo Sapiens
YPQNLLFDN

SEQ ID NO: 243468 - protein, 9 aa, Homo Sapiens
VNKGFPPLA

SEQ ID NO: 243469 - protein, 9 aa, Homo Sapiens
RLHPLHKIE

SEQ ID NO: 243470 - protein, 9 aa, Homo Sapiens
EEGLFKVDY

SEQ ID NO: 243471 - protein, 9 aa, Homo Sapiens
KQIVDHSHL

SEQ ID NO: 243472 - protein, 9 aa, Homo Sapiens
IITLTNRID

SEQ ID NO: 243473 - protein, 9 aa, Homo Sapiens
TPYQSQGFS

SEQ ID NO: 243474 - protein, 9 aa, Homo Sapiens
AMSGGGALH

SEQ ID NO: 243475 - protein, 9 aa, Homo Sapiens
KGDVILKIE

SEQ ID NO: 243476 - protein, 9 aa, Homo Sapiens
STSKPEVEF

SEQ ID NO: 243477 - protein, 9 aa, Homo Sapiens
LEDIKARPD

SEQ ID NO: 243478 - protein, 9 aa, Homo Sapiens
HLRHHYSNK

SEQ ID NO: 243479 - protein, 9 aa, Homo Sapiens
YRHIPDKKL

SEQ ID NO: 243480 - protein, 9 aa, Homo Sapiens
HTAVKYFVI

SEQ ID NO: 243481 - protein, 9 aa, Homo Sapiens
VIEHRAKII

SEQ ID NO: 243482 - protein, 9 aa, Homo Sapiens
RVHNGETVI

SEQ ID NO: 243483 - protein, 9 aa, Homo Sapiens
ELVTFKDVA

SEQ ID NO: 243484 - protein, 9 aa, Homo Sapiens
HKKDSSCIR

SEQ ID NO: 243485 - protein, 9 aa, Homo Sapiens
PLQALDLFG

SEQ ID NO: 243486 - protein, 9 aa, Homo Sapiens
LQSESQKIE

SEQ ID NO: 243487 - protein, 9 aa, Homo Sapiens
ALSGLEDVS

SEQ ID NO: 243488 - protein, 9 aa, Homo Sapiens
TVPSDFHQT

SEQ ID NO: 243489 - protein, 9 aa, Homo Sapiens
IVHFQDKNL

SEQ ID NO: 243490 - protein, 9 aa, Homo Sapiens
KSHGIIRFY

SEQ ID NO: 243491 - protein, 9 aa, Homo Sapiens
GLDDSYLLR

SEQ ID NO: 243492 - protein, 9 aa, Homo Sapiens
LLGDPSPSS

SEQ ID NO: 243493 - protein, 9 aa, Homo Sapiens
TQNKVCFPN

SEQ ID NO: 243494 - protein, 9 aa, Homo Sapiens
EMNESVGVL

SEQ ID NO: 243495 - protein, 9 aa, Homo Sapiens
DAFHHQVHA

SEQ ID NO: 243496 - protein, 9 aa, Homo Sapiens
CNNSLTELL

SEQ ID NO: 243497 - protein, 9 aa, Homo Sapiens
VSTNVLKQN

SEQ ID NO: 243498 - protein, 9 aa, Homo Sapiens
LLMMHRINK

SEQ ID NO: 243499 - protein, 9 aa, Homo Sapiens
LTYRGVKEV

SEQ ID NO: 243500 - protein, 9 aa, Homo Sapiens
SLSGKKRTQ

SEQ ID NO: 243501 - protein, 9 aa, Homo Sapiens
IPLTVDHLK

SEQ ID NO: 243502 - protein, 9 aa, Homo Sapiens
SLLKGRVAL

SEQ ID NO: 243503 - protein, 9 aa, Homo Sapiens
HLKWLPSGM

SEQ ID NO: 243504 - protein, 9 aa, Homo Sapiens
DYLLLGLLA

SEQ ID NO: 243505 - protein, 9 aa, Homo Sapiens
VTTIPAVAG

SEQ ID NO: 243506 - protein, 9 aa, Homo Sapiens
QISHKRSEC

SEQ ID NO: 243507 - protein, 9 aa, Homo Sapiens
QWEKNITLG

SEQ ID NO: 243508 - protein, 9 aa, Homo Sapiens
LGQKRKVQR

SEQ ID NO: 243509 - protein, 9 aa, Homo Sapiens
DTWNMHTCP

SEQ ID NO: 243510 - protein, 9 aa, Homo Sapiens
HKKRIIEKV

SEQ ID NO: 243511 - protein, 9 aa, Homo Sapiens
PQKINGICI

SEQ ID NO: 243512 - protein, 9 aa, Homo Sapiens
GPKNPNVGC

SEQ ID NO: 243513 - protein, 9 aa, Homo Sapiens
INRIRLQWS

SEQ ID NO: 243514 - protein, 9 aa, Homo Sapiens
GIYSKKKED

SEQ ID NO: 243515 - protein, 9 aa, Homo Sapiens
ETDREAVVT

SEQ ID NO: 243516 - protein, 9 aa, Homo Sapiens
MLNKSLKVF

SEQ ID NO: 243517 - protein, 9 aa, Homo Sapiens
LHRHLPHAR

SEQ ID NO: 243518 - protein, 9 aa, Homo Sapiens
CNDVDLWPA

SEQ ID NO: 243519 - protein, 9 aa, Homo Sapiens
NSVFSDADL

SEQ ID NO: 243520 - protein, 9 aa, Homo Sapiens
KLQKKDFLE

SEQ ID NO: 243521 - protein, 9 aa, Homo Sapiens
TIGVQHFES

SEQ ID NO: 243522 - protein, 9 aa, Homo Sapiens
CPVGELFLW

SEQ ID NO: 243523 - protein, 9 aa, Homo Sapiens
KLHDRLWQS

SEQ ID NO: 243524 - protein, 9 aa, Homo Sapiens
AQFAKIKLE

SEQ ID NO: 243525 - protein, 9 aa, Homo Sapiens
NNPSGQPRL

SEQ ID NO: 243526 - protein, 9 aa, Homo Sapiens
TFIITLLRA

SEQ ID NO: 243527 - protein, 9 aa, Homo Sapiens
KLASFSFDH

SEQ ID NO: 243528 - protein, 9 aa, Homo Sapiens
PWDPRTVVG

SEQ ID NO: 243529 - protein, 9 aa, Homo Sapiens
CASDPRGLP

SEQ ID NO: 243530 - protein, 9 aa, Homo Sapiens
SSFDTTLKV

SEQ ID NO: 243531 - protein, 9 aa, Homo Sapiens
DPVEDALEV

SEQ ID NO: 243532 - protein, 9 aa, Homo Sapiens
SFNKTWDII

SEQ ID NO: 243533 - protein, 9 aa, Homo Sapiens
SPRSPAGPD

SEQ ID NO: 243534 - protein, 9 aa, Homo Sapiens
FVIFLSSQF

SEQ ID NO: 243535 - protein, 9 aa, Homo Sapiens
NFLDGALVM

SEQ ID NO: 243536 - protein, 9 aa, Homo Sapiens
IKNLEKEKY

SEQ ID NO: 243537 - protein, 9 aa, Homo Sapiens
STGLAPDPV

SEQ ID NO: 243538 - protein, 9 aa, Homo Sapiens
LLEKEGFVT

SEQ ID NO: 243539 - protein, 9 aa, Homo Sapiens
LALPQYLQA

SEQ ID NO: 243540 - protein, 9 aa, Homo Sapiens
KYYNGLNQC

SEQ ID NO: 243541 - protein, 9 aa, Homo Sapiens
ATVQPYTSQ

SEQ ID NO: 243542 - protein, 9 aa, Homo Sapiens
LTAGKKCRI

SEQ ID NO: 243543 - protein, 9 aa, Homo Sapiens
GITTNSEQR

SEQ ID NO: 243544 - protein, 9 aa, Homo Sapiens
AIVFSAPLL

SEQ ID NO: 243545 - protein, 9 aa, Homo Sapiens
KLIYIVSSQ

SEQ ID NO: 243546 - protein, 9 aa, Homo Sapiens
AATKQEGMA

SEQ ID NO: 243547 - protein, 9 aa, Homo Sapiens
MHKVSFQDK

SEQ ID NO: 243548 - protein, 9 aa, Homo Sapiens
YSSNWEKQE

SEQ ID NO: 243549 - protein, 9 aa, Homo Sapiens
TNVPFSWKI

SEQ ID NO: 243550 - protein, 9 aa, Homo Sapiens
IIISGGPTS

SEQ ID NO: 243551 - protein, 9 aa, Homo Sapiens
NVKMVQGDY

SEQ ID NO: 243552 - protein, 9 aa, Homo Sapiens
CIQQNIPKS

SEQ ID NO: 243553 - protein, 9 aa, Homo Sapiens
YTCKDCGAN

SEQ ID NO: 243554 - protein, 9 aa, Homo Sapiens
SYDLVRSAE

SEQ ID NO: 243555 - protein, 9 aa, Homo Sapiens
QGRIGVVIA

SEQ ID NO: 243556 - protein, 9 aa, Homo Sapiens
RWQPPDFLL

SEQ ID NO: 243557 - protein, 9 aa, Homo Sapiens
TFILGSCAS

SEQ ID NO: 243558 - protein, 9 aa, Homo Sapiens
LRQIVKQLK

SEQ ID NO: 243559 - protein, 9 aa, Homo Sapiens
VDSVELAVE

SEQ ID NO: 243560 - protein, 9 aa, Homo Sapiens
SSCIRIHKV

SEQ ID NO: 243561 - protein, 9 aa, Homo Sapiens
GKSDAETLK

SEQ ID NO: 243562 - protein, 9 aa, Homo Sapiens
DGSDKRHCA

SEQ ID NO: 243563 - protein, 9 aa, Homo Sapiens
NWSRENIQA

SEQ ID NO: 243564 - protein, 9 aa, Homo Sapiens
QLWRLNSSE

SEQ ID NO: 243565 - protein, 9 aa, Homo Sapiens
TPLSATRIN

SEQ ID NO: 243566 - protein, 9 aa, Homo Sapiens
RFIMSVKNN

SEQ ID NO: 243567 - protein, 9 aa, Homo Sapiens
WPQDEPRQG

SEQ ID NO: 243568 - protein, 9 aa, Homo Sapiens
NNSPIIWRE

SEQ ID NO: 243569 - protein, 9 aa, Homo Sapiens
QLFDLYHRI

SEQ ID NO: 243570 - protein, 9 aa, Homo Sapiens
GFGGPECEE

SEQ ID NO: 243571 - protein, 9 aa, Homo Sapiens
AHNSCGITL

SEQ ID NO: 243572 - protein, 9 aa, Homo Sapiens
VLSAQKAGY

SEQ ID NO: 243573 - protein, 9 aa, Homo Sapiens
IPAVAGHQL

SEQ ID NO: 243574 - protein, 9 aa, Homo Sapiens
TGFPGLETA

SEQ ID NO: 243575 - protein, 9 aa, Homo Sapiens
ECGECGKYF

SEQ ID NO: 243576 - protein, 9 aa, Homo Sapiens
DKDKHFSLL

SEQ ID NO: 243577 - protein, 9 aa, Homo Sapiens
ENNWNREKV

SEQ ID NO: 243578 - protein, 9 aa, Homo Sapiens
QFYQASIVA

SEQ ID NO: 243579 - protein, 9 aa, Homo Sapiens
YQPEKWDEE

SEQ ID NO: 243580 - protein, 9 aa, Homo Sapiens
RVVIGKNGE

SEQ ID NO: 243581 - protein, 9 aa, Homo Sapiens
AVPTTSGNG

SEQ ID NO: 243582 - protein, 9 aa, Homo Sapiens
NSQNDLAVA

SEQ ID NO: 243583 - protein, 9 aa, Homo Sapiens
KMLSNIISE

SEQ ID NO: 243584 - protein, 9 aa, Homo Sapiens
PENYNEAKF

SEQ ID NO: 243585 - protein, 9 aa, Homo Sapiens
SCHIVPVFS

SEQ ID NO: 243586 - protein, 9 aa, Homo Sapiens
KVATWLIGL

SEQ ID NO: 243587 - protein, 9 aa, Homo Sapiens
TRLCGARLE

SEQ ID NO: 243588 - protein, 9 aa, Homo Sapiens
EDIKYETEE

SEQ ID NO: 243589 - protein, 9 aa, Homo Sapiens
FVILELGYF

SEQ ID NO: 243590 - protein, 9 aa, Homo Sapiens
RIYKVISRM

SEQ ID NO: 243591 - protein, 9 aa, Homo Sapiens
LQDFTRDHV

SEQ ID NO: 243592 - protein, 9 aa, Homo Sapiens
WCHGLGPRP

SEQ ID NO: 243593 - protein, 9 aa, Homo Sapiens
AVLQRMDMK

SEQ ID NO: 243594 - protein, 9 aa, Homo Sapiens
PAVTTAPKK

SEQ ID NO: 243595 - protein, 9 aa, Homo Sapiens
DILNWNYHF

SEQ ID NO: 243596 - protein, 9 aa, Homo Sapiens
FCLICIDLW

SEQ ID NO: 243597 - protein, 9 aa, Homo Sapiens
CQFMPPEKV

SEQ ID NO: 243598 - protein, 9 aa, Homo Sapiens
LNVRYIVYC

SEQ ID NO: 243599 - protein, 9 aa, Homo Sapiens
NALDIYGRT

SEQ ID NO: 243600 - protein, 9 aa, Homo Sapiens
KKSIKIILI

SEQ ID NO: 243601 - protein, 9 aa, Homo Sapiens
WMGPTDPEE

SEQ ID NO: 243602 - protein, 9 aa, Homo Sapiens
ISQAAFPLA

SEQ ID NO: 243603 - protein, 9 aa, Homo Sapiens
SRETCSIAV

SEQ ID NO: 243604 - protein, 9 aa, Homo Sapiens
KIVIKQGEG

SEQ ID NO: 243605 - protein, 9 aa, Homo Sapiens
RMRSKMPLK

SEQ ID NO: 243606 - protein, 9 aa, Homo Sapiens
ASYVLRLNS

SEQ ID NO: 243607 - protein, 9 aa, Homo Sapiens
SFIPTYAST

SEQ ID NO: 243608 - protein, 9 aa, Homo Sapiens
HSSWTLCGS

SEQ ID NO: 243609 - protein, 9 aa, Homo Sapiens
KEDILKKQE

SEQ ID NO: 243610 - protein, 9 aa, Homo Sapiens
ASVQDQDKQ

SEQ ID NO: 243611 - protein, 9 aa, Homo Sapiens
EFTHLQGVA

SEQ ID NO: 243612 - protein, 9 aa, Homo Sapiens
YRLFQKTLR

SEQ ID NO: 243613 - protein, 9 aa, Homo Sapiens
TCIVWLAFL

SEQ ID NO: 243614 - protein, 9 aa, Homo Sapiens
NSKVMDVVF

SEQ ID NO: 243615 - protein, 9 aa, Homo Sapiens
LTDSEITGA

SEQ ID NO: 243616 - protein, 9 aa, Homo Sapiens
NVSLHYACF

SEQ ID NO: 243617 - protein, 9 aa, Homo Sapiens
KRILHNTKG

SEQ ID NO: 243618 - protein, 9 aa, Homo Sapiens
GLNLVIAVI

SEQ ID NO: 243619 - protein, 9 aa, Homo Sapiens
NIETKDVPL

SEQ ID NO: 243620 - protein, 9 aa, Homo Sapiens
NNCPGAEVP

SEQ ID NO: 243621 - protein, 9 aa, Homo Sapiens
TVIFPLRNP

SEQ ID NO: 243622 - protein, 9 aa, Homo Sapiens
SRRSHANRV

SEQ ID NO: 243623 - protein, 9 aa, Homo Sapiens
VHKPSYFWK

SEQ ID NO: 243624 - protein, 9 aa, Homo Sapiens
NDMKPSPSF

SEQ ID NO: 243625 - protein, 9 aa, Homo Sapiens
GFQSPIQKE

SEQ ID NO: 243626 - protein, 9 aa, Homo Sapiens
RTDAILSLN

SEQ ID NO: 243627 - protein, 9 aa, Homo Sapiens
HPDKVLKFG

SEQ ID NO: 243628 - protein, 9 aa, Homo Sapiens
QCPNPLAPS

SEQ ID NO: 243629 - protein, 9 aa, Homo Sapiens
RNLFHIWRN

SEQ ID NO: 243630 - protein, 9 aa, Homo Sapiens
CYERECKLP

SEQ ID NO: 243631 - protein, 9 aa, Homo Sapiens
NLYALHWYR

SEQ ID NO: 243632 - protein, 9 aa, Homo Sapiens
NGRKYDTNG

SEQ ID NO: 243633 - protein, 9 aa, Homo Sapiens
AGDLSTLFN

SEQ ID NO: 243634 - protein, 9 aa, Homo Sapiens
QNQALLQTR

SEQ ID NO: 243635 - protein, 9 aa, Homo Sapiens
VVKQGCWLD

SEQ ID NO: 243636 - protein, 9 aa, Homo Sapiens
RYIRESAWK

SEQ ID NO: 243637 - protein, 9 aa, Homo Sapiens
IQVSEVDKT

SEQ ID NO: 243638 - protein, 9 aa, Homo Sapiens
EIRFSLRLY

SEQ ID NO: 243639 - protein, 9 aa, Homo Sapiens
QVKCLNISG

SEQ ID NO: 243640 - protein, 9 aa, Homo Sapiens
MKGNRVNKT

SEQ ID NO: 243641 - protein, 9 aa, Homo Sapiens
KALGIGRLK

SEQ ID NO: 243642 - protein, 9 aa, Homo Sapiens
LEAEYLTVF

SEQ ID NO: 243643 - protein, 9 aa, Homo Sapiens
EGQVMAKRI

SEQ ID NO: 243644 - protein, 9 aa, Homo Sapiens
GSDSIIVGR

SEQ ID NO: 243645 - protein, 9 aa, Homo Sapiens
IPKEMVLDF

SEQ ID NO: 243646 - protein, 9 aa, Homo Sapiens
VESNGRSTA

SEQ ID NO: 243647 - protein, 9 aa, Homo Sapiens
QSSVDINSA

SEQ ID NO: 243648 - protein, 9 aa, Homo Sapiens
GVGTGATNT

SEQ ID NO: 243649 - protein, 9 aa, Homo Sapiens
TVCFIGELT

SEQ ID NO: 243650 - protein, 9 aa, Homo Sapiens
WGSISASML

SEQ ID NO: 243651 - protein, 9 aa, Homo Sapiens
DIVSRLRDD

SEQ ID NO: 243652 - protein, 9 aa, Homo Sapiens
LMNKMGIKS

SEQ ID NO: 243653 - protein, 9 aa, Homo Sapiens
QLIEEAWSP

SEQ ID NO: 243654 - protein, 9 aa, Homo Sapiens
RMYEEQRVG

SEQ ID NO: 243655 - protein, 9 aa, Homo Sapiens
NQLNEEVTH

SEQ ID NO: 243656 - protein, 9 aa, Homo Sapiens
HGSLPHMAE

SEQ ID NO: 243657 - protein, 9 aa, Homo Sapiens
LDAELEDGE

SEQ ID NO: 243658 - protein, 9 aa, Homo Sapiens
SNKKTFIIL

SEQ ID NO: 243659 - protein, 9 aa, Homo Sapiens
RSDLIEHQI

SEQ ID NO: 243660 - protein, 9 aa, Homo Sapiens
APLYFCLGN

SEQ ID NO: 243661 - protein, 9 aa, Homo Sapiens
TLLLEHKAL

SEQ ID NO: 243662 - protein, 9 aa, Homo Sapiens
RPNSQYNQR

SEQ ID NO: 243663 - protein, 9 aa, Homo Sapiens
AMRKAASTC

SEQ ID NO: 243664 - protein, 9 aa, Homo Sapiens
CGGLCMHVQ

SEQ ID NO: 243665 - protein, 9 aa, Homo Sapiens
RRRYGQKNK

SEQ ID NO: 243666 - protein, 9 aa, Homo Sapiens
NGAVPQGQQ

SEQ ID NO: 243667 - protein, 9 aa, Homo Sapiens
IKKNTLNHV

SEQ ID NO: 243668 - protein, 9 aa, Homo Sapiens
EQSIRIESI

SEQ ID NO: 243669 - protein, 9 aa, Homo Sapiens
NACGVQSSK

SEQ ID NO: 243670 - protein, 9 aa, Homo Sapiens
DIPREPRQI

SEQ ID NO: 243671 - protein, 9 aa, Homo Sapiens
AHDFLQYTV

SEQ ID NO: 243672 - protein, 9 aa, Homo Sapiens
TFWEKSNPT

SEQ ID NO: 243673 - protein, 9 aa, Homo Sapiens
TQENDIPTD

SEQ ID NO: 243674 - protein, 9 aa, Homo Sapiens
KKADYQAVN

SEQ ID NO: 243675 - protein, 9 aa, Homo Sapiens
RSASTFKIH

SEQ ID NO: 243676 - protein, 9 aa, Homo Sapiens
QVHKKWKCP

SEQ ID NO: 243677 - protein, 9 aa, Homo Sapiens
PSQKTGDVV

SEQ ID NO: 243678 - protein, 9 aa, Homo Sapiens
RRFKETFSK

SEQ ID NO: 243679 - protein, 9 aa, Homo Sapiens
MELFERYHA

SEQ ID NO: 243680 - protein, 9 aa, Homo Sapiens
QQELHNQCI

SEQ ID NO: 243681 - protein, 9 aa, Homo Sapiens
LLTLPVIIC

SEQ ID NO: 243682 - protein, 9 aa, Homo Sapiens
SKNVGIYDE

SEQ ID NO: 243683 - protein, 9 aa, Homo Sapiens
SLQLHQNVH

SEQ ID NO: 243684 - protein, 9 aa, Homo Sapiens
IPRIGPRFG

SEQ ID NO: 243685 - protein, 8 aa, Homo Sapiens
KSLTWILG

SEQ ID NO: 243686 - protein, 9 aa, Homo Sapiens
NKLAAQLDK

SEQ ID NO: 243687 - protein, 9 aa, Homo Sapiens
DMISPVSHS

SEQ ID NO: 243688 - protein, 9 aa, Homo Sapiens
VSHLSDLNI

SEQ ID NO: 243689 - protein, 9 aa, Homo Sapiens
QRASDYFNL

SEQ ID NO: 243690 - protein, 9 aa, Homo Sapiens
TALILATQK

SEQ ID NO: 243691 - protein, 9 aa, Homo Sapiens
STSVLTTTS

SEQ ID NO: 243692 - protein, 9 aa, Homo Sapiens
DHQRVHTGD

SEQ ID NO: 243693 - protein, 9 aa, Homo Sapiens
CSYIAWYCR

SEQ ID NO: 243694 - protein, 9 aa, Homo Sapiens
KVVQNRCSS

SEQ ID NO: 243695 - protein, 9 aa, Homo Sapiens
KIYDRKELL

SEQ ID NO: 243696 - protein, 9 aa, Homo Sapiens
EKCLVRYIY

SEQ ID NO: 243697 - protein, 9 aa, Homo Sapiens
FYLRQPSPV

SEQ ID NO: 243698 - protein, 9 aa, Homo Sapiens
NLFQSFTRP

SEQ ID NO: 243699 - protein, 9 aa, Homo Sapiens
ENSLSYDAD

SEQ ID NO: 243700 - protein, 9 aa, Homo Sapiens
DEKTRMKLT

SEQ ID NO: 243701 - protein, 9 aa, Homo Sapiens
VSSPQISSE

SEQ ID NO: 243702 - protein, 9 aa, Homo Sapiens
KAIAQQWLE

SEQ ID NO: 243703 - protein, 9 aa, Homo Sapiens
QVAARIIDS

SEQ ID NO: 243704 - protein, 9 aa, Homo Sapiens
KPHVSNTVS

SEQ ID NO: 243705 - protein, 9 aa, Homo Sapiens
AENVCSQRG

SEQ ID NO: 243706 - protein, 9 aa, Homo Sapiens
FSGSPLHMP

SEQ ID NO: 243707 - protein, 9 aa, Homo Sapiens
NTPFVCTEC

SEQ ID NO: 243708 - protein, 9 aa, Homo Sapiens
SQTCDWKVD

SEQ ID NO: 243709 - protein, 9 aa, Homo Sapiens
NTFIQRDDT

SEQ ID NO: 243710 - protein, 9 aa, Homo Sapiens
LSLEEWHCL

SEQ ID NO: 243711 - protein, 9 aa, Homo Sapiens
ILYFFSDCI

SEQ ID NO: 243712 - protein, 9 aa, Homo Sapiens
GLSHTVGRL

SEQ ID NO: 243713 - protein, 9 aa, Homo Sapiens
AAALGSALF

SEQ ID NO: 243714 - protein, 9 aa, Homo Sapiens
TMKTFLHKR

SEQ ID NO: 243715 - protein, 9 aa, Homo Sapiens
ATSDESIKE

SEQ ID NO: 243716 - protein, 9 aa, Homo Sapiens
NVGAFNKVS

SEQ ID NO: 243717 - protein, 9 aa, Homo Sapiens
LNSSTVEPK

SEQ ID NO: 243718 - protein, 9 aa, Homo Sapiens
SLAIALLFL

SEQ ID NO: 243719 - protein, 9 aa, Homo Sapiens
LLHHFRPNC

SEQ ID NO: 243720 - protein, 9 aa, Homo Sapiens
RYKLGVCLY

SEQ ID NO: 243721 - protein, 9 aa, Homo Sapiens
SVVINAQNQ

SEQ ID NO: 243722 - protein, 9 aa, Homo Sapiens
LAFADSQVN

SEQ ID NO: 243723 - protein, 9 aa, Homo Sapiens
KCIQESEEK

SEQ ID NO: 243724 - protein, 9 aa, Homo Sapiens
VLFKIMKTL

SEQ ID NO: 243725 - protein, 9 aa, Homo Sapiens
PHLSRHRKS

SEQ ID NO: 243726 - protein, 9 aa, Homo Sapiens
PTGGESFTF

SEQ ID NO: 243727 - protein, 9 aa, Homo Sapiens
YLNLFQLLV

SEQ ID NO: 243728 - protein, 9 aa, Homo Sapiens
ETAKEKEFQ

SEQ ID NO: 243729 - protein, 9 aa, Homo Sapiens
REQEKKEIE

SEQ ID NO: 243730 - protein, 9 aa, Homo Sapiens
IITRYKIKS

SEQ ID NO: 243731 - protein, 9 aa, Homo Sapiens
TPGPSQLCS

SEQ ID NO: 243732 - protein, 9 aa, Homo Sapiens
RLKKEQANN

SEQ ID NO: 243733 - protein, 9 aa, Homo Sapiens
AAMSLITNN

SEQ ID NO: 243734 - protein, 9 aa, Homo Sapiens
SNPRIFLPP

SEQ ID NO: 243735 - protein, 9 aa, Homo Sapiens
GDVNRDGKL

SEQ ID NO: 243736 - protein, 9 aa, Homo Sapiens
LQWNESEPS

SEQ ID NO: 243737 - protein, 9 aa, Homo Sapiens
QEYSLLISI

SEQ ID NO: 243738 - protein, 9 aa, Homo Sapiens
TNTEPFQER

SEQ ID NO: 243739 - protein, 9 aa, Homo Sapiens
LTPYQSQGF

SEQ ID NO: 243740 - protein, 9 aa, Homo Sapiens
AGCGADLHK

SEQ ID NO: 243741 - protein, 9 aa, Homo Sapiens
VIHLHEVYE

SEQ ID NO: 243742 - protein, 9 aa, Homo Sapiens
SREFDMIRG

SEQ ID NO: 243743 - protein, 9 aa, Homo Sapiens
VRASYLDIY

SEQ ID NO: 243744 - protein, 9 aa, Homo Sapiens
EHHRGIGLF

SEQ ID NO: 243745 - protein, 9 aa, Homo Sapiens
KDEMSSVQK

SEQ ID NO: 243746 - protein, 9 aa, Homo Sapiens
HGHPPLSGC

SEQ ID NO: 243747 - protein, 9 aa, Homo Sapiens
VWEQNVYAI

SEQ ID NO: 243748 - protein, 9 aa, Homo Sapiens
AQAGSDYNF

SEQ ID NO: 243749 - protein, 9 aa, Homo Sapiens
LERRLMNRN

SEQ ID NO: 243750 - protein, 9 aa, Homo Sapiens
PQVTACHSA

SEQ ID NO: 243751 - protein, 9 aa, Homo Sapiens
TRGVFSFLD

SEQ ID NO: 243752 - protein, 9 aa, Homo Sapiens
REQAGDLGT

SEQ ID NO: 243753 - protein, 9 aa, Homo Sapiens
HIMHTSYFL

SEQ ID NO: 243754 - protein, 9 aa, Homo Sapiens
FIFRKNYAK

SEQ ID NO: 243755 - protein, 9 aa, Homo Sapiens
SQAKKLLKN

SEQ ID NO: 243756 - protein, 9 aa, Homo Sapiens
SFGCAVCLE

SEQ ID NO: 243757 - protein, 9 aa, Homo Sapiens
GMDYEVYKT

SEQ ID NO: 243758 - protein, 9 aa, Homo Sapiens
FIILMGKNF

SEQ ID NO: 243759 - protein, 9 aa, Homo Sapiens
TLNNYQVFP

SEQ ID NO: 243760 - protein, 9 aa, Homo Sapiens
LGEDWERTK

SEQ ID NO: 243761 - protein, 9 aa, Homo Sapiens
PNPNKTMIA

SEQ ID NO: 243762 - protein, 9 aa, Homo Sapiens
KGTYRNLST

SEQ ID NO: 243763 - protein, 9 aa, Homo Sapiens
DLVGDTATK

SEQ ID NO: 243764 - protein, 9 aa, Homo Sapiens
SHERLLHYK

SEQ ID NO: 243765 - protein, 9 aa, Homo Sapiens
LFGGDEIAR

SEQ ID NO: 243766 - protein, 9 aa, Homo Sapiens
SLCLRTFSC

SEQ ID NO: 243767 - protein, 9 aa, Homo Sapiens
QRPSEKNQH

SEQ ID NO: 243768 - protein, 9 aa, Homo Sapiens
IGIFYGSVA

SEQ ID NO: 243769 - protein, 9 aa, Homo Sapiens
SAPTVSQPT

SEQ ID NO: 243770 - protein, 9 aa, Homo Sapiens
DLFNRVNLI

SEQ ID NO: 243771 - protein, 9 aa, Homo Sapiens
TISSSQFST

SEQ ID NO: 243772 - protein, 9 aa, Homo Sapiens
GNGLFVAFY

SEQ ID NO: 243773 - protein, 9 aa, Homo Sapiens
PQESFRSMQ

SEQ ID NO: 243774 - protein, 9 aa, Homo Sapiens
GAYGSQIMG

SEQ ID NO: 243775 - protein, 9 aa, Homo Sapiens
CKETAKENK

SEQ ID NO: 243776 - protein, 9 aa, Homo Sapiens
RFINYFVKG

SEQ ID NO: 243777 - protein, 9 aa, Homo Sapiens
GPWGLLLCM

SEQ ID NO: 243778 - protein, 9 aa, Homo Sapiens
SEKISSALK

SEQ ID NO: 243779 - protein, 9 aa, Homo Sapiens
RINASSRQC

SEQ ID NO: 243780 - protein, 9 aa, Homo Sapiens
EVALAEIPG

SEQ ID NO: 243781 - protein, 9 aa, Homo Sapiens
DTQLSEFTP

SEQ ID NO: 243782 - protein, 9 aa, Homo Sapiens
REESGEQGG

SEQ ID NO: 243783 - protein, 9 aa, Homo Sapiens
HVIDNQRTL

SEQ ID NO: 243784 - protein, 9 aa, Homo Sapiens
PWVPARGGG

SEQ ID NO: 243785 - protein, 9 aa, Homo Sapiens
AKLDESLKE

SEQ ID NO: 243786 - protein, 9 aa, Homo Sapiens
EDKSAATAE

SEQ ID NO: 243787 - protein, 9 aa, Homo Sapiens
KHIASGKKC

SEQ ID NO: 243788 - protein, 9 aa, Homo Sapiens
LRLKMFQED

SEQ ID NO: 243789 - protein, 9 aa, Homo Sapiens
IGIEMKFNN

SEQ ID NO: 243790 - protein, 9 aa, Homo Sapiens
KTPKFSIKT

SEQ ID NO: 243791 - protein, 9 aa, Homo Sapiens
KEEFPDVDE

SEQ ID NO: 243792 - protein, 9 aa, Homo Sapiens
PEVTLVPPP

SEQ ID NO: 243793 - protein, 9 aa, Homo Sapiens
FRDLFLPKG

SEQ ID NO: 243794 - protein, 9 aa, Homo Sapiens
SLCMRLFSE

SEQ ID NO: 243795 - protein, 9 aa, Homo Sapiens
PGLPGELTP

SEQ ID NO: 243796 - protein, 9 aa, Homo Sapiens
MQKRVLGHY

SEQ ID NO: 243797 - protein, 9 aa, Homo Sapiens
MFIKAIHAD

SEQ ID NO: 243798 - protein, 9 aa, Homo Sapiens
HTPEEERNL

SEQ ID NO: 243799 - protein, 9 aa, Homo Sapiens
DCGQKMSHQ

SEQ ID NO: 243800 - protein, 9 aa, Homo Sapiens
GAFTIKADV

SEQ ID NO: 243801 - protein, 9 aa, Homo Sapiens
MKHVKKEKT

SEQ ID NO: 243802 - protein, 9 aa, Homo Sapiens
QYQASGPNN

SEQ ID NO: 243803 - protein, 9 aa, Homo Sapiens
HPGGRGGNP

SEQ ID NO: 243804 - protein, 9 aa, Homo Sapiens
ETSSSEDMG

SEQ ID NO: 243805 - protein, 9 aa, Homo Sapiens
AHKIIHNRE

SEQ ID NO: 243806 - protein, 9 aa, Homo Sapiens
SADRYRSIV

SEQ ID NO: 243807 - protein, 9 aa, Homo Sapiens
ETKNCCGPS

SEQ ID NO: 243808 - protein, 9 aa, Homo Sapiens
NQTLSAPKQ

SEQ ID NO: 243809 - protein, 9 aa, Homo Sapiens
SEGIFKNLR

SEQ ID NO: 243810 - protein, 9 aa, Homo Sapiens
WKAYSWTET

SEQ ID NO: 243811 - protein, 9 aa, Homo Sapiens
IYCKRQLME

SEQ ID NO: 243812 - protein, 9 aa, Homo Sapiens
LAACNILVN

SEQ ID NO: 243813 - protein, 9 aa, Homo Sapiens
TLAGNGLGS

SEQ ID NO: 243814 - protein, 9 aa, Homo Sapiens
ICNRVTDLD

SEQ ID NO: 243815 - protein, 9 aa, Homo Sapiens
EISDNSDDC

SEQ ID NO: 243816 - protein, 9 aa, Homo Sapiens
LLLLWPHGC

SEQ ID NO: 243817 - protein, 9 aa, Homo Sapiens
ELRRNSRVT

SEQ ID NO: 243818 - protein, 9 aa, Homo Sapiens
SLIFVSSYV

SEQ ID NO: 243819 - protein, 9 aa, Homo Sapiens
PPPVYLLED

SEQ ID NO: 243820 - protein, 9 aa, Homo Sapiens
PIMNAKDVV

SEQ ID NO: 243821 - protein, 9 aa, Homo Sapiens
NNFLPFQID

SEQ ID NO: 243822 - protein, 9 aa, Homo Sapiens
GNLEIECME

SEQ ID NO: 243823 - protein, 9 aa, Homo Sapiens
AVIESLEME

SEQ ID NO: 243824 - protein, 9 aa, Homo Sapiens
IENKSGRLS

SEQ ID NO: 243825 - protein, 9 aa, Homo Sapiens
HEQIYTYVG

SEQ ID NO: 243826 - protein, 9 aa, Homo Sapiens
RTGISAPVV

SEQ ID NO: 243827 - protein, 9 aa, Homo Sapiens
GLIPPTARL

SEQ ID NO: 243828 - protein, 9 aa, Homo Sapiens
MCMPPPSAD

SEQ ID NO: 243829 - protein, 9 aa, Homo Sapiens
HLPRFKPWL

SEQ ID NO: 243830 - protein, 9 aa, Homo Sapiens
ESPSSLDAV

SEQ ID NO: 243831 - protein, 9 aa, Homo Sapiens
LPLPQFCSK

SEQ ID NO: 243832 - protein, 9 aa, Homo Sapiens
VKDTICINY

SEQ ID NO: 243833 - protein, 9 aa, Homo Sapiens
LLKGRVALT

SEQ ID NO: 243834 - protein, 9 aa, Homo Sapiens
VDHSTRLIL

SEQ ID NO: 243835 - protein, 9 aa, Homo Sapiens
KKFSKQYKA

SEQ ID NO: 243836 - protein, 9 aa, Homo Sapiens
KPVLSLNTS

SEQ ID NO: 243837 - protein, 9 aa, Homo Sapiens
CYFDDPRLL

SEQ ID NO: 243838 - protein, 9 aa, Homo Sapiens
VSLDKLRNL

SEQ ID NO: 243839 - protein, 9 aa, Homo Sapiens
CPGDLIEVS

SEQ ID NO: 243840 - protein, 9 aa, Homo Sapiens
TTPNRLLQI

SEQ ID NO: 243841 - protein, 9 aa, Homo Sapiens
LQLSCLLES

SEQ ID NO: 243842 - protein, 9 aa, Homo Sapiens
IRRNIAHQQ

SEQ ID NO: 243843 - protein, 9 aa, Homo Sapiens
TVFGLGIGA

SEQ ID NO: 243844 - protein, 9 aa, Homo Sapiens
YIFFPDAPW

SEQ ID NO: 243845 - protein, 9 aa, Homo Sapiens
EESNLRNHG

SEQ ID NO: 243846 - protein, 9 aa, Homo Sapiens
YIQANIPGA

SEQ ID NO: 243847 - protein, 9 aa, Homo Sapiens
AHTASSAWG

SEQ ID NO: 243848 - protein, 9 aa, Homo Sapiens
CRVNRNNLE

SEQ ID NO: 243849 - protein, 9 aa, Homo Sapiens
DTCPEVLGP

SEQ ID NO: 243850 - protein, 9 aa, Homo Sapiens
RHNDPDHLN

SEQ ID NO: 243851 - protein, 9 aa, Homo Sapiens
IENKPLQQQ

SEQ ID NO: 243852 - protein, 9 aa, Homo Sapiens
SSFQMHERT

SEQ ID NO: 243853 - protein, 9 aa, Homo Sapiens
KFSKTQSKD

SEQ ID NO: 243854 - protein, 9 aa, Homo Sapiens
WALTHIASG

SEQ ID NO: 243855 - protein, 9 aa, Homo Sapiens
CGVKKLPWP

SEQ ID NO: 243856 - protein, 9 aa, Homo Sapiens
GFAKLYGSN

SEQ ID NO: 243857 - protein, 9 aa, Homo Sapiens
IAPVANGIQ

SEQ ID NO: 243858 - protein, 9 aa, Homo Sapiens
ESLECQMRE

SEQ ID NO: 243859 - protein, 9 aa, Homo Sapiens
KVLAHPPQD

SEQ ID NO: 243860 - protein, 9 aa, Homo Sapiens
SPTRSSRYG

SEQ ID NO: 243861 - protein, 9 aa, Homo Sapiens
KCGKAFSKF

SEQ ID NO: 243862 - protein, 9 aa, Homo Sapiens
SQKEESPSA

SEQ ID NO: 243863 - protein, 9 aa, Homo Sapiens
DMCTQVAKW

SEQ ID NO: 243864 - protein, 9 aa, Homo Sapiens
ARRSAANIA

SEQ ID NO: 243865 - protein, 9 aa, Homo Sapiens
NGLEDPSIS

SEQ ID NO: 243866 - protein, 9 aa, Homo Sapiens
CDPLRYKAT

SEQ ID NO: 243867 - protein, 9 aa, Homo Sapiens
EGGKQKKHE

SEQ ID NO: 243868 - protein, 9 aa, Homo Sapiens
LEEQEKQEI

SEQ ID NO: 243869 - protein, 9 aa, Homo Sapiens
SLRNVQPDF

SEQ ID NO: 243870 - protein, 9 aa, Homo Sapiens
ISHLTKDFI

SEQ ID NO: 243871 - protein, 9 aa, Homo Sapiens
ICYLAASVF

SEQ ID NO: 243872 - protein, 9 aa, Homo Sapiens
NNVERKKGW

SEQ ID NO: 243873 - protein, 9 aa, Homo Sapiens
DQLTQAISD

SEQ ID NO: 243874 - protein, 9 aa, Homo Sapiens
REWLGLINN

SEQ ID NO: 243875 - protein, 9 aa, Homo Sapiens
SRDSVPSLQ

SEQ ID NO: 243876 - protein, 9 aa, Homo Sapiens
KTVCFIGEL

SEQ ID NO: 243877 - protein, 9 aa, Homo Sapiens
QHLKNRCGF

SEQ ID NO: 243878 - protein, 9 aa, Homo Sapiens
PKYLIYGPV

SEQ ID NO: 243879 - protein, 9 aa, Homo Sapiens
NAATEDIWE

SEQ ID NO: 243880 - protein, 9 aa, Homo Sapiens
PRNPKTDNM

SEQ ID NO: 243881 - protein, 9 aa, Homo Sapiens
SLETVYLEW

SEQ ID NO: 243882 - protein, 9 aa, Homo Sapiens
DLFDLNSVV

SEQ ID NO: 243883 - protein, 9 aa, Homo Sapiens
KSSGGKSTH

SEQ ID NO: 243884 - protein, 9 aa, Homo Sapiens
SLNLEKYEK

SEQ ID NO: 243885 - protein, 9 aa, Homo Sapiens
FKSALHAIG

SEQ ID NO: 243886 - protein, 9 aa, Homo Sapiens
PKSRGKSIS

SEQ ID NO: 243887 - protein, 9 aa, Homo Sapiens
PVTECIAHC

SEQ ID NO: 243888 - protein, 9 aa, Homo Sapiens
QEVNACDLP

SEQ ID NO: 243889 - protein, 9 aa, Homo Sapiens
QGLTEGLHG

SEQ ID NO: 243890 - protein, 9 aa, Homo Sapiens
NIKYSFEKV

SEQ ID NO: 243891 - protein, 9 aa, Homo Sapiens
IWRKVKCAS

SEQ ID NO: 243892 - protein, 9 aa, Homo Sapiens
KIQQLEKYL

SEQ ID NO: 243893 - protein, 9 aa, Homo Sapiens
HKEVIESVT

SEQ ID NO: 243894 - protein, 9 aa, Homo Sapiens
IGRFQNHVH

SEQ ID NO: 243895 - protein, 9 aa, Homo Sapiens
VAILTGLCL

SEQ ID NO: 243896 - protein, 9 aa, Homo Sapiens
KIIHNREKA

SEQ ID NO: 243897 - protein, 9 aa, Homo Sapiens
HSAAEFREV

SEQ ID NO: 243898 - protein, 9 aa, Homo Sapiens
NSSSFVRNP

SEQ ID NO: 243899 - protein, 9 aa, Homo Sapiens
VKVCVNIHG

SEQ ID NO: 243900 - protein, 9 aa, Homo Sapiens
FIQERELCR

SEQ ID NO: 243901 - protein, 9 aa, Homo Sapiens
DLIYEYKSK

SEQ ID NO: 243902 - protein, 9 aa, Homo Sapiens
LPAGFVTLS

SEQ ID NO: 243903 - protein, 9 aa, Homo Sapiens
VLSEAISLI

SEQ ID NO: 243904 - protein, 9 aa, Homo Sapiens
VCEAIQRFD

SEQ ID NO: 243905 - protein, 9 aa, Homo Sapiens
EINQQSPFR

SEQ ID NO: 243906 - protein, 9 aa, Homo Sapiens
LGTTSTIST

SEQ ID NO: 243907 - protein, 9 aa, Homo Sapiens
PELTTDVKA

SEQ ID NO: 243908 - protein, 9 aa, Homo Sapiens
PTENREMRA

SEQ ID NO: 243909 - protein, 9 aa, Homo Sapiens
KHPLECSLT

SEQ ID NO: 243910 - protein, 9 aa, Homo Sapiens
YLLSSTESS

SEQ ID NO: 243911 - protein, 9 aa, Homo Sapiens
HSKCITECV

SEQ ID NO: 243912 - protein, 9 aa, Homo Sapiens
EEEATLTKL

SEQ ID NO: 243913 - protein, 9 aa, Homo Sapiens
TGNAKQQPD

SEQ ID NO: 243914 - protein, 9 aa, Homo Sapiens
NMLQIDVKG

SEQ ID NO: 243915 - protein, 9 aa, Homo Sapiens
GDEDYCPHS

SEQ ID NO: 243916 - protein, 9 aa, Homo Sapiens
SYQMAVRLT

SEQ ID NO: 243917 - protein, 9 aa, Homo Sapiens
ADIEKCQDR

SEQ ID NO: 243918 - protein, 9 aa, Homo Sapiens
ALPLGSPQI

SEQ ID NO: 243919 - protein, 9 aa, Homo Sapiens
KGIEHLSLM

SEQ ID NO: 243920 - protein, 9 aa, Homo Sapiens
HFTQMQELF

SEQ ID NO: 243921 - protein, 9 aa, Homo Sapiens
HSYPHTDQL

SEQ ID NO: 243922 - protein, 9 aa, Homo Sapiens
GRKALEQEV

SEQ ID NO: 243923 - protein, 9 aa, Homo Sapiens
SDRLERGSL

SEQ ID NO: 243924 - protein, 9 aa, Homo Sapiens
KRFHFVNDQ

SEQ ID NO: 243925 - protein, 9 aa, Homo Sapiens
ENRPSFYHL

SEQ ID NO: 243926 - protein, 9 aa, Homo Sapiens
EKVFSPLRK

SEQ ID NO: 243927 - protein, 9 aa, Homo Sapiens
SFRRICKSR

SEQ ID NO: 243928 - protein, 9 aa, Homo Sapiens
KDKMENFDY

SEQ ID NO: 243929 - protein, 9 aa, Homo Sapiens
DLNNDKKSA

SEQ ID NO: 243930 - protein, 9 aa, Homo Sapiens
NSDSQAVAH

SEQ ID NO: 243931 - protein, 9 aa, Homo Sapiens
EHGGFPPES

SEQ ID NO: 243932 - protein, 9 aa, Homo Sapiens
ATIWTSSPQ

SEQ ID NO: 243933 - protein, 9 aa, Homo Sapiens
QRLYLVTGF

SEQ ID NO: 243934 - protein, 9 aa, Homo Sapiens
ESPELLTYK

SEQ ID NO: 243935 - protein, 9 aa, Homo Sapiens
PELLRKKHT

SEQ ID NO: 243936 - protein, 9 aa, Homo Sapiens
PQHVPVCLV

SEQ ID NO: 243937 - protein, 9 aa, Homo Sapiens
AQRRKEQEE

SEQ ID NO: 243938 - protein, 9 aa, Homo Sapiens
ELSDMFYFC

SEQ ID NO: 243939 - protein, 9 aa, Homo Sapiens
LVQPAWQIV

SEQ ID NO: 243940 - protein, 9 aa, Homo Sapiens
RDCHESGNI

SEQ ID NO: 243941 - protein, 9 aa, Homo Sapiens
LPVVAGIKP

SEQ ID NO: 243942 - protein, 9 aa, Homo Sapiens
ELRNLERSA

SEQ ID NO: 243943 - protein, 9 aa, Homo Sapiens
YPAILMHLN

SEQ ID NO: 243944 - protein, 9 aa, Homo Sapiens
IPFSECMIQ

SEQ ID NO: 243945 - protein, 9 aa, Homo Sapiens
IMLYLAEVM

SEQ ID NO: 243946 - protein, 9 aa, Homo Sapiens
LDPFQYLLV

SEQ ID NO: 243947 - protein, 9 aa, Homo Sapiens
GEIKVLQGC

SEQ ID NO: 243948 - protein, 9 aa, Homo Sapiens
WIGYLAKSG

SEQ ID NO: 243949 - protein, 9 aa, Homo Sapiens
QSLPMTHNL

SEQ ID NO: 243950 - protein, 9 aa, Homo Sapiens
FSQKSHTFL

SEQ ID NO: 243951 - protein, 9 aa, Homo Sapiens
IVICLGETI

SEQ ID NO: 243952 - protein, 9 aa, Homo Sapiens
IIITYINAH

SEQ ID NO: 243953 - protein, 9 aa, Homo Sapiens
RIIKQPMDM

SEQ ID NO: 243954 - protein, 9 aa, Homo Sapiens
AVVWPSQRG

SEQ ID NO: 243955 - protein, 9 aa, Homo Sapiens
FMLFMGLAC

SEQ ID NO: 243956 - protein, 9 aa, Homo Sapiens
DSLDHSCTS

SEQ ID NO: 243957 - protein, 9 aa, Homo Sapiens
SFQTQEIPH

SEQ ID NO: 243958 - protein, 9 aa, Homo Sapiens
RESSQDVIE

SEQ ID NO: 243959 - protein, 9 aa, Homo Sapiens
RLCVQLVAG

SEQ ID NO: 243960 - protein, 9 aa, Homo Sapiens
SRPFSNPEL

SEQ ID NO: 243961 - protein, 9 aa, Homo Sapiens
KAFYQSSKL

SEQ ID NO: 243962 - protein, 9 aa, Homo Sapiens
VVTLFCCHK

SEQ ID NO: 243963 - protein, 9 aa, Homo Sapiens
RSLGVHLSK

SEQ ID NO: 243964 - protein, 9 aa, Homo Sapiens
YPSFATPER

SEQ ID NO: 243965 - protein, 9 aa, Homo Sapiens
LLIIATTEV

SEQ ID NO: 243966 - protein, 9 aa, Homo Sapiens
SDHYGAPNL

SEQ ID NO: 243967 - protein, 9 aa, Homo Sapiens
RFHFNSESE

SEQ ID NO: 243968 - protein, 9 aa, Homo Sapiens
QNKNHCSAI

SEQ ID NO: 243969 - protein, 9 aa, Homo Sapiens
AKNMMISLS

SEQ ID NO: 243970 - protein, 9 aa, Homo Sapiens
RLQEALDLC

SEQ ID NO: 243971 - protein, 9 aa, Homo Sapiens
YLHLRQTLH

SEQ ID NO: 243972 - protein, 9 aa, Homo Sapiens
MNGRHPGGR

SEQ ID NO: 243973 - protein, 9 aa, Homo Sapiens
PRYVVGCHR

SEQ ID NO: 243974 - protein, 9 aa, Homo Sapiens
DIAPPERGG

SEQ ID NO: 243975 - protein, 9 aa, Homo Sapiens
HKKTSNHLL

SEQ ID NO: 243976 - protein, 8 aa, Homo Sapiens
NHSPLKTA

SEQ ID NO: 243977 - protein, 9 aa, Homo Sapiens
NNLKNIRCL

SEQ ID NO: 243978 - protein, 9 aa, Homo Sapiens
TRSEMAEKL

SEQ ID NO: 243979 - protein, 9 aa, Homo Sapiens
KLVQLNKLF

SEQ ID NO: 243980 - protein, 9 aa, Homo Sapiens
RNGRWQQSL

SEQ ID NO: 243981 - protein, 9 aa, Homo Sapiens
DKCENHHDK

SEQ ID NO: 243982 - protein, 9 aa, Homo Sapiens
NKYESKNSF

SEQ ID NO: 243983 - protein, 9 aa, Homo Sapiens
ALVARLPIH

SEQ ID NO: 243984 - protein, 9 aa, Homo Sapiens
WQLAHQFVL

SEQ ID NO: 243985 - protein, 9 aa, Homo Sapiens
SAQPFITKS

SEQ ID NO: 243986 - protein, 9 aa, Homo Sapiens
QNVVQIQKL

SEQ ID NO: 243987 - protein, 9 aa, Homo Sapiens
VALTGKINL

SEQ ID NO: 243988 - protein, 9 aa, Homo Sapiens
PHYWLCDNC

SEQ ID NO: 243989 - protein, 9 aa, Homo Sapiens
GNVYLARLN

SEQ ID NO: 243990 - protein, 9 aa, Homo Sapiens
SVHLAHHQQ

SEQ ID NO: 243991 - protein, 9 aa, Homo Sapiens
RCGSSKGHD

SEQ ID NO: 243992 - protein, 9 aa, Homo Sapiens
IVEAKEIMA

SEQ ID NO: 243993 - protein, 9 aa, Homo Sapiens
FEHDKEIIR

SEQ ID NO: 243994 - protein, 9 aa, Homo Sapiens
SAYLSGDVP

SEQ ID NO: 243995 - protein, 9 aa, Homo Sapiens
NDMQLDSEG

SEQ ID NO: 243996 - protein, 9 aa, Homo Sapiens
ENFLLVGII

SEQ ID NO: 243997 - protein, 9 aa, Homo Sapiens
ALQKLKNVL

SEQ ID NO: 243998 - protein, 9 aa, Homo Sapiens
IFPIIRFCH

SEQ ID NO: 243999 - protein, 9 aa, Homo Sapiens
PVPDGKKAM

SEQ ID NO: 244000 - protein, 9 aa, Homo Sapiens
DQGVPEYPG

SEQ ID NO: 244001 - protein, 9 aa, Homo Sapiens
DDIAYVSVV

SEQ ID NO: 244002 - protein, 9 aa, Homo Sapiens
LPDSGKAQD

SEQ ID NO: 244003 - protein, 9 aa, Homo Sapiens
ENIIGVVGG

SEQ ID NO: 244004 - protein, 9 aa, Homo Sapiens
IVLHEVEVD

SEQ ID NO: 244005 - protein, 9 aa, Homo Sapiens
LRMVWVAWL

SEQ ID NO: 244006 - protein, 9 aa, Homo Sapiens
HPASLNGHL

SEQ ID NO: 244007 - protein, 9 aa, Homo Sapiens
QLHPIIDAR

SEQ ID NO: 244008 - protein, 9 aa, Homo Sapiens
QMAVRLTTR

SEQ ID NO: 244009 - protein, 9 aa, Homo Sapiens
EVPSKDKLV

SEQ ID NO: 244010 - protein, 9 aa, Homo Sapiens
LECKEAFAK

SEQ ID NO: 244011 - protein, 9 aa, Homo Sapiens
DMYLEYTRT

SEQ ID NO: 244012 - protein, 9 aa, Homo Sapiens
SAHNKSVSC

SEQ ID NO: 244013 - protein, 9 aa, Homo Sapiens
ENASTNVPF

SEQ ID NO: 244014 - protein, 9 aa, Homo Sapiens
RSALEDSYS

SEQ ID NO: 244015 - protein, 9 aa, Homo Sapiens
FCDFVALLK

SEQ ID NO: 244016 - protein, 9 aa, Homo Sapiens
EKTYAFHNT

SEQ ID NO: 244017 - protein, 9 aa, Homo Sapiens
ENCESRADN

SEQ ID NO: 244018 - protein, 9 aa, Homo Sapiens
LALFIIAIV

SEQ ID NO: 244019 - protein, 9 aa, Homo Sapiens
LGRLFRLQT

SEQ ID NO: 244020 - protein, 9 aa, Homo Sapiens
LLSREDEIR

SEQ ID NO: 244021 - protein, 9 aa, Homo Sapiens
GQFAPDHDG

SEQ ID NO: 244022 - protein, 9 aa, Homo Sapiens
QEKHKQKFA

SEQ ID NO: 244023 - protein, 9 aa, Homo Sapiens
MEITIRHDT

SEQ ID NO: 244024 - protein, 9 aa, Homo Sapiens
DGVRSLIQA

SEQ ID NO: 244025 - protein, 9 aa, Homo Sapiens
PQLFWLSSC

SEQ ID NO: 244026 - protein, 9 aa, Homo Sapiens
TILKVTPEI

SEQ ID NO: 244027 - protein, 9 aa, Homo Sapiens
KAEQFCKSF

SEQ ID NO: 244028 - protein, 9 aa, Homo Sapiens
DNMVNHRLI

SEQ ID NO: 244029 - protein, 9 aa, Homo Sapiens
VEAEDIYKS

SEQ ID NO: 244030 - protein, 9 aa, Homo Sapiens
NRGILTLKY

SEQ ID NO: 244031 - protein, 9 aa, Homo Sapiens
HCAKNRSLC

SEQ ID NO: 244032 - protein, 9 aa, Homo Sapiens
HFWRHGRNT

SEQ ID NO: 244033 - protein, 9 aa, Homo Sapiens
STSYSVTKS

SEQ ID NO: 244034 - protein, 9 aa, Homo Sapiens
ARDGKLVSE

SEQ ID NO: 244035 - protein, 9 aa, Homo Sapiens
VMCMYLRPT

SEQ ID NO: 244036 - protein, 9 aa, Homo Sapiens
EVWGKMMSG

SEQ ID NO: 244037 - protein, 9 aa, Homo Sapiens
IDTVGMAPS

SEQ ID NO: 244038 - protein, 9 aa, Homo Sapiens
RAQQGKHSL

SEQ ID NO: 244039 - protein, 9 aa, Homo Sapiens
KTNYGKIQG

SEQ ID NO: 244040 - protein, 9 aa, Homo Sapiens
KDNQWLGVS

SEQ ID NO: 244041 - protein, 9 aa, Homo Sapiens
VCCHQHPQT

SEQ ID NO: 244042 - protein, 9 aa, Homo Sapiens
RSQFQARDI

SEQ ID NO: 244043 - protein, 9 aa, Homo Sapiens
AGLLRALLG

SEQ ID NO: 244044 - protein, 9 aa, Homo Sapiens
NKVCFPNLI

SEQ ID NO: 244045 - protein, 9 aa, Homo Sapiens
SLPITICSL

SEQ ID NO: 244046 - protein, 9 aa, Homo Sapiens
LRIGNLWQF

SEQ ID NO: 244047 - protein, 9 aa, Homo Sapiens
SWHLQQSSV

SEQ ID NO: 244048 - protein, 9 aa, Homo Sapiens
RIYMEVRPY

SEQ ID NO: 244049 - protein, 9 aa, Homo Sapiens
EMITNVGKK

SEQ ID NO: 244050 - protein, 9 aa, Homo Sapiens
ASVNYLKYL

SEQ ID NO: 244051 - protein, 9 aa, Homo Sapiens
KTLDLIDVL

SEQ ID NO: 244052 - protein, 9 aa, Homo Sapiens
IKRINLDKC

SEQ ID NO: 244053 - protein, 9 aa, Homo Sapiens
FGGDEIARQ

SEQ ID NO: 244054 - protein, 9 aa, Homo Sapiens
HLQQQPPPL

SEQ ID NO: 244055 - protein, 9 aa, Homo Sapiens
IDMVVYMVP

SEQ ID NO: 244056 - protein, 9 aa, Homo Sapiens
LFGHGAEDS

SEQ ID NO: 244057 - protein, 9 aa, Homo Sapiens
RNTIKKCEK

SEQ ID NO: 244058 - protein, 9 aa, Homo Sapiens
WIQEANNFT

SEQ ID NO: 244059 - protein, 9 aa, Homo Sapiens
KEKIHILHT

SEQ ID NO: 244060 - protein, 9 aa, Homo Sapiens
TLKETTHSM

SEQ ID NO: 244061 - protein, 9 aa, Homo Sapiens
DVLIYGDPN

SEQ ID NO: 244062 - protein, 9 aa, Homo Sapiens
EFVCEAIQR

SEQ ID NO: 244063 - protein, 9 aa, Homo Sapiens
ATDYIPENA

SEQ ID NO: 244064 - protein, 9 aa, Homo Sapiens
VGCTQGSER

SEQ ID NO: 244065 - protein, 9 aa, Homo Sapiens
LSELFKERA

SEQ ID NO: 244066 - protein, 9 aa, Homo Sapiens
SDAACIVCP

SEQ ID NO: 244067 - protein, 9 aa, Homo Sapiens
VVLSSLNNS

SEQ ID NO: 244068 - protein, 9 aa, Homo Sapiens
SIKDYFQKV

SEQ ID NO: 244069 - protein, 9 aa, Homo Sapiens
ALQSNDTIR

SEQ ID NO: 244070 - protein, 9 aa, Homo Sapiens
LLFCRIRPI

SEQ ID NO: 244071 - protein, 9 aa, Homo Sapiens
QLVLGLHFI

SEQ ID NO: 244072 - protein, 9 aa, Homo Sapiens
RNLSDLWEI

SEQ ID NO: 244073 - protein, 9 aa, Homo Sapiens
PNSLYTVGM

SEQ ID NO: 244074 - protein, 9 aa, Homo Sapiens
DQTAQDMQE

SEQ ID NO: 244075 - protein, 9 aa, Homo Sapiens
NADGRFKGS

SEQ ID NO: 244076 - protein, 9 aa, Homo Sapiens
KHVSVPDQI

SEQ ID NO: 244077 - protein, 9 aa, Homo Sapiens
VQIVEKLIK

SEQ ID NO: 244078 - protein, 9 aa, Homo Sapiens
INLTRIRST

SEQ ID NO: 244079 - protein, 9 aa, Homo Sapiens
FTKCEITST

SEQ ID NO: 244080 - protein, 9 aa, Homo Sapiens
DLKQERINR

SEQ ID NO: 244081 - protein, 9 aa, Homo Sapiens
LNCAEVNIF

SEQ ID NO: 244082 - protein, 9 aa, Homo Sapiens
SGGVQRGGG

SEQ ID NO: 244083 - protein, 9 aa, Homo Sapiens
KRLDTFNRQ

SEQ ID NO: 244084 - protein, 9 aa, Homo Sapiens
PRFLLTIVT

SEQ ID NO: 244085 - protein, 9 aa, Homo Sapiens
ICGYRVLFA

SEQ ID NO: 244086 - protein, 9 aa, Homo Sapiens
IINAIVDFS

SEQ ID NO: 244087 - protein, 9 aa, Homo Sapiens
VWLNLRNRI

SEQ ID NO: 244088 - protein, 9 aa, Homo Sapiens
TGEGSAEAS

SEQ ID NO: 244089 - protein, 9 aa, Homo Sapiens
IRMMSLITL

SEQ ID NO: 244090 - protein, 9 aa, Homo Sapiens
ITESPESIK

SEQ ID NO: 244091 - protein, 9 aa, Homo Sapiens
LKHLKGQHE

SEQ ID NO: 244092 - protein, 9 aa, Homo Sapiens
LVGKWNGLS

SEQ ID NO: 244093 - protein, 9 aa, Homo Sapiens
PQFFMDQYK

SEQ ID NO: 244094 - protein, 9 aa, Homo Sapiens
CSRPLSMDR

SEQ ID NO: 244095 - protein, 9 aa, Homo Sapiens
PSGLSNGDK

SEQ ID NO: 244096 - protein, 9 aa, Homo Sapiens
DTLNCAEVN

SEQ ID NO: 244097 - protein, 9 aa, Homo Sapiens
VSNTQQKPA

SEQ ID NO: 244098 - protein, 9 aa, Homo Sapiens
YFFSNLSFL

SEQ ID NO: 244099 - protein, 9 aa, Homo Sapiens
WHQLALQVL

SEQ ID NO: 244100 - protein, 9 aa, Homo Sapiens
LEINGLEEK

SEQ ID NO: 244101 - protein, 9 aa, Homo Sapiens
ANEPTKNLP

SEQ ID NO: 244102 - protein, 9 aa, Homo Sapiens
GEWNLNMLQ

SEQ ID NO: 244103 - protein, 9 aa, Homo Sapiens
SSQVGPNQA

SEQ ID NO: 244104 - protein, 9 aa, Homo Sapiens
DFGISKIMD

SEQ ID NO: 244105 - protein, 9 aa, Homo Sapiens
YIKEIKDLR

SEQ ID NO: 244106 - protein, 9 aa, Homo Sapiens
EGRGGLALT

SEQ ID NO: 244107 - protein, 9 aa, Homo Sapiens
ITRVTANLS

SEQ ID NO: 244108 - protein, 9 aa, Homo Sapiens
IAETDLEKR

SEQ ID NO: 244109 - protein, 9 aa, Homo Sapiens
PTGSSQSCS

SEQ ID NO: 244110 - protein, 9 aa, Homo Sapiens
TIIQFAFQA

SEQ ID NO: 244111 - protein, 9 aa, Homo Sapiens
VRQGLQCKI

SEQ ID NO: 244112 - protein, 9 aa, Homo Sapiens
EPQMHLGTN

SEQ ID NO: 244113 - protein, 9 aa, Homo Sapiens
EEEEEQNIG

SEQ ID NO: 244114 - protein, 9 aa, Homo Sapiens
MYLNNVAET

SEQ ID NO: 244115 - protein, 9 aa, Homo Sapiens
SVQYKLLGA

SEQ ID NO: 244116 - protein, 9 aa, Homo Sapiens
ELRQIVKQL

SEQ ID NO: 244117 - protein, 9 aa, Homo Sapiens
RRELGCLNA

SEQ ID NO: 244118 - protein, 9 aa, Homo Sapiens
PLLAQEHNY

SEQ ID NO: 244119 - protein, 9 aa, Homo Sapiens
PIMYWAKED

SEQ ID NO: 244120 - protein, 9 aa, Homo Sapiens
KEAEEKACL

SEQ ID NO: 244121 - protein, 9 aa, Homo Sapiens
ATTLIQDED

SEQ ID NO: 244122 - protein, 9 aa, Homo Sapiens
SISSLLILY

SEQ ID NO: 244123 - protein, 9 aa, Homo Sapiens
LYSTGSLDP

SEQ ID NO: 244124 - protein, 9 aa, Homo Sapiens
TFPSFFKMK

SEQ ID NO: 244125 - protein, 9 aa, Homo Sapiens
ITLTDDFSY

SEQ ID NO: 244126 - protein, 9 aa, Homo Sapiens
VMQHILNPA

SEQ ID NO: 244127 - protein, 9 aa, Homo Sapiens
PTPKEVVKG

SEQ ID NO: 244128 - protein, 9 aa, Homo Sapiens
HIEPKKLAG

SEQ ID NO: 244129 - protein, 9 aa, Homo Sapiens
QMQKRVLGH

SEQ ID NO: 244130 - protein, 9 aa, Homo Sapiens
IHKIIHTER

SEQ ID NO: 244131 - protein, 9 aa, Homo Sapiens
QYNAQKSQQ

SEQ ID NO: 244132 - protein, 9 aa, Homo Sapiens
PEESKDKGI

SEQ ID NO: 244133 - protein, 9 aa, Homo Sapiens
SKQTIEFNK

SEQ ID NO: 244134 - protein, 9 aa, Homo Sapiens
EIINENEKG

SEQ ID NO: 244135 - protein, 9 aa, Homo Sapiens
VCLFGCPPG

SEQ ID NO: 244136 - protein, 9 aa, Homo Sapiens
PACSDVVGW

SEQ ID NO: 244137 - protein, 9 aa, Homo Sapiens
EWKQKHLPR

SEQ ID NO: 244138 - protein, 9 aa, Homo Sapiens
NKKTEGTYD

SEQ ID NO: 244139 - protein, 9 aa, Homo Sapiens
ASQEDTHCI

SEQ ID NO: 244140 - protein, 9 aa, Homo Sapiens
NASPPEGAP

SEQ ID NO: 244141 - protein, 9 aa, Homo Sapiens
DIKARPDMQ

SEQ ID NO: 244142 - protein, 9 aa, Homo Sapiens
KGAVAQVLR

SEQ ID NO: 244143 - protein, 9 aa, Homo Sapiens
DIAHRRSEE

SEQ ID NO: 244144 - protein, 9 aa, Homo Sapiens
DEVTRKRFN

SEQ ID NO: 244145 - protein, 9 aa, Homo Sapiens
MLINLTRIR

SEQ ID NO: 244146 - protein, 9 aa, Homo Sapiens
CAARGEDYD

SEQ ID NO: 244147 - protein, 9 aa, Homo Sapiens
LCCEFLTGQ

SEQ ID NO: 244148 - protein, 9 aa, Homo Sapiens
LPIEQLCST

SEQ ID NO: 244149 - protein, 9 aa, Homo Sapiens
VQGYVGSFV

SEQ ID NO: 244150 - protein, 9 aa, Homo Sapiens
ECGNAFIHS

SEQ ID NO: 244151 - protein, 9 aa, Homo Sapiens
LLFISSTCV

SEQ ID NO: 244152 - protein, 9 aa, Homo Sapiens
LEANRLWDN

SEQ ID NO: 244153 - protein, 9 aa, Homo Sapiens
RNGSVVRTR

SEQ ID NO: 244154 - protein, 9 aa, Homo Sapiens
KGSTFSNSE

SEQ ID NO: 244155 - protein, 9 aa, Homo Sapiens
ITSMETALA

SEQ ID NO: 244156 - protein, 9 aa, Homo Sapiens
FGKELFNPH

SEQ ID NO: 244157 - protein, 9 aa, Homo Sapiens
GLNLLQPRL

SEQ ID NO: 244158 - protein, 9 aa, Homo Sapiens
GQETFAPRL

SEQ ID NO: 244159 - protein, 9 aa, Homo Sapiens
YFSQKACAC

SEQ ID NO: 244160 - protein, 9 aa, Homo Sapiens
KADEMYDKY

SEQ ID NO: 244161 - protein, 9 aa, Homo Sapiens
SILTNISSS

SEQ ID NO: 244162 - protein, 9 aa, Homo Sapiens
SLTVTPENG

SEQ ID NO: 244163 - protein, 9 aa, Homo Sapiens
EMDGTETGL

SEQ ID NO: 244164 - protein, 9 aa, Homo Sapiens
LLCHPGWST

SEQ ID NO: 244165 - protein, 9 aa, Homo Sapiens
NDGQFRKAE

SEQ ID NO: 244166 - protein, 9 aa, Homo Sapiens
HKASFLSRL

SEQ ID NO: 244167 - protein, 9 aa, Homo Sapiens
AELRRIFER

SEQ ID NO: 244168 - protein, 9 aa, Homo Sapiens
GTRTGPLME

SEQ ID NO: 244169 - protein, 9 aa, Homo Sapiens
LKKWPMQSR

SEQ ID NO: 244170 - protein, 9 aa, Homo Sapiens
CLPYGHTVT

SEQ ID NO: 244171 - protein, 9 aa, Homo Sapiens
MQDMVPYLP

SEQ ID NO: 244172 - protein, 9 aa, Homo Sapiens
FFTESSKYG

SEQ ID NO: 244173 - protein, 9 aa, Homo Sapiens
ARCDPKPGA

SEQ ID NO: 244174 - protein, 9 aa, Homo Sapiens
KEKTCDCLP

SEQ ID NO: 244175 - protein, 9 aa, Homo Sapiens
KKVWLPSKH

SEQ ID NO: 244176 - protein, 9 aa, Homo Sapiens
DTCLCKDSL

SEQ ID NO: 244177 - protein, 9 aa, Homo Sapiens
NELYHCFLP

SEQ ID NO: 244178 - protein, 9 aa, Homo Sapiens
VIEALKDTF

SEQ ID NO: 244179 - protein, 9 aa, Homo Sapiens
EVNNYPENT

SEQ ID NO: 244180 - protein, 9 aa, Homo Sapiens
RGRRTRQRV

SEQ ID NO: 244181 - protein, 9 aa, Homo Sapiens
QALHWYCPV

SEQ ID NO: 244182 - protein, 9 aa, Homo Sapiens
WKHLICVLN

SEQ ID NO: 244183 - protein, 9 aa, Homo Sapiens
YGLISCELY

SEQ ID NO: 244184 - protein, 9 aa, Homo Sapiens
HFDLRIPFA

SEQ ID NO: 244185 - protein, 9 aa, Homo Sapiens
GKTLYYFWS

SEQ ID NO: 244186 - protein, 9 aa, Homo Sapiens
AVDKYEEVL

SEQ ID NO: 244187 - protein, 9 aa, Homo Sapiens
LSNQELAIE

SEQ ID NO: 244188 - protein, 9 aa, Homo Sapiens
QPSGADSGT

SEQ ID NO: 244189 - protein, 9 aa, Homo Sapiens
YSSEWELNP

SEQ ID NO: 244190 - protein, 9 aa, Homo Sapiens
ILVGYVDSH

SEQ ID NO: 244191 - protein, 9 aa, Homo Sapiens
RGLSNSPWA

SEQ ID NO: 244192 - protein, 9 aa, Homo Sapiens
KMKVIKSLQ

SEQ ID NO: 244193 - protein, 9 aa, Homo Sapiens
APNDQGCLH

SEQ ID NO: 244194 - protein, 9 aa, Homo Sapiens
PQAVPTSSS

SEQ ID NO: 244195 - protein, 9 aa, Homo Sapiens
IILASNLAQ

SEQ ID NO: 244196 - protein, 9 aa, Homo Sapiens
EVVFLQPRG

SEQ ID NO: 244197 - protein, 9 aa, Homo Sapiens
HLGISLGID

SEQ ID NO: 244198 - protein, 9 aa, Homo Sapiens
GSYRCQCPP

SEQ ID NO: 244199 - protein, 9 aa, Homo Sapiens
QVALREKKV

SEQ ID NO: 244200 - protein, 9 aa, Homo Sapiens
KLANQYHPD

SEQ ID NO: 244201 - protein, 9 aa, Homo Sapiens
DDHLSIVTQ

SEQ ID NO: 244202 - protein, 9 aa, Homo Sapiens
EYEMESPTI

SEQ ID NO: 244203 - protein, 9 aa, Homo Sapiens
PDILNWNYH

SEQ ID NO: 244204 - protein, 9 aa, Homo Sapiens
TGEVLETSA

SEQ ID NO: 244205 - protein, 9 aa, Homo Sapiens
KKNNDNLLK

SEQ ID NO: 244206 - protein, 9 aa, Homo Sapiens
LWNLLETSS

SEQ ID NO: 244207 - protein, 9 aa, Homo Sapiens
SKANIAFGQ

SEQ ID NO: 244208 - protein, 9 aa, Homo Sapiens
RRARSQSCE

SEQ ID NO: 244209 - protein, 9 aa, Homo Sapiens
PAVDKGRFT

SEQ ID NO: 244210 - protein, 9 aa, Homo Sapiens
NGVRTEQYL

SEQ ID NO: 244211 - protein, 9 aa, Homo Sapiens
LRRDIKAFG

SEQ ID NO: 244212 - protein, 9 aa, Homo Sapiens
LGINLVVGM

SEQ ID NO: 244213 - protein, 9 aa, Homo Sapiens
LYGNSETND

SEQ ID NO: 244214 - protein, 9 aa, Homo Sapiens
YERKIEEAQ

SEQ ID NO: 244215 - protein, 9 aa, Homo Sapiens
DLIFQYGHL

SEQ ID NO: 244216 - protein, 9 aa, Homo Sapiens
FTDNSQLHS

SEQ ID NO: 244217 - protein, 9 aa, Homo Sapiens
DGGVCEGVG

SEQ ID NO: 244218 - protein, 9 aa, Homo Sapiens
SCIFSAFSF

SEQ ID NO: 244219 - protein, 9 aa, Homo Sapiens
WVNTFPVEM

SEQ ID NO: 244220 - protein, 9 aa, Homo Sapiens
PPQRWQNIF

SEQ ID NO: 244221 - protein, 9 aa, Homo Sapiens
RNCASDPRG

SEQ ID NO: 244222 - protein, 9 aa, Homo Sapiens
GISCTYFIR

SEQ ID NO: 244223 - protein, 9 aa, Homo Sapiens
STERLDQDG

SEQ ID NO: 244224 - protein, 9 aa, Homo Sapiens
KLLSRLGQM

SEQ ID NO: 244225 - protein, 9 aa, Homo Sapiens
IIHSREKPH

SEQ ID NO: 244226 - protein, 9 aa, Homo Sapiens
DCVRKFILD

SEQ ID NO: 244227 - protein, 9 aa, Homo Sapiens
VSRSCRVHL

SEQ ID NO: 244228 - protein, 9 aa, Homo Sapiens
KVNCVIFQD

SEQ ID NO: 244229 - protein, 9 aa, Homo Sapiens
LSALKTQRR

SEQ ID NO: 244230 - protein, 9 aa, Homo Sapiens
DCIFFHLNA

SEQ ID NO: 244231 - protein, 9 aa, Homo Sapiens
FREEDTSRQ

SEQ ID NO: 244232 - protein, 9 aa, Homo Sapiens
KPGIYVMTV

SEQ ID NO: 244233 - protein, 9 aa, Homo Sapiens
VIKYKYYFP

SEQ ID NO: 244234 - protein, 9 aa, Homo Sapiens
PGQYMISAY

SEQ ID NO: 244235 - protein, 9 aa, Homo Sapiens
AQHQNIHTG

SEQ ID NO: 244236 - protein, 9 aa, Homo Sapiens
LGRVHFLVN

SEQ ID NO: 244237 - protein, 9 aa, Homo Sapiens
CVLSSPRKT

SEQ ID NO: 244238 - protein, 9 aa, Homo Sapiens
ILDPQVPAK

SEQ ID NO: 244239 - protein, 9 aa, Homo Sapiens
VIFFQKYYQ

SEQ ID NO: 244240 - protein, 9 aa, Homo Sapiens
MNKLMELTN

SEQ ID NO: 244241 - protein, 9 aa, Homo Sapiens
KRQAEEYAH

SEQ ID NO: 244242 - protein, 9 aa, Homo Sapiens
DLAACNILV

SEQ ID NO: 244243 - protein, 9 aa, Homo Sapiens
VRSNHPFRQ

SEQ ID NO: 244244 - protein, 9 aa, Homo Sapiens
SYKGSTLNI

SEQ ID NO: 244245 - protein, 9 aa, Homo Sapiens
FSYTQPAIE

SEQ ID NO: 244246 - protein, 9 aa, Homo Sapiens
SNSIAIVGV

SEQ ID NO: 244247 - protein, 9 aa, Homo Sapiens
YIEMPYVIE

SEQ ID NO: 244248 - protein, 9 aa, Homo Sapiens
MSFATKLSD

SEQ ID NO: 244249 - protein, 9 aa, Homo Sapiens
RCQVHMEMV

SEQ ID NO: 244250 - protein, 9 aa, Homo Sapiens
LRPLKTTTS

SEQ ID NO: 244251 - protein, 9 aa, Homo Sapiens
QKYADYANY

SEQ ID NO: 244252 - protein, 9 aa, Homo Sapiens
AEDDCENDF

SEQ ID NO: 244253 - protein, 9 aa, Homo Sapiens
RDGVIQYSS

SEQ ID NO: 244254 - protein, 9 aa, Homo Sapiens
VSAFFFSLL

SEQ ID NO: 244255 - protein, 9 aa, Homo Sapiens
AEERLRRRK

SEQ ID NO: 244256 - protein, 9 aa, Homo Sapiens
LLMSESQKL

SEQ ID NO: 244257 - protein, 9 aa, Homo Sapiens
MEAFLLAVM

SEQ ID NO: 244258 - protein, 9 aa, Homo Sapiens
APAALSPTP

SEQ ID NO: 244259 - protein, 9 aa, Homo Sapiens
KGAEDRLIL

SEQ ID NO: 244260 - protein, 9 aa, Homo Sapiens
NVSESHVVS

SEQ ID NO: 244261 - protein, 9 aa, Homo Sapiens
MGREPEDNS

SEQ ID NO: 244262 - protein, 9 aa, Homo Sapiens
TDGEIILGL

SEQ ID NO: 244263 - protein, 9 aa, Homo Sapiens
INGKQQTFP

SEQ ID NO: 244264 - protein, 9 aa, Homo Sapiens
LHAAVPSGN

SEQ ID NO: 244265 - protein, 9 aa, Homo Sapiens
GVSCDACLN

SEQ ID NO: 244266 - protein, 9 aa, Homo Sapiens
IADVDDLLS

SEQ ID NO: 244267 - protein, 9 aa, Homo Sapiens
RMTHLAHKF

SEQ ID NO: 244268 - protein, 9 aa, Homo Sapiens
TLIGSCVKI

SEQ ID NO: 244269 - protein, 9 aa, Homo Sapiens
CDFMLFMGL

SEQ ID NO: 244270 - protein, 9 aa, Homo Sapiens
QLYPDNSEQ

SEQ ID NO: 244271 - protein, 9 aa, Homo Sapiens
AIQISKSPD

SEQ ID NO: 244272 - protein, 9 aa, Homo Sapiens
EGTARSGGQ

SEQ ID NO: 244273 - protein, 9 aa, Homo Sapiens
LEYPREDEQ

SEQ ID NO: 244274 - protein, 9 aa, Homo Sapiens
RGSGGVQRG

SEQ ID NO: 244275 - protein, 9 aa, Homo Sapiens
NQGLRGPGL

SEQ ID NO: 244276 - protein, 9 aa, Homo Sapiens
AERLTLIQM

SEQ ID NO: 244277 - protein, 9 aa, Homo Sapiens
KEFSYESGV

SEQ ID NO: 244278 - protein, 9 aa, Homo Sapiens
PHSCIFSAF

SEQ ID NO: 244279 - protein, 9 aa, Homo Sapiens
VPLSDENSQ

SEQ ID NO: 244280 - protein, 9 aa, Homo Sapiens
DVDATNPIY

SEQ ID NO: 244281 - protein, 9 aa, Homo Sapiens
SSQGHSIFQ

SEQ ID NO: 244282 - protein, 9 aa, Homo Sapiens
SFFLPILAP

SEQ ID NO: 244283 - protein, 9 aa, Homo Sapiens
NNYWDKCVK

SEQ ID NO: 244284 - protein, 9 aa, Homo Sapiens
QTLSAPKQL

SEQ ID NO: 244285 - protein, 9 aa, Homo Sapiens
FPGAQEGGV

SEQ ID NO: 244286 - protein, 9 aa, Homo Sapiens
HKFFPKAKD

SEQ ID NO: 244287 - protein, 9 aa, Homo Sapiens
GMSLVILPH

SEQ ID NO: 244288 - protein, 9 aa, Homo Sapiens
SFFAERLFA

SEQ ID NO: 244289 - protein, 9 aa, Homo Sapiens
EDIESVKKN

SEQ ID NO: 244290 - protein, 9 aa, Homo Sapiens
DTHHSQNPS

SEQ ID NO: 244291 - protein, 9 aa, Homo Sapiens
LSMPMDSEE

SEQ ID NO: 244292 - protein, 9 aa, Homo Sapiens
RRSAANIAL

SEQ ID NO: 244293 - protein, 9 aa, Homo Sapiens
ISFPVFVVV

SEQ ID NO: 244294 - protein, 9 aa, Homo Sapiens
AAGDNKKRP

SEQ ID NO: 244295 - protein, 9 aa, Homo Sapiens
SSDVTSTTS

SEQ ID NO: 244296 - protein, 9 aa, Homo Sapiens
REEQNEQTL

SEQ ID NO: 244297 - protein, 9 aa, Homo Sapiens
RKIWDSQER

SEQ ID NO: 244298 - protein, 9 aa, Homo Sapiens
LHSWADDGK

SEQ ID NO: 244299 - protein, 9 aa, Homo Sapiens
PPRLPAKRK

SEQ ID NO: 244300 - protein, 9 aa, Homo Sapiens
TLIRECQRQ

SEQ ID NO: 244301 - protein, 9 aa, Homo Sapiens
GSALFLLLF

SEQ ID NO: 244302 - protein, 9 aa, Homo Sapiens
FVHQCYGNK

SEQ ID NO: 244303 - protein, 9 aa, Homo Sapiens
RENSGSKVL

SEQ ID NO: 244304 - protein, 9 aa, Homo Sapiens
FLQPNNIHD

SEQ ID NO: 244305 - protein, 9 aa, Homo Sapiens
FNYYPQNIT

SEQ ID NO: 244306 - protein, 9 aa, Homo Sapiens
RPDDWSQGA

SEQ ID NO: 244307 - protein, 9 aa, Homo Sapiens
AFSATDSFN

SEQ ID NO: 244308 - protein, 9 aa, Homo Sapiens
PDGKKAMSI

SEQ ID NO: 244309 - protein, 9 aa, Homo Sapiens
DSSSDVTST

SEQ ID NO: 244310 - protein, 9 aa, Homo Sapiens
KESDFEFLS

SEQ ID NO: 244311 - protein, 9 aa, Homo Sapiens
GPLQEVPLC

SEQ ID NO: 244312 - protein, 9 aa, Homo Sapiens
KEALGPINF

SEQ ID NO: 244313 - protein, 9 aa, Homo Sapiens
NKISGLKNG

SEQ ID NO: 244314 - protein, 9 aa, Homo Sapiens
GLPWIFEEL

SEQ ID NO: 244315 - protein, 9 aa, Homo Sapiens
YVINLMHHA

SEQ ID NO: 244316 - protein, 9 aa, Homo Sapiens
NKDVKTAFM

SEQ ID NO: 244317 - protein, 9 aa, Homo Sapiens
THLRFQEFF

SEQ ID NO: 244318 - protein, 9 aa, Homo Sapiens
VKIFTPCFN

SEQ ID NO: 244319 - protein, 9 aa, Homo Sapiens
DHSHLEEGI

SEQ ID NO: 244320 - protein, 9 aa, Homo Sapiens
TDFGISKIM

SEQ ID NO: 244321 - protein, 9 aa, Homo Sapiens
KNPAVTKLV

SEQ ID NO: 244322 - protein, 9 aa, Homo Sapiens
RLTCCFCIC

SEQ ID NO: 244323 - protein, 9 aa, Homo Sapiens
PVTDYRTAI

SEQ ID NO: 244324 - protein, 9 aa, Homo Sapiens
LPPARWTPI

SEQ ID NO: 244325 - protein, 9 aa, Homo Sapiens
LDIDPRYTG

SEQ ID NO: 244326 - protein, 9 aa, Homo Sapiens
SAGKLAMDS

SEQ ID NO: 244327 - protein, 9 aa, Homo Sapiens
RPNDSHMLV

SEQ ID NO: 244328 - protein, 9 aa, Homo Sapiens
DNPQSDKGA

SEQ ID NO: 244329 - protein, 9 aa, Homo Sapiens
SKQQGKTFI

SEQ ID NO: 244330 - protein, 9 aa, Homo Sapiens
VIYTNTHIK

SEQ ID NO: 244331 - protein, 9 aa, Homo Sapiens
AHVPEIIEM

SEQ ID NO: 244332 - protein, 9 aa, Homo Sapiens
NLATMDTIC

SEQ ID NO: 244333 - protein, 9 aa, Homo Sapiens
IATAGLHCQ

SEQ ID NO: 244334 - protein, 9 aa, Homo Sapiens
DITSNKKLF

SEQ ID NO: 244335 - protein, 9 aa, Homo Sapiens
WIISITAST

SEQ ID NO: 244336 - protein, 9 aa, Homo Sapiens
KLRKAPSDL

SEQ ID NO: 244337 - protein, 9 aa, Homo Sapiens
QEPSSSGGS

SEQ ID NO: 244338 - protein, 9 aa, Homo Sapiens
ITDMYKSNN

SEQ ID NO: 244339 - protein, 9 aa, Homo Sapiens
YRRGQVASS

SEQ ID NO: 244340 - protein, 9 aa, Homo Sapiens
SGIIESLIT

SEQ ID NO: 244341 - protein, 9 aa, Homo Sapiens
KSVFCNTNQ

SEQ ID NO: 244342 - protein, 9 aa, Homo Sapiens
FQDIYSECN

SEQ ID NO: 244343 - protein, 9 aa, Homo Sapiens
KKGGCKGHF

SEQ ID NO: 244344 - protein, 9 aa, Homo Sapiens
HGLCVNKGT

SEQ ID NO: 244345 - protein, 9 aa, Homo Sapiens
NHQIIHSRE

SEQ ID NO: 244346 - protein, 9 aa, Homo Sapiens
VVINAQNQN

SEQ ID NO: 244347 - protein, 9 aa, Homo Sapiens
FVNMNISTD

SEQ ID NO: 244348 - protein, 9 aa, Homo Sapiens
DCKDEYFAK

SEQ ID NO: 244349 - protein, 9 aa, Homo Sapiens
FAVDKRVQS

SEQ ID NO: 244350 - protein, 9 aa, Homo Sapiens
CKESRPFSN

SEQ ID NO: 244351 - protein, 9 aa, Homo Sapiens
NNFNPPTRR

SEQ ID NO: 244352 - protein, 9 aa, Homo Sapiens
AGNKKTSIK

SEQ ID NO: 244353 - protein, 9 aa, Homo Sapiens
VVNCSTLPA

SEQ ID NO: 244354 - protein, 9 aa, Homo Sapiens
QTLNLTAGN

SEQ ID NO: 244355 - protein, 9 aa, Homo Sapiens
ILLSCLPYG

SEQ ID NO: 244356 - protein, 9 aa, Homo Sapiens
LSPTYPQAY

SEQ ID NO: 244357 - protein, 9 aa, Homo Sapiens
SSEISSATE

SEQ ID NO: 244358 - protein, 9 aa, Homo Sapiens
MKWKKYNKL

SEQ ID NO: 244359 - protein, 9 aa, Homo Sapiens
LATRGEIIT

SEQ ID NO: 244360 - protein, 9 aa, Homo Sapiens
GYVVLWMAM

SEQ ID NO: 244361 - protein, 9 aa, Homo Sapiens
LWSSSLSPT

SEQ ID NO: 244362 - protein, 9 aa, Homo Sapiens
ISSIKGSNN

SEQ ID NO: 244363 - protein, 9 aa, Homo Sapiens
TSPVLGLEI

SEQ ID NO: 244364 - protein, 9 aa, Homo Sapiens
LEIFHPFVK

SEQ ID NO: 244365 - protein, 9 aa, Homo Sapiens
HNLLERRLM

SEQ ID NO: 244366 - protein, 9 aa, Homo Sapiens
DLYKNPASS

SEQ ID NO: 244367 - protein, 9 aa, Homo Sapiens
SLRRQVPAI

SEQ ID NO: 244368 - protein, 9 aa, Homo Sapiens
PPTVYRMLM

SEQ ID NO: 244369 - protein, 9 aa, Homo Sapiens
VDDNEVYSA

SEQ ID NO: 244370 - protein, 9 aa, Homo Sapiens
DRPLIYFLR

SEQ ID NO: 244371 - protein, 9 aa, Homo Sapiens
KEYEREHVD

SEQ ID NO: 244372 - protein, 9 aa, Homo Sapiens
ATLLNILAL

SEQ ID NO: 244373 - protein, 9 aa, Homo Sapiens
VCGKIGLIE

SEQ ID NO: 244374 - protein, 9 aa, Homo Sapiens
HHQRVHNKQ

SEQ ID NO: 244375 - protein, 9 aa, Homo Sapiens
HAIGVEAHQ

SEQ ID NO: 244376 - protein, 9 aa, Homo Sapiens
CGLQDLLFS

SEQ ID NO: 244377 - protein, 9 aa, Homo Sapiens
IKHVKAANR

SEQ ID NO: 244378 - protein, 9 aa, Homo Sapiens
YPPEKKDKG

SEQ ID NO: 244379 - protein, 9 aa, Homo Sapiens
ALIEGQVMA

SEQ ID NO: 244380 - protein, 9 aa, Homo Sapiens
TGHYDLMER

SEQ ID NO: 244381 - protein, 9 aa, Homo Sapiens
CQVCGFWSR

SEQ ID NO: 244382 - protein, 9 aa, Homo Sapiens
QKGGKCRNV

SEQ ID NO: 244383 - protein, 9 aa, Homo Sapiens
DVIHKLNNL

SEQ ID NO: 244384 - protein, 9 aa, Homo Sapiens
ELRVNLDQL

SEQ ID NO: 244385 - protein, 9 aa, Homo Sapiens
RQLEIKHIP

SEQ ID NO: 244386 - protein, 9 aa, Homo Sapiens
FQMHERTHT

SEQ ID NO: 244387 - protein, 9 aa, Homo Sapiens
KEVYAAAAD

SEQ ID NO: 244388 - protein, 9 aa, Homo Sapiens
ELKIPLNGR

SEQ ID NO: 244389 - protein, 9 aa, Homo Sapiens
KPEKISNKS

SEQ ID NO: 244390 - protein, 9 aa, Homo Sapiens
CNHVFHTSC

SEQ ID NO: 244391 - protein, 9 aa, Homo Sapiens
YQFTLPRYV

SEQ ID NO: 244392 - protein, 9 aa, Homo Sapiens
KCVGILSWH

SEQ ID NO: 244393 - protein, 9 aa, Homo Sapiens
SVGSPYGSQ

SEQ ID NO: 244394 - protein, 9 aa, Homo Sapiens
KLKSRLEKW

SEQ ID NO: 244395 - protein, 9 aa, Homo Sapiens
YNQAYHWDT

SEQ ID NO: 244396 - protein, 9 aa, Homo Sapiens
AKKNVDSII

SEQ ID NO: 244397 - protein, 9 aa, Homo Sapiens
LVLDRICKL

SEQ ID NO: 244398 - protein, 9 aa, Homo Sapiens
PGYCAFYDK

SEQ ID NO: 244399 - protein, 9 aa, Homo Sapiens
SDYGPMKGG

SEQ ID NO: 244400 - protein, 9 aa, Homo Sapiens
LFNKTENKE

SEQ ID NO: 244401 - protein, 9 aa, Homo Sapiens
KDRKFVIFD

SEQ ID NO: 244402 - protein, 9 aa, Homo Sapiens
LISKMYPSR

SEQ ID NO: 244403 - protein, 9 aa, Homo Sapiens
ANLRNLATG

SEQ ID NO: 244404 - protein, 9 aa, Homo Sapiens
IRQIFHPEY

SEQ ID NO: 244405 - protein, 9 aa, Homo Sapiens
ESEIPEDSD

SEQ ID NO: 244406 - protein, 9 aa, Homo Sapiens
TTENSTGRN

SEQ ID NO: 244407 - protein, 9 aa, Homo Sapiens
DRLLGILKE

SEQ ID NO: 244408 - protein, 9 aa, Homo Sapiens
AIRRVFCDI

SEQ ID NO: 244409 - protein, 9 aa, Homo Sapiens
KKGEWPPAH

SEQ ID NO: 244410 - protein, 9 aa, Homo Sapiens
GKELFNPHG

SEQ ID NO: 244411 - protein, 9 aa, Homo Sapiens
YLLYFVILC

SEQ ID NO: 244412 - protein, 9 aa, Homo Sapiens
SNWTSVSRF

SEQ ID NO: 244413 - protein, 9 aa, Homo Sapiens
FPVNTGQKG

SEQ ID NO: 244414 - protein, 9 aa, Homo Sapiens
LDLDKVYLY

SEQ ID NO: 244415 - protein, 9 aa, Homo Sapiens
FSNAGQKKH

SEQ ID NO: 244416 - protein, 9 aa, Homo Sapiens
QPLGDIMPI

SEQ ID NO: 244417 - protein, 9 aa, Homo Sapiens
AAVERLIMV

SEQ ID NO: 244418 - protein, 9 aa, Homo Sapiens
LGGKLWSIL

SEQ ID NO: 244419 - protein, 9 aa, Homo Sapiens
VMEWNGWGY

SEQ ID NO: 244420 - protein, 9 aa, Homo Sapiens
ANEDICPEK

SEQ ID NO: 244421 - protein, 9 aa, Homo Sapiens
DPQSSCLGD

SEQ ID NO: 244422 - protein, 9 aa, Homo Sapiens
RNANLRFLN

SEQ ID NO: 244423 - protein, 9 aa, Homo Sapiens
PEGLLAGPS

SEQ ID NO: 244424 - protein, 9 aa, Homo Sapiens
PLFTFELPP

SEQ ID NO: 244425 - protein, 9 aa, Homo Sapiens
FPWILLGYL

SEQ ID NO: 244426 - protein, 9 aa, Homo Sapiens
QIDLDDNPW

SEQ ID NO: 244427 - protein, 9 aa, Homo Sapiens
SQISSQRNC

SEQ ID NO: 244428 - protein, 9 aa, Homo Sapiens
REPKKLDPI

SEQ ID NO: 244429 - protein, 9 aa, Homo Sapiens
AQEAQKETD

SEQ ID NO: 244430 - protein, 9 aa, Homo Sapiens
IKNPMHNWS

SEQ ID NO: 244431 - protein, 9 aa, Homo Sapiens
CHEAPYLFQ

SEQ ID NO: 244432 - protein, 9 aa, Homo Sapiens
IGVLISHSN

SEQ ID NO: 244433 - protein, 9 aa, Homo Sapiens
SQEELDEEV

SEQ ID NO: 244434 - protein, 9 aa, Homo Sapiens
SSALKKAVG

SEQ ID NO: 244435 - protein, 9 aa, Homo Sapiens
ELEYFYLNH

SEQ ID NO: 244436 - protein, 9 aa, Homo Sapiens
PDGGLMAQE

SEQ ID NO: 244437 - protein, 9 aa, Homo Sapiens
RLPVTKINV

SEQ ID NO: 244438 - protein, 9 aa, Homo Sapiens
RVSPRYTQS

SEQ ID NO: 244439 - protein, 9 aa, Homo Sapiens
DKKKHDCFN

SEQ ID NO: 244440 - protein, 9 aa, Homo Sapiens
GNNFFKQEF

SEQ ID NO: 244441 - protein, 9 aa, Homo Sapiens
SLLTDHMNL

SEQ ID NO: 244442 - protein, 9 aa, Homo Sapiens
ESKTMEFGK

SEQ ID NO: 244443 - protein, 9 aa, Homo Sapiens
RRPQSRPQS

SEQ ID NO: 244444 - protein, 9 aa, Homo Sapiens
QMLKSVMQE

SEQ ID NO: 244445 - protein, 9 aa, Homo Sapiens
CRIIKQAFQ

SEQ ID NO: 244446 - protein, 9 aa, Homo Sapiens
YKDQSAWTF

SEQ ID NO: 244447 - protein, 9 aa, Homo Sapiens
RNVKFNVWD

SEQ ID NO: 244448 - protein, 9 aa, Homo Sapiens
KERRMRLYI

SEQ ID NO: 244449 - protein, 9 aa, Homo Sapiens
NKVVPHHCL

SEQ ID NO: 244450 - protein, 9 aa, Homo Sapiens
IRELENLQT

SEQ ID NO: 244451 - protein, 9 aa, Homo Sapiens
PRNEIAAQI

SEQ ID NO: 244452 - protein, 9 aa, Homo Sapiens
DVKALRWQC

SEQ ID NO: 244453 - protein, 9 aa, Homo Sapiens
GHQSKFMLK

SEQ ID NO: 244454 - protein, 9 aa, Homo Sapiens
EEKACLAAE

SEQ ID NO: 244455 - protein, 9 aa, Homo Sapiens
EFIQVGVVQ

SEQ ID NO: 244456 - protein, 9 aa, Homo Sapiens
TLNPQVLQK

SEQ ID NO: 244457 - protein, 9 aa, Homo Sapiens
CNTNQINFN

SEQ ID NO: 244458 - protein, 9 aa, Homo Sapiens
PVENRRNRE

SEQ ID NO: 244459 - protein, 9 aa, Homo Sapiens
IHRSLGVHL

SEQ ID NO: 244460 - protein, 9 aa, Homo Sapiens
DSAHELENP

SEQ ID NO: 244461 - protein, 9 aa, Homo Sapiens
VDPLGDYMV

SEQ ID NO: 244462 - protein, 9 aa, Homo Sapiens
PGEKRRKNI

SEQ ID NO: 244463 - protein, 9 aa, Homo Sapiens
SFGPLQILL

SEQ ID NO: 244464 - protein, 9 aa, Homo Sapiens
HLFKDGKMK

SEQ ID NO: 244465 - protein, 9 aa, Homo Sapiens
LQNKVLISL

SEQ ID NO: 244466 - protein, 9 aa, Homo Sapiens
KTSECGKSF

SEQ ID NO: 244467 - protein, 9 aa, Homo Sapiens
RFLLTIVTR

SEQ ID NO: 244468 - protein, 9 aa, Homo Sapiens
SRGKAKRRN

SEQ ID NO: 244469 - protein, 9 aa, Homo Sapiens
TILGLSHAF

SEQ ID NO: 244470 - protein, 9 aa, Homo Sapiens
PHNLIAQSQ

SEQ ID NO: 244471 - protein, 9 aa, Homo Sapiens
NGSCINKIE

SEQ ID NO: 244472 - protein, 9 aa, Homo Sapiens
EHSLETAKA

SEQ ID NO: 244473 - protein, 9 aa, Homo Sapiens
AMDLVQEEY

SEQ ID NO: 244474 - protein, 9 aa, Homo Sapiens
WREGDKVTL

SEQ ID NO: 244475 - protein, 9 aa, Homo Sapiens
QQKVGIMHC

SEQ ID NO: 244476 - protein, 9 aa, Homo Sapiens
CRIRPIFVF

SEQ ID NO: 244477 - protein, 9 aa, Homo Sapiens
RLAGTKSPV

SEQ ID NO: 244478 - protein, 9 aa, Homo Sapiens
QQDCGIAQE

SEQ ID NO: 244479 - protein, 9 aa, Homo Sapiens
RWDPGWEGL

SEQ ID NO: 244480 - protein, 9 aa, Homo Sapiens
SDLLRRTDR

SEQ ID NO: 244481 - protein, 9 aa, Homo Sapiens
GNYLSRKMA

SEQ ID NO: 244482 - protein, 9 aa, Homo Sapiens
KTSYLSLFF

SEQ ID NO: 244483 - protein, 9 aa, Homo Sapiens
NIRKNQATD

SEQ ID NO: 244484 - protein, 9 aa, Homo Sapiens
MIHSMTIEA

SEQ ID NO: 244485 - protein, 9 aa, Homo Sapiens
KDAEEEGDD

SEQ ID NO: 244486 - protein, 9 aa, Homo Sapiens
VVKTCNLPL

SEQ ID NO: 244487 - protein, 9 aa, Homo Sapiens
ANLFGSNAQ

SEQ ID NO: 244488 - protein, 9 aa, Homo Sapiens
EIMDSFKDK

SEQ ID NO: 244489 - protein, 9 aa, Homo Sapiens
TEATGLSKT

SEQ ID NO: 244490 - protein, 9 aa, Homo Sapiens
RLAALQVTK

SEQ ID NO: 244491 - protein, 9 aa, Homo Sapiens
EKLGEGSYE

SEQ ID NO: 244492 - protein, 9 aa, Homo Sapiens
TNRAARNAV

SEQ ID NO: 244493 - protein, 9 aa, Homo Sapiens
LVNLIPEYE

SEQ ID NO: 244494 - protein, 9 aa, Homo Sapiens
AIRAMDRTS

SEQ ID NO: 244495 - protein, 9 aa, Homo Sapiens
NSLAAQHVE

SEQ ID NO: 244496 - protein, 9 aa, Homo Sapiens
NIQGYDAKS

SEQ ID NO: 244497 - protein, 9 aa, Homo Sapiens
LETPGELPS

SEQ ID NO: 244498 - protein, 9 aa, Homo Sapiens
RIKEPLHLF

SEQ ID NO: 244499 - protein, 9 aa, Homo Sapiens
QCNSLVRLC

SEQ ID NO: 244500 - protein, 9 aa, Homo Sapiens
LVGYVDSHP

SEQ ID NO: 244501 - protein, 9 aa, Homo Sapiens
IFFSFPHLL

SEQ ID NO: 244502 - protein, 9 aa, Homo Sapiens
LLTAIVSTH

SEQ ID NO: 244503 - protein, 9 aa, Homo Sapiens
TAESPISGL

SEQ ID NO: 244504 - protein, 9 aa, Homo Sapiens
DLDKVYLYP

SEQ ID NO: 244505 - protein, 9 aa, Homo Sapiens
TYNSVKAII

SEQ ID NO: 244506 - protein, 9 aa, Homo Sapiens
EYQAKDVIE

SEQ ID NO: 244507 - protein, 9 aa, Homo Sapiens
HRLPLPKQG

SEQ ID NO: 244508 - protein, 9 aa, Homo Sapiens
FVMQEEFSC

SEQ ID NO: 244509 - protein, 9 aa, Homo Sapiens
VFLGILHKC

SEQ ID NO: 244510 - protein, 9 aa, Homo Sapiens
YCTQELTVF

SEQ ID NO: 244511 - protein, 9 aa, Homo Sapiens
KVSMDGCKV

SEQ ID NO: 244512 - protein, 9 aa, Homo Sapiens
NRINEIQRI

SEQ ID NO: 244513 - protein, 9 aa, Homo Sapiens
VCQEGWNRF

SEQ ID NO: 244514 - protein, 9 aa, Homo Sapiens
EDAVEAILN

SEQ ID NO: 244515 - protein, 9 aa, Homo Sapiens
SSSICKYNA

SEQ ID NO: 244516 - protein, 9 aa, Homo Sapiens
DLQDLMLAS

SEQ ID NO: 244517 - protein, 9 aa, Homo Sapiens
SMITKIWWV

SEQ ID NO: 244518 - protein, 9 aa, Homo Sapiens
QSRMDWGKV

SEQ ID NO: 244519 - protein, 9 aa, Homo Sapiens
SRLCYDRIK

SEQ ID NO: 244520 - protein, 9 aa, Homo Sapiens
KVPDFLSGS

SEQ ID NO: 244521 - protein, 9 aa, Homo Sapiens
DECMIMSGG

SEQ ID NO: 244522 - protein, 9 aa, Homo Sapiens
ERESGVLKL

SEQ ID NO: 244523 - protein, 9 aa, Homo Sapiens
NNCFELWKL

SEQ ID NO: 244524 - protein, 9 aa, Homo Sapiens
CGFIQRFEM

SEQ ID NO: 244525 - protein, 9 aa, Homo Sapiens
WDKREWVKI

SEQ ID NO: 244526 - protein, 9 aa, Homo Sapiens
DPFLEVKME

SEQ ID NO: 244527 - protein, 9 aa, Homo Sapiens
KNGRLYKLL

SEQ ID NO: 244528 - protein, 9 aa, Homo Sapiens
ELSRMSRSD

SEQ ID NO: 244529 - protein, 9 aa, Homo Sapiens
FICIACFYG

SEQ ID NO: 244530 - protein, 9 aa, Homo Sapiens
SYVLRLNSV

SEQ ID NO: 244531 - protein, 9 aa, Homo Sapiens
GKMFSNTFF

SEQ ID NO: 244532 - protein, 9 aa, Homo Sapiens
LSELHVNYY

SEQ ID NO: 244533 - protein, 9 aa, Homo Sapiens
NNSLTELLL

SEQ ID NO: 244534 - protein, 9 aa, Homo Sapiens
LVQSSVDIN

SEQ ID NO: 244535 - protein, 9 aa, Homo Sapiens
QLDLTGISM

SEQ ID NO: 244536 - protein, 9 aa, Homo Sapiens
REFLKLQTR

SEQ ID NO: 244537 - protein, 9 aa, Homo Sapiens
PKYIIHFFR

SEQ ID NO: 244538 - protein, 9 aa, Homo Sapiens
SLIYDKLGE

SEQ ID NO: 244539 - protein, 9 aa, Homo Sapiens
NQTTRLKLQ

SEQ ID NO: 244540 - protein, 9 aa, Homo Sapiens
WFRSYRKEW

SEQ ID NO: 244541 - protein, 9 aa, Homo Sapiens
ELTIIALSH

SEQ ID NO: 244542 - protein, 9 aa, Homo Sapiens
NESTGSLGM

SEQ ID NO: 244543 - protein, 9 aa, Homo Sapiens
DLWIVGCIF

SEQ ID NO: 244544 - protein, 9 aa, Homo Sapiens
VLVHLQHDG

SEQ ID NO: 244545 - protein, 9 aa, Homo Sapiens
FFCDFVALL

SEQ ID NO: 244546 - protein, 9 aa, Homo Sapiens
LSNGDKSDQ

SEQ ID NO: 244547 - protein, 9 aa, Homo Sapiens
EQINKKIEK

SEQ ID NO: 244548 - protein, 9 aa, Homo Sapiens
TRLFQDRMI

SEQ ID NO: 244549 - protein, 9 aa, Homo Sapiens
RRRVEETLK

SEQ ID NO: 244550 - protein, 9 aa, Homo Sapiens
LCTERQKYW

SEQ ID NO: 244551 - protein, 9 aa, Homo Sapiens
DADGPTYGS

SEQ ID NO: 244552 - protein, 9 aa, Homo Sapiens
CTTSGNNFF

SEQ ID NO: 244553 - protein, 9 aa, Homo Sapiens
LFHTGISVL

SEQ ID NO: 244554 - protein, 9 aa, Homo Sapiens
TLRNKDVKT

SEQ ID NO: 244555 - protein, 9 aa, Homo Sapiens
CLGTFFISW

SEQ ID NO: 244556 - protein, 9 aa, Homo Sapiens
SGGPTSVYA

SEQ ID NO: 244557 - protein, 9 aa, Homo Sapiens
ECSDKLLSL

SEQ ID NO: 244558 - protein, 9 aa, Homo Sapiens
VVAANDIKW

SEQ ID NO: 244559 - protein, 9 aa, Homo Sapiens
AVNSQFPTS

SEQ ID NO: 244560 - protein, 9 aa, Homo Sapiens
DEMSSVQKK

SEQ ID NO: 244561 - protein, 9 aa, Homo Sapiens
NRPRKTSYL

SEQ ID NO: 244562 - protein, 9 aa, Homo Sapiens
RVLITVKQY

SEQ ID NO: 244563 - protein, 9 aa, Homo Sapiens
YIVPAILMG

SEQ ID NO: 244564 - protein, 9 aa, Homo Sapiens
IISCSPKTR

SEQ ID NO: 244565 - protein, 9 aa, Homo Sapiens
ADVEFYLSL

SEQ ID NO: 244566 - protein, 9 aa, Homo Sapiens
FMLKDDLKL

SEQ ID NO: 244567 - protein, 9 aa, Homo Sapiens
SQKAVCLFG

SEQ ID NO: 244568 - protein, 9 aa, Homo Sapiens
EPDLFSPSL

SEQ ID NO: 244569 - protein, 9 aa, Homo Sapiens
NCKHQIKIR

SEQ ID NO: 244570 - protein, 9 aa, Homo Sapiens
TGNRHVQIN

SEQ ID NO: 244571 - protein, 9 aa, Homo Sapiens
RVSFITQTP

SEQ ID NO: 244572 - protein, 9 aa, Homo Sapiens
EIISPGIRG

SEQ ID NO: 244573 - protein, 9 aa, Homo Sapiens
ISMTMRSFK

SEQ ID NO: 244574 - protein, 9 aa, Homo Sapiens
DNVPGEKKP

SEQ ID NO: 244575 - protein, 9 aa, Homo Sapiens
GGGHSYLFK

SEQ ID NO: 244576 - protein, 9 aa, Homo Sapiens
NPVVINFEM

SEQ ID NO: 244577 - protein, 9 aa, Homo Sapiens
MTHKNKDCF

SEQ ID NO: 244578 - protein, 9 aa, Homo Sapiens
CLNVLRLVQ

SEQ ID NO: 244579 - protein, 9 aa, Homo Sapiens
CGKTFQTQA

SEQ ID NO: 244580 - protein, 9 aa, Homo Sapiens
LGMDIDSRP

SEQ ID NO: 244581 - protein, 9 aa, Homo Sapiens
VTAAKFIQE

SEQ ID NO: 244582 - protein, 9 aa, Homo Sapiens
GAYSRVLAG

SEQ ID NO: 244583 - protein, 9 aa, Homo Sapiens
VESLKSHGI

SEQ ID NO: 244584 - protein, 9 aa, Homo Sapiens
TDSCDRYPT

SEQ ID NO: 244585 - protein, 9 aa, Homo Sapiens
ATTLINKAC

SEQ ID NO: 244586 - protein, 9 aa, Homo Sapiens
NVAQTAIRS

SEQ ID NO: 244587 - protein, 9 aa, Homo Sapiens
RIMDDNNNR

SEQ ID NO: 244588 - protein, 9 aa, Homo Sapiens
HRKKRRSTP

SEQ ID NO: 244589 - protein, 9 aa, Homo Sapiens
SFTPNYLQR

SEQ ID NO: 244590 - protein, 9 aa, Homo Sapiens
IEKTDTVEV

SEQ ID NO: 244591 - protein, 9 aa, Homo Sapiens
DFNTKILHT

SEQ ID NO: 244592 - protein, 9 aa, Homo Sapiens
ACPGCSSNS

SEQ ID NO: 244593 - protein, 9 aa, Homo Sapiens
WQPPDFLLV

SEQ ID NO: 244594 - protein, 9 aa, Homo Sapiens
FGTPVIANK

SEQ ID NO: 244595 - protein, 9 aa, Homo Sapiens
YSQHLEGKA

SEQ ID NO: 244596 - protein, 9 aa, Homo Sapiens
GTDIFLLTV

SEQ ID NO: 244597 - protein, 9 aa, Homo Sapiens
VLSSCRAEE

SEQ ID NO: 244598 - protein, 9 aa, Homo Sapiens
SHKRKGLPC

SEQ ID NO: 244599 - protein, 9 aa, Homo Sapiens
VSTSKPEVE

SEQ ID NO: 244600 - protein, 9 aa, Homo Sapiens
KSLSYTGEK

SEQ ID NO: 244601 - protein, 9 aa, Homo Sapiens
ENDFQCSTG

SEQ ID NO: 244602 - protein, 9 aa, Homo Sapiens
SAEKRKKYK

SEQ ID NO: 244603 - protein, 9 aa, Homo Sapiens
PESSATDYD

SEQ ID NO: 244604 - protein, 9 aa, Homo Sapiens
AQNVVQIQK

SEQ ID NO: 244605 - protein, 9 aa, Homo Sapiens
LRIIPLSDN

SEQ ID NO: 244606 - protein, 9 aa, Homo Sapiens
LALAKPPLP

SEQ ID NO: 244607 - protein, 9 aa, Homo Sapiens
SLNHHYHLT

SEQ ID NO: 244608 - protein, 9 aa, Homo Sapiens
FEDDDEWGD

SEQ ID NO: 244609 - protein, 9 aa, Homo Sapiens
QKNLPIAES

SEQ ID NO: 244610 - protein, 9 aa, Homo Sapiens
NNSFPYENG

SEQ ID NO: 244611 - protein, 9 aa, Homo Sapiens
AGEPRPYRP

SEQ ID NO: 244612 - protein, 9 aa, Homo Sapiens
AAFRLLSQD

SEQ ID NO: 244613 - protein, 9 aa, Homo Sapiens
PDMCVYQRG

SEQ ID NO: 244614 - protein, 9 aa, Homo Sapiens
PRVCYHERL

SEQ ID NO: 244615 - protein, 9 aa, Homo Sapiens
LDKKRKVKE

SEQ ID NO: 244616 - protein, 9 aa, Homo Sapiens
LLVGDLRAE

SEQ ID NO: 244617 - protein, 9 aa, Homo Sapiens
HLFIVGIYV

SEQ ID NO: 244618 - protein, 9 aa, Homo Sapiens
AKHRIKETD

SEQ ID NO: 244619 - protein, 9 aa, Homo Sapiens
FNEFPAPEQ

SEQ ID NO: 244620 - protein, 9 aa, Homo Sapiens
KREAENVCS

SEQ ID NO: 244621 - protein, 9 aa, Homo Sapiens
EQLALKGKL

SEQ ID NO: 244622 - protein, 9 aa, Homo Sapiens
LIDVFMGFI

SEQ ID NO: 244623 - protein, 9 aa, Homo Sapiens
NNRIHYRLQ

SEQ ID NO: 244624 - protein, 9 aa, Homo Sapiens
HPDLRSTIH

SEQ ID NO: 244625 - protein, 9 aa, Homo Sapiens
FEAYSMAKM

SEQ ID NO: 244626 - protein, 9 aa, Homo Sapiens
KCRKIDYSW

SEQ ID NO: 244627 - protein, 9 aa, Homo Sapiens
SRLPQTPKQ

SEQ ID NO: 244628 - protein, 9 aa, Homo Sapiens
KLCQENDYS

SEQ ID NO: 244629 - protein, 9 aa, Homo Sapiens
PFFHMAADT

SEQ ID NO: 244630 - protein, 9 aa, Homo Sapiens
LSFLGAALP

SEQ ID NO: 244631 - protein, 9 aa, Homo Sapiens
EITFDGKKR

SEQ ID NO: 244632 - protein, 9 aa, Homo Sapiens
NAYKEDPKL

SEQ ID NO: 244633 - protein, 9 aa, Homo Sapiens
SHLKAASNS

SEQ ID NO: 244634 - protein, 9 aa, Homo Sapiens
NFDKFLVGP

SEQ ID NO: 244635 - protein, 9 aa, Homo Sapiens
TLFYGTVMC

SEQ ID NO: 244636 - protein, 9 aa, Homo Sapiens
NKTSFFFEA

SEQ ID NO: 244637 - protein, 9 aa, Homo Sapiens
DFQTVTFKG

SEQ ID NO: 244638 - protein, 9 aa, Homo Sapiens
SGLWRALEQ

SEQ ID NO: 244639 - protein, 9 aa, Homo Sapiens
SRTVHLYDK

SEQ ID NO: 244640 - protein, 9 aa, Homo Sapiens
NDGDMHSSS

SEQ ID NO: 244641 - protein, 9 aa, Homo Sapiens
IQRQTPRLG

SEQ ID NO: 244642 - protein, 9 aa, Homo Sapiens
HITILKLVG

SEQ ID NO: 244643 - protein, 9 aa, Homo Sapiens
LIFQYGHLI

SEQ ID NO: 244644 - protein, 9 aa, Homo Sapiens
SQGRQDGSE

SEQ ID NO: 244645 - protein, 9 aa, Homo Sapiens
IRTSPTFQR

SEQ ID NO: 244646 - protein, 9 aa, Homo Sapiens
TSVKINDLS

SEQ ID NO: 244647 - protein, 9 aa, Homo Sapiens
VDCYLTEVG

SEQ ID NO: 244648 - protein, 9 aa, Homo Sapiens
AKKDSLDEE

SEQ ID NO: 244649 - protein, 9 aa, Homo Sapiens
QGPKGEQGY

SEQ ID NO: 244650 - protein, 9 aa, Homo Sapiens
VGSPYGSQP

SEQ ID NO: 244651 - protein, 9 aa, Homo Sapiens
LYNPYGPQT

SEQ ID NO: 244652 - protein, 9 aa, Homo Sapiens
NYRLPAGRP

SEQ ID NO: 244653 - protein, 9 aa, Homo Sapiens
FLSANVMYT

SEQ ID NO: 244654 - protein, 9 aa, Homo Sapiens
EAHCFIPQE

SEQ ID NO: 244655 - protein, 9 aa, Homo Sapiens
DTTPYLALL

SEQ ID NO: 244656 - protein, 9 aa, Homo Sapiens
APDKSVPDD

SEQ ID NO: 244657 - protein, 9 aa, Homo Sapiens
VGVGEEVGG

SEQ ID NO: 244658 - protein, 9 aa, Homo Sapiens
FGWSWFIPE

SEQ ID NO: 244659 - protein, 9 aa, Homo Sapiens
RRNKYMPQP

SEQ ID NO: 244660 - protein, 9 aa, Homo Sapiens
KWKVPDEIL

SEQ ID NO: 244661 - protein, 9 aa, Homo Sapiens
KIENKPLQQ

SEQ ID NO: 244662 - protein, 9 aa, Homo Sapiens
QTFPSFFKM

SEQ ID NO: 244663 - protein, 9 aa, Homo Sapiens
LRMIKSGSV

SEQ ID NO: 244664 - protein, 9 aa, Homo Sapiens
FVNQVLENT

SEQ ID NO: 244665 - protein, 9 aa, Homo Sapiens
LPGRVYDGK

SEQ ID NO: 244666 - protein, 9 aa, Homo Sapiens
RRVKGDKKK

SEQ ID NO: 244667 - protein, 9 aa, Homo Sapiens
TIGASVMTK

SEQ ID NO: 244668 - protein, 9 aa, Homo Sapiens
RSFPLLRYL

SEQ ID NO: 244669 - protein, 9 aa, Homo Sapiens
QGKRKNAIE

SEQ ID NO: 244670 - protein, 9 aa, Homo Sapiens
TGECSDKLL

SEQ ID NO: 244671 - protein, 9 aa, Homo Sapiens
VRTEIGVLI

SEQ ID NO: 244672 - protein, 9 aa, Homo Sapiens
DSPSAARGG

SEQ ID NO: 244673 - protein, 9 aa, Homo Sapiens
PDISLDERG

SEQ ID NO: 244674 - protein, 9 aa, Homo Sapiens
EWYKLRKAP

SEQ ID NO: 244675 - protein, 9 aa, Homo Sapiens
ITSEELSAL

SEQ ID NO: 244676 - protein, 9 aa, Homo Sapiens
LLVAAKKKD

SEQ ID NO: 244677 - protein, 9 aa, Homo Sapiens
QSRLGDRDF

SEQ ID NO: 244678 - protein, 9 aa, Homo Sapiens
LPFCCMYII

SEQ ID NO: 244679 - protein, 9 aa, Homo Sapiens
PPPDKVVVN

SEQ ID NO: 244680 - protein, 9 aa, Homo Sapiens
VEKAIKFVL

SEQ ID NO: 244681 - protein, 9 aa, Homo Sapiens
TCGCQITTC

SEQ ID NO: 244682 - protein, 9 aa, Homo Sapiens
DTLVKIYKH

SEQ ID NO: 244683 - protein, 9 aa, Homo Sapiens
MFSAIRSHH

SEQ ID NO: 244684 - protein, 9 aa, Homo Sapiens
TDYINKVKE

SEQ ID NO: 244685 - protein, 9 aa, Homo Sapiens
EKVVERELG

SEQ ID NO: 244686 - protein, 9 aa, Homo Sapiens
PVDNKIYRY

SEQ ID NO: 244687 - protein, 9 aa, Homo Sapiens
TNYFGHLAG

SEQ ID NO: 244688 - protein, 9 aa, Homo Sapiens
VFFNLVHLT

SEQ ID NO: 244689 - protein, 9 aa, Homo Sapiens
DNEYTTELK

SEQ ID NO: 244690 - protein, 9 aa, Homo Sapiens
SKYFSKYWK

SEQ ID NO: 244691 - protein, 9 aa, Homo Sapiens
GSDKRHCAR

SEQ ID NO: 244692 - protein, 9 aa, Homo Sapiens
MKPLYWTMI

SEQ ID NO: 244693 - protein, 9 aa, Homo Sapiens
DTFVEIGAH

SEQ ID NO: 244694 - protein, 9 aa, Homo Sapiens
SQRLQVVAC

SEQ ID NO: 244695 - protein, 9 aa, Homo Sapiens
PDHLNKLLE

SEQ ID NO: 244696 - protein, 9 aa, Homo Sapiens
LAKKINVHI

SEQ ID NO: 244697 - protein, 9 aa, Homo Sapiens
PLQTTSQAS

SEQ ID NO: 244698 - protein, 9 aa, Homo Sapiens
IVEGIIEED

SEQ ID NO: 244699 - protein, 9 aa, Homo Sapiens
PDEYQADGG

SEQ ID NO: 244700 - protein, 9 aa, Homo Sapiens
IFRDVNNHL

SEQ ID NO: 244701 - protein, 9 aa, Homo Sapiens
SSDWPKLFE

SEQ ID NO: 244702 - protein, 9 aa, Homo Sapiens
NGSETTGVA

SEQ ID NO: 244703 - protein, 9 aa, Homo Sapiens
PTAMIRPDH

SEQ ID NO: 244704 - protein, 9 aa, Homo Sapiens
VRRICSLQR

SEQ ID NO: 244705 - protein, 9 aa, Homo Sapiens
DYRKRKYLE

SEQ ID NO: 244706 - protein, 9 aa, Homo Sapiens
TSEENNSEN

SEQ ID NO: 244707 - protein, 9 aa, Homo Sapiens
LPVCPDTMV

SEQ ID NO: 244708 - protein, 9 aa, Homo Sapiens
FNMVPRAAE

SEQ ID NO: 244709 - protein, 9 aa, Homo Sapiens
ENAPVNTQL

SEQ ID NO: 244710 - protein, 9 aa, Homo Sapiens
IKILTTSNL

SEQ ID NO: 244711 - protein, 9 aa, Homo Sapiens
AINKNLIDR

SEQ ID NO: 244712 - protein, 9 aa, Homo Sapiens
VVGQYTQLV

SEQ ID NO: 244713 - protein, 9 aa, Homo Sapiens
CEYVSQHLG

SEQ ID NO: 244714 - protein, 9 aa, Homo Sapiens
GLLAAIKEA

SEQ ID NO: 244715 - protein, 9 aa, Homo Sapiens
STPVTPVIR

SEQ ID NO: 244716 - protein, 9 aa, Homo Sapiens
LIQDEDYML

SEQ ID NO: 244717 - protein, 9 aa, Homo Sapiens
LMQSDNLCS

SEQ ID NO: 244718 - protein, 9 aa, Homo Sapiens
QHNKKVEEN

SEQ ID NO: 244719 - protein, 9 aa, Homo Sapiens
ALTQNRMTV

SEQ ID NO: 244720 - protein, 9 aa, Homo Sapiens
RVPGPGQYM

SEQ ID NO: 244721 - protein, 9 aa, Homo Sapiens
ADPDNLSEE

SEQ ID NO: 244722 - protein, 9 aa, Homo Sapiens
AELYPHIVS

SEQ ID NO: 244723 - protein, 9 aa, Homo Sapiens
MIADGAPEL

SEQ ID NO: 244724 - protein, 9 aa, Homo Sapiens
WTWISFEKE

SEQ ID NO: 244725 - protein, 9 aa, Homo Sapiens
RFTRPLTMT

SEQ ID NO: 244726 - protein, 9 aa, Homo Sapiens
LVFLNAKTF

SEQ ID NO: 244727 - protein, 9 aa, Homo Sapiens
EEAKIIGIK

SEQ ID NO: 244728 - protein, 9 aa, Homo Sapiens
NVLYFSRYG

SEQ ID NO: 244729 - protein, 9 aa, Homo Sapiens
TEKLGLIAP

SEQ ID NO: 244730 - protein, 9 aa, Homo Sapiens
VQRSIRLMS

SEQ ID NO: 244731 - protein, 9 aa, Homo Sapiens
KKIPSLCYS

SEQ ID NO: 244732 - protein, 9 aa, Homo Sapiens
CETAKKNHD

SEQ ID NO: 244733 - protein, 9 aa, Homo Sapiens
RQQWCFDQI

SEQ ID NO: 244734 - protein, 9 aa, Homo Sapiens
GLFILANAL

SEQ ID NO: 244735 - protein, 9 aa, Homo Sapiens
VKPKRQKLR

SEQ ID NO: 244736 - protein, 9 aa, Homo Sapiens
ESITASLGT

SEQ ID NO: 244737 - protein, 9 aa, Homo Sapiens
DIYRPLDPK

SEQ ID NO: 244738 - protein, 9 aa, Homo Sapiens
VVLDSSQGH

SEQ ID NO: 244739 - protein, 9 aa, Homo Sapiens
STKHPGASI

SEQ ID NO: 244740 - protein, 9 aa, Homo Sapiens
DGNKQDTNS

SEQ ID NO: 244741 - protein, 9 aa, Homo Sapiens
DDCSDVESS

SEQ ID NO: 244742 - protein, 9 aa, Homo Sapiens
DKYEEVLHN

SEQ ID NO: 244743 - protein, 9 aa, Homo Sapiens
DFYFSEAPM

SEQ ID NO: 244744 - protein, 9 aa, Homo Sapiens
IPSKAFASP

SEQ ID NO: 244745 - protein, 9 aa, Homo Sapiens
SMYQRLQGN

SEQ ID NO: 244746 - protein, 9 aa, Homo Sapiens
TLVFFLNSG

SEQ ID NO: 244747 - protein, 9 aa, Homo Sapiens
TVYRLDDYD

SEQ ID NO: 244748 - protein, 9 aa, Homo Sapiens
MNHIALGSR

SEQ ID NO: 244749 - protein, 9 aa, Homo Sapiens
VNYNLLKHI

SEQ ID NO: 244750 - protein, 9 aa, Homo Sapiens
REEKHCMCR

SEQ ID NO: 244751 - protein, 9 aa, Homo Sapiens
NKLIQNQDC

SEQ ID NO: 244752 - protein, 9 aa, Homo Sapiens
FGTVRDTLD

SEQ ID NO: 244753 - protein, 9 aa, Homo Sapiens
RDNRRRVEE

SEQ ID NO: 244754 - protein, 9 aa, Homo Sapiens
IAQRFCDNI

SEQ ID NO: 244755 - protein, 9 aa, Homo Sapiens
SEMLAINQV

SEQ ID NO: 244756 - protein, 9 aa, Homo Sapiens
MNKFQGSVT

SEQ ID NO: 244757 - protein, 9 aa, Homo Sapiens
KEVFRAPGT

SEQ ID NO: 244758 - protein, 9 aa, Homo Sapiens
WYKQDSNKF

SEQ ID NO: 244759 - protein, 9 aa, Homo Sapiens
YRIRYRCSD

SEQ ID NO: 244760 - protein, 9 aa, Homo Sapiens
LSDLKALQG

SEQ ID NO: 244761 - protein, 9 aa, Homo Sapiens
GPTYGSSAR

SEQ ID NO: 244762 - protein, 9 aa, Homo Sapiens
HSLLVAAKK

SEQ ID NO: 244763 - protein, 9 aa, Homo Sapiens
ERLTLIQMT

SEQ ID NO: 244764 - protein, 9 aa, Homo Sapiens
FGYPGETED

SEQ ID NO: 244765 - protein, 9 aa, Homo Sapiens
VIMVELFMR

SEQ ID NO: 244766 - protein, 9 aa, Homo Sapiens
AIKRINLDK

SEQ ID NO: 244767 - protein, 9 aa, Homo Sapiens
ILSWSQNFD

SEQ ID NO: 244768 - protein, 9 aa, Homo Sapiens
GWRRAVWEN

SEQ ID NO: 244769 - protein, 9 aa, Homo Sapiens
YAYMNFITP

SEQ ID NO: 244770 - protein, 9 aa, Homo Sapiens
WQEAHGRLA

SEQ ID NO: 244771 - protein, 9 aa, Homo Sapiens
ADTITDEIN

SEQ ID NO: 244772 - protein, 9 aa, Homo Sapiens
GLPTPIMYW

SEQ ID NO: 244773 - protein, 9 aa, Homo Sapiens
IHEKVFSPL

SEQ ID NO: 244774 - protein, 9 aa, Homo Sapiens
LFCKDEGQL

SEQ ID NO: 244775 - protein, 9 aa, Homo Sapiens
TLGALLSIL

SEQ ID NO: 244776 - protein, 9 aa, Homo Sapiens
PLYDKGDVI

SEQ ID NO: 244777 - protein, 9 aa, Homo Sapiens
DHTVLIQTR

SEQ ID NO: 244778 - protein, 9 aa, Homo Sapiens
QTHCYRAAL

SEQ ID NO: 244779 - protein, 9 aa, Homo Sapiens
SSRSPNPRV

SEQ ID NO: 244780 - protein, 9 aa, Homo Sapiens
EKEQESPDK

SEQ ID NO: 244781 - protein, 9 aa, Homo Sapiens
TNYNEIHKN

SEQ ID NO: 244782 - protein, 9 aa, Homo Sapiens
LAQVYKQSD

SEQ ID NO: 244783 - protein, 9 aa, Homo Sapiens
TEPFQERIS

SEQ ID NO: 244784 - protein, 9 aa, Homo Sapiens
SLLSNDLVA

SEQ ID NO: 244785 - protein, 9 aa, Homo Sapiens
CEDAEDDCE

SEQ ID NO: 244786 - protein, 9 aa, Homo Sapiens
NVNFEKPKL

SEQ ID NO: 244787 - protein, 9 aa, Homo Sapiens
GPGRSRKGR

SEQ ID NO: 244788 - protein, 9 aa, Homo Sapiens
PSKRSHHSP

SEQ ID NO: 244789 - protein, 9 aa, Homo Sapiens
LASFILVFC

SEQ ID NO: 244790 - protein, 9 aa, Homo Sapiens
EKMFEFLED

SEQ ID NO: 244791 - protein, 9 aa, Homo Sapiens
TMNEQDFCK

SEQ ID NO: 244792 - protein, 9 aa, Homo Sapiens
WTLCGSSGP

SEQ ID NO: 244793 - protein, 9 aa, Homo Sapiens
AFYSLKSLK

SEQ ID NO: 244794 - protein, 9 aa, Homo Sapiens
RSLIQASGL

SEQ ID NO: 244795 - protein, 9 aa, Homo Sapiens
SLNFRVKFV

SEQ ID NO: 244796 - protein, 9 aa, Homo Sapiens
RAKIIITYI

SEQ ID NO: 244797 - protein, 9 aa, Homo Sapiens
NCTLLGLRD

SEQ ID NO: 244798 - protein, 9 aa, Homo Sapiens
STLMSRRFC

SEQ ID NO: 244799 - protein, 9 aa, Homo Sapiens
EYRLMIFKL

SEQ ID NO: 244800 - protein, 9 aa, Homo Sapiens
DMLKAGATA

SEQ ID NO: 244801 - protein, 9 aa, Homo Sapiens
VDTAVLFLH

SEQ ID NO: 244802 - protein, 9 aa, Homo Sapiens
MTDAVRVVF

SEQ ID NO: 244803 - protein, 9 aa, Homo Sapiens
FGMRKENVF

SEQ ID NO: 244804 - protein, 9 aa, Homo Sapiens
LGMQGRLCN

SEQ ID NO: 244805 - protein, 9 aa, Homo Sapiens
SLLGLLSQT

SEQ ID NO: 244806 - protein, 9 aa, Homo Sapiens
KKMLDKARA

SEQ ID NO: 244807 - protein, 9 aa, Homo Sapiens
SERGPQMCR

SEQ ID NO: 244808 - protein, 9 aa, Homo Sapiens
DIPQYIHIL

SEQ ID NO: 244809 - protein, 9 aa, Homo Sapiens
RKDLLCHDP

SEQ ID NO: 244810 - protein, 9 aa, Homo Sapiens
TSLAHQSVE

SEQ ID NO: 244811 - protein, 9 aa, Homo Sapiens
SQVVLGVCA

SEQ ID NO: 244812 - protein, 9 aa, Homo Sapiens
QPIDKTAGK

SEQ ID NO: 244813 - protein, 9 aa, Homo Sapiens
EIKKEKNIN

SEQ ID NO: 244814 - protein, 9 aa, Homo Sapiens
RYGNLSHVN

SEQ ID NO: 244815 - protein, 9 aa, Homo Sapiens
INIVAYYHS

SEQ ID NO: 244816 - protein, 9 aa, Homo Sapiens
TTSLPPNTV

SEQ ID NO: 244817 - protein, 9 aa, Homo Sapiens
NLSSACGIA

SEQ ID NO: 244818 - protein, 9 aa, Homo Sapiens
NVLSLSLVF

SEQ ID NO: 244819 - protein, 9 aa, Homo Sapiens
ECKDLIKCM

SEQ ID NO: 244820 - protein, 9 aa, Homo Sapiens
FEKNGGGFM

SEQ ID NO: 244821 - protein, 9 aa, Homo Sapiens
PIQNNLTFD

SEQ ID NO: 244822 - protein, 9 aa, Homo Sapiens
LVNPEPSTY

SEQ ID NO: 244823 - protein, 9 aa, Homo Sapiens
VEFYLSLTQ

SEQ ID NO: 244824 - protein, 9 aa, Homo Sapiens
FFTICNYFD

SEQ ID NO: 244825 - protein, 9 aa, Homo Sapiens
VNYLRKIIG

SEQ ID NO: 244826 - protein, 9 aa, Homo Sapiens
ISMFLSVCE

SEQ ID NO: 244827 - protein, 9 aa, Homo Sapiens
TGLCLTLLL

SEQ ID NO: 244828 - protein, 9 aa, Homo Sapiens
GGGPGKSPA

SEQ ID NO: 244829 - protein, 9 aa, Homo Sapiens
AFLDENFKQ

SEQ ID NO: 244830 - protein, 9 aa, Homo Sapiens
GLFTHTSFY

SEQ ID NO: 244831 - protein, 9 aa, Homo Sapiens
AQNNYFNIL

SEQ ID NO: 244832 - protein, 9 aa, Homo Sapiens
GEQFHLFCK

SEQ ID NO: 244833 - protein, 9 aa, Homo Sapiens
YLIKILTTS

SEQ ID NO: 244834 - protein, 9 aa, Homo Sapiens
ESGNWSHCS

SEQ ID NO: 244835 - protein, 9 aa, Homo Sapiens
MSAIFKFQS

SEQ ID NO: 244836 - protein, 9 aa, Homo Sapiens
LSAFLEQQQ

SEQ ID NO: 244837 - protein, 9 aa, Homo Sapiens
TYQLRNDSN

SEQ ID NO: 244838 - protein, 9 aa, Homo Sapiens
SARRAPQDF

SEQ ID NO: 244839 - protein, 9 aa, Homo Sapiens
KQKKVIASR

SEQ ID NO: 244840 - protein, 9 aa, Homo Sapiens
GHEMEKEYE

SEQ ID NO: 244841 - protein, 9 aa, Homo Sapiens
EYFKERDPL

SEQ ID NO: 244842 - protein, 9 aa, Homo Sapiens
AAGHEGSWF

SEQ ID NO: 244843 - protein, 9 aa, Homo Sapiens
TGENNLPCA

SEQ ID NO: 244844 - protein, 9 aa, Homo Sapiens
LCPRPDEVE

SEQ ID NO: 244845 - protein, 9 aa, Homo Sapiens
DLGEDDEYA

SEQ ID NO: 244846 - protein, 9 aa, Homo Sapiens
IKNFGEYMD

SEQ ID NO: 244847 - protein, 9 aa, Homo Sapiens
EDSGGGDND

SEQ ID NO: 244848 - protein, 9 aa, Homo Sapiens
MMEILSETK

SEQ ID NO: 244849 - protein, 9 aa, Homo Sapiens
LNNARAQQG

SEQ ID NO: 244850 - protein, 9 aa, Homo Sapiens
PPTEEFEVL

SEQ ID NO: 244851 - protein, 9 aa, Homo Sapiens
GKAFSQIIH

SEQ ID NO: 244852 - protein, 9 aa, Homo Sapiens
LPCVGPGPP

SEQ ID NO: 244853 - protein, 9 aa, Homo Sapiens
RYLCSDGRL

SEQ ID NO: 244854 - protein, 9 aa, Homo Sapiens
EKIHVNEIT

SEQ ID NO: 244855 - protein, 9 aa, Homo Sapiens
FNQLNEEVT

SEQ ID NO: 244856 - protein, 9 aa, Homo Sapiens
LDPQVPAKD

SEQ ID NO: 244857 - protein, 9 aa, Homo Sapiens
RPQAPPPSG

SEQ ID NO: 244858 - protein, 9 aa, Homo Sapiens
NMSDWEVQS

SEQ ID NO: 244859 - protein, 9 aa, Homo Sapiens
KTERKIWDS

SEQ ID NO: 244860 - protein, 9 aa, Homo Sapiens
QRKLHLFKD

SEQ ID NO: 244861 - protein, 9 aa, Homo Sapiens
LEKRRRATA

SEQ ID NO: 244862 - protein, 9 aa, Homo Sapiens
LITHTKEKP

SEQ ID NO: 244863 - protein, 9 aa, Homo Sapiens
KKWCHGLGP

SEQ ID NO: 244864 - protein, 9 aa, Homo Sapiens
QIHRMNENS

SEQ ID NO: 244865 - protein, 9 aa, Homo Sapiens
PDYFFKEVN

SEQ ID NO: 244866 - protein, 9 aa, Homo Sapiens
RCPLQRLLD

SEQ ID NO: 244867 - protein, 9 aa, Homo Sapiens
TLSRRLDDL

SEQ ID NO: 244868 - protein, 9 aa, Homo Sapiens
WRRAVWENN

SEQ ID NO: 244869 - protein, 9 aa, Homo Sapiens
RLDRRENDE

SEQ ID NO: 244870 - protein, 9 aa, Homo Sapiens
HDLSWSMLL

SEQ ID NO: 244871 - protein, 9 aa, Homo Sapiens
KKKYGDEIN

SEQ ID NO: 244872 - protein, 9 aa, Homo Sapiens
LAKNMMISL

SEQ ID NO: 244873 - protein, 9 aa, Homo Sapiens
AGGLVFNTG

SEQ ID NO: 244874 - protein, 9 aa, Homo Sapiens
FEDFVRIVD

SEQ ID NO: 244875 - protein, 9 aa, Homo Sapiens
GAPTPKIIE

SEQ ID NO: 244876 - protein, 9 aa, Homo Sapiens
HATLDIVET

SEQ ID NO: 244877 - protein, 9 aa, Homo Sapiens
AIGFHSVKP

SEQ ID NO: 244878 - protein, 9 aa, Homo Sapiens
IFEKINASL

SEQ ID NO: 244879 - protein, 9 aa, Homo Sapiens
FHCESSVHW

SEQ ID NO: 244880 - protein, 9 aa, Homo Sapiens
QQSTTFPNN

SEQ ID NO: 244881 - protein, 9 aa, Homo Sapiens
GQVVEHLMN

SEQ ID NO: 244882 - protein, 9 aa, Homo Sapiens
ALYIIYMPG

SEQ ID NO: 244883 - protein, 9 aa, Homo Sapiens
QHERCHTGN

SEQ ID NO: 244884 - protein, 9 aa, Homo Sapiens
SPVLSQVGH

SEQ ID NO: 244885 - protein, 9 aa, Homo Sapiens
SFSEYLGAI

SEQ ID NO: 244886 - protein, 9 aa, Homo Sapiens
NGQLKEALD

SEQ ID NO: 244887 - protein, 9 aa, Homo Sapiens
REKGLRTAG

SEQ ID NO: 244888 - protein, 9 aa, Homo Sapiens
HEARDTHHS

SEQ ID NO: 244889 - protein, 9 aa, Homo Sapiens
KHKKICLRC

SEQ ID NO: 244890 - protein, 9 aa, Homo Sapiens
GLNEIISDP

SEQ ID NO: 244891 - protein, 9 aa, Homo Sapiens
CSQEGNDYL

SEQ ID NO: 244892 - protein, 9 aa, Homo Sapiens
QLLQNQIVT

SEQ ID NO: 244893 - protein, 9 aa, Homo Sapiens
KRKKEQPTS

SEQ ID NO: 244894 - protein, 9 aa, Homo Sapiens
QHQIIHFLE

SEQ ID NO: 244895 - protein, 9 aa, Homo Sapiens
TKDYFMSKA

SEQ ID NO: 244896 - protein, 9 aa, Homo Sapiens
NLYRIGRLT

SEQ ID NO: 244897 - protein, 9 aa, Homo Sapiens
FNQRTTLII

SEQ ID NO: 244898 - protein, 9 aa, Homo Sapiens
SEQLEQVKR

SEQ ID NO: 244899 - protein, 9 aa, Homo Sapiens
FHDSLKKIV

SEQ ID NO: 244900 - protein, 9 aa, Homo Sapiens
DAESWYRSK

SEQ ID NO: 244901 - protein, 9 aa, Homo Sapiens
SPAGPDKPR

SEQ ID NO: 244902 - protein, 9 aa, Homo Sapiens
PCFDYSQQY

SEQ ID NO: 244903 - protein, 9 aa, Homo Sapiens
VDGIWLLGT

SEQ ID NO: 244904 - protein, 9 aa, Homo Sapiens
PGLNEIISD

SEQ ID NO: 244905 - protein, 9 aa, Homo Sapiens
QLDPKPHVS

SEQ ID NO: 244906 - protein, 9 aa, Homo Sapiens
PVKIGIPLF

SEQ ID NO: 244907 - protein, 9 aa, Homo Sapiens
QELSREQAG

SEQ ID NO: 244908 - protein, 9 aa, Homo Sapiens
GFKDKLSSI

SEQ ID NO: 244909 - protein, 9 aa, Homo Sapiens
PQERIEASN

SEQ ID NO: 244910 - protein, 9 aa, Homo Sapiens
FEEYKEKCF

SEQ ID NO: 244911 - protein, 9 aa, Homo Sapiens
SSYDIGNVT

SEQ ID NO: 244912 - protein, 9 aa, Homo Sapiens
LSKKTLLHF

SEQ ID NO: 244913 - protein, 9 aa, Homo Sapiens
SACMAEILY

SEQ ID NO: 244914 - protein, 9 aa, Homo Sapiens
KKEGKMYRL

SEQ ID NO: 244915 - protein, 9 aa, Homo Sapiens
ALNVLKYEE

SEQ ID NO: 244916 - protein, 9 aa, Homo Sapiens
SAQENYNAP

SEQ ID NO: 244917 - protein, 9 aa, Homo Sapiens
NAIQRSLEP

SEQ ID NO: 244918 - protein, 9 aa, Homo Sapiens
PVRGVYSFW

SEQ ID NO: 244919 - protein, 9 aa, Homo Sapiens
TTYLKTIAL

SEQ ID NO: 244920 - protein, 9 aa, Homo Sapiens
QAGDLGTEQ

SEQ ID NO: 244921 - protein, 9 aa, Homo Sapiens
PGAAHGISS

SEQ ID NO: 244922 - protein, 9 aa, Homo Sapiens
QVIDRLEEV

SEQ ID NO: 244923 - protein, 9 aa, Homo Sapiens
DKTERKIWD

SEQ ID NO: 244924 - protein, 9 aa, Homo Sapiens
HSHNDKTKG

SEQ ID NO: 244925 - protein, 9 aa, Homo Sapiens
KQMQEVYNF

SEQ ID NO: 244926 - protein, 9 aa, Homo Sapiens
FLLQSIQAV

SEQ ID NO: 244927 - protein, 9 aa, Homo Sapiens
WDQEFDPVV

SEQ ID NO: 244928 - protein, 9 aa, Homo Sapiens
EPCNMKRHV

SEQ ID NO: 244929 - protein, 9 aa, Homo Sapiens
RTAVAEFII

SEQ ID NO: 244930 - protein, 9 aa, Homo Sapiens
KNFLYIKSV

SEQ ID NO: 244931 - protein, 9 aa, Homo Sapiens
TNFTLAKLG

SEQ ID NO: 244932 - protein, 9 aa, Homo Sapiens
PSSALVQQL

SEQ ID NO: 244933 - protein, 9 aa, Homo Sapiens
GVQKLGCWN

SEQ ID NO: 244934 - protein, 9 aa, Homo Sapiens
QHQNIHTGV

SEQ ID NO: 244935 - protein, 9 aa, Homo Sapiens
DMSVILEQD

SEQ ID NO: 244936 - protein, 9 aa, Homo Sapiens
LAFWIISIT

SEQ ID NO: 244937 - protein, 9 aa, Homo Sapiens
CYPFVQANQ

SEQ ID NO: 244938 - protein, 9 aa, Homo Sapiens
VPPDLQNKV

SEQ ID NO: 244939 - protein, 9 aa, Homo Sapiens
NFILEVEKS

SEQ ID NO: 244940 - protein, 9 aa, Homo Sapiens
YNPEGTLLG

SEQ ID NO: 244941 - protein, 9 aa, Homo Sapiens
LMRVVQSVN

SEQ ID NO: 244942 - protein, 9 aa, Homo Sapiens
KHHVIQKHS

SEQ ID NO: 244943 - protein, 9 aa, Homo Sapiens
NGAIDFVLW

SEQ ID NO: 244944 - protein, 9 aa, Homo Sapiens
ERELGALLE

SEQ ID NO: 244945 - protein, 9 aa, Homo Sapiens
SQAVAHYKG

SEQ ID NO: 244946 - protein, 9 aa, Homo Sapiens
QLVKVDGGE

SEQ ID NO: 244947 - protein, 9 aa, Homo Sapiens
CKDCGIMDD

SEQ ID NO: 244948 - protein, 9 aa, Homo Sapiens
LLPEEHPSV

SEQ ID NO: 244949 - protein, 9 aa, Homo Sapiens
SEIMAYYSG

SEQ ID NO: 244950 - protein, 9 aa, Homo Sapiens
LDPGRLTSH

SEQ ID NO: 244951 - protein, 9 aa, Homo Sapiens
EVEQFMKEL

SEQ ID NO: 244952 - protein, 9 aa, Homo Sapiens
FGHNVEDER

SEQ ID NO: 244953 - protein, 9 aa, Homo Sapiens
VRADSMRNQ

SEQ ID NO: 244954 - protein, 9 aa, Homo Sapiens
YSIRDEWIF

SEQ ID NO: 244955 - protein, 9 aa, Homo Sapiens
RPHVLMPEV

SEQ ID NO: 244956 - protein, 9 aa, Homo Sapiens
RCIKEEDTP

SEQ ID NO: 244957 - protein, 9 aa, Homo Sapiens
NTMVNNLSS

SEQ ID NO: 244958 - protein, 9 aa, Homo Sapiens
SVSEAINKN

SEQ ID NO: 244959 - protein, 9 aa, Homo Sapiens
RGISSEGVF

SEQ ID NO: 244960 - protein, 9 aa, Homo Sapiens
VILYFFSDC

SEQ ID NO: 244961 - protein, 9 aa, Homo Sapiens
PDVDEETGI

SEQ ID NO: 244962 - protein, 9 aa, Homo Sapiens
GSGENGWVV

SEQ ID NO: 244963 - protein, 9 aa, Homo Sapiens
TREQYPNTF

SEQ ID NO: 244964 - protein, 9 aa, Homo Sapiens
LAFNAFDAL

SEQ ID NO: 244965 - protein, 9 aa, Homo Sapiens
LVPVQVKQE

SEQ ID NO: 244966 - protein, 9 aa, Homo Sapiens
FSTLIFEGR

SEQ ID NO: 244967 - protein, 9 aa, Homo Sapiens
SQRLESLQE

SEQ ID NO: 244968 - protein, 9 aa, Homo Sapiens
PQFCSKKLF

SEQ ID NO: 244969 - protein, 9 aa, Homo Sapiens
EKFEGWYFH

SEQ ID NO: 244970 - protein, 9 aa, Homo Sapiens
EELGRGVQK

SEQ ID NO: 244971 - protein, 9 aa, Homo Sapiens
FSDDMAFRL

SEQ ID NO: 244972 - protein, 9 aa, Homo Sapiens
FVPNEKKPE

SEQ ID NO: 244973 - protein, 9 aa, Homo Sapiens
HCMVTSVQE

SEQ ID NO: 244974 - protein, 9 aa, Homo Sapiens
VLGLQRYVS

SEQ ID NO: 244975 - protein, 9 aa, Homo Sapiens
RKNSAILEN

SEQ ID NO: 244976 - protein, 9 aa, Homo Sapiens
CLEQNNTTE

SEQ ID NO: 244977 - protein, 9 aa, Homo Sapiens
FALVEDKVL

SEQ ID NO: 244978 - protein, 9 aa, Homo Sapiens
KACLLLRSI

SEQ ID NO: 244979 - protein, 9 aa, Homo Sapiens
SNHTRMGRH

SEQ ID NO: 244980 - protein, 9 aa, Homo Sapiens
NEWGPGESY

SEQ ID NO: 244981 - protein, 9 aa, Homo Sapiens
DYINDMNAS

SEQ ID NO: 244982 - protein, 9 aa, Homo Sapiens
VLVFVPYLY

SEQ ID NO: 244983 - protein, 9 aa, Homo Sapiens
EEVDKDYQK

SEQ ID NO: 244984 - protein, 9 aa, Homo Sapiens
VDHAAAFGI

SEQ ID NO: 244985 - protein, 9 aa, Homo Sapiens
RLFELFVLL

SEQ ID NO: 244986 - protein, 9 aa, Homo Sapiens
HANTPLPAW

SEQ ID NO: 244987 - protein, 9 aa, Homo Sapiens
AALAAEDPV

SEQ ID NO: 244988 - protein, 9 aa, Homo Sapiens
HPHPREGQK

SEQ ID NO: 244989 - protein, 9 aa, Homo Sapiens
VYLFCADHK

SEQ ID NO: 244990 - protein, 9 aa, Homo Sapiens
ARKWSSRPG

SEQ ID NO: 244991 - protein, 9 aa, Homo Sapiens
RSQSCEEQA

SEQ ID NO: 244992 - protein, 9 aa, Homo Sapiens
TVINSECSQ

SEQ ID NO: 244993 - protein, 9 aa, Homo Sapiens
CDACLNGNF

SEQ ID NO: 244994 - protein, 9 aa, Homo Sapiens
SRNFGSYVT

SEQ ID NO: 244995 - protein, 9 aa, Homo Sapiens
NELMRGIHS

SEQ ID NO: 244996 - protein, 9 aa, Homo Sapiens
IPTFLLQSI

SEQ ID NO: 244997 - protein, 9 aa, Homo Sapiens
LQTFYMASN

SEQ ID NO: 244998 - protein, 9 aa, Homo Sapiens
EPEDNSKIS

SEQ ID NO: 244999 - protein, 9 aa, Homo Sapiens
TRSRADAES

SEQ ID NO: 245000 - protein, 9 aa, Homo Sapiens
CRQIVSAVQ

SEQ ID NO: 245001 - protein, 9 aa, Homo Sapiens
HNGSMVGSD

SEQ ID NO: 245002 - protein, 9 aa, Homo Sapiens
LMNVTATYT

SEQ ID NO: 245003 - protein, 9 aa, Homo Sapiens
HCHQHMVGR

SEQ ID NO: 245004 - protein, 9 aa, Homo Sapiens
EDPTEVTPE

SEQ ID NO: 245005 - protein, 9 aa, Homo Sapiens
RVVQNFEHL

SEQ ID NO: 245006 - protein, 9 aa, Homo Sapiens
PLIDMLVYF

SEQ ID NO: 245007 - protein, 9 aa, Homo Sapiens
PPAGDGNKP

SEQ ID NO: 245008 - protein, 9 aa, Homo Sapiens
RLRASLERV

SEQ ID NO: 245009 - protein, 9 aa, Homo Sapiens
TQPQPSTNM

SEQ ID NO: 245010 - protein, 9 aa, Homo Sapiens
TVLKECIRL

SEQ ID NO: 245011 - protein, 9 aa, Homo Sapiens
GVLPDCNMS

SEQ ID NO: 245012 - protein, 9 aa, Homo Sapiens
DTICINYSR

SEQ ID NO: 245013 - protein, 9 aa, Homo Sapiens
YRTLSGIIE

SEQ ID NO: 245014 - protein, 9 aa, Homo Sapiens
TWPSPALTL

SEQ ID NO: 245015 - protein, 9 aa, Homo Sapiens
SEVEIARFI

SEQ ID NO: 245016 - protein, 9 aa, Homo Sapiens
VKEIHYRKD

SEQ ID NO: 245017 - protein, 9 aa, Homo Sapiens
LAFPCNQLG

SEQ ID NO: 245018 - protein, 9 aa, Homo Sapiens
KEDILELIK

SEQ ID NO: 245019 - protein, 9 aa, Homo Sapiens
FIDKTFVVQ

SEQ ID NO: 245020 - protein, 9 aa, Homo Sapiens
AVKYFVIIP

SEQ ID NO: 245021 - protein, 9 aa, Homo Sapiens
KIETSLRES

SEQ ID NO: 245022 - protein, 9 aa, Homo Sapiens
FVNSQIDRE

SEQ ID NO: 245023 - protein, 9 aa, Homo Sapiens
KDKKPYCQK

SEQ ID NO: 245024 - protein, 9 aa, Homo Sapiens
LEIDFIGMF

SEQ ID NO: 245025 - protein, 9 aa, Homo Sapiens
TTVEESFKN

SEQ ID NO: 245026 - protein, 9 aa, Homo Sapiens
KRENKDLHD

SEQ ID NO: 245027 - protein, 9 aa, Homo Sapiens
FLLDENYLG

SEQ ID NO: 245028 - protein, 9 aa, Homo Sapiens
HNRIHTGER

SEQ ID NO: 245029 - protein, 9 aa, Homo Sapiens
TLTQNRITV

SEQ ID NO: 245030 - protein, 9 aa, Homo Sapiens
MGIKPSKGV

SEQ ID NO: 245031 - protein, 9 aa, Homo Sapiens
ESFEEESEI

SEQ ID NO: 245032 - protein, 9 aa, Homo Sapiens
RHRVQTEKH

SEQ ID NO: 245033 - protein, 9 aa, Homo Sapiens
LHYYSIMNR

SEQ ID NO: 245034 - protein, 9 aa, Homo Sapiens
LPGPKEPAL

SEQ ID NO: 245035 - protein, 9 aa, Homo Sapiens
KNYSAVIQR

SEQ ID NO: 245036 - protein, 9 aa, Homo Sapiens
SLSQTCCTD

SEQ ID NO: 245037 - protein, 9 aa, Homo Sapiens
ALDPTDCGP

SEQ ID NO: 245038 - protein, 9 aa, Homo Sapiens
LTSIYEIKP

SEQ ID NO: 245039 - protein, 9 aa, Homo Sapiens
GKHWLGNEV

SEQ ID NO: 245040 - protein, 9 aa, Homo Sapiens
FCAILHHFI

SEQ ID NO: 245041 - protein, 9 aa, Homo Sapiens
KEALASNLY

SEQ ID NO: 245042 - protein, 9 aa, Homo Sapiens
KFPKEKKRN

SEQ ID NO: 245043 - protein, 9 aa, Homo Sapiens
KTKETKRLR

SEQ ID NO: 245044 - protein, 9 aa, Homo Sapiens
DFNDTFYQQ

SEQ ID NO: 245045 - protein, 9 aa, Homo Sapiens
TGTTEAQNI

SEQ ID NO: 245046 - protein, 9 aa, Homo Sapiens
RRDKLYHLA

SEQ ID NO: 245047 - protein, 9 aa, Homo Sapiens
LWQSLRSER

SEQ ID NO: 245048 - protein, 9 aa, Homo Sapiens
LEADPYSKR

SEQ ID NO: 245049 - protein, 9 aa, Homo Sapiens
SGPVRSNHP

SEQ ID NO: 245050 - protein, 9 aa, Homo Sapiens
LQQMPNFTH

SEQ ID NO: 245051 - protein, 9 aa, Homo Sapiens
RIKPFTLEE

SEQ ID NO: 245052 - protein, 9 aa, Homo Sapiens
LCCLCRGDS

SEQ ID NO: 245053 - protein, 9 aa, Homo Sapiens
HRKQRREVA

SEQ ID NO: 245054 - protein, 9 aa, Homo Sapiens
GGVNYLFDV

SEQ ID NO: 245055 - protein, 9 aa, Homo Sapiens
IPIDNSICV

SEQ ID NO: 245056 - protein, 9 aa, Homo Sapiens
FYQSHQSLV

SEQ ID NO: 245057 - protein, 9 aa, Homo Sapiens
ASRAAWKAC

SEQ ID NO: 245058 - protein, 9 aa, Homo Sapiens
ADTLDNSRS

SEQ ID NO: 245059 - protein, 9 aa, Homo Sapiens
GEDVRRIPC

SEQ ID NO: 245060 - protein, 9 aa, Homo Sapiens
DTESTVPQN

SEQ ID NO: 245061 - protein, 9 aa, Homo Sapiens
SASLLVRSG

SEQ ID NO: 245062 - protein, 9 aa, Homo Sapiens
LLALAPHKE

SEQ ID NO: 245063 - protein, 9 aa, Homo Sapiens
MYSAWKTPR

SEQ ID NO: 245064 - protein, 9 aa, Homo Sapiens
KEEGRKHEM

SEQ ID NO: 245065 - protein, 9 aa, Homo Sapiens
ALIQTLGKQ

SEQ ID NO: 245066 - protein, 9 aa, Homo Sapiens
KRNDMQLDS

SEQ ID NO: 245067 - protein, 9 aa, Homo Sapiens
SPKSTVESL

SEQ ID NO: 245068 - protein, 9 aa, Homo Sapiens
NLVIAVIAA

SEQ ID NO: 245069 - protein, 9 aa, Homo Sapiens
CTEATGLSK

SEQ ID NO: 245070 - protein, 9 aa, Homo Sapiens
TSKCELYTC

SEQ ID NO: 245071 - protein, 9 aa, Homo Sapiens
RCLTDVYLG

SEQ ID NO: 245072 - protein, 9 aa, Homo Sapiens
LYLLDIPKG

SEQ ID NO: 245073 - protein, 9 aa, Homo Sapiens
IVYIVAFLG

SEQ ID NO: 245074 - protein, 9 aa, Homo Sapiens
VVWPSQRGT

SEQ ID NO: 245075 - protein, 9 aa, Homo Sapiens
LYMQIINLF

SEQ ID NO: 245076 - protein, 9 aa, Homo Sapiens
SSPPSLLTS

SEQ ID NO: 245077 - protein, 9 aa, Homo Sapiens
MAGLLGTLV

SEQ ID NO: 245078 - protein, 9 aa, Homo Sapiens
MGMYSITVA

SEQ ID NO: 245079 - protein, 9 aa, Homo Sapiens
GWHLDEKNL

SEQ ID NO: 245080 - protein, 9 aa, Homo Sapiens
LRHLRFTYG

SEQ ID NO: 245081 - protein, 9 aa, Homo Sapiens
GVCTLIFGG

SEQ ID NO: 245082 - protein, 9 aa, Homo Sapiens
LQEACDQAD

SEQ ID NO: 245083 - protein, 9 aa, Homo Sapiens
MFTSSSFDT

SEQ ID NO: 245084 - protein, 9 aa, Homo Sapiens
GLMLKFAIP

SEQ ID NO: 245085 - protein, 9 aa, Homo Sapiens
MQQHKLKTH

SEQ ID NO: 245086 - protein, 9 aa, Homo Sapiens
PILVQGRIV

SEQ ID NO: 245087 - protein, 9 aa, Homo Sapiens
EAINKNLID

SEQ ID NO: 245088 - protein, 9 aa, Homo Sapiens
RDTLVISAM

SEQ ID NO: 245089 - protein, 9 aa, Homo Sapiens
RKKAYFTCS

SEQ ID NO: 245090 - protein, 9 aa, Homo Sapiens
IGSRGDGSG

SEQ ID NO: 245091 - protein, 9 aa, Homo Sapiens
KVLKFGMTP

SEQ ID NO: 245092 - protein, 9 aa, Homo Sapiens
RVRLLAAAN

SEQ ID NO: 245093 - protein, 9 aa, Homo Sapiens
LMPVKEEHE

SEQ ID NO: 245094 - protein, 9 aa, Homo Sapiens
HVTVRRDIA

SEQ ID NO: 245095 - protein, 9 aa, Homo Sapiens
LATKEIISP

SEQ ID NO: 245096 - protein, 9 aa, Homo Sapiens
AVLAQVYKQ

SEQ ID NO: 245097 - protein, 9 aa, Homo Sapiens
VIVESLTCL

SEQ ID NO: 245098 - protein, 9 aa, Homo Sapiens
IGLPGFPGS

SEQ ID NO: 245099 - protein, 9 aa, Homo Sapiens
AQHSQAPDG

SEQ ID NO: 245100 - protein, 9 aa, Homo Sapiens
EGFLCEVPT

SEQ ID NO: 245101 - protein, 9 aa, Homo Sapiens
QTLLREKIM

SEQ ID NO: 245102 - protein, 9 aa, Homo Sapiens
IDRLQRITV

SEQ ID NO: 245103 - protein, 9 aa, Homo Sapiens
EFMRQAGEV

SEQ ID NO: 245104 - protein, 9 aa, Homo Sapiens
NAQNQNNYH

SEQ ID NO: 245105 - protein, 9 aa, Homo Sapiens
FSDAETDQI

SEQ ID NO: 245106 - protein, 9 aa, Homo Sapiens
PNIPHQQTR

SEQ ID NO: 245107 - protein, 9 aa, Homo Sapiens
PTGAGRGGA

SEQ ID NO: 245108 - protein, 9 aa, Homo Sapiens
GHDNLHLKI

SEQ ID NO: 245109 - protein, 9 aa, Homo Sapiens
NPTIVTYVG

SEQ ID NO: 245110 - protein, 9 aa, Homo Sapiens
DQYSQILFP

SEQ ID NO: 245111 - protein, 9 aa, Homo Sapiens
EAMKYHVLP

SEQ ID NO: 245112 - protein, 9 aa, Homo Sapiens
LITVKQYPK

SEQ ID NO: 245113 - protein, 9 aa, Homo Sapiens
VHDIMVYFG

SEQ ID NO: 245114 - protein, 9 aa, Homo Sapiens
FVRLPLISV

SEQ ID NO: 245115 - protein, 9 aa, Homo Sapiens
GANGTFHCD

SEQ ID NO: 245116 - protein, 9 aa, Homo Sapiens
TLLPLQVRL

SEQ ID NO: 245117 - protein, 9 aa, Homo Sapiens
KRAILNVMG

SEQ ID NO: 245118 - protein, 9 aa, Homo Sapiens
FDKTCTEHA

SEQ ID NO: 245119 - protein, 9 aa, Homo Sapiens
GLREDALSM

SEQ ID NO: 245120 - protein, 9 aa, Homo Sapiens
ASVKNVIAE

SEQ ID NO: 245121 - protein, 9 aa, Homo Sapiens
VVQIRSDLK

SEQ ID NO: 245122 - protein, 9 aa, Homo Sapiens
FPGIQVRHV

SEQ ID NO: 245123 - protein, 9 aa, Homo Sapiens
FGMNSGGGP

SEQ ID NO: 245124 - protein, 9 aa, Homo Sapiens
VTVYVKSGP

SEQ ID NO: 245125 - protein, 9 aa, Homo Sapiens
RLPMAHPGT

SEQ ID NO: 245126 - protein, 9 aa, Homo Sapiens
GVQHLGALR

SEQ ID NO: 245127 - protein, 9 aa, Homo Sapiens
KPYNLYSSL

SEQ ID NO: 245128 - protein, 9 aa, Homo Sapiens
ENTLLGLGN

SEQ ID NO: 245129 - protein, 9 aa, Homo Sapiens
PGPHDPADA

SEQ ID NO: 245130 - protein, 9 aa, Homo Sapiens
HDILGIPSD

SEQ ID NO: 245131 - protein, 9 aa, Homo Sapiens
NYHLLGNVG

SEQ ID NO: 245132 - protein, 9 aa, Homo Sapiens
RTQKLKEDS

SEQ ID NO: 245133 - protein, 9 aa, Homo Sapiens
CDIPIIQII

SEQ ID NO: 245134 - protein, 9 aa, Homo Sapiens
TKKGEKELA

SEQ ID NO: 245135 - protein, 9 aa, Homo Sapiens
RARCQEISN

SEQ ID NO: 245136 - protein, 9 aa, Homo Sapiens
LTIIAIVVY

SEQ ID NO: 245137 - protein, 9 aa, Homo Sapiens
IPMHLLLGN

SEQ ID NO: 245138 - protein, 9 aa, Homo Sapiens
PLSAIPSVV

SEQ ID NO: 245139 - protein, 9 aa, Homo Sapiens
SVIIDIIAQ

SEQ ID NO: 245140 - protein, 9 aa, Homo Sapiens
IDRGRTPGS

SEQ ID NO: 245141 - protein, 9 aa, Homo Sapiens
PREGAFLAA

SEQ ID NO: 245142 - protein, 9 aa, Homo Sapiens
RRLVQKRKK

SEQ ID NO: 245143 - protein, 9 aa, Homo Sapiens
ATHSRNITC

SEQ ID NO: 245144 - protein, 9 aa, Homo Sapiens
PMYYFFSNL

SEQ ID NO: 245145 - protein, 9 aa, Homo Sapiens
VRFLAAVQQ

SEQ ID NO: 245146 - protein, 9 aa, Homo Sapiens
LYHRIQTLS

SEQ ID NO: 245147 - protein, 9 aa, Homo Sapiens
NSQIDREEL

SEQ ID NO: 245148 - protein, 9 aa, Homo Sapiens
PHLALRRGY

SEQ ID NO: 245149 - protein, 9 aa, Homo Sapiens
TPPPPQAPG

SEQ ID NO: 245150 - protein, 9 aa, Homo Sapiens
NRKIPYILK

SEQ ID NO: 245151 - protein, 9 aa, Homo Sapiens
CNETIARRL

SEQ ID NO: 245152 - protein, 9 aa, Homo Sapiens
FTIHVSSKE

SEQ ID NO: 245153 - protein, 9 aa, Homo Sapiens
TYAFHNTYL

SEQ ID NO: 245154 - protein, 9 aa, Homo Sapiens
EGDNYIINC

SEQ ID NO: 245155 - protein, 9 aa, Homo Sapiens
QPPKDLEAQ

SEQ ID NO: 245156 - protein, 9 aa, Homo Sapiens
PACDLRVLG

SEQ ID NO: 245157 - protein, 9 aa, Homo Sapiens
VSIRGFTMP

SEQ ID NO: 245158 - protein, 9 aa, Homo Sapiens
IISLAAGFS

SEQ ID NO: 245159 - protein, 9 aa, Homo Sapiens
WLSTHKFCR

SEQ ID NO: 245160 - protein, 9 aa, Homo Sapiens
HVHSNGYYT

SEQ ID NO: 245161 - protein, 9 aa, Homo Sapiens
TDLQLWQME

SEQ ID NO: 245162 - protein, 9 aa, Homo Sapiens
RGFTMPKKF

SEQ ID NO: 245163 - protein, 9 aa, Homo Sapiens
LNESNELHD

SEQ ID NO: 245164 - protein, 9 aa, Homo Sapiens
KNISEYSEA

SEQ ID NO: 245165 - protein, 9 aa, Homo Sapiens
GRGFVDLII

SEQ ID NO: 245166 - protein, 9 aa, Homo Sapiens
LLNGDLDDI

SEQ ID NO: 245167 - protein, 9 aa, Homo Sapiens
ETFSKAAQQ

SEQ ID NO: 245168 - protein, 9 aa, Homo Sapiens
LYLPRPEYN

SEQ ID NO: 245169 - protein, 9 aa, Homo Sapiens
CPNECVVSE

SEQ ID NO: 245170 - protein, 9 aa, Homo Sapiens
FTMSCVPQM

SEQ ID NO: 245171 - protein, 9 aa, Homo Sapiens
GKNYHSEML

SEQ ID NO: 245172 - protein, 9 aa, Homo Sapiens
RNLLWLSVC

SEQ ID NO: 245173 - protein, 9 aa, Homo Sapiens
PLMLAEPPH

SEQ ID NO: 245174 - protein, 9 aa, Homo Sapiens
WGLICISYP

SEQ ID NO: 245175 - protein, 9 aa, Homo Sapiens
AVPTFKQRK

SEQ ID NO: 245176 - protein, 9 aa, Homo Sapiens
SACDALNDQ

SEQ ID NO: 245177 - protein, 9 aa, Homo Sapiens
FSPACVLLF

SEQ ID NO: 245178 - protein, 9 aa, Homo Sapiens
SVSLKEKLA

SEQ ID NO: 245179 - protein, 9 aa, Homo Sapiens
AMIHSMTIE

SEQ ID NO: 245180 - protein, 9 aa, Homo Sapiens
QVGKSMFVF

SEQ ID NO: 245181 - protein, 9 aa, Homo Sapiens
LSPEPPKPT

SEQ ID NO: 245182 - protein, 9 aa, Homo Sapiens
KRYTGEFDE

SEQ ID NO: 245183 - protein, 9 aa, Homo Sapiens
TAQVDKASK

SEQ ID NO: 245184 - protein, 9 aa, Homo Sapiens
DKLLHNVLM

SEQ ID NO: 245185 - protein, 9 aa, Homo Sapiens
GKAFYQSSK

SEQ ID NO: 245186 - protein, 9 aa, Homo Sapiens
DGSEQISHK

SEQ ID NO: 245187 - protein, 9 aa, Homo Sapiens
PYLVDAVIY

SEQ ID NO: 245188 - protein, 9 aa, Homo Sapiens
KREEIANTC

SEQ ID NO: 245189 - protein, 9 aa, Homo Sapiens
APEQFKTLW

SEQ ID NO: 245190 - protein, 9 aa, Homo Sapiens
IIINCGANV

SEQ ID NO: 245191 - protein, 9 aa, Homo Sapiens
NPVYEDFYF

SEQ ID NO: 245192 - protein, 9 aa, Homo Sapiens
SYLSLFFRK

SEQ ID NO: 245193 - protein, 9 aa, Homo Sapiens
DAMNTFKWT

SEQ ID NO: 245194 - protein, 9 aa, Homo Sapiens
ALQNQSQKV

SEQ ID NO: 245195 - protein, 9 aa, Homo Sapiens
KHPGASIAL

SEQ ID NO: 245196 - protein, 9 aa, Homo Sapiens
SLTSECTTL

SEQ ID NO: 245197 - protein, 9 aa, Homo Sapiens
AMKRGEPDI

SEQ ID NO: 245198 - protein, 9 aa, Homo Sapiens
CWYCNYASK

SEQ ID NO: 245199 - protein, 9 aa, Homo Sapiens
PGNVETFIK

SEQ ID NO: 245200 - protein, 9 aa, Homo Sapiens
LQVSNTQQK

SEQ ID NO: 245201 - protein, 9 aa, Homo Sapiens
ELQSEINYL

SEQ ID NO: 245202 - protein, 9 aa, Homo Sapiens
PRSRALSRN

SEQ ID NO: 245203 - protein, 9 aa, Homo Sapiens
YLRGNYQKA

SEQ ID NO: 245204 - protein, 9 aa, Homo Sapiens
ALIKLKTKL

SEQ ID NO: 245205 - protein, 9 aa, Homo Sapiens
QHSQAPDGM

SEQ ID NO: 245206 - protein, 9 aa, Homo Sapiens
NKEITRQAT

SEQ ID NO: 245207 - protein, 9 aa, Homo Sapiens
PGHSLGPSH

SEQ ID NO: 245208 - protein, 9 aa, Homo Sapiens
KSSGQLNTQ

SEQ ID NO: 245209 - protein, 9 aa, Homo Sapiens
KTRYSLRKK

SEQ ID NO: 245210 - protein, 9 aa, Homo Sapiens
QAWTGKIFA

SEQ ID NO: 245211 - protein, 9 aa, Homo Sapiens
KTDQLEQLK

SEQ ID NO: 245212 - protein, 9 aa, Homo Sapiens
DAALGFKNV

SEQ ID NO: 245213 - protein, 9 aa, Homo Sapiens
EWWSHIQVA

SEQ ID NO: 245214 - protein, 9 aa, Homo Sapiens
SAYPETKHS

SEQ ID NO: 245215 - protein, 9 aa, Homo Sapiens
GAGRFINYF

SEQ ID NO: 245216 - protein, 9 aa, Homo Sapiens
RPLTAIIVS

SEQ ID NO: 245217 - protein, 9 aa, Homo Sapiens
IPVVHEEDC

SEQ ID NO: 245218 - protein, 9 aa, Homo Sapiens
TVDVWNSIT

SEQ ID NO: 245219 - protein, 9 aa, Homo Sapiens
ATECINPQY

SEQ ID NO: 245220 - protein, 9 aa, Homo Sapiens
CENWLEQQQ

SEQ ID NO: 245221 - protein, 9 aa, Homo Sapiens
WAKDKSSRK

SEQ ID NO: 245222 - protein, 9 aa, Homo Sapiens
AENAVLQQL

SEQ ID NO: 245223 - protein, 9 aa, Homo Sapiens
RGCLDWDEN

SEQ ID NO: 245224 - protein, 9 aa, Homo Sapiens
RQKGSVHHN

SEQ ID NO: 245225 - protein, 9 aa, Homo Sapiens
YDGLCIALL

SEQ ID NO: 245226 - protein, 9 aa, Homo Sapiens
TFVMGLNLV

SEQ ID NO: 245227 - protein, 9 aa, Homo Sapiens
AFKDNSNVY

SEQ ID NO: 245228 - protein, 9 aa, Homo Sapiens
VWQTSLTIP

SEQ ID NO: 245229 - protein, 9 aa, Homo Sapiens
LYEALNNLT

SEQ ID NO: 245230 - protein, 9 aa, Homo Sapiens
PENMRKLTK

SEQ ID NO: 245231 - protein, 9 aa, Homo Sapiens
LTLMHLYFA

SEQ ID NO: 245232 - protein, 9 aa, Homo Sapiens
ENLNGFIEI

SEQ ID NO: 245233 - protein, 9 aa, Homo Sapiens
VLQGVALSD

SEQ ID NO: 245234 - protein, 9 aa, Homo Sapiens
IMSPGQKSS

SEQ ID NO: 245235 - protein, 9 aa, Homo Sapiens
KNIDTSPPV

SEQ ID NO: 245236 - protein, 9 aa, Homo Sapiens
IVLKLLSEN

SEQ ID NO: 245237 - protein, 9 aa, Homo Sapiens
AYGLSDQLT

SEQ ID NO: 245238 - protein, 9 aa, Homo Sapiens
CGIGEVPVE

SEQ ID NO: 245239 - protein, 9 aa, Homo Sapiens
YKMTGDYHR

SEQ ID NO: 245240 - protein, 9 aa, Homo Sapiens
LEPPIVARC

SEQ ID NO: 245241 - protein, 9 aa, Homo Sapiens
FNLKVGHEV

SEQ ID NO: 245242 - protein, 9 aa, Homo Sapiens
DKVVVNTKT

SEQ ID NO: 245243 - protein, 9 aa, Homo Sapiens
DNSSPSAEH

SEQ ID NO: 245244 - protein, 9 aa, Homo Sapiens
ERQSSKPKV

SEQ ID NO: 245245 - protein, 9 aa, Homo Sapiens
SRSKLVSIP

SEQ ID NO: 245246 - protein, 9 aa, Homo Sapiens
KSRPFWGSS

SEQ ID NO: 245247 - protein, 9 aa, Homo Sapiens
TLTQRASNK

SEQ ID NO: 245248 - protein, 9 aa, Homo Sapiens
MVIHATWRG

SEQ ID NO: 245249 - protein, 9 aa, Homo Sapiens
EENFLSVDD

SEQ ID NO: 245250 - protein, 9 aa, Homo Sapiens
LLPTSPGLP

SEQ ID NO: 245251 - protein, 9 aa, Homo Sapiens
TCIMEASTN

SEQ ID NO: 245252 - protein, 9 aa, Homo Sapiens
RSQLSELTI

SEQ ID NO: 245253 - protein, 9 aa, Homo Sapiens
LECEKTYSL

SEQ ID NO: 245254 - protein, 9 aa, Homo Sapiens
TDQGIWIQL

SEQ ID NO: 245255 - protein, 9 aa, Homo Sapiens
RFYLVVYPA

SEQ ID NO: 245256 - protein, 9 aa, Homo Sapiens
EEQEMMDNL

SEQ ID NO: 245257 - protein, 9 aa, Homo Sapiens
KDYGKEYQA

SEQ ID NO: 245258 - protein, 9 aa, Homo Sapiens
LHYHSKILN

SEQ ID NO: 245259 - protein, 9 aa, Homo Sapiens
AEISDHYGA

SEQ ID NO: 245260 - protein, 9 aa, Homo Sapiens
KNVPPDIQK

SEQ ID NO: 245261 - protein, 9 aa, Homo Sapiens
RIQVILDME

SEQ ID NO: 245262 - protein, 9 aa, Homo Sapiens
IKEANLFGS

SEQ ID NO: 245263 - protein, 9 aa, Homo Sapiens
LNWSDSDSS

SEQ ID NO: 245264 - protein, 9 aa, Homo Sapiens
VMVIQAIEP

SEQ ID NO: 245265 - protein, 9 aa, Homo Sapiens
TGNGAIDFV

SEQ ID NO: 245266 - protein, 9 aa, Homo Sapiens
NGTFIELFP

SEQ ID NO: 245267 - protein, 9 aa, Homo Sapiens
KQRPKDLWD

SEQ ID NO: 245268 - protein, 9 aa, Homo Sapiens
ELLHTQLKD

SEQ ID NO: 245269 - protein, 9 aa, Homo Sapiens
GVQHILAAM

SEQ ID NO: 245270 - protein, 9 aa, Homo Sapiens
NVELNCAVL

SEQ ID NO: 245271 - protein, 9 aa, Homo Sapiens
ALTLTDSEI

SEQ ID NO: 245272 - protein, 9 aa, Homo Sapiens
GRHFPRRPK

SEQ ID NO: 245273 - protein, 9 aa, Homo Sapiens
NEEYVIEPL

SEQ ID NO: 245274 - protein, 9 aa, Homo Sapiens
NDQSISQNH

SEQ ID NO: 245275 - protein, 9 aa, Homo Sapiens
LSVDGIWLL

SEQ ID NO: 245276 - protein, 9 aa, Homo Sapiens
HSKLRVAGG

SEQ ID NO: 245277 - protein, 9 aa, Homo Sapiens
NLPYRTISE

SEQ ID NO: 245278 - protein, 9 aa, Homo Sapiens
EGTALPFSA

SEQ ID NO: 245279 - protein, 9 aa, Homo Sapiens
APKPKWTPL

SEQ ID NO: 245280 - protein, 9 aa, Homo Sapiens
IKKLLESDD

SEQ ID NO: 245281 - protein, 9 aa, Homo Sapiens
LNKNIFLQY

SEQ ID NO: 245282 - protein, 9 aa, Homo Sapiens
TCTHVYIRV

SEQ ID NO: 245283 - protein, 9 aa, Homo Sapiens
PQILGDILN

SEQ ID NO: 245284 - protein, 9 aa, Homo Sapiens
PKIIEYPLK

SEQ ID NO: 245285 - protein, 9 aa, Homo Sapiens
GGQFRPKVS

SEQ ID NO: 245286 - protein, 9 aa, Homo Sapiens
TCKVPLSDE

SEQ ID NO: 245287 - protein, 9 aa, Homo Sapiens
SIKGTPLPH

SEQ ID NO: 245288 - protein, 9 aa, Homo Sapiens
PLLMEYSHQ

SEQ ID NO: 245289 - protein, 9 aa, Homo Sapiens
SGGAYGSQI

SEQ ID NO: 245290 - protein, 9 aa, Homo Sapiens
SSALVQQLI

SEQ ID NO: 245291 - protein, 9 aa, Homo Sapiens
KKQSESKSQ

SEQ ID NO: 245292 - protein, 9 aa, Homo Sapiens
NMEEIKQLT

SEQ ID NO: 245293 - protein, 9 aa, Homo Sapiens
VMKHYRLTH

SEQ ID NO: 245294 - protein, 9 aa, Homo Sapiens
LIWQKIISS

SEQ ID NO: 245295 - protein, 9 aa, Homo Sapiens
IGANWRTEI

SEQ ID NO: 245296 - protein, 9 aa, Homo Sapiens
NPLSPSLSN

SEQ ID NO: 245297 - protein, 9 aa, Homo Sapiens
ITVSHLWFD

SEQ ID NO: 245298 - protein, 9 aa, Homo Sapiens
GFKRLFCLN

SEQ ID NO: 245299 - protein, 9 aa, Homo Sapiens
TCCLKLSVK

SEQ ID NO: 245300 - protein, 9 aa, Homo Sapiens
LQIPMYYFF

SEQ ID NO: 245301 - protein, 9 aa, Homo Sapiens
NIALQGSWA

SEQ ID NO: 245302 - protein, 9 aa, Homo Sapiens
FGTQSRNLK

SEQ ID NO: 245303 - protein, 9 aa, Homo Sapiens
ISNPLLNGR

SEQ ID NO: 245304 - protein, 9 aa, Homo Sapiens
FAIRCNLAP

SEQ ID NO: 245305 - protein, 9 aa, Homo Sapiens
LPGITTLEC

SEQ ID NO: 245306 - protein, 9 aa, Homo Sapiens
YIQLYGRKF

SEQ ID NO: 245307 - protein, 9 aa, Homo Sapiens
KMLLGQFSF

SEQ ID NO: 245308 - protein, 9 aa, Homo Sapiens
FIITVTTDG

SEQ ID NO: 245309 - protein, 9 aa, Homo Sapiens
PVNRDNFTQ

SEQ ID NO: 245310 - protein, 9 aa, Homo Sapiens
PASPKNNIK

SEQ ID NO: 245311 - protein, 9 aa, Homo Sapiens
WHWRNRNKK

SEQ ID NO: 245312 - protein, 9 aa, Homo Sapiens
QKSKEMVYS

SEQ ID NO: 245313 - protein, 9 aa, Homo Sapiens
RNLSLSLST

SEQ ID NO: 245314 - protein, 9 aa, Homo Sapiens
SGKAMRKAA

SEQ ID NO: 245315 - protein, 9 aa, Homo Sapiens
KLNSHPITE

SEQ ID NO: 245316 - protein, 9 aa, Homo Sapiens
SCESENSKV

SEQ ID NO: 245317 - protein, 9 aa, Homo Sapiens
KHHNVHTAE

SEQ ID NO: 245318 - protein, 9 aa, Homo Sapiens
EAIHFINER

SEQ ID NO: 245319 - protein, 9 aa, Homo Sapiens
PLKKWPMQS

SEQ ID NO: 245320 - protein, 9 aa, Homo Sapiens
NQQLETQLR

SEQ ID NO: 245321 - protein, 9 aa, Homo Sapiens
TSFQYPSQP

SEQ ID NO: 245322 - protein, 9 aa, Homo Sapiens
LFPKSKSVA

SEQ ID NO: 245323 - protein, 9 aa, Homo Sapiens
IQTGYMPRK

SEQ ID NO: 245324 - protein, 9 aa, Homo Sapiens
IVPASKPPR

SEQ ID NO: 245325 - protein, 9 aa, Homo Sapiens
GKLHYHSKI

SEQ ID NO: 245326 - protein, 9 aa, Homo Sapiens
CSILLTNVL

SEQ ID NO: 245327 - protein, 9 aa, Homo Sapiens
KMRPGYGML

SEQ ID NO: 245328 - protein, 9 aa, Homo Sapiens
CDLITRLLC

SEQ ID NO: 245329 - protein, 9 aa, Homo Sapiens
QIWQQIANY

SEQ ID NO: 245330 - protein, 9 aa, Homo Sapiens
ELTTDVKAL

SEQ ID NO: 245331 - protein, 9 aa, Homo Sapiens
AIVVTVLLT

SEQ ID NO: 245332 - protein, 9 aa, Homo Sapiens
NSEGNRFIQ

SEQ ID NO: 245333 - protein, 9 aa, Homo Sapiens
ARLAREREL

SEQ ID NO: 245334 - protein, 9 aa, Homo Sapiens
KQDSNKFLK

SEQ ID NO: 245335 - protein, 9 aa, Homo Sapiens
SGALLGREG

SEQ ID NO: 245336 - protein, 9 aa, Homo Sapiens
LDNRIVAAR

SEQ ID NO: 245337 - protein, 9 aa, Homo Sapiens
RRTDRNHIE

SEQ ID NO: 245338 - protein, 9 aa, Homo Sapiens
YVIFTLDEI

SEQ ID NO: 245339 - protein, 9 aa, Homo Sapiens
TNTDGSYRC

SEQ ID NO: 245340 - protein, 9 aa, Homo Sapiens
VWSLISEED

SEQ ID NO: 245341 - protein, 9 aa, Homo Sapiens
PVHISAHHL

SEQ ID NO: 245342 - protein, 9 aa, Homo Sapiens
YSNKKTFII

SEQ ID NO: 245343 - protein, 9 aa, Homo Sapiens
FPDAPWGKA

SEQ ID NO: 245344 - protein, 9 aa, Homo Sapiens
KSMFVFVCL

SEQ ID NO: 245345 - protein, 9 aa, Homo Sapiens
SEQGHFLIV

SEQ ID NO: 245346 - protein, 9 aa, Homo Sapiens
CQEKFKQLE

SEQ ID NO: 245347 - protein, 9 aa, Homo Sapiens
HNMDLVGDT

SEQ ID NO: 245348 - protein, 9 aa, Homo Sapiens
KSEAEEGTG

SEQ ID NO: 245349 - protein, 9 aa, Homo Sapiens
WLGGQAVGT

SEQ ID NO: 245350 - protein, 9 aa, Homo Sapiens
VSSVCMNTP

SEQ ID NO: 245351 - protein, 9 aa, Homo Sapiens
LGHYVTSAA

SEQ ID NO: 245352 - protein, 9 aa, Homo Sapiens
FNAWNIKEM

SEQ ID NO: 245353 - protein, 9 aa, Homo Sapiens
WDQHDLSWS

SEQ ID NO: 245354 - protein, 9 aa, Homo Sapiens
FLIQQVTLN

SEQ ID NO: 245355 - protein, 9 aa, Homo Sapiens
PSQLCSGAR

SEQ ID NO: 245356 - protein, 9 aa, Homo Sapiens
GCLSDSDMV

SEQ ID NO: 245357 - protein, 9 aa, Homo Sapiens
HYFDHFHSL

SEQ ID NO: 245358 - protein, 9 aa, Homo Sapiens
LVHLDDSSS

SEQ ID NO: 245359 - protein, 9 aa, Homo Sapiens
CGKIISSDS

SEQ ID NO: 245360 - protein, 9 aa, Homo Sapiens
GMLHKEKLE

SEQ ID NO: 245361 - protein, 9 aa, Homo Sapiens
WEHMGKRIN

SEQ ID NO: 245362 - protein, 9 aa, Homo Sapiens
RIGANWRTE

SEQ ID NO: 245363 - protein, 9 aa, Homo Sapiens
YLPEYKIFF

SEQ ID NO: 245364 - protein, 9 aa, Homo Sapiens
AGPGRVMLF

SEQ ID NO: 245365 - protein, 9 aa, Homo Sapiens
SLHVPGLNN

SEQ ID NO: 245366 - protein, 9 aa, Homo Sapiens
SYILVYRQF

SEQ ID NO: 245367 - protein, 9 aa, Homo Sapiens
QGLFILANA

SEQ ID NO: 245368 - protein, 9 aa, Homo Sapiens
KFVLKEGQL

SEQ ID NO: 245369 - protein, 9 aa, Homo Sapiens
FLLVGIIEE

SEQ ID NO: 245370 - protein, 9 aa, Homo Sapiens
RLLKDPLCK

SEQ ID NO: 245371 - protein, 9 aa, Homo Sapiens
LQNCLPHLK

SEQ ID NO: 245372 - protein, 9 aa, Homo Sapiens
IPNKPDVTN

SEQ ID NO: 245373 - protein, 9 aa, Homo Sapiens
SINGTQIAG

SEQ ID NO: 245374 - protein, 9 aa, Homo Sapiens
PDAVLQTRV

SEQ ID NO: 245375 - protein, 9 aa, Homo Sapiens
DNKIYRYVY

SEQ ID NO: 245376 - protein, 9 aa, Homo Sapiens
QRESEGDKK

SEQ ID NO: 245377 - protein, 9 aa, Homo Sapiens
KCMTLDPVS

SEQ ID NO: 245378 - protein, 9 aa, Homo Sapiens
LNMVKYWKD

SEQ ID NO: 245379 - protein, 9 aa, Homo Sapiens
ESGFDPFQL

SEQ ID NO: 245380 - protein, 9 aa, Homo Sapiens
TKHPGASIA

SEQ ID NO: 245381 - protein, 9 aa, Homo Sapiens
ESESRSTYN

SEQ ID NO: 245382 - protein, 9 aa, Homo Sapiens
MVRFREHWQ

SEQ ID NO: 245383 - protein, 9 aa, Homo Sapiens
TGEKHFSCP

SEQ ID NO: 245384 - protein, 9 aa, Homo Sapiens
YKLQKEHNL

SEQ ID NO: 245385 - protein, 9 aa, Homo Sapiens
AGVLNYLKY

SEQ ID NO: 245386 - protein, 9 aa, Homo Sapiens
IQYSKDSYG

SEQ ID NO: 245387 - protein, 9 aa, Homo Sapiens
QKAVKLLNS

SEQ ID NO: 245388 - protein, 9 aa, Homo Sapiens
VKCLAPIQD

SEQ ID NO: 245389 - protein, 9 aa, Homo Sapiens
LLDPRETAI

SEQ ID NO: 245390 - protein, 9 aa, Homo Sapiens
LESLSGKKR

SEQ ID NO: 245391 - protein, 9 aa, Homo Sapiens
DSASESLGE

SEQ ID NO: 245392 - protein, 9 aa, Homo Sapiens
VSRQYHGAW

SEQ ID NO: 245393 - protein, 9 aa, Homo Sapiens
KTRHTGEKF

SEQ ID NO: 245394 - protein, 9 aa, Homo Sapiens
ALSRLPQTP

SEQ ID NO: 245395 - protein, 9 aa, Homo Sapiens
LIAEDSAIM

SEQ ID NO: 245396 - protein, 9 aa, Homo Sapiens
EELDYVIAL

SEQ ID NO: 245397 - protein, 9 aa, Homo Sapiens
ETEKENGPS

SEQ ID NO: 245398 - protein, 9 aa, Homo Sapiens
NNRQIHTGK

SEQ ID NO: 245399 - protein, 9 aa, Homo Sapiens
TYIKKNHEE

SEQ ID NO: 245400 - protein, 9 aa, Homo Sapiens
DVRQHHRYL

SEQ ID NO: 245401 - protein, 9 aa, Homo Sapiens
SKIEEACKI

SEQ ID NO: 245402 - protein, 9 aa, Homo Sapiens
RFIFQLKAE

SEQ ID NO: 245403 - protein, 9 aa, Homo Sapiens
ESIKSRLQL

SEQ ID NO: 245404 - protein, 9 aa, Homo Sapiens
EIVKLMILS

SEQ ID NO: 245405 - protein, 9 aa, Homo Sapiens
LPSQPTTDI

SEQ ID NO: 245406 - protein, 9 aa, Homo Sapiens
GPGRVMLFE

SEQ ID NO: 245407 - protein, 9 aa, Homo Sapiens
SSGYLRYSF

SEQ ID NO: 245408 - protein, 9 aa, Homo Sapiens
TCPEVLGPG

SEQ ID NO: 245409 - protein, 9 aa, Homo Sapiens
GDQPESMVR

SEQ ID NO: 245410 - protein, 9 aa, Homo Sapiens
HRLWRWHKS

SEQ ID NO: 245411 - protein, 9 aa, Homo Sapiens
VSRLRDDQG

SEQ ID NO: 245412 - protein, 9 aa, Homo Sapiens
PTPKHKEQA

SEQ ID NO: 245413 - protein, 9 aa, Homo Sapiens
NSGGLHEFL

SEQ ID NO: 245414 - protein, 9 aa, Homo Sapiens
KGTNESLEC

SEQ ID NO: 245415 - protein, 9 aa, Homo Sapiens
NIPLFEGCI

SEQ ID NO: 245416 - protein, 9 aa, Homo Sapiens
MDYDDDRLR

SEQ ID NO: 245417 - protein, 9 aa, Homo Sapiens
KEGDLQKVL

SEQ ID NO: 245418 - protein, 9 aa, Homo Sapiens
ESEEEVEKP

SEQ ID NO: 245419 - protein, 9 aa, Homo Sapiens
TQVPNSGSS

SEQ ID NO: 245420 - protein, 9 aa, Homo Sapiens
IINTQPPLP

SEQ ID NO: 245421 - protein, 9 aa, Homo Sapiens
FRAKVCGKI

SEQ ID NO: 245422 - protein, 9 aa, Homo Sapiens
DSQAFTPDN

SEQ ID NO: 245423 - protein, 9 aa, Homo Sapiens
AVKSEQSCG

SEQ ID NO: 245424 - protein, 9 aa, Homo Sapiens
NRIHYRLQL

SEQ ID NO: 245425 - protein, 9 aa, Homo Sapiens
DDQKDDVPV

SEQ ID NO: 245426 - protein, 9 aa, Homo Sapiens
ESVKQMLKS

SEQ ID NO: 245427 - protein, 9 aa, Homo Sapiens
HIVNNACGV

SEQ ID NO: 245428 - protein, 9 aa, Homo Sapiens
SSRRLVKEA

SEQ ID NO: 245429 - protein, 9 aa, Homo Sapiens
RLAELRRIF

SEQ ID NO: 245430 - protein, 9 aa, Homo Sapiens
EEQGYIEVK

SEQ ID NO: 245431 - protein, 9 aa, Homo Sapiens
GKSARAVTV

SEQ ID NO: 245432 - protein, 9 aa, Homo Sapiens
LVTVADNRE

SEQ ID NO: 245433 - protein, 9 aa, Homo Sapiens
YLTRCQDSM

SEQ ID NO: 245434 - protein, 9 aa, Homo Sapiens
APAKSAVNC

SEQ ID NO: 245435 - protein, 9 aa, Homo Sapiens
DDVYEQYKK

SEQ ID NO: 245436 - protein, 9 aa, Homo Sapiens
SSTHSSPEM

SEQ ID NO: 245437 - protein, 9 aa, Homo Sapiens
LKSRLEKWL

SEQ ID NO: 245438 - protein, 9 aa, Homo Sapiens
GRGENNELI

SEQ ID NO: 245439 - protein, 9 aa, Homo Sapiens
FEEAYRFGA

SEQ ID NO: 245440 - protein, 9 aa, Homo Sapiens
GSKAAFLCQ

SEQ ID NO: 245441 - protein, 9 aa, Homo Sapiens
FLPSQPRYS

SEQ ID NO: 245442 - protein, 9 aa, Homo Sapiens
NSIKHRCST

SEQ ID NO: 245443 - protein, 9 aa, Homo Sapiens
DKIVSTLYT

SEQ ID NO: 245444 - protein, 9 aa, Homo Sapiens
VVESSRRLV

SEQ ID NO: 245445 - protein, 9 aa, Homo Sapiens
DSGTCQIPS

SEQ ID NO: 245446 - protein, 9 aa, Homo Sapiens
LHLSKTHGT

SEQ ID NO: 245447 - protein, 9 aa, Homo Sapiens
HPPMHEYAD

SEQ ID NO: 245448 - protein, 9 aa, Homo Sapiens
QINLSKRQV

SEQ ID NO: 245449 - protein, 9 aa, Homo Sapiens
KVQYKSSCK

SEQ ID NO: 245450 - protein, 9 aa, Homo Sapiens
YARIYIYWV

SEQ ID NO: 245451 - protein, 9 aa, Homo Sapiens
DIPFVLKSL

SEQ ID NO: 245452 - protein, 9 aa, Homo Sapiens
VRDEKRKWT

SEQ ID NO: 245453 - protein, 9 aa, Homo Sapiens
IHPLFLYLI

SEQ ID NO: 245454 - protein, 9 aa, Homo Sapiens
NFSQSQYLI

SEQ ID NO: 245455 - protein, 9 aa, Homo Sapiens
LLRCQYFLA

SEQ ID NO: 245456 - protein, 9 aa, Homo Sapiens
LVPGRHDTA

SEQ ID NO: 245457 - protein, 9 aa, Homo Sapiens
NTSQEEGSG

SEQ ID NO: 245458 - protein, 9 aa, Homo Sapiens
ATQKNLPIA

SEQ ID NO: 245459 - protein, 9 aa, Homo Sapiens
RRSKRNWKC

SEQ ID NO: 245460 - protein, 9 aa, Homo Sapiens
GRLPMAHPG

SEQ ID NO: 245461 - protein, 9 aa, Homo Sapiens
LEKAMSLEC

SEQ ID NO: 245462 - protein, 9 aa, Homo Sapiens
SLDKLRNLS

SEQ ID NO: 245463 - protein, 9 aa, Homo Sapiens
TFAKKGELR

SEQ ID NO: 245464 - protein, 9 aa, Homo Sapiens
GEECPATLR

SEQ ID NO: 245465 - protein, 9 aa, Homo Sapiens
EMLAINQVF

SEQ ID NO: 245466 - protein, 9 aa, Homo Sapiens
MERNVLTAF

SEQ ID NO: 245467 - protein, 9 aa, Homo Sapiens
DRLSPYFYE

SEQ ID NO: 245468 - protein, 9 aa, Homo Sapiens
YYTLLKKAS

SEQ ID NO: 245469 - protein, 9 aa, Homo Sapiens
LLKINENIY

SEQ ID NO: 245470 - protein, 9 aa, Homo Sapiens
IQNGTIKDK

SEQ ID NO: 245471 - protein, 9 aa, Homo Sapiens
SLMIVLLSY

SEQ ID NO: 245472 - protein, 9 aa, Homo Sapiens
QAIKTDLTD

SEQ ID NO: 245473 - protein, 9 aa, Homo Sapiens
WLSDLAKHK

SEQ ID NO: 245474 - protein, 9 aa, Homo Sapiens
RWHDNVFTS

SEQ ID NO: 245475 - protein, 9 aa, Homo Sapiens
LVDKMQDRL

SEQ ID NO: 245476 - protein, 9 aa, Homo Sapiens
KNTCTIDGL

SEQ ID NO: 245477 - protein, 9 aa, Homo Sapiens
HDKLSVFCW

SEQ ID NO: 245478 - protein, 9 aa, Homo Sapiens
LVQIGPKEC

SEQ ID NO: 245479 - protein, 9 aa, Homo Sapiens
TFKDQQKIN

SEQ ID NO: 245480 - protein, 9 aa, Homo Sapiens
FVLPCWPLS

SEQ ID NO: 245481 - protein, 9 aa, Homo Sapiens
EEFSCDGKA

SEQ ID NO: 245482 - protein, 9 aa, Homo Sapiens
MFWFGVTSV

SEQ ID NO: 245483 - protein, 9 aa, Homo Sapiens
TGSKVGVHI

SEQ ID NO: 245484 - protein, 9 aa, Homo Sapiens
QLQNKFYLD

SEQ ID NO: 245485 - protein, 9 aa, Homo Sapiens
LIHGLSMPM

SEQ ID NO: 245486 - protein, 9 aa, Homo Sapiens
LGGWRTSGK

SEQ ID NO: 245487 - protein, 9 aa, Homo Sapiens
SLQSWVEFN

SEQ ID NO: 245488 - protein, 9 aa, Homo Sapiens
EKPMNELDT

SEQ ID NO: 245489 - protein, 9 aa, Homo Sapiens
RKSGGHSRK

SEQ ID NO: 245490 - protein, 9 aa, Homo Sapiens
NAWNIKEML

SEQ ID NO: 245491 - protein, 9 aa, Homo Sapiens
VLIFLLNFT

SEQ ID NO: 245492 - protein, 9 aa, Homo Sapiens
NKYLTEEAE

SEQ ID NO: 245493 - protein, 9 aa, Homo Sapiens
SRKYAVNSL

SEQ ID NO: 245494 - protein, 9 aa, Homo Sapiens
IECFIIYAC

SEQ ID NO: 245495 - protein, 9 aa, Homo Sapiens
ITHKAKSQN

SEQ ID NO: 245496 - protein, 9 aa, Homo Sapiens
TSQDKAITH

SEQ ID NO: 245497 - protein, 9 aa, Homo Sapiens
DIDSGGGNI

SEQ ID NO: 245498 - protein, 9 aa, Homo Sapiens
ACFYGRILL

SEQ ID NO: 245499 - protein, 9 aa, Homo Sapiens
IVCLYIICA

SEQ ID NO: 245500 - protein, 9 aa, Homo Sapiens
LSQAFYSLK

SEQ ID NO: 245501 - protein, 9 aa, Homo Sapiens
DLVGPSTRT

SEQ ID NO: 245502 - protein, 9 aa, Homo Sapiens
SHTENRDPL

SEQ ID NO: 245503 - protein, 9 aa, Homo Sapiens
DRYDPNHVC

SEQ ID NO: 245504 - protein, 9 aa, Homo Sapiens
TKGSTFSNS

SEQ ID NO: 245505 - protein, 9 aa, Homo Sapiens
AFSCKDTLV

SEQ ID NO: 245506 - protein, 9 aa, Homo Sapiens
PFEHDKEII

SEQ ID NO: 245507 - protein, 9 aa, Homo Sapiens
SPEPGCTKV

SEQ ID NO: 245508 - protein, 9 aa, Homo Sapiens
KQTCYIANL

SEQ ID NO: 245509 - protein, 9 aa, Homo Sapiens
KYLKDVQNN

SEQ ID NO: 245510 - protein, 9 aa, Homo Sapiens
SMMDKYEKI

SEQ ID NO: 245511 - protein, 9 aa, Homo Sapiens
YLANRLSEH

SEQ ID NO: 245512 - protein, 9 aa, Homo Sapiens
QFSNVIRKQ

SEQ ID NO: 245513 - protein, 9 aa, Homo Sapiens
PDVRVVGVE

SEQ ID NO: 245514 - protein, 9 aa, Homo Sapiens
CKEAGLKCA

SEQ ID NO: 245515 - protein, 9 aa, Homo Sapiens
GQRLYLVTG

SEQ ID NO: 245516 - protein, 9 aa, Homo Sapiens
VCDAFPPLR

SEQ ID NO: 245517 - protein, 9 aa, Homo Sapiens
DKKYKWMVC

SEQ ID NO: 245518 - protein, 9 aa, Homo Sapiens
MFIAIVFSA

SEQ ID NO: 245519 - protein, 9 aa, Homo Sapiens
LGFELFEAS

SEQ ID NO: 245520 - protein, 9 aa, Homo Sapiens
SFKNLFWSI

SEQ ID NO: 245521 - protein, 9 aa, Homo Sapiens
AEIMDSFKD

SEQ ID NO: 245522 - protein, 9 aa, Homo Sapiens
EPDPGFKRL

SEQ ID NO: 245523 - protein, 9 aa, Homo Sapiens
KTMKTFLHK

SEQ ID NO: 245524 - protein, 9 aa, Homo Sapiens
DNEEYVIEP

SEQ ID NO: 245525 - protein, 9 aa, Homo Sapiens
RVPVSRSCR

SEQ ID NO: 245526 - protein, 9 aa, Homo Sapiens
NISSEKINF

SEQ ID NO: 245527 - protein, 9 aa, Homo Sapiens
NGFAKLYGS

SEQ ID NO: 245528 - protein, 9 aa, Homo Sapiens
TSQGKKPAM

SEQ ID NO: 245529 - protein, 9 aa, Homo Sapiens
FRIMDDNNN

SEQ ID NO: 245530 - protein, 9 aa, Homo Sapiens
EMGIKPSKG

SEQ ID NO: 245531 - protein, 9 aa, Homo Sapiens
LGFGEDKLG

SEQ ID NO: 245532 - protein, 9 aa, Homo Sapiens
ICCPIHYTT

SEQ ID NO: 245533 - protein, 9 aa, Homo Sapiens
AHPVRTNKP

SEQ ID NO: 245534 - protein, 9 aa, Homo Sapiens
LIIATTEVF

SEQ ID NO: 245535 - protein, 9 aa, Homo Sapiens
CSRNRHSQN

SEQ ID NO: 245536 - protein, 9 aa, Homo Sapiens
EPKKLDPIV

SEQ ID NO: 245537 - protein, 9 aa, Homo Sapiens
FETNNKYES

SEQ ID NO: 245538 - protein, 9 aa, Homo Sapiens
THIASGTSE

SEQ ID NO: 245539 - protein, 9 aa, Homo Sapiens
MEASTNFLP

SEQ ID NO: 245540 - protein, 9 aa, Homo Sapiens
PMRTLDPQI

SEQ ID NO: 245541 - protein, 9 aa, Homo Sapiens
SSSCKGMVT

SEQ ID NO: 245542 - protein, 9 aa, Homo Sapiens
RICKLADQC

SEQ ID NO: 245543 - protein, 9 aa, Homo Sapiens
LFDLYHRIQ

SEQ ID NO: 245544 - protein, 9 aa, Homo Sapiens
EGEEDAQQS

SEQ ID NO: 245545 - protein, 9 aa, Homo Sapiens
GQDYLVGDK

SEQ ID NO: 245546 - protein, 9 aa, Homo Sapiens
QPVTSLNST

SEQ ID NO: 245547 - protein, 9 aa, Homo Sapiens
SITHATVED

SEQ ID NO: 245548 - protein, 9 aa, Homo Sapiens
SVFYCKNIT

SEQ ID NO: 245549 - protein, 9 aa, Homo Sapiens
KKKLREVER

SEQ ID NO: 245550 - protein, 9 aa, Homo Sapiens
KAKALMGHF

SEQ ID NO: 245551 - protein, 9 aa, Homo Sapiens
HRYKFIIQV

SEQ ID NO: 245552 - protein, 9 aa, Homo Sapiens
EEYVIEPLE

SEQ ID NO: 245553 - protein, 9 aa, Homo Sapiens
TLAGEYFQK

SEQ ID NO: 245554 - protein, 9 aa, Homo Sapiens
LRIDSANMT

SEQ ID NO: 245555 - protein, 9 aa, Homo Sapiens
ELSEFQRKY

SEQ ID NO: 245556 - protein, 9 aa, Homo Sapiens
RTVLVNVDG

SEQ ID NO: 245557 - protein, 9 aa, Homo Sapiens
NKFLKIMFS

SEQ ID NO: 245558 - protein, 9 aa, Homo Sapiens
TCTRTQAQH

SEQ ID NO: 245559 - protein, 9 aa, Homo Sapiens
YLAAVKRLQ

SEQ ID NO: 245560 - protein, 9 aa, Homo Sapiens
NFYHVANWL

SEQ ID NO: 245561 - protein, 9 aa, Homo Sapiens
TYKEVARYQ

SEQ ID NO: 245562 - protein, 9 aa, Homo Sapiens
SQLQNKFYL

SEQ ID NO: 245563 - protein, 9 aa, Homo Sapiens
PPIQFHQLA

SEQ ID NO: 245564 - protein, 9 aa, Homo Sapiens
RFSLRLYEH

SEQ ID NO: 245565 - protein, 9 aa, Homo Sapiens
FLDIDPRYT

SEQ ID NO: 245566 - protein, 9 aa, Homo Sapiens
GQLYEMFSL

SEQ ID NO: 245567 - protein, 9 aa, Homo Sapiens
VFKRISKRM

SEQ ID NO: 245568 - protein, 9 aa, Homo Sapiens
VLKQNVLVP

SEQ ID NO: 245569 - protein, 9 aa, Homo Sapiens
VERKYVADY

SEQ ID NO: 245570 - protein, 9 aa, Homo Sapiens
DFLPSQPRY

SEQ ID NO: 245571 - protein, 9 aa, Homo Sapiens
PGEFLCYVN

SEQ ID NO: 245572 - protein, 9 aa, Homo Sapiens
TVCQEVKTL

SEQ ID NO: 245573 - protein, 9 aa, Homo Sapiens
PQQEKHKQK

SEQ ID NO: 245574 - protein, 9 aa, Homo Sapiens
EYQSNEMEV

SEQ ID NO: 245575 - protein, 9 aa, Homo Sapiens
IRVKSLKSH

SEQ ID NO: 245576 - protein, 9 aa, Homo Sapiens
VPPPRPPQG

SEQ ID NO: 245577 - protein, 9 aa, Homo Sapiens
STLREKSQR

SEQ ID NO: 245578 - protein, 9 aa, Homo Sapiens
KYVRLHEVP

SEQ ID NO: 245579 - protein, 9 aa, Homo Sapiens
YSATFQSLV

SEQ ID NO: 245580 - protein, 9 aa, Homo Sapiens
SSDEELSGG

SEQ ID NO: 245581 - protein, 9 aa, Homo Sapiens
YYKSLLSVE

SEQ ID NO: 245582 - protein, 9 aa, Homo Sapiens
REGDKVTLI

SEQ ID NO: 245583 - protein, 9 aa, Homo Sapiens
FLKTILHHI

SEQ ID NO: 245584 - protein, 9 aa, Homo Sapiens
KETSPNHPG

SEQ ID NO: 245585 - protein, 9 aa, Homo Sapiens
GNFILRDSE

SEQ ID NO: 245586 - protein, 9 aa, Homo Sapiens
MYGRKGLPP

SEQ ID NO: 245587 - protein, 9 aa, Homo Sapiens
AAQHVESQQ

SEQ ID NO: 245588 - protein, 9 aa, Homo Sapiens
KSSGKKCLP

SEQ ID NO: 245589 - protein, 9 aa, Homo Sapiens
MQDTINKLK

SEQ ID NO: 245590 - protein, 9 aa, Homo Sapiens
MVSVAAGLP

SEQ ID NO: 245591 - protein, 9 aa, Homo Sapiens
RHLHEYMGM

SEQ ID NO: 245592 - protein, 9 aa, Homo Sapiens
SDTSPILTE

SEQ ID NO: 245593 - protein, 9 aa, Homo Sapiens
VQRSVFGEI

SEQ ID NO: 245594 - protein, 9 aa, Homo Sapiens
MTTASMSLM

SEQ ID NO: 245595 - protein, 9 aa, Homo Sapiens
RRTGISAPV

SEQ ID NO: 245596 - protein, 9 aa, Homo Sapiens
HLDDSSSFC

SEQ ID NO: 245597 - protein, 9 aa, Homo Sapiens
YRPIQQRVY

SEQ ID NO: 245598 - protein, 9 aa, Homo Sapiens
LLVERRWHA

SEQ ID NO: 245599 - protein, 9 aa, Homo Sapiens
INSTWDAKQ

SEQ ID NO: 245600 - protein, 9 aa, Homo Sapiens
SSGGSEFFR

SEQ ID NO: 245601 - protein, 9 aa, Homo Sapiens
HIKEKQHKK

SEQ ID NO: 245602 - protein, 9 aa, Homo Sapiens
TFSCMFFGA

SEQ ID NO: 245603 - protein, 9 aa, Homo Sapiens
TQNYSTMFA

SEQ ID NO: 245604 - protein, 9 aa, Homo Sapiens
FKRRHQTFP

SEQ ID NO: 245605 - protein, 9 aa, Homo Sapiens
GIQPSPHKP

SEQ ID NO: 245606 - protein, 9 aa, Homo Sapiens
LKVLSAQKA

SEQ ID NO: 245607 - protein, 9 aa, Homo Sapiens
YGVFSQRFE

SEQ ID NO: 245608 - protein, 9 aa, Homo Sapiens
WQNILVDRQ

SEQ ID NO: 245609 - protein, 9 aa, Homo Sapiens
IRGHLYPTE

SEQ ID NO: 245610 - protein, 9 aa, Homo Sapiens
GLAWITQGQ

SEQ ID NO: 245611 - protein, 9 aa, Homo Sapiens
SEKTNNRIH

SEQ ID NO: 245612 - protein, 9 aa, Homo Sapiens
KHLICVLNK

SEQ ID NO: 245613 - protein, 9 aa, Homo Sapiens
AINSYTWGI

SEQ ID NO: 245614 - protein, 9 aa, Homo Sapiens
RYRSRTSFS

SEQ ID NO: 245615 - protein, 9 aa, Homo Sapiens
EAKFVTFSL

SEQ ID NO: 245616 - protein, 9 aa, Homo Sapiens
EFEEAYRFG

SEQ ID NO: 245617 - protein, 9 aa, Homo Sapiens
LHQAFSDYQ

SEQ ID NO: 245618 - protein, 9 aa, Homo Sapiens
IKELQDAAT

SEQ ID NO: 245619 - protein, 9 aa, Homo Sapiens
VVYRYAHTL

SEQ ID NO: 245620 - protein, 9 aa, Homo Sapiens
PTVHSSETA

SEQ ID NO: 245621 - protein, 9 aa, Homo Sapiens
NCGAWSKSE

SEQ ID NO: 245622 - protein, 9 aa, Homo Sapiens
NNSGAGEKK

SEQ ID NO: 245623 - protein, 9 aa, Homo Sapiens
ESFQELNSL

SEQ ID NO: 245624 - protein, 9 aa, Homo Sapiens
ILLAFQVFI

SEQ ID NO: 245625 - protein, 9 aa, Homo Sapiens
LWETRVLGV

SEQ ID NO: 245626 - protein, 9 aa, Homo Sapiens
RSASENLGE

SEQ ID NO: 245627 - protein, 9 aa, Homo Sapiens
SRLYNATNG

SEQ ID NO: 245628 - protein, 9 aa, Homo Sapiens
TELKKLEKY

SEQ ID NO: 245629 - protein, 9 aa, Homo Sapiens
LGEMRKKIY

SEQ ID NO: 245630 - protein, 9 aa, Homo Sapiens
FRLNSIHFI

SEQ ID NO: 245631 - protein, 9 aa, Homo Sapiens
GPNNVPYSA

SEQ ID NO: 245632 - protein, 9 aa, Homo Sapiens
NISSTLNTH

SEQ ID NO: 245633 - protein, 9 aa, Homo Sapiens
VKTAFMKVV

SEQ ID NO: 245634 - protein, 9 aa, Homo Sapiens
GQSVVYVAT

SEQ ID NO: 245635 - protein, 9 aa, Homo Sapiens
MDPSLCLLN

SEQ ID NO: 245636 - protein, 9 aa, Homo Sapiens
VHSQTYTTS

SEQ ID NO: 245637 - protein, 9 aa, Homo Sapiens
SQEDTHCIL

SEQ ID NO: 245638 - protein, 9 aa, Homo Sapiens
PEHETFVLK

SEQ ID NO: 245639 - protein, 9 aa, Homo Sapiens
ILAVAKKAE

SEQ ID NO: 245640 - protein, 9 aa, Homo Sapiens
LGIKDSGDM

SEQ ID NO: 245641 - protein, 9 aa, Homo Sapiens
PPLHPLLII

SEQ ID NO: 245642 - protein, 9 aa, Homo Sapiens
RSQCKEIML

SEQ ID NO: 245643 - protein, 9 aa, Homo Sapiens
PDQEYFSLN

SEQ ID NO: 245644 - protein, 9 aa, Homo Sapiens
CGHCQALVP

SEQ ID NO: 245645 - protein, 9 aa, Homo Sapiens
PVTEPPLEE

SEQ ID NO: 245646 - protein, 9 aa, Homo Sapiens
TCLLGFSLL

SEQ ID NO: 245647 - protein, 9 aa, Homo Sapiens
ETAVILASY

SEQ ID NO: 245648 - protein, 9 aa, Homo Sapiens
WPCDSRYFW

SEQ ID NO: 245649 - protein, 9 aa, Homo Sapiens
SECSQSGKL

SEQ ID NO: 245650 - protein, 9 aa, Homo Sapiens
KCLAPIQDP

SEQ ID NO: 245651 - protein, 9 aa, Homo Sapiens
CVRKFILDY

SEQ ID NO: 245652 - protein, 9 aa, Homo Sapiens
RFNPHLQAP

SEQ ID NO: 245653 - protein, 9 aa, Homo Sapiens
GTCQGQWQA

SEQ ID NO: 245654 - protein, 9 aa, Homo Sapiens
LSLTENYHN

SEQ ID NO: 245655 - protein, 9 aa, Homo Sapiens
DFSDRATKN

SEQ ID NO: 245656 - protein, 9 aa, Homo Sapiens
HVVVSGDTM

SEQ ID NO: 245657 - protein, 9 aa, Homo Sapiens
PEVVFLQPR

SEQ ID NO: 245658 - protein, 9 aa, Homo Sapiens
YFDDIAYIR

SEQ ID NO: 245659 - protein, 9 aa, Homo Sapiens
KLMGFVDDQ

SEQ ID NO: 245660 - protein, 9 aa, Homo Sapiens
VCPTLPAGF

SEQ ID NO: 245661 - protein, 9 aa, Homo Sapiens
KITSMETAL

SEQ ID NO: 245662 - protein, 9 aa, Homo Sapiens
IMSGGCDTQ

SEQ ID NO: 245663 - protein, 9 aa, Homo Sapiens
IYVKTRSSW

SEQ ID NO: 245664 - protein, 9 aa, Homo Sapiens
VKEDTFKWN

SEQ ID NO: 245665 - protein, 9 aa, Homo Sapiens
IDNINLTNG

SEQ ID NO: 245666 - protein, 9 aa, Homo Sapiens
RGTTVQKSK

SEQ ID NO: 245667 - protein, 9 aa, Homo Sapiens
VKPTVTIIV

SEQ ID NO: 245668 - protein, 9 aa, Homo Sapiens
PRHISVVMD

SEQ ID NO: 245669 - protein, 9 aa, Homo Sapiens
YDLLCTIMG

SEQ ID NO: 245670 - protein, 9 aa, Homo Sapiens
NFLPFQIDH

SEQ ID NO: 245671 - protein, 9 aa, Homo Sapiens
EATLTKLGN

SEQ ID NO: 245672 - protein, 9 aa, Homo Sapiens
VANADYSSK

SEQ ID NO: 245673 - protein, 9 aa, Homo Sapiens
LASIYYPDH

SEQ ID NO: 245674 - protein, 9 aa, Homo Sapiens
KAGMGRDSA

SEQ ID NO: 245675 - protein, 9 aa, Homo Sapiens
NQHQDKDQH

SEQ ID NO: 245676 - protein, 9 aa, Homo Sapiens
ADTQHSRVL

SEQ ID NO: 245677 - protein, 9 aa, Homo Sapiens
GQELSKCNP

SEQ ID NO: 245678 - protein, 9 aa, Homo Sapiens
HYRKDSPLV

SEQ ID NO: 245679 - protein, 9 aa, Homo Sapiens
QNKKMNREY

SEQ ID NO: 245680 - protein, 9 aa, Homo Sapiens
PQPPFLYPG

SEQ ID NO: 245681 - protein, 9 aa, Homo Sapiens
FFGWSWFIP

SEQ ID NO: 245682 - protein, 9 aa, Homo Sapiens
YLIVHCKTH

SEQ ID NO: 245683 - protein, 9 aa, Homo Sapiens
SQFQMLFTS

SEQ ID NO: 245684 - protein, 9 aa, Homo Sapiens
TFENVDEVS

SEQ ID NO: 245685 - protein, 9 aa, Homo Sapiens
LVGHQQIIH

SEQ ID NO: 245686 - protein, 9 aa, Homo Sapiens
LSAEPPSKP

SEQ ID NO: 245687 - protein, 9 aa, Homo Sapiens
YTNFDKNRN

SEQ ID NO: 245688 - protein, 9 aa, Homo Sapiens
FFGRRKDML

SEQ ID NO: 245689 - protein, 9 aa, Homo Sapiens
PSDKGSLVF

SEQ ID NO: 245690 - protein, 9 aa, Homo Sapiens
GSHFFICTA

SEQ ID NO: 245691 - protein, 9 aa, Homo Sapiens
IGKWRFRIQ

SEQ ID NO: 245692 - protein, 9 aa, Homo Sapiens
VSLQKQNTM

SEQ ID NO: 245693 - protein, 9 aa, Homo Sapiens
VPAPFLDHT

SEQ ID NO: 245694 - protein, 9 aa, Homo Sapiens
RYNTRVYKQ

SEQ ID NO: 245695 - protein, 9 aa, Homo Sapiens
ACNDVDLWP

SEQ ID NO: 245696 - protein, 9 aa, Homo Sapiens
EKLSQICLN

SEQ ID NO: 245697 - protein, 9 aa, Homo Sapiens
AGLKLLTSS

SEQ ID NO: 245698 - protein, 9 aa, Homo Sapiens
QWLLYAQNV

SEQ ID NO: 245699 - protein, 9 aa, Homo Sapiens
TVCDLFCNP

SEQ ID NO: 245700 - protein, 9 aa, Homo Sapiens
ELTKMRAKK

SEQ ID NO: 245701 - protein, 9 aa, Homo Sapiens
RWIVHGLVP

SEQ ID NO: 245702 - protein, 9 aa, Homo Sapiens
QENDYSFED

SEQ ID NO: 245703 - protein, 9 aa, Homo Sapiens
RIQRQTPRL

SEQ ID NO: 245704 - protein, 9 aa, Homo Sapiens
AISTLQKAI

SEQ ID NO: 245705 - protein, 9 aa, Homo Sapiens
SSYSSQSSS

SEQ ID NO: 245706 - protein, 9 aa, Homo Sapiens
PLSGCFDMF

SEQ ID NO: 245707 - protein, 9 aa, Homo Sapiens
HIQGTHTII

SEQ ID NO: 245708 - protein, 9 aa, Homo Sapiens
ILFLTCVSA

SEQ ID NO: 245709 - protein, 9 aa, Homo Sapiens
KFSIKTSFH

SEQ ID NO: 245710 - protein, 9 aa, Homo Sapiens
WPHGCVSGP

SEQ ID NO: 245711 - protein, 9 aa, Homo Sapiens
WGRSEGDPM

SEQ ID NO: 245712 - protein, 9 aa, Homo Sapiens
KVAGEAEKY

SEQ ID NO: 245713 - protein, 9 aa, Homo Sapiens
NQSSTKHPG

SEQ ID NO: 245714 - protein, 9 aa, Homo Sapiens
KINKGGLNG

SEQ ID NO: 245715 - protein, 9 aa, Homo Sapiens
FELSEFQRK

SEQ ID NO: 245716 - protein, 9 aa, Homo Sapiens
LLKATTLIQ

SEQ ID NO: 245717 - protein, 9 aa, Homo Sapiens
SPTLFNCLM

SEQ ID NO: 245718 - protein, 9 aa, Homo Sapiens
SILANIGPK

SEQ ID NO: 245719 - protein, 9 aa, Homo Sapiens
QLENSPLGE

SEQ ID NO: 245720 - protein, 9 aa, Homo Sapiens
AIVGSLPGL

SEQ ID NO: 245721 - protein, 9 aa, Homo Sapiens
CIALSLALA

SEQ ID NO: 245722 - protein, 9 aa, Homo Sapiens
YLANVFEKK

SEQ ID NO: 245723 - protein, 9 aa, Homo Sapiens
RSAMRGCAT

SEQ ID NO: 245724 - protein, 9 aa, Homo Sapiens
KVFIGGVPW

SEQ ID NO: 245725 - protein, 9 aa, Homo Sapiens
RGEEPMFVV

SEQ ID NO: 245726 - protein, 9 aa, Homo Sapiens
APSLYIIHL

SEQ ID NO: 245727 - protein, 9 aa, Homo Sapiens
PVTLNLLPQ

SEQ ID NO: 245728 - protein, 9 aa, Homo Sapiens
NVAFVANLF

SEQ ID NO: 245729 - protein, 9 aa, Homo Sapiens
RGALQATGF

SEQ ID NO: 245730 - protein, 9 aa, Homo Sapiens
FYDRNYIEK

SEQ ID NO: 245731 - protein, 9 aa, Homo Sapiens
GGKSTHQAA

SEQ ID NO: 245732 - protein, 9 aa, Homo Sapiens
QKQKLSLKL

SEQ ID NO: 245733 - protein, 9 aa, Homo Sapiens
LGVFQGPDI

SEQ ID NO: 245734 - protein, 9 aa, Homo Sapiens
VSSEGEGQI

SEQ ID NO: 245735 - protein, 9 aa, Homo Sapiens
EQAKKMNIS

SEQ ID NO: 245736 - protein, 9 aa, Homo Sapiens
HLIVHQIIH

SEQ ID NO: 245737 - protein, 9 aa, Homo Sapiens
DLPRPQAPP

SEQ ID NO: 245738 - protein, 9 aa, Homo Sapiens
LPVGCTQGS

SEQ ID NO: 245739 - protein, 9 aa, Homo Sapiens
DHMNLLQRM

SEQ ID NO: 245740 - protein, 9 aa, Homo Sapiens
YLYFYKKTS

SEQ ID NO: 245741 - protein, 9 aa, Homo Sapiens
LLDVNEDGK

SEQ ID NO: 245742 - protein, 9 aa, Homo Sapiens
LVDGEEHVS

SEQ ID NO: 245743 - protein, 9 aa, Homo Sapiens
KNVYIELTL

SEQ ID NO: 245744 - protein, 9 aa, Homo Sapiens
TSLLSNSSP

SEQ ID NO: 245745 - protein, 9 aa, Homo Sapiens
NLLQQYYLS

SEQ ID NO: 245746 - protein, 9 aa, Homo Sapiens
KCPYLNLFQ

SEQ ID NO: 245747 - protein, 9 aa, Homo Sapiens
KQHFCGRRN

SEQ ID NO: 245748 - protein, 9 aa, Homo Sapiens
ADKQSGKNR

SEQ ID NO: 245749 - protein, 9 aa, Homo Sapiens
CPQRDNWKG

SEQ ID NO: 245750 - protein, 9 aa, Homo Sapiens
ILEESYQEQ

SEQ ID NO: 245751 - protein, 9 aa, Homo Sapiens
EDFQTLLFK

SEQ ID NO: 245752 - protein, 9 aa, Homo Sapiens
ERSDNISEA

SEQ ID NO: 245753 - protein, 9 aa, Homo Sapiens
YEEVVLQAV

SEQ ID NO: 245754 - protein, 9 aa, Homo Sapiens
AEPPSKPSF

SEQ ID NO: 245755 - protein, 9 aa, Homo Sapiens
YLRFGVQVL

SEQ ID NO: 245756 - protein, 9 aa, Homo Sapiens
DKEENSKVM

SEQ ID NO: 245757 - protein, 9 aa, Homo Sapiens
LYLQPHASS

SEQ ID NO: 245758 - protein, 9 aa, Homo Sapiens
SRMMFYPPP

SEQ ID NO: 245759 - protein, 9 aa, Homo Sapiens
VLGVYLLWF

SEQ ID NO: 245760 - protein, 9 aa, Homo Sapiens
TCEYRGKVF

SEQ ID NO: 245761 - protein, 9 aa, Homo Sapiens
NVSKFSDCT

SEQ ID NO: 245762 - protein, 9 aa, Homo Sapiens
MNDIYLTPN

SEQ ID NO: 245763 - protein, 9 aa, Homo Sapiens
IIKLKELVC

SEQ ID NO: 245764 - protein, 9 aa, Homo Sapiens
KFCIAGFRR

SEQ ID NO: 245765 - protein, 9 aa, Homo Sapiens
PPPESFGSV

SEQ ID NO: 245766 - protein, 9 aa, Homo Sapiens
GNLQRIVKS

SEQ ID NO: 245767 - protein, 9 aa, Homo Sapiens
RGGYNRFAS

SEQ ID NO: 245768 - protein, 9 aa, Homo Sapiens
RKFYMDKVL

SEQ ID NO: 245769 - protein, 9 aa, Homo Sapiens
IIHTAKKTY

SEQ ID NO: 245770 - protein, 9 aa, Homo Sapiens
LTNVLCTLP

SEQ ID NO: 245771 - protein, 9 aa, Homo Sapiens
VEGGATLFT

SEQ ID NO: 245772 - protein, 9 aa, Homo Sapiens
QPESMVRVE

SEQ ID NO: 245773 - protein, 9 aa, Homo Sapiens
MDSKHQCVQ

SEQ ID NO: 245774 - protein, 9 aa, Homo Sapiens
ITIRHDTFS

SEQ ID NO: 245775 - protein, 9 aa, Homo Sapiens
SGSSASSSS

SEQ ID NO: 245776 - protein, 9 aa, Homo Sapiens
RMQFGAPLA

SEQ ID NO: 245777 - protein, 9 aa, Homo Sapiens
PLYVLKVFG

SEQ ID NO: 245778 - protein, 9 aa, Homo Sapiens
VKGQETFAP

SEQ ID NO: 245779 - protein, 9 aa, Homo Sapiens
TKMAKHIQK

SEQ ID NO: 245780 - protein, 9 aa, Homo Sapiens
QLNPFNLKV

SEQ ID NO: 245781 - protein, 9 aa, Homo Sapiens
PRGLSNSPW

SEQ ID NO: 245782 - protein, 9 aa, Homo Sapiens
ISDPNLFKM

SEQ ID NO: 245783 - protein, 9 aa, Homo Sapiens
EMFIKDANL

SEQ ID NO: 245784 - protein, 9 aa, Homo Sapiens
QLEAVDKYE

SEQ ID NO: 245785 - protein, 9 aa, Homo Sapiens
QGPQGDKGD

SEQ ID NO: 245786 - protein, 9 aa, Homo Sapiens
PFLLILISD

SEQ ID NO: 245787 - protein, 9 aa, Homo Sapiens
RKGSKMRQH

SEQ ID NO: 245788 - protein, 9 aa, Homo Sapiens
LAAHNNFEN

SEQ ID NO: 245789 - protein, 9 aa, Homo Sapiens
SSEFVQEAV

SEQ ID NO: 245790 - protein, 9 aa, Homo Sapiens
SPALAYHVA

SEQ ID NO: 245791 - protein, 9 aa, Homo Sapiens
ICGNNFGQS

SEQ ID NO: 245792 - protein, 9 aa, Homo Sapiens
PESSCIGAA

SEQ ID NO: 245793 - protein, 9 aa, Homo Sapiens
KKCFSGEVY

SEQ ID NO: 245794 - protein, 9 aa, Homo Sapiens
CIALLVEEK

SEQ ID NO: 245795 - protein, 9 aa, Homo Sapiens
LMVFPPAFY

SEQ ID NO: 245796 - protein, 9 aa, Homo Sapiens
FFLYNQGPE

SEQ ID NO: 245797 - protein, 9 aa, Homo Sapiens
GLSIHICTT

SEQ ID NO: 245798 - protein, 9 aa, Homo Sapiens
IIHTGEKSF

SEQ ID NO: 245799 - protein, 9 aa, Homo Sapiens
NSYARVQAV

SEQ ID NO: 245800 - protein, 9 aa, Homo Sapiens
RQPRPNSQY

SEQ ID NO: 245801 - protein, 9 aa, Homo Sapiens
EQLSQRLKN

SEQ ID NO: 245802 - protein, 9 aa, Homo Sapiens
RLGSSPPVL

SEQ ID NO: 245803 - protein, 9 aa, Homo Sapiens
YLVTAEDSS

SEQ ID NO: 245804 - protein, 9 aa, Homo Sapiens
SSFFQKHGK

SEQ ID NO: 245805 - protein, 9 aa, Homo Sapiens
YSTEANTGN

SEQ ID NO: 245806 - protein, 9 aa, Homo Sapiens
QKVMWRFDG

SEQ ID NO: 245807 - protein, 9 aa, Homo Sapiens
DRLKPALRK

SEQ ID NO: 245808 - protein, 9 aa, Homo Sapiens
INRDPVLMY

SEQ ID NO: 245809 - protein, 9 aa, Homo Sapiens
LFTSGQSEV

SEQ ID NO: 245810 - protein, 9 aa, Homo Sapiens
CKMSLEITD

SEQ ID NO: 245811 - protein, 9 aa, Homo Sapiens
AEIRRIKSL

SEQ ID NO: 245812 - protein, 9 aa, Homo Sapiens
ISCKTETHA

SEQ ID NO: 245813 - protein, 9 aa, Homo Sapiens
QADIEQMYG

SEQ ID NO: 245814 - protein, 9 aa, Homo Sapiens
LDEGHVQAG

SEQ ID NO: 245815 - protein, 9 aa, Homo Sapiens
ANPGSWFSE

SEQ ID NO: 245816 - protein, 9 aa, Homo Sapiens
EEECALEII

SEQ ID NO: 245817 - protein, 9 aa, Homo Sapiens
VLIAKASVF

SEQ ID NO: 245818 - protein, 9 aa, Homo Sapiens
KMQKTIQMW

SEQ ID NO: 245819 - protein, 9 aa, Homo Sapiens
PFTLEEKQR

SEQ ID NO: 245820 - protein, 9 aa, Homo Sapiens
HNLIAQSQS

SEQ ID NO: 245821 - protein, 9 aa, Homo Sapiens
VELQEMDSS

SEQ ID NO: 245822 - protein, 9 aa, Homo Sapiens
FYFSEAPMF

SEQ ID NO: 245823 - protein, 9 aa, Homo Sapiens
PQAKVDFIL

SEQ ID NO: 245824 - protein, 9 aa, Homo Sapiens
QKLFLYFSY

SEQ ID NO: 245825 - protein, 9 aa, Homo Sapiens
NKSKSLSYT

SEQ ID NO: 245826 - protein, 9 aa, Homo Sapiens
VISLEEGLF

SEQ ID NO: 245827 - protein, 9 aa, Homo Sapiens
ERLRKHQIH

SEQ ID NO: 245828 - protein, 9 aa, Homo Sapiens
YVKITLRNL

SEQ ID NO: 245829 - protein, 9 aa, Homo Sapiens
PQQLQPGAH

SEQ ID NO: 245830 - protein, 9 aa, Homo Sapiens
PIMSPGNAR

SEQ ID NO: 245831 - protein, 9 aa, Homo Sapiens
QEWHWMDPI

SEQ ID NO: 245832 - protein, 9 aa, Homo Sapiens
SGTCLTSQG

SEQ ID NO: 245833 - protein, 9 aa, Homo Sapiens
SETLGHGYF

SEQ ID NO: 245834 - protein, 9 aa, Homo Sapiens
LLSQTAGFS

SEQ ID NO: 245835 - protein, 9 aa, Homo Sapiens
SQERLWALL

SEQ ID NO: 245836 - protein, 9 aa, Homo Sapiens
KQCFRDFCF

SEQ ID NO: 245837 - protein, 9 aa, Homo Sapiens
HSGKAMRKA

SEQ ID NO: 245838 - protein, 9 aa, Homo Sapiens
LYVVKPLNY

SEQ ID NO: 245839 - protein, 9 aa, Homo Sapiens
LTRVTKFIL

SEQ ID NO: 245840 - protein, 9 aa, Homo Sapiens
ISQHENIFP

SEQ ID NO: 245841 - protein, 9 aa, Homo Sapiens
RGTFLFISV

SEQ ID NO: 245842 - protein, 9 aa, Homo Sapiens
AFDKMKGQM

SEQ ID NO: 245843 - protein, 9 aa, Homo Sapiens
FRKVQQSFA

SEQ ID NO: 245844 - protein, 9 aa, Homo Sapiens
MLASSCCSS

SEQ ID NO: 245845 - protein, 9 aa, Homo Sapiens
QVDFLRLST

SEQ ID NO: 245846 - protein, 9 aa, Homo Sapiens
LTCPNDQTC

SEQ ID NO: 245847 - protein, 9 aa, Homo Sapiens
IAHQQHGVT

SEQ ID NO: 245848 - protein, 9 aa, Homo Sapiens
ECKECEKVF

SEQ ID NO: 245849 - protein, 9 aa, Homo Sapiens
GNLEEFEVD

SEQ ID NO: 245850 - protein, 9 aa, Homo Sapiens
EIDRYASDN

SEQ ID NO: 245851 - protein, 9 aa, Homo Sapiens
SDETEDIFL

SEQ ID NO: 245852 - protein, 9 aa, Homo Sapiens
QDAEARVGL

SEQ ID NO: 245853 - protein, 9 aa, Homo Sapiens
NAIIFSYGH

SEQ ID NO: 245854 - protein, 9 aa, Homo Sapiens
TGSYNGVLY

SEQ ID NO: 245855 - protein, 9 aa, Homo Sapiens
AIDGMSVVL

SEQ ID NO: 245856 - protein, 9 aa, Homo Sapiens
VAGVEAFAK

SEQ ID NO: 245857 - protein, 9 aa, Homo Sapiens
LRKAYGRNK

SEQ ID NO: 245858 - protein, 9 aa, Homo Sapiens
LKSDMYLEY

SEQ ID NO: 245859 - protein, 9 aa, Homo Sapiens
TTPYLALLA

SEQ ID NO: 245860 - protein, 9 aa, Homo Sapiens
FHIVERLAS

SEQ ID NO: 245861 - protein, 9 aa, Homo Sapiens
PHIKYPSNF

SEQ ID NO: 245862 - protein, 9 aa, Homo Sapiens
KRVEANPRD

SEQ ID NO: 245863 - protein, 9 aa, Homo Sapiens
LMQKDLKRY

SEQ ID NO: 245864 - protein, 9 aa, Homo Sapiens
ANLCQVIQI

SEQ ID NO: 245865 - protein, 9 aa, Homo Sapiens
VREVAKEAQ

SEQ ID NO: 245866 - protein, 9 aa, Homo Sapiens
DLAGDFQMK

SEQ ID NO: 245867 - protein, 9 aa, Homo Sapiens
SLFGDVLSE

SEQ ID NO: 245868 - protein, 9 aa, Homo Sapiens
IDSEEELIH

SEQ ID NO: 245869 - protein, 9 aa, Homo Sapiens
SLSTGIADF

SEQ ID NO: 245870 - protein, 9 aa, Homo Sapiens
LRNTEVKGA

SEQ ID NO: 245871 - protein, 9 aa, Homo Sapiens
MVEAKVGQD

SEQ ID NO: 245872 - protein, 9 aa, Homo Sapiens
AFWLSWCLL

SEQ ID NO: 245873 - protein, 9 aa, Homo Sapiens
DFGGHRGLV

SEQ ID NO: 245874 - protein, 9 aa, Homo Sapiens
MKIETSLRE

SEQ ID NO: 245875 - protein, 9 aa, Homo Sapiens
KEVITLDEL

SEQ ID NO: 245876 - protein, 9 aa, Homo Sapiens
KHIPSDGHC

SEQ ID NO: 245877 - protein, 9 aa, Homo Sapiens
LTNKNENYK

SEQ ID NO: 245878 - protein, 9 aa, Homo Sapiens
TKLSDYFLL

SEQ ID NO: 245879 - protein, 9 aa, Homo Sapiens
VYFEQLALK

SEQ ID NO: 245880 - protein, 9 aa, Homo Sapiens
HVFHTSCLR

SEQ ID NO: 245881 - protein, 9 aa, Homo Sapiens
PNTESYGDM

SEQ ID NO: 245882 - protein, 9 aa, Homo Sapiens
GCSYTAIST

SEQ ID NO: 245883 - protein, 9 aa, Homo Sapiens
DSVFSVVRH

SEQ ID NO: 245884 - protein, 9 aa, Homo Sapiens
GALSLPSTD

SEQ ID NO: 245885 - protein, 9 aa, Homo Sapiens
EAFAKLQTD

SEQ ID NO: 245886 - protein, 9 aa, Homo Sapiens
HFRAKLASC

SEQ ID NO: 245887 - protein, 9 aa, Homo Sapiens
SPQISSEAA

SEQ ID NO: 245888 - protein, 9 aa, Homo Sapiens
IVLAVHYCH

SEQ ID NO: 245889 - protein, 9 aa, Homo Sapiens
EANYYEEIV

SEQ ID NO: 245890 - protein, 9 aa, Homo Sapiens
VHVNRFVVR

SEQ ID NO: 245891 - protein, 9 aa, Homo Sapiens
NYLSRKMAF

SEQ ID NO: 245892 - protein, 9 aa, Homo Sapiens
TTRLFCPQP

SEQ ID NO: 245893 - protein, 9 aa, Homo Sapiens
TSLNSTLQG

SEQ ID NO: 245894 - protein, 9 aa, Homo Sapiens
SSKAFPDDV

SEQ ID NO: 245895 - protein, 9 aa, Homo Sapiens
ASLLGLLSQ

SEQ ID NO: 245896 - protein, 9 aa, Homo Sapiens
YQRQTELQD

SEQ ID NO: 245897 - protein, 9 aa, Homo Sapiens
KDSLIDRGR

SEQ ID NO: 245898 - protein, 9 aa, Homo Sapiens
RTLHAFSAI

SEQ ID NO: 245899 - protein, 9 aa, Homo Sapiens
VFGMGKEVG

SEQ ID NO: 245900 - protein, 9 aa, Homo Sapiens
NVYFASLQE

SEQ ID NO: 245901 - protein, 9 aa, Homo Sapiens
PQEPFWESG

SEQ ID NO: 245902 - protein, 9 aa, Homo Sapiens
PNWVRKVCI

SEQ ID NO: 245903 - protein, 9 aa, Homo Sapiens
AANDIKWQT

SEQ ID NO: 245904 - protein, 9 aa, Homo Sapiens
IMDNKRCAR

SEQ ID NO: 245905 - protein, 9 aa, Homo Sapiens
AFLQRLERG

SEQ ID NO: 245906 - protein, 9 aa, Homo Sapiens
SVLEAIAGE

SEQ ID NO: 245907 - protein, 9 aa, Homo Sapiens
VVKESHVNQ

SEQ ID NO: 245908 - protein, 9 aa, Homo Sapiens
AINYEGRLE

SEQ ID NO: 245909 - protein, 9 aa, Homo Sapiens
QGRLGRQGN

SEQ ID NO: 245910 - protein, 9 aa, Homo Sapiens
AETKFEASR

SEQ ID NO: 245911 - protein, 9 aa, Homo Sapiens
VTKLVDRTR

SEQ ID NO: 245912 - protein, 9 aa, Homo Sapiens
TSASFLWPL

SEQ ID NO: 245913 - protein, 9 aa, Homo Sapiens
PTELGGCEI

SEQ ID NO: 245914 - protein, 9 aa, Homo Sapiens
QFQMLFTSF

SEQ ID NO: 245915 - protein, 9 aa, Homo Sapiens
NRGPENSKN

SEQ ID NO: 245916 - protein, 9 aa, Homo Sapiens
ALDIYGRTA

SEQ ID NO: 245917 - protein, 9 aa, Homo Sapiens
SPLTGKFTA

SEQ ID NO: 245918 - protein, 9 aa, Homo Sapiens
LFCLNLPSS

SEQ ID NO: 245919 - protein, 9 aa, Homo Sapiens
DSDNVELNC

SEQ ID NO: 245920 - protein, 9 aa, Homo Sapiens
ELCRQDAKG

SEQ ID NO: 245921 - protein, 9 aa, Homo Sapiens
PVLLPTSPG

SEQ ID NO: 245922 - protein, 9 aa, Homo Sapiens
INLFKGLSC

SEQ ID NO: 245923 - protein, 9 aa, Homo Sapiens
LHLCSTENI

SEQ ID NO: 245924 - protein, 9 aa, Homo Sapiens
QKGVKVSPL

SEQ ID NO: 245925 - protein, 9 aa, Homo Sapiens
TNNICFYST

SEQ ID NO: 245926 - protein, 9 aa, Homo Sapiens
SVVLQKEEK

SEQ ID NO: 245927 - protein, 9 aa, Homo Sapiens
SDSSTSSYS

SEQ ID NO: 245928 - protein, 9 aa, Homo Sapiens
FRDCFLEGD

SEQ ID NO: 245929 - protein, 9 aa, Homo Sapiens
NSMKIYLVQ

SEQ ID NO: 245930 - protein, 9 aa, Homo Sapiens
YTGEFDETR

SEQ ID NO: 245931 - protein, 9 aa, Homo Sapiens
RKWKVPDEI

SEQ ID NO: 245932 - protein, 9 aa, Homo Sapiens
MNTAYPRED

SEQ ID NO: 245933 - protein, 9 aa, Homo Sapiens
IAGLLGLAL

SEQ ID NO: 245934 - protein, 9 aa, Homo Sapiens
RMPQERIEA

SEQ ID NO: 245935 - protein, 9 aa, Homo Sapiens
EDKDSTLGQ

SEQ ID NO: 245936 - protein, 9 aa, Homo Sapiens
INKLYVTFV

SEQ ID NO: 245937 - protein, 9 aa, Homo Sapiens
LFWAPIMKW

SEQ ID NO: 245938 - protein, 9 aa, Homo Sapiens
DFQGCMRLI

SEQ ID NO: 245939 - protein, 9 aa, Homo Sapiens
STVILPAPI

SEQ ID NO: 245940 - protein, 9 aa, Homo Sapiens
HQNIHTGQK

SEQ ID NO: 245941 - protein, 9 aa, Homo Sapiens
QIIHTRERS

SEQ ID NO: 245942 - protein, 9 aa, Homo Sapiens
LKNNSKERP

SEQ ID NO: 245943 - protein, 9 aa, Homo Sapiens
ELRQQLDLN

SEQ ID NO: 245944 - protein, 9 aa, Homo Sapiens
IPAHPTLLA

SEQ ID NO: 245945 - protein, 9 aa, Homo Sapiens
KRNGKNHVS

SEQ ID NO: 245946 - protein, 9 aa, Homo Sapiens
QTKALGNQQ

SEQ ID NO: 245947 - protein, 9 aa, Homo Sapiens
NISEYSEAD

SEQ ID NO: 245948 - protein, 9 aa, Homo Sapiens
VQNNKHRYL

SEQ ID NO: 245949 - protein, 9 aa, Homo Sapiens
LQNMIEYRT

SEQ ID NO: 245950 - protein, 9 aa, Homo Sapiens
DRILLSREI

SEQ ID NO: 245951 - protein, 9 aa, Homo Sapiens
RNNTFQTFP

SEQ ID NO: 245952 - protein, 9 aa, Homo Sapiens
YQLQKWTGD

SEQ ID NO: 245953 - protein, 9 aa, Homo Sapiens
KQQSTTFPN

SEQ ID NO: 245954 - protein, 9 aa, Homo Sapiens
LMAKCQMLI

SEQ ID NO: 245955 - protein, 9 aa, Homo Sapiens
GKITDYGKL

SEQ ID NO: 245956 - protein, 9 aa, Homo Sapiens
FSWLLFCAC

SEQ ID NO: 245957 - protein, 9 aa, Homo Sapiens
KIKRTSFVM

SEQ ID NO: 245958 - protein, 9 aa, Homo Sapiens
IYAIRNLTK

SEQ ID NO: 245959 - protein, 9 aa, Homo Sapiens
SSTLTQDKI

SEQ ID NO: 245960 - protein, 9 aa, Homo Sapiens
NQIYIQVSE

SEQ ID NO: 245961 - protein, 9 aa, Homo Sapiens
REYTRNASN

SEQ ID NO: 245962 - protein, 9 aa, Homo Sapiens
ILNANNRRL

SEQ ID NO: 245963 - protein, 9 aa, Homo Sapiens
IGLVEEKDK

SEQ ID NO: 245964 - protein, 9 aa, Homo Sapiens
KDCGKGLSS

SEQ ID NO: 245965 - protein, 9 aa, Homo Sapiens
SKLSPGGGS

SEQ ID NO: 245966 - protein, 9 aa, Homo Sapiens
MNTLKKRNH

SEQ ID NO: 245967 - protein, 9 aa, Homo Sapiens
NKRFLARVS

SEQ ID NO: 245968 - protein, 9 aa, Homo Sapiens
QWLGGLAPP

SEQ ID NO: 245969 - protein, 9 aa, Homo Sapiens
CVHTGERPY

SEQ ID NO: 245970 - protein, 9 aa, Homo Sapiens
GTGNAKQQP

SEQ ID NO: 245971 - protein, 9 aa, Homo Sapiens
ITKIWWVHT

SEQ ID NO: 245972 - protein, 9 aa, Homo Sapiens
DIRLASGGP

SEQ ID NO: 245973 - protein, 9 aa, Homo Sapiens
FSLDVNNLE

SEQ ID NO: 245974 - protein, 9 aa, Homo Sapiens
ATVGLPIGF

SEQ ID NO: 245975 - protein, 9 aa, Homo Sapiens
SDAETDQIM

SEQ ID NO: 245976 - protein, 9 aa, Homo Sapiens
KQSWNPCPD

SEQ ID NO: 245977 - protein, 9 aa, Homo Sapiens
REMEDIAHR

SEQ ID NO: 245978 - protein, 9 aa, Homo Sapiens
ALTLDFATY

SEQ ID NO: 245979 - protein, 9 aa, Homo Sapiens
ALPFSARPC

SEQ ID NO: 245980 - protein, 9 aa, Homo Sapiens
LLGNKEDVT

SEQ ID NO: 245981 - protein, 9 aa, Homo Sapiens
LSAVDEGHV

SEQ ID NO: 245982 - protein, 9 aa, Homo Sapiens
QSTVLTHKQ

SEQ ID NO: 245983 - protein, 9 aa, Homo Sapiens
WAYIVQLSY

SEQ ID NO: 245984 - protein, 9 aa, Homo Sapiens
VICLGETIA

SEQ ID NO: 245985 - protein, 9 aa, Homo Sapiens
HKQTERVIS

SEQ ID NO: 245986 - protein, 9 aa, Homo Sapiens
GADVTAVDF

SEQ ID NO: 245987 - protein, 9 aa, Homo Sapiens
INNSRFYNY

SEQ ID NO: 245988 - protein, 8 aa, Homo Sapiens
AASAAETR

SEQ ID NO: 245989 - protein, 9 aa, Homo Sapiens
PDVPHDFGN

SEQ ID NO: 245990 - protein, 9 aa, Homo Sapiens
DEEVEQFMK

SEQ ID NO: 245991 - protein, 9 aa, Homo Sapiens
IRHWGFHSA

SEQ ID NO: 245992 - protein, 9 aa, Homo Sapiens
IPMYYFFSN

SEQ ID NO: 245993 - protein, 9 aa, Homo Sapiens
KNADNDWFQ

SEQ ID NO: 245994 - protein, 9 aa, Homo Sapiens
RTNPLDRPT

SEQ ID NO: 245995 - protein, 9 aa, Homo Sapiens
LTKKGCNDC

SEQ ID NO: 245996 - protein, 9 aa, Homo Sapiens
SLGEDNFEV

SEQ ID NO: 245997 - protein, 9 aa, Homo Sapiens
PRWEDNCEE

SEQ ID NO: 245998 - protein, 9 aa, Homo Sapiens
RLLFRECCA

SEQ ID NO: 245999 - protein, 9 aa, Homo Sapiens
AWNNGKIRA

SEQ ID NO: 246000 - protein, 9 aa, Homo Sapiens
DYVLTKCNV

SEQ ID NO: 246001 - protein, 9 aa, Homo Sapiens
NYSAVIQRK

SEQ ID NO: 246002 - protein, 9 aa, Homo Sapiens
YLFKGAYYL

SEQ ID NO: 246003 - protein, 9 aa, Homo Sapiens
WVMFVSVSA

SEQ ID NO: 246004 - protein, 9 aa, Homo Sapiens
PWGLLLCMY

SEQ ID NO: 246005 - protein, 9 aa, Homo Sapiens
ACFKEVNYL

SEQ ID NO: 246006 - protein, 9 aa, Homo Sapiens
AGVIALSLV

SEQ ID NO: 246007 - protein, 9 aa, Homo Sapiens
VMLISLSYF

SEQ ID NO: 246008 - protein, 9 aa, Homo Sapiens
CLEHLYYNG

SEQ ID NO: 246009 - protein, 9 aa, Homo Sapiens
LRLGFIFVV

SEQ ID NO: 246010 - protein, 9 aa, Homo Sapiens
IFMENIMLC

SEQ ID NO: 246011 - protein, 9 aa, Homo Sapiens
RLYAISARF

SEQ ID NO: 246012 - protein, 9 aa, Homo Sapiens
FMGNSFGST

SEQ ID NO: 246013 - protein, 9 aa, Homo Sapiens
NQMFEELRL

SEQ ID NO: 246014 - protein, 9 aa, Homo Sapiens
CYVMKHYRL

SEQ ID NO: 246015 - protein, 9 aa, Homo Sapiens
IQQDFLDTY

SEQ ID NO: 246016 - protein, 9 aa, Homo Sapiens
DPVVVILRT

SEQ ID NO: 246017 - protein, 9 aa, Homo Sapiens
IFLPKVRAA

SEQ ID NO: 246018 - protein, 9 aa, Homo Sapiens
ESSTGPSYY

SEQ ID NO: 246019 - protein, 9 aa, Homo Sapiens
LVPPPRLPA

SEQ ID NO: 246020 - protein, 9 aa, Homo Sapiens
IPDLDFPFL

SEQ ID NO: 246021 - protein, 9 aa, Homo Sapiens
LYLPFVPGR

SEQ ID NO: 246022 - protein, 9 aa, Homo Sapiens
HHHQAPSGG

SEQ ID NO: 246023 - protein, 9 aa, Homo Sapiens
WEGANYAVA

SEQ ID NO: 246024 - protein, 9 aa, Homo Sapiens
SIVRDKKCM

SEQ ID NO: 246025 - protein, 9 aa, Homo Sapiens
SAFSLIREM

SEQ ID NO: 246026 - protein, 9 aa, Homo Sapiens
SNKFPHYSP

SEQ ID NO: 246027 - protein, 9 aa, Homo Sapiens
AKQLARNNV

SEQ ID NO: 246028 - protein, 9 aa, Homo Sapiens
LGCVLYKLC

SEQ ID NO: 246029 - protein, 9 aa, Homo Sapiens
HSSLQENKI

SEQ ID NO: 246030 - protein, 9 aa, Homo Sapiens
SSSRHTLKG

SEQ ID NO: 246031 - protein, 9 aa, Homo Sapiens
VKRSVFASP

SEQ ID NO: 246032 - protein, 9 aa, Homo Sapiens
KVQFLNNLN

SEQ ID NO: 246033 - protein, 9 aa, Homo Sapiens
LWMLELSAF

SEQ ID NO: 246034 - protein, 9 aa, Homo Sapiens
ESRPFSNPE

SEQ ID NO: 246035 - protein, 9 aa, Homo Sapiens
RKDKRHLRK

SEQ ID NO: 246036 - protein, 9 aa, Homo Sapiens
DDVISFIKW

SEQ ID NO: 246037 - protein, 9 aa, Homo Sapiens
YRSFKVAGE

SEQ ID NO: 246038 - protein, 9 aa, Homo Sapiens
NKNKWYKSA

SEQ ID NO: 246039 - protein, 9 aa, Homo Sapiens
ENGWVVSHD

SEQ ID NO: 246040 - protein, 9 aa, Homo Sapiens
NWQAVVKGS

SEQ ID NO: 246041 - protein, 9 aa, Homo Sapiens
KNENQFYLK

SEQ ID NO: 246042 - protein, 9 aa, Homo Sapiens
VLGNNSRRQ

SEQ ID NO: 246043 - protein, 9 aa, Homo Sapiens
LRLCVQLVA

SEQ ID NO: 246044 - protein, 9 aa, Homo Sapiens
HGQDYLVGD

SEQ ID NO: 246045 - protein, 9 aa, Homo Sapiens
QVHPGESNA

SEQ ID NO: 246046 - protein, 9 aa, Homo Sapiens
YQRIADGYH

SEQ ID NO: 246047 - protein, 9 aa, Homo Sapiens
NFYDWKRME

SEQ ID NO: 246048 - protein, 9 aa, Homo Sapiens
QMDIENPNL

SEQ ID NO: 246049 - protein, 9 aa, Homo Sapiens
SVMSAPVSL

SEQ ID NO: 246050 - protein, 9 aa, Homo Sapiens
VNIVAISED

SEQ ID NO: 246051 - protein, 9 aa, Homo Sapiens
TRYPEKKIK

SEQ ID NO: 246052 - protein, 9 aa, Homo Sapiens
VSTSNASPP

SEQ ID NO: 246053 - protein, 9 aa, Homo Sapiens
LKTQIQKLD

SEQ ID NO: 246054 - protein, 9 aa, Homo Sapiens
EVARTADHI

SEQ ID NO: 246055 - protein, 9 aa, Homo Sapiens
AKEVRDKLS

SEQ ID NO: 246056 - protein, 9 aa, Homo Sapiens
VFCLLATDT

SEQ ID NO: 246057 - protein, 9 aa, Homo Sapiens
VHPASLNGH

SEQ ID NO: 246058 - protein, 9 aa, Homo Sapiens
SLSHNGKDI

SEQ ID NO: 246059 - protein, 9 aa, Homo Sapiens
LTPSRPAQQ

SEQ ID NO: 246060 - protein, 9 aa, Homo Sapiens
PEPRLKKMK

SEQ ID NO: 246061 - protein, 9 aa, Homo Sapiens
LDDSYLLRD

SEQ ID NO: 246062 - protein, 9 aa, Homo Sapiens
LVPSQLRAF

SEQ ID NO: 246063 - protein, 9 aa, Homo Sapiens
SLESIKSRL

SEQ ID NO: 246064 - protein, 9 aa, Homo Sapiens
TVYLEWNPL

SEQ ID NO: 246065 - protein, 9 aa, Homo Sapiens
RALLLQTPV

SEQ ID NO: 246066 - protein, 9 aa, Homo Sapiens
EKKAKHQGP

SEQ ID NO: 246067 - protein, 9 aa, Homo Sapiens
YLHECLEAA

SEQ ID NO: 246068 - protein, 9 aa, Homo Sapiens
TSSLLTSNM

SEQ ID NO: 246069 - protein, 9 aa, Homo Sapiens
EALDPIDCN

SEQ ID NO: 246070 - protein, 9 aa, Homo Sapiens
LLVSLTSRM

SEQ ID NO: 246071 - protein, 9 aa, Homo Sapiens
LLCEMQNPR

SEQ ID NO: 246072 - protein, 9 aa, Homo Sapiens
RHGTLLLLS

SEQ ID NO: 246073 - protein, 9 aa, Homo Sapiens
IPREPRQIV

SEQ ID NO: 246074 - protein, 9 aa, Homo Sapiens
EASDDDTPF

SEQ ID NO: 246075 - protein, 9 aa, Homo Sapiens
TCGGGVKTA

SEQ ID NO: 246076 - protein, 9 aa, Homo Sapiens
YTSLLSNSS

SEQ ID NO: 246077 - protein, 9 aa, Homo Sapiens
TVKSTGDRL

SEQ ID NO: 246078 - protein, 9 aa, Homo Sapiens
YIKFFVPSW

SEQ ID NO: 246079 - protein, 9 aa, Homo Sapiens
GNFFSNMFS

SEQ ID NO: 246080 - protein, 9 aa, Homo Sapiens
NHVPNNLFF

SEQ ID NO: 246081 - protein, 9 aa, Homo Sapiens
EKSQRLESL

SEQ ID NO: 246082 - protein, 9 aa, Homo Sapiens
IGLALIVLG

SEQ ID NO: 246083 - protein, 9 aa, Homo Sapiens
LHMGGVYWI

SEQ ID NO: 246084 - protein, 9 aa, Homo Sapiens
PIALRNVII

SEQ ID NO: 246085 - protein, 9 aa, Homo Sapiens
LRRIQRQTP

SEQ ID NO: 246086 - protein, 9 aa, Homo Sapiens
RAGWLDKNP

SEQ ID NO: 246087 - protein, 9 aa, Homo Sapiens
YIADKKDAY

SEQ ID NO: 246088 - protein, 9 aa, Homo Sapiens
ALEMCQKPR

SEQ ID NO: 246089 - protein, 9 aa, Homo Sapiens
EKEAVGQLT

SEQ ID NO: 246090 - protein, 9 aa, Homo Sapiens
CTDVNNSKA

SEQ ID NO: 246091 - protein, 9 aa, Homo Sapiens
AFYVAGFDM

SEQ ID NO: 246092 - protein, 9 aa, Homo Sapiens
PGPPRVPFA

SEQ ID NO: 246093 - protein, 9 aa, Homo Sapiens
QHLEMVVAM

SEQ ID NO: 246094 - protein, 9 aa, Homo Sapiens
LIIHLKRFH

SEQ ID NO: 246095 - protein, 9 aa, Homo Sapiens
KQINQEECK

SEQ ID NO: 246096 - protein, 9 aa, Homo Sapiens
EDVYIQYLK

SEQ ID NO: 246097 - protein, 9 aa, Homo Sapiens
EKVQKLSAP

SEQ ID NO: 246098 - protein, 9 aa, Homo Sapiens
EAVDKYEEV

SEQ ID NO: 246099 - protein, 9 aa, Homo Sapiens
TEECKALSH

SEQ ID NO: 246100 - protein, 9 aa, Homo Sapiens
VCIYVDAVI

SEQ ID NO: 246101 - protein, 9 aa, Homo Sapiens
NCTHNLYMI

SEQ ID NO: 246102 - protein, 9 aa, Homo Sapiens
IESMEEVIL

SEQ ID NO: 246103 - protein, 9 aa, Homo Sapiens
KGSVLNSEE

SEQ ID NO: 246104 - protein, 9 aa, Homo Sapiens
NITYKANPN

SEQ ID NO: 246105 - protein, 9 aa, Homo Sapiens
HFLPAGFVT

SEQ ID NO: 246106 - protein, 9 aa, Homo Sapiens
KVEYEFDSP

SEQ ID NO: 246107 - protein, 9 aa, Homo Sapiens
CSDKTGALT

SEQ ID NO: 246108 - protein, 9 aa, Homo Sapiens
THVYIRVFT

SEQ ID NO: 246109 - protein, 9 aa, Homo Sapiens
KSCSQSSDN

SEQ ID NO: 246110 - protein, 9 aa, Homo Sapiens
DEPTSLLEG

SEQ ID NO: 246111 - protein, 9 aa, Homo Sapiens
DSHHSPSST

SEQ ID NO: 246112 - protein, 9 aa, Homo Sapiens
LHPQIKQLL

SEQ ID NO: 246113 - protein, 9 aa, Homo Sapiens
MPNEMVPLG

SEQ ID NO: 246114 - protein, 9 aa, Homo Sapiens
KQHLKNRCG

SEQ ID NO: 246115 - protein, 9 aa, Homo Sapiens
QGKRKGQEN

SEQ ID NO: 246116 - protein, 9 aa, Homo Sapiens
EIMISFSLS

SEQ ID NO: 246117 - protein, 9 aa, Homo Sapiens
KEGKMYRLR

SEQ ID NO: 246118 - protein, 9 aa, Homo Sapiens
RPVLLKCNS

SEQ ID NO: 246119 - protein, 9 aa, Homo Sapiens
EQLMISMPQ

SEQ ID NO: 246120 - protein, 9 aa, Homo Sapiens
AVDSSAPED

SEQ ID NO: 246121 - protein, 9 aa, Homo Sapiens
VCVVYENYS

SEQ ID NO: 246122 - protein, 9 aa, Homo Sapiens
HQSGSFINS

SEQ ID NO: 246123 - protein, 9 aa, Homo Sapiens
WCEKPIQDS

SEQ ID NO: 246124 - protein, 9 aa, Homo Sapiens
YTVYQASRM

SEQ ID NO: 246125 - protein, 9 aa, Homo Sapiens
AGDRIFFVP

SEQ ID NO: 246126 - protein, 9 aa, Homo Sapiens
RHFVSDHSS

SEQ ID NO: 246127 - protein, 9 aa, Homo Sapiens
MGLSFQGPQ

SEQ ID NO: 246128 - protein, 9 aa, Homo Sapiens
KTIYYSECL

SEQ ID NO: 246129 - protein, 9 aa, Homo Sapiens
STAEEKAIA

SEQ ID NO: 246130 - protein, 9 aa, Homo Sapiens
DAGRRINSL

SEQ ID NO: 246131 - protein, 9 aa, Homo Sapiens
SSHKHNSSH

SEQ ID NO: 246132 - protein, 9 aa, Homo Sapiens
DNIFQQHRG

SEQ ID NO: 246133 - protein, 9 aa, Homo Sapiens
VWLGEIINA

SEQ ID NO: 246134 - protein, 9 aa, Homo Sapiens
GVKNMDIIV

SEQ ID NO: 246135 - protein, 9 aa, Homo Sapiens
FLNGNYFIQ

SEQ ID NO: 246136 - protein, 9 aa, Homo Sapiens
YYLTNKNEN

SEQ ID NO: 246137 - protein, 9 aa, Homo Sapiens
YFNNFIDGY

SEQ ID NO: 246138 - protein, 9 aa, Homo Sapiens
YIFSLEERR

SEQ ID NO: 246139 - protein, 9 aa, Homo Sapiens
DILELIKQA

SEQ ID NO: 246140 - protein, 9 aa, Homo Sapiens
DIFKPIQSK

SEQ ID NO: 246141 - protein, 9 aa, Homo Sapiens
LSENASTNV

SEQ ID NO: 246142 - protein, 9 aa, Homo Sapiens
VPQLEKWLQ

SEQ ID NO: 246143 - protein, 9 aa, Homo Sapiens
RTSTLNQGH

SEQ ID NO: 246144 - protein, 9 aa, Homo Sapiens
DALNDQNSK

SEQ ID NO: 246145 - protein, 9 aa, Homo Sapiens
AARQKNISF

SEQ ID NO: 246146 - protein, 9 aa, Homo Sapiens
STDSCDRYP

SEQ ID NO: 246147 - protein, 9 aa, Homo Sapiens
TLSYGTPSV

SEQ ID NO: 246148 - protein, 9 aa, Homo Sapiens
NLMPQDSGV

SEQ ID NO: 246149 - protein, 9 aa, Homo Sapiens
IFSDCQRDK

SEQ ID NO: 246150 - protein, 9 aa, Homo Sapiens
LIEDSGYKE

SEQ ID NO: 246151 - protein, 9 aa, Homo Sapiens
NIHQEFLSS

SEQ ID NO: 246152 - protein, 9 aa, Homo Sapiens
YSSQSSSIL

SEQ ID NO: 246153 - protein, 9 aa, Homo Sapiens
GWHRAETLG

SEQ ID NO: 246154 - protein, 9 aa, Homo Sapiens
LPLGQCDTI

SEQ ID NO: 246155 - protein, 9 aa, Homo Sapiens
LWSADTQHS

SEQ ID NO: 246156 - protein, 9 aa, Homo Sapiens
IFKDKERTR

SEQ ID NO: 246157 - protein, 9 aa, Homo Sapiens
NVLKYEEVD

SEQ ID NO: 246158 - protein, 9 aa, Homo Sapiens
LQTVSSSQV

SEQ ID NO: 246159 - protein, 9 aa, Homo Sapiens
VNDASPNQV

SEQ ID NO: 246160 - protein, 9 aa, Homo Sapiens
MTNCSTVSK

SEQ ID NO: 246161 - protein, 9 aa, Homo Sapiens
KGKSERSPE

SEQ ID NO: 246162 - protein, 9 aa, Homo Sapiens
QSSGYISNY

SEQ ID NO: 246163 - protein, 9 aa, Homo Sapiens
FLILFQSFL

SEQ ID NO: 246164 - protein, 9 aa, Homo Sapiens
DQKDDVPVE

SEQ ID NO: 246165 - protein, 9 aa, Homo Sapiens
GYHVPFCLF

SEQ ID NO: 246166 - protein, 9 aa, Homo Sapiens
KRINLDKCQ

SEQ ID NO: 246167 - protein, 9 aa, Homo Sapiens
KKNGIWEVM

SEQ ID NO: 246168 - protein, 9 aa, Homo Sapiens
ENRAKAGYN

SEQ ID NO: 246169 - protein, 9 aa, Homo Sapiens
ILNYNLLSS

SEQ ID NO: 246170 - protein, 9 aa, Homo Sapiens
AFAFLFSFQ

SEQ ID NO: 246171 - protein, 9 aa, Homo Sapiens
FCKDEGQLI

SEQ ID NO: 246172 - protein, 9 aa, Homo Sapiens
DAGGVTKAD

SEQ ID NO: 246173 - protein, 9 aa, Homo Sapiens
CQELKKVSE

SEQ ID NO: 246174 - protein, 9 aa, Homo Sapiens
FFSKEFLSK

SEQ ID NO: 246175 - protein, 9 aa, Homo Sapiens
LLKFYSFYK

SEQ ID NO: 246176 - protein, 9 aa, Homo Sapiens
NKIPLYLQP

SEQ ID NO: 246177 - protein, 9 aa, Homo Sapiens
HIQVNNVNE

SEQ ID NO: 246178 - protein, 9 aa, Homo Sapiens
PLYSQPQPS

SEQ ID NO: 246179 - protein, 9 aa, Homo Sapiens
LIAAHKQKV

SEQ ID NO: 246180 - protein, 9 aa, Homo Sapiens
GGTLCQGKT

SEQ ID NO: 246181 - protein, 9 aa, Homo Sapiens
PESFPLKLF

SEQ ID NO: 246182 - protein, 9 aa, Homo Sapiens
AGSISTLDY

SEQ ID NO: 246183 - protein, 9 aa, Homo Sapiens
HVCNPRTLE

SEQ ID NO: 246184 - protein, 9 aa, Homo Sapiens
PSTHDNRVF

SEQ ID NO: 246185 - protein, 9 aa, Homo Sapiens
SPWHQFALR

SEQ ID NO: 246186 - protein, 9 aa, Homo Sapiens
FLGILHKCM

SEQ ID NO: 246187 - protein, 9 aa, Homo Sapiens
AILASVSVI

SEQ ID NO: 246188 - protein, 9 aa, Homo Sapiens
QSISGYPEI

SEQ ID NO: 246189 - protein, 9 aa, Homo Sapiens
LLGVATATV

SEQ ID NO: 246190 - protein, 9 aa, Homo Sapiens
LGFAGMDEM

SEQ ID NO: 246191 - protein, 9 aa, Homo Sapiens
HRHLPHARQ

SEQ ID NO: 246192 - protein, 9 aa, Homo Sapiens
YRKRKYLED

SEQ ID NO: 246193 - protein, 9 aa, Homo Sapiens
NSHLPSGEP

SEQ ID NO: 246194 - protein, 9 aa, Homo Sapiens
AYRWLSDLA

SEQ ID NO: 246195 - protein, 9 aa, Homo Sapiens
WQQSLSWWP

SEQ ID NO: 246196 - protein, 9 aa, Homo Sapiens
DVQDYSENL

SEQ ID NO: 246197 - protein, 9 aa, Homo Sapiens
YFREKSVFI

SEQ ID NO: 246198 - protein, 9 aa, Homo Sapiens
DHLNKAEEN

SEQ ID NO: 246199 - protein, 9 aa, Homo Sapiens
VKKKTGECS

SEQ ID NO: 246200 - protein, 9 aa, Homo Sapiens
DVVGWQSPF

SEQ ID NO: 246201 - protein, 9 aa, Homo Sapiens
IAMPQFFMD

SEQ ID NO: 246202 - protein, 9 aa, Homo Sapiens
NRAARNAVI

SEQ ID NO: 246203 - protein, 9 aa, Homo Sapiens
MERKLAQTF

SEQ ID NO: 246204 - protein, 9 aa, Homo Sapiens
RAPVRSRVH

SEQ ID NO: 246205 - protein, 9 aa, Homo Sapiens
DKEKYSEKE

SEQ ID NO: 246206 - protein, 9 aa, Homo Sapiens
MMKKEITKD

SEQ ID NO: 246207 - protein, 9 aa, Homo Sapiens
VKEVFRAPG

SEQ ID NO: 246208 - protein, 9 aa, Homo Sapiens
LSEGESEHS

SEQ ID NO: 246209 - protein, 9 aa, Homo Sapiens
LIRHWGFHS

SEQ ID NO: 246210 - protein, 9 aa, Homo Sapiens
IFSAAGLPR

SEQ ID NO: 246211 - protein, 9 aa, Homo Sapiens
QSFSLTMYI

SEQ ID NO: 246212 - protein, 9 aa, Homo Sapiens
FGEDKLGEV

SEQ ID NO: 246213 - protein, 9 aa, Homo Sapiens
TNIVPPATI

SEQ ID NO: 246214 - protein, 9 aa, Homo Sapiens
CQVIQIELD

SEQ ID NO: 246215 - protein, 9 aa, Homo Sapiens
QICLNTEWV

SEQ ID NO: 246216 - protein, 9 aa, Homo Sapiens
YAVWFRLYG

SEQ ID NO: 246217 - protein, 9 aa, Homo Sapiens
HKLNNLIKL

SEQ ID NO: 246218 - protein, 9 aa, Homo Sapiens
LVSLISNKR

SEQ ID NO: 246219 - protein, 9 aa, Homo Sapiens
GAADDDSDS

SEQ ID NO: 246220 - protein, 9 aa, Homo Sapiens
KKKLSASQF

SEQ ID NO: 246221 - protein, 9 aa, Homo Sapiens
IIKEAQKSQ

SEQ ID NO: 246222 - protein, 9 aa, Homo Sapiens
EQGNLEKQM

SEQ ID NO: 246223 - protein, 9 aa, Homo Sapiens
VKDTLRETI

SEQ ID NO: 246224 - protein, 9 aa, Homo Sapiens
QRHDGNKHI

SEQ ID NO: 246225 - protein, 9 aa, Homo Sapiens
LFSAVTASV

SEQ ID NO: 246226 - protein, 9 aa, Homo Sapiens
DVYERTLMV

SEQ ID NO: 246227 - protein, 9 aa, Homo Sapiens
VGFGALLNP

SEQ ID NO: 246228 - protein, 9 aa, Homo Sapiens
LGGEPYTLG

SEQ ID NO: 246229 - protein, 9 aa, Homo Sapiens
KCIEQSDLL

SEQ ID NO: 246230 - protein, 9 aa, Homo Sapiens
AREQEQQQQ

SEQ ID NO: 246231 - protein, 9 aa, Homo Sapiens
AFYDLSERI

SEQ ID NO: 246232 - protein, 9 aa, Homo Sapiens
NSRPCKRTA

SEQ ID NO: 246233 - protein, 9 aa, Homo Sapiens
ELSLEMKCQ

SEQ ID NO: 246234 - protein, 9 aa, Homo Sapiens
QGDYGKFVI

SEQ ID NO: 246235 - protein, 9 aa, Homo Sapiens
WRIKKFCEA

SEQ ID NO: 246236 - protein, 9 aa, Homo Sapiens
MGRDSAVGS

SEQ ID NO: 246237 - protein, 9 aa, Homo Sapiens
WNMHTCPRW

SEQ ID NO: 246238 - protein, 9 aa, Homo Sapiens
SCLGDECKN

SEQ ID NO: 246239 - protein, 9 aa, Homo Sapiens
LKRMGIVSN

SEQ ID NO: 246240 - protein, 9 aa, Homo Sapiens
QDTISSSQF

SEQ ID NO: 246241 - protein, 9 aa, Homo Sapiens
TNKTQIDGQ

SEQ ID NO: 246242 - protein, 9 aa, Homo Sapiens
ILHHFIPDL

SEQ ID NO: 246243 - protein, 9 aa, Homo Sapiens
EYHSSWTLC

SEQ ID NO: 246244 - protein, 9 aa, Homo Sapiens
ISLASEQYD

SEQ ID NO: 246245 - protein, 9 aa, Homo Sapiens
KNAHVRMAT

SEQ ID NO: 246246 - protein, 9 aa, Homo Sapiens
KMFSNTFFH

SEQ ID NO: 246247 - protein, 9 aa, Homo Sapiens
VIASHPPLA

SEQ ID NO: 246248 - protein, 9 aa, Homo Sapiens
RLMDTFLIR

SEQ ID NO: 246249 - protein, 9 aa, Homo Sapiens
HTGKKEEAS

SEQ ID NO: 246250 - protein, 9 aa, Homo Sapiens
TYHKITHTG

SEQ ID NO: 246251 - protein, 9 aa, Homo Sapiens
ADGGRESKW

SEQ ID NO: 246252 - protein, 9 aa, Homo Sapiens
GSTPTLDKQ

SEQ ID NO: 246253 - protein, 9 aa, Homo Sapiens
GIINIQKEL

SEQ ID NO: 246254 - protein, 9 aa, Homo Sapiens
HKNKDCFER

SEQ ID NO: 246255 - protein, 9 aa, Homo Sapiens
FFSAIDLSS

SEQ ID NO: 246256 - protein, 9 aa, Homo Sapiens
VFYYKMTGD

SEQ ID NO: 246257 - protein, 9 aa, Homo Sapiens
SPRTFPREN

SEQ ID NO: 246258 - protein, 9 aa, Homo Sapiens
GKVATWLIG

SEQ ID NO: 246259 - protein, 9 aa, Homo Sapiens
TGMLTVVNK

SEQ ID NO: 246260 - protein, 9 aa, Homo Sapiens
STTTSRVTS

SEQ ID NO: 246261 - protein, 9 aa, Homo Sapiens
LAIRWHDNV

SEQ ID NO: 246262 - protein, 9 aa, Homo Sapiens
ALHLIATHS

SEQ ID NO: 246263 - protein, 9 aa, Homo Sapiens
TQPPGRQVM

SEQ ID NO: 246264 - protein, 9 aa, Homo Sapiens
HGKTFTFRD

SEQ ID NO: 246265 - protein, 9 aa, Homo Sapiens
ILNKGKAIF

SEQ ID NO: 246266 - protein, 9 aa, Homo Sapiens
DSLQNEHAQ

SEQ ID NO: 246267 - protein, 9 aa, Homo Sapiens
VGKRRCIGK

SEQ ID NO: 246268 - protein, 9 aa, Homo Sapiens
EINLLSVAY

SEQ ID NO: 246269 - protein, 9 aa, Homo Sapiens
GFMLMYDIT

SEQ ID NO: 246270 - protein, 9 aa, Homo Sapiens
WSALKGHLY

SEQ ID NO: 246271 - protein, 9 aa, Homo Sapiens
SREIFAIDL

SEQ ID NO: 246272 - protein, 9 aa, Homo Sapiens
DDGEFWTAF

SEQ ID NO: 246273 - protein, 9 aa, Homo Sapiens
NIPPHLQWD

SEQ ID NO: 246274 - protein, 9 aa, Homo Sapiens
QHIKEDRAR

SEQ ID NO: 246275 - protein, 9 aa, Homo Sapiens
FAKKGELRK

SEQ ID NO: 246276 - protein, 9 aa, Homo Sapiens
DVQNLSVGL

SEQ ID NO: 246277 - protein, 9 aa, Homo Sapiens
YSTLSIPPG

SEQ ID NO: 246278 - protein, 9 aa, Homo Sapiens
VILSMAILS

SEQ ID NO: 246279 - protein, 9 aa, Homo Sapiens
EHKMVWNQT

SEQ ID NO: 246280 - protein, 9 aa, Homo Sapiens
HDGKLYFAD

SEQ ID NO: 246281 - protein, 9 aa, Homo Sapiens
EKELRKCRK

SEQ ID NO: 246282 - protein, 9 aa, Homo Sapiens
SVLVILSTL

SEQ ID NO: 246283 - protein, 9 aa, Homo Sapiens
DEGHVSCVK

SEQ ID NO: 246284 - protein, 9 aa, Homo Sapiens
AKLQQVPRL

SEQ ID NO: 246285 - protein, 9 aa, Homo Sapiens
TTQDLQEGE

SEQ ID NO: 246286 - protein, 9 aa, Homo Sapiens
ERKGIPVRQ

SEQ ID NO: 246287 - protein, 9 aa, Homo Sapiens
LSHHQRVHN

SEQ ID NO: 246288 - protein, 9 aa, Homo Sapiens
LAWNLVIQE

SEQ ID NO: 246289 - protein, 9 aa, Homo Sapiens
VEDIIEAIH

SEQ ID NO: 246290 - protein, 9 aa, Homo Sapiens
TPWLFMPLD

SEQ ID NO: 246291 - protein, 9 aa, Homo Sapiens
FKPKHYLTD

SEQ ID NO: 246292 - protein, 9 aa, Homo Sapiens
RNVSVRGIT

SEQ ID NO: 246293 - protein, 9 aa, Homo Sapiens
PERLNAFIA

SEQ ID NO: 246294 - protein, 9 aa, Homo Sapiens
AADTLVTKL

SEQ ID NO: 246295 - protein, 9 aa, Homo Sapiens
GSDNSHLRT

SEQ ID NO: 246296 - protein, 9 aa, Homo Sapiens
VALGMLWLF

SEQ ID NO: 246297 - protein, 9 aa, Homo Sapiens
YFQINYRQF

SEQ ID NO: 246298 - protein, 9 aa, Homo Sapiens
EAHVKAIKV

SEQ ID NO: 246299 - protein, 9 aa, Homo Sapiens
LNNGHIKIW

SEQ ID NO: 246300 - protein, 9 aa, Homo Sapiens
NLSVTDASG

SEQ ID NO: 246301 - protein, 9 aa, Homo Sapiens
AEQEYKEKG

SEQ ID NO: 246302 - protein, 9 aa, Homo Sapiens
QSSTFSISK

SEQ ID NO: 246303 - protein, 9 aa, Homo Sapiens
ESAEEEDNF

SEQ ID NO: 246304 - protein, 9 aa, Homo Sapiens
CWNSEPENR

SEQ ID NO: 246305 - protein, 9 aa, Homo Sapiens
EVSKQSLVY

SEQ ID NO: 246306 - protein, 9 aa, Homo Sapiens
DNSYARVQA

SEQ ID NO: 246307 - protein, 9 aa, Homo Sapiens
SGNTQNRFS

SEQ ID NO: 246308 - protein, 9 aa, Homo Sapiens
GHRGVQAGW

SEQ ID NO: 246309 - protein, 9 aa, Homo Sapiens
QQLSNQELA

SEQ ID NO: 246310 - protein, 9 aa, Homo Sapiens
VKTAIRECN

SEQ ID NO: 246311 - protein, 9 aa, Homo Sapiens
NFGEYMDDE

SEQ ID NO: 246312 - protein, 9 aa, Homo Sapiens
HFPCSMIIL

SEQ ID NO: 246313 - protein, 9 aa, Homo Sapiens
TITPLRQRS

SEQ ID NO: 246314 - protein, 9 aa, Homo Sapiens
RERLRASLE

SEQ ID NO: 246315 - protein, 9 aa, Homo Sapiens
TQKAWKIYP

SEQ ID NO: 246316 - protein, 9 aa, Homo Sapiens
PKSTKKESF

SEQ ID NO: 246317 - protein, 9 aa, Homo Sapiens
LFVKDVPQI

SEQ ID NO: 246318 - protein, 9 aa, Homo Sapiens
RARSKKLDH

SEQ ID NO: 246319 - protein, 9 aa, Homo Sapiens
PSPTEVQSL

SEQ ID NO: 246320 - protein, 9 aa, Homo Sapiens
PAADIRWFE

SEQ ID NO: 246321 - protein, 9 aa, Homo Sapiens
CEPTSCQIS

SEQ ID NO: 246322 - protein, 9 aa, Homo Sapiens
YPHTDQLQE

SEQ ID NO: 246323 - protein, 9 aa, Homo Sapiens
ITKNIDVKG

SEQ ID NO: 246324 - protein, 9 aa, Homo Sapiens
CPFPLPIIG

SEQ ID NO: 246325 - protein, 9 aa, Homo Sapiens
KHLKKNNLR

SEQ ID NO: 246326 - protein, 9 aa, Homo Sapiens
FKAQWANSF

SEQ ID NO: 246327 - protein, 9 aa, Homo Sapiens
EKKDKGYPK

SEQ ID NO: 246328 - protein, 9 aa, Homo Sapiens
IFSHNSPFI

SEQ ID NO: 246329 - protein, 9 aa, Homo Sapiens
CHFGFEVYP

SEQ ID NO: 246330 - protein, 9 aa, Homo Sapiens
SMFLSVCED

SEQ ID NO: 246331 - protein, 9 aa, Homo Sapiens
LCRDISISY

SEQ ID NO: 246332 - protein, 9 aa, Homo Sapiens
SNVKMVQGD

SEQ ID NO: 246333 - protein, 9 aa, Homo Sapiens
GTLVELVYF

SEQ ID NO: 246334 - protein, 9 aa, Homo Sapiens
TADADSESD

SEQ ID NO: 246335 - protein, 9 aa, Homo Sapiens
VGNPPNAII

SEQ ID NO: 246336 - protein, 9 aa, Homo Sapiens
TLELKLNSH

SEQ ID NO: 246337 - protein, 9 aa, Homo Sapiens
EPPEGTKSY

SEQ ID NO: 246338 - protein, 9 aa, Homo Sapiens
THDSIVNKN

SEQ ID NO: 246339 - protein, 9 aa, Homo Sapiens
GQHLISTEN

SEQ ID NO: 246340 - protein, 9 aa, Homo Sapiens
TGINDKMAE

SEQ ID NO: 246341 - protein, 9 aa, Homo Sapiens
ASISIADPL

SEQ ID NO: 246342 - protein, 9 aa, Homo Sapiens
PDIHEREGY

SEQ ID NO: 246343 - protein, 9 aa, Homo Sapiens
GPAQMRKRI

SEQ ID NO: 246344 - protein, 9 aa, Homo Sapiens
RNIPLFEGC

SEQ ID NO: 246345 - protein, 9 aa, Homo Sapiens
FMEREDKVH

SEQ ID NO: 246346 - protein, 9 aa, Homo Sapiens
HPGPFLLLT

SEQ ID NO: 246347 - protein, 9 aa, Homo Sapiens
WTCISRETE

SEQ ID NO: 246348 - protein, 9 aa, Homo Sapiens
HEKVFSPLR

SEQ ID NO: 246349 - protein, 9 aa, Homo Sapiens
IEHLKLKDW

SEQ ID NO: 246350 - protein, 9 aa, Homo Sapiens
CQPFRRKEM

SEQ ID NO: 246351 - protein, 9 aa, Homo Sapiens
AAHNNFENV

SEQ ID NO: 246352 - protein, 9 aa, Homo Sapiens
GHYQYTVFL

SEQ ID NO: 246353 - protein, 9 aa, Homo Sapiens
GCSSNSFKL

SEQ ID NO: 246354 - protein, 9 aa, Homo Sapiens
ISVVCRESR

SEQ ID NO: 246355 - protein, 9 aa, Homo Sapiens
INSSGQFVS

SEQ ID NO: 246356 - protein, 9 aa, Homo Sapiens
EKPYVCMER

SEQ ID NO: 246357 - protein, 9 aa, Homo Sapiens
SFLGAALPN

SEQ ID NO: 246358 - protein, 9 aa, Homo Sapiens
VRLDRSRMY

SEQ ID NO: 246359 - protein, 9 aa, Homo Sapiens
LVEDYKNRY

SEQ ID NO: 246360 - protein, 9 aa, Homo Sapiens
KTNEIMLVR

SEQ ID NO: 246361 - protein, 9 aa, Homo Sapiens
RTGAGSNGL

SEQ ID NO: 246362 - protein, 9 aa, Homo Sapiens
CKNITTFDR

SEQ ID NO: 246363 - protein, 9 aa, Homo Sapiens
SPVLGLEIK

SEQ ID NO: 246364 - protein, 9 aa, Homo Sapiens
HLFCKDEGQ

SEQ ID NO: 246365 - protein, 9 aa, Homo Sapiens
SKEKQLRGL

SEQ ID NO: 246366 - protein, 9 aa, Homo Sapiens
NPDCVRKFI

SEQ ID NO: 246367 - protein, 9 aa, Homo Sapiens
NVTVIPNSM

SEQ ID NO: 246368 - protein, 9 aa, Homo Sapiens
KRYLHQNRV

SEQ ID NO: 246369 - protein, 9 aa, Homo Sapiens
NKGTETRPV

SEQ ID NO: 246370 - protein, 9 aa, Homo Sapiens
FLDNFSILE

SEQ ID NO: 246371 - protein, 9 aa, Homo Sapiens
DIQKNIDCM

SEQ ID NO: 246372 - protein, 9 aa, Homo Sapiens
AGATPRTRG

SEQ ID NO: 246373 - protein, 9 aa, Homo Sapiens
EECDRKLLS

SEQ ID NO: 246374 - protein, 9 aa, Homo Sapiens
LTFQAGFLN

SEQ ID NO: 246375 - protein, 9 aa, Homo Sapiens
IYITNYYYG

SEQ ID NO: 246376 - protein, 9 aa, Homo Sapiens
VTEVDALAL

SEQ ID NO: 246377 - protein, 9 aa, Homo Sapiens
YRLDPGGQS

SEQ ID NO: 246378 - protein, 9 aa, Homo Sapiens
ILPLTGGRG

SEQ ID NO: 246379 - protein, 9 aa, Homo Sapiens
EKTQMIYKL

SEQ ID NO: 246380 - protein, 9 aa, Homo Sapiens
VRSTNLNFS

SEQ ID NO: 246381 - protein, 9 aa, Homo Sapiens
SASSNSEES

SEQ ID NO: 246382 - protein, 9 aa, Homo Sapiens
SISIADPLF

SEQ ID NO: 246383 - protein, 9 aa, Homo Sapiens
STVVYRYAH

SEQ ID NO: 246384 - protein, 9 aa, Homo Sapiens
GKADIRIWV

SEQ ID NO: 246385 - protein, 9 aa, Homo Sapiens
IFIVTQCCL

SEQ ID NO: 246386 - protein, 9 aa, Homo Sapiens
LICNCDRNA

SEQ ID NO: 246387 - protein, 9 aa, Homo Sapiens
PIGTRIAKV

SEQ ID NO: 246388 - protein, 9 aa, Homo Sapiens
YDALVYSAA

SEQ ID NO: 246389 - protein, 9 aa, Homo Sapiens
GGRPFLQAF

SEQ ID NO: 246390 - protein, 9 aa, Homo Sapiens
QPKPKQIQI

SEQ ID NO: 246391 - protein, 9 aa, Homo Sapiens
DLQLPPSDF

SEQ ID NO: 246392 - protein, 9 aa, Homo Sapiens
SLLQTRFMT

SEQ ID NO: 246393 - protein, 9 aa, Homo Sapiens
LDKVLAHPP

SEQ ID NO: 246394 - protein, 9 aa, Homo Sapiens
VTMMFFSNC

SEQ ID NO: 246395 - protein, 9 aa, Homo Sapiens
EIGAIAHVH

SEQ ID NO: 246396 - protein, 9 aa, Homo Sapiens
LAHHQQIHT

SEQ ID NO: 246397 - protein, 9 aa, Homo Sapiens
CIQEPSYVS

SEQ ID NO: 246398 - protein, 9 aa, Homo Sapiens
IKENNFLPF

SEQ ID NO: 246399 - protein, 9 aa, Homo Sapiens
VSACHFLWK

SEQ ID NO: 246400 - protein, 9 aa, Homo Sapiens
LSHERLLHY

SEQ ID NO: 246401 - protein, 9 aa, Homo Sapiens
KLEREQRRT

SEQ ID NO: 246402 - protein, 9 aa, Homo Sapiens
HKDHALRWR

SEQ ID NO: 246403 - protein, 9 aa, Homo Sapiens
QMTNEDNSF

SEQ ID NO: 246404 - protein, 9 aa, Homo Sapiens
TIKLKEDNI

SEQ ID NO: 246405 - protein, 9 aa, Homo Sapiens
YGRDQTGMM

SEQ ID NO: 246406 - protein, 9 aa, Homo Sapiens
SLISLEIKK

SEQ ID NO: 246407 - protein, 9 aa, Homo Sapiens
RLRALCSLD

SEQ ID NO: 246408 - protein, 9 aa, Homo Sapiens
HKEQAIGAI

SEQ ID NO: 246409 - protein, 9 aa, Homo Sapiens
IKDLAADLE

SEQ ID NO: 246410 - protein, 9 aa, Homo Sapiens
FVIHRRLLY

SEQ ID NO: 246411 - protein, 9 aa, Homo Sapiens
LSKLIRQSY

SEQ ID NO: 246412 - protein, 9 aa, Homo Sapiens
DRVANPKYI

SEQ ID NO: 246413 - protein, 9 aa, Homo Sapiens
ASVLLYSDC

SEQ ID NO: 246414 - protein, 9 aa, Homo Sapiens
KDDGFSSYL

SEQ ID NO: 246415 - protein, 9 aa, Homo Sapiens
NERVNDASP

SEQ ID NO: 246416 - protein, 9 aa, Homo Sapiens
FRTLASYKR

SEQ ID NO: 246417 - protein, 9 aa, Homo Sapiens
SFTFQIYKA

SEQ ID NO: 246418 - protein, 9 aa, Homo Sapiens
VLLVGGFSQ

SEQ ID NO: 246419 - protein, 9 aa, Homo Sapiens
STEALENIR

SEQ ID NO: 246420 - protein, 9 aa, Homo Sapiens
QIIDFGLAR

SEQ ID NO: 246421 - protein, 9 aa, Homo Sapiens
QEKEDILKK

SEQ ID NO: 246422 - protein, 9 aa, Homo Sapiens
PSSGSDGAD

SEQ ID NO: 246423 - protein, 9 aa, Homo Sapiens
RLFRLQTLG

SEQ ID NO: 246424 - protein, 9 aa, Homo Sapiens
RPGIPAAEV

SEQ ID NO: 246425 - protein, 9 aa, Homo Sapiens
LSDYFLLIE

SEQ ID NO: 246426 - protein, 9 aa, Homo Sapiens
QCSRPLSMD

SEQ ID NO: 246427 - protein, 9 aa, Homo Sapiens
LIVHKIIHT

SEQ ID NO: 246428 - protein, 9 aa, Homo Sapiens
IVSTLYTVV

SEQ ID NO: 246429 - protein, 9 aa, Homo Sapiens
ANCDQIATV

SEQ ID NO: 246430 - protein, 9 aa, Homo Sapiens
QPGEPATEL

SEQ ID NO: 246431 - protein, 9 aa, Homo Sapiens
RINKLFGFI

SEQ ID NO: 246432 - protein, 9 aa, Homo Sapiens
SVCEDKFDI

SEQ ID NO: 246433 - protein, 9 aa, Homo Sapiens
RMMFYPPPR

SEQ ID NO: 246434 - protein, 9 aa, Homo Sapiens
GPYGFIKSP

SEQ ID NO: 246435 - protein, 9 aa, Homo Sapiens
AIANVLKKI

SEQ ID NO: 246436 - protein, 9 aa, Homo Sapiens
LGEIINAGS

SEQ ID NO: 246437 - protein, 9 aa, Homo Sapiens
RSYDLVRSA

SEQ ID NO: 246438 - protein, 9 aa, Homo Sapiens
ALEENKTGP

SEQ ID NO: 246439 - protein, 9 aa, Homo Sapiens
TAPKKNKNK

SEQ ID NO: 246440 - protein, 9 aa, Homo Sapiens
DPLFQIQQE

SEQ ID NO: 246441 - protein, 9 aa, Homo Sapiens
RMGKKVWEY

SEQ ID NO: 246442 - protein, 9 aa, Homo Sapiens
WHKSKGQQL

SEQ ID NO: 246443 - protein, 9 aa, Homo Sapiens
LNSSNYASM

SEQ ID NO: 246444 - protein, 9 aa, Homo Sapiens
PGRQVMEGD

SEQ ID NO: 246445 - protein, 9 aa, Homo Sapiens
EIKKKIHNF

SEQ ID NO: 246446 - protein, 9 aa, Homo Sapiens
DVPAWESCR

SEQ ID NO: 246447 - protein, 9 aa, Homo Sapiens
MNAFMVNLK

SEQ ID NO: 246448 - protein, 9 aa, Homo Sapiens
LSLVFLVYS

SEQ ID NO: 246449 - protein, 9 aa, Homo Sapiens
CISVIFSDC

SEQ ID NO: 246450 - protein, 9 aa, Homo Sapiens
ENNDTKSIY

SEQ ID NO: 246451 - protein, 9 aa, Homo Sapiens
IFHDQFDYK

SEQ ID NO: 246452 - protein, 9 aa, Homo Sapiens
TTASMSLMA

SEQ ID NO: 246453 - protein, 9 aa, Homo Sapiens
KESKDNQWL

SEQ ID NO: 246454 - protein, 9 aa, Homo Sapiens
KVHRKTINP

SEQ ID NO: 246455 - protein, 9 aa, Homo Sapiens
EFKEEGRKH

SEQ ID NO: 246456 - protein, 9 aa, Homo Sapiens
ECRASNYPK

SEQ ID NO: 246457 - protein, 9 aa, Homo Sapiens
GTVRDTLDA

SEQ ID NO: 246458 - protein, 9 aa, Homo Sapiens
KDVDKKAMM

SEQ ID NO: 246459 - protein, 9 aa, Homo Sapiens
KAKSKTLDL

SEQ ID NO: 246460 - protein, 9 aa, Homo Sapiens
YIDKNELLD

SEQ ID NO: 246461 - protein, 9 aa, Homo Sapiens
TAFMKVVEK

SEQ ID NO: 246462 - protein, 9 aa, Homo Sapiens
PINAGLKGK

SEQ ID NO: 246463 - protein, 9 aa, Homo Sapiens
GDHPSKGCF

SEQ ID NO: 246464 - protein, 9 aa, Homo Sapiens
VFLRQNSST

SEQ ID NO: 246465 - protein, 9 aa, Homo Sapiens
QHTFHLEAT

SEQ ID NO: 246466 - protein, 9 aa, Homo Sapiens
EMFPASYSS

SEQ ID NO: 246467 - protein, 9 aa, Homo Sapiens
LQAPDLRHF

SEQ ID NO: 246468 - protein, 9 aa, Homo Sapiens
ILGKLFLLH

SEQ ID NO: 246469 - protein, 9 aa, Homo Sapiens
DHAAAFGII

SEQ ID NO: 246470 - protein, 9 aa, Homo Sapiens
KNAEDVHHQ

SEQ ID NO: 246471 - protein, 9 aa, Homo Sapiens
LYIIHLGIS

SEQ ID NO: 246472 - protein, 9 aa, Homo Sapiens
QCFSRQPTG

SEQ ID NO: 246473 - protein, 9 aa, Homo Sapiens
TPDNPYHQQ

SEQ ID NO: 246474 - protein, 9 aa, Homo Sapiens
ILSLNARSS

SEQ ID NO: 246475 - protein, 9 aa, Homo Sapiens
FCTAAMSYS

SEQ ID NO: 246476 - protein, 9 aa, Homo Sapiens
KVGVIPPNK

SEQ ID NO: 246477 - protein, 9 aa, Homo Sapiens
TCPYSTTTS

SEQ ID NO: 246478 - protein, 9 aa, Homo Sapiens
WYKLRKAPS

SEQ ID NO: 246479 - protein, 9 aa, Homo Sapiens
RYFPVFEKV

SEQ ID NO: 246480 - protein, 9 aa, Homo Sapiens
SRTEMQELE

SEQ ID NO: 246481 - protein, 9 aa, Homo Sapiens
LINGKQQTF

SEQ ID NO: 246482 - protein, 9 aa, Homo Sapiens
TGKFTAATE

SEQ ID NO: 246483 - protein, 9 aa, Homo Sapiens
SSDYLIPPM

SEQ ID NO: 246484 - protein, 9 aa, Homo Sapiens
ENREMRANE

SEQ ID NO: 246485 - protein, 9 aa, Homo Sapiens
STIKPRIIQ

SEQ ID NO: 246486 - protein, 9 aa, Homo Sapiens
GHLTGLQTF

SEQ ID NO: 246487 - protein, 9 aa, Homo Sapiens
GHKNEQYCI

SEQ ID NO: 246488 - protein, 9 aa, Homo Sapiens
TGLNNGHIK

SEQ ID NO: 246489 - protein, 9 aa, Homo Sapiens
CNSLVRLCY

SEQ ID NO: 246490 - protein, 9 aa, Homo Sapiens
SHDKAIANV

SEQ ID NO: 246491 - protein, 9 aa, Homo Sapiens
EQKEELDYV

SEQ ID NO: 246492 - protein, 9 aa, Homo Sapiens
TKKELSMLN

SEQ ID NO: 246493 - protein, 9 aa, Homo Sapiens
LRKDKRHLR

SEQ ID NO: 246494 - protein, 9 aa, Homo Sapiens
LSVLQCRRI

SEQ ID NO: 246495 - protein, 9 aa, Homo Sapiens
LICMSVNGL

SEQ ID NO: 246496 - protein, 9 aa, Homo Sapiens
INITDVAQV

SEQ ID NO: 246497 - protein, 9 aa, Homo Sapiens
QGVQETATG

SEQ ID NO: 246498 - protein, 9 aa, Homo Sapiens
KHLDKKRKV

SEQ ID NO: 246499 - protein, 9 aa, Homo Sapiens
VFCHSRRVI

SEQ ID NO: 246500 - protein, 9 aa, Homo Sapiens
LSGACMGQG

SEQ ID NO: 246501 - protein, 9 aa, Homo Sapiens
VDSRGVPRG

SEQ ID NO: 246502 - protein, 9 aa, Homo Sapiens
DHPKIANIF

SEQ ID NO: 246503 - protein, 9 aa, Homo Sapiens
QDFCKIVGR

SEQ ID NO: 246504 - protein, 9 aa, Homo Sapiens
IPQVMIEPS

SEQ ID NO: 246505 - protein, 9 aa, Homo Sapiens
FTRGSPGQS

SEQ ID NO: 246506 - protein, 9 aa, Homo Sapiens
ELDLFLKGN

SEQ ID NO: 246507 - protein, 9 aa, Homo Sapiens
RDLINTYLL

SEQ ID NO: 246508 - protein, 9 aa, Homo Sapiens
LCRQDAKGL

SEQ ID NO: 246509 - protein, 9 aa, Homo Sapiens
TDFKEEPDP

SEQ ID NO: 246510 - protein, 9 aa, Homo Sapiens
HFGFEVYPF

SEQ ID NO: 246511 - protein, 9 aa, Homo Sapiens
SSKPKVRDG

SEQ ID NO: 246512 - protein, 9 aa, Homo Sapiens
LKDHAKAAA

SEQ ID NO: 246513 - protein, 9 aa, Homo Sapiens
EEVINRKIP

SEQ ID NO: 246514 - protein, 9 aa, Homo Sapiens
MYKQVRKSL

SEQ ID NO: 246515 - protein, 9 aa, Homo Sapiens
REGLIQAQS

SEQ ID NO: 246516 - protein, 9 aa, Homo Sapiens
QSTYNLINE

SEQ ID NO: 246517 - protein, 9 aa, Homo Sapiens
SDSMDKSLS

SEQ ID NO: 246518 - protein, 9 aa, Homo Sapiens
EQNRRAQDE

SEQ ID NO: 246519 - protein, 9 aa, Homo Sapiens
IQLPGIDKT

SEQ ID NO: 246520 - protein, 9 aa, Homo Sapiens
APGQFILIL

SEQ ID NO: 246521 - protein, 9 aa, Homo Sapiens
IVTLNVRRA

SEQ ID NO: 246522 - protein, 9 aa, Homo Sapiens
VYCVVLVIW

SEQ ID NO: 246523 - protein, 9 aa, Homo Sapiens
TKDELLNEF

SEQ ID NO: 246524 - protein, 9 aa, Homo Sapiens
GIENVSSVE

SEQ ID NO: 246525 - protein, 9 aa, Homo Sapiens
TLPSKPPFQ

SEQ ID NO: 246526 - protein, 9 aa, Homo Sapiens
YSHPELFAS

SEQ ID NO: 246527 - protein, 9 aa, Homo Sapiens
QAGSDYNFL

SEQ ID NO: 246528 - protein, 9 aa, Homo Sapiens
PEKQRLFAT

SEQ ID NO: 246529 - protein, 9 aa, Homo Sapiens
KLGEGSYES

SEQ ID NO: 246530 - protein, 9 aa, Homo Sapiens
RNRKENRNN

SEQ ID NO: 246531 - protein, 9 aa, Homo Sapiens
NLLSKPPNP

SEQ ID NO: 246532 - protein, 9 aa, Homo Sapiens
HDKLIMNQT

SEQ ID NO: 246533 - protein, 9 aa, Homo Sapiens
NSPKGCDIF

SEQ ID NO: 246534 - protein, 9 aa, Homo Sapiens
ERILELELP

SEQ ID NO: 246535 - protein, 9 aa, Homo Sapiens
SIKSRLQLV

SEQ ID NO: 246536 - protein, 9 aa, Homo Sapiens
ADIHSAIPT

SEQ ID NO: 246537 - protein, 9 aa, Homo Sapiens
HRTPSASIR

SEQ ID NO: 246538 - protein, 9 aa, Homo Sapiens
HKDVDKKAM

SEQ ID NO: 246539 - protein, 9 aa, Homo Sapiens
SRGDGSGFG

SEQ ID NO: 246540 - protein, 9 aa, Homo Sapiens
HVKRPALHK

SEQ ID NO: 246541 - protein, 9 aa, Homo Sapiens
EASPESEDK

SEQ ID NO: 246542 - protein, 9 aa, Homo Sapiens
EPLDELVGS

SEQ ID NO: 246543 - protein, 9 aa, Homo Sapiens
RRMEEMETY

SEQ ID NO: 246544 - protein, 9 aa, Homo Sapiens
TDKDLLAFI

SEQ ID NO: 246545 - protein, 9 aa, Homo Sapiens
TSNLYPSGL

SEQ ID NO: 246546 - protein, 9 aa, Homo Sapiens
DKKRKVKEM

SEQ ID NO: 246547 - protein, 9 aa, Homo Sapiens
RDDYPAILM

SEQ ID NO: 246548 - protein, 9 aa, Homo Sapiens
CGTFSSFVP

SEQ ID NO: 246549 - protein, 9 aa, Homo Sapiens
RFWIHTEVI

SEQ ID NO: 246550 - protein, 9 aa, Homo Sapiens
VWNQTTHLW

SEQ ID NO: 246551 - protein, 9 aa, Homo Sapiens
ETWLENKWG

SEQ ID NO: 246552 - protein, 9 aa, Homo Sapiens
GQEELGPGH

SEQ ID NO: 246553 - protein, 9 aa, Homo Sapiens
PFSSLRWYK

SEQ ID NO: 246554 - protein, 9 aa, Homo Sapiens
TLNCAEVNI

SEQ ID NO: 246555 - protein, 9 aa, Homo Sapiens
ITEKKDNAA

SEQ ID NO: 246556 - protein, 9 aa, Homo Sapiens
EKGGRVGAV

SEQ ID NO: 246557 - protein, 9 aa, Homo Sapiens
QDYCKVCQQ

SEQ ID NO: 246558 - protein, 9 aa, Homo Sapiens
DELVNEALK

SEQ ID NO: 246559 - protein, 9 aa, Homo Sapiens
SDIDSGGGN

SEQ ID NO: 246560 - protein, 9 aa, Homo Sapiens
HHIRKNADD

SEQ ID NO: 246561 - protein, 9 aa, Homo Sapiens
LLPKLDEIR

SEQ ID NO: 246562 - protein, 9 aa, Homo Sapiens
NQLQMATYL

SEQ ID NO: 246563 - protein, 9 aa, Homo Sapiens
ADNFQELLR

SEQ ID NO: 246564 - protein, 9 aa, Homo Sapiens
KDREMQINE

SEQ ID NO: 246565 - protein, 9 aa, Homo Sapiens
ANIALMNSV

SEQ ID NO: 246566 - protein, 9 aa, Homo Sapiens
PNKSIQSGP

SEQ ID NO: 246567 - protein, 9 aa, Homo Sapiens
SRTRWWSPT

SEQ ID NO: 246568 - protein, 9 aa, Homo Sapiens
HLCAILLDR

SEQ ID NO: 246569 - protein, 9 aa, Homo Sapiens
TLPAIFTPF

SEQ ID NO: 246570 - protein, 9 aa, Homo Sapiens
ILQEMRKIT

SEQ ID NO: 246571 - protein, 9 aa, Homo Sapiens
GWAYEKIEL

SEQ ID NO: 246572 - protein, 9 aa, Homo Sapiens
MPKVQYKSS

SEQ ID NO: 246573 - protein, 9 aa, Homo Sapiens
KVPDVELLL

SEQ ID NO: 246574 - protein, 9 aa, Homo Sapiens
NFMMDNQLT

SEQ ID NO: 246575 - protein, 9 aa, Homo Sapiens
GGYKTIYFF

SEQ ID NO: 246576 - protein, 9 aa, Homo Sapiens
HLVDGAHCL

SEQ ID NO: 246577 - protein, 9 aa, Homo Sapiens
DKLKLTSNE

SEQ ID NO: 246578 - protein, 9 aa, Homo Sapiens
VFMGFITPA

SEQ ID NO: 246579 - protein, 9 aa, Homo Sapiens
TRVTADIYL

SEQ ID NO: 246580 - protein, 9 aa, Homo Sapiens
MAPSSPISV

SEQ ID NO: 246581 - protein, 9 aa, Homo Sapiens
MPHNIYLHL

SEQ ID NO: 246582 - protein, 9 aa, Homo Sapiens
NQNAFLYKD

SEQ ID NO: 246583 - protein, 9 aa, Homo Sapiens
IGGVDVFYL

SEQ ID NO: 246584 - protein, 9 aa, Homo Sapiens
MESRKVKKS

SEQ ID NO: 246585 - protein, 9 aa, Homo Sapiens
ATAVLQQAN

SEQ ID NO: 246586 - protein, 9 aa, Homo Sapiens
DAMLKEALG

SEQ ID NO: 246587 - protein, 9 aa, Homo Sapiens
FLPAMKQID

SEQ ID NO: 246588 - protein, 9 aa, Homo Sapiens
LSMRPRVHG

SEQ ID NO: 246589 - protein, 9 aa, Homo Sapiens
LSLAVSYNR

SEQ ID NO: 246590 - protein, 9 aa, Homo Sapiens
VQWFECTLD

SEQ ID NO: 246591 - protein, 9 aa, Homo Sapiens
EEKPAVTTA

SEQ ID NO: 246592 - protein, 9 aa, Homo Sapiens
LFETKKVLQ

SEQ ID NO: 246593 - protein, 9 aa, Homo Sapiens
RQHQELILE

SEQ ID NO: 246594 - protein, 9 aa, Homo Sapiens
QFLLILAIY

SEQ ID NO: 246595 - protein, 9 aa, Homo Sapiens
EDEFGIKQA

SEQ ID NO: 246596 - protein, 9 aa, Homo Sapiens
TQKQKDIQS

SEQ ID NO: 246597 - protein, 9 aa, Homo Sapiens
EDASTENSE

SEQ ID NO: 246598 - protein, 9 aa, Homo Sapiens
WTLLIISLA

SEQ ID NO: 246599 - protein, 9 aa, Homo Sapiens
QEFIALGLC

SEQ ID NO: 246600 - protein, 9 aa, Homo Sapiens
EWTLLDQAR

SEQ ID NO: 246601 - protein, 9 aa, Homo Sapiens
WGRGGTCVN

SEQ ID NO: 246602 - protein, 9 aa, Homo Sapiens
SCKVFIGGV

SEQ ID NO: 246603 - protein, 9 aa, Homo Sapiens
GQMFAMKML

SEQ ID NO: 246604 - protein, 9 aa, Homo Sapiens
LDITKNERL

SEQ ID NO: 246605 - protein, 9 aa, Homo Sapiens
TRNRSKGRK

SEQ ID NO: 246606 - protein, 9 aa, Homo Sapiens
ELTIQVGEI

SEQ ID NO: 246607 - protein, 9 aa, Homo Sapiens
SLVLGMVGC

SEQ ID NO: 246608 - protein, 9 aa, Homo Sapiens
MLSVEQVKI

SEQ ID NO: 246609 - protein, 9 aa, Homo Sapiens
HLAGLLRAL

SEQ ID NO: 246610 - protein, 9 aa, Homo Sapiens
PVVHEEDCQ

SEQ ID NO: 246611 - protein, 9 aa, Homo Sapiens
SFTRSIAEI

SEQ ID NO: 246612 - protein, 9 aa, Homo Sapiens
QNLLSVAYK

SEQ ID NO: 246613 - protein, 9 aa, Homo Sapiens
IHGDLLEVN

SEQ ID NO: 246614 - protein, 9 aa, Homo Sapiens
KKNDHAYRV

SEQ ID NO: 246615 - protein, 9 aa, Homo Sapiens
DTQLKQHMS

SEQ ID NO: 246616 - protein, 9 aa, Homo Sapiens
VGGQKMSCP

SEQ ID NO: 246617 - protein, 9 aa, Homo Sapiens
WNYHFVNLM

SEQ ID NO: 246618 - protein, 9 aa, Homo Sapiens
FIHGFTFME

SEQ ID NO: 246619 - protein, 9 aa, Homo Sapiens
FKIPFLIWQ

SEQ ID NO: 246620 - protein, 9 aa, Homo Sapiens
CQLLYITAF

SEQ ID NO: 246621 - protein, 9 aa, Homo Sapiens
IKSGQLSLI

SEQ ID NO: 246622 - protein, 9 aa, Homo Sapiens
GGFFPQTLE

SEQ ID NO: 246623 - protein, 9 aa, Homo Sapiens
GFGALLNPL

SEQ ID NO: 246624 - protein, 9 aa, Homo Sapiens
NHHDKLSVF

SEQ ID NO: 246625 - protein, 9 aa, Homo Sapiens
AREVQDLAG

SEQ ID NO: 246626 - protein, 9 aa, Homo Sapiens
SHHSPSSTS

SEQ ID NO: 246627 - protein, 9 aa, Homo Sapiens
TPFASAKNH

SEQ ID NO: 246628 - protein, 9 aa, Homo Sapiens
MRKENVFPG

SEQ ID NO: 246629 - protein, 9 aa, Homo Sapiens
YGQKFCIAG

SEQ ID NO: 246630 - protein, 9 aa, Homo Sapiens
NWLTGNFYF

SEQ ID NO: 246631 - protein, 9 aa, Homo Sapiens
SHILLVGDP

SEQ ID NO: 246632 - protein, 9 aa, Homo Sapiens
VSSSVVMGD

SEQ ID NO: 246633 - protein, 9 aa, Homo Sapiens
PINVGVLNG

SEQ ID NO: 246634 - protein, 9 aa, Homo Sapiens
FLQPRGNEV

SEQ ID NO: 246635 - protein, 9 aa, Homo Sapiens
SSAQHSHAF

SEQ ID NO: 246636 - protein, 9 aa, Homo Sapiens
IKDTSLVLT

SEQ ID NO: 246637 - protein, 9 aa, Homo Sapiens
KWSVCYSVF

SEQ ID NO: 246638 - protein, 9 aa, Homo Sapiens
SLDEDGLNL

SEQ ID NO: 246639 - protein, 9 aa, Homo Sapiens
KQAKAVLKT

SEQ ID NO: 246640 - protein, 9 aa, Homo Sapiens
LEFDFLTVM

SEQ ID NO: 246641 - protein, 9 aa, Homo Sapiens
ANIRAKEKR

SEQ ID NO: 246642 - protein, 9 aa, Homo Sapiens
WCQDNIIRL

SEQ ID NO: 246643 - protein, 9 aa, Homo Sapiens
IEINPMAED

SEQ ID NO: 246644 - protein, 9 aa, Homo Sapiens
SPENHFVID

SEQ ID NO: 246645 - protein, 9 aa, Homo Sapiens
PPDNKINRI

SEQ ID NO: 246646 - protein, 9 aa, Homo Sapiens
LVRLDLNSR

SEQ ID NO: 246647 - protein, 9 aa, Homo Sapiens
FGILDKVLA

SEQ ID NO: 246648 - protein, 9 aa, Homo Sapiens
IAFRMRSKM

SEQ ID NO: 246649 - protein, 9 aa, Homo Sapiens
PGAHFMTTA

SEQ ID NO: 246650 - protein, 9 aa, Homo Sapiens
HSPAICPAC

SEQ ID NO: 246651 - protein, 9 aa, Homo Sapiens
RIYISRLKE

SEQ ID NO: 246652 - protein, 9 aa, Homo Sapiens
VLEKEENLE

SEQ ID NO: 246653 - protein, 9 aa, Homo Sapiens
FTRPLTMTE

SEQ ID NO: 246654 - protein, 9 aa, Homo Sapiens
LILPSVTKN

SEQ ID NO: 246655 - protein, 9 aa, Homo Sapiens
YLCSDGRLV

SEQ ID NO: 246656 - protein, 9 aa, Homo Sapiens
NELRETVDK

SEQ ID NO: 246657 - protein, 9 aa, Homo Sapiens
PSHHMTKRK

SEQ ID NO: 246658 - protein, 9 aa, Homo Sapiens
HQKEDHQTW

SEQ ID NO: 246659 - protein, 9 aa, Homo Sapiens
CLNAYRRHD

SEQ ID NO: 246660 - protein, 9 aa, Homo Sapiens
LGMVGCFGM

SEQ ID NO: 246661 - protein, 9 aa, Homo Sapiens
FLIWQKIIS

SEQ ID NO: 246662 - protein, 9 aa, Homo Sapiens
YQKAVKLLN

SEQ ID NO: 246663 - protein, 9 aa, Homo Sapiens
QEEERKWQE

SEQ ID NO: 246664 - protein, 9 aa, Homo Sapiens
SITFCNAKV

SEQ ID NO: 246665 - protein, 9 aa, Homo Sapiens
IISGTKMAK

SEQ ID NO: 246666 - protein, 9 aa, Homo Sapiens
LDPSTRTYC

SEQ ID NO: 246667 - protein, 9 aa, Homo Sapiens
MTNRAARNA

SEQ ID NO: 246668 - protein, 9 aa, Homo Sapiens
ASKNHQDDG

SEQ ID NO: 246669 - protein, 9 aa, Homo Sapiens
PQTETLGAM

SEQ ID NO: 246670 - protein, 9 aa, Homo Sapiens
EYLRGNYQK

SEQ ID NO: 246671 - protein, 9 aa, Homo Sapiens
VTSDEMYKQ

SEQ ID NO: 246672 - protein, 9 aa, Homo Sapiens
KADYQAVND

SEQ ID NO: 246673 - protein, 9 aa, Homo Sapiens
VSALKEECR

SEQ ID NO: 246674 - protein, 9 aa, Homo Sapiens
DLNTVFLRY

SEQ ID NO: 246675 - protein, 9 aa, Homo Sapiens
SGILDFQIC

SEQ ID NO: 246676 - protein, 9 aa, Homo Sapiens
TSQLYAWPF

SEQ ID NO: 246677 - protein, 9 aa, Homo Sapiens
PNKVKDPLI

SEQ ID NO: 246678 - protein, 9 aa, Homo Sapiens
KCDECGNTF

SEQ ID NO: 246679 - protein, 9 aa, Homo Sapiens
GGILIMDLK

SEQ ID NO: 246680 - protein, 9 aa, Homo Sapiens
FRTEEEETI

SEQ ID NO: 246681 - protein, 9 aa, Homo Sapiens
IQTYLYFFL

SEQ ID NO: 246682 - protein, 9 aa, Homo Sapiens
KRQEVMEWN

SEQ ID NO: 246683 - protein, 9 aa, Homo Sapiens
LVWNRIYKV

SEQ ID NO: 246684 - protein, 9 aa, Homo Sapiens
QNSAENFSQ

SEQ ID NO: 246685 - protein, 9 aa, Homo Sapiens
PSEDPEAEV

SEQ ID NO: 246686 - protein, 9 aa, Homo Sapiens
HRQLDKSKL

SEQ ID NO: 246687 - protein, 9 aa, Homo Sapiens
TTLECEPPQ

SEQ ID NO: 246688 - protein, 9 aa, Homo Sapiens
ETNNRYDIT

SEQ ID NO: 246689 - protein, 9 aa, Homo Sapiens
FYQSSKLTE

SEQ ID NO: 246690 - protein, 9 aa, Homo Sapiens
YMVIEHCIK

SEQ ID NO: 246691 - protein, 9 aa, Homo Sapiens
QRMVKFLIN

SEQ ID NO: 246692 - protein, 9 aa, Homo Sapiens
QNPDNKQIE

SEQ ID NO: 246693 - protein, 9 aa, Homo Sapiens
LANIFNTDK

SEQ ID NO: 246694 - protein, 9 aa, Homo Sapiens
SIQAFSLLQ

SEQ ID NO: 246695 - protein, 9 aa, Homo Sapiens
LLQAGPPIC

SEQ ID NO: 246696 - protein, 9 aa, Homo Sapiens
KDPFLEVKM

SEQ ID NO: 246697 - protein, 9 aa, Homo Sapiens
RVDAGWIGF

SEQ ID NO: 246698 - protein, 9 aa, Homo Sapiens
GVQSHMFDI

SEQ ID NO: 246699 - protein, 9 aa, Homo Sapiens
RKVQRYLSK

SEQ ID NO: 246700 - protein, 9 aa, Homo Sapiens
DFLQLLLPT

SEQ ID NO: 246701 - protein, 9 aa, Homo Sapiens
LSDYRFLEE

SEQ ID NO: 246702 - protein, 9 aa, Homo Sapiens
SKSSWKRVY

SEQ ID NO: 246703 - protein, 9 aa, Homo Sapiens
DLLAFISRC

SEQ ID NO: 246704 - protein, 9 aa, Homo Sapiens
IRSKKSPRV

SEQ ID NO: 246705 - protein, 9 aa, Homo Sapiens
TNFLPGLNF

SEQ ID NO: 246706 - protein, 9 aa, Homo Sapiens
PKSKHHTTS

SEQ ID NO: 246707 - protein, 9 aa, Homo Sapiens
SVDGIWLLG

SEQ ID NO: 246708 - protein, 9 aa, Homo Sapiens
LGKLFLLHH

SEQ ID NO: 246709 - protein, 9 aa, Homo Sapiens
ILDYLTSFL

SEQ ID NO: 246710 - protein, 9 aa, Homo Sapiens
LESISSGSE

SEQ ID NO: 246711 - protein, 9 aa, Homo Sapiens
KNISGSIEV

SEQ ID NO: 246712 - protein, 9 aa, Homo Sapiens
LAVICNHHQ

SEQ ID NO: 246713 - protein, 9 aa, Homo Sapiens
TDMSSGQME

SEQ ID NO: 246714 - protein, 9 aa, Homo Sapiens
QFGQPSLFG

SEQ ID NO: 246715 - protein, 9 aa, Homo Sapiens
ATSKDKLFD

SEQ ID NO: 246716 - protein, 9 aa, Homo Sapiens
PSCNRARPL

SEQ ID NO: 246717 - protein, 9 aa, Homo Sapiens
EQHRNCAQS

SEQ ID NO: 246718 - protein, 9 aa, Homo Sapiens
LAQNFGYKL

SEQ ID NO: 246719 - protein, 9 aa, Homo Sapiens
QYQQELHQM

SEQ ID NO: 246720 - protein, 9 aa, Homo Sapiens
IAIINVSFC

SEQ ID NO: 246721 - protein, 9 aa, Homo Sapiens
IKHFLMENI

SEQ ID NO: 246722 - protein, 9 aa, Homo Sapiens
EQPLGEITE

SEQ ID NO: 246723 - protein, 9 aa, Homo Sapiens
NENLEISDN

SEQ ID NO: 246724 - protein, 9 aa, Homo Sapiens
LKKHHHHNE

SEQ ID NO: 246725 - protein, 9 aa, Homo Sapiens
VCQSTLIPS

SEQ ID NO: 246726 - protein, 9 aa, Homo Sapiens
KSEQKRNPQ

SEQ ID NO: 246727 - protein, 9 aa, Homo Sapiens
CGATRRGYF

SEQ ID NO: 246728 - protein, 9 aa, Homo Sapiens
PGVSLNSDF

SEQ ID NO: 246729 - protein, 9 aa, Homo Sapiens
IDLVLDRIC

SEQ ID NO: 246730 - protein, 9 aa, Homo Sapiens
GLRMMIFSW

SEQ ID NO: 246731 - protein, 9 aa, Homo Sapiens
KCGHDNLHL

SEQ ID NO: 246732 - protein, 9 aa, Homo Sapiens
TDERDLTNR

SEQ ID NO: 246733 - protein, 9 aa, Homo Sapiens
VNMFQKHNS

SEQ ID NO: 246734 - protein, 9 aa, Homo Sapiens
TQKLSDRLK

SEQ ID NO: 246735 - protein, 9 aa, Homo Sapiens
EHAETDVRR

SEQ ID NO: 246736 - protein, 9 aa, Homo Sapiens
VGSKVDMND

SEQ ID NO: 246737 - protein, 9 aa, Homo Sapiens
YGKEKVNGY

SEQ ID NO: 246738 - protein, 9 aa, Homo Sapiens
LEGHKHKKK

SEQ ID NO: 246739 - protein, 9 aa, Homo Sapiens
LSYNKLTDR

SEQ ID NO: 246740 - protein, 9 aa, Homo Sapiens
IAEGCMQDM

SEQ ID NO: 246741 - protein, 9 aa, Homo Sapiens
SSLTKIKGS

SEQ ID NO: 246742 - protein, 9 aa, Homo Sapiens
HSGSPACSY

SEQ ID NO: 246743 - protein, 9 aa, Homo Sapiens
AKFLKDTFV

SEQ ID NO: 246744 - protein, 9 aa, Homo Sapiens
KLYRNNLNG

SEQ ID NO: 246745 - protein, 9 aa, Homo Sapiens
HACGVATYM

SEQ ID NO: 246746 - protein, 9 aa, Homo Sapiens
CQSGMDNDT

SEQ ID NO: 246747 - protein, 9 aa, Homo Sapiens
WDPRTVVGK

SEQ ID NO: 246748 - protein, 9 aa, Homo Sapiens
IHTSPFPGI

SEQ ID NO: 246749 - protein, 9 aa, Homo Sapiens
YLDKSTEQT

SEQ ID NO: 246750 - protein, 9 aa, Homo Sapiens
APEPRLKKM

SEQ ID NO: 246751 - protein, 9 aa, Homo Sapiens
TNAWGHQHG

SEQ ID NO: 246752 - protein, 9 aa, Homo Sapiens
PQALTVKFL

SEQ ID NO: 246753 - protein, 9 aa, Homo Sapiens
KRIDTISQA

SEQ ID NO: 246754 - protein, 9 aa, Homo Sapiens
ATNPIYEIM

SEQ ID NO: 246755 - protein, 9 aa, Homo Sapiens
MMMGLFETG

SEQ ID NO: 246756 - protein, 9 aa, Homo Sapiens
VGEPGVPVP

SEQ ID NO: 246757 - protein, 9 aa, Homo Sapiens
TTDILGITQ

SEQ ID NO: 246758 - protein, 9 aa, Homo Sapiens
ASMSCASFL

SEQ ID NO: 246759 - protein, 9 aa, Homo Sapiens
ISALFMLFF

SEQ ID NO: 246760 - protein, 9 aa, Homo Sapiens
SKSLEKFFL

SEQ ID NO: 246761 - protein, 9 aa, Homo Sapiens
VEIDLTGSK

SEQ ID NO: 246762 - protein, 9 aa, Homo Sapiens
NKDGKGIQS

SEQ ID NO: 246763 - protein, 9 aa, Homo Sapiens
QSYTCPYST

SEQ ID NO: 246764 - protein, 9 aa, Homo Sapiens
VIYYIDKAK

SEQ ID NO: 246765 - protein, 9 aa, Homo Sapiens
EGLLAGPSS

SEQ ID NO: 246766 - protein, 9 aa, Homo Sapiens
QYCTQELTV

SEQ ID NO: 246767 - protein, 9 aa, Homo Sapiens
GKSKVKEKK

SEQ ID NO: 246768 - protein, 9 aa, Homo Sapiens
ISSFFGGSG

SEQ ID NO: 246769 - protein, 9 aa, Homo Sapiens
YLLQSFQKE

SEQ ID NO: 246770 - protein, 9 aa, Homo Sapiens
FSVITNAFV

SEQ ID NO: 246771 - protein, 9 aa, Homo Sapiens
FLMSRGLHV

SEQ ID NO: 246772 - protein, 9 aa, Homo Sapiens
PFEEQENYY

SEQ ID NO: 246773 - protein, 9 aa, Homo Sapiens
IVTSSLTKY

SEQ ID NO: 246774 - protein, 9 aa, Homo Sapiens
VEVIITNAG

SEQ ID NO: 246775 - protein, 9 aa, Homo Sapiens
CAAAVASLT

SEQ ID NO: 246776 - protein, 9 aa, Homo Sapiens
VQEVNITLP

SEQ ID NO: 246777 - protein, 9 aa, Homo Sapiens
NAPKPKWTP

SEQ ID NO: 246778 - protein, 9 aa, Homo Sapiens
QQQEEEIQA

SEQ ID NO: 246779 - protein, 9 aa, Homo Sapiens
GFPDTQTIH

SEQ ID NO: 246780 - protein, 9 aa, Homo Sapiens
DFKMLFAPC

SEQ ID NO: 246781 - protein, 9 aa, Homo Sapiens
CPGPNMNHI

SEQ ID NO: 246782 - protein, 9 aa, Homo Sapiens
FKYLNMNVN

SEQ ID NO: 246783 - protein, 9 aa, Homo Sapiens
TLPKNFHSP

SEQ ID NO: 246784 - protein, 9 aa, Homo Sapiens
GMEVCNLCI

SEQ ID NO: 246785 - protein, 9 aa, Homo Sapiens
QIHMYEQGG

SEQ ID NO: 246786 - protein, 9 aa, Homo Sapiens
NNVTLLYLK

SEQ ID NO: 246787 - protein, 9 aa, Homo Sapiens
MNTSRMEKL

SEQ ID NO: 246788 - protein, 9 aa, Homo Sapiens
DELFILGSK

SEQ ID NO: 246789 - protein, 9 aa, Homo Sapiens
KKNSGQLWS

SEQ ID NO: 246790 - protein, 9 aa, Homo Sapiens
SVNYHFTHQ

SEQ ID NO: 246791 - protein, 9 aa, Homo Sapiens
GSFFLPILA

SEQ ID NO: 246792 - protein, 9 aa, Homo Sapiens
AKSAVNCVP

SEQ ID NO: 246793 - protein, 9 aa, Homo Sapiens
MEQIQNPEY

SEQ ID NO: 246794 - protein, 9 aa, Homo Sapiens
KWALIFSIR

SEQ ID NO: 246795 - protein, 9 aa, Homo Sapiens
QLAKPSITP

SEQ ID NO: 246796 - protein, 9 aa, Homo Sapiens
EYRVKMHFK

SEQ ID NO: 246797 - protein, 9 aa, Homo Sapiens
SDFETDVAD

SEQ ID NO: 246798 - protein, 9 aa, Homo Sapiens
EIYCYYGDG

SEQ ID NO: 246799 - protein, 9 aa, Homo Sapiens
FTLNPASKV

SEQ ID NO: 246800 - protein, 9 aa, Homo Sapiens
HLIAPSQVQ

SEQ ID NO: 246801 - protein, 9 aa, Homo Sapiens
DKAGSPTLF

SEQ ID NO: 246802 - protein, 9 aa, Homo Sapiens
LHDPEGMGV

SEQ ID NO: 246803 - protein, 9 aa, Homo Sapiens
TMLESLDED

SEQ ID NO: 246804 - protein, 9 aa, Homo Sapiens
ERSIHSARC

SEQ ID NO: 246805 - protein, 9 aa, Homo Sapiens
VDQKPELNI

SEQ ID NO: 246806 - protein, 9 aa, Homo Sapiens
YCQKDFLAM

SEQ ID NO: 246807 - protein, 9 aa, Homo Sapiens
VHDIRWNFD

SEQ ID NO: 246808 - protein, 9 aa, Homo Sapiens
TFYQQFHII

SEQ ID NO: 246809 - protein, 9 aa, Homo Sapiens
SGSLALLCE

SEQ ID NO: 246810 - protein, 9 aa, Homo Sapiens
DADTCPEVL

SEQ ID NO: 246811 - protein, 9 aa, Homo Sapiens
LQKQLGQDP

SEQ ID NO: 246812 - protein, 9 aa, Homo Sapiens
RKLTDIIDN

SEQ ID NO: 246813 - protein, 9 aa, Homo Sapiens
AESDQLINR

SEQ ID NO: 246814 - protein, 9 aa, Homo Sapiens
EYDLNDSFI

SEQ ID NO: 246815 - protein, 9 aa, Homo Sapiens
RKRINNGSY

SEQ ID NO: 246816 - protein, 9 aa, Homo Sapiens
KWQKDTLQN

SEQ ID NO: 246817 - protein, 9 aa, Homo Sapiens
RDINKDRND

SEQ ID NO: 246818 - protein, 9 aa, Homo Sapiens
VKKRNMLNA

SEQ ID NO: 246819 - protein, 9 aa, Homo Sapiens
ATFIHSLHK

SEQ ID NO: 246820 - protein, 9 aa, Homo Sapiens
ESSSVSLLE

SEQ ID NO: 246821 - protein, 9 aa, Homo Sapiens
VTSEINQLR

SEQ ID NO: 246822 - protein, 9 aa, Homo Sapiens
NCDQIATVQ

SEQ ID NO: 246823 - protein, 9 aa, Homo Sapiens
IIEYPLKAH

SEQ ID NO: 246824 - protein, 9 aa, Homo Sapiens
GTLVFFLNS

SEQ ID NO: 246825 - protein, 9 aa, Homo Sapiens
QLDLSIVKI

SEQ ID NO: 246826 - protein, 9 aa, Homo Sapiens
KHRIKETDT

SEQ ID NO: 246827 - protein, 9 aa, Homo Sapiens
SQTDREIKV

SEQ ID NO: 246828 - protein, 9 aa, Homo Sapiens
GPGVETYPN

SEQ ID NO: 246829 - protein, 9 aa, Homo Sapiens
ARCSDSVIL

SEQ ID NO: 246830 - protein, 9 aa, Homo Sapiens
FVFGIVVGT

SEQ ID NO: 246831 - protein, 9 aa, Homo Sapiens
QQSSTEQSG

SEQ ID NO: 246832 - protein, 9 aa, Homo Sapiens
PSHSKSSVS

SEQ ID NO: 246833 - protein, 9 aa, Homo Sapiens
GSLVFQLKR

SEQ ID NO: 246834 - protein, 9 aa, Homo Sapiens
YSSPSETTS

SEQ ID NO: 246835 - protein, 9 aa, Homo Sapiens
KFYLETQAE

SEQ ID NO: 246836 - protein, 9 aa, Homo Sapiens
RDSRKERLK

SEQ ID NO: 246837 - protein, 9 aa, Homo Sapiens
LISLEIKKE

SEQ ID NO: 246838 - protein, 9 aa, Homo Sapiens
HLSRHRKSH

SEQ ID NO: 246839 - protein, 9 aa, Homo Sapiens
DARRKRRSF

SEQ ID NO: 246840 - protein, 9 aa, Homo Sapiens
SKKANNSID

SEQ ID NO: 246841 - protein, 9 aa, Homo Sapiens
GVGQHQELR

SEQ ID NO: 246842 - protein, 9 aa, Homo Sapiens
MAWVNFLRK

SEQ ID NO: 246843 - protein, 9 aa, Homo Sapiens
VGPNATRDG

SEQ ID NO: 246844 - protein, 9 aa, Homo Sapiens
AEEEATLTK

SEQ ID NO: 246845 - protein, 9 aa, Homo Sapiens
STLDTTVAG

SEQ ID NO: 246846 - protein, 9 aa, Homo Sapiens
IKSEDKTLA

SEQ ID NO: 246847 - protein, 9 aa, Homo Sapiens
FNNCMLYKE

SEQ ID NO: 246848 - protein, 9 aa, Homo Sapiens
KQYPYTNLY

SEQ ID NO: 246849 - protein, 9 aa, Homo Sapiens
CTSDTWILD

SEQ ID NO: 246850 - protein, 9 aa, Homo Sapiens
GFQLDGNKT

SEQ ID NO: 246851 - protein, 9 aa, Homo Sapiens
LDLNSRPQA

SEQ ID NO: 246852 - protein, 9 aa, Homo Sapiens
TSNASPPEG

SEQ ID NO: 246853 - protein, 9 aa, Homo Sapiens
YQLHRVFVQ

SEQ ID NO: 246854 - protein, 9 aa, Homo Sapiens
KYRDLGKSG

SEQ ID NO: 246855 - protein, 9 aa, Homo Sapiens
IKYSFEKVT

SEQ ID NO: 246856 - protein, 9 aa, Homo Sapiens
YVCMERGKA

SEQ ID NO: 246857 - protein, 9 aa, Homo Sapiens
TELGGCEIV

SEQ ID NO: 246858 - protein, 9 aa, Homo Sapiens
NVEKAIKFV

SEQ ID NO: 246859 - protein, 9 aa, Homo Sapiens
FRKPSPFIF

SEQ ID NO: 246860 - protein, 9 aa, Homo Sapiens
MQGRLCNKT

SEQ ID NO: 246861 - protein, 9 aa, Homo Sapiens
DPNREMVAQ

SEQ ID NO: 246862 - protein, 9 aa, Homo Sapiens
HLKGQHEAA

SEQ ID NO: 246863 - protein, 9 aa, Homo Sapiens
LELTPHLCT

SEQ ID NO: 246864 - protein, 9 aa, Homo Sapiens
RFNKQLLYD

SEQ ID NO: 246865 - protein, 9 aa, Homo Sapiens
SHLAYIDNA

SEQ ID NO: 246866 - protein, 9 aa, Homo Sapiens
TSRNIDPQP

SEQ ID NO: 246867 - protein, 9 aa, Homo Sapiens
DKSMCSHFS

SEQ ID NO: 246868 - protein, 9 aa, Homo Sapiens
INHNLALGR

SEQ ID NO: 246869 - protein, 9 aa, Homo Sapiens
DKLGTGENL

SEQ ID NO: 246870 - protein, 9 aa, Homo Sapiens
LPPPSLYMS

SEQ ID NO: 246871 - protein, 9 aa, Homo Sapiens
SPTEVQSLC

SEQ ID NO: 246872 - protein, 9 aa, Homo Sapiens
QSSQVGPNQ

SEQ ID NO: 246873 - protein, 9 aa, Homo Sapiens
FDQKEEGRR

SEQ ID NO: 246874 - protein, 9 aa, Homo Sapiens
RNCDDEVSE

SEQ ID NO: 246875 - protein, 9 aa, Homo Sapiens
VKPKGACKA

SEQ ID NO: 246876 - protein, 9 aa, Homo Sapiens
PEFFKSALH

SEQ ID NO: 246877 - protein, 9 aa, Homo Sapiens
KLDLPGHLP

SEQ ID NO: 246878 - protein, 9 aa, Homo Sapiens
PENSKNTEF

SEQ ID NO: 246879 - protein, 9 aa, Homo Sapiens
AFQVFIIML

SEQ ID NO: 246880 - protein, 9 aa, Homo Sapiens
SVLLFRKPS

SEQ ID NO: 246881 - protein, 9 aa, Homo Sapiens
SEASLLENK

SEQ ID NO: 246882 - protein, 9 aa, Homo Sapiens
RLDRSRMYD

SEQ ID NO: 246883 - protein, 9 aa, Homo Sapiens
TLKSFGECC

SEQ ID NO: 246884 - protein, 9 aa, Homo Sapiens
GDKKSVPFW

SEQ ID NO: 246885 - protein, 9 aa, Homo Sapiens
TSRQIVFEI

SEQ ID NO: 246886 - protein, 9 aa, Homo Sapiens
SKLHWCNNA

SEQ ID NO: 246887 - protein, 9 aa, Homo Sapiens
SADVEFYLS

SEQ ID NO: 246888 - protein, 9 aa, Homo Sapiens
LYRNNLNGI

SEQ ID NO: 246889 - protein, 9 aa, Homo Sapiens
PGPREGAFL

SEQ ID NO: 246890 - protein, 9 aa, Homo Sapiens
FSHSPAICP

SEQ ID NO: 246891 - protein, 9 aa, Homo Sapiens
GSDSKGAAD

SEQ ID NO: 246892 - protein, 9 aa, Homo Sapiens
EFDCHEIQI

SEQ ID NO: 246893 - protein, 9 aa, Homo Sapiens
AACNDVDLW

SEQ ID NO: 246894 - protein, 9 aa, Homo Sapiens
RFDQVMKFS

SEQ ID NO: 246895 - protein, 9 aa, Homo Sapiens
RALSRNPQP

SEQ ID NO: 246896 - protein, 9 aa, Homo Sapiens
AKVACVKLR

SEQ ID NO: 246897 - protein, 9 aa, Homo Sapiens
LRDVIGLSI

SEQ ID NO: 246898 - protein, 9 aa, Homo Sapiens
VKIWIVYFT

SEQ ID NO: 246899 - protein, 9 aa, Homo Sapiens
EERPRQQNP

SEQ ID NO: 246900 - protein, 9 aa, Homo Sapiens
FPDVDEETG

SEQ ID NO: 246901 - protein, 9 aa, Homo Sapiens
NGRYLQNPI

SEQ ID NO: 246902 - protein, 9 aa, Homo Sapiens
HFVNLMQEF

SEQ ID NO: 246903 - protein, 9 aa, Homo Sapiens
FVHLTNVAL

SEQ ID NO: 246904 - protein, 9 aa, Homo Sapiens
GAYTSLLSN

SEQ ID NO: 246905 - protein, 9 aa, Homo Sapiens
SEHLQTLKV

SEQ ID NO: 246906 - protein, 9 aa, Homo Sapiens
GNDLCLVAV

SEQ ID NO: 246907 - protein, 9 aa, Homo Sapiens
IFHARVSGI

SEQ ID NO: 246908 - protein, 9 aa, Homo Sapiens
ARFIHFLHK

SEQ ID NO: 246909 - protein, 9 aa, Homo Sapiens
PSKGVILYG

SEQ ID NO: 246910 - protein, 9 aa, Homo Sapiens
WIKRPWPLC

SEQ ID NO: 246911 - protein, 9 aa, Homo Sapiens
ARTPELSNR

SEQ ID NO: 246912 - protein, 9 aa, Homo Sapiens
EIVLFAHNE

SEQ ID NO: 246913 - protein, 9 aa, Homo Sapiens
ERHKQLESA

SEQ ID NO: 246914 - protein, 9 aa, Homo Sapiens
HKCGDCEKI

SEQ ID NO: 246915 - protein, 9 aa, Homo Sapiens
SKIDQYSQI

SEQ ID NO: 246916 - protein, 9 aa, Homo Sapiens
LDGFIITVT

SEQ ID NO: 246917 - protein, 9 aa, Homo Sapiens
NMDLVGDTA

SEQ ID NO: 246918 - protein, 9 aa, Homo Sapiens
IVMPHRVCS

SEQ ID NO: 246919 - protein, 9 aa, Homo Sapiens
QKTLKTSEC

SEQ ID NO: 246920 - protein, 9 aa, Homo Sapiens
QMVRTQRQL

SEQ ID NO: 246921 - protein, 9 aa, Homo Sapiens
YEKDDMKME

SEQ ID NO: 246922 - protein, 9 aa, Homo Sapiens
DGVQHLGAL

SEQ ID NO: 246923 - protein, 9 aa, Homo Sapiens
QALVPEYSK

SEQ ID NO: 246924 - protein, 9 aa, Homo Sapiens
QDAASSDNI

SEQ ID NO: 246925 - protein, 9 aa, Homo Sapiens
ILSLTENYH

SEQ ID NO: 246926 - protein, 9 aa, Homo Sapiens
WSFLYSVLI

SEQ ID NO: 246927 - protein, 9 aa, Homo Sapiens
IISPGIRGT

SEQ ID NO: 246928 - protein, 9 aa, Homo Sapiens
NRLSYLTKH

SEQ ID NO: 246929 - protein, 9 aa, Homo Sapiens
RLPFCGPNH

SEQ ID NO: 246930 - protein, 9 aa, Homo Sapiens
TCMVTNSVG

SEQ ID NO: 246931 - protein, 9 aa, Homo Sapiens
GINSCLIHH

SEQ ID NO: 246932 - protein, 9 aa, Homo Sapiens
SDKTGVCLS

SEQ ID NO: 246933 - protein, 9 aa, Homo Sapiens
CADCGRAFT

SEQ ID NO: 246934 - protein, 9 aa, Homo Sapiens
ALAVLQRMD

SEQ ID NO: 246935 - protein, 9 aa, Homo Sapiens
HFIGPNAGE

SEQ ID NO: 246936 - protein, 9 aa, Homo Sapiens
DNIIRLMSA

SEQ ID NO: 246937 - protein, 9 aa, Homo Sapiens
TVIRRGPIS

SEQ ID NO: 246938 - protein, 9 aa, Homo Sapiens
QKALERDGG

SEQ ID NO: 246939 - protein, 9 aa, Homo Sapiens
PMNELDTVV

SEQ ID NO: 246940 - protein, 9 aa, Homo Sapiens
TEEKPFKCN

SEQ ID NO: 246941 - protein, 9 aa, Homo Sapiens
TSQNHSKCI

SEQ ID NO: 246942 - protein, 9 aa, Homo Sapiens
VCDLPEELS

SEQ ID NO: 246943 - protein, 9 aa, Homo Sapiens
IHMTKGATK

SEQ ID NO: 246944 - protein, 9 aa, Homo Sapiens
KDWMPTSAL

SEQ ID NO: 246945 - protein, 9 aa, Homo Sapiens
LWAGSNMKN

SEQ ID NO: 246946 - protein, 9 aa, Homo Sapiens
GDIGDNVED

SEQ ID NO: 246947 - protein, 9 aa, Homo Sapiens
RNITSHLGN

SEQ ID NO: 246948 - protein, 9 aa, Homo Sapiens
QHVESQQDL

SEQ ID NO: 246949 - protein, 9 aa, Homo Sapiens
IDWIAFQSN

SEQ ID NO: 246950 - protein, 9 aa, Homo Sapiens
MLISLSYFL

SEQ ID NO: 246951 - protein, 9 aa, Homo Sapiens
DDYPAILMH

SEQ ID NO: 246952 - protein, 9 aa, Homo Sapiens
ELRVPDHQN

SEQ ID NO: 246953 - protein, 9 aa, Homo Sapiens
NKDLLGELS

SEQ ID NO: 246954 - protein, 9 aa, Homo Sapiens
RRDLYRDVM

SEQ ID NO: 246955 - protein, 9 aa, Homo Sapiens
LICHEAPYL

SEQ ID NO: 246956 - protein, 9 aa, Homo Sapiens
QLLSYAILG

SEQ ID NO: 246957 - protein, 9 aa, Homo Sapiens
TLNYVQERK

SEQ ID NO: 246958 - protein, 9 aa, Homo Sapiens
SNRGILTLK

SEQ ID NO: 246959 - protein, 9 aa, Homo Sapiens
LPEINKIIY

SEQ ID NO: 246960 - protein, 9 aa, Homo Sapiens
EVYICLDFI

SEQ ID NO: 246961 - protein, 9 aa, Homo Sapiens
GFSSPPSLL

SEQ ID NO: 246962 - protein, 9 aa, Homo Sapiens
LEDELVNEA

SEQ ID NO: 246963 - protein, 9 aa, Homo Sapiens
LGESQGDLR

SEQ ID NO: 246964 - protein, 9 aa, Homo Sapiens
VRGNLDNLF

SEQ ID NO: 246965 - protein, 9 aa, Homo Sapiens
QKYGGIPKF

SEQ ID NO: 246966 - protein, 9 aa, Homo Sapiens
AKDKSSRKN

SEQ ID NO: 246967 - protein, 9 aa, Homo Sapiens
RCSHDLSEC

SEQ ID NO: 246968 - protein, 9 aa, Homo Sapiens
IYIYWVHSY

SEQ ID NO: 246969 - protein, 9 aa, Homo Sapiens
QEFLAAYAP

SEQ ID NO: 246970 - protein, 9 aa, Homo Sapiens
LKHLVDGAH

SEQ ID NO: 246971 - protein, 9 aa, Homo Sapiens
LSRRLDDLS

SEQ ID NO: 246972 - protein, 9 aa, Homo Sapiens
LDLFLKGNI

SEQ ID NO: 246973 - protein, 9 aa, Homo Sapiens
TCTIDGLLM

SEQ ID NO: 246974 - protein, 9 aa, Homo Sapiens
NDCCFGTFN

SEQ ID NO: 246975 - protein, 9 aa, Homo Sapiens
RFIFFQVGC

SEQ ID NO: 246976 - protein, 9 aa, Homo Sapiens
HCAVTEEHM

SEQ ID NO: 246977 - protein, 9 aa, Homo Sapiens
PFGYVKAST

SEQ ID NO: 246978 - protein, 9 aa, Homo Sapiens
HSLSDYNIQ

SEQ ID NO: 246979 - protein, 9 aa, Homo Sapiens
NFCTEATGL

SEQ ID NO: 246980 - protein, 9 aa, Homo Sapiens
EETAQKTAQ

SEQ ID NO: 246981 - protein, 9 aa, Homo Sapiens
RCHSSLSHH

SEQ ID NO: 246982 - protein, 9 aa, Homo Sapiens
ATQERIYLQ

SEQ ID NO: 246983 - protein, 9 aa, Homo Sapiens
SATYPKFLA

SEQ ID NO: 246984 - protein, 9 aa, Homo Sapiens
SYQIRYRAA

SEQ ID NO: 246985 - protein, 9 aa, Homo Sapiens
TSPRDKQQN

SEQ ID NO: 246986 - protein, 9 aa, Homo Sapiens
GDIITLTNR

SEQ ID NO: 246987 - protein, 9 aa, Homo Sapiens
LLLHFNVLV

SEQ ID NO: 246988 - protein, 9 aa, Homo Sapiens
WGKMMSGHV

SEQ ID NO: 246989 - protein, 9 aa, Homo Sapiens
HNTKGKRFT

SEQ ID NO: 246990 - protein, 9 aa, Homo Sapiens
CLPLGQCDT

SEQ ID NO: 246991 - protein, 9 aa, Homo Sapiens
QMKTLKPTE

SEQ ID NO: 246992 - protein, 9 aa, Homo Sapiens
QFEERLRTR

SEQ ID NO: 246993 - protein, 9 aa, Homo Sapiens
ILGNCSKQH

SEQ ID NO: 246994 - protein, 9 aa, Homo Sapiens
ALPNLTPLS

SEQ ID NO: 246995 - protein, 9 aa, Homo Sapiens
WFGLVTSPL

SEQ ID NO: 246996 - protein, 9 aa, Homo Sapiens
FLDHLATDN

SEQ ID NO: 246997 - protein, 9 aa, Homo Sapiens
PIPKDLGTP

SEQ ID NO: 246998 - protein, 9 aa, Homo Sapiens
LSSVDVSKV

SEQ ID NO: 246999 - protein, 9 aa, Homo Sapiens
VGNQFTCSC

SEQ ID NO: 247000 - protein, 9 aa, Homo Sapiens
LKIEYISEE

SEQ ID NO: 247001 - protein, 9 aa, Homo Sapiens
MMFFSNCPF

SEQ ID NO: 247002 - protein, 9 aa, Homo Sapiens
CIYYDEYFN

SEQ ID NO: 247003 - protein, 9 aa, Homo Sapiens
PMQSRLYAG

SEQ ID NO: 247004 - protein, 9 aa, Homo Sapiens
LKLNKKSLR

SEQ ID NO: 247005 - protein, 9 aa, Homo Sapiens
RLPRIHALG

SEQ ID NO: 247006 - protein, 9 aa, Homo Sapiens
DKKQKKKTN

SEQ ID NO: 247007 - protein, 9 aa, Homo Sapiens
SQSIPEERY

SEQ ID NO: 247008 - protein, 9 aa, Homo Sapiens
SHKRRKQNI

SEQ ID NO: 247009 - protein, 9 aa, Homo Sapiens
VCNPRTLEA

SEQ ID NO: 247010 - protein, 9 aa, Homo Sapiens
QLPGIDKTK

SEQ ID NO: 247011 - protein, 9 aa, Homo Sapiens
KYHVLPERR

SEQ ID NO: 247012 - protein, 9 aa, Homo Sapiens
KISVTLYGK

SEQ ID NO: 247013 - protein, 9 aa, Homo Sapiens
VHREHGLCG

SEQ ID NO: 247014 - protein, 9 aa, Homo Sapiens
QFQQIMFIY

SEQ ID NO: 247015 - protein, 9 aa, Homo Sapiens
EAKKDSLDE

SEQ ID NO: 247016 - protein, 9 aa, Homo Sapiens
RFPVPSPPG

SEQ ID NO: 247017 - protein, 9 aa, Homo Sapiens
IVKTSVKPS

SEQ ID NO: 247018 - protein, 9 aa, Homo Sapiens
MEPVNRDNF

SEQ ID NO: 247019 - protein, 9 aa, Homo Sapiens
IFRKLWCQQ

SEQ ID NO: 247020 - protein, 9 aa, Homo Sapiens
QDCRSPFIA

SEQ ID NO: 247021 - protein, 9 aa, Homo Sapiens
QKTGDVVEI

SEQ ID NO: 247022 - protein, 9 aa, Homo Sapiens
RMPFQQDRH

SEQ ID NO: 247023 - protein, 9 aa, Homo Sapiens
CFDVIVSAK

SEQ ID NO: 247024 - protein, 9 aa, Homo Sapiens
EREQLETTC

SEQ ID NO: 247025 - protein, 9 aa, Homo Sapiens
QENCEGRAA

SEQ ID NO: 247026 - protein, 9 aa, Homo Sapiens
MFAKTLEEA

SEQ ID NO: 247027 - protein, 9 aa, Homo Sapiens
CDCSTANKI

SEQ ID NO: 247028 - protein, 9 aa, Homo Sapiens
VSHIMEMWL

SEQ ID NO: 247029 - protein, 9 aa, Homo Sapiens
SRQIAIGLD

SEQ ID NO: 247030 - protein, 9 aa, Homo Sapiens
VLPHQPLVT

SEQ ID NO: 247031 - protein, 9 aa, Homo Sapiens
EAPQPGPHT

SEQ ID NO: 247032 - protein, 9 aa, Homo Sapiens
ISAEDCGFI

SEQ ID NO: 247033 - protein, 9 aa, Homo Sapiens
SREQAGDLG

SEQ ID NO: 247034 - protein, 9 aa, Homo Sapiens
IDGYVVLWM

SEQ ID NO: 247035 - protein, 9 aa, Homo Sapiens
LCGQDLNTT

SEQ ID NO: 247036 - protein, 9 aa, Homo Sapiens
KRLDLCQRI

SEQ ID NO: 247037 - protein, 9 aa, Homo Sapiens
LLECEVYLE

SEQ ID NO: 247038 - protein, 9 aa, Homo Sapiens
KEKGKSKVK

SEQ ID NO: 247039 - protein, 9 aa, Homo Sapiens
VCYHERLSV

SEQ ID NO: 247040 - protein, 9 aa, Homo Sapiens
MQPATNAIL

SEQ ID NO: 247041 - protein, 9 aa, Homo Sapiens
GSGISGTTA

SEQ ID NO: 247042 - protein, 9 aa, Homo Sapiens
ATKTSKRAR

SEQ ID NO: 247043 - protein, 9 aa, Homo Sapiens
LEKHRQAKL

SEQ ID NO: 247044 - protein, 9 aa, Homo Sapiens
KHKRGETKP

SEQ ID NO: 247045 - protein, 9 aa, Homo Sapiens
LQYFDDIAY

SEQ ID NO: 247046 - protein, 9 aa, Homo Sapiens
MKQSNSKAR

SEQ ID NO: 247047 - protein, 9 aa, Homo Sapiens
TKEAANIIQ

SEQ ID NO: 247048 - protein, 9 aa, Homo Sapiens
SKINEEACN

SEQ ID NO: 247049 - protein, 9 aa, Homo Sapiens
ENGWISKLV

SEQ ID NO: 247050 - protein, 9 aa, Homo Sapiens
STMYLPLKR

SEQ ID NO: 247051 - protein, 9 aa, Homo Sapiens
RGKKNRSSV

SEQ ID NO: 247052 - protein, 9 aa, Homo Sapiens
HNRSSEILN

SEQ ID NO: 247053 - protein, 9 aa, Homo Sapiens
QYSKFMNLL

SEQ ID NO: 247054 - protein, 9 aa, Homo Sapiens
HRVVIGKNG

SEQ ID NO: 247055 - protein, 9 aa, Homo Sapiens
VEDAVEAIL

SEQ ID NO: 247056 - protein, 9 aa, Homo Sapiens
MAVPHTADQ

SEQ ID NO: 247057 - protein, 9 aa, Homo Sapiens
PQFLLILAI

SEQ ID NO: 247058 - protein, 9 aa, Homo Sapiens
LTKIKQLCS

SEQ ID NO: 247059 - protein, 9 aa, Homo Sapiens
LDCYDPTVD

SEQ ID NO: 247060 - protein, 9 aa, Homo Sapiens
TAVCTLRCL

SEQ ID NO: 247061 - protein, 9 aa, Homo Sapiens
LQTVECYNP

SEQ ID NO: 247062 - protein, 9 aa, Homo Sapiens
GFELVVSFG

SEQ ID NO: 247063 - protein, 9 aa, Homo Sapiens
HASGHDTRD

SEQ ID NO: 247064 - protein, 9 aa, Homo Sapiens
LKGLTHQPG

SEQ ID NO: 247065 - protein, 9 aa, Homo Sapiens
AAEIAISLF

SEQ ID NO: 247066 - protein, 9 aa, Homo Sapiens
DLQGLREDA

SEQ ID NO: 247067 - protein, 9 aa, Homo Sapiens
MIMSGGCDT

SEQ ID NO: 247068 - protein, 9 aa, Homo Sapiens
HLQQSSVQD

SEQ ID NO: 247069 - protein, 9 aa, Homo Sapiens
RATEAQNTM

SEQ ID NO: 247070 - protein, 9 aa, Homo Sapiens
DAQEYASKL

SEQ ID NO: 247071 - protein, 9 aa, Homo Sapiens
GSVGNLYSG

SEQ ID NO: 247072 - protein, 9 aa, Homo Sapiens
SNLIRHQII

SEQ ID NO: 247073 - protein, 9 aa, Homo Sapiens
WEITDTFRK

SEQ ID NO: 247074 - protein, 9 aa, Homo Sapiens
LLLLFVELF

SEQ ID NO: 247075 - protein, 9 aa, Homo Sapiens
LTLTDSEIT

SEQ ID NO: 247076 - protein, 9 aa, Homo Sapiens
GLFAFLSSF

SEQ ID NO: 247077 - protein, 9 aa, Homo Sapiens
ESTCINSTW

SEQ ID NO: 247078 - protein, 9 aa, Homo Sapiens
KVKQNGSSC

SEQ ID NO: 247079 - protein, 9 aa, Homo Sapiens
NELIKTIIS

SEQ ID NO: 247080 - protein, 9 aa, Homo Sapiens
KKSKDETDK

SEQ ID NO: 247081 - protein, 9 aa, Homo Sapiens
HHCAHFTDE

SEQ ID NO: 247082 - protein, 9 aa, Homo Sapiens
DSQAVAHYK

SEQ ID NO: 247083 - protein, 9 aa, Homo Sapiens
KRNPQAVLD

SEQ ID NO: 247084 - protein, 9 aa, Homo Sapiens
LWRHHIKNL

SEQ ID NO: 247085 - protein, 9 aa, Homo Sapiens
SKILNKNGL

SEQ ID NO: 247086 - protein, 9 aa, Homo Sapiens
LQDSSLPNI

SEQ ID NO: 247087 - protein, 9 aa, Homo Sapiens
EGNLQRIVK

SEQ ID NO: 247088 - protein, 9 aa, Homo Sapiens
EGYILVKKT

SEQ ID NO: 247089 - protein, 9 aa, Homo Sapiens
PTAGNVFVL

SEQ ID NO: 247090 - protein, 9 aa, Homo Sapiens
VRSRVHTFL

SEQ ID NO: 247091 - protein, 9 aa, Homo Sapiens
FIILNKGKA

SEQ ID NO: 247092 - protein, 9 aa, Homo Sapiens
MDTICTSSI

SEQ ID NO: 247093 - protein, 9 aa, Homo Sapiens
YDKVKLLEI

SEQ ID NO: 247094 - protein, 9 aa, Homo Sapiens
WTTDEQLVA

SEQ ID NO: 247095 - protein, 9 aa, Homo Sapiens
YKTNKGDGL

SEQ ID NO: 247096 - protein, 9 aa, Homo Sapiens
GGSLIYDKL

SEQ ID NO: 247097 - protein, 9 aa, Homo Sapiens
RDCEDPNNS

SEQ ID NO: 247098 - protein, 9 aa, Homo Sapiens
CSYQWDVPE

SEQ ID NO: 247099 - protein, 9 aa, Homo Sapiens
SFEINAFKL

SEQ ID NO: 247100 - protein, 9 aa, Homo Sapiens
IDRLEEVDN

SEQ ID NO: 247101 - protein, 9 aa, Homo Sapiens
ADMQKESKD

SEQ ID NO: 247102 - protein, 9 aa, Homo Sapiens
VSIFCPPRK

SEQ ID NO: 247103 - protein, 9 aa, Homo Sapiens
MLLLHGFPG

SEQ ID NO: 247104 - protein, 9 aa, Homo Sapiens
TLATKEKEV

SEQ ID NO: 247105 - protein, 9 aa, Homo Sapiens
YTIPLDFIS

SEQ ID NO: 247106 - protein, 9 aa, Homo Sapiens
VAFSCVFAS

SEQ ID NO: 247107 - protein, 9 aa, Homo Sapiens
QELTKKGCN

SEQ ID NO: 247108 - protein, 9 aa, Homo Sapiens
NQIYCGQIY

SEQ ID NO: 247109 - protein, 9 aa, Homo Sapiens
KYIKGVLMF

SEQ ID NO: 247110 - protein, 9 aa, Homo Sapiens
RDQRTTTKW

SEQ ID NO: 247111 - protein, 9 aa, Homo Sapiens
EAQNTMLES

SEQ ID NO: 247112 - protein, 9 aa, Homo Sapiens
QTCTKTPCL

SEQ ID NO: 247113 - protein, 9 aa, Homo Sapiens
SIKGIEHLS

SEQ ID NO: 247114 - protein, 9 aa, Homo Sapiens
VIFLSSQFG

SEQ ID NO: 247115 - protein, 9 aa, Homo Sapiens
NQSRLKVEL

SEQ ID NO: 247116 - protein, 9 aa, Homo Sapiens
FEPKASMKQ

SEQ ID NO: 247117 - protein, 9 aa, Homo Sapiens
FVALLKLSC

SEQ ID NO: 247118 - protein, 9 aa, Homo Sapiens
LLFNTTKSV

SEQ ID NO: 247119 - protein, 9 aa, Homo Sapiens
CRRIELTVL

SEQ ID NO: 247120 - protein, 9 aa, Homo Sapiens
KSQSFKTQN

SEQ ID NO: 247121 - protein, 9 aa, Homo Sapiens
EQVGSEGTS

SEQ ID NO: 247122 - protein, 9 aa, Homo Sapiens
PCVRLLPWP

SEQ ID NO: 247123 - protein, 9 aa, Homo Sapiens
EVVKQGCWL

SEQ ID NO: 247124 - protein, 9 aa, Homo Sapiens
NPAVTKLVD

SEQ ID NO: 247125 - protein, 9 aa, Homo Sapiens
QPKENETVV

SEQ ID NO: 247126 - protein, 9 aa, Homo Sapiens
TLIYVDKDN

SEQ ID NO: 247127 - protein, 9 aa, Homo Sapiens
ETEKKVLAE

SEQ ID NO: 247128 - protein, 9 aa, Homo Sapiens
TGEFDETRF

SEQ ID NO: 247129 - protein, 9 aa, Homo Sapiens
PLPRICNWV

SEQ ID NO: 247130 - protein, 9 aa, Homo Sapiens
KLFYSSVSE

SEQ ID NO: 247131 - protein, 9 aa, Homo Sapiens
VKMLLGQFS

SEQ ID NO: 247132 - protein, 9 aa, Homo Sapiens
KQNKRGRRT

SEQ ID NO: 247133 - protein, 9 aa, Homo Sapiens
QWEINIFLQ

SEQ ID NO: 247134 - protein, 9 aa, Homo Sapiens
NRRRVEETL

SEQ ID NO: 247135 - protein, 9 aa, Homo Sapiens
PGPRAHLPC

SEQ ID NO: 247136 - protein, 9 aa, Homo Sapiens
TQLIDVDEK

SEQ ID NO: 247137 - protein, 9 aa, Homo Sapiens
LFCGRFSIS

SEQ ID NO: 247138 - protein, 9 aa, Homo Sapiens
ILKKQEGAV

SEQ ID NO: 247139 - protein, 9 aa, Homo Sapiens
DKCGHDNLH

SEQ ID NO: 247140 - protein, 9 aa, Homo Sapiens
HIAHVGSDD

SEQ ID NO: 247141 - protein, 9 aa, Homo Sapiens
CQKDFLAMF

SEQ ID NO: 247142 - protein, 9 aa, Homo Sapiens
RAARNAVIH

SEQ ID NO: 247143 - protein, 9 aa, Homo Sapiens
RTDESEFFL

SEQ ID NO: 247144 - protein, 9 aa, Homo Sapiens
LLRCRRTGI

SEQ ID NO: 247145 - protein, 9 aa, Homo Sapiens
IKQNYSSKN

SEQ ID NO: 247146 - protein, 9 aa, Homo Sapiens
LIQFFKTLQ

SEQ ID NO: 247147 - protein, 9 aa, Homo Sapiens
SQEREHPAE

SEQ ID NO: 247148 - protein, 9 aa, Homo Sapiens
QQVKDPLYL

SEQ ID NO: 247149 - protein, 9 aa, Homo Sapiens
SSLLMIWAI

SEQ ID NO: 247150 - protein, 9 aa, Homo Sapiens
LDCLPLGQC

SEQ ID NO: 247151 - protein, 9 aa, Homo Sapiens
ELIKTIISQ

SEQ ID NO: 247152 - protein, 9 aa, Homo Sapiens
NEEGFVQLY

SEQ ID NO: 247153 - protein, 9 aa, Homo Sapiens
CSQEWHWMD

SEQ ID NO: 247154 - protein, 9 aa, Homo Sapiens
SREEVSSLI

SEQ ID NO: 247155 - protein, 9 aa, Homo Sapiens
EGKMYRLRT

SEQ ID NO: 247156 - protein, 9 aa, Homo Sapiens
TASSAWGTF

SEQ ID NO: 247157 - protein, 9 aa, Homo Sapiens
QRTLILESH

SEQ ID NO: 247158 - protein, 9 aa, Homo Sapiens
NLDTYDPYL

SEQ ID NO: 247159 - protein, 9 aa, Homo Sapiens
SNTSLVTAF

SEQ ID NO: 247160 - protein, 9 aa, Homo Sapiens
YVCESDSLN

SEQ ID NO: 247161 - protein, 9 aa, Homo Sapiens
PRRNVEDND

SEQ ID NO: 247162 - protein, 9 aa, Homo Sapiens
IAEIVEAKE

SEQ ID NO: 247163 - protein, 9 aa, Homo Sapiens
LLKLKLLVL

SEQ ID NO: 247164 - protein, 9 aa, Homo Sapiens
LSDLSTLSN

SEQ ID NO: 247165 - protein, 9 aa, Homo Sapiens
ISLDEQVEE

SEQ ID NO: 247166 - protein, 9 aa, Homo Sapiens
AVLHTLWVE

SEQ ID NO: 247167 - protein, 9 aa, Homo Sapiens
TTMHELEYL

SEQ ID NO: 247168 - protein, 9 aa, Homo Sapiens
SQRQRLTST

SEQ ID NO: 247169 - protein, 9 aa, Homo Sapiens
SLMYPALQP

SEQ ID NO: 247170 - protein, 9 aa, Homo Sapiens
SSAFGLDRS

SEQ ID NO: 247171 - protein, 9 aa, Homo Sapiens
IWSVTRRDS

SEQ ID NO: 247172 - protein, 9 aa, Homo Sapiens
DSAVGSVTE

SEQ ID NO: 247173 - protein, 9 aa, Homo Sapiens
YKCDECGNT

SEQ ID NO: 247174 - protein, 9 aa, Homo Sapiens
HALYSHILD

SEQ ID NO: 247175 - protein, 9 aa, Homo Sapiens
KHEGVRGLY

SEQ ID NO: 247176 - protein, 9 aa, Homo Sapiens
HSFPMRYMN

SEQ ID NO: 247177 - protein, 9 aa, Homo Sapiens
LHRITIKKR

SEQ ID NO: 247178 - protein, 9 aa, Homo Sapiens
GKYFTSHST

SEQ ID NO: 247179 - protein, 9 aa, Homo Sapiens
QTLLGDNEK

SEQ ID NO: 247180 - protein, 9 aa, Homo Sapiens
VLQRCQEYL

SEQ ID NO: 247181 - protein, 9 aa, Homo Sapiens
RFFFHLGVK

SEQ ID NO: 247182 - protein, 9 aa, Homo Sapiens
VNGTVFAIM

SEQ ID NO: 247183 - protein, 9 aa, Homo Sapiens
TPVEEVDAL

SEQ ID NO: 247184 - protein, 9 aa, Homo Sapiens
SAYCAAAVA

SEQ ID NO: 247185 - protein, 9 aa, Homo Sapiens
SLLKKMHQT

SEQ ID NO: 247186 - protein, 9 aa, Homo Sapiens
VDISLLRCQ

SEQ ID NO: 247187 - protein, 9 aa, Homo Sapiens
LQSRPYHIY

SEQ ID NO: 247188 - protein, 9 aa, Homo Sapiens
WMLELSAFL

SEQ ID NO: 247189 - protein, 9 aa, Homo Sapiens
ITDLLLGLM

SEQ ID NO: 247190 - protein, 9 aa, Homo Sapiens
RLDTFNRQG

SEQ ID NO: 247191 - protein, 9 aa, Homo Sapiens
TTSQLPSPP

SEQ ID NO: 247192 - protein, 9 aa, Homo Sapiens
SPQNGTITC

SEQ ID NO: 247193 - protein, 9 aa, Homo Sapiens
LPAPSKARK

SEQ ID NO: 247194 - protein, 9 aa, Homo Sapiens
YSGHYIARV

SEQ ID NO: 247195 - protein, 9 aa, Homo Sapiens
LKQPSVFVK

SEQ ID NO: 247196 - protein, 9 aa, Homo Sapiens
LVEDKVLCR

SEQ ID NO: 247197 - protein, 9 aa, Homo Sapiens
LHQIHHLLF

SEQ ID NO: 247198 - protein, 9 aa, Homo Sapiens
LEEEVNTLD

SEQ ID NO: 247199 - protein, 9 aa, Homo Sapiens
LSEFDYWDY

SEQ ID NO: 247200 - protein, 9 aa, Homo Sapiens
VAVILLAFQ

SEQ ID NO: 247201 - protein, 9 aa, Homo Sapiens
NKGVLMKLI

SEQ ID NO: 247202 - protein, 9 aa, Homo Sapiens
YRFVCDKHY

SEQ ID NO: 247203 - protein, 9 aa, Homo Sapiens
LTDPPLNHK

SEQ ID NO: 247204 - protein, 9 aa, Homo Sapiens
SCVKGWGAE

SEQ ID NO: 247205 - protein, 9 aa, Homo Sapiens
PPGLRGDPD

SEQ ID NO: 247206 - protein, 9 aa, Homo Sapiens
TITDTMKFF

SEQ ID NO: 247207 - protein, 9 aa, Homo Sapiens
TGAGPGALS

SEQ ID NO: 247208 - protein, 9 aa, Homo Sapiens
SLGFFCCKQ

SEQ ID NO: 247209 - protein, 9 aa, Homo Sapiens
VSLSAPGTP

SEQ ID NO: 247210 - protein, 9 aa, Homo Sapiens
SPGSLAVSD

SEQ ID NO: 247211 - protein, 9 aa, Homo Sapiens
DLTATHLKW

SEQ ID NO: 247212 - protein, 9 aa, Homo Sapiens
IGERIQVIL

SEQ ID NO: 247213 - protein, 9 aa, Homo Sapiens
IEMFQNMQN

SEQ ID NO: 247214 - protein, 9 aa, Homo Sapiens
RPWFYNILA

SEQ ID NO: 247215 - protein, 9 aa, Homo Sapiens
FSIKTSFHV

SEQ ID NO: 247216 - protein, 9 aa, Homo Sapiens
SGPQHTELA

SEQ ID NO: 247217 - protein, 9 aa, Homo Sapiens
SAAEFREVI

SEQ ID NO: 247218 - protein, 9 aa, Homo Sapiens
QTERVISGK

SEQ ID NO: 247219 - protein, 9 aa, Homo Sapiens
AVEPNTESY

SEQ ID NO: 247220 - protein, 9 aa, Homo Sapiens
AAERVEAFL

SEQ ID NO: 247221 - protein, 9 aa, Homo Sapiens
YNNLIIKYI

SEQ ID NO: 247222 - protein, 9 aa, Homo Sapiens
HNELEKHRQ

SEQ ID NO: 247223 - protein, 9 aa, Homo Sapiens
KDLLCRTIK

SEQ ID NO: 247224 - protein, 9 aa, Homo Sapiens
YPVKTPIKV

SEQ ID NO: 247225 - protein, 9 aa, Homo Sapiens
KSRKELRKD

SEQ ID NO: 247226 - protein, 9 aa, Homo Sapiens
TTHFSKEKD

SEQ ID NO: 247227 - protein, 9 aa, Homo Sapiens
HSRLAALQV

SEQ ID NO: 247228 - protein, 9 aa, Homo Sapiens
RYLQAGKLF

SEQ ID NO: 247229 - protein, 9 aa, Homo Sapiens
EKKDNAAAL

SEQ ID NO: 247230 - protein, 9 aa, Homo Sapiens
IGYILEKSS

SEQ ID NO: 247231 - protein, 9 aa, Homo Sapiens
TRDGVIQYS

SEQ ID NO: 247232 - protein, 9 aa, Homo Sapiens
VNCFRQLFV

SEQ ID NO: 247233 - protein, 9 aa, Homo Sapiens
EVKHSRHRR

SEQ ID NO: 247234 - protein, 9 aa, Homo Sapiens
LQATRVQPE

SEQ ID NO: 247235 - protein, 9 aa, Homo Sapiens
PYLHRHLPH

SEQ ID NO: 247236 - protein, 9 aa, Homo Sapiens
AIQMLQQIA

SEQ ID NO: 247237 - protein, 9 aa, Homo Sapiens
PPLEADTET

SEQ ID NO: 247238 - protein, 9 aa, Homo Sapiens
RCPVYLREA

SEQ ID NO: 247239 - protein, 9 aa, Homo Sapiens
TKKLWHQLA

SEQ ID NO: 247240 - protein, 9 aa, Homo Sapiens
VCSNNVERK

SEQ ID NO: 247241 - protein, 9 aa, Homo Sapiens
AACIVCPYA

SEQ ID NO: 247242 - protein, 9 aa, Homo Sapiens
CSLTELYAC

SEQ ID NO: 247243 - protein, 9 aa, Homo Sapiens
SMRSTVVYR

SEQ ID NO: 247244 - protein, 9 aa, Homo Sapiens
VDRPLRSVF

SEQ ID NO: 247245 - protein, 9 aa, Homo Sapiens
FRFAYYTLL

SEQ ID NO: 247246 - protein, 9 aa, Homo Sapiens
PGRVMLFEK

SEQ ID NO: 247247 - protein, 9 aa, Homo Sapiens
RKKYKQEDS

SEQ ID NO: 247248 - protein, 9 aa, Homo Sapiens
LTENKYSPC

SEQ ID NO: 247249 - protein, 9 aa, Homo Sapiens
LIVYIVAFL

SEQ ID NO: 247250 - protein, 9 aa, Homo Sapiens
NRIFIHGWP

SEQ ID NO: 247251 - protein, 9 aa, Homo Sapiens
NELSLHQAF

SEQ ID NO: 247252 - protein, 9 aa, Homo Sapiens
IFYRGMLDH

SEQ ID NO: 247253 - protein, 9 aa, Homo Sapiens
HLSDLNIGS

SEQ ID NO: 247254 - protein, 9 aa, Homo Sapiens
PDQKDLLGY

SEQ ID NO: 247255 - protein, 9 aa, Homo Sapiens
AEDVHHQIL

SEQ ID NO: 247256 - protein, 9 aa, Homo Sapiens
PKPPASFKS

SEQ ID NO: 247257 - protein, 9 aa, Homo Sapiens
VSCNINITK

SEQ ID NO: 247258 - protein, 9 aa, Homo Sapiens
QEEVEDAVE

SEQ ID NO: 247259 - protein, 9 aa, Homo Sapiens
YDLSTNTQE

SEQ ID NO: 247260 - protein, 9 aa, Homo Sapiens
NQATDFQFG

SEQ ID NO: 247261 - protein, 9 aa, Homo Sapiens
ACQDPRFDA

SEQ ID NO: 247262 - protein, 9 aa, Homo Sapiens
NLNHKLEEF

SEQ ID NO: 247263 - protein, 9 aa, Homo Sapiens
LSIGANCDQ

SEQ ID NO: 247264 - protein, 9 aa, Homo Sapiens
HSYGRDQTG

SEQ ID NO: 247265 - protein, 9 aa, Homo Sapiens
GEKLFKRDV

SEQ ID NO: 247266 - protein, 9 aa, Homo Sapiens
DILLELGQC

SEQ ID NO: 247267 - protein, 9 aa, Homo Sapiens
HGGKSQNYL

SEQ ID NO: 247268 - protein, 9 aa, Homo Sapiens
EKAFSQYSS

SEQ ID NO: 247269 - protein, 9 aa, Homo Sapiens
FSGEVYWEA

SEQ ID NO: 247270 - protein, 9 aa, Homo Sapiens
TKTELKKLE

SEQ ID NO: 247271 - protein, 9 aa, Homo Sapiens
KANSGYKWC

SEQ ID NO: 247272 - protein, 9 aa, Homo Sapiens
SQKVDELVA

SEQ ID NO: 247273 - protein, 9 aa, Homo Sapiens
SCDACLNGN

SEQ ID NO: 247274 - protein, 9 aa, Homo Sapiens
QSSKKRFIF

SEQ ID NO: 247275 - protein, 9 aa, Homo Sapiens
ASHFSLGFV

SEQ ID NO: 247276 - protein, 9 aa, Homo Sapiens
FILVFCVAS

SEQ ID NO: 247277 - protein, 9 aa, Homo Sapiens
KTLLFVVLF

SEQ ID NO: 247278 - protein, 9 aa, Homo Sapiens
LDNFIPGHL

SEQ ID NO: 247279 - protein, 9 aa, Homo Sapiens
DTSRQIVFE

SEQ ID NO: 247280 - protein, 9 aa, Homo Sapiens
TLPVIICVT

SEQ ID NO: 247281 - protein, 9 aa, Homo Sapiens
PNQIDHFVC

SEQ ID NO: 247282 - protein, 9 aa, Homo Sapiens
SYRFVCDKH

SEQ ID NO: 247283 - protein, 9 aa, Homo Sapiens
TKGANGTFH

SEQ ID NO: 247284 - protein, 9 aa, Homo Sapiens
FTPFFLWMA

SEQ ID NO: 247285 - protein, 9 aa, Homo Sapiens
DELLVKIYG

SEQ ID NO: 247286 - protein, 9 aa, Homo Sapiens
KYFREKSVF

SEQ ID NO: 247287 - protein, 9 aa, Homo Sapiens
AKAYLGEEC

SEQ ID NO: 247288 - protein, 9 aa, Homo Sapiens
EDPPWSRNL

SEQ ID NO: 247289 - protein, 9 aa, Homo Sapiens
PTAEEILSW

SEQ ID NO: 247290 - protein, 9 aa, Homo Sapiens
KKYPQMNDF

SEQ ID NO: 247291 - protein, 9 aa, Homo Sapiens
ELDVSRNEL

SEQ ID NO: 247292 - protein, 9 aa, Homo Sapiens
IFERLRLKE

SEQ ID NO: 247293 - protein, 9 aa, Homo Sapiens
KFKEQQPST

SEQ ID NO: 247294 - protein, 9 aa, Homo Sapiens
DAKPKKKTE

SEQ ID NO: 247295 - protein, 9 aa, Homo Sapiens
PTEVLEAGE

SEQ ID NO: 247296 - protein, 9 aa, Homo Sapiens
LSAPTIPDK

SEQ ID NO: 247297 - protein, 9 aa, Homo Sapiens
KDVLAGRPL

SEQ ID NO: 247298 - protein, 9 aa, Homo Sapiens
SHLRYFLER

SEQ ID NO: 247299 - protein, 9 aa, Homo Sapiens
GEGDEYEYE

SEQ ID NO: 247300 - protein, 9 aa, Homo Sapiens
FCKTTIVPV

SEQ ID NO: 247301 - protein, 9 aa, Homo Sapiens
FRQFQQIMF

SEQ ID NO: 247302 - protein, 9 aa, Homo Sapiens
NTFQTFPQA

SEQ ID NO: 247303 - protein, 9 aa, Homo Sapiens
HLYLANNHI

SEQ ID NO: 247304 - protein, 9 aa, Homo Sapiens
YSRKDLQIN

SEQ ID NO: 247305 - protein, 9 aa, Homo Sapiens
ESRKVKKSK

SEQ ID NO: 247306 - protein, 9 aa, Homo Sapiens
CQEELLVAV

SEQ ID NO: 247307 - protein, 9 aa, Homo Sapiens
MHLARGTIQ

SEQ ID NO: 247308 - protein, 9 aa, Homo Sapiens
RLPIHMFRT

SEQ ID NO: 247309 - protein, 9 aa, Homo Sapiens
KTPHNWSRE

SEQ ID NO: 247310 - protein, 9 aa, Homo Sapiens
VYYVPCILI

SEQ ID NO: 247311 - protein, 9 aa, Homo Sapiens
CLHGSFLAV

SEQ ID NO: 247312 - protein, 9 aa, Homo Sapiens
KMRQHQREV

SEQ ID NO: 247313 - protein, 9 aa, Homo Sapiens
NIMQTLKKD

SEQ ID NO: 247314 - protein, 9 aa, Homo Sapiens
ILEIVLFAH

SEQ ID NO: 247315 - protein, 9 aa, Homo Sapiens
DFLSLTRNT

SEQ ID NO: 247316 - protein, 9 aa, Homo Sapiens
SGSGEGEDE

SEQ ID NO: 247317 - protein, 9 aa, Homo Sapiens
GIQKVMEQT

SEQ ID NO: 247318 - protein, 9 aa, Homo Sapiens
PSEERVYVV

SEQ ID NO: 247319 - protein, 9 aa, Homo Sapiens
SEKINFLLG

SEQ ID NO: 247320 - protein, 9 aa, Homo Sapiens
HVNHVRDTL

SEQ ID NO: 247321 - protein, 9 aa, Homo Sapiens
QPRKKATYK

SEQ ID NO: 247322 - protein, 9 aa, Homo Sapiens
TERQSFIRQ

SEQ ID NO: 247323 - protein, 9 aa, Homo Sapiens
GSPLHMPYS

SEQ ID NO: 247324 - protein, 9 aa, Homo Sapiens
SEHCFVAEN

SEQ ID NO: 247325 - protein, 9 aa, Homo Sapiens
PPDVIAKHR

SEQ ID NO: 247326 - protein, 9 aa, Homo Sapiens
NNYQVFPMN

SEQ ID NO: 247327 - protein, 9 aa, Homo Sapiens
LKESSHLHL

SEQ ID NO: 247328 - protein, 9 aa, Homo Sapiens
DKHKHEKIK

SEQ ID NO: 247329 - protein, 9 aa, Homo Sapiens
GRLTSHAIF

SEQ ID NO: 247330 - protein, 9 aa, Homo Sapiens
LDIQVDNLI

SEQ ID NO: 247331 - protein, 9 aa, Homo Sapiens
RHRDNNKPI

SEQ ID NO: 247332 - protein, 9 aa, Homo Sapiens
LAPGQFILI

SEQ ID NO: 247333 - protein, 9 aa, Homo Sapiens
DNLCSYIFT

SEQ ID NO: 247334 - protein, 9 aa, Homo Sapiens
TPGEYSVHI

SEQ ID NO: 247335 - protein, 9 aa, Homo Sapiens
YCSPRRKSA

SEQ ID NO: 247336 - protein, 9 aa, Homo Sapiens
DFLSKCSKF

SEQ ID NO: 247337 - protein, 9 aa, Homo Sapiens
DQEFDPVVV

SEQ ID NO: 247338 - protein, 9 aa, Homo Sapiens
EKQLSELKE

SEQ ID NO: 247339 - protein, 9 aa, Homo Sapiens
KSKVKEKKR

SEQ ID NO: 247340 - protein, 9 aa, Homo Sapiens
INDNVPRLL

SEQ ID NO: 247341 - protein, 9 aa, Homo Sapiens
GCKELENTL

SEQ ID NO: 247342 - protein, 9 aa, Homo Sapiens
PTPKRWRVD

SEQ ID NO: 247343 - protein, 9 aa, Homo Sapiens
EMSPGFRLA

SEQ ID NO: 247344 - protein, 9 aa, Homo Sapiens
SIGYLCTDK

SEQ ID NO: 247345 - protein, 9 aa, Homo Sapiens
LSERYNGSV

SEQ ID NO: 247346 - protein, 9 aa, Homo Sapiens
KPRSAMRGC

SEQ ID NO: 247347 - protein, 9 aa, Homo Sapiens
LVRYQKCIK

SEQ ID NO: 247348 - protein, 9 aa, Homo Sapiens
LRPNDSHML

SEQ ID NO: 247349 - protein, 9 aa, Homo Sapiens
ASSSEFYKA

SEQ ID NO: 247350 - protein, 9 aa, Homo Sapiens
KMHFKVNRD

SEQ ID NO: 247351 - protein, 9 aa, Homo Sapiens
NVSSSTLQS

SEQ ID NO: 247352 - protein, 9 aa, Homo Sapiens
SVLLYSDCG

SEQ ID NO: 247353 - protein, 9 aa, Homo Sapiens
DEDFLSLTR

SEQ ID NO: 247354 - protein, 9 aa, Homo Sapiens
ILGMTPGFI

SEQ ID NO: 247355 - protein, 9 aa, Homo Sapiens
NPKVFPGNV

SEQ ID NO: 247356 - protein, 9 aa, Homo Sapiens
RRTGAGSNG

SEQ ID NO: 247357 - protein, 9 aa, Homo Sapiens
ADGNGYIDK

SEQ ID NO: 247358 - protein, 9 aa, Homo Sapiens
TVGQLMEPC

SEQ ID NO: 247359 - protein, 9 aa, Homo Sapiens
PRDLINTYL

SEQ ID NO: 247360 - protein, 9 aa, Homo Sapiens
YSTPNLQQE

SEQ ID NO: 247361 - protein, 9 aa, Homo Sapiens
NTFLHEPFA

SEQ ID NO: 247362 - protein, 9 aa, Homo Sapiens
FNLFSTNNS

SEQ ID NO: 247363 - protein, 9 aa, Homo Sapiens
CVYQRGRKK

SEQ ID NO: 247364 - protein, 9 aa, Homo Sapiens
WERGRDTHV

SEQ ID NO: 247365 - protein, 9 aa, Homo Sapiens
VLYHTKIRW

SEQ ID NO: 247366 - protein, 9 aa, Homo Sapiens
QYLLVIKNH

SEQ ID NO: 247367 - protein, 9 aa, Homo Sapiens
CSRKPGMCA

SEQ ID NO: 247368 - protein, 9 aa, Homo Sapiens
LRYNSGIIN

SEQ ID NO: 247369 - protein, 9 aa, Homo Sapiens
ETLCPQVIN

SEQ ID NO: 247370 - protein, 9 aa, Homo Sapiens
KAVLKTLQE

SEQ ID NO: 247371 - protein, 9 aa, Homo Sapiens
PIDKTAGKI

SEQ ID NO: 247372 - protein, 9 aa, Homo Sapiens
ELENREVLE

SEQ ID NO: 247373 - protein, 9 aa, Homo Sapiens
YEEDENIIG

SEQ ID NO: 247374 - protein, 9 aa, Homo Sapiens
LATYQTAIV

SEQ ID NO: 247375 - protein, 9 aa, Homo Sapiens
KIPPEEIKQ

SEQ ID NO: 247376 - protein, 9 aa, Homo Sapiens
SSAMVGGDV

SEQ ID NO: 247377 - protein, 9 aa, Homo Sapiens
INHQIIHSR

SEQ ID NO: 247378 - protein, 9 aa, Homo Sapiens
GSEDIDHLN

SEQ ID NO: 247379 - protein, 9 aa, Homo Sapiens
STRLILDPV

SEQ ID NO: 247380 - protein, 9 aa, Homo Sapiens
DNLKDVQNN

SEQ ID NO: 247381 - protein, 9 aa, Homo Sapiens
KSLLVVHQQ

SEQ ID NO: 247382 - protein, 9 aa, Homo Sapiens
QSQKFGVGD

SEQ ID NO: 247383 - protein, 9 aa, Homo Sapiens
HLADEGMLQ

SEQ ID NO: 247384 - protein, 9 aa, Homo Sapiens
DRGYDCGYD

SEQ ID NO: 247385 - protein, 9 aa, Homo Sapiens
RHKKIHTRE

SEQ ID NO: 247386 - protein, 9 aa, Homo Sapiens
SESRSKREQ

SEQ ID NO: 247387 - protein, 9 aa, Homo Sapiens
RPCRCNKCG

SEQ ID NO: 247388 - protein, 9 aa, Homo Sapiens
HSIIIANVE

SEQ ID NO: 247389 - protein, 9 aa, Homo Sapiens
SVIIKCDGF

SEQ ID NO: 247390 - protein, 9 aa, Homo Sapiens
VANGGLTCT

SEQ ID NO: 247391 - protein, 9 aa, Homo Sapiens
YDLVRSAET

SEQ ID NO: 247392 - protein, 9 aa, Homo Sapiens
GELCQGINS

SEQ ID NO: 247393 - protein, 9 aa, Homo Sapiens
QMFFIHGFT

SEQ ID NO: 247394 - protein, 9 aa, Homo Sapiens
SSEGEGQIL

SEQ ID NO: 247395 - protein, 9 aa, Homo Sapiens
YNFRAKVCG

SEQ ID NO: 247396 - protein, 9 aa, Homo Sapiens
RVQPELYHS

SEQ ID NO: 247397 - protein, 9 aa, Homo Sapiens
SMINSHLPS

SEQ ID NO: 247398 - protein, 9 aa, Homo Sapiens
KCQARFLQG

SEQ ID NO: 247399 - protein, 9 aa, Homo Sapiens
AIPGLIPYL

SEQ ID NO: 247400 - protein, 9 aa, Homo Sapiens
CHRRVLAAC

SEQ ID NO: 247401 - protein, 9 aa, Homo Sapiens
QSCKLDKTQ

SEQ ID NO: 247402 - protein, 9 aa, Homo Sapiens
LFEASAKEN

SEQ ID NO: 247403 - protein, 9 aa, Homo Sapiens
APGQDLVSL

SEQ ID NO: 247404 - protein, 9 aa, Homo Sapiens
WSQPAFYDL

SEQ ID NO: 247405 - protein, 9 aa, Homo Sapiens
QHTCLTLNY

SEQ ID NO: 247406 - protein, 9 aa, Homo Sapiens
VPPPLVDNS

SEQ ID NO: 247407 - protein, 9 aa, Homo Sapiens
FCHSSLSEM

SEQ ID NO: 247408 - protein, 9 aa, Homo Sapiens
CEYNFVFPS

SEQ ID NO: 247409 - protein, 9 aa, Homo Sapiens
LIMNNTGEW

SEQ ID NO: 247410 - protein, 9 aa, Homo Sapiens
DPVQLSEDI

SEQ ID NO: 247411 - protein, 9 aa, Homo Sapiens
AQSQYVCRL

SEQ ID NO: 247412 - protein, 9 aa, Homo Sapiens
LCDNCLLCL

SEQ ID NO: 247413 - protein, 9 aa, Homo Sapiens
HPAGPRTVL

SEQ ID NO: 247414 - protein, 9 aa, Homo Sapiens
IRPDTCNPC

SEQ ID NO: 247415 - protein, 9 aa, Homo Sapiens
FLNNYPGSC

SEQ ID NO: 247416 - protein, 9 aa, Homo Sapiens
VEMLSSQES

SEQ ID NO: 247417 - protein, 9 aa, Homo Sapiens
SVSEKISSA

SEQ ID NO: 247418 - protein, 9 aa, Homo Sapiens
EKLNSVGNY

SEQ ID NO: 247419 - protein, 9 aa, Homo Sapiens
HPEITYQLR

SEQ ID NO: 247420 - protein, 9 aa, Homo Sapiens
GADTTPYLA

SEQ ID NO: 247421 - protein, 9 aa, Homo Sapiens
NVSVRGITN

SEQ ID NO: 247422 - protein, 9 aa, Homo Sapiens
QSSTVESEI

SEQ ID NO: 247423 - protein, 9 aa, Homo Sapiens
MGNPMAKHL

SEQ ID NO: 247424 - protein, 9 aa, Homo Sapiens
DKHFPFWLW

SEQ ID NO: 247425 - protein, 9 aa, Homo Sapiens
DVIGLSIQR

SEQ ID NO: 247426 - protein, 9 aa, Homo Sapiens
PELLTYKEV

SEQ ID NO: 247427 - protein, 9 aa, Homo Sapiens
NPIQLTGDL

SEQ ID NO: 247428 - protein, 9 aa, Homo Sapiens
KDLWDILNE

SEQ ID NO: 247429 - protein, 9 aa, Homo Sapiens
EMQFVLPCW

SEQ ID NO: 247430 - protein, 9 aa, Homo Sapiens
FKDQQKINK

SEQ ID NO: 247431 - protein, 9 aa, Homo Sapiens
APFIDKVRF

SEQ ID NO: 247432 - protein, 9 aa, Homo Sapiens
ESLKEIKSI

SEQ ID NO: 247433 - protein, 9 aa, Homo Sapiens
FIFICKRPY

SEQ ID NO: 247434 - protein, 9 aa, Homo Sapiens
EQQEEDGLE

SEQ ID NO: 247435 - protein, 9 aa, Homo Sapiens
SDSLNDFVT

SEQ ID NO: 247436 - protein, 9 aa, Homo Sapiens
YDEYFNCDI

SEQ ID NO: 247437 - protein, 9 aa, Homo Sapiens
EQDKMLSLF

SEQ ID NO: 247438 - protein, 9 aa, Homo Sapiens
LPFMMVPHP

SEQ ID NO: 247439 - protein, 9 aa, Homo Sapiens
YYQFTLPRY

SEQ ID NO: 247440 - protein, 9 aa, Homo Sapiens
MLVDWMYPT

SEQ ID NO: 247441 - protein, 9 aa, Homo Sapiens
HAYRVFKTV

SEQ ID NO: 247442 - protein, 9 aa, Homo Sapiens
KGSVHHNYR

SEQ ID NO: 247443 - protein, 9 aa, Homo Sapiens
AFISVDHLG

SEQ ID NO: 247444 - protein, 9 aa, Homo Sapiens
EKHRQAKLR

SEQ ID NO: 247445 - protein, 9 aa, Homo Sapiens
VVESLQKQL

SEQ ID NO: 247446 - protein, 9 aa, Homo Sapiens
ANEDKSAAT

SEQ ID NO: 247447 - protein, 9 aa, Homo Sapiens
VNTAGISLP

SEQ ID NO: 247448 - protein, 9 aa, Homo Sapiens
RLHSAINSQ

SEQ ID NO: 247449 - protein, 9 aa, Homo Sapiens
QEYKEKGRK

SEQ ID NO: 247450 - protein, 9 aa, Homo Sapiens
LDELMAHLG

SEQ ID NO: 247451 - protein, 9 aa, Homo Sapiens
FPFPTRIAS

SEQ ID NO: 247452 - protein, 9 aa, Homo Sapiens
ADIFDCLGP

SEQ ID NO: 247453 - protein, 9 aa, Homo Sapiens
LREKSQRLE

SEQ ID NO: 247454 - protein, 9 aa, Homo Sapiens
LENLDKLMY

SEQ ID NO: 247455 - protein, 9 aa, Homo Sapiens
QSHKDVDKK

SEQ ID NO: 247456 - protein, 9 aa, Homo Sapiens
FIKSPGYPG

SEQ ID NO: 247457 - protein, 9 aa, Homo Sapiens
KYQPEKWDE

SEQ ID NO: 247458 - protein, 9 aa, Homo Sapiens
VDMNELYHC

SEQ ID NO: 247459 - protein, 9 aa, Homo Sapiens
KLLENSGWI

SEQ ID NO: 247460 - protein, 9 aa, Homo Sapiens
EREIPPRRR

SEQ ID NO: 247461 - protein, 9 aa, Homo Sapiens
NQDHDKLFE

SEQ ID NO: 247462 - protein, 9 aa, Homo Sapiens
DLVMCPYER

SEQ ID NO: 247463 - protein, 9 aa, Homo Sapiens
DEYAPMITG

SEQ ID NO: 247464 - protein, 9 aa, Homo Sapiens
IMHTSYFLF

SEQ ID NO: 247465 - protein, 9 aa, Homo Sapiens
THTSFYKEY

SEQ ID NO: 247466 - protein, 9 aa, Homo Sapiens
VRYIVYCTG

SEQ ID NO: 247467 - protein, 9 aa, Homo Sapiens
NKNVKCTAQ

SEQ ID NO: 247468 - protein, 9 aa, Homo Sapiens
FLQATNKNS

SEQ ID NO: 247469 - protein, 9 aa, Homo Sapiens
YIYATDQEG

SEQ ID NO: 247470 - protein, 9 aa, Homo Sapiens
VRFGLSITQ

SEQ ID NO: 247471 - protein, 9 aa, Homo Sapiens
EVAARYPHI

SEQ ID NO: 247472 - protein, 9 aa, Homo Sapiens
SCISMYVKP

SEQ ID NO: 247473 - protein, 9 aa, Homo Sapiens
DYETFKNFF

SEQ ID NO: 247474 - protein, 9 aa, Homo Sapiens
SSSSAAFAG

SEQ ID NO: 247475 - protein, 9 aa, Homo Sapiens
STTSEYSDH

SEQ ID NO: 247476 - protein, 9 aa, Homo Sapiens
EKESLIGNK

SEQ ID NO: 247477 - protein, 9 aa, Homo Sapiens
VNTFPVEMT

SEQ ID NO: 247478 - protein, 9 aa, Homo Sapiens
IHVSSKEPG

SEQ ID NO: 247479 - protein, 9 aa, Homo Sapiens
VEFPQKGLS

SEQ ID NO: 247480 - protein, 9 aa, Homo Sapiens
MHLYFAQVV

SEQ ID NO: 247481 - protein, 9 aa, Homo Sapiens
ECGNYLFRQ

SEQ ID NO: 247482 - protein, 9 aa, Homo Sapiens
PLTPELEAR

SEQ ID NO: 247483 - protein, 9 aa, Homo Sapiens
PATKRLFDL

SEQ ID NO: 247484 - protein, 9 aa, Homo Sapiens
GQHFRSIPQ

SEQ ID NO: 247485 - protein, 9 aa, Homo Sapiens
KKWPMQSRL

SEQ ID NO: 247486 - protein, 9 aa, Homo Sapiens
MNVTGQLGA

SEQ ID NO: 247487 - protein, 9 aa, Homo Sapiens
IAMNCIIAK

SEQ ID NO: 247488 - protein, 9 aa, Homo Sapiens
PDDGDDFVW

SEQ ID NO: 247489 - protein, 9 aa, Homo Sapiens
RRCIGKELS

SEQ ID NO: 247490 - protein, 9 aa, Homo Sapiens
KMRKFFSFT

SEQ ID NO: 247491 - protein, 9 aa, Homo Sapiens
PEGMGVIPR

SEQ ID NO: 247492 - protein, 9 aa, Homo Sapiens
TEELLSQMA

SEQ ID NO: 247493 - protein, 9 aa, Homo Sapiens
WNPPQRSFN

SEQ ID NO: 247494 - protein, 9 aa, Homo Sapiens
TGTFLVKIA

SEQ ID NO: 247495 - protein, 9 aa, Homo Sapiens
PAIQMLQQI

SEQ ID NO: 247496 - protein, 9 aa, Homo Sapiens
LHEVEVDVA

SEQ ID NO: 247497 - protein, 9 aa, Homo Sapiens
KLNIAQNEQ

SEQ ID NO: 247498 - protein, 9 aa, Homo Sapiens
SKVEEDELL

SEQ ID NO: 247499 - protein, 9 aa, Homo Sapiens
GKRNANLRF

SEQ ID NO: 247500 - protein, 9 aa, Homo Sapiens
EEKELRKCR

SEQ ID NO: 247501 - protein, 9 aa, Homo Sapiens
WKGELYRQN

SEQ ID NO: 247502 - protein, 9 aa, Homo Sapiens
ALRHLDVLF

SEQ ID NO: 247503 - protein, 9 aa, Homo Sapiens
QNNLYRYVM

SEQ ID NO: 247504 - protein, 9 aa, Homo Sapiens
PEKLTALKE

SEQ ID NO: 247505 - protein, 9 aa, Homo Sapiens
VTYMEASTK

SEQ ID NO: 247506 - protein, 9 aa, Homo Sapiens
ILDAVRLQR

SEQ ID NO: 247507 - protein, 9 aa, Homo Sapiens
LRRNSRVTG

SEQ ID NO: 247508 - protein, 9 aa, Homo Sapiens
LDKKKKEPA

SEQ ID NO: 247509 - protein, 9 aa, Homo Sapiens
FTQLITLPK

SEQ ID NO: 247510 - protein, 9 aa, Homo Sapiens
SINNEKLEW

SEQ ID NO: 247511 - protein, 9 aa, Homo Sapiens
VPGRHDTAF

SEQ ID NO: 247512 - protein, 9 aa, Homo Sapiens
NLTDKHEAV

SEQ ID NO: 247513 - protein, 9 aa, Homo Sapiens
TSQLGRCSV

SEQ ID NO: 247514 - protein, 9 aa, Homo Sapiens
KYQNQHTMN

SEQ ID NO: 247515 - protein, 9 aa, Homo Sapiens
TETLILSEN

SEQ ID NO: 247516 - protein, 9 aa, Homo Sapiens
HKIVKEIHG

SEQ ID NO: 247517 - protein, 9 aa, Homo Sapiens
TVLYCTFGD

SEQ ID NO: 247518 - protein, 9 aa, Homo Sapiens
PEKKDKGYP

SEQ ID NO: 247519 - protein, 9 aa, Homo Sapiens
SRSNLPLPV

SEQ ID NO: 247520 - protein, 9 aa, Homo Sapiens
EDIFQHLQN

SEQ ID NO: 247521 - protein, 9 aa, Homo Sapiens
FGSKEDATV

SEQ ID NO: 247522 - protein, 9 aa, Homo Sapiens
VNVWSMVNL

SEQ ID NO: 247523 - protein, 9 aa, Homo Sapiens
PLRYKATMN

SEQ ID NO: 247524 - protein, 9 aa, Homo Sapiens
ECEELLSVN

SEQ ID NO: 247525 - protein, 9 aa, Homo Sapiens
PVGTLDADT

SEQ ID NO: 247526 - protein, 9 aa, Homo Sapiens
QTCRLRLSY

SEQ ID NO: 247527 - protein, 9 aa, Homo Sapiens
RWTKSQTTI

SEQ ID NO: 247528 - protein, 9 aa, Homo Sapiens
KPENYDGGN

SEQ ID NO: 247529 - protein, 9 aa, Homo Sapiens
DIPENIYGG

SEQ ID NO: 247530 - protein, 9 aa, Homo Sapiens
YLPKTPIFR

SEQ ID NO: 247531 - protein, 9 aa, Homo Sapiens
VFAVKNENQ

SEQ ID NO: 247532 - protein, 9 aa, Homo Sapiens
KGEAGGLMV

SEQ ID NO: 247533 - protein, 9 aa, Homo Sapiens
INTLFPTKQ

SEQ ID NO: 247534 - protein, 9 aa, Homo Sapiens
GPYPATTSF

SEQ ID NO: 247535 - protein, 9 aa, Homo Sapiens
NLMNSLEQN

SEQ ID NO: 247536 - protein, 9 aa, Homo Sapiens
KRLPCNHVF

SEQ ID NO: 247537 - protein, 9 aa, Homo Sapiens
QKGLSPFRK

SEQ ID NO: 247538 - protein, 9 aa, Homo Sapiens
DQEGRVFQD

SEQ ID NO: 247539 - protein, 9 aa, Homo Sapiens
SPGPYPTPP

SEQ ID NO: 247540 - protein, 9 aa, Homo Sapiens
QGDLTKENK

SEQ ID NO: 247541 - protein, 9 aa, Homo Sapiens
ENGGYKTIY

SEQ ID NO: 247542 - protein, 9 aa, Homo Sapiens
ADATLKINY

SEQ ID NO: 247543 - protein, 9 aa, Homo Sapiens
FSKNERFNC

SEQ ID NO: 247544 - protein, 9 aa, Homo Sapiens
FMYFRPCSS

SEQ ID NO: 247545 - protein, 9 aa, Homo Sapiens
VARCVRFIP

SEQ ID NO: 247546 - protein, 9 aa, Homo Sapiens
IQFFKTLQD

SEQ ID NO: 247547 - protein, 9 aa, Homo Sapiens
PEKISNKSY

SEQ ID NO: 247548 - protein, 9 aa, Homo Sapiens
TEGLDWEYK

SEQ ID NO: 247549 - protein, 9 aa, Homo Sapiens
ARVKDPQSG

SEQ ID NO: 247550 - protein, 9 aa, Homo Sapiens
EEIRQKITC

SEQ ID NO: 247551 - protein, 9 aa, Homo Sapiens
KKLYSAEND

SEQ ID NO: 247552 - protein, 9 aa, Homo Sapiens
SLEIKKEKN

SEQ ID NO: 247553 - protein, 9 aa, Homo Sapiens
NGLEKTGKA

SEQ ID NO: 247554 - protein, 9 aa, Homo Sapiens
ALSGACMGQ

SEQ ID NO: 247555 - protein, 9 aa, Homo Sapiens
DWKRMEVGQ

SEQ ID NO: 247556 - protein, 9 aa, Homo Sapiens
LKYLFRDFD

SEQ ID NO: 247557 - protein, 9 aa, Homo Sapiens
QNEQDAYAI

SEQ ID NO: 247558 - protein, 9 aa, Homo Sapiens
PHSKKKNFE

SEQ ID NO: 247559 - protein, 9 aa, Homo Sapiens
SHLLSYIKD

SEQ ID NO: 247560 - protein, 9 aa, Homo Sapiens
VIFAFTLPF

SEQ ID NO: 247561 - protein, 9 aa, Homo Sapiens
GTKMAKHIQ

SEQ ID NO: 247562 - protein, 9 aa, Homo Sapiens
LAHKFFPKA

SEQ ID NO: 247563 - protein, 9 aa, Homo Sapiens
ETCTPMPSP

SEQ ID NO: 247564 - protein, 9 aa, Homo Sapiens
VFTLLAIAM

SEQ ID NO: 247565 - protein, 9 aa, Homo Sapiens
KDKKEKPKI

SEQ ID NO: 247566 - protein, 9 aa, Homo Sapiens
DPGRCFYVD

SEQ ID NO: 247567 - protein, 9 aa, Homo Sapiens
MLELSAFLE

SEQ ID NO: 247568 - protein, 9 aa, Homo Sapiens
QNKIISNIT

SEQ ID NO: 247569 - protein, 9 aa, Homo Sapiens
DLIIYTDEA

SEQ ID NO: 247570 - protein, 9 aa, Homo Sapiens
DVKIERDAQ

SEQ ID NO: 247571 - protein, 9 aa, Homo Sapiens
ELGGCEIVL

SEQ ID NO: 247572 - protein, 9 aa, Homo Sapiens
RSNLPLPVP

SEQ ID NO: 247573 - protein, 9 aa, Homo Sapiens
VILFKVLLT

SEQ ID NO: 247574 - protein, 9 aa, Homo Sapiens
GGLALTLVG

SEQ ID NO: 247575 - protein, 9 aa, Homo Sapiens
NGLTKLINA

SEQ ID NO: 247576 - protein, 9 aa, Homo Sapiens
FLISLYLAC

SEQ ID NO: 247577 - protein, 9 aa, Homo Sapiens
DSSTKPENY

SEQ ID NO: 247578 - protein, 9 aa, Homo Sapiens
PASESPSSL

SEQ ID NO: 247579 - protein, 9 aa, Homo Sapiens
SCVFDVLIY

SEQ ID NO: 247580 - protein, 9 aa, Homo Sapiens
YCHSQTRLD

SEQ ID NO: 247581 - protein, 9 aa, Homo Sapiens
LYFFLGTVE

SEQ ID NO: 247582 - protein, 9 aa, Homo Sapiens
NNELIKEIE

SEQ ID NO: 247583 - protein, 9 aa, Homo Sapiens
DTYELDILS

SEQ ID NO: 247584 - protein, 9 aa, Homo Sapiens
KYPSVAVVQ

SEQ ID NO: 247585 - protein, 9 aa, Homo Sapiens
IDVKGSENS

SEQ ID NO: 247586 - protein, 9 aa, Homo Sapiens
CAKKLYDAK

SEQ ID NO: 247587 - protein, 9 aa, Homo Sapiens
GLIAFEWLG

SEQ ID NO: 247588 - protein, 9 aa, Homo Sapiens
RKGLPCDTL

SEQ ID NO: 247589 - protein, 9 aa, Homo Sapiens
HNLFLNTGL

SEQ ID NO: 247590 - protein, 9 aa, Homo Sapiens
QGLDALLEM

SEQ ID NO: 247591 - protein, 9 aa, Homo Sapiens
EVEVYKLKA

SEQ ID NO: 247592 - protein, 9 aa, Homo Sapiens
MGQNGQKTY

SEQ ID NO: 247593 - protein, 9 aa, Homo Sapiens
FVVKESHVN

SEQ ID NO: 247594 - protein, 9 aa, Homo Sapiens
CYSTDSDQC

SEQ ID NO: 247595 - protein, 9 aa, Homo Sapiens
YLARKVSLW

SEQ ID NO: 247596 - protein, 9 aa, Homo Sapiens
DKPGGILIM

SEQ ID NO: 247597 - protein, 9 aa, Homo Sapiens
TAEREIVQD

SEQ ID NO: 247598 - protein, 9 aa, Homo Sapiens
VTNGGIYEG

SEQ ID NO: 247599 - protein, 9 aa, Homo Sapiens
SARRSKRNW

SEQ ID NO: 247600 - protein, 9 aa, Homo Sapiens
WFRLYGVHR

SEQ ID NO: 247601 - protein, 9 aa, Homo Sapiens
VHNRQPQIN

SEQ ID NO: 247602 - protein, 9 aa, Homo Sapiens
KLLLGQVGA

SEQ ID NO: 247603 - protein, 9 aa, Homo Sapiens
VTECIAHCK

SEQ ID NO: 247604 - protein, 9 aa, Homo Sapiens
VPAGFFNMW

SEQ ID NO: 247605 - protein, 9 aa, Homo Sapiens
KTTASAATS

SEQ ID NO: 247606 - protein, 9 aa, Homo Sapiens
IEARDTLVI

SEQ ID NO: 247607 - protein, 9 aa, Homo Sapiens
LRDHHIIHT

SEQ ID NO: 247608 - protein, 9 aa, Homo Sapiens
LLKAAASPI

SEQ ID NO: 247609 - protein, 9 aa, Homo Sapiens
PLHPLLIIA

SEQ ID NO: 247610 - protein, 9 aa, Homo Sapiens
QIDHFVCDF

SEQ ID NO: 247611 - protein, 9 aa, Homo Sapiens
DKTDPLEHE

SEQ ID NO: 247612 - protein, 9 aa, Homo Sapiens
EVEVALAEI

SEQ ID NO: 247613 - protein, 9 aa, Homo Sapiens
TSDSISARQ

SEQ ID NO: 247614 - protein, 9 aa, Homo Sapiens
YVTVIGLYL

SEQ ID NO: 247615 - protein, 9 aa, Homo Sapiens
VSLLYPVAF

SEQ ID NO: 247616 - protein, 9 aa, Homo Sapiens
WQKNQEDLL

SEQ ID NO: 247617 - protein, 9 aa, Homo Sapiens
PNPTLAECW

SEQ ID NO: 247618 - protein, 9 aa, Homo Sapiens
LTSHWTLCM

SEQ ID NO: 247619 - protein, 9 aa, Homo Sapiens
LTAQRKRMK

SEQ ID NO: 247620 - protein, 9 aa, Homo Sapiens
LGLVHAFKE

SEQ ID NO: 247621 - protein, 9 aa, Homo Sapiens
SFIRQFLQW

SEQ ID NO: 247622 - protein, 9 aa, Homo Sapiens
PDGKVAGAW

SEQ ID NO: 247623 - protein, 9 aa, Homo Sapiens
ELSDRIGST

SEQ ID NO: 247624 - protein, 9 aa, Homo Sapiens
YNFVFPSKS

SEQ ID NO: 247625 - protein, 9 aa, Homo Sapiens
LVILIQTDS

SEQ ID NO: 247626 - protein, 9 aa, Homo Sapiens
TLQIQQQTP

SEQ ID NO: 247627 - protein, 9 aa, Homo Sapiens
LTPLPSTVP

SEQ ID NO: 247628 - protein, 9 aa, Homo Sapiens
PLVLCAALI

SEQ ID NO: 247629 - protein, 9 aa, Homo Sapiens
WDLAGGQHR

SEQ ID NO: 247630 - protein, 9 aa, Homo Sapiens
LSKCSKFLR

SEQ ID NO: 247631 - protein, 9 aa, Homo Sapiens
ILSISKDDL

SEQ ID NO: 247632 - protein, 9 aa, Homo Sapiens
GLVCCECSL

SEQ ID NO: 247633 - protein, 9 aa, Homo Sapiens
NTLSSVSPR

SEQ ID NO: 247634 - protein, 9 aa, Homo Sapiens
RRNLLSLVG

SEQ ID NO: 247635 - protein, 9 aa, Homo Sapiens
QNFQTILCE

SEQ ID NO: 247636 - protein, 9 aa, Homo Sapiens
VPEESKDKG

SEQ ID NO: 247637 - protein, 9 aa, Homo Sapiens
SQEPDPGVH

SEQ ID NO: 247638 - protein, 9 aa, Homo Sapiens
HIWNWRACE

SEQ ID NO: 247639 - protein, 9 aa, Homo Sapiens
EFIFTNLVT

SEQ ID NO: 247640 - protein, 9 aa, Homo Sapiens
CKDCGKGLS

SEQ ID NO: 247641 - protein, 9 aa, Homo Sapiens
DPEGKTFDR

SEQ ID NO: 247642 - protein, 9 aa, Homo Sapiens
DAAGHEGSW

SEQ ID NO: 247643 - protein, 9 aa, Homo Sapiens
AMNCIIAKH

SEQ ID NO: 247644 - protein, 9 aa, Homo Sapiens
FLQNMIEYR

SEQ ID NO: 247645 - protein, 9 aa, Homo Sapiens
KAPPKTDLM

SEQ ID NO: 247646 - protein, 9 aa, Homo Sapiens
PQIPLPAQQ

SEQ ID NO: 247647 - protein, 9 aa, Homo Sapiens
SSSDVTSTT

SEQ ID NO: 247648 - protein, 9 aa, Homo Sapiens
TTYVSDWWE

SEQ ID NO: 247649 - protein, 9 aa, Homo Sapiens
SAKTAFNVE

SEQ ID NO: 247650 - protein, 9 aa, Homo Sapiens
LIVEKGMDY

SEQ ID NO: 247651 - protein, 9 aa, Homo Sapiens
SSSPTDPKW

SEQ ID NO: 247652 - protein, 9 aa, Homo Sapiens
PGFKRLFCL

SEQ ID NO: 247653 - protein, 9 aa, Homo Sapiens
ALTNIKIAV

SEQ ID NO: 247654 - protein, 9 aa, Homo Sapiens
RRENELPNF

SEQ ID NO: 247655 - protein, 9 aa, Homo Sapiens
PSLPTNNFP

SEQ ID NO: 247656 - protein, 9 aa, Homo Sapiens
TMKDVQTST

SEQ ID NO: 247657 - protein, 9 aa, Homo Sapiens
RRYREFLKL

SEQ ID NO: 247658 - protein, 9 aa, Homo Sapiens
SVILEQDIF

SEQ ID NO: 247659 - protein, 9 aa, Homo Sapiens
GQLSLIFVS

SEQ ID NO: 247660 - protein, 9 aa, Homo Sapiens
VVSFFVLMT

SEQ ID NO: 247661 - protein, 9 aa, Homo Sapiens
ASEQYDKDD

SEQ ID NO: 247662 - protein, 9 aa, Homo Sapiens
QEEIRQRSQ

SEQ ID NO: 247663 - protein, 9 aa, Homo Sapiens
SIKDSNRCC

SEQ ID NO: 247664 - protein, 9 aa, Homo Sapiens
TYRSLLGSE

SEQ ID NO: 247665 - protein, 9 aa, Homo Sapiens
TIKKNTLNH

SEQ ID NO: 247666 - protein, 9 aa, Homo Sapiens
IPKMLSNII

SEQ ID NO: 247667 - protein, 9 aa, Homo Sapiens
TRVQPEPRA

SEQ ID NO: 247668 - protein, 9 aa, Homo Sapiens
ERSYDLVRS

SEQ ID NO: 247669 - protein, 9 aa, Homo Sapiens
IKLKTKLKY

SEQ ID NO: 247670 - protein, 9 aa, Homo Sapiens
FMQIPCVDA

SEQ ID NO: 247671 - protein, 9 aa, Homo Sapiens
PLWEHLRSW

SEQ ID NO: 247672 - protein, 9 aa, Homo Sapiens
MWFVFRMYE

SEQ ID NO: 247673 - protein, 9 aa, Homo Sapiens
FCGANAIRR

SEQ ID NO: 247674 - protein, 9 aa, Homo Sapiens
DETTKVVQN

SEQ ID NO: 247675 - protein, 9 aa, Homo Sapiens
GKAILDSKR

SEQ ID NO: 247676 - protein, 9 aa, Homo Sapiens
VKLFFHFRC

SEQ ID NO: 247677 - protein, 9 aa, Homo Sapiens
DVLTSHPLK

SEQ ID NO: 247678 - protein, 9 aa, Homo Sapiens
RTGPLMEDR

SEQ ID NO: 247679 - protein, 9 aa, Homo Sapiens
LNKPVVTEV

SEQ ID NO: 247680 - protein, 9 aa, Homo Sapiens
ESDYLATSI

SEQ ID NO: 247681 - protein, 9 aa, Homo Sapiens
FPDGGIAQL

SEQ ID NO: 247682 - protein, 9 aa, Homo Sapiens
QEDLESEIP

SEQ ID NO: 247683 - protein, 9 aa, Homo Sapiens
TFRHSEATE

SEQ ID NO: 247684 - protein, 9 aa, Homo Sapiens
GNKSHIRTL

SEQ ID NO: 247685 - protein, 9 aa, Homo Sapiens
TVSPFSSLR

SEQ ID NO: 247686 - protein, 9 aa, Homo Sapiens
YLETQAEKL

SEQ ID NO: 247687 - protein, 9 aa, Homo Sapiens
VQLKELETE

SEQ ID NO: 247688 - protein, 9 aa, Homo Sapiens
CKDLQLPPS

SEQ ID NO: 247689 - protein, 9 aa, Homo Sapiens
VQFRWSWED

SEQ ID NO: 247690 - protein, 9 aa, Homo Sapiens
PLNALMLYM

SEQ ID NO: 247691 - protein, 9 aa, Homo Sapiens
LRYLALCCQ

SEQ ID NO: 247692 - protein, 9 aa, Homo Sapiens
KKTLLQTAT

SEQ ID NO: 247693 - protein, 9 aa, Homo Sapiens
SVPHFAEAF

SEQ ID NO: 247694 - protein, 9 aa, Homo Sapiens
SCIGAAIGF

SEQ ID NO: 247695 - protein, 9 aa, Homo Sapiens
QDKTDQLEQ

SEQ ID NO: 247696 - protein, 9 aa, Homo Sapiens
NKLADMEEP

SEQ ID NO: 247697 - protein, 9 aa, Homo Sapiens
KIKSILDIV

SEQ ID NO: 247698 - protein, 9 aa, Homo Sapiens
YTSESLVKI

SEQ ID NO: 247699 - protein, 9 aa, Homo Sapiens
EERISEFSR

SEQ ID NO: 247700 - protein, 9 aa, Homo Sapiens
SFLKSDMYL

SEQ ID NO: 247701 - protein, 9 aa, Homo Sapiens
GRVGAVSSP

SEQ ID NO: 247702 - protein, 9 aa, Homo Sapiens
ANFNQTHKY

SEQ ID NO: 247703 - protein, 9 aa, Homo Sapiens
IVKLSDEYL

SEQ ID NO: 247704 - protein, 9 aa, Homo Sapiens
ASCLYMLKT

SEQ ID NO: 247705 - protein, 9 aa, Homo Sapiens
DSPASSCSI

SEQ ID NO: 247706 - protein, 9 aa, Homo Sapiens
MKKEITKDR

SEQ ID NO: 247707 - protein, 9 aa, Homo Sapiens
HSSETYAIE

SEQ ID NO: 247708 - protein, 9 aa, Homo Sapiens
SNPPLATVL

SEQ ID NO: 247709 - protein, 9 aa, Homo Sapiens
IIKSRDNEI

SEQ ID NO: 247710 - protein, 9 aa, Homo Sapiens
QFKYLNMNV

SEQ ID NO: 247711 - protein, 9 aa, Homo Sapiens
RIITGENNL

SEQ ID NO: 247712 - protein, 9 aa, Homo Sapiens
YDYEIIEVV

SEQ ID NO: 247713 - protein, 9 aa, Homo Sapiens
LIQPLGDIM

SEQ ID NO: 247714 - protein, 9 aa, Homo Sapiens
TLCKAGLEA

SEQ ID NO: 247715 - protein, 9 aa, Homo Sapiens
LISSPFPEV

SEQ ID NO: 247716 - protein, 9 aa, Homo Sapiens
QVTIMLYLA

SEQ ID NO: 247717 - protein, 9 aa, Homo Sapiens
ENYYLLCDV

SEQ ID NO: 247718 - protein, 9 aa, Homo Sapiens
NDWSKEKQL

SEQ ID NO: 247719 - protein, 9 aa, Homo Sapiens
TTLGGLFSP

SEQ ID NO: 247720 - protein, 9 aa, Homo Sapiens
ICNYFDATE

SEQ ID NO: 247721 - protein, 9 aa, Homo Sapiens
VLIIHLKIF

SEQ ID NO: 247722 - protein, 9 aa, Homo Sapiens
AEDNYTCTY

SEQ ID NO: 247723 - protein, 9 aa, Homo Sapiens
NILHIKHWL

SEQ ID NO: 247724 - protein, 9 aa, Homo Sapiens
SRTNLSYME

SEQ ID NO: 247725 - protein, 9 aa, Homo Sapiens
IRELMLGSE

SEQ ID NO: 247726 - protein, 9 aa, Homo Sapiens
YGKTPFYAE

SEQ ID NO: 247727 - protein, 9 aa, Homo Sapiens
MREALRHLD

SEQ ID NO: 247728 - protein, 9 aa, Homo Sapiens
SLNAYLHSK

SEQ ID NO: 247729 - protein, 9 aa, Homo Sapiens
KSERSPEDP

SEQ ID NO: 247730 - protein, 9 aa, Homo Sapiens
QQLLEECDV

SEQ ID NO: 247731 - protein, 9 aa, Homo Sapiens
EAIAGDLHC

SEQ ID NO: 247732 - protein, 9 aa, Homo Sapiens
TLHLEIHGA

SEQ ID NO: 247733 - protein, 9 aa, Homo Sapiens
NLNVDVPIS

SEQ ID NO: 247734 - protein, 9 aa, Homo Sapiens
KSGGHSRKI

SEQ ID NO: 247735 - protein, 9 aa, Homo Sapiens
YSENRKIIL

SEQ ID NO: 247736 - protein, 9 aa, Homo Sapiens
LVSLIHCFH

SEQ ID NO: 247737 - protein, 9 aa, Homo Sapiens
KFCHSSLSE

SEQ ID NO: 247738 - protein, 9 aa, Homo Sapiens
GMQEEQNKL

SEQ ID NO: 247739 - protein, 9 aa, Homo Sapiens
KSHLERHRI

SEQ ID NO: 247740 - protein, 9 aa, Homo Sapiens
DIRCLSQRW

SEQ ID NO: 247741 - protein, 9 aa, Homo Sapiens
SKKTLLHFW

SEQ ID NO: 247742 - protein, 9 aa, Homo Sapiens
INSMLDPVV

SEQ ID NO: 247743 - protein, 9 aa, Homo Sapiens
EQLPPKPAL

SEQ ID NO: 247744 - protein, 9 aa, Homo Sapiens
FFFFGRSEC

SEQ ID NO: 247745 - protein, 9 aa, Homo Sapiens
NLCDLITRL

SEQ ID NO: 247746 - protein, 9 aa, Homo Sapiens
KLDFFRSKK

SEQ ID NO: 247747 - protein, 9 aa, Homo Sapiens
SISHLTKDF

SEQ ID NO: 247748 - protein, 9 aa, Homo Sapiens
VCRASNLHD

SEQ ID NO: 247749 - protein, 9 aa, Homo Sapiens
EQNNSLNAN

SEQ ID NO: 247750 - protein, 9 aa, Homo Sapiens
FLICIRILG

SEQ ID NO: 247751 - protein, 9 aa, Homo Sapiens
TATKESYAI

SEQ ID NO: 247752 - protein, 9 aa, Homo Sapiens
FLEIDFIGM

SEQ ID NO: 247753 - protein, 9 aa, Homo Sapiens
ASKMTREER

SEQ ID NO: 247754 - protein, 9 aa, Homo Sapiens
ALNADIAAQ

SEQ ID NO: 247755 - protein, 9 aa, Homo Sapiens
YPAICSYQW

SEQ ID NO: 247756 - protein, 9 aa, Homo Sapiens
TKWLDINGN

SEQ ID NO: 247757 - protein, 9 aa, Homo Sapiens
TLRLDPSTR

SEQ ID NO: 247758 - protein, 9 aa, Homo Sapiens
FETSNVPAM

SEQ ID NO: 247759 - protein, 9 aa, Homo Sapiens
DEEVHDLER

SEQ ID NO: 247760 - protein, 9 aa, Homo Sapiens
HIPLTVDHL

SEQ ID NO: 247761 - protein, 9 aa, Homo Sapiens
KCDINIRKD

SEQ ID NO: 247762 - protein, 9 aa, Homo Sapiens
SQAQNSPKG

SEQ ID NO: 247763 - protein, 9 aa, Homo Sapiens
ENGKETSPN

SEQ ID NO: 247764 - protein, 9 aa, Homo Sapiens
LLSDLLQSP

SEQ ID NO: 247765 - protein, 9 aa, Homo Sapiens
VNHVRDTLR

SEQ ID NO: 247766 - protein, 9 aa, Homo Sapiens
TIDGLLMLL

SEQ ID NO: 247767 - protein, 9 aa, Homo Sapiens
FQWNDDRCK

SEQ ID NO: 247768 - protein, 9 aa, Homo Sapiens
SKVGIRKRI

SEQ ID NO: 247769 - protein, 9 aa, Homo Sapiens
PAQMRKRIK

SEQ ID NO: 247770 - protein, 9 aa, Homo Sapiens
DSSRDNEVD

SEQ ID NO: 247771 - protein, 9 aa, Homo Sapiens
HVEHELYGE

SEQ ID NO: 247772 - protein, 9 aa, Homo Sapiens
TIRSLCDQN

SEQ ID NO: 247773 - protein, 9 aa, Homo Sapiens
FTANVQGDT

SEQ ID NO: 247774 - protein, 9 aa, Homo Sapiens
PKQYPYTNL

SEQ ID NO: 247775 - protein, 9 aa, Homo Sapiens
RIRLHGIDL

SEQ ID NO: 247776 - protein, 9 aa, Homo Sapiens
FAPRTWIFP

SEQ ID NO: 247777 - protein, 9 aa, Homo Sapiens
LSLVNTVCD

SEQ ID NO: 247778 - protein, 9 aa, Homo Sapiens
STNNCCKPA

SEQ ID NO: 247779 - protein, 9 aa, Homo Sapiens
GSGIYAPTS

SEQ ID NO: 247780 - protein, 9 aa, Homo Sapiens
DSLYAELQR

SEQ ID NO: 247781 - protein, 9 aa, Homo Sapiens
ILLTSGLGF

SEQ ID NO: 247782 - protein, 9 aa, Homo Sapiens
DLAADLEEE

SEQ ID NO: 247783 - protein, 9 aa, Homo Sapiens
KRLNIHLKK

SEQ ID NO: 247784 - protein, 9 aa, Homo Sapiens
AISPTRSSR

SEQ ID NO: 247785 - protein, 9 aa, Homo Sapiens
ALHCAAQNG

SEQ ID NO: 247786 - protein, 9 aa, Homo Sapiens
LDRCSHDLS

SEQ ID NO: 247787 - protein, 9 aa, Homo Sapiens
SQPSEFVIL

SEQ ID NO: 247788 - protein, 9 aa, Homo Sapiens
ESVRELSPV

SEQ ID NO: 247789 - protein, 9 aa, Homo Sapiens
VAGLQLKLS

SEQ ID NO: 247790 - protein, 9 aa, Homo Sapiens
FYLNLGLLD

SEQ ID NO: 247791 - protein, 9 aa, Homo Sapiens
YEYQDYAPQ

SEQ ID NO: 247792 - protein, 9 aa, Homo Sapiens
NHQCVHTGE

SEQ ID NO: 247793 - protein, 9 aa, Homo Sapiens
TNTSCKHVV

SEQ ID NO: 247794 - protein, 9 aa, Homo Sapiens
LEGEIIDLY

SEQ ID NO: 247795 - protein, 9 aa, Homo Sapiens
TIIVKNENI

SEQ ID NO: 247796 - protein, 9 aa, Homo Sapiens
SPEVDTTPP

SEQ ID NO: 247797 - protein, 9 aa, Homo Sapiens
TAKKLNIAQ

SEQ ID NO: 247798 - protein, 9 aa, Homo Sapiens
NRPDDTAFQ

SEQ ID NO: 247799 - protein, 9 aa, Homo Sapiens
AILMHLNAT

SEQ ID NO: 247800 - protein, 9 aa, Homo Sapiens
CENLGSSGC

SEQ ID NO: 247801 - protein, 9 aa, Homo Sapiens
LRMPFQQDR

SEQ ID NO: 247802 - protein, 9 aa, Homo Sapiens
SVDINSAEQ

SEQ ID NO: 247803 - protein, 9 aa, Homo Sapiens
VFLAIYPIT

SEQ ID NO: 247804 - protein, 9 aa, Homo Sapiens
YLSVMALDR

SEQ ID NO: 247805 - protein, 9 aa, Homo Sapiens
IIYLQNNLI

SEQ ID NO: 247806 - protein, 9 aa, Homo Sapiens
KKLYAKNER

SEQ ID NO: 247807 - protein, 9 aa, Homo Sapiens
TLRRGLISR

SEQ ID NO: 247808 - protein, 9 aa, Homo Sapiens
SANKFFVEE

SEQ ID NO: 247809 - protein, 9 aa, Homo Sapiens
VGDLSGLPT

SEQ ID NO: 247810 - protein, 9 aa, Homo Sapiens
PFELPMTFP

SEQ ID NO: 247811 - protein, 9 aa, Homo Sapiens
EEAQSQANQ

SEQ ID NO: 247812 - protein, 9 aa, Homo Sapiens
VRAPTVNPT

SEQ ID NO: 247813 - protein, 9 aa, Homo Sapiens
SESISTNKT

SEQ ID NO: 247814 - protein, 9 aa, Homo Sapiens
NPAISCVRV

SEQ ID NO: 247815 - protein, 9 aa, Homo Sapiens
AAVQQPDGF

SEQ ID NO: 247816 - protein, 9 aa, Homo Sapiens
QAKADTITD

SEQ ID NO: 247817 - protein, 9 aa, Homo Sapiens
EKKLSPEKE

SEQ ID NO: 247818 - protein, 9 aa, Homo Sapiens
PQKQKLSLK

SEQ ID NO: 247819 - protein, 9 aa, Homo Sapiens
HRREMASPP

SEQ ID NO: 247820 - protein, 9 aa, Homo Sapiens
YTKGCVPQL

SEQ ID NO: 247821 - protein, 9 aa, Homo Sapiens
PSQNNLYRD

SEQ ID NO: 247822 - protein, 9 aa, Homo Sapiens
NHQRKGFNA

SEQ ID NO: 247823 - protein, 9 aa, Homo Sapiens
MAADTLLQQ

SEQ ID NO: 247824 - protein, 9 aa, Homo Sapiens
DKDNGEPGT

SEQ ID NO: 247825 - protein, 9 aa, Homo Sapiens
GLFSNCSTM

SEQ ID NO: 247826 - protein, 9 aa, Homo Sapiens
VSGNPKLNV

SEQ ID NO: 247827 - protein, 9 aa, Homo Sapiens
DKSKSNIKQ

SEQ ID NO: 247828 - protein, 9 aa, Homo Sapiens
LSERIASRD

SEQ ID NO: 247829 - protein, 9 aa, Homo Sapiens
SSINLDKSL

SEQ ID NO: 247830 - protein, 9 aa, Homo Sapiens
EQQDCGIAQ

SEQ ID NO: 247831 - protein, 9 aa, Homo Sapiens
SMVQKMIFY

SEQ ID NO: 247832 - protein, 9 aa, Homo Sapiens
AEEGTGNAT

SEQ ID NO: 247833 - protein, 9 aa, Homo Sapiens
GQDLVSLKR

SEQ ID NO: 247834 - protein, 9 aa, Homo Sapiens
HVTKVDKVV

SEQ ID NO: 247835 - protein, 9 aa, Homo Sapiens
TVIERTFRV

SEQ ID NO: 247836 - protein, 9 aa, Homo Sapiens
MKYIKGVLM

SEQ ID NO: 247837 - protein, 9 aa, Homo Sapiens
DYQYIGKLH

SEQ ID NO: 247838 - protein, 9 aa, Homo Sapiens
IMTILEIVL

SEQ ID NO: 247839 - protein, 9 aa, Homo Sapiens
CLAVICNHH

SEQ ID NO: 247840 - protein, 9 aa, Homo Sapiens
QRTTLIIHM

SEQ ID NO: 247841 - protein, 9 aa, Homo Sapiens
LSHLICHEA

SEQ ID NO: 247842 - protein, 9 aa, Homo Sapiens
KALPTLSAH

SEQ ID NO: 247843 - protein, 9 aa, Homo Sapiens
KTNQIYRIF

SEQ ID NO: 247844 - protein, 9 aa, Homo Sapiens
RKLNMDSTE

SEQ ID NO: 247845 - protein, 9 aa, Homo Sapiens
DFSGSSFKM

SEQ ID NO: 247846 - protein, 9 aa, Homo Sapiens
HDLSECQGK

SEQ ID NO: 247847 - protein, 9 aa, Homo Sapiens
CSDTYNNEL

SEQ ID NO: 247848 - protein, 9 aa, Homo Sapiens
GPNTNGSHF

SEQ ID NO: 247849 - protein, 9 aa, Homo Sapiens
YNNASKFDG

SEQ ID NO: 247850 - protein, 9 aa, Homo Sapiens
FFFGRSECF

SEQ ID NO: 247851 - protein, 9 aa, Homo Sapiens
KRPVQIEKE

SEQ ID NO: 247852 - protein, 9 aa, Homo Sapiens
EVVTPPYPK

SEQ ID NO: 247853 - protein, 9 aa, Homo Sapiens
PQQTFLRPD

SEQ ID NO: 247854 - protein, 9 aa, Homo Sapiens
KLIRQSYHG

SEQ ID NO: 247855 - protein, 9 aa, Homo Sapiens
GLNVTFIEN

SEQ ID NO: 247856 - protein, 9 aa, Homo Sapiens
TTLFMVLRN

SEQ ID NO: 247857 - protein, 9 aa, Homo Sapiens
RFNNCMLYK

SEQ ID NO: 247858 - protein, 9 aa, Homo Sapiens
VNLVLSREL

SEQ ID NO: 247859 - protein, 9 aa, Homo Sapiens
PKVKEQNLV

SEQ ID NO: 247860 - protein, 9 aa, Homo Sapiens
MESPTITDT

SEQ ID NO: 247861 - protein, 9 aa, Homo Sapiens
PLSISCLFC

SEQ ID NO: 247862 - protein, 9 aa, Homo Sapiens
SSVSTLSPS

SEQ ID NO: 247863 - protein, 9 aa, Homo Sapiens
LNSEKLSLV

SEQ ID NO: 247864 - protein, 9 aa, Homo Sapiens
DPSQNNLYR

SEQ ID NO: 247865 - protein, 9 aa, Homo Sapiens
SIHSARCIF

SEQ ID NO: 247866 - protein, 9 aa, Homo Sapiens
CPHVKLKAQ

SEQ ID NO: 247867 - protein, 9 aa, Homo Sapiens
HIPDKKLFF

SEQ ID NO: 247868 - protein, 9 aa, Homo Sapiens
GHIKQMQEV

SEQ ID NO: 247869 - protein, 9 aa, Homo Sapiens
TKDLTSIYE

SEQ ID NO: 247870 - protein, 9 aa, Homo Sapiens
DEKGGRVGA

SEQ ID NO: 247871 - protein, 9 aa, Homo Sapiens
DHERKEETC

SEQ ID NO: 247872 - protein, 9 aa, Homo Sapiens
VHHNYRGIL

SEQ ID NO: 247873 - protein, 9 aa, Homo Sapiens
EQFQMPDLR

SEQ ID NO: 247874 - protein, 9 aa, Homo Sapiens
CKHIASGKK

SEQ ID NO: 247875 - protein, 9 aa, Homo Sapiens
DLVMPNEMV

SEQ ID NO: 247876 - protein, 9 aa, Homo Sapiens
FAHFLLNVM

SEQ ID NO: 247877 - protein, 9 aa, Homo Sapiens
KDREKDKVD

SEQ ID NO: 247878 - protein, 9 aa, Homo Sapiens
FKCEEYIQP

SEQ ID NO: 247879 - protein, 9 aa, Homo Sapiens
NPEVIKIKS

SEQ ID NO: 247880 - protein, 9 aa, Homo Sapiens
DDSLIAFRM

SEQ ID NO: 247881 - protein, 9 aa, Homo Sapiens
KQQCAFDQK

SEQ ID NO: 247882 - protein, 9 aa, Homo Sapiens
DGAMGPWGL

SEQ ID NO: 247883 - protein, 9 aa, Homo Sapiens
IINCGANVD

SEQ ID NO: 247884 - protein, 9 aa, Homo Sapiens
NMDCFWKIA

SEQ ID NO: 247885 - protein, 9 aa, Homo Sapiens
LWKNNHNLT

SEQ ID NO: 247886 - protein, 9 aa, Homo Sapiens
ILIVVAAFL

SEQ ID NO: 247887 - protein, 9 aa, Homo Sapiens
KEEEASKSV

SEQ ID NO: 247888 - protein, 9 aa, Homo Sapiens
LQGDSFLQV

SEQ ID NO: 247889 - protein, 9 aa, Homo Sapiens
NRCIAKCDH

SEQ ID NO: 247890 - protein, 9 aa, Homo Sapiens
PTEVQSLCT

SEQ ID NO: 247891 - protein, 9 aa, Homo Sapiens
GQNKTKPEF

SEQ ID NO: 247892 - protein, 9 aa, Homo Sapiens
EDVQEKKEN

SEQ ID NO: 247893 - protein, 9 aa, Homo Sapiens
RKDVTFNTI

SEQ ID NO: 247894 - protein, 9 aa, Homo Sapiens
EFSHSPAIC

SEQ ID NO: 247895 - protein, 9 aa, Homo Sapiens
QQEKHKQKF

SEQ ID NO: 247896 - protein, 9 aa, Homo Sapiens
LSENRAQKK

SEQ ID NO: 247897 - protein, 9 aa, Homo Sapiens
LLLFVELFI

SEQ ID NO: 247898 - protein, 9 aa, Homo Sapiens
YYCTIRGCD

SEQ ID NO: 247899 - protein, 9 aa, Homo Sapiens
EQDMISPVS

SEQ ID NO: 247900 - protein, 9 aa, Homo Sapiens
QNNSKGSSD

SEQ ID NO: 247901 - protein, 9 aa, Homo Sapiens
TGCSSILPA

SEQ ID NO: 247902 - protein, 9 aa, Homo Sapiens
MDPRVVLNM

SEQ ID NO: 247903 - protein, 9 aa, Homo Sapiens
LAKPSITPV

SEQ ID NO: 247904 - protein, 9 aa, Homo Sapiens
RHISVVMDK

SEQ ID NO: 247905 - protein, 9 aa, Homo Sapiens
FVKLPRPAE

SEQ ID NO: 247906 - protein, 9 aa, Homo Sapiens
PEVDFNEMS

SEQ ID NO: 247907 - protein, 9 aa, Homo Sapiens
VTYATPDSV

SEQ ID NO: 247908 - protein, 9 aa, Homo Sapiens
EKVGGQKMS

SEQ ID NO: 247909 - protein, 9 aa, Homo Sapiens
LETHNSVAS

SEQ ID NO: 247910 - protein, 9 aa, Homo Sapiens
ISNSSSFVR

SEQ ID NO: 247911 - protein, 9 aa, Homo Sapiens
TAFRVFDKE

SEQ ID NO: 247912 - protein, 9 aa, Homo Sapiens
NIINAIVDF

SEQ ID NO: 247913 - protein, 9 aa, Homo Sapiens
GDINILQNY

SEQ ID NO: 247914 - protein, 9 aa, Homo Sapiens
IESVQGVKN

SEQ ID NO: 247915 - protein, 9 aa, Homo Sapiens
AGNDDEDGA

SEQ ID NO: 247916 - protein, 9 aa, Homo Sapiens
GKEEVINRK

SEQ ID NO: 247917 - protein, 9 aa, Homo Sapiens
QLPASQEEN

SEQ ID NO: 247918 - protein, 9 aa, Homo Sapiens
AHPTLLAGH

SEQ ID NO: 247919 - protein, 9 aa, Homo Sapiens
MVFPPAFYG

SEQ ID NO: 247920 - protein, 9 aa, Homo Sapiens
VRQRDTGQM

SEQ ID NO: 247921 - protein, 9 aa, Homo Sapiens
ICHEAPYLF

SEQ ID NO: 247922 - protein, 9 aa, Homo Sapiens
QRQEPSTHD

SEQ ID NO: 247923 - protein, 9 aa, Homo Sapiens
MDEIGLPTI

SEQ ID NO: 247924 - protein, 9 aa, Homo Sapiens
EEIKQIEVC

SEQ ID NO: 247925 - protein, 9 aa, Homo Sapiens
LILGKLFLL

SEQ ID NO: 247926 - protein, 9 aa, Homo Sapiens
EYLLSGKKN

SEQ ID NO: 247927 - protein, 9 aa, Homo Sapiens
VALVNDSSS

SEQ ID NO: 247928 - protein, 9 aa, Homo Sapiens
KLKIPPEEI

SEQ ID NO: 247929 - protein, 9 aa, Homo Sapiens
AMLLEICWS

SEQ ID NO: 247930 - protein, 9 aa, Homo Sapiens
HIGVCSNNV

SEQ ID NO: 247931 - protein, 9 aa, Homo Sapiens
KYKWMVCKK

SEQ ID NO: 247932 - protein, 9 aa, Homo Sapiens
ALESLNSGY

SEQ ID NO: 247933 - protein, 9 aa, Homo Sapiens
IVPVEDWEK

SEQ ID NO: 247934 - protein, 9 aa, Homo Sapiens
EIQRTLNQF

SEQ ID NO: 247935 - protein, 9 aa, Homo Sapiens
QYWRNSLPP

SEQ ID NO: 247936 - protein, 9 aa, Homo Sapiens
TPTGKEDTQ

SEQ ID NO: 247937 - protein, 9 aa, Homo Sapiens
ARLQDERTV

SEQ ID NO: 247938 - protein, 9 aa, Homo Sapiens
YLFEIVQIL

SEQ ID NO: 247939 - protein, 9 aa, Homo Sapiens
TAVLFLHYL

SEQ ID NO: 247940 - protein, 9 aa, Homo Sapiens
NNLTDKHEA

SEQ ID NO: 247941 - protein, 9 aa, Homo Sapiens
YPSFLKSDM

SEQ ID NO: 247942 - protein, 9 aa, Homo Sapiens
EAYSKLLSR

SEQ ID NO: 247943 - protein, 9 aa, Homo Sapiens
DRKIIPLKN

SEQ ID NO: 247944 - protein, 9 aa, Homo Sapiens
YGGNIKPTS

SEQ ID NO: 247945 - protein, 9 aa, Homo Sapiens
SKDKEKYSE

SEQ ID NO: 247946 - protein, 9 aa, Homo Sapiens
PENPCYFTG

SEQ ID NO: 247947 - protein, 9 aa, Homo Sapiens
KLSSFPYLQ

SEQ ID NO: 247948 - protein, 9 aa, Homo Sapiens
WYFHSREYK

SEQ ID NO: 247949 - protein, 9 aa, Homo Sapiens
EQQKAWKMQ

SEQ ID NO: 247950 - protein, 9 aa, Homo Sapiens
QCVNETSII

SEQ ID NO: 247951 - protein, 9 aa, Homo Sapiens
TIRGCDKSY

SEQ ID NO: 247952 - protein, 9 aa, Homo Sapiens
QGPQGIGGP

SEQ ID NO: 247953 - protein, 9 aa, Homo Sapiens
QLMEPCRLY

SEQ ID NO: 247954 - protein, 9 aa, Homo Sapiens
IMDSFKDKM

SEQ ID NO: 247955 - protein, 9 aa, Homo Sapiens
KLQSPQFYN

SEQ ID NO: 247956 - protein, 9 aa, Homo Sapiens
DHLSIVTQE

SEQ ID NO: 247957 - protein, 9 aa, Homo Sapiens
INYLWREEN

SEQ ID NO: 247958 - protein, 9 aa, Homo Sapiens
DFFQGTRAT

SEQ ID NO: 247959 - protein, 9 aa, Homo Sapiens
STGFRATDC

SEQ ID NO: 247960 - protein, 9 aa, Homo Sapiens
QKVGIMHCK

SEQ ID NO: 247961 - protein, 9 aa, Homo Sapiens
GMDIDSRPT

SEQ ID NO: 247962 - protein, 9 aa, Homo Sapiens
TRGPLDSTA

SEQ ID NO: 247963 - protein, 9 aa, Homo Sapiens
EETIKSQGQ

SEQ ID NO: 247964 - protein, 9 aa, Homo Sapiens
NKGLPLLQV

SEQ ID NO: 247965 - protein, 9 aa, Homo Sapiens
DHPHSPLSR

SEQ ID NO: 247966 - protein, 9 aa, Homo Sapiens
DKFSQITPW

SEQ ID NO: 247967 - protein, 9 aa, Homo Sapiens
LDLIDVLLL

SEQ ID NO: 247968 - protein, 9 aa, Homo Sapiens
LDRSRMYDS

SEQ ID NO: 247969 - protein, 9 aa, Homo Sapiens
TESSCKAKN

SEQ ID NO: 247970 - protein, 9 aa, Homo Sapiens
CLGPECLRR

SEQ ID NO: 247971 - protein, 9 aa, Homo Sapiens
EIPCNCHFL

SEQ ID NO: 247972 - protein, 9 aa, Homo Sapiens
GPLAQQMNH

SEQ ID NO: 247973 - protein, 9 aa, Homo Sapiens
ALSLPSTDS

SEQ ID NO: 247974 - protein, 9 aa, Homo Sapiens
NYLRRNLLS

SEQ ID NO: 247975 - protein, 9 aa, Homo Sapiens
YRGCLDWDE

SEQ ID NO: 247976 - protein, 9 aa, Homo Sapiens
PSEQKIKQS

SEQ ID NO: 247977 - protein, 9 aa, Homo Sapiens
SKPPRAAEN

SEQ ID NO: 247978 - protein, 9 aa, Homo Sapiens
LSQLWRLNS

SEQ ID NO: 247979 - protein, 9 aa, Homo Sapiens
CNAKVPSGI

SEQ ID NO: 247980 - protein, 9 aa, Homo Sapiens
LTMTELSRL

SEQ ID NO: 247981 - protein, 9 aa, Homo Sapiens
QERHKQLES

SEQ ID NO: 247982 - protein, 9 aa, Homo Sapiens
DYRFLEEVA

SEQ ID NO: 247983 - protein, 9 aa, Homo Sapiens
FYVANADYS

SEQ ID NO: 247984 - protein, 9 aa, Homo Sapiens
NQRQSSVTS

SEQ ID NO: 247985 - protein, 9 aa, Homo Sapiens
ASLLVRSGS

SEQ ID NO: 247986 - protein, 9 aa, Homo Sapiens
FQGTRATLV

SEQ ID NO: 247987 - protein, 9 aa, Homo Sapiens
TKHPLECSL

SEQ ID NO: 247988 - protein, 9 aa, Homo Sapiens
KAFCLGKHS

SEQ ID NO: 247989 - protein, 9 aa, Homo Sapiens
RSKSLEKFF

SEQ ID NO: 247990 - protein, 9 aa, Homo Sapiens
IDSLIDVFM

SEQ ID NO: 247991 - protein, 9 aa, Homo Sapiens
DRKLLSRED

SEQ ID NO: 247992 - protein, 9 aa, Homo Sapiens
CPELRVNLD

SEQ ID NO: 247993 - protein, 9 aa, Homo Sapiens
TKEDTQDKL

SEQ ID NO: 247994 - protein, 9 aa, Homo Sapiens
AFTIKADVW

SEQ ID NO: 247995 - protein, 9 aa, Homo Sapiens
PSKVPLTPS

SEQ ID NO: 247996 - protein, 9 aa, Homo Sapiens
MLSPNSYYE

SEQ ID NO: 247997 - protein, 9 aa, Homo Sapiens
SEDYMYWRT

SEQ ID NO: 247998 - protein, 9 aa, Homo Sapiens
DKTDQLEQL

SEQ ID NO: 247999 - protein, 9 aa, Homo Sapiens
QKQLTKAKI

SEQ ID NO: 248000 - protein, 9 aa, Homo Sapiens
GKDFLVRSI

SEQ ID NO: 248001 - protein, 9 aa, Homo Sapiens
EDLKRDCGQ

SEQ ID NO: 248002 - protein, 9 aa, Homo Sapiens
QNDLTYVTE

SEQ ID NO: 248003 - protein, 9 aa, Homo Sapiens
EEYIKQRGA

SEQ ID NO: 248004 - protein, 9 aa, Homo Sapiens
DVIVSAKRA

SEQ ID NO: 248005 - protein, 9 aa, Homo Sapiens
PGDFAVDKR

SEQ ID NO: 248006 - protein, 9 aa, Homo Sapiens
GVRSLIQAS

SEQ ID NO: 248007 - protein, 9 aa, Homo Sapiens
LAVPPGYTF

SEQ ID NO: 248008 - protein, 9 aa, Homo Sapiens
WQGQICYST

SEQ ID NO: 248009 - protein, 9 aa, Homo Sapiens
ALDLCTVFG

SEQ ID NO: 248010 - protein, 9 aa, Homo Sapiens
FSYLTQHKI

SEQ ID NO: 248011 - protein, 9 aa, Homo Sapiens
LPHQPLVTY

SEQ ID NO: 248012 - protein, 9 aa, Homo Sapiens
KNQNAFLYK

SEQ ID NO: 248013 - protein, 9 aa, Homo Sapiens
FRDGSSGQR

SEQ ID NO: 248014 - protein, 9 aa, Homo Sapiens
LTFRTLCDL

SEQ ID NO: 248015 - protein, 9 aa, Homo Sapiens
FNASTIIRS

SEQ ID NO: 248016 - protein, 9 aa, Homo Sapiens
YATVNELAP

SEQ ID NO: 248017 - protein, 9 aa, Homo Sapiens
RQSFIRQFL

SEQ ID NO: 248018 - protein, 9 aa, Homo Sapiens
KLSALQRSL

SEQ ID NO: 248019 - protein, 9 aa, Homo Sapiens
ISKEGQRDL

SEQ ID NO: 248020 - protein, 9 aa, Homo Sapiens
KALDADIHS

SEQ ID NO: 248021 - protein, 9 aa, Homo Sapiens
LKESFFQYE

SEQ ID NO: 248022 - protein, 9 aa, Homo Sapiens
PNGQFVRVL

SEQ ID NO: 248023 - protein, 9 aa, Homo Sapiens
ECKLPKIDV

SEQ ID NO: 248024 - protein, 9 aa, Homo Sapiens
QSSLTKIKG

SEQ ID NO: 248025 - protein, 9 aa, Homo Sapiens
LNYNLLSSL

SEQ ID NO: 248026 - protein, 9 aa, Homo Sapiens
VSLHLGAAD

SEQ ID NO: 248027 - protein, 9 aa, Homo Sapiens
IALAALHDR

SEQ ID NO: 248028 - protein, 9 aa, Homo Sapiens
PVPNPNPTP

SEQ ID NO: 248029 - protein, 9 aa, Homo Sapiens
LSTFILLYI

SEQ ID NO: 248030 - protein, 9 aa, Homo Sapiens
FVEVQGQLI

SEQ ID NO: 248031 - protein, 9 aa, Homo Sapiens
ELQKRVPQL

SEQ ID NO: 248032 - protein, 9 aa, Homo Sapiens
GKILAKKIN

SEQ ID NO: 248033 - protein, 9 aa, Homo Sapiens
KNLAKALMI

SEQ ID NO: 248034 - protein, 9 aa, Homo Sapiens
SHLYLGCNK

SEQ ID NO: 248035 - protein, 9 aa, Homo Sapiens
SGSLHFAVQ

SEQ ID NO: 248036 - protein, 9 aa, Homo Sapiens
FKGDFRIYS

SEQ ID NO: 248037 - protein, 9 aa, Homo Sapiens
YDGDIVLWN

SEQ ID NO: 248038 - protein, 9 aa, Homo Sapiens
SCEYNFVFP

SEQ ID NO: 248039 - protein, 9 aa, Homo Sapiens
QMQEVYNFN

SEQ ID NO: 248040 - protein, 9 aa, Homo Sapiens
IRSELDGLQ

SEQ ID NO: 248041 - protein, 9 aa, Homo Sapiens
SDDSASSNS

SEQ ID NO: 248042 - protein, 9 aa, Homo Sapiens
INVFFKEIE

SEQ ID NO: 248043 - protein, 9 aa, Homo Sapiens
TILKLVGVG

SEQ ID NO: 248044 - protein, 9 aa, Homo Sapiens
YPVAFGFGT

SEQ ID NO: 248045 - protein, 9 aa, Homo Sapiens
LVFNTGIGQ

SEQ ID NO: 248046 - protein, 9 aa, Homo Sapiens
PLVTYTTVG

SEQ ID NO: 248047 - protein, 9 aa, Homo Sapiens
NNIENYPLN

SEQ ID NO: 248048 - protein, 9 aa, Homo Sapiens
VRPCRCNKC

SEQ ID NO: 248049 - protein, 9 aa, Homo Sapiens
FSCVFASCR

SEQ ID NO: 248050 - protein, 9 aa, Homo Sapiens
TMKFGKNMY

SEQ ID NO: 248051 - protein, 9 aa, Homo Sapiens
GGNIKYILS

SEQ ID NO: 248052 - protein, 9 aa, Homo Sapiens
RLILDAPDL

SEQ ID NO: 248053 - protein, 9 aa, Homo Sapiens
RLSYLTKHK

SEQ ID NO: 248054 - protein, 9 aa, Homo Sapiens
RPQNELIPL

SEQ ID NO: 248055 - protein, 9 aa, Homo Sapiens
DKPYYCTIR

SEQ ID NO: 248056 - protein, 9 aa, Homo Sapiens
NYLIKLWAK

SEQ ID NO: 248057 - protein, 9 aa, Homo Sapiens
EHDFKMLFA

SEQ ID NO: 248058 - protein, 9 aa, Homo Sapiens
DNPAPHLHF

SEQ ID NO: 248059 - protein, 9 aa, Homo Sapiens
ETLCKNDSA

SEQ ID NO: 248060 - protein, 9 aa, Homo Sapiens
LVIYIARLF

SEQ ID NO: 248061 - protein, 9 aa, Homo Sapiens
LDDGEFWTA

SEQ ID NO: 248062 - protein, 9 aa, Homo Sapiens
ALDGTLFHK

SEQ ID NO: 248063 - protein, 9 aa, Homo Sapiens
GKQQEKIEL

SEQ ID NO: 248064 - protein, 9 aa, Homo Sapiens
PESKINEEA

SEQ ID NO: 248065 - protein, 9 aa, Homo Sapiens
LTLQHIPLT

SEQ ID NO: 248066 - protein, 9 aa, Homo Sapiens
RTLNPQVLQ

SEQ ID NO: 248067 - protein, 9 aa, Homo Sapiens
WSASVTDSS

SEQ ID NO: 248068 - protein, 9 aa, Homo Sapiens
DANEPTKNL

SEQ ID NO: 248069 - protein, 9 aa, Homo Sapiens
WLLSASAHQ

SEQ ID NO: 248070 - protein, 9 aa, Homo Sapiens
HYEDVHWHK

SEQ ID NO: 248071 - protein, 9 aa, Homo Sapiens
LSVSSSVNE

SEQ ID NO: 248072 - protein, 9 aa, Homo Sapiens
GALRPVNGG

SEQ ID NO: 248073 - protein, 9 aa, Homo Sapiens
YECIWNKIQ

SEQ ID NO: 248074 - protein, 9 aa, Homo Sapiens
TRYSLRKKS

SEQ ID NO: 248075 - protein, 9 aa, Homo Sapiens
EEVEKPEER

SEQ ID NO: 248076 - protein, 9 aa, Homo Sapiens
IPPEGRRGV

SEQ ID NO: 248077 - protein, 9 aa, Homo Sapiens
NMWDLSSPD

SEQ ID NO: 248078 - protein, 9 aa, Homo Sapiens
WNRIYKVIS

SEQ ID NO: 248079 - protein, 9 aa, Homo Sapiens
CISRRGHAA

SEQ ID NO: 248080 - protein, 9 aa, Homo Sapiens
PYGTVGAVS

SEQ ID NO: 248081 - protein, 9 aa, Homo Sapiens
MPREGHPMY

SEQ ID NO: 248082 - protein, 9 aa, Homo Sapiens
LRAEAAQAK

SEQ ID NO: 248083 - protein, 9 aa, Homo Sapiens
PTEKQWLKK

SEQ ID NO: 248084 - protein, 9 aa, Homo Sapiens
RFGMTRNYI

SEQ ID NO: 248085 - protein, 9 aa, Homo Sapiens
AGPASMSCA

SEQ ID NO: 248086 - protein, 9 aa, Homo Sapiens
IYNISKKHD

SEQ ID NO: 248087 - protein, 9 aa, Homo Sapiens
FYDFFRYVK

SEQ ID NO: 248088 - protein, 9 aa, Homo Sapiens
PEALHFSFS

SEQ ID NO: 248089 - protein, 9 aa, Homo Sapiens
KFPQGQNKT

SEQ ID NO: 248090 - protein, 9 aa, Homo Sapiens
ESENQHKER

SEQ ID NO: 248091 - protein, 9 aa, Homo Sapiens
NTFSLIEHL

SEQ ID NO: 248092 - protein, 9 aa, Homo Sapiens
DNLSEEKCG

SEQ ID NO: 248093 - protein, 9 aa, Homo Sapiens
ADFFNVIDY

SEQ ID NO: 248094 - protein, 9 aa, Homo Sapiens
GEELSQRLQ

SEQ ID NO: 248095 - protein, 9 aa, Homo Sapiens
GSLLYLFPL

SEQ ID NO: 248096 - protein, 9 aa, Homo Sapiens
EIPGNLNKV

SEQ ID NO: 248097 - protein, 9 aa, Homo Sapiens
PDDKYSLHR

SEQ ID NO: 248098 - protein, 9 aa, Homo Sapiens
SLHFAVQTI

SEQ ID NO: 248099 - protein, 9 aa, Homo Sapiens
IFEELLTCS

SEQ ID NO: 248100 - protein, 9 aa, Homo Sapiens
DKTYGVRNR

SEQ ID NO: 248101 - protein, 9 aa, Homo Sapiens
KQLSELKEK

SEQ ID NO: 248102 - protein, 9 aa, Homo Sapiens
SNHIPLRLG

SEQ ID NO: 248103 - protein, 9 aa, Homo Sapiens
SVNIETKDV

SEQ ID NO: 248104 - protein, 9 aa, Homo Sapiens
CLNISGTAT

SEQ ID NO: 248105 - protein, 9 aa, Homo Sapiens
VLCDQTAQD

SEQ ID NO: 248106 - protein, 9 aa, Homo Sapiens
NATEICPLI

SEQ ID NO: 248107 - protein, 9 aa, Homo Sapiens
EDPAEAPMT

SEQ ID NO: 248108 - protein, 9 aa, Homo Sapiens
SAFAGVGER

SEQ ID NO: 248109 - protein, 9 aa, Homo Sapiens
MMKLLKNKQ

SEQ ID NO: 248110 - protein, 9 aa, Homo Sapiens
RFQTAREKR

SEQ ID NO: 248111 - protein, 9 aa, Homo Sapiens
QPELYHSVQ

SEQ ID NO: 248112 - protein, 9 aa, Homo Sapiens
RTLMVDGED

SEQ ID NO: 248113 - protein, 9 aa, Homo Sapiens
QRPNIPHQQ

SEQ ID NO: 248114 - protein, 9 aa, Homo Sapiens
KGLFLVSLL

SEQ ID NO: 248115 - protein, 9 aa, Homo Sapiens
HSGQKYFKC

SEQ ID NO: 248116 - protein, 9 aa, Homo Sapiens
KGDKFVLKE

SEQ ID NO: 248117 - protein, 9 aa, Homo Sapiens
GCEIVLLVN

SEQ ID NO: 248118 - protein, 9 aa, Homo Sapiens
YFLNVCFKV

SEQ ID NO: 248119 - protein, 9 aa, Homo Sapiens
GTCLTSQGK

SEQ ID NO: 248120 - protein, 9 aa, Homo Sapiens
LYSNHTRMG

SEQ ID NO: 248121 - protein, 9 aa, Homo Sapiens
TSPTPASYA

SEQ ID NO: 248122 - protein, 9 aa, Homo Sapiens
KTNPCGSIY

SEQ ID NO: 248123 - protein, 9 aa, Homo Sapiens
LSNRRSTPR

SEQ ID NO: 248124 - protein, 9 aa, Homo Sapiens
WVVRGKKYL

SEQ ID NO: 248125 - protein, 9 aa, Homo Sapiens
FTLVVIAVE

SEQ ID NO: 248126 - protein, 9 aa, Homo Sapiens
ISLAIALLF

SEQ ID NO: 248127 - protein, 9 aa, Homo Sapiens
NKTWDIITS

SEQ ID NO: 248128 - protein, 9 aa, Homo Sapiens
ILKTTLFMV

SEQ ID NO: 248129 - protein, 9 aa, Homo Sapiens
LQKLLNFYE

SEQ ID NO: 248130 - protein, 9 aa, Homo Sapiens
VEDERWRKA

SEQ ID NO: 248131 - protein, 9 aa, Homo Sapiens
RRLRALCSL

SEQ ID NO: 248132 - protein, 9 aa, Homo Sapiens
YCNNESGSR

SEQ ID NO: 248133 - protein, 9 aa, Homo Sapiens
QMLKLQHLV

SEQ ID NO: 248134 - protein, 9 aa, Homo Sapiens
GFAKPYNLY

SEQ ID NO: 248135 - protein, 9 aa, Homo Sapiens
ITKYPKIVH

SEQ ID NO: 248136 - protein, 9 aa, Homo Sapiens
GLIQVTIML

SEQ ID NO: 248137 - protein, 9 aa, Homo Sapiens
TSTSYSVTK

SEQ ID NO: 248138 - protein, 9 aa, Homo Sapiens
RSDNISEAS

SEQ ID NO: 248139 - protein, 9 aa, Homo Sapiens
SEENNSENP

SEQ ID NO: 248140 - protein, 9 aa, Homo Sapiens
KARPDMQLE

SEQ ID NO: 248141 - protein, 9 aa, Homo Sapiens
QLSGSFFLP

SEQ ID NO: 248142 - protein, 9 aa, Homo Sapiens
FLRQNSSTS

SEQ ID NO: 248143 - protein, 9 aa, Homo Sapiens
STFILPIFF

SEQ ID NO: 248144 - protein, 9 aa, Homo Sapiens
YSNKWHRFR

SEQ ID NO: 248145 - protein, 9 aa, Homo Sapiens
DRFLSVTRV

SEQ ID NO: 248146 - protein, 9 aa, Homo Sapiens
HFQNVSKDM

SEQ ID NO: 248147 - protein, 9 aa, Homo Sapiens
AFKEGKDEL

SEQ ID NO: 248148 - protein, 9 aa, Homo Sapiens
GLDALLEMK

SEQ ID NO: 248149 - protein, 9 aa, Homo Sapiens
AKIIITYIN

SEQ ID NO: 248150 - protein, 9 aa, Homo Sapiens
ACNILVNSN

SEQ ID NO: 248151 - protein, 9 aa, Homo Sapiens
ISKIMDDDS

SEQ ID NO: 248152 - protein, 9 aa, Homo Sapiens
PEGILRYFL

SEQ ID NO: 248153 - protein, 9 aa, Homo Sapiens
AESKTMEFG

SEQ ID NO: 248154 - protein, 9 aa, Homo Sapiens
GAAHGISSQ

SEQ ID NO: 248155 - protein, 9 aa, Homo Sapiens
IFRQEGDRR

SEQ ID NO: 248156 - protein, 9 aa, Homo Sapiens
LVVQERNYA

SEQ ID NO: 248157 - protein, 9 aa, Homo Sapiens
RLFSEPVTT

SEQ ID NO: 248158 - protein, 9 aa, Homo Sapiens
LSETISTLQ

SEQ ID NO: 248159 - protein, 9 aa, Homo Sapiens
EEFLDRLGQ

SEQ ID NO: 248160 - protein, 9 aa, Homo Sapiens
FTKHLLTSG

SEQ ID NO: 248161 - protein, 9 aa, Homo Sapiens
QAFIYRPIQ

SEQ ID NO: 248162 - protein, 9 aa, Homo Sapiens
EKLFTLTAY

SEQ ID NO: 248163 - protein, 9 aa, Homo Sapiens
RHKKNEENF

SEQ ID NO: 248164 - protein, 9 aa, Homo Sapiens
LCPSETPIN

SEQ ID NO: 248165 - protein, 9 aa, Homo Sapiens
LAYLWQKNQ

SEQ ID NO: 248166 - protein, 9 aa, Homo Sapiens
NKQIEAKEL

SEQ ID NO: 248167 - protein, 9 aa, Homo Sapiens
EKQTPLFQP

SEQ ID NO: 248168 - protein, 9 aa, Homo Sapiens
RKKTSEDIF

SEQ ID NO: 248169 - protein, 9 aa, Homo Sapiens
FFFNLVRLL

SEQ ID NO: 248170 - protein, 9 aa, Homo Sapiens
IENIPKEMV

SEQ ID NO: 248171 - protein, 9 aa, Homo Sapiens
IPVLFKIMK

SEQ ID NO: 248172 - protein, 9 aa, Homo Sapiens
YRGSGGVQR

SEQ ID NO: 248173 - protein, 9 aa, Homo Sapiens
VQRKGTYRN

SEQ ID NO: 248174 - protein, 9 aa, Homo Sapiens
HKGRDADEC

SEQ ID NO: 248175 - protein, 9 aa, Homo Sapiens
NTSRKENFN

SEQ ID NO: 248176 - protein, 9 aa, Homo Sapiens
EDKKNGIWE

SEQ ID NO: 248177 - protein, 9 aa, Homo Sapiens
DLEIVNLLE

SEQ ID NO: 248178 - protein, 9 aa, Homo Sapiens
VAEWRRWMG

SEQ ID NO: 248179 - protein, 9 aa, Homo Sapiens
GSVISEKMF

SEQ ID NO: 248180 - protein, 9 aa, Homo Sapiens
NSREFSRII

SEQ ID NO: 248181 - protein, 9 aa, Homo Sapiens
SKDLSATVR

SEQ ID NO: 248182 - protein, 9 aa, Homo Sapiens
LLFRECCAT

SEQ ID NO: 248183 - protein, 9 aa, Homo Sapiens
CVQLNDGHF

SEQ ID NO: 248184 - protein, 9 aa, Homo Sapiens
FENLLSKPP

SEQ ID NO: 248185 - protein, 9 aa, Homo Sapiens
VKRPALHKK

SEQ ID NO: 248186 - protein, 9 aa, Homo Sapiens
RQNTNSSRI

SEQ ID NO: 248187 - protein, 9 aa, Homo Sapiens
EPSADGETS

SEQ ID NO: 248188 - protein, 9 aa, Homo Sapiens
LIPYLVAGT

SEQ ID NO: 248189 - protein, 9 aa, Homo Sapiens
NISDACQDP

SEQ ID NO: 248190 - protein, 9 aa, Homo Sapiens
RYESYGIEH

SEQ ID NO: 248191 - protein, 9 aa, Homo Sapiens
AEDPVRADS

SEQ ID NO: 248192 - protein, 9 aa, Homo Sapiens
SWMKEKILS

SEQ ID NO: 248193 - protein, 9 aa, Homo Sapiens
PDEGMRGDG

SEQ ID NO: 248194 - protein, 9 aa, Homo Sapiens
YPNTINVPP

SEQ ID NO: 248195 - protein, 9 aa, Homo Sapiens
EKKSNDLTA

SEQ ID NO: 248196 - protein, 9 aa, Homo Sapiens
ALKRLDTFN

SEQ ID NO: 248197 - protein, 9 aa, Homo Sapiens
NEAKLDESL

SEQ ID NO: 248198 - protein, 9 aa, Homo Sapiens
ATKVQRHDM

SEQ ID NO: 248199 - protein, 9 aa, Homo Sapiens
RTNQSSKNI

SEQ ID NO: 248200 - protein, 9 aa, Homo Sapiens
KMCTIRMSC

SEQ ID NO: 248201 - protein, 9 aa, Homo Sapiens
SSSTKNYPS

SEQ ID NO: 248202 - protein, 9 aa, Homo Sapiens
NLKQFLKTL

SEQ ID NO: 248203 - protein, 9 aa, Homo Sapiens
EIGKPGAEG

SEQ ID NO: 248204 - protein, 9 aa, Homo Sapiens
DNDTNNLAK

SEQ ID NO: 248205 - protein, 9 aa, Homo Sapiens
FEGNLQRIV

SEQ ID NO: 248206 - protein, 9 aa, Homo Sapiens
NLTDEELKT

SEQ ID NO: 248207 - protein, 9 aa, Homo Sapiens
INKQHEVEE

SEQ ID NO: 248208 - protein, 9 aa, Homo Sapiens
VYFGRRVLC

SEQ ID NO: 248209 - protein, 9 aa, Homo Sapiens
INGLRRVPD

SEQ ID NO: 248210 - protein, 9 aa, Homo Sapiens
VVTAAVLVS

SEQ ID NO: 248211 - protein, 9 aa, Homo Sapiens
ATIFLQVID

SEQ ID NO: 248212 - protein, 9 aa, Homo Sapiens
FKEQQPSTY

SEQ ID NO: 248213 - protein, 9 aa, Homo Sapiens
EIVLKLLSE

SEQ ID NO: 248214 - protein, 9 aa, Homo Sapiens
TPAHVSRVD

SEQ ID NO: 248215 - protein, 9 aa, Homo Sapiens
PTRSSRYGS

SEQ ID NO: 248216 - protein, 9 aa, Homo Sapiens
SVDDILMSH

SEQ ID NO: 248217 - protein, 9 aa, Homo Sapiens
GPQMCRCLR

SEQ ID NO: 248218 - protein, 9 aa, Homo Sapiens
QRDNWKGTW

SEQ ID NO: 248219 - protein, 9 aa, Homo Sapiens
REEEKGLEL

SEQ ID NO: 248220 - protein, 9 aa, Homo Sapiens
GELFLWQVE

SEQ ID NO: 248221 - protein, 9 aa, Homo Sapiens
IDKWDLLKL

SEQ ID NO: 248222 - protein, 9 aa, Homo Sapiens
PQFLQRFYK

SEQ ID NO: 248223 - protein, 9 aa, Homo Sapiens
PVPASWPHH

SEQ ID NO: 248224 - protein, 9 aa, Homo Sapiens
IHGQLKAFW

SEQ ID NO: 248225 - protein, 9 aa, Homo Sapiens
ESLCCLCRG

SEQ ID NO: 248226 - protein, 9 aa, Homo Sapiens
TSSEKPTLQ

SEQ ID NO: 248227 - protein, 9 aa, Homo Sapiens
WFLNNYPGS

SEQ ID NO: 248228 - protein, 9 aa, Homo Sapiens
PTATVAPQG

SEQ ID NO: 248229 - protein, 9 aa, Homo Sapiens
SVTFRATRK

SEQ ID NO: 248230 - protein, 9 aa, Homo Sapiens
AGSGKLQDF

SEQ ID NO: 248231 - protein, 9 aa, Homo Sapiens
RSQHLDNLS

SEQ ID NO: 248232 - protein, 9 aa, Homo Sapiens
LNYAVTVVL

SEQ ID NO: 248233 - protein, 9 aa, Homo Sapiens
RVNSEQGHF

SEQ ID NO: 248234 - protein, 9 aa, Homo Sapiens
LPLQPHEFW

SEQ ID NO: 248235 - protein, 9 aa, Homo Sapiens
VIQRLQGVL

SEQ ID NO: 248236 - protein, 9 aa, Homo Sapiens
FFHMAADTL

SEQ ID NO: 248237 - protein, 9 aa, Homo Sapiens
FCEACIELL

SEQ ID NO: 248238 - protein, 9 aa, Homo Sapiens
GGDDKYDDE

SEQ ID NO: 248239 - protein, 9 aa, Homo Sapiens
LKRLDTFNR

SEQ ID NO: 248240 - protein, 9 aa, Homo Sapiens
QRIPYQLGR

SEQ ID NO: 248241 - protein, 9 aa, Homo Sapiens
IEDYANYKK

SEQ ID NO: 248242 - protein, 9 aa, Homo Sapiens
VEDQLREEV

SEQ ID NO: 248243 - protein, 9 aa, Homo Sapiens
VNYPTDPAL

SEQ ID NO: 248244 - protein, 9 aa, Homo Sapiens
LSYIISWLI

SEQ ID NO: 248245 - protein, 9 aa, Homo Sapiens
QLLEHRDSI

SEQ ID NO: 248246 - protein, 9 aa, Homo Sapiens
STKPENYDG

SEQ ID NO: 248247 - protein, 9 aa, Homo Sapiens
NCGPGLLCR

SEQ ID NO: 248248 - protein, 9 aa, Homo Sapiens
KKVIASRQY

SEQ ID NO: 248249 - protein, 9 aa, Homo Sapiens
IVEEDPLHS

SEQ ID NO: 248250 - protein, 9 aa, Homo Sapiens
RWLGTCANI

SEQ ID NO: 248251 - protein, 9 aa, Homo Sapiens
NYPSNMDCF

SEQ ID NO: 248252 - protein, 9 aa, Homo Sapiens
MLSPHENEY

SEQ ID NO: 248253 - protein, 9 aa, Homo Sapiens
SNTEQNGLK

SEQ ID NO: 248254 - protein, 9 aa, Homo Sapiens
TKPLNRRSA

SEQ ID NO: 248255 - protein, 9 aa, Homo Sapiens
CLAHLLMDQ

SEQ ID NO: 248256 - protein, 9 aa, Homo Sapiens
QETSIEVEL

SEQ ID NO: 248257 - protein, 9 aa, Homo Sapiens
ETAIMNNSQ

SEQ ID NO: 248258 - protein, 9 aa, Homo Sapiens
NLDQLKAGQ

SEQ ID NO: 248259 - protein, 9 aa, Homo Sapiens
QSCSSYELQ

SEQ ID NO: 248260 - protein, 9 aa, Homo Sapiens
IQRWYMRFV

SEQ ID NO: 248261 - protein, 9 aa, Homo Sapiens
YQSRYILLR

SEQ ID NO: 248262 - protein, 9 aa, Homo Sapiens
NIAWSINGT

SEQ ID NO: 248263 - protein, 9 aa, Homo Sapiens
FLIKVNTDN

SEQ ID NO: 248264 - protein, 9 aa, Homo Sapiens
ISVEVFLPV

SEQ ID NO: 248265 - protein, 9 aa, Homo Sapiens
EKIWIEIIA

SEQ ID NO: 248266 - protein, 9 aa, Homo Sapiens
SYFVAELIM

SEQ ID NO: 248267 - protein, 9 aa, Homo Sapiens
CFGGILMNN

SEQ ID NO: 248268 - protein, 9 aa, Homo Sapiens
LQKEHNLNM

SEQ ID NO: 248269 - protein, 9 aa, Homo Sapiens
RELENLQTL

SEQ ID NO: 248270 - protein, 9 aa, Homo Sapiens
AHVDLFPKD

SEQ ID NO: 248271 - protein, 9 aa, Homo Sapiens
DRLAAINYE

SEQ ID NO: 248272 - protein, 9 aa, Homo Sapiens
TTCINGEYM

SEQ ID NO: 248273 - protein, 9 aa, Homo Sapiens
VADAIIGNK

SEQ ID NO: 248274 - protein, 9 aa, Homo Sapiens
SPSPINAFI

SEQ ID NO: 248275 - protein, 9 aa, Homo Sapiens
LFQIHGNDT

SEQ ID NO: 248276 - protein, 9 aa, Homo Sapiens
TWATQERIY

SEQ ID NO: 248277 - protein, 9 aa, Homo Sapiens
HLRPQFLLI

SEQ ID NO: 248278 - protein, 9 aa, Homo Sapiens
PKASLFDES

SEQ ID NO: 248279 - protein, 9 aa, Homo Sapiens
KGVLMKLII

SEQ ID NO: 248280 - protein, 9 aa, Homo Sapiens
VLQQFKDSG

SEQ ID NO: 248281 - protein, 9 aa, Homo Sapiens
KNAIENAKQ

SEQ ID NO: 248282 - protein, 9 aa, Homo Sapiens
EYSSNWEKQ

SEQ ID NO: 248283 - protein, 9 aa, Homo Sapiens
NIKMSSDKI

SEQ ID NO: 248284 - protein, 9 aa, Homo Sapiens
MGEISAYQR

SEQ ID NO: 248285 - protein, 9 aa, Homo Sapiens
NFVVKESHV

SEQ ID NO: 248286 - protein, 9 aa, Homo Sapiens
GPTPVRRHM

SEQ ID NO: 248287 - protein, 9 aa, Homo Sapiens
AERERLECQ

SEQ ID NO: 248288 - protein, 9 aa, Homo Sapiens
KFILMGFMD

SEQ ID NO: 248289 - protein, 9 aa, Homo Sapiens
GKTEDKSRQ

SEQ ID NO: 248290 - protein, 9 aa, Homo Sapiens
GIEKFEGWY

SEQ ID NO: 248291 - protein, 9 aa, Homo Sapiens
AVVKYETSL

SEQ ID NO: 248292 - protein, 9 aa, Homo Sapiens
TNSGEKPYG

SEQ ID NO: 248293 - protein, 9 aa, Homo Sapiens
VKWYNHSSL

SEQ ID NO: 248294 - protein, 9 aa, Homo Sapiens
FQEMKEAAK

SEQ ID NO: 248295 - protein, 9 aa, Homo Sapiens
RKLWACLTI

SEQ ID NO: 248296 - protein, 9 aa, Homo Sapiens
NHGRLLPQY

SEQ ID NO: 248297 - protein, 9 aa, Homo Sapiens
ESIMRDTMP

SEQ ID NO: 248298 - protein, 9 aa, Homo Sapiens
DGSVISEKM

SEQ ID NO: 248299 - protein, 9 aa, Homo Sapiens
LCLTIEATV

SEQ ID NO: 248300 - protein, 9 aa, Homo Sapiens
IDHFVCDFS

SEQ ID NO: 248301 - protein, 9 aa, Homo Sapiens
RVCIDSEFF

SEQ ID NO: 248302 - protein, 9 aa, Homo Sapiens
VMEHDDQSL

SEQ ID NO: 248303 - protein, 9 aa, Homo Sapiens
EDSYSKFNR

SEQ ID NO: 248304 - protein, 9 aa, Homo Sapiens
IKYPSNFLK

SEQ ID NO: 248305 - protein, 9 aa, Homo Sapiens
AIPQAKCDS

SEQ ID NO: 248306 - protein, 9 aa, Homo Sapiens
GGRCRNGHR

SEQ ID NO: 248307 - protein, 9 aa, Homo Sapiens
RKDKSKVAK

SEQ ID NO: 248308 - protein, 9 aa, Homo Sapiens
LISDFETDV

SEQ ID NO: 248309 - protein, 9 aa, Homo Sapiens
VMEVDERDQ

SEQ ID NO: 248310 - protein, 9 aa, Homo Sapiens
VVFGESITA

SEQ ID NO: 248311 - protein, 9 aa, Homo Sapiens
LILISDGFI

SEQ ID NO: 248312 - protein, 9 aa, Homo Sapiens
VYGIDKFMK

SEQ ID NO: 248313 - protein, 9 aa, Homo Sapiens
DPQFQWSVC

SEQ ID NO: 248314 - protein, 9 aa, Homo Sapiens
PRNPGCPNY

SEQ ID NO: 248315 - protein, 9 aa, Homo Sapiens
HFLLNVMNV

SEQ ID NO: 248316 - protein, 9 aa, Homo Sapiens
EKSVISDKT

SEQ ID NO: 248317 - protein, 9 aa, Homo Sapiens
MPVRNVSKF

SEQ ID NO: 248318 - protein, 9 aa, Homo Sapiens
RCNCGPGLL

SEQ ID NO: 248319 - protein, 9 aa, Homo Sapiens
AQLFNKVVP

SEQ ID NO: 248320 - protein, 9 aa, Homo Sapiens
FQWSVCRAS

SEQ ID NO: 248321 - protein, 9 aa, Homo Sapiens
EEINRVVHN

SEQ ID NO: 248322 - protein, 9 aa, Homo Sapiens
SVPDQITGR

SEQ ID NO: 248323 - protein, 9 aa, Homo Sapiens
HICTTILLV

SEQ ID NO: 248324 - protein, 9 aa, Homo Sapiens
SIPVINGRY

SEQ ID NO: 248325 - protein, 9 aa, Homo Sapiens
DINILQNYD

SEQ ID NO: 248326 - protein, 9 aa, Homo Sapiens
LLAMIMWLQ

SEQ ID NO: 248327 - protein, 9 aa, Homo Sapiens
SNAGQKKHA

SEQ ID NO: 248328 - protein, 9 aa, Homo Sapiens
ENTDIANYV

SEQ ID NO: 248329 - protein, 9 aa, Homo Sapiens
LAEKLAPSE

SEQ ID NO: 248330 - protein, 9 aa, Homo Sapiens
HREPKKLDP

SEQ ID NO: 248331 - protein, 9 aa, Homo Sapiens
NNAPDIFII

SEQ ID NO: 248332 - protein, 9 aa, Homo Sapiens
GTSTSVLTT

SEQ ID NO: 248333 - protein, 9 aa, Homo Sapiens
NVCSGENNV

SEQ ID NO: 248334 - protein, 9 aa, Homo Sapiens
LLLEHKALD

SEQ ID NO: 248335 - protein, 9 aa, Homo Sapiens
PEYKIFFVM

SEQ ID NO: 248336 - protein, 9 aa, Homo Sapiens
LNSIIDQGL

SEQ ID NO: 248337 - protein, 9 aa, Homo Sapiens
TEFLPRHNS

SEQ ID NO: 248338 - protein, 9 aa, Homo Sapiens
ASFKFIDKK

SEQ ID NO: 248339 - protein, 9 aa, Homo Sapiens
LDWLFSFLL

SEQ ID NO: 248340 - protein, 9 aa, Homo Sapiens
LGHVPRRLR

SEQ ID NO: 248341 - protein, 9 aa, Homo Sapiens
MLSVMLASI

SEQ ID NO: 248342 - protein, 9 aa, Homo Sapiens
RREGLIQAQ

SEQ ID NO: 248343 - protein, 9 aa, Homo Sapiens
GVLIRLSHP

SEQ ID NO: 248344 - protein, 9 aa, Homo Sapiens
YVCQSGYFS

SEQ ID NO: 248345 - protein, 9 aa, Homo Sapiens
ILWLPFCGN

SEQ ID NO: 248346 - protein, 9 aa, Homo Sapiens
VMLIFGVVG

SEQ ID NO: 248347 - protein, 9 aa, Homo Sapiens
TLGGSEHLQ

SEQ ID NO: 248348 - protein, 9 aa, Homo Sapiens
MYKGKSSFQ

SEQ ID NO: 248349 - protein, 9 aa, Homo Sapiens
GTGTGTLPN

SEQ ID NO: 248350 - protein, 9 aa, Homo Sapiens
FQPFRDGSS

SEQ ID NO: 248351 - protein, 9 aa, Homo Sapiens
SGVDNMVLL

SEQ ID NO: 248352 - protein, 9 aa, Homo Sapiens
ADVLEFVCE

SEQ ID NO: 248353 - protein, 9 aa, Homo Sapiens
EESSDMEQI

SEQ ID NO: 248354 - protein, 9 aa, Homo Sapiens
LDDQKALER

SEQ ID NO: 248355 - protein, 9 aa, Homo Sapiens
WTEPECYFP

SEQ ID NO: 248356 - protein, 9 aa, Homo Sapiens
NIIKLKELV

SEQ ID NO: 248357 - protein, 9 aa, Homo Sapiens
WGEGSPAAI

SEQ ID NO: 248358 - protein, 9 aa, Homo Sapiens
KYYQLLEKK

SEQ ID NO: 248359 - protein, 9 aa, Homo Sapiens
LLLLALLMF

SEQ ID NO: 248360 - protein, 9 aa, Homo Sapiens
SVESSNKGT

SEQ ID NO: 248361 - protein, 9 aa, Homo Sapiens
EPRLKKMKT

SEQ ID NO: 248362 - protein, 9 aa, Homo Sapiens
VEKKSVARL

SEQ ID NO: 248363 - protein, 9 aa, Homo Sapiens
AVPSGNIKT

SEQ ID NO: 248364 - protein, 9 aa, Homo Sapiens
SEFDYWDYV

SEQ ID NO: 248365 - protein, 9 aa, Homo Sapiens
LYEDRAFQG

SEQ ID NO: 248366 - protein, 9 aa, Homo Sapiens
RCISCKTET

SEQ ID NO: 248367 - protein, 9 aa, Homo Sapiens
SKHKSSLKQ

SEQ ID NO: 248368 - protein, 9 aa, Homo Sapiens
SSLPLVERI

SEQ ID NO: 248369 - protein, 9 aa, Homo Sapiens
PQPGNTKSP

SEQ ID NO: 248370 - protein, 9 aa, Homo Sapiens
DNLNKDIES

SEQ ID NO: 248371 - protein, 9 aa, Homo Sapiens
AIKEAIRIS

SEQ ID NO: 248372 - protein, 9 aa, Homo Sapiens
NVKMATDIS

SEQ ID NO: 248373 - protein, 9 aa, Homo Sapiens
RQADEVKSM

SEQ ID NO: 248374 - protein, 9 aa, Homo Sapiens
YFMRIWAAG

SEQ ID NO: 248375 - protein, 9 aa, Homo Sapiens
PKDPRKWIR

SEQ ID NO: 248376 - protein, 9 aa, Homo Sapiens
VFVTLLAAA

SEQ ID NO: 248377 - protein, 9 aa, Homo Sapiens
KRGKFSEVK

SEQ ID NO: 248378 - protein, 9 aa, Homo Sapiens
TGPYYFVNN

SEQ ID NO: 248379 - protein, 9 aa, Homo Sapiens
IRTAQTQAE

SEQ ID NO: 248380 - protein, 9 aa, Homo Sapiens
TSKINLHQH

SEQ ID NO: 248381 - protein, 9 aa, Homo Sapiens
MDCEHSLSV

SEQ ID NO: 248382 - protein, 9 aa, Homo Sapiens
QPPGYQSRY

SEQ ID NO: 248383 - protein, 9 aa, Homo Sapiens
GVTGAMHLA

SEQ ID NO: 248384 - protein, 9 aa, Homo Sapiens
GVNFTGTTV

SEQ ID NO: 248385 - protein, 9 aa, Homo Sapiens
MRGSIHARR

SEQ ID NO: 248386 - protein, 9 aa, Homo Sapiens
QKLDDQGDS

SEQ ID NO: 248387 - protein, 9 aa, Homo Sapiens
TQQYVRADV

SEQ ID NO: 248388 - protein, 9 aa, Homo Sapiens
EKRVMEHDD

SEQ ID NO: 248389 - protein, 9 aa, Homo Sapiens
IMQTLKKDY

SEQ ID NO: 248390 - protein, 9 aa, Homo Sapiens
DVELLLLTD

SEQ ID NO: 248391 - protein, 9 aa, Homo Sapiens
GVETYPNGS

SEQ ID NO: 248392 - protein, 9 aa, Homo Sapiens
DNVELNCAV

SEQ ID NO: 248393 - protein, 9 aa, Homo Sapiens
LLSVDGIWL

SEQ ID NO: 248394 - protein, 9 aa, Homo Sapiens
LNGFIEIII

SEQ ID NO: 248395 - protein, 9 aa, Homo Sapiens
TSVHFEEDV

SEQ ID NO: 248396 - protein, 9 aa, Homo Sapiens
GTYQDTKAS

SEQ ID NO: 248397 - protein, 9 aa, Homo Sapiens
FTSDSNHQR

SEQ ID NO: 248398 - protein, 9 aa, Homo Sapiens
RICNWVSAN

SEQ ID NO: 248399 - protein, 9 aa, Homo Sapiens
EICITSITT

SEQ ID NO: 248400 - protein, 9 aa, Homo Sapiens
QFEEKNIAL

SEQ ID NO: 248401 - protein, 9 aa, Homo Sapiens
CQMLIQENQ

SEQ ID NO: 248402 - protein, 9 aa, Homo Sapiens
AIVVYTAYV

SEQ ID NO: 248403 - protein, 9 aa, Homo Sapiens
DIWFRQFNK

SEQ ID NO: 248404 - protein, 9 aa, Homo Sapiens
CQQQQIEAQ

SEQ ID NO: 248405 - protein, 9 aa, Homo Sapiens
QKYFYRGCL

SEQ ID NO: 248406 - protein, 9 aa, Homo Sapiens
RLYNATNGR

SEQ ID NO: 248407 - protein, 9 aa, Homo Sapiens
QTSYRGSLF

SEQ ID NO: 248408 - protein, 9 aa, Homo Sapiens
SRDSYSSPS

SEQ ID NO: 248409 - protein, 9 aa, Homo Sapiens
NNHVFCLIC

SEQ ID NO: 248410 - protein, 9 aa, Homo Sapiens
RYHRLPLPK

SEQ ID NO: 248411 - protein, 9 aa, Homo Sapiens
MGLFETGSY

SEQ ID NO: 248412 - protein, 9 aa, Homo Sapiens
VHLDDSSSF

SEQ ID NO: 248413 - protein, 9 aa, Homo Sapiens
LLKTASENA

SEQ ID NO: 248414 - protein, 9 aa, Homo Sapiens
CAADKYWRF

SEQ ID NO: 248415 - protein, 9 aa, Homo Sapiens
TLEGHSKCV

SEQ ID NO: 248416 - protein, 9 aa, Homo Sapiens
FKQCFRDFC

SEQ ID NO: 248417 - protein, 9 aa, Homo Sapiens
RMVKFLINK

SEQ ID NO: 248418 - protein, 9 aa, Homo Sapiens
FQPMLIEYF

SEQ ID NO: 248419 - protein, 9 aa, Homo Sapiens
LQQSSVQDL

SEQ ID NO: 248420 - protein, 9 aa, Homo Sapiens
DKLAALLPE

SEQ ID NO: 248421 - protein, 9 aa, Homo Sapiens
ESTWWFTSF

SEQ ID NO: 248422 - protein, 9 aa, Homo Sapiens
IDMPGAAHG

SEQ ID NO: 248423 - protein, 9 aa, Homo Sapiens
FGLKVTGKS

SEQ ID NO: 248424 - protein, 9 aa, Homo Sapiens
VVLFAIYLI

SEQ ID NO: 248425 - protein, 9 aa, Homo Sapiens
LANRLSEHI

SEQ ID NO: 248426 - protein, 9 aa, Homo Sapiens
HVTIPKEQY

SEQ ID NO: 248427 - protein, 9 aa, Homo Sapiens
YIFHQCKDN

SEQ ID NO: 248428 - protein, 9 aa, Homo Sapiens
TICTSSIMP

SEQ ID NO: 248429 - protein, 9 aa, Homo Sapiens
TPLPENPCY

SEQ ID NO: 248430 - protein, 9 aa, Homo Sapiens
LFGLTEFQR

SEQ ID NO: 248431 - protein, 9 aa, Homo Sapiens
NEEVDKDYQ

SEQ ID NO: 248432 - protein, 9 aa, Homo Sapiens
KAFRKPYIF

SEQ ID NO: 248433 - protein, 9 aa, Homo Sapiens
PLTGKFTAA

SEQ ID NO: 248434 - protein, 9 aa, Homo Sapiens
GEIINAGSQ

SEQ ID NO: 248435 - protein, 9 aa, Homo Sapiens
FMLADFDGV

SEQ ID NO: 248436 - protein, 9 aa, Homo Sapiens
CISALFMLF

SEQ ID NO: 248437 - protein, 9 aa, Homo Sapiens
ELRKDKRHL

SEQ ID NO: 248438 - protein, 9 aa, Homo Sapiens
KDVRAYQQL

SEQ ID NO: 248439 - protein, 9 aa, Homo Sapiens
FRRLRALCS

SEQ ID NO: 248440 - protein, 9 aa, Homo Sapiens
QFNLLYRFW

SEQ ID NO: 248441 - protein, 9 aa, Homo Sapiens
VSVSAFFFS

SEQ ID NO: 248442 - protein, 9 aa, Homo Sapiens
ARRAPQDFE

SEQ ID NO: 248443 - protein, 9 aa, Homo Sapiens
NRLPKDHRE

SEQ ID NO: 248444 - protein, 9 aa, Homo Sapiens
ILTPVFVRC

SEQ ID NO: 248445 - protein, 9 aa, Homo Sapiens
YEKLFTVEP

SEQ ID NO: 248446 - protein, 9 aa, Homo Sapiens
RDIFAQQRD

SEQ ID NO: 248447 - protein, 9 aa, Homo Sapiens
NVTATYTRH

SEQ ID NO: 248448 - protein, 9 aa, Homo Sapiens
DSCPPVPGG

SEQ ID NO: 248449 - protein, 9 aa, Homo Sapiens
IFGGEQFML

SEQ ID NO: 248450 - protein, 9 aa, Homo Sapiens
DNSAFMEPR

SEQ ID NO: 248451 - protein, 9 aa, Homo Sapiens
MQIVLEGKK

SEQ ID NO: 248452 - protein, 9 aa, Homo Sapiens
PFQFGQPSL

SEQ ID NO: 248453 - protein, 9 aa, Homo Sapiens
LCTFGFYEV

SEQ ID NO: 248454 - protein, 9 aa, Homo Sapiens
WTAPEAINV

SEQ ID NO: 248455 - protein, 9 aa, Homo Sapiens
MLFRFGQHL

SEQ ID NO: 248456 - protein, 9 aa, Homo Sapiens
FSELVLTLN

SEQ ID NO: 248457 - protein, 9 aa, Homo Sapiens
SKDLKGGGG

SEQ ID NO: 248458 - protein, 9 aa, Homo Sapiens
TFIKGVYGP

SEQ ID NO: 248459 - protein, 9 aa, Homo Sapiens
QPRHISVVM

SEQ ID NO: 248460 - protein, 9 aa, Homo Sapiens
EQWDNIYHA

SEQ ID NO: 248461 - protein, 9 aa, Homo Sapiens
IMNAKDVVA

SEQ ID NO: 248462 - protein, 9 aa, Homo Sapiens
TDTYNKILQ

SEQ ID NO: 248463 - protein, 9 aa, Homo Sapiens
NGQHFRSIP

SEQ ID NO: 248464 - protein, 9 aa, Homo Sapiens
KFHMPEDVQ

SEQ ID NO: 248465 - protein, 9 aa, Homo Sapiens
DCLAPGVSS

SEQ ID NO: 248466 - protein, 9 aa, Homo Sapiens
NRITVSHLW

SEQ ID NO: 248467 - protein, 9 aa, Homo Sapiens
AKGRWITNP

SEQ ID NO: 248468 - protein, 9 aa, Homo Sapiens
VESIVTLNV

SEQ ID NO: 248469 - protein, 9 aa, Homo Sapiens
RYFFQTLSL

SEQ ID NO: 248470 - protein, 9 aa, Homo Sapiens
DDGKAILDS

SEQ ID NO: 248471 - protein, 9 aa, Homo Sapiens
VPSYDPLKI

SEQ ID NO: 248472 - protein, 9 aa, Homo Sapiens
ETGSYNGVL

SEQ ID NO: 248473 - protein, 9 aa, Homo Sapiens
ILRKETAKK

SEQ ID NO: 248474 - protein, 9 aa, Homo Sapiens
FGLANKKRA

SEQ ID NO: 248475 - protein, 9 aa, Homo Sapiens
LMVCLGTFF

SEQ ID NO: 248476 - protein, 9 aa, Homo Sapiens
ASGAYIVFG

SEQ ID NO: 248477 - protein, 9 aa, Homo Sapiens
IFSIRPLSC

SEQ ID NO: 248478 - protein, 9 aa, Homo Sapiens
PLLRCPLQR

SEQ ID NO: 248479 - protein, 9 aa, Homo Sapiens
KVSKDDCSD

SEQ ID NO: 248480 - protein, 9 aa, Homo Sapiens
EFWLLGNKE

SEQ ID NO: 248481 - protein, 9 aa, Homo Sapiens
ENSSTHSSP

SEQ ID NO: 248482 - protein, 9 aa, Homo Sapiens
MYTHLWENV

SEQ ID NO: 248483 - protein, 9 aa, Homo Sapiens
DFTSQCLKN

SEQ ID NO: 248484 - protein, 9 aa, Homo Sapiens
SWFGHIKGW

SEQ ID NO: 248485 - protein, 9 aa, Homo Sapiens
NGHIKIWDV

SEQ ID NO: 248486 - protein, 9 aa, Homo Sapiens
LLKEFIKPE

SEQ ID NO: 248487 - protein, 9 aa, Homo Sapiens
YVKYLYLDN

SEQ ID NO: 248488 - protein, 9 aa, Homo Sapiens
MDFENLLSK

SEQ ID NO: 248489 - protein, 9 aa, Homo Sapiens
VFQILICNR

SEQ ID NO: 248490 - protein, 9 aa, Homo Sapiens
KMALLPLLQ

SEQ ID NO: 248491 - protein, 9 aa, Homo Sapiens
NPMHNWSPD

SEQ ID NO: 248492 - protein, 9 aa, Homo Sapiens
GISKIMDDD

SEQ ID NO: 248493 - protein, 9 aa, Homo Sapiens
AVQNISIET

SEQ ID NO: 248494 - protein, 9 aa, Homo Sapiens
GATRRGYFG

SEQ ID NO: 248495 - protein, 9 aa, Homo Sapiens
SSTSSYSSQ

SEQ ID NO: 248496 - protein, 9 aa, Homo Sapiens
SLQENKIKT

SEQ ID NO: 248497 - protein, 9 aa, Homo Sapiens
IKSFDSVLK

SEQ ID NO: 248498 - protein, 9 aa, Homo Sapiens
DTYDPYLIA

SEQ ID NO: 248499 - protein, 9 aa, Homo Sapiens
LHLEIHGAM

SEQ ID NO: 248500 - protein, 9 aa, Homo Sapiens
KTYFCAADK

SEQ ID NO: 248501 - protein, 9 aa, Homo Sapiens
EDCCKKCQD

SEQ ID NO: 248502 - protein, 9 aa, Homo Sapiens
NIYSRHKMY

SEQ ID NO: 248503 - protein, 9 aa, Homo Sapiens
GKKNISFLC

SEQ ID NO: 248504 - protein, 9 aa, Homo Sapiens
SIMKKRCGS

SEQ ID NO: 248505 - protein, 9 aa, Homo Sapiens
GEKCACYKI

SEQ ID NO: 248506 - protein, 9 aa, Homo Sapiens
NHSLLFLLC

SEQ ID NO: 248507 - protein, 9 aa, Homo Sapiens
SPSLLSNNS

SEQ ID NO: 248508 - protein, 9 aa, Homo Sapiens
ITQFWLYFA

SEQ ID NO: 248509 - protein, 9 aa, Homo Sapiens
ENLSPNQTK

SEQ ID NO: 248510 - protein, 9 aa, Homo Sapiens
KMAYLARKV

SEQ ID NO: 248511 - protein, 9 aa, Homo Sapiens
LGLKLQRFL

SEQ ID NO: 248512 - protein, 9 aa, Homo Sapiens
HKHIKEKQH

SEQ ID NO: 248513 - protein, 9 aa, Homo Sapiens
LHDFLEDVY

SEQ ID NO: 248514 - protein, 9 aa, Homo Sapiens
EHLFIPLPF

SEQ ID NO: 248515 - protein, 9 aa, Homo Sapiens
VQETMQEKA

SEQ ID NO: 248516 - protein, 9 aa, Homo Sapiens
ELYGEKHAS

SEQ ID NO: 248517 - protein, 9 aa, Homo Sapiens
LVINKAIHT

SEQ ID NO: 248518 - protein, 9 aa, Homo Sapiens
EIPLELQRR

SEQ ID NO: 248519 - protein, 9 aa, Homo Sapiens
HKTSNADIK

SEQ ID NO: 248520 - protein, 9 aa, Homo Sapiens
HLISSPFPE

SEQ ID NO: 248521 - protein, 9 aa, Homo Sapiens
QDSESTEIS

SEQ ID NO: 248522 - protein, 9 aa, Homo Sapiens
LASLSQLWR

SEQ ID NO: 248523 - protein, 9 aa, Homo Sapiens
ILFRWCDIQ

SEQ ID NO: 248524 - protein, 9 aa, Homo Sapiens
KTTIVPVED

SEQ ID NO: 248525 - protein, 9 aa, Homo Sapiens
DCHESGNIL

SEQ ID NO: 248526 - protein, 9 aa, Homo Sapiens
IQYCTQELT

SEQ ID NO: 248527 - protein, 9 aa, Homo Sapiens
EERMHDEIL

SEQ ID NO: 248528 - protein, 9 aa, Homo Sapiens
SREKKERLS

SEQ ID NO: 248529 - protein, 9 aa, Homo Sapiens
FITVPFMLI

SEQ ID NO: 248530 - protein, 9 aa, Homo Sapiens
PRAAENMAV

SEQ ID NO: 248531 - protein, 9 aa, Homo Sapiens
GEGSYESVF

SEQ ID NO: 248532 - protein, 9 aa, Homo Sapiens
RFQEFFAAM

SEQ ID NO: 248533 - protein, 9 aa, Homo Sapiens
SPAASALIQ

SEQ ID NO: 248534 - protein, 9 aa, Homo Sapiens
QGEKEEYKW

SEQ ID NO: 248535 - protein, 9 aa, Homo Sapiens
QSHQSLVAQ

SEQ ID NO: 248536 - protein, 9 aa, Homo Sapiens
PSRGAPRGA

SEQ ID NO: 248537 - protein, 9 aa, Homo Sapiens
GEVEILDPN

SEQ ID NO: 248538 - protein, 9 aa, Homo Sapiens
FITLHDYTT

SEQ ID NO: 248539 - protein, 9 aa, Homo Sapiens
LYVIFEYRA

SEQ ID NO: 248540 - protein, 9 aa, Homo Sapiens
PAPHLHFSI

SEQ ID NO: 248541 - protein, 9 aa, Homo Sapiens
IIRKFSAKY

SEQ ID NO: 248542 - protein, 9 aa, Homo Sapiens
RLFQDRMIA

SEQ ID NO: 248543 - protein, 9 aa, Homo Sapiens
MTDDITTSL

SEQ ID NO: 248544 - protein, 9 aa, Homo Sapiens
LYRQNRFAS

SEQ ID NO: 248545 - protein, 9 aa, Homo Sapiens
NAKTFYTDL

SEQ ID NO: 248546 - protein, 9 aa, Homo Sapiens
NPGSNKPER

SEQ ID NO: 248547 - protein, 9 aa, Homo Sapiens
PATTSFQYP

SEQ ID NO: 248548 - protein, 9 aa, Homo Sapiens
SVDNENYAR

SEQ ID NO: 248549 - protein, 9 aa, Homo Sapiens
FSSPTSRME

SEQ ID NO: 248550 - protein, 9 aa, Homo Sapiens
AMAPHYVPY

SEQ ID NO: 248551 - protein, 9 aa, Homo Sapiens
PVQYNAQKS

SEQ ID NO: 248552 - protein, 9 aa, Homo Sapiens
VLKEVIPEG

SEQ ID NO: 248553 - protein, 9 aa, Homo Sapiens
RGPQMCRCL

SEQ ID NO: 248554 - protein, 9 aa, Homo Sapiens
VWFKYSVGV

SEQ ID NO: 248555 - protein, 9 aa, Homo Sapiens
TNLCDLITR

SEQ ID NO: 248556 - protein, 9 aa, Homo Sapiens
YFSWLLFCA

SEQ ID NO: 248557 - protein, 9 aa, Homo Sapiens
CLDMYGEKY

SEQ ID NO: 248558 - protein, 9 aa, Homo Sapiens
IEEAQSQAN

SEQ ID NO: 248559 - protein, 9 aa, Homo Sapiens
KEKYSEKEK

SEQ ID NO: 248560 - protein, 9 aa, Homo Sapiens
TKYCKTWQD

SEQ ID NO: 248561 - protein, 9 aa, Homo Sapiens
LNEYQSNEM

SEQ ID NO: 248562 - protein, 9 aa, Homo Sapiens
LRLPFIGFT

SEQ ID NO: 248563 - protein, 9 aa, Homo Sapiens
FVQLLASVS

SEQ ID NO: 248564 - protein, 9 aa, Homo Sapiens
TLNHVYNEA

SEQ ID NO: 248565 - protein, 9 aa, Homo Sapiens
SSLVLYLGS

SEQ ID NO: 248566 - protein, 9 aa, Homo Sapiens
FKEEPDPGF

SEQ ID NO: 248567 - protein, 9 aa, Homo Sapiens
CHFLRLHIH

SEQ ID NO: 248568 - protein, 9 aa, Homo Sapiens
TMNVTGQLG

SEQ ID NO: 248569 - protein, 9 aa, Homo Sapiens
SFSLTMYIE

SEQ ID NO: 248570 - protein, 9 aa, Homo Sapiens
SFERMNVDK

SEQ ID NO: 248571 - protein, 9 aa, Homo Sapiens
RKLFDKTCT

SEQ ID NO: 248572 - protein, 9 aa, Homo Sapiens
PMIKKAHKV

SEQ ID NO: 248573 - protein, 9 aa, Homo Sapiens
QSVNHTKRK

SEQ ID NO: 248574 - protein, 9 aa, Homo Sapiens
EVAEVEMGT

SEQ ID NO: 248575 - protein, 9 aa, Homo Sapiens
SIPAYTMPL

SEQ ID NO: 248576 - protein, 9 aa, Homo Sapiens
PGMLASYQS

SEQ ID NO: 248577 - protein, 9 aa, Homo Sapiens
SVKINDLSI

SEQ ID NO: 248578 - protein, 9 aa, Homo Sapiens
HKLQAHIGL

SEQ ID NO: 248579 - protein, 9 aa, Homo Sapiens
TAVILASYA

SEQ ID NO: 248580 - protein, 9 aa, Homo Sapiens
SLNKGNKLM

SEQ ID NO: 248581 - protein, 9 aa, Homo Sapiens
TKLAQYVGS

SEQ ID NO: 248582 - protein, 9 aa, Homo Sapiens
RPQFLLILA

SEQ ID NO: 248583 - protein, 9 aa, Homo Sapiens
EENSKVMDV

SEQ ID NO: 248584 - protein, 9 aa, Homo Sapiens
NLLAMSLQN

SEQ ID NO: 248585 - protein, 9 aa, Homo Sapiens
KVKLCEKMA

SEQ ID NO: 248586 - protein, 9 aa, Homo Sapiens
FFVERNIIS

SEQ ID NO: 248587 - protein, 9 aa, Homo Sapiens
ARQLEAALD

SEQ ID NO: 248588 - protein, 9 aa, Homo Sapiens
KSPHNEREN

SEQ ID NO: 248589 - protein, 9 aa, Homo Sapiens
LSMTEHVLG

SEQ ID NO: 248590 - protein, 9 aa, Homo Sapiens
VCGTPTYMA

SEQ ID NO: 248591 - protein, 9 aa, Homo Sapiens
KVQGIGWHL

SEQ ID NO: 248592 - protein, 9 aa, Homo Sapiens
RRLTDTYNK

SEQ ID NO: 248593 - protein, 9 aa, Homo Sapiens
SSTKPENYD

SEQ ID NO: 248594 - protein, 9 aa, Homo Sapiens
IHKKRIIEK

SEQ ID NO: 248595 - protein, 9 aa, Homo Sapiens
QINKQHEVE

SEQ ID NO: 248596 - protein, 9 aa, Homo Sapiens
RPPRGPGRS

SEQ ID NO: 248597 - protein, 9 aa, Homo Sapiens
IKITDFGIS

SEQ ID NO: 248598 - protein, 9 aa, Homo Sapiens
IERIQGLDV

SEQ ID NO: 248599 - protein, 9 aa, Homo Sapiens
PLSNEEQNL

SEQ ID NO: 248600 - protein, 9 aa, Homo Sapiens
FIDTDTLIT

SEQ ID NO: 248601 - protein, 9 aa, Homo Sapiens
SKKLKRSNP

SEQ ID NO: 248602 - protein, 9 aa, Homo Sapiens
IGNGQAGVQ

SEQ ID NO: 248603 - protein, 9 aa, Homo Sapiens
AFVCQSTLI

SEQ ID NO: 248604 - protein, 9 aa, Homo Sapiens
VENRRNRER

SEQ ID NO: 248605 - protein, 9 aa, Homo Sapiens
DISVETEGN

SEQ ID NO: 248606 - protein, 9 aa, Homo Sapiens
PLQVRLDRS

SEQ ID NO: 248607 - protein, 9 aa, Homo Sapiens
DSGIVMQII

SEQ ID NO: 248608 - protein, 9 aa, Homo Sapiens
NNIRYLIQF

SEQ ID NO: 248609 - protein, 9 aa, Homo Sapiens
LELIKGTLV

SEQ ID NO: 248610 - protein, 9 aa, Homo Sapiens
VVQGLEVLR

SEQ ID NO: 248611 - protein, 9 aa, Homo Sapiens
TEPECYFPD

SEQ ID NO: 248612 - protein, 9 aa, Homo Sapiens
FTDKWNTDN

SEQ ID NO: 248613 - protein, 9 aa, Homo Sapiens
IYWNLDNYP

SEQ ID NO: 248614 - protein, 9 aa, Homo Sapiens
KDCKIRLFI

SEQ ID NO: 248615 - protein, 9 aa, Homo Sapiens
RSRPGSHKA

SEQ ID NO: 248616 - protein, 9 aa, Homo Sapiens
SILNANNRR

SEQ ID NO: 248617 - protein, 9 aa, Homo Sapiens
LSVLRMIKS

SEQ ID NO: 248618 - protein, 9 aa, Homo Sapiens
SAEEEDNFV

SEQ ID NO: 248619 - protein, 9 aa, Homo Sapiens
FVIQMDLSA

SEQ ID NO: 248620 - protein, 9 aa, Homo Sapiens
FLLLGLSDL

SEQ ID NO: 248621 - protein, 9 aa, Homo Sapiens
DCAANTLIE

SEQ ID NO: 248622 - protein, 9 aa, Homo Sapiens
EVSHKRVVC

SEQ ID NO: 248623 - protein, 9 aa, Homo Sapiens
ENAVLQQLV

SEQ ID NO: 248624 - protein, 9 aa, Homo Sapiens
LNINTSDEG

SEQ ID NO: 248625 - protein, 9 aa, Homo Sapiens
YMSPELRCM

SEQ ID NO: 248626 - protein, 9 aa, Homo Sapiens
ISQEPDPGV

SEQ ID NO: 248627 - protein, 9 aa, Homo Sapiens
RSEAERQAQ

SEQ ID NO: 248628 - protein, 9 aa, Homo Sapiens
YFMSKALGI

SEQ ID NO: 248629 - protein, 9 aa, Homo Sapiens
NLLLISLAH

SEQ ID NO: 248630 - protein, 9 aa, Homo Sapiens
SAVGHGLWT

SEQ ID NO: 248631 - protein, 9 aa, Homo Sapiens
FPVGSEDKN

SEQ ID NO: 248632 - protein, 9 aa, Homo Sapiens
SGYRADLWM

SEQ ID NO: 248633 - protein, 9 aa, Homo Sapiens
EEERKLFLV

SEQ ID NO: 248634 - protein, 9 aa, Homo Sapiens
QLDSEGIFL

SEQ ID NO: 248635 - protein, 9 aa, Homo Sapiens
ANYYEEIVF

SEQ ID NO: 248636 - protein, 9 aa, Homo Sapiens
NYFDATESK

SEQ ID NO: 248637 - protein, 9 aa, Homo Sapiens
TLNQFGTPQ

SEQ ID NO: 248638 - protein, 9 aa, Homo Sapiens
MKQIDNVAA

SEQ ID NO: 248639 - protein, 9 aa, Homo Sapiens
VVTDGEIIL

SEQ ID NO: 248640 - protein, 9 aa, Homo Sapiens
QFQDLTGIK

SEQ ID NO: 248641 - protein, 9 aa, Homo Sapiens
AWFFLPSLS

SEQ ID NO: 248642 - protein, 9 aa, Homo Sapiens
IQVQIGALE

SEQ ID NO: 248643 - protein, 9 aa, Homo Sapiens
AGNVFVLEM

SEQ ID NO: 248644 - protein, 9 aa, Homo Sapiens
PSLGHVPRR

SEQ ID NO: 248645 - protein, 9 aa, Homo Sapiens
GFKYLHECL

SEQ ID NO: 248646 - protein, 9 aa, Homo Sapiens
DVQNNKHRY

SEQ ID NO: 248647 - protein, 9 aa, Homo Sapiens
WELRQQLDL

SEQ ID NO: 248648 - protein, 9 aa, Homo Sapiens
REIVQDIKE

SEQ ID NO: 248649 - protein, 9 aa, Homo Sapiens
LYLVQIRQK

SEQ ID NO: 248650 - protein, 9 aa, Homo Sapiens
IGASVMTKT

SEQ ID NO: 248651 - protein, 9 aa, Homo Sapiens
SAESDQLIN

SEQ ID NO: 248652 - protein, 9 aa, Homo Sapiens
KYVVSGFNV

SEQ ID NO: 248653 - protein, 9 aa, Homo Sapiens
CFKEVNYLH

SEQ ID NO: 248654 - protein, 9 aa, Homo Sapiens
ALSFTEEGY

SEQ ID NO: 248655 - protein, 9 aa, Homo Sapiens
CSECGNAFI

SEQ ID NO: 248656 - protein, 9 aa, Homo Sapiens
NSEPENRPS

SEQ ID NO: 248657 - protein, 9 aa, Homo Sapiens
CGDCEKIFN

SEQ ID NO: 248658 - protein, 9 aa, Homo Sapiens
CIKLLGEIM

SEQ ID NO: 248659 - protein, 9 aa, Homo Sapiens
ASGQRTVFL

SEQ ID NO: 248660 - protein, 9 aa, Homo Sapiens
CSSPDLQRN

SEQ ID NO: 248661 - protein, 9 aa, Homo Sapiens
GVAQNNYFN

SEQ ID NO: 248662 - protein, 9 aa, Homo Sapiens
WSKEKTCDC

SEQ ID NO: 248663 - protein, 9 aa, Homo Sapiens
KLRSGSYFS

SEQ ID NO: 248664 - protein, 9 aa, Homo Sapiens
RLFGHGAED

SEQ ID NO: 248665 - protein, 9 aa, Homo Sapiens
PLKIDEVYK

SEQ ID NO: 248666 - protein, 9 aa, Homo Sapiens
DLDKKKKEP

SEQ ID NO: 248667 - protein, 9 aa, Homo Sapiens
FEEEKLVIS

SEQ ID NO: 248668 - protein, 9 aa, Homo Sapiens
RDLKIIYLQ

SEQ ID NO: 248669 - protein, 9 aa, Homo Sapiens
HVRDTLREI

SEQ ID NO: 248670 - protein, 9 aa, Homo Sapiens
HNAGPIANY

SEQ ID NO: 248671 - protein, 9 aa, Homo Sapiens
SSLLINSRR

SEQ ID NO: 248672 - protein, 9 aa, Homo Sapiens
SPQAVPTSS

SEQ ID NO: 248673 - protein, 9 aa, Homo Sapiens
HDRALVKHK

SEQ ID NO: 248674 - protein, 9 aa, Homo Sapiens
RVHTGDKPY

SEQ ID NO: 248675 - protein, 9 aa, Homo Sapiens
FHMAADTLL

SEQ ID NO: 248676 - protein, 9 aa, Homo Sapiens
WLRSKFGTV

SEQ ID NO: 248677 - protein, 9 aa, Homo Sapiens
QDTQTLKRL

SEQ ID NO: 248678 - protein, 9 aa, Homo Sapiens
RVHTGDKPF

SEQ ID NO: 248679 - protein, 9 aa, Homo Sapiens
PREEAGVPS

SEQ ID NO: 248680 - protein, 9 aa, Homo Sapiens
IIDNLKDVQ

SEQ ID NO: 248681 - protein, 9 aa, Homo Sapiens
HRIHTGNKP

SEQ ID NO: 248682 - protein, 9 aa, Homo Sapiens
LTVFKKTVS

SEQ ID NO: 248683 - protein, 9 aa, Homo Sapiens
TDISAADKA

SEQ ID NO: 248684 - protein, 9 aa, Homo Sapiens
NFDLKVLSA

SEQ ID NO: 248685 - protein, 9 aa, Homo Sapiens
EALHFSFSQ

SEQ ID NO: 248686 - protein, 9 aa, Homo Sapiens
YGEILSPTY

SEQ ID NO: 248687 - protein, 9 aa, Homo Sapiens
HHDKLSVFC

SEQ ID NO: 248688 - protein, 9 aa, Homo Sapiens
EPDIAVPTF

SEQ ID NO: 248689 - protein, 9 aa, Homo Sapiens
IKIAVIRAL

SEQ ID NO: 248690 - protein, 9 aa, Homo Sapiens
CNCGPGLLC

SEQ ID NO: 248691 - protein, 9 aa, Homo Sapiens
GTLFHKSGV

SEQ ID NO: 248692 - protein, 9 aa, Homo Sapiens
APLYHINLH

SEQ ID NO: 248693 - protein, 9 aa, Homo Sapiens
GMAGLLGTL

SEQ ID NO: 248694 - protein, 9 aa, Homo Sapiens
YEALQAFKF

SEQ ID NO: 248695 - protein, 9 aa, Homo Sapiens
KWELRQQLD

SEQ ID NO: 248696 - protein, 9 aa, Homo Sapiens
FEKCGHDNL

SEQ ID NO: 248697 - protein, 9 aa, Homo Sapiens
HNIKLLNKI

SEQ ID NO: 248698 - protein, 9 aa, Homo Sapiens
SLVTADSLP

SEQ ID NO: 248699 - protein, 9 aa, Homo Sapiens
PTVESLPCD

SEQ ID NO: 248700 - protein, 9 aa, Homo Sapiens
KPVAFSYYI

SEQ ID NO: 248701 - protein, 9 aa, Homo Sapiens
KLINGKQQT

SEQ ID NO: 248702 - protein, 9 aa, Homo Sapiens
LLGLIRAKR

SEQ ID NO: 248703 - protein, 9 aa, Homo Sapiens
PGGILIMDL

SEQ ID NO: 248704 - protein, 9 aa, Homo Sapiens
MRANEKTTL

SEQ ID NO: 248705 - protein, 9 aa, Homo Sapiens
SPTYPQAYP

SEQ ID NO: 248706 - protein, 9 aa, Homo Sapiens
RYPAVSLRH

SEQ ID NO: 248707 - protein, 9 aa, Homo Sapiens
IEGVLLFNY

SEQ ID NO: 248708 - protein, 9 aa, Homo Sapiens
IKGANILRN

SEQ ID NO: 248709 - protein, 9 aa, Homo Sapiens
LDMLVMEQL

SEQ ID NO: 248710 - protein, 9 aa, Homo Sapiens
LDGTNWQAV

SEQ ID NO: 248711 - protein, 9 aa, Homo Sapiens
LDLKSNNIH

SEQ ID NO: 248712 - protein, 9 aa, Homo Sapiens
CRLFCCAVL

SEQ ID NO: 248713 - protein, 9 aa, Homo Sapiens
PFMLADFDG

SEQ ID NO: 248714 - protein, 9 aa, Homo Sapiens
MKKDLVMPN

SEQ ID NO: 248715 - protein, 9 aa, Homo Sapiens
FLDRLGQRV

SEQ ID NO: 248716 - protein, 9 aa, Homo Sapiens
NTLKAASGT

SEQ ID NO: 248717 - protein, 9 aa, Homo Sapiens
ATDTSFKNT

SEQ ID NO: 248718 - protein, 9 aa, Homo Sapiens
RSIQNQKAF

SEQ ID NO: 248719 - protein, 9 aa, Homo Sapiens
NSVIFRSNY

SEQ ID NO: 248720 - protein, 9 aa, Homo Sapiens
SGLCAIVGV

SEQ ID NO: 248721 - protein, 9 aa, Homo Sapiens
FNFVEKVQW

SEQ ID NO: 248722 - protein, 9 aa, Homo Sapiens
VHLCCEFLT

SEQ ID NO: 248723 - protein, 9 aa, Homo Sapiens
DVTIELSLE

SEQ ID NO: 248724 - protein, 9 aa, Homo Sapiens
ITVSLSQML

SEQ ID NO: 248725 - protein, 9 aa, Homo Sapiens
MFLELEKGV

SEQ ID NO: 248726 - protein, 9 aa, Homo Sapiens
ILVGNQFTC

SEQ ID NO: 248727 - protein, 9 aa, Homo Sapiens
PSTFTYHKI

SEQ ID NO: 248728 - protein, 9 aa, Homo Sapiens
TDFSGSSFK

SEQ ID NO: 248729 - protein, 9 aa, Homo Sapiens
GQENAIESL

SEQ ID NO: 248730 - protein, 9 aa, Homo Sapiens
QEQQEILLQ

SEQ ID NO: 248731 - protein, 9 aa, Homo Sapiens
SPLRNIPLF

SEQ ID NO: 248732 - protein, 9 aa, Homo Sapiens
WQNIFSFNV

SEQ ID NO: 248733 - protein, 9 aa, Homo Sapiens
HKEKVIMVE

SEQ ID NO: 248734 - protein, 9 aa, Homo Sapiens
CQNVQDFKR

SEQ ID NO: 248735 - protein, 9 aa, Homo Sapiens
LEDVSRVLI

SEQ ID NO: 248736 - protein, 9 aa, Homo Sapiens
DGSSVAMSH

SEQ ID NO: 248737 - protein, 9 aa, Homo Sapiens
IRKSGGHSR

SEQ ID NO: 248738 - protein, 9 aa, Homo Sapiens
RQEKNWLDI

SEQ ID NO: 248739 - protein, 9 aa, Homo Sapiens
EENKKGGER

SEQ ID NO: 248740 - protein, 9 aa, Homo Sapiens
LLHPNMAAR

SEQ ID NO: 248741 - protein, 9 aa, Homo Sapiens
NKIIDRVLN

SEQ ID NO: 248742 - protein, 9 aa, Homo Sapiens
LVRSSFNSC

SEQ ID NO: 248743 - protein, 9 aa, Homo Sapiens
YRLSNANKQ

SEQ ID NO: 248744 - protein, 9 aa, Homo Sapiens
FFRGNVTIK

SEQ ID NO: 248745 - protein, 9 aa, Homo Sapiens
LPNTALISL

SEQ ID NO: 248746 - protein, 9 aa, Homo Sapiens
KANEAVKSE

SEQ ID NO: 248747 - protein, 9 aa, Homo Sapiens
KKHRRKLRQ

SEQ ID NO: 248748 - protein, 9 aa, Homo Sapiens
VGFAGVIAL

SEQ ID NO: 248749 - protein, 9 aa, Homo Sapiens
EYKEKGRKL

SEQ ID NO: 248750 - protein, 9 aa, Homo Sapiens
VAVEAPVRE

SEQ ID NO: 248751 - protein, 9 aa, Homo Sapiens
MLSFLLFPQ

SEQ ID NO: 248752 - protein, 9 aa, Homo Sapiens
GGQPLDILT

SEQ ID NO: 248753 - protein, 9 aa, Homo Sapiens
VLMPEVTPD

SEQ ID NO: 248754 - protein, 9 aa, Homo Sapiens
YPLYVLKVF

SEQ ID NO: 248755 - protein, 9 aa, Homo Sapiens
FLQLVRLDL

SEQ ID NO: 248756 - protein, 9 aa, Homo Sapiens
GQVSCNINI

SEQ ID NO: 248757 - protein, 9 aa, Homo Sapiens
PPTLAITYS

SEQ ID NO: 248758 - protein, 9 aa, Homo Sapiens
ARNNVTQAL

SEQ ID NO: 248759 - protein, 9 aa, Homo Sapiens
GCRLFCCAV

SEQ ID NO: 248760 - protein, 9 aa, Homo Sapiens
TRLILDPVL

SEQ ID NO: 248761 - protein, 9 aa, Homo Sapiens
PEALRMVWV

SEQ ID NO: 248762 - protein, 9 aa, Homo Sapiens
IGMLGYPGY

SEQ ID NO: 248763 - protein, 9 aa, Homo Sapiens
RAKIKEDIE

SEQ ID NO: 248764 - protein, 9 aa, Homo Sapiens
NGFIEIIIP

SEQ ID NO: 248765 - protein, 9 aa, Homo Sapiens
QNNLYRDVM

SEQ ID NO: 248766 - protein, 9 aa, Homo Sapiens
LVQEFPQLI

SEQ ID NO: 248767 - protein, 9 aa, Homo Sapiens
PHLTIPTVV

SEQ ID NO: 248768 - protein, 9 aa, Homo Sapiens
VPISGPGFK

SEQ ID NO: 248769 - protein, 9 aa, Homo Sapiens
VDNMVLLSK

SEQ ID NO: 248770 - protein, 9 aa, Homo Sapiens
AVLGPGLPW

SEQ ID NO: 248771 - protein, 9 aa, Homo Sapiens
IGWHLDEKN

SEQ ID NO: 248772 - protein, 9 aa, Homo Sapiens
AKREMGMYS

SEQ ID NO: 248773 - protein, 9 aa, Homo Sapiens
KDHALRWRS

SEQ ID NO: 248774 - protein, 9 aa, Homo Sapiens
MLANIFNTD

SEQ ID NO: 248775 - protein, 9 aa, Homo Sapiens
RFNSDSQAV

SEQ ID NO: 248776 - protein, 9 aa, Homo Sapiens
KYIFSLEER

SEQ ID NO: 248777 - protein, 9 aa, Homo Sapiens
TEANTGNMV

SEQ ID NO: 248778 - protein, 9 aa, Homo Sapiens
KSLQLKSKG

SEQ ID NO: 248779 - protein, 9 aa, Homo Sapiens
MVCAGYLNG

SEQ ID NO: 248780 - protein, 9 aa, Homo Sapiens
GLELKTINY

SEQ ID NO: 248781 - protein, 9 aa, Homo Sapiens
ICHSKESGD

SEQ ID NO: 248782 - protein, 9 aa, Homo Sapiens
MDTFLIREM

SEQ ID NO: 248783 - protein, 9 aa, Homo Sapiens
QLALKGKLN

SEQ ID NO: 248784 - protein, 9 aa, Homo Sapiens
IVGSLPGLR

SEQ ID NO: 248785 - protein, 9 aa, Homo Sapiens
PKHLNLATD

SEQ ID NO: 248786 - protein, 9 aa, Homo Sapiens
YIVIQVKRL

SEQ ID NO: 248787 - protein, 9 aa, Homo Sapiens
HLVFGFIDH

SEQ ID NO: 248788 - protein, 9 aa, Homo Sapiens
EAKVGQDSE

SEQ ID NO: 248789 - protein, 9 aa, Homo Sapiens
GDQDKTDQL

SEQ ID NO: 248790 - protein, 9 aa, Homo Sapiens
TNVDMILKF

SEQ ID NO: 248791 - protein, 9 aa, Homo Sapiens
LDTQDAEAR

SEQ ID NO: 248792 - protein, 9 aa, Homo Sapiens
VCADTALFD

SEQ ID NO: 248793 - protein, 9 aa, Homo Sapiens
TVPSTTCHL

SEQ ID NO: 248794 - protein, 9 aa, Homo Sapiens
ALIMKITCL

SEQ ID NO: 248795 - protein, 9 aa, Homo Sapiens
PTKVTLAKS

SEQ ID NO: 248796 - protein, 9 aa, Homo Sapiens
SPESEDKEE

SEQ ID NO: 248797 - protein, 9 aa, Homo Sapiens
ESPLDTTHF

SEQ ID NO: 248798 - protein, 9 aa, Homo Sapiens
QPACSDVVG

SEQ ID NO: 248799 - protein, 9 aa, Homo Sapiens
LRKETAKKK

SEQ ID NO: 248800 - protein, 9 aa, Homo Sapiens
LPNAQSSQV

SEQ ID NO: 248801 - protein, 9 aa, Homo Sapiens
PVVVILRTV

SEQ ID NO: 248802 - protein, 9 aa, Homo Sapiens
MDAQLFNKV

SEQ ID NO: 248803 - protein, 9 aa, Homo Sapiens
VEEDPLHSG

SEQ ID NO: 248804 - protein, 9 aa, Homo Sapiens
VQHTPEEER

SEQ ID NO: 248805 - protein, 9 aa, Homo Sapiens
CFIGELTKF

SEQ ID NO: 248806 - protein, 9 aa, Homo Sapiens
VVVKRYTGE

SEQ ID NO: 248807 - protein, 9 aa, Homo Sapiens
TRRHFCPPN

SEQ ID NO: 248808 - protein, 9 aa, Homo Sapiens
YNDSAWRKQ

SEQ ID NO: 248809 - protein, 9 aa, Homo Sapiens
VDIFVSSVT

SEQ ID NO: 248810 - protein, 9 aa, Homo Sapiens
AFTNVGNGN

SEQ ID NO: 248811 - protein, 9 aa, Homo Sapiens
LQNKGSVLI

SEQ ID NO: 248812 - protein, 9 aa, Homo Sapiens
SRTSGEVEI

SEQ ID NO: 248813 - protein, 9 aa, Homo Sapiens
RQEPSTHDN

SEQ ID NO: 248814 - protein, 9 aa, Homo Sapiens
ECIPSSGLL

SEQ ID NO: 248815 - protein, 9 aa, Homo Sapiens
KRTQKLKED

SEQ ID NO: 248816 - protein, 9 aa, Homo Sapiens
TLRDKASRV

SEQ ID NO: 248817 - protein, 9 aa, Homo Sapiens
PENSTFENG

SEQ ID NO: 248818 - protein, 9 aa, Homo Sapiens
ERRPQQELH

SEQ ID NO: 248819 - protein, 9 aa, Homo Sapiens
LQGLFILAN

SEQ ID NO: 248820 - protein, 9 aa, Homo Sapiens
LARHCRIHT

SEQ ID NO: 248821 - protein, 9 aa, Homo Sapiens
QAFKFRVGA

SEQ ID NO: 248822 - protein, 9 aa, Homo Sapiens
KKEKNVLQK

SEQ ID NO: 248823 - protein, 9 aa, Homo Sapiens
CKLRHLRFT

SEQ ID NO: 248824 - protein, 9 aa, Homo Sapiens
FLGITKKIL

SEQ ID NO: 248825 - protein, 9 aa, Homo Sapiens
EQTKAFKFK

SEQ ID NO: 248826 - protein, 9 aa, Homo Sapiens
VGNGGVLNN

SEQ ID NO: 248827 - protein, 9 aa, Homo Sapiens
RRSSVCRLI

SEQ ID NO: 248828 - protein, 9 aa, Homo Sapiens
TFFHWSALK

SEQ ID NO: 248829 - protein, 9 aa, Homo Sapiens
LLQYLENLD

SEQ ID NO: 248830 - protein, 9 aa, Homo Sapiens
AIPEGQFIN

SEQ ID NO: 248831 - protein, 9 aa, Homo Sapiens
FCSRSFHNL

SEQ ID NO: 248832 - protein, 9 aa, Homo Sapiens
YLWSADTQH

SEQ ID NO: 248833 - protein, 9 aa, Homo Sapiens
PPQGRSERE

SEQ ID NO: 248834 - protein, 9 aa, Homo Sapiens
CIKHYHVKE

SEQ ID NO: 248835 - protein, 9 aa, Homo Sapiens
SIGIFYGSV

SEQ ID NO: 248836 - protein, 9 aa, Homo Sapiens
DVCSQSCLS

SEQ ID NO: 248837 - protein, 9 aa, Homo Sapiens
GLYGNSETN

SEQ ID NO: 248838 - protein, 9 aa, Homo Sapiens
GAMGPWGLL

SEQ ID NO: 248839 - protein, 9 aa, Homo Sapiens
EEQKRMNIS

SEQ ID NO: 248840 - protein, 9 aa, Homo Sapiens
HRDAKEALD

SEQ ID NO: 248841 - protein, 9 aa, Homo Sapiens
AISVVCRES

SEQ ID NO: 248842 - protein, 9 aa, Homo Sapiens
YRIGRLTDE

SEQ ID NO: 248843 - protein, 9 aa, Homo Sapiens
LCGAWAGHP

SEQ ID NO: 248844 - protein, 9 aa, Homo Sapiens
IIHTRERSY

SEQ ID NO: 248845 - protein, 9 aa, Homo Sapiens
LIITSYNAW

SEQ ID NO: 248846 - protein, 9 aa, Homo Sapiens
GVVWFKYSV

SEQ ID NO: 248847 - protein, 9 aa, Homo Sapiens
LAGTKSPVR

SEQ ID NO: 248848 - protein, 9 aa, Homo Sapiens
APVREEYAD

SEQ ID NO: 248849 - protein, 9 aa, Homo Sapiens
SGNYGDKPS

SEQ ID NO: 248850 - protein, 9 aa, Homo Sapiens
AFNNFPFLE

SEQ ID NO: 248851 - protein, 9 aa, Homo Sapiens
TYFKNRENC

SEQ ID NO: 248852 - protein, 9 aa, Homo Sapiens
CQSEMFKYE

SEQ ID NO: 248853 - protein, 9 aa, Homo Sapiens
VELEPVTEP

SEQ ID NO: 248854 - protein, 9 aa, Homo Sapiens
IERTFRVET

SEQ ID NO: 248855 - protein, 9 aa, Homo Sapiens
SLHYACFWG

SEQ ID NO: 248856 - protein, 9 aa, Homo Sapiens
ENKDLHDKL

SEQ ID NO: 248857 - protein, 9 aa, Homo Sapiens
RCRKLYEKS

SEQ ID NO: 248858 - protein, 9 aa, Homo Sapiens
REPEDNSKI

SEQ ID NO: 248859 - protein, 9 aa, Homo Sapiens
AMARYPHSL

SEQ ID NO: 248860 - protein, 9 aa, Homo Sapiens
APIPKDLGT

SEQ ID NO: 248861 - protein, 9 aa, Homo Sapiens
TNPHLRIIS

SEQ ID NO: 248862 - protein, 9 aa, Homo Sapiens
INTYRSLLG

SEQ ID NO: 248863 - protein, 9 aa, Homo Sapiens
HIEKKLNQN

SEQ ID NO: 248864 - protein, 9 aa, Homo Sapiens
SCRIIKQAF

SEQ ID NO: 248865 - protein, 9 aa, Homo Sapiens
TLVTKLNQL

SEQ ID NO: 248866 - protein, 9 aa, Homo Sapiens
VMLENYSKL

SEQ ID NO: 248867 - protein, 9 aa, Homo Sapiens
FACEQILAS

SEQ ID NO: 248868 - protein, 9 aa, Homo Sapiens
KEKGRKLEE

SEQ ID NO: 248869 - protein, 9 aa, Homo Sapiens
TSDPVMLPE

SEQ ID NO: 248870 - protein, 9 aa, Homo Sapiens
MLQQIAADE

SEQ ID NO: 248871 - protein, 9 aa, Homo Sapiens
QQSPFREIS

SEQ ID NO: 248872 - protein, 9 aa, Homo Sapiens
FLSKCSKFL

SEQ ID NO: 248873 - protein, 9 aa, Homo Sapiens
YSHFIDEKT

SEQ ID NO: 248874 - protein, 9 aa, Homo Sapiens
TWTDYTQCN

SEQ ID NO: 248875 - protein, 9 aa, Homo Sapiens
SRKTYKMPL

SEQ ID NO: 248876 - protein, 9 aa, Homo Sapiens
MLAINQVFD

SEQ ID NO: 248877 - protein, 9 aa, Homo Sapiens
YARVQAVVM

SEQ ID NO: 248878 - protein, 9 aa, Homo Sapiens
HQVQSFAPH

SEQ ID NO: 248879 - protein, 9 aa, Homo Sapiens
DALSDGLQL

SEQ ID NO: 248880 - protein, 9 aa, Homo Sapiens
PNKYLGSFY

SEQ ID NO: 248881 - protein, 9 aa, Homo Sapiens
YSAKNTSKL

SEQ ID NO: 248882 - protein, 9 aa, Homo Sapiens
TCDICGNNF

SEQ ID NO: 248883 - protein, 9 aa, Homo Sapiens
VISDVPVHI

SEQ ID NO: 248884 - protein, 9 aa, Homo Sapiens
QVMLLVNGA

SEQ ID NO: 248885 - protein, 9 aa, Homo Sapiens
ILTEMYRIV

SEQ ID NO: 248886 - protein, 9 aa, Homo Sapiens
VERLASVIP

SEQ ID NO: 248887 - protein, 9 aa, Homo Sapiens
AGSYLNYSN

SEQ ID NO: 248888 - protein, 9 aa, Homo Sapiens
VTMLMRKRW

SEQ ID NO: 248889 - protein, 9 aa, Homo Sapiens
TKIHLSPGK

SEQ ID NO: 248890 - protein, 9 aa, Homo Sapiens
KFKRLPYSE

SEQ ID NO: 248891 - protein, 9 aa, Homo Sapiens
HMSGQVVEH

SEQ ID NO: 248892 - protein, 9 aa, Homo Sapiens
AATPPAVKL

SEQ ID NO: 248893 - protein, 9 aa, Homo Sapiens
IYTHIYIHT

SEQ ID NO: 248894 - protein, 9 aa, Homo Sapiens
LQSVSTGSS

SEQ ID NO: 248895 - protein, 9 aa, Homo Sapiens
GFNALDQLS

SEQ ID NO: 248896 - protein, 9 aa, Homo Sapiens
QQDRHCNVT

SEQ ID NO: 248897 - protein, 9 aa, Homo Sapiens
RPRVHGSAA

SEQ ID NO: 248898 - protein, 9 aa, Homo Sapiens
TGERPFPCM

SEQ ID NO: 248899 - protein, 9 aa, Homo Sapiens
ADGFEGESC

SEQ ID NO: 248900 - protein, 9 aa, Homo Sapiens
YKPQPKPNT

SEQ ID NO: 248901 - protein, 9 aa, Homo Sapiens
KKSNDLTAA

SEQ ID NO: 248902 - protein, 9 aa, Homo Sapiens
LKTEAKNEA

SEQ ID NO: 248903 - protein, 9 aa, Homo Sapiens
RMVWEQNVY

SEQ ID NO: 248904 - protein, 9 aa, Homo Sapiens
HSAVSHAGS

SEQ ID NO: 248905 - protein, 9 aa, Homo Sapiens
PMPKAEAAK

SEQ ID NO: 248906 - protein, 9 aa, Homo Sapiens
AIVIGTVAL

SEQ ID NO: 248907 - protein, 9 aa, Homo Sapiens
DPSTRTYCY

SEQ ID NO: 248908 - protein, 9 aa, Homo Sapiens
AGRIILNIK

SEQ ID NO: 248909 - protein, 9 aa, Homo Sapiens
PVITNGAYT

SEQ ID NO: 248910 - protein, 9 aa, Homo Sapiens
TSPTWSASV

SEQ ID NO: 248911 - protein, 9 aa, Homo Sapiens
KKTFIILNK

SEQ ID NO: 248912 - protein, 9 aa, Homo Sapiens
SDYFNLAAN

SEQ ID NO: 248913 - protein, 9 aa, Homo Sapiens
QKILYYCKG

SEQ ID NO: 248914 - protein, 9 aa, Homo Sapiens
QNQNNYHCH

SEQ ID NO: 248915 - protein, 9 aa, Homo Sapiens
AEAPESSTC

SEQ ID NO: 248916 - protein, 9 aa, Homo Sapiens
LHVPQDGAE

SEQ ID NO: 248917 - protein, 9 aa, Homo Sapiens
GALSRLPQT

SEQ ID NO: 248918 - protein, 9 aa, Homo Sapiens
SLNTSLIDM

SEQ ID NO: 248919 - protein, 9 aa, Homo Sapiens
EMYKQVRKS

SEQ ID NO: 248920 - protein, 9 aa, Homo Sapiens
DCYIYNKPT

SEQ ID NO: 248921 - protein, 9 aa, Homo Sapiens
SPSEQKIKQ

SEQ ID NO: 248922 - protein, 9 aa, Homo Sapiens
VGTAGTARD

SEQ ID NO: 248923 - protein, 9 aa, Homo Sapiens
LFGETLSCI

SEQ ID NO: 248924 - protein, 9 aa, Homo Sapiens
TMIALSIGD

SEQ ID NO: 248925 - protein, 9 aa, Homo Sapiens
AHDSDILCL

SEQ ID NO: 248926 - protein, 9 aa, Homo Sapiens
LFFHFRCRM

SEQ ID NO: 248927 - protein, 9 aa, Homo Sapiens
NPEQIIATE

SEQ ID NO: 248928 - protein, 9 aa, Homo Sapiens
VPRPHKVRC

SEQ ID NO: 248929 - protein, 9 aa, Homo Sapiens
GAVAQVLRH

SEQ ID NO: 248930 - protein, 9 aa, Homo Sapiens
HAELFLKNL

SEQ ID NO: 248931 - protein, 9 aa, Homo Sapiens
AQLKKILWG

SEQ ID NO: 248932 - protein, 9 aa, Homo Sapiens
AALYLVQIR

SEQ ID NO: 248933 - protein, 9 aa, Homo Sapiens
KHEAVLQSK

SEQ ID NO: 248934 - protein, 9 aa, Homo Sapiens
MNFNAWNIK

SEQ ID NO: 248935 - protein, 9 aa, Homo Sapiens
LSETSESHP

SEQ ID NO: 248936 - protein, 9 aa, Homo Sapiens
ALQSHLNNS

SEQ ID NO: 248937 - protein, 9 aa, Homo Sapiens
SSISLATAW

SEQ ID NO: 248938 - protein, 9 aa, Homo Sapiens
ELTNLQPKR

SEQ ID NO: 248939 - protein, 9 aa, Homo Sapiens
VLGEMRKKI

SEQ ID NO: 248940 - protein, 9 aa, Homo Sapiens
CSTENIYKE

SEQ ID NO: 248941 - protein, 9 aa, Homo Sapiens
LENALIGQY

SEQ ID NO: 248942 - protein, 9 aa, Homo Sapiens
DNDMQNILD

SEQ ID NO: 248943 - protein, 9 aa, Homo Sapiens
ISIKFVSNL

SEQ ID NO: 248944 - protein, 9 aa, Homo Sapiens
LSISTFQQA

SEQ ID NO: 248945 - protein, 9 aa, Homo Sapiens
VLNNFSGRI

SEQ ID NO: 248946 - protein, 9 aa, Homo Sapiens
KISSALKKA

SEQ ID NO: 248947 - protein, 9 aa, Homo Sapiens
RHQHRSFPL

SEQ ID NO: 248948 - protein, 9 aa, Homo Sapiens
KIKQKLIDE

SEQ ID NO: 248949 - protein, 9 aa, Homo Sapiens
PHLHFSIKH

SEQ ID NO: 248950 - protein, 9 aa, Homo Sapiens
GEFAMLLQS

SEQ ID NO: 248951 - protein, 9 aa, Homo Sapiens
LGPGLPWLL

SEQ ID NO: 248952 - protein, 9 aa, Homo Sapiens
IGTGFFIGI

SEQ ID NO: 248953 - protein, 9 aa, Homo Sapiens
EVFPDILDP

SEQ ID NO: 248954 - protein, 9 aa, Homo Sapiens
SSFCLAGRF

SEQ ID NO: 248955 - protein, 9 aa, Homo Sapiens
SVVSLFYVT

SEQ ID NO: 248956 - protein, 9 aa, Homo Sapiens
PTLCPSIKG

SEQ ID NO: 248957 - protein, 9 aa, Homo Sapiens
VQNRCSSCG

SEQ ID NO: 248958 - protein, 9 aa, Homo Sapiens
ANSTHADTC

SEQ ID NO: 248959 - protein, 9 aa, Homo Sapiens
LGREGYTFQ

SEQ ID NO: 248960 - protein, 9 aa, Homo Sapiens
RSMRLLHCS

SEQ ID NO: 248961 - protein, 9 aa, Homo Sapiens
RQIQVNDDD

SEQ ID NO: 248962 - protein, 9 aa, Homo Sapiens
ADIYLAKRS

SEQ ID NO: 248963 - protein, 9 aa, Homo Sapiens
LLNRNRKEN

SEQ ID NO: 248964 - protein, 9 aa, Homo Sapiens
FDAICNNKF

SEQ ID NO: 248965 - protein, 9 aa, Homo Sapiens
AKNKKEQEL

SEQ ID NO: 248966 - protein, 9 aa, Homo Sapiens
DSEQWDNIY

SEQ ID NO: 248967 - protein, 9 aa, Homo Sapiens
AFSQIIHLS

SEQ ID NO: 248968 - protein, 9 aa, Homo Sapiens
LEKSRFIFQ

SEQ ID NO: 248969 - protein, 9 aa, Homo Sapiens
SFVEVQGQL

SEQ ID NO: 248970 - protein, 9 aa, Homo Sapiens
DAFVGTWKV

SEQ ID NO: 248971 - protein, 9 aa, Homo Sapiens
IEVSVKGAP

SEQ ID NO: 248972 - protein, 9 aa, Homo Sapiens
LLDEDFVFD

SEQ ID NO: 248973 - protein, 9 aa, Homo Sapiens
EMFSLVMKH

SEQ ID NO: 248974 - protein, 9 aa, Homo Sapiens
LLSKSLSRE

SEQ ID NO: 248975 - protein, 9 aa, Homo Sapiens
LQATNKNSL

SEQ ID NO: 248976 - protein, 9 aa, Homo Sapiens
MQNEKEQDM

SEQ ID NO: 248977 - protein, 9 aa, Homo Sapiens
HGTEKLGLI

SEQ ID NO: 248978 - protein, 9 aa, Homo Sapiens
LRMTFTTMP

SEQ ID NO: 248979 - protein, 9 aa, Homo Sapiens
HSMVESIKH

SEQ ID NO: 248980 - protein, 9 aa, Homo Sapiens
FWSGLYAET

SEQ ID NO: 248981 - protein, 9 aa, Homo Sapiens
ALKEDILEL

SEQ ID NO: 248982 - protein, 9 aa, Homo Sapiens
EIFRRSKIA

SEQ ID NO: 248983 - protein, 9 aa, Homo Sapiens
QYMKSLQKT

SEQ ID NO: 248984 - protein, 9 aa, Homo Sapiens
MDYAFSYLM

SEQ ID NO: 248985 - protein, 9 aa, Homo Sapiens
KSGPNRSHQ

SEQ ID NO: 248986 - protein, 9 aa, Homo Sapiens
FNQSSTLIR

SEQ ID NO: 248987 - protein, 9 aa, Homo Sapiens
PQGRSEREF

SEQ ID NO: 248988 - protein, 9 aa, Homo Sapiens
DPWVYLLLK

SEQ ID NO: 248989 - protein, 9 aa, Homo Sapiens
QEQEANMWR

SEQ ID NO: 248990 - protein, 9 aa, Homo Sapiens
TKQEGMAGL

SEQ ID NO: 248991 - protein, 9 aa, Homo Sapiens
LTIVTRDKT

SEQ ID NO: 248992 - protein, 9 aa, Homo Sapiens
KGALQEGRT

SEQ ID NO: 248993 - protein, 9 aa, Homo Sapiens
AKLQQQLPM

SEQ ID NO: 248994 - protein, 9 aa, Homo Sapiens
RLRVPLLHC

SEQ ID NO: 248995 - protein, 9 aa, Homo Sapiens
QANNKEDSN

SEQ ID NO: 248996 - protein, 9 aa, Homo Sapiens
KSVTEVDAL

SEQ ID NO: 248997 - protein, 9 aa, Homo Sapiens
ELKWQKDTL

SEQ ID NO: 248998 - protein, 9 aa, Homo Sapiens
LLVIIHAPN

SEQ ID NO: 248999 - protein, 9 aa, Homo Sapiens
LSEIQWEKN

SEQ ID NO: 249000 - protein, 9 aa, Homo Sapiens
LMRNKMKLR

SEQ ID NO: 249001 - protein, 9 aa, Homo Sapiens
WVAVHVVDL

SEQ ID NO: 249002 - protein, 9 aa, Homo Sapiens
CYRWLLLDF

SEQ ID NO: 249003 - protein, 9 aa, Homo Sapiens
ACTWRQNTN

SEQ ID NO: 249004 - protein, 9 aa, Homo Sapiens
LHNITGNPY

SEQ ID NO: 249005 - protein, 9 aa, Homo Sapiens
TVDRISIKF

SEQ ID NO: 249006 - protein, 9 aa, Homo Sapiens
TDVKIGQKS

SEQ ID NO: 249007 - protein, 9 aa, Homo Sapiens
VVQELLTYS

SEQ ID NO: 249008 - protein, 9 aa, Homo Sapiens
IHGSLPHMA

SEQ ID NO: 249009 - protein, 9 aa, Homo Sapiens
YATAVLQQA

SEQ ID NO: 249010 - protein, 9 aa, Homo Sapiens
RKYAVNSLQ

SEQ ID NO: 249011 - protein, 9 aa, Homo Sapiens
LKIKGKLIY

SEQ ID NO: 249012 - protein, 9 aa, Homo Sapiens
SDLEIVNLL

SEQ ID NO: 249013 - protein, 9 aa, Homo Sapiens
AEWRRWMGP

SEQ ID NO: 249014 - protein, 9 aa, Homo Sapiens
GHTYIKFFV

SEQ ID NO: 249015 - protein, 9 aa, Homo Sapiens
VDMILKFFD

SEQ ID NO: 249016 - protein, 9 aa, Homo Sapiens
YHRLPLPKQ

SEQ ID NO: 249017 - protein, 9 aa, Homo Sapiens
LRLSCAGII

SEQ ID NO: 249018 - protein, 9 aa, Homo Sapiens
EVDSVELAV

SEQ ID NO: 249019 - protein, 9 aa, Homo Sapiens
PVLHCQIIE

SEQ ID NO: 249020 - protein, 9 aa, Homo Sapiens
TYSENRKII

SEQ ID NO: 249021 - protein, 9 aa, Homo Sapiens
GDECKNTVG

SEQ ID NO: 249022 - protein, 9 aa, Homo Sapiens
QIQNPEYST

SEQ ID NO: 249023 - protein, 9 aa, Homo Sapiens
IQPLGDIMP

SEQ ID NO: 249024 - protein, 9 aa, Homo Sapiens
TSIDGMEIP

SEQ ID NO: 249025 - protein, 9 aa, Homo Sapiens
SEEEVEKPE

SEQ ID NO: 249026 - protein, 9 aa, Homo Sapiens
PKSEFGEYN

SEQ ID NO: 249027 - protein, 9 aa, Homo Sapiens
LHQQNHTGE

SEQ ID NO: 249028 - protein, 9 aa, Homo Sapiens
EFIQWFKKL

SEQ ID NO: 249029 - protein, 9 aa, Homo Sapiens
LAADLEEEL

SEQ ID NO: 249030 - protein, 9 aa, Homo Sapiens
RTCHENTNN

SEQ ID NO: 249031 - protein, 9 aa, Homo Sapiens
DPESFVKVL

SEQ ID NO: 249032 - protein, 9 aa, Homo Sapiens
LALLCELMD

SEQ ID NO: 249033 - protein, 9 aa, Homo Sapiens
RCGYCNNES

SEQ ID NO: 249034 - protein, 9 aa, Homo Sapiens
KEKEQQKLK

SEQ ID NO: 249035 - protein, 9 aa, Homo Sapiens
ALLGREGYT

SEQ ID NO: 249036 - protein, 9 aa, Homo Sapiens
WEKEKANVS

SEQ ID NO: 249037 - protein, 9 aa, Homo Sapiens
FAHGRLVYM

SEQ ID NO: 249038 - protein, 9 aa, Homo Sapiens
EPLSNEEQN

SEQ ID NO: 249039 - protein, 9 aa, Homo Sapiens
DFAINQEQT

SEQ ID NO: 249040 - protein, 9 aa, Homo Sapiens
LSLEEWEFL

SEQ ID NO: 249041 - protein, 9 aa, Homo Sapiens
DTSNTKAVE

SEQ ID NO: 249042 - protein, 9 aa, Homo Sapiens
SVWPNLTSQ

SEQ ID NO: 249043 - protein, 9 aa, Homo Sapiens
QYPDPHSHN

SEQ ID NO: 249044 - protein, 9 aa, Homo Sapiens
CYICLSIYQ

SEQ ID NO: 249045 - protein, 9 aa, Homo Sapiens
STLVSLISN

SEQ ID NO: 249046 - protein, 9 aa, Homo Sapiens
NTNSSRIEA

SEQ ID NO: 249047 - protein, 9 aa, Homo Sapiens
IKLWAKLSA

SEQ ID NO: 249048 - protein, 9 aa, Homo Sapiens
LFTSLIGVL

SEQ ID NO: 249049 - protein, 9 aa, Homo Sapiens
QCLCHVGQE

SEQ ID NO: 249050 - protein, 9 aa, Homo Sapiens
TLVELVYFE

SEQ ID NO: 249051 - protein, 9 aa, Homo Sapiens
SRNSSSVWP

SEQ ID NO: 249052 - protein, 9 aa, Homo Sapiens
LSPTGGESF

SEQ ID NO: 249053 - protein, 9 aa, Homo Sapiens
PQSKEHFRG

SEQ ID NO: 249054 - protein, 9 aa, Homo Sapiens
SQCLKNNSK

SEQ ID NO: 249055 - protein, 9 aa, Homo Sapiens
SLIAFRMRS

SEQ ID NO: 249056 - protein, 9 aa, Homo Sapiens
EDNSFGCPS

SEQ ID NO: 249057 - protein, 9 aa, Homo Sapiens
KADIRIWVA

SEQ ID NO: 249058 - protein, 9 aa, Homo Sapiens
KQEMKKAGE

SEQ ID NO: 249059 - protein, 9 aa, Homo Sapiens
FPEAGGGAV

SEQ ID NO: 249060 - protein, 9 aa, Homo Sapiens
VLLYSDCGI

SEQ ID NO: 249061 - protein, 9 aa, Homo Sapiens
KEEWDKMKM

SEQ ID NO: 249062 - protein, 9 aa, Homo Sapiens
TGETKKEGT

SEQ ID NO: 249063 - protein, 9 aa, Homo Sapiens
PQGRYSDHG

SEQ ID NO: 249064 - protein, 9 aa, Homo Sapiens
QKGSVHHNY

SEQ ID NO: 249065 - protein, 9 aa, Homo Sapiens
RCVRFIPVT

SEQ ID NO: 249066 - protein, 9 aa, Homo Sapiens
LMSNLDSSR

SEQ ID NO: 249067 - protein, 9 aa, Homo Sapiens
VALDGTLFH

SEQ ID NO: 249068 - protein, 9 aa, Homo Sapiens
STWLHNIKL

SEQ ID NO: 249069 - protein, 9 aa, Homo Sapiens
GMNSGGGPS

SEQ ID NO: 249070 - protein, 9 aa, Homo Sapiens
LLVKIYGAQ

SEQ ID NO: 249071 - protein, 9 aa, Homo Sapiens
DLMVSVAAG

SEQ ID NO: 249072 - protein, 9 aa, Homo Sapiens
NNYIRITSD

SEQ ID NO: 249073 - protein, 9 aa, Homo Sapiens
ICCREHDRC

SEQ ID NO: 249074 - protein, 9 aa, Homo Sapiens
ISFLCKLQD

SEQ ID NO: 249075 - protein, 9 aa, Homo Sapiens
ESGNFKNSE

SEQ ID NO: 249076 - protein, 9 aa, Homo Sapiens
AFPKSINVF

SEQ ID NO: 249077 - protein, 9 aa, Homo Sapiens
PMLIEYFTY

SEQ ID NO: 249078 - protein, 9 aa, Homo Sapiens
EQYDKDDEA

SEQ ID NO: 249079 - protein, 9 aa, Homo Sapiens
LQWHEKTLA

SEQ ID NO: 249080 - protein, 9 aa, Homo Sapiens
PPAMLSVST

SEQ ID NO: 249081 - protein, 9 aa, Homo Sapiens
TVERKGSRT

SEQ ID NO: 249082 - protein, 9 aa, Homo Sapiens
GDQSAALLG

SEQ ID NO: 249083 - protein, 9 aa, Homo Sapiens
PTFLLQSIQ

SEQ ID NO: 249084 - protein, 9 aa, Homo Sapiens
SYGRDQTGM

SEQ ID NO: 249085 - protein, 9 aa, Homo Sapiens
PEGSDGTNI

SEQ ID NO: 249086 - protein, 9 aa, Homo Sapiens
VFDKAIKQC

SEQ ID NO: 249087 - protein, 9 aa, Homo Sapiens
YQPNMVVFV

SEQ ID NO: 249088 - protein, 9 aa, Homo Sapiens
FTIPDSLDR

SEQ ID NO: 249089 - protein, 9 aa, Homo Sapiens
RKKVAEIIK

SEQ ID NO: 249090 - protein, 9 aa, Homo Sapiens
LNKAEENCL

SEQ ID NO: 249091 - protein, 9 aa, Homo Sapiens
PVTSFGCAV

SEQ ID NO: 249092 - protein, 9 aa, Homo Sapiens
WWPMLLNMR

SEQ ID NO: 249093 - protein, 9 aa, Homo Sapiens
KLSARPSSI

SEQ ID NO: 249094 - protein, 9 aa, Homo Sapiens
HLFIPLPFA

SEQ ID NO: 249095 - protein, 9 aa, Homo Sapiens
KTLSPSRRR

SEQ ID NO: 249096 - protein, 9 aa, Homo Sapiens
TLFPDMWLF

SEQ ID NO: 249097 - protein, 9 aa, Homo Sapiens
QYVLCAATP

SEQ ID NO: 249098 - protein, 9 aa, Homo Sapiens
FFIKICDEL

SEQ ID NO: 249099 - protein, 9 aa, Homo Sapiens
FIKEIPPKK

SEQ ID NO: 249100 - protein, 9 aa, Homo Sapiens
QLPCEQKLL

SEQ ID NO: 249101 - protein, 9 aa, Homo Sapiens
VGAVSGGEQ

SEQ ID NO: 249102 - protein, 9 aa, Homo Sapiens
FVMDLPKGL

SEQ ID NO: 249103 - protein, 9 aa, Homo Sapiens
RKDLQINKL

SEQ ID NO: 249104 - protein, 9 aa, Homo Sapiens
RVIHAKEEK

SEQ ID NO: 249105 - protein, 9 aa, Homo Sapiens
QHAAMFRQF

SEQ ID NO: 249106 - protein, 9 aa, Homo Sapiens
GPGALSVCN

SEQ ID NO: 249107 - protein, 9 aa, Homo Sapiens
VEPNTESYG

SEQ ID NO: 249108 - protein, 9 aa, Homo Sapiens
LAELRRIFE

SEQ ID NO: 249109 - protein, 9 aa, Homo Sapiens
VQHFESEED

SEQ ID NO: 249110 - protein, 9 aa, Homo Sapiens
GINTLQPVL

SEQ ID NO: 249111 - protein, 9 aa, Homo Sapiens
KDVSDKYQY

SEQ ID NO: 249112 - protein, 9 aa, Homo Sapiens
SSEYHMDDG

SEQ ID NO: 249113 - protein, 9 aa, Homo Sapiens
VGSLDEKRK

SEQ ID NO: 249114 - protein, 9 aa, Homo Sapiens
NYGNGKTFL

SEQ ID NO: 249115 - protein, 9 aa, Homo Sapiens
AAASYFSLL

SEQ ID NO: 249116 - protein, 9 aa, Homo Sapiens
KKNKLVEEL

SEQ ID NO: 249117 - protein, 9 aa, Homo Sapiens
EKKEIELEM

SEQ ID NO: 249118 - protein, 9 aa, Homo Sapiens
KEKYILVLP

SEQ ID NO: 249119 - protein, 9 aa, Homo Sapiens
DATLKINYQ

SEQ ID NO: 249120 - protein, 9 aa, Homo Sapiens
LHSYGRDQT

SEQ ID NO: 249121 - protein, 9 aa, Homo Sapiens
YQSSKLTEH

SEQ ID NO: 249122 - protein, 9 aa, Homo Sapiens
AAGFSCCSF

SEQ ID NO: 249123 - protein, 9 aa, Homo Sapiens
RDIGRCAIK

SEQ ID NO: 249124 - protein, 9 aa, Homo Sapiens
NGLQSSYSE

SEQ ID NO: 249125 - protein, 9 aa, Homo Sapiens
TNPIYEIMC

SEQ ID NO: 249126 - protein, 9 aa, Homo Sapiens
IILKTLLDF

SEQ ID NO: 249127 - protein, 9 aa, Homo Sapiens
GDPMRHQIL

SEQ ID NO: 249128 - protein, 9 aa, Homo Sapiens
NTLLGLGNK

SEQ ID NO: 249129 - protein, 9 aa, Homo Sapiens
MSCVPQMLV

SEQ ID NO: 249130 - protein, 9 aa, Homo Sapiens
APEEVTKYQ

SEQ ID NO: 249131 - protein, 9 aa, Homo Sapiens
LSQSKLLWS

SEQ ID NO: 249132 - protein, 9 aa, Homo Sapiens
ETCIDDALR

SEQ ID NO: 249133 - protein, 9 aa, Homo Sapiens
AVNIYIDKN

SEQ ID NO: 249134 - protein, 9 aa, Homo Sapiens
IKKNHEEEM

SEQ ID NO: 249135 - protein, 9 aa, Homo Sapiens
HIMEVVGTP

SEQ ID NO: 249136 - protein, 9 aa, Homo Sapiens
QSQEPSDQH

SEQ ID NO: 249137 - protein, 9 aa, Homo Sapiens
DQYKYERYS

SEQ ID NO: 249138 - protein, 9 aa, Homo Sapiens
SIITTHTTL

SEQ ID NO: 249139 - protein, 9 aa, Homo Sapiens
LSDVTGNKI

SEQ ID NO: 249140 - protein, 9 aa, Homo Sapiens
HISAHHLHQ

SEQ ID NO: 249141 - protein, 9 aa, Homo Sapiens
GEWWSHIQV

SEQ ID NO: 249142 - protein, 9 aa, Homo Sapiens
FIENRAKAG

SEQ ID NO: 249143 - protein, 9 aa, Homo Sapiens
GLTPFSCLS

SEQ ID NO: 249144 - protein, 9 aa, Homo Sapiens
QEMIEALQK

SEQ ID NO: 249145 - protein, 9 aa, Homo Sapiens
VTFKDQQKI

SEQ ID NO: 249146 - protein, 9 aa, Homo Sapiens
LCVRECTQF

SEQ ID NO: 249147 - protein, 9 aa, Homo Sapiens
AFKISKDVL

SEQ ID NO: 249148 - protein, 9 aa, Homo Sapiens
SQPTTDIST

SEQ ID NO: 249149 - protein, 9 aa, Homo Sapiens
KIRSELDGL

SEQ ID NO: 249150 - protein, 9 aa, Homo Sapiens
NADIAAQKL

SEQ ID NO: 249151 - protein, 9 aa, Homo Sapiens
EYQPKPQMS

SEQ ID NO: 249152 - protein, 9 aa, Homo Sapiens
ANIGPKDKK

SEQ ID NO: 249153 - protein, 9 aa, Homo Sapiens
IAHSAVVHE

SEQ ID NO: 249154 - protein, 9 aa, Homo Sapiens
TFLKSLLEA

SEQ ID NO: 249155 - protein, 9 aa, Homo Sapiens
HFWLPFGFI

SEQ ID NO: 249156 - protein, 9 aa, Homo Sapiens
SSLLNLSLT

SEQ ID NO: 249157 - protein, 9 aa, Homo Sapiens
NVPRLLTEE

SEQ ID NO: 249158 - protein, 9 aa, Homo Sapiens
VCMVTVCAE

SEQ ID NO: 249159 - protein, 9 aa, Homo Sapiens
KYWWDAVCT

SEQ ID NO: 249160 - protein, 9 aa, Homo Sapiens
IFIQTSMGL

SEQ ID NO: 249161 - protein, 9 aa, Homo Sapiens
FQRKFLNDL

SEQ ID NO: 249162 - protein, 9 aa, Homo Sapiens
GKLLRDSHV

SEQ ID NO: 249163 - protein, 9 aa, Homo Sapiens
PSGGQTPGA

SEQ ID NO: 249164 - protein, 9 aa, Homo Sapiens
NIQQHQRQH

SEQ ID NO: 249165 - protein, 9 aa, Homo Sapiens
AFSHSGSLQ

SEQ ID NO: 249166 - protein, 9 aa, Homo Sapiens
SLEHLDLNS

SEQ ID NO: 249167 - protein, 9 aa, Homo Sapiens
FRINRLALL

SEQ ID NO: 249168 - protein, 9 aa, Homo Sapiens
FHSVKPTGS

SEQ ID NO: 249169 - protein, 9 aa, Homo Sapiens
DSSRTLHAF

SEQ ID NO: 249170 - protein, 9 aa, Homo Sapiens
YFLERYCDK

SEQ ID NO: 249171 - protein, 9 aa, Homo Sapiens
YPEIDKKIK

SEQ ID NO: 249172 - protein, 9 aa, Homo Sapiens
LSDQITFIE

SEQ ID NO: 249173 - protein, 9 aa, Homo Sapiens
TVIFHARVS

SEQ ID NO: 249174 - protein, 9 aa, Homo Sapiens
RLYNKISNL

SEQ ID NO: 249175 - protein, 9 aa, Homo Sapiens
DLSSFQRHM

SEQ ID NO: 249176 - protein, 9 aa, Homo Sapiens
KNHCSAINN

SEQ ID NO: 249177 - protein, 9 aa, Homo Sapiens
GGTVLYCTF

SEQ ID NO: 249178 - protein, 9 aa, Homo Sapiens
SSNLNKSES

SEQ ID NO: 249179 - protein, 9 aa, Homo Sapiens
AAVSRKKTR

SEQ ID NO: 249180 - protein, 9 aa, Homo Sapiens
KKCSTQDFF

SEQ ID NO: 249181 - protein, 9 aa, Homo Sapiens
ECSITLSNW

SEQ ID NO: 249182 - protein, 9 aa, Homo Sapiens
RSDLKAARS

SEQ ID NO: 249183 - protein, 9 aa, Homo Sapiens
APDPPTLKN

SEQ ID NO: 249184 - protein, 9 aa, Homo Sapiens
TPIMYWAKE

SEQ ID NO: 249185 - protein, 9 aa, Homo Sapiens
CFVAILTGL

SEQ ID NO: 249186 - protein, 9 aa, Homo Sapiens
KFKTPATVG

SEQ ID NO: 249187 - protein, 9 aa, Homo Sapiens
QELHQMGKA

SEQ ID NO: 249188 - protein, 9 aa, Homo Sapiens
ELYRQNRFA

SEQ ID NO: 249189 - protein, 9 aa, Homo Sapiens
RANNTFYET

SEQ ID NO: 249190 - protein, 9 aa, Homo Sapiens
LWVLVFVPY

SEQ ID NO: 249191 - protein, 9 aa, Homo Sapiens
KEYILPALL

SEQ ID NO: 249192 - protein, 9 aa, Homo Sapiens
KDHPKIANI

SEQ ID NO: 249193 - protein, 9 aa, Homo Sapiens
FLTGSSKQM

SEQ ID NO: 249194 - protein, 9 aa, Homo Sapiens
NLEISDNSD

SEQ ID NO: 249195 - protein, 9 aa, Homo Sapiens
LLPLEMDGT

SEQ ID NO: 249196 - protein, 9 aa, Homo Sapiens
KYQLSQPEV

SEQ ID NO: 249197 - protein, 9 aa, Homo Sapiens
GYGMSSVPS

SEQ ID NO: 249198 - protein, 9 aa, Homo Sapiens
ARTGGSTTF

SEQ ID NO: 249199 - protein, 9 aa, Homo Sapiens
LVLGMVGCF

SEQ ID NO: 249200 - protein, 9 aa, Homo Sapiens
QNLGLDDTN

SEQ ID NO: 249201 - protein, 9 aa, Homo Sapiens
TYLNQCLPP

SEQ ID NO: 249202 - protein, 9 aa, Homo Sapiens
SDMEQISII

SEQ ID NO: 249203 - protein, 9 aa, Homo Sapiens
LTTDVKALR

SEQ ID NO: 249204 - protein, 9 aa, Homo Sapiens
NGLSRPVSQ

SEQ ID NO: 249205 - protein, 9 aa, Homo Sapiens
NGTQIAGAC

SEQ ID NO: 249206 - protein, 9 aa, Homo Sapiens
ANFNTQKKT

SEQ ID NO: 249207 - protein, 9 aa, Homo Sapiens
EKLEEWNEK

SEQ ID NO: 249208 - protein, 9 aa, Homo Sapiens
YSKFMNLLA

SEQ ID NO: 249209 - protein, 9 aa, Homo Sapiens
GKSPARGST

SEQ ID NO: 249210 - protein, 9 aa, Homo Sapiens
DDDYPDKDK

SEQ ID NO: 249211 - protein, 9 aa, Homo Sapiens
VDSLPDVSD

SEQ ID NO: 249212 - protein, 9 aa, Homo Sapiens
SSQPHWSNK

SEQ ID NO: 249213 - protein, 9 aa, Homo Sapiens
EDKPEDVLT

SEQ ID NO: 249214 - protein, 9 aa, Homo Sapiens
IGNNTIRGC

SEQ ID NO: 249215 - protein, 9 aa, Homo Sapiens
GTWKSPLGT

SEQ ID NO: 249216 - protein, 9 aa, Homo Sapiens
AWGHQHGYR

SEQ ID NO: 249217 - protein, 9 aa, Homo Sapiens
IKDPSKVPL

SEQ ID NO: 249218 - protein, 9 aa, Homo Sapiens
ALSDLSSFQ

SEQ ID NO: 249219 - protein, 9 aa, Homo Sapiens
ITQLIDVDE

SEQ ID NO: 249220 - protein, 9 aa, Homo Sapiens
HMNLLQRMK

SEQ ID NO: 249221 - protein, 9 aa, Homo Sapiens
NLEDELVNE

SEQ ID NO: 249222 - protein, 9 aa, Homo Sapiens
GETEARTRL

SEQ ID NO: 249223 - protein, 9 aa, Homo Sapiens
LLLTRGSKT

SEQ ID NO: 249224 - protein, 9 aa, Homo Sapiens
GQKYFKCEE

SEQ ID NO: 249225 - protein, 9 aa, Homo Sapiens
PGRTFKQSL

SEQ ID NO: 249226 - protein, 9 aa, Homo Sapiens
VHLLSNKKS

SEQ ID NO: 249227 - protein, 9 aa, Homo Sapiens
FFSGIVFII

SEQ ID NO: 249228 - protein, 9 aa, Homo Sapiens
GRKRKKHRK

SEQ ID NO: 249229 - protein, 9 aa, Homo Sapiens
ANNCFELWK

SEQ ID NO: 249230 - protein, 9 aa, Homo Sapiens
QPFITKSFN

SEQ ID NO: 249231 - protein, 9 aa, Homo Sapiens
PKNFHSPMV

SEQ ID NO: 249232 - protein, 9 aa, Homo Sapiens
FLSQSKLLW

SEQ ID NO: 249233 - protein, 9 aa, Homo Sapiens
QVKQETVEP

SEQ ID NO: 249234 - protein, 9 aa, Homo Sapiens
DEGKCYCKP

SEQ ID NO: 249235 - protein, 9 aa, Homo Sapiens
NQFYLKEVN

SEQ ID NO: 249236 - protein, 9 aa, Homo Sapiens
KALRLNVNA

SEQ ID NO: 249237 - protein, 9 aa, Homo Sapiens
HRKDLEIQD

SEQ ID NO: 249238 - protein, 9 aa, Homo Sapiens
KSWIYKRIP

SEQ ID NO: 249239 - protein, 9 aa, Homo Sapiens
IIYSILKQI

SEQ ID NO: 249240 - protein, 9 aa, Homo Sapiens
WKEVCFTCV

SEQ ID NO: 249241 - protein, 9 aa, Homo Sapiens
LVLGIYSKK

SEQ ID NO: 249242 - protein, 9 aa, Homo Sapiens
ACMGQGMGA

SEQ ID NO: 249243 - protein, 9 aa, Homo Sapiens
TLYYFWSQE

SEQ ID NO: 249244 - protein, 9 aa, Homo Sapiens
ALIGQYVIT

SEQ ID NO: 249245 - protein, 9 aa, Homo Sapiens
LRSKSLEKF

SEQ ID NO: 249246 - protein, 9 aa, Homo Sapiens
EKYHAALKM

SEQ ID NO: 249247 - protein, 9 aa, Homo Sapiens
NCKQKCRDS

SEQ ID NO: 249248 - protein, 9 aa, Homo Sapiens
VQQVGADTT

SEQ ID NO: 249249 - protein, 9 aa, Homo Sapiens
NHVYNEAII

SEQ ID NO: 249250 - protein, 9 aa, Homo Sapiens
SNVYMVMEY

SEQ ID NO: 249251 - protein, 9 aa, Homo Sapiens
NAVAEWRRW

SEQ ID NO: 249252 - protein, 9 aa, Homo Sapiens
MMGLFETGS

SEQ ID NO: 249253 - protein, 9 aa, Homo Sapiens
EKGLRTAGL

SEQ ID NO: 249254 - protein, 9 aa, Homo Sapiens
TEFQHMLVA

SEQ ID NO: 249255 - protein, 9 aa, Homo Sapiens
FKDSGLSHV

SEQ ID NO: 249256 - protein, 9 aa, Homo Sapiens
HPPKEVVPQ

SEQ ID NO: 249257 - protein, 9 aa, Homo Sapiens
ILTTSNLPE

SEQ ID NO: 249258 - protein, 9 aa, Homo Sapiens
ASQEVIQKA

SEQ ID NO: 249259 - protein, 9 aa, Homo Sapiens
NSEKTNNRI

SEQ ID NO: 249260 - protein, 9 aa, Homo Sapiens
YVVKPLNYE

SEQ ID NO: 249261 - protein, 9 aa, Homo Sapiens
GTNHTHVLY

SEQ ID NO: 249262 - protein, 9 aa, Homo Sapiens
GVHSGDVTL

SEQ ID NO: 249263 - protein, 9 aa, Homo Sapiens
NPVALQCPI

SEQ ID NO: 249264 - protein, 9 aa, Homo Sapiens
MLTLNNYQV

SEQ ID NO: 249265 - protein, 9 aa, Homo Sapiens
ELMRGIHSQ

SEQ ID NO: 249266 - protein, 9 aa, Homo Sapiens
VQTVQQNTI

SEQ ID NO: 249267 - protein, 9 aa, Homo Sapiens
SSCLSDHFQ

SEQ ID NO: 249268 - protein, 9 aa, Homo Sapiens
SASTTGSRQ

SEQ ID NO: 249269 - protein, 9 aa, Homo Sapiens
QDKKTEELF

SEQ ID NO: 249270 - protein, 9 aa, Homo Sapiens
YHSEMLAIN

SEQ ID NO: 249271 - protein, 9 aa, Homo Sapiens
LDKVHLEPV

SEQ ID NO: 249272 - protein, 9 aa, Homo Sapiens
VCNAPHWSK

SEQ ID NO: 249273 - protein, 9 aa, Homo Sapiens
CASPRTFPR

SEQ ID NO: 249274 - protein, 9 aa, Homo Sapiens
KWEKHFYVV

SEQ ID NO: 249275 - protein, 9 aa, Homo Sapiens
LSEQSPVAD

SEQ ID NO: 249276 - protein, 9 aa, Homo Sapiens
FGEINFNIH

SEQ ID NO: 249277 - protein, 9 aa, Homo Sapiens
TFLRPDPQR

SEQ ID NO: 249278 - protein, 9 aa, Homo Sapiens
MQQEAPSLP

SEQ ID NO: 249279 - protein, 9 aa, Homo Sapiens
CLLLSKVLS

SEQ ID NO: 249280 - protein, 9 aa, Homo Sapiens
IRECQRQQL

SEQ ID NO: 249281 - protein, 9 aa, Homo Sapiens
DIITLTNRI

SEQ ID NO: 249282 - protein, 9 aa, Homo Sapiens
EHVCKVLLT

SEQ ID NO: 249283 - protein, 9 aa, Homo Sapiens
FCAADKYWR

SEQ ID NO: 249284 - protein, 9 aa, Homo Sapiens
NLEIECMEE

SEQ ID NO: 249285 - protein, 9 aa, Homo Sapiens
EASVKNVIA

SEQ ID NO: 249286 - protein, 9 aa, Homo Sapiens
CRAFHYNVN

SEQ ID NO: 249287 - protein, 9 aa, Homo Sapiens
KNFYLNLGL

SEQ ID NO: 249288 - protein, 9 aa, Homo Sapiens
LFDAICNNK

SEQ ID NO: 249289 - protein, 9 aa, Homo Sapiens
GSGATGSKD

SEQ ID NO: 249290 - protein, 9 aa, Homo Sapiens
VPMLGLTQI

SEQ ID NO: 249291 - protein, 9 aa, Homo Sapiens
CKKGGCKGH

SEQ ID NO: 249292 - protein, 9 aa, Homo Sapiens
ECPWQVMLL

SEQ ID NO: 249293 - protein, 9 aa, Homo Sapiens
VIGYRAAEK

SEQ ID NO: 249294 - protein, 9 aa, Homo Sapiens
FAVQTILTF

SEQ ID NO: 249295 - protein, 9 aa, Homo Sapiens
ILDPVLLVG

SEQ ID NO: 249296 - protein, 9 aa, Homo Sapiens
LESSDLTKV

SEQ ID NO: 249297 - protein, 9 aa, Homo Sapiens
FRQFNKILA

SEQ ID NO: 249298 - protein, 9 aa, Homo Sapiens
YKLGVCLYY

SEQ ID NO: 249299 - protein, 9 aa, Homo Sapiens
NLDQADVDH

SEQ ID NO: 249300 - protein, 9 aa, Homo Sapiens
GQKMSHQHV

SEQ ID NO: 249301 - protein, 9 aa, Homo Sapiens
WLLYAQNVV

SEQ ID NO: 249302 - protein, 9 aa, Homo Sapiens
LTNRIDENW

SEQ ID NO: 249303 - protein, 9 aa, Homo Sapiens
THTGEKHFS

SEQ ID NO: 249304 - protein, 9 aa, Homo Sapiens
LHIAHVGSD

SEQ ID NO: 249305 - protein, 9 aa, Homo Sapiens
GADWPTPIL

SEQ ID NO: 249306 - protein, 9 aa, Homo Sapiens
MLDKIIKIS

SEQ ID NO: 249307 - protein, 9 aa, Homo Sapiens
DQSIKYSFQ

SEQ ID NO: 249308 - protein, 9 aa, Homo Sapiens
PGSHTIDFF

SEQ ID NO: 249309 - protein, 9 aa, Homo Sapiens
SATLSYGTP

SEQ ID NO: 249310 - protein, 9 aa, Homo Sapiens
RNLILSLGL

SEQ ID NO: 249311 - protein, 9 aa, Homo Sapiens
VFLIWAVIH

SEQ ID NO: 249312 - protein, 9 aa, Homo Sapiens
CIRILGILL

SEQ ID NO: 249313 - protein, 9 aa, Homo Sapiens
PGDACGLQD

SEQ ID NO: 249314 - protein, 9 aa, Homo Sapiens
TKLINAYKE

SEQ ID NO: 249315 - protein, 9 aa, Homo Sapiens
SGDRIHCID

SEQ ID NO: 249316 - protein, 9 aa, Homo Sapiens
KARLHVCQN

SEQ ID NO: 249317 - protein, 9 aa, Homo Sapiens
NTEVKGALK

SEQ ID NO: 249318 - protein, 9 aa, Homo Sapiens
RSKDKNILH

SEQ ID NO: 249319 - protein, 9 aa, Homo Sapiens
KKIAIINVS

SEQ ID NO: 249320 - protein, 9 aa, Homo Sapiens
LEEWNEKVT

SEQ ID NO: 249321 - protein, 9 aa, Homo Sapiens
WIYKRIPNC

SEQ ID NO: 249322 - protein, 9 aa, Homo Sapiens
DPQEGTAPE

SEQ ID NO: 249323 - protein, 9 aa, Homo Sapiens
QEISEVVRE

SEQ ID NO: 249324 - protein, 9 aa, Homo Sapiens
CSHDLSECQ

SEQ ID NO: 249325 - protein, 9 aa, Homo Sapiens
NISNKLFQY

SEQ ID NO: 249326 - protein, 9 aa, Homo Sapiens
SELNEAAAQ

SEQ ID NO: 249327 - protein, 9 aa, Homo Sapiens
EARDTLVIS

SEQ ID NO: 249328 - protein, 9 aa, Homo Sapiens
YPDSLEPRR

SEQ ID NO: 249329 - protein, 9 aa, Homo Sapiens
SRVTSTDHY

SEQ ID NO: 249330 - protein, 9 aa, Homo Sapiens
ERISEFSRM

SEQ ID NO: 249331 - protein, 9 aa, Homo Sapiens
VINKVTDKS

SEQ ID NO: 249332 - protein, 9 aa, Homo Sapiens
ITDMRTKHF

SEQ ID NO: 249333 - protein, 9 aa, Homo Sapiens
AKQLNKSMK

SEQ ID NO: 249334 - protein, 9 aa, Homo Sapiens
ALSLALATN

SEQ ID NO: 249335 - protein, 9 aa, Homo Sapiens
KDLAADLEE

SEQ ID NO: 249336 - protein, 9 aa, Homo Sapiens
DLNIEHEKQ

SEQ ID NO: 249337 - protein, 9 aa, Homo Sapiens
IPQKVMWRF

SEQ ID NO: 249338 - protein, 9 aa, Homo Sapiens
SDSHHSPSS

SEQ ID NO: 249339 - protein, 9 aa, Homo Sapiens
VNTQLAIEH

SEQ ID NO: 249340 - protein, 9 aa, Homo Sapiens
KPKSEFGEY

SEQ ID NO: 249341 - protein, 9 aa, Homo Sapiens
KTLIGKRIA

SEQ ID NO: 249342 - protein, 9 aa, Homo Sapiens
IHKSVQIAY

SEQ ID NO: 249343 - protein, 9 aa, Homo Sapiens
KHFSENIYE

SEQ ID NO: 249344 - protein, 9 aa, Homo Sapiens
HHTQLLFCI

SEQ ID NO: 249345 - protein, 9 aa, Homo Sapiens
LSRVREFVG

SEQ ID NO: 249346 - protein, 9 aa, Homo Sapiens
NCSKQHLRL

SEQ ID NO: 249347 - protein, 9 aa, Homo Sapiens
SSVNSVATK

SEQ ID NO: 249348 - protein, 9 aa, Homo Sapiens
TEQLLETID

SEQ ID NO: 249349 - protein, 9 aa, Homo Sapiens
CQVKIWIVY

SEQ ID NO: 249350 - protein, 9 aa, Homo Sapiens
LGPFLTSPW

SEQ ID NO: 249351 - protein, 9 aa, Homo Sapiens
ELQSNLEVP

SEQ ID NO: 249352 - protein, 9 aa, Homo Sapiens
AVPTTTVLN

SEQ ID NO: 249353 - protein, 9 aa, Homo Sapiens
PWQRKKMTR

SEQ ID NO: 249354 - protein, 9 aa, Homo Sapiens
ASPLQALDL

SEQ ID NO: 249355 - protein, 9 aa, Homo Sapiens
GAGAGRQLT

SEQ ID NO: 249356 - protein, 9 aa, Homo Sapiens
RAASHGVGQ

SEQ ID NO: 249357 - protein, 9 aa, Homo Sapiens
ELLNELHKF

SEQ ID NO: 249358 - protein, 9 aa, Homo Sapiens
SLPPSMSSV

SEQ ID NO: 249359 - protein, 9 aa, Homo Sapiens
FSLNNWNAN

SEQ ID NO: 249360 - protein, 9 aa, Homo Sapiens
DGEESPQKY

SEQ ID NO: 249361 - protein, 9 aa, Homo Sapiens
SQLNSEASL

SEQ ID NO: 249362 - protein, 9 aa, Homo Sapiens
FPQKGLSPF

SEQ ID NO: 249363 - protein, 9 aa, Homo Sapiens
KIYARAANM

SEQ ID NO: 249364 - protein, 9 aa, Homo Sapiens
YSTRFPSQT

SEQ ID NO: 249365 - protein, 9 aa, Homo Sapiens
ERRAISPTR

SEQ ID NO: 249366 - protein, 9 aa, Homo Sapiens
DSLIDVFMG

SEQ ID NO: 249367 - protein, 9 aa, Homo Sapiens
VGILTYRGV

SEQ ID NO: 249368 - protein, 9 aa, Homo Sapiens
GSCRWDPGW

SEQ ID NO: 249369 - protein, 9 aa, Homo Sapiens
NIMRENNPD

SEQ ID NO: 249370 - protein, 9 aa, Homo Sapiens
VFPEVLLTK

SEQ ID NO: 249371 - protein, 9 aa, Homo Sapiens
LYYFWSQED

SEQ ID NO: 249372 - protein, 9 aa, Homo Sapiens
PVVIIIDNL

SEQ ID NO: 249373 - protein, 9 aa, Homo Sapiens
PDCNMSEEE

SEQ ID NO: 249374 - protein, 9 aa, Homo Sapiens
LSTLFASLN

SEQ ID NO: 249375 - protein, 9 aa, Homo Sapiens
QNESINNYL

SEQ ID NO: 249376 - protein, 9 aa, Homo Sapiens
RNKEPANDE

SEQ ID NO: 249377 - protein, 9 aa, Homo Sapiens
NLLSTIPPG

SEQ ID NO: 249378 - protein, 9 aa, Homo Sapiens
YFSQRAGSS

SEQ ID NO: 249379 - protein, 9 aa, Homo Sapiens
KSPTFSENM

SEQ ID NO: 249380 - protein, 9 aa, Homo Sapiens
ECIWNKIQC

SEQ ID NO: 249381 - protein, 9 aa, Homo Sapiens
ETIKSQGQD

SEQ ID NO: 249382 - protein, 9 aa, Homo Sapiens
TLYDYCRVP

SEQ ID NO: 249383 - protein, 9 aa, Homo Sapiens
KFQWLGGLA

SEQ ID NO: 249384 - protein, 9 aa, Homo Sapiens
SDDINFEPV

SEQ ID NO: 249385 - protein, 9 aa, Homo Sapiens
AQPFITKSF

SEQ ID NO: 249386 - protein, 9 aa, Homo Sapiens
RQSSTVESE

SEQ ID NO: 249387 - protein, 9 aa, Homo Sapiens
EEIIFNLAD

SEQ ID NO: 249388 - protein, 9 aa, Homo Sapiens
SSRHDPSIS

SEQ ID NO: 249389 - protein, 9 aa, Homo Sapiens
YPCRCVRPG

SEQ ID NO: 249390 - protein, 9 aa, Homo Sapiens
PVHREHGLC

SEQ ID NO: 249391 - protein, 9 aa, Homo Sapiens
RLLNIVYVT

SEQ ID NO: 249392 - protein, 9 aa, Homo Sapiens
PKWTPLSGR

SEQ ID NO: 249393 - protein, 9 aa, Homo Sapiens
TALFDIYAI

SEQ ID NO: 249394 - protein, 9 aa, Homo Sapiens
DNIIVSSKY

SEQ ID NO: 249395 - protein, 9 aa, Homo Sapiens
SDAFWLDDC

SEQ ID NO: 249396 - protein, 9 aa, Homo Sapiens
IGLLIIGIY

SEQ ID NO: 249397 - protein, 9 aa, Homo Sapiens
KAQQLPKYT

SEQ ID NO: 249398 - protein, 9 aa, Homo Sapiens
LIVLGTGGI

SEQ ID NO: 249399 - protein, 9 aa, Homo Sapiens
PRIFLPPGT

SEQ ID NO: 249400 - protein, 9 aa, Homo Sapiens
LEIKEEEPG

SEQ ID NO: 249401 - protein, 9 aa, Homo Sapiens
PNTHDSGIV

SEQ ID NO: 249402 - protein, 9 aa, Homo Sapiens
DAKKVANKD

SEQ ID NO: 249403 - protein, 9 aa, Homo Sapiens
PGKMFSNTF

SEQ ID NO: 249404 - protein, 9 aa, Homo Sapiens
YCELCKHSF

SEQ ID NO: 249405 - protein, 9 aa, Homo Sapiens
VQAVPTTTV

SEQ ID NO: 249406 - protein, 9 aa, Homo Sapiens
PLNAIYVKP

SEQ ID NO: 249407 - protein, 9 aa, Homo Sapiens
ASSSEDSIT

SEQ ID NO: 249408 - protein, 9 aa, Homo Sapiens
KLDPGQFID

SEQ ID NO: 249409 - protein, 9 aa, Homo Sapiens
DGKRRTPDR

SEQ ID NO: 249410 - protein, 9 aa, Homo Sapiens
VFASPESVT

SEQ ID NO: 249411 - protein, 9 aa, Homo Sapiens
RPYQVITAQ

SEQ ID NO: 249412 - protein, 9 aa, Homo Sapiens
NKKANLNAL

SEQ ID NO: 249413 - protein, 9 aa, Homo Sapiens
TAFQKFYER

SEQ ID NO: 249414 - protein, 9 aa, Homo Sapiens
EVLEAGEGQ

SEQ ID NO: 249415 - protein, 9 aa, Homo Sapiens
LALTLVGTQ

SEQ ID NO: 249416 - protein, 9 aa, Homo Sapiens
SMVMASAWC

SEQ ID NO: 249417 - protein, 9 aa, Homo Sapiens
VHRINNTTV

SEQ ID NO: 249418 - protein, 9 aa, Homo Sapiens
WSTVICALT

SEQ ID NO: 249419 - protein, 9 aa, Homo Sapiens
HYEQQQENL

SEQ ID NO: 249420 - protein, 9 aa, Homo Sapiens
KALEEALPV

SEQ ID NO: 249421 - protein, 9 aa, Homo Sapiens
GVQTFRLES

SEQ ID NO: 249422 - protein, 9 aa, Homo Sapiens
NFIDGYVVL

SEQ ID NO: 249423 - protein, 9 aa, Homo Sapiens
LKILTTSIQ

SEQ ID NO: 249424 - protein, 9 aa, Homo Sapiens
AIVKSGGRI

SEQ ID NO: 249425 - protein, 9 aa, Homo Sapiens
KATQELIPS

SEQ ID NO: 249426 - protein, 9 aa, Homo Sapiens
SVHHNYRGI

SEQ ID NO: 249427 - protein, 9 aa, Homo Sapiens
RKEAGYFYY

SEQ ID NO: 249428 - protein, 9 aa, Homo Sapiens
YSFWFHVVK

SEQ ID NO: 249429 - protein, 9 aa, Homo Sapiens
VEQPLGEIT

SEQ ID NO: 249430 - protein, 9 aa, Homo Sapiens
PRRLTDTYN

SEQ ID NO: 249431 - protein, 9 aa, Homo Sapiens
EVSPPVVVN

SEQ ID NO: 249432 - protein, 9 aa, Homo Sapiens
YNQRNIIDT

SEQ ID NO: 249433 - protein, 9 aa, Homo Sapiens
DGCMLLIAV

SEQ ID NO: 249434 - protein, 9 aa, Homo Sapiens
PGTEEKLEK

SEQ ID NO: 249435 - protein, 9 aa, Homo Sapiens
PYQVITAQV

SEQ ID NO: 249436 - protein, 9 aa, Homo Sapiens
TQLAIEHPA

SEQ ID NO: 249437 - protein, 9 aa, Homo Sapiens
VKEQNLVSR

SEQ ID NO: 249438 - protein, 9 aa, Homo Sapiens
HPCSPDSPR

SEQ ID NO: 249439 - protein, 9 aa, Homo Sapiens
GKKPFKCKD

SEQ ID NO: 249440 - protein, 9 aa, Homo Sapiens
MHGSLGAAG

SEQ ID NO: 249441 - protein, 9 aa, Homo Sapiens
KSEAASETQ

SEQ ID NO: 249442 - protein, 9 aa, Homo Sapiens
VNTKTEYEP

SEQ ID NO: 249443 - protein, 9 aa, Homo Sapiens
KRCGSSKGH

SEQ ID NO: 249444 - protein, 9 aa, Homo Sapiens
PSIKGTPLP

SEQ ID NO: 249445 - protein, 9 aa, Homo Sapiens
QFTCSCDIM

SEQ ID NO: 249446 - protein, 9 aa, Homo Sapiens
SQHNKKVEE

SEQ ID NO: 249447 - protein, 9 aa, Homo Sapiens
SPTWSASVT

SEQ ID NO: 249448 - protein, 9 aa, Homo Sapiens
CGKAFSQII

SEQ ID NO: 249449 - protein, 9 aa, Homo Sapiens
INQLRGELD

SEQ ID NO: 249450 - protein, 9 aa, Homo Sapiens
KSVVMRHSW

SEQ ID NO: 249451 - protein, 9 aa, Homo Sapiens
LVTYTTVGP

SEQ ID NO: 249452 - protein, 9 aa, Homo Sapiens
WIVGCIFAE

SEQ ID NO: 249453 - protein, 9 aa, Homo Sapiens
FVRIVDEVM

SEQ ID NO: 249454 - protein, 9 aa, Homo Sapiens
TSLGFAGMD

SEQ ID NO: 249455 - protein, 9 aa, Homo Sapiens
LPRNIEVPG

SEQ ID NO: 249456 - protein, 9 aa, Homo Sapiens
GPGFKLLLR

SEQ ID NO: 249457 - protein, 9 aa, Homo Sapiens
LSITQLIDV

SEQ ID NO: 249458 - protein, 9 aa, Homo Sapiens
MFQSIPNCT

SEQ ID NO: 249459 - protein, 9 aa, Homo Sapiens
KDNSQNQDL

SEQ ID NO: 249460 - protein, 9 aa, Homo Sapiens
SGSRPLTDR

SEQ ID NO: 249461 - protein, 9 aa, Homo Sapiens
EDKNFYLNL

SEQ ID NO: 249462 - protein, 9 aa, Homo Sapiens
LKAAASPIL

SEQ ID NO: 249463 - protein, 9 aa, Homo Sapiens
EPNTESYGD

SEQ ID NO: 249464 - protein, 9 aa, Homo Sapiens
SCNHKEITY

SEQ ID NO: 249465 - protein, 9 aa, Homo Sapiens
PVGSEDKNI

SEQ ID NO: 249466 - protein, 9 aa, Homo Sapiens
ELIAETTED

SEQ ID NO: 249467 - protein, 9 aa, Homo Sapiens
TINLNVDVP

SEQ ID NO: 249468 - protein, 9 aa, Homo Sapiens
NRISQDSES

SEQ ID NO: 249469 - protein, 9 aa, Homo Sapiens
KPVWNRRHS

SEQ ID NO: 249470 - protein, 9 aa, Homo Sapiens
SKLLFKKNI

SEQ ID NO: 249471 - protein, 9 aa, Homo Sapiens
TKKTGHEME

SEQ ID NO: 249472 - protein, 9 aa, Homo Sapiens
FPRTRKWSK

SEQ ID NO: 249473 - protein, 9 aa, Homo Sapiens
PLNVRYIVY

SEQ ID NO: 249474 - protein, 9 aa, Homo Sapiens
VLTSILYIG

SEQ ID NO: 249475 - protein, 9 aa, Homo Sapiens
RINNTTVIY

SEQ ID NO: 249476 - protein, 9 aa, Homo Sapiens
QLEYGGCYL

SEQ ID NO: 249477 - protein, 9 aa, Homo Sapiens
SSVSLTVTP

SEQ ID NO: 249478 - protein, 9 aa, Homo Sapiens
TILLTIIAI

SEQ ID NO: 249479 - protein, 9 aa, Homo Sapiens
GGIAQLRVF

SEQ ID NO: 249480 - protein, 9 aa, Homo Sapiens
LYKHFNSPH

SEQ ID NO: 249481 - protein, 9 aa, Homo Sapiens
SAPEDVDTW

SEQ ID NO: 249482 - protein, 9 aa, Homo Sapiens
RGTLTYFWW

SEQ ID NO: 249483 - protein, 9 aa, Homo Sapiens
IQFHQLAAQ

SEQ ID NO: 249484 - protein, 9 aa, Homo Sapiens
TNRMLASSC

SEQ ID NO: 249485 - protein, 9 aa, Homo Sapiens
LSTRLFLVS

SEQ ID NO: 249486 - protein, 9 aa, Homo Sapiens
ITVRPRNAA

SEQ ID NO: 249487 - protein, 9 aa, Homo Sapiens
LLTNLMYVL

SEQ ID NO: 249488 - protein, 9 aa, Homo Sapiens
SAKNTSKLL

SEQ ID NO: 249489 - protein, 9 aa, Homo Sapiens
LKKLLNRLP

SEQ ID NO: 249490 - protein, 9 aa, Homo Sapiens
KDKHFSLLY

SEQ ID NO: 249491 - protein, 9 aa, Homo Sapiens
ISLATAWLV

SEQ ID NO: 249492 - protein, 9 aa, Homo Sapiens
FLCQPSGSG

SEQ ID NO: 249493 - protein, 9 aa, Homo Sapiens
RLKVIFYRG

SEQ ID NO: 249494 - protein, 9 aa, Homo Sapiens
PALRKGHPQ

SEQ ID NO: 249495 - protein, 9 aa, Homo Sapiens
SQKYADYAN

SEQ ID NO: 249496 - protein, 9 aa, Homo Sapiens
TTLNKHHNV

SEQ ID NO: 249497 - protein, 9 aa, Homo Sapiens
KDYELPTCS

SEQ ID NO: 249498 - protein, 9 aa, Homo Sapiens
DVQRKGTYR

SEQ ID NO: 249499 - protein, 9 aa, Homo Sapiens
NSGYKWCPT

SEQ ID NO: 249500 - protein, 9 aa, Homo Sapiens
KKKKNKGNK

SEQ ID NO: 249501 - protein, 9 aa, Homo Sapiens
VKPTNDFAH

SEQ ID NO: 249502 - protein, 9 aa, Homo Sapiens
MNHGCSYTA

SEQ ID NO: 249503 - protein, 9 aa, Homo Sapiens
CLGLGTAFS

SEQ ID NO: 249504 - protein, 9 aa, Homo Sapiens
PEVIKIKSI

SEQ ID NO: 249505 - protein, 9 aa, Homo Sapiens
KPDDKSIMT

SEQ ID NO: 249506 - protein, 9 aa, Homo Sapiens
IIQQRNGRK

SEQ ID NO: 249507 - protein, 9 aa, Homo Sapiens
YSKDNNSGA

SEQ ID NO: 249508 - protein, 9 aa, Homo Sapiens
TQSPLFTFE

SEQ ID NO: 249509 - protein, 9 aa, Homo Sapiens
LPVFNPMSQ

SEQ ID NO: 249510 - protein, 9 aa, Homo Sapiens
KDAGRRINS

SEQ ID NO: 249511 - protein, 9 aa, Homo Sapiens
TSQHFVQIP

SEQ ID NO: 249512 - protein, 9 aa, Homo Sapiens
LETVYLEWN

SEQ ID NO: 249513 - protein, 9 aa, Homo Sapiens
RHDPSISFS

SEQ ID NO: 249514 - protein, 9 aa, Homo Sapiens
QICGYRVLF

SEQ ID NO: 249515 - protein, 9 aa, Homo Sapiens
EPNTQKNVS

SEQ ID NO: 249516 - protein, 9 aa, Homo Sapiens
VVALDLHGV

SEQ ID NO: 249517 - protein, 9 aa, Homo Sapiens
DAGNKKTSI

SEQ ID NO: 249518 - protein, 9 aa, Homo Sapiens
EHLKLSPKS

SEQ ID NO: 249519 - protein, 9 aa, Homo Sapiens
RNQSWSWCR

SEQ ID NO: 249520 - protein, 9 aa, Homo Sapiens
SNLDQADVD

SEQ ID NO: 249521 - protein, 9 aa, Homo Sapiens
SMGLSCPLQ

SEQ ID NO: 249522 - protein, 9 aa, Homo Sapiens
WVESIVLIF

SEQ ID NO: 249523 - protein, 9 aa, Homo Sapiens
MLESLDEDN

SEQ ID NO: 249524 - protein, 9 aa, Homo Sapiens
NYAGLGPSP

SEQ ID NO: 249525 - protein, 9 aa, Homo Sapiens
AVNKAMQYG

SEQ ID NO: 249526 - protein, 9 aa, Homo Sapiens
HLLNDLQAN

SEQ ID NO: 249527 - protein, 9 aa, Homo Sapiens
WLFCRVRFD

SEQ ID NO: 249528 - protein, 9 aa, Homo Sapiens
YGAHVGKQA

SEQ ID NO: 249529 - protein, 9 aa, Homo Sapiens
GFQNLHIDD

SEQ ID NO: 249530 - protein, 9 aa, Homo Sapiens
TNMMVPPLP

SEQ ID NO: 249531 - protein, 9 aa, Homo Sapiens
TVKHKLQAH

SEQ ID NO: 249532 - protein, 9 aa, Homo Sapiens
RCGAGTAPK

SEQ ID NO: 249533 - protein, 9 aa, Homo Sapiens
QQVSFPHNG

SEQ ID NO: 249534 - protein, 9 aa, Homo Sapiens
RDCGQKMSH

SEQ ID NO: 249535 - protein, 9 aa, Homo Sapiens
ELGGWRTSG

SEQ ID NO: 249536 - protein, 9 aa, Homo Sapiens
NRRNRERKT

SEQ ID NO: 249537 - protein, 9 aa, Homo Sapiens
QQTPQPSIL

SEQ ID NO: 249538 - protein, 9 aa, Homo Sapiens
STENIYKEF

SEQ ID NO: 249539 - protein, 9 aa, Homo Sapiens
EHVIGLLDV

SEQ ID NO: 249540 - protein, 9 aa, Homo Sapiens
YCAVHFTRN

SEQ ID NO: 249541 - protein, 9 aa, Homo Sapiens
GADNDGSGA

SEQ ID NO: 249542 - protein, 9 aa, Homo Sapiens
LSLVDIFVS

SEQ ID NO: 249543 - protein, 9 aa, Homo Sapiens
FLFMLFFVL

SEQ ID NO: 249544 - protein, 9 aa, Homo Sapiens
GYSYDTIGK

SEQ ID NO: 249545 - protein, 9 aa, Homo Sapiens
MNTEAEKVK

SEQ ID NO: 249546 - protein, 9 aa, Homo Sapiens
DDLEKVNET

SEQ ID NO: 249547 - protein, 9 aa, Homo Sapiens
ECIPPEGRR

SEQ ID NO: 249548 - protein, 9 aa, Homo Sapiens
VLRVLDQVQ

SEQ ID NO: 249549 - protein, 9 aa, Homo Sapiens
EKHKQKFAP

SEQ ID NO: 249550 - protein, 9 aa, Homo Sapiens
LCDQNQKKP

SEQ ID NO: 249551 - protein, 9 aa, Homo Sapiens
SAEASGAPE

SEQ ID NO: 249552 - protein, 9 aa, Homo Sapiens
SGGIPLFSL

SEQ ID NO: 249553 - protein, 9 aa, Homo Sapiens
DYSVPRRDS

SEQ ID NO: 249554 - protein, 9 aa, Homo Sapiens
SSKLNYKFW

SEQ ID NO: 249555 - protein, 9 aa, Homo Sapiens
HKRNLDLEK

SEQ ID NO: 249556 - protein, 9 aa, Homo Sapiens
ILHLITHTK

SEQ ID NO: 249557 - protein, 9 aa, Homo Sapiens
VFTEVDNFH

SEQ ID NO: 249558 - protein, 9 aa, Homo Sapiens
HWSALKGHL

SEQ ID NO: 249559 - protein, 9 aa, Homo Sapiens
ALEDLAMFQ

SEQ ID NO: 249560 - protein, 9 aa, Homo Sapiens
QFYNSEGYG

SEQ ID NO: 249561 - protein, 9 aa, Homo Sapiens
HSGMLVMLH

SEQ ID NO: 249562 - protein, 9 aa, Homo Sapiens
MIKKAHKVF

SEQ ID NO: 249563 - protein, 9 aa, Homo Sapiens
APQPGPHTT

SEQ ID NO: 249564 - protein, 9 aa, Homo Sapiens
GGRGKISKG

SEQ ID NO: 249565 - protein, 9 aa, Homo Sapiens
PLRLGFIFV

SEQ ID NO: 249566 - protein, 9 aa, Homo Sapiens
GTITCVQPL

SEQ ID NO: 249567 - protein, 9 aa, Homo Sapiens
QEDTYELDI

SEQ ID NO: 249568 - protein, 9 aa, Homo Sapiens
LDNLSNQIG

SEQ ID NO: 249569 - protein, 9 aa, Homo Sapiens
KNTFALLVE

SEQ ID NO: 249570 - protein, 9 aa, Homo Sapiens
SLINLHIMH

SEQ ID NO: 249571 - protein, 9 aa, Homo Sapiens
HPLTVSSSV

SEQ ID NO: 249572 - protein, 9 aa, Homo Sapiens
AIWELNEYL

SEQ ID NO: 249573 - protein, 9 aa, Homo Sapiens
LPNIALQGS

SEQ ID NO: 249574 - protein, 9 aa, Homo Sapiens
RYGQKNKKI

SEQ ID NO: 249575 - protein, 9 aa, Homo Sapiens
YRGKVFKNC

SEQ ID NO: 249576 - protein, 9 aa, Homo Sapiens
ILQAAFRLL

SEQ ID NO: 249577 - protein, 9 aa, Homo Sapiens
KRFHFNSES

SEQ ID NO: 249578 - protein, 9 aa, Homo Sapiens
SKCELYTCL

SEQ ID NO: 249579 - protein, 9 aa, Homo Sapiens
GAQSQYVCR

SEQ ID NO: 249580 - protein, 9 aa, Homo Sapiens
IGSDPLQLV

SEQ ID NO: 249581 - protein, 9 aa, Homo Sapiens
LQEMDSSGE

SEQ ID NO: 249582 - protein, 9 aa, Homo Sapiens
NDPEITING

SEQ ID NO: 249583 - protein, 9 aa, Homo Sapiens
NRDSIFRSS

SEQ ID NO: 249584 - protein, 9 aa, Homo Sapiens
SNCSQYSDI

SEQ ID NO: 249585 - protein, 9 aa, Homo Sapiens
RQLFVCDVL

SEQ ID NO: 249586 - protein, 9 aa, Homo Sapiens
TDAGIDFCS

SEQ ID NO: 249587 - protein, 9 aa, Homo Sapiens
VKLLLGQIC

SEQ ID NO: 249588 - protein, 9 aa, Homo Sapiens
QLHQNVHVG

SEQ ID NO: 249589 - protein, 9 aa, Homo Sapiens
PSPFRNSVA

SEQ ID NO: 249590 - protein, 9 aa, Homo Sapiens
DHWKFPQGQ

SEQ ID NO: 249591 - protein, 9 aa, Homo Sapiens
DNWKGTWPG

SEQ ID NO: 249592 - protein, 9 aa, Homo Sapiens
LEQQNIQSQ

SEQ ID NO: 249593 - protein, 9 aa, Homo Sapiens
RRKEMEIMA

SEQ ID NO: 249594 - protein, 9 aa, Homo Sapiens
EPTSCQISC

SEQ ID NO: 249595 - protein, 9 aa, Homo Sapiens
EQEVAWQGL

SEQ ID NO: 249596 - protein, 9 aa, Homo Sapiens
ENVSSSAVL

SEQ ID NO: 249597 - protein, 9 aa, Homo Sapiens
KFSEKAQNM

SEQ ID NO: 249598 - protein, 9 aa, Homo Sapiens
QIYIQVSEV

SEQ ID NO: 249599 - protein, 9 aa, Homo Sapiens
TASENANKG

SEQ ID NO: 249600 - protein, 9 aa, Homo Sapiens
VFVPYLYST

SEQ ID NO: 249601 - protein, 9 aa, Homo Sapiens
RKTRYSLRK

SEQ ID NO: 249602 - protein, 9 aa, Homo Sapiens
SKPEKPQDS

SEQ ID NO: 249603 - protein, 9 aa, Homo Sapiens
HLAQAVHVQ

SEQ ID NO: 249604 - protein, 9 aa, Homo Sapiens
SVDENFRPQ

SEQ ID NO: 249605 - protein, 9 aa, Homo Sapiens
DKNIENVTF

SEQ ID NO: 249606 - protein, 9 aa, Homo Sapiens
QGIVCFYGK

SEQ ID NO: 249607 - protein, 9 aa, Homo Sapiens
IGMFTDPAH

SEQ ID NO: 249608 - protein, 9 aa, Homo Sapiens
SPPANPSIL

SEQ ID NO: 249609 - protein, 9 aa, Homo Sapiens
GHSKSIQWL

SEQ ID NO: 249610 - protein, 9 aa, Homo Sapiens
QERELCRQD

SEQ ID NO: 249611 - protein, 9 aa, Homo Sapiens
VVLALEHLH

SEQ ID NO: 249612 - protein, 9 aa, Homo Sapiens
LSLGLVACV

SEQ ID NO: 249613 - protein, 9 aa, Homo Sapiens
LNDFVTQQT

SEQ ID NO: 249614 - protein, 9 aa, Homo Sapiens
DVDHLFQNK

SEQ ID NO: 249615 - protein, 9 aa, Homo Sapiens
EEMIQIINK

SEQ ID NO: 249616 - protein, 9 aa, Homo Sapiens
LHKIYVCQS

SEQ ID NO: 249617 - protein, 9 aa, Homo Sapiens
CMLYKEDRI

SEQ ID NO: 249618 - protein, 9 aa, Homo Sapiens
EQVHQYSSC

SEQ ID NO: 249619 - protein, 9 aa, Homo Sapiens
LLGRTVKDI

SEQ ID NO: 249620 - protein, 9 aa, Homo Sapiens
LVVIAVERF

SEQ ID NO: 249621 - protein, 9 aa, Homo Sapiens
FLSVFYCKN

SEQ ID NO: 249622 - protein, 9 aa, Homo Sapiens
RTLQTKNHK

SEQ ID NO: 249623 - protein, 9 aa, Homo Sapiens
QNQLYDTQV

SEQ ID NO: 249624 - protein, 9 aa, Homo Sapiens
SYGTLKLHV

SEQ ID NO: 249625 - protein, 9 aa, Homo Sapiens
SNLDSSRDN

SEQ ID NO: 249626 - protein, 9 aa, Homo Sapiens
RTSGKWTSL

SEQ ID NO: 249627 - protein, 9 aa, Homo Sapiens
SLTQVPNSG

SEQ ID NO: 249628 - protein, 9 aa, Homo Sapiens
IDVRGHSSL

SEQ ID NO: 249629 - protein, 9 aa, Homo Sapiens
VVFLVTFLL

SEQ ID NO: 249630 - protein, 9 aa, Homo Sapiens
DHTGLTAVS

SEQ ID NO: 249631 - protein, 9 aa, Homo Sapiens
RSGSYFSQR

SEQ ID NO: 249632 - protein, 9 aa, Homo Sapiens
IWESLENAS

SEQ ID NO: 249633 - protein, 9 aa, Homo Sapiens
KLFLLCGQY

SEQ ID NO: 249634 - protein, 9 aa, Homo Sapiens
EKHCMCRNL

SEQ ID NO: 249635 - protein, 9 aa, Homo Sapiens
KRNTIKKCE

SEQ ID NO: 249636 - protein, 9 aa, Homo Sapiens
LLHPDVISY

SEQ ID NO: 249637 - protein, 9 aa, Homo Sapiens
GTVQSKLHN

SEQ ID NO: 249638 - protein, 9 aa, Homo Sapiens
PITSSEKPT

SEQ ID NO: 249639 - protein, 9 aa, Homo Sapiens
IVSWDSDTC

SEQ ID NO: 249640 - protein, 9 aa, Homo Sapiens
PRAKSTWLH

SEQ ID NO: 249641 - protein, 9 aa, Homo Sapiens
ENDFMTLFF

SEQ ID NO: 249642 - protein, 9 aa, Homo Sapiens
QAKNPKVSR

SEQ ID NO: 249643 - protein, 9 aa, Homo Sapiens
KVVTIIPRI

SEQ ID NO: 249644 - protein, 9 aa, Homo Sapiens
VWIIFVMWT

SEQ ID NO: 249645 - protein, 9 aa, Homo Sapiens
DKKPESKIN

SEQ ID NO: 249646 - protein, 9 aa, Homo Sapiens
DIKAFGVHV

SEQ ID NO: 249647 - protein, 9 aa, Homo Sapiens
IHIEKYQRC

SEQ ID NO: 249648 - protein, 9 aa, Homo Sapiens
GLKNGALSQ

SEQ ID NO: 249649 - protein, 9 aa, Homo Sapiens
WICGQVLNN

SEQ ID NO: 249650 - protein, 9 aa, Homo Sapiens
GGVTDISAA

SEQ ID NO: 249651 - protein, 9 aa, Homo Sapiens
KVAEIIKEA

SEQ ID NO: 249652 - protein, 9 aa, Homo Sapiens
HKDYIECAK

SEQ ID NO: 249653 - protein, 9 aa, Homo Sapiens
AQKSQQMPQ

SEQ ID NO: 249654 - protein, 9 aa, Homo Sapiens
QLSLAPGQF

SEQ ID NO: 249655 - protein, 9 aa, Homo Sapiens
LQDGSLLYL

SEQ ID NO: 249656 - protein, 9 aa, Homo Sapiens
MCYLPEYKI

SEQ ID NO: 249657 - protein, 9 aa, Homo Sapiens
TLTFQAGFL

SEQ ID NO: 249658 - protein, 9 aa, Homo Sapiens
DVRAYQQLL

SEQ ID NO: 249659 - protein, 9 aa, Homo Sapiens
IRRKARSLP

SEQ ID NO: 249660 - protein, 9 aa, Homo Sapiens
IMESMLNTN

SEQ ID NO: 249661 - protein, 9 aa, Homo Sapiens
SNPEVIKIK

SEQ ID NO: 249662 - protein, 9 aa, Homo Sapiens
KYPKIVHFS

SEQ ID NO: 249663 - protein, 9 aa, Homo Sapiens
LKPTLNNFY

SEQ ID NO: 249664 - protein, 9 aa, Homo Sapiens
YFQMDFGHT

SEQ ID NO: 249665 - protein, 9 aa, Homo Sapiens
VLSKEGVER

SEQ ID NO: 249666 - protein, 9 aa, Homo Sapiens
ELQRRVHGG

SEQ ID NO: 249667 - protein, 9 aa, Homo Sapiens
NPTEKSRQY

SEQ ID NO: 249668 - protein, 9 aa, Homo Sapiens
VEQVSSFLD

SEQ ID NO: 249669 - protein, 9 aa, Homo Sapiens
FTPNYLQRG

SEQ ID NO: 249670 - protein, 9 aa, Homo Sapiens
VSPEDIKKA

SEQ ID NO: 249671 - protein, 9 aa, Homo Sapiens
EWVFGGPPC

SEQ ID NO: 249672 - protein, 9 aa, Homo Sapiens
TTDVKALRW

SEQ ID NO: 249673 - protein, 9 aa, Homo Sapiens
EVCFTCVDG

SEQ ID NO: 249674 - protein, 9 aa, Homo Sapiens
DLTNRASFK

SEQ ID NO: 249675 - protein, 9 aa, Homo Sapiens
EVEAYKHFK

SEQ ID NO: 249676 - protein, 9 aa, Homo Sapiens
PHFAEAFKA

SEQ ID NO: 249677 - protein, 9 aa, Homo Sapiens
LEGHSKCVG

SEQ ID NO: 249678 - protein, 9 aa, Homo Sapiens
SINYSKIDY

SEQ ID NO: 249679 - protein, 9 aa, Homo Sapiens
EYAPMITGF

SEQ ID NO: 249680 - protein, 9 aa, Homo Sapiens
ALTHNGTPQ

SEQ ID NO: 249681 - protein, 9 aa, Homo Sapiens
KVGLYQRQT

SEQ ID NO: 249682 - protein, 9 aa, Homo Sapiens
LVMGVDVML

SEQ ID NO: 249683 - protein, 9 aa, Homo Sapiens
LDTTPSCNR

SEQ ID NO: 249684 - protein, 9 aa, Homo Sapiens
IAIVFSAPL

SEQ ID NO: 249685 - protein, 9 aa, Homo Sapiens
LSDLLQSPS

SEQ ID NO: 249686 - protein, 9 aa, Homo Sapiens
GEYNAANLR

SEQ ID NO: 249687 - protein, 9 aa, Homo Sapiens
YDHNPKVFP

SEQ ID NO: 249688 - protein, 9 aa, Homo Sapiens
ALPKYKLAN

SEQ ID NO: 249689 - protein, 9 aa, Homo Sapiens
ESPSALQVL

SEQ ID NO: 249690 - protein, 9 aa, Homo Sapiens
VNQHSSETY

SEQ ID NO: 249691 - protein, 9 aa, Homo Sapiens
NECLFCVEQ

SEQ ID NO: 249692 - protein, 9 aa, Homo Sapiens
WLQYQEETT

SEQ ID NO: 249693 - protein, 9 aa, Homo Sapiens
LRGMHPRAN

SEQ ID NO: 249694 - protein, 9 aa, Homo Sapiens
SGLPSLGHV

SEQ ID NO: 249695 - protein, 9 aa, Homo Sapiens
RPNWQLERL

SEQ ID NO: 249696 - protein, 9 aa, Homo Sapiens
TAVNNFILK

SEQ ID NO: 249697 - protein, 9 aa, Homo Sapiens
VFIVDSCDE

SEQ ID NO: 249698 - protein, 9 aa, Homo Sapiens
IYKRIPNCK

SEQ ID NO: 249699 - protein, 9 aa, Homo Sapiens
SNKEFEEYK

SEQ ID NO: 249700 - protein, 9 aa, Homo Sapiens
TYYPSERKR

SEQ ID NO: 249701 - protein, 9 aa, Homo Sapiens
LSLSFFTTS

SEQ ID NO: 249702 - protein, 9 aa, Homo Sapiens
CAVIAHSAV

SEQ ID NO: 249703 - protein, 9 aa, Homo Sapiens
AVRAANIVS

SEQ ID NO: 249704 - protein, 9 aa, Homo Sapiens
PTHPPKEVV

SEQ ID NO: 249705 - protein, 9 aa, Homo Sapiens
YKCSECGNA

SEQ ID NO: 249706 - protein, 9 aa, Homo Sapiens
LFCLCELAA

SEQ ID NO: 249707 - protein, 9 aa, Homo Sapiens
GQAVHGELP

SEQ ID NO: 249708 - protein, 9 aa, Homo Sapiens
VHSSETAIM

SEQ ID NO: 249709 - protein, 9 aa, Homo Sapiens
LSALLDWRY

SEQ ID NO: 249710 - protein, 9 aa, Homo Sapiens
SKIEKTDTV

SEQ ID NO: 249711 - protein, 9 aa, Homo Sapiens
PMKSRAPPL

SEQ ID NO: 249712 - protein, 9 aa, Homo Sapiens
YCAAAVASL

SEQ ID NO: 249713 - protein, 9 aa, Homo Sapiens
CDGTDKYNS

SEQ ID NO: 249714 - protein, 9 aa, Homo Sapiens
FPDILDPQV

SEQ ID NO: 249715 - protein, 9 aa, Homo Sapiens
DEADQMFDM

SEQ ID NO: 249716 - protein, 9 aa, Homo Sapiens
IQLAKEKTQ

SEQ ID NO: 249717 - protein, 9 aa, Homo Sapiens
DENSILYHN

SEQ ID NO: 249718 - protein, 9 aa, Homo Sapiens
DDIIPREMK

SEQ ID NO: 249719 - protein, 9 aa, Homo Sapiens
PKNNIKTRS

SEQ ID NO: 249720 - protein, 9 aa, Homo Sapiens
NRRTIGVQH

SEQ ID NO: 249721 - protein, 9 aa, Homo Sapiens
RLFQKTLRL

SEQ ID NO: 249722 - protein, 9 aa, Homo Sapiens
SQKACACAE

SEQ ID NO: 249723 - protein, 9 aa, Homo Sapiens
TGKAKALTS

SEQ ID NO: 249724 - protein, 9 aa, Homo Sapiens
FVFDKAIKQ

SEQ ID NO: 249725 - protein, 9 aa, Homo Sapiens
REVKIYCQV

SEQ ID NO: 249726 - protein, 9 aa, Homo Sapiens
CRQDAKGLF

SEQ ID NO: 249727 - protein, 9 aa, Homo Sapiens
LVQKKAHPV

SEQ ID NO: 249728 - protein, 9 aa, Homo Sapiens
WWATTYVSD

SEQ ID NO: 249729 - protein, 9 aa, Homo Sapiens
RQKYWWDAV

SEQ ID NO: 249730 - protein, 9 aa, Homo Sapiens
YPEFPVLEW

SEQ ID NO: 249731 - protein, 9 aa, Homo Sapiens
NTISFAGCF

SEQ ID NO: 249732 - protein, 9 aa, Homo Sapiens
YTLRLDPST

SEQ ID NO: 249733 - protein, 9 aa, Homo Sapiens
EVTPELSFF

SEQ ID NO: 249734 - protein, 9 aa, Homo Sapiens
LRSHSGKAM

SEQ ID NO: 249735 - protein, 9 aa, Homo Sapiens
FISRCRDGL

SEQ ID NO: 249736 - protein, 9 aa, Homo Sapiens
KYFSRKGHL

SEQ ID NO: 249737 - protein, 9 aa, Homo Sapiens
GVVWYFQIN

SEQ ID NO: 249738 - protein, 9 aa, Homo Sapiens
DCSFVVCTT

SEQ ID NO: 249739 - protein, 9 aa, Homo Sapiens
HDVEVLEQN

SEQ ID NO: 249740 - protein, 9 aa, Homo Sapiens
AIFVIFTLL

SEQ ID NO: 249741 - protein, 9 aa, Homo Sapiens
NNTVGNDSC

SEQ ID NO: 249742 - protein, 9 aa, Homo Sapiens
LVNNYYTLE

SEQ ID NO: 249743 - protein, 9 aa, Homo Sapiens
YLPKFKYPS

SEQ ID NO: 249744 - protein, 9 aa, Homo Sapiens
KLREMEDIA

SEQ ID NO: 249745 - protein, 9 aa, Homo Sapiens
KVCMHPHNA

SEQ ID NO: 249746 - protein, 9 aa, Homo Sapiens
MIEALQKRC

SEQ ID NO: 249747 - protein, 9 aa, Homo Sapiens
SIEKLSETI

SEQ ID NO: 249748 - protein, 9 aa, Homo Sapiens
VRVVGVEPH

SEQ ID NO: 249749 - protein, 9 aa, Homo Sapiens
AVEAILNQK

SEQ ID NO: 249750 - protein, 9 aa, Homo Sapiens
ILKILTTSI

SEQ ID NO: 249751 - protein, 9 aa, Homo Sapiens
LLKKFASVQ

SEQ ID NO: 249752 - protein, 9 aa, Homo Sapiens
DNMNKINGD

SEQ ID NO: 249753 - protein, 9 aa, Homo Sapiens
EEEDDDYDN

SEQ ID NO: 249754 - protein, 9 aa, Homo Sapiens
IMSPGNARP

SEQ ID NO: 249755 - protein, 9 aa, Homo Sapiens
ATNSAPTSS

SEQ ID NO: 249756 - protein, 9 aa, Homo Sapiens
YSRHRVQTE

SEQ ID NO: 249757 - protein, 9 aa, Homo Sapiens
TTITLAAFT

SEQ ID NO: 249758 - protein, 9 aa, Homo Sapiens
KHNLISPED

SEQ ID NO: 249759 - protein, 9 aa, Homo Sapiens
AQLAQIQVQ

SEQ ID NO: 249760 - protein, 9 aa, Homo Sapiens
QAPSGGQTP

SEQ ID NO: 249761 - protein, 9 aa, Homo Sapiens
VELDLLGDP

SEQ ID NO: 249762 - protein, 9 aa, Homo Sapiens
SDDGGKVLL

SEQ ID NO: 249763 - protein, 9 aa, Homo Sapiens
TFHDNDFEP

SEQ ID NO: 249764 - protein, 9 aa, Homo Sapiens
CFRVWFNFT

SEQ ID NO: 249765 - protein, 9 aa, Homo Sapiens
QGTSWGRGG

SEQ ID NO: 249766 - protein, 9 aa, Homo Sapiens
VSELNTQKV

SEQ ID NO: 249767 - protein, 9 aa, Homo Sapiens
SIREEPLTE

SEQ ID NO: 249768 - protein, 9 aa, Homo Sapiens
IICVIVEKD

SEQ ID NO: 249769 - protein, 9 aa, Homo Sapiens
ARNTSQEEG

SEQ ID NO: 249770 - protein, 9 aa, Homo Sapiens
HFVNDQWIK

SEQ ID NO: 249771 - protein, 9 aa, Homo Sapiens
LIGVLISHS

SEQ ID NO: 249772 - protein, 9 aa, Homo Sapiens
MKEAAKIAK

SEQ ID NO: 249773 - protein, 9 aa, Homo Sapiens
YGRNKSWLC

SEQ ID NO: 249774 - protein, 9 aa, Homo Sapiens
YGFVIFLSS

SEQ ID NO: 249775 - protein, 9 aa, Homo Sapiens
RISQDSESW

SEQ ID NO: 249776 - protein, 9 aa, Homo Sapiens
AVIAHSAVV

SEQ ID NO: 249777 - protein, 9 aa, Homo Sapiens
ERFSLFTNR

SEQ ID NO: 249778 - protein, 9 aa, Homo Sapiens
INIDIEQDV

SEQ ID NO: 249779 - protein, 9 aa, Homo Sapiens
YLNSLLQTR

SEQ ID NO: 249780 - protein, 9 aa, Homo Sapiens
QEVNTLHCQ

SEQ ID NO: 249781 - protein, 9 aa, Homo Sapiens
ETLILSENY

SEQ ID NO: 249782 - protein, 9 aa, Homo Sapiens
YLDFARYSD

SEQ ID NO: 249783 - protein, 9 aa, Homo Sapiens
GKTFLQPKH

SEQ ID NO: 249784 - protein, 9 aa, Homo Sapiens
NSANPIIYF

SEQ ID NO: 249785 - protein, 9 aa, Homo Sapiens
EEFQVVKYA

SEQ ID NO: 249786 - protein, 9 aa, Homo Sapiens
NELDNPHTQ

SEQ ID NO: 249787 - protein, 9 aa, Homo Sapiens
KEYQAKDVI

SEQ ID NO: 249788 - protein, 9 aa, Homo Sapiens
QAQHPYLHR

SEQ ID NO: 249789 - protein, 9 aa, Homo Sapiens
LTLLNIIKL

SEQ ID NO: 249790 - protein, 9 aa, Homo Sapiens
DVNIGMKGL

SEQ ID NO: 249791 - protein, 9 aa, Homo Sapiens
LFSWDTVFT

SEQ ID NO: 249792 - protein, 9 aa, Homo Sapiens
IYRYVYHSS

SEQ ID NO: 249793 - protein, 9 aa, Homo Sapiens
WGYQVALRE

SEQ ID NO: 249794 - protein, 9 aa, Homo Sapiens
TVADQGEQQ

SEQ ID NO: 249795 - protein, 9 aa, Homo Sapiens
GPREGAFLA

SEQ ID NO: 249796 - protein, 9 aa, Homo Sapiens
GMGLIPEEP

SEQ ID NO: 249797 - protein, 9 aa, Homo Sapiens
ICIRILGIL

SEQ ID NO: 249798 - protein, 9 aa, Homo Sapiens
NLILSLGLF

SEQ ID NO: 249799 - protein, 9 aa, Homo Sapiens
ALTRFNKQL

SEQ ID NO: 249800 - protein, 9 aa, Homo Sapiens
ELLYVTDTN

SEQ ID NO: 249801 - protein, 9 aa, Homo Sapiens
PGPLTPELE

SEQ ID NO: 249802 - protein, 9 aa, Homo Sapiens
NLSQAFYSL

SEQ ID NO: 249803 - protein, 9 aa, Homo Sapiens
RLVPSPDQK

SEQ ID NO: 249804 - protein, 9 aa, Homo Sapiens
QNPSSGVRL

SEQ ID NO: 249805 - protein, 9 aa, Homo Sapiens
FLVRDNSKK

SEQ ID NO: 249806 - protein, 9 aa, Homo Sapiens
ITHTKEKPY

SEQ ID NO: 249807 - protein, 9 aa, Homo Sapiens
SERLLGTFS

SEQ ID NO: 249808 - protein, 9 aa, Homo Sapiens
DDERNYHIV

SEQ ID NO: 249809 - protein, 9 aa, Homo Sapiens
KYMELSFAV

SEQ ID NO: 249810 - protein, 9 aa, Homo Sapiens
AAADVLGLI

SEQ ID NO: 249811 - protein, 9 aa, Homo Sapiens
LHQNFMLII

SEQ ID NO: 249812 - protein, 9 aa, Homo Sapiens
YKTNFYSSQ

SEQ ID NO: 249813 - protein, 9 aa, Homo Sapiens
YSPAGRIIL

SEQ ID NO: 249814 - protein, 9 aa, Homo Sapiens
TVVTVTCSR

SEQ ID NO: 249815 - protein, 9 aa, Homo Sapiens
IYWSMYQRL

SEQ ID NO: 249816 - protein, 9 aa, Homo Sapiens
NHSKCITEC

SEQ ID NO: 249817 - protein, 9 aa, Homo Sapiens
TGILGKCLG

SEQ ID NO: 249818 - protein, 9 aa, Homo Sapiens
TMLDLQSPN

SEQ ID NO: 249819 - protein, 9 aa, Homo Sapiens
VKVLQELQR

SEQ ID NO: 249820 - protein, 9 aa, Homo Sapiens
KSGGRISLK

SEQ ID NO: 249821 - protein, 9 aa, Homo Sapiens
PQSRPQSFF

SEQ ID NO: 249822 - protein, 9 aa, Homo Sapiens
RRFILNILN

SEQ ID NO: 249823 - protein, 9 aa, Homo Sapiens
GNYKNFFFF

SEQ ID NO: 249824 - protein, 9 aa, Homo Sapiens
KIWIEIIAL

SEQ ID NO: 249825 - protein, 9 aa, Homo Sapiens
GKTPCEGRL

SEQ ID NO: 249826 - protein, 9 aa, Homo Sapiens
RMQQHKLKT

SEQ ID NO: 249827 - protein, 9 aa, Homo Sapiens
AKTITPLRQ

SEQ ID NO: 249828 - protein, 9 aa, Homo Sapiens
ATGLDDSYL

SEQ ID NO: 249829 - protein, 9 aa, Homo Sapiens
DRLQIPWLR

SEQ ID NO: 249830 - protein, 9 aa, Homo Sapiens
LLPLQVRLD

SEQ ID NO: 249831 - protein, 9 aa, Homo Sapiens
SSSAAFAGS

SEQ ID NO: 249832 - protein, 9 aa, Homo Sapiens
PERVGDKDK

SEQ ID NO: 249833 - protein, 9 aa, Homo Sapiens
AHITEFTII

SEQ ID NO: 249834 - protein, 9 aa, Homo Sapiens
PPSYFRRFT

SEQ ID NO: 249835 - protein, 9 aa, Homo Sapiens
YWWDAVCTL

SEQ ID NO: 249836 - protein, 9 aa, Homo Sapiens
TLTVASEHY

SEQ ID NO: 249837 - protein, 9 aa, Homo Sapiens
TATGPRTES

SEQ ID NO: 249838 - protein, 9 aa, Homo Sapiens
DRLYGGVCH

SEQ ID NO: 249839 - protein, 9 aa, Homo Sapiens
CLGSILTPK

SEQ ID NO: 249840 - protein, 9 aa, Homo Sapiens
KYIAQRKWE

SEQ ID NO: 249841 - protein, 9 aa, Homo Sapiens
TSAHTLVTC

SEQ ID NO: 249842 - protein, 9 aa, Homo Sapiens
SKEANIRAK

SEQ ID NO: 249843 - protein, 9 aa, Homo Sapiens
PLPTLKWKP

SEQ ID NO: 249844 - protein, 9 aa, Homo Sapiens
RREIWLQKQ

SEQ ID NO: 249845 - protein, 9 aa, Homo Sapiens
DERDLTNRA

SEQ ID NO: 249846 - protein, 9 aa, Homo Sapiens
DKILFGTEF

SEQ ID NO: 249847 - protein, 9 aa, Homo Sapiens
GVWQNVSMA

SEQ ID NO: 249848 - protein, 9 aa, Homo Sapiens
ELIRAKLCP

SEQ ID NO: 249849 - protein, 9 aa, Homo Sapiens
DYINATFIK

SEQ ID NO: 249850 - protein, 9 aa, Homo Sapiens
AQSFENVMA

SEQ ID NO: 249851 - protein, 9 aa, Homo Sapiens
YEIIEVVLK

SEQ ID NO: 249852 - protein, 9 aa, Homo Sapiens
KGECPWQVM

SEQ ID NO: 249853 - protein, 9 aa, Homo Sapiens
LQKGVRRKD

SEQ ID NO: 249854 - protein, 9 aa, Homo Sapiens
EIRKFDLLF

SEQ ID NO: 249855 - protein, 9 aa, Homo Sapiens
RITKLNEDL

SEQ ID NO: 249856 - protein, 9 aa, Homo Sapiens
LKKGASPEG

SEQ ID NO: 249857 - protein, 9 aa, Homo Sapiens
LINAAKLNV

SEQ ID NO: 249858 - protein, 9 aa, Homo Sapiens
CGAPRWNDY

SEQ ID NO: 249859 - protein, 9 aa, Homo Sapiens
LSPSAVELR

SEQ ID NO: 249860 - protein, 9 aa, Homo Sapiens
PVANGIQFR

SEQ ID NO: 249861 - protein, 9 aa, Homo Sapiens
PTMIKLACG

SEQ ID NO: 249862 - protein, 9 aa, Homo Sapiens
RGHSSLQEN

SEQ ID NO: 249863 - protein, 9 aa, Homo Sapiens
ELETLPTTN

SEQ ID NO: 249864 - protein, 9 aa, Homo Sapiens
CFNCGTWMD

SEQ ID NO: 249865 - protein, 9 aa, Homo Sapiens
PLDELVGSL

SEQ ID NO: 249866 - protein, 9 aa, Homo Sapiens
SVPADTPLM

SEQ ID NO: 249867 - protein, 9 aa, Homo Sapiens
KNCCGPSVT

SEQ ID NO: 249868 - protein, 9 aa, Homo Sapiens
DVQNIVESQ

SEQ ID NO: 249869 - protein, 9 aa, Homo Sapiens
GKSAIVRQL

SEQ ID NO: 249870 - protein, 9 aa, Homo Sapiens
EQVHSGEKN

SEQ ID NO: 249871 - protein, 9 aa, Homo Sapiens
EDGNIKIIQ

SEQ ID NO: 249872 - protein, 9 aa, Homo Sapiens
EKAVVVVDY

SEQ ID NO: 249873 - protein, 9 aa, Homo Sapiens
LFTLLLQHL

SEQ ID NO: 249874 - protein, 9 aa, Homo Sapiens
NPEGTLLGA

SEQ ID NO: 249875 - protein, 9 aa, Homo Sapiens
NINLSFSYS

SEQ ID NO: 249876 - protein, 9 aa, Homo Sapiens
LVTYRSFNT

SEQ ID NO: 249877 - protein, 9 aa, Homo Sapiens
FLPWVPARG

SEQ ID NO: 249878 - protein, 9 aa, Homo Sapiens
NIQRLFGHG

SEQ ID NO: 249879 - protein, 9 aa, Homo Sapiens
ILALPQFYQ

SEQ ID NO: 249880 - protein, 9 aa, Homo Sapiens
IAGDLHCDC

SEQ ID NO: 249881 - protein, 9 aa, Homo Sapiens
QVLRVVQNF

SEQ ID NO: 249882 - protein, 9 aa, Homo Sapiens
EVAWQGLEG

SEQ ID NO: 249883 - protein, 9 aa, Homo Sapiens
LENPEDTYE

SEQ ID NO: 249884 - protein, 9 aa, Homo Sapiens
SGGKIWRPA

SEQ ID NO: 249885 - protein, 9 aa, Homo Sapiens
QYSKDSYGV

SEQ ID NO: 249886 - protein, 9 aa, Homo Sapiens
WDSKKQSVV

SEQ ID NO: 249887 - protein, 9 aa, Homo Sapiens
GVPQHVPVC

SEQ ID NO: 249888 - protein, 9 aa, Homo Sapiens
DNENFLSVR

SEQ ID NO: 249889 - protein, 9 aa, Homo Sapiens
AYLWQKNQE

SEQ ID NO: 249890 - protein, 9 aa, Homo Sapiens
LEDSYSKFN

SEQ ID NO: 249891 - protein, 9 aa, Homo Sapiens
KKVSEASDV

SEQ ID NO: 249892 - protein, 9 aa, Homo Sapiens
TFQTFPQAV

SEQ ID NO: 249893 - protein, 9 aa, Homo Sapiens
KEFEEYKEK

SEQ ID NO: 249894 - protein, 9 aa, Homo Sapiens
QILENQRKF

SEQ ID NO: 249895 - protein, 9 aa, Homo Sapiens
LADLTCEIK

SEQ ID NO: 249896 - protein, 9 aa, Homo Sapiens
ALDNKLPVV

SEQ ID NO: 249897 - protein, 9 aa, Homo Sapiens
PVNISDACQ

SEQ ID NO: 249898 - protein, 9 aa, Homo Sapiens
CGYDRYEDY

SEQ ID NO: 249899 - protein, 9 aa, Homo Sapiens
RHSKLRVAG

SEQ ID NO: 249900 - protein, 9 aa, Homo Sapiens
GNRIDKENR

SEQ ID NO: 249901 - protein, 9 aa, Homo Sapiens
VQFMLTITH

SEQ ID NO: 249902 - protein, 9 aa, Homo Sapiens
IVKRIRKKQ

SEQ ID NO: 249903 - protein, 9 aa, Homo Sapiens
SLKQVETGV

SEQ ID NO: 249904 - protein, 9 aa, Homo Sapiens
ASQNPKSRG

SEQ ID NO: 249905 - protein, 9 aa, Homo Sapiens
HLQINQMFE

SEQ ID NO: 249906 - protein, 9 aa, Homo Sapiens
RSFKVAGEA

SEQ ID NO: 249907 - protein, 9 aa, Homo Sapiens
EEGAAALGS

SEQ ID NO: 249908 - protein, 9 aa, Homo Sapiens
VGLFFGIDM

SEQ ID NO: 249909 - protein, 9 aa, Homo Sapiens
FMDAMNTFK

SEQ ID NO: 249910 - protein, 9 aa, Homo Sapiens
SNSKDVQNL

SEQ ID NO: 249911 - protein, 9 aa, Homo Sapiens
FQKCIEQSD

SEQ ID NO: 249912 - protein, 9 aa, Homo Sapiens
PQYIHILLA

SEQ ID NO: 249913 - protein, 9 aa, Homo Sapiens
RVNKTKPAA

SEQ ID NO: 249914 - protein, 9 aa, Homo Sapiens
LGRGVQKLG

SEQ ID NO: 249915 - protein, 9 aa, Homo Sapiens
YKGAPTPKI

SEQ ID NO: 249916 - protein, 9 aa, Homo Sapiens
LCVRHCVNM

SEQ ID NO: 249917 - protein, 9 aa, Homo Sapiens
TVLVNVDGE

SEQ ID NO: 249918 - protein, 9 aa, Homo Sapiens
RFLARVSPS

SEQ ID NO: 249919 - protein, 9 aa, Homo Sapiens
MQHILNPAF

SEQ ID NO: 249920 - protein, 9 aa, Homo Sapiens
EWRRWMGPT

SEQ ID NO: 249921 - protein, 9 aa, Homo Sapiens
SVGNYLSRK

SEQ ID NO: 249922 - protein, 9 aa, Homo Sapiens
QTGMMKELQ

SEQ ID NO: 249923 - protein, 9 aa, Homo Sapiens
SDISPELFM

SEQ ID NO: 249924 - protein, 9 aa, Homo Sapiens
NTRKDFQKY

SEQ ID NO: 249925 - protein, 9 aa, Homo Sapiens
NGGVLNNKT

SEQ ID NO: 249926 - protein, 9 aa, Homo Sapiens
ESSSDSDPH

SEQ ID NO: 249927 - protein, 9 aa, Homo Sapiens
DKQLQDLWR

SEQ ID NO: 249928 - protein, 9 aa, Homo Sapiens
SENLGELSS

SEQ ID NO: 249929 - protein, 9 aa, Homo Sapiens
RPALMVSST

SEQ ID NO: 249930 - protein, 9 aa, Homo Sapiens
VAHVKKRNM

SEQ ID NO: 249931 - protein, 9 aa, Homo Sapiens
ENSTFENGT

SEQ ID NO: 249932 - protein, 9 aa, Homo Sapiens
QWTALHCAA

SEQ ID NO: 249933 - protein, 9 aa, Homo Sapiens
SKHTQTGRE

SEQ ID NO: 249934 - protein, 9 aa, Homo Sapiens
LTPPSPFRN

SEQ ID NO: 249935 - protein, 9 aa, Homo Sapiens
YLKEGYKKS

SEQ ID NO: 249936 - protein, 9 aa, Homo Sapiens
NPLSGSRTA

SEQ ID NO: 249937 - protein, 9 aa, Homo Sapiens
TLADSLDHS

SEQ ID NO: 249938 - protein, 9 aa, Homo Sapiens
YEIKPFPKI

SEQ ID NO: 249939 - protein, 9 aa, Homo Sapiens
FQPACSDVV

SEQ ID NO: 249940 - protein, 9 aa, Homo Sapiens
PLMVIFQAA

SEQ ID NO: 249941 - protein, 9 aa, Homo Sapiens
TRSIAEIGI

SEQ ID NO: 249942 - protein, 9 aa, Homo Sapiens
FRIPTSNLY

SEQ ID NO: 249943 - protein, 9 aa, Homo Sapiens
HFQSEKKVF

SEQ ID NO: 249944 - protein, 9 aa, Homo Sapiens
VQDIKEKLC

SEQ ID NO: 249945 - protein, 9 aa, Homo Sapiens
NMKNMNQSR

SEQ ID NO: 249946 - protein, 9 aa, Homo Sapiens
EPTVTWIHI

SEQ ID NO: 249947 - protein, 9 aa, Homo Sapiens
HSDDSASSN

SEQ ID NO: 249948 - protein, 9 aa, Homo Sapiens
DGDGKISFQ

SEQ ID NO: 249949 - protein, 9 aa, Homo Sapiens
DSGSPSLLS

SEQ ID NO: 249950 - protein, 9 aa, Homo Sapiens
FGGCVAQLD

SEQ ID NO: 249951 - protein, 9 aa, Homo Sapiens
QAKIYWNLD

SEQ ID NO: 249952 - protein, 9 aa, Homo Sapiens
HLIYSLRQS

SEQ ID NO: 249953 - protein, 9 aa, Homo Sapiens
QLKCTETWS

SEQ ID NO: 249954 - protein, 9 aa, Homo Sapiens
EKQFILYAY

SEQ ID NO: 249955 - protein, 9 aa, Homo Sapiens
PIDAEDNYT

SEQ ID NO: 249956 - protein, 9 aa, Homo Sapiens
KKTEVAKKE

SEQ ID NO: 249957 - protein, 9 aa, Homo Sapiens
VIFTLDEIY

SEQ ID NO: 249958 - protein, 9 aa, Homo Sapiens
IVLGTGLTD

SEQ ID NO: 249959 - protein, 9 aa, Homo Sapiens
NCKETAKEN

SEQ ID NO: 249960 - protein, 9 aa, Homo Sapiens
MCKLDPGQF

SEQ ID NO: 249961 - protein, 9 aa, Homo Sapiens
LFDVEVGRT

SEQ ID NO: 249962 - protein, 9 aa, Homo Sapiens
QLMISMPQE

SEQ ID NO: 249963 - protein, 9 aa, Homo Sapiens
KLSDQITFM

SEQ ID NO: 249964 - protein, 9 aa, Homo Sapiens
TLNNKFAPF

SEQ ID NO: 249965 - protein, 9 aa, Homo Sapiens
EKDKDNIFQ

SEQ ID NO: 249966 - protein, 9 aa, Homo Sapiens
RISQLDTRL

SEQ ID NO: 249967 - protein, 9 aa, Homo Sapiens
VLEADANVE

SEQ ID NO: 249968 - protein, 9 aa, Homo Sapiens
EMVAINQVL

SEQ ID NO: 249969 - protein, 9 aa, Homo Sapiens
SVGSKRRQT

SEQ ID NO: 249970 - protein, 9 aa, Homo Sapiens
SKDMKVLQN

SEQ ID NO: 249971 - protein, 9 aa, Homo Sapiens
FKSESEEKK

SEQ ID NO: 249972 - protein, 9 aa, Homo Sapiens
GVPEYPGKP

SEQ ID NO: 249973 - protein, 9 aa, Homo Sapiens
TFIENRAKA

SEQ ID NO: 249974 - protein, 9 aa, Homo Sapiens
ALLNKAESG

SEQ ID NO: 249975 - protein, 9 aa, Homo Sapiens
AQNIRKDTR

SEQ ID NO: 249976 - protein, 9 aa, Homo Sapiens
LYLGSISTL

SEQ ID NO: 249977 - protein, 9 aa, Homo Sapiens
DKCGKNPEL

SEQ ID NO: 249978 - protein, 9 aa, Homo Sapiens
LKEDFHLSH

SEQ ID NO: 249979 - protein, 9 aa, Homo Sapiens
SDCGIGEVP

SEQ ID NO: 249980 - protein, 9 aa, Homo Sapiens
QSFENVMAT

SEQ ID NO: 249981 - protein, 9 aa, Homo Sapiens
LRHVENGGY

SEQ ID NO: 249982 - protein, 9 aa, Homo Sapiens
YMRIRGHLY

SEQ ID NO: 249983 - protein, 9 aa, Homo Sapiens
KFLNALTSP

SEQ ID NO: 249984 - protein, 9 aa, Homo Sapiens
QALNRPDDT

SEQ ID NO: 249985 - protein, 9 aa, Homo Sapiens
ISKIEQWLE

SEQ ID NO: 249986 - protein, 9 aa, Homo Sapiens
NTLNPDCVR

SEQ ID NO: 249987 - protein, 9 aa, Homo Sapiens
IKQIEVCKS

SEQ ID NO: 249988 - protein, 9 aa, Homo Sapiens
APSYPGYLQ

SEQ ID NO: 249989 - protein, 9 aa, Homo Sapiens
YVYVQDCRS

SEQ ID NO: 249990 - protein, 9 aa, Homo Sapiens
PSNCSQYSD

SEQ ID NO: 249991 - protein, 9 aa, Homo Sapiens
MDAMNTFKW

SEQ ID NO: 249992 - protein, 9 aa, Homo Sapiens
SLDNPTPLP

SEQ ID NO: 249993 - protein, 9 aa, Homo Sapiens
ILDKVLAHP

SEQ ID NO: 249994 - protein, 9 aa, Homo Sapiens
HRAEICLYR

SEQ ID NO: 249995 - protein, 9 aa, Homo Sapiens
YDCGYDRYE

SEQ ID NO: 249996 - protein, 9 aa, Homo Sapiens
DVCIPVGSC

SEQ ID NO: 249997 - protein, 9 aa, Homo Sapiens
NGEFYESCC

SEQ ID NO: 249998 - protein, 9 aa, Homo Sapiens
IFKADRPLI

SEQ ID NO: 249999 - protein, 9 aa, Homo Sapiens
CLLHFQVLF

SEQ ID NO: 250000 - protein, 9 aa, Homo Sapiens
KPLNRRSAL

SEQ ID NO: 250001 - protein, 9 aa, Homo Sapiens
PFITKSFNY

SEQ ID NO: 250002 - protein, 9 aa, Homo Sapiens
PENYDGGNY

SEQ ID NO: 250003 - protein, 9 aa, Homo Sapiens
DKLFELILM

SEQ ID NO: 250004 - protein, 9 aa, Homo Sapiens
LCTDKSNVY

SEQ ID NO: 250005 - protein, 9 aa, Homo Sapiens
NGKIRAFAP

SEQ ID NO: 250006 - protein, 9 aa, Homo Sapiens
HESFTATAK

SEQ ID NO: 250007 - protein, 9 aa, Homo Sapiens
KGTEPSADG

SEQ ID NO: 250008 - protein, 9 aa, Homo Sapiens
KPKVRDGME

SEQ ID NO: 250009 - protein, 9 aa, Homo Sapiens
YVADVKSAS

SEQ ID NO: 250010 - protein, 9 aa, Homo Sapiens
MLQPKVRRY

SEQ ID NO: 250011 - protein, 9 aa, Homo Sapiens
ETLGGNTVK

SEQ ID NO: 250012 - protein, 9 aa, Homo Sapiens
DYVYLRSSS

SEQ ID NO: 250013 - protein, 9 aa, Homo Sapiens
NLTKDNSQN

SEQ ID NO: 250014 - protein, 9 aa, Homo Sapiens
EKQEIAERV

SEQ ID NO: 250015 - protein, 9 aa, Homo Sapiens
DVDNGLSPV

SEQ ID NO: 250016 - protein, 9 aa, Homo Sapiens
DNSVGFVKA

SEQ ID NO: 250017 - protein, 9 aa, Homo Sapiens
RDAVTSVQV

SEQ ID NO: 250018 - protein, 9 aa, Homo Sapiens
FASAKNHNY

SEQ ID NO: 250019 - protein, 9 aa, Homo Sapiens
LKYTFTHTP

SEQ ID NO: 250020 - protein, 9 aa, Homo Sapiens
GLPHPFTIT

SEQ ID NO: 250021 - protein, 9 aa, Homo Sapiens
ELRRHRSEP

SEQ ID NO: 250022 - protein, 9 aa, Homo Sapiens
INVAFSCVF

SEQ ID NO: 250023 - protein, 9 aa, Homo Sapiens
KQYRKIIDS

SEQ ID NO: 250024 - protein, 9 aa, Homo Sapiens
NQILENQRK

SEQ ID NO: 250025 - protein, 9 aa, Homo Sapiens
QGHFSVVLQ

SEQ ID NO: 250026 - protein, 9 aa, Homo Sapiens
IYVKPANKQ

SEQ ID NO: 250027 - protein, 9 aa, Homo Sapiens
NIAQNEQDA

SEQ ID NO: 250028 - protein, 9 aa, Homo Sapiens
NTLFPDMWL

SEQ ID NO: 250029 - protein, 9 aa, Homo Sapiens
LRQPSPVSA

SEQ ID NO: 250030 - protein, 9 aa, Homo Sapiens
RPRYYPTED

SEQ ID NO: 250031 - protein, 9 aa, Homo Sapiens
CGDLYVIFE

SEQ ID NO: 250032 - protein, 9 aa, Homo Sapiens
LSGHPKGYA

SEQ ID NO: 250033 - protein, 9 aa, Homo Sapiens
PAVFCPPMK

SEQ ID NO: 250034 - protein, 9 aa, Homo Sapiens
CLYEANYYE

SEQ ID NO: 250035 - protein, 9 aa, Homo Sapiens
VTSSSQARS

SEQ ID NO: 250036 - protein, 9 aa, Homo Sapiens
LLLLVISSD

SEQ ID NO: 250037 - protein, 9 aa, Homo Sapiens
NLAFIRLSY

SEQ ID NO: 250038 - protein, 9 aa, Homo Sapiens
GQKQGIVCF

SEQ ID NO: 250039 - protein, 9 aa, Homo Sapiens
AKEIMASEV

SEQ ID NO: 250040 - protein, 9 aa, Homo Sapiens
DNTDSQRSG

SEQ ID NO: 250041 - protein, 9 aa, Homo Sapiens
FTGTVHRIN

SEQ ID NO: 250042 - protein, 9 aa, Homo Sapiens
ERELCRQDA

SEQ ID NO: 250043 - protein, 9 aa, Homo Sapiens
ENDILLVNR

SEQ ID NO: 250044 - protein, 9 aa, Homo Sapiens
QTFNERIEE

SEQ ID NO: 250045 - protein, 9 aa, Homo Sapiens
PKVVLNLFN

SEQ ID NO: 250046 - protein, 9 aa, Homo Sapiens
RVKDPQSGE

SEQ ID NO: 250047 - protein, 9 aa, Homo Sapiens
STAIDGMSV

SEQ ID NO: 250048 - protein, 9 aa, Homo Sapiens
QKYFKCEEC

SEQ ID NO: 250049 - protein, 9 aa, Homo Sapiens
IVWLAFLPI

SEQ ID NO: 250050 - protein, 9 aa, Homo Sapiens
KVLHKKFED

SEQ ID NO: 250051 - protein, 9 aa, Homo Sapiens
HQPAHFYPW

SEQ ID NO: 250052 - protein, 9 aa, Homo Sapiens
SHYRFIKCC

SEQ ID NO: 250053 - protein, 9 aa, Homo Sapiens
SFYFGIIAW

SEQ ID NO: 250054 - protein, 9 aa, Homo Sapiens
HVHYTDDPE

SEQ ID NO: 250055 - protein, 9 aa, Homo Sapiens
AFNRYSHLT

SEQ ID NO: 250056 - protein, 9 aa, Homo Sapiens
QEAIYFIDC

SEQ ID NO: 250057 - protein, 9 aa, Homo Sapiens
PAISCVRVI

SEQ ID NO: 250058 - protein, 9 aa, Homo Sapiens
EAALSREMN

SEQ ID NO: 250059 - protein, 9 aa, Homo Sapiens
YFSDEEGSS

SEQ ID NO: 250060 - protein, 9 aa, Homo Sapiens
DKGISDEDV

SEQ ID NO: 250061 - protein, 9 aa, Homo Sapiens
FTQMQELFS

SEQ ID NO: 250062 - protein, 9 aa, Homo Sapiens
LHLISSPFP

SEQ ID NO: 250063 - protein, 9 aa, Homo Sapiens
ISSLLILYV

SEQ ID NO: 250064 - protein, 9 aa, Homo Sapiens
LVDASDLKT

SEQ ID NO: 250065 - protein, 9 aa, Homo Sapiens
RLQEEKGKV

SEQ ID NO: 250066 - protein, 9 aa, Homo Sapiens
RNALCVAEV

SEQ ID NO: 250067 - protein, 9 aa, Homo Sapiens
TNIKIAVIR

SEQ ID NO: 250068 - protein, 9 aa, Homo Sapiens
ARHQQIHTG

SEQ ID NO: 250069 - protein, 9 aa, Homo Sapiens
LKKAVSLLY

SEQ ID NO: 250070 - protein, 9 aa, Homo Sapiens
QTLAGEYFQ

SEQ ID NO: 250071 - protein, 9 aa, Homo Sapiens
ETKTIYYSE

SEQ ID NO: 250072 - protein, 9 aa, Homo Sapiens
DGHSLSDYN

SEQ ID NO: 250073 - protein, 9 aa, Homo Sapiens
NQQGNFPLR

SEQ ID NO: 250074 - protein, 9 aa, Homo Sapiens
REEIKEHSL

SEQ ID NO: 250075 - protein, 9 aa, Homo Sapiens
PVINWAQII

SEQ ID NO: 250076 - protein, 9 aa, Homo Sapiens
RFLVIEASL

SEQ ID NO: 250077 - protein, 9 aa, Homo Sapiens
HNLNEDVSQ

SEQ ID NO: 250078 - protein, 9 aa, Homo Sapiens
KLRNLSVSS

SEQ ID NO: 250079 - protein, 9 aa, Homo Sapiens
SVVLSSLNN

SEQ ID NO: 250080 - protein, 9 aa, Homo Sapiens
TYIHHVVSV

SEQ ID NO: 250081 - protein, 9 aa, Homo Sapiens
VMDVVFQWL

SEQ ID NO: 250082 - protein, 9 aa, Homo Sapiens
DLVPEAAKG

SEQ ID NO: 250083 - protein, 9 aa, Homo Sapiens
VRGCDVAFE

SEQ ID NO: 250084 - protein, 9 aa, Homo Sapiens
FKCKDCGKG

SEQ ID NO: 250085 - protein, 9 aa, Homo Sapiens
SPKNNIKTR

SEQ ID NO: 250086 - protein, 9 aa, Homo Sapiens
INYAGLGPS

SEQ ID NO: 250087 - protein, 9 aa, Homo Sapiens
TLHAFSAIK

SEQ ID NO: 250088 - protein, 9 aa, Homo Sapiens
TIVSCNPSY

SEQ ID NO: 250089 - protein, 9 aa, Homo Sapiens
WKTLPAPLY

SEQ ID NO: 250090 - protein, 9 aa, Homo Sapiens
QPCEHLLDG

SEQ ID NO: 250091 - protein, 9 aa, Homo Sapiens
TTGISQDTQ

SEQ ID NO: 250092 - protein, 9 aa, Homo Sapiens
CDALNDQNS

SEQ ID NO: 250093 - protein, 9 aa, Homo Sapiens
FVILCENKS

SEQ ID NO: 250094 - protein, 9 aa, Homo Sapiens
KKLHDRLWQ

SEQ ID NO: 250095 - protein, 9 aa, Homo Sapiens
QHDLSWSML

SEQ ID NO: 250096 - protein, 9 aa, Homo Sapiens
FHPEYGMFT

SEQ ID NO: 250097 - protein, 9 aa, Homo Sapiens
HQLQVIQGD

SEQ ID NO: 250098 - protein, 9 aa, Homo Sapiens
YYEMGYTSR

SEQ ID NO: 250099 - protein, 9 aa, Homo Sapiens
NRDAKQIQI

SEQ ID NO: 250100 - protein, 9 aa, Homo Sapiens
CFPTESTWG

SEQ ID NO: 250101 - protein, 9 aa, Homo Sapiens
GLQTFYMAS

SEQ ID NO: 250102 - protein, 9 aa, Homo Sapiens
YTLDEKGGR

SEQ ID NO: 250103 - protein, 9 aa, Homo Sapiens
SLGSPGRTF

SEQ ID NO: 250104 - protein, 9 aa, Homo Sapiens
ENNPDMVAG

SEQ ID NO: 250105 - protein, 9 aa, Homo Sapiens
PPPLVDNSA

SEQ ID NO: 250106 - protein, 9 aa, Homo Sapiens
TNEMFINAS

SEQ ID NO: 250107 - protein, 9 aa, Homo Sapiens
VKHHGNGTP

SEQ ID NO: 250108 - protein, 9 aa, Homo Sapiens
QIRRNIAHQ

SEQ ID NO: 250109 - protein, 9 aa, Homo Sapiens
IKEEKLFTL

SEQ ID NO: 250110 - protein, 9 aa, Homo Sapiens
RTTNRMLAS

SEQ ID NO: 250111 - protein, 9 aa, Homo Sapiens
NHEASNHVQ

SEQ ID NO: 250112 - protein, 9 aa, Homo Sapiens
NRMHSQNID

SEQ ID NO: 250113 - protein, 9 aa, Homo Sapiens
ALVNDSSSD

SEQ ID NO: 250114 - protein, 9 aa, Homo Sapiens
YIVGAPRYK

SEQ ID NO: 250115 - protein, 9 aa, Homo Sapiens
LDEGRQKVA

SEQ ID NO: 250116 - protein, 9 aa, Homo Sapiens
EGILWNKFF

SEQ ID NO: 250117 - protein, 9 aa, Homo Sapiens
KRSHHSPAR

SEQ ID NO: 250118 - protein, 9 aa, Homo Sapiens
RLDDYDREG

SEQ ID NO: 250119 - protein, 9 aa, Homo Sapiens
RSSKAFPDD

SEQ ID NO: 250120 - protein, 9 aa, Homo Sapiens
RFDMARALP

SEQ ID NO: 250121 - protein, 9 aa, Homo Sapiens
QDTKSTDQK

SEQ ID NO: 250122 - protein, 9 aa, Homo Sapiens
KWPVDTQAC

SEQ ID NO: 250123 - protein, 9 aa, Homo Sapiens
VATMNEQDF

SEQ ID NO: 250124 - protein, 9 aa, Homo Sapiens
HIFYQIISG

SEQ ID NO: 250125 - protein, 9 aa, Homo Sapiens
NHRVQFEEK

SEQ ID NO: 250126 - protein, 9 aa, Homo Sapiens
INVPPEEEC

SEQ ID NO: 250127 - protein, 9 aa, Homo Sapiens
HPLLIIATT

SEQ ID NO: 250128 - protein, 9 aa, Homo Sapiens
PTVTFSYEK

SEQ ID NO: 250129 - protein, 9 aa, Homo Sapiens
IAKCDHHCP

SEQ ID NO: 250130 - protein, 9 aa, Homo Sapiens
SASLNYKYF

SEQ ID NO: 250131 - protein, 9 aa, Homo Sapiens
SLYGGEVLR

SEQ ID NO: 250132 - protein, 9 aa, Homo Sapiens
CSMQLSPCL

SEQ ID NO: 250133 - protein, 9 aa, Homo Sapiens
ANRVKPDVM

SEQ ID NO: 250134 - protein, 9 aa, Homo Sapiens
NFLDIDPRY

SEQ ID NO: 250135 - protein, 9 aa, Homo Sapiens
NERKRKTKT

SEQ ID NO: 250136 - protein, 9 aa, Homo Sapiens
CFELWKLGI

SEQ ID NO: 250137 - protein, 9 aa, Homo Sapiens
PHDFGNQGS

SEQ ID NO: 250138 - protein, 9 aa, Homo Sapiens
VCSQSCLST

SEQ ID NO: 250139 - protein, 9 aa, Homo Sapiens
VAIKKLLES

SEQ ID NO: 250140 - protein, 9 aa, Homo Sapiens
IEGQVMAKR

SEQ ID NO: 250141 - protein, 9 aa, Homo Sapiens
LNTLFPDMW

SEQ ID NO: 250142 - protein, 9 aa, Homo Sapiens
IQGTHTIID

SEQ ID NO: 250143 - protein, 9 aa, Homo Sapiens
QILLGRTVK

SEQ ID NO: 250144 - protein, 9 aa, Homo Sapiens
HIVLREGRE

SEQ ID NO: 250145 - protein, 9 aa, Homo Sapiens
NGSEIYIWD

SEQ ID NO: 250146 - protein, 9 aa, Homo Sapiens
LNPFNLKVG

SEQ ID NO: 250147 - protein, 9 aa, Homo Sapiens
ESRADNFQE

SEQ ID NO: 250148 - protein, 9 aa, Homo Sapiens
SYHNNEKYI

SEQ ID NO: 250149 - protein, 9 aa, Homo Sapiens
QDIIGKADP

SEQ ID NO: 250150 - protein, 9 aa, Homo Sapiens
DEDSASESL

SEQ ID NO: 250151 - protein, 9 aa, Homo Sapiens
IVHQRTNSG

SEQ ID NO: 250152 - protein, 9 aa, Homo Sapiens
YRFLEEVAR

SEQ ID NO: 250153 - protein, 9 aa, Homo Sapiens
PRASSISTV

SEQ ID NO: 250154 - protein, 9 aa, Homo Sapiens
KSLVNNYYT

SEQ ID NO: 250155 - protein, 9 aa, Homo Sapiens
ELFERKSSE

SEQ ID NO: 250156 - protein, 9 aa, Homo Sapiens
FRRNLILSL

SEQ ID NO: 250157 - protein, 9 aa, Homo Sapiens
KVTTKNITG

SEQ ID NO: 250158 - protein, 9 aa, Homo Sapiens
QVLNNFSGR

SEQ ID NO: 250159 - protein, 9 aa, Homo Sapiens
QKVLFRFCV

SEQ ID NO: 250160 - protein, 9 aa, Homo Sapiens
ITKDYELPT

SEQ ID NO: 250161 - protein, 9 aa, Homo Sapiens
YAAEIAISL

SEQ ID NO: 250162 - protein, 9 aa, Homo Sapiens
QELSKCNPC

SEQ ID NO: 250163 - protein, 9 aa, Homo Sapiens
IIREVCRVL

SEQ ID NO: 250164 - protein, 9 aa, Homo Sapiens
RGAMGFMLM

SEQ ID NO: 250165 - protein, 9 aa, Homo Sapiens
AKFREQILR

SEQ ID NO: 250166 - protein, 9 aa, Homo Sapiens
VKPFKCSEC

SEQ ID NO: 250167 - protein, 9 aa, Homo Sapiens
ILVYRQFLF

SEQ ID NO: 250168 - protein, 9 aa, Homo Sapiens
PTTTVLNSQ

SEQ ID NO: 250169 - protein, 9 aa, Homo Sapiens
VDVSKVNRW

SEQ ID NO: 250170 - protein, 9 aa, Homo Sapiens
KETAKKKKQ

SEQ ID NO: 250171 - protein, 9 aa, Homo Sapiens
MLATPIMNA

SEQ ID NO: 250172 - protein, 9 aa, Homo Sapiens
KQEQRRHTA

SEQ ID NO: 250173 - protein, 9 aa, Homo Sapiens
QLLQVDFLR

SEQ ID NO: 250174 - protein, 9 aa, Homo Sapiens
IVKEIHGQL

SEQ ID NO: 250175 - protein, 9 aa, Homo Sapiens
QFNKILAGF

SEQ ID NO: 250176 - protein, 9 aa, Homo Sapiens
NQIYIQLPG

SEQ ID NO: 250177 - protein, 9 aa, Homo Sapiens
KFFQSLTYA

SEQ ID NO: 250178 - protein, 9 aa, Homo Sapiens
GALLNPLIA

SEQ ID NO: 250179 - protein, 9 aa, Homo Sapiens
PVDYGFVST

SEQ ID NO: 250180 - protein, 9 aa, Homo Sapiens
IKEHSLLLT

SEQ ID NO: 250181 - protein, 9 aa, Homo Sapiens
LDPQILPRG

SEQ ID NO: 250182 - protein, 9 aa, Homo Sapiens
MIALSIGDP

SEQ ID NO: 250183 - protein, 9 aa, Homo Sapiens
KPPVENRRN

SEQ ID NO: 250184 - protein, 9 aa, Homo Sapiens
HYKFSGLYI

SEQ ID NO: 250185 - protein, 9 aa, Homo Sapiens
PENILCVQS

SEQ ID NO: 250186 - protein, 9 aa, Homo Sapiens
YLKDVQNNK

SEQ ID NO: 250187 - protein, 9 aa, Homo Sapiens
EVEDLFLEN

SEQ ID NO: 250188 - protein, 9 aa, Homo Sapiens
GMCSMKRGL

SEQ ID NO: 250189 - protein, 9 aa, Homo Sapiens
HKSGVISGG

SEQ ID NO: 250190 - protein, 9 aa, Homo Sapiens
ELIKEIEPV

SEQ ID NO: 250191 - protein, 9 aa, Homo Sapiens
ACKAFTGEG

SEQ ID NO: 250192 - protein, 9 aa, Homo Sapiens
AMTSHLIVT

SEQ ID NO: 250193 - protein, 9 aa, Homo Sapiens
DELLCYICL

SEQ ID NO: 250194 - protein, 9 aa, Homo Sapiens
LVIFVFGIV

SEQ ID NO: 250195 - protein, 9 aa, Homo Sapiens
SLLWGIVRQ

SEQ ID NO: 250196 - protein, 9 aa, Homo Sapiens
KCLGPFLTS

SEQ ID NO: 250197 - protein, 9 aa, Homo Sapiens
FGKGLNLRR

SEQ ID NO: 250198 - protein, 9 aa, Homo Sapiens
LMVLPFSAI

SEQ ID NO: 250199 - protein, 9 aa, Homo Sapiens
FEEHVTGEN

SEQ ID NO: 250200 - protein, 9 aa, Homo Sapiens
RLDLNSRPQ

SEQ ID NO: 250201 - protein, 9 aa, Homo Sapiens
IFNLDPIQN

SEQ ID NO: 250202 - protein, 9 aa, Homo Sapiens
KLNLTPIQI

SEQ ID NO: 250203 - protein, 9 aa, Homo Sapiens
LEHHFTQMQ

SEQ ID NO: 250204 - protein, 9 aa, Homo Sapiens
RRRKTEYID

SEQ ID NO: 250205 - protein, 9 aa, Homo Sapiens
VVESYEITP

SEQ ID NO: 250206 - protein, 9 aa, Homo Sapiens
ASFKGADPT

SEQ ID NO: 250207 - protein, 9 aa, Homo Sapiens
PEGQFINSK

SEQ ID NO: 250208 - protein, 9 aa, Homo Sapiens
LMTEEETQL

SEQ ID NO: 250209 - protein, 9 aa, Homo Sapiens
TPQPSILQA

SEQ ID NO: 250210 - protein, 9 aa, Homo Sapiens
SAPRDLINT

SEQ ID NO: 250211 - protein, 9 aa, Homo Sapiens
REVAKEAQA

SEQ ID NO: 250212 - protein, 9 aa, Homo Sapiens
VDTKAAVAA

SEQ ID NO: 250213 - protein, 9 aa, Homo Sapiens
LCLKIASKP

SEQ ID NO: 250214 - protein, 9 aa, Homo Sapiens
AACKENTSQ

SEQ ID NO: 250215 - protein, 9 aa, Homo Sapiens
RDQTGMMKE

SEQ ID NO: 250216 - protein, 9 aa, Homo Sapiens
MTQFFGHNV

SEQ ID NO: 250217 - protein, 9 aa, Homo Sapiens
ASTNFLPGL

SEQ ID NO: 250218 - protein, 9 aa, Homo Sapiens
SSTATKMFL

SEQ ID NO: 250219 - protein, 9 aa, Homo Sapiens
KKNVCVSLV

SEQ ID NO: 250220 - protein, 9 aa, Homo Sapiens
VQETATGPR

SEQ ID NO: 250221 - protein, 9 aa, Homo Sapiens
TLNPEHQER

SEQ ID NO: 250222 - protein, 9 aa, Homo Sapiens
LLSYAFGKC

SEQ ID NO: 250223 - protein, 9 aa, Homo Sapiens
QHVTKVDKV

SEQ ID NO: 250224 - protein, 9 aa, Homo Sapiens
LPVTKINVA

SEQ ID NO: 250225 - protein, 9 aa, Homo Sapiens
QLAGRKLSD

SEQ ID NO: 250226 - protein, 9 aa, Homo Sapiens
ITDNDMQNI

SEQ ID NO: 250227 - protein, 9 aa, Homo Sapiens
RNGHRGVQA

SEQ ID NO: 250228 - protein, 9 aa, Homo Sapiens
DSHMLVALG

SEQ ID NO: 250229 - protein, 9 aa, Homo Sapiens
NLLQPRLVV

SEQ ID NO: 250230 - protein, 9 aa, Homo Sapiens
VEVYKLKAE

SEQ ID NO: 250231 - protein, 9 aa, Homo Sapiens
DQDKTDQLE

SEQ ID NO: 250232 - protein, 9 aa, Homo Sapiens
QEHKMVWNQ

SEQ ID NO: 250233 - protein, 9 aa, Homo Sapiens
VVNGKEYPL

SEQ ID NO: 250234 - protein, 9 aa, Homo Sapiens
LAQHQNIHT

SEQ ID NO: 250235 - protein, 9 aa, Homo Sapiens
AEHGNIPVV

SEQ ID NO: 250236 - protein, 9 aa, Homo Sapiens
VKTLLEYLE

SEQ ID NO: 250237 - protein, 9 aa, Homo Sapiens
GGTLVELVY

SEQ ID NO: 250238 - protein, 9 aa, Homo Sapiens
SGTNEFTFL

SEQ ID NO: 250239 - protein, 9 aa, Homo Sapiens
KDQSAWTFQ

SEQ ID NO: 250240 - protein, 9 aa, Homo Sapiens
KEANLFGSN

SEQ ID NO: 250241 - protein, 9 aa, Homo Sapiens
VNAACKENT

SEQ ID NO: 250242 - protein, 9 aa, Homo Sapiens
SVCGKQISK

SEQ ID NO: 250243 - protein, 9 aa, Homo Sapiens
LQINQMFEE

SEQ ID NO: 250244 - protein, 9 aa, Homo Sapiens
LQLVRDAME

SEQ ID NO: 250245 - protein, 9 aa, Homo Sapiens
IVSPSDTSR

SEQ ID NO: 250246 - protein, 9 aa, Homo Sapiens
LRANQARDD

SEQ ID NO: 250247 - protein, 9 aa, Homo Sapiens
MWCASPVVV

SEQ ID NO: 250248 - protein, 9 aa, Homo Sapiens
CPSFISGTA

SEQ ID NO: 250249 - protein, 9 aa, Homo Sapiens
IFANIQDSL

SEQ ID NO: 250250 - protein, 9 aa, Homo Sapiens
ILQTPISEG

SEQ ID NO: 250251 - protein, 9 aa, Homo Sapiens
QLALLDYLL

SEQ ID NO: 250252 - protein, 9 aa, Homo Sapiens
DSKGAADDD

SEQ ID NO: 250253 - protein, 9 aa, Homo Sapiens
LQPSLERDQ

SEQ ID NO: 250254 - protein, 9 aa, Homo Sapiens
VGDYFGKEG

SEQ ID NO: 250255 - protein, 9 aa, Homo Sapiens
YLVQYALLA

SEQ ID NO: 250256 - protein, 9 aa, Homo Sapiens
KCKDCGKGL

SEQ ID NO: 250257 - protein, 9 aa, Homo Sapiens
PGIVDFEWI

SEQ ID NO: 250258 - protein, 9 aa, Homo Sapiens
LDTSNEPSV

SEQ ID NO: 250259 - protein, 9 aa, Homo Sapiens
SCGTIVVAA

SEQ ID NO: 250260 - protein, 9 aa, Homo Sapiens
DRIGSTIDD

SEQ ID NO: 250261 - protein, 9 aa, Homo Sapiens
EKTDGFVNL

SEQ ID NO: 250262 - protein, 9 aa, Homo Sapiens
SNDNMLVKL

SEQ ID NO: 250263 - protein, 9 aa, Homo Sapiens
SLFQSNKDY

SEQ ID NO: 250264 - protein, 9 aa, Homo Sapiens
PHHPEMANK

SEQ ID NO: 250265 - protein, 9 aa, Homo Sapiens
TYDMLKAGA

SEQ ID NO: 250266 - protein, 9 aa, Homo Sapiens
TCLESVTIG

SEQ ID NO: 250267 - protein, 9 aa, Homo Sapiens
LSRHRKSHA

SEQ ID NO: 250268 - protein, 9 aa, Homo Sapiens
VNCLDMYGE

SEQ ID NO: 250269 - protein, 9 aa, Homo Sapiens
CMMKDFSST

SEQ ID NO: 250270 - protein, 9 aa, Homo Sapiens
TNTFLLLLS

SEQ ID NO: 250271 - protein, 9 aa, Homo Sapiens
LLSKVLSEV

SEQ ID NO: 250272 - protein, 9 aa, Homo Sapiens
GEEPRSDLK

SEQ ID NO: 250273 - protein, 9 aa, Homo Sapiens
QNKGLPLLQ

SEQ ID NO: 250274 - protein, 9 aa, Homo Sapiens
NCAQSNQYQ

SEQ ID NO: 250275 - protein, 9 aa, Homo Sapiens
VAVLMTLFA

SEQ ID NO: 250276 - protein, 9 aa, Homo Sapiens
YMCRECEQG

SEQ ID NO: 250277 - protein, 9 aa, Homo Sapiens
ERAKITDPS

SEQ ID NO: 250278 - protein, 9 aa, Homo Sapiens
KIPSLCYSP

SEQ ID NO: 250279 - protein, 9 aa, Homo Sapiens
RKDLLCRTI

SEQ ID NO: 250280 - protein, 9 aa, Homo Sapiens
LCLNPKTNL

SEQ ID NO: 250281 - protein, 9 aa, Homo Sapiens
AMKQIDNVA

SEQ ID NO: 250282 - protein, 9 aa, Homo Sapiens
RQFFNEPED

SEQ ID NO: 250283 - protein, 9 aa, Homo Sapiens
RAYGDMYDL

SEQ ID NO: 250284 - protein, 9 aa, Homo Sapiens
PSEKIWIEI

SEQ ID NO: 250285 - protein, 9 aa, Homo Sapiens
IANFNQTHK

SEQ ID NO: 250286 - protein, 9 aa, Homo Sapiens
EHVVFLVTF

SEQ ID NO: 250287 - protein, 9 aa, Homo Sapiens
IGNKMFTHY

SEQ ID NO: 250288 - protein, 9 aa, Homo Sapiens
SQIKEVQRW

SEQ ID NO: 250289 - protein, 9 aa, Homo Sapiens
DEIEDYTHQ

SEQ ID NO: 250290 - protein, 9 aa, Homo Sapiens
PVSARCSDS

SEQ ID NO: 250291 - protein, 9 aa, Homo Sapiens
VWIQEANNF

SEQ ID NO: 250292 - protein, 9 aa, Homo Sapiens
TEGTQKQKD

SEQ ID NO: 250293 - protein, 9 aa, Homo Sapiens
LVIQERLKT

SEQ ID NO: 250294 - protein, 9 aa, Homo Sapiens
LSMQTHATR

SEQ ID NO: 250295 - protein, 9 aa, Homo Sapiens
YEKGKQNLS

SEQ ID NO: 250296 - protein, 9 aa, Homo Sapiens
HDPYRHERR

SEQ ID NO: 250297 - protein, 9 aa, Homo Sapiens
YVYLRSSSG

SEQ ID NO: 250298 - protein, 9 aa, Homo Sapiens
TKTSYTMLV

SEQ ID NO: 250299 - protein, 9 aa, Homo Sapiens
SVLSVTHLA

SEQ ID NO: 250300 - protein, 9 aa, Homo Sapiens
PPMPKAEAA

SEQ ID NO: 250301 - protein, 9 aa, Homo Sapiens
TSKRARPPR

SEQ ID NO: 250302 - protein, 9 aa, Homo Sapiens
PWQDRHGKT

SEQ ID NO: 250303 - protein, 9 aa, Homo Sapiens
RKWQEEEKK

SEQ ID NO: 250304 - protein, 9 aa, Homo Sapiens
VSSLVLYLG

SEQ ID NO: 250305 - protein, 9 aa, Homo Sapiens
MEKSTKKTY

SEQ ID NO: 250306 - protein, 9 aa, Homo Sapiens
LAKLGICEP

SEQ ID NO: 250307 - protein, 9 aa, Homo Sapiens
MQAAPEEEC

SEQ ID NO: 250308 - protein, 9 aa, Homo Sapiens
TITVFEDSL

SEQ ID NO: 250309 - protein, 9 aa, Homo Sapiens
IVKLMILSY

SEQ ID NO: 250310 - protein, 9 aa, Homo Sapiens
ILQGDRHFV

SEQ ID NO: 250311 - protein, 9 aa, Homo Sapiens
QTRWSKSHF

SEQ ID NO: 250312 - protein, 9 aa, Homo Sapiens
IHDNIYTPK

SEQ ID NO: 250313 - protein, 9 aa, Homo Sapiens
KDLRDELLV

SEQ ID NO: 250314 - protein, 9 aa, Homo Sapiens
PKGACKAFT

SEQ ID NO: 250315 - protein, 9 aa, Homo Sapiens
VCVSLVFSF

SEQ ID NO: 250316 - protein, 9 aa, Homo Sapiens
KGTHIDTLL

SEQ ID NO: 250317 - protein, 9 aa, Homo Sapiens
SHSPAICPA

SEQ ID NO: 250318 - protein, 9 aa, Homo Sapiens
ECKALSHSD

SEQ ID NO: 250319 - protein, 9 aa, Homo Sapiens
SSKLLYIYG

SEQ ID NO: 250320 - protein, 9 aa, Homo Sapiens
VDKAAAWKV

SEQ ID NO: 250321 - protein, 9 aa, Homo Sapiens
TVNIVAISE

SEQ ID NO: 250322 - protein, 9 aa, Homo Sapiens
PELMILASD

SEQ ID NO: 250323 - protein, 9 aa, Homo Sapiens
GQLRRIQRQ

SEQ ID NO: 250324 - protein, 9 aa, Homo Sapiens
KIIEAKQKG

SEQ ID NO: 250325 - protein, 9 aa, Homo Sapiens
GNKLGLTSD

SEQ ID NO: 250326 - protein, 9 aa, Homo Sapiens
WVLFELARY

SEQ ID NO: 250327 - protein, 9 aa, Homo Sapiens
GIKGQHLIS

SEQ ID NO: 250328 - protein, 9 aa, Homo Sapiens
HFSRAVADS

SEQ ID NO: 250329 - protein, 9 aa, Homo Sapiens
DVHKLRELQ

SEQ ID NO: 250330 - protein, 9 aa, Homo Sapiens
THRYSDGWC

SEQ ID NO: 250331 - protein, 9 aa, Homo Sapiens
NKLDREKED

SEQ ID NO: 250332 - protein, 9 aa, Homo Sapiens
DLRCVEMKQ

SEQ ID NO: 250333 - protein, 9 aa, Homo Sapiens
SLARLQQLP

SEQ ID NO: 250334 - protein, 9 aa, Homo Sapiens
ERVKTMLLK

SEQ ID NO: 250335 - protein, 9 aa, Homo Sapiens
LRSQFQARD

SEQ ID NO: 250336 - protein, 9 aa, Homo Sapiens
DAVLYLLDI

SEQ ID NO: 250337 - protein, 9 aa, Homo Sapiens
NEQAKKMNI

SEQ ID NO: 250338 - protein, 9 aa, Homo Sapiens
CITDVKIGQ

SEQ ID NO: 250339 - protein, 9 aa, Homo Sapiens
GDLYVIFEY

SEQ ID NO: 250340 - protein, 9 aa, Homo Sapiens
FDAKQLNKS

SEQ ID NO: 250341 - protein, 9 aa, Homo Sapiens
KPYENRFIV

SEQ ID NO: 250342 - protein, 9 aa, Homo Sapiens
ASACTNHQP

SEQ ID NO: 250343 - protein, 9 aa, Homo Sapiens
EGRPLNAEK

SEQ ID NO: 250344 - protein, 9 aa, Homo Sapiens
IVSNYEKIR

SEQ ID NO: 250345 - protein, 9 aa, Homo Sapiens
MCCCCCCCC

SEQ ID NO: 250346 - protein, 9 aa, Homo Sapiens
LNPELIWPF

SEQ ID NO: 250347 - protein, 9 aa, Homo Sapiens
GLTPYLVTA

SEQ ID NO: 250348 - protein, 9 aa, Homo Sapiens
IHVNHVRDT

SEQ ID NO: 250349 - protein, 9 aa, Homo Sapiens
FAREVQDLA

SEQ ID NO: 250350 - protein, 9 aa, Homo Sapiens
NTSTCELVR

SEQ ID NO: 250351 - protein, 9 aa, Homo Sapiens
NKSIQSGPL

SEQ ID NO: 250352 - protein, 9 aa, Homo Sapiens
NGSDSKGAA

SEQ ID NO: 250353 - protein, 9 aa, Homo Sapiens
DVHLKKELF

SEQ ID NO: 250354 - protein, 9 aa, Homo Sapiens
FGSPGKTED

SEQ ID NO: 250355 - protein, 9 aa, Homo Sapiens
TIPAVAGHQ

SEQ ID NO: 250356 - protein, 9 aa, Homo Sapiens
GKNYGNGKT

SEQ ID NO: 250357 - protein, 9 aa, Homo Sapiens
RVLWGLLDQ

SEQ ID NO: 250358 - protein, 9 aa, Homo Sapiens
LMNKDVKGA

SEQ ID NO: 250359 - protein, 9 aa, Homo Sapiens
FLWTFRHSE

SEQ ID NO: 250360 - protein, 9 aa, Homo Sapiens
GVELQEMDS

SEQ ID NO: 250361 - protein, 9 aa, Homo Sapiens
VHSANKFFV

SEQ ID NO: 250362 - protein, 9 aa, Homo Sapiens
SMQQEAPSL

SEQ ID NO: 250363 - protein, 9 aa, Homo Sapiens
GLGSIASLA

SEQ ID NO: 250364 - protein, 9 aa, Homo Sapiens
EKNIPKYNV

SEQ ID NO: 250365 - protein, 9 aa, Homo Sapiens
DGMEVPDDS

SEQ ID NO: 250366 - protein, 9 aa, Homo Sapiens
DEEFFIKIA

SEQ ID NO: 250367 - protein, 9 aa, Homo Sapiens
NAFVLFLGE

SEQ ID NO: 250368 - protein, 9 aa, Homo Sapiens
GFKITEDGR

SEQ ID NO: 250369 - protein, 9 aa, Homo Sapiens
GVASCGACK

SEQ ID NO: 250370 - protein, 9 aa, Homo Sapiens
GQDDYIYLF

SEQ ID NO: 250371 - protein, 9 aa, Homo Sapiens
NFDIGPEFI

SEQ ID NO: 250372 - protein, 9 aa, Homo Sapiens
VKITILKED

SEQ ID NO: 250373 - protein, 9 aa, Homo Sapiens
WGQGAPFIP

SEQ ID NO: 250374 - protein, 9 aa, Homo Sapiens
TEMFIKDAN

SEQ ID NO: 250375 - protein, 9 aa, Homo Sapiens
FLHSNSIAI

SEQ ID NO: 250376 - protein, 9 aa, Homo Sapiens
LKQHLKNRC

SEQ ID NO: 250377 - protein, 9 aa, Homo Sapiens
TYGVRNRKH

SEQ ID NO: 250378 - protein, 9 aa, Homo Sapiens
SSAQPFITK

SEQ ID NO: 250379 - protein, 9 aa, Homo Sapiens
AESVKYQNQ

SEQ ID NO: 250380 - protein, 9 aa, Homo Sapiens
GLAPDPVFD

SEQ ID NO: 250381 - protein, 9 aa, Homo Sapiens
YVVMNHGCS

SEQ ID NO: 250382 - protein, 9 aa, Homo Sapiens
RKFKLENQD

SEQ ID NO: 250383 - protein, 9 aa, Homo Sapiens
RVNDASPNQ

SEQ ID NO: 250384 - protein, 9 aa, Homo Sapiens
SALEQLEYG

SEQ ID NO: 250385 - protein, 9 aa, Homo Sapiens
VNRFVVRSQ

SEQ ID NO: 250386 - protein, 9 aa, Homo Sapiens
AITDNDMQN

SEQ ID NO: 250387 - protein, 9 aa, Homo Sapiens
IYYDEYFNC

SEQ ID NO: 250388 - protein, 9 aa, Homo Sapiens
LIPDSCRII

SEQ ID NO: 250389 - protein, 9 aa, Homo Sapiens
DSLDRIKEE

SEQ ID NO: 250390 - protein, 9 aa, Homo Sapiens
GHLTHDRIK

SEQ ID NO: 250391 - protein, 9 aa, Homo Sapiens
PSTYIQINP

SEQ ID NO: 250392 - protein, 9 aa, Homo Sapiens
PNMAARLAA

SEQ ID NO: 250393 - protein, 9 aa, Homo Sapiens
TLGAMDVSE

SEQ ID NO: 250394 - protein, 9 aa, Homo Sapiens
HTAFIGDIN

SEQ ID NO: 250395 - protein, 9 aa, Homo Sapiens
IMYSCWRTN

SEQ ID NO: 250396 - protein, 9 aa, Homo Sapiens
MSELSDQIT

SEQ ID NO: 250397 - protein, 9 aa, Homo Sapiens
PGEPATELS

SEQ ID NO: 250398 - protein, 9 aa, Homo Sapiens
FTLAKLGIC

SEQ ID NO: 250399 - protein, 9 aa, Homo Sapiens
FTKAYQQMV

SEQ ID NO: 250400 - protein, 9 aa, Homo Sapiens
KDVAQDDAE

SEQ ID NO: 250401 - protein, 9 aa, Homo Sapiens
DDFKLNSST

SEQ ID NO: 250402 - protein, 9 aa, Homo Sapiens
CGNVSNRFQ

SEQ ID NO: 250403 - protein, 9 aa, Homo Sapiens
DLYVIFEYR

SEQ ID NO: 250404 - protein, 9 aa, Homo Sapiens
LLANKTPHN

SEQ ID NO: 250405 - protein, 9 aa, Homo Sapiens
KKATYKDYS

SEQ ID NO: 250406 - protein, 9 aa, Homo Sapiens
DRERIEASR

SEQ ID NO: 250407 - protein, 9 aa, Homo Sapiens
EEVKEEIIN

SEQ ID NO: 250408 - protein, 9 aa, Homo Sapiens
ACGVATYMV

SEQ ID NO: 250409 - protein, 9 aa, Homo Sapiens
CNPSMRKRI

SEQ ID NO: 250410 - protein, 9 aa, Homo Sapiens
ELWFGLVTS

SEQ ID NO: 250411 - protein, 9 aa, Homo Sapiens
MDCILALPQ

SEQ ID NO: 250412 - protein, 9 aa, Homo Sapiens
AMFRQFQQI

SEQ ID NO: 250413 - protein, 9 aa, Homo Sapiens
HSDPYNQRR

SEQ ID NO: 250414 - protein, 9 aa, Homo Sapiens
NTDTVVDFM

SEQ ID NO: 250415 - protein, 9 aa, Homo Sapiens
INQMFEELR

SEQ ID NO: 250416 - protein, 9 aa, Homo Sapiens
SMQGLCTFG

SEQ ID NO: 250417 - protein, 9 aa, Homo Sapiens
TSESRSKRE

SEQ ID NO: 250418 - protein, 9 aa, Homo Sapiens
RFILNILNM

SEQ ID NO: 250419 - protein, 9 aa, Homo Sapiens
SQTYTTSSE

SEQ ID NO: 250420 - protein, 9 aa, Homo Sapiens
PTSVYAEDA

SEQ ID NO: 250421 - protein, 9 aa, Homo Sapiens
HGELPPVTD

SEQ ID NO: 250422 - protein, 9 aa, Homo Sapiens
WNKPTVESL

SEQ ID NO: 250423 - protein, 9 aa, Homo Sapiens
GLTCVYIPQ

SEQ ID NO: 250424 - protein, 9 aa, Homo Sapiens
SLVQKKAHP

SEQ ID NO: 250425 - protein, 9 aa, Homo Sapiens
RRVKLGQSQ

SEQ ID NO: 250426 - protein, 9 aa, Homo Sapiens
RQNQLYDTQ

SEQ ID NO: 250427 - protein, 9 aa, Homo Sapiens
KHIQYKLLD

SEQ ID NO: 250428 - protein, 9 aa, Homo Sapiens
KRKLQWNES

SEQ ID NO: 250429 - protein, 9 aa, Homo Sapiens
DICLQLSCL

SEQ ID NO: 250430 - protein, 9 aa, Homo Sapiens
NNELSMFIV

SEQ ID NO: 250431 - protein, 9 aa, Homo Sapiens
IPETKNCCG

SEQ ID NO: 250432 - protein, 9 aa, Homo Sapiens
TEDPHLVND

SEQ ID NO: 250433 - protein, 9 aa, Homo Sapiens
PVRSNHPFR

SEQ ID NO: 250434 - protein, 9 aa, Homo Sapiens
TKILHTAWH

SEQ ID NO: 250435 - protein, 9 aa, Homo Sapiens
DLVLDRICK

SEQ ID NO: 250436 - protein, 9 aa, Homo Sapiens
IKKVKCILK

SEQ ID NO: 250437 - protein, 9 aa, Homo Sapiens
MQLDSEGIF

SEQ ID NO: 250438 - protein, 9 aa, Homo Sapiens
GMYSITVAF

SEQ ID NO: 250439 - protein, 9 aa, Homo Sapiens
TNGSSGSES

SEQ ID NO: 250440 - protein, 9 aa, Homo Sapiens
GGSEHLQTL

SEQ ID NO: 250441 - protein, 9 aa, Homo Sapiens
KKPVAFSYY

SEQ ID NO: 250442 - protein, 9 aa, Homo Sapiens
NHKKFFQMV

SEQ ID NO: 250443 - protein, 9 aa, Homo Sapiens
LSRPVSQET

SEQ ID NO: 250444 - protein, 9 aa, Homo Sapiens
GPGQYMISA

SEQ ID NO: 250445 - protein, 9 aa, Homo Sapiens
EYNVLPASE

SEQ ID NO: 250446 - protein, 9 aa, Homo Sapiens
STPGPGIKL

SEQ ID NO: 250447 - protein, 9 aa, Homo Sapiens
VYPASASTQ

SEQ ID NO: 250448 - protein, 9 aa, Homo Sapiens
QTKAMAHLI

SEQ ID NO: 250449 - protein, 9 aa, Homo Sapiens
QNLPSTGFF

SEQ ID NO: 250450 - protein, 9 aa, Homo Sapiens
LKVEYEFDS

SEQ ID NO: 250451 - protein, 9 aa, Homo Sapiens
LFSTNNSSA

SEQ ID NO: 250452 - protein, 9 aa, Homo Sapiens
VGKDRSPLS

SEQ ID NO: 250453 - protein, 9 aa, Homo Sapiens
QFPQSIDLL

SEQ ID NO: 250454 - protein, 9 aa, Homo Sapiens
TLEFDLLYG

SEQ ID NO: 250455 - protein, 9 aa, Homo Sapiens
QNENVSSSA

SEQ ID NO: 250456 - protein, 9 aa, Homo Sapiens
LDYTFAPRT

SEQ ID NO: 250457 - protein, 9 aa, Homo Sapiens
DMLAEKLAP

SEQ ID NO: 250458 - protein, 9 aa, Homo Sapiens
VFASCRIVH

SEQ ID NO: 250459 - protein, 9 aa, Homo Sapiens
MLGGEPYTL

SEQ ID NO: 250460 - protein, 9 aa, Homo Sapiens
FRDNLNKLM

SEQ ID NO: 250461 - protein, 9 aa, Homo Sapiens
ISEFVEHHI

SEQ ID NO: 250462 - protein, 9 aa, Homo Sapiens
EDAFNNFPF

SEQ ID NO: 250463 - protein, 9 aa, Homo Sapiens
QFMLEETDW

SEQ ID NO: 250464 - protein, 9 aa, Homo Sapiens
TSVSRFVLL

SEQ ID NO: 250465 - protein, 9 aa, Homo Sapiens
QGQNYNQAY

SEQ ID NO: 250466 - protein, 9 aa, Homo Sapiens
ESKLEITPQ

SEQ ID NO: 250467 - protein, 9 aa, Homo Sapiens
VVLNMQFLD

SEQ ID NO: 250468 - protein, 9 aa, Homo Sapiens
ASHLKIENV

SEQ ID NO: 250469 - protein, 9 aa, Homo Sapiens
MAFRLDRRE

SEQ ID NO: 250470 - protein, 9 aa, Homo Sapiens
SIIHHDQPV

SEQ ID NO: 250471 - protein, 9 aa, Homo Sapiens
FRKRHVLGL

SEQ ID NO: 250472 - protein, 9 aa, Homo Sapiens
DVDVQNIVE

SEQ ID NO: 250473 - protein, 9 aa, Homo Sapiens
ILQRRLMGT

SEQ ID NO: 250474 - protein, 9 aa, Homo Sapiens
PVVTSQLGR

SEQ ID NO: 250475 - protein, 9 aa, Homo Sapiens
AKAHGGYSA

SEQ ID NO: 250476 - protein, 9 aa, Homo Sapiens
ETTDPSDKK

SEQ ID NO: 250477 - protein, 9 aa, Homo Sapiens
ERHLHNNFL

SEQ ID NO: 250478 - protein, 9 aa, Homo Sapiens
AWTKRNDMQ

SEQ ID NO: 250479 - protein, 9 aa, Homo Sapiens
KVTPEIQTV

SEQ ID NO: 250480 - protein, 9 aa, Homo Sapiens
RDIKSKEAE

SEQ ID NO: 250481 - protein, 9 aa, Homo Sapiens
EFNLLDPRE

SEQ ID NO: 250482 - protein, 9 aa, Homo Sapiens
MEHISDKVS

SEQ ID NO: 250483 - protein, 9 aa, Homo Sapiens
ITILKLVGV

SEQ ID NO: 250484 - protein, 9 aa, Homo Sapiens
SSTEMQLMA

SEQ ID NO: 250485 - protein, 9 aa, Homo Sapiens
EMLNSCSSS

SEQ ID NO: 250486 - protein, 9 aa, Homo Sapiens
NNGGLIKGR

SEQ ID NO: 250487 - protein, 9 aa, Homo Sapiens
YMMFKVMEP

SEQ ID NO: 250488 - protein, 9 aa, Homo Sapiens
AAILKKGHS

SEQ ID NO: 250489 - protein, 9 aa, Homo Sapiens
TPNKLVQLN

SEQ ID NO: 250490 - protein, 9 aa, Homo Sapiens
YHPAERISA

SEQ ID NO: 250491 - protein, 9 aa, Homo Sapiens
MARYPHSLW

SEQ ID NO: 250492 - protein, 9 aa, Homo Sapiens
PAKEVLNAR

SEQ ID NO: 250493 - protein, 9 aa, Homo Sapiens
NKPYECTEC

SEQ ID NO: 250494 - protein, 9 aa, Homo Sapiens
YFEQLALKG

SEQ ID NO: 250495 - protein, 9 aa, Homo Sapiens
FLSQKARRK

SEQ ID NO: 250496 - protein, 9 aa, Homo Sapiens
RLKHIWNWR

SEQ ID NO: 250497 - protein, 9 aa, Homo Sapiens
NFSAFSLIR

SEQ ID NO: 250498 - protein, 9 aa, Homo Sapiens
ELGAPAKSA

SEQ ID NO: 250499 - protein, 9 aa, Homo Sapiens
LTQAISDHY

SEQ ID NO: 250500 - protein, 9 aa, Homo Sapiens
IDFFVERNI

SEQ ID NO: 250501 - protein, 9 aa, Homo Sapiens
AWWPNPQAF

SEQ ID NO: 250502 - protein, 9 aa, Homo Sapiens
DFGTVRDTL

SEQ ID NO: 250503 - protein, 9 aa, Homo Sapiens
QIHHSENNW

SEQ ID NO: 250504 - protein, 9 aa, Homo Sapiens
SSCYINVRW

SEQ ID NO: 250505 - protein, 9 aa, Homo Sapiens
RNCMWLQVL

SEQ ID NO: 250506 - protein, 9 aa, Homo Sapiens
SAKGKLQAE

SEQ ID NO: 250507 - protein, 9 aa, Homo Sapiens
FLVMYVVTL

SEQ ID NO: 250508 - protein, 9 aa, Homo Sapiens
FGETLSCIF

SEQ ID NO: 250509 - protein, 9 aa, Homo Sapiens
GSPSLLSNN

SEQ ID NO: 250510 - protein, 9 aa, Homo Sapiens
ENVDKVAFT

SEQ ID NO: 250511 - protein, 9 aa, Homo Sapiens
KEVVTPPYP

SEQ ID NO: 250512 - protein, 9 aa, Homo Sapiens
YFLVISCSH

SEQ ID NO: 250513 - protein, 9 aa, Homo Sapiens
NKSRSAQSP

SEQ ID NO: 250514 - protein, 9 aa, Homo Sapiens
LKKKLSASQ

SEQ ID NO: 250515 - protein, 9 aa, Homo Sapiens
LQMFQALNR

SEQ ID NO: 250516 - protein, 9 aa, Homo Sapiens
NSSKTTSKK

SEQ ID NO: 250517 - protein, 9 aa, Homo Sapiens
VGSAEEGYF

SEQ ID NO: 250518 - protein, 9 aa, Homo Sapiens
QELKQCPNP

SEQ ID NO: 250519 - protein, 9 aa, Homo Sapiens
KKGRKYALL

SEQ ID NO: 250520 - protein, 9 aa, Homo Sapiens
VKTMLLKSN

SEQ ID NO: 250521 - protein, 9 aa, Homo Sapiens
SERSDNISE

SEQ ID NO: 250522 - protein, 9 aa, Homo Sapiens
QSESQKIEI

SEQ ID NO: 250523 - protein, 9 aa, Homo Sapiens
FAICFVCGI

SEQ ID NO: 250524 - protein, 9 aa, Homo Sapiens
DAGKLHYHS

SEQ ID NO: 250525 - protein, 9 aa, Homo Sapiens
FYQQFHIIV

SEQ ID NO: 250526 - protein, 9 aa, Homo Sapiens
PRVTLDWSE

SEQ ID NO: 250527 - protein, 9 aa, Homo Sapiens
DFETMSLYD

SEQ ID NO: 250528 - protein, 9 aa, Homo Sapiens
PIRDDGNMP

SEQ ID NO: 250529 - protein, 9 aa, Homo Sapiens
SFATPRAKA

SEQ ID NO: 250530 - protein, 9 aa, Homo Sapiens
LTIQVGEII

SEQ ID NO: 250531 - protein, 9 aa, Homo Sapiens
SHKRVVCNQ

SEQ ID NO: 250532 - protein, 9 aa, Homo Sapiens
VKAHTAPVR

SEQ ID NO: 250533 - protein, 9 aa, Homo Sapiens
PPRAAENMA

SEQ ID NO: 250534 - protein, 9 aa, Homo Sapiens
LLRAKNAQL

SEQ ID NO: 250535 - protein, 9 aa, Homo Sapiens
ELGIIGNNT

SEQ ID NO: 250536 - protein, 9 aa, Homo Sapiens
LLGLASVIN

SEQ ID NO: 250537 - protein, 9 aa, Homo Sapiens
HMPDTRFSM

SEQ ID NO: 250538 - protein, 9 aa, Homo Sapiens
QSLCTISNQ

SEQ ID NO: 250539 - protein, 9 aa, Homo Sapiens
FAEKFQEMK

SEQ ID NO: 250540 - protein, 9 aa, Homo Sapiens
QCDNMNKIN

SEQ ID NO: 250541 - protein, 9 aa, Homo Sapiens
LFSLEFGYP

SEQ ID NO: 250542 - protein, 9 aa, Homo Sapiens
GFVTEMCMR

SEQ ID NO: 250543 - protein, 9 aa, Homo Sapiens
YCPPETAVI

SEQ ID NO: 250544 - protein, 9 aa, Homo Sapiens
LLLEVTNGT

SEQ ID NO: 250545 - protein, 9 aa, Homo Sapiens
WLAFLPIFF

SEQ ID NO: 250546 - protein, 9 aa, Homo Sapiens
VYVKSGPNR

SEQ ID NO: 250547 - protein, 9 aa, Homo Sapiens
ESSCIGAAI

SEQ ID NO: 250548 - protein, 9 aa, Homo Sapiens
NIVAYYHSR

SEQ ID NO: 250549 - protein, 9 aa, Homo Sapiens
DLTKVVVYG

SEQ ID NO: 250550 - protein, 9 aa, Homo Sapiens
TSPPKQAKA

SEQ ID NO: 250551 - protein, 9 aa, Homo Sapiens
GADSGTLAR

SEQ ID NO: 250552 - protein, 9 aa, Homo Sapiens
GSLFNKTEN

SEQ ID NO: 250553 - protein, 9 aa, Homo Sapiens
TIQIQGYPL

SEQ ID NO: 250554 - protein, 9 aa, Homo Sapiens
IFPPMPKAE

SEQ ID NO: 250555 - protein, 9 aa, Homo Sapiens
NLFRHYRIN

SEQ ID NO: 250556 - protein, 9 aa, Homo Sapiens
ISEASERSD

SEQ ID NO: 250557 - protein, 9 aa, Homo Sapiens
LRHKAYERE

SEQ ID NO: 250558 - protein, 9 aa, Homo Sapiens
KHMKHEHVI

SEQ ID NO: 250559 - protein, 9 aa, Homo Sapiens
HLLLGNLAF

SEQ ID NO: 250560 - protein, 9 aa, Homo Sapiens
INTESTLKT

SEQ ID NO: 250561 - protein, 9 aa, Homo Sapiens
VIENVLSLS

SEQ ID NO: 250562 - protein, 9 aa, Homo Sapiens
HILHTNAKV

SEQ ID NO: 250563 - protein, 9 aa, Homo Sapiens
KCDGFYLIS

SEQ ID NO: 250564 - protein, 9 aa, Homo Sapiens
GANYAVAVG

SEQ ID NO: 250565 - protein, 9 aa, Homo Sapiens
EEHLDNSNT

SEQ ID NO: 250566 - protein, 9 aa, Homo Sapiens
LMKEYFKER

SEQ ID NO: 250567 - protein, 9 aa, Homo Sapiens
TQAQLVQFM

SEQ ID NO: 250568 - protein, 9 aa, Homo Sapiens
PNMLSVALS

SEQ ID NO: 250569 - protein, 9 aa, Homo Sapiens
ESRLELQAY

SEQ ID NO: 250570 - protein, 9 aa, Homo Sapiens
ALQRHRIIH

SEQ ID NO: 250571 - protein, 9 aa, Homo Sapiens
GHSTLRVAI

SEQ ID NO: 250572 - protein, 9 aa, Homo Sapiens
SVTEGAVGA

SEQ ID NO: 250573 - protein, 9 aa, Homo Sapiens
ESLTCLCNI

SEQ ID NO: 250574 - protein, 9 aa, Homo Sapiens
QTARECLVK

SEQ ID NO: 250575 - protein, 9 aa, Homo Sapiens
ENETVVLSG

SEQ ID NO: 250576 - protein, 9 aa, Homo Sapiens
EKQRLFATK

SEQ ID NO: 250577 - protein, 9 aa, Homo Sapiens
HDPADAAEP

SEQ ID NO: 250578 - protein, 9 aa, Homo Sapiens
VVKSHKQVK

SEQ ID NO: 250579 - protein, 9 aa, Homo Sapiens
ELPVVIIID

SEQ ID NO: 250580 - protein, 9 aa, Homo Sapiens
YFSRKGHLR

SEQ ID NO: 250581 - protein, 9 aa, Homo Sapiens
SDEESHDEP

SEQ ID NO: 250582 - protein, 9 aa, Homo Sapiens
QSPHTAVKY

SEQ ID NO: 250583 - protein, 9 aa, Homo Sapiens
QEWADPDNL

SEQ ID NO: 250584 - protein, 9 aa, Homo Sapiens
IYIETSQLQ

SEQ ID NO: 250585 - protein, 9 aa, Homo Sapiens
DDSYLLRDS

SEQ ID NO: 250586 - protein, 9 aa, Homo Sapiens
FRRQNDLTY

SEQ ID NO: 250587 - protein, 9 aa, Homo Sapiens
THKFCRCYC

SEQ ID NO: 250588 - protein, 9 aa, Homo Sapiens
TSDNKDSVS

SEQ ID NO: 250589 - protein, 9 aa, Homo Sapiens
PSGQRNEEF

SEQ ID NO: 250590 - protein, 9 aa, Homo Sapiens
VSATYPKFL

SEQ ID NO: 250591 - protein, 9 aa, Homo Sapiens
MRNKMKLRK

SEQ ID NO: 250592 - protein, 9 aa, Homo Sapiens
DKDKGIQKD

SEQ ID NO: 250593 - protein, 9 aa, Homo Sapiens
WEKHFYVVT

SEQ ID NO: 250594 - protein, 9 aa, Homo Sapiens
KTSIKMWFS

SEQ ID NO: 250595 - protein, 9 aa, Homo Sapiens
TPVPDGKKA

SEQ ID NO: 250596 - protein, 9 aa, Homo Sapiens
KEVTELYVQ

SEQ ID NO: 250597 - protein, 9 aa, Homo Sapiens
FNDIHYFPT

SEQ ID NO: 250598 - protein, 9 aa, Homo Sapiens
SAIPMVSVV

SEQ ID NO: 250599 - protein, 9 aa, Homo Sapiens
RWVKIFTPC

SEQ ID NO: 250600 - protein, 9 aa, Homo Sapiens
LSKRGPRRP

SEQ ID NO: 250601 - protein, 9 aa, Homo Sapiens
NVAPVGDTK

SEQ ID NO: 250602 - protein, 9 aa, Homo Sapiens
LSILLGGYL

SEQ ID NO: 250603 - protein, 9 aa, Homo Sapiens
QEVQKVLLY

SEQ ID NO: 250604 - protein, 9 aa, Homo Sapiens
AGYGVFSQR

SEQ ID NO: 250605 - protein, 9 aa, Homo Sapiens
DQEKDKEKE

SEQ ID NO: 250606 - protein, 9 aa, Homo Sapiens
KGMLHKEKL

SEQ ID NO: 250607 - protein, 9 aa, Homo Sapiens
TTQPKRQKH

SEQ ID NO: 250608 - protein, 9 aa, Homo Sapiens
SSDGLGSSS

SEQ ID NO: 250609 - protein, 9 aa, Homo Sapiens
HRIKETDTI

SEQ ID NO: 250610 - protein, 9 aa, Homo Sapiens
RCQEYLIKK

SEQ ID NO: 250611 - protein, 9 aa, Homo Sapiens
ENTAEGNPT

SEQ ID NO: 250612 - protein, 9 aa, Homo Sapiens
KCNPCGKVF

SEQ ID NO: 250613 - protein, 9 aa, Homo Sapiens
ESDAEFDKG

SEQ ID NO: 250614 - protein, 9 aa, Homo Sapiens
LLEHKALDE

SEQ ID NO: 250615 - protein, 9 aa, Homo Sapiens
SLDEKRKSL

SEQ ID NO: 250616 - protein, 9 aa, Homo Sapiens
TSVYPNGQF

SEQ ID NO: 250617 - protein, 9 aa, Homo Sapiens
QYYMMFKVM

SEQ ID NO: 250618 - protein, 9 aa, Homo Sapiens
LQRHRIIHT

SEQ ID NO: 250619 - protein, 9 aa, Homo Sapiens
MEIQGTRTQ

SEQ ID NO: 250620 - protein, 9 aa, Homo Sapiens
HLAGCGADL

SEQ ID NO: 250621 - protein, 9 aa, Homo Sapiens
LLSCLPYGH

SEQ ID NO: 250622 - protein, 9 aa, Homo Sapiens
KFSQITPWL

SEQ ID NO: 250623 - protein, 9 aa, Homo Sapiens
ALYSTRFPS

SEQ ID NO: 250624 - protein, 9 aa, Homo Sapiens
FPAFSYKPW

SEQ ID NO: 250625 - protein, 9 aa, Homo Sapiens
LARNCMWLQ

SEQ ID NO: 250626 - protein, 9 aa, Homo Sapiens
ETGHSPPPA

SEQ ID NO: 250627 - protein, 9 aa, Homo Sapiens
LVRVMDPSL

SEQ ID NO: 250628 - protein, 9 aa, Homo Sapiens
SEITDEDIN

SEQ ID NO: 250629 - protein, 9 aa, Homo Sapiens
CKLYSSLLA

SEQ ID NO: 250630 - protein, 9 aa, Homo Sapiens
TFALLVEMG

SEQ ID NO: 250631 - protein, 9 aa, Homo Sapiens
CPTRDLPRP

SEQ ID NO: 250632 - protein, 9 aa, Homo Sapiens
HIASGTSEQ

SEQ ID NO: 250633 - protein, 9 aa, Homo Sapiens
NLLNPIHGL

SEQ ID NO: 250634 - protein, 9 aa, Homo Sapiens
RRNCSKLRK

SEQ ID NO: 250635 - protein, 9 aa, Homo Sapiens
EALNNLTPY

SEQ ID NO: 250636 - protein, 9 aa, Homo Sapiens
AWKGSVSPT

SEQ ID NO: 250637 - protein, 9 aa, Homo Sapiens
QEIKMCGKE

SEQ ID NO: 250638 - protein, 9 aa, Homo Sapiens
HCAAQNGDE

SEQ ID NO: 250639 - protein, 9 aa, Homo Sapiens
KTNHVTIPK

SEQ ID NO: 250640 - protein, 9 aa, Homo Sapiens
SLLGSMAYN

SEQ ID NO: 250641 - protein, 9 aa, Homo Sapiens
PSDKKEKKS

SEQ ID NO: 250642 - protein, 9 aa, Homo Sapiens
KVMEQTFDL

SEQ ID NO: 250643 - protein, 9 aa, Homo Sapiens
KTPLPNMDS

SEQ ID NO: 250644 - protein, 9 aa, Homo Sapiens
VEEHFRTLN

SEQ ID NO: 250645 - protein, 9 aa, Homo Sapiens
KNHQDDGKM

SEQ ID NO: 250646 - protein, 9 aa, Homo Sapiens
PIHGLVQSV

SEQ ID NO: 250647 - protein, 9 aa, Homo Sapiens
FAQLEFQLW

SEQ ID NO: 250648 - protein, 9 aa, Homo Sapiens
KRVDLENNQ

SEQ ID NO: 250649 - protein, 9 aa, Homo Sapiens
ASNSGCKIW

SEQ ID NO: 250650 - protein, 9 aa, Homo Sapiens
ASNRTWTDY

SEQ ID NO: 250651 - protein, 9 aa, Homo Sapiens
PSLREKAKN

SEQ ID NO: 250652 - protein, 9 aa, Homo Sapiens
EDMKRYLHQ

SEQ ID NO: 250653 - protein, 9 aa, Homo Sapiens
CLTDVYLGR

SEQ ID NO: 250654 - protein, 9 aa, Homo Sapiens
RRGQVASSL

SEQ ID NO: 250655 - protein, 9 aa, Homo Sapiens
DINSAEQGP

SEQ ID NO: 250656 - protein, 9 aa, Homo Sapiens
KLLRAKNAQ

SEQ ID NO: 250657 - protein, 9 aa, Homo Sapiens
AESPISGLQ

SEQ ID NO: 250658 - protein, 9 aa, Homo Sapiens
KYNEALQSN

SEQ ID NO: 250659 - protein, 9 aa, Homo Sapiens
DDGGFFPQT

SEQ ID NO: 250660 - protein, 9 aa, Homo Sapiens
IYKHEGVRG

SEQ ID NO: 250661 - protein, 9 aa, Homo Sapiens
GGPTSVYAE

SEQ ID NO: 250662 - protein, 9 aa, Homo Sapiens
GHSSLQENK

SEQ ID NO: 250663 - protein, 9 aa, Homo Sapiens
AVKATAQPP

SEQ ID NO: 250664 - protein, 9 aa, Homo Sapiens
GVKLFFHFR

SEQ ID NO: 250665 - protein, 9 aa, Homo Sapiens
AFSCVFASC

SEQ ID NO: 250666 - protein, 9 aa, Homo Sapiens
PNTLHLEIH

SEQ ID NO: 250667 - protein, 9 aa, Homo Sapiens
DGTLFHKSG

SEQ ID NO: 250668 - protein, 9 aa, Homo Sapiens
IREEPLTEQ

SEQ ID NO: 250669 - protein, 9 aa, Homo Sapiens
SPSRGAPRG

SEQ ID NO: 250670 - protein, 9 aa, Homo Sapiens
RELMLGSET

SEQ ID NO: 250671 - protein, 9 aa, Homo Sapiens
VRFYLVVYP

SEQ ID NO: 250672 - protein, 9 aa, Homo Sapiens
FGVFLVMYV

SEQ ID NO: 250673 - protein, 9 aa, Homo Sapiens
FVSVSAFFF

SEQ ID NO: 250674 - protein, 9 aa, Homo Sapiens
GASRNSSSV

SEQ ID NO: 250675 - protein, 9 aa, Homo Sapiens
NNTFNLEKQ

SEQ ID NO: 250676 - protein, 9 aa, Homo Sapiens
DQADLSLDD

SEQ ID NO: 250677 - protein, 9 aa, Homo Sapiens
NLKVGHEVL

SEQ ID NO: 250678 - protein, 9 aa, Homo Sapiens
PGPNMNHIA

SEQ ID NO: 250679 - protein, 9 aa, Homo Sapiens
DIDECMIMS

SEQ ID NO: 250680 - protein, 9 aa, Homo Sapiens
VPSPDQKDS

SEQ ID NO: 250681 - protein, 9 aa, Homo Sapiens
TFRVETPEE

SEQ ID NO: 250682 - protein, 9 aa, Homo Sapiens
LHQLLPHHA

SEQ ID NO: 250683 - protein, 9 aa, Homo Sapiens
GGIILAVAK

SEQ ID NO: 250684 - protein, 9 aa, Homo Sapiens
CNFEDRILL

SEQ ID NO: 250685 - protein, 9 aa, Homo Sapiens
DPIRLLGLI

SEQ ID NO: 250686 - protein, 9 aa, Homo Sapiens
GILKEVENE

SEQ ID NO: 250687 - protein, 9 aa, Homo Sapiens
SVTPDSTRD

SEQ ID NO: 250688 - protein, 9 aa, Homo Sapiens
VLGHYVTSA

SEQ ID NO: 250689 - protein, 9 aa, Homo Sapiens
EDGFKITED

SEQ ID NO: 250690 - protein, 9 aa, Homo Sapiens
KQRRREIWL

SEQ ID NO: 250691 - protein, 9 aa, Homo Sapiens
PLPENPCYF

SEQ ID NO: 250692 - protein, 9 aa, Homo Sapiens
KWPMQSRLY

SEQ ID NO: 250693 - protein, 9 aa, Homo Sapiens
LLTIIAIVV

SEQ ID NO: 250694 - protein, 9 aa, Homo Sapiens
GEIEDDDED

SEQ ID NO: 250695 - protein, 9 aa, Homo Sapiens
RGEPDIYRP

SEQ ID NO: 250696 - protein, 9 aa, Homo Sapiens
VNPPVITAA

SEQ ID NO: 250697 - protein, 9 aa, Homo Sapiens
CNRCIAKCD

SEQ ID NO: 250698 - protein, 9 aa, Homo Sapiens
EKGREHIAN

SEQ ID NO: 250699 - protein, 9 aa, Homo Sapiens
SSATESRKK

SEQ ID NO: 250700 - protein, 9 aa, Homo Sapiens
VNLIPEYEI

SEQ ID NO: 250701 - protein, 9 aa, Homo Sapiens
TGSLNAYLH

SEQ ID NO: 250702 - protein, 9 aa, Homo Sapiens
GAVSVAGAF

SEQ ID NO: 250703 - protein, 9 aa, Homo Sapiens
AFTQKSELI

SEQ ID NO: 250704 - protein, 9 aa, Homo Sapiens
VEVTYYHKH

SEQ ID NO: 250705 - protein, 9 aa, Homo Sapiens
PCKEAGLKC

SEQ ID NO: 250706 - protein, 9 aa, Homo Sapiens
QVRLDRSRM

SEQ ID NO: 250707 - protein, 9 aa, Homo Sapiens
FLVKIARPK

SEQ ID NO: 250708 - protein, 9 aa, Homo Sapiens
PQKENEQAK

SEQ ID NO: 250709 - protein, 9 aa, Homo Sapiens
EEVEDAVEA

SEQ ID NO: 250710 - protein, 9 aa, Homo Sapiens
ETSIIIRNT

SEQ ID NO: 250711 - protein, 9 aa, Homo Sapiens
DRELRNLER

SEQ ID NO: 250712 - protein, 9 aa, Homo Sapiens
ISGTKMAKH

SEQ ID NO: 250713 - protein, 9 aa, Homo Sapiens
LKLVGVGEE

SEQ ID NO: 250714 - protein, 9 aa, Homo Sapiens
AGNWANRPY

SEQ ID NO: 250715 - protein, 9 aa, Homo Sapiens
QSSTLIRHK

SEQ ID NO: 250716 - protein, 9 aa, Homo Sapiens
VLILNYNLL

SEQ ID NO: 250717 - protein, 9 aa, Homo Sapiens
PQPYKCQQP

SEQ ID NO: 250718 - protein, 9 aa, Homo Sapiens
MMKHARNNY

SEQ ID NO: 250719 - protein, 9 aa, Homo Sapiens
VVHNAGPIA

SEQ ID NO: 250720 - protein, 9 aa, Homo Sapiens
CTAAMSYSL

SEQ ID NO: 250721 - protein, 9 aa, Homo Sapiens
IWNQTSAVL

SEQ ID NO: 250722 - protein, 9 aa, Homo Sapiens
LPYSDDEKF

SEQ ID NO: 250723 - protein, 9 aa, Homo Sapiens
AAGSPQKPQ

SEQ ID NO: 250724 - protein, 9 aa, Homo Sapiens
NENDILLVN

SEQ ID NO: 250725 - protein, 9 aa, Homo Sapiens
REIFNALSS

SEQ ID NO: 250726 - protein, 9 aa, Homo Sapiens
ITPWLFMPL

SEQ ID NO: 250727 - protein, 9 aa, Homo Sapiens
SNLNKSESQ

SEQ ID NO: 250728 - protein, 9 aa, Homo Sapiens
LEVPPGRGS

SEQ ID NO: 250729 - protein, 9 aa, Homo Sapiens
FLYKDCVFN

SEQ ID NO: 250730 - protein, 9 aa, Homo Sapiens
QEQINNSLK

SEQ ID NO: 250731 - protein, 9 aa, Homo Sapiens
WTVAQALTL

SEQ ID NO: 250732 - protein, 9 aa, Homo Sapiens
LNRLPKDHR

SEQ ID NO: 250733 - protein, 9 aa, Homo Sapiens
EYGGCYLCS

SEQ ID NO: 250734 - protein, 9 aa, Homo Sapiens
CIPIGHWIE

SEQ ID NO: 250735 - protein, 9 aa, Homo Sapiens
DLNSRPQAE

SEQ ID NO: 250736 - protein, 9 aa, Homo Sapiens
GKQISKQLY

SEQ ID NO: 250737 - protein, 9 aa, Homo Sapiens
RTLFFQRFS

SEQ ID NO: 250738 - protein, 9 aa, Homo Sapiens
GAPVPYPDS

SEQ ID NO: 250739 - protein, 9 aa, Homo Sapiens
YRSFNTFFP

SEQ ID NO: 250740 - protein, 9 aa, Homo Sapiens
NLKPNPGSN

SEQ ID NO: 250741 - protein, 9 aa, Homo Sapiens
HLHEIIHTG

SEQ ID NO: 250742 - protein, 9 aa, Homo Sapiens
LVYSAASPF

SEQ ID NO: 250743 - protein, 9 aa, Homo Sapiens
GMRESSQDV

SEQ ID NO: 250744 - protein, 9 aa, Homo Sapiens
AENDKPHDA

SEQ ID NO: 250745 - protein, 9 aa, Homo Sapiens
KVAVVREDN

SEQ ID NO: 250746 - protein, 9 aa, Homo Sapiens
ARNCIEITF

SEQ ID NO: 250747 - protein, 9 aa, Homo Sapiens
VLCTLPAGH

SEQ ID NO: 250748 - protein, 9 aa, Homo Sapiens
SSDDQKDDV

SEQ ID NO: 250749 - protein, 9 aa, Homo Sapiens
VPERIAIAV

SEQ ID NO: 250750 - protein, 9 aa, Homo Sapiens
KFQNVAALH

SEQ ID NO: 250751 - protein, 9 aa, Homo Sapiens
DIYAIVGTI

SEQ ID NO: 250752 - protein, 9 aa, Homo Sapiens
TPCETDNPM

SEQ ID NO: 250753 - protein, 9 aa, Homo Sapiens
KSLKVFKMA

SEQ ID NO: 250754 - protein, 9 aa, Homo Sapiens
HPGSQAPIV

SEQ ID NO: 250755 - protein, 9 aa, Homo Sapiens
DQGSHPRPA

SEQ ID NO: 250756 - protein, 9 aa, Homo Sapiens
TFQQALKDP

SEQ ID NO: 250757 - protein, 9 aa, Homo Sapiens
DVYKSPASG

SEQ ID NO: 250758 - protein, 9 aa, Homo Sapiens
IAEKLDLKT

SEQ ID NO: 250759 - protein, 9 aa, Homo Sapiens
AIRNLTKDN

SEQ ID NO: 250760 - protein, 9 aa, Homo Sapiens
PIKDPSKVP

SEQ ID NO: 250761 - protein, 9 aa, Homo Sapiens
STDDQIIVS

SEQ ID NO: 250762 - protein, 9 aa, Homo Sapiens
LTKENSRDD

SEQ ID NO: 250763 - protein, 9 aa, Homo Sapiens
WAIMHVSPT

SEQ ID NO: 250764 - protein, 9 aa, Homo Sapiens
ENMRKLTKT

SEQ ID NO: 250765 - protein, 9 aa, Homo Sapiens
QKVSMDNRL

SEQ ID NO: 250766 - protein, 9 aa, Homo Sapiens
KQLRGLQSR

SEQ ID NO: 250767 - protein, 9 aa, Homo Sapiens
KDDCSDVES

SEQ ID NO: 250768 - protein, 9 aa, Homo Sapiens
EGWYFHSRE

SEQ ID NO: 250769 - protein, 9 aa, Homo Sapiens
CIVYPCRCV

SEQ ID NO: 250770 - protein, 9 aa, Homo Sapiens
KVLLDTSNE

SEQ ID NO: 250771 - protein, 9 aa, Homo Sapiens
LSLTSECTT

SEQ ID NO: 250772 - protein, 9 aa, Homo Sapiens
FNTNNLWIY

SEQ ID NO: 250773 - protein, 9 aa, Homo Sapiens
DLRAEEIAI

SEQ ID NO: 250774 - protein, 9 aa, Homo Sapiens
KANKKQNLK

SEQ ID NO: 250775 - protein, 9 aa, Homo Sapiens
TFQNECLFC

SEQ ID NO: 250776 - protein, 9 aa, Homo Sapiens
KVILKKIRG

SEQ ID NO: 250777 - protein, 9 aa, Homo Sapiens
PITFNTNLT

SEQ ID NO: 250778 - protein, 9 aa, Homo Sapiens
IRGREACNE

SEQ ID NO: 250779 - protein, 9 aa, Homo Sapiens
HAVDTIRRA

SEQ ID NO: 250780 - protein, 9 aa, Homo Sapiens
LVLDNCINT

SEQ ID NO: 250781 - protein, 9 aa, Homo Sapiens
LPQLEEETK

SEQ ID NO: 250782 - protein, 9 aa, Homo Sapiens
GIAHAEKAS

SEQ ID NO: 250783 - protein, 9 aa, Homo Sapiens
VPVQVKQET

SEQ ID NO: 250784 - protein, 9 aa, Homo Sapiens
SHVVSALTV

SEQ ID NO: 250785 - protein, 9 aa, Homo Sapiens
DILRLRDFQ

SEQ ID NO: 250786 - protein, 9 aa, Homo Sapiens
SDENSQVPQ

SEQ ID NO: 250787 - protein, 9 aa, Homo Sapiens
SKSLGEDNF

SEQ ID NO: 250788 - protein, 9 aa, Homo Sapiens
PSSDYLLSS

SEQ ID NO: 250789 - protein, 9 aa, Homo Sapiens
RFMEMYPAV

SEQ ID NO: 250790 - protein, 9 aa, Homo Sapiens
RPVNGGINT

SEQ ID NO: 250791 - protein, 9 aa, Homo Sapiens
PQMDYLALS

SEQ ID NO: 250792 - protein, 9 aa, Homo Sapiens
FALAVLQRM

SEQ ID NO: 250793 - protein, 9 aa, Homo Sapiens
KKKQVHKKW

SEQ ID NO: 250794 - protein, 9 aa, Homo Sapiens
IIHLKIFRQ

SEQ ID NO: 250795 - protein, 9 aa, Homo Sapiens
LRLRDFQEV

SEQ ID NO: 250796 - protein, 9 aa, Homo Sapiens
SIEVVKQGC

SEQ ID NO: 250797 - protein, 9 aa, Homo Sapiens
NESHFIVAL

SEQ ID NO: 250798 - protein, 9 aa, Homo Sapiens
GNVEIDLTG

SEQ ID NO: 250799 - protein, 9 aa, Homo Sapiens
NKTENKEVI

SEQ ID NO: 250800 - protein, 9 aa, Homo Sapiens
PQVADAIIG

SEQ ID NO: 250801 - protein, 9 aa, Homo Sapiens
RLPYSELLF

SEQ ID NO: 250802 - protein, 9 aa, Homo Sapiens
LSLVQKKAH

SEQ ID NO: 250803 - protein, 9 aa, Homo Sapiens
RYDVPIYMS

SEQ ID NO: 250804 - protein, 9 aa, Homo Sapiens
KIMHTGEKP

SEQ ID NO: 250805 - protein, 9 aa, Homo Sapiens
HPMYQRQMS

SEQ ID NO: 250806 - protein, 9 aa, Homo Sapiens
HCQLGDRLN

SEQ ID NO: 250807 - protein, 9 aa, Homo Sapiens
ASLSQLWRL

SEQ ID NO: 250808 - protein, 9 aa, Homo Sapiens
KGAADDDSD

SEQ ID NO: 250809 - protein, 9 aa, Homo Sapiens
SALEKNLIK

SEQ ID NO: 250810 - protein, 9 aa, Homo Sapiens
MLCSELVEG

SEQ ID NO: 250811 - protein, 9 aa, Homo Sapiens
LANQLAKDF

SEQ ID NO: 250812 - protein, 9 aa, Homo Sapiens
TTVERKGSR

SEQ ID NO: 250813 - protein, 9 aa, Homo Sapiens
DPQILPRGP

SEQ ID NO: 250814 - protein, 9 aa, Homo Sapiens
HSLSLQLRG

SEQ ID NO: 250815 - protein, 9 aa, Homo Sapiens
CKEAFAKLQ

SEQ ID NO: 250816 - protein, 9 aa, Homo Sapiens
GCLEHLYYN

SEQ ID NO: 250817 - protein, 9 aa, Homo Sapiens
HEDSGCCVA

SEQ ID NO: 250818 - protein, 9 aa, Homo Sapiens
ISQMELLPD

SEQ ID NO: 250819 - protein, 9 aa, Homo Sapiens
NKEIIPDFL

SEQ ID NO: 250820 - protein, 9 aa, Homo Sapiens
MADNIYNDE

SEQ ID NO: 250821 - protein, 9 aa, Homo Sapiens
KDCGIMDDK

SEQ ID NO: 250822 - protein, 9 aa, Homo Sapiens
TDEELGLLD

SEQ ID NO: 250823 - protein, 9 aa, Homo Sapiens
GIENKSGRL

SEQ ID NO: 250824 - protein, 9 aa, Homo Sapiens
NIVESQINF

SEQ ID NO: 250825 - protein, 9 aa, Homo Sapiens
IGNLSFLDI

SEQ ID NO: 250826 - protein, 9 aa, Homo Sapiens
KDVMLDNYR

SEQ ID NO: 250827 - protein, 9 aa, Homo Sapiens
FVVGTLLVA

SEQ ID NO: 250828 - protein, 9 aa, Homo Sapiens
LKDRVNLVL

SEQ ID NO: 250829 - protein, 9 aa, Homo Sapiens
MGIVSNYEK

SEQ ID NO: 250830 - protein, 9 aa, Homo Sapiens
RLLNLGRHT

SEQ ID NO: 250831 - protein, 9 aa, Homo Sapiens
SGFLCRDIS

SEQ ID NO: 250832 - protein, 9 aa, Homo Sapiens
MNSAISMTM

SEQ ID NO: 250833 - protein, 9 aa, Homo Sapiens
RWTRPKDLA

SEQ ID NO: 250834 - protein, 9 aa, Homo Sapiens
YYGNTEILN

SEQ ID NO: 250835 - protein, 9 aa, Homo Sapiens
LGNSIKHRC

SEQ ID NO: 250836 - protein, 9 aa, Homo Sapiens
LIAETTEDY

SEQ ID NO: 250837 - protein, 9 aa, Homo Sapiens
QDMVPYLPE

SEQ ID NO: 250838 - protein, 9 aa, Homo Sapiens
RHFCPPNHW

SEQ ID NO: 250839 - protein, 9 aa, Homo Sapiens
GPGEWNLNM

SEQ ID NO: 250840 - protein, 9 aa, Homo Sapiens
SDFEFLSSA

SEQ ID NO: 250841 - protein, 9 aa, Homo Sapiens
HVEMLADQP

SEQ ID NO: 250842 - protein, 9 aa, Homo Sapiens
WIHISPKAV

SEQ ID NO: 250843 - protein, 9 aa, Homo Sapiens
CRASNLHDL

SEQ ID NO: 250844 - protein, 9 aa, Homo Sapiens
AAGYGVFSQ

SEQ ID NO: 250845 - protein, 9 aa, Homo Sapiens
VPKGGVTDI

SEQ ID NO: 250846 - protein, 9 aa, Homo Sapiens
GHDTRDPSS

SEQ ID NO: 250847 - protein, 9 aa, Homo Sapiens
QMNTLKKRN

SEQ ID NO: 250848 - protein, 9 aa, Homo Sapiens
FEVDDLNYE

SEQ ID NO: 250849 - protein, 9 aa, Homo Sapiens
LELHLGGDS

SEQ ID NO: 250850 - protein, 9 aa, Homo Sapiens
NIILPSNTH

SEQ ID NO: 250851 - protein, 9 aa, Homo Sapiens
ILPSVTKNE

SEQ ID NO: 250852 - protein, 9 aa, Homo Sapiens
HLIQHQITH

SEQ ID NO: 250853 - protein, 9 aa, Homo Sapiens
SRKELRKDK

SEQ ID NO: 250854 - protein, 9 aa, Homo Sapiens
LDKTQRKRC

SEQ ID NO: 250855 - protein, 9 aa, Homo Sapiens
QTETLGAMD

SEQ ID NO: 250856 - protein, 9 aa, Homo Sapiens
TISTTLGKL

SEQ ID NO: 250857 - protein, 9 aa, Homo Sapiens
RLFRQLRRI

SEQ ID NO: 250858 - protein, 9 aa, Homo Sapiens
GLFKSSRHD

SEQ ID NO: 250859 - protein, 9 aa, Homo Sapiens
REDALSMKH

SEQ ID NO: 250860 - protein, 9 aa, Homo Sapiens
LADMMAFCS

SEQ ID NO: 250861 - protein, 9 aa, Homo Sapiens
ELFMEAIEA

SEQ ID NO: 250862 - protein, 9 aa, Homo Sapiens
ATKLGLFGV

SEQ ID NO: 250863 - protein, 9 aa, Homo Sapiens
QKKSCSGTT

SEQ ID NO: 250864 - protein, 9 aa, Homo Sapiens
HTCLTLNYV

SEQ ID NO: 250865 - protein, 9 aa, Homo Sapiens
NTDCLAPGV

SEQ ID NO: 250866 - protein, 9 aa, Homo Sapiens
RVISINNYH

SEQ ID NO: 250867 - protein, 9 aa, Homo Sapiens
TNLDTYDPY

SEQ ID NO: 250868 - protein, 9 aa, Homo Sapiens
FSGGTYQDT

SEQ ID NO: 250869 - protein, 9 aa, Homo Sapiens
KMHKVSFQD

SEQ ID NO: 250870 - protein, 9 aa, Homo Sapiens
GLHFIGPNA

SEQ ID NO: 250871 - protein, 9 aa, Homo Sapiens
PKYVRYSKI

SEQ ID NO: 250872 - protein, 9 aa, Homo Sapiens
KTSFFLSRK

SEQ ID NO: 250873 - protein, 9 aa, Homo Sapiens
DLEQQDCGI

SEQ ID NO: 250874 - protein, 9 aa, Homo Sapiens
QPAALAAAA

SEQ ID NO: 250875 - protein, 9 aa, Homo Sapiens
FQTDNLPEN

SEQ ID NO: 250876 - protein, 9 aa, Homo Sapiens
QTSMGLSCP

SEQ ID NO: 250877 - protein, 9 aa, Homo Sapiens
PMTHNLQLS

SEQ ID NO: 250878 - protein, 9 aa, Homo Sapiens
VFPGNVETF

SEQ ID NO: 250879 - protein, 9 aa, Homo Sapiens
VSPLQQSEA

SEQ ID NO: 250880 - protein, 9 aa, Homo Sapiens
TVLKEKGIP

SEQ ID NO: 250881 - protein, 9 aa, Homo Sapiens
PNIKMSSDK

SEQ ID NO: 250882 - protein, 9 aa, Homo Sapiens
RAVNSQFPT

SEQ ID NO: 250883 - protein, 9 aa, Homo Sapiens
WGLLLCMYL

SEQ ID NO: 250884 - protein, 9 aa, Homo Sapiens
FWFDAHKIN

SEQ ID NO: 250885 - protein, 9 aa, Homo Sapiens
ILARVIHDW

SEQ ID NO: 250886 - protein, 9 aa, Homo Sapiens
IMKLSIIHH

SEQ ID NO: 250887 - protein, 9 aa, Homo Sapiens
TQTSLVQEF

SEQ ID NO: 250888 - protein, 9 aa, Homo Sapiens
EKASKMTRE

SEQ ID NO: 250889 - protein, 9 aa, Homo Sapiens
RFTLIALRE

SEQ ID NO: 250890 - protein, 9 aa, Homo Sapiens
INYFVKGRQ

SEQ ID NO: 250891 - protein, 9 aa, Homo Sapiens
NQSSTLIRH

SEQ ID NO: 250892 - protein, 9 aa, Homo Sapiens
DKPLPAVSP

SEQ ID NO: 250893 - protein, 9 aa, Homo Sapiens
ATGLSKTFP

SEQ ID NO: 250894 - protein, 9 aa, Homo Sapiens
AESLISLEI

SEQ ID NO: 250895 - protein, 9 aa, Homo Sapiens
DFSVCILTA

SEQ ID NO: 250896 - protein, 9 aa, Homo Sapiens
NKKLSLDFV

SEQ ID NO: 250897 - protein, 9 aa, Homo Sapiens
VCATSQTDR

SEQ ID NO: 250898 - protein, 9 aa, Homo Sapiens
GLTDCILSG

SEQ ID NO: 250899 - protein, 9 aa, Homo Sapiens
HEQPVEEVL

SEQ ID NO: 250900 - protein, 9 aa, Homo Sapiens
REECLQTVE

SEQ ID NO: 250901 - protein, 9 aa, Homo Sapiens
SQIISCSPK

SEQ ID NO: 250902 - protein, 9 aa, Homo Sapiens
EREIVQDIK

SEQ ID NO: 250903 - protein, 9 aa, Homo Sapiens
PSMAMIHSM

SEQ ID NO: 250904 - protein, 9 aa, Homo Sapiens
WCLQYISLG

SEQ ID NO: 250905 - protein, 9 aa, Homo Sapiens
AFLCQPSGS

SEQ ID NO: 250906 - protein, 9 aa, Homo Sapiens
LGSVLSPEP

SEQ ID NO: 250907 - protein, 9 aa, Homo Sapiens
LIEISEGTG

SEQ ID NO: 250908 - protein, 9 aa, Homo Sapiens
ARPDDLAIA

SEQ ID NO: 250909 - protein, 9 aa, Homo Sapiens
PFSTVDIEG

SEQ ID NO: 250910 - protein, 9 aa, Homo Sapiens
VTASVTFRA

SEQ ID NO: 250911 - protein, 9 aa, Homo Sapiens
EMKFNNMLF

SEQ ID NO: 250912 - protein, 9 aa, Homo Sapiens
LIPGLSKKL

SEQ ID NO: 250913 - protein, 9 aa, Homo Sapiens
LVQSVVYHE

SEQ ID NO: 250914 - protein, 9 aa, Homo Sapiens
SPSKRSHHS

SEQ ID NO: 250915 - protein, 9 aa, Homo Sapiens
ESISSGSER

SEQ ID NO: 250916 - protein, 9 aa, Homo Sapiens
LHGQCQAWK

SEQ ID NO: 250917 - protein, 9 aa, Homo Sapiens
RLNWSDSDS

SEQ ID NO: 250918 - protein, 9 aa, Homo Sapiens
ALSLAYQTD

SEQ ID NO: 250919 - protein, 9 aa, Homo Sapiens
CNNTLLTEF

SEQ ID NO: 250920 - protein, 9 aa, Homo Sapiens
LKDNNHLRH

SEQ ID NO: 250921 - protein, 9 aa, Homo Sapiens
PSTRTYCYK

SEQ ID NO: 250922 - protein, 9 aa, Homo Sapiens
VFEVPSKDK

SEQ ID NO: 250923 - protein, 9 aa, Homo Sapiens
LWTFRHSEA

SEQ ID NO: 250924 - protein, 9 aa, Homo Sapiens
LEEALPVFN

SEQ ID NO: 250925 - protein, 9 aa, Homo Sapiens
MEEMETYQE

SEQ ID NO: 250926 - protein, 9 aa, Homo Sapiens
KSRLEKWLT

SEQ ID NO: 250927 - protein, 9 aa, Homo Sapiens
QFRKAEQFC

SEQ ID NO: 250928 - protein, 9 aa, Homo Sapiens
LGEDDEYAP

SEQ ID NO: 250929 - protein, 9 aa, Homo Sapiens
EEQQKAWKM

SEQ ID NO: 250930 - protein, 9 aa, Homo Sapiens
SKWALIFSI

SEQ ID NO: 250931 - protein, 9 aa, Homo Sapiens
YWEAVELDV

SEQ ID NO: 250932 - protein, 9 aa, Homo Sapiens
SGQEARWAV

SEQ ID NO: 250933 - protein, 9 aa, Homo Sapiens
CAIISVSSV

SEQ ID NO: 250934 - protein, 9 aa, Homo Sapiens
KRVAVEAPV

SEQ ID NO: 250935 - protein, 9 aa, Homo Sapiens
SPTGGESFT

SEQ ID NO: 250936 - protein, 9 aa, Homo Sapiens
GKSERSPED

SEQ ID NO: 250937 - protein, 9 aa, Homo Sapiens
IINVSFCVK

SEQ ID NO: 250938 - protein, 9 aa, Homo Sapiens
SRRVIHRDL

SEQ ID NO: 250939 - protein, 9 aa, Homo Sapiens
LKRLSDVTG

SEQ ID NO: 250940 - protein, 9 aa, Homo Sapiens
SHEPSSHPD

SEQ ID NO: 250941 - protein, 9 aa, Homo Sapiens
FSSSRAGKE

SEQ ID NO: 250942 - protein, 9 aa, Homo Sapiens
QEMRKITPL

SEQ ID NO: 250943 - protein, 9 aa, Homo Sapiens
FCVASVGVR

SEQ ID NO: 250944 - protein, 9 aa, Homo Sapiens
SFIDISIID

SEQ ID NO: 250945 - protein, 9 aa, Homo Sapiens
CSGTTRSRK

SEQ ID NO: 250946 - protein, 9 aa, Homo Sapiens
ERDIKSKEA

SEQ ID NO: 250947 - protein, 9 aa, Homo Sapiens
TYMVIEHCI

SEQ ID NO: 250948 - protein, 9 aa, Homo Sapiens
MAIFKRHSA

SEQ ID NO: 250949 - protein, 9 aa, Homo Sapiens
KPKWTPLSG

SEQ ID NO: 250950 - protein, 9 aa, Homo Sapiens
FVAILTGLC

SEQ ID NO: 250951 - protein, 9 aa, Homo Sapiens
PFMVVYGNI

SEQ ID NO: 250952 - protein, 9 aa, Homo Sapiens
ISLADMMAF

SEQ ID NO: 250953 - protein, 9 aa, Homo Sapiens
YHLLGNVGI

SEQ ID NO: 250954 - protein, 9 aa, Homo Sapiens
GLTFTDKWN

SEQ ID NO: 250955 - protein, 9 aa, Homo Sapiens
VKFQESNDT

SEQ ID NO: 250956 - protein, 9 aa, Homo Sapiens
PIEPVFITA

SEQ ID NO: 250957 - protein, 9 aa, Homo Sapiens
DKLDKKEKK

SEQ ID NO: 250958 - protein, 9 aa, Homo Sapiens
SKETCPKGD

SEQ ID NO: 250959 - protein, 9 aa, Homo Sapiens
HTAFAQQSK

SEQ ID NO: 250960 - protein, 9 aa, Homo Sapiens
EELFSVVTT

SEQ ID NO: 250961 - protein, 9 aa, Homo Sapiens
LEISDNSDD

SEQ ID NO: 250962 - protein, 9 aa, Homo Sapiens
ETSNFCSLV

SEQ ID NO: 250963 - protein, 9 aa, Homo Sapiens
SVHFEEDVH

SEQ ID NO: 250964 - protein, 9 aa, Homo Sapiens
FNLIGDSLY

SEQ ID NO: 250965 - protein, 9 aa, Homo Sapiens
VFVQEELGC

SEQ ID NO: 250966 - protein, 9 aa, Homo Sapiens
SYTGEKKEK

SEQ ID NO: 250967 - protein, 9 aa, Homo Sapiens
ALLRAAPGD

SEQ ID NO: 250968 - protein, 9 aa, Homo Sapiens
MKNFLYIKS

SEQ ID NO: 250969 - protein, 9 aa, Homo Sapiens
DSSQGHSIF

SEQ ID NO: 250970 - protein, 9 aa, Homo Sapiens
VCEDSVPTT

SEQ ID NO: 250971 - protein, 9 aa, Homo Sapiens
SEFQRKYEE

SEQ ID NO: 250972 - protein, 9 aa, Homo Sapiens
NSAEQGPVK

SEQ ID NO: 250973 - protein, 9 aa, Homo Sapiens
FDLYHRIQT

SEQ ID NO: 250974 - protein, 9 aa, Homo Sapiens
ERVANSLVT

SEQ ID NO: 250975 - protein, 9 aa, Homo Sapiens
RFVRLPLIS

SEQ ID NO: 250976 - protein, 9 aa, Homo Sapiens
GRFINYFVK

SEQ ID NO: 250977 - protein, 9 aa, Homo Sapiens
SVPHSPRII

SEQ ID NO: 250978 - protein, 9 aa, Homo Sapiens
NVQNIHTED

SEQ ID NO: 250979 - protein, 9 aa, Homo Sapiens
NLAPTATVA

SEQ ID NO: 250980 - protein, 9 aa, Homo Sapiens
EFEEYKEKC

SEQ ID NO: 250981 - protein, 9 aa, Homo Sapiens
ITCEPSPSA

SEQ ID NO: 250982 - protein, 9 aa, Homo Sapiens
DELREIFNA

SEQ ID NO: 250983 - protein, 9 aa, Homo Sapiens
FVIIQTYFI

SEQ ID NO: 250984 - protein, 9 aa, Homo Sapiens
NIHLTQHKI

SEQ ID NO: 250985 - protein, 9 aa, Homo Sapiens
PPPCSDSCY

SEQ ID NO: 250986 - protein, 9 aa, Homo Sapiens
YFCYRWLLL

SEQ ID NO: 250987 - protein, 9 aa, Homo Sapiens
STMYKGKSS

SEQ ID NO: 250988 - protein, 9 aa, Homo Sapiens
EAVVSSVNS

SEQ ID NO: 250989 - protein, 9 aa, Homo Sapiens
PLPGFPGAQ

SEQ ID NO: 250990 - protein, 9 aa, Homo Sapiens
RTNIIKILF

SEQ ID NO: 250991 - protein, 9 aa, Homo Sapiens
DKVVAQSLV

SEQ ID NO: 250992 - protein, 9 aa, Homo Sapiens
AVQRCVVQI

SEQ ID NO: 250993 - protein, 9 aa, Homo Sapiens
IARLIPHGP

SEQ ID NO: 250994 - protein, 9 aa, Homo Sapiens
PNTSKMITI

SEQ ID NO: 250995 - protein, 9 aa, Homo Sapiens
RPKVSMDGC

SEQ ID NO: 250996 - protein, 9 aa, Homo Sapiens
FQSTENSAG

SEQ ID NO: 250997 - protein, 9 aa, Homo Sapiens
SCCVPIYCQ

SEQ ID NO: 250998 - protein, 9 aa, Homo Sapiens
EDLESEIPE

SEQ ID NO: 250999 - protein, 9 aa, Homo Sapiens
TAIRSLNRT

SEQ ID NO: 251000 - protein, 9 aa, Homo Sapiens
GQSLPMTHN

SEQ ID NO: 251001 - protein, 9 aa, Homo Sapiens
PCTLVKMNR

SEQ ID NO: 251002 - protein, 9 aa, Homo Sapiens
PHIPRFSPA

SEQ ID NO: 251003 - protein, 9 aa, Homo Sapiens
VTSVLLHPN

SEQ ID NO: 251004 - protein, 9 aa, Homo Sapiens
NRPYVPYEQ

SEQ ID NO: 251005 - protein, 9 aa, Homo Sapiens
TTRVNSEQG

SEQ ID NO: 251006 - protein, 9 aa, Homo Sapiens
FQARPDDLA

SEQ ID NO: 251007 - protein, 9 aa, Homo Sapiens
ESLEVAMQC

SEQ ID NO: 251008 - protein, 9 aa, Homo Sapiens
LEFPAELYP

SEQ ID NO: 251009 - protein, 9 aa, Homo Sapiens
STDVSQPPP

SEQ ID NO: 251010 - protein, 9 aa, Homo Sapiens
WARQRQPPS

SEQ ID NO: 251011 - protein, 9 aa, Homo Sapiens
QSIPNCTVF

SEQ ID NO: 251012 - protein, 9 aa, Homo Sapiens
FGVELQEMD

SEQ ID NO: 251013 - protein, 9 aa, Homo Sapiens
ANQDPVSPI

SEQ ID NO: 251014 - protein, 9 aa, Homo Sapiens
DKQQNNSKG

SEQ ID NO: 251015 - protein, 9 aa, Homo Sapiens
FCTEATGLS

SEQ ID NO: 251016 - protein, 9 aa, Homo Sapiens
EQTFSGGTY

SEQ ID NO: 251017 - protein, 9 aa, Homo Sapiens
TASACTNHQ

SEQ ID NO: 251018 - protein, 9 aa, Homo Sapiens
EQNIKYSFE

SEQ ID NO: 251019 - protein, 9 aa, Homo Sapiens
RCGDNKHLI

SEQ ID NO: 251020 - protein, 9 aa, Homo Sapiens
QICSLKVSG

SEQ ID NO: 251021 - protein, 9 aa, Homo Sapiens
MSQMLEDRD

SEQ ID NO: 251022 - protein, 9 aa, Homo Sapiens
ATMNILVIC

SEQ ID NO: 251023 - protein, 9 aa, Homo Sapiens
NIVSSKKIT

SEQ ID NO: 251024 - protein, 9 aa, Homo Sapiens
AELYVKEYK

SEQ ID NO: 251025 - protein, 9 aa, Homo Sapiens
SPPVVVNGK

SEQ ID NO: 251026 - protein, 9 aa, Homo Sapiens
EYKSKRYED

SEQ ID NO: 251027 - protein, 9 aa, Homo Sapiens
QGDITTLIR

SEQ ID NO: 251028 - protein, 9 aa, Homo Sapiens
ACGVQSSKC

SEQ ID NO: 251029 - protein, 9 aa, Homo Sapiens
ACSDGYPDV

SEQ ID NO: 251030 - protein, 9 aa, Homo Sapiens
DNSMTLLHA

SEQ ID NO: 251031 - protein, 9 aa, Homo Sapiens
ANTPLPAWH

SEQ ID NO: 251032 - protein, 9 aa, Homo Sapiens
LSYLQNILG

SEQ ID NO: 251033 - protein, 9 aa, Homo Sapiens
AKLLAEGGI

SEQ ID NO: 251034 - protein, 9 aa, Homo Sapiens
PFMLIVVSY

SEQ ID NO: 251035 - protein, 9 aa, Homo Sapiens
QAVVMTRDD

SEQ ID NO: 251036 - protein, 9 aa, Homo Sapiens
YQTAIVQNQ

SEQ ID NO: 251037 - protein, 9 aa, Homo Sapiens
ESSFLKCIQ

SEQ ID NO: 251038 - protein, 9 aa, Homo Sapiens
NIQSSTRDW

SEQ ID NO: 251039 - protein, 9 aa, Homo Sapiens
KPKQLNPFN

SEQ ID NO: 251040 - protein, 9 aa, Homo Sapiens
DHRRFRDLH

SEQ ID NO: 251041 - protein, 9 aa, Homo Sapiens
QMTSGSWTE

SEQ ID NO: 251042 - protein, 9 aa, Homo Sapiens
QLNDGHFMP

SEQ ID NO: 251043 - protein, 9 aa, Homo Sapiens
ATDTCFLGA

SEQ ID NO: 251044 - protein, 9 aa, Homo Sapiens
KRSVFASPE

SEQ ID NO: 251045 - protein, 9 aa, Homo Sapiens
WPRNWHQKE

SEQ ID NO: 251046 - protein, 9 aa, Homo Sapiens
NKKEQELKK

SEQ ID NO: 251047 - protein, 9 aa, Homo Sapiens
GLNKKPLLS

SEQ ID NO: 251048 - protein, 9 aa, Homo Sapiens
LKKHKKTSN

SEQ ID NO: 251049 - protein, 9 aa, Homo Sapiens
YSFQPDVYA

SEQ ID NO: 251050 - protein, 9 aa, Homo Sapiens
ASLEGGLAW

SEQ ID NO: 251051 - protein, 9 aa, Homo Sapiens
ELVQVVDNS

SEQ ID NO: 251052 - protein, 9 aa, Homo Sapiens
VYLPECFNS

SEQ ID NO: 251053 - protein, 9 aa, Homo Sapiens
RANQARDDY

SEQ ID NO: 251054 - protein, 9 aa, Homo Sapiens
ERNITSHLG

SEQ ID NO: 251055 - protein, 9 aa, Homo Sapiens
LLPQPPFLY

SEQ ID NO: 251056 - protein, 9 aa, Homo Sapiens
ETFILGSCA

SEQ ID NO: 251057 - protein, 9 aa, Homo Sapiens
CQNPTAEEI

SEQ ID NO: 251058 - protein, 9 aa, Homo Sapiens
DAAIFQSLT

SEQ ID NO: 251059 - protein, 9 aa, Homo Sapiens
PFICIACFY

SEQ ID NO: 251060 - protein, 9 aa, Homo Sapiens
RKNADDSTK

SEQ ID NO: 251061 - protein, 9 aa, Homo Sapiens
VPYLEFRYN

SEQ ID NO: 251062 - protein, 9 aa, Homo Sapiens
SSCKPSTFA

SEQ ID NO: 251063 - protein, 9 aa, Homo Sapiens
EAECQAKNL

SEQ ID NO: 251064 - protein, 9 aa, Homo Sapiens
HGIPITGRR

SEQ ID NO: 251065 - protein, 9 aa, Homo Sapiens
KHPEPGILT

SEQ ID NO: 251066 - protein, 9 aa, Homo Sapiens
MLAYAVCRL

SEQ ID NO: 251067 - protein, 9 aa, Homo Sapiens
AKREEALAA

SEQ ID NO: 251068 - protein, 9 aa, Homo Sapiens
ALSVLRMIK

SEQ ID NO: 251069 - protein, 9 aa, Homo Sapiens
KAMSLECGC

SEQ ID NO: 251070 - protein, 9 aa, Homo Sapiens
KTSEDIFQH

SEQ ID NO: 251071 - protein, 9 aa, Homo Sapiens
KGMAFLTSK

SEQ ID NO: 251072 - protein, 9 aa, Homo Sapiens
RYLKGALTK

SEQ ID NO: 251073 - protein, 9 aa, Homo Sapiens
IGRLLFREC

SEQ ID NO: 251074 - protein, 9 aa, Homo Sapiens
TSVIDYDIV

SEQ ID NO: 251075 - protein, 9 aa, Homo Sapiens
EDHIKRKDL

SEQ ID NO: 251076 - protein, 9 aa, Homo Sapiens
KSSRVQPEL

SEQ ID NO: 251077 - protein, 9 aa, Homo Sapiens
SILTPKSLT

SEQ ID NO: 251078 - protein, 9 aa, Homo Sapiens
GETKKEGTA

SEQ ID NO: 251079 - protein, 9 aa, Homo Sapiens
HVSPDVMLD

SEQ ID NO: 251080 - protein, 9 aa, Homo Sapiens
ETADLTLCH

SEQ ID NO: 251081 - protein, 9 aa, Homo Sapiens
PRIGPRFGD

SEQ ID NO: 251082 - protein, 9 aa, Homo Sapiens
EIPEDSDQE

SEQ ID NO: 251083 - protein, 9 aa, Homo Sapiens
RELATLLHR

SEQ ID NO: 251084 - protein, 9 aa, Homo Sapiens
NSRYAQYKK

SEQ ID NO: 251085 - protein, 9 aa, Homo Sapiens
YYNINRIRL

SEQ ID NO: 251086 - protein, 9 aa, Homo Sapiens
QKKLYAKNE

SEQ ID NO: 251087 - protein, 9 aa, Homo Sapiens
EAGPAHNSC

SEQ ID NO: 251088 - protein, 9 aa, Homo Sapiens
KYGWDNLSD

SEQ ID NO: 251089 - protein, 9 aa, Homo Sapiens
EYFYLNHFS

SEQ ID NO: 251090 - protein, 9 aa, Homo Sapiens
GELTPPVPD

SEQ ID NO: 251091 - protein, 9 aa, Homo Sapiens
KASKYISLF

SEQ ID NO: 251092 - protein, 9 aa, Homo Sapiens
TANLSLAKR

SEQ ID NO: 251093 - protein, 9 aa, Homo Sapiens
HKHGSTFIC

SEQ ID NO: 251094 - protein, 9 aa, Homo Sapiens
ECISVKGII

SEQ ID NO: 251095 - protein, 9 aa, Homo Sapiens
PGIQLTAYL

SEQ ID NO: 251096 - protein, 9 aa, Homo Sapiens
ISSLESIRP

SEQ ID NO: 251097 - protein, 9 aa, Homo Sapiens
STSNVSSLS

SEQ ID NO: 251098 - protein, 9 aa, Homo Sapiens
GDNKKRPPQ

SEQ ID NO: 251099 - protein, 9 aa, Homo Sapiens
PLLLPSGSK

SEQ ID NO: 251100 - protein, 9 aa, Homo Sapiens
VEVNNYPEN

SEQ ID NO: 251101 - protein, 9 aa, Homo Sapiens
EPPTKYQLS

SEQ ID NO: 251102 - protein, 9 aa, Homo Sapiens
RWIQMTHGK

SEQ ID NO: 251103 - protein, 9 aa, Homo Sapiens
ARDCHESGN

SEQ ID NO: 251104 - protein, 9 aa, Homo Sapiens
LKKKGTSAF

SEQ ID NO: 251105 - protein, 9 aa, Homo Sapiens
LKGALTKVV

SEQ ID NO: 251106 - protein, 9 aa, Homo Sapiens
YPCRSYTYF

SEQ ID NO: 251107 - protein, 9 aa, Homo Sapiens
LKYYRPRKI

SEQ ID NO: 251108 - protein, 9 aa, Homo Sapiens
DKVFFNLVH

SEQ ID NO: 251109 - protein, 9 aa, Homo Sapiens
NDSFIDDEE

SEQ ID NO: 251110 - protein, 9 aa, Homo Sapiens
GVKGMLHKE

SEQ ID NO: 251111 - protein, 9 aa, Homo Sapiens
IWFRQFNKI

SEQ ID NO: 251112 - protein, 9 aa, Homo Sapiens
VLWCYSNAA

SEQ ID NO: 251113 - protein, 9 aa, Homo Sapiens
AAFCYMLPL

SEQ ID NO: 251114 - protein, 9 aa, Homo Sapiens
YDGALLDED

SEQ ID NO: 251115 - protein, 9 aa, Homo Sapiens
TDGFVNLPD

SEQ ID NO: 251116 - protein, 9 aa, Homo Sapiens
PYIFHQVTI

SEQ ID NO: 251117 - protein, 9 aa, Homo Sapiens
ATELSCREL

SEQ ID NO: 251118 - protein, 9 aa, Homo Sapiens
NSMTSQEER

SEQ ID NO: 251119 - protein, 9 aa, Homo Sapiens
SETYLEKDG

SEQ ID NO: 251120 - protein, 9 aa, Homo Sapiens
TSKADYELY

SEQ ID NO: 251121 - protein, 9 aa, Homo Sapiens
SGKRLPRTL

SEQ ID NO: 251122 - protein, 9 aa, Homo Sapiens
VDLHLKGPD

SEQ ID NO: 251123 - protein, 9 aa, Homo Sapiens
YACFSVKGK

SEQ ID NO: 251124 - protein, 9 aa, Homo Sapiens
HQCVHTGER

SEQ ID NO: 251125 - protein, 9 aa, Homo Sapiens
QLFVCDVLP

SEQ ID NO: 251126 - protein, 9 aa, Homo Sapiens
GSKMRQHQR

SEQ ID NO: 251127 - protein, 9 aa, Homo Sapiens
MGICKRRVH

SEQ ID NO: 251128 - protein, 9 aa, Homo Sapiens
SRMSRSDAE

SEQ ID NO: 251129 - protein, 9 aa, Homo Sapiens
KGQVKRSVF

SEQ ID NO: 251130 - protein, 9 aa, Homo Sapiens
STLNIHQIR

SEQ ID NO: 251131 - protein, 9 aa, Homo Sapiens
VPHFAEAFK

SEQ ID NO: 251132 - protein, 9 aa, Homo Sapiens
IKNLNYLSF

SEQ ID NO: 251133 - protein, 9 aa, Homo Sapiens
FFGGSGSKQ

SEQ ID NO: 251134 - protein, 9 aa, Homo Sapiens
IKKKMSEEF

SEQ ID NO: 251135 - protein, 9 aa, Homo Sapiens
MSKKGRPQI

SEQ ID NO: 251136 - protein, 9 aa, Homo Sapiens
DTCHSFFQH

SEQ ID NO: 251137 - protein, 9 aa, Homo Sapiens
FKNVESVAD

SEQ ID NO: 251138 - protein, 9 aa, Homo Sapiens
VITQTSHCY

SEQ ID NO: 251139 - protein, 9 aa, Homo Sapiens
VDKNGRLYK

SEQ ID NO: 251140 - protein, 9 aa, Homo Sapiens
LESAGIARP

SEQ ID NO: 251141 - protein, 9 aa, Homo Sapiens
YLPICATRW

SEQ ID NO: 251142 - protein, 9 aa, Homo Sapiens
QEELAQQYE

SEQ ID NO: 251143 - protein, 9 aa, Homo Sapiens
MSYYFDRGD

SEQ ID NO: 251144 - protein, 9 aa, Homo Sapiens
THQHAVDTI

SEQ ID NO: 251145 - protein, 9 aa, Homo Sapiens
IEVVKQGCW

SEQ ID NO: 251146 - protein, 9 aa, Homo Sapiens
RNVSSEGEG

SEQ ID NO: 251147 - protein, 9 aa, Homo Sapiens
RKDKADVLC

SEQ ID NO: 251148 - protein, 9 aa, Homo Sapiens
ADDLAKQTN

SEQ ID NO: 251149 - protein, 9 aa, Homo Sapiens
MMKDFSSTA

SEQ ID NO: 251150 - protein, 9 aa, Homo Sapiens
WSRNLTCRA

SEQ ID NO: 251151 - protein, 9 aa, Homo Sapiens
MKHSSHKHN

SEQ ID NO: 251152 - protein, 9 aa, Homo Sapiens
YPDPHSHND

SEQ ID NO: 251153 - protein, 9 aa, Homo Sapiens
NFFTICNYF

SEQ ID NO: 251154 - protein, 9 aa, Homo Sapiens
MGKNYGNGK

SEQ ID NO: 251155 - protein, 9 aa, Homo Sapiens
KTYKMPLGN

SEQ ID NO: 251156 - protein, 9 aa, Homo Sapiens
IIKCDGFYL

SEQ ID NO: 251157 - protein, 9 aa, Homo Sapiens
NLLEGEVDD

SEQ ID NO: 251158 - protein, 9 aa, Homo Sapiens
HPSVYSLSY

SEQ ID NO: 251159 - protein, 9 aa, Homo Sapiens
KSCTTSGNN

SEQ ID NO: 251160 - protein, 9 aa, Homo Sapiens
RKNAIENAK

SEQ ID NO: 251161 - protein, 9 aa, Homo Sapiens
RSGIENVSS

SEQ ID NO: 251162 - protein, 9 aa, Homo Sapiens
EIELEMAKK

SEQ ID NO: 251163 - protein, 9 aa, Homo Sapiens
YHKITHTGE

SEQ ID NO: 251164 - protein, 9 aa, Homo Sapiens
KLHWCNNAP

SEQ ID NO: 251165 - protein, 9 aa, Homo Sapiens
WFDAHKINY

SEQ ID NO: 251166 - protein, 9 aa, Homo Sapiens
HIFEKISNI

SEQ ID NO: 251167 - protein, 9 aa, Homo Sapiens
YVKSGPNRS

SEQ ID NO: 251168 - protein, 9 aa, Homo Sapiens
GQIYIETSQ

SEQ ID NO: 251169 - protein, 9 aa, Homo Sapiens
KDVPQIPLE

SEQ ID NO: 251170 - protein, 9 aa, Homo Sapiens
KSDAETLKV

SEQ ID NO: 251171 - protein, 9 aa, Homo Sapiens
GRAPEASRQ

SEQ ID NO: 251172 - protein, 9 aa, Homo Sapiens
LSLLLLPQQ

SEQ ID NO: 251173 - protein, 9 aa, Homo Sapiens
KEAQAARLA

SEQ ID NO: 251174 - protein, 9 aa, Homo Sapiens
KHLCHSAAE

SEQ ID NO: 251175 - protein, 9 aa, Homo Sapiens
RTISENTMC

SEQ ID NO: 251176 - protein, 9 aa, Homo Sapiens
SQSISGYPE

SEQ ID NO: 251177 - protein, 9 aa, Homo Sapiens
LKKSEAASE

SEQ ID NO: 251178 - protein, 9 aa, Homo Sapiens
KKTNNFNPP

SEQ ID NO: 251179 - protein, 9 aa, Homo Sapiens
IIHKIIHTE

SEQ ID NO: 251180 - protein, 9 aa, Homo Sapiens
TDLQGLRED

SEQ ID NO: 251181 - protein, 9 aa, Homo Sapiens
APQVADAII

SEQ ID NO: 251182 - protein, 9 aa, Homo Sapiens
SAILENANW

SEQ ID NO: 251183 - protein, 9 aa, Homo Sapiens
YLYEIITED

SEQ ID NO: 251184 - protein, 9 aa, Homo Sapiens
NIGPKDKKF

SEQ ID NO: 251185 - protein, 9 aa, Homo Sapiens
FLYKMLVGD

SEQ ID NO: 251186 - protein, 9 aa, Homo Sapiens
KAKNVFEKK

SEQ ID NO: 251187 - protein, 9 aa, Homo Sapiens
CGIAQEIQE

SEQ ID NO: 251188 - protein, 9 aa, Homo Sapiens
CAQPKTVIL

SEQ ID NO: 251189 - protein, 9 aa, Homo Sapiens
QLETEKKVL

SEQ ID NO: 251190 - protein, 9 aa, Homo Sapiens
NISPNGKYV

SEQ ID NO: 251191 - protein, 9 aa, Homo Sapiens
TYLRMPRQS

SEQ ID NO: 251192 - protein, 9 aa, Homo Sapiens
SATGIFAGF

SEQ ID NO: 251193 - protein, 9 aa, Homo Sapiens
ACGLQDLLF

SEQ ID NO: 251194 - protein, 9 aa, Homo Sapiens
GTSAFLQRL

SEQ ID NO: 251195 - protein, 9 aa, Homo Sapiens
AVTKLVDRT

SEQ ID NO: 251196 - protein, 9 aa, Homo Sapiens
NVMYTIGDL

SEQ ID NO: 251197 - protein, 9 aa, Homo Sapiens
KKAAIFCLS

SEQ ID NO: 251198 - protein, 9 aa, Homo Sapiens
FRYLSSLHI

SEQ ID NO: 251199 - protein, 9 aa, Homo Sapiens
KNKKEQELK

SEQ ID NO: 251200 - protein, 9 aa, Homo Sapiens
HLKGKVVTK

SEQ ID NO: 251201 - protein, 9 aa, Homo Sapiens
KNIQLLKDM

SEQ ID NO: 251202 - protein, 9 aa, Homo Sapiens
QSTQSSGYI

SEQ ID NO: 251203 - protein, 9 aa, Homo Sapiens
SACGIAQAS

SEQ ID NO: 251204 - protein, 9 aa, Homo Sapiens
QNILDLHNK

SEQ ID NO: 251205 - protein, 9 aa, Homo Sapiens
FGWLFCRVR

SEQ ID NO: 251206 - protein, 9 aa, Homo Sapiens
LASSLRIMI

SEQ ID NO: 251207 - protein, 9 aa, Homo Sapiens
DIRINIVSS

SEQ ID NO: 251208 - protein, 9 aa, Homo Sapiens
TDHMNLLQR

SEQ ID NO: 251209 - protein, 9 aa, Homo Sapiens
PRIHALGGF

SEQ ID NO: 251210 - protein, 9 aa, Homo Sapiens
PHWSNKLIA

SEQ ID NO: 251211 - protein, 9 aa, Homo Sapiens
EEFALVEDK

SEQ ID NO: 251212 - protein, 9 aa, Homo Sapiens
EKPNKVKDP

SEQ ID NO: 251213 - protein, 9 aa, Homo Sapiens
IMENEYLDV

SEQ ID NO: 251214 - protein, 9 aa, Homo Sapiens
KMKPEVISH

SEQ ID NO: 251215 - protein, 9 aa, Homo Sapiens
CQGIKHEWQ

SEQ ID NO: 251216 - protein, 9 aa, Homo Sapiens
TYALARAFG

SEQ ID NO: 251217 - protein, 9 aa, Homo Sapiens
SYRCQCPPG

SEQ ID NO: 251218 - protein, 9 aa, Homo Sapiens
NFTGNLIED

SEQ ID NO: 251219 - protein, 9 aa, Homo Sapiens
AVLVSFMPY

SEQ ID NO: 251220 - protein, 9 aa, Homo Sapiens
DFYIFELEA

SEQ ID NO: 251221 - protein, 9 aa, Homo Sapiens
NNVAITFSH

SEQ ID NO: 251222 - protein, 9 aa, Homo Sapiens
QYKLLDEDF

SEQ ID NO: 251223 - protein, 9 aa, Homo Sapiens
LEVSSEYHM

SEQ ID NO: 251224 - protein, 9 aa, Homo Sapiens
HRVQFEEKN

SEQ ID NO: 251225 - protein, 9 aa, Homo Sapiens
GYPGYQATT

SEQ ID NO: 251226 - protein, 9 aa, Homo Sapiens
NMSCQGFTK

SEQ ID NO: 251227 - protein, 9 aa, Homo Sapiens
SSMMDKYEK

SEQ ID NO: 251228 - protein, 9 aa, Homo Sapiens
TALPFSARP

SEQ ID NO: 251229 - protein, 9 aa, Homo Sapiens
LKSFGECCD

SEQ ID NO: 251230 - protein, 9 aa, Homo Sapiens
GLLSQTAGF

SEQ ID NO: 251231 - protein, 9 aa, Homo Sapiens
PTGPKDTDT

SEQ ID NO: 251232 - protein, 9 aa, Homo Sapiens
TEQNGLKDN

SEQ ID NO: 251233 - protein, 9 aa, Homo Sapiens
DSQTCYLEL

SEQ ID NO: 251234 - protein, 9 aa, Homo Sapiens
LYKMKAASE

SEQ ID NO: 251235 - protein, 9 aa, Homo Sapiens
PVISLEEGL

SEQ ID NO: 251236 - protein, 9 aa, Homo Sapiens
GTFESMPNP

SEQ ID NO: 251237 - protein, 9 aa, Homo Sapiens
IYIYTHIYI

SEQ ID NO: 251238 - protein, 9 aa, Homo Sapiens
DGKNDGDMH

SEQ ID NO: 251239 - protein, 9 aa, Homo Sapiens
KAAAWKVLS

SEQ ID NO: 251240 - protein, 9 aa, Homo Sapiens
RSLCDQNQK

SEQ ID NO: 251241 - protein, 9 aa, Homo Sapiens
YDNSAFMEP

SEQ ID NO: 251242 - protein, 9 aa, Homo Sapiens
GMEIPGNLN

SEQ ID NO: 251243 - protein, 9 aa, Homo Sapiens
RDFSVCILT

SEQ ID NO: 251244 - protein, 9 aa, Homo Sapiens
AGLGEYLFK

SEQ ID NO: 251245 - protein, 9 aa, Homo Sapiens
VIALVCKEP

SEQ ID NO: 251246 - protein, 9 aa, Homo Sapiens
IKTEFINRL

SEQ ID NO: 251247 - protein, 9 aa, Homo Sapiens
RLKPGTTPC

SEQ ID NO: 251248 - protein, 9 aa, Homo Sapiens
LLLPTQDEK

SEQ ID NO: 251249 - protein, 9 aa, Homo Sapiens
VYIGHTIWG

SEQ ID NO: 251250 - protein, 9 aa, Homo Sapiens
TFILLYIMN

SEQ ID NO: 251251 - protein, 9 aa, Homo Sapiens
SIVKIWFKN

SEQ ID NO: 251252 - protein, 9 aa, Homo Sapiens
LRATHPNNK

SEQ ID NO: 251253 - protein, 9 aa, Homo Sapiens
PQVMIEPSG

SEQ ID NO: 251254 - protein, 9 aa, Homo Sapiens
QNGNFRKKK

SEQ ID NO: 251255 - protein, 9 aa, Homo Sapiens
YVQFIHLAL

SEQ ID NO: 251256 - protein, 9 aa, Homo Sapiens
PATIWTSSP

SEQ ID NO: 251257 - protein, 9 aa, Homo Sapiens
VIDTNYNRP

SEQ ID NO: 251258 - protein, 9 aa, Homo Sapiens
SLSVDNENY

SEQ ID NO: 251259 - protein, 9 aa, Homo Sapiens
WSISFTMLI

SEQ ID NO: 251260 - protein, 9 aa, Homo Sapiens
KFDTTPNKL

SEQ ID NO: 251261 - protein, 9 aa, Homo Sapiens
DGNFILRDS

SEQ ID NO: 251262 - protein, 9 aa, Homo Sapiens
NDDRCKMKN

SEQ ID NO: 251263 - protein, 9 aa, Homo Sapiens
AALNLGCIN

SEQ ID NO: 251264 - protein, 9 aa, Homo Sapiens
NDFMTLFFA

SEQ ID NO: 251265 - protein, 9 aa, Homo Sapiens
RPHLLLSGE

SEQ ID NO: 251266 - protein, 9 aa, Homo Sapiens
SGPNNVPYS

SEQ ID NO: 251267 - protein, 9 aa, Homo Sapiens
FMRIWAAGC

SEQ ID NO: 251268 - protein, 9 aa, Homo Sapiens
EHGNVSLHY

SEQ ID NO: 251269 - protein, 9 aa, Homo Sapiens
TFYTDLMNM

SEQ ID NO: 251270 - protein, 9 aa, Homo Sapiens
DKALSYICR

SEQ ID NO: 251271 - protein, 9 aa, Homo Sapiens
RIIPPKSLG

SEQ ID NO: 251272 - protein, 9 aa, Homo Sapiens
NEVSQQCED

SEQ ID NO: 251273 - protein, 9 aa, Homo Sapiens
PPPDNKINR

SEQ ID NO: 251274 - protein, 9 aa, Homo Sapiens
QLITGVNFT

SEQ ID NO: 251275 - protein, 9 aa, Homo Sapiens
ALGIGRLKR

SEQ ID NO: 251276 - protein, 9 aa, Homo Sapiens
CHSFFQHFS

SEQ ID NO: 251277 - protein, 9 aa, Homo Sapiens
IYPSLNLEK

SEQ ID NO: 251278 - protein, 9 aa, Homo Sapiens
TIVTYVGRP

SEQ ID NO: 251279 - protein, 9 aa, Homo Sapiens
VLWCLQYIS

SEQ ID NO: 251280 - protein, 9 aa, Homo Sapiens
QAGAVDMLV

SEQ ID NO: 251281 - protein, 9 aa, Homo Sapiens
ALNVAPVGD

SEQ ID NO: 251282 - protein, 9 aa, Homo Sapiens
KNSAILENA

SEQ ID NO: 251283 - protein, 9 aa, Homo Sapiens
LMEPVNRDN

SEQ ID NO: 251284 - protein, 9 aa, Homo Sapiens
GCQSHPGLH

SEQ ID NO: 251285 - protein, 9 aa, Homo Sapiens
EFKRRFKET

SEQ ID NO: 251286 - protein, 9 aa, Homo Sapiens
ALATRYLLP

SEQ ID NO: 251287 - protein, 9 aa, Homo Sapiens
DKFLVGPDG

SEQ ID NO: 251288 - protein, 9 aa, Homo Sapiens
SDFSHAIQK

SEQ ID NO: 251289 - protein, 9 aa, Homo Sapiens
EKRFEESDD

SEQ ID NO: 251290 - protein, 9 aa, Homo Sapiens
HTIDFFEMC

SEQ ID NO: 251291 - protein, 9 aa, Homo Sapiens
RPGSHKASF

SEQ ID NO: 251292 - protein, 9 aa, Homo Sapiens
TIGLDKIII

SEQ ID NO: 251293 - protein, 9 aa, Homo Sapiens
EEVDALFKG

SEQ ID NO: 251294 - protein, 9 aa, Homo Sapiens
INNEKLEWA

SEQ ID NO: 251295 - protein, 9 aa, Homo Sapiens
QEEMKKLPL

SEQ ID NO: 251296 - protein, 9 aa, Homo Sapiens
QKLSLKLDA

SEQ ID NO: 251297 - protein, 9 aa, Homo Sapiens
EAEDSEAEN

SEQ ID NO: 251298 - protein, 9 aa, Homo Sapiens
RRFTLIALR

SEQ ID NO: 251299 - protein, 9 aa, Homo Sapiens
QIPMYYFFS

SEQ ID NO: 251300 - protein, 9 aa, Homo Sapiens
YKPPALRKS

SEQ ID NO: 251301 - protein, 9 aa, Homo Sapiens
YHVSQQQRQ

SEQ ID NO: 251302 - protein, 9 aa, Homo Sapiens
PLNGEFYES

SEQ ID NO: 251303 - protein, 9 aa, Homo Sapiens
GVLASAKAL

SEQ ID NO: 251304 - protein, 9 aa, Homo Sapiens
NNTIRGCGG

SEQ ID NO: 251305 - protein, 9 aa, Homo Sapiens
YFFKEVNTT

SEQ ID NO: 251306 - protein, 9 aa, Homo Sapiens
GSMSVTRIM

SEQ ID NO: 251307 - protein, 9 aa, Homo Sapiens
CGQKMSHQH

SEQ ID NO: 251308 - protein, 9 aa, Homo Sapiens
LHFIGPNAG

SEQ ID NO: 251309 - protein, 9 aa, Homo Sapiens
TDREAVVTA

SEQ ID NO: 251310 - protein, 9 aa, Homo Sapiens
DEGMRGDGM

SEQ ID NO: 251311 - protein, 9 aa, Homo Sapiens
VKVKTERDS

SEQ ID NO: 251312 - protein, 9 aa, Homo Sapiens
DFEWIRRAL

SEQ ID NO: 251313 - protein, 9 aa, Homo Sapiens
IARKPDKAE

SEQ ID NO: 251314 - protein, 9 aa, Homo Sapiens
MLFDAICNN

SEQ ID NO: 251315 - protein, 9 aa, Homo Sapiens
LTGECKNLI

SEQ ID NO: 251316 - protein, 9 aa, Homo Sapiens
YAKLQQVPR

SEQ ID NO: 251317 - protein, 9 aa, Homo Sapiens
RRRSSTQLQ

SEQ ID NO: 251318 - protein, 9 aa, Homo Sapiens
FHMPEDVQE

SEQ ID NO: 251319 - protein, 9 aa, Homo Sapiens
NYNLLKHIC

SEQ ID NO: 251320 - protein, 9 aa, Homo Sapiens
GPENSKNTE

SEQ ID NO: 251321 - protein, 9 aa, Homo Sapiens
TKVDKVVAQ

SEQ ID NO: 251322 - protein, 9 aa, Homo Sapiens
SMRKIKSKI

SEQ ID NO: 251323 - protein, 9 aa, Homo Sapiens
FLFFLIVYI

SEQ ID NO: 251324 - protein, 9 aa, Homo Sapiens
PWIPLHHSR

SEQ ID NO: 251325 - protein, 9 aa, Homo Sapiens
LSDQLTQAI

SEQ ID NO: 251326 - protein, 9 aa, Homo Sapiens
LACAAGYFH

SEQ ID NO: 251327 - protein, 9 aa, Homo Sapiens
LDPKIYRNV

SEQ ID NO: 251328 - protein, 9 aa, Homo Sapiens
IHGWPWVTL

SEQ ID NO: 251329 - protein, 9 aa, Homo Sapiens
AETDVRRVL

SEQ ID NO: 251330 - protein, 9 aa, Homo Sapiens
RAYQQLLEE

SEQ ID NO: 251331 - protein, 9 aa, Homo Sapiens
QQLHFMNTS

SEQ ID NO: 251332 - protein, 9 aa, Homo Sapiens
RGSKTKKLV

SEQ ID NO: 251333 - protein, 9 aa, Homo Sapiens
PKMLSNIIS

SEQ ID NO: 251334 - protein, 9 aa, Homo Sapiens
FEDVAVYLI

SEQ ID NO: 251335 - protein, 9 aa, Homo Sapiens
QQDFLDTYN

SEQ ID NO: 251336 - protein, 9 aa, Homo Sapiens
PALHKKTQS

SEQ ID NO: 251337 - protein, 9 aa, Homo Sapiens
DILQHDPDS

SEQ ID NO: 251338 - protein, 9 aa, Homo Sapiens
AIAKVKLYD

SEQ ID NO: 251339 - protein, 9 aa, Homo Sapiens
CQIPSLEEP

SEQ ID NO: 251340 - protein, 9 aa, Homo Sapiens
VKEKNAELQ

SEQ ID NO: 251341 - protein, 9 aa, Homo Sapiens
PSNNRQLIR

SEQ ID NO: 251342 - protein, 9 aa, Homo Sapiens
TLNVSHNKL

SEQ ID NO: 251343 - protein, 9 aa, Homo Sapiens
TCGNVAQTA

SEQ ID NO: 251344 - protein, 9 aa, Homo Sapiens
PWPSISHLT

SEQ ID NO: 251345 - protein, 9 aa, Homo Sapiens
VPSGNIKTV

SEQ ID NO: 251346 - protein, 9 aa, Homo Sapiens
SRDNEVDFQ

SEQ ID NO: 251347 - protein, 9 aa, Homo Sapiens
GPNRSHQPK

SEQ ID NO: 251348 - protein, 9 aa, Homo Sapiens
PAKRKASEE

SEQ ID NO: 251349 - protein, 9 aa, Homo Sapiens
TLVEFPQKG

SEQ ID NO: 251350 - protein, 9 aa, Homo Sapiens
AVTMEHISD

SEQ ID NO: 251351 - protein, 9 aa, Homo Sapiens
EQYCIFANF

SEQ ID NO: 251352 - protein, 9 aa, Homo Sapiens
RDTAFILTG

SEQ ID NO: 251353 - protein, 9 aa, Homo Sapiens
LRFQGISWE

SEQ ID NO: 251354 - protein, 9 aa, Homo Sapiens
ENDQSISQN

SEQ ID NO: 251355 - protein, 9 aa, Homo Sapiens
FNRYSHLTQ

SEQ ID NO: 251356 - protein, 9 aa, Homo Sapiens
VVKDYGKEY

SEQ ID NO: 251357 - protein, 9 aa, Homo Sapiens
RRRRMEMIV

SEQ ID NO: 251358 - protein, 9 aa, Homo Sapiens
MGTDAAIFQ

SEQ ID NO: 251359 - protein, 9 aa, Homo Sapiens
SNGLTRHRI

SEQ ID NO: 251360 - protein, 9 aa, Homo Sapiens
FVCQVCGFW

SEQ ID NO: 251361 - protein, 9 aa, Homo Sapiens
EEWNEKVTQ

SEQ ID NO: 251362 - protein, 9 aa, Homo Sapiens
ATKINITDM

SEQ ID NO: 251363 - protein, 9 aa, Homo Sapiens
WKRANIIFR

SEQ ID NO: 251364 - protein, 9 aa, Homo Sapiens
IYLPLSGII

SEQ ID NO: 251365 - protein, 9 aa, Homo Sapiens
MSFTRSIAE

SEQ ID NO: 251366 - protein, 9 aa, Homo Sapiens
FRTLNPQVL

SEQ ID NO: 251367 - protein, 9 aa, Homo Sapiens
WIVGILTYR

SEQ ID NO: 251368 - protein, 9 aa, Homo Sapiens
LVRSIFLQQ

SEQ ID NO: 251369 - protein, 9 aa, Homo Sapiens
EWPPAHLSP

SEQ ID NO: 251370 - protein, 9 aa, Homo Sapiens
IPGFKFDNL

SEQ ID NO: 251371 - protein, 9 aa, Homo Sapiens
PAEYKILAV

SEQ ID NO: 251372 - protein, 9 aa, Homo Sapiens
ESLETFSGL

SEQ ID NO: 251373 - protein, 9 aa, Homo Sapiens
EQLEYGGCY

SEQ ID NO: 251374 - protein, 9 aa, Homo Sapiens
AMIPRCIKE

SEQ ID NO: 251375 - protein, 9 aa, Homo Sapiens
MILSYSGSV

SEQ ID NO: 251376 - protein, 9 aa, Homo Sapiens
LGVTAQQFH

SEQ ID NO: 251377 - protein, 9 aa, Homo Sapiens
KSENSSTHS

SEQ ID NO: 251378 - protein, 9 aa, Homo Sapiens
KKDQDKTDP

SEQ ID NO: 251379 - protein, 9 aa, Homo Sapiens
ISVPVPPGP

SEQ ID NO: 251380 - protein, 9 aa, Homo Sapiens
EHAGANYLS

SEQ ID NO: 251381 - protein, 9 aa, Homo Sapiens
GNNTIRGCG

SEQ ID NO: 251382 - protein, 9 aa, Homo Sapiens
RLTTRSCIG

SEQ ID NO: 251383 - protein, 9 aa, Homo Sapiens
LSDLNIGSG

SEQ ID NO: 251384 - protein, 9 aa, Homo Sapiens
QDFNTMFTD

SEQ ID NO: 251385 - protein, 9 aa, Homo Sapiens
PPPAPQSFL

SEQ ID NO: 251386 - protein, 9 aa, Homo Sapiens
TCGLFTHTS

SEQ ID NO: 251387 - protein, 9 aa, Homo Sapiens
YAASIYNIS

SEQ ID NO: 251388 - protein, 9 aa, Homo Sapiens
SPACVLLFS

SEQ ID NO: 251389 - protein, 9 aa, Homo Sapiens
TSESLVKIL

SEQ ID NO: 251390 - protein, 9 aa, Homo Sapiens
MGLFKSSRH

SEQ ID NO: 251391 - protein, 9 aa, Homo Sapiens
HQQIIHTRE

SEQ ID NO: 251392 - protein, 9 aa, Homo Sapiens
HVLPERRPM

SEQ ID NO: 251393 - protein, 9 aa, Homo Sapiens
FRLKPGTTP

SEQ ID NO: 251394 - protein, 9 aa, Homo Sapiens
ELIWPFILE

SEQ ID NO: 251395 - protein, 9 aa, Homo Sapiens
LSGSFFLPI

SEQ ID NO: 251396 - protein, 9 aa, Homo Sapiens
ALDLFGNGP

SEQ ID NO: 251397 - protein, 9 aa, Homo Sapiens
IPCNCHFLR

SEQ ID NO: 251398 - protein, 9 aa, Homo Sapiens
QKHLQINQM

SEQ ID NO: 251399 - protein, 9 aa, Homo Sapiens
GVKPFKCSE

SEQ ID NO: 251400 - protein, 9 aa, Homo Sapiens
VFEDIKYET

SEQ ID NO: 251401 - protein, 9 aa, Homo Sapiens
LFRINRLAL

SEQ ID NO: 251402 - protein, 9 aa, Homo Sapiens
KNKGNKTQE

SEQ ID NO: 251403 - protein, 9 aa, Homo Sapiens
SASGIFGGL

SEQ ID NO: 251404 - protein, 9 aa, Homo Sapiens
IKVPDFLSG

SEQ ID NO: 251405 - protein, 9 aa, Homo Sapiens
GWVAVLMTL

SEQ ID NO: 251406 - protein, 9 aa, Homo Sapiens
EFTEHFTAN

SEQ ID NO: 251407 - protein, 9 aa, Homo Sapiens
PMNGFAKLY

SEQ ID NO: 251408 - protein, 9 aa, Homo Sapiens
HRIRLHGID

SEQ ID NO: 251409 - protein, 9 aa, Homo Sapiens
CNVQKTRFG

SEQ ID NO: 251410 - protein, 9 aa, Homo Sapiens
RENIQRLFG

SEQ ID NO: 251411 - protein, 9 aa, Homo Sapiens
KGEQGYPGI

SEQ ID NO: 251412 - protein, 9 aa, Homo Sapiens
FGFIDHTVL

SEQ ID NO: 251413 - protein, 9 aa, Homo Sapiens
IPDSCRIIK

SEQ ID NO: 251414 - protein, 9 aa, Homo Sapiens
KRVVCNQEE

SEQ ID NO: 251415 - protein, 9 aa, Homo Sapiens
PGLRGDPDF

SEQ ID NO: 251416 - protein, 9 aa, Homo Sapiens
WAGPVNDGV

SEQ ID NO: 251417 - protein, 9 aa, Homo Sapiens
SQHQEDTYE

SEQ ID NO: 251418 - protein, 9 aa, Homo Sapiens
AWVNFLRKP

SEQ ID NO: 251419 - protein, 9 aa, Homo Sapiens
ETQLVKELV

SEQ ID NO: 251420 - protein, 9 aa, Homo Sapiens
PEFLLLGLS

SEQ ID NO: 251421 - protein, 9 aa, Homo Sapiens
STGPKPRFH

SEQ ID NO: 251422 - protein, 9 aa, Homo Sapiens
TDNHASICR

SEQ ID NO: 251423 - protein, 9 aa, Homo Sapiens
GWDGSDLTE

SEQ ID NO: 251424 - protein, 9 aa, Homo Sapiens
EACRLYTKL

SEQ ID NO: 251425 - protein, 9 aa, Homo Sapiens
YKSRRNCSK

SEQ ID NO: 251426 - protein, 9 aa, Homo Sapiens
LKKEYSNKN

SEQ ID NO: 251427 - protein, 9 aa, Homo Sapiens
VGIYVLSSC

SEQ ID NO: 251428 - protein, 9 aa, Homo Sapiens
QNQSSTKHP

SEQ ID NO: 251429 - protein, 9 aa, Homo Sapiens
EGAVRSRLE

SEQ ID NO: 251430 - protein, 9 aa, Homo Sapiens
PRIIPPKSL

SEQ ID NO: 251431 - protein, 9 aa, Homo Sapiens
IISDSVPLE

SEQ ID NO: 251432 - protein, 9 aa, Homo Sapiens
AYQGFQAGK

SEQ ID NO: 251433 - protein, 9 aa, Homo Sapiens
AERLQLDEE

SEQ ID NO: 251434 - protein, 9 aa, Homo Sapiens
DVTAVDFLG

SEQ ID NO: 251435 - protein, 9 aa, Homo Sapiens
LRQSIALSP

SEQ ID NO: 251436 - protein, 9 aa, Homo Sapiens
GVRLNQDKR

SEQ ID NO: 251437 - protein, 9 aa, Homo Sapiens
MDGATSSFE

SEQ ID NO: 251438 - protein, 9 aa, Homo Sapiens
SSYLWSSSL

SEQ ID NO: 251439 - protein, 9 aa, Homo Sapiens
LVEEKDKGT

SEQ ID NO: 251440 - protein, 9 aa, Homo Sapiens
GQTTGLIPV

SEQ ID NO: 251441 - protein, 9 aa, Homo Sapiens
NLMENVEAL

SEQ ID NO: 251442 - protein, 9 aa, Homo Sapiens
LRLDPSTRT

SEQ ID NO: 251443 - protein, 9 aa, Homo Sapiens
EQDTPLVES

SEQ ID NO: 251444 - protein, 9 aa, Homo Sapiens
PENFSAFSL

SEQ ID NO: 251445 - protein, 9 aa, Homo Sapiens
KEIVRWRTK

SEQ ID NO: 251446 - protein, 9 aa, Homo Sapiens
KSHVEKETQ

SEQ ID NO: 251447 - protein, 9 aa, Homo Sapiens
LPGFPGAQE

SEQ ID NO: 251448 - protein, 9 aa, Homo Sapiens
KVAAVIESL

SEQ ID NO: 251449 - protein, 9 aa, Homo Sapiens
LLAEGGIRG

SEQ ID NO: 251450 - protein, 9 aa, Homo Sapiens
LKGQDDYIY

SEQ ID NO: 251451 - protein, 9 aa, Homo Sapiens
VHRFEYKEH

SEQ ID NO: 251452 - protein, 9 aa, Homo Sapiens
VIIDIIAQV

SEQ ID NO: 251453 - protein, 9 aa, Homo Sapiens
DLAFNAFDA

SEQ ID NO: 251454 - protein, 9 aa, Homo Sapiens
RSWRGEGNT

SEQ ID NO: 251455 - protein, 9 aa, Homo Sapiens
INGTQIAGA

SEQ ID NO: 251456 - protein, 9 aa, Homo Sapiens
CQLQVNSDT

SEQ ID NO: 251457 - protein, 9 aa, Homo Sapiens
PKVSMDGCK

SEQ ID NO: 251458 - protein, 9 aa, Homo Sapiens
GNSPALAYH

SEQ ID NO: 251459 - protein, 9 aa, Homo Sapiens
RHSPGESEE

SEQ ID NO: 251460 - protein, 9 aa, Homo Sapiens
RVKPDVMHH

SEQ ID NO: 251461 - protein, 9 aa, Homo Sapiens
VPDTEGAVR

SEQ ID NO: 251462 - protein, 9 aa, Homo Sapiens
SNNRQLIRQ

SEQ ID NO: 251463 - protein, 9 aa, Homo Sapiens
LLTEEINVK

SEQ ID NO: 251464 - protein, 9 aa, Homo Sapiens
KKIEPDAVL

SEQ ID NO: 251465 - protein, 9 aa, Homo Sapiens
LRKKHTTSA

SEQ ID NO: 251466 - protein, 9 aa, Homo Sapiens
ISRETEKEN

SEQ ID NO: 251467 - protein, 9 aa, Homo Sapiens
QYKSSCKPS

SEQ ID NO: 251468 - protein, 9 aa, Homo Sapiens
SPFWLPEPV

SEQ ID NO: 251469 - protein, 9 aa, Homo Sapiens
CLVPCFIDT

SEQ ID NO: 251470 - protein, 9 aa, Homo Sapiens
NQMAEKTDG

SEQ ID NO: 251471 - protein, 9 aa, Homo Sapiens
NRRMTHLAH

SEQ ID NO: 251472 - protein, 9 aa, Homo Sapiens
VPDLSELFK

SEQ ID NO: 251473 - protein, 9 aa, Homo Sapiens
LNNCHRSRL

SEQ ID NO: 251474 - protein, 9 aa, Homo Sapiens
KTVLHIIYG

SEQ ID NO: 251475 - protein, 9 aa, Homo Sapiens
EILYVPRGA

SEQ ID NO: 251476 - protein, 9 aa, Homo Sapiens
DEEIRFSLR

SEQ ID NO: 251477 - protein, 9 aa, Homo Sapiens
WPYLEIRAL

SEQ ID NO: 251478 - protein, 9 aa, Homo Sapiens
YISSSARRT

SEQ ID NO: 251479 - protein, 9 aa, Homo Sapiens
TWWFTSFFH

SEQ ID NO: 251480 - protein, 9 aa, Homo Sapiens
VTGKSDAET

SEQ ID NO: 251481 - protein, 9 aa, Homo Sapiens
DLLLEVTNG

SEQ ID NO: 251482 - protein, 9 aa, Homo Sapiens
QLRGEELSQ

SEQ ID NO: 251483 - protein, 9 aa, Homo Sapiens
KTFLHKRKT

SEQ ID NO: 251484 - protein, 9 aa, Homo Sapiens
RKSHAGENS

SEQ ID NO: 251485 - protein, 9 aa, Homo Sapiens
LFFLIVYIV

SEQ ID NO: 251486 - protein, 9 aa, Homo Sapiens
RPKVPADIE

SEQ ID NO: 251487 - protein, 9 aa, Homo Sapiens
EGDPMRHQI

SEQ ID NO: 251488 - protein, 9 aa, Homo Sapiens
INRRERLVQ

SEQ ID NO: 251489 - protein, 9 aa, Homo Sapiens
DQSAWTFQI

SEQ ID NO: 251490 - protein, 9 aa, Homo Sapiens
KTHPHGDEF

SEQ ID NO: 251491 - protein, 9 aa, Homo Sapiens
CYHLLSEES

SEQ ID NO: 251492 - protein, 9 aa, Homo Sapiens
IVEDEDDEF

SEQ ID NO: 251493 - protein, 9 aa, Homo Sapiens
TYEEVVLQA

SEQ ID NO: 251494 - protein, 9 aa, Homo Sapiens
DSSLPTKEK

SEQ ID NO: 251495 - protein, 9 aa, Homo Sapiens
TNSVGNTTA

SEQ ID NO: 251496 - protein, 9 aa, Homo Sapiens
PEDVQEKKE

SEQ ID NO: 251497 - protein, 9 aa, Homo Sapiens
GGINTLQPV

SEQ ID NO: 251498 - protein, 9 aa, Homo Sapiens
SYESVFKAI

SEQ ID NO: 251499 - protein, 9 aa, Homo Sapiens
IPGLIPYLV

SEQ ID NO: 251500 - protein, 9 aa, Homo Sapiens
LREKEQNTP

SEQ ID NO: 251501 - protein, 9 aa, Homo Sapiens
QTGGSLRGN

SEQ ID NO: 251502 - protein, 9 aa, Homo Sapiens
EGIVKQESL

SEQ ID NO: 251503 - protein, 9 aa, Homo Sapiens
SSSLYGGEV

SEQ ID NO: 251504 - protein, 9 aa, Homo Sapiens
LFLENAIGK

SEQ ID NO: 251505 - protein, 9 aa, Homo Sapiens
LGLHFIGPN

SEQ ID NO: 251506 - protein, 9 aa, Homo Sapiens
KKRPVQIEK

SEQ ID NO: 251507 - protein, 9 aa, Homo Sapiens
SSSEDSNDS

SEQ ID NO: 251508 - protein, 9 aa, Homo Sapiens
NLQIWDTAG

SEQ ID NO: 251509 - protein, 9 aa, Homo Sapiens
IDIKTLEGA

SEQ ID NO: 251510 - protein, 9 aa, Homo Sapiens
NYFVKGRQA

SEQ ID NO: 251511 - protein, 9 aa, Homo Sapiens
PNAYFRQGV

SEQ ID NO: 251512 - protein, 9 aa, Homo Sapiens
TGPKPRFHE

SEQ ID NO: 251513 - protein, 9 aa, Homo Sapiens
RVRLQCKLY

SEQ ID NO: 251514 - protein, 9 aa, Homo Sapiens
ERKLFLVPS

SEQ ID NO: 251515 - protein, 9 aa, Homo Sapiens
SYADFVWSL

SEQ ID NO: 251516 - protein, 9 aa, Homo Sapiens
NYPLNLQPL

SEQ ID NO: 251517 - protein, 9 aa, Homo Sapiens
EEVNTLDLE

SEQ ID NO: 251518 - protein, 9 aa, Homo Sapiens
VREDNLEAV

SEQ ID NO: 251519 - protein, 9 aa, Homo Sapiens
GTNESLECQ

SEQ ID NO: 251520 - protein, 9 aa, Homo Sapiens
FGAFTIKAD

SEQ ID NO: 251521 - protein, 9 aa, Homo Sapiens
LPSGLSNGD

SEQ ID NO: 251522 - protein, 9 aa, Homo Sapiens
LSQILRIKT

SEQ ID NO: 251523 - protein, 9 aa, Homo Sapiens
MTIHFQSDI

SEQ ID NO: 251524 - protein, 9 aa, Homo Sapiens
LFQNKLAAQ

SEQ ID NO: 251525 - protein, 9 aa, Homo Sapiens
GSDLLRRTD

SEQ ID NO: 251526 - protein, 9 aa, Homo Sapiens
KDAIKKKCQ

SEQ ID NO: 251527 - protein, 9 aa, Homo Sapiens
FENYQPNMV

SEQ ID NO: 251528 - protein, 9 aa, Homo Sapiens
LPPGWVTLE

SEQ ID NO: 251529 - protein, 9 aa, Homo Sapiens
EKSNPTKHQ

SEQ ID NO: 251530 - protein, 9 aa, Homo Sapiens
CPSETPINE

SEQ ID NO: 251531 - protein, 9 aa, Homo Sapiens
NFRVKFVVS

SEQ ID NO: 251532 - protein, 9 aa, Homo Sapiens
ETTTSPNKY

SEQ ID NO: 251533 - protein, 9 aa, Homo Sapiens
MEYVILIEY

SEQ ID NO: 251534 - protein, 9 aa, Homo Sapiens
IIVDDFSER

SEQ ID NO: 251535 - protein, 9 aa, Homo Sapiens
AHPQQTFLR

SEQ ID NO: 251536 - protein, 9 aa, Homo Sapiens
IPVHVNRFV

SEQ ID NO: 251537 - protein, 9 aa, Homo Sapiens
MPKRGLNVS

SEQ ID NO: 251538 - protein, 9 aa, Homo Sapiens
ESKRAIQAK

SEQ ID NO: 251539 - protein, 9 aa, Homo Sapiens
RRVIRNQDI

SEQ ID NO: 251540 - protein, 9 aa, Homo Sapiens
RKAEQFCKS

SEQ ID NO: 251541 - protein, 9 aa, Homo Sapiens
GGNIYLDFF

SEQ ID NO: 251542 - protein, 9 aa, Homo Sapiens
MRIRGHLYP

SEQ ID NO: 251543 - protein, 9 aa, Homo Sapiens
LYKMLVGDT

SEQ ID NO: 251544 - protein, 9 aa, Homo Sapiens
SSFARHQKI

SEQ ID NO: 251545 - protein, 9 aa, Homo Sapiens
EHEVEAYKH

SEQ ID NO: 251546 - protein, 9 aa, Homo Sapiens
DLPKNAALN

SEQ ID NO: 251547 - protein, 9 aa, Homo Sapiens
HQFNTEDQV

SEQ ID NO: 251548 - protein, 9 aa, Homo Sapiens
LEDVYIQYL

SEQ ID NO: 251549 - protein, 9 aa, Homo Sapiens
AGLIQVTIM

SEQ ID NO: 251550 - protein, 9 aa, Homo Sapiens
GKRFTDNSQ

SEQ ID NO: 251551 - protein, 9 aa, Homo Sapiens
KVGIMHCKA

SEQ ID NO: 251552 - protein, 9 aa, Homo Sapiens
LRHHYSNKW

SEQ ID NO: 251553 - protein, 9 aa, Homo Sapiens
NCEPYKILF

SEQ ID NO: 251554 - protein, 9 aa, Homo Sapiens
LKGNIVFVT

SEQ ID NO: 251555 - protein, 9 aa, Homo Sapiens
AISRRIIVG

SEQ ID NO: 251556 - protein, 9 aa, Homo Sapiens
ASSNSEESE

SEQ ID NO: 251557 - protein, 9 aa, Homo Sapiens
SSDPGRCFY

SEQ ID NO: 251558 - protein, 9 aa, Homo Sapiens
ISHGDLIQF

SEQ ID NO: 251559 - protein, 9 aa, Homo Sapiens
SYISYSNSK

SEQ ID NO: 251560 - protein, 9 aa, Homo Sapiens
YSDDEKFML

SEQ ID NO: 251561 - protein, 9 aa, Homo Sapiens
LVLFSLDVN

SEQ ID NO: 251562 - protein, 9 aa, Homo Sapiens
YLMLEESDK

SEQ ID NO: 251563 - protein, 9 aa, Homo Sapiens
VTIELSLEE

SEQ ID NO: 251564 - protein, 9 aa, Homo Sapiens
KRNANLRFL

SEQ ID NO: 251565 - protein, 9 aa, Homo Sapiens
TCGTQPGLH

SEQ ID NO: 251566 - protein, 9 aa, Homo Sapiens
IDMSSFTKC

SEQ ID NO: 251567 - protein, 9 aa, Homo Sapiens
KIYVCQSGY

SEQ ID NO: 251568 - protein, 9 aa, Homo Sapiens
TADLTLCHI

SEQ ID NO: 251569 - protein, 9 aa, Homo Sapiens
ASKPPRAAE

SEQ ID NO: 251570 - protein, 9 aa, Homo Sapiens
CEITSFAFL

SEQ ID NO: 251571 - protein, 9 aa, Homo Sapiens
CFKTSVDCL

SEQ ID NO: 251572 - protein, 9 aa, Homo Sapiens
SDVGRYIDQ

SEQ ID NO: 251573 - protein, 9 aa, Homo Sapiens
SGEQGGRAG

SEQ ID NO: 251574 - protein, 9 aa, Homo Sapiens
CSTWNYQNS

SEQ ID NO: 251575 - protein, 9 aa, Homo Sapiens
GPKGEQGYP

SEQ ID NO: 251576 - protein, 9 aa, Homo Sapiens
RLPKDHRED

SEQ ID NO: 251577 - protein, 9 aa, Homo Sapiens
WHQKEDHQT

SEQ ID NO: 251578 - protein, 9 aa, Homo Sapiens
HLGVKAYSC

SEQ ID NO: 251579 - protein, 9 aa, Homo Sapiens
LQHAELFLK

SEQ ID NO: 251580 - protein, 9 aa, Homo Sapiens
LQKQNTMKF

SEQ ID NO: 251581 - protein, 9 aa, Homo Sapiens
NNGSCINKI

SEQ ID NO: 251582 - protein, 9 aa, Homo Sapiens
GPSIMKKRC

SEQ ID NO: 251583 - protein, 9 aa, Homo Sapiens
LYHSVQGAS

SEQ ID NO: 251584 - protein, 9 aa, Homo Sapiens
ELRKCRKID

SEQ ID NO: 251585 - protein, 9 aa, Homo Sapiens
VRIRSDRYK

SEQ ID NO: 251586 - protein, 9 aa, Homo Sapiens
PTNMKTVSL

SEQ ID NO: 251587 - protein, 9 aa, Homo Sapiens
SKRRQTGGS

SEQ ID NO: 251588 - protein, 9 aa, Homo Sapiens
AGPGLQTHC

SEQ ID NO: 251589 - protein, 9 aa, Homo Sapiens
DLLCRTIKK

SEQ ID NO: 251590 - protein, 9 aa, Homo Sapiens
VFCKYKKNS

SEQ ID NO: 251591 - protein, 9 aa, Homo Sapiens
VETCPAETT

SEQ ID NO: 251592 - protein, 9 aa, Homo Sapiens
TLQTVSSSQ

SEQ ID NO: 251593 - protein, 9 aa, Homo Sapiens
ILFHTGISV

SEQ ID NO: 251594 - protein, 9 aa, Homo Sapiens
KVMDVVFQW

SEQ ID NO: 251595 - protein, 9 aa, Homo Sapiens
DKGIQKDFV

SEQ ID NO: 251596 - protein, 9 aa, Homo Sapiens
FNLRKPVEL

SEQ ID NO: 251597 - protein, 9 aa, Homo Sapiens
YSAAPRGQF

SEQ ID NO: 251598 - protein, 9 aa, Homo Sapiens
STNLNFSVI

SEQ ID NO: 251599 - protein, 9 aa, Homo Sapiens
GQFILILKK

SEQ ID NO: 251600 - protein, 9 aa, Homo Sapiens
KSLKEQKKR

SEQ ID NO: 251601 - protein, 9 aa, Homo Sapiens
NTGPYYFVN

SEQ ID NO: 251602 - protein, 9 aa, Homo Sapiens
KHARQAACI

SEQ ID NO: 251603 - protein, 9 aa, Homo Sapiens
GTSPEDHLL

SEQ ID NO: 251604 - protein, 9 aa, Homo Sapiens
MDSSFAHTA

SEQ ID NO: 251605 - protein, 9 aa, Homo Sapiens
VTSKGACFS

SEQ ID NO: 251606 - protein, 9 aa, Homo Sapiens
VRDPAVDRP

SEQ ID NO: 251607 - protein, 9 aa, Homo Sapiens
NNKTLGEKI

SEQ ID NO: 251608 - protein, 9 aa, Homo Sapiens
LKSRDTRRH

SEQ ID NO: 251609 - protein, 9 aa, Homo Sapiens
AFCSVAQAG

SEQ ID NO: 251610 - protein, 9 aa, Homo Sapiens
NIFSFNVWG

SEQ ID NO: 251611 - protein, 9 aa, Homo Sapiens
SEQSIKDYF

SEQ ID NO: 251612 - protein, 9 aa, Homo Sapiens
THTGEKPLE

SEQ ID NO: 251613 - protein, 9 aa, Homo Sapiens
VNGHFVKRE

SEQ ID NO: 251614 - protein, 9 aa, Homo Sapiens
WLPEPVPSG

SEQ ID NO: 251615 - protein, 9 aa, Homo Sapiens
EANCKDLAV

SEQ ID NO: 251616 - protein, 9 aa, Homo Sapiens
VPADIEKCQ

SEQ ID NO: 251617 - protein, 9 aa, Homo Sapiens
CSQIIYNYN

SEQ ID NO: 251618 - protein, 9 aa, Homo Sapiens
EVYFSAIRK

SEQ ID NO: 251619 - protein, 9 aa, Homo Sapiens
FDLKVLSAQ

SEQ ID NO: 251620 - protein, 9 aa, Homo Sapiens
GTQGAVGCP

SEQ ID NO: 251621 - protein, 9 aa, Homo Sapiens
IVVYTAYVF

SEQ ID NO: 251622 - protein, 9 aa, Homo Sapiens
DRGKTPLMI

SEQ ID NO: 251623 - protein, 9 aa, Homo Sapiens
LQCGYACCL

SEQ ID NO: 251624 - protein, 9 aa, Homo Sapiens
VDLGGNSFN

SEQ ID NO: 251625 - protein, 9 aa, Homo Sapiens
ELTKKGCND

SEQ ID NO: 251626 - protein, 9 aa, Homo Sapiens
IRIHEIIHT

SEQ ID NO: 251627 - protein, 9 aa, Homo Sapiens
KWTLDLESR

SEQ ID NO: 251628 - protein, 9 aa, Homo Sapiens
PLVFLNAKT

SEQ ID NO: 251629 - protein, 9 aa, Homo Sapiens
CDNLAPTAT

SEQ ID NO: 251630 - protein, 9 aa, Homo Sapiens
CTRTQAQHL

SEQ ID NO: 251631 - protein, 9 aa, Homo Sapiens
YFKNRENCE

SEQ ID NO: 251632 - protein, 9 aa, Homo Sapiens
QTSSGQYSA

SEQ ID NO: 251633 - protein, 9 aa, Homo Sapiens
KLSVKKNIS

SEQ ID NO: 251634 - protein, 9 aa, Homo Sapiens
EPPQTLLRE

SEQ ID NO: 251635 - protein, 9 aa, Homo Sapiens
LFAFLSSFV

SEQ ID NO: 251636 - protein, 9 aa, Homo Sapiens
NEDICPEKG

SEQ ID NO: 251637 - protein, 9 aa, Homo Sapiens
WNESEPSEM

SEQ ID NO: 251638 - protein, 9 aa, Homo Sapiens
LIGDSLYFD

SEQ ID NO: 251639 - protein, 9 aa, Homo Sapiens
NVAFSCVFA

SEQ ID NO: 251640 - protein, 9 aa, Homo Sapiens
MYLYTCLVE

SEQ ID NO: 251641 - protein, 9 aa, Homo Sapiens
QQQLHFMNT

SEQ ID NO: 251642 - protein, 9 aa, Homo Sapiens
AHISKLAEC

SEQ ID NO: 251643 - protein, 9 aa, Homo Sapiens
IGGAPSVIV

SEQ ID NO: 251644 - protein, 9 aa, Homo Sapiens
QHGLRPVKV

SEQ ID NO: 251645 - protein, 9 aa, Homo Sapiens
AYDKEQKAN

SEQ ID NO: 251646 - protein, 9 aa, Homo Sapiens
PADSRDTVR

SEQ ID NO: 251647 - protein, 9 aa, Homo Sapiens
TSQRDDAPA

SEQ ID NO: 251648 - protein, 9 aa, Homo Sapiens
DFGKTSSTV

SEQ ID NO: 251649 - protein, 9 aa, Homo Sapiens
HSVIVNPPV

SEQ ID NO: 251650 - protein, 9 aa, Homo Sapiens
DNIMAQKCL

SEQ ID NO: 251651 - protein, 9 aa, Homo Sapiens
SKGRPTPCA

SEQ ID NO: 251652 - protein, 9 aa, Homo Sapiens
GDPSGFAVL

SEQ ID NO: 251653 - protein, 9 aa, Homo Sapiens
KQEWADPDN

SEQ ID NO: 251654 - protein, 9 aa, Homo Sapiens
SYIHILQAA

SEQ ID NO: 251655 - protein, 9 aa, Homo Sapiens
GIFSVTEGA

SEQ ID NO: 251656 - protein, 9 aa, Homo Sapiens
KLEVIKQLR

SEQ ID NO: 251657 - protein, 9 aa, Homo Sapiens
TSPGLPPGW

SEQ ID NO: 251658 - protein, 9 aa, Homo Sapiens
AKCDHHCPW

SEQ ID NO: 251659 - protein, 9 aa, Homo Sapiens
TSVLTTTSP

SEQ ID NO: 251660 - protein, 9 aa, Homo Sapiens
SMSLMAPTP

SEQ ID NO: 251661 - protein, 9 aa, Homo Sapiens
MFTLGGSEH

SEQ ID NO: 251662 - protein, 9 aa, Homo Sapiens
PYKCNECGQ

SEQ ID NO: 251663 - protein, 9 aa, Homo Sapiens
GKAFIWPAS

SEQ ID NO: 251664 - protein, 9 aa, Homo Sapiens
FKSSRHDPS

SEQ ID NO: 251665 - protein, 9 aa, Homo Sapiens
CGAMTHKNK

SEQ ID NO: 251666 - protein, 9 aa, Homo Sapiens
RVNVWSMVN

SEQ ID NO: 251667 - protein, 9 aa, Homo Sapiens
VGDTKWLTL

SEQ ID NO: 251668 - protein, 9 aa, Homo Sapiens
NIDTSPPVD

SEQ ID NO: 251669 - protein, 9 aa, Homo Sapiens
SITPSAQTQ

SEQ ID NO: 251670 - protein, 9 aa, Homo Sapiens
QQIRRNIAH

SEQ ID NO: 251671 - protein, 9 aa, Homo Sapiens
SNNVTLLYL

SEQ ID NO: 251672 - protein, 9 aa, Homo Sapiens
QRARYLFFA

SEQ ID NO: 251673 - protein, 9 aa, Homo Sapiens
FYNNASKFD

SEQ ID NO: 251674 - protein, 9 aa, Homo Sapiens
QIMRFAMKY

SEQ ID NO: 251675 - protein, 9 aa, Homo Sapiens
ELLSVNFVD

SEQ ID NO: 251676 - protein, 9 aa, Homo Sapiens
LRIKEPLHL

SEQ ID NO: 251677 - protein, 9 aa, Homo Sapiens
VSSVTIPKM

SEQ ID NO: 251678 - protein, 9 aa, Homo Sapiens
VANPKYIIH

SEQ ID NO: 251679 - protein, 9 aa, Homo Sapiens
DTNFCIQNC

SEQ ID NO: 251680 - protein, 9 aa, Homo Sapiens
DFLLVHDSG

SEQ ID NO: 251681 - protein, 9 aa, Homo Sapiens
VIPNSMTPA

SEQ ID NO: 251682 - protein, 9 aa, Homo Sapiens
VLLFSISAD

SEQ ID NO: 251683 - protein, 9 aa, Homo Sapiens
MVITQTSHC

SEQ ID NO: 251684 - protein, 9 aa, Homo Sapiens
VSSSQVTEI

SEQ ID NO: 251685 - protein, 9 aa, Homo Sapiens
LYPHIVSTD

SEQ ID NO: 251686 - protein, 9 aa, Homo Sapiens
SDLELKKSL

SEQ ID NO: 251687 - protein, 9 aa, Homo Sapiens
TTKVVQNRC

SEQ ID NO: 251688 - protein, 9 aa, Homo Sapiens
CQVRNYRHI

SEQ ID NO: 251689 - protein, 9 aa, Homo Sapiens
FKYLHECLE

SEQ ID NO: 251690 - protein, 9 aa, Homo Sapiens
RGNNHKENV

SEQ ID NO: 251691 - protein, 9 aa, Homo Sapiens
QLYEMFSLV

SEQ ID NO: 251692 - protein, 9 aa, Homo Sapiens
DNFLDFAES

SEQ ID NO: 251693 - protein, 9 aa, Homo Sapiens
FKNEAADPQ

SEQ ID NO: 251694 - protein, 9 aa, Homo Sapiens
FKDLMPKLT

SEQ ID NO: 251695 - protein, 9 aa, Homo Sapiens
GWISKLVSG

SEQ ID NO: 251696 - protein, 9 aa, Homo Sapiens
SKLSFQNKI

SEQ ID NO: 251697 - protein, 9 aa, Homo Sapiens
VNRDTKMAL

SEQ ID NO: 251698 - protein, 9 aa, Homo Sapiens
ERNIISFDG

SEQ ID NO: 251699 - protein, 9 aa, Homo Sapiens
FYRGCLDWD

SEQ ID NO: 251700 - protein, 9 aa, Homo Sapiens
GEYLFKRLT

SEQ ID NO: 251701 - protein, 9 aa, Homo Sapiens
DQKPELNIV

SEQ ID NO: 251702 - protein, 9 aa, Homo Sapiens
VRRDIAPPE

SEQ ID NO: 251703 - protein, 9 aa, Homo Sapiens
DVYIQYLKS

SEQ ID NO: 251704 - protein, 9 aa, Homo Sapiens
HQCKDNEDY

SEQ ID NO: 251705 - protein, 9 aa, Homo Sapiens
ANIQDSLGG

SEQ ID NO: 251706 - protein, 9 aa, Homo Sapiens
IQRPNIPHQ

SEQ ID NO: 251707 - protein, 9 aa, Homo Sapiens
LSTTFEHLV

SEQ ID NO: 251708 - protein, 9 aa, Homo Sapiens
TFGLSSKES

SEQ ID NO: 251709 - protein, 9 aa, Homo Sapiens
FSHTSYLSQ

SEQ ID NO: 251710 - protein, 9 aa, Homo Sapiens
RLFLHSNKL

SEQ ID NO: 251711 - protein, 9 aa, Homo Sapiens
YWRTALLRA

SEQ ID NO: 251712 - protein, 9 aa, Homo Sapiens
KSWMEDTAF

SEQ ID NO: 251713 - protein, 9 aa, Homo Sapiens
YAVLDCLLD

SEQ ID NO: 251714 - protein, 9 aa, Homo Sapiens
GEKGFKDKL

SEQ ID NO: 251715 - protein, 9 aa, Homo Sapiens
RHKAAESEL

SEQ ID NO: 251716 - protein, 9 aa, Homo Sapiens
SKRYEDLPI

SEQ ID NO: 251717 - protein, 9 aa, Homo Sapiens
FNNMLFPMI

SEQ ID NO: 251718 - protein, 9 aa, Homo Sapiens
YFVGGQSYT

SEQ ID NO: 251719 - protein, 9 aa, Homo Sapiens
APIKNIMDS

SEQ ID NO: 251720 - protein, 9 aa, Homo Sapiens
TAFALGFVK

SEQ ID NO: 251721 - protein, 9 aa, Homo Sapiens
GGKIWRPAN

SEQ ID NO: 251722 - protein, 9 aa, Homo Sapiens
YSKLVSMAG

SEQ ID NO: 251723 - protein, 9 aa, Homo Sapiens
KVLIDIKEY

SEQ ID NO: 251724 - protein, 9 aa, Homo Sapiens
PGTEEKSVI

SEQ ID NO: 251725 - protein, 9 aa, Homo Sapiens
DRIIDQRFK

SEQ ID NO: 251726 - protein, 9 aa, Homo Sapiens
SHSLGPEFG

SEQ ID NO: 251727 - protein, 9 aa, Homo Sapiens
TRQSKRNEG

SEQ ID NO: 251728 - protein, 9 aa, Homo Sapiens
YLSLTQYES

SEQ ID NO: 251729 - protein, 9 aa, Homo Sapiens
HVENGGYKT

SEQ ID NO: 251730 - protein, 9 aa, Homo Sapiens
HVWLGEIIN

SEQ ID NO: 251731 - protein, 9 aa, Homo Sapiens
HLQSMFEII

SEQ ID NO: 251732 - protein, 9 aa, Homo Sapiens
LHFDEAKDH

SEQ ID NO: 251733 - protein, 9 aa, Homo Sapiens
KEHAHLKEI

SEQ ID NO: 251734 - protein, 9 aa, Homo Sapiens
AGEAEKYNL

SEQ ID NO: 251735 - protein, 9 aa, Homo Sapiens
PCEQKLLCG

SEQ ID NO: 251736 - protein, 9 aa, Homo Sapiens
SGTKMAKHI

SEQ ID NO: 251737 - protein, 9 aa, Homo Sapiens
SYLQNILGL

SEQ ID NO: 251738 - protein, 9 aa, Homo Sapiens
INAYKEDPK

SEQ ID NO: 251739 - protein, 9 aa, Homo Sapiens
RNCIEITFD

SEQ ID NO: 251740 - protein, 9 aa, Homo Sapiens
QVAKWPVDT

SEQ ID NO: 251741 - protein, 9 aa, Homo Sapiens
LSVTRVVSY

SEQ ID NO: 251742 - protein, 9 aa, Homo Sapiens
REVLEQVAE

SEQ ID NO: 251743 - protein, 9 aa, Homo Sapiens
YLLSMASSI

SEQ ID NO: 251744 - protein, 9 aa, Homo Sapiens
AEKVQKLSA

SEQ ID NO: 251745 - protein, 9 aa, Homo Sapiens
EAEAEKPPT

SEQ ID NO: 251746 - protein, 9 aa, Homo Sapiens
SYKRIAPRY

SEQ ID NO: 251747 - protein, 9 aa, Homo Sapiens
SLPPIDLAD

SEQ ID NO: 251748 - protein, 9 aa, Homo Sapiens
FKSTKSATP

SEQ ID NO: 251749 - protein, 9 aa, Homo Sapiens
FCDPTFLPD

SEQ ID NO: 251750 - protein, 9 aa, Homo Sapiens
YFSKYWKKE

SEQ ID NO: 251751 - protein, 9 aa, Homo Sapiens
KIKKFSKTQ

SEQ ID NO: 251752 - protein, 9 aa, Homo Sapiens
SSRQCQGDR

SEQ ID NO: 251753 - protein, 9 aa, Homo Sapiens
EKSSGQLNT

SEQ ID NO: 251754 - protein, 9 aa, Homo Sapiens
ELTEEKESD

SEQ ID NO: 251755 - protein, 9 aa, Homo Sapiens
SRAPPLHLE

SEQ ID NO: 251756 - protein, 9 aa, Homo Sapiens
TFINHQIIH

SEQ ID NO: 251757 - protein, 9 aa, Homo Sapiens
CSLLGSMAY

SEQ ID NO: 251758 - protein, 9 aa, Homo Sapiens
ERIYITNYY

SEQ ID NO: 251759 - protein, 9 aa, Homo Sapiens
QIMQLLCEM

SEQ ID NO: 251760 - protein, 9 aa, Homo Sapiens
EITSFAFLR

SEQ ID NO: 251761 - protein, 9 aa, Homo Sapiens
PEKDMMVYV

SEQ ID NO: 251762 - protein, 9 aa, Homo Sapiens
TQDKLGEDD

SEQ ID NO: 251763 - protein, 9 aa, Homo Sapiens
KLTKTSNLS

SEQ ID NO: 251764 - protein, 9 aa, Homo Sapiens
VGRCSGDKN

SEQ ID NO: 251765 - protein, 9 aa, Homo Sapiens
ITVEWRLRG

SEQ ID NO: 251766 - protein, 9 aa, Homo Sapiens
EDPNNSSVS

SEQ ID NO: 251767 - protein, 9 aa, Homo Sapiens
VMKFSEKAQ

SEQ ID NO: 251768 - protein, 9 aa, Homo Sapiens
KDLQDLMLA

SEQ ID NO: 251769 - protein, 9 aa, Homo Sapiens
LLDIPKGEM

SEQ ID NO: 251770 - protein, 9 aa, Homo Sapiens
LLQIWNDGR

SEQ ID NO: 251771 - protein, 9 aa, Homo Sapiens
FLALTPSLP

SEQ ID NO: 251772 - protein, 9 aa, Homo Sapiens
RVLRVLDQV

SEQ ID NO: 251773 - protein, 9 aa, Homo Sapiens
EEMINNQNK

SEQ ID NO: 251774 - protein, 9 aa, Homo Sapiens
WVAVLMTLF

SEQ ID NO: 251775 - protein, 9 aa, Homo Sapiens
KSRVQESFQ

SEQ ID NO: 251776 - protein, 9 aa, Homo Sapiens
SRSLFDYHD

SEQ ID NO: 251777 - protein, 9 aa, Homo Sapiens
NYLFDVEVG

SEQ ID NO: 251778 - protein, 9 aa, Homo Sapiens
FARHQKIHT

SEQ ID NO: 251779 - protein, 9 aa, Homo Sapiens
AGIWMINNR

SEQ ID NO: 251780 - protein, 9 aa, Homo Sapiens
MISFSLSIN

SEQ ID NO: 251781 - protein, 9 aa, Homo Sapiens
ENINTFLTS

SEQ ID NO: 251782 - protein, 9 aa, Homo Sapiens
KKQKKKRNK

SEQ ID NO: 251783 - protein, 9 aa, Homo Sapiens
FQYNGTVGL

SEQ ID NO: 251784 - protein, 9 aa, Homo Sapiens
SSSQARSSP

SEQ ID NO: 251785 - protein, 9 aa, Homo Sapiens
QFVLPCWPL

SEQ ID NO: 251786 - protein, 9 aa, Homo Sapiens
PHNALSDVV

SEQ ID NO: 251787 - protein, 9 aa, Homo Sapiens
TDDWDRKRC

SEQ ID NO: 251788 - protein, 9 aa, Homo Sapiens
HFQHVKRGW

SEQ ID NO: 251789 - protein, 9 aa, Homo Sapiens
EKTREKEEK

SEQ ID NO: 251790 - protein, 9 aa, Homo Sapiens
ELEKNFNNF

SEQ ID NO: 251791 - protein, 9 aa, Homo Sapiens
VMAKRIHAE

SEQ ID NO: 251792 - protein, 9 aa, Homo Sapiens
AALEMCQKP

SEQ ID NO: 251793 - protein, 9 aa, Homo Sapiens
SVCCCQSEM

SEQ ID NO: 251794 - protein, 9 aa, Homo Sapiens
LLAMRRSLE

SEQ ID NO: 251795 - protein, 9 aa, Homo Sapiens
SGKVTTKNI

SEQ ID NO: 251796 - protein, 9 aa, Homo Sapiens
YSAWKTPRG

SEQ ID NO: 251797 - protein, 9 aa, Homo Sapiens
VLNLKQFLK

SEQ ID NO: 251798 - protein, 9 aa, Homo Sapiens
LFHIWRNKT

SEQ ID NO: 251799 - protein, 9 aa, Homo Sapiens
SIFCPPRKS

SEQ ID NO: 251800 - protein, 9 aa, Homo Sapiens
APHKEQYKE

SEQ ID NO: 251801 - protein, 9 aa, Homo Sapiens
TCINGEYMS

SEQ ID NO: 251802 - protein, 9 aa, Homo Sapiens
TACHSAPGH

SEQ ID NO: 251803 - protein, 9 aa, Homo Sapiens
MFFTSGSLL

SEQ ID NO: 251804 - protein, 9 aa, Homo Sapiens
CQAFCLLKA

SEQ ID NO: 251805 - protein, 9 aa, Homo Sapiens
YPSRQIAIG

SEQ ID NO: 251806 - protein, 9 aa, Homo Sapiens
MLSSQESMK

SEQ ID NO: 251807 - protein, 9 aa, Homo Sapiens
QNHAVLTAN

SEQ ID NO: 251808 - protein, 9 aa, Homo Sapiens
FCFLRKENK

SEQ ID NO: 251809 - protein, 9 aa, Homo Sapiens
SLKVFKMAA

SEQ ID NO: 251810 - protein, 9 aa, Homo Sapiens
PLTDIDSTL

SEQ ID NO: 251811 - protein, 9 aa, Homo Sapiens
ALFDIYAIV

SEQ ID NO: 251812 - protein, 9 aa, Homo Sapiens
IEAHEKYME

SEQ ID NO: 251813 - protein, 9 aa, Homo Sapiens
NLLINQIEN

SEQ ID NO: 251814 - protein, 9 aa, Homo Sapiens
MRGYHGDQG

SEQ ID NO: 251815 - protein, 9 aa, Homo Sapiens
IASCLYMLK

SEQ ID NO: 251816 - protein, 9 aa, Homo Sapiens
AADLEEELV

SEQ ID NO: 251817 - protein, 9 aa, Homo Sapiens
KGSDTFTYV

SEQ ID NO: 251818 - protein, 9 aa, Homo Sapiens
YKDVEDIIT

SEQ ID NO: 251819 - protein, 9 aa, Homo Sapiens
KCKSVHEIS

SEQ ID NO: 251820 - protein, 9 aa, Homo Sapiens
QIRNYQCIE

SEQ ID NO: 251821 - protein, 9 aa, Homo Sapiens
ISHPGNKSL

SEQ ID NO: 251822 - protein, 9 aa, Homo Sapiens
THHCLAHLL

SEQ ID NO: 251823 - protein, 9 aa, Homo Sapiens
LDNIKNPMH

SEQ ID NO: 251824 - protein, 9 aa, Homo Sapiens
HELPHELGE

SEQ ID NO: 251825 - protein, 9 aa, Homo Sapiens
PSHTQCIAD

SEQ ID NO: 251826 - protein, 9 aa, Homo Sapiens
SKAESPQCT

SEQ ID NO: 251827 - protein, 9 aa, Homo Sapiens
VFVYFWQAV

SEQ ID NO: 251828 - protein, 9 aa, Homo Sapiens
LDASQHISL

SEQ ID NO: 251829 - protein, 9 aa, Homo Sapiens
YEMFSLVMK

SEQ ID NO: 251830 - protein, 9 aa, Homo Sapiens
NAANQGLRG

SEQ ID NO: 251831 - protein, 9 aa, Homo Sapiens
GNIVFTGLS

SEQ ID NO: 251832 - protein, 9 aa, Homo Sapiens
RMQLVRGIR

SEQ ID NO: 251833 - protein, 9 aa, Homo Sapiens
GKALTSKIN

SEQ ID NO: 251834 - protein, 9 aa, Homo Sapiens
GSSRTVHQI

SEQ ID NO: 251835 - protein, 9 aa, Homo Sapiens
ESVSDHLGH

SEQ ID NO: 251836 - protein, 9 aa, Homo Sapiens
NQNKEDTTS

SEQ ID NO: 251837 - protein, 9 aa, Homo Sapiens
TFLIREMSG

SEQ ID NO: 251838 - protein, 9 aa, Homo Sapiens
MVYVFYTIL

SEQ ID NO: 251839 - protein, 9 aa, Homo Sapiens
QYCLFGNTV

SEQ ID NO: 251840 - protein, 9 aa, Homo Sapiens
VNNYPENTY

SEQ ID NO: 251841 - protein, 9 aa, Homo Sapiens
LFYRDRPAD

SEQ ID NO: 251842 - protein, 9 aa, Homo Sapiens
PPIQNGNFR

SEQ ID NO: 251843 - protein, 9 aa, Homo Sapiens
QTVGGVNYL

SEQ ID NO: 251844 - protein, 9 aa, Homo Sapiens
HNVHTAERP

SEQ ID NO: 251845 - protein, 9 aa, Homo Sapiens
ENFKVDIPD

SEQ ID NO: 251846 - protein, 9 aa, Homo Sapiens
FPLKLFLRY

SEQ ID NO: 251847 - protein, 9 aa, Homo Sapiens
GLSKTFPGI

SEQ ID NO: 251848 - protein, 9 aa, Homo Sapiens
HRAETLGAL

SEQ ID NO: 251849 - protein, 9 aa, Homo Sapiens
HYNCPGDNA

SEQ ID NO: 251850 - protein, 9 aa, Homo Sapiens
QSLVYGKKQ

SEQ ID NO: 251851 - protein, 9 aa, Homo Sapiens
QHDQRHDGN

SEQ ID NO: 251852 - protein, 9 aa, Homo Sapiens
SLEFSPGSN

SEQ ID NO: 251853 - protein, 9 aa, Homo Sapiens
RKWSKMNLT

SEQ ID NO: 251854 - protein, 9 aa, Homo Sapiens
WNQLFVLEE

SEQ ID NO: 251855 - protein, 9 aa, Homo Sapiens
SFIVARCRQ

SEQ ID NO: 251856 - protein, 9 aa, Homo Sapiens
FRNLKERGV

SEQ ID NO: 251857 - protein, 9 aa, Homo Sapiens
CPIDWIAFQ

SEQ ID NO: 251858 - protein, 9 aa, Homo Sapiens
TDFVDLGNV

SEQ ID NO: 251859 - protein, 9 aa, Homo Sapiens
GALLEQQNT

SEQ ID NO: 251860 - protein, 9 aa, Homo Sapiens
AQENYNAPD

SEQ ID NO: 251861 - protein, 9 aa, Homo Sapiens
LWAKLSAKK

SEQ ID NO: 251862 - protein, 9 aa, Homo Sapiens
SRLGQMGQD

SEQ ID NO: 251863 - protein, 9 aa, Homo Sapiens
DARWLGGQA

SEQ ID NO: 251864 - protein, 9 aa, Homo Sapiens
GTCQIPSLE

SEQ ID NO: 251865 - protein, 9 aa, Homo Sapiens
SLNLMEFNL

SEQ ID NO: 251866 - protein, 9 aa, Homo Sapiens
ITKSFNYSP

SEQ ID NO: 251867 - protein, 9 aa, Homo Sapiens
GWAIMHVSP

SEQ ID NO: 251868 - protein, 9 aa, Homo Sapiens
PFCGPNHIQ

SEQ ID NO: 251869 - protein, 9 aa, Homo Sapiens
CRSMRLLHC

SEQ ID NO: 251870 - protein, 9 aa, Homo Sapiens
LSIVRDKKC

SEQ ID NO: 251871 - protein, 9 aa, Homo Sapiens
VTPEIQTVP

SEQ ID NO: 251872 - protein, 9 aa, Homo Sapiens
EAANEDKSA

SEQ ID NO: 251873 - protein, 9 aa, Homo Sapiens
VLKRLSDVT

SEQ ID NO: 251874 - protein, 9 aa, Homo Sapiens
SARAVTVLK

SEQ ID NO: 251875 - protein, 9 aa, Homo Sapiens
QLSNQELAI

SEQ ID NO: 251876 - protein, 9 aa, Homo Sapiens
VPLCYLLGM

SEQ ID NO: 251877 - protein, 9 aa, Homo Sapiens
SALLDWRYL

SEQ ID NO: 251878 - protein, 9 aa, Homo Sapiens
PIPCVCDHS

SEQ ID NO: 251879 - protein, 9 aa, Homo Sapiens
IEAKEPEQQ

SEQ ID NO: 251880 - protein, 9 aa, Homo Sapiens
LSHVNMMAS

SEQ ID NO: 251881 - protein, 9 aa, Homo Sapiens
VGPSTRTPV

SEQ ID NO: 251882 - protein, 9 aa, Homo Sapiens
RRQLPASQE

SEQ ID NO: 251883 - protein, 9 aa, Homo Sapiens
SRHRKSHAG

SEQ ID NO: 251884 - protein, 9 aa, Homo Sapiens
SAVILNLWK

SEQ ID NO: 251885 - protein, 9 aa, Homo Sapiens
LEVLIEYPE

SEQ ID NO: 251886 - protein, 9 aa, Homo Sapiens
ESEDKEEAL

SEQ ID NO: 251887 - protein, 9 aa, Homo Sapiens
AERQSSKPK

SEQ ID NO: 251888 - protein, 9 aa, Homo Sapiens
CSQSGKLAS

SEQ ID NO: 251889 - protein, 9 aa, Homo Sapiens
IIYNYNPEK

SEQ ID NO: 251890 - protein, 9 aa, Homo Sapiens
WFTSFFHSE

SEQ ID NO: 251891 - protein, 9 aa, Homo Sapiens
KAQWANSFD

SEQ ID NO: 251892 - protein, 9 aa, Homo Sapiens
SVMLASIMS

SEQ ID NO: 251893 - protein, 9 aa, Homo Sapiens
MEEQHKCSL

SEQ ID NO: 251894 - protein, 9 aa, Homo Sapiens
GDPAGKHWL

SEQ ID NO: 251895 - protein, 9 aa, Homo Sapiens
RDHARTPEL

SEQ ID NO: 251896 - protein, 9 aa, Homo Sapiens
KAFDLDVAV

SEQ ID NO: 251897 - protein, 9 aa, Homo Sapiens
FKADRPLIY

SEQ ID NO: 251898 - protein, 9 aa, Homo Sapiens
VSALFRDNL

SEQ ID NO: 251899 - protein, 9 aa, Homo Sapiens
QLTPTGKED

SEQ ID NO: 251900 - protein, 9 aa, Homo Sapiens
SRKPGMCAA

SEQ ID NO: 251901 - protein, 9 aa, Homo Sapiens
LENQEKEDI

SEQ ID NO: 251902 - protein, 9 aa, Homo Sapiens
MTSYLIILH

SEQ ID NO: 251903 - protein, 9 aa, Homo Sapiens
CKGKRGSVC

SEQ ID NO: 251904 - protein, 9 aa, Homo Sapiens
DWQKTAKGA

SEQ ID NO: 251905 - protein, 9 aa, Homo Sapiens
SSGGPFKFK

SEQ ID NO: 251906 - protein, 9 aa, Homo Sapiens
ASVSHYELS

SEQ ID NO: 251907 - protein, 9 aa, Homo Sapiens
ELTRPQDTI

SEQ ID NO: 251908 - protein, 9 aa, Homo Sapiens
LAPEDHIEP

SEQ ID NO: 251909 - protein, 9 aa, Homo Sapiens
KHEMLLSKV

SEQ ID NO: 251910 - protein, 9 aa, Homo Sapiens
DFVPNEKKP

SEQ ID NO: 251911 - protein, 9 aa, Homo Sapiens
GSEGIKGQH

SEQ ID NO: 251912 - protein, 9 aa, Homo Sapiens
LNHGRLLPQ

SEQ ID NO: 251913 - protein, 9 aa, Homo Sapiens
QIVLAVHYC

SEQ ID NO: 251914 - protein, 9 aa, Homo Sapiens
KKPYQCDKC

SEQ ID NO: 251915 - protein, 9 aa, Homo Sapiens
ISNKLFQYA

SEQ ID NO: 251916 - protein, 9 aa, Homo Sapiens
SHFQSEIKR

SEQ ID NO: 251917 - protein, 9 aa, Homo Sapiens
FALKYRHRQ

SEQ ID NO: 251918 - protein, 9 aa, Homo Sapiens
GDSFLQVEI

SEQ ID NO: 251919 - protein, 9 aa, Homo Sapiens
TELYACIEN

SEQ ID NO: 251920 - protein, 9 aa, Homo Sapiens
EASNHVQEL

SEQ ID NO: 251921 - protein, 9 aa, Homo Sapiens
TRHKIMHTG

SEQ ID NO: 251922 - protein, 9 aa, Homo Sapiens
KTKLLIAAH

SEQ ID NO: 251923 - protein, 9 aa, Homo Sapiens
DPTFLPDND

SEQ ID NO: 251924 - protein, 9 aa, Homo Sapiens
TPQLSAELK

SEQ ID NO: 251925 - protein, 9 aa, Homo Sapiens
FQSDISFQN

SEQ ID NO: 251926 - protein, 9 aa, Homo Sapiens
VLASAKALV

SEQ ID NO: 251927 - protein, 9 aa, Homo Sapiens
NLAQQSLNM

SEQ ID NO: 251928 - protein, 9 aa, Homo Sapiens
GLYFCGQIE

SEQ ID NO: 251929 - protein, 9 aa, Homo Sapiens
FERYHALEK

SEQ ID NO: 251930 - protein, 9 aa, Homo Sapiens
HIRVHSANK

SEQ ID NO: 251931 - protein, 9 aa, Homo Sapiens
ALILAAHLA

SEQ ID NO: 251932 - protein, 9 aa, Homo Sapiens
EVAKNEFMQ

SEQ ID NO: 251933 - protein, 9 aa, Homo Sapiens
KIEEAQSQA

SEQ ID NO: 251934 - protein, 9 aa, Homo Sapiens
CVGPGPPRA

SEQ ID NO: 251935 - protein, 9 aa, Homo Sapiens
IWVQFIYPH

SEQ ID NO: 251936 - protein, 9 aa, Homo Sapiens
GKISFQEFL

SEQ ID NO: 251937 - protein, 9 aa, Homo Sapiens
WRLNSSEAQ

SEQ ID NO: 251938 - protein, 9 aa, Homo Sapiens
WMAPEALHF

SEQ ID NO: 251939 - protein, 9 aa, Homo Sapiens
HIEKYQRCR

SEQ ID NO: 251940 - protein, 9 aa, Homo Sapiens
DWQGQICYS

SEQ ID NO: 251941 - protein, 9 aa, Homo Sapiens
SMTSQEERN

SEQ ID NO: 251942 - protein, 9 aa, Homo Sapiens
AHQKPTPDL

SEQ ID NO: 251943 - protein, 9 aa, Homo Sapiens
SAPTVALNQ

SEQ ID NO: 251944 - protein, 9 aa, Homo Sapiens
FQNKLAAQL

SEQ ID NO: 251945 - protein, 9 aa, Homo Sapiens
GDYPKYIFS

SEQ ID NO: 251946 - protein, 9 aa, Homo Sapiens
LKNKLSCLW

SEQ ID NO: 251947 - protein, 9 aa, Homo Sapiens
GNHEASNHV

SEQ ID NO: 251948 - protein, 9 aa, Homo Sapiens
AKEEQQKAW

SEQ ID NO: 251949 - protein, 9 aa, Homo Sapiens
RYNSGIINT

SEQ ID NO: 251950 - protein, 9 aa, Homo Sapiens
PVPCINQVT

SEQ ID NO: 251951 - protein, 9 aa, Homo Sapiens
RDELFMEAI

SEQ ID NO: 251952 - protein, 9 aa, Homo Sapiens
LVNEQWILT

SEQ ID NO: 251953 - protein, 9 aa, Homo Sapiens
EIVNLLERS

SEQ ID NO: 251954 - protein, 9 aa, Homo Sapiens
AGAGRQLTG

SEQ ID NO: 251955 - protein, 9 aa, Homo Sapiens
IGKPGAEGC

SEQ ID NO: 251956 - protein, 9 aa, Homo Sapiens
LSSQESMKV

SEQ ID NO: 251957 - protein, 9 aa, Homo Sapiens
RLGFIFVVN

SEQ ID NO: 251958 - protein, 9 aa, Homo Sapiens
GQFRKAEQF

SEQ ID NO: 251959 - protein, 9 aa, Homo Sapiens
AAPGDPSGF

SEQ ID NO: 251960 - protein, 9 aa, Homo Sapiens
LQIILEKVA

SEQ ID NO: 251961 - protein, 9 aa, Homo Sapiens
YCIPIGHWI

SEQ ID NO: 251962 - protein, 9 aa, Homo Sapiens
SNKLSKIPA

SEQ ID NO: 251963 - protein, 9 aa, Homo Sapiens
KQTPLFQPN

SEQ ID NO: 251964 - protein, 9 aa, Homo Sapiens
INLSKRQVP

SEQ ID NO: 251965 - protein, 9 aa, Homo Sapiens
AGAAQMKTL

SEQ ID NO: 251966 - protein, 9 aa, Homo Sapiens
LPTLSAHII

SEQ ID NO: 251967 - protein, 9 aa, Homo Sapiens
YSADETEDE

SEQ ID NO: 251968 - protein, 9 aa, Homo Sapiens
QVCGFWSRL

SEQ ID NO: 251969 - protein, 9 aa, Homo Sapiens
IQTSRNIDP

SEQ ID NO: 251970 - protein, 9 aa, Homo Sapiens
MSGGLCMCG

SEQ ID NO: 251971 - protein, 9 aa, Homo Sapiens
NCLKHHVIQ

SEQ ID NO: 251972 - protein, 9 aa, Homo Sapiens
VIKIKSILD

SEQ ID NO: 251973 - protein, 9 aa, Homo Sapiens
DVLQRCQEY

SEQ ID NO: 251974 - protein, 9 aa, Homo Sapiens
INAIVDFSS

SEQ ID NO: 251975 - protein, 9 aa, Homo Sapiens
LGGMASTFG

SEQ ID NO: 251976 - protein, 9 aa, Homo Sapiens
ASPLSSDYP

SEQ ID NO: 251977 - protein, 9 aa, Homo Sapiens
LSAPREMPK

SEQ ID NO: 251978 - protein, 9 aa, Homo Sapiens
NTYLEDMKT

SEQ ID NO: 251979 - protein, 9 aa, Homo Sapiens
AEDTNFCIQ

SEQ ID NO: 251980 - protein, 9 aa, Homo Sapiens
LPRASSIST

SEQ ID NO: 251981 - protein, 9 aa, Homo Sapiens
DFQTLLFKR

SEQ ID NO: 251982 - protein, 9 aa, Homo Sapiens
LKMDLLQGA

SEQ ID NO: 251983 - protein, 9 aa, Homo Sapiens
HIRMESLFN

SEQ ID NO: 251984 - protein, 9 aa, Homo Sapiens
ALQDSSLPN

SEQ ID NO: 251985 - protein, 9 aa, Homo Sapiens
FLSLDHPSA

SEQ ID NO: 251986 - protein, 9 aa, Homo Sapiens
KGEAIGFHS

SEQ ID NO: 251987 - protein, 9 aa, Homo Sapiens
AAAVGLAQS

SEQ ID NO: 251988 - protein, 9 aa, Homo Sapiens
IQSVKKLYD

SEQ ID NO: 251989 - protein, 9 aa, Homo Sapiens
RDHFRGKAM

SEQ ID NO: 251990 - protein, 9 aa, Homo Sapiens
NMQNSAFPP

SEQ ID NO: 251991 - protein, 9 aa, Homo Sapiens
KPELTIIAL

SEQ ID NO: 251992 - protein, 9 aa, Homo Sapiens
ETPFVKMLP

SEQ ID NO: 251993 - protein, 9 aa, Homo Sapiens
LSILVHPDT

SEQ ID NO: 251994 - protein, 9 aa, Homo Sapiens
KILYYCKGI

SEQ ID NO: 251995 - protein, 9 aa, Homo Sapiens
NMHIKEEKL

SEQ ID NO: 251996 - protein, 9 aa, Homo Sapiens
EYKEHGPFF

SEQ ID NO: 251997 - protein, 9 aa, Homo Sapiens
VAFAHGNIY

SEQ ID NO: 251998 - protein, 9 aa, Homo Sapiens
LGFSVGEKC

SEQ ID NO: 251999 - protein, 9 aa, Homo Sapiens
HIMWSQRDP

SEQ ID NO: 252000 - protein, 9 aa, Homo Sapiens
NYEKIRTFA

SEQ ID NO: 252001 - protein, 9 aa, Homo Sapiens
DEEPTPVCG

SEQ ID NO: 252002 - protein, 9 aa, Homo Sapiens
EEKAREDKS

SEQ ID NO: 252003 - protein, 9 aa, Homo Sapiens
FLARVSPSP

SEQ ID NO: 252004 - protein, 9 aa, Homo Sapiens
REYQPKPQM

SEQ ID NO: 252005 - protein, 9 aa, Homo Sapiens
IGSCVKITI

SEQ ID NO: 252006 - protein, 9 aa, Homo Sapiens
MIGNYAVWF

SEQ ID NO: 252007 - protein, 9 aa, Homo Sapiens
PQEELDLFL

SEQ ID NO: 252008 - protein, 9 aa, Homo Sapiens
QDAPVTTNN

SEQ ID NO: 252009 - protein, 9 aa, Homo Sapiens
CYVNGLCVP

SEQ ID NO: 252010 - protein, 9 aa, Homo Sapiens
YISCDRGYL

SEQ ID NO: 252011 - protein, 9 aa, Homo Sapiens
ETLSCIFPE

SEQ ID NO: 252012 - protein, 9 aa, Homo Sapiens
LTLNNYQVF

SEQ ID NO: 252013 - protein, 9 aa, Homo Sapiens
IWDNFHYWA

SEQ ID NO: 252014 - protein, 9 aa, Homo Sapiens
SENTDCLAP

SEQ ID NO: 252015 - protein, 9 aa, Homo Sapiens
GVNSGVMLI

SEQ ID NO: 252016 - protein, 9 aa, Homo Sapiens
GKDRSPLST

SEQ ID NO: 252017 - protein, 9 aa, Homo Sapiens
LGEGGGEGG

SEQ ID NO: 252018 - protein, 9 aa, Homo Sapiens
NGQFVRVLG

SEQ ID NO: 252019 - protein, 9 aa, Homo Sapiens
LVPLQIILE

SEQ ID NO: 252020 - protein, 9 aa, Homo Sapiens
SVRQRQLQQ

SEQ ID NO: 252021 - protein, 9 aa, Homo Sapiens
VEDSKTLAT

SEQ ID NO: 252022 - protein, 9 aa, Homo Sapiens
MGNVGMILI

SEQ ID NO: 252023 - protein, 9 aa, Homo Sapiens
QVKTNTSQE

SEQ ID NO: 252024 - protein, 9 aa, Homo Sapiens
TPERDSLMC

SEQ ID NO: 252025 - protein, 9 aa, Homo Sapiens
NETILALKE

SEQ ID NO: 252026 - protein, 9 aa, Homo Sapiens
LFCCHKGPK

SEQ ID NO: 252027 - protein, 9 aa, Homo Sapiens
AVRLQESDY

SEQ ID NO: 252028 - protein, 9 aa, Homo Sapiens
VPASKPPRA

SEQ ID NO: 252029 - protein, 9 aa, Homo Sapiens
KTAFNVEEA

SEQ ID NO: 252030 - protein, 9 aa, Homo Sapiens
IFLQVIDRL

SEQ ID NO: 252031 - protein, 9 aa, Homo Sapiens
PTFDPTEVL

SEQ ID NO: 252032 - protein, 9 aa, Homo Sapiens
LESLNSGYE

SEQ ID NO: 252033 - protein, 9 aa, Homo Sapiens
YKQFSCLTL

SEQ ID NO: 252034 - protein, 9 aa, Homo Sapiens
KFNPIETFI

SEQ ID NO: 252035 - protein, 9 aa, Homo Sapiens
DSIIVGRGI

SEQ ID NO: 252036 - protein, 9 aa, Homo Sapiens
QLQLERQLI

SEQ ID NO: 252037 - protein, 9 aa, Homo Sapiens
RTRKKRERH

SEQ ID NO: 252038 - protein, 9 aa, Homo Sapiens
ESNIFERAT

SEQ ID NO: 252039 - protein, 9 aa, Homo Sapiens
PQRSFNNFT

SEQ ID NO: 252040 - protein, 9 aa, Homo Sapiens
PTSETLGHG

SEQ ID NO: 252041 - protein, 9 aa, Homo Sapiens
EMFINASKQ

SEQ ID NO: 252042 - protein, 9 aa, Homo Sapiens
EKDKHKHEK

SEQ ID NO: 252043 - protein, 9 aa, Homo Sapiens
ASQVTHTLD

SEQ ID NO: 252044 - protein, 9 aa, Homo Sapiens
TALLLLKDI

SEQ ID NO: 252045 - protein, 9 aa, Homo Sapiens
RRPQQELHN

SEQ ID NO: 252046 - protein, 9 aa, Homo Sapiens
ILLGGYLLF

SEQ ID NO: 252047 - protein, 9 aa, Homo Sapiens
KKRNMLNAG

SEQ ID NO: 252048 - protein, 9 aa, Homo Sapiens
ASAKNHNYF

SEQ ID NO: 252049 - protein, 9 aa, Homo Sapiens
ESSLPAPSK

SEQ ID NO: 252050 - protein, 9 aa, Homo Sapiens
DEVGKRWQE

SEQ ID NO: 252051 - protein, 9 aa, Homo Sapiens
FFQKHGKMH

SEQ ID NO: 252052 - protein, 9 aa, Homo Sapiens
LLYAQNVVQ

SEQ ID NO: 252053 - protein, 9 aa, Homo Sapiens
QVGICQDCI

SEQ ID NO: 252054 - protein, 9 aa, Homo Sapiens
ISLAFPVNT

SEQ ID NO: 252055 - protein, 9 aa, Homo Sapiens
LQEALDLCT

SEQ ID NO: 252056 - protein, 9 aa, Homo Sapiens
TEDIWESLE

SEQ ID NO: 252057 - protein, 9 aa, Homo Sapiens
KFLINKKAN

SEQ ID NO: 252058 - protein, 9 aa, Homo Sapiens
AVIYAYMNF

SEQ ID NO: 252059 - protein, 9 aa, Homo Sapiens
QFIGVYFVS

SEQ ID NO: 252060 - protein, 9 aa, Homo Sapiens
HISKLAECI

SEQ ID NO: 252061 - protein, 9 aa, Homo Sapiens
DCQRDKVIT

SEQ ID NO: 252062 - protein, 9 aa, Homo Sapiens
KGNLYKFQA

SEQ ID NO: 252063 - protein, 9 aa, Homo Sapiens
KVSACHFLW

SEQ ID NO: 252064 - protein, 9 aa, Homo Sapiens
FSHSGSLQI

SEQ ID NO: 252065 - protein, 9 aa, Homo Sapiens
GIQAKLERV

SEQ ID NO: 252066 - protein, 9 aa, Homo Sapiens
HWTPPRGHV

SEQ ID NO: 252067 - protein, 9 aa, Homo Sapiens
SGEVYWEAV

SEQ ID NO: 252068 - protein, 9 aa, Homo Sapiens
VPPDIQKMK

SEQ ID NO: 252069 - protein, 9 aa, Homo Sapiens
INGRYLQNP

SEQ ID NO: 252070 - protein, 9 aa, Homo Sapiens
VNKLDREKE

SEQ ID NO: 252071 - protein, 9 aa, Homo Sapiens
RMSPYLVSI

SEQ ID NO: 252072 - protein, 9 aa, Homo Sapiens
GESFTFQIY

SEQ ID NO: 252073 - protein, 9 aa, Homo Sapiens
CCCQSEMFK

SEQ ID NO: 252074 - protein, 9 aa, Homo Sapiens
CTECGKHFR

SEQ ID NO: 252075 - protein, 9 aa, Homo Sapiens
CVIPTSDPV

SEQ ID NO: 252076 - protein, 9 aa, Homo Sapiens
NIQLLKDMQ

SEQ ID NO: 252077 - protein, 9 aa, Homo Sapiens
ALKSETFSF

SEQ ID NO: 252078 - protein, 9 aa, Homo Sapiens
VLYVVKPLN

SEQ ID NO: 252079 - protein, 9 aa, Homo Sapiens
IELDHERMS

SEQ ID NO: 252080 - protein, 9 aa, Homo Sapiens
MTCYQQQSR

SEQ ID NO: 252081 - protein, 9 aa, Homo Sapiens
CKQVIQRED

SEQ ID NO: 252082 - protein, 9 aa, Homo Sapiens
CCPIDWIAF

SEQ ID NO: 252083 - protein, 9 aa, Homo Sapiens
HNTYLEDMK

SEQ ID NO: 252084 - protein, 9 aa, Homo Sapiens
ALQDKKAHS

SEQ ID NO: 252085 - protein, 9 aa, Homo Sapiens
LEISGGFGK

SEQ ID NO: 252086 - protein, 9 aa, Homo Sapiens
SLTTASLME

SEQ ID NO: 252087 - protein, 9 aa, Homo Sapiens
PLSGCSTPS

SEQ ID NO: 252088 - protein, 9 aa, Homo Sapiens
EEKHCMCRN

SEQ ID NO: 252089 - protein, 9 aa, Homo Sapiens
KIIGVVSQE

SEQ ID NO: 252090 - protein, 9 aa, Homo Sapiens
VPQLSLYKH

SEQ ID NO: 252091 - protein, 9 aa, Homo Sapiens
LSLVLCLTI

SEQ ID NO: 252092 - protein, 9 aa, Homo Sapiens
DRYKMEDGK

SEQ ID NO: 252093 - protein, 9 aa, Homo Sapiens
GAYIVFGEA

SEQ ID NO: 252094 - protein, 9 aa, Homo Sapiens
LGGYSPPRK

SEQ ID NO: 252095 - protein, 9 aa, Homo Sapiens
RKWTLDLES

SEQ ID NO: 252096 - protein, 9 aa, Homo Sapiens
TFIQRDDTE

SEQ ID NO: 252097 - protein, 9 aa, Homo Sapiens
YCKRQLMEK

SEQ ID NO: 252098 - protein, 9 aa, Homo Sapiens
LLGSEDCKL

SEQ ID NO: 252099 - protein, 9 aa, Homo Sapiens
SLAAQHVES

SEQ ID NO: 252100 - protein, 9 aa, Homo Sapiens
SLRIGANWR

SEQ ID NO: 252101 - protein, 9 aa, Homo Sapiens
SSGFPEAGG

SEQ ID NO: 252102 - protein, 9 aa, Homo Sapiens
ILHYLLCDD

SEQ ID NO: 252103 - protein, 9 aa, Homo Sapiens
RDNEHGVAS

SEQ ID NO: 252104 - protein, 9 aa, Homo Sapiens
NAGDIPCCS

SEQ ID NO: 252105 - protein, 9 aa, Homo Sapiens
EPKASMKQY

SEQ ID NO: 252106 - protein, 9 aa, Homo Sapiens
EKKKEKGKS

SEQ ID NO: 252107 - protein, 9 aa, Homo Sapiens
LNNYQVFPM

SEQ ID NO: 252108 - protein, 9 aa, Homo Sapiens
KGSSLPAHG

SEQ ID NO: 252109 - protein, 9 aa, Homo Sapiens
LPPPLTDID

SEQ ID NO: 252110 - protein, 9 aa, Homo Sapiens
SAFSPSSDY

SEQ ID NO: 252111 - protein, 9 aa, Homo Sapiens
QRMWNYMQL

SEQ ID NO: 252112 - protein, 9 aa, Homo Sapiens
NFQEEIEFR

SEQ ID NO: 252113 - protein, 9 aa, Homo Sapiens
QLTTDPDLI

SEQ ID NO: 252114 - protein, 9 aa, Homo Sapiens
TDDITTSLR

SEQ ID NO: 252115 - protein, 9 aa, Homo Sapiens
TLVDKMQDR

SEQ ID NO: 252116 - protein, 9 aa, Homo Sapiens
DGLSNRIQN

SEQ ID NO: 252117 - protein, 9 aa, Homo Sapiens
SYQPIKVAT

SEQ ID NO: 252118 - protein, 9 aa, Homo Sapiens
TLFPTKQSL

SEQ ID NO: 252119 - protein, 9 aa, Homo Sapiens
IYVGEVVLA

SEQ ID NO: 252120 - protein, 9 aa, Homo Sapiens
IGHLVFTSI

SEQ ID NO: 252121 - protein, 9 aa, Homo Sapiens
VWHQNGGCN

SEQ ID NO: 252122 - protein, 9 aa, Homo Sapiens
IVIKQGEGY

SEQ ID NO: 252123 - protein, 9 aa, Homo Sapiens
ACHFLWKLH

SEQ ID NO: 252124 - protein, 9 aa, Homo Sapiens
TYKTIKQYQ

SEQ ID NO: 252125 - protein, 9 aa, Homo Sapiens
DVGSLDEKR

SEQ ID NO: 252126 - protein, 9 aa, Homo Sapiens
DGHQLFDLY

SEQ ID NO: 252127 - protein, 9 aa, Homo Sapiens
PDRKDVAQD

SEQ ID NO: 252128 - protein, 9 aa, Homo Sapiens
AVGAMTDAV

SEQ ID NO: 252129 - protein, 9 aa, Homo Sapiens
NLSSSAGYL

SEQ ID NO: 252130 - protein, 9 aa, Homo Sapiens
TLTAISMSA

SEQ ID NO: 252131 - protein, 9 aa, Homo Sapiens
KSVIRVLWG

SEQ ID NO: 252132 - protein, 9 aa, Homo Sapiens
KLSTYIQLY

SEQ ID NO: 252133 - protein, 9 aa, Homo Sapiens
PSIMKKRCG

SEQ ID NO: 252134 - protein, 9 aa, Homo Sapiens
RHSIRKINI

SEQ ID NO: 252135 - protein, 9 aa, Homo Sapiens
PKENETVVL

SEQ ID NO: 252136 - protein, 9 aa, Homo Sapiens
SPPKQAKAV

SEQ ID NO: 252137 - protein, 9 aa, Homo Sapiens
DLIAYVSND

SEQ ID NO: 252138 - protein, 9 aa, Homo Sapiens
DWKSKEMQV

SEQ ID NO: 252139 - protein, 9 aa, Homo Sapiens
QVRQRAVAL

SEQ ID NO: 252140 - protein, 9 aa, Homo Sapiens
SRLRVPLLH

SEQ ID NO: 252141 - protein, 9 aa, Homo Sapiens
KWKSQHQED

SEQ ID NO: 252142 - protein, 9 aa, Homo Sapiens
GEGNTTQIF

SEQ ID NO: 252143 - protein, 9 aa, Homo Sapiens
NKKRAKELE

SEQ ID NO: 252144 - protein, 9 aa, Homo Sapiens
EVKIYCQVE

SEQ ID NO: 252145 - protein, 9 aa, Homo Sapiens
ISLVYRVLL

SEQ ID NO: 252146 - protein, 9 aa, Homo Sapiens
VEMKQNFEN

SEQ ID NO: 252147 - protein, 9 aa, Homo Sapiens
DINRTSTLN

SEQ ID NO: 252148 - protein, 9 aa, Homo Sapiens
NDMQNILDL

SEQ ID NO: 252149 - protein, 9 aa, Homo Sapiens
KLFLLHHKH

SEQ ID NO: 252150 - protein, 9 aa, Homo Sapiens
PDVGVNLLQ

SEQ ID NO: 252151 - protein, 9 aa, Homo Sapiens
LDGETNLKC

SEQ ID NO: 252152 - protein, 9 aa, Homo Sapiens
AELKLLQKV

SEQ ID NO: 252153 - protein, 9 aa, Homo Sapiens
SKTTSKKRG

SEQ ID NO: 252154 - protein, 9 aa, Homo Sapiens
LKTNVVRVW

SEQ ID NO: 252155 - protein, 9 aa, Homo Sapiens
RKKMLDKAR

SEQ ID NO: 252156 - protein, 9 aa, Homo Sapiens
LAKQTNIEY

SEQ ID NO: 252157 - protein, 9 aa, Homo Sapiens
FNLDPIQNN

SEQ ID NO: 252158 - protein, 9 aa, Homo Sapiens
FTHTSFYKE

SEQ ID NO: 252159 - protein, 9 aa, Homo Sapiens
EECKALSHS

SEQ ID NO: 252160 - protein, 9 aa, Homo Sapiens
WVPARGGGE

SEQ ID NO: 252161 - protein, 9 aa, Homo Sapiens
QFMLTITHT

SEQ ID NO: 252162 - protein, 9 aa, Homo Sapiens
DTFYQQFHI

SEQ ID NO: 252163 - protein, 9 aa, Homo Sapiens
MKAAKPAGD

SEQ ID NO: 252164 - protein, 9 aa, Homo Sapiens
ISRLYNATN

SEQ ID NO: 252165 - protein, 9 aa, Homo Sapiens
IAAGQSVVY

SEQ ID NO: 252166 - protein, 9 aa, Homo Sapiens
SPTQISEHV

SEQ ID NO: 252167 - protein, 9 aa, Homo Sapiens
HMKYRDSTP

SEQ ID NO: 252168 - protein, 9 aa, Homo Sapiens
TPGPGIKLY

SEQ ID NO: 252169 - protein, 9 aa, Homo Sapiens
HYKAPAVVL

SEQ ID NO: 252170 - protein, 9 aa, Homo Sapiens
LLSQDQLPP

SEQ ID NO: 252171 - protein, 9 aa, Homo Sapiens
VGIIEELED

SEQ ID NO: 252172 - protein, 9 aa, Homo Sapiens
TTMCIYVSL

SEQ ID NO: 252173 - protein, 9 aa, Homo Sapiens
EYLSANDVF

SEQ ID NO: 252174 - protein, 9 aa, Homo Sapiens
QHQEVWGKM

SEQ ID NO: 252175 - protein, 9 aa, Homo Sapiens
FRVKFVVSD

SEQ ID NO: 252176 - protein, 9 aa, Homo Sapiens
ISKDDLIAY

SEQ ID NO: 252177 - protein, 9 aa, Homo Sapiens
FLPDNDSLF

SEQ ID NO: 252178 - protein, 9 aa, Homo Sapiens
WLRHPGILE

SEQ ID NO: 252179 - protein, 9 aa, Homo Sapiens
CESENSKVF

SEQ ID NO: 252180 - protein, 9 aa, Homo Sapiens
MAVRLTTRS

SEQ ID NO: 252181 - protein, 9 aa, Homo Sapiens
TSYTMLVDW

SEQ ID NO: 252182 - protein, 9 aa, Homo Sapiens
TSSSRQRPS

SEQ ID NO: 252183 - protein, 9 aa, Homo Sapiens
VLCRIHYNT

SEQ ID NO: 252184 - protein, 9 aa, Homo Sapiens
SDNEEYVIE

SEQ ID NO: 252185 - protein, 9 aa, Homo Sapiens
DSGGGNIKY

SEQ ID NO: 252186 - protein, 9 aa, Homo Sapiens
DTSTTTSRV

SEQ ID NO: 252187 - protein, 9 aa, Homo Sapiens
SLNYKYFSK

SEQ ID NO: 252188 - protein, 9 aa, Homo Sapiens
QRCVVQIRS

SEQ ID NO: 252189 - protein, 9 aa, Homo Sapiens
YLLLKKILL

SEQ ID NO: 252190 - protein, 9 aa, Homo Sapiens
GRQVDSRGV

SEQ ID NO: 252191 - protein, 9 aa, Homo Sapiens
ALSQMDIIF

SEQ ID NO: 252192 - protein, 9 aa, Homo Sapiens
VEPNNHHHF

SEQ ID NO: 252193 - protein, 9 aa, Homo Sapiens
QEIPHTGKK

SEQ ID NO: 252194 - protein, 9 aa, Homo Sapiens
SVLPCLGVH

SEQ ID NO: 252195 - protein, 9 aa, Homo Sapiens
AIMSPGQKS

SEQ ID NO: 252196 - protein, 9 aa, Homo Sapiens
NQETSNFCS

SEQ ID NO: 252197 - protein, 9 aa, Homo Sapiens
KKLMAKCQM

SEQ ID NO: 252198 - protein, 9 aa, Homo Sapiens
DSEKKLSPE

SEQ ID NO: 252199 - protein, 9 aa, Homo Sapiens
VFIILLTID

SEQ ID NO: 252200 - protein, 9 aa, Homo Sapiens
TERTIQLNI

SEQ ID NO: 252201 - protein, 9 aa, Homo Sapiens
KNDFGGHRG

SEQ ID NO: 252202 - protein, 9 aa, Homo Sapiens
NSSGAVESA

SEQ ID NO: 252203 - protein, 9 aa, Homo Sapiens
RINRRTIGV

SEQ ID NO: 252204 - protein, 9 aa, Homo Sapiens
GNQTKNVYI

SEQ ID NO: 252205 - protein, 9 aa, Homo Sapiens
FMMDNQLTK

SEQ ID NO: 252206 - protein, 9 aa, Homo Sapiens
HCDCYTGAD

SEQ ID NO: 252207 - protein, 9 aa, Homo Sapiens
KNLSSLKLC

SEQ ID NO: 252208 - protein, 9 aa, Homo Sapiens
ISNKSYVHS

SEQ ID NO: 252209 - protein, 9 aa, Homo Sapiens
AWAEVAEVE

SEQ ID NO: 252210 - protein, 9 aa, Homo Sapiens
PKVSFCGRR

SEQ ID NO: 252211 - protein, 9 aa, Homo Sapiens
DVKGEYDVT

SEQ ID NO: 252212 - protein, 9 aa, Homo Sapiens
DYEIIEVVL

SEQ ID NO: 252213 - protein, 9 aa, Homo Sapiens
EAEDIYKSE

SEQ ID NO: 252214 - protein, 9 aa, Homo Sapiens
LKLSPFSTI

SEQ ID NO: 252215 - protein, 9 aa, Homo Sapiens
LYEATTGNR

SEQ ID NO: 252216 - protein, 9 aa, Homo Sapiens
ERSLQSWVE

SEQ ID NO: 252217 - protein, 9 aa, Homo Sapiens
LLSISTFQQ

SEQ ID NO: 252218 - protein, 9 aa, Homo Sapiens
RSDNEMCKL

SEQ ID NO: 252219 - protein, 9 aa, Homo Sapiens
EKLEEETEN

SEQ ID NO: 252220 - protein, 9 aa, Homo Sapiens
ILQAVSKGP

SEQ ID NO: 252221 - protein, 9 aa, Homo Sapiens
IINENEKGK

SEQ ID NO: 252222 - protein, 9 aa, Homo Sapiens
LEEAIRISL

SEQ ID NO: 252223 - protein, 9 aa, Homo Sapiens
SLKDEIIQA

SEQ ID NO: 252224 - protein, 9 aa, Homo Sapiens
LFMGLACSD

SEQ ID NO: 252225 - protein, 9 aa, Homo Sapiens
EVISHPERF

SEQ ID NO: 252226 - protein, 9 aa, Homo Sapiens
QNTGFHYDV

SEQ ID NO: 252227 - protein, 9 aa, Homo Sapiens
NAIYVKPAN

SEQ ID NO: 252228 - protein, 9 aa, Homo Sapiens
VYMPDVWTI

SEQ ID NO: 252229 - protein, 9 aa, Homo Sapiens
CQDNIIRLM

SEQ ID NO: 252230 - protein, 9 aa, Homo Sapiens
EDCKLNNGR

SEQ ID NO: 252231 - protein, 9 aa, Homo Sapiens
LKNMALFGL

SEQ ID NO: 252232 - protein, 9 aa, Homo Sapiens
PDGFQLDGN

SEQ ID NO: 252233 - protein, 9 aa, Homo Sapiens
RNQIYIQVS

SEQ ID NO: 252234 - protein, 9 aa, Homo Sapiens
LLGHPDNSV

SEQ ID NO: 252235 - protein, 9 aa, Homo Sapiens
KEERPRQQN

SEQ ID NO: 252236 - protein, 9 aa, Homo Sapiens
TLYQFIQLY

SEQ ID NO: 252237 - protein, 9 aa, Homo Sapiens
FQKYFVKYC

SEQ ID NO: 252238 - protein, 9 aa, Homo Sapiens
KPNTRSSQF

SEQ ID NO: 252239 - protein, 9 aa, Homo Sapiens
SYDIGNVTY

SEQ ID NO: 252240 - protein, 9 aa, Homo Sapiens
VTSAQVMKP

SEQ ID NO: 252241 - protein, 9 aa, Homo Sapiens
SLREKAKNV

SEQ ID NO: 252242 - protein, 9 aa, Homo Sapiens
VGEGIFYCC

SEQ ID NO: 252243 - protein, 9 aa, Homo Sapiens
RGEGTALPF

SEQ ID NO: 252244 - protein, 9 aa, Homo Sapiens
MYWAKEDGM

SEQ ID NO: 252245 - protein, 9 aa, Homo Sapiens
SQVQIAGNQ

SEQ ID NO: 252246 - protein, 9 aa, Homo Sapiens
GISRNLLWL

SEQ ID NO: 252247 - protein, 9 aa, Homo Sapiens
GMLTVVNKL

SEQ ID NO: 252248 - protein, 9 aa, Homo Sapiens
ERPQKINGI

SEQ ID NO: 252249 - protein, 9 aa, Homo Sapiens
RDQSVSVQE

SEQ ID NO: 252250 - protein, 9 aa, Homo Sapiens
YVKTSEKLE

SEQ ID NO: 252251 - protein, 9 aa, Homo Sapiens
FILKGLTHQ

SEQ ID NO: 252252 - protein, 9 aa, Homo Sapiens
HPTGSSQSC

SEQ ID NO: 252253 - protein, 9 aa, Homo Sapiens
QFGTPQDSP

SEQ ID NO: 252254 - protein, 9 aa, Homo Sapiens
GDLGDSSAS

SEQ ID NO: 252255 - protein, 9 aa, Homo Sapiens
YCVNGVGTQ

SEQ ID NO: 252256 - protein, 9 aa, Homo Sapiens
DCLHLNIYT

SEQ ID NO: 252257 - protein, 9 aa, Homo Sapiens
FIITRYKIK

SEQ ID NO: 252258 - protein, 9 aa, Homo Sapiens
RFHFVNDQW

SEQ ID NO: 252259 - protein, 9 aa, Homo Sapiens
GKRNGKNHV

SEQ ID NO: 252260 - protein, 9 aa, Homo Sapiens
SQGHSIFQI

SEQ ID NO: 252261 - protein, 9 aa, Homo Sapiens
RESKWKREL

SEQ ID NO: 252262 - protein, 9 aa, Homo Sapiens
KCQMLIQEN

SEQ ID NO: 252263 - protein, 9 aa, Homo Sapiens
SPKTMKTFL

SEQ ID NO: 252264 - protein, 9 aa, Homo Sapiens
PDGSALFNM

SEQ ID NO: 252265 - protein, 9 aa, Homo Sapiens
YIANLFLIY

SEQ ID NO: 252266 - protein, 9 aa, Homo Sapiens
QASGPNNVP

SEQ ID NO: 252267 - protein, 9 aa, Homo Sapiens
KYLTKKHLK

SEQ ID NO: 252268 - protein, 9 aa, Homo Sapiens
AQFTLGSPL

SEQ ID NO: 252269 - protein, 9 aa, Homo Sapiens
GLRSALEDS

SEQ ID NO: 252270 - protein, 9 aa, Homo Sapiens
PASSLPMLT

SEQ ID NO: 252271 - protein, 9 aa, Homo Sapiens
EGIIEEDEE

SEQ ID NO: 252272 - protein, 9 aa, Homo Sapiens
FLDRLWTTT

SEQ ID NO: 252273 - protein, 9 aa, Homo Sapiens
LGGRALLLQ

SEQ ID NO: 252274 - protein, 9 aa, Homo Sapiens
AKAVLKTLQ

SEQ ID NO: 252275 - protein, 9 aa, Homo Sapiens
VSFLAVSSQ

SEQ ID NO: 252276 - protein, 9 aa, Homo Sapiens
LSDSHHSPS

SEQ ID NO: 252277 - protein, 9 aa, Homo Sapiens
REKTLAQIL

SEQ ID NO: 252278 - protein, 9 aa, Homo Sapiens
GVDGCNQVD

SEQ ID NO: 252279 - protein, 9 aa, Homo Sapiens
LTLNPEHQE

SEQ ID NO: 252280 - protein, 9 aa, Homo Sapiens
QIRQKKAQG

SEQ ID NO: 252281 - protein, 9 aa, Homo Sapiens
LALATNSAP

SEQ ID NO: 252282 - protein, 9 aa, Homo Sapiens
SSIKGSNNS

SEQ ID NO: 252283 - protein, 9 aa, Homo Sapiens
LTHIASGTS

SEQ ID NO: 252284 - protein, 9 aa, Homo Sapiens
ARNAVIHIP

SEQ ID NO: 252285 - protein, 9 aa, Homo Sapiens
DNKLPVVEK

SEQ ID NO: 252286 - protein, 9 aa, Homo Sapiens
PELIWPFIL

SEQ ID NO: 252287 - protein, 9 aa, Homo Sapiens
VVRGKKYLM

SEQ ID NO: 252288 - protein, 9 aa, Homo Sapiens
FLPKTHPHG

SEQ ID NO: 252289 - protein, 9 aa, Homo Sapiens
FQSQGLGRL

SEQ ID NO: 252290 - protein, 9 aa, Homo Sapiens
NRNKKTEGT

SEQ ID NO: 252291 - protein, 9 aa, Homo Sapiens
GEGGSGASD

SEQ ID NO: 252292 - protein, 9 aa, Homo Sapiens
LHCSLQRLM

SEQ ID NO: 252293 - protein, 9 aa, Homo Sapiens
LIGQYVITV

SEQ ID NO: 252294 - protein, 9 aa, Homo Sapiens
LKAKKKELE

SEQ ID NO: 252295 - protein, 9 aa, Homo Sapiens
FSKKIRQPI

SEQ ID NO: 252296 - protein, 9 aa, Homo Sapiens
EEHTLAVEI

SEQ ID NO: 252297 - protein, 9 aa, Homo Sapiens
ANIQQHQRQ

SEQ ID NO: 252298 - protein, 9 aa, Homo Sapiens
DNRVFTDSE

SEQ ID NO: 252299 - protein, 9 aa, Homo Sapiens
NNLNQETSN

SEQ ID NO: 252300 - protein, 9 aa, Homo Sapiens
GVPVPRGLP

SEQ ID NO: 252301 - protein, 9 aa, Homo Sapiens
RELSRMSRS

SEQ ID NO: 252302 - protein, 9 aa, Homo Sapiens
DVNYHPPQF

SEQ ID NO: 252303 - protein, 9 aa, Homo Sapiens
QFYISANIQ

SEQ ID NO: 252304 - protein, 9 aa, Homo Sapiens
PKLTPKGAC

SEQ ID NO: 252305 - protein, 9 aa, Homo Sapiens
ELNEYQSNE

SEQ ID NO: 252306 - protein, 9 aa, Homo Sapiens
VIQERLKTS

SEQ ID NO: 252307 - protein, 9 aa, Homo Sapiens
EYKDAPGTL

SEQ ID NO: 252308 - protein, 9 aa, Homo Sapiens
PLYGTVCFG

SEQ ID NO: 252309 - protein, 9 aa, Homo Sapiens
HERHLHNNF

SEQ ID NO: 252310 - protein, 9 aa, Homo Sapiens
EDVYERTLM

SEQ ID NO: 252311 - protein, 9 aa, Homo Sapiens
CVGPSDLLV

SEQ ID NO: 252312 - protein, 9 aa, Homo Sapiens
EHGLCGHWG

SEQ ID NO: 252313 - protein, 9 aa, Homo Sapiens
HLLNHPKTQ

SEQ ID NO: 252314 - protein, 9 aa, Homo Sapiens
QLEAALDEG

SEQ ID NO: 252315 - protein, 9 aa, Homo Sapiens
ASQEGRSLQ

SEQ ID NO: 252316 - protein, 9 aa, Homo Sapiens
VLQGCWLLY

SEQ ID NO: 252317 - protein, 9 aa, Homo Sapiens
RGMFIAIVF

SEQ ID NO: 252318 - protein, 9 aa, Homo Sapiens
NQCGKAFNI

SEQ ID NO: 252319 - protein, 9 aa, Homo Sapiens
VYIKNFGEY

SEQ ID NO: 252320 - protein, 9 aa, Homo Sapiens
VSTLYTVVF

SEQ ID NO: 252321 - protein, 9 aa, Homo Sapiens
LSELKEKLF

SEQ ID NO: 252322 - protein, 9 aa, Homo Sapiens
NEIQRYSAL

SEQ ID NO: 252323 - protein, 9 aa, Homo Sapiens
QMTHGKNSL

SEQ ID NO: 252324 - protein, 9 aa, Homo Sapiens
CSLKIRVIH

SEQ ID NO: 252325 - protein, 9 aa, Homo Sapiens
PVQLSEDIT

SEQ ID NO: 252326 - protein, 9 aa, Homo Sapiens
SYDTIGKTT

SEQ ID NO: 252327 - protein, 9 aa, Homo Sapiens
TDESEFFLA

SEQ ID NO: 252328 - protein, 9 aa, Homo Sapiens
TGTVQVLKW

SEQ ID NO: 252329 - protein, 9 aa, Homo Sapiens
RKFGNRIKA

SEQ ID NO: 252330 - protein, 9 aa, Homo Sapiens
WDGTEEIRQ

SEQ ID NO: 252331 - protein, 9 aa, Homo Sapiens
QIYRIFEQG

SEQ ID NO: 252332 - protein, 9 aa, Homo Sapiens
FLGFSSFGN

SEQ ID NO: 252333 - protein, 9 aa, Homo Sapiens
ATKTELKKL

SEQ ID NO: 252334 - protein, 9 aa, Homo Sapiens
PINSKTRPE

SEQ ID NO: 252335 - protein, 9 aa, Homo Sapiens
KTTESSLPA

SEQ ID NO: 252336 - protein, 9 aa, Homo Sapiens
FPEVLLTKI

SEQ ID NO: 252337 - protein, 9 aa, Homo Sapiens
PPQRSFNNF

SEQ ID NO: 252338 - protein, 9 aa, Homo Sapiens
PLNVKHHGN

SEQ ID NO: 252339 - protein, 9 aa, Homo Sapiens
TVLHIIYGK

SEQ ID NO: 252340 - protein, 9 aa, Homo Sapiens
IKPSKGVIL

SEQ ID NO: 252341 - protein, 9 aa, Homo Sapiens
HLQWDVLDG

SEQ ID NO: 252342 - protein, 9 aa, Homo Sapiens
YEESQSRLS

SEQ ID NO: 252343 - protein, 9 aa, Homo Sapiens
FSYYLICVL

SEQ ID NO: 252344 - protein, 9 aa, Homo Sapiens
DIKTRLEQD

SEQ ID NO: 252345 - protein, 9 aa, Homo Sapiens
LDIRKDKAD

SEQ ID NO: 252346 - protein, 9 aa, Homo Sapiens
WLGTCANIK

SEQ ID NO: 252347 - protein, 9 aa, Homo Sapiens
RLSKRGPRR

SEQ ID NO: 252348 - protein, 9 aa, Homo Sapiens
IGLPTIFYP

SEQ ID NO: 252349 - protein, 9 aa, Homo Sapiens
AAHAQEQIH

SEQ ID NO: 252350 - protein, 9 aa, Homo Sapiens
HLKKNNLRD

SEQ ID NO: 252351 - protein, 9 aa, Homo Sapiens
LDSSKKNLL

SEQ ID NO: 252352 - protein, 9 aa, Homo Sapiens
LYVPEHKLH

SEQ ID NO: 252353 - protein, 9 aa, Homo Sapiens
CGTQPGLHR

SEQ ID NO: 252354 - protein, 9 aa, Homo Sapiens
ENRRNRERK

SEQ ID NO: 252355 - protein, 9 aa, Homo Sapiens
ASQSRVGCL

SEQ ID NO: 252356 - protein, 9 aa, Homo Sapiens
PPSWIAVGV

SEQ ID NO: 252357 - protein, 9 aa, Homo Sapiens
GEFKALVAE

SEQ ID NO: 252358 - protein, 9 aa, Homo Sapiens
EFGSPGKTE

SEQ ID NO: 252359 - protein, 9 aa, Homo Sapiens
GEINFNIHS

SEQ ID NO: 252360 - protein, 9 aa, Homo Sapiens
ALRPVNGGI

SEQ ID NO: 252361 - protein, 9 aa, Homo Sapiens
QHFRQNSAE

SEQ ID NO: 252362 - protein, 9 aa, Homo Sapiens
EPPHNLIAQ

SEQ ID NO: 252363 - protein, 9 aa, Homo Sapiens
NNIFYIVPA

SEQ ID NO: 252364 - protein, 9 aa, Homo Sapiens
SCSGTTRSR

SEQ ID NO: 252365 - protein, 9 aa, Homo Sapiens
EQNEQTLGH

SEQ ID NO: 252366 - protein, 9 aa, Homo Sapiens
VRDKLSELH

SEQ ID NO: 252367 - protein, 9 aa, Homo Sapiens
SDEMYKQVR

SEQ ID NO: 252368 - protein, 9 aa, Homo Sapiens
PLSGSRTAG

SEQ ID NO: 252369 - protein, 9 aa, Homo Sapiens
NEEYWDFYI

SEQ ID NO: 252370 - protein, 9 aa, Homo Sapiens
INKVTDKSR

SEQ ID NO: 252371 - protein, 9 aa, Homo Sapiens
GINISPNGK

SEQ ID NO: 252372 - protein, 9 aa, Homo Sapiens
CSDSCYFDD

SEQ ID NO: 252373 - protein, 9 aa, Homo Sapiens
QLLVLLCRH

SEQ ID NO: 252374 - protein, 9 aa, Homo Sapiens
DLQINKLYV

SEQ ID NO: 252375 - protein, 9 aa, Homo Sapiens
VSSDDGRGF

SEQ ID NO: 252376 - protein, 9 aa, Homo Sapiens
NTQNRFSIT

SEQ ID NO: 252377 - protein, 9 aa, Homo Sapiens
HKHNSSHFK

SEQ ID NO: 252378 - protein, 9 aa, Homo Sapiens
ELENLQTLN

SEQ ID NO: 252379 - protein, 9 aa, Homo Sapiens
SFALERIGM

SEQ ID NO: 252380 - protein, 9 aa, Homo Sapiens
VGHISKKHT

SEQ ID NO: 252381 - protein, 9 aa, Homo Sapiens
EDTSCSTMY

SEQ ID NO: 252382 - protein, 9 aa, Homo Sapiens
EMYPAVFCP

SEQ ID NO: 252383 - protein, 9 aa, Homo Sapiens
PHESFTCSE

SEQ ID NO: 252384 - protein, 9 aa, Homo Sapiens
EGQKYSVTS

SEQ ID NO: 252385 - protein, 9 aa, Homo Sapiens
EYKESASSY

SEQ ID NO: 252386 - protein, 9 aa, Homo Sapiens
EKLEAQNRK

SEQ ID NO: 252387 - protein, 9 aa, Homo Sapiens
SLDEQVEEE

SEQ ID NO: 252388 - protein, 9 aa, Homo Sapiens
TQKNLPIAE

SEQ ID NO: 252389 - protein, 9 aa, Homo Sapiens
LNVLKYEEV

SEQ ID NO: 252390 - protein, 9 aa, Homo Sapiens
NIGKVVHQP

SEQ ID NO: 252391 - protein, 9 aa, Homo Sapiens
VRPVLLKCN

SEQ ID NO: 252392 - protein, 9 aa, Homo Sapiens
WMSVSGPQH

SEQ ID NO: 252393 - protein, 9 aa, Homo Sapiens
NSFNSAFRP

SEQ ID NO: 252394 - protein, 9 aa, Homo Sapiens
QSVRKVIQN

SEQ ID NO: 252395 - protein, 9 aa, Homo Sapiens
EQASNIYSD

SEQ ID NO: 252396 - protein, 9 aa, Homo Sapiens
YYINRRERL

SEQ ID NO: 252397 - protein, 9 aa, Homo Sapiens
FQKHNSKPS

SEQ ID NO: 252398 - protein, 9 aa, Homo Sapiens
VELNCAVLQ

SEQ ID NO: 252399 - protein, 9 aa, Homo Sapiens
NGEEHTLAV

SEQ ID NO: 252400 - protein, 9 aa, Homo Sapiens
KLYDVMILT

SEQ ID NO: 252401 - protein, 9 aa, Homo Sapiens
HILGFGEDK

SEQ ID NO: 252402 - protein, 9 aa, Homo Sapiens
KRGLNVSSC

SEQ ID NO: 252403 - protein, 9 aa, Homo Sapiens
VFRHYGPGA

SEQ ID NO: 252404 - protein, 9 aa, Homo Sapiens
VQVQWEINI

SEQ ID NO: 252405 - protein, 9 aa, Homo Sapiens
HHVIQKHSN

SEQ ID NO: 252406 - protein, 9 aa, Homo Sapiens
MHGEKYKPF

SEQ ID NO: 252407 - protein, 9 aa, Homo Sapiens
EAVLQSKEK

SEQ ID NO: 252408 - protein, 9 aa, Homo Sapiens
FNSMEPNTQ

SEQ ID NO: 252409 - protein, 9 aa, Homo Sapiens
ENSKVMDVV

SEQ ID NO: 252410 - protein, 9 aa, Homo Sapiens
RWQEARGAL

SEQ ID NO: 252411 - protein, 9 aa, Homo Sapiens
KPQMSLEFP

SEQ ID NO: 252412 - protein, 9 aa, Homo Sapiens
EKGLVPQNK

SEQ ID NO: 252413 - protein, 9 aa, Homo Sapiens
SVALNANVV

SEQ ID NO: 252414 - protein, 9 aa, Homo Sapiens
KLSEQASNI

SEQ ID NO: 252415 - protein, 9 aa, Homo Sapiens
ECKNLIYHM

SEQ ID NO: 252416 - protein, 9 aa, Homo Sapiens
IPKDLGTPV

SEQ ID NO: 252417 - protein, 9 aa, Homo Sapiens
ENDPIRGPG

SEQ ID NO: 252418 - protein, 9 aa, Homo Sapiens
LFCTQCGPD

SEQ ID NO: 252419 - protein, 9 aa, Homo Sapiens
AATYNSLLQ

SEQ ID NO: 252420 - protein, 9 aa, Homo Sapiens
KDKVDLEKS

SEQ ID NO: 252421 - protein, 9 aa, Homo Sapiens
QATAQINNL

SEQ ID NO: 252422 - protein, 9 aa, Homo Sapiens
ESNLRNHGL

SEQ ID NO: 252423 - protein, 9 aa, Homo Sapiens
GFGTQSRNL

SEQ ID NO: 252424 - protein, 9 aa, Homo Sapiens
VPVEDWEKG

SEQ ID NO: 252425 - protein, 9 aa, Homo Sapiens
LALSSAHNL

SEQ ID NO: 252426 - protein, 9 aa, Homo Sapiens
HLYLGCNKL

SEQ ID NO: 252427 - protein, 9 aa, Homo Sapiens
FRRKEMEIM

SEQ ID NO: 252428 - protein, 9 aa, Homo Sapiens
NNIMLIAEW

SEQ ID NO: 252429 - protein, 9 aa, Homo Sapiens
PKTQQYVRA

SEQ ID NO: 252430 - protein, 9 aa, Homo Sapiens
GKTFTFRDP

SEQ ID NO: 252431 - protein, 9 aa, Homo Sapiens
LSPGSLAVS

SEQ ID NO: 252432 - protein, 9 aa, Homo Sapiens
AFSPSSDYL

SEQ ID NO: 252433 - protein, 9 aa, Homo Sapiens
KSRLEEQKV

SEQ ID NO: 252434 - protein, 9 aa, Homo Sapiens
IDYGICLNR

SEQ ID NO: 252435 - protein, 9 aa, Homo Sapiens
FKLLHPDVI

SEQ ID NO: 252436 - protein, 9 aa, Homo Sapiens
EFCPGDFAV

SEQ ID NO: 252437 - protein, 9 aa, Homo Sapiens
SYLFKGAYY

SEQ ID NO: 252438 - protein, 9 aa, Homo Sapiens
SEELVQVVD

SEQ ID NO: 252439 - protein, 9 aa, Homo Sapiens
STLFASLNF

SEQ ID NO: 252440 - protein, 9 aa, Homo Sapiens
MCMYLRPTS

SEQ ID NO: 252441 - protein, 9 aa, Homo Sapiens
EHFTANVQG

SEQ ID NO: 252442 - protein, 9 aa, Homo Sapiens
FLQRFYKIR

SEQ ID NO: 252443 - protein, 9 aa, Homo Sapiens
RLERGSLKR

SEQ ID NO: 252444 - protein, 9 aa, Homo Sapiens
IFQYTNFDK

SEQ ID NO: 252445 - protein, 9 aa, Homo Sapiens
KVLSEVVMQ

SEQ ID NO: 252446 - protein, 9 aa, Homo Sapiens
NFHGCLEHL

SEQ ID NO: 252447 - protein, 9 aa, Homo Sapiens
NKIENWDEQ

SEQ ID NO: 252448 - protein, 9 aa, Homo Sapiens
VERRWHAAR

SEQ ID NO: 252449 - protein, 9 aa, Homo Sapiens
PHQQTRDTY

SEQ ID NO: 252450 - protein, 9 aa, Homo Sapiens
HISLSTRFG

SEQ ID NO: 252451 - protein, 9 aa, Homo Sapiens
MFCADELVI

SEQ ID NO: 252452 - protein, 9 aa, Homo Sapiens
TRKCSLLDT

SEQ ID NO: 252453 - protein, 9 aa, Homo Sapiens
ASMCMPPPS

SEQ ID NO: 252454 - protein, 9 aa, Homo Sapiens
EPSTHDNRV

SEQ ID NO: 252455 - protein, 9 aa, Homo Sapiens
ISMAFESTM

SEQ ID NO: 252456 - protein, 9 aa, Homo Sapiens
LLYVTDTNN

SEQ ID NO: 252457 - protein, 9 aa, Homo Sapiens
KNFKKIPME

SEQ ID NO: 252458 - protein, 9 aa, Homo Sapiens
VLAFADSQV

SEQ ID NO: 252459 - protein, 9 aa, Homo Sapiens
FDPVVVILR

SEQ ID NO: 252460 - protein, 9 aa, Homo Sapiens
DCNMSEEEK

SEQ ID NO: 252461 - protein, 9 aa, Homo Sapiens
CEERFSLFT

SEQ ID NO: 252462 - protein, 9 aa, Homo Sapiens
STIIKHQRI

SEQ ID NO: 252463 - protein, 9 aa, Homo Sapiens
FNTNLTGYP

SEQ ID NO: 252464 - protein, 9 aa, Homo Sapiens
ISSTLNTHT

SEQ ID NO: 252465 - protein, 9 aa, Homo Sapiens
ENTTTSKDV

SEQ ID NO: 252466 - protein, 9 aa, Homo Sapiens
CQDKKYRVG

SEQ ID NO: 252467 - protein, 9 aa, Homo Sapiens
GPHHPEMAN

SEQ ID NO: 252468 - protein, 9 aa, Homo Sapiens
ESHVNQVIM

SEQ ID NO: 252469 - protein, 9 aa, Homo Sapiens
RGKRNANLR

SEQ ID NO: 252470 - protein, 9 aa, Homo Sapiens
NNSALKQDV

SEQ ID NO: 252471 - protein, 9 aa, Homo Sapiens
SSTPTFIIL

SEQ ID NO: 252472 - protein, 9 aa, Homo Sapiens
QLMAIFKRH

SEQ ID NO: 252473 - protein, 9 aa, Homo Sapiens
ETHEKLSQI

SEQ ID NO: 252474 - protein, 9 aa, Homo Sapiens
RTERLSALL

SEQ ID NO: 252475 - protein, 9 aa, Homo Sapiens
QKQLGQDPF

SEQ ID NO: 252476 - protein, 9 aa, Homo Sapiens
GALQATGFQ

SEQ ID NO: 252477 - protein, 9 aa, Homo Sapiens
LEFSPGSNK

SEQ ID NO: 252478 - protein, 9 aa, Homo Sapiens
ISGLKNGSF

SEQ ID NO: 252479 - protein, 9 aa, Homo Sapiens
SYSADETED

SEQ ID NO: 252480 - protein, 9 aa, Homo Sapiens
TLLREKIMK

SEQ ID NO: 252481 - protein, 9 aa, Homo Sapiens
LEENAEKAL

SEQ ID NO: 252482 - protein, 9 aa, Homo Sapiens
IIHAPNLPY

SEQ ID NO: 252483 - protein, 9 aa, Homo Sapiens
LEKQKKCKL

SEQ ID NO: 252484 - protein, 9 aa, Homo Sapiens
IAEPFNTDL

SEQ ID NO: 252485 - protein, 9 aa, Homo Sapiens
QTVSSSQVT

SEQ ID NO: 252486 - protein, 9 aa, Homo Sapiens
DLLKINENI

SEQ ID NO: 252487 - protein, 9 aa, Homo Sapiens
SSPQESFTS

SEQ ID NO: 252488 - protein, 9 aa, Homo Sapiens
ASTKIRMNV

SEQ ID NO: 252489 - protein, 9 aa, Homo Sapiens
YGDFLPIPQ

SEQ ID NO: 252490 - protein, 9 aa, Homo Sapiens
GNLALVDFC

SEQ ID NO: 252491 - protein, 9 aa, Homo Sapiens
SSFGNHQIT

SEQ ID NO: 252492 - protein, 9 aa, Homo Sapiens
CIQNCCGRS

SEQ ID NO: 252493 - protein, 9 aa, Homo Sapiens
ENGELLYVT

SEQ ID NO: 252494 - protein, 9 aa, Homo Sapiens
DKMATNTVY

SEQ ID NO: 252495 - protein, 9 aa, Homo Sapiens
DTPVTKLQH

SEQ ID NO: 252496 - protein, 9 aa, Homo Sapiens
RNMSCQGFT

SEQ ID NO: 252497 - protein, 9 aa, Homo Sapiens
RVLQRSVKL

SEQ ID NO: 252498 - protein, 9 aa, Homo Sapiens
SNDGKNDGD

SEQ ID NO: 252499 - protein, 9 aa, Homo Sapiens
FHDPYRHER

SEQ ID NO: 252500 - protein, 9 aa, Homo Sapiens
EDYLGIVSF

SEQ ID NO: 252501 - protein, 9 aa, Homo Sapiens
LNLGCINAE

SEQ ID NO: 252502 - protein, 9 aa, Homo Sapiens
APPPTPARC

SEQ ID NO: 252503 - protein, 9 aa, Homo Sapiens
LPEEAHCFI

SEQ ID NO: 252504 - protein, 9 aa, Homo Sapiens
SVVWIQEAN

SEQ ID NO: 252505 - protein, 9 aa, Homo Sapiens
LYRKDGSAF

SEQ ID NO: 252506 - protein, 9 aa, Homo Sapiens
QYYPHVRIS

SEQ ID NO: 252507 - protein, 9 aa, Homo Sapiens
ELSMLNQKF

SEQ ID NO: 252508 - protein, 9 aa, Homo Sapiens
ANTRLCGAR

SEQ ID NO: 252509 - protein, 9 aa, Homo Sapiens
AIRFTHAEK

SEQ ID NO: 252510 - protein, 9 aa, Homo Sapiens
MNSLEQNIR

SEQ ID NO: 252511 - protein, 9 aa, Homo Sapiens
EHKKKILNK

SEQ ID NO: 252512 - protein, 9 aa, Homo Sapiens
PEGMCIQAD

SEQ ID NO: 252513 - protein, 9 aa, Homo Sapiens
HTKICHVDA

SEQ ID NO: 252514 - protein, 9 aa, Homo Sapiens
KTLVKIKRT

SEQ ID NO: 252515 - protein, 9 aa, Homo Sapiens
YDTESTVPQ

SEQ ID NO: 252516 - protein, 9 aa, Homo Sapiens
KLIPEFINK

SEQ ID NO: 252517 - protein, 9 aa, Homo Sapiens
SYKRNICSV

SEQ ID NO: 252518 - protein, 9 aa, Homo Sapiens
PCITDVKIG

SEQ ID NO: 252519 - protein, 9 aa, Homo Sapiens
LHNKGNQGR

SEQ ID NO: 252520 - protein, 9 aa, Homo Sapiens
ASMQALMHA

SEQ ID NO: 252521 - protein, 9 aa, Homo Sapiens
YLATSIDPK

SEQ ID NO: 252522 - protein, 9 aa, Homo Sapiens
FDLLYGRAS

SEQ ID NO: 252523 - protein, 9 aa, Homo Sapiens
NDKPHDAEI

SEQ ID NO: 252524 - protein, 9 aa, Homo Sapiens
DNQLTKRVK

SEQ ID NO: 252525 - protein, 9 aa, Homo Sapiens
ELPPVTDFR

SEQ ID NO: 252526 - protein, 9 aa, Homo Sapiens
RERLECQQK

SEQ ID NO: 252527 - protein, 9 aa, Homo Sapiens
KAARNMSCQ

SEQ ID NO: 252528 - protein, 9 aa, Homo Sapiens
TSNTKAVEV

SEQ ID NO: 252529 - protein, 9 aa, Homo Sapiens
MEVCNLCIL

SEQ ID NO: 252530 - protein, 9 aa, Homo Sapiens
GGSQPSMKQ

SEQ ID NO: 252531 - protein, 9 aa, Homo Sapiens
YSQGNPCTL

SEQ ID NO: 252532 - protein, 9 aa, Homo Sapiens
LPRPQAPPP

SEQ ID NO: 252533 - protein, 9 aa, Homo Sapiens
TQSLTEEKT

SEQ ID NO: 252534 - protein, 9 aa, Homo Sapiens
AQMFFIHGF

SEQ ID NO: 252535 - protein, 9 aa, Homo Sapiens
KERDPLKDC

SEQ ID NO: 252536 - protein, 9 aa, Homo Sapiens
LCKHIASGK

SEQ ID NO: 252537 - protein, 9 aa, Homo Sapiens
ATTGNRHVQ

SEQ ID NO: 252538 - protein, 9 aa, Homo Sapiens
CGTYAEEEG

SEQ ID NO: 252539 - protein, 9 aa, Homo Sapiens
HTLKGDLQL

SEQ ID NO: 252540 - protein, 9 aa, Homo Sapiens
TFRTLCDLI

SEQ ID NO: 252541 - protein, 9 aa, Homo Sapiens
SFLQVEISD

SEQ ID NO: 252542 - protein, 9 aa, Homo Sapiens
DQIIDMLSV

SEQ ID NO: 252543 - protein, 9 aa, Homo Sapiens
VLIPPHARI

SEQ ID NO: 252544 - protein, 9 aa, Homo Sapiens
VQIRGNLAN

SEQ ID NO: 252545 - protein, 9 aa, Homo Sapiens
HNFAIRCNL

SEQ ID NO: 252546 - protein, 9 aa, Homo Sapiens
KLRKRPRYY

SEQ ID NO: 252547 - protein, 9 aa, Homo Sapiens
ANEDDDVFF

SEQ ID NO: 252548 - protein, 9 aa, Homo Sapiens
GTSFSHKRS

SEQ ID NO: 252549 - protein, 9 aa, Homo Sapiens
KKKEDDVPQ

SEQ ID NO: 252550 - protein, 9 aa, Homo Sapiens
GTKYRYFFQ

SEQ ID NO: 252551 - protein, 9 aa, Homo Sapiens
PGRHDTAFV

SEQ ID NO: 252552 - protein, 9 aa, Homo Sapiens
KDKDNIFQQ

SEQ ID NO: 252553 - protein, 9 aa, Homo Sapiens
QCFIHDVGL

SEQ ID NO: 252554 - protein, 9 aa, Homo Sapiens
MLIVVSYGK

SEQ ID NO: 252555 - protein, 9 aa, Homo Sapiens
NRRCQTADA

SEQ ID NO: 252556 - protein, 9 aa, Homo Sapiens
ICPLIAAAV

SEQ ID NO: 252557 - protein, 9 aa, Homo Sapiens
SLNGGRPFL

SEQ ID NO: 252558 - protein, 9 aa, Homo Sapiens
VDTTPNQGR

SEQ ID NO: 252559 - protein, 9 aa, Homo Sapiens
KHLMEKASI

SEQ ID NO: 252560 - protein, 9 aa, Homo Sapiens
NNARAQQGK

SEQ ID NO: 252561 - protein, 9 aa, Homo Sapiens
HPYSKDNNS

SEQ ID NO: 252562 - protein, 9 aa, Homo Sapiens
VQEKKENLL

SEQ ID NO: 252563 - protein, 9 aa, Homo Sapiens
FDQIIDMLS

SEQ ID NO: 252564 - protein, 9 aa, Homo Sapiens
ACYNTSQTC

SEQ ID NO: 252565 - protein, 9 aa, Homo Sapiens
WEYKDAPGT

SEQ ID NO: 252566 - protein, 9 aa, Homo Sapiens
ENKPLQQQL

SEQ ID NO: 252567 - protein, 9 aa, Homo Sapiens
GAFLGMSLV

SEQ ID NO: 252568 - protein, 9 aa, Homo Sapiens
TLTDSEITG

SEQ ID NO: 252569 - protein, 9 aa, Homo Sapiens
CNGCGKAFS

SEQ ID NO: 252570 - protein, 9 aa, Homo Sapiens
LASCAKAKM

SEQ ID NO: 252571 - protein, 9 aa, Homo Sapiens
AVLETSSSE

SEQ ID NO: 252572 - protein, 9 aa, Homo Sapiens
SVEQVKIHA

SEQ ID NO: 252573 - protein, 9 aa, Homo Sapiens
SLVGPFTTP

SEQ ID NO: 252574 - protein, 9 aa, Homo Sapiens
CPKEFSYES

SEQ ID NO: 252575 - protein, 9 aa, Homo Sapiens
QKHGKMHTG

SEQ ID NO: 252576 - protein, 9 aa, Homo Sapiens
LVQALQKAL

SEQ ID NO: 252577 - protein, 9 aa, Homo Sapiens
MNLHWKNSN

SEQ ID NO: 252578 - protein, 9 aa, Homo Sapiens
VIPMIGPTE

SEQ ID NO: 252579 - protein, 9 aa, Homo Sapiens
DMQEKLQNF

SEQ ID NO: 252580 - protein, 9 aa, Homo Sapiens
PASYAAPGP

SEQ ID NO: 252581 - protein, 9 aa, Homo Sapiens
GYYCHSQTR

SEQ ID NO: 252582 - protein, 9 aa, Homo Sapiens
SEDKNITLH

SEQ ID NO: 252583 - protein, 9 aa, Homo Sapiens
AIYPITLAG

SEQ ID NO: 252584 - protein, 9 aa, Homo Sapiens
LNGDLDDIE

SEQ ID NO: 252585 - protein, 9 aa, Homo Sapiens
PATNAILRG

SEQ ID NO: 252586 - protein, 9 aa, Homo Sapiens
LTKVVGRVV

SEQ ID NO: 252587 - protein, 9 aa, Homo Sapiens
ATNALKDHA

SEQ ID NO: 252588 - protein, 9 aa, Homo Sapiens
QIFIQTSMG

SEQ ID NO: 252589 - protein, 9 aa, Homo Sapiens
IIVSYLWIR

SEQ ID NO: 252590 - protein, 9 aa, Homo Sapiens
ETDHQDYCK

SEQ ID NO: 252591 - protein, 9 aa, Homo Sapiens
EVIKIKSIL

SEQ ID NO: 252592 - protein, 9 aa, Homo Sapiens
SHLIVHQII

SEQ ID NO: 252593 - protein, 9 aa, Homo Sapiens
VVRRPDQKD

SEQ ID NO: 252594 - protein, 9 aa, Homo Sapiens
KANNSIDKS

SEQ ID NO: 252595 - protein, 9 aa, Homo Sapiens
RWHAARKPL

SEQ ID NO: 252596 - protein, 9 aa, Homo Sapiens
KIHVNEITR

SEQ ID NO: 252597 - protein, 9 aa, Homo Sapiens
FDPYKMCWG

SEQ ID NO: 252598 - protein, 9 aa, Homo Sapiens
QVAGAPLIT

SEQ ID NO: 252599 - protein, 9 aa, Homo Sapiens
YQLIYHQTI

SEQ ID NO: 252600 - protein, 9 aa, Homo Sapiens
EKASIMLKF

SEQ ID NO: 252601 - protein, 9 aa, Homo Sapiens
HTRNQHVST

SEQ ID NO: 252602 - protein, 9 aa, Homo Sapiens
LLVAVKRAV

SEQ ID NO: 252603 - protein, 9 aa, Homo Sapiens
GSDGTVQTW

SEQ ID NO: 252604 - protein, 9 aa, Homo Sapiens
KVVKPKRQK

SEQ ID NO: 252605 - protein, 9 aa, Homo Sapiens
AALSGLEDV

SEQ ID NO: 252606 - protein, 9 aa, Homo Sapiens
AVILAFDVK

SEQ ID NO: 252607 - protein, 9 aa, Homo Sapiens
EEVVLQAVM

SEQ ID NO: 252608 - protein, 9 aa, Homo Sapiens
KVLIAQDKM

SEQ ID NO: 252609 - protein, 9 aa, Homo Sapiens
NSGLTLYLV

SEQ ID NO: 252610 - protein, 9 aa, Homo Sapiens
NKNAVVKRM

SEQ ID NO: 252611 - protein, 9 aa, Homo Sapiens
PKYKLANYR

SEQ ID NO: 252612 - protein, 9 aa, Homo Sapiens
YFYEESETD

SEQ ID NO: 252613 - protein, 9 aa, Homo Sapiens
YPASASTQT

SEQ ID NO: 252614 - protein, 9 aa, Homo Sapiens
NQRKFLNAL

SEQ ID NO: 252615 - protein, 9 aa, Homo Sapiens
IEKAAEDSN

SEQ ID NO: 252616 - protein, 9 aa, Homo Sapiens
NSFDPSKTE

SEQ ID NO: 252617 - protein, 9 aa, Homo Sapiens
SGDGVRVSA

SEQ ID NO: 252618 - protein, 9 aa, Homo Sapiens
VLKRKRLSK

SEQ ID NO: 252619 - protein, 9 aa, Homo Sapiens
FASLSGLHK

SEQ ID NO: 252620 - protein, 9 aa, Homo Sapiens
TVIPNSMTP

SEQ ID NO: 252621 - protein, 9 aa, Homo Sapiens
SMCKLGSAN

SEQ ID NO: 252622 - protein, 9 aa, Homo Sapiens
SSTCSTVSP

SEQ ID NO: 252623 - protein, 9 aa, Homo Sapiens
GQLTPTGKE

SEQ ID NO: 252624 - protein, 9 aa, Homo Sapiens
DDPTSKREH

SEQ ID NO: 252625 - protein, 9 aa, Homo Sapiens
TNELQQLQS

SEQ ID NO: 252626 - protein, 9 aa, Homo Sapiens
LYQRQTELQ

SEQ ID NO: 252627 - protein, 9 aa, Homo Sapiens
LTPELEARQ

SEQ ID NO: 252628 - protein, 9 aa, Homo Sapiens
DEQDTPLVE

SEQ ID NO: 252629 - protein, 9 aa, Homo Sapiens
HHFLPAGFV

SEQ ID NO: 252630 - protein, 9 aa, Homo Sapiens
VEDIITYRE

SEQ ID NO: 252631 - protein, 9 aa, Homo Sapiens
SVVPEKPNK

SEQ ID NO: 252632 - protein, 9 aa, Homo Sapiens
RNQLSVKCW

SEQ ID NO: 252633 - protein, 9 aa, Homo Sapiens
ECAKKLYDA

SEQ ID NO: 252634 - protein, 9 aa, Homo Sapiens
EEREQLVKA

SEQ ID NO: 252635 - protein, 9 aa, Homo Sapiens
YTNGHNETS

SEQ ID NO: 252636 - protein, 9 aa, Homo Sapiens
LQLIQPLEC

SEQ ID NO: 252637 - protein, 9 aa, Homo Sapiens
RKADKRSQC

SEQ ID NO: 252638 - protein, 9 aa, Homo Sapiens
PAHGPEAHA

SEQ ID NO: 252639 - protein, 9 aa, Homo Sapiens
YKEHGPFFL

SEQ ID NO: 252640 - protein, 9 aa, Homo Sapiens
RVLGHYVTS

SEQ ID NO: 252641 - protein, 9 aa, Homo Sapiens
SKPPFQFGQ

SEQ ID NO: 252642 - protein, 9 aa, Homo Sapiens
LQAHIGLVH

SEQ ID NO: 252643 - protein, 9 aa, Homo Sapiens
DLDFPFLCL

SEQ ID NO: 252644 - protein, 9 aa, Homo Sapiens
KRNALCVAE

SEQ ID NO: 252645 - protein, 9 aa, Homo Sapiens
LQEYVIEKL

SEQ ID NO: 252646 - protein, 9 aa, Homo Sapiens
FRKLWCQQI

SEQ ID NO: 252647 - protein, 9 aa, Homo Sapiens
TFAPRTWIF

SEQ ID NO: 252648 - protein, 9 aa, Homo Sapiens
CVVSEWGLW

SEQ ID NO: 252649 - protein, 9 aa, Homo Sapiens
HSSDWPKLF

SEQ ID NO: 252650 - protein, 9 aa, Homo Sapiens
LFMEIRKFD

SEQ ID NO: 252651 - protein, 9 aa, Homo Sapiens
SWTLCGSSG

SEQ ID NO: 252652 - protein, 9 aa, Homo Sapiens
CYCEDGFKI

SEQ ID NO: 252653 - protein, 9 aa, Homo Sapiens
SLMNKDVKG

SEQ ID NO: 252654 - protein, 9 aa, Homo Sapiens
HYDLMERKL

SEQ ID NO: 252655 - protein, 9 aa, Homo Sapiens
THQCNYKCG

SEQ ID NO: 252656 - protein, 9 aa, Homo Sapiens
AIFESLYYR

SEQ ID NO: 252657 - protein, 9 aa, Homo Sapiens
LHLIATHSR

SEQ ID NO: 252658 - protein, 9 aa, Homo Sapiens
PVPGEAPND

SEQ ID NO: 252659 - protein, 9 aa, Homo Sapiens
TSRKENFNQ

SEQ ID NO: 252660 - protein, 9 aa, Homo Sapiens
TNAKRLRRK

SEQ ID NO: 252661 - protein, 9 aa, Homo Sapiens
KKGCNDCCF

SEQ ID NO: 252662 - protein, 9 aa, Homo Sapiens
RTAGLFRRS

SEQ ID NO: 252663 - protein, 9 aa, Homo Sapiens
SSTENLNGF

SEQ ID NO: 252664 - protein, 9 aa, Homo Sapiens
RNRNCKQKC

SEQ ID NO: 252665 - protein, 9 aa, Homo Sapiens
AERVLPTCI

SEQ ID NO: 252666 - protein, 9 aa, Homo Sapiens
SPDSQEDEF

SEQ ID NO: 252667 - protein, 9 aa, Homo Sapiens
PAHPTLLAG

SEQ ID NO: 252668 - protein, 9 aa, Homo Sapiens
CVLKKKLSA

SEQ ID NO: 252669 - protein, 9 aa, Homo Sapiens
IPLSGCFDM

SEQ ID NO: 252670 - protein, 9 aa, Homo Sapiens
GETNLKCKM

SEQ ID NO: 252671 - protein, 9 aa, Homo Sapiens
LKRFHFVND

SEQ ID NO: 252672 - protein, 9 aa, Homo Sapiens
SKVFDGTSS

SEQ ID NO: 252673 - protein, 9 aa, Homo Sapiens
PQPSTNMFG

SEQ ID NO: 252674 - protein, 9 aa, Homo Sapiens
LEMDGTETG

SEQ ID NO: 252675 - protein, 9 aa, Homo Sapiens
PFLIWQKII

SEQ ID NO: 252676 - protein, 9 aa, Homo Sapiens
IISVSSVCM

SEQ ID NO: 252677 - protein, 9 aa, Homo Sapiens
AKLYGSNGP

SEQ ID NO: 252678 - protein, 9 aa, Homo Sapiens
SADLQIRKS

SEQ ID NO: 252679 - protein, 9 aa, Homo Sapiens
DAGLYYVRN

SEQ ID NO: 252680 - protein, 9 aa, Homo Sapiens
LFHIDIGGR

SEQ ID NO: 252681 - protein, 9 aa, Homo Sapiens
LWLLSASAH

SEQ ID NO: 252682 - protein, 9 aa, Homo Sapiens
LFRDNLNKL

SEQ ID NO: 252683 - protein, 9 aa, Homo Sapiens
EDQFDEIIL

SEQ ID NO: 252684 - protein, 9 aa, Homo Sapiens
NLCSRKFSL

SEQ ID NO: 252685 - protein, 9 aa, Homo Sapiens
ENTLKAASG

SEQ ID NO: 252686 - protein, 9 aa, Homo Sapiens
SDSGYSYDT

SEQ ID NO: 252687 - protein, 9 aa, Homo Sapiens
EKTKETKRL

SEQ ID NO: 252688 - protein, 9 aa, Homo Sapiens
LNVAFVANL

SEQ ID NO: 252689 - protein, 9 aa, Homo Sapiens
KRTSFVMEY

SEQ ID NO: 252690 - protein, 9 aa, Homo Sapiens
YKKHRRKLR

SEQ ID NO: 252691 - protein, 9 aa, Homo Sapiens
HIIYGKFLG

SEQ ID NO: 252692 - protein, 9 aa, Homo Sapiens
TKRLFDLNN

SEQ ID NO: 252693 - protein, 9 aa, Homo Sapiens
VEVLEQNFQ

SEQ ID NO: 252694 - protein, 9 aa, Homo Sapiens
ASVVVKRYT

SEQ ID NO: 252695 - protein, 9 aa, Homo Sapiens
ILLGRTVKD

SEQ ID NO: 252696 - protein, 9 aa, Homo Sapiens
GGLCMCGDN

SEQ ID NO: 252697 - protein, 9 aa, Homo Sapiens
PQSLPKYLI

SEQ ID NO: 252698 - protein, 9 aa, Homo Sapiens
CFSIHKTQC

SEQ ID NO: 252699 - protein, 9 aa, Homo Sapiens
IIKQAFQGA

SEQ ID NO: 252700 - protein, 9 aa, Homo Sapiens
QYSSCLPEE

SEQ ID NO: 252701 - protein, 9 aa, Homo Sapiens
RNLPDSGKA

SEQ ID NO: 252702 - protein, 9 aa, Homo Sapiens
AVCLFGCPP

SEQ ID NO: 252703 - protein, 9 aa, Homo Sapiens
NLKDVQNNK

SEQ ID NO: 252704 - protein, 9 aa, Homo Sapiens
DLVSLIHCF

SEQ ID NO: 252705 - protein, 9 aa, Homo Sapiens
IIDAATFIS

SEQ ID NO: 252706 - protein, 9 aa, Homo Sapiens
SGSKSMSMA

SEQ ID NO: 252707 - protein, 9 aa, Homo Sapiens
VKISDLITG

SEQ ID NO: 252708 - protein, 9 aa, Homo Sapiens
VMPLVYMPT

SEQ ID NO: 252709 - protein, 9 aa, Homo Sapiens
VPKKSPTSQ

SEQ ID NO: 252710 - protein, 9 aa, Homo Sapiens
MPLVYMPTH

SEQ ID NO: 252711 - protein, 9 aa, Homo Sapiens
TFGKGLNLR

SEQ ID NO: 252712 - protein, 9 aa, Homo Sapiens
HLEILNGRH

SEQ ID NO: 252713 - protein, 9 aa, Homo Sapiens
EQANFTMLP

SEQ ID NO: 252714 - protein, 9 aa, Homo Sapiens
FSVPERIAI

SEQ ID NO: 252715 - protein, 9 aa, Homo Sapiens
WKCPVKFDD

SEQ ID NO: 252716 - protein, 9 aa, Homo Sapiens
KETQEGIIN

SEQ ID NO: 252717 - protein, 9 aa, Homo Sapiens
VMSKLSDQI

SEQ ID NO: 252718 - protein, 9 aa, Homo Sapiens
AKLLSPRQT

SEQ ID NO: 252719 - protein, 9 aa, Homo Sapiens
STISANSTH

SEQ ID NO: 252720 - protein, 9 aa, Homo Sapiens
VSDGMEVPD

SEQ ID NO: 252721 - protein, 9 aa, Homo Sapiens
RSKALSAFD

SEQ ID NO: 252722 - protein, 9 aa, Homo Sapiens
GNIIRVSAL

SEQ ID NO: 252723 - protein, 9 aa, Homo Sapiens
KNCLKHHVI

SEQ ID NO: 252724 - protein, 9 aa, Homo Sapiens
EENIDNIKI

SEQ ID NO: 252725 - protein, 9 aa, Homo Sapiens
YNQAYLLLE

SEQ ID NO: 252726 - protein, 9 aa, Homo Sapiens
LENREVLEQ

SEQ ID NO: 252727 - protein, 9 aa, Homo Sapiens
DETLQGKIN

SEQ ID NO: 252728 - protein, 9 aa, Homo Sapiens
TFLLAWMIP

SEQ ID NO: 252729 - protein, 9 aa, Homo Sapiens
SITFDPFIY

SEQ ID NO: 252730 - protein, 9 aa, Homo Sapiens
IDRYASDNV

SEQ ID NO: 252731 - protein, 9 aa, Homo Sapiens
TKHLLTSGS

SEQ ID NO: 252732 - protein, 9 aa, Homo Sapiens
GRSKDKNIL

SEQ ID NO: 252733 - protein, 9 aa, Homo Sapiens
PSVNIETKD

SEQ ID NO: 252734 - protein, 9 aa, Homo Sapiens
ANVSVPADT

SEQ ID NO: 252735 - protein, 9 aa, Homo Sapiens
GDKLQSPQF

SEQ ID NO: 252736 - protein, 9 aa, Homo Sapiens
DDSSSFCLA

SEQ ID NO: 252737 - protein, 9 aa, Homo Sapiens
EQCDNMNKI

SEQ ID NO: 252738 - protein, 9 aa, Homo Sapiens
PCPFPLPII

SEQ ID NO: 252739 - protein, 9 aa, Homo Sapiens
EIFQRCNCG

SEQ ID NO: 252740 - protein, 9 aa, Homo Sapiens
SRTRYPEKK

SEQ ID NO: 252741 - protein, 9 aa, Homo Sapiens
LLHFNVLVL

SEQ ID NO: 252742 - protein, 9 aa, Homo Sapiens
GLIAVVTQD

SEQ ID NO: 252743 - protein, 9 aa, Homo Sapiens
PPQKVLFRF

SEQ ID NO: 252744 - protein, 9 aa, Homo Sapiens
LCPSLCSYS

SEQ ID NO: 252745 - protein, 9 aa, Homo Sapiens
LYDKWIKDA

SEQ ID NO: 252746 - protein, 9 aa, Homo Sapiens
LKKMAYLAR

SEQ ID NO: 252747 - protein, 9 aa, Homo Sapiens
QTSLVQEFP

SEQ ID NO: 252748 - protein, 9 aa, Homo Sapiens
YNTSQTCDW

SEQ ID NO: 252749 - protein, 9 aa, Homo Sapiens
GTIVVAASV

SEQ ID NO: 252750 - protein, 9 aa, Homo Sapiens
EAAYHKGRD

SEQ ID NO: 252751 - protein, 9 aa, Homo Sapiens
KADADEGIF

SEQ ID NO: 252752 - protein, 9 aa, Homo Sapiens
NGGKQFCSI

SEQ ID NO: 252753 - protein, 9 aa, Homo Sapiens
NFNNFPRQY

SEQ ID NO: 252754 - protein, 9 aa, Homo Sapiens
QDITFTDVS

SEQ ID NO: 252755 - protein, 9 aa, Homo Sapiens
SENASTNVP

SEQ ID NO: 252756 - protein, 9 aa, Homo Sapiens
SGQNFQHIS

SEQ ID NO: 252757 - protein, 9 aa, Homo Sapiens
ITAVNNFIL

SEQ ID NO: 252758 - protein, 9 aa, Homo Sapiens
EEEVEKPEE

SEQ ID NO: 252759 - protein, 9 aa, Homo Sapiens
APEASRQDK

SEQ ID NO: 252760 - protein, 9 aa, Homo Sapiens
LDKLMYNAY

SEQ ID NO: 252761 - protein, 9 aa, Homo Sapiens
RLFISHANE

SEQ ID NO: 252762 - protein, 9 aa, Homo Sapiens
DKNITLHCE

SEQ ID NO: 252763 - protein, 9 aa, Homo Sapiens
KYILVLPLD

SEQ ID NO: 252764 - protein, 9 aa, Homo Sapiens
QGSPAVDKG

SEQ ID NO: 252765 - protein, 9 aa, Homo Sapiens
EDGLNLEEI

SEQ ID NO: 252766 - protein, 9 aa, Homo Sapiens
DFIQLHKLI

SEQ ID NO: 252767 - protein, 9 aa, Homo Sapiens
CHTGNTPFV

SEQ ID NO: 252768 - protein, 9 aa, Homo Sapiens
MFSESHKTV

SEQ ID NO: 252769 - protein, 9 aa, Homo Sapiens
DSRRRKTEY

SEQ ID NO: 252770 - protein, 9 aa, Homo Sapiens
SVLSPHIKY

SEQ ID NO: 252771 - protein, 9 aa, Homo Sapiens
PQQELHNQC

SEQ ID NO: 252772 - protein, 9 aa, Homo Sapiens
DKTCMFCHP

SEQ ID NO: 252773 - protein, 9 aa, Homo Sapiens
KHRNGTKNS

SEQ ID NO: 252774 - protein, 9 aa, Homo Sapiens
DYEVYKTAR

SEQ ID NO: 252775 - protein, 9 aa, Homo Sapiens
NIQVLESSL

SEQ ID NO: 252776 - protein, 9 aa, Homo Sapiens
QTCYIANLF

SEQ ID NO: 252777 - protein, 9 aa, Homo Sapiens
YLITMMGNV

SEQ ID NO: 252778 - protein, 9 aa, Homo Sapiens
IFLGGVDKI

SEQ ID NO: 252779 - protein, 9 aa, Homo Sapiens
VQNIHTEDK

SEQ ID NO: 252780 - protein, 9 aa, Homo Sapiens
LIGVLNVII

SEQ ID NO: 252781 - protein, 9 aa, Homo Sapiens
TQGLPWIFE

SEQ ID NO: 252782 - protein, 9 aa, Homo Sapiens
IYFAPATSH

SEQ ID NO: 252783 - protein, 9 aa, Homo Sapiens
FKVLQGCWL

SEQ ID NO: 252784 - protein, 9 aa, Homo Sapiens
SPLPPLLAQ

SEQ ID NO: 252785 - protein, 9 aa, Homo Sapiens
STIIRSKKS

SEQ ID NO: 252786 - protein, 9 aa, Homo Sapiens
SPFKYGWDN

SEQ ID NO: 252787 - protein, 9 aa, Homo Sapiens
LSHAIGKQQ

SEQ ID NO: 252788 - protein, 9 aa, Homo Sapiens
DIDPEGKTF

SEQ ID NO: 252789 - protein, 9 aa, Homo Sapiens
HLQGLFILA

SEQ ID NO: 252790 - protein, 9 aa, Homo Sapiens
TGEVCEDLK

SEQ ID NO: 252791 - protein, 9 aa, Homo Sapiens
VLQSYPASG

SEQ ID NO: 252792 - protein, 9 aa, Homo Sapiens
QLAPPAMLS

SEQ ID NO: 252793 - protein, 9 aa, Homo Sapiens
LRMMIFSWI

SEQ ID NO: 252794 - protein, 9 aa, Homo Sapiens
PMTNCSTVS

SEQ ID NO: 252795 - protein, 9 aa, Homo Sapiens
SFVKVLMHL

SEQ ID NO: 252796 - protein, 9 aa, Homo Sapiens
TELHSTATQ

SEQ ID NO: 252797 - protein, 9 aa, Homo Sapiens
FNQENTTYL

SEQ ID NO: 252798 - protein, 9 aa, Homo Sapiens
VPVPRGLPG

SEQ ID NO: 252799 - protein, 9 aa, Homo Sapiens
DYELPTCSC

SEQ ID NO: 252800 - protein, 9 aa, Homo Sapiens
KVVERELGA

SEQ ID NO: 252801 - protein, 9 aa, Homo Sapiens
THATRMRTF

SEQ ID NO: 252802 - protein, 9 aa, Homo Sapiens
RYRSIVNPM

SEQ ID NO: 252803 - protein, 9 aa, Homo Sapiens
LQAEGAKVE

SEQ ID NO: 252804 - protein, 9 aa, Homo Sapiens
DFRIYSIRD

SEQ ID NO: 252805 - protein, 9 aa, Homo Sapiens
NMAARLAAA

SEQ ID NO: 252806 - protein, 9 aa, Homo Sapiens
NDPIRGPGG

SEQ ID NO: 252807 - protein, 9 aa, Homo Sapiens
ALYSHILDY

SEQ ID NO: 252808 - protein, 9 aa, Homo Sapiens
CTTLTAISM

SEQ ID NO: 252809 - protein, 9 aa, Homo Sapiens
ENNMKMIEL

SEQ ID NO: 252810 - protein, 9 aa, Homo Sapiens
MQNTLTRFV

SEQ ID NO: 252811 - protein, 9 aa, Homo Sapiens
VERFKDNKP

SEQ ID NO: 252812 - protein, 9 aa, Homo Sapiens
TFYMASNNL

SEQ ID NO: 252813 - protein, 9 aa, Homo Sapiens
KKRRSTPLT

SEQ ID NO: 252814 - protein, 9 aa, Homo Sapiens
LSIKGIEHL

SEQ ID NO: 252815 - protein, 9 aa, Homo Sapiens
LTDYINKVK

SEQ ID NO: 252816 - protein, 9 aa, Homo Sapiens
APETRRKVE

SEQ ID NO: 252817 - protein, 9 aa, Homo Sapiens
KQQGKTFIR

SEQ ID NO: 252818 - protein, 9 aa, Homo Sapiens
NMGICKRRV

SEQ ID NO: 252819 - protein, 9 aa, Homo Sapiens
LCFLLLSAH

SEQ ID NO: 252820 - protein, 9 aa, Homo Sapiens
VLQKKGHKI

SEQ ID NO: 252821 - protein, 9 aa, Homo Sapiens
SEKLEEWNE

SEQ ID NO: 252822 - protein, 9 aa, Homo Sapiens
LTKKEKNVL

SEQ ID NO: 252823 - protein, 9 aa, Homo Sapiens
LGAMDVSTC

SEQ ID NO: 252824 - protein, 9 aa, Homo Sapiens
SGMPELQYF

SEQ ID NO: 252825 - protein, 9 aa, Homo Sapiens
VMDKFGFSL

SEQ ID NO: 252826 - protein, 9 aa, Homo Sapiens
MYGECTMQI

SEQ ID NO: 252827 - protein, 9 aa, Homo Sapiens
LEYGGCYLC

SEQ ID NO: 252828 - protein, 9 aa, Homo Sapiens
FKQFCSLRN

SEQ ID NO: 252829 - protein, 9 aa, Homo Sapiens
LVPSPDQKD

SEQ ID NO: 252830 - protein, 9 aa, Homo Sapiens
ISDDEEDKG

SEQ ID NO: 252831 - protein, 9 aa, Homo Sapiens
HELGEFAML

SEQ ID NO: 252832 - protein, 9 aa, Homo Sapiens
SGQILTCLS

SEQ ID NO: 252833 - protein, 9 aa, Homo Sapiens
PRTVLFWAP

SEQ ID NO: 252834 - protein, 9 aa, Homo Sapiens
LLNPKWPNA

SEQ ID NO: 252835 - protein, 9 aa, Homo Sapiens
NILKQTCYI

SEQ ID NO: 252836 - protein, 9 aa, Homo Sapiens
NVEIDLTGS

SEQ ID NO: 252837 - protein, 9 aa, Homo Sapiens
QARFLQGFG

SEQ ID NO: 252838 - protein, 9 aa, Homo Sapiens
GDSEKLVWV

SEQ ID NO: 252839 - protein, 9 aa, Homo Sapiens
EVDKDYQKK

SEQ ID NO: 252840 - protein, 9 aa, Homo Sapiens
FNLVHLTEL

SEQ ID NO: 252841 - protein, 9 aa, Homo Sapiens
SLNELKTEL

SEQ ID NO: 252842 - protein, 9 aa, Homo Sapiens
RAAEKVEEN

SEQ ID NO: 252843 - protein, 9 aa, Homo Sapiens
YATPVDLWI

SEQ ID NO: 252844 - protein, 9 aa, Homo Sapiens
DSKHQCVQL

SEQ ID NO: 252845 - protein, 9 aa, Homo Sapiens
TNEFTFLKP

SEQ ID NO: 252846 - protein, 9 aa, Homo Sapiens
GSLNWGYQV

SEQ ID NO: 252847 - protein, 9 aa, Homo Sapiens
VAIIGLLIV

SEQ ID NO: 252848 - protein, 9 aa, Homo Sapiens
RPCKRTACQ

SEQ ID NO: 252849 - protein, 9 aa, Homo Sapiens
LQLDLSIVK

SEQ ID NO: 252850 - protein, 9 aa, Homo Sapiens
LEPDFVPNE

SEQ ID NO: 252851 - protein, 9 aa, Homo Sapiens
WLTWPFCVL

SEQ ID NO: 252852 - protein, 9 aa, Homo Sapiens
ESMDANEPT

SEQ ID NO: 252853 - protein, 9 aa, Homo Sapiens
EFTFLKPII

SEQ ID NO: 252854 - protein, 9 aa, Homo Sapiens
QLKSKGLTL

SEQ ID NO: 252855 - protein, 9 aa, Homo Sapiens
EEEEDKDST

SEQ ID NO: 252856 - protein, 9 aa, Homo Sapiens
GEFYLRQPS

SEQ ID NO: 252857 - protein, 9 aa, Homo Sapiens
ELPKLEKRR

SEQ ID NO: 252858 - protein, 9 aa, Homo Sapiens
ESLMLFDAI

SEQ ID NO: 252859 - protein, 9 aa, Homo Sapiens
GSGGVQRGG

SEQ ID NO: 252860 - protein, 9 aa, Homo Sapiens
DEELKTEAK

SEQ ID NO: 252861 - protein, 9 aa, Homo Sapiens
FRRLFELFV

SEQ ID NO: 252862 - protein, 9 aa, Homo Sapiens
SGGQTPGAR

SEQ ID NO: 252863 - protein, 9 aa, Homo Sapiens
CSTPGPGIK

SEQ ID NO: 252864 - protein, 9 aa, Homo Sapiens
AWITQGQPL

SEQ ID NO: 252865 - protein, 9 aa, Homo Sapiens
WAGSNMKNM

SEQ ID NO: 252866 - protein, 9 aa, Homo Sapiens
IHQILERMC

SEQ ID NO: 252867 - protein, 9 aa, Homo Sapiens
IEIRAQVAD

SEQ ID NO: 252868 - protein, 9 aa, Homo Sapiens
FSVVLQKEE

SEQ ID NO: 252869 - protein, 9 aa, Homo Sapiens
FFWKNMTFI

SEQ ID NO: 252870 - protein, 9 aa, Homo Sapiens
MKWVESIVL

SEQ ID NO: 252871 - protein, 9 aa, Homo Sapiens
LASSESMRK

SEQ ID NO: 252872 - protein, 9 aa, Homo Sapiens
MQLVRGIRK

SEQ ID NO: 252873 - protein, 9 aa, Homo Sapiens
KESHVNQVI

SEQ ID NO: 252874 - protein, 9 aa, Homo Sapiens
KEPALDPTD

SEQ ID NO: 252875 - protein, 9 aa, Homo Sapiens
LFNTETPLT

SEQ ID NO: 252876 - protein, 9 aa, Homo Sapiens
WDPGWEGLH

SEQ ID NO: 252877 - protein, 9 aa, Homo Sapiens
YKILAVFYT

SEQ ID NO: 252878 - protein, 9 aa, Homo Sapiens
IQQQTPQPS

SEQ ID NO: 252879 - protein, 9 aa, Homo Sapiens
GYFYYMAGN

SEQ ID NO: 252880 - protein, 9 aa, Homo Sapiens
QIEDVIHKL

SEQ ID NO: 252881 - protein, 9 aa, Homo Sapiens
AVLRSNGVP

SEQ ID NO: 252882 - protein, 9 aa, Homo Sapiens
GYPEVKDTL

SEQ ID NO: 252883 - protein, 9 aa, Homo Sapiens
ETQVGICQD

SEQ ID NO: 252884 - protein, 9 aa, Homo Sapiens
AKAASQGRQ

SEQ ID NO: 252885 - protein, 9 aa, Homo Sapiens
HDKEIIRGQ

SEQ ID NO: 252886 - protein, 9 aa, Homo Sapiens
VLAVNIYID

SEQ ID NO: 252887 - protein, 9 aa, Homo Sapiens
LMKLPFTTP

SEQ ID NO: 252888 - protein, 9 aa, Homo Sapiens
FGGQPLDIL

SEQ ID NO: 252889 - protein, 9 aa, Homo Sapiens
FPKSKSVAI

SEQ ID NO: 252890 - protein, 9 aa, Homo Sapiens
KLAMDSFPS

SEQ ID NO: 252891 - protein, 9 aa, Homo Sapiens
KIYRYVYHS

SEQ ID NO: 252892 - protein, 9 aa, Homo Sapiens
ASLPWRLQM

SEQ ID NO: 252893 - protein, 9 aa, Homo Sapiens
IPCLSPNCP

SEQ ID NO: 252894 - protein, 9 aa, Homo Sapiens
KLYSAENDR

SEQ ID NO: 252895 - protein, 9 aa, Homo Sapiens
SDRIGSTID

SEQ ID NO: 252896 - protein, 9 aa, Homo Sapiens
PFIYLPVPL

SEQ ID NO: 252897 - protein, 9 aa, Homo Sapiens
QELPQILGD

SEQ ID NO: 252898 - protein, 9 aa, Homo Sapiens
FDCKADADE

SEQ ID NO: 252899 - protein, 9 aa, Homo Sapiens
TVLNSQAYL

SEQ ID NO: 252900 - protein, 9 aa, Homo Sapiens
ITLLRATNA

SEQ ID NO: 252901 - protein, 9 aa, Homo Sapiens
DVCDAFPPL

SEQ ID NO: 252902 - protein, 9 aa, Homo Sapiens
DSIGLDYSS

SEQ ID NO: 252903 - protein, 9 aa, Homo Sapiens
QIYIETSQL

SEQ ID NO: 252904 - protein, 9 aa, Homo Sapiens
LDDQGDSEG

SEQ ID NO: 252905 - protein, 9 aa, Homo Sapiens
GRRTRQRVK

SEQ ID NO: 252906 - protein, 9 aa, Homo Sapiens
YAAAADVLG

SEQ ID NO: 252907 - protein, 9 aa, Homo Sapiens
TNVGNGNQF

SEQ ID NO: 252908 - protein, 9 aa, Homo Sapiens
GVCSNNVER

SEQ ID NO: 252909 - protein, 9 aa, Homo Sapiens
DYDNSAFME

SEQ ID NO: 252910 - protein, 9 aa, Homo Sapiens
IDHGIPITG

SEQ ID NO: 252911 - protein, 9 aa, Homo Sapiens
QEKKENLLL

SEQ ID NO: 252912 - protein, 9 aa, Homo Sapiens
PLATKEIIS

SEQ ID NO: 252913 - protein, 9 aa, Homo Sapiens
SPLKYGSQM

SEQ ID NO: 252914 - protein, 9 aa, Homo Sapiens
ENVFIGGTK

SEQ ID NO: 252915 - protein, 9 aa, Homo Sapiens
QRVVVEDSV

SEQ ID NO: 252916 - protein, 9 aa, Homo Sapiens
VSHYELSRV

SEQ ID NO: 252917 - protein, 9 aa, Homo Sapiens
GQNGQKTYQ

SEQ ID NO: 252918 - protein, 9 aa, Homo Sapiens
KVQKLSAPR

SEQ ID NO: 252919 - protein, 9 aa, Homo Sapiens
VGMAPSSPI

SEQ ID NO: 252920 - protein, 9 aa, Homo Sapiens
MHELEYLVY

SEQ ID NO: 252921 - protein, 9 aa, Homo Sapiens
SQLYAWPFL

SEQ ID NO: 252922 - protein, 9 aa, Homo Sapiens
ITLSNWWFV

SEQ ID NO: 252923 - protein, 9 aa, Homo Sapiens
LMPEVTPDM

SEQ ID NO: 252924 - protein, 9 aa, Homo Sapiens
LDEFLNKPA

SEQ ID NO: 252925 - protein, 9 aa, Homo Sapiens
AGISCTYFI

SEQ ID NO: 252926 - protein, 9 aa, Homo Sapiens
VSTVQHLEM

SEQ ID NO: 252927 - protein, 9 aa, Homo Sapiens
CMERGKAFS

SEQ ID NO: 252928 - protein, 9 aa, Homo Sapiens
ALTQNVITD

SEQ ID NO: 252929 - protein, 9 aa, Homo Sapiens
YQQMVLDAV

SEQ ID NO: 252930 - protein, 9 aa, Homo Sapiens
RMVWVAWLF

SEQ ID NO: 252931 - protein, 9 aa, Homo Sapiens
GPDKPRGTQ

SEQ ID NO: 252932 - protein, 9 aa, Homo Sapiens
QRRRSSTQL

SEQ ID NO: 252933 - protein, 9 aa, Homo Sapiens
LQCKLYSSL

SEQ ID NO: 252934 - protein, 9 aa, Homo Sapiens
LEHILLFIR

SEQ ID NO: 252935 - protein, 9 aa, Homo Sapiens
SKYSTPNLQ

SEQ ID NO: 252936 - protein, 9 aa, Homo Sapiens
HDKDPESFV

SEQ ID NO: 252937 - protein, 9 aa, Homo Sapiens
FRVALTLIR

SEQ ID NO: 252938 - protein, 9 aa, Homo Sapiens
LNDFKALDS

SEQ ID NO: 252939 - protein, 9 aa, Homo Sapiens
IIGDHHWKC

SEQ ID NO: 252940 - protein, 9 aa, Homo Sapiens
GNELEYFYL

SEQ ID NO: 252941 - protein, 9 aa, Homo Sapiens
EPSEDPEAE

SEQ ID NO: 252942 - protein, 9 aa, Homo Sapiens
DAGVKLFFH

SEQ ID NO: 252943 - protein, 9 aa, Homo Sapiens
ILICNRVTD

SEQ ID NO: 252944 - protein, 9 aa, Homo Sapiens
SDLWEIEEK

SEQ ID NO: 252945 - protein, 9 aa, Homo Sapiens
SAEDCGFIQ

SEQ ID NO: 252946 - protein, 9 aa, Homo Sapiens
RVVTLLEYH

SEQ ID NO: 252947 - protein, 9 aa, Homo Sapiens
KEITRQATS

SEQ ID NO: 252948 - protein, 9 aa, Homo Sapiens
NTSDEGIYR

SEQ ID NO: 252949 - protein, 9 aa, Homo Sapiens
DLKECILII

SEQ ID NO: 252950 - protein, 9 aa, Homo Sapiens
YRPHLLLSG

SEQ ID NO: 252951 - protein, 9 aa, Homo Sapiens
TREEKHCMC

SEQ ID NO: 252952 - protein, 9 aa, Homo Sapiens
EIKIKQKLI

SEQ ID NO: 252953 - protein, 9 aa, Homo Sapiens
LSIEKLSET

SEQ ID NO: 252954 - protein, 9 aa, Homo Sapiens
PLLYNIVMP

SEQ ID NO: 252955 - protein, 9 aa, Homo Sapiens
TGLAPDPVF

SEQ ID NO: 252956 - protein, 9 aa, Homo Sapiens
SECEAPGTE

SEQ ID NO: 252957 - protein, 9 aa, Homo Sapiens
MFSNTFFHE

SEQ ID NO: 252958 - protein, 9 aa, Homo Sapiens
NYFIQGPSG

SEQ ID NO: 252959 - protein, 9 aa, Homo Sapiens
WSSNLAKDQ

SEQ ID NO: 252960 - protein, 9 aa, Homo Sapiens
WEKRITKLN

SEQ ID NO: 252961 - protein, 9 aa, Homo Sapiens
EGAEEFEEK

SEQ ID NO: 252962 - protein, 9 aa, Homo Sapiens
FSNLSFLDI

SEQ ID NO: 252963 - protein, 9 aa, Homo Sapiens
CESSVHWPI

SEQ ID NO: 252964 - protein, 9 aa, Homo Sapiens
AHKVFIPDD

SEQ ID NO: 252965 - protein, 9 aa, Homo Sapiens
KNLLEGEVD

SEQ ID NO: 252966 - protein, 9 aa, Homo Sapiens
FPVIVESLT

SEQ ID NO: 252967 - protein, 9 aa, Homo Sapiens
RLTSTPNVH

SEQ ID NO: 252968 - protein, 9 aa, Homo Sapiens
AYSGIWDNF

SEQ ID NO: 252969 - protein, 9 aa, Homo Sapiens
RQLRRIGLD

SEQ ID NO: 252970 - protein, 9 aa, Homo Sapiens
RAFTQKSEL

SEQ ID NO: 252971 - protein, 9 aa, Homo Sapiens
ADLQIRKSQ

SEQ ID NO: 252972 - protein, 9 aa, Homo Sapiens
AVTLRRGLI

SEQ ID NO: 252973 - protein, 9 aa, Homo Sapiens
VYEDFYFSE

SEQ ID NO: 252974 - protein, 9 aa, Homo Sapiens
SRPCKRTAC

SEQ ID NO: 252975 - protein, 9 aa, Homo Sapiens
MNSVVPSDK

SEQ ID NO: 252976 - protein, 9 aa, Homo Sapiens
LDQPISLDR

SEQ ID NO: 252977 - protein, 9 aa, Homo Sapiens
DNYAVTVML

SEQ ID NO: 252978 - protein, 9 aa, Homo Sapiens
SLDRLVVKS

SEQ ID NO: 252979 - protein, 9 aa, Homo Sapiens
WSKCETIFF

SEQ ID NO: 252980 - protein, 9 aa, Homo Sapiens
NRRRKRSGN

SEQ ID NO: 252981 - protein, 9 aa, Homo Sapiens
DRHCNVTPL

SEQ ID NO: 252982 - protein, 9 aa, Homo Sapiens
LHEPFASVA

SEQ ID NO: 252983 - protein, 9 aa, Homo Sapiens
KVLKALDPK

SEQ ID NO: 252984 - protein, 9 aa, Homo Sapiens
ALRNVIIIT

SEQ ID NO: 252985 - protein, 9 aa, Homo Sapiens
TVSRPRSSP

SEQ ID NO: 252986 - protein, 9 aa, Homo Sapiens
ESVSLKEKL

SEQ ID NO: 252987 - protein, 9 aa, Homo Sapiens
QKKPPSSQT

SEQ ID NO: 252988 - protein, 9 aa, Homo Sapiens
ICLNTEWVE

SEQ ID NO: 252989 - protein, 9 aa, Homo Sapiens
MLTVVNKLD

SEQ ID NO: 252990 - protein, 9 aa, Homo Sapiens
DDLGFELFE

SEQ ID NO: 252991 - protein, 9 aa, Homo Sapiens
LRVLGKLLR

SEQ ID NO: 252992 - protein, 9 aa, Homo Sapiens
IRTPIFGGQ

SEQ ID NO: 252993 - protein, 9 aa, Homo Sapiens
TLFNCLMYK

SEQ ID NO: 252994 - protein, 9 aa, Homo Sapiens
LKKNQNAFL

SEQ ID NO: 252995 - protein, 9 aa, Homo Sapiens
NYNEIHKNG

SEQ ID NO: 252996 - protein, 9 aa, Homo Sapiens
KKTQVTHNP

SEQ ID NO: 252997 - protein, 9 aa, Homo Sapiens
FKISKDVLA

SEQ ID NO: 252998 - protein, 9 aa, Homo Sapiens
APTGFPCVR

SEQ ID NO: 252999 - protein, 9 aa, Homo Sapiens
IQVKRLEWK

SEQ ID NO: 253000 - protein, 9 aa, Homo Sapiens
QNAHNNSTG

SEQ ID NO: 253001 - protein, 9 aa, Homo Sapiens
NGNHDAFNI

SEQ ID NO: 253002 - protein, 9 aa, Homo Sapiens
LNKHLKGKV

SEQ ID NO: 253003 - protein, 9 aa, Homo Sapiens
TLLTVFSDT

SEQ ID NO: 253004 - protein, 9 aa, Homo Sapiens
PMDSSFAHT

SEQ ID NO: 253005 - protein, 9 aa, Homo Sapiens
AQMKTLKPT

SEQ ID NO: 253006 - protein, 9 aa, Homo Sapiens
VAGEAEKYN

SEQ ID NO: 253007 - protein, 9 aa, Homo Sapiens
KMKNNFICK

SEQ ID NO: 253008 - protein, 9 aa, Homo Sapiens
MVFDVQRKG

SEQ ID NO: 253009 - protein, 9 aa, Homo Sapiens
EYQDYAPQP

SEQ ID NO: 253010 - protein, 9 aa, Homo Sapiens
SLVYGKKQP

SEQ ID NO: 253011 - protein, 9 aa, Homo Sapiens
FRQADEVKS

SEQ ID NO: 253012 - protein, 9 aa, Homo Sapiens
ANQYHPDSG

SEQ ID NO: 253013 - protein, 9 aa, Homo Sapiens
GKCLGPFLT

SEQ ID NO: 253014 - protein, 9 aa, Homo Sapiens
EWNLNMLQC

SEQ ID NO: 253015 - protein, 9 aa, Homo Sapiens
QHEAALECL

SEQ ID NO: 253016 - protein, 9 aa, Homo Sapiens
PQRCTVDGS

SEQ ID NO: 253017 - protein, 9 aa, Homo Sapiens
PSYYLKNTS

SEQ ID NO: 253018 - protein, 9 aa, Homo Sapiens
RLAKAQETS

SEQ ID NO: 253019 - protein, 9 aa, Homo Sapiens
LPWIFEELL

SEQ ID NO: 253020 - protein, 9 aa, Homo Sapiens
KLQLLEHSL

SEQ ID NO: 253021 - protein, 9 aa, Homo Sapiens
YGPGARFIH

SEQ ID NO: 253022 - protein, 9 aa, Homo Sapiens
SLLKTPKQV

SEQ ID NO: 253023 - protein, 9 aa, Homo Sapiens
SLDAAGHEG

SEQ ID NO: 253024 - protein, 9 aa, Homo Sapiens
GLNLLHQHH

SEQ ID NO: 253025 - protein, 9 aa, Homo Sapiens
KLSAPREMP

SEQ ID NO: 253026 - protein, 9 aa, Homo Sapiens
RADPNIQYK

SEQ ID NO: 253027 - protein, 9 aa, Homo Sapiens
DCKIRLFIG

SEQ ID NO: 253028 - protein, 9 aa, Homo Sapiens
HKMKVIKSL

SEQ ID NO: 253029 - protein, 9 aa, Homo Sapiens
IFLLICGLQ

SEQ ID NO: 253030 - protein, 9 aa, Homo Sapiens
EIEFRNAIF

SEQ ID NO: 253031 - protein, 9 aa, Homo Sapiens
VLFQRDSLV

SEQ ID NO: 253032 - protein, 9 aa, Homo Sapiens
FQDKNLMEN

SEQ ID NO: 253033 - protein, 9 aa, Homo Sapiens
KFEGWYFHS

SEQ ID NO: 253034 - protein, 9 aa, Homo Sapiens
ASHYKNLKY

SEQ ID NO: 253035 - protein, 9 aa, Homo Sapiens
IPSSQVKYS

SEQ ID NO: 253036 - protein, 9 aa, Homo Sapiens
TRFMTPEFR

SEQ ID NO: 253037 - protein, 9 aa, Homo Sapiens
DQMFDMGFE

SEQ ID NO: 253038 - protein, 9 aa, Homo Sapiens
LKEVIPEGE

SEQ ID NO: 253039 - protein, 9 aa, Homo Sapiens
ITPLRQRSR

SEQ ID NO: 253040 - protein, 9 aa, Homo Sapiens
NPWTVRPFS

SEQ ID NO: 253041 - protein, 9 aa, Homo Sapiens
AGTQEVVGD

SEQ ID NO: 253042 - protein, 9 aa, Homo Sapiens
IPENFSAFS

SEQ ID NO: 253043 - protein, 9 aa, Homo Sapiens
CGLFTHTSF

SEQ ID NO: 253044 - protein, 9 aa, Homo Sapiens
YNGGYGLSG

SEQ ID NO: 253045 - protein, 9 aa, Homo Sapiens
LMFTGHLLL

SEQ ID NO: 253046 - protein, 9 aa, Homo Sapiens
CRHNGSMVG

SEQ ID NO: 253047 - protein, 9 aa, Homo Sapiens
APFLDHTGL

SEQ ID NO: 253048 - protein, 9 aa, Homo Sapiens
GHQHGYRIQ

SEQ ID NO: 253049 - protein, 9 aa, Homo Sapiens
AAEDSNAKI

SEQ ID NO: 253050 - protein, 9 aa, Homo Sapiens
RHFLEAEFL

SEQ ID NO: 253051 - protein, 9 aa, Homo Sapiens
NTTPRVENQ

SEQ ID NO: 253052 - protein, 9 aa, Homo Sapiens
GDPNAEAGL

SEQ ID NO: 253053 - protein, 9 aa, Homo Sapiens
EWEVYATAV

SEQ ID NO: 253054 - protein, 9 aa, Homo Sapiens
GAVATKVQR

SEQ ID NO: 253055 - protein, 9 aa, Homo Sapiens
RLTSHAIFN

SEQ ID NO: 253056 - protein, 9 aa, Homo Sapiens
NMQELVERL

SEQ ID NO: 253057 - protein, 9 aa, Homo Sapiens
SPSIKQNYS

SEQ ID NO: 253058 - protein, 9 aa, Homo Sapiens
CFYPNTINV

SEQ ID NO: 253059 - protein, 9 aa, Homo Sapiens
VSLFYVTVI

SEQ ID NO: 253060 - protein, 9 aa, Homo Sapiens
SVNYLKYLL

SEQ ID NO: 253061 - protein, 9 aa, Homo Sapiens
EIQYQEQIN

SEQ ID NO: 253062 - protein, 9 aa, Homo Sapiens
CLGETIAQW

SEQ ID NO: 253063 - protein, 9 aa, Homo Sapiens
ARPPRPRPK

SEQ ID NO: 253064 - protein, 9 aa, Homo Sapiens
KNSKYQLLN

SEQ ID NO: 253065 - protein, 9 aa, Homo Sapiens
KIFEEHVTG

SEQ ID NO: 253066 - protein, 9 aa, Homo Sapiens
PVVRRPDQK

SEQ ID NO: 253067 - protein, 9 aa, Homo Sapiens
PINYQLELA

SEQ ID NO: 253068 - protein, 9 aa, Homo Sapiens
KEYNFITMK

SEQ ID NO: 253069 - protein, 9 aa, Homo Sapiens
CHQHPQTRV

SEQ ID NO: 253070 - protein, 9 aa, Homo Sapiens
SIVNLDYPM

SEQ ID NO: 253071 - protein, 9 aa, Homo Sapiens
YAQYKKFKV

SEQ ID NO: 253072 - protein, 9 aa, Homo Sapiens
LTYALARAF

SEQ ID NO: 253073 - protein, 9 aa, Homo Sapiens
SNISLMHNG

SEQ ID NO: 253074 - protein, 9 aa, Homo Sapiens
REERISEFS

SEQ ID NO: 253075 - protein, 9 aa, Homo Sapiens
QIFSKNERF

SEQ ID NO: 253076 - protein, 9 aa, Homo Sapiens
DEFLKGEVP

SEQ ID NO: 253077 - protein, 9 aa, Homo Sapiens
YTKRNALCV

SEQ ID NO: 253078 - protein, 9 aa, Homo Sapiens
ACEEYAQNV

SEQ ID NO: 253079 - protein, 9 aa, Homo Sapiens
IIPLPTLKW

SEQ ID NO: 253080 - protein, 9 aa, Homo Sapiens
YFDDPRLLK

SEQ ID NO: 253081 - protein, 9 aa, Homo Sapiens
CNWMMCVRP

SEQ ID NO: 253082 - protein, 9 aa, Homo Sapiens
CTRKESKVM

SEQ ID NO: 253083 - protein, 9 aa, Homo Sapiens
ATDFQFGRE

SEQ ID NO: 253084 - protein, 9 aa, Homo Sapiens
PENAASPDN

SEQ ID NO: 253085 - protein, 9 aa, Homo Sapiens
RHLMVHQRI

SEQ ID NO: 253086 - protein, 9 aa, Homo Sapiens
NKLEENPYD

SEQ ID NO: 253087 - protein, 9 aa, Homo Sapiens
FDAHKINYG

SEQ ID NO: 253088 - protein, 9 aa, Homo Sapiens
QVGVSRPGR

SEQ ID NO: 253089 - protein, 9 aa, Homo Sapiens
LVNSQNDLA

SEQ ID NO: 253090 - protein, 9 aa, Homo Sapiens
SRIIIGDHH

SEQ ID NO: 253091 - protein, 9 aa, Homo Sapiens
SSRPETLDS

SEQ ID NO: 253092 - protein, 9 aa, Homo Sapiens
SDQEKDKEK

SEQ ID NO: 253093 - protein, 9 aa, Homo Sapiens
LLIIGIYCA

SEQ ID NO: 253094 - protein, 9 aa, Homo Sapiens
RGSKAAFLC

SEQ ID NO: 253095 - protein, 9 aa, Homo Sapiens
EYMDDERLK

SEQ ID NO: 253096 - protein, 9 aa, Homo Sapiens
TSQCLKNNS

SEQ ID NO: 253097 - protein, 9 aa, Homo Sapiens
CAKTLISLE

SEQ ID NO: 253098 - protein, 9 aa, Homo Sapiens
PTLAITYSI

SEQ ID NO: 253099 - protein, 9 aa, Homo Sapiens
PDLRHFRAV

SEQ ID NO: 253100 - protein, 9 aa, Homo Sapiens
GCYPGSQRS

SEQ ID NO: 253101 - protein, 9 aa, Homo Sapiens
DDEFLKGEV

SEQ ID NO: 253102 - protein, 9 aa, Homo Sapiens
TVWNKPTVE

SEQ ID NO: 253103 - protein, 9 aa, Homo Sapiens
CVILSRIII

SEQ ID NO: 253104 - protein, 9 aa, Homo Sapiens
HLQAPMYFF

SEQ ID NO: 253105 - protein, 9 aa, Homo Sapiens
CSLKSLEHK

SEQ ID NO: 253106 - protein, 9 aa, Homo Sapiens
YLALCCQPG

SEQ ID NO: 253107 - protein, 9 aa, Homo Sapiens
NILIPLSGC

SEQ ID NO: 253108 - protein, 9 aa, Homo Sapiens
AFGKCPTVV

SEQ ID NO: 253109 - protein, 9 aa, Homo Sapiens
IGYLCTDKS

SEQ ID NO: 253110 - protein, 9 aa, Homo Sapiens
GTFSSFVPS

SEQ ID NO: 253111 - protein, 9 aa, Homo Sapiens
KAKWLTSKK

SEQ ID NO: 253112 - protein, 9 aa, Homo Sapiens
LNDTRKMLS

SEQ ID NO: 253113 - protein, 9 aa, Homo Sapiens
LTTRSCIGR

SEQ ID NO: 253114 - protein, 9 aa, Homo Sapiens
KFKQLENSP

SEQ ID NO: 253115 - protein, 9 aa, Homo Sapiens
YFRAMFSIC

SEQ ID NO: 253116 - protein, 9 aa, Homo Sapiens
AFDEFLGIC

SEQ ID NO: 253117 - protein, 9 aa, Homo Sapiens
HSSLSHHQR

SEQ ID NO: 253118 - protein, 9 aa, Homo Sapiens
SIGLDYSSL

SEQ ID NO: 253119 - protein, 9 aa, Homo Sapiens
VIGLSIQRN

SEQ ID NO: 253120 - protein, 9 aa, Homo Sapiens
CSQYSDIVI

SEQ ID NO: 253121 - protein, 9 aa, Homo Sapiens
PYKCSECGN

SEQ ID NO: 253122 - protein, 9 aa, Homo Sapiens
QNPPQNKKV

SEQ ID NO: 253123 - protein, 9 aa, Homo Sapiens
YLDCCGNIM

SEQ ID NO: 253124 - protein, 9 aa, Homo Sapiens
YTNSKVTGK

SEQ ID NO: 253125 - protein, 9 aa, Homo Sapiens
DEVVKKKSK

SEQ ID NO: 253126 - protein, 9 aa, Homo Sapiens
STDITQLKI

SEQ ID NO: 253127 - protein, 9 aa, Homo Sapiens
LVGIIEELE

SEQ ID NO: 253128 - protein, 9 aa, Homo Sapiens
LGHPDNSVR

SEQ ID NO: 253129 - protein, 9 aa, Homo Sapiens
FVRDVTVLQ

SEQ ID NO: 253130 - protein, 9 aa, Homo Sapiens
PNMLGIFWF

SEQ ID NO: 253131 - protein, 9 aa, Homo Sapiens
NFTLAKLGI

SEQ ID NO: 253132 - protein, 9 aa, Homo Sapiens
GRCHSYSVI

SEQ ID NO: 253133 - protein, 9 aa, Homo Sapiens
RKNKEVFAR

SEQ ID NO: 253134 - protein, 9 aa, Homo Sapiens
TKNHKLAEM

SEQ ID NO: 253135 - protein, 9 aa, Homo Sapiens
TALILAAHL

SEQ ID NO: 253136 - protein, 9 aa, Homo Sapiens
NKPARTQGS

SEQ ID NO: 253137 - protein, 9 aa, Homo Sapiens
SNQELAIER

SEQ ID NO: 253138 - protein, 9 aa, Homo Sapiens
KRAQDIYVK

SEQ ID NO: 253139 - protein, 9 aa, Homo Sapiens
NTDSQRSGV

SEQ ID NO: 253140 - protein, 9 aa, Homo Sapiens
VWGSIQGLT

SEQ ID NO: 253141 - protein, 9 aa, Homo Sapiens
DRMIADGAP

SEQ ID NO: 253142 - protein, 9 aa, Homo Sapiens
TLKAASGTQ

SEQ ID NO: 253143 - protein, 9 aa, Homo Sapiens
WPSPALTLD

SEQ ID NO: 253144 - protein, 9 aa, Homo Sapiens
LGGVDKITQ

SEQ ID NO: 253145 - protein, 9 aa, Homo Sapiens
TLLAAADLV

SEQ ID NO: 253146 - protein, 9 aa, Homo Sapiens
AVLNEPLDE

SEQ ID NO: 253147 - protein, 9 aa, Homo Sapiens
HPHANNGRF

SEQ ID NO: 253148 - protein, 9 aa, Homo Sapiens
PSTQTGVIP

SEQ ID NO: 253149 - protein, 9 aa, Homo Sapiens
QYPAICSYQ

SEQ ID NO: 253150 - protein, 9 aa, Homo Sapiens
TAGLFRRSA

SEQ ID NO: 253151 - protein, 9 aa, Homo Sapiens
CLSDHFQIH

SEQ ID NO: 253152 - protein, 9 aa, Homo Sapiens
SNNSSEISS

SEQ ID NO: 253153 - protein, 9 aa, Homo Sapiens
PLKKNQNAF

SEQ ID NO: 253154 - protein, 9 aa, Homo Sapiens
QSHSREGRS

SEQ ID NO: 253155 - protein, 9 aa, Homo Sapiens
IIDYGICLN

SEQ ID NO: 253156 - protein, 9 aa, Homo Sapiens
YSSHVSWIA

SEQ ID NO: 253157 - protein, 9 aa, Homo Sapiens
TNCLTLWAA

SEQ ID NO: 253158 - protein, 9 aa, Homo Sapiens
SLASAQENY

SEQ ID NO: 253159 - protein, 9 aa, Homo Sapiens
DSWHLQQSS

SEQ ID NO: 253160 - protein, 9 aa, Homo Sapiens
LIIDAATFI

SEQ ID NO: 253161 - protein, 9 aa, Homo Sapiens
QLDTRLPVT

SEQ ID NO: 253162 - protein, 9 aa, Homo Sapiens
TPNLDMYGE

SEQ ID NO: 253163 - protein, 9 aa, Homo Sapiens
LWPAPVPGK

SEQ ID NO: 253164 - protein, 9 aa, Homo Sapiens
QTAQDMQEK

SEQ ID NO: 253165 - protein, 9 aa, Homo Sapiens
GRFQNHVHL

SEQ ID NO: 253166 - protein, 9 aa, Homo Sapiens
ELSILEADP

SEQ ID NO: 253167 - protein, 9 aa, Homo Sapiens
LGNSWAEIA

SEQ ID NO: 253168 - protein, 9 aa, Homo Sapiens
RFEYKEHGP

SEQ ID NO: 253169 - protein, 9 aa, Homo Sapiens
VSSSAVLCQ

SEQ ID NO: 253170 - protein, 9 aa, Homo Sapiens
PRPWENLNM

SEQ ID NO: 253171 - protein, 9 aa, Homo Sapiens
EGAAALGSA

SEQ ID NO: 253172 - protein, 9 aa, Homo Sapiens
SAFTNVGNG

SEQ ID NO: 253173 - protein, 9 aa, Homo Sapiens
VLPEEAHCF

SEQ ID NO: 253174 - protein, 9 aa, Homo Sapiens
ADLWMPAVR

SEQ ID NO: 253175 - protein, 9 aa, Homo Sapiens
HRFNNCMLY

SEQ ID NO: 253176 - protein, 9 aa, Homo Sapiens
ATGSKDDDD

SEQ ID NO: 253177 - protein, 9 aa, Homo Sapiens
NTGKRSYGC

SEQ ID NO: 253178 - protein, 9 aa, Homo Sapiens
LSKENQTLS

SEQ ID NO: 253179 - protein, 9 aa, Homo Sapiens
EDREAVRSE

SEQ ID NO: 253180 - protein, 9 aa, Homo Sapiens
DEFGIKQAA

SEQ ID NO: 253181 - protein, 9 aa, Homo Sapiens
KTCNLPLLM

SEQ ID NO: 253182 - protein, 9 aa, Homo Sapiens
CDSRYLCSD

SEQ ID NO: 253183 - protein, 9 aa, Homo Sapiens
EEIKQLTTD

SEQ ID NO: 253184 - protein, 9 aa, Homo Sapiens
SSDLLIHQK

SEQ ID NO: 253185 - protein, 9 aa, Homo Sapiens
GRRGVTQIG

SEQ ID NO: 253186 - protein, 9 aa, Homo Sapiens
EGLNTLFPD

SEQ ID NO: 253187 - protein, 9 aa, Homo Sapiens
ITVYRLDDY

SEQ ID NO: 253188 - protein, 9 aa, Homo Sapiens
MLFLLFLIL

SEQ ID NO: 253189 - protein, 9 aa, Homo Sapiens
VANMEEIKQ

SEQ ID NO: 253190 - protein, 9 aa, Homo Sapiens
KTEELFSVV

SEQ ID NO: 253191 - protein, 9 aa, Homo Sapiens
INAAKLNVS

SEQ ID NO: 253192 - protein, 9 aa, Homo Sapiens
ESLPCDICK

SEQ ID NO: 253193 - protein, 9 aa, Homo Sapiens
CDECGTSFS

SEQ ID NO: 253194 - protein, 9 aa, Homo Sapiens
SYKGLWSVC

SEQ ID NO: 253195 - protein, 9 aa, Homo Sapiens
CRCVRPGKC

SEQ ID NO: 253196 - protein, 9 aa, Homo Sapiens
EALGILQCF

SEQ ID NO: 253197 - protein, 9 aa, Homo Sapiens
DYQAVNDEI

SEQ ID NO: 253198 - protein, 9 aa, Homo Sapiens
TQNVLILEC

SEQ ID NO: 253199 - protein, 9 aa, Homo Sapiens
LDYLTSFLG

SEQ ID NO: 253200 - protein, 9 aa, Homo Sapiens
LEEEKVLEK

SEQ ID NO: 253201 - protein, 9 aa, Homo Sapiens
EMCQKPRPL

SEQ ID NO: 253202 - protein, 9 aa, Homo Sapiens
IDHTFEQIP

SEQ ID NO: 253203 - protein, 9 aa, Homo Sapiens
ERPALMVSS

SEQ ID NO: 253204 - protein, 9 aa, Homo Sapiens
IYLVQSVLV

SEQ ID NO: 253205 - protein, 9 aa, Homo Sapiens
VQKKAHPVR

SEQ ID NO: 253206 - protein, 9 aa, Homo Sapiens
SEEMTYIKK

SEQ ID NO: 253207 - protein, 9 aa, Homo Sapiens
KNKDKCDCI

SEQ ID NO: 253208 - protein, 9 aa, Homo Sapiens
KNFDIGPEF

SEQ ID NO: 253209 - protein, 9 aa, Homo Sapiens
QKTLRLCRF

SEQ ID NO: 253210 - protein, 9 aa, Homo Sapiens
HHNVHTAER

SEQ ID NO: 253211 - protein, 9 aa, Homo Sapiens
VYERTLMVD

SEQ ID NO: 253212 - protein, 9 aa, Homo Sapiens
EQGHFLIVP

SEQ ID NO: 253213 - protein, 9 aa, Homo Sapiens
NELVSVDFG

SEQ ID NO: 253214 - protein, 9 aa, Homo Sapiens
VNLKKNIHL

SEQ ID NO: 253215 - protein, 9 aa, Homo Sapiens
NRLKHIWNW

SEQ ID NO: 253216 - protein, 9 aa, Homo Sapiens
GDFNEFPAP

SEQ ID NO: 253217 - protein, 9 aa, Homo Sapiens
QQIHTGESS

SEQ ID NO: 253218 - protein, 9 aa, Homo Sapiens
LQPRLVVLQ

SEQ ID NO: 253219 - protein, 9 aa, Homo Sapiens
EIIKEAQKS

SEQ ID NO: 253220 - protein, 9 aa, Homo Sapiens
FECTLDDSA

SEQ ID NO: 253221 - protein, 9 aa, Homo Sapiens
VKESHVNQV

SEQ ID NO: 253222 - protein, 9 aa, Homo Sapiens
EALRMVWVA

SEQ ID NO: 253223 - protein, 9 aa, Homo Sapiens
FQPQLTDDY

SEQ ID NO: 253224 - protein, 9 aa, Homo Sapiens
KDLLAFISR

SEQ ID NO: 253225 - protein, 9 aa, Homo Sapiens
LPNFPHIDE

SEQ ID NO: 253226 - protein, 9 aa, Homo Sapiens
NFASLSGLH

SEQ ID NO: 253227 - protein, 9 aa, Homo Sapiens
SQLAPPAML

SEQ ID NO: 253228 - protein, 9 aa, Homo Sapiens
RVPAPFLDH

SEQ ID NO: 253229 - protein, 9 aa, Homo Sapiens
KCWVIASHP

SEQ ID NO: 253230 - protein, 9 aa, Homo Sapiens
HHPGPFLLL

SEQ ID NO: 253231 - protein, 9 aa, Homo Sapiens
VDLWPAPVP

SEQ ID NO: 253232 - protein, 9 aa, Homo Sapiens
SNAKNAVLS

SEQ ID NO: 253233 - protein, 9 aa, Homo Sapiens
RRKLEMQFV

SEQ ID NO: 253234 - protein, 9 aa, Homo Sapiens
EDYTHQFNT

SEQ ID NO: 253235 - protein, 9 aa, Homo Sapiens
LSREMNAKE

SEQ ID NO: 253236 - protein, 9 aa, Homo Sapiens
EKAHVDLFP

SEQ ID NO: 253237 - protein, 9 aa, Homo Sapiens
KVRTLKKCI

SEQ ID NO: 253238 - protein, 9 aa, Homo Sapiens
RSRADAESW

SEQ ID NO: 253239 - protein, 9 aa, Homo Sapiens
QPPGRQVME

SEQ ID NO: 253240 - protein, 9 aa, Homo Sapiens
RKWSSRPGI

SEQ ID NO: 253241 - protein, 9 aa, Homo Sapiens
KPLIPGLSK

SEQ ID NO: 253242 - protein, 9 aa, Homo Sapiens
YTHIYIHTH

SEQ ID NO: 253243 - protein, 9 aa, Homo Sapiens
KDPKYVRYS

SEQ ID NO: 253244 - protein, 9 aa, Homo Sapiens
ELEAEYLTV

SEQ ID NO: 253245 - protein, 9 aa, Homo Sapiens
TELIRAKLC

SEQ ID NO: 253246 - protein, 9 aa, Homo Sapiens
VWSMVNLVV

SEQ ID NO: 253247 - protein, 9 aa, Homo Sapiens
ADLTGAIKV

SEQ ID NO: 253248 - protein, 9 aa, Homo Sapiens
KKAHPVRTN

SEQ ID NO: 253249 - protein, 9 aa, Homo Sapiens
MATYLDRLL

SEQ ID NO: 253250 - protein, 9 aa, Homo Sapiens
EAHGRLAEL

SEQ ID NO: 253251 - protein, 9 aa, Homo Sapiens
EILISFIDH

SEQ ID NO: 253252 - protein, 9 aa, Homo Sapiens
MDGSIGAWA

SEQ ID NO: 253253 - protein, 9 aa, Homo Sapiens
QKDAEEEGD

SEQ ID NO: 253254 - protein, 9 aa, Homo Sapiens
KRIAPRYRW

SEQ ID NO: 253255 - protein, 9 aa, Homo Sapiens
DVIAKHRIK

SEQ ID NO: 253256 - protein, 9 aa, Homo Sapiens
SIPGVSLNS

SEQ ID NO: 253257 - protein, 9 aa, Homo Sapiens
LQHLVIPWA

SEQ ID NO: 253258 - protein, 9 aa, Homo Sapiens
HSSRDSVPS

SEQ ID NO: 253259 - protein, 9 aa, Homo Sapiens
LQPTWDVDL

SEQ ID NO: 253260 - protein, 9 aa, Homo Sapiens
LKRMLEKKI

SEQ ID NO: 253261 - protein, 9 aa, Homo Sapiens
SGMDNDTNN

SEQ ID NO: 253262 - protein, 9 aa, Homo Sapiens
CCIPNTSKM

SEQ ID NO: 253263 - protein, 9 aa, Homo Sapiens
ALDPKIYRN

SEQ ID NO: 253264 - protein, 9 aa, Homo Sapiens
DEYQADGGQ

SEQ ID NO: 253265 - protein, 9 aa, Homo Sapiens
SRRRKTEYI

SEQ ID NO: 253266 - protein, 9 aa, Homo Sapiens
NRGFGFVYF

SEQ ID NO: 253267 - protein, 9 aa, Homo Sapiens
IYGDTISLS

SEQ ID NO: 253268 - protein, 9 aa, Homo Sapiens
SNSSSFVRN

SEQ ID NO: 253269 - protein, 9 aa, Homo Sapiens
TTTSKDVCS

SEQ ID NO: 253270 - protein, 9 aa, Homo Sapiens
SKMTREERI

SEQ ID NO: 253271 - protein, 9 aa, Homo Sapiens
KCLNISGTA

SEQ ID NO: 253272 - protein, 9 aa, Homo Sapiens
PICSSLQAP

SEQ ID NO: 253273 - protein, 9 aa, Homo Sapiens
DAAEHGNIP

SEQ ID NO: 253274 - protein, 9 aa, Homo Sapiens
WALEETSIP

SEQ ID NO: 253275 - protein, 9 aa, Homo Sapiens
NRQPQINSY

SEQ ID NO: 253276 - protein, 9 aa, Homo Sapiens
CSKQHLRLV

SEQ ID NO: 253277 - protein, 9 aa, Homo Sapiens
IWIEIIALS

SEQ ID NO: 253278 - protein, 9 aa, Homo Sapiens
AGSNMKNMN

SEQ ID NO: 253279 - protein, 9 aa, Homo Sapiens
ALFTSEPLR

SEQ ID NO: 253280 - protein, 9 aa, Homo Sapiens
SKGTSLTTE

SEQ ID NO: 253281 - protein, 9 aa, Homo Sapiens
NFGSFVEVQ

SEQ ID NO: 253282 - protein, 9 aa, Homo Sapiens
GEAQRRKEQ

SEQ ID NO: 253283 - protein, 9 aa, Homo Sapiens
ESIVTLLDA

SEQ ID NO: 253284 - protein, 9 aa, Homo Sapiens
TVGGQVIKP

SEQ ID NO: 253285 - protein, 9 aa, Homo Sapiens
INRTSTLNQ

SEQ ID NO: 253286 - protein, 9 aa, Homo Sapiens
RQEEMKKLP

SEQ ID NO: 253287 - protein, 9 aa, Homo Sapiens
YSCEYNFVF

SEQ ID NO: 253288 - protein, 9 aa, Homo Sapiens
ENGTFIELF

SEQ ID NO: 253289 - protein, 9 aa, Homo Sapiens
HIIPYLSFG

SEQ ID NO: 253290 - protein, 9 aa, Homo Sapiens
RVHGSAARE

SEQ ID NO: 253291 - protein, 9 aa, Homo Sapiens
GANAIRRVF

SEQ ID NO: 253292 - protein, 9 aa, Homo Sapiens
SSWNLPPCP

SEQ ID NO: 253293 - protein, 9 aa, Homo Sapiens
REMQINEAK

SEQ ID NO: 253294 - protein, 9 aa, Homo Sapiens
ILQGHFSVV

SEQ ID NO: 253295 - protein, 9 aa, Homo Sapiens
QQWMTQSLT

SEQ ID NO: 253296 - protein, 9 aa, Homo Sapiens
YTLIDEQDT

SEQ ID NO: 253297 - protein, 9 aa, Homo Sapiens
AEVEQEAGE

SEQ ID NO: 253298 - protein, 9 aa, Homo Sapiens
SYVRQLHVI

SEQ ID NO: 253299 - protein, 9 aa, Homo Sapiens
VMQPATNAI

SEQ ID NO: 253300 - protein, 9 aa, Homo Sapiens
SLPPPSLYM

SEQ ID NO: 253301 - protein, 9 aa, Homo Sapiens
ESKFIFRKN

SEQ ID NO: 253302 - protein, 9 aa, Homo Sapiens
FASVAATCQ

SEQ ID NO: 253303 - protein, 8 aa, Homo Sapiens
NLVAVMGA

SEQ ID NO: 253304 - protein, 9 aa, Homo Sapiens
FRQRIAQVL

SEQ ID NO: 253305 - protein, 9 aa, Homo Sapiens
TDHQDYCKV

SEQ ID NO: 253306 - protein, 9 aa, Homo Sapiens
NKMKLRKEA

SEQ ID NO: 253307 - protein, 9 aa, Homo Sapiens
VLNGELPLC

SEQ ID NO: 253308 - protein, 9 aa, Homo Sapiens
EVGAVSVAG

SEQ ID NO: 253309 - protein, 9 aa, Homo Sapiens
VPVDNKIYR

SEQ ID NO: 253310 - protein, 9 aa, Homo Sapiens
QNLSFIDIS

SEQ ID NO: 253311 - protein, 9 aa, Homo Sapiens
KANIAFGQS

SEQ ID NO: 253312 - protein, 9 aa, Homo Sapiens
FEKPKLTFS

SEQ ID NO: 253313 - protein, 9 aa, Homo Sapiens
DLGKSGLRV

SEQ ID NO: 253314 - protein, 9 aa, Homo Sapiens
EIHYRKDSP

SEQ ID NO: 253315 - protein, 9 aa, Homo Sapiens
TGIATTLIN

SEQ ID NO: 253316 - protein, 9 aa, Homo Sapiens
LAVNIYIDK

SEQ ID NO: 253317 - protein, 9 aa, Homo Sapiens
TNNSDQMVY

SEQ ID NO: 253318 - protein, 9 aa, Homo Sapiens
IAVIRALQN

SEQ ID NO: 253319 - protein, 9 aa, Homo Sapiens
ALTQHQIIH

SEQ ID NO: 253320 - protein, 9 aa, Homo Sapiens
PSGYRADLW

SEQ ID NO: 253321 - protein, 9 aa, Homo Sapiens
AEVDRLLGI

SEQ ID NO: 253322 - protein, 9 aa, Homo Sapiens
TNASTFSSE

SEQ ID NO: 253323 - protein, 9 aa, Homo Sapiens
EPRSDLKAA

SEQ ID NO: 253324 - protein, 9 aa, Homo Sapiens
TALLNKAES

SEQ ID NO: 253325 - protein, 9 aa, Homo Sapiens
MYMSCGTIV

SEQ ID NO: 253326 - protein, 9 aa, Homo Sapiens
LLVNSQNDL

SEQ ID NO: 253327 - protein, 9 aa, Homo Sapiens
ETLGHGYFK

SEQ ID NO: 253328 - protein, 9 aa, Homo Sapiens
EGTKYRYFF

SEQ ID NO: 253329 - protein, 9 aa, Homo Sapiens
TESSLPAPS

SEQ ID NO: 253330 - protein, 9 aa, Homo Sapiens
GYSRKDLQI

SEQ ID NO: 253331 - protein, 9 aa, Homo Sapiens
TARMNLRLC

SEQ ID NO: 253332 - protein, 9 aa, Homo Sapiens
TPFFLWMAG

SEQ ID NO: 253333 - protein, 9 aa, Homo Sapiens
ALTLIRQHQ

SEQ ID NO: 253334 - protein, 9 aa, Homo Sapiens
LMNDVNYLI

SEQ ID NO: 253335 - protein, 9 aa, Homo Sapiens
GGCVAQLDF

SEQ ID NO: 253336 - protein, 9 aa, Homo Sapiens
CINPQYYKK

SEQ ID NO: 253337 - protein, 9 aa, Homo Sapiens
TIVVAASVW

SEQ ID NO: 253338 - protein, 9 aa, Homo Sapiens
FHPYSKDNN

SEQ ID NO: 253339 - protein, 9 aa, Homo Sapiens
ENHINSKKL

SEQ ID NO: 253340 - protein, 9 aa, Homo Sapiens
NILQNYDNK

SEQ ID NO: 253341 - protein, 9 aa, Homo Sapiens
SIGANCDQI

SEQ ID NO: 253342 - protein, 9 aa, Homo Sapiens
ISFRLKPGT

SEQ ID NO: 253343 - protein, 9 aa, Homo Sapiens
AEHAETDVR

SEQ ID NO: 253344 - protein, 9 aa, Homo Sapiens
IKIKQKLID

SEQ ID NO: 253345 - protein, 9 aa, Homo Sapiens
EFAMLLQSG

SEQ ID NO: 253346 - protein, 9 aa, Homo Sapiens
EDILVPYSH

SEQ ID NO: 253347 - protein, 9 aa, Homo Sapiens
YAFHNTYLE

SEQ ID NO: 253348 - protein, 9 aa, Homo Sapiens
PILKILTTS

SEQ ID NO: 253349 - protein, 9 aa, Homo Sapiens
CKDLIKCML

SEQ ID NO: 253350 - protein, 9 aa, Homo Sapiens
TGNKPYECT

SEQ ID NO: 253351 - protein, 9 aa, Homo Sapiens
AIRDQRTTT

SEQ ID NO: 253352 - protein, 9 aa, Homo Sapiens
CLPKFLVIG

SEQ ID NO: 253353 - protein, 9 aa, Homo Sapiens
FQEHHGTSQ

SEQ ID NO: 253354 - protein, 9 aa, Homo Sapiens
GYHGDQGSH

SEQ ID NO: 253355 - protein, 9 aa, Homo Sapiens
FTLPFCGPY

SEQ ID NO: 253356 - protein, 9 aa, Homo Sapiens
REHIANRAM

SEQ ID NO: 253357 - protein, 9 aa, Homo Sapiens
RNYPMAQTP

SEQ ID NO: 253358 - protein, 9 aa, Homo Sapiens
KIHIAEKPY

SEQ ID NO: 253359 - protein, 9 aa, Homo Sapiens
IIFVMWTFA

SEQ ID NO: 253360 - protein, 9 aa, Homo Sapiens
SLAHVDSQL

SEQ ID NO: 253361 - protein, 9 aa, Homo Sapiens
VTPELSFFN

SEQ ID NO: 253362 - protein, 9 aa, Homo Sapiens
DLRTMPESS

SEQ ID NO: 253363 - protein, 9 aa, Homo Sapiens
MLAEPPHNL

SEQ ID NO: 253364 - protein, 9 aa, Homo Sapiens
TSKPYINSI

SEQ ID NO: 253365 - protein, 9 aa, Homo Sapiens
AAGGVVLGG

SEQ ID NO: 253366 - protein, 9 aa, Homo Sapiens
GNNSRRQSQ

SEQ ID NO: 253367 - protein, 9 aa, Homo Sapiens
TLEPELPLI

SEQ ID NO: 253368 - protein, 9 aa, Homo Sapiens
KNKWSHNNS

SEQ ID NO: 253369 - protein, 9 aa, Homo Sapiens
PPETAVILA

SEQ ID NO: 253370 - protein, 9 aa, Homo Sapiens
ERDKEAGAL

SEQ ID NO: 253371 - protein, 9 aa, Homo Sapiens
SRKDLQINK

SEQ ID NO: 253372 - protein, 9 aa, Homo Sapiens
SNHQRKGFN

SEQ ID NO: 253373 - protein, 9 aa, Homo Sapiens
LESTRAAVK

SEQ ID NO: 253374 - protein, 9 aa, Homo Sapiens
CTIMGETFK

SEQ ID NO: 253375 - protein, 9 aa, Homo Sapiens
QLSKRTVST

SEQ ID NO: 253376 - protein, 9 aa, Homo Sapiens
LAAYAPGAR

SEQ ID NO: 253377 - protein, 9 aa, Homo Sapiens
PHFLEKQLK

SEQ ID NO: 253378 - protein, 9 aa, Homo Sapiens
SRHKMYKLS

SEQ ID NO: 253379 - protein, 9 aa, Homo Sapiens
QDFNDTFYQ

SEQ ID NO: 253380 - protein, 9 aa, Homo Sapiens
GEQNKKSVT

SEQ ID NO: 253381 - protein, 9 aa, Homo Sapiens
YIKDFLSKC

SEQ ID NO: 253382 - protein, 9 aa, Homo Sapiens
FGVREECFA

SEQ ID NO: 253383 - protein, 9 aa, Homo Sapiens
RPSVEVCIL

SEQ ID NO: 253384 - protein, 9 aa, Homo Sapiens
LGPGHAGAP

SEQ ID NO: 253385 - protein, 9 aa, Homo Sapiens
HGLSKALPT

SEQ ID NO: 253386 - protein, 9 aa, Homo Sapiens
PFPCMECEK

SEQ ID NO: 253387 - protein, 9 aa, Homo Sapiens
KVKVCVNIH

SEQ ID NO: 253388 - protein, 9 aa, Homo Sapiens
EAGALETET

SEQ ID NO: 253389 - protein, 9 aa, Homo Sapiens
EDIPREPRQ

SEQ ID NO: 253390 - protein, 9 aa, Homo Sapiens
AGHPCSPDS

SEQ ID NO: 253391 - protein, 9 aa, Homo Sapiens
GLSNRIQNT

SEQ ID NO: 253392 - protein, 9 aa, Homo Sapiens
QNIGKVVHQ

SEQ ID NO: 253393 - protein, 9 aa, Homo Sapiens
GHSVPEINL

SEQ ID NO: 253394 - protein, 9 aa, Homo Sapiens
SYPHTDQLQ

SEQ ID NO: 253395 - protein, 9 aa, Homo Sapiens
SPSDEKTRM

SEQ ID NO: 253396 - protein, 9 aa, Homo Sapiens
MFEKDKLEL

SEQ ID NO: 253397 - protein, 9 aa, Homo Sapiens
KGSLKSTSR

SEQ ID NO: 253398 - protein, 9 aa, Homo Sapiens
QEKQEIAER

SEQ ID NO: 253399 - protein, 9 aa, Homo Sapiens
QGLTCREEL

SEQ ID NO: 253400 - protein, 9 aa, Homo Sapiens
KLGELSDRI

SEQ ID NO: 253401 - protein, 9 aa, Homo Sapiens
TVHIQVNNV

SEQ ID NO: 253402 - protein, 9 aa, Homo Sapiens
LNGNFRGRR

SEQ ID NO: 253403 - protein, 9 aa, Homo Sapiens
PAVTKLVDR

SEQ ID NO: 253404 - protein, 9 aa, Homo Sapiens
EQTLEACFD

SEQ ID NO: 253405 - protein, 9 aa, Homo Sapiens
ETNSFSKMN

SEQ ID NO: 253406 - protein, 9 aa, Homo Sapiens
YIEVKMSSA

SEQ ID NO: 253407 - protein, 9 aa, Homo Sapiens
IVNVSLVQC

SEQ ID NO: 253408 - protein, 9 aa, Homo Sapiens
RSLSECGAP

SEQ ID NO: 253409 - protein, 9 aa, Homo Sapiens
KGRPTPCAF

SEQ ID NO: 253410 - protein, 9 aa, Homo Sapiens
RDPSSHEMR

SEQ ID NO: 253411 - protein, 9 aa, Homo Sapiens
RLHERPALM

SEQ ID NO: 253412 - protein, 9 aa, Homo Sapiens
GGGYLFIGL

SEQ ID NO: 253413 - protein, 9 aa, Homo Sapiens
LVDFCCACA

SEQ ID NO: 253414 - protein, 9 aa, Homo Sapiens
NTSSFSCEA

SEQ ID NO: 253415 - protein, 9 aa, Homo Sapiens
YIQVSEVDK

SEQ ID NO: 253416 - protein, 9 aa, Homo Sapiens
VLEPTLKSF

SEQ ID NO: 253417 - protein, 9 aa, Homo Sapiens
PHQQPTTEG

SEQ ID NO: 253418 - protein, 9 aa, Homo Sapiens
VFQTYAKLQ

SEQ ID NO: 253419 - protein, 9 aa, Homo Sapiens
VLIGQIIFS

SEQ ID NO: 253420 - protein, 9 aa, Homo Sapiens
THPPAGDGN

SEQ ID NO: 253421 - protein, 9 aa, Homo Sapiens
KNTKKNSSE

SEQ ID NO: 253422 - protein, 9 aa, Homo Sapiens
KMSKETCPK

SEQ ID NO: 253423 - protein, 9 aa, Homo Sapiens
TLAQILADS

SEQ ID NO: 253424 - protein, 9 aa, Homo Sapiens
AVPKVVLNL

SEQ ID NO: 253425 - protein, 9 aa, Homo Sapiens
VVLRQVGVS

SEQ ID NO: 253426 - protein, 9 aa, Homo Sapiens
VAKWPVDTQ

SEQ ID NO: 253427 - protein, 9 aa, Homo Sapiens
VGQLTPTGK

SEQ ID NO: 253428 - protein, 9 aa, Homo Sapiens
GGVTWIGFP

SEQ ID NO: 253429 - protein, 9 aa, Homo Sapiens
SLVDIFVSS

SEQ ID NO: 253430 - protein, 9 aa, Homo Sapiens
ISFTPNYLQ

SEQ ID NO: 253431 - protein, 9 aa, Homo Sapiens
PRICPHLCS

SEQ ID NO: 253432 - protein, 9 aa, Homo Sapiens
SYHSSLFGF

SEQ ID NO: 253433 - protein, 9 aa, Homo Sapiens
LDEIRDEGK

SEQ ID NO: 253434 - protein, 9 aa, Homo Sapiens
DNRRWMRDN

SEQ ID NO: 253435 - protein, 9 aa, Homo Sapiens
PQAFRACFL

SEQ ID NO: 253436 - protein, 9 aa, Homo Sapiens
NRITVTGSS

SEQ ID NO: 253437 - protein, 9 aa, Homo Sapiens
CYDRIKFLI

SEQ ID NO: 253438 - protein, 9 aa, Homo Sapiens
KEDSSFVSM

SEQ ID NO: 253439 - protein, 9 aa, Homo Sapiens
AGSDYNFLS

SEQ ID NO: 253440 - protein, 9 aa, Homo Sapiens
TSECTTLAA

SEQ ID NO: 253441 - protein, 9 aa, Homo Sapiens
ASNGVLLFM

SEQ ID NO: 253442 - protein, 9 aa, Homo Sapiens
QASISGIQA

SEQ ID NO: 253443 - protein, 9 aa, Homo Sapiens
NSEVEQVSS

SEQ ID NO: 253444 - protein, 9 aa, Homo Sapiens
ALEGRLPMA

SEQ ID NO: 253445 - protein, 9 aa, Homo Sapiens
DDLDTKRLS

SEQ ID NO: 253446 - protein, 9 aa, Homo Sapiens
TSDESIKEE

SEQ ID NO: 253447 - protein, 9 aa, Homo Sapiens
IYQTSYRGS

SEQ ID NO: 253448 - protein, 9 aa, Homo Sapiens
HSAIPTEKV

SEQ ID NO: 253449 - protein, 9 aa, Homo Sapiens
ESNRISQDS

SEQ ID NO: 253450 - protein, 9 aa, Homo Sapiens
TILRKLLEN

SEQ ID NO: 253451 - protein, 9 aa, Homo Sapiens
LKLQHLVIP

SEQ ID NO: 253452 - protein, 9 aa, Homo Sapiens
DTQTIHIVY

SEQ ID NO: 253453 - protein, 9 aa, Homo Sapiens
LLKAITEKD

SEQ ID NO: 253454 - protein, 9 aa, Homo Sapiens
STLIFEGRP

SEQ ID NO: 253455 - protein, 9 aa, Homo Sapiens
SNGRSTATF

SEQ ID NO: 253456 - protein, 9 aa, Homo Sapiens
ETEHLFIPL

SEQ ID NO: 253457 - protein, 9 aa, Homo Sapiens
ELVPLHPGL

SEQ ID NO: 253458 - protein, 9 aa, Homo Sapiens
FSDTSPILT

SEQ ID NO: 253459 - protein, 9 aa, Homo Sapiens
LIIHKIIHT

SEQ ID NO: 253460 - protein, 9 aa, Homo Sapiens
TLITTHPLS

SEQ ID NO: 253461 - protein, 9 aa, Homo Sapiens
NSSGQFVSS

SEQ ID NO: 253462 - protein, 9 aa, Homo Sapiens
VFIGGVPWD

SEQ ID NO: 253463 - protein, 9 aa, Homo Sapiens
NYTYNVSTS

SEQ ID NO: 253464 - protein, 9 aa, Homo Sapiens
TRENSEKIH

SEQ ID NO: 253465 - protein, 9 aa, Homo Sapiens
PNAEAGLAP

SEQ ID NO: 253466 - protein, 9 aa, Homo Sapiens
LNYDTNLTH

SEQ ID NO: 253467 - protein, 9 aa, Homo Sapiens
IIFSLAAVF

SEQ ID NO: 253468 - protein, 9 aa, Homo Sapiens
KIINQVFQS

SEQ ID NO: 253469 - protein, 9 aa, Homo Sapiens
ASLNGHLPH

SEQ ID NO: 253470 - protein, 9 aa, Homo Sapiens
KVCQQGGEI

SEQ ID NO: 253471 - protein, 9 aa, Homo Sapiens
KLDEIRDEG

SEQ ID NO: 253472 - protein, 9 aa, Homo Sapiens
NLSHVNMMA

SEQ ID NO: 253473 - protein, 9 aa, Homo Sapiens
KQNEARMET

SEQ ID NO: 253474 - protein, 9 aa, Homo Sapiens
IKTIISQHE

SEQ ID NO: 253475 - protein, 9 aa, Homo Sapiens
AIYVKPANK

SEQ ID NO: 253476 - protein, 9 aa, Homo Sapiens
FLVRSIFLQ

SEQ ID NO: 253477 - protein, 9 aa, Homo Sapiens
QASRMSFCE

SEQ ID NO: 253478 - protein, 9 aa, Homo Sapiens
ATARCPRWL

SEQ ID NO: 253479 - protein, 9 aa, Homo Sapiens
LTVDRISIK

SEQ ID NO: 253480 - protein, 9 aa, Homo Sapiens
IYIARNGSV

SEQ ID NO: 253481 - protein, 9 aa, Homo Sapiens
SVVGMLTIT

SEQ ID NO: 253482 - protein, 9 aa, Homo Sapiens
SEYSDHPHS

SEQ ID NO: 253483 - protein, 9 aa, Homo Sapiens
TNVVRVWFC

SEQ ID NO: 253484 - protein, 9 aa, Homo Sapiens
PVYFYMYTL

SEQ ID NO: 253485 - protein, 9 aa, Homo Sapiens
FPVLEWGDS

SEQ ID NO: 253486 - protein, 9 aa, Homo Sapiens
ANTLYMSHR

SEQ ID NO: 253487 - protein, 9 aa, Homo Sapiens
CSPSPGPFQ

SEQ ID NO: 253488 - protein, 9 aa, Homo Sapiens
HPLSLLLLP

SEQ ID NO: 253489 - protein, 9 aa, Homo Sapiens
TSHALYSHI

SEQ ID NO: 253490 - protein, 9 aa, Homo Sapiens
SIQDLEIKR

SEQ ID NO: 253491 - protein, 9 aa, Homo Sapiens
LYFPVIQFK

SEQ ID NO: 253492 - protein, 9 aa, Homo Sapiens
QMSFTRSIA

SEQ ID NO: 253493 - protein, 9 aa, Homo Sapiens
HSAKVLVSS

SEQ ID NO: 253494 - protein, 9 aa, Homo Sapiens
FIVTQCCLF

SEQ ID NO: 253495 - protein, 9 aa, Homo Sapiens
KSQRNSLCV

SEQ ID NO: 253496 - protein, 9 aa, Homo Sapiens
EAVQLQCGY

SEQ ID NO: 253497 - protein, 9 aa, Homo Sapiens
EFRYNTRVY

SEQ ID NO: 253498 - protein, 9 aa, Homo Sapiens
QLHVIDNQR

SEQ ID NO: 253499 - protein, 9 aa, Homo Sapiens
DSDIRCLSQ

SEQ ID NO: 253500 - protein, 9 aa, Homo Sapiens
NLFQLLVLA

SEQ ID NO: 253501 - protein, 9 aa, Homo Sapiens
QPTNEMLLK

SEQ ID NO: 253502 - protein, 9 aa, Homo Sapiens
HKEITYTKA

SEQ ID NO: 253503 - protein, 9 aa, Homo Sapiens
QSNEMEVHA

SEQ ID NO: 253504 - protein, 9 aa, Homo Sapiens
VHIQVNNVN

SEQ ID NO: 253505 - protein, 9 aa, Homo Sapiens
TMDTICTSS

SEQ ID NO: 253506 - protein, 9 aa, Homo Sapiens
QKMSHQHVF

SEQ ID NO: 253507 - protein, 9 aa, Homo Sapiens
LRLNPHFIS

SEQ ID NO: 253508 - protein, 9 aa, Homo Sapiens
IAEIIIVDD

SEQ ID NO: 253509 - protein, 9 aa, Homo Sapiens
GGYKPVWNR

SEQ ID NO: 253510 - protein, 9 aa, Homo Sapiens
ALNEIASEP

SEQ ID NO: 253511 - protein, 9 aa, Homo Sapiens
QGEQCDNMN

SEQ ID NO: 253512 - protein, 9 aa, Homo Sapiens
LEENKTGPT

SEQ ID NO: 253513 - protein, 9 aa, Homo Sapiens
KMEDGKVIE

SEQ ID NO: 253514 - protein, 9 aa, Homo Sapiens
AKSTWLHNI

SEQ ID NO: 253515 - protein, 9 aa, Homo Sapiens
KVRAPTVNP

SEQ ID NO: 253516 - protein, 9 aa, Homo Sapiens
ARSKCRQIV

SEQ ID NO: 253517 - protein, 9 aa, Homo Sapiens
EALKDTFNK

SEQ ID NO: 253518 - protein, 9 aa, Homo Sapiens
MSSVQKKNE

SEQ ID NO: 253519 - protein, 9 aa, Homo Sapiens
RPPGSVPSH

SEQ ID NO: 253520 - protein, 9 aa, Homo Sapiens
SRGFVVDVP

SEQ ID NO: 253521 - protein, 9 aa, Homo Sapiens
MLTITHTMS

SEQ ID NO: 253522 - protein, 9 aa, Homo Sapiens
TTREQLSRH

SEQ ID NO: 253523 - protein, 9 aa, Homo Sapiens
LLDENYLGS

SEQ ID NO: 253524 - protein, 9 aa, Homo Sapiens
GIIAFSCPQ

SEQ ID NO: 253525 - protein, 9 aa, Homo Sapiens
IFSSVYEQL

SEQ ID NO: 253526 - protein, 9 aa, Homo Sapiens
KEMQIVLEG

SEQ ID NO: 253527 - protein, 9 aa, Homo Sapiens
LNATFDLSA

SEQ ID NO: 253528 - protein, 9 aa, Homo Sapiens
ESQESNRIS

SEQ ID NO: 253529 - protein, 9 aa, Homo Sapiens
LDFQICGYR

SEQ ID NO: 253530 - protein, 9 aa, Homo Sapiens
ESPEGSPVR

SEQ ID NO: 253531 - protein, 9 aa, Homo Sapiens
WKACCHPPE

SEQ ID NO: 253532 - protein, 9 aa, Homo Sapiens
STVRTVNNK

SEQ ID NO: 253533 - protein, 9 aa, Homo Sapiens
CSLQRSVQV

SEQ ID NO: 253534 - protein, 9 aa, Homo Sapiens
MLILFRWCD

SEQ ID NO: 253535 - protein, 9 aa, Homo Sapiens
AMLSVSTPQ

SEQ ID NO: 253536 - protein, 9 aa, Homo Sapiens
ENQRKFLNA

SEQ ID NO: 253537 - protein, 9 aa, Homo Sapiens
LLIISLAAG

SEQ ID NO: 253538 - protein, 9 aa, Homo Sapiens
NNCMLYKED

SEQ ID NO: 253539 - protein, 9 aa, Homo Sapiens
GLVPQNKGL

SEQ ID NO: 253540 - protein, 9 aa, Homo Sapiens
VITNGAYTS

SEQ ID NO: 253541 - protein, 9 aa, Homo Sapiens
QNLILGRPS

SEQ ID NO: 253542 - protein, 9 aa, Homo Sapiens
PRFGDAEWA

SEQ ID NO: 253543 - protein, 9 aa, Homo Sapiens
TQLITLPKT

SEQ ID NO: 253544 - protein, 9 aa, Homo Sapiens
QQNIPKSSS

SEQ ID NO: 253545 - protein, 9 aa, Homo Sapiens
LESLEFYYS

SEQ ID NO: 253546 - protein, 9 aa, Homo Sapiens
KVKPVLFNS

SEQ ID NO: 253547 - protein, 9 aa, Homo Sapiens
KEAANIIQD

SEQ ID NO: 253548 - protein, 9 aa, Homo Sapiens
GLALIVLGT

SEQ ID NO: 253549 - protein, 9 aa, Homo Sapiens
PGTPGSHNL

SEQ ID NO: 253550 - protein, 9 aa, Homo Sapiens
LEAQFAKIK

SEQ ID NO: 253551 - protein, 9 aa, Homo Sapiens
LLIVGSKVD

SEQ ID NO: 253552 - protein, 9 aa, Homo Sapiens
SNLNGQHFR

SEQ ID NO: 253553 - protein, 9 aa, Homo Sapiens
IRPNWQLER

SEQ ID NO: 253554 - protein, 9 aa, Homo Sapiens
AHGTEKLGL

SEQ ID NO: 253555 - protein, 9 aa, Homo Sapiens
QTSRNIDPQ

SEQ ID NO: 253556 - protein, 9 aa, Homo Sapiens
MRVISINNY

SEQ ID NO: 253557 - protein, 9 aa, Homo Sapiens
GIDKTKEEL

SEQ ID NO: 253558 - protein, 9 aa, Homo Sapiens
IDAADRERI

SEQ ID NO: 253559 - protein, 9 aa, Homo Sapiens
IAGYITYIQ

SEQ ID NO: 253560 - protein, 9 aa, Homo Sapiens
SKLVSIPSR

SEQ ID NO: 253561 - protein, 9 aa, Homo Sapiens
CLNRPGDAC

SEQ ID NO: 253562 - protein, 9 aa, Homo Sapiens
SGVEICIAT

SEQ ID NO: 253563 - protein, 9 aa, Homo Sapiens
TVICALTSR

SEQ ID NO: 253564 - protein, 9 aa, Homo Sapiens
FLRVNRVAV

SEQ ID NO: 253565 - protein, 9 aa, Homo Sapiens
RDDCLEWPE

SEQ ID NO: 253566 - protein, 9 aa, Homo Sapiens
SVWLNLRNR

SEQ ID NO: 253567 - protein, 9 aa, Homo Sapiens
NYTVQIPEG

SEQ ID NO: 253568 - protein, 9 aa, Homo Sapiens
LDEKIKLGS

SEQ ID NO: 253569 - protein, 9 aa, Homo Sapiens
WKKYNKLKS

SEQ ID NO: 253570 - protein, 9 aa, Homo Sapiens
YSQSTVLTH

SEQ ID NO: 253571 - protein, 9 aa, Homo Sapiens
SLTDDSKTA

SEQ ID NO: 253572 - protein, 9 aa, Homo Sapiens
QDFFLIVKT

SEQ ID NO: 253573 - protein, 9 aa, Homo Sapiens
SYGTPSVLP

SEQ ID NO: 253574 - protein, 9 aa, Homo Sapiens
PRGHVEPGE

SEQ ID NO: 253575 - protein, 9 aa, Homo Sapiens
SFPLLRYLA

SEQ ID NO: 253576 - protein, 9 aa, Homo Sapiens
VINNTPLYF

SEQ ID NO: 253577 - protein, 9 aa, Homo Sapiens
LNMSKKTVY

SEQ ID NO: 253578 - protein, 9 aa, Homo Sapiens
CACPGCSSN

SEQ ID NO: 253579 - protein, 9 aa, Homo Sapiens
QAANIILPS

SEQ ID NO: 253580 - protein, 9 aa, Homo Sapiens
SIFLQQQAA

SEQ ID NO: 253581 - protein, 9 aa, Homo Sapiens
SSLPNITPA

SEQ ID NO: 253582 - protein, 9 aa, Homo Sapiens
FYRCGYCNN

SEQ ID NO: 253583 - protein, 9 aa, Homo Sapiens
IIGGIIFLA

SEQ ID NO: 253584 - protein, 9 aa, Homo Sapiens
FYSLKSLKI

SEQ ID NO: 253585 - protein, 9 aa, Homo Sapiens
SFSRSTTLT

SEQ ID NO: 253586 - protein, 9 aa, Homo Sapiens
LPITKYPKI

SEQ ID NO: 253587 - protein, 9 aa, Homo Sapiens
RFVCDKHYY

SEQ ID NO: 253588 - protein, 9 aa, Homo Sapiens
SFMDAMNTF

SEQ ID NO: 253589 - protein, 9 aa, Homo Sapiens
QNMTGWAYE

SEQ ID NO: 253590 - protein, 9 aa, Homo Sapiens
LVLKRLSDV

SEQ ID NO: 253591 - protein, 9 aa, Homo Sapiens
NRNRYRYVS

SEQ ID NO: 253592 - protein, 9 aa, Homo Sapiens
TKNERLWLL

SEQ ID NO: 253593 - protein, 9 aa, Homo Sapiens
EAINVGSFT

SEQ ID NO: 253594 - protein, 9 aa, Homo Sapiens
FVVCTTGWL

SEQ ID NO: 253595 - protein, 9 aa, Homo Sapiens
EKESKRLTI

SEQ ID NO: 253596 - protein, 9 aa, Homo Sapiens
NILAVVLSI

SEQ ID NO: 253597 - protein, 9 aa, Homo Sapiens
PDTQTIHIV

SEQ ID NO: 253598 - protein, 9 aa, Homo Sapiens
DSTNAFSAF

SEQ ID NO: 253599 - protein, 9 aa, Homo Sapiens
HNKEPASSV

SEQ ID NO: 253600 - protein, 9 aa, Homo Sapiens
IEESFQESK

SEQ ID NO: 253601 - protein, 9 aa, Homo Sapiens
LSLLIDTFQ

SEQ ID NO: 253602 - protein, 9 aa, Homo Sapiens
SMATEGLHE

SEQ ID NO: 253603 - protein, 9 aa, Homo Sapiens
ISSEKINFL

SEQ ID NO: 253604 - protein, 9 aa, Homo Sapiens
KNILHIKHW

SEQ ID NO: 253605 - protein, 9 aa, Homo Sapiens
QKRKKDLTQ

SEQ ID NO: 253606 - protein, 9 aa, Homo Sapiens
NEHGNVSLH

SEQ ID NO: 253607 - protein, 9 aa, Homo Sapiens
FLFMSPMEQ

SEQ ID NO: 253608 - protein, 9 aa, Homo Sapiens
IMLQSGVDP

SEQ ID NO: 253609 - protein, 9 aa, Homo Sapiens
TTAETLTFL

SEQ ID NO: 253610 - protein, 9 aa, Homo Sapiens
GFEGESCEV

SEQ ID NO: 253611 - protein, 9 aa, Homo Sapiens
RAVSDALMT

SEQ ID NO: 253612 - protein, 9 aa, Homo Sapiens
LRHDLEKTS

SEQ ID NO: 253613 - protein, 9 aa, Homo Sapiens
KHSAKVLVS

SEQ ID NO: 253614 - protein, 9 aa, Homo Sapiens
TPRLIKNLG

SEQ ID NO: 253615 - protein, 9 aa, Homo Sapiens
KHYHVKETN

SEQ ID NO: 253616 - protein, 9 aa, Homo Sapiens
RKLLSREDE

SEQ ID NO: 253617 - protein, 9 aa, Homo Sapiens
ENVSIKKKM

SEQ ID NO: 253618 - protein, 9 aa, Homo Sapiens
HYHSKILNK

SEQ ID NO: 253619 - protein, 9 aa, Homo Sapiens
IEHEKQVYN

SEQ ID NO: 253620 - protein, 9 aa, Homo Sapiens
PLPRASSIS

SEQ ID NO: 253621 - protein, 9 aa, Homo Sapiens
TILHVMCTD

SEQ ID NO: 253622 - protein, 9 aa, Homo Sapiens
NERIEERNE

SEQ ID NO: 253623 - protein, 9 aa, Homo Sapiens
SILGNLKYM

SEQ ID NO: 253624 - protein, 9 aa, Homo Sapiens
RIGSTIDDT

SEQ ID NO: 253625 - protein, 9 aa, Homo Sapiens
LGICHSKES

SEQ ID NO: 253626 - protein, 9 aa, Homo Sapiens
IQSKDVSDK

SEQ ID NO: 253627 - protein, 9 aa, Homo Sapiens
SNLNHKLEE

SEQ ID NO: 253628 - protein, 9 aa, Homo Sapiens
EWNGWGYND

SEQ ID NO: 253629 - protein, 9 aa, Homo Sapiens
GHDRLHARG

SEQ ID NO: 253630 - protein, 9 aa, Homo Sapiens
RYKHKMTQR

SEQ ID NO: 253631 - protein, 9 aa, Homo Sapiens
CWPLPEYRK

SEQ ID NO: 253632 - protein, 9 aa, Homo Sapiens
SIKIILIVV

SEQ ID NO: 253633 - protein, 9 aa, Homo Sapiens
KLMRNKMKL

SEQ ID NO: 253634 - protein, 9 aa, Homo Sapiens
PRLEGEINT

SEQ ID NO: 253635 - protein, 9 aa, Homo Sapiens
GGLHAFLLA

SEQ ID NO: 253636 - protein, 9 aa, Homo Sapiens
TSEINQLRG

SEQ ID NO: 253637 - protein, 9 aa, Homo Sapiens
TVRPRNAAL

SEQ ID NO: 253638 - protein, 9 aa, Homo Sapiens
SNYASMQAL

SEQ ID NO: 253639 - protein, 9 aa, Homo Sapiens
TINYAGLGP

SEQ ID NO: 253640 - protein, 9 aa, Homo Sapiens
GSILTPKSL

SEQ ID NO: 253641 - protein, 9 aa, Homo Sapiens
YYPDHTNNS

SEQ ID NO: 253642 - protein, 9 aa, Homo Sapiens
EDRRKCQAR

SEQ ID NO: 253643 - protein, 9 aa, Homo Sapiens
KMTNRAARN

SEQ ID NO: 253644 - protein, 9 aa, Homo Sapiens
IDSNRSETG

SEQ ID NO: 253645 - protein, 9 aa, Homo Sapiens
DKVKPVLFN

SEQ ID NO: 253646 - protein, 9 aa, Homo Sapiens
EEFEVLKEV

SEQ ID NO: 253647 - protein, 9 aa, Homo Sapiens
GYTSRSEQL

SEQ ID NO: 253648 - protein, 9 aa, Homo Sapiens
RFCIHHLTV

SEQ ID NO: 253649 - protein, 9 aa, Homo Sapiens
FTYHTRPHT

SEQ ID NO: 253650 - protein, 9 aa, Homo Sapiens
QINSAKLVS

SEQ ID NO: 253651 - protein, 9 aa, Homo Sapiens
EDPFIFTYA

SEQ ID NO: 253652 - protein, 9 aa, Homo Sapiens
TVLEADANV

SEQ ID NO: 253653 - protein, 9 aa, Homo Sapiens
DNNSGAGEK

SEQ ID NO: 253654 - protein, 9 aa, Homo Sapiens
AFSYLMRDR

SEQ ID NO: 253655 - protein, 9 aa, Homo Sapiens
NDLLEEILG

SEQ ID NO: 253656 - protein, 9 aa, Homo Sapiens
SSHIFQDLQ

SEQ ID NO: 253657 - protein, 9 aa, Homo Sapiens
IYDPSLKTM

SEQ ID NO: 253658 - protein, 9 aa, Homo Sapiens
SLQLEQLSH

SEQ ID NO: 253659 - protein, 9 aa, Homo Sapiens
LGVVWYFQI

SEQ ID NO: 253660 - protein, 9 aa, Homo Sapiens
KRRCIGKEL

SEQ ID NO: 253661 - protein, 9 aa, Homo Sapiens
GATVTTAET

SEQ ID NO: 253662 - protein, 9 aa, Homo Sapiens
KKCMTLDPV

SEQ ID NO: 253663 - protein, 9 aa, Homo Sapiens
KHHLNSLGQ

SEQ ID NO: 253664 - protein, 9 aa, Homo Sapiens
LEYSLQIQK

SEQ ID NO: 253665 - protein, 9 aa, Homo Sapiens
LDKALSYIC

SEQ ID NO: 253666 - protein, 9 aa, Homo Sapiens
RFCRSPCTI

SEQ ID NO: 253667 - protein, 9 aa, Homo Sapiens
LAAFEAWKA

SEQ ID NO: 253668 - protein, 9 aa, Homo Sapiens
SLSAGDLGD

SEQ ID NO: 253669 - protein, 9 aa, Homo Sapiens
ESEPDLFSP

SEQ ID NO: 253670 - protein, 9 aa, Homo Sapiens
APARHRKKR

SEQ ID NO: 253671 - protein, 9 aa, Homo Sapiens
KFQRKFLND

SEQ ID NO: 253672 - protein, 9 aa, Homo Sapiens
RKIRFVGRQ

SEQ ID NO: 253673 - protein, 9 aa, Homo Sapiens
DSKAKTITP

SEQ ID NO: 253674 - protein, 9 aa, Homo Sapiens
DMYKSNNYL

SEQ ID NO: 253675 - protein, 9 aa, Homo Sapiens
DSAFWLSWC

SEQ ID NO: 253676 - protein, 9 aa, Homo Sapiens
IDLSSDIRK

SEQ ID NO: 253677 - protein, 9 aa, Homo Sapiens
RCRVYLEEF

SEQ ID NO: 253678 - protein, 9 aa, Homo Sapiens
DLTGIKSMD

SEQ ID NO: 253679 - protein, 9 aa, Homo Sapiens
DEKKNDHAY

SEQ ID NO: 253680 - protein, 9 aa, Homo Sapiens
REAMHDPLL

SEQ ID NO: 253681 - protein, 9 aa, Homo Sapiens
GSDGADSPS

SEQ ID NO: 253682 - protein, 9 aa, Homo Sapiens
NSNIILLGE

SEQ ID NO: 253683 - protein, 9 aa, Homo Sapiens
KPTSETLGH

SEQ ID NO: 253684 - protein, 9 aa, Homo Sapiens
NRNEEQRMR

SEQ ID NO: 253685 - protein, 9 aa, Homo Sapiens
FLPEEYIKQ

SEQ ID NO: 253686 - protein, 9 aa, Homo Sapiens
SEGIKGQHL

SEQ ID NO: 253687 - protein, 9 aa, Homo Sapiens
AASQSLGPF

SEQ ID NO: 253688 - protein, 9 aa, Homo Sapiens
LDDTNILPG

SEQ ID NO: 253689 - protein, 9 aa, Homo Sapiens
FSHLRYFLE

SEQ ID NO: 253690 - protein, 9 aa, Homo Sapiens
NNITKKNKL

SEQ ID NO: 253691 - protein, 9 aa, Homo Sapiens
KDTLQNQKE

SEQ ID NO: 253692 - protein, 9 aa, Homo Sapiens
SNIITSGKM

SEQ ID NO: 253693 - protein, 9 aa, Homo Sapiens
ERLCLGPEC

SEQ ID NO: 253694 - protein, 9 aa, Homo Sapiens
YNEIHKNGK

SEQ ID NO: 253695 - protein, 9 aa, Homo Sapiens
YIARLFWHM

SEQ ID NO: 253696 - protein, 9 aa, Homo Sapiens
WFLTLFASH

SEQ ID NO: 253697 - protein, 9 aa, Homo Sapiens
KELRKDKRH

SEQ ID NO: 253698 - protein, 9 aa, Homo Sapiens
GQVKRSVFA

SEQ ID NO: 253699 - protein, 9 aa, Homo Sapiens
DIKEDTSFF

SEQ ID NO: 253700 - protein, 9 aa, Homo Sapiens
KCNSLESVE

SEQ ID NO: 253701 - protein, 9 aa, Homo Sapiens
CEDPNGIPK

SEQ ID NO: 253702 - protein, 9 aa, Homo Sapiens
FLATLPHEV

SEQ ID NO: 253703 - protein, 9 aa, Homo Sapiens
RSREIFAID

SEQ ID NO: 253704 - protein, 9 aa, Homo Sapiens
RRVLAACSD

SEQ ID NO: 253705 - protein, 9 aa, Homo Sapiens
VLNQTTRLK

SEQ ID NO: 253706 - protein, 9 aa, Homo Sapiens
EVQDLAGDF

SEQ ID NO: 253707 - protein, 9 aa, Homo Sapiens
LKLVKLSRK

SEQ ID NO: 253708 - protein, 9 aa, Homo Sapiens
DWLDGRGWA

SEQ ID NO: 253709 - protein, 9 aa, Homo Sapiens
RTKDDGFSS

SEQ ID NO: 253710 - protein, 9 aa, Homo Sapiens
KKEVVTPPY

SEQ ID NO: 253711 - protein, 9 aa, Homo Sapiens
ATFINSSGQ

SEQ ID NO: 253712 - protein, 9 aa, Homo Sapiens
ESCKLRHLR

SEQ ID NO: 253713 - protein, 9 aa, Homo Sapiens
ILHQLFIAR

SEQ ID NO: 253714 - protein, 9 aa, Homo Sapiens
GTLKLHVEM

SEQ ID NO: 253715 - protein, 9 aa, Homo Sapiens
AFIWPASLN

SEQ ID NO: 253716 - protein, 9 aa, Homo Sapiens
LGIQKVMEQ

SEQ ID NO: 253717 - protein, 9 aa, Homo Sapiens
CGNYLFRQN

SEQ ID NO: 253718 - protein, 9 aa, Homo Sapiens
KNKKLSLDF

SEQ ID NO: 253719 - protein, 9 aa, Homo Sapiens
ELVPGDFLF

SEQ ID NO: 253720 - protein, 9 aa, Homo Sapiens
GIVDFEWIR

SEQ ID NO: 253721 - protein, 9 aa, Homo Sapiens
DYSDSPTEK

SEQ ID NO: 253722 - protein, 9 aa, Homo Sapiens
EHRSRLDKS

SEQ ID NO: 253723 - protein, 9 aa, Homo Sapiens
ELKHAGKIS

SEQ ID NO: 253724 - protein, 9 aa, Homo Sapiens
TEKSRQYLK

SEQ ID NO: 253725 - protein, 9 aa, Homo Sapiens
IIATTEVFK

SEQ ID NO: 253726 - protein, 9 aa, Homo Sapiens
AANEDKSAA

SEQ ID NO: 253727 - protein, 9 aa, Homo Sapiens
GQWLEWGSW

SEQ ID NO: 253728 - protein, 9 aa, Homo Sapiens
KHQGPQEQW

SEQ ID NO: 253729 - protein, 9 aa, Homo Sapiens
AENITPERD

SEQ ID NO: 253730 - protein, 9 aa, Homo Sapiens
SHANRVKPD

SEQ ID NO: 253731 - protein, 9 aa, Homo Sapiens
QKALEPALS

SEQ ID NO: 253732 - protein, 9 aa, Homo Sapiens
DTSPILTEK

SEQ ID NO: 253733 - protein, 9 aa, Homo Sapiens
IVNLNKHVY

SEQ ID NO: 253734 - protein, 9 aa, Homo Sapiens
LTNVDLGGN

SEQ ID NO: 253735 - protein, 9 aa, Homo Sapiens
SESMRKIKS

SEQ ID NO: 253736 - protein, 9 aa, Homo Sapiens
VDALFKGDN

SEQ ID NO: 253737 - protein, 9 aa, Homo Sapiens
LASAQENYN

SEQ ID NO: 253738 - protein, 9 aa, Homo Sapiens
LISRLYNAT

SEQ ID NO: 253739 - protein, 9 aa, Homo Sapiens
QRVCSGKAP

SEQ ID NO: 253740 - protein, 9 aa, Homo Sapiens
AVGLAQSLA

SEQ ID NO: 253741 - protein, 9 aa, Homo Sapiens
VKCMPYTTY

SEQ ID NO: 253742 - protein, 9 aa, Homo Sapiens
YTVNIVAIS

SEQ ID NO: 253743 - protein, 9 aa, Homo Sapiens
PRSPNMLSV

SEQ ID NO: 253744 - protein, 9 aa, Homo Sapiens
AIFQHFNSL

SEQ ID NO: 253745 - protein, 9 aa, Homo Sapiens
NPWGPRPLG

SEQ ID NO: 253746 - protein, 9 aa, Homo Sapiens
RYFSTDMSS

SEQ ID NO: 253747 - protein, 9 aa, Homo Sapiens
HRIIHTAKK

SEQ ID NO: 253748 - protein, 9 aa, Homo Sapiens
HFSENIYEA

SEQ ID NO: 253749 - protein, 9 aa, Homo Sapiens
GPGESYQPI

SEQ ID NO: 253750 - protein, 9 aa, Homo Sapiens
ASWPHHPGP

SEQ ID NO: 253751 - protein, 9 aa, Homo Sapiens
ADCGRAFTQ

SEQ ID NO: 253752 - protein, 9 aa, Homo Sapiens
VLQQCLAPR

SEQ ID NO: 253753 - protein, 9 aa, Homo Sapiens
RGSAKQGTS

SEQ ID NO: 253754 - protein, 9 aa, Homo Sapiens
LQKSRTEMQ

SEQ ID NO: 253755 - protein, 9 aa, Homo Sapiens
TVVLSGLAS

SEQ ID NO: 253756 - protein, 9 aa, Homo Sapiens
VIERTFRVE

SEQ ID NO: 253757 - protein, 9 aa, Homo Sapiens
PFASVAATC

SEQ ID NO: 253758 - protein, 9 aa, Homo Sapiens
CEEQAVLLV

SEQ ID NO: 253759 - protein, 9 aa, Homo Sapiens
VINLMHHAA

SEQ ID NO: 253760 - protein, 9 aa, Homo Sapiens
SSDPSHLAY

SEQ ID NO: 253761 - protein, 9 aa, Homo Sapiens
SYALRTIHT

SEQ ID NO: 253762 - protein, 9 aa, Homo Sapiens
NEMITNVGK

SEQ ID NO: 253763 - protein, 9 aa, Homo Sapiens
EHGEIEVTI

SEQ ID NO: 253764 - protein, 9 aa, Homo Sapiens
AKPTKVTLA

SEQ ID NO: 253765 - protein, 9 aa, Homo Sapiens
RTTTKWVAM

SEQ ID NO: 253766 - protein, 9 aa, Homo Sapiens
LGNIVKTSV

SEQ ID NO: 253767 - protein, 9 aa, Homo Sapiens
LNTNPSLRP

SEQ ID NO: 253768 - protein, 9 aa, Homo Sapiens
FVLKPKWRS

SEQ ID NO: 253769 - protein, 9 aa, Homo Sapiens
YLKYLTKKH

SEQ ID NO: 253770 - protein, 9 aa, Homo Sapiens
MHTSTSYSV

SEQ ID NO: 253771 - protein, 9 aa, Homo Sapiens
RGGTCVNVG

SEQ ID NO: 253772 - protein, 9 aa, Homo Sapiens
YFHMSPIKL

SEQ ID NO: 253773 - protein, 9 aa, Homo Sapiens
LLFDNTTVV

SEQ ID NO: 253774 - protein, 9 aa, Homo Sapiens
KIIMIIGNG

SEQ ID NO: 253775 - protein, 9 aa, Homo Sapiens
ARNCMWLQV

SEQ ID NO: 253776 - protein, 9 aa, Homo Sapiens
LSPDPQMDY

SEQ ID NO: 253777 - protein, 9 aa, Homo Sapiens
LYNSINNEK

SEQ ID NO: 253778 - protein, 9 aa, Homo Sapiens
SLKDELLCY

SEQ ID NO: 253779 - protein, 9 aa, Homo Sapiens
SVCYSVFFN

SEQ ID NO: 253780 - protein, 9 aa, Homo Sapiens
RSPNMLSVA

SEQ ID NO: 253781 - protein, 9 aa, Homo Sapiens
GRLYAISAR

SEQ ID NO: 253782 - protein, 9 aa, Homo Sapiens
HERCHTGNT

SEQ ID NO: 253783 - protein, 9 aa, Homo Sapiens
WFIPEGLQC

SEQ ID NO: 253784 - protein, 9 aa, Homo Sapiens
CPQKSNLDQ

SEQ ID NO: 253785 - protein, 9 aa, Homo Sapiens
WDGSDLTED

SEQ ID NO: 253786 - protein, 9 aa, Homo Sapiens
VMQIIDVSW

SEQ ID NO: 253787 - protein, 9 aa, Homo Sapiens
TLTRHKIMH

SEQ ID NO: 253788 - protein, 9 aa, Homo Sapiens
TVMLNGQKG

SEQ ID NO: 253789 - protein, 9 aa, Homo Sapiens
TEEKSVISD

SEQ ID NO: 253790 - protein, 9 aa, Homo Sapiens
AVYLIRKEW

SEQ ID NO: 253791 - protein, 9 aa, Homo Sapiens
ERVYNLVKE

SEQ ID NO: 253792 - protein, 9 aa, Homo Sapiens
SEASENKCI

SEQ ID NO: 253793 - protein, 9 aa, Homo Sapiens
IALRNVIII

SEQ ID NO: 253794 - protein, 9 aa, Homo Sapiens
QGTRATLVG

SEQ ID NO: 253795 - protein, 9 aa, Homo Sapiens
NETLQANEI

SEQ ID NO: 253796 - protein, 9 aa, Homo Sapiens
WEKSKGYGF

SEQ ID NO: 253797 - protein, 9 aa, Homo Sapiens
LLKDIYRTM

SEQ ID NO: 253798 - protein, 9 aa, Homo Sapiens
FVLSFLGAA

SEQ ID NO: 253799 - protein, 9 aa, Homo Sapiens
VIIITWEII

SEQ ID NO: 253800 - protein, 9 aa, Homo Sapiens
KAIANVLKK

SEQ ID NO: 253801 - protein, 9 aa, Homo Sapiens
QEIKYAFEL

SEQ ID NO: 253802 - protein, 9 aa, Homo Sapiens
NSYQSLAPL

SEQ ID NO: 253803 - protein, 9 aa, Homo Sapiens
VGKRWQEAR

SEQ ID NO: 253804 - protein, 9 aa, Homo Sapiens
VNFYDWKRM

SEQ ID NO: 253805 - protein, 9 aa, Homo Sapiens
FLQVIDRLE

SEQ ID NO: 253806 - protein, 9 aa, Homo Sapiens
HKPPYNSKA

SEQ ID NO: 253807 - protein, 9 aa, Homo Sapiens
SMKQVGTSQ

SEQ ID NO: 253808 - protein, 9 aa, Homo Sapiens
TNIVSENTI

SEQ ID NO: 253809 - protein, 9 aa, Homo Sapiens
DDRLLIEKL

SEQ ID NO: 253810 - protein, 9 aa, Homo Sapiens
ENYTVQIPE

SEQ ID NO: 253811 - protein, 9 aa, Homo Sapiens
TDIKEANLF

SEQ ID NO: 253812 - protein, 9 aa, Homo Sapiens
VNELMRGIH

SEQ ID NO: 253813 - protein, 9 aa, Homo Sapiens
VGTGATNTK

SEQ ID NO: 253814 - protein, 9 aa, Homo Sapiens
CKGFSYFGE

SEQ ID NO: 253815 - protein, 9 aa, Homo Sapiens
LSLPTTITL

SEQ ID NO: 253816 - protein, 9 aa, Homo Sapiens
DLVDASDLK

SEQ ID NO: 253817 - protein, 9 aa, Homo Sapiens
LWTVPAMDP

SEQ ID NO: 253818 - protein, 9 aa, Homo Sapiens
SNRTWTDYT

SEQ ID NO: 253819 - protein, 9 aa, Homo Sapiens
KALLVLLLL

SEQ ID NO: 253820 - protein, 9 aa, Homo Sapiens
KAWFDQHQI

SEQ ID NO: 253821 - protein, 9 aa, Homo Sapiens
AILTGLCLT

SEQ ID NO: 253822 - protein, 9 aa, Homo Sapiens
NSGPAWGSK

SEQ ID NO: 253823 - protein, 9 aa, Homo Sapiens
EEAVDPLGD

SEQ ID NO: 253824 - protein, 9 aa, Homo Sapiens
SDYNFLSLR

SEQ ID NO: 253825 - protein, 9 aa, Homo Sapiens
LQTESLTQV

SEQ ID NO: 253826 - protein, 9 aa, Homo Sapiens
LYILARVIH

SEQ ID NO: 253827 - protein, 9 aa, Homo Sapiens
RRKGHRVVK

SEQ ID NO: 253828 - protein, 9 aa, Homo Sapiens
CKPLHYYSI

SEQ ID NO: 253829 - protein, 9 aa, Homo Sapiens
LMYSLRNKE

SEQ ID NO: 253830 - protein, 9 aa, Homo Sapiens
MIQLPSNNR

SEQ ID NO: 253831 - protein, 9 aa, Homo Sapiens
SLNGHLPHP

SEQ ID NO: 253832 - protein, 9 aa, Homo Sapiens
FNTDKAISF

SEQ ID NO: 253833 - protein, 9 aa, Homo Sapiens
YYLTNMEGN

SEQ ID NO: 253834 - protein, 9 aa, Homo Sapiens
NDDEDGAPA

SEQ ID NO: 253835 - protein, 9 aa, Homo Sapiens
NGRFSLCEW

SEQ ID NO: 253836 - protein, 9 aa, Homo Sapiens
NPCGSIYFT

SEQ ID NO: 253837 - protein, 9 aa, Homo Sapiens
WIRRALRTP

SEQ ID NO: 253838 - protein, 9 aa, Homo Sapiens
VPGAGRFIN

SEQ ID NO: 253839 - protein, 9 aa, Homo Sapiens
RKIQGSYGD

SEQ ID NO: 253840 - protein, 9 aa, Homo Sapiens
YECKECEKV

SEQ ID NO: 253841 - protein, 9 aa, Homo Sapiens
TSLTTENST

SEQ ID NO: 253842 - protein, 9 aa, Homo Sapiens
VNVNFEKPK

SEQ ID NO: 253843 - protein, 9 aa, Homo Sapiens
YPGYQATTY

SEQ ID NO: 253844 - protein, 9 aa, Homo Sapiens
CADTALFDI

SEQ ID NO: 253845 - protein, 9 aa, Homo Sapiens
VFRTEEEET

SEQ ID NO: 253846 - protein, 9 aa, Homo Sapiens
FVQANQSNR

SEQ ID NO: 253847 - protein, 9 aa, Homo Sapiens
GDPVHPGVA

SEQ ID NO: 253848 - protein, 9 aa, Homo Sapiens
GILFVNSQI

SEQ ID NO: 253849 - protein, 9 aa, Homo Sapiens
PKNAALNLG

SEQ ID NO: 253850 - protein, 9 aa, Homo Sapiens
LMDDKLLHN

SEQ ID NO: 253851 - protein, 9 aa, Homo Sapiens
EALAAFEAW

SEQ ID NO: 253852 - protein, 9 aa, Homo Sapiens
LVTGFELVV

SEQ ID NO: 253853 - protein, 9 aa, Homo Sapiens
INLLSVAYK

SEQ ID NO: 253854 - protein, 9 aa, Homo Sapiens
VHYTDDPEA

SEQ ID NO: 253855 - protein, 9 aa, Homo Sapiens
GSVGCCSEQ

SEQ ID NO: 253856 - protein, 9 aa, Homo Sapiens
NSKKASEKL

SEQ ID NO: 253857 - protein, 9 aa, Homo Sapiens
PYQLGRVVD

SEQ ID NO: 253858 - protein, 9 aa, Homo Sapiens
KIFKSQIDN

SEQ ID NO: 253859 - protein, 9 aa, Homo Sapiens
SEVKYLGPL

SEQ ID NO: 253860 - protein, 9 aa, Homo Sapiens
VLENTAEGN

SEQ ID NO: 253861 - protein, 9 aa, Homo Sapiens
VVWIQEANN

SEQ ID NO: 253862 - protein, 9 aa, Homo Sapiens
FFSNCPFSW

SEQ ID NO: 253863 - protein, 9 aa, Homo Sapiens
TPRSAYLLY

SEQ ID NO: 253864 - protein, 9 aa, Homo Sapiens
GQCQAWKGS

SEQ ID NO: 253865 - protein, 9 aa, Homo Sapiens
TFLVRDNSK

SEQ ID NO: 253866 - protein, 9 aa, Homo Sapiens
KVEEDTENM

SEQ ID NO: 253867 - protein, 9 aa, Homo Sapiens
NLVARRRGI

SEQ ID NO: 253868 - protein, 9 aa, Homo Sapiens
LFIYVKPKQ

SEQ ID NO: 253869 - protein, 9 aa, Homo Sapiens
DADGNGYID

SEQ ID NO: 253870 - protein, 9 aa, Homo Sapiens
EEDVHKLRE

SEQ ID NO: 253871 - protein, 9 aa, Homo Sapiens
ETYLMFWFG

SEQ ID NO: 253872 - protein, 9 aa, Homo Sapiens
VSTLYTINV

SEQ ID NO: 253873 - protein, 9 aa, Homo Sapiens
SNSLLNRYA

SEQ ID NO: 253874 - protein, 9 aa, Homo Sapiens
EAIIISGTK

SEQ ID NO: 253875 - protein, 9 aa, Homo Sapiens
LVRYIYYGN

SEQ ID NO: 253876 - protein, 9 aa, Homo Sapiens
MSSRGGGRG

SEQ ID NO: 253877 - protein, 9 aa, Homo Sapiens
TLDDRLLGE

SEQ ID NO: 253878 - protein, 9 aa, Homo Sapiens
TLRDVIGLS

SEQ ID NO: 253879 - protein, 9 aa, Homo Sapiens
KMVWNQTTH

SEQ ID NO: 253880 - protein, 9 aa, Homo Sapiens
DREEIKEHS

SEQ ID NO: 253881 - protein, 9 aa, Homo Sapiens
IYLPVPLPQ

SEQ ID NO: 253882 - protein, 9 aa, Homo Sapiens
KNHDISNDA

SEQ ID NO: 253883 - protein, 9 aa, Homo Sapiens
SIIKSRDNE

SEQ ID NO: 253884 - protein, 9 aa, Homo Sapiens
SAQFMGSPQ

SEQ ID NO: 253885 - protein, 9 aa, Homo Sapiens
ASPEGFKKS

SEQ ID NO: 253886 - protein, 9 aa, Homo Sapiens
QAESFEEES

SEQ ID NO: 253887 - protein, 9 aa, Homo Sapiens
FLTGHDRLH

SEQ ID NO: 253888 - protein, 9 aa, Homo Sapiens
NWWKGEHHR

SEQ ID NO: 253889 - protein, 9 aa, Homo Sapiens
RTEPGLIAF

SEQ ID NO: 253890 - protein, 9 aa, Homo Sapiens
FPEFLGFKH

SEQ ID NO: 253891 - protein, 9 aa, Homo Sapiens
PFGVQSHMF

SEQ ID NO: 253892 - protein, 9 aa, Homo Sapiens
SDVLPKAAS

SEQ ID NO: 253893 - protein, 9 aa, Homo Sapiens
ILGNLKYMA

SEQ ID NO: 253894 - protein, 9 aa, Homo Sapiens
EEEIQAREQ

SEQ ID NO: 253895 - protein, 9 aa, Homo Sapiens
VRQAASQSL

SEQ ID NO: 253896 - protein, 9 aa, Homo Sapiens
MLKFAIPSE

SEQ ID NO: 253897 - protein, 9 aa, Homo Sapiens
LISNTGSKH

SEQ ID NO: 253898 - protein, 9 aa, Homo Sapiens
RISPTVTTW

SEQ ID NO: 253899 - protein, 9 aa, Homo Sapiens
EEHVSFLKT

SEQ ID NO: 253900 - protein, 9 aa, Homo Sapiens
PINITGEKF

SEQ ID NO: 253901 - protein, 9 aa, Homo Sapiens
LLKRHEKSH

SEQ ID NO: 253902 - protein, 9 aa, Homo Sapiens
QNRVLSSSN

SEQ ID NO: 253903 - protein, 9 aa, Homo Sapiens
GKVAGAWDP

SEQ ID NO: 253904 - protein, 9 aa, Homo Sapiens
QNIKYREKF

SEQ ID NO: 253905 - protein, 9 aa, Homo Sapiens
SLLETHNSV

SEQ ID NO: 253906 - protein, 9 aa, Homo Sapiens
IQQCSRPLS

SEQ ID NO: 253907 - protein, 9 aa, Homo Sapiens
GAQPSPFLP

SEQ ID NO: 253908 - protein, 9 aa, Homo Sapiens
LETQPPGRQ

SEQ ID NO: 253909 - protein, 9 aa, Homo Sapiens
GLEGNGIDS

SEQ ID NO: 253910 - protein, 9 aa, Homo Sapiens
FAPFIDKVR

SEQ ID NO: 253911 - protein, 9 aa, Homo Sapiens
TNFDKNRNY

SEQ ID NO: 253912 - protein, 9 aa, Homo Sapiens
SLPLVERIH

SEQ ID NO: 253913 - protein, 9 aa, Homo Sapiens
WFLDRLWTT

SEQ ID NO: 253914 - protein, 9 aa, Homo Sapiens
ESNDRGKTP

SEQ ID NO: 253915 - protein, 9 aa, Homo Sapiens
VEFTTLDFP

SEQ ID NO: 253916 - protein, 9 aa, Homo Sapiens
EQLIYAFFG

SEQ ID NO: 253917 - protein, 9 aa, Homo Sapiens
PRPYRPKPG

SEQ ID NO: 253918 - protein, 9 aa, Homo Sapiens
STENLNGFI

SEQ ID NO: 253919 - protein, 9 aa, Homo Sapiens
TEVDNFHLD

SEQ ID NO: 253920 - protein, 9 aa, Homo Sapiens
RIASQSGAT

SEQ ID NO: 253921 - protein, 9 aa, Homo Sapiens
FTRPKSATH

SEQ ID NO: 253922 - protein, 9 aa, Homo Sapiens
HLDKKRKVK

SEQ ID NO: 253923 - protein, 9 aa, Homo Sapiens
CCSEQQEED

SEQ ID NO: 253924 - protein, 9 aa, Homo Sapiens
SILFLTCVS

SEQ ID NO: 253925 - protein, 9 aa, Homo Sapiens
GKQKKHEQP

SEQ ID NO: 253926 - protein, 9 aa, Homo Sapiens
VAFGVELQE

SEQ ID NO: 253927 - protein, 9 aa, Homo Sapiens
SSSANEDDD

SEQ ID NO: 253928 - protein, 9 aa, Homo Sapiens
VEDSAEEEA

SEQ ID NO: 253929 - protein, 9 aa, Homo Sapiens
REVQLGRNG

SEQ ID NO: 253930 - protein, 9 aa, Homo Sapiens
KITLYEDRA

SEQ ID NO: 253931 - protein, 9 aa, Homo Sapiens
NKKVSLLEY

SEQ ID NO: 253932 - protein, 9 aa, Homo Sapiens
ISPTRSSRY

SEQ ID NO: 253933 - protein, 9 aa, Homo Sapiens
HSLETAKAV

SEQ ID NO: 253934 - protein, 9 aa, Homo Sapiens
KCLGFRDET

SEQ ID NO: 253935 - protein, 9 aa, Homo Sapiens
LMYLKEGYK

SEQ ID NO: 253936 - protein, 9 aa, Homo Sapiens
SLSSSDRND

SEQ ID NO: 253937 - protein, 9 aa, Homo Sapiens
STSPHIPRF

SEQ ID NO: 253938 - protein, 9 aa, Homo Sapiens
PQPSNRNVM

SEQ ID NO: 253939 - protein, 9 aa, Homo Sapiens
AGLFRRSAS

SEQ ID NO: 253940 - protein, 9 aa, Homo Sapiens
ELFLDKFFL

SEQ ID NO: 253941 - protein, 9 aa, Homo Sapiens
LDDLTMDIY

SEQ ID NO: 253942 - protein, 9 aa, Homo Sapiens
IDLAQNFGY

SEQ ID NO: 253943 - protein, 9 aa, Homo Sapiens
DNFQELLRS

SEQ ID NO: 253944 - protein, 9 aa, Homo Sapiens
STVLTHKQS

SEQ ID NO: 253945 - protein, 9 aa, Homo Sapiens
KNTKVDLFA

SEQ ID NO: 253946 - protein, 9 aa, Homo Sapiens
TSSSEDMGR

SEQ ID NO: 253947 - protein, 9 aa, Homo Sapiens
FCLGNLAFL

SEQ ID NO: 253948 - protein, 9 aa, Homo Sapiens
HQELLRKER

SEQ ID NO: 253949 - protein, 9 aa, Homo Sapiens
EDYDKVKLL

SEQ ID NO: 253950 - protein, 9 aa, Homo Sapiens
CSWNYRLPA

SEQ ID NO: 253951 - protein, 9 aa, Homo Sapiens
ICHVDAHAT

SEQ ID NO: 253952 - protein, 9 aa, Homo Sapiens
RVSGKVTTK

SEQ ID NO: 253953 - protein, 9 aa, Homo Sapiens
DAEIRRIKS

SEQ ID NO: 253954 - protein, 9 aa, Homo Sapiens
VMSAPVSLA

SEQ ID NO: 253955 - protein, 9 aa, Homo Sapiens
RTVHQIIHT

SEQ ID NO: 253956 - protein, 9 aa, Homo Sapiens
MLTYYPSER

SEQ ID NO: 253957 - protein, 9 aa, Homo Sapiens
KYLYTFMSM

SEQ ID NO: 253958 - protein, 9 aa, Homo Sapiens
VQIRQKKAQ

SEQ ID NO: 253959 - protein, 9 aa, Homo Sapiens
VYENYSQQL

SEQ ID NO: 253960 - protein, 9 aa, Homo Sapiens
HWMLEAQFA

SEQ ID NO: 253961 - protein, 9 aa, Homo Sapiens
HLSIVTQEE

SEQ ID NO: 253962 - protein, 9 aa, Homo Sapiens
QQLLSYAIL

SEQ ID NO: 253963 - protein, 9 aa, Homo Sapiens
LADDLGFEL

SEQ ID NO: 253964 - protein, 9 aa, Homo Sapiens
LLLKDIYRT

SEQ ID NO: 253965 - protein, 9 aa, Homo Sapiens
VNNACGVQS

SEQ ID NO: 253966 - protein, 9 aa, Homo Sapiens
GHPVVESLQ

SEQ ID NO: 253967 - protein, 9 aa, Homo Sapiens
QRRCPLGCG

SEQ ID NO: 253968 - protein, 9 aa, Homo Sapiens
AWHWRNRNK

SEQ ID NO: 253969 - protein, 9 aa, Homo Sapiens
IYVCQSGYF

SEQ ID NO: 253970 - protein, 9 aa, Homo Sapiens
MYLEYTRTG

SEQ ID NO: 253971 - protein, 9 aa, Homo Sapiens
IQSLMYPAL

SEQ ID NO: 253972 - protein, 9 aa, Homo Sapiens
DPNNSSVST

SEQ ID NO: 253973 - protein, 9 aa, Homo Sapiens
GEQGPQGIG

SEQ ID NO: 253974 - protein, 9 aa, Homo Sapiens
NVCFKVITK

SEQ ID NO: 253975 - protein, 9 aa, Homo Sapiens
LESHNWRYA

SEQ ID NO: 253976 - protein, 9 aa, Homo Sapiens
DPTEVTPEL

SEQ ID NO: 253977 - protein, 9 aa, Homo Sapiens
QNIFSFNVW

SEQ ID NO: 253978 - protein, 9 aa, Homo Sapiens
ILELGYFND

SEQ ID NO: 253979 - protein, 9 aa, Homo Sapiens
RTQRQLGDA

SEQ ID NO: 253980 - protein, 9 aa, Homo Sapiens
VEIKNCKHQ

SEQ ID NO: 253981 - protein, 9 aa, Homo Sapiens
DADLRPSKL

SEQ ID NO: 253982 - protein, 9 aa, Homo Sapiens
DPSDKKEKK

SEQ ID NO: 253983 - protein, 9 aa, Homo Sapiens
QGIGGPPGL

SEQ ID NO: 253984 - protein, 9 aa, Homo Sapiens
VPTTTVLNS

SEQ ID NO: 253985 - protein, 9 aa, Homo Sapiens
RNITYKANP

SEQ ID NO: 253986 - protein, 9 aa, Homo Sapiens
SRKENFNQT

SEQ ID NO: 253987 - protein, 9 aa, Homo Sapiens
SSSEDSITP

SEQ ID NO: 253988 - protein, 9 aa, Homo Sapiens
QNNSLNANF

SEQ ID NO: 253989 - protein, 9 aa, Homo Sapiens
AYYTLLKKA

SEQ ID NO: 253990 - protein, 9 aa, Homo Sapiens
ILHHFLPAG

SEQ ID NO: 253991 - protein, 9 aa, Homo Sapiens
FGDQPESMV

SEQ ID NO: 253992 - protein, 9 aa, Homo Sapiens
YKRIPNCKI

SEQ ID NO: 253993 - protein, 9 aa, Homo Sapiens
NSPDGALEE

SEQ ID NO: 253994 - protein, 9 aa, Homo Sapiens
VRDSRKNSA

SEQ ID NO: 253995 - protein, 9 aa, Homo Sapiens
TKHKEVIES

SEQ ID NO: 253996 - protein, 9 aa, Homo Sapiens
NRLDLPPYT

SEQ ID NO: 253997 - protein, 9 aa, Homo Sapiens
LSVPRAPSF

SEQ ID NO: 253998 - protein, 9 aa, Homo Sapiens
HYSNKWHRF

SEQ ID NO: 253999 - protein, 9 aa, Homo Sapiens
SQKSHTFLP

SEQ ID NO: 254000 - protein, 9 aa, Homo Sapiens
TRVKVQYLV

SEQ ID NO: 254001 - protein, 9 aa, Homo Sapiens
YRSASENLG

SEQ ID NO: 254002 - protein, 9 aa, Homo Sapiens
LVWKSLDLY

SEQ ID NO: 254003 - protein, 9 aa, Homo Sapiens
NVWSMVNLV

SEQ ID NO: 254004 - protein, 9 aa, Homo Sapiens
LLLLQVPAQ

SEQ ID NO: 254005 - protein, 9 aa, Homo Sapiens
EELNTNLFD

SEQ ID NO: 254006 - protein, 9 aa, Homo Sapiens
ITDVKIGQK

SEQ ID NO: 254007 - protein, 9 aa, Homo Sapiens
WREEHLDNS

SEQ ID NO: 254008 - protein, 9 aa, Homo Sapiens
HTSRLCYDR

SEQ ID NO: 254009 - protein, 9 aa, Homo Sapiens
FDEAKDHNS

SEQ ID NO: 254010 - protein, 9 aa, Homo Sapiens
ICYERECKL

SEQ ID NO: 254011 - protein, 9 aa, Homo Sapiens
GLSNGDKSD

SEQ ID NO: 254012 - protein, 9 aa, Homo Sapiens
CPIDITLTQ

SEQ ID NO: 254013 - protein, 9 aa, Homo Sapiens
AALLTKTNQ

SEQ ID NO: 254014 - protein, 9 aa, Homo Sapiens
EASLRKDPI

SEQ ID NO: 254015 - protein, 9 aa, Homo Sapiens
LCPSKTSFF

SEQ ID NO: 254016 - protein, 9 aa, Homo Sapiens
QTQEIPHTG

SEQ ID NO: 254017 - protein, 9 aa, Homo Sapiens
RDELLVKIY

SEQ ID NO: 254018 - protein, 9 aa, Homo Sapiens
QHRNGINTL

SEQ ID NO: 254019 - protein, 9 aa, Homo Sapiens
QPKTVILFK

SEQ ID NO: 254020 - protein, 9 aa, Homo Sapiens
VLLCRHNGS

SEQ ID NO: 254021 - protein, 9 aa, Homo Sapiens
SETKEISWE

SEQ ID NO: 254022 - protein, 9 aa, Homo Sapiens
KTETHAKLA

SEQ ID NO: 254023 - protein, 9 aa, Homo Sapiens
SGLPTGEVL

SEQ ID NO: 254024 - protein, 9 aa, Homo Sapiens
FSDLQSLIK

SEQ ID NO: 254025 - protein, 9 aa, Homo Sapiens
RMQSEQIWK

SEQ ID NO: 254026 - protein, 9 aa, Homo Sapiens
QESELRTAF

SEQ ID NO: 254027 - protein, 9 aa, Homo Sapiens
ELENVFIGG

SEQ ID NO: 254028 - protein, 9 aa, Homo Sapiens
NVVSWKSRT

SEQ ID NO: 254029 - protein, 9 aa, Homo Sapiens
FPVFEKVLK

SEQ ID NO: 254030 - protein, 9 aa, Homo Sapiens
PWQVMLLVN

SEQ ID NO: 254031 - protein, 9 aa, Homo Sapiens
DELTIQVGE

SEQ ID NO: 254032 - protein, 9 aa, Homo Sapiens
IDVFMGFIT

SEQ ID NO: 254033 - protein, 9 aa, Homo Sapiens
APPSYFRRF

SEQ ID NO: 254034 - protein, 9 aa, Homo Sapiens
LRVNRVAVH

SEQ ID NO: 254035 - protein, 9 aa, Homo Sapiens
LDDRLLGEK

SEQ ID NO: 254036 - protein, 9 aa, Homo Sapiens
DNLYGYPEV

SEQ ID NO: 254037 - protein, 9 aa, Homo Sapiens
EVCLNVLRL

SEQ ID NO: 254038 - protein, 9 aa, Homo Sapiens
NKVSIVPTQ

SEQ ID NO: 254039 - protein, 9 aa, Homo Sapiens
QIRKSQHSV

SEQ ID NO: 254040 - protein, 9 aa, Homo Sapiens
DMIRGKLEN

SEQ ID NO: 254041 - protein, 9 aa, Homo Sapiens
FSRTNIIKI

SEQ ID NO: 254042 - protein, 9 aa, Homo Sapiens
SRFLKPSKV

SEQ ID NO: 254043 - protein, 9 aa, Homo Sapiens
EVEKPEERQ

SEQ ID NO: 254044 - protein, 9 aa, Homo Sapiens
VLISHSNVG

SEQ ID NO: 254045 - protein, 9 aa, Homo Sapiens
TAIVSTHSP

SEQ ID NO: 254046 - protein, 9 aa, Homo Sapiens
YVSPFDHSR

SEQ ID NO: 254047 - protein, 9 aa, Homo Sapiens
HPSVHEYYD

SEQ ID NO: 254048 - protein, 9 aa, Homo Sapiens
ADDGKAILD

SEQ ID NO: 254049 - protein, 9 aa, Homo Sapiens
LSDYPLWEA

SEQ ID NO: 254050 - protein, 9 aa, Homo Sapiens
TTEVWERSL

SEQ ID NO: 254051 - protein, 9 aa, Homo Sapiens
TVSVSEAIN

SEQ ID NO: 254052 - protein, 9 aa, Homo Sapiens
EDFKKKYGD

SEQ ID NO: 254053 - protein, 9 aa, Homo Sapiens
VTFDIYANG

SEQ ID NO: 254054 - protein, 9 aa, Homo Sapiens
LTTSQLPSP

SEQ ID NO: 254055 - protein, 9 aa, Homo Sapiens
AEDEGEDKD

SEQ ID NO: 254056 - protein, 9 aa, Homo Sapiens
DIVTEFGGS

SEQ ID NO: 254057 - protein, 9 aa, Homo Sapiens
QAKEGDLQK

SEQ ID NO: 254058 - protein, 9 aa, Homo Sapiens
NVTVPSTTC

SEQ ID NO: 254059 - protein, 9 aa, Homo Sapiens
ESLYSRFHG

SEQ ID NO: 254060 - protein, 9 aa, Homo Sapiens
QAPPQKVLF

SEQ ID NO: 254061 - protein, 9 aa, Homo Sapiens
AITEKDKIE

SEQ ID NO: 254062 - protein, 9 aa, Homo Sapiens
ECLLNLHSE

SEQ ID NO: 254063 - protein, 9 aa, Homo Sapiens
IVLWCYSNA

SEQ ID NO: 254064 - protein, 9 aa, Homo Sapiens
SCTTSGNNF

SEQ ID NO: 254065 - protein, 9 aa, Homo Sapiens
LPLLLPSGS

SEQ ID NO: 254066 - protein, 9 aa, Homo Sapiens
LFFAHGRLV

SEQ ID NO: 254067 - protein, 9 aa, Homo Sapiens
VLNKRILNF

SEQ ID NO: 254068 - protein, 9 aa, Homo Sapiens
KADVTPITQ

SEQ ID NO: 254069 - protein, 9 aa, Homo Sapiens
RFKDNKPNY

SEQ ID NO: 254070 - protein, 9 aa, Homo Sapiens
LVNGTTIEG

SEQ ID NO: 254071 - protein, 9 aa, Homo Sapiens
QGAVGCPGP

SEQ ID NO: 254072 - protein, 9 aa, Homo Sapiens
SYTVEVIIT

SEQ ID NO: 254073 - protein, 9 aa, Homo Sapiens
LAQAVHVQS

SEQ ID NO: 254074 - protein, 9 aa, Homo Sapiens
KMCKRILVE

SEQ ID NO: 254075 - protein, 9 aa, Homo Sapiens
HFDEAKDHN

SEQ ID NO: 254076 - protein, 9 aa, Homo Sapiens
ASPDNEDGD

SEQ ID NO: 254077 - protein, 9 aa, Homo Sapiens
AQEIDQVSY

SEQ ID NO: 254078 - protein, 9 aa, Homo Sapiens
SSILTNHKI

SEQ ID NO: 254079 - protein, 9 aa, Homo Sapiens
EWIRRALRT

SEQ ID NO: 254080 - protein, 9 aa, Homo Sapiens
QVGSAEEGY

SEQ ID NO: 254081 - protein, 9 aa, Homo Sapiens
KRKTESSCK

SEQ ID NO: 254082 - protein, 9 aa, Homo Sapiens
EKVHIVSIK

SEQ ID NO: 254083 - protein, 9 aa, Homo Sapiens
SPTFSENMS

SEQ ID NO: 254084 - protein, 9 aa, Homo Sapiens
GEDAAAGLR

SEQ ID NO: 254085 - protein, 9 aa, Homo Sapiens
RGQFGIPCC

SEQ ID NO: 254086 - protein, 9 aa, Homo Sapiens
GSCVKITIL

SEQ ID NO: 254087 - protein, 9 aa, Homo Sapiens
ATQMLKLQH

SEQ ID NO: 254088 - protein, 9 aa, Homo Sapiens
NGSVLPCLG

SEQ ID NO: 254089 - protein, 9 aa, Homo Sapiens
SISQNHAVL

SEQ ID NO: 254090 - protein, 9 aa, Homo Sapiens
LPNKSIQSG

SEQ ID NO: 254091 - protein, 9 aa, Homo Sapiens
FPVLSYYYT

SEQ ID NO: 254092 - protein, 9 aa, Homo Sapiens
VKVPAGVQM

SEQ ID NO: 254093 - protein, 9 aa, Homo Sapiens
CLRCQKGIP

SEQ ID NO: 254094 - protein, 9 aa, Homo Sapiens
SANMTDDIT

SEQ ID NO: 254095 - protein, 9 aa, Homo Sapiens
IEKQFILYA

SEQ ID NO: 254096 - protein, 9 aa, Homo Sapiens
DPFQYLLVI

SEQ ID NO: 254097 - protein, 9 aa, Homo Sapiens
EHEKRIALE

SEQ ID NO: 254098 - protein, 9 aa, Homo Sapiens
EWGSWGPCS

SEQ ID NO: 254099 - protein, 9 aa, Homo Sapiens
HGAFMFVAW

SEQ ID NO: 254100 - protein, 9 aa, Homo Sapiens
QESEAFLSQ

SEQ ID NO: 254101 - protein, 9 aa, Homo Sapiens
MMIFSWIVS

SEQ ID NO: 254102 - protein, 9 aa, Homo Sapiens
QNKVLISLL

SEQ ID NO: 254103 - protein, 9 aa, Homo Sapiens
VKGIIYSIL

SEQ ID NO: 254104 - protein, 9 aa, Homo Sapiens
EIKQIEVCK

SEQ ID NO: 254105 - protein, 9 aa, Homo Sapiens
LQSSDLKTI

SEQ ID NO: 254106 - protein, 9 aa, Homo Sapiens
EERSAQKEN

SEQ ID NO: 254107 - protein, 9 aa, Homo Sapiens
PQDTISSSQ

SEQ ID NO: 254108 - protein, 9 aa, Homo Sapiens
RPERDMHYL

SEQ ID NO: 254109 - protein, 9 aa, Homo Sapiens
SLKNDHNSG

SEQ ID NO: 254110 - protein, 9 aa, Homo Sapiens
LPHPFTITV

SEQ ID NO: 254111 - protein, 9 aa, Homo Sapiens
THDRIKDVK

SEQ ID NO: 254112 - protein, 9 aa, Homo Sapiens
EDSDIRCLS

SEQ ID NO: 254113 - protein, 9 aa, Homo Sapiens
FFKSALHAI

SEQ ID NO: 254114 - protein, 9 aa, Homo Sapiens
KNPVYEDFY

SEQ ID NO: 254115 - protein, 9 aa, Homo Sapiens
NVIRMMSLI

SEQ ID NO: 254116 - protein, 9 aa, Homo Sapiens
FVPPLYYLV

SEQ ID NO: 254117 - protein, 9 aa, Homo Sapiens
RRDIAPPER

SEQ ID NO: 254118 - protein, 9 aa, Homo Sapiens
KTLIQLTVK

SEQ ID NO: 254119 - protein, 9 aa, Homo Sapiens
TLKINYQIK

SEQ ID NO: 254120 - protein, 9 aa, Homo Sapiens
FGCNSTIIK

SEQ ID NO: 254121 - protein, 9 aa, Homo Sapiens
WKDCKIRLF

SEQ ID NO: 254122 - protein, 9 aa, Homo Sapiens
SYSVRRKGK

SEQ ID NO: 254123 - protein, 9 aa, Homo Sapiens
VQDPMLLAT

SEQ ID NO: 254124 - protein, 9 aa, Homo Sapiens
QKILFEESN

SEQ ID NO: 254125 - protein, 9 aa, Homo Sapiens
RVHSANKFF

SEQ ID NO: 254126 - protein, 9 aa, Homo Sapiens
FLDHTGLTA

SEQ ID NO: 254127 - protein, 9 aa, Homo Sapiens
NSNVYMVME

SEQ ID NO: 254128 - protein, 9 aa, Homo Sapiens
PKMIQLPSN

SEQ ID NO: 254129 - protein, 9 aa, Homo Sapiens
SRNTSFRRN

SEQ ID NO: 254130 - protein, 9 aa, Homo Sapiens
RSVKPHLCS

SEQ ID NO: 254131 - protein, 9 aa, Homo Sapiens
QGVFQILIC

SEQ ID NO: 254132 - protein, 9 aa, Homo Sapiens
DIDHLNKAE

SEQ ID NO: 254133 - protein, 9 aa, Homo Sapiens
YGIKSFDSV

SEQ ID NO: 254134 - protein, 9 aa, Homo Sapiens
EWERILYQF

SEQ ID NO: 254135 - protein, 9 aa, Homo Sapiens
FFQDKGRGM

SEQ ID NO: 254136 - protein, 9 aa, Homo Sapiens
FNVETVTYR

SEQ ID NO: 254137 - protein, 9 aa, Homo Sapiens
SDADGPTYG

SEQ ID NO: 254138 - protein, 9 aa, Homo Sapiens
PQKSNLDQA

SEQ ID NO: 254139 - protein, 9 aa, Homo Sapiens
TKYRYFFQT

SEQ ID NO: 254140 - protein, 9 aa, Homo Sapiens
EIYFLGPKD

SEQ ID NO: 254141 - protein, 9 aa, Homo Sapiens
VCRLISREK

SEQ ID NO: 254142 - protein, 9 aa, Homo Sapiens
CIFVIPSIK

SEQ ID NO: 254143 - protein, 9 aa, Homo Sapiens
TKSLEYPRE

SEQ ID NO: 254144 - protein, 9 aa, Homo Sapiens
EIALIIFNI

SEQ ID NO: 254145 - protein, 9 aa, Homo Sapiens
YATPDSVGL

SEQ ID NO: 254146 - protein, 9 aa, Homo Sapiens
IKRRDKTCM

SEQ ID NO: 254147 - protein, 9 aa, Homo Sapiens
QAGELFMEI

SEQ ID NO: 254148 - protein, 9 aa, Homo Sapiens
QELKKVSEA

SEQ ID NO: 254149 - protein, 9 aa, Homo Sapiens
VVSGDTMKL

SEQ ID NO: 254150 - protein, 9 aa, Homo Sapiens
VQTEGAEAT

SEQ ID NO: 254151 - protein, 9 aa, Homo Sapiens
LTPQDELFI

SEQ ID NO: 254152 - protein, 9 aa, Homo Sapiens
EAVNSLREE

SEQ ID NO: 254153 - protein, 9 aa, Homo Sapiens
PFQYLLVIK

SEQ ID NO: 254154 - protein, 9 aa, Homo Sapiens
RFNQLNEEV

SEQ ID NO: 254155 - protein, 9 aa, Homo Sapiens
AHKINYGAC

SEQ ID NO: 254156 - protein, 9 aa, Homo Sapiens
IVQELPQIL

SEQ ID NO: 254157 - protein, 9 aa, Homo Sapiens
ICKPLHYYS

SEQ ID NO: 254158 - protein, 9 aa, Homo Sapiens
SLMAPTPVS

SEQ ID NO: 254159 - protein, 9 aa, Homo Sapiens
KSQSGSSAS

SEQ ID NO: 254160 - protein, 9 aa, Homo Sapiens
NWLEQQQGN

SEQ ID NO: 254161 - protein, 9 aa, Homo Sapiens
AYNVPLPNK

SEQ ID NO: 254162 - protein, 9 aa, Homo Sapiens
YVQRLWREE

SEQ ID NO: 254163 - protein, 9 aa, Homo Sapiens
DNHFHARRG

SEQ ID NO: 254164 - protein, 9 aa, Homo Sapiens
STHDNRVFT

SEQ ID NO: 254165 - protein, 9 aa, Homo Sapiens
DLADLEVLV

SEQ ID NO: 254166 - protein, 9 aa, Homo Sapiens
WRCPGGFRI

SEQ ID NO: 254167 - protein, 9 aa, Homo Sapiens
ATHLKWLPS

SEQ ID NO: 254168 - protein, 9 aa, Homo Sapiens
SYFMISHSL

SEQ ID NO: 254169 - protein, 9 aa, Homo Sapiens
RHNERKRKT

SEQ ID NO: 254170 - protein, 9 aa, Homo Sapiens
ALLLQTPVV

SEQ ID NO: 254171 - protein, 9 aa, Homo Sapiens
KKILLRKFC

SEQ ID NO: 254172 - protein, 9 aa, Homo Sapiens
EPLSSTATK

SEQ ID NO: 254173 - protein, 9 aa, Homo Sapiens
HIGVKPFKC

SEQ ID NO: 254174 - protein, 9 aa, Homo Sapiens
RGYFAILRK

SEQ ID NO: 254175 - protein, 9 aa, Homo Sapiens
CGIIFSHNS

SEQ ID NO: 254176 - protein, 9 aa, Homo Sapiens
IPSSESFTT

SEQ ID NO: 254177 - protein, 9 aa, Homo Sapiens
GLNGLDESL

SEQ ID NO: 254178 - protein, 9 aa, Homo Sapiens
YSLHTEAVW

SEQ ID NO: 254179 - protein, 9 aa, Homo Sapiens
LLRKKHTTS

SEQ ID NO: 254180 - protein, 9 aa, Homo Sapiens
GIGDINILQ

SEQ ID NO: 254181 - protein, 9 aa, Homo Sapiens
ENYQPNMVV

SEQ ID NO: 254182 - protein, 9 aa, Homo Sapiens
SPTVTTWSN

SEQ ID NO: 254183 - protein, 9 aa, Homo Sapiens
PVKIIGEYT

SEQ ID NO: 254184 - protein, 9 aa, Homo Sapiens
QKKHEQPVE

SEQ ID NO: 254185 - protein, 9 aa, Homo Sapiens
ALHDRMTEQ

SEQ ID NO: 254186 - protein, 9 aa, Homo Sapiens
IHAIKILDR

SEQ ID NO: 254187 - protein, 9 aa, Homo Sapiens
IMDSYSKQR

SEQ ID NO: 254188 - protein, 9 aa, Homo Sapiens
ECGKRFTDN

SEQ ID NO: 254189 - protein, 9 aa, Homo Sapiens
IQSIIHQDE

SEQ ID NO: 254190 - protein, 9 aa, Homo Sapiens
IAQRKWEKH

SEQ ID NO: 254191 - protein, 9 aa, Homo Sapiens
ELDEEVEQF

SEQ ID NO: 254192 - protein, 9 aa, Homo Sapiens
TALVFLDNR

SEQ ID NO: 254193 - protein, 9 aa, Homo Sapiens
GEDDEYAPM

SEQ ID NO: 254194 - protein, 9 aa, Homo Sapiens
LPLSDYPLW

SEQ ID NO: 254195 - protein, 9 aa, Homo Sapiens
RDLTPSRPA

SEQ ID NO: 254196 - protein, 9 aa, Homo Sapiens
LISASLFIR

SEQ ID NO: 254197 - protein, 9 aa, Homo Sapiens
ATCLLGFSL

SEQ ID NO: 254198 - protein, 9 aa, Homo Sapiens
EADPYSKRA

SEQ ID NO: 254199 - protein, 9 aa, Homo Sapiens
DLVNWIIKQ

SEQ ID NO: 254200 - protein, 9 aa, Homo Sapiens
TIRHDTFSD

SEQ ID NO: 254201 - protein, 9 aa, Homo Sapiens
LEKHLGRVH

SEQ ID NO: 254202 - protein, 9 aa, Homo Sapiens
KTCDCFSPY

SEQ ID NO: 254203 - protein, 9 aa, Homo Sapiens
KIKELFHID

SEQ ID NO: 254204 - protein, 9 aa, Homo Sapiens
SPGLPPGWE

SEQ ID NO: 254205 - protein, 9 aa, Homo Sapiens
SQFQTAPPG

SEQ ID NO: 254206 - protein, 9 aa, Homo Sapiens
VQLGRNGVE

SEQ ID NO: 254207 - protein, 9 aa, Homo Sapiens
VLICCCCTT

SEQ ID NO: 254208 - protein, 9 aa, Homo Sapiens
ISDRIIVCY

SEQ ID NO: 254209 - protein, 9 aa, Homo Sapiens
CDCFSPYEN

SEQ ID NO: 254210 - protein, 9 aa, Homo Sapiens
TSGPDLTTV

SEQ ID NO: 254211 - protein, 9 aa, Homo Sapiens
LNLTAGNEA

SEQ ID NO: 254212 - protein, 9 aa, Homo Sapiens
SLEKVYDLV

SEQ ID NO: 254213 - protein, 9 aa, Homo Sapiens
GHTFQNECL

SEQ ID NO: 254214 - protein, 9 aa, Homo Sapiens
YGEENAVLY

SEQ ID NO: 254215 - protein, 9 aa, Homo Sapiens
SSCSKSLHI

SEQ ID NO: 254216 - protein, 9 aa, Homo Sapiens
PPANSLDIA

SEQ ID NO: 254217 - protein, 9 aa, Homo Sapiens
WGYHCYEPS

SEQ ID NO: 254218 - protein, 9 aa, Homo Sapiens
VPQEELDLF

SEQ ID NO: 254219 - protein, 9 aa, Homo Sapiens
LLMEYSHQE

SEQ ID NO: 254220 - protein, 9 aa, Homo Sapiens
ISQLQNKFY

SEQ ID NO: 254221 - protein, 9 aa, Homo Sapiens
IETDERDLT

SEQ ID NO: 254222 - protein, 9 aa, Homo Sapiens
AARQLEIKH

SEQ ID NO: 254223 - protein, 9 aa, Homo Sapiens
TDEDINGIL

SEQ ID NO: 254224 - protein, 9 aa, Homo Sapiens
AENEEDKNV

SEQ ID NO: 254225 - protein, 9 aa, Homo Sapiens
NVNGQTIYL

SEQ ID NO: 254226 - protein, 9 aa, Homo Sapiens
VSIENINLD

SEQ ID NO: 254227 - protein, 9 aa, Homo Sapiens
ALPDNEFKK

SEQ ID NO: 254228 - protein, 9 aa, Homo Sapiens
DHYGAPNLS

SEQ ID NO: 254229 - protein, 9 aa, Homo Sapiens
LATKAMLNK

SEQ ID NO: 254230 - protein, 9 aa, Homo Sapiens
VYQNIKYRE

SEQ ID NO: 254231 - protein, 9 aa, Homo Sapiens
STSSQLMMD

SEQ ID NO: 254232 - protein, 9 aa, Homo Sapiens
SKVSLQDKN

SEQ ID NO: 254233 - protein, 9 aa, Homo Sapiens
KINENIYQI

SEQ ID NO: 254234 - protein, 9 aa, Homo Sapiens
LNCAIRLKT

SEQ ID NO: 254235 - protein, 9 aa, Homo Sapiens
QVKRVKETE

SEQ ID NO: 254236 - protein, 9 aa, Homo Sapiens
KLQAHIGLV

SEQ ID NO: 254237 - protein, 9 aa, Homo Sapiens
SIPCLSPNC

SEQ ID NO: 254238 - protein, 9 aa, Homo Sapiens
PGEKMVLNF

SEQ ID NO: 254239 - protein, 9 aa, Homo Sapiens
DLTKENKDL

SEQ ID NO: 254240 - protein, 9 aa, Homo Sapiens
PANCTHNLY

SEQ ID NO: 254241 - protein, 9 aa, Homo Sapiens
VDKDNGEPG

SEQ ID NO: 254242 - protein, 9 aa, Homo Sapiens
NTDRPSRMM

SEQ ID NO: 254243 - protein, 9 aa, Homo Sapiens
FLFTDNCSF

SEQ ID NO: 254244 - protein, 9 aa, Homo Sapiens
LVSLSPMGR

SEQ ID NO: 254245 - protein, 9 aa, Homo Sapiens
FKHEQIYTY

SEQ ID NO: 254246 - protein, 9 aa, Homo Sapiens
ILENQRKFL

SEQ ID NO: 254247 - protein, 9 aa, Homo Sapiens
SISTFQQAL

SEQ ID NO: 254248 - protein, 9 aa, Homo Sapiens
YTHDVVMND

SEQ ID NO: 254249 - protein, 9 aa, Homo Sapiens
AGELFMEIR

SEQ ID NO: 254250 - protein, 9 aa, Homo Sapiens
SAHNLNEDV

SEQ ID NO: 254251 - protein, 9 aa, Homo Sapiens
FYCDFMLFM

SEQ ID NO: 254252 - protein, 9 aa, Homo Sapiens
DKGRIHLMN

SEQ ID NO: 254253 - protein, 9 aa, Homo Sapiens
DPTLVDKMQ

SEQ ID NO: 254254 - protein, 9 aa, Homo Sapiens
EWTPTLQYY

SEQ ID NO: 254255 - protein, 9 aa, Homo Sapiens
EMIGGLWNN

SEQ ID NO: 254256 - protein, 9 aa, Homo Sapiens
QENGLEDPS

SEQ ID NO: 254257 - protein, 9 aa, Homo Sapiens
RRLIGLDAG

SEQ ID NO: 254258 - protein, 9 aa, Homo Sapiens
LIDMLVYFN

SEQ ID NO: 254259 - protein, 9 aa, Homo Sapiens
SSWTLCGSS

SEQ ID NO: 254260 - protein, 9 aa, Homo Sapiens
LPWTEPECY

SEQ ID NO: 254261 - protein, 9 aa, Homo Sapiens
TVYDVDNKT

SEQ ID NO: 254262 - protein, 9 aa, Homo Sapiens
YFCAADKYW

SEQ ID NO: 254263 - protein, 9 aa, Homo Sapiens
IEWAKDKSS

SEQ ID NO: 254264 - protein, 9 aa, Homo Sapiens
EAAKGKPEL

SEQ ID NO: 254265 - protein, 9 aa, Homo Sapiens
SKTKKLVYL

SEQ ID NO: 254266 - protein, 9 aa, Homo Sapiens
RFKKVSYFV

SEQ ID NO: 254267 - protein, 9 aa, Homo Sapiens
ELSRDKKKG

SEQ ID NO: 254268 - protein, 9 aa, Homo Sapiens
FELSQTRYF

SEQ ID NO: 254269 - protein, 9 aa, Homo Sapiens
GAMGFMLMY

SEQ ID NO: 254270 - protein, 9 aa, Homo Sapiens
KGKVDKQYK

SEQ ID NO: 254271 - protein, 9 aa, Homo Sapiens
IPPDVIAKH

SEQ ID NO: 254272 - protein, 9 aa, Homo Sapiens
GRSRKGRGW

SEQ ID NO: 254273 - protein, 9 aa, Homo Sapiens
GLLGGQTSK

SEQ ID NO: 254274 - protein, 9 aa, Homo Sapiens
RGRTPGSSA

SEQ ID NO: 254275 - protein, 9 aa, Homo Sapiens
VAPQQDFAK

SEQ ID NO: 254276 - protein, 9 aa, Homo Sapiens
SSGGGLRLP

SEQ ID NO: 254277 - protein, 9 aa, Homo Sapiens
YYRGAMGFM

SEQ ID NO: 254278 - protein, 9 aa, Homo Sapiens
AVQKTSNLI

SEQ ID NO: 254279 - protein, 9 aa, Homo Sapiens
KNVDEAIHF

SEQ ID NO: 254280 - protein, 9 aa, Homo Sapiens
QEYLIKKIN

SEQ ID NO: 254281 - protein, 9 aa, Homo Sapiens
TVEPKEPAP

SEQ ID NO: 254282 - protein, 9 aa, Homo Sapiens
LKESISYIL

SEQ ID NO: 254283 - protein, 9 aa, Homo Sapiens
VLFSLDVNN

SEQ ID NO: 254284 - protein, 9 aa, Homo Sapiens
VRELVNLIP

SEQ ID NO: 254285 - protein, 9 aa, Homo Sapiens
LKKCHAPET

SEQ ID NO: 254286 - protein, 9 aa, Homo Sapiens
KSVISDKTA

SEQ ID NO: 254287 - protein, 9 aa, Homo Sapiens
SQEWHWMDP

SEQ ID NO: 254288 - protein, 9 aa, Homo Sapiens
ISVYIGHTI

SEQ ID NO: 254289 - protein, 9 aa, Homo Sapiens
GILTYRGVK

SEQ ID NO: 254290 - protein, 9 aa, Homo Sapiens
SDILCLEYS

SEQ ID NO: 254291 - protein, 9 aa, Homo Sapiens
GMGYHVSQQ

SEQ ID NO: 254292 - protein, 9 aa, Homo Sapiens
DPKKNRHWH

SEQ ID NO: 254293 - protein, 9 aa, Homo Sapiens
VAMQCLETV

SEQ ID NO: 254294 - protein, 9 aa, Homo Sapiens
QKEMQKTMT

SEQ ID NO: 254295 - protein, 9 aa, Homo Sapiens
IGTNHTHVL

SEQ ID NO: 254296 - protein, 9 aa, Homo Sapiens
KKAKALMGH

SEQ ID NO: 254297 - protein, 9 aa, Homo Sapiens
NNKFAPFID

SEQ ID NO: 254298 - protein, 9 aa, Homo Sapiens
NSRGQTQSG

SEQ ID NO: 254299 - protein, 9 aa, Homo Sapiens
KKVDFTEYR

SEQ ID NO: 254300 - protein, 9 aa, Homo Sapiens
FPWHSRNKN

SEQ ID NO: 254301 - protein, 9 aa, Homo Sapiens
EYTTELKLS

SEQ ID NO: 254302 - protein, 9 aa, Homo Sapiens
LNNKFAPFI

SEQ ID NO: 254303 - protein, 9 aa, Homo Sapiens
ADHYLTDAW

SEQ ID NO: 254304 - protein, 9 aa, Homo Sapiens
DIEQMYGRK

SEQ ID NO: 254305 - protein, 9 aa, Homo Sapiens
INVRWFPFD

SEQ ID NO: 254306 - protein, 9 aa, Homo Sapiens
KEKILSEVT

SEQ ID NO: 254307 - protein, 9 aa, Homo Sapiens
EERLRRRKV

SEQ ID NO: 254308 - protein, 9 aa, Homo Sapiens
DREYMGSKM

SEQ ID NO: 254309 - protein, 9 aa, Homo Sapiens
LGMRVNTVY

SEQ ID NO: 254310 - protein, 9 aa, Homo Sapiens
DEDCKLNNG

SEQ ID NO: 254311 - protein, 9 aa, Homo Sapiens
VGLEDGTLI

SEQ ID NO: 254312 - protein, 9 aa, Homo Sapiens
TSGNNFFKQ

SEQ ID NO: 254313 - protein, 9 aa, Homo Sapiens
LDEEVEQFM

SEQ ID NO: 254314 - protein, 9 aa, Homo Sapiens
QPMLVQALQ

SEQ ID NO: 254315 - protein, 9 aa, Homo Sapiens
DSSSDTYEE

SEQ ID NO: 254316 - protein, 9 aa, Homo Sapiens
IEEACKIYA

SEQ ID NO: 254317 - protein, 9 aa, Homo Sapiens
HHVEQMAIN

SEQ ID NO: 254318 - protein, 9 aa, Homo Sapiens
CCDGTDKYN

SEQ ID NO: 254319 - protein, 9 aa, Homo Sapiens
PPCPVSFLA

SEQ ID NO: 254320 - protein, 9 aa, Homo Sapiens
SKTLDLIDV

SEQ ID NO: 254321 - protein, 9 aa, Homo Sapiens
VNLELQDLL

SEQ ID NO: 254322 - protein, 9 aa, Homo Sapiens
QYSDIVIVE

SEQ ID NO: 254323 - protein, 9 aa, Homo Sapiens
LSENKEGKR

SEQ ID NO: 254324 - protein, 9 aa, Homo Sapiens
KMLPVNLGQ

SEQ ID NO: 254325 - protein, 9 aa, Homo Sapiens
SLNSTLQGT

SEQ ID NO: 254326 - protein, 9 aa, Homo Sapiens
YIYIGSEAE

SEQ ID NO: 254327 - protein, 9 aa, Homo Sapiens
TMPREGHPM

SEQ ID NO: 254328 - protein, 9 aa, Homo Sapiens
QNKEDTTSM

SEQ ID NO: 254329 - protein, 9 aa, Homo Sapiens
RVKVQYLVL

SEQ ID NO: 254330 - protein, 9 aa, Homo Sapiens
LHFNVLVLP

SEQ ID NO: 254331 - protein, 9 aa, Homo Sapiens
QERAGRKEA

SEQ ID NO: 254332 - protein, 9 aa, Homo Sapiens
DCEKIFNHR

SEQ ID NO: 254333 - protein, 9 aa, Homo Sapiens
GREKQDLTT

SEQ ID NO: 254334 - protein, 9 aa, Homo Sapiens
PHLVNDPAT

SEQ ID NO: 254335 - protein, 9 aa, Homo Sapiens
ESMVRVEAK

SEQ ID NO: 254336 - protein, 9 aa, Homo Sapiens
SVSGALLGR

SEQ ID NO: 254337 - protein, 9 aa, Homo Sapiens
QWNDDRCKM

SEQ ID NO: 254338 - protein, 9 aa, Homo Sapiens
RLECQQKKK

SEQ ID NO: 254339 - protein, 9 aa, Homo Sapiens
SNEAEDSEA

SEQ ID NO: 254340 - protein, 9 aa, Homo Sapiens
EEMVEAKVG

SEQ ID NO: 254341 - protein, 9 aa, Homo Sapiens
TCNSFLTLK

SEQ ID NO: 254342 - protein, 9 aa, Homo Sapiens
RNVEDNDYL

SEQ ID NO: 254343 - protein, 9 aa, Homo Sapiens
ATYALCILS

SEQ ID NO: 254344 - protein, 9 aa, Homo Sapiens
KNITTFDRP

SEQ ID NO: 254345 - protein, 9 aa, Homo Sapiens
GATPRTRGV

SEQ ID NO: 254346 - protein, 9 aa, Homo Sapiens
PLALPVCPD

SEQ ID NO: 254347 - protein, 9 aa, Homo Sapiens
GEVVLALEH

SEQ ID NO: 254348 - protein, 9 aa, Homo Sapiens
GAESGYTTP

SEQ ID NO: 254349 - protein, 9 aa, Homo Sapiens
SITASLGTD

SEQ ID NO: 254350 - protein, 9 aa, Homo Sapiens
RHPLYLTGL

SEQ ID NO: 254351 - protein, 9 aa, Homo Sapiens
IQSLLRANQ

SEQ ID NO: 254352 - protein, 9 aa, Homo Sapiens
SDGYPDVAR

SEQ ID NO: 254353 - protein, 9 aa, Homo Sapiens
EYSFGRSNI

SEQ ID NO: 254354 - protein, 9 aa, Homo Sapiens
RSRVPVIRY

SEQ ID NO: 254355 - protein, 9 aa, Homo Sapiens
QEEEIQARE

SEQ ID NO: 254356 - protein, 9 aa, Homo Sapiens
AEVERVKTM

SEQ ID NO: 254357 - protein, 9 aa, Homo Sapiens
RLTFQNPPI

SEQ ID NO: 254358 - protein, 9 aa, Homo Sapiens
SQHLDNLSN

SEQ ID NO: 254359 - protein, 9 aa, Homo Sapiens
TYTGHKNEQ

SEQ ID NO: 254360 - protein, 9 aa, Homo Sapiens
LLSPQNGTI

SEQ ID NO: 254361 - protein, 9 aa, Homo Sapiens
LCVALPMSL

SEQ ID NO: 254362 - protein, 9 aa, Homo Sapiens
IRHDTFSDS

SEQ ID NO: 254363 - protein, 9 aa, Homo Sapiens
RRPPVCPMS

SEQ ID NO: 254364 - protein, 9 aa, Homo Sapiens
EKPVRMNMI

SEQ ID NO: 254365 - protein, 9 aa, Homo Sapiens
SRPYHIYPF

SEQ ID NO: 254366 - protein, 9 aa, Homo Sapiens
QEPSYVSQT

SEQ ID NO: 254367 - protein, 9 aa, Homo Sapiens
PTLKNAIII

SEQ ID NO: 254368 - protein, 9 aa, Homo Sapiens
NFNQTLTSN

SEQ ID NO: 254369 - protein, 9 aa, Homo Sapiens
CAPPPTPAR

SEQ ID NO: 254370 - protein, 9 aa, Homo Sapiens
KQSLANIDE

SEQ ID NO: 254371 - protein, 9 aa, Homo Sapiens
TYLMFWFGV

SEQ ID NO: 254372 - protein, 9 aa, Homo Sapiens
DPNAEAGLA

SEQ ID NO: 254373 - protein, 9 aa, Homo Sapiens
KALEGLIAV

SEQ ID NO: 254374 - protein, 9 aa, Homo Sapiens
EITDEDING

SEQ ID NO: 254375 - protein, 9 aa, Homo Sapiens
DNCSFNTYV

SEQ ID NO: 254376 - protein, 9 aa, Homo Sapiens
VITIYNQEI

SEQ ID NO: 254377 - protein, 9 aa, Homo Sapiens
CVLLHGSSS

SEQ ID NO: 254378 - protein, 9 aa, Homo Sapiens
NIDVKGSEN

SEQ ID NO: 254379 - protein, 9 aa, Homo Sapiens
STSSTVQTE

SEQ ID NO: 254380 - protein, 9 aa, Homo Sapiens
SGPDLTTVY

SEQ ID NO: 254381 - protein, 9 aa, Homo Sapiens
VTENYHTLY

SEQ ID NO: 254382 - protein, 9 aa, Homo Sapiens
RHRFSGRPK

SEQ ID NO: 254383 - protein, 9 aa, Homo Sapiens
QEGIINIQK

SEQ ID NO: 254384 - protein, 9 aa, Homo Sapiens
HHIRVHSAN

SEQ ID NO: 254385 - protein, 9 aa, Homo Sapiens
KTSLKIWSV

SEQ ID NO: 254386 - protein, 9 aa, Homo Sapiens
GLHSRETPH

SEQ ID NO: 254387 - protein, 9 aa, Homo Sapiens
TRLPVTKIN

SEQ ID NO: 254388 - protein, 9 aa, Homo Sapiens
GNKEDVTGQ

SEQ ID NO: 254389 - protein, 9 aa, Homo Sapiens
YAFELFDTD

SEQ ID NO: 254390 - protein, 9 aa, Homo Sapiens
SKDLSTLTA

SEQ ID NO: 254391 - protein, 9 aa, Homo Sapiens
AVDMNELYH

SEQ ID NO: 254392 - protein, 9 aa, Homo Sapiens
NPYGPQTPS

SEQ ID NO: 254393 - protein, 9 aa, Homo Sapiens
RRHRSEPSN

SEQ ID NO: 254394 - protein, 9 aa, Homo Sapiens
IADGAPELK

SEQ ID NO: 254395 - protein, 9 aa, Homo Sapiens
EEDDSSEND

SEQ ID NO: 254396 - protein, 9 aa, Homo Sapiens
LAAQVQRRR

SEQ ID NO: 254397 - protein, 9 aa, Homo Sapiens
TKHYSLIVV

SEQ ID NO: 254398 - protein, 9 aa, Homo Sapiens
VITLTAIGF

SEQ ID NO: 254399 - protein, 9 aa, Homo Sapiens
GAVSLTTSQ

SEQ ID NO: 254400 - protein, 9 aa, Homo Sapiens
LHRNLMQET

SEQ ID NO: 254401 - protein, 9 aa, Homo Sapiens
PPPTPARCP

SEQ ID NO: 254402 - protein, 9 aa, Homo Sapiens
LVILLSIFE

SEQ ID NO: 254403 - protein, 9 aa, Homo Sapiens
QSSTEQSGE

SEQ ID NO: 254404 - protein, 9 aa, Homo Sapiens
RGNRLKVIF

SEQ ID NO: 254405 - protein, 9 aa, Homo Sapiens
KKGEDPFQT

SEQ ID NO: 254406 - protein, 9 aa, Homo Sapiens
RSLINLHIM

SEQ ID NO: 254407 - protein, 9 aa, Homo Sapiens
ISKRINSSD

SEQ ID NO: 254408 - protein, 9 aa, Homo Sapiens
RLPAKRKAS

SEQ ID NO: 254409 - protein, 9 aa, Homo Sapiens
QVIFAFTLP

SEQ ID NO: 254410 - protein, 9 aa, Homo Sapiens
WVIELGGTS

SEQ ID NO: 254411 - protein, 9 aa, Homo Sapiens
LVGPSTRTP

SEQ ID NO: 254412 - protein, 9 aa, Homo Sapiens
TDYTQCNVN

SEQ ID NO: 254413 - protein, 9 aa, Homo Sapiens
HESLMLFDA

SEQ ID NO: 254414 - protein, 9 aa, Homo Sapiens
MVSSVAEVV

SEQ ID NO: 254415 - protein, 9 aa, Homo Sapiens
VQKVLLYLD

SEQ ID NO: 254416 - protein, 9 aa, Homo Sapiens
KVLNNLKNI

SEQ ID NO: 254417 - protein, 9 aa, Homo Sapiens
WHLQQSSVQ

SEQ ID NO: 254418 - protein, 9 aa, Homo Sapiens
NLLKPNSLY

SEQ ID NO: 254419 - protein, 9 aa, Homo Sapiens
KDVEDIITY

SEQ ID NO: 254420 - protein, 9 aa, Homo Sapiens
EAPGTEEKL

SEQ ID NO: 254421 - protein, 9 aa, Homo Sapiens
EGGATLFTL

SEQ ID NO: 254422 - protein, 9 aa, Homo Sapiens
ELGLVQFKY

SEQ ID NO: 254423 - protein, 9 aa, Homo Sapiens
PPLSGCSTP

SEQ ID NO: 254424 - protein, 9 aa, Homo Sapiens
KASKMTREE

SEQ ID NO: 254425 - protein, 9 aa, Homo Sapiens
MNKDVKGAL

SEQ ID NO: 254426 - protein, 9 aa, Homo Sapiens
EPLENQFKK

SEQ ID NO: 254427 - protein, 9 aa, Homo Sapiens
LSVGGTVLY

SEQ ID NO: 254428 - protein, 9 aa, Homo Sapiens
VTIPKEQYT

SEQ ID NO: 254429 - protein, 9 aa, Homo Sapiens
LPIHLHQIH

SEQ ID NO: 254430 - protein, 9 aa, Homo Sapiens
ENKEGKRSI

SEQ ID NO: 254431 - protein, 9 aa, Homo Sapiens
TYNNELSMF

SEQ ID NO: 254432 - protein, 9 aa, Homo Sapiens
PPDPVQLSE

SEQ ID NO: 254433 - protein, 9 aa, Homo Sapiens
QDLNTTSRQ

SEQ ID NO: 254434 - protein, 9 aa, Homo Sapiens
PAGPRTVLF

SEQ ID NO: 254435 - protein, 9 aa, Homo Sapiens
RVPVIRYKD

SEQ ID NO: 254436 - protein, 9 aa, Homo Sapiens
LFYGTVMCM

SEQ ID NO: 254437 - protein, 9 aa, Homo Sapiens
SGSDGADSP

SEQ ID NO: 254438 - protein, 9 aa, Homo Sapiens
LLNEKPRLS

SEQ ID NO: 254439 - protein, 9 aa, Homo Sapiens
ALPQFYQAS

SEQ ID NO: 254440 - protein, 9 aa, Homo Sapiens
ETETLTQEV

SEQ ID NO: 254441 - protein, 9 aa, Homo Sapiens
AAALFTSEP

SEQ ID NO: 254442 - protein, 9 aa, Homo Sapiens
SLECQMREM

SEQ ID NO: 254443 - protein, 9 aa, Homo Sapiens
LYEANYYEE

SEQ ID NO: 254444 - protein, 9 aa, Homo Sapiens
AKGGDDSKL

SEQ ID NO: 254445 - protein, 9 aa, Homo Sapiens
QAKKLLKNL

SEQ ID NO: 254446 - protein, 9 aa, Homo Sapiens
HKSVQIAYH

SEQ ID NO: 254447 - protein, 9 aa, Homo Sapiens
EGAVGATIG

SEQ ID NO: 254448 - protein, 9 aa, Homo Sapiens
VPELASEIM

SEQ ID NO: 254449 - protein, 9 aa, Homo Sapiens
PISGQLEGI

SEQ ID NO: 254450 - protein, 9 aa, Homo Sapiens
HLKKMAYLA

SEQ ID NO: 254451 - protein, 9 aa, Homo Sapiens
ERKKLLDIL

SEQ ID NO: 254452 - protein, 9 aa, Homo Sapiens
WGLLDQGIP

SEQ ID NO: 254453 - protein, 9 aa, Homo Sapiens
RNTEVKGAL

SEQ ID NO: 254454 - protein, 9 aa, Homo Sapiens
IRQHQELIL

SEQ ID NO: 254455 - protein, 9 aa, Homo Sapiens
GSQLKTKDP

SEQ ID NO: 254456 - protein, 9 aa, Homo Sapiens
VRIVDEVMG

SEQ ID NO: 254457 - protein, 9 aa, Homo Sapiens
KGGDDKYDD

SEQ ID NO: 254458 - protein, 9 aa, Homo Sapiens
RHRREMASP

SEQ ID NO: 254459 - protein, 9 aa, Homo Sapiens
NNFGSSHVM

SEQ ID NO: 254460 - protein, 9 aa, Homo Sapiens
DMERKVEES

SEQ ID NO: 254461 - protein, 9 aa, Homo Sapiens
LFELSQTRY

SEQ ID NO: 254462 - protein, 9 aa, Homo Sapiens
SNIKQNSVP

SEQ ID NO: 254463 - protein, 9 aa, Homo Sapiens
TLEDHIKRK

SEQ ID NO: 254464 - protein, 9 aa, Homo Sapiens
LQILNINTS

SEQ ID NO: 254465 - protein, 9 aa, Homo Sapiens
VQINPTSTQ

SEQ ID NO: 254466 - protein, 9 aa, Homo Sapiens
REEINRVVH

SEQ ID NO: 254467 - protein, 9 aa, Homo Sapiens
PISLIGYWV

SEQ ID NO: 254468 - protein, 9 aa, Homo Sapiens
ESLVINLNR

SEQ ID NO: 254469 - protein, 9 aa, Homo Sapiens
PLLGSYMFR

SEQ ID NO: 254470 - protein, 9 aa, Homo Sapiens
EKNNSCSIC

SEQ ID NO: 254471 - protein, 9 aa, Homo Sapiens
DVALIKLKT

SEQ ID NO: 254472 - protein, 9 aa, Homo Sapiens
GRKHEMLLS

SEQ ID NO: 254473 - protein, 9 aa, Homo Sapiens
WECCEYDQI

SEQ ID NO: 254474 - protein, 9 aa, Homo Sapiens
RNIIDTLMY

SEQ ID NO: 254475 - protein, 9 aa, Homo Sapiens
DNDHENVKY

SEQ ID NO: 254476 - protein, 9 aa, Homo Sapiens
TGWAYEKIE

SEQ ID NO: 254477 - protein, 9 aa, Homo Sapiens
CHIVQELPQ

SEQ ID NO: 254478 - protein, 9 aa, Homo Sapiens
PYTNLYLER

SEQ ID NO: 254479 - protein, 9 aa, Homo Sapiens
IFQYGHLIS

SEQ ID NO: 254480 - protein, 9 aa, Homo Sapiens
EGSQPSHTE

SEQ ID NO: 254481 - protein, 9 aa, Homo Sapiens
TNFLKKHKK

SEQ ID NO: 254482 - protein, 9 aa, Homo Sapiens
LHGNILNGV

SEQ ID NO: 254483 - protein, 9 aa, Homo Sapiens
DEGSGAEVH

SEQ ID NO: 254484 - protein, 9 aa, Homo Sapiens
FLMTKALLV

SEQ ID NO: 254485 - protein, 9 aa, Homo Sapiens
SWGPCSTSC

SEQ ID NO: 254486 - protein, 9 aa, Homo Sapiens
DATNPIYEI

SEQ ID NO: 254487 - protein, 9 aa, Homo Sapiens
LETAHHWIS

SEQ ID NO: 254488 - protein, 9 aa, Homo Sapiens
RECGNYLFR

SEQ ID NO: 254489 - protein, 9 aa, Homo Sapiens
QETWLENKW

SEQ ID NO: 254490 - protein, 9 aa, Homo Sapiens
KTTLFMVLR

SEQ ID NO: 254491 - protein, 9 aa, Homo Sapiens
HLNNSDSIV

SEQ ID NO: 254492 - protein, 9 aa, Homo Sapiens
LAHKGYFCE

SEQ ID NO: 254493 - protein, 9 aa, Homo Sapiens
GKTESTNLI

SEQ ID NO: 254494 - protein, 9 aa, Homo Sapiens
NKNRNRYRY

SEQ ID NO: 254495 - protein, 9 aa, Homo Sapiens
CKHSFAFTP

SEQ ID NO: 254496 - protein, 9 aa, Homo Sapiens
GGSDGTVQT

SEQ ID NO: 254497 - protein, 9 aa, Homo Sapiens
IINVKNDRD

SEQ ID NO: 254498 - protein, 9 aa, Homo Sapiens
TSGKMSLID

SEQ ID NO: 254499 - protein, 9 aa, Homo Sapiens
RQVMMKFND

SEQ ID NO: 254500 - protein, 9 aa, Homo Sapiens
HAGANYLSE

SEQ ID NO: 254501 - protein, 9 aa, Homo Sapiens
LPFTTPELV

SEQ ID NO: 254502 - protein, 9 aa, Homo Sapiens
FCIAGFRRS

SEQ ID NO: 254503 - protein, 9 aa, Homo Sapiens
EITVSLSQM

SEQ ID NO: 254504 - protein, 9 aa, Homo Sapiens
GLTRHRIIH

SEQ ID NO: 254505 - protein, 9 aa, Homo Sapiens
KMLVGDTPF

SEQ ID NO: 254506 - protein, 9 aa, Homo Sapiens
VFKGFLDCL

SEQ ID NO: 254507 - protein, 9 aa, Homo Sapiens
VEICITSIT

SEQ ID NO: 254508 - protein, 9 aa, Homo Sapiens
WWPNPQAFR

SEQ ID NO: 254509 - protein, 9 aa, Homo Sapiens
FTTPALISW

SEQ ID NO: 254510 - protein, 9 aa, Homo Sapiens
QPDVYAFGI

SEQ ID NO: 254511 - protein, 9 aa, Homo Sapiens
LKVARNCIE

SEQ ID NO: 254512 - protein, 9 aa, Homo Sapiens
STENSENDI

SEQ ID NO: 254513 - protein, 9 aa, Homo Sapiens
KQSGKNRGF

SEQ ID NO: 254514 - protein, 9 aa, Homo Sapiens
AAAADVLGL

SEQ ID NO: 254515 - protein, 9 aa, Homo Sapiens
YLSGDVPVM

SEQ ID NO: 254516 - protein, 9 aa, Homo Sapiens
ILLKEFIKP

SEQ ID NO: 254517 - protein, 9 aa, Homo Sapiens
LTYHNTDLS

SEQ ID NO: 254518 - protein, 9 aa, Homo Sapiens
NLERSATDS

SEQ ID NO: 254519 - protein, 9 aa, Homo Sapiens
HKCMTKELP

SEQ ID NO: 254520 - protein, 9 aa, Homo Sapiens
QNKKSVTEM

SEQ ID NO: 254521 - protein, 9 aa, Homo Sapiens
VTYLNQCLP

SEQ ID NO: 254522 - protein, 9 aa, Homo Sapiens
GQFSFDIAE

SEQ ID NO: 254523 - protein, 9 aa, Homo Sapiens
HAQEQIHRM

SEQ ID NO: 254524 - protein, 9 aa, Homo Sapiens
HSVKPTGSI

SEQ ID NO: 254525 - protein, 9 aa, Homo Sapiens
RTWSFLLEE

SEQ ID NO: 254526 - protein, 9 aa, Homo Sapiens
GSEDPPWSR

SEQ ID NO: 254527 - protein, 9 aa, Homo Sapiens
SSDLTKVVV

SEQ ID NO: 254528 - protein, 9 aa, Homo Sapiens
KAEHWYMES

SEQ ID NO: 254529 - protein, 9 aa, Homo Sapiens
LHCQLGDRL

SEQ ID NO: 254530 - protein, 9 aa, Homo Sapiens
GSGMPELQY

SEQ ID NO: 254531 - protein, 9 aa, Homo Sapiens
RHGKTFTFR

SEQ ID NO: 254532 - protein, 9 aa, Homo Sapiens
EFSSERGPQ

SEQ ID NO: 254533 - protein, 9 aa, Homo Sapiens
RRGYSFLIL

SEQ ID NO: 254534 - protein, 9 aa, Homo Sapiens
CNFGSNCRF

SEQ ID NO: 254535 - protein, 9 aa, Homo Sapiens
EKRMQQHKL

SEQ ID NO: 254536 - protein, 9 aa, Homo Sapiens
ANRLWDNMR

SEQ ID NO: 254537 - protein, 9 aa, Homo Sapiens
MNLLAMSLQ

SEQ ID NO: 254538 - protein, 9 aa, Homo Sapiens
AWALTHIAS

SEQ ID NO: 254539 - protein, 9 aa, Homo Sapiens
QNSVPNKDL

SEQ ID NO: 254540 - protein, 9 aa, Homo Sapiens
CQGINSCLI

SEQ ID NO: 254541 - protein, 9 aa, Homo Sapiens
YDIEARDTL

SEQ ID NO: 254542 - protein, 9 aa, Homo Sapiens
DMVPYLPEL

SEQ ID NO: 254543 - protein, 9 aa, Homo Sapiens
EYISEELDA

SEQ ID NO: 254544 - protein, 9 aa, Homo Sapiens
PNDPLPRIC

SEQ ID NO: 254545 - protein, 9 aa, Homo Sapiens
HSQKFSKCS

SEQ ID NO: 254546 - protein, 9 aa, Homo Sapiens
FNPLRFTRE

SEQ ID NO: 254547 - protein, 9 aa, Homo Sapiens
NKHVSVPDQ

SEQ ID NO: 254548 - protein, 9 aa, Homo Sapiens
TSQPLERKD

SEQ ID NO: 254549 - protein, 9 aa, Homo Sapiens
GQPLDILTY

SEQ ID NO: 254550 - protein, 9 aa, Homo Sapiens
VNNLPLHEL

SEQ ID NO: 254551 - protein, 9 aa, Homo Sapiens
NWNYHFVNL

SEQ ID NO: 254552 - protein, 9 aa, Homo Sapiens
RIMPVRNVS

SEQ ID NO: 254553 - protein, 9 aa, Homo Sapiens
GVVLLTCRD

SEQ ID NO: 254554 - protein, 9 aa, Homo Sapiens
AFECGTYAE

SEQ ID NO: 254555 - protein, 9 aa, Homo Sapiens
IQVLFIQKT

SEQ ID NO: 254556 - protein, 9 aa, Homo Sapiens
NKDIESTKG

SEQ ID NO: 254557 - protein, 9 aa, Homo Sapiens
RKRKKHRKH

SEQ ID NO: 254558 - protein, 9 aa, Homo Sapiens
STRIWMCNT

SEQ ID NO: 254559 - protein, 9 aa, Homo Sapiens
SLALLCELM

SEQ ID NO: 254560 - protein, 9 aa, Homo Sapiens
SRGVPRGVH

SEQ ID NO: 254561 - protein, 9 aa, Homo Sapiens
DYPVKTPIK

SEQ ID NO: 254562 - protein, 9 aa, Homo Sapiens
GMQGRLCNK

SEQ ID NO: 254563 - protein, 9 aa, Homo Sapiens
GTLTQNRIT

SEQ ID NO: 254564 - protein, 9 aa, Homo Sapiens
NETSIIIRN

SEQ ID NO: 254565 - protein, 9 aa, Homo Sapiens
VRELSPVSF

SEQ ID NO: 254566 - protein, 9 aa, Homo Sapiens
LTTLLNRNR

SEQ ID NO: 254567 - protein, 9 aa, Homo Sapiens
NTEMRTSCL

SEQ ID NO: 254568 - protein, 9 aa, Homo Sapiens
SAGKEYILP

SEQ ID NO: 254569 - protein, 9 aa, Homo Sapiens
IWKPYKKHR

SEQ ID NO: 254570 - protein, 9 aa, Homo Sapiens
SSIMPNMLG

SEQ ID NO: 254571 - protein, 9 aa, Homo Sapiens
PHSKKANLG

SEQ ID NO: 254572 - protein, 9 aa, Homo Sapiens
CCHQHPQTR

SEQ ID NO: 254573 - protein, 9 aa, Homo Sapiens
ELDKVLEDV

SEQ ID NO: 254574 - protein, 9 aa, Homo Sapiens
DLIEVSRPG

SEQ ID NO: 254575 - protein, 9 aa, Homo Sapiens
DDIQQLLNK

SEQ ID NO: 254576 - protein, 9 aa, Homo Sapiens
PILENALIG

SEQ ID NO: 254577 - protein, 9 aa, Homo Sapiens
NKYKQNTQG

SEQ ID NO: 254578 - protein, 9 aa, Homo Sapiens
ADARAVMLQ

SEQ ID NO: 254579 - protein, 9 aa, Homo Sapiens
KTSNADIKS

SEQ ID NO: 254580 - protein, 9 aa, Homo Sapiens
QPIAGMGYH

SEQ ID NO: 254581 - protein, 9 aa, Homo Sapiens
LEDYRKRKY

SEQ ID NO: 254582 - protein, 9 aa, Homo Sapiens
LDLPGHLPG

SEQ ID NO: 254583 - protein, 9 aa, Homo Sapiens
RNFHGCLEH

SEQ ID NO: 254584 - protein, 9 aa, Homo Sapiens
GSDLELKKS

SEQ ID NO: 254585 - protein, 9 aa, Homo Sapiens
TAAGALRNF

SEQ ID NO: 254586 - protein, 9 aa, Homo Sapiens
GMKYRDLGK

SEQ ID NO: 254587 - protein, 9 aa, Homo Sapiens
LMETNTEPF

SEQ ID NO: 254588 - protein, 9 aa, Homo Sapiens
ISHANEKTL

SEQ ID NO: 254589 - protein, 9 aa, Homo Sapiens
DSYLLRDSE

SEQ ID NO: 254590 - protein, 9 aa, Homo Sapiens
KKGEAIGFH

SEQ ID NO: 254591 - protein, 9 aa, Homo Sapiens
LHHFRPNCL

SEQ ID NO: 254592 - protein, 9 aa, Homo Sapiens
GTKTQMDDK

SEQ ID NO: 254593 - protein, 9 aa, Homo Sapiens
IEIFFQAEL

SEQ ID NO: 254594 - protein, 9 aa, Homo Sapiens
EEKGKVDKQ

SEQ ID NO: 254595 - protein, 9 aa, Homo Sapiens
CGKTFRLNY

SEQ ID NO: 254596 - protein, 9 aa, Homo Sapiens
PCEGRLELK

SEQ ID NO: 254597 - protein, 9 aa, Homo Sapiens
CLECEKTYS

SEQ ID NO: 254598 - protein, 9 aa, Homo Sapiens
CITSITTAI

SEQ ID NO: 254599 - protein, 9 aa, Homo Sapiens
HLTCGCQIT

SEQ ID NO: 254600 - protein, 9 aa, Homo Sapiens
ESTANNKSK

SEQ ID NO: 254601 - protein, 9 aa, Homo Sapiens
SLMEKVRGL

SEQ ID NO: 254602 - protein, 9 aa, Homo Sapiens
VMDEANLEL

SEQ ID NO: 254603 - protein, 9 aa, Homo Sapiens
SAFECGTYA

SEQ ID NO: 254604 - protein, 9 aa, Homo Sapiens
LKKVGDWIM

SEQ ID NO: 254605 - protein, 9 aa, Homo Sapiens
KMLANIFNT

SEQ ID NO: 254606 - protein, 9 aa, Homo Sapiens
FWRMVWEQN

SEQ ID NO: 254607 - protein, 9 aa, Homo Sapiens
CDNIIVSSK

SEQ ID NO: 254608 - protein, 9 aa, Homo Sapiens
LNFRVKFVV

SEQ ID NO: 254609 - protein, 9 aa, Homo Sapiens
NYPSFATPE

SEQ ID NO: 254610 - protein, 9 aa, Homo Sapiens
LERKLKKAK

SEQ ID NO: 254611 - protein, 9 aa, Homo Sapiens
AGKNAEDVH

SEQ ID NO: 254612 - protein, 9 aa, Homo Sapiens
MLFFVLYGG

SEQ ID NO: 254613 - protein, 9 aa, Homo Sapiens
LEVLMHVST

SEQ ID NO: 254614 - protein, 9 aa, Homo Sapiens
MLQIDVKGI

SEQ ID NO: 254615 - protein, 9 aa, Homo Sapiens
PWGGGLKRA

SEQ ID NO: 254616 - protein, 9 aa, Homo Sapiens
ASVTDSSWS

SEQ ID NO: 254617 - protein, 9 aa, Homo Sapiens
LALLITYLN

SEQ ID NO: 254618 - protein, 9 aa, Homo Sapiens
IPGLKAAMP

SEQ ID NO: 254619 - protein, 9 aa, Homo Sapiens
IKEDIEARK

SEQ ID NO: 254620 - protein, 9 aa, Homo Sapiens
NVVKSHKQV

SEQ ID NO: 254621 - protein, 9 aa, Homo Sapiens
LDCLLKLGD

SEQ ID NO: 254622 - protein, 9 aa, Homo Sapiens
SQYSDIVIV

SEQ ID NO: 254623 - protein, 9 aa, Homo Sapiens
ANIFNTDKA

SEQ ID NO: 254624 - protein, 9 aa, Homo Sapiens
QSEGNGGYF

SEQ ID NO: 254625 - protein, 9 aa, Homo Sapiens
LLFCTQCGP

SEQ ID NO: 254626 - protein, 9 aa, Homo Sapiens
EDICLQLSC

SEQ ID NO: 254627 - protein, 9 aa, Homo Sapiens
DLLQSPSSA

SEQ ID NO: 254628 - protein, 9 aa, Homo Sapiens
EARWAVGGV

SEQ ID NO: 254629 - protein, 9 aa, Homo Sapiens
YIAQRKWEK

SEQ ID NO: 254630 - protein, 9 aa, Homo Sapiens
EFLGICHSK

SEQ ID NO: 254631 - protein, 9 aa, Homo Sapiens
NIVYVTGRL

SEQ ID NO: 254632 - protein, 9 aa, Homo Sapiens
LEKVYCVVL

SEQ ID NO: 254633 - protein, 9 aa, Homo Sapiens
NYQLIYHQT

SEQ ID NO: 254634 - protein, 9 aa, Homo Sapiens
GQETTDPSD

SEQ ID NO: 254635 - protein, 9 aa, Homo Sapiens
DYIECAKKL

SEQ ID NO: 254636 - protein, 9 aa, Homo Sapiens
TENEASQYG

SEQ ID NO: 254637 - protein, 9 aa, Homo Sapiens
ESLTATTKS

SEQ ID NO: 254638 - protein, 9 aa, Homo Sapiens
LLTSNMFCA

SEQ ID NO: 254639 - protein, 9 aa, Homo Sapiens
LSCSFPDFF

SEQ ID NO: 254640 - protein, 9 aa, Homo Sapiens
QVLEYLNDL

SEQ ID NO: 254641 - protein, 9 aa, Homo Sapiens
TNIEYGAVE

SEQ ID NO: 254642 - protein, 9 aa, Homo Sapiens
QKTMTSLKR

SEQ ID NO: 254643 - protein, 9 aa, Homo Sapiens
DLWEIEEKY

SEQ ID NO: 254644 - protein, 9 aa, Homo Sapiens
IARFLGSME

SEQ ID NO: 254645 - protein, 9 aa, Homo Sapiens
HLVGKWNGL

SEQ ID NO: 254646 - protein, 9 aa, Homo Sapiens
DCPDPQAYA

SEQ ID NO: 254647 - protein, 9 aa, Homo Sapiens
AMNVNKIFM

SEQ ID NO: 254648 - protein, 9 aa, Homo Sapiens
YRTGNKSHL

SEQ ID NO: 254649 - protein, 9 aa, Homo Sapiens
VIKQLRHPK

SEQ ID NO: 254650 - protein, 9 aa, Homo Sapiens
NAYTIPLDF

SEQ ID NO: 254651 - protein, 9 aa, Homo Sapiens
IAWQGDYGK

SEQ ID NO: 254652 - protein, 9 aa, Homo Sapiens
LHRVFVQEE

SEQ ID NO: 254653 - protein, 9 aa, Homo Sapiens
VESSTNVDM

SEQ ID NO: 254654 - protein, 9 aa, Homo Sapiens
FLISPLPPL

SEQ ID NO: 254655 - protein, 9 aa, Homo Sapiens
CLFCVEQRE

SEQ ID NO: 254656 - protein, 9 aa, Homo Sapiens
QQNIQSQQE

SEQ ID NO: 254657 - protein, 9 aa, Homo Sapiens
LVYMPTHLA

SEQ ID NO: 254658 - protein, 9 aa, Homo Sapiens
SWVTVLQLM

SEQ ID NO: 254659 - protein, 9 aa, Homo Sapiens
FELSDMFYF

SEQ ID NO: 254660 - protein, 9 aa, Homo Sapiens
TNSVGKDRS

SEQ ID NO: 254661 - protein, 9 aa, Homo Sapiens
HILLFIRRM

SEQ ID NO: 254662 - protein, 9 aa, Homo Sapiens
DKTIIVKNE

SEQ ID NO: 254663 - protein, 9 aa, Homo Sapiens
VNCVIFQDH

SEQ ID NO: 254664 - protein, 9 aa, Homo Sapiens
EVCVVYENY

SEQ ID NO: 254665 - protein, 9 aa, Homo Sapiens
QYDTESTVP

SEQ ID NO: 254666 - protein, 9 aa, Homo Sapiens
LKRWLGTCA

SEQ ID NO: 254667 - protein, 9 aa, Homo Sapiens
AGMDEMVAP

SEQ ID NO: 254668 - protein, 9 aa, Homo Sapiens
LSSVRKSQG

SEQ ID NO: 254669 - protein, 9 aa, Homo Sapiens
IKVLWKNNH

SEQ ID NO: 254670 - protein, 9 aa, Homo Sapiens
RPRCITKLA

SEQ ID NO: 254671 - protein, 9 aa, Homo Sapiens
TKKLVYLPG

SEQ ID NO: 254672 - protein, 9 aa, Homo Sapiens
YLRQIKMEL

SEQ ID NO: 254673 - protein, 9 aa, Homo Sapiens
DPKPHVSGR

SEQ ID NO: 254674 - protein, 9 aa, Homo Sapiens
PKYIFSLEE

SEQ ID NO: 254675 - protein, 9 aa, Homo Sapiens
DIEARDTLV

SEQ ID NO: 254676 - protein, 9 aa, Homo Sapiens
LIDRGRTPG

SEQ ID NO: 254677 - protein, 9 aa, Homo Sapiens
PATDGMAVW

SEQ ID NO: 254678 - protein, 9 aa, Homo Sapiens
DGDKLGTGE

SEQ ID NO: 254679 - protein, 9 aa, Homo Sapiens
AQVFLNKNI

SEQ ID NO: 254680 - protein, 9 aa, Homo Sapiens
LCPHSTHRY

SEQ ID NO: 254681 - protein, 9 aa, Homo Sapiens
SPTVLKEKG

SEQ ID NO: 254682 - protein, 9 aa, Homo Sapiens
ELNTQKVTF

SEQ ID NO: 254683 - protein, 9 aa, Homo Sapiens
IQERELCRQ

SEQ ID NO: 254684 - protein, 9 aa, Homo Sapiens
KYLTEEAEN

SEQ ID NO: 254685 - protein, 9 aa, Homo Sapiens
IGIFSVITN

SEQ ID NO: 254686 - protein, 9 aa, Homo Sapiens
KPPFQFGQP

SEQ ID NO: 254687 - protein, 9 aa, Homo Sapiens
FQNLHIDDQ

SEQ ID NO: 254688 - protein, 9 aa, Homo Sapiens
SQLDTRLPV

SEQ ID NO: 254689 - protein, 9 aa, Homo Sapiens
ALNSIFDSF

SEQ ID NO: 254690 - protein, 9 aa, Homo Sapiens
TKYPKIVHF

SEQ ID NO: 254691 - protein, 9 aa, Homo Sapiens
RIIDQRFKK

SEQ ID NO: 254692 - protein, 9 aa, Homo Sapiens
SSAVPKVVL

SEQ ID NO: 254693 - protein, 9 aa, Homo Sapiens
LKTLIQLTV

SEQ ID NO: 254694 - protein, 9 aa, Homo Sapiens
HPRRLTDTY

SEQ ID NO: 254695 - protein, 9 aa, Homo Sapiens
KVQVWFQKH

SEQ ID NO: 254696 - protein, 9 aa, Homo Sapiens
QSLLEPSVN

SEQ ID NO: 254697 - protein, 9 aa, Homo Sapiens
KIYCQVEAV

SEQ ID NO: 254698 - protein, 9 aa, Homo Sapiens
VLEWGDSEK

SEQ ID NO: 254699 - protein, 9 aa, Homo Sapiens
LGEECPATL

SEQ ID NO: 254700 - protein, 9 aa, Homo Sapiens
KKVNCVIFQ

SEQ ID NO: 254701 - protein, 9 aa, Homo Sapiens
SDSKGAADD

SEQ ID NO: 254702 - protein, 9 aa, Homo Sapiens
VEAILNQKI

SEQ ID NO: 254703 - protein, 9 aa, Homo Sapiens
FKESMDANE

SEQ ID NO: 254704 - protein, 9 aa, Homo Sapiens
KNRNRYRYV

SEQ ID NO: 254705 - protein, 9 aa, Homo Sapiens
MDDKTVTST

SEQ ID NO: 254706 - protein, 9 aa, Homo Sapiens
GTDKYNSGV

SEQ ID NO: 254707 - protein, 9 aa, Homo Sapiens
YLLPCSHVP

SEQ ID NO: 254708 - protein, 9 aa, Homo Sapiens
DVEVLEQNF

SEQ ID NO: 254709 - protein, 9 aa, Homo Sapiens
VQWEINIFL

SEQ ID NO: 254710 - protein, 9 aa, Homo Sapiens
KKWIGNMDR

SEQ ID NO: 254711 - protein, 9 aa, Homo Sapiens
VIRTEPGLI

SEQ ID NO: 254712 - protein, 9 aa, Homo Sapiens
VQKKTQVTH

SEQ ID NO: 254713 - protein, 9 aa, Homo Sapiens
LETKWELRQ

SEQ ID NO: 254714 - protein, 9 aa, Homo Sapiens
KEGVEREVI

SEQ ID NO: 254715 - protein, 9 aa, Homo Sapiens
NTFENVDEV

SEQ ID NO: 254716 - protein, 9 aa, Homo Sapiens
AILSLNARS

SEQ ID NO: 254717 - protein, 9 aa, Homo Sapiens
MDYEVYKTA

SEQ ID NO: 254718 - protein, 9 aa, Homo Sapiens
KKLSENTDC

SEQ ID NO: 254719 - protein, 9 aa, Homo Sapiens
EKQLRGLQS

SEQ ID NO: 254720 - protein, 9 aa, Homo Sapiens
SALYIIYMP

SEQ ID NO: 254721 - protein, 9 aa, Homo Sapiens
LDGALVMEV

SEQ ID NO: 254722 - protein, 9 aa, Homo Sapiens
KPTPDLEKV

SEQ ID NO: 254723 - protein, 9 aa, Homo Sapiens
EKDKLELFV

SEQ ID NO: 254724 - protein, 9 aa, Homo Sapiens
PQSFFAAAR

SEQ ID NO: 254725 - protein, 9 aa, Homo Sapiens
PLISVKPLY

SEQ ID NO: 254726 - protein, 9 aa, Homo Sapiens
VKLMEQIQN

SEQ ID NO: 254727 - protein, 9 aa, Homo Sapiens
KDNSMTLLH

SEQ ID NO: 254728 - protein, 9 aa, Homo Sapiens
PRPEYNFLL

SEQ ID NO: 254729 - protein, 9 aa, Homo Sapiens
TKNNDLVCK

SEQ ID NO: 254730 - protein, 9 aa, Homo Sapiens
SPTLCPSIK

SEQ ID NO: 254731 - protein, 9 aa, Homo Sapiens
LRVASSYLG

SEQ ID NO: 254732 - protein, 9 aa, Homo Sapiens
DGVYCIPIG

SEQ ID NO: 254733 - protein, 9 aa, Homo Sapiens
EQIADAYSY

SEQ ID NO: 254734 - protein, 9 aa, Homo Sapiens
GSRETYGFG

SEQ ID NO: 254735 - protein, 9 aa, Homo Sapiens
EDSSFVSMY

SEQ ID NO: 254736 - protein, 9 aa, Homo Sapiens
GDPTGAGRG

SEQ ID NO: 254737 - protein, 9 aa, Homo Sapiens
KHEITHTGE

SEQ ID NO: 254738 - protein, 9 aa, Homo Sapiens
NHVFHTSCL

SEQ ID NO: 254739 - protein, 9 aa, Homo Sapiens
YRSFQNENV

SEQ ID NO: 254740 - protein, 9 aa, Homo Sapiens
VKYLYLDNN

SEQ ID NO: 254741 - protein, 9 aa, Homo Sapiens
KPQEAVQGY

SEQ ID NO: 254742 - protein, 9 aa, Homo Sapiens
DKLQPELMI

SEQ ID NO: 254743 - protein, 9 aa, Homo Sapiens
TFQNIVVEI

SEQ ID NO: 254744 - protein, 9 aa, Homo Sapiens
SWDSDTCST

SEQ ID NO: 254745 - protein, 9 aa, Homo Sapiens
VFNPLRFTR

SEQ ID NO: 254746 - protein, 9 aa, Homo Sapiens
KSEDYMYWR

SEQ ID NO: 254747 - protein, 9 aa, Homo Sapiens
QGLNLLHQH

SEQ ID NO: 254748 - protein, 9 aa, Homo Sapiens
QAQLVQFML

SEQ ID NO: 254749 - protein, 9 aa, Homo Sapiens
TWISFEKEY

SEQ ID NO: 254750 - protein, 9 aa, Homo Sapiens
QVQRGPAQK

SEQ ID NO: 254751 - protein, 9 aa, Homo Sapiens
SQMDIIFHS

SEQ ID NO: 254752 - protein, 9 aa, Homo Sapiens
LTQITNTAY

SEQ ID NO: 254753 - protein, 9 aa, Homo Sapiens
GTFLFISVL

SEQ ID NO: 254754 - protein, 9 aa, Homo Sapiens
HCAVIAHSA

SEQ ID NO: 254755 - protein, 9 aa, Homo Sapiens
DRNKRKKYP

SEQ ID NO: 254756 - protein, 9 aa, Homo Sapiens
DEMYKQVRK

SEQ ID NO: 254757 - protein, 9 aa, Homo Sapiens
QPSDLGAMD

SEQ ID NO: 254758 - protein, 9 aa, Homo Sapiens
NIRAKEKRN

SEQ ID NO: 254759 - protein, 9 aa, Homo Sapiens
EVPLCYLLG

SEQ ID NO: 254760 - protein, 9 aa, Homo Sapiens
LSEKQTKWK

SEQ ID NO: 254761 - protein, 9 aa, Homo Sapiens
ITNTAYQCF

SEQ ID NO: 254762 - protein, 9 aa, Homo Sapiens
NNSKGSSDF

SEQ ID NO: 254763 - protein, 9 aa, Homo Sapiens
NCSTPGPGI

SEQ ID NO: 254764 - protein, 9 aa, Homo Sapiens
PKDIRINIV

SEQ ID NO: 254765 - protein, 9 aa, Homo Sapiens
VNVSLVQCN

SEQ ID NO: 254766 - protein, 9 aa, Homo Sapiens
RCHPVERDI

SEQ ID NO: 254767 - protein, 9 aa, Homo Sapiens
TNRRCQTAD

SEQ ID NO: 254768 - protein, 9 aa, Homo Sapiens
LVGNRIDKE

SEQ ID NO: 254769 - protein, 9 aa, Homo Sapiens
EESENQHKE

SEQ ID NO: 254770 - protein, 9 aa, Homo Sapiens
IITFPEFLG

SEQ ID NO: 254771 - protein, 9 aa, Homo Sapiens
IPVVSQPQF

SEQ ID NO: 254772 - protein, 9 aa, Homo Sapiens
QPFELPMTF

SEQ ID NO: 254773 - protein, 9 aa, Homo Sapiens
HPKFQNVAA

SEQ ID NO: 254774 - protein, 9 aa, Homo Sapiens
YVVPILIIV

SEQ ID NO: 254775 - protein, 9 aa, Homo Sapiens
KLLDLPMQA

SEQ ID NO: 254776 - protein, 9 aa, Homo Sapiens
LRRWGCYPG

SEQ ID NO: 254777 - protein, 9 aa, Homo Sapiens
DTFNKTLNI

SEQ ID NO: 254778 - protein, 9 aa, Homo Sapiens
QAVCCENDI

SEQ ID NO: 254779 - protein, 9 aa, Homo Sapiens
ELKISRSLF

SEQ ID NO: 254780 - protein, 9 aa, Homo Sapiens
WVHRFEYKE

SEQ ID NO: 254781 - protein, 9 aa, Homo Sapiens
ALHYAVKQH

SEQ ID NO: 254782 - protein, 9 aa, Homo Sapiens
VMASDADGP

SEQ ID NO: 254783 - protein, 9 aa, Homo Sapiens
REEALAAFE

SEQ ID NO: 254784 - protein, 9 aa, Homo Sapiens
RGIRKEEVD

SEQ ID NO: 254785 - protein, 9 aa, Homo Sapiens
LEREQRRTQ

SEQ ID NO: 254786 - protein, 9 aa, Homo Sapiens
HPEMANKLS

SEQ ID NO: 254787 - protein, 9 aa, Homo Sapiens
SIQAAFSDA

SEQ ID NO: 254788 - protein, 9 aa, Homo Sapiens
ENNFLPFQI

SEQ ID NO: 254789 - protein, 9 aa, Homo Sapiens
RVFVQEELG

SEQ ID NO: 254790 - protein, 9 aa, Homo Sapiens
ISVSELIAE

SEQ ID NO: 254791 - protein, 9 aa, Homo Sapiens
VAPVGDTKW

SEQ ID NO: 254792 - protein, 9 aa, Homo Sapiens
AMIAKDKDT

SEQ ID NO: 254793 - protein, 9 aa, Homo Sapiens
CKLGVPVFY

SEQ ID NO: 254794 - protein, 9 aa, Homo Sapiens
TRQNQLYDT

SEQ ID NO: 254795 - protein, 9 aa, Homo Sapiens
HQNGGCNTS

SEQ ID NO: 254796 - protein, 9 aa, Homo Sapiens
DSTLADSLD

SEQ ID NO: 254797 - protein, 9 aa, Homo Sapiens
YTQPAIENI

SEQ ID NO: 254798 - protein, 9 aa, Homo Sapiens
RRELILHYL

SEQ ID NO: 254799 - protein, 9 aa, Homo Sapiens
DFKPEVKMV

SEQ ID NO: 254800 - protein, 9 aa, Homo Sapiens
EGAKVEEDT

SEQ ID NO: 254801 - protein, 9 aa, Homo Sapiens
EFDPVVVIL

SEQ ID NO: 254802 - protein, 9 aa, Homo Sapiens
REDNLEAVK

SEQ ID NO: 254803 - protein, 9 aa, Homo Sapiens
IHLALYSNP

SEQ ID NO: 254804 - protein, 9 aa, Homo Sapiens
GKSQNYLTS

SEQ ID NO: 254805 - protein, 9 aa, Homo Sapiens
KKPESKINE

SEQ ID NO: 254806 - protein, 9 aa, Homo Sapiens
NPKSRGKSI

SEQ ID NO: 254807 - protein, 9 aa, Homo Sapiens
CSIKEKETE

SEQ ID NO: 254808 - protein, 9 aa, Homo Sapiens
CWYDKSLQF

SEQ ID NO: 254809 - protein, 9 aa, Homo Sapiens
PLQVNGFKY

SEQ ID NO: 254810 - protein, 9 aa, Homo Sapiens
KKVQGIGWH

SEQ ID NO: 254811 - protein, 9 aa, Homo Sapiens
KRIMLRIPN

SEQ ID NO: 254812 - protein, 9 aa, Homo Sapiens
ISPTVLKEK

SEQ ID NO: 254813 - protein, 9 aa, Homo Sapiens
SAMVGGDVG

SEQ ID NO: 254814 - protein, 9 aa, Homo Sapiens
AVRPKPLFH

SEQ ID NO: 254815 - protein, 9 aa, Homo Sapiens
CSSPGSIEI

SEQ ID NO: 254816 - protein, 9 aa, Homo Sapiens
KIDEVYKVI

SEQ ID NO: 254817 - protein, 9 aa, Homo Sapiens
SLLDDLTMD

SEQ ID NO: 254818 - protein, 9 aa, Homo Sapiens
EFDNMKKVW

SEQ ID NO: 254819 - protein, 9 aa, Homo Sapiens
TFSGATMLI

SEQ ID NO: 254820 - protein, 9 aa, Homo Sapiens
GNKKTSIKM

SEQ ID NO: 254821 - protein, 9 aa, Homo Sapiens
VSLSVEIGK

SEQ ID NO: 254822 - protein, 9 aa, Homo Sapiens
PKQSWNPCP

SEQ ID NO: 254823 - protein, 9 aa, Homo Sapiens
GKLIYIVSS

SEQ ID NO: 254824 - protein, 9 aa, Homo Sapiens
SVTEVDALA

SEQ ID NO: 254825 - protein, 9 aa, Homo Sapiens
LLEFPAELY

SEQ ID NO: 254826 - protein, 9 aa, Homo Sapiens
HQLRPNDSH

SEQ ID NO: 254827 - protein, 9 aa, Homo Sapiens
YQYTALTSV

SEQ ID NO: 254828 - protein, 9 aa, Homo Sapiens
MERVANSLV

SEQ ID NO: 254829 - protein, 9 aa, Homo Sapiens
KVSCVLSSD

SEQ ID NO: 254830 - protein, 9 aa, Homo Sapiens
SLLVAAKKK

SEQ ID NO: 254831 - protein, 9 aa, Homo Sapiens
RFQPFRDGS

SEQ ID NO: 254832 - protein, 9 aa, Homo Sapiens
FSLDRTKDD

SEQ ID NO: 254833 - protein, 9 aa, Homo Sapiens
DSKTLATKE

SEQ ID NO: 254834 - protein, 9 aa, Homo Sapiens
LFQMVRTQR

SEQ ID NO: 254835 - protein, 9 aa, Homo Sapiens
DSRKERLKL

SEQ ID NO: 254836 - protein, 9 aa, Homo Sapiens
YCYYGDGFF

SEQ ID NO: 254837 - protein, 9 aa, Homo Sapiens
DSKPELTII

SEQ ID NO: 254838 - protein, 9 aa, Homo Sapiens
MEVDERDQD

SEQ ID NO: 254839 - protein, 9 aa, Homo Sapiens
ILNQSDIKE

SEQ ID NO: 254840 - protein, 9 aa, Homo Sapiens
KHLTGECKN

SEQ ID NO: 254841 - protein, 9 aa, Homo Sapiens
ETAQKTAQL

SEQ ID NO: 254842 - protein, 9 aa, Homo Sapiens
IMDLKEEKP

SEQ ID NO: 254843 - protein, 9 aa, Homo Sapiens
TFLREKSPT

SEQ ID NO: 254844 - protein, 9 aa, Homo Sapiens
VSTLLALMY

SEQ ID NO: 254845 - protein, 9 aa, Homo Sapiens
RLILDPVLL

SEQ ID NO: 254846 - protein, 9 aa, Homo Sapiens
SSAKFLKDT

SEQ ID NO: 254847 - protein, 9 aa, Homo Sapiens
QKVMEQTFD

SEQ ID NO: 254848 - protein, 9 aa, Homo Sapiens
GDIHAIKIL

SEQ ID NO: 254849 - protein, 9 aa, Homo Sapiens
PGTEQDMLY

SEQ ID NO: 254850 - protein, 9 aa, Homo Sapiens
SPVPCINQV

SEQ ID NO: 254851 - protein, 9 aa, Homo Sapiens
WVTSKCELY

SEQ ID NO: 254852 - protein, 9 aa, Homo Sapiens
KAKVMQHIL

SEQ ID NO: 254853 - protein, 9 aa, Homo Sapiens
QSPIQKEWV

SEQ ID NO: 254854 - protein, 9 aa, Homo Sapiens
DPAEAPMTL

SEQ ID NO: 254855 - protein, 9 aa, Homo Sapiens
DKKPRKCDL

SEQ ID NO: 254856 - protein, 9 aa, Homo Sapiens
ERIQVILDM

SEQ ID NO: 254857 - protein, 9 aa, Homo Sapiens
EDYMYWRTA

SEQ ID NO: 254858 - protein, 9 aa, Homo Sapiens
FHDNDFEPY

SEQ ID NO: 254859 - protein, 9 aa, Homo Sapiens
QDLALIAWE

SEQ ID NO: 254860 - protein, 9 aa, Homo Sapiens
MEPCRLYHR

SEQ ID NO: 254861 - protein, 9 aa, Homo Sapiens
FNNFPFLEE

SEQ ID NO: 254862 - protein, 9 aa, Homo Sapiens
LDEDGLNLE

SEQ ID NO: 254863 - protein, 9 aa, Homo Sapiens
QHQNIHTGQ

SEQ ID NO: 254864 - protein, 9 aa, Homo Sapiens
PALKATSDN

SEQ ID NO: 254865 - protein, 9 aa, Homo Sapiens
FRRDQRYLY

SEQ ID NO: 254866 - protein, 9 aa, Homo Sapiens
LTGYPDRPG

SEQ ID NO: 254867 - protein, 9 aa, Homo Sapiens
GSYASLGKI

SEQ ID NO: 254868 - protein, 9 aa, Homo Sapiens
KQDITFTDV

SEQ ID NO: 254869 - protein, 9 aa, Homo Sapiens
KSIAVATLH

SEQ ID NO: 254870 - protein, 9 aa, Homo Sapiens
IDEVYKVIL

SEQ ID NO: 254871 - protein, 9 aa, Homo Sapiens
MLEFLWTFR

SEQ ID NO: 254872 - protein, 9 aa, Homo Sapiens
SSATDYDYY

SEQ ID NO: 254873 - protein, 9 aa, Homo Sapiens
VKQESLVIN

SEQ ID NO: 254874 - protein, 9 aa, Homo Sapiens
VYMPTHLAP

SEQ ID NO: 254875 - protein, 9 aa, Homo Sapiens
GKYVNLQIW

SEQ ID NO: 254876 - protein, 9 aa, Homo Sapiens
GLSGMQGGL

SEQ ID NO: 254877 - protein, 9 aa, Homo Sapiens
VNYHLLGNV

SEQ ID NO: 254878 - protein, 9 aa, Homo Sapiens
LESIKSRLQ

SEQ ID NO: 254879 - protein, 9 aa, Homo Sapiens
VMAVPHTAD

SEQ ID NO: 254880 - protein, 9 aa, Homo Sapiens
EELSGGQEA

SEQ ID NO: 254881 - protein, 9 aa, Homo Sapiens
SKYGSLEED

SEQ ID NO: 254882 - protein, 9 aa, Homo Sapiens
GEKFYKCTE

SEQ ID NO: 254883 - protein, 9 aa, Homo Sapiens
QFKETIEKC

SEQ ID NO: 254884 - protein, 9 aa, Homo Sapiens
NFLFTDNCS

SEQ ID NO: 254885 - protein, 9 aa, Homo Sapiens
FTPDKFCHS

SEQ ID NO: 254886 - protein, 9 aa, Homo Sapiens
HPLFLYLII

SEQ ID NO: 254887 - protein, 9 aa, Homo Sapiens
LLFSISADP

SEQ ID NO: 254888 - protein, 9 aa, Homo Sapiens
MPKLTEGQY

SEQ ID NO: 254889 - protein, 9 aa, Homo Sapiens
VNNVNEYAP

SEQ ID NO: 254890 - protein, 9 aa, Homo Sapiens
TEKLEKERQ

SEQ ID NO: 254891 - protein, 9 aa, Homo Sapiens
LDLTGISMH

SEQ ID NO: 254892 - protein, 9 aa, Homo Sapiens
GNIKIIQTL

SEQ ID NO: 254893 - protein, 9 aa, Homo Sapiens
KPLTFRTLC

SEQ ID NO: 254894 - protein, 9 aa, Homo Sapiens
ESDPSYKRN

SEQ ID NO: 254895 - protein, 9 aa, Homo Sapiens
QNHQRASDY

SEQ ID NO: 254896 - protein, 9 aa, Homo Sapiens
NTYRSLLGS

SEQ ID NO: 254897 - protein, 9 aa, Homo Sapiens
IKEIPPKKE

SEQ ID NO: 254898 - protein, 9 aa, Homo Sapiens
IKRQEKNWL

SEQ ID NO: 254899 - protein, 9 aa, Homo Sapiens
RSILYKENS

SEQ ID NO: 254900 - protein, 9 aa, Homo Sapiens
QDTTYIHHV

SEQ ID NO: 254901 - protein, 9 aa, Homo Sapiens
LKFQEIKMC

SEQ ID NO: 254902 - protein, 9 aa, Homo Sapiens
KSLLSVEEA

SEQ ID NO: 254903 - protein, 9 aa, Homo Sapiens
HFRPNCLSE

SEQ ID NO: 254904 - protein, 9 aa, Homo Sapiens
VWEYTMLRN

SEQ ID NO: 254905 - protein, 9 aa, Homo Sapiens
QYTALTSVQ

SEQ ID NO: 254906 - protein, 9 aa, Homo Sapiens
VFWWPEGMC

SEQ ID NO: 254907 - protein, 9 aa, Homo Sapiens
VVLLTCRDK

SEQ ID NO: 254908 - protein, 9 aa, Homo Sapiens
LTGGSVYKN

SEQ ID NO: 254909 - protein, 9 aa, Homo Sapiens
TPYLVTAED

SEQ ID NO: 254910 - protein, 9 aa, Homo Sapiens
DNGNNSVQY

SEQ ID NO: 254911 - protein, 9 aa, Homo Sapiens
KFAPFNVLV

SEQ ID NO: 254912 - protein, 9 aa, Homo Sapiens
EAVRSEAER

SEQ ID NO: 254913 - protein, 9 aa, Homo Sapiens
YYLSYTEES

SEQ ID NO: 254914 - protein, 9 aa, Homo Sapiens
CFSTFILPI

SEQ ID NO: 254915 - protein, 9 aa, Homo Sapiens
VLESLETFS

SEQ ID NO: 254916 - protein, 9 aa, Homo Sapiens
LLLCGGLCM

SEQ ID NO: 254917 - protein, 9 aa, Homo Sapiens
KWIYFVRGA

SEQ ID NO: 254918 - protein, 9 aa, Homo Sapiens
YDQAVAISC

SEQ ID NO: 254919 - protein, 9 aa, Homo Sapiens
SCTYFIRTT

SEQ ID NO: 254920 - protein, 9 aa, Homo Sapiens
LQSRNLNCT

SEQ ID NO: 254921 - protein, 9 aa, Homo Sapiens
PPIVARCVR

SEQ ID NO: 254922 - protein, 9 aa, Homo Sapiens
RDAKQIQII

SEQ ID NO: 254923 - protein, 9 aa, Homo Sapiens
ITNLRLKFV

SEQ ID NO: 254924 - protein, 9 aa, Homo Sapiens
PETKHSAKV

SEQ ID NO: 254925 - protein, 9 aa, Homo Sapiens
NQESELRTA

SEQ ID NO: 254926 - protein, 9 aa, Homo Sapiens
YEREHVDTF

SEQ ID NO: 254927 - protein, 9 aa, Homo Sapiens
LMISMPQEL

SEQ ID NO: 254928 - protein, 9 aa, Homo Sapiens
DALRKIQGS

SEQ ID NO: 254929 - protein, 9 aa, Homo Sapiens
NREKSKRDY

SEQ ID NO: 254930 - protein, 9 aa, Homo Sapiens
IVLLAHRLW

SEQ ID NO: 254931 - protein, 9 aa, Homo Sapiens
YCFVNFTRL

SEQ ID NO: 254932 - protein, 9 aa, Homo Sapiens
VLTITLREE

SEQ ID NO: 254933 - protein, 9 aa, Homo Sapiens
EIDERGPSP

SEQ ID NO: 254934 - protein, 9 aa, Homo Sapiens
TNDNHPVFN

SEQ ID NO: 254935 - protein, 9 aa, Homo Sapiens
VIVNPPVIT

SEQ ID NO: 254936 - protein, 9 aa, Homo Sapiens
FDCDEGKCY

SEQ ID NO: 254937 - protein, 9 aa, Homo Sapiens
IFSLSYIIS

SEQ ID NO: 254938 - protein, 9 aa, Homo Sapiens
ATSKKNVCV

SEQ ID NO: 254939 - protein, 9 aa, Homo Sapiens
LIKGQSAGG

SEQ ID NO: 254940 - protein, 9 aa, Homo Sapiens
FKFRVGATD

SEQ ID NO: 254941 - protein, 9 aa, Homo Sapiens
ENKIINKYL

SEQ ID NO: 254942 - protein, 9 aa, Homo Sapiens
DGNIKIIQT

SEQ ID NO: 254943 - protein, 9 aa, Homo Sapiens
LGLSDLKAL

SEQ ID NO: 254944 - protein, 9 aa, Homo Sapiens
SQYSSFNEH

SEQ ID NO: 254945 - protein, 9 aa, Homo Sapiens
PEYLSANDV

SEQ ID NO: 254946 - protein, 9 aa, Homo Sapiens
FFQRFSVIF

SEQ ID NO: 254947 - protein, 9 aa, Homo Sapiens
NGYIHVESK

SEQ ID NO: 254948 - protein, 9 aa, Homo Sapiens
NPYEPKCHS

SEQ ID NO: 254949 - protein, 9 aa, Homo Sapiens
TLAMSPWQR

SEQ ID NO: 254950 - protein, 9 aa, Homo Sapiens
TKTQEEGKL

SEQ ID NO: 254951 - protein, 9 aa, Homo Sapiens
TDHRSSSYH

SEQ ID NO: 254952 - protein, 9 aa, Homo Sapiens
SYVSQTRIA

SEQ ID NO: 254953 - protein, 9 aa, Homo Sapiens
CATGDIIQI

SEQ ID NO: 254954 - protein, 9 aa, Homo Sapiens
TKSQTTISI

SEQ ID NO: 254955 - protein, 9 aa, Homo Sapiens
LKEEPDEFI

SEQ ID NO: 254956 - protein, 9 aa, Homo Sapiens
TQGAVGCPG

SEQ ID NO: 254957 - protein, 9 aa, Homo Sapiens
PEFITLHDY

SEQ ID NO: 254958 - protein, 9 aa, Homo Sapiens
ALSTTFEHL

SEQ ID NO: 254959 - protein, 9 aa, Homo Sapiens
CNINITKHL

SEQ ID NO: 254960 - protein, 9 aa, Homo Sapiens
TTFCIFIRD

SEQ ID NO: 254961 - protein, 9 aa, Homo Sapiens
KSIACPSIG

SEQ ID NO: 254962 - protein, 9 aa, Homo Sapiens
ALGTSIICN

SEQ ID NO: 254963 - protein, 9 aa, Homo Sapiens
ECPGWASTI

SEQ ID NO: 254964 - protein, 9 aa, Homo Sapiens
EASRQDKEG

SEQ ID NO: 254965 - protein, 9 aa, Homo Sapiens
VDKVVAQSL

SEQ ID NO: 254966 - protein, 9 aa, Homo Sapiens
PVKKVNCVI

SEQ ID NO: 254967 - protein, 9 aa, Homo Sapiens
LHFDLRIPF

SEQ ID NO: 254968 - protein, 9 aa, Homo Sapiens
SIYIRIHEI

SEQ ID NO: 254969 - protein, 9 aa, Homo Sapiens
ESFVKVLMH

SEQ ID NO: 254970 - protein, 9 aa, Homo Sapiens
DQATMKYIK

SEQ ID NO: 254971 - protein, 9 aa, Homo Sapiens
IIQSIIHQD

SEQ ID NO: 254972 - protein, 9 aa, Homo Sapiens
LEVSPPVVV

SEQ ID NO: 254973 - protein, 9 aa, Homo Sapiens
CMYSLIGLY

SEQ ID NO: 254974 - protein, 9 aa, Homo Sapiens
PEQNKNHCS

SEQ ID NO: 254975 - protein, 9 aa, Homo Sapiens
YDYYSPTGG

SEQ ID NO: 254976 - protein, 9 aa, Homo Sapiens
CFSPCGWTL

SEQ ID NO: 254977 - protein, 9 aa, Homo Sapiens
SHTGFSGLR

SEQ ID NO: 254978 - protein, 9 aa, Homo Sapiens
SQRGTLTYF

SEQ ID NO: 254979 - protein, 9 aa, Homo Sapiens
LERKKDCKQ

SEQ ID NO: 254980 - protein, 9 aa, Homo Sapiens
ESTGPKPRF

SEQ ID NO: 254981 - protein, 9 aa, Homo Sapiens
HSKCVGILS

SEQ ID NO: 254982 - protein, 9 aa, Homo Sapiens
KFQEMKEAA

SEQ ID NO: 254983 - protein, 9 aa, Homo Sapiens
LDLLGDPSP

SEQ ID NO: 254984 - protein, 9 aa, Homo Sapiens
DDEEFFIKI

SEQ ID NO: 254985 - protein, 9 aa, Homo Sapiens
QKQNTMKFG

SEQ ID NO: 254986 - protein, 9 aa, Homo Sapiens
ESHVVSALT

SEQ ID NO: 254987 - protein, 9 aa, Homo Sapiens
TSHWTLCMN

SEQ ID NO: 254988 - protein, 9 aa, Homo Sapiens
NEEVTHVIV

SEQ ID NO: 254989 - protein, 9 aa, Homo Sapiens
QPYKCQQPK

SEQ ID NO: 254990 - protein, 9 aa, Homo Sapiens
MMEAFLLAV

SEQ ID NO: 254991 - protein, 9 aa, Homo Sapiens
NKSKARPKS

SEQ ID NO: 254992 - protein, 9 aa, Homo Sapiens
LYHLAKETG

SEQ ID NO: 254993 - protein, 9 aa, Homo Sapiens
ADMEEPPLL

SEQ ID NO: 254994 - protein, 9 aa, Homo Sapiens
KHKQKFAPF

SEQ ID NO: 254995 - protein, 9 aa, Homo Sapiens
SPEALRMVW

SEQ ID NO: 254996 - protein, 9 aa, Homo Sapiens
GIAQASHLF

SEQ ID NO: 254997 - protein, 9 aa, Homo Sapiens
LWEKSKGYG

SEQ ID NO: 254998 - protein, 9 aa, Homo Sapiens
PDLILIDYG

SEQ ID NO: 254999 - protein, 9 aa, Homo Sapiens
RYHALEKQN

SEQ ID NO: 255000 - protein, 9 aa, Homo Sapiens
KSKDETDKE

SEQ ID NO: 255001 - protein, 9 aa, Homo Sapiens
VYSATFQSL

SEQ ID NO: 255002 - protein, 9 aa, Homo Sapiens
SNNCNNSLT

SEQ ID NO: 255003 - protein, 9 aa, Homo Sapiens
ISTSIPVVS

SEQ ID NO: 255004 - protein, 9 aa, Homo Sapiens
IICVTTVPG

SEQ ID NO: 255005 - protein, 9 aa, Homo Sapiens
NSVGKDRSP

SEQ ID NO: 255006 - protein, 9 aa, Homo Sapiens
FQNECLFCV

SEQ ID NO: 255007 - protein, 9 aa, Homo Sapiens
FAKLLAEGG

SEQ ID NO: 255008 - protein, 9 aa, Homo Sapiens
HLKNRCGFS

SEQ ID NO: 255009 - protein, 9 aa, Homo Sapiens
LLYGRASCT

SEQ ID NO: 255010 - protein, 9 aa, Homo Sapiens
NWTWISFEK

SEQ ID NO: 255011 - protein, 9 aa, Homo Sapiens
EARRSAANI

SEQ ID NO: 255012 - protein, 9 aa, Homo Sapiens
NMYYFSELV

SEQ ID NO: 255013 - protein, 9 aa, Homo Sapiens
CDNCLLCLQ

SEQ ID NO: 255014 - protein, 9 aa, Homo Sapiens
IIIGDHHWK

SEQ ID NO: 255015 - protein, 9 aa, Homo Sapiens
CCLCASCWT

SEQ ID NO: 255016 - protein, 9 aa, Homo Sapiens
VILHSPLTL

SEQ ID NO: 255017 - protein, 9 aa, Homo Sapiens
QDPFLTGSS

SEQ ID NO: 255018 - protein, 9 aa, Homo Sapiens
LGSLFNKTE

SEQ ID NO: 255019 - protein, 9 aa, Homo Sapiens
YFLDQIKVC

SEQ ID NO: 255020 - protein, 9 aa, Homo Sapiens
KIKYFQMDF

SEQ ID NO: 255021 - protein, 9 aa, Homo Sapiens
DLSDRLERG

SEQ ID NO: 255022 - protein, 9 aa, Homo Sapiens
LGLFSNCST

SEQ ID NO: 255023 - protein, 9 aa, Homo Sapiens
HPPLSGCST

SEQ ID NO: 255024 - protein, 9 aa, Homo Sapiens
HSGVDNMVL

SEQ ID NO: 255025 - protein, 9 aa, Homo Sapiens
NKKIEKALY

SEQ ID NO: 255026 - protein, 9 aa, Homo Sapiens
FPGTDCNLT

SEQ ID NO: 255027 - protein, 9 aa, Homo Sapiens
RKLCLPSSN

SEQ ID NO: 255028 - protein, 9 aa, Homo Sapiens
AVIVRPDDW

SEQ ID NO: 255029 - protein, 9 aa, Homo Sapiens
RIQQRISIK

SEQ ID NO: 255030 - protein, 9 aa, Homo Sapiens
EEKSVISDK

SEQ ID NO: 255031 - protein, 9 aa, Homo Sapiens
LLVVHQQTH

SEQ ID NO: 255032 - protein, 9 aa, Homo Sapiens
PVYVQFIHL

SEQ ID NO: 255033 - protein, 9 aa, Homo Sapiens
IVNLLKPNS

SEQ ID NO: 255034 - protein, 9 aa, Homo Sapiens
ALKEDFHLS

SEQ ID NO: 255035 - protein, 9 aa, Homo Sapiens
LKARQLEGK

SEQ ID NO: 255036 - protein, 9 aa, Homo Sapiens
DRSVKPHLC

SEQ ID NO: 255037 - protein, 9 aa, Homo Sapiens
NIKWEKTSD

SEQ ID NO: 255038 - protein, 9 aa, Homo Sapiens
INFLLGSEI

SEQ ID NO: 255039 - protein, 9 aa, Homo Sapiens
AGFQNFVGL

SEQ ID NO: 255040 - protein, 9 aa, Homo Sapiens
VHFLVNAAG

SEQ ID NO: 255041 - protein, 9 aa, Homo Sapiens
TTLIQDEDY

SEQ ID NO: 255042 - protein, 9 aa, Homo Sapiens
LEQLSHAKY

SEQ ID NO: 255043 - protein, 9 aa, Homo Sapiens
FITASEDHT

SEQ ID NO: 255044 - protein, 9 aa, Homo Sapiens
PEYSQDPTM

SEQ ID NO: 255045 - protein, 9 aa, Homo Sapiens
TVRPFSKTP

SEQ ID NO: 255046 - protein, 9 aa, Homo Sapiens
AKLERKQEQ

SEQ ID NO: 255047 - protein, 9 aa, Homo Sapiens
VKELWRLET

SEQ ID NO: 255048 - protein, 9 aa, Homo Sapiens
PGGCNLEFN

SEQ ID NO: 255049 - protein, 9 aa, Homo Sapiens
FPDDVVRVI

SEQ ID NO: 255050 - protein, 9 aa, Homo Sapiens
GEGAPDPQR

SEQ ID NO: 255051 - protein, 9 aa, Homo Sapiens
LCPQRDNWK

SEQ ID NO: 255052 - protein, 9 aa, Homo Sapiens
PLGSPQIPL

SEQ ID NO: 255053 - protein, 9 aa, Homo Sapiens
IQANVERKY

SEQ ID NO: 255054 - protein, 9 aa, Homo Sapiens
MPQDSGVYT

SEQ ID NO: 255055 - protein, 9 aa, Homo Sapiens
LVLFILFIT

SEQ ID NO: 255056 - protein, 9 aa, Homo Sapiens
RSSPVRREI

SEQ ID NO: 255057 - protein, 9 aa, Homo Sapiens
KLMILSYSG

SEQ ID NO: 255058 - protein, 9 aa, Homo Sapiens
EYPSVTNYI

SEQ ID NO: 255059 - protein, 9 aa, Homo Sapiens
FFDEPTSLL

SEQ ID NO: 255060 - protein, 9 aa, Homo Sapiens
NYTAIRFTH

SEQ ID NO: 255061 - protein, 9 aa, Homo Sapiens
NIYYGAHVG

SEQ ID NO: 255062 - protein, 9 aa, Homo Sapiens
KRYIRESAW

SEQ ID NO: 255063 - protein, 9 aa, Homo Sapiens
QSPLATKEI

SEQ ID NO: 255064 - protein, 9 aa, Homo Sapiens
KDNCRLVPS

SEQ ID NO: 255065 - protein, 9 aa, Homo Sapiens
LSLPSTDSC

SEQ ID NO: 255066 - protein, 9 aa, Homo Sapiens
KKKKEPAIT

SEQ ID NO: 255067 - protein, 9 aa, Homo Sapiens
DSTRQVEKE

SEQ ID NO: 255068 - protein, 9 aa, Homo Sapiens
QLSEFTPDI

SEQ ID NO: 255069 - protein, 9 aa, Homo Sapiens
CVLTGQPFN

SEQ ID NO: 255070 - protein, 9 aa, Homo Sapiens
GLSKKLKRS

SEQ ID NO: 255071 - protein, 9 aa, Homo Sapiens
RSLRIGANW

SEQ ID NO: 255072 - protein, 9 aa, Homo Sapiens
FYKDVRAYQ

SEQ ID NO: 255073 - protein, 9 aa, Homo Sapiens
FSNCSTMDP

SEQ ID NO: 255074 - protein, 9 aa, Homo Sapiens
DKSLQKERL

SEQ ID NO: 255075 - protein, 9 aa, Homo Sapiens
PCRCGAGTA

SEQ ID NO: 255076 - protein, 9 aa, Homo Sapiens
LSNIISEKK

SEQ ID NO: 255077 - protein, 9 aa, Homo Sapiens
GDLIQFFKT

SEQ ID NO: 255078 - protein, 9 aa, Homo Sapiens
SQATAQINN

SEQ ID NO: 255079 - protein, 9 aa, Homo Sapiens
LCHDPDLHM

SEQ ID NO: 255080 - protein, 9 aa, Homo Sapiens
LNHLIYSLR

SEQ ID NO: 255081 - protein, 9 aa, Homo Sapiens
AQQSLNMEQ

SEQ ID NO: 255082 - protein, 9 aa, Homo Sapiens
SPSLSNKDR

SEQ ID NO: 255083 - protein, 9 aa, Homo Sapiens
FSSINLDKS

SEQ ID NO: 255084 - protein, 9 aa, Homo Sapiens
VVSDPNKLQ

SEQ ID NO: 255085 - protein, 9 aa, Homo Sapiens
NQELHDGCS

SEQ ID NO: 255086 - protein, 9 aa, Homo Sapiens
TNFCIQNCC

SEQ ID NO: 255087 - protein, 9 aa, Homo Sapiens
DNMKKVWLP

SEQ ID NO: 255088 - protein, 9 aa, Homo Sapiens
SLEPIGTRI

SEQ ID NO: 255089 - protein, 9 aa, Homo Sapiens
QIIATEQNT

SEQ ID NO: 255090 - protein, 9 aa, Homo Sapiens
SLELFSKKS

SEQ ID NO: 255091 - protein, 9 aa, Homo Sapiens
LQKRVPQLI

SEQ ID NO: 255092 - protein, 9 aa, Homo Sapiens
NEWQNTGFH

SEQ ID NO: 255093 - protein, 9 aa, Homo Sapiens
YQYIQSHFY

SEQ ID NO: 255094 - protein, 9 aa, Homo Sapiens
AKLCPRPDE

SEQ ID NO: 255095 - protein, 9 aa, Homo Sapiens
LTAPGTPCG

SEQ ID NO: 255096 - protein, 9 aa, Homo Sapiens
AVGRDKFKR

SEQ ID NO: 255097 - protein, 9 aa, Homo Sapiens
QEVAVLETS

SEQ ID NO: 255098 - protein, 9 aa, Homo Sapiens
KKSLESIKS

SEQ ID NO: 255099 - protein, 9 aa, Homo Sapiens
SKGVKCMPY

SEQ ID NO: 255100 - protein, 9 aa, Homo Sapiens
RSQCCQSAC

SEQ ID NO: 255101 - protein, 9 aa, Homo Sapiens
AFLPIFFGT

SEQ ID NO: 255102 - protein, 9 aa, Homo Sapiens
QKLLRAKNA

SEQ ID NO: 255103 - protein, 9 aa, Homo Sapiens
RHRKSHAGE

SEQ ID NO: 255104 - protein, 9 aa, Homo Sapiens
QELSFQKCI

SEQ ID NO: 255105 - protein, 9 aa, Homo Sapiens
KVTLAKSRK

SEQ ID NO: 255106 - protein, 9 aa, Homo Sapiens
AAHAIVLVN

SEQ ID NO: 255107 - protein, 9 aa, Homo Sapiens
CPTVVWTWW

SEQ ID NO: 255108 - protein, 9 aa, Homo Sapiens
QAQNFLSSF

SEQ ID NO: 255109 - protein, 9 aa, Homo Sapiens
WPVDTQACN

SEQ ID NO: 255110 - protein, 9 aa, Homo Sapiens
ASTEGSDIT

SEQ ID NO: 255111 - protein, 9 aa, Homo Sapiens
DREELCDPT

SEQ ID NO: 255112 - protein, 9 aa, Homo Sapiens
IRQKITCKG

SEQ ID NO: 255113 - protein, 9 aa, Homo Sapiens
PLRSVFVGN

SEQ ID NO: 255114 - protein, 9 aa, Homo Sapiens
YFIIINCGA

SEQ ID NO: 255115 - protein, 9 aa, Homo Sapiens
IEDVIHKLN

SEQ ID NO: 255116 - protein, 9 aa, Homo Sapiens
GDKSDQNAM

SEQ ID NO: 255117 - protein, 9 aa, Homo Sapiens
YFFWKNMTF

SEQ ID NO: 255118 - protein, 9 aa, Homo Sapiens
ISCPLIGVL

SEQ ID NO: 255119 - protein, 9 aa, Homo Sapiens
LSREQAGDL

SEQ ID NO: 255120 - protein, 9 aa, Homo Sapiens
SFQKCIEQS

SEQ ID NO: 255121 - protein, 9 aa, Homo Sapiens
QNDLLGYPK

SEQ ID NO: 255122 - protein, 9 aa, Homo Sapiens
KIRVSGKVT

SEQ ID NO: 255123 - protein, 9 aa, Homo Sapiens
AFNYYPQNI

SEQ ID NO: 255124 - protein, 9 aa, Homo Sapiens
IHVNEITRF

SEQ ID NO: 255125 - protein, 9 aa, Homo Sapiens
EVQLGRNGV

SEQ ID NO: 255126 - protein, 9 aa, Homo Sapiens
KSPNAVVGQ

SEQ ID NO: 255127 - protein, 9 aa, Homo Sapiens
RKTEYIDGL

SEQ ID NO: 255128 - protein, 9 aa, Homo Sapiens
PCYFTGSEP

SEQ ID NO: 255129 - protein, 9 aa, Homo Sapiens
NGWVVSHDF

SEQ ID NO: 255130 - protein, 9 aa, Homo Sapiens
PEINLDTDK

SEQ ID NO: 255131 - protein, 9 aa, Homo Sapiens
NTICKKCGW

SEQ ID NO: 255132 - protein, 9 aa, Homo Sapiens
DALFQYNGT

SEQ ID NO: 255133 - protein, 9 aa, Homo Sapiens
LNPDRMSHY

SEQ ID NO: 255134 - protein, 9 aa, Homo Sapiens
YEPKCHSLT

SEQ ID NO: 255135 - protein, 9 aa, Homo Sapiens
EALDVNIGM

SEQ ID NO: 255136 - protein, 9 aa, Homo Sapiens
DVNVTFKDQ

SEQ ID NO: 255137 - protein, 9 aa, Homo Sapiens
FPLLRYLAL

SEQ ID NO: 255138 - protein, 9 aa, Homo Sapiens
VILSLTENY

SEQ ID NO: 255139 - protein, 9 aa, Homo Sapiens
ETPTHPPKE

SEQ ID NO: 255140 - protein, 9 aa, Homo Sapiens
RNCSTPGPG

SEQ ID NO: 255141 - protein, 9 aa, Homo Sapiens
SSEAAYHKG

SEQ ID NO: 255142 - protein, 9 aa, Homo Sapiens
SLHTEAVWA

SEQ ID NO: 255143 - protein, 9 aa, Homo Sapiens
DFFDEPTSL

SEQ ID NO: 255144 - protein, 9 aa, Homo Sapiens
AVGHGLWTW

SEQ ID NO: 255145 - protein, 9 aa, Homo Sapiens
SEDCLHLNI

SEQ ID NO: 255146 - protein, 9 aa, Homo Sapiens
TFLVKIARP

SEQ ID NO: 255147 - protein, 9 aa, Homo Sapiens
CNCHFLRLH

SEQ ID NO: 255148 - protein, 9 aa, Homo Sapiens
IFNTDKAIS

SEQ ID NO: 255149 - protein, 9 aa, Homo Sapiens
IRVSGKVTT

SEQ ID NO: 255150 - protein, 9 aa, Homo Sapiens
PAHFNLYMF

SEQ ID NO: 255151 - protein, 9 aa, Homo Sapiens
ALQKALEPA

SEQ ID NO: 255152 - protein, 9 aa, Homo Sapiens
AFTPDNPYH

SEQ ID NO: 255153 - protein, 9 aa, Homo Sapiens
KVHIQALQT

SEQ ID NO: 255154 - protein, 9 aa, Homo Sapiens
QSNLARHCR

SEQ ID NO: 255155 - protein, 9 aa, Homo Sapiens
DDWDRKRCR

SEQ ID NO: 255156 - protein, 9 aa, Homo Sapiens
LSKEYNFIT

SEQ ID NO: 255157 - protein, 9 aa, Homo Sapiens
DFLKSDDGG

SEQ ID NO: 255158 - protein, 9 aa, Homo Sapiens
AVIHSVKEV

SEQ ID NO: 255159 - protein, 9 aa, Homo Sapiens
LCATGIIIV

SEQ ID NO: 255160 - protein, 9 aa, Homo Sapiens
LALPQFYQA

SEQ ID NO: 255161 - protein, 9 aa, Homo Sapiens
MKELLSEGE

SEQ ID NO: 255162 - protein, 9 aa, Homo Sapiens
QLEGRPLNA

SEQ ID NO: 255163 - protein, 9 aa, Homo Sapiens
KARRKGHRV

SEQ ID NO: 255164 - protein, 9 aa, Homo Sapiens
TLCKNDSAL

SEQ ID NO: 255165 - protein, 9 aa, Homo Sapiens
ENKPKENLE

SEQ ID NO: 255166 - protein, 9 aa, Homo Sapiens
YQATTYASR

SEQ ID NO: 255167 - protein, 9 aa, Homo Sapiens
NSAFRPSQT

SEQ ID NO: 255168 - protein, 9 aa, Homo Sapiens
LSFTKNTKK

SEQ ID NO: 255169 - protein, 9 aa, Homo Sapiens
HAAMFRQFQ

SEQ ID NO: 255170 - protein, 9 aa, Homo Sapiens
QLTDDYGLD

SEQ ID NO: 255171 - protein, 9 aa, Homo Sapiens
NGKVDSCQG

SEQ ID NO: 255172 - protein, 9 aa, Homo Sapiens
RKTSYLSLF

SEQ ID NO: 255173 - protein, 9 aa, Homo Sapiens
STNGAVVKY

SEQ ID NO: 255174 - protein, 9 aa, Homo Sapiens
GASMYEQFY

SEQ ID NO: 255175 - protein, 9 aa, Homo Sapiens
IPASSLPML

SEQ ID NO: 255176 - protein, 9 aa, Homo Sapiens
EAVWAARWA

SEQ ID NO: 255177 - protein, 9 aa, Homo Sapiens
LFFVALGGI

SEQ ID NO: 255178 - protein, 9 aa, Homo Sapiens
PISFTPNYL

SEQ ID NO: 255179 - protein, 9 aa, Homo Sapiens
SILLILWLP

SEQ ID NO: 255180 - protein, 9 aa, Homo Sapiens
HLRIYVYVL

SEQ ID NO: 255181 - protein, 9 aa, Homo Sapiens
YSENLQEIK

SEQ ID NO: 255182 - protein, 9 aa, Homo Sapiens
KLLFDNLVY

SEQ ID NO: 255183 - protein, 9 aa, Homo Sapiens
NGQAGAVDM

SEQ ID NO: 255184 - protein, 9 aa, Homo Sapiens
DKFRKTRYS

SEQ ID NO: 255185 - protein, 9 aa, Homo Sapiens
PNSQYNQRL

SEQ ID NO: 255186 - protein, 9 aa, Homo Sapiens
SNKNAVVKR

SEQ ID NO: 255187 - protein, 9 aa, Homo Sapiens
ILAFPCNQL

SEQ ID NO: 255188 - protein, 9 aa, Homo Sapiens
SNGLQSSYS

SEQ ID NO: 255189 - protein, 9 aa, Homo Sapiens
VLGITSILY

SEQ ID NO: 255190 - protein, 9 aa, Homo Sapiens
DGPSSEKLE

SEQ ID NO: 255191 - protein, 9 aa, Homo Sapiens
VFGIFDTFL

SEQ ID NO: 255192 - protein, 9 aa, Homo Sapiens
RTILTRGLL

SEQ ID NO: 255193 - protein, 9 aa, Homo Sapiens
RKLNQAFWE

SEQ ID NO: 255194 - protein, 9 aa, Homo Sapiens
AQHIKEDRA

SEQ ID NO: 255195 - protein, 9 aa, Homo Sapiens
EIHKNGKGS

SEQ ID NO: 255196 - protein, 9 aa, Homo Sapiens
WERTKVLHK

SEQ ID NO: 255197 - protein, 9 aa, Homo Sapiens
RDSIGLDYS

SEQ ID NO: 255198 - protein, 9 aa, Homo Sapiens
LGGLFSPPT

SEQ ID NO: 255199 - protein, 9 aa, Homo Sapiens
ALDLHGVVF

SEQ ID NO: 255200 - protein, 9 aa, Homo Sapiens
LMVIFQAAL

SEQ ID NO: 255201 - protein, 9 aa, Homo Sapiens
KTPEEICKT

SEQ ID NO: 255202 - protein, 9 aa, Homo Sapiens
CGECKLCLN

SEQ ID NO: 255203 - protein, 9 aa, Homo Sapiens
KETEAIESD

SEQ ID NO: 255204 - protein, 9 aa, Homo Sapiens
QPTMSQFKM

SEQ ID NO: 255205 - protein, 9 aa, Homo Sapiens
SHAGENSLR

SEQ ID NO: 255206 - protein, 9 aa, Homo Sapiens
IAWSINGTQ

SEQ ID NO: 255207 - protein, 9 aa, Homo Sapiens
RCITKLAQY

SEQ ID NO: 255208 - protein, 9 aa, Homo Sapiens
RKEQTETHK

SEQ ID NO: 255209 - protein, 9 aa, Homo Sapiens
EISDHYGAP

SEQ ID NO: 255210 - protein, 9 aa, Homo Sapiens
RLIYPSLNL

SEQ ID NO: 255211 - protein, 9 aa, Homo Sapiens
ELIHKKRII

SEQ ID NO: 255212 - protein, 9 aa, Homo Sapiens
CGHDNLHLK

SEQ ID NO: 255213 - protein, 9 aa, Homo Sapiens
MTEHVLGDG

SEQ ID NO: 255214 - protein, 9 aa, Homo Sapiens
RKKIEPDAV

SEQ ID NO: 255215 - protein, 9 aa, Homo Sapiens
QWFDTAPSR

SEQ ID NO: 255216 - protein, 9 aa, Homo Sapiens
NKLVEELAL

SEQ ID NO: 255217 - protein, 9 aa, Homo Sapiens
SIYFTTSKF

SEQ ID NO: 255218 - protein, 9 aa, Homo Sapiens
PDQSIKYSF

SEQ ID NO: 255219 - protein, 9 aa, Homo Sapiens
KRKVQRYLS

SEQ ID NO: 255220 - protein, 9 aa, Homo Sapiens
KCSKFLRRC

SEQ ID NO: 255221 - protein, 9 aa, Homo Sapiens
PKVHNRQPQ

SEQ ID NO: 255222 - protein, 9 aa, Homo Sapiens
SVENGTFIE

SEQ ID NO: 255223 - protein, 9 aa, Homo Sapiens
PDDWSQGAI

SEQ ID NO: 255224 - protein, 9 aa, Homo Sapiens
HLQTCRLRL

SEQ ID NO: 255225 - protein, 9 aa, Homo Sapiens
IYVDKDNGE

SEQ ID NO: 255226 - protein, 9 aa, Homo Sapiens
KVLACTDLE

SEQ ID NO: 255227 - protein, 9 aa, Homo Sapiens
EIEILDASE

SEQ ID NO: 255228 - protein, 9 aa, Homo Sapiens
VKYLGPLEI

SEQ ID NO: 255229 - protein, 9 aa, Homo Sapiens
APEAINVGS

SEQ ID NO: 255230 - protein, 9 aa, Homo Sapiens
DKPSQISVM

SEQ ID NO: 255231 - protein, 9 aa, Homo Sapiens
QPTGPKDTD

SEQ ID NO: 255232 - protein, 9 aa, Homo Sapiens
AGNEAVLIE

SEQ ID NO: 255233 - protein, 9 aa, Homo Sapiens
CHVGQEGPR

SEQ ID NO: 255234 - protein, 9 aa, Homo Sapiens
ADNSVGFVK

SEQ ID NO: 255235 - protein, 9 aa, Homo Sapiens
LAVLGPGLP

SEQ ID NO: 255236 - protein, 9 aa, Homo Sapiens
SYHNKPPGT

SEQ ID NO: 255237 - protein, 9 aa, Homo Sapiens
AEDSEAENT

SEQ ID NO: 255238 - protein, 9 aa, Homo Sapiens
KHSEEVKTQ

SEQ ID NO: 255239 - protein, 9 aa, Homo Sapiens
KLFPKSKSV

SEQ ID NO: 255240 - protein, 9 aa, Homo Sapiens
PQISSEAAY

SEQ ID NO: 255241 - protein, 9 aa, Homo Sapiens
KKQKKKTNN

SEQ ID NO: 255242 - protein, 9 aa, Homo Sapiens
KGIHILEAM

SEQ ID NO: 255243 - protein, 9 aa, Homo Sapiens
WVKIFTPCF

SEQ ID NO: 255244 - protein, 9 aa, Homo Sapiens
MNLVPFPQR

SEQ ID NO: 255245 - protein, 9 aa, Homo Sapiens
VALTLIRQH

SEQ ID NO: 255246 - protein, 9 aa, Homo Sapiens
CHGQETTDP

SEQ ID NO: 255247 - protein, 9 aa, Homo Sapiens
YQSLAPLMM

SEQ ID NO: 255248 - protein, 9 aa, Homo Sapiens
RWFENDKEI

SEQ ID NO: 255249 - protein, 9 aa, Homo Sapiens
LGQCKKTQI

SEQ ID NO: 255250 - protein, 9 aa, Homo Sapiens
IILMGKNFI

SEQ ID NO: 255251 - protein, 9 aa, Homo Sapiens
VFVRCLTDV

SEQ ID NO: 255252 - protein, 9 aa, Homo Sapiens
LAVLQRMDM

SEQ ID NO: 255253 - protein, 9 aa, Homo Sapiens
DSHNFAIRC

SEQ ID NO: 255254 - protein, 9 aa, Homo Sapiens
DKVLCRVHY

SEQ ID NO: 255255 - protein, 9 aa, Homo Sapiens
ALSRNPQPQ

SEQ ID NO: 255256 - protein, 9 aa, Homo Sapiens
NTKTEYEPD

SEQ ID NO: 255257 - protein, 9 aa, Homo Sapiens
NKLTKTCFL

SEQ ID NO: 255258 - protein, 9 aa, Homo Sapiens
SLLSKLIRQ

SEQ ID NO: 255259 - protein, 9 aa, Homo Sapiens
PLDEGYGMS

SEQ ID NO: 255260 - protein, 9 aa, Homo Sapiens
ASQYGRFLC

SEQ ID NO: 255261 - protein, 9 aa, Homo Sapiens
LHLSKCWDY

SEQ ID NO: 255262 - protein, 9 aa, Homo Sapiens
KGACKAFTG

SEQ ID NO: 255263 - protein, 9 aa, Homo Sapiens
SQHLEGKAE

SEQ ID NO: 255264 - protein, 9 aa, Homo Sapiens
ASSIMPNML

SEQ ID NO: 255265 - protein, 9 aa, Homo Sapiens
WHHDCIIDE

SEQ ID NO: 255266 - protein, 9 aa, Homo Sapiens
VGLYGNSET

SEQ ID NO: 255267 - protein, 9 aa, Homo Sapiens
RCGYGELLG

SEQ ID NO: 255268 - protein, 9 aa, Homo Sapiens
QPELFGDLP

SEQ ID NO: 255269 - protein, 9 aa, Homo Sapiens
TWIHISPKA

SEQ ID NO: 255270 - protein, 9 aa, Homo Sapiens
QEKDYLASQ

SEQ ID NO: 255271 - protein, 9 aa, Homo Sapiens
LPMTHNLQL

SEQ ID NO: 255272 - protein, 9 aa, Homo Sapiens
WNLYLPRPE

SEQ ID NO: 255273 - protein, 9 aa, Homo Sapiens
NPMAKHLMK

SEQ ID NO: 255274 - protein, 9 aa, Homo Sapiens
IKPLALSTT

SEQ ID NO: 255275 - protein, 9 aa, Homo Sapiens
ILNKKAETG

SEQ ID NO: 255276 - protein, 9 aa, Homo Sapiens
LPAGFQNFV

SEQ ID NO: 255277 - protein, 9 aa, Homo Sapiens
GYIEVKMSS

SEQ ID NO: 255278 - protein, 9 aa, Homo Sapiens
HMAEPSVPY

SEQ ID NO: 255279 - protein, 9 aa, Homo Sapiens
DTQDKLGED

SEQ ID NO: 255280 - protein, 9 aa, Homo Sapiens
GDLHCDCYT

SEQ ID NO: 255281 - protein, 9 aa, Homo Sapiens
HKIYVCQSG

SEQ ID NO: 255282 - protein, 9 aa, Homo Sapiens
TLLDQARRD

SEQ ID NO: 255283 - protein, 9 aa, Homo Sapiens
YSIDSLIDV

SEQ ID NO: 255284 - protein, 9 aa, Homo Sapiens
AALLGQMCF

SEQ ID NO: 255285 - protein, 9 aa, Homo Sapiens
SYYNINRIR

SEQ ID NO: 255286 - protein, 9 aa, Homo Sapiens
HPLTRWARQ

SEQ ID NO: 255287 - protein, 9 aa, Homo Sapiens
LDNLELTYG

SEQ ID NO: 255288 - protein, 9 aa, Homo Sapiens
IHGVPEFIL

SEQ ID NO: 255289 - protein, 9 aa, Homo Sapiens
FQASLSFQD

SEQ ID NO: 255290 - protein, 9 aa, Homo Sapiens
KKANKKQNL

SEQ ID NO: 255291 - protein, 9 aa, Homo Sapiens
CLAGLVFVF

SEQ ID NO: 255292 - protein, 9 aa, Homo Sapiens
MWKGELYRQ

SEQ ID NO: 255293 - protein, 9 aa, Homo Sapiens
EDLKAKKKE

SEQ ID NO: 255294 - protein, 9 aa, Homo Sapiens
KQKFAPFNV

SEQ ID NO: 255295 - protein, 9 aa, Homo Sapiens
AHSNLTEML

SEQ ID NO: 255296 - protein, 9 aa, Homo Sapiens
MYVVTLMGN

SEQ ID NO: 255297 - protein, 9 aa, Homo Sapiens
GSPGRKFYM

SEQ ID NO: 255298 - protein, 9 aa, Homo Sapiens
NHRDNEHGV

SEQ ID NO: 255299 - protein, 9 aa, Homo Sapiens
LIDVLLLSK

SEQ ID NO: 255300 - protein, 9 aa, Homo Sapiens
LDQKSNGLN

SEQ ID NO: 255301 - protein, 9 aa, Homo Sapiens
NANTSIISF

SEQ ID NO: 255302 - protein, 9 aa, Homo Sapiens
CLERLCLGP

SEQ ID NO: 255303 - protein, 9 aa, Homo Sapiens
TRDLPRPQA

SEQ ID NO: 255304 - protein, 9 aa, Homo Sapiens
HQRVHTADK

SEQ ID NO: 255305 - protein, 9 aa, Homo Sapiens
VSKKEREIP

SEQ ID NO: 255306 - protein, 9 aa, Homo Sapiens
GIWGSMGEI

SEQ ID NO: 255307 - protein, 9 aa, Homo Sapiens
EEVTHVIVG

SEQ ID NO: 255308 - protein, 9 aa, Homo Sapiens
KWKDCKIRL

SEQ ID NO: 255309 - protein, 9 aa, Homo Sapiens
KKFYRKFCP

SEQ ID NO: 255310 - protein, 9 aa, Homo Sapiens
KDELLCYIC

SEQ ID NO: 255311 - protein, 9 aa, Homo Sapiens
KHCASHYSE

SEQ ID NO: 255312 - protein, 9 aa, Homo Sapiens
FYCKNITTF

SEQ ID NO: 255313 - protein, 9 aa, Homo Sapiens
DRLLGEKLQ

SEQ ID NO: 255314 - protein, 9 aa, Homo Sapiens
TAMFRPSVE

SEQ ID NO: 255315 - protein, 9 aa, Homo Sapiens
EDGEESPQK

SEQ ID NO: 255316 - protein, 9 aa, Homo Sapiens
EKAKNVFEK

SEQ ID NO: 255317 - protein, 9 aa, Homo Sapiens
DAPCDKTFI

SEQ ID NO: 255318 - protein, 9 aa, Homo Sapiens
RPRKGSKMR

SEQ ID NO: 255319 - protein, 9 aa, Homo Sapiens
LQVALKDVS

SEQ ID NO: 255320 - protein, 9 aa, Homo Sapiens
KNQERIIRE

SEQ ID NO: 255321 - protein, 9 aa, Homo Sapiens
GSIRICVSH

SEQ ID NO: 255322 - protein, 9 aa, Homo Sapiens
IANPCSNIP

SEQ ID NO: 255323 - protein, 9 aa, Homo Sapiens
APGTEEKLE

SEQ ID NO: 255324 - protein, 9 aa, Homo Sapiens
LKDTFNKTL

SEQ ID NO: 255325 - protein, 9 aa, Homo Sapiens
IKKRKKAAI

SEQ ID NO: 255326 - protein, 9 aa, Homo Sapiens
PFIFTYASH

SEQ ID NO: 255327 - protein, 9 aa, Homo Sapiens
ALPVCPDTM

SEQ ID NO: 255328 - protein, 9 aa, Homo Sapiens
YCEDGFKIT

SEQ ID NO: 255329 - protein, 9 aa, Homo Sapiens
NKDTEKESA

SEQ ID NO: 255330 - protein, 9 aa, Homo Sapiens
QHRDAKEAL

SEQ ID NO: 255331 - protein, 9 aa, Homo Sapiens
SNTSDSISA

SEQ ID NO: 255332 - protein, 9 aa, Homo Sapiens
RQSCPGDKL

SEQ ID NO: 255333 - protein, 9 aa, Homo Sapiens
KTNTSQESK

SEQ ID NO: 255334 - protein, 9 aa, Homo Sapiens
RYDVKTRTW

SEQ ID NO: 255335 - protein, 9 aa, Homo Sapiens
SFQRHMITH

SEQ ID NO: 255336 - protein, 9 aa, Homo Sapiens
WSNKLIAEQ

SEQ ID NO: 255337 - protein, 9 aa, Homo Sapiens
RTALKSLNK

SEQ ID NO: 255338 - protein, 9 aa, Homo Sapiens
RRFEKCGHD

SEQ ID NO: 255339 - protein, 9 aa, Homo Sapiens
DLNSNAIMS

SEQ ID NO: 255340 - protein, 9 aa, Homo Sapiens
VVISVEVFL

SEQ ID NO: 255341 - protein, 9 aa, Homo Sapiens
INYQIKIDA

SEQ ID NO: 255342 - protein, 9 aa, Homo Sapiens
PTPVRRHMV

SEQ ID NO: 255343 - protein, 9 aa, Homo Sapiens
ISEKMFEFL

SEQ ID NO: 255344 - protein, 9 aa, Homo Sapiens
TDIIDNDHE

SEQ ID NO: 255345 - protein, 9 aa, Homo Sapiens
DITPGPSQL

SEQ ID NO: 255346 - protein, 9 aa, Homo Sapiens
ELLGTLSPY

SEQ ID NO: 255347 - protein, 9 aa, Homo Sapiens
KKHEQPVEE

SEQ ID NO: 255348 - protein, 9 aa, Homo Sapiens
YVSSDGLGS

SEQ ID NO: 255349 - protein, 9 aa, Homo Sapiens
LFPDMWLFP

SEQ ID NO: 255350 - protein, 9 aa, Homo Sapiens
DYEALQAFK

SEQ ID NO: 255351 - protein, 9 aa, Homo Sapiens
AVLFLHYLG

SEQ ID NO: 255352 - protein, 9 aa, Homo Sapiens
ESGDLLSDL

SEQ ID NO: 255353 - protein, 9 aa, Homo Sapiens
AIGLLGGQT

SEQ ID NO: 255354 - protein, 9 aa, Homo Sapiens
VVWPIKDPS

SEQ ID NO: 255355 - protein, 9 aa, Homo Sapiens
NVLQKILEQ

SEQ ID NO: 255356 - protein, 9 aa, Homo Sapiens
SAEEREQLV

SEQ ID NO: 255357 - protein, 9 aa, Homo Sapiens
KNNYRRVPY

SEQ ID NO: 255358 - protein, 9 aa, Homo Sapiens
EQIHRMNEN

SEQ ID NO: 255359 - protein, 9 aa, Homo Sapiens
YIQLPGIDK

SEQ ID NO: 255360 - protein, 9 aa, Homo Sapiens
TKVVQNRCS

SEQ ID NO: 255361 - protein, 9 aa, Homo Sapiens
EAITLTDDF

SEQ ID NO: 255362 - protein, 9 aa, Homo Sapiens
IWLLGTTHA

SEQ ID NO: 255363 - protein, 9 aa, Homo Sapiens
ALLFISSTC

SEQ ID NO: 255364 - protein, 9 aa, Homo Sapiens
VCSQRGLVP

SEQ ID NO: 255365 - protein, 9 aa, Homo Sapiens
ERAKREMGM

SEQ ID NO: 255366 - protein, 9 aa, Homo Sapiens
EWGPGESYQ

SEQ ID NO: 255367 - protein, 9 aa, Homo Sapiens
WSHNNSPII

SEQ ID NO: 255368 - protein, 9 aa, Homo Sapiens
HCYEPSIYR

SEQ ID NO: 255369 - protein, 9 aa, Homo Sapiens
SPLVKIWNL

SEQ ID NO: 255370 - protein, 9 aa, Homo Sapiens
AFSLIREMR

SEQ ID NO: 255371 - protein, 9 aa, Homo Sapiens
SRLMDTFLI

SEQ ID NO: 255372 - protein, 9 aa, Homo Sapiens
AFPVNTGQK

SEQ ID NO: 255373 - protein, 9 aa, Homo Sapiens
SQEGNDYLY

SEQ ID NO: 255374 - protein, 9 aa, Homo Sapiens
VKTCNLPLL

SEQ ID NO: 255375 - protein, 9 aa, Homo Sapiens
FEHGGFPPE

SEQ ID NO: 255376 - protein, 9 aa, Homo Sapiens
VDRLLGILK

SEQ ID NO: 255377 - protein, 9 aa, Homo Sapiens
TTNRMLASS

SEQ ID NO: 255378 - protein, 9 aa, Homo Sapiens
GRPSSGQII

SEQ ID NO: 255379 - protein, 9 aa, Homo Sapiens
NQTTHLWND

SEQ ID NO: 255380 - protein, 9 aa, Homo Sapiens
ISSASLLVR

SEQ ID NO: 255381 - protein, 9 aa, Homo Sapiens
PCFIDTDTL

SEQ ID NO: 255382 - protein, 9 aa, Homo Sapiens
GDGNKPSIA

SEQ ID NO: 255383 - protein, 9 aa, Homo Sapiens
LAENITPER

SEQ ID NO: 255384 - protein, 9 aa, Homo Sapiens
GPMMLCVTG

SEQ ID NO: 255385 - protein, 9 aa, Homo Sapiens
YWLCDNCLL

SEQ ID NO: 255386 - protein, 9 aa, Homo Sapiens
TGEYSRNTK

SEQ ID NO: 255387 - protein, 9 aa, Homo Sapiens
VTVMLGGEP

SEQ ID NO: 255388 - protein, 9 aa, Homo Sapiens
TRTGPLMED

SEQ ID NO: 255389 - protein, 9 aa, Homo Sapiens
LRSLLGHPD

SEQ ID NO: 255390 - protein, 9 aa, Homo Sapiens
NSENPKNTD

SEQ ID NO: 255391 - protein, 9 aa, Homo Sapiens
LDELEEEVN

SEQ ID NO: 255392 - protein, 9 aa, Homo Sapiens
DNVFTSVRS

SEQ ID NO: 255393 - protein, 9 aa, Homo Sapiens
ASRFSQVFC

SEQ ID NO: 255394 - protein, 9 aa, Homo Sapiens
EEIKEHSLL

SEQ ID NO: 255395 - protein, 9 aa, Homo Sapiens
GTVMCMYLR

SEQ ID NO: 255396 - protein, 9 aa, Homo Sapiens
RLQEELNTN

SEQ ID NO: 255397 - protein, 9 aa, Homo Sapiens
RQHHRYLSH

SEQ ID NO: 255398 - protein, 9 aa, Homo Sapiens
QKPDSCPPV

SEQ ID NO: 255399 - protein, 9 aa, Homo Sapiens
LEEAVQLQC

SEQ ID NO: 255400 - protein, 9 aa, Homo Sapiens
LKFIAGFRV

SEQ ID NO: 255401 - protein, 9 aa, Homo Sapiens
ALEETSIPA

SEQ ID NO: 255402 - protein, 9 aa, Homo Sapiens
KIPVEAVNK

SEQ ID NO: 255403 - protein, 9 aa, Homo Sapiens
QAWKGSVSP

SEQ ID NO: 255404 - protein, 9 aa, Homo Sapiens
LIGSCVKIT

SEQ ID NO: 255405 - protein, 9 aa, Homo Sapiens
TNLYLERGG

SEQ ID NO: 255406 - protein, 9 aa, Homo Sapiens
TNSATGIFA

SEQ ID NO: 255407 - protein, 9 aa, Homo Sapiens
DALEVELGK

SEQ ID NO: 255408 - protein, 9 aa, Homo Sapiens
DDASERDFI

SEQ ID NO: 255409 - protein, 9 aa, Homo Sapiens
IKLSWLLAK

SEQ ID NO: 255410 - protein, 9 aa, Homo Sapiens
TGSKHLPDV

SEQ ID NO: 255411 - protein, 9 aa, Homo Sapiens
NQKPGTDEA

SEQ ID NO: 255412 - protein, 9 aa, Homo Sapiens
IHYRKDSPL

SEQ ID NO: 255413 - protein, 9 aa, Homo Sapiens
EMKELLSEG

SEQ ID NO: 255414 - protein, 9 aa, Homo Sapiens
IRKIGERAL

SEQ ID NO: 255415 - protein, 9 aa, Homo Sapiens
LLKATKLGL

SEQ ID NO: 255416 - protein, 9 aa, Homo Sapiens
RIHCIDILF

SEQ ID NO: 255417 - protein, 9 aa, Homo Sapiens
AYTSLLSNS

SEQ ID NO: 255418 - protein, 9 aa, Homo Sapiens
NLELPEDED

SEQ ID NO: 255419 - protein, 9 aa, Homo Sapiens
YKFIIQVLF

SEQ ID NO: 255420 - protein, 9 aa, Homo Sapiens
HISDKVSPS

SEQ ID NO: 255421 - protein, 9 aa, Homo Sapiens
VADLLSRCP

SEQ ID NO: 255422 - protein, 9 aa, Homo Sapiens
VNYRLSNAN

SEQ ID NO: 255423 - protein, 9 aa, Homo Sapiens
FKGPEIRKI

SEQ ID NO: 255424 - protein, 9 aa, Homo Sapiens
NQERIIREV

SEQ ID NO: 255425 - protein, 9 aa, Homo Sapiens
ALLNPLIAD

SEQ ID NO: 255426 - protein, 9 aa, Homo Sapiens
VLSLTSECT

SEQ ID NO: 255427 - protein, 9 aa, Homo Sapiens
YSVAMYGGV

SEQ ID NO: 255428 - protein, 9 aa, Homo Sapiens
CLLNLHSEE

SEQ ID NO: 255429 - protein, 9 aa, Homo Sapiens
HTDIQDIQK

SEQ ID NO: 255430 - protein, 9 aa, Homo Sapiens
PADFEAKII

SEQ ID NO: 255431 - protein, 9 aa, Homo Sapiens
YEQAAKNLA

SEQ ID NO: 255432 - protein, 9 aa, Homo Sapiens
SKRSHHSPA

SEQ ID NO: 255433 - protein, 9 aa, Homo Sapiens
DETNEIYDE

SEQ ID NO: 255434 - protein, 9 aa, Homo Sapiens
TQPPSYHNK

SEQ ID NO: 255435 - protein, 9 aa, Homo Sapiens
EDNRRWMRD

SEQ ID NO: 255436 - protein, 9 aa, Homo Sapiens
TPVDLWIVG

SEQ ID NO: 255437 - protein, 9 aa, Homo Sapiens
EIIEMDGSI

SEQ ID NO: 255438 - protein, 9 aa, Homo Sapiens
DLAPEPRLK

SEQ ID NO: 255439 - protein, 9 aa, Homo Sapiens
RKKLLDILQ

SEQ ID NO: 255440 - protein, 9 aa, Homo Sapiens
RSRLINTFS

SEQ ID NO: 255441 - protein, 9 aa, Homo Sapiens
IHKNGKGST

SEQ ID NO: 255442 - protein, 9 aa, Homo Sapiens
AVLQQANEN

SEQ ID NO: 255443 - protein, 9 aa, Homo Sapiens
GVCIYVDAV

SEQ ID NO: 255444 - protein, 9 aa, Homo Sapiens
RITVTGSSF

SEQ ID NO: 255445 - protein, 9 aa, Homo Sapiens
GPWGDYDNS

SEQ ID NO: 255446 - protein, 9 aa, Homo Sapiens
VMLALSLQV

SEQ ID NO: 255447 - protein, 9 aa, Homo Sapiens
AIFTPFFLW

SEQ ID NO: 255448 - protein, 9 aa, Homo Sapiens
EVADLLSRC

SEQ ID NO: 255449 - protein, 9 aa, Homo Sapiens
FILMLVLYV

SEQ ID NO: 255450 - protein, 9 aa, Homo Sapiens
SFWFHVVKV

SEQ ID NO: 255451 - protein, 9 aa, Homo Sapiens
KNYPSTRVM

SEQ ID NO: 255452 - protein, 9 aa, Homo Sapiens
HVFCLICID

SEQ ID NO: 255453 - protein, 9 aa, Homo Sapiens
FASCRIVHE

SEQ ID NO: 255454 - protein, 9 aa, Homo Sapiens
EVSSEYHMD

SEQ ID NO: 255455 - protein, 9 aa, Homo Sapiens
HTIGRKPPA

SEQ ID NO: 255456 - protein, 9 aa, Homo Sapiens
SMSLLSFYF

SEQ ID NO: 255457 - protein, 9 aa, Homo Sapiens
ELIITSYNA

SEQ ID NO: 255458 - protein, 9 aa, Homo Sapiens
GTTVQKSKE

SEQ ID NO: 255459 - protein, 9 aa, Homo Sapiens
IEPGEEIYC

SEQ ID NO: 255460 - protein, 9 aa, Homo Sapiens
ENLNMSDWE

SEQ ID NO: 255461 - protein, 9 aa, Homo Sapiens
DDNNNRTLD

SEQ ID NO: 255462 - protein, 9 aa, Homo Sapiens
LEEENQCKE

SEQ ID NO: 255463 - protein, 9 aa, Homo Sapiens
NGRWQQSLS

SEQ ID NO: 255464 - protein, 9 aa, Homo Sapiens
TTSNLPEEE

SEQ ID NO: 255465 - protein, 9 aa, Homo Sapiens
ITLMLNHLI

SEQ ID NO: 255466 - protein, 9 aa, Homo Sapiens
AQVLRHLFS

SEQ ID NO: 255467 - protein, 9 aa, Homo Sapiens
DSALSTRWG

SEQ ID NO: 255468 - protein, 9 aa, Homo Sapiens
GRKIADMQG

SEQ ID NO: 255469 - protein, 9 aa, Homo Sapiens
QEEIEFRNA

SEQ ID NO: 255470 - protein, 9 aa, Homo Sapiens
AASYFSLLQ

SEQ ID NO: 255471 - protein, 9 aa, Homo Sapiens
LLQHLSQLL

SEQ ID NO: 255472 - protein, 9 aa, Homo Sapiens
NNTFYETLP

SEQ ID NO: 255473 - protein, 9 aa, Homo Sapiens
DEKRKSLDV

SEQ ID NO: 255474 - protein, 9 aa, Homo Sapiens
YLYDEVAAQ

SEQ ID NO: 255475 - protein, 9 aa, Homo Sapiens
ISGNCRQRY

SEQ ID NO: 255476 - protein, 9 aa, Homo Sapiens
LQQLQSKIS

SEQ ID NO: 255477 - protein, 9 aa, Homo Sapiens
GSGLLAAIK

SEQ ID NO: 255478 - protein, 9 aa, Homo Sapiens
MKRHVMVAK

SEQ ID NO: 255479 - protein, 9 aa, Homo Sapiens
RSIRLMSVL

SEQ ID NO: 255480 - protein, 9 aa, Homo Sapiens
LSSSCKGMV

SEQ ID NO: 255481 - protein, 9 aa, Homo Sapiens
LLAHRLWRW

SEQ ID NO: 255482 - protein, 9 aa, Homo Sapiens
MKLPFTTPE

SEQ ID NO: 255483 - protein, 9 aa, Homo Sapiens
TRMKLTLLH

SEQ ID NO: 255484 - protein, 9 aa, Homo Sapiens
ISSPFPEVW

SEQ ID NO: 255485 - protein, 9 aa, Homo Sapiens
SSRVENDYN

SEQ ID NO: 255486 - protein, 9 aa, Homo Sapiens
TEDFSPWDP

SEQ ID NO: 255487 - protein, 9 aa, Homo Sapiens
GKKCRILAT

SEQ ID NO: 255488 - protein, 9 aa, Homo Sapiens
FRELPCLKS

SEQ ID NO: 255489 - protein, 9 aa, Homo Sapiens
TNPLYAIFV

SEQ ID NO: 255490 - protein, 9 aa, Homo Sapiens
KKGHKIKHF

SEQ ID NO: 255491 - protein, 9 aa, Homo Sapiens
SIEVELTNI

SEQ ID NO: 255492 - protein, 9 aa, Homo Sapiens
KGGKCRNVS

SEQ ID NO: 255493 - protein, 9 aa, Homo Sapiens
ALEQLEYGG

SEQ ID NO: 255494 - protein, 9 aa, Homo Sapiens
EQPTAGNVF

SEQ ID NO: 255495 - protein, 9 aa, Homo Sapiens
LITDTYKTI

SEQ ID NO: 255496 - protein, 9 aa, Homo Sapiens
LGAPAKSAV

SEQ ID NO: 255497 - protein, 9 aa, Homo Sapiens
IIPKLLDLP

SEQ ID NO: 255498 - protein, 9 aa, Homo Sapiens
HADDLLSSS

SEQ ID NO: 255499 - protein, 9 aa, Homo Sapiens
LSFHNLKCD

SEQ ID NO: 255500 - protein, 9 aa, Homo Sapiens
LPPNTVFKD

SEQ ID NO: 255501 - protein, 9 aa, Homo Sapiens
LFKRLTLKH

SEQ ID NO: 255502 - protein, 9 aa, Homo Sapiens
QSAALLGQM

SEQ ID NO: 255503 - protein, 9 aa, Homo Sapiens
VHERHLHNN

SEQ ID NO: 255504 - protein, 9 aa, Homo Sapiens
KAVFTEFLA

SEQ ID NO: 255505 - protein, 9 aa, Homo Sapiens
GQVGALHPA

SEQ ID NO: 255506 - protein, 9 aa, Homo Sapiens
KGRKWKVPD

SEQ ID NO: 255507 - protein, 9 aa, Homo Sapiens
TGRFVIEDI

SEQ ID NO: 255508 - protein, 9 aa, Homo Sapiens
LYAISARFK

SEQ ID NO: 255509 - protein, 9 aa, Homo Sapiens
LTEVLKEKT

SEQ ID NO: 255510 - protein, 9 aa, Homo Sapiens
SGEQNKKSV

SEQ ID NO: 255511 - protein, 9 aa, Homo Sapiens
ANSEKTNNR

SEQ ID NO: 255512 - protein, 9 aa, Homo Sapiens
PYRGKRNAN

SEQ ID NO: 255513 - protein, 9 aa, Homo Sapiens
HDRIKDVKR

SEQ ID NO: 255514 - protein, 9 aa, Homo Sapiens
TSHAIFNET

SEQ ID NO: 255515 - protein, 9 aa, Homo Sapiens
EGIGIFSVI

SEQ ID NO: 255516 - protein, 9 aa, Homo Sapiens
VTPITQGVE

SEQ ID NO: 255517 - protein, 9 aa, Homo Sapiens
ERDLKKSEA

SEQ ID NO: 255518 - protein, 9 aa, Homo Sapiens
KIWRPANVP

SEQ ID NO: 255519 - protein, 9 aa, Homo Sapiens
FDGKLKCWY

SEQ ID NO: 255520 - protein, 9 aa, Homo Sapiens
ILTNISSSL

SEQ ID NO: 255521 - protein, 9 aa, Homo Sapiens
TINVPPEEE

SEQ ID NO: 255522 - protein, 9 aa, Homo Sapiens
LLLLLLWPH

SEQ ID NO: 255523 - protein, 9 aa, Homo Sapiens
SSVRKSQGI

SEQ ID NO: 255524 - protein, 9 aa, Homo Sapiens
TTRRAVNSQ

SEQ ID NO: 255525 - protein, 9 aa, Homo Sapiens
RIPCMHLFH

SEQ ID NO: 255526 - protein, 9 aa, Homo Sapiens
DLQNNKITK

SEQ ID NO: 255527 - protein, 9 aa, Homo Sapiens
VFLNTLTVA

SEQ ID NO: 255528 - protein, 9 aa, Homo Sapiens
DLQRNQKRI

SEQ ID NO: 255529 - protein, 9 aa, Homo Sapiens
AVERLIMVA

SEQ ID NO: 255530 - protein, 9 aa, Homo Sapiens
MSLITLPIT

SEQ ID NO: 255531 - protein, 9 aa, Homo Sapiens
KLQHLVIPW

SEQ ID NO: 255532 - protein, 9 aa, Homo Sapiens
KAVASRLLE

SEQ ID NO: 255533 - protein, 9 aa, Homo Sapiens
LQIPMWSKR

SEQ ID NO: 255534 - protein, 9 aa, Homo Sapiens
PGMVRFREH

SEQ ID NO: 255535 - protein, 9 aa, Homo Sapiens
ATDCFGGIL

SEQ ID NO: 255536 - protein, 9 aa, Homo Sapiens
SFITQTPGE

SEQ ID NO: 255537 - protein, 9 aa, Homo Sapiens
YFCLGNLAF

SEQ ID NO: 255538 - protein, 9 aa, Homo Sapiens
AIENIQVRE

SEQ ID NO: 255539 - protein, 9 aa, Homo Sapiens
AIRCNLAPV

SEQ ID NO: 255540 - protein, 9 aa, Homo Sapiens
LSGVAQNNY

SEQ ID NO: 255541 - protein, 9 aa, Homo Sapiens
GRHRFSGRP

SEQ ID NO: 255542 - protein, 9 aa, Homo Sapiens
GLWTVPAMD

SEQ ID NO: 255543 - protein, 9 aa, Homo Sapiens
HVFWWPEGM

SEQ ID NO: 255544 - protein, 9 aa, Homo Sapiens
YSRVLAGGF

SEQ ID NO: 255545 - protein, 9 aa, Homo Sapiens
SGAFRKRHV

SEQ ID NO: 255546 - protein, 9 aa, Homo Sapiens
VKCTAQEIY

SEQ ID NO: 255547 - protein, 9 aa, Homo Sapiens
VYCFVNFTR

SEQ ID NO: 255548 - protein, 9 aa, Homo Sapiens
IYGFVIFLS

SEQ ID NO: 255549 - protein, 9 aa, Homo Sapiens
HILDEAERS

SEQ ID NO: 255550 - protein, 9 aa, Homo Sapiens
IEARWEQPQ

SEQ ID NO: 255551 - protein, 9 aa, Homo Sapiens
PYKKHRRKL

SEQ ID NO: 255552 - protein, 9 aa, Homo Sapiens
GFFGRHRFS

SEQ ID NO: 255553 - protein, 9 aa, Homo Sapiens
FSHAIQKEL

SEQ ID NO: 255554 - protein, 9 aa, Homo Sapiens
LAAMGCAFP

SEQ ID NO: 255555 - protein, 9 aa, Homo Sapiens
NISKKHDQQ

SEQ ID NO: 255556 - protein, 9 aa, Homo Sapiens
QIYIQLPGI

SEQ ID NO: 255557 - protein, 9 aa, Homo Sapiens
IREQIVKIY

SEQ ID NO: 255558 - protein, 9 aa, Homo Sapiens
LTFVSRYDG

SEQ ID NO: 255559 - protein, 9 aa, Homo Sapiens
RVANSLVTL

SEQ ID NO: 255560 - protein, 9 aa, Homo Sapiens
QETLKYLGR

SEQ ID NO: 255561 - protein, 9 aa, Homo Sapiens
PPGGTQPHS

SEQ ID NO: 255562 - protein, 9 aa, Homo Sapiens
KEDVPAWES

SEQ ID NO: 255563 - protein, 9 aa, Homo Sapiens
TNNIMLIAE

SEQ ID NO: 255564 - protein, 9 aa, Homo Sapiens
RLRTRKKRE

SEQ ID NO: 255565 - protein, 9 aa, Homo Sapiens
QKNAATEDI

SEQ ID NO: 255566 - protein, 9 aa, Homo Sapiens
PTSARRKLL

SEQ ID NO: 255567 - protein, 9 aa, Homo Sapiens
DTLREIVGA

SEQ ID NO: 255568 - protein, 9 aa, Homo Sapiens
RRRRLVQKR

SEQ ID NO: 255569 - protein, 9 aa, Homo Sapiens
IKVEEEQGY

SEQ ID NO: 255570 - protein, 9 aa, Homo Sapiens
LKHMKHEHV

SEQ ID NO: 255571 - protein, 9 aa, Homo Sapiens
SVNHTKRKS

SEQ ID NO: 255572 - protein, 9 aa, Homo Sapiens
FALRLSCAG

SEQ ID NO: 255573 - protein, 9 aa, Homo Sapiens
LINNFYFLF

SEQ ID NO: 255574 - protein, 9 aa, Homo Sapiens
NFYVANADY

SEQ ID NO: 255575 - protein, 9 aa, Homo Sapiens
IALVCKEPT

SEQ ID NO: 255576 - protein, 9 aa, Homo Sapiens
DMCVYQRGR

SEQ ID NO: 255577 - protein, 9 aa, Homo Sapiens
IDRSRPGSH

SEQ ID NO: 255578 - protein, 9 aa, Homo Sapiens
CEAPGTEEK

SEQ ID NO: 255579 - protein, 9 aa, Homo Sapiens
TVEELSRTK

SEQ ID NO: 255580 - protein, 9 aa, Homo Sapiens
PTARLTFQN

SEQ ID NO: 255581 - protein, 9 aa, Homo Sapiens
NWTSVSRFV

SEQ ID NO: 255582 - protein, 9 aa, Homo Sapiens
KAELKLLQK

SEQ ID NO: 255583 - protein, 9 aa, Homo Sapiens
FPSKSFWTR

SEQ ID NO: 255584 - protein, 9 aa, Homo Sapiens
YAVNSLQLK

SEQ ID NO: 255585 - protein, 9 aa, Homo Sapiens
YQPKPKQIQ

SEQ ID NO: 255586 - protein, 9 aa, Homo Sapiens
LRCLGLGTA

SEQ ID NO: 255587 - protein, 9 aa, Homo Sapiens
VLTHKQSYY

SEQ ID NO: 255588 - protein, 9 aa, Homo Sapiens
MFINASKQY

SEQ ID NO: 255589 - protein, 9 aa, Homo Sapiens
WSKSHFREW

SEQ ID NO: 255590 - protein, 9 aa, Homo Sapiens
EIESMEEVI

SEQ ID NO: 255591 - protein, 9 aa, Homo Sapiens
YYSELYKLV

SEQ ID NO: 255592 - protein, 9 aa, Homo Sapiens
IRFSLRLYE

SEQ ID NO: 255593 - protein, 9 aa, Homo Sapiens
GKCYCKPHF

SEQ ID NO: 255594 - protein, 9 aa, Homo Sapiens
VIRIIIARS

SEQ ID NO: 255595 - protein, 9 aa, Homo Sapiens
FRLDRREND

SEQ ID NO: 255596 - protein, 9 aa, Homo Sapiens
VRDTLREIV

SEQ ID NO: 255597 - protein, 9 aa, Homo Sapiens
KGGCKGHFA

SEQ ID NO: 255598 - protein, 9 aa, Homo Sapiens
YLTGLFGGY

SEQ ID NO: 255599 - protein, 9 aa, Homo Sapiens
AKVLTWGEE

SEQ ID NO: 255600 - protein, 9 aa, Homo Sapiens
AKMKQPKGS

SEQ ID NO: 255601 - protein, 9 aa, Homo Sapiens
SCYISCDRG

SEQ ID NO: 255602 - protein, 9 aa, Homo Sapiens
RIYSYSYLV

SEQ ID NO: 255603 - protein, 9 aa, Homo Sapiens
TSNCRKVPI

SEQ ID NO: 255604 - protein, 9 aa, Homo Sapiens
EYEYEDMEH

SEQ ID NO: 255605 - protein, 9 aa, Homo Sapiens
SLEKEASDD

SEQ ID NO: 255606 - protein, 9 aa, Homo Sapiens
FNTLQTKLW

SEQ ID NO: 255607 - protein, 9 aa, Homo Sapiens
QTYLYFFLG

SEQ ID NO: 255608 - protein, 9 aa, Homo Sapiens
GKLKKWNDY

SEQ ID NO: 255609 - protein, 9 aa, Homo Sapiens
VEETKLMGF

SEQ ID NO: 255610 - protein, 9 aa, Homo Sapiens
IPPEHSLET

SEQ ID NO: 255611 - protein, 9 aa, Homo Sapiens
NYPMAQTPP

SEQ ID NO: 255612 - protein, 9 aa, Homo Sapiens
NLSNSADDI

SEQ ID NO: 255613 - protein, 9 aa, Homo Sapiens
EESFNKTWD

SEQ ID NO: 255614 - protein, 9 aa, Homo Sapiens
FENDKEIKD

SEQ ID NO: 255615 - protein, 9 aa, Homo Sapiens
RENKDLHDK

SEQ ID NO: 255616 - protein, 9 aa, Homo Sapiens
STHADTCTP

SEQ ID NO: 255617 - protein, 9 aa, Homo Sapiens
LLAFISRCR

SEQ ID NO: 255618 - protein, 9 aa, Homo Sapiens
GMEVPDDSA

SEQ ID NO: 255619 - protein, 9 aa, Homo Sapiens
SRYGVSLCW

SEQ ID NO: 255620 - protein, 9 aa, Homo Sapiens
QINITDVAQ

SEQ ID NO: 255621 - protein, 9 aa, Homo Sapiens
LTMYIEMPY

SEQ ID NO: 255622 - protein, 9 aa, Homo Sapiens
DRKSRLEEQ

SEQ ID NO: 255623 - protein, 9 aa, Homo Sapiens
QKSKLVEEP

SEQ ID NO: 255624 - protein, 9 aa, Homo Sapiens
GGKLWSILR

SEQ ID NO: 255625 - protein, 9 aa, Homo Sapiens
TLMMDTQLS

SEQ ID NO: 255626 - protein, 9 aa, Homo Sapiens
TTLKVWDTN

SEQ ID NO: 255627 - protein, 9 aa, Homo Sapiens
VTLNLLPQL

SEQ ID NO: 255628 - protein, 9 aa, Homo Sapiens
ILAATFIHS

SEQ ID NO: 255629 - protein, 9 aa, Homo Sapiens
SIQPVTSLN

SEQ ID NO: 255630 - protein, 9 aa, Homo Sapiens
QMDDKKPRK

SEQ ID NO: 255631 - protein, 9 aa, Homo Sapiens
GVHSSTNEL

SEQ ID NO: 255632 - protein, 9 aa, Homo Sapiens
LLFDNLVYY

SEQ ID NO: 255633 - protein, 9 aa, Homo Sapiens
PVMFIKAIH

SEQ ID NO: 255634 - protein, 9 aa, Homo Sapiens
HSILITACS

SEQ ID NO: 255635 - protein, 9 aa, Homo Sapiens
ETDKEKDVR

SEQ ID NO: 255636 - protein, 9 aa, Homo Sapiens
ETSPSLLDD

SEQ ID NO: 255637 - protein, 9 aa, Homo Sapiens
DPLCSIKEK

SEQ ID NO: 255638 - protein, 9 aa, Homo Sapiens
QGKTSECDV

SEQ ID NO: 255639 - protein, 9 aa, Homo Sapiens
SEIDKIVQY

SEQ ID NO: 255640 - protein, 9 aa, Homo Sapiens
LHKQTERVI

SEQ ID NO: 255641 - protein, 9 aa, Homo Sapiens
RFGVQVLQD

SEQ ID NO: 255642 - protein, 9 aa, Homo Sapiens
GSVLSPEPP

SEQ ID NO: 255643 - protein, 9 aa, Homo Sapiens
YFTSHSTLI

SEQ ID NO: 255644 - protein, 9 aa, Homo Sapiens
LFCSRSFHN

SEQ ID NO: 255645 - protein, 9 aa, Homo Sapiens
NKHHNVHTA

SEQ ID NO: 255646 - protein, 9 aa, Homo Sapiens
SSDPHLGTT

SEQ ID NO: 255647 - protein, 9 aa, Homo Sapiens
VPNKDLEWK

SEQ ID NO: 255648 - protein, 9 aa, Homo Sapiens
KEQEELQVK

SEQ ID NO: 255649 - protein, 9 aa, Homo Sapiens
GNSSSIPCL

SEQ ID NO: 255650 - protein, 9 aa, Homo Sapiens
TVSTVLPQI

SEQ ID NO: 255651 - protein, 9 aa, Homo Sapiens
FSGSSFKMT

SEQ ID NO: 255652 - protein, 9 aa, Homo Sapiens
KEVRKKFSK

SEQ ID NO: 255653 - protein, 9 aa, Homo Sapiens
KADRPLIYF

SEQ ID NO: 255654 - protein, 9 aa, Homo Sapiens
LCRQEVNAC

SEQ ID NO: 255655 - protein, 9 aa, Homo Sapiens
SLLTCKITL

SEQ ID NO: 255656 - protein, 9 aa, Homo Sapiens
AIMHVSPTG

SEQ ID NO: 255657 - protein, 9 aa, Homo Sapiens
QHNRKQANL

SEQ ID NO: 255658 - protein, 9 aa, Homo Sapiens
IKVCRDKGW

SEQ ID NO: 255659 - protein, 9 aa, Homo Sapiens
IDPEGKTFD

SEQ ID NO: 255660 - protein, 9 aa, Homo Sapiens
PTRDLPRPQ

SEQ ID NO: 255661 - protein, 9 aa, Homo Sapiens
VLYCTFGDM

SEQ ID NO: 255662 - protein, 9 aa, Homo Sapiens
RASSISTVE

SEQ ID NO: 255663 - protein, 9 aa, Homo Sapiens
MHCKAGQST

SEQ ID NO: 255664 - protein, 9 aa, Homo Sapiens
DYRFSGSPL

SEQ ID NO: 255665 - protein, 9 aa, Homo Sapiens
HAYSTQSEK

SEQ ID NO: 255666 - protein, 9 aa, Homo Sapiens
GNQFTCSCD

SEQ ID NO: 255667 - protein, 9 aa, Homo Sapiens
LVKVDGGEV

SEQ ID NO: 255668 - protein, 9 aa, Homo Sapiens
ETLGALLSI

SEQ ID NO: 255669 - protein, 9 aa, Homo Sapiens
DSDMVSQAG

SEQ ID NO: 255670 - protein, 9 aa, Homo Sapiens
AICSYQWDV

SEQ ID NO: 255671 - protein, 9 aa, Homo Sapiens
KLRNSNLVA

SEQ ID NO: 255672 - protein, 9 aa, Homo Sapiens
GFTMPKKFV

SEQ ID NO: 255673 - protein, 9 aa, Homo Sapiens
QDCGIAQEI

SEQ ID NO: 255674 - protein, 9 aa, Homo Sapiens
ILRSKSLEK

SEQ ID NO: 255675 - protein, 9 aa, Homo Sapiens
GRGVQKLGC

SEQ ID NO: 255676 - protein, 9 aa, Homo Sapiens
EGKTFDRVS

SEQ ID NO: 255677 - protein, 9 aa, Homo Sapiens
LADMEEPPL

SEQ ID NO: 255678 - protein, 9 aa, Homo Sapiens
LSKCDNKCK

SEQ ID NO: 255679 - protein, 9 aa, Homo Sapiens
EIRQKITCK

SEQ ID NO: 255680 - protein, 9 aa, Homo Sapiens
VYFYMYTLF

SEQ ID NO: 255681 - protein, 9 aa, Homo Sapiens
LPCEQKLLC

SEQ ID NO: 255682 - protein, 9 aa, Homo Sapiens
SVHEDEVLA

SEQ ID NO: 255683 - protein, 9 aa, Homo Sapiens
LALLDYLLL

SEQ ID NO: 255684 - protein, 9 aa, Homo Sapiens
AFICSYQLT

SEQ ID NO: 255685 - protein, 9 aa, Homo Sapiens
GEQGYPGIP

SEQ ID NO: 255686 - protein, 9 aa, Homo Sapiens
LAPPAMLSV

SEQ ID NO: 255687 - protein, 9 aa, Homo Sapiens
TSAFNKEIT

SEQ ID NO: 255688 - protein, 9 aa, Homo Sapiens
QLEIKHIPS

SEQ ID NO: 255689 - protein, 9 aa, Homo Sapiens
DKVLKFGMT

SEQ ID NO: 255690 - protein, 9 aa, Homo Sapiens
TEEEPHNDN

SEQ ID NO: 255691 - protein, 9 aa, Homo Sapiens
VNSRLLKRS

SEQ ID NO: 255692 - protein, 9 aa, Homo Sapiens
ECGKSFGTL

SEQ ID NO: 255693 - protein, 9 aa, Homo Sapiens
CVQPDQEYF

SEQ ID NO: 255694 - protein, 9 aa, Homo Sapiens
SEIMFAKTL

SEQ ID NO: 255695 - protein, 9 aa, Homo Sapiens
YPRDVVNCS

SEQ ID NO: 255696 - protein, 9 aa, Homo Sapiens
PDSGENRKE

SEQ ID NO: 255697 - protein, 9 aa, Homo Sapiens
GVKTAIREC

SEQ ID NO: 255698 - protein, 9 aa, Homo Sapiens
KEYFKERDP

SEQ ID NO: 255699 - protein, 9 aa, Homo Sapiens
LLIEKLIDN

SEQ ID NO: 255700 - protein, 9 aa, Homo Sapiens
KKHTGKPST

SEQ ID NO: 255701 - protein, 9 aa, Homo Sapiens
EHKKIHIAE

SEQ ID NO: 255702 - protein, 9 aa, Homo Sapiens
WLNFTVITF

SEQ ID NO: 255703 - protein, 9 aa, Homo Sapiens
FPPVEAGKE

SEQ ID NO: 255704 - protein, 9 aa, Homo Sapiens
QSFSYKSSL

SEQ ID NO: 255705 - protein, 9 aa, Homo Sapiens
IAGGNVEDQ

SEQ ID NO: 255706 - protein, 9 aa, Homo Sapiens
NWPPGKMFS

SEQ ID NO: 255707 - protein, 9 aa, Homo Sapiens
KGEKELAEV

SEQ ID NO: 255708 - protein, 9 aa, Homo Sapiens
GGSEFFRNR

SEQ ID NO: 255709 - protein, 9 aa, Homo Sapiens
FQHFNSLID

SEQ ID NO: 255710 - protein, 9 aa, Homo Sapiens
QSQANQKAQ

SEQ ID NO: 255711 - protein, 9 aa, Homo Sapiens
MNAQLQLER

SEQ ID NO: 255712 - protein, 9 aa, Homo Sapiens
RHQTTKLLY

SEQ ID NO: 255713 - protein, 9 aa, Homo Sapiens
DKHARQAAC

SEQ ID NO: 255714 - protein, 9 aa, Homo Sapiens
FEHIGHAIN

SEQ ID NO: 255715 - protein, 9 aa, Homo Sapiens
TVLFWAPIM

SEQ ID NO: 255716 - protein, 9 aa, Homo Sapiens
GYVHSFVTH

SEQ ID NO: 255717 - protein, 9 aa, Homo Sapiens
FLLHHKHPE

SEQ ID NO: 255718 - protein, 9 aa, Homo Sapiens
VGTRHRALI

SEQ ID NO: 255719 - protein, 9 aa, Homo Sapiens
DCCKKCQDW

SEQ ID NO: 255720 - protein, 9 aa, Homo Sapiens
KITDYGKLY

SEQ ID NO: 255721 - protein, 9 aa, Homo Sapiens
HSFFSEIIS

SEQ ID NO: 255722 - protein, 9 aa, Homo Sapiens
RKIILASNL

SEQ ID NO: 255723 - protein, 9 aa, Homo Sapiens
DLSAFKFNQ

SEQ ID NO: 255724 - protein, 9 aa, Homo Sapiens
KDLKGGGGG

SEQ ID NO: 255725 - protein, 9 aa, Homo Sapiens
KDVAVVFTD

SEQ ID NO: 255726 - protein, 9 aa, Homo Sapiens
IKSPDRLAA

SEQ ID NO: 255727 - protein, 9 aa, Homo Sapiens
EMEDIAHRR

SEQ ID NO: 255728 - protein, 9 aa, Homo Sapiens
LTYFDSVFQ

SEQ ID NO: 255729 - protein, 9 aa, Homo Sapiens
PCIKHYHVK

SEQ ID NO: 255730 - protein, 9 aa, Homo Sapiens
SAVELRRNS

SEQ ID NO: 255731 - protein, 9 aa, Homo Sapiens
KKIRISIGS

SEQ ID NO: 255732 - protein, 9 aa, Homo Sapiens
HHHNEKKRN

SEQ ID NO: 255733 - protein, 9 aa, Homo Sapiens
ALVTYNTGT

SEQ ID NO: 255734 - protein, 9 aa, Homo Sapiens
TYIQANIPG

SEQ ID NO: 255735 - protein, 9 aa, Homo Sapiens
STYDQQHDS

SEQ ID NO: 255736 - protein, 9 aa, Homo Sapiens
ESKPKQECL

SEQ ID NO: 255737 - protein, 9 aa, Homo Sapiens
RTLSGIIES

SEQ ID NO: 255738 - protein, 9 aa, Homo Sapiens
SVSELIAET

SEQ ID NO: 255739 - protein, 9 aa, Homo Sapiens
RGMHPRANI

SEQ ID NO: 255740 - protein, 9 aa, Homo Sapiens
ATAQINNLM

SEQ ID NO: 255741 - protein, 9 aa, Homo Sapiens
MMDKYEKIG

SEQ ID NO: 255742 - protein, 9 aa, Homo Sapiens
WFSHHLSNV

SEQ ID NO: 255743 - protein, 9 aa, Homo Sapiens
SLASSLRIM

SEQ ID NO: 255744 - protein, 9 aa, Homo Sapiens
QHLLSCSFP

SEQ ID NO: 255745 - protein, 9 aa, Homo Sapiens
HWHWSSGSL

SEQ ID NO: 255746 - protein, 9 aa, Homo Sapiens
GEGSPAAIP

SEQ ID NO: 255747 - protein, 9 aa, Homo Sapiens
IIIININPK

SEQ ID NO: 255748 - protein, 9 aa, Homo Sapiens
PFRFAPSSA

SEQ ID NO: 255749 - protein, 9 aa, Homo Sapiens
SASAIPMVS

SEQ ID NO: 255750 - protein, 9 aa, Homo Sapiens
YASMQALMH

SEQ ID NO: 255751 - protein, 9 aa, Homo Sapiens
NSECSQSGK

SEQ ID NO: 255752 - protein, 9 aa, Homo Sapiens
DRSGIENVS

SEQ ID NO: 255753 - protein, 9 aa, Homo Sapiens
EAVVDFGKT

SEQ ID NO: 255754 - protein, 9 aa, Homo Sapiens
VVRIYISRL

SEQ ID NO: 255755 - protein, 9 aa, Homo Sapiens
TLESPFKYG

SEQ ID NO: 255756 - protein, 9 aa, Homo Sapiens
YYDRMDYDD

SEQ ID NO: 255757 - protein, 9 aa, Homo Sapiens
ERGPQMCRC

SEQ ID NO: 255758 - protein, 9 aa, Homo Sapiens
LLRKHNLIS

SEQ ID NO: 255759 - protein, 9 aa, Homo Sapiens
KDVDHLFQN

SEQ ID NO: 255760 - protein, 9 aa, Homo Sapiens
FQVIFTDCK

SEQ ID NO: 255761 - protein, 9 aa, Homo Sapiens
CDCIIISDS

SEQ ID NO: 255762 - protein, 9 aa, Homo Sapiens
NEIIADVDD

SEQ ID NO: 255763 - protein, 9 aa, Homo Sapiens
ANPCSNIPY

SEQ ID NO: 255764 - protein, 9 aa, Homo Sapiens
QIKNEEIAF

SEQ ID NO: 255765 - protein, 9 aa, Homo Sapiens
HTFHLEATE

SEQ ID NO: 255766 - protein, 9 aa, Homo Sapiens
PKTDNMVNH

SEQ ID NO: 255767 - protein, 9 aa, Homo Sapiens
SNNMKVVKT

SEQ ID NO: 255768 - protein, 9 aa, Homo Sapiens
SQGITAAFK

SEQ ID NO: 255769 - protein, 9 aa, Homo Sapiens
EQSTYDQQH

SEQ ID NO: 255770 - protein, 9 aa, Homo Sapiens
ECENVSIKK

SEQ ID NO: 255771 - protein, 9 aa, Homo Sapiens
GPELLRKKH

SEQ ID NO: 255772 - protein, 9 aa, Homo Sapiens
KTQQYVRAD

SEQ ID NO: 255773 - protein, 9 aa, Homo Sapiens
ANRLSEHIV

SEQ ID NO: 255774 - protein, 9 aa, Homo Sapiens
KLPLLNGGL

SEQ ID NO: 255775 - protein, 9 aa, Homo Sapiens
MIWAIILKR

SEQ ID NO: 255776 - protein, 9 aa, Homo Sapiens
FSVRLLKLS

SEQ ID NO: 255777 - protein, 9 aa, Homo Sapiens
EITINGPQS

SEQ ID NO: 255778 - protein, 9 aa, Homo Sapiens
DLKKSEAAS

SEQ ID NO: 255779 - protein, 9 aa, Homo Sapiens
VPDKEPNST

SEQ ID NO: 255780 - protein, 9 aa, Homo Sapiens
NDSLRRDIK

SEQ ID NO: 255781 - protein, 9 aa, Homo Sapiens
PPKPALEAG

SEQ ID NO: 255782 - protein, 9 aa, Homo Sapiens
TDVAQVEIR

SEQ ID NO: 255783 - protein, 9 aa, Homo Sapiens
NPLSQDEGI

SEQ ID NO: 255784 - protein, 9 aa, Homo Sapiens
SSSRTLFFQ

SEQ ID NO: 255785 - protein, 9 aa, Homo Sapiens
YFILPCDVT

SEQ ID NO: 255786 - protein, 9 aa, Homo Sapiens
VSQPPPVYL

SEQ ID NO: 255787 - protein, 9 aa, Homo Sapiens
THLQGVAAS

SEQ ID NO: 255788 - protein, 9 aa, Homo Sapiens
LKTINYAGL

SEQ ID NO: 255789 - protein, 9 aa, Homo Sapiens
ITSILYYYF

SEQ ID NO: 255790 - protein, 9 aa, Homo Sapiens
IRITSDISP

SEQ ID NO: 255791 - protein, 9 aa, Homo Sapiens
GAGATPRTR

SEQ ID NO: 255792 - protein, 9 aa, Homo Sapiens
STLDYLDFA

SEQ ID NO: 255793 - protein, 9 aa, Homo Sapiens
GHLQGLFIL

SEQ ID NO: 255794 - protein, 9 aa, Homo Sapiens
MGPKRFCRS

SEQ ID NO: 255795 - protein, 9 aa, Homo Sapiens
QNYTYNVST

SEQ ID NO: 255796 - protein, 9 aa, Homo Sapiens
YVFYTILTP

SEQ ID NO: 255797 - protein, 9 aa, Homo Sapiens
AIAAGYRHF

SEQ ID NO: 255798 - protein, 9 aa, Homo Sapiens
EKEGIVKQE

SEQ ID NO: 255799 - protein, 9 aa, Homo Sapiens
NSCHSCTCG

SEQ ID NO: 255800 - protein, 9 aa, Homo Sapiens
QRITVADQG

SEQ ID NO: 255801 - protein, 9 aa, Homo Sapiens
THGTSPEDH

SEQ ID NO: 255802 - protein, 9 aa, Homo Sapiens
LSECGAPRW

SEQ ID NO: 255803 - protein, 9 aa, Homo Sapiens
DKAIKQCLW

SEQ ID NO: 255804 - protein, 9 aa, Homo Sapiens
KNVDSIIED

SEQ ID NO: 255805 - protein, 9 aa, Homo Sapiens
IVTRSRADA

SEQ ID NO: 255806 - protein, 9 aa, Homo Sapiens
ILCDKLSGH

SEQ ID NO: 255807 - protein, 9 aa, Homo Sapiens
LEDPSISFS

SEQ ID NO: 255808 - protein, 9 aa, Homo Sapiens
DESLCGRTL

SEQ ID NO: 255809 - protein, 9 aa, Homo Sapiens
CACLLTPLP

SEQ ID NO: 255810 - protein, 9 aa, Homo Sapiens
LCRSMRLLH

SEQ ID NO: 255811 - protein, 9 aa, Homo Sapiens
QIPLPAQQS

SEQ ID NO: 255812 - protein, 9 aa, Homo Sapiens
KTVKHKLQA

SEQ ID NO: 255813 - protein, 9 aa, Homo Sapiens
ASENLGELS

SEQ ID NO: 255814 - protein, 9 aa, Homo Sapiens
VDSGSPSLL

SEQ ID NO: 255815 - protein, 9 aa, Homo Sapiens
IQPVTSLNS

SEQ ID NO: 255816 - protein, 9 aa, Homo Sapiens
VETIEKGKD

SEQ ID NO: 255817 - protein, 9 aa, Homo Sapiens
IINGEIIPM

SEQ ID NO: 255818 - protein, 9 aa, Homo Sapiens
LPEYDRYLT

SEQ ID NO: 255819 - protein, 9 aa, Homo Sapiens
DKPFKCEQC

SEQ ID NO: 255820 - protein, 9 aa, Homo Sapiens
GKNLTINTE

SEQ ID NO: 255821 - protein, 9 aa, Homo Sapiens
NFLSVRGTT

SEQ ID NO: 255822 - protein, 9 aa, Homo Sapiens
QLDEELRRE

SEQ ID NO: 255823 - protein, 9 aa, Homo Sapiens
RDNSKKTTT

SEQ ID NO: 255824 - protein, 9 aa, Homo Sapiens
QCKESSSFK

SEQ ID NO: 255825 - protein, 9 aa, Homo Sapiens
QTKNHKLAE

SEQ ID NO: 255826 - protein, 9 aa, Homo Sapiens
VVDLLSNIN

SEQ ID NO: 255827 - protein, 9 aa, Homo Sapiens
DCCDGTDKY

SEQ ID NO: 255828 - protein, 9 aa, Homo Sapiens
YHNTDLSEI

SEQ ID NO: 255829 - protein, 9 aa, Homo Sapiens
PHFVRSEFY

SEQ ID NO: 255830 - protein, 9 aa, Homo Sapiens
PPLRWGPLW

SEQ ID NO: 255831 - protein, 9 aa, Homo Sapiens
ANNFTFNDD

SEQ ID NO: 255832 - protein, 9 aa, Homo Sapiens
TPTFIILGF

SEQ ID NO: 255833 - protein, 9 aa, Homo Sapiens
ENVGAFNKV

SEQ ID NO: 255834 - protein, 9 aa, Homo Sapiens
FAYYTLLKK

SEQ ID NO: 255835 - protein, 9 aa, Homo Sapiens
DSVILSVKL

SEQ ID NO: 255836 - protein, 9 aa, Homo Sapiens
SYQSLAPLM

SEQ ID NO: 255837 - protein, 9 aa, Homo Sapiens
YQLLEKKTT

SEQ ID NO: 255838 - protein, 9 aa, Homo Sapiens
LDNGNNSVQ

SEQ ID NO: 255839 - protein, 9 aa, Homo Sapiens
HNTDTVVDF

SEQ ID NO: 255840 - protein, 9 aa, Homo Sapiens
FVLKSLVNN

SEQ ID NO: 255841 - protein, 9 aa, Homo Sapiens
IRDDGNMPD

SEQ ID NO: 255842 - protein, 9 aa, Homo Sapiens
NLFGSNAQY

SEQ ID NO: 255843 - protein, 9 aa, Homo Sapiens
ESSREQEYL

SEQ ID NO: 255844 - protein, 9 aa, Homo Sapiens
ILSFFTILI

SEQ ID NO: 255845 - protein, 9 aa, Homo Sapiens
TCHSFFQHF

SEQ ID NO: 255846 - protein, 9 aa, Homo Sapiens
EYSVHICGM

SEQ ID NO: 255847 - protein, 9 aa, Homo Sapiens
VAHVCNPRT

SEQ ID NO: 255848 - protein, 9 aa, Homo Sapiens
ENEAYHPAE

SEQ ID NO: 255849 - protein, 9 aa, Homo Sapiens
PRFHEVPIP

SEQ ID NO: 255850 - protein, 9 aa, Homo Sapiens
HPGWSTMAR

SEQ ID NO: 255851 - protein, 9 aa, Homo Sapiens
SPNKYYLAE

SEQ ID NO: 255852 - protein, 9 aa, Homo Sapiens
REFNLLDPR

SEQ ID NO: 255853 - protein, 9 aa, Homo Sapiens
EFSPGSNKL

SEQ ID NO: 255854 - protein, 9 aa, Homo Sapiens
LVTKLNQLP

SEQ ID NO: 255855 - protein, 9 aa, Homo Sapiens
LTKTSNLSE

SEQ ID NO: 255856 - protein, 9 aa, Homo Sapiens
SNIPYFCLP

SEQ ID NO: 255857 - protein, 9 aa, Homo Sapiens
HIYIAKGCN

SEQ ID NO: 255858 - protein, 9 aa, Homo Sapiens
ARAVMLQGV

SEQ ID NO: 255859 - protein, 9 aa, Homo Sapiens
RLFGETLSC

SEQ ID NO: 255860 - protein, 9 aa, Homo Sapiens
FKRRFKETF

SEQ ID NO: 255861 - protein, 9 aa, Homo Sapiens
YMYTLFGLQ

SEQ ID NO: 255862 - protein, 9 aa, Homo Sapiens
KEGVDGNFI

SEQ ID NO: 255863 - protein, 9 aa, Homo Sapiens
ISEKKTISF

SEQ ID NO: 255864 - protein, 9 aa, Homo Sapiens
RINRLALLI

SEQ ID NO: 255865 - protein, 9 aa, Homo Sapiens
DPLLKNQEC

SEQ ID NO: 255866 - protein, 9 aa, Homo Sapiens
IHEIIHTGE

SEQ ID NO: 255867 - protein, 9 aa, Homo Sapiens
DRDEEDIGA

SEQ ID NO: 255868 - protein, 9 aa, Homo Sapiens
KYFVNMNIS

SEQ ID NO: 255869 - protein, 9 aa, Homo Sapiens
DSSAMVGGD

SEQ ID NO: 255870 - protein, 9 aa, Homo Sapiens
IHYFPTEIL

SEQ ID NO: 255871 - protein, 9 aa, Homo Sapiens
GLRMEEIIF

SEQ ID NO: 255872 - protein, 9 aa, Homo Sapiens
KTQVTHNPG

SEQ ID NO: 255873 - protein, 9 aa, Homo Sapiens
VNWIIKQEP

SEQ ID NO: 255874 - protein, 9 aa, Homo Sapiens
GREVKIYCQ

SEQ ID NO: 255875 - protein, 9 aa, Homo Sapiens
IMVVTAAVL

SEQ ID NO: 255876 - protein, 9 aa, Homo Sapiens
EYNVFPRTR

SEQ ID NO: 255877 - protein, 9 aa, Homo Sapiens
PSTDSCDRY

SEQ ID NO: 255878 - protein, 9 aa, Homo Sapiens
KTWQDEDGK

SEQ ID NO: 255879 - protein, 9 aa, Homo Sapiens
PLWEKSKGY

SEQ ID NO: 255880 - protein, 9 aa, Homo Sapiens
EEDPLHSGD

SEQ ID NO: 255881 - protein, 9 aa, Homo Sapiens
RSRVHTFLS

SEQ ID NO: 255882 - protein, 9 aa, Homo Sapiens
RGRPDISLD

SEQ ID NO: 255883 - protein, 9 aa, Homo Sapiens
FEWIRRALR

SEQ ID NO: 255884 - protein, 9 aa, Homo Sapiens
VRERLRASL

SEQ ID NO: 255885 - protein, 9 aa, Homo Sapiens
INTFSLIEH

SEQ ID NO: 255886 - protein, 9 aa, Homo Sapiens
KQKKKTNNF

SEQ ID NO: 255887 - protein, 9 aa, Homo Sapiens
LKNGALSQG

SEQ ID NO: 255888 - protein, 9 aa, Homo Sapiens
LKPLIPGLS

SEQ ID NO: 255889 - protein, 9 aa, Homo Sapiens
HTGSMLQLT

SEQ ID NO: 255890 - protein, 9 aa, Homo Sapiens
KPLQQQLSV

SEQ ID NO: 255891 - protein, 9 aa, Homo Sapiens
TWKVVSSEN

SEQ ID NO: 255892 - protein, 9 aa, Homo Sapiens
MQVRQRAVA

SEQ ID NO: 255893 - protein, 9 aa, Homo Sapiens
MNVDTFLIV

SEQ ID NO: 255894 - protein, 9 aa, Homo Sapiens
LNYVIYTNT

SEQ ID NO: 255895 - protein, 9 aa, Homo Sapiens
QGPMPADML

SEQ ID NO: 255896 - protein, 9 aa, Homo Sapiens
TKLLASKSR

SEQ ID NO: 255897 - protein, 9 aa, Homo Sapiens
AYGSQIMGG

SEQ ID NO: 255898 - protein, 9 aa, Homo Sapiens
LAQYVGSFP

SEQ ID NO: 255899 - protein, 9 aa, Homo Sapiens
NVNYLRKII

SEQ ID NO: 255900 - protein, 9 aa, Homo Sapiens
FTIIRVSQE

SEQ ID NO: 255901 - protein, 9 aa, Homo Sapiens
RFIFLGKSL

SEQ ID NO: 255902 - protein, 9 aa, Homo Sapiens
PGPHTTAAP

SEQ ID NO: 255903 - protein, 9 aa, Homo Sapiens
YEFLGATNN

SEQ ID NO: 255904 - protein, 9 aa, Homo Sapiens
HSSLFGFVL

SEQ ID NO: 255905 - protein, 9 aa, Homo Sapiens
EERSSFEIN

SEQ ID NO: 255906 - protein, 9 aa, Homo Sapiens
EKTYSLLQA

SEQ ID NO: 255907 - protein, 9 aa, Homo Sapiens
GIDMKQEMD

SEQ ID NO: 255908 - protein, 9 aa, Homo Sapiens
RLVQKRKKD

SEQ ID NO: 255909 - protein, 9 aa, Homo Sapiens
QGLTTQDLQ

SEQ ID NO: 255910 - protein, 9 aa, Homo Sapiens
FCKYKKNSG

SEQ ID NO: 255911 - protein, 9 aa, Homo Sapiens
WKLAPALAC

SEQ ID NO: 255912 - protein, 9 aa, Homo Sapiens
HSTTLYVAD

SEQ ID NO: 255913 - protein, 9 aa, Homo Sapiens
LEKVLKEID

SEQ ID NO: 255914 - protein, 9 aa, Homo Sapiens
EVEVDVAQV

SEQ ID NO: 255915 - protein, 9 aa, Homo Sapiens
LHWYCPVLR

SEQ ID NO: 255916 - protein, 9 aa, Homo Sapiens
SKEVKAALK

SEQ ID NO: 255917 - protein, 9 aa, Homo Sapiens
DMEEPPLLP

SEQ ID NO: 255918 - protein, 9 aa, Homo Sapiens
EYDNSPTAL

SEQ ID NO: 255919 - protein, 9 aa, Homo Sapiens
EPISFTPNY

SEQ ID NO: 255920 - protein, 9 aa, Homo Sapiens
GSISIYTSS

SEQ ID NO: 255921 - protein, 9 aa, Homo Sapiens
FSYESGVKY

SEQ ID NO: 255922 - protein, 9 aa, Homo Sapiens
SAGKVRDMN

SEQ ID NO: 255923 - protein, 9 aa, Homo Sapiens
VASGANGSE

SEQ ID NO: 255924 - protein, 9 aa, Homo Sapiens
FLVTFLLAW

SEQ ID NO: 255925 - protein, 9 aa, Homo Sapiens
ATFRAVDSS

SEQ ID NO: 255926 - protein, 9 aa, Homo Sapiens
GGSGENGWV

SEQ ID NO: 255927 - protein, 9 aa, Homo Sapiens
TNSSRIEAI

SEQ ID NO: 255928 - protein, 9 aa, Homo Sapiens
ADVTLGNTV

SEQ ID NO: 255929 - protein, 9 aa, Homo Sapiens
INEEACNMP

SEQ ID NO: 255930 - protein, 9 aa, Homo Sapiens
DGSCESENS

SEQ ID NO: 255931 - protein, 9 aa, Homo Sapiens
LCDPTEPCI

SEQ ID NO: 255932 - protein, 9 aa, Homo Sapiens
CFISPYLNP

SEQ ID NO: 255933 - protein, 9 aa, Homo Sapiens
YSLSFTKNT

SEQ ID NO: 255934 - protein, 9 aa, Homo Sapiens
EQNIGKVVH

SEQ ID NO: 255935 - protein, 9 aa, Homo Sapiens
IHSYIKEIK

SEQ ID NO: 255936 - protein, 9 aa, Homo Sapiens
ALPVFNPMS

SEQ ID NO: 255937 - protein, 9 aa, Homo Sapiens
WFHVVKVYN

SEQ ID NO: 255938 - protein, 9 aa, Homo Sapiens
IIALAINSG

SEQ ID NO: 255939 - protein, 9 aa, Homo Sapiens
YSMQGLCTF

SEQ ID NO: 255940 - protein, 9 aa, Homo Sapiens
AQWANSFDP

SEQ ID NO: 255941 - protein, 9 aa, Homo Sapiens
HRALIRIMV

SEQ ID NO: 255942 - protein, 9 aa, Homo Sapiens
ERMLAAATS

SEQ ID NO: 255943 - protein, 9 aa, Homo Sapiens
QSGSSASSS

SEQ ID NO: 255944 - protein, 9 aa, Homo Sapiens
AYFIPFLPL

SEQ ID NO: 255945 - protein, 9 aa, Homo Sapiens
LSSLNNSAN

SEQ ID NO: 255946 - protein, 9 aa, Homo Sapiens
SLSFQDVTV

SEQ ID NO: 255947 - protein, 9 aa, Homo Sapiens
QVHADDLLS

SEQ ID NO: 255948 - protein, 9 aa, Homo Sapiens
LPLTGGRGK

SEQ ID NO: 255949 - protein, 9 aa, Homo Sapiens
SIRGFTMPK

SEQ ID NO: 255950 - protein, 9 aa, Homo Sapiens
WEVGTGAES

SEQ ID NO: 255951 - protein, 9 aa, Homo Sapiens
STSVGFFFH

SEQ ID NO: 255952 - protein, 9 aa, Homo Sapiens
RSMNDIYLT

SEQ ID NO: 255953 - protein, 9 aa, Homo Sapiens
RPDPQRPLP

SEQ ID NO: 255954 - protein, 9 aa, Homo Sapiens
EEQLTANTL

SEQ ID NO: 255955 - protein, 9 aa, Homo Sapiens
HLCHTLRDV

SEQ ID NO: 255956 - protein, 9 aa, Homo Sapiens
LHQNLQRQF

SEQ ID NO: 255957 - protein, 9 aa, Homo Sapiens
LGGTSLQIA

SEQ ID NO: 255958 - protein, 9 aa, Homo Sapiens
QEIDETNEI

SEQ ID NO: 255959 - protein, 9 aa, Homo Sapiens
IVDEVMGCF

SEQ ID NO: 255960 - protein, 9 aa, Homo Sapiens
KDELQSEIN

SEQ ID NO: 255961 - protein, 9 aa, Homo Sapiens
EQTISDEES

SEQ ID NO: 255962 - protein, 9 aa, Homo Sapiens
EREIWNQTS

SEQ ID NO: 255963 - protein, 9 aa, Homo Sapiens
LTDRGKKTE

SEQ ID NO: 255964 - protein, 9 aa, Homo Sapiens
DLLTSALDI

SEQ ID NO: 255965 - protein, 9 aa, Homo Sapiens
RDIAPPERG

SEQ ID NO: 255966 - protein, 9 aa, Homo Sapiens
SNSGCKIWV

SEQ ID NO: 255967 - protein, 9 aa, Homo Sapiens
LLSCDLQES

SEQ ID NO: 255968 - protein, 9 aa, Homo Sapiens
YSWTETLIL

SEQ ID NO: 255969 - protein, 9 aa, Homo Sapiens
TYDRRTQER

SEQ ID NO: 255970 - protein, 9 aa, Homo Sapiens
PEFPVLEWG

SEQ ID NO: 255971 - protein, 9 aa, Homo Sapiens
KLNQLPVEL

SEQ ID NO: 255972 - protein, 9 aa, Homo Sapiens
CDLVWSAPE

SEQ ID NO: 255973 - protein, 9 aa, Homo Sapiens
TLDEFLNKP

SEQ ID NO: 255974 - protein, 9 aa, Homo Sapiens
TYSLLQALD

SEQ ID NO: 255975 - protein, 9 aa, Homo Sapiens
DYHMKYRDS

SEQ ID NO: 255976 - protein, 9 aa, Homo Sapiens
PYNSIITTH

SEQ ID NO: 255977 - protein, 9 aa, Homo Sapiens
INTFENVDE

SEQ ID NO: 255978 - protein, 9 aa, Homo Sapiens
PFDAQSPLY

SEQ ID NO: 255979 - protein, 9 aa, Homo Sapiens
KRASVIWIG

SEQ ID NO: 255980 - protein, 9 aa, Homo Sapiens
IVHSQTYTT

SEQ ID NO: 255981 - protein, 9 aa, Homo Sapiens
TIPLPQAQV

SEQ ID NO: 255982 - protein, 9 aa, Homo Sapiens
LTAHKIIHN

SEQ ID NO: 255983 - protein, 9 aa, Homo Sapiens
LKISDGVQH

SEQ ID NO: 255984 - protein, 9 aa, Homo Sapiens
YPGYLQIVR

SEQ ID NO: 255985 - protein, 9 aa, Homo Sapiens
LAPKQETSI

SEQ ID NO: 255986 - protein, 9 aa, Homo Sapiens
AQDMQEKLQ

SEQ ID NO: 255987 - protein, 9 aa, Homo Sapiens
ITPECVKGV

SEQ ID NO: 255988 - protein, 9 aa, Homo Sapiens
NNRYDITNN

SEQ ID NO: 255989 - protein, 9 aa, Homo Sapiens
PSNNRQIHT

SEQ ID NO: 255990 - protein, 9 aa, Homo Sapiens
YFSRYGVSL

SEQ ID NO: 255991 - protein, 9 aa, Homo Sapiens
KLLASKSRE

SEQ ID NO: 255992 - protein, 9 aa, Homo Sapiens
PEVCKTMCK

SEQ ID NO: 255993 - protein, 9 aa, Homo Sapiens
YTVCQEVKT

SEQ ID NO: 255994 - protein, 9 aa, Homo Sapiens
PTQPPSYHN

SEQ ID NO: 255995 - protein, 9 aa, Homo Sapiens
MCHLTVQIN

SEQ ID NO: 255996 - protein, 9 aa, Homo Sapiens
ESTFSHLRY

SEQ ID NO: 255997 - protein, 9 aa, Homo Sapiens
HTGEKHFSC

SEQ ID NO: 255998 - protein, 9 aa, Homo Sapiens
RMMEILSET

SEQ ID NO: 255999 - protein, 9 aa, Homo Sapiens
QSRPYHIYP

SEQ ID NO: 256000 - protein, 9 aa, Homo Sapiens
YYHRFGMTR

SEQ ID NO: 256001 - protein, 9 aa, Homo Sapiens
QMLTKENSR

SEQ ID NO: 256002 - protein, 9 aa, Homo Sapiens
PSFDQPHQT

SEQ ID NO: 256003 - protein, 9 aa, Homo Sapiens
RLVWLGLDL

SEQ ID NO: 256004 - protein, 9 aa, Homo Sapiens
DFEAKIIEA

SEQ ID NO: 256005 - protein, 9 aa, Homo Sapiens
WKGSVSPTF

SEQ ID NO: 256006 - protein, 9 aa, Homo Sapiens
TPKIIEYPL

SEQ ID NO: 256007 - protein, 9 aa, Homo Sapiens
NNSTGSGRG

SEQ ID NO: 256008 - protein, 9 aa, Homo Sapiens
EKGFKDKLS

SEQ ID NO: 256009 - protein, 9 aa, Homo Sapiens
SRPLDYTFA

SEQ ID NO: 256010 - protein, 9 aa, Homo Sapiens
CEKAFSQYS

SEQ ID NO: 256011 - protein, 9 aa, Homo Sapiens
ILLTIIAIV

SEQ ID NO: 256012 - protein, 9 aa, Homo Sapiens
KCGKSFSRR

SEQ ID NO: 256013 - protein, 9 aa, Homo Sapiens
TPEVLHFDE

SEQ ID NO: 256014 - protein, 9 aa, Homo Sapiens
YFCHCRNIG

SEQ ID NO: 256015 - protein, 9 aa, Homo Sapiens
NCESRADNF

SEQ ID NO: 256016 - protein, 9 aa, Homo Sapiens
VKEEIINEN

SEQ ID NO: 256017 - protein, 9 aa, Homo Sapiens
LANVVKSHK

SEQ ID NO: 256018 - protein, 9 aa, Homo Sapiens
LLSEGESEH

SEQ ID NO: 256019 - protein, 9 aa, Homo Sapiens
PRYRSRTSF

SEQ ID NO: 256020 - protein, 9 aa, Homo Sapiens
QLYGRKFSK

SEQ ID NO: 256021 - protein, 9 aa, Homo Sapiens
GMVGCFGMG

SEQ ID NO: 256022 - protein, 9 aa, Homo Sapiens
VNEQWILTA

SEQ ID NO: 256023 - protein, 9 aa, Homo Sapiens
FTANEDICP

SEQ ID NO: 256024 - protein, 9 aa, Homo Sapiens
RYLLPCSHV

SEQ ID NO: 256025 - protein, 9 aa, Homo Sapiens
DNKKRPPQR

SEQ ID NO: 256026 - protein, 9 aa, Homo Sapiens
ESIRPSSPL

SEQ ID NO: 256027 - protein, 9 aa, Homo Sapiens
HSRETPHAG

SEQ ID NO: 256028 - protein, 9 aa, Homo Sapiens
VQEDGCMLL

SEQ ID NO: 256029 - protein, 9 aa, Homo Sapiens
ASHENVDKV

SEQ ID NO: 256030 - protein, 9 aa, Homo Sapiens
QQSDYGPMK

SEQ ID NO: 256031 - protein, 9 aa, Homo Sapiens
FGLSITQLI

SEQ ID NO: 256032 - protein, 9 aa, Homo Sapiens
CLTINQLLA

SEQ ID NO: 256033 - protein, 9 aa, Homo Sapiens
EEFVKAAGL

SEQ ID NO: 256034 - protein, 9 aa, Homo Sapiens
SNSGLIRHW

SEQ ID NO: 256035 - protein, 9 aa, Homo Sapiens
QSHPGLHHG

SEQ ID NO: 256036 - protein, 9 aa, Homo Sapiens
QEISNQIRS

SEQ ID NO: 256037 - protein, 9 aa, Homo Sapiens
KRAQRLKLL

SEQ ID NO: 256038 - protein, 9 aa, Homo Sapiens
NLQTLNVSH

SEQ ID NO: 256039 - protein, 9 aa, Homo Sapiens
YLLPGRVYD

SEQ ID NO: 256040 - protein, 9 aa, Homo Sapiens
KQSESKSQI

SEQ ID NO: 256041 - protein, 9 aa, Homo Sapiens
DPLEHELRR

SEQ ID NO: 256042 - protein, 9 aa, Homo Sapiens
KVDFTEYRL

SEQ ID NO: 256043 - protein, 9 aa, Homo Sapiens
KINIRNERL

SEQ ID NO: 256044 - protein, 9 aa, Homo Sapiens
ISGLKVNCL

SEQ ID NO: 256045 - protein, 9 aa, Homo Sapiens
PVPPGPPGP

SEQ ID NO: 256046 - protein, 9 aa, Homo Sapiens
RLFLVSAAL

SEQ ID NO: 256047 - protein, 9 aa, Homo Sapiens
NGGYKTIYF

SEQ ID NO: 256048 - protein, 9 aa, Homo Sapiens
PYCQKDFLA

SEQ ID NO: 256049 - protein, 9 aa, Homo Sapiens
VYPNGQFVR

SEQ ID NO: 256050 - protein, 9 aa, Homo Sapiens
GAGRGGASI

SEQ ID NO: 256051 - protein, 9 aa, Homo Sapiens
TKINITDMY

SEQ ID NO: 256052 - protein, 9 aa, Homo Sapiens
EDGPHSANR

SEQ ID NO: 256053 - protein, 9 aa, Homo Sapiens
LCSYIFTHA

SEQ ID NO: 256054 - protein, 9 aa, Homo Sapiens
STNKTQIDG

SEQ ID NO: 256055 - protein, 9 aa, Homo Sapiens
KIKDSDNVE

SEQ ID NO: 256056 - protein, 9 aa, Homo Sapiens
GEGNPDDGT

SEQ ID NO: 256057 - protein, 9 aa, Homo Sapiens
SSLLTSESR

SEQ ID NO: 256058 - protein, 9 aa, Homo Sapiens
YQEQINNSL

SEQ ID NO: 256059 - protein, 9 aa, Homo Sapiens
FSDVSISAF

SEQ ID NO: 256060 - protein, 9 aa, Homo Sapiens
ARLLSDAAC

SEQ ID NO: 256061 - protein, 9 aa, Homo Sapiens
PGFKFDNLL

SEQ ID NO: 256062 - protein, 9 aa, Homo Sapiens
ILAAHLAVE

SEQ ID NO: 256063 - protein, 9 aa, Homo Sapiens
ALAGPITTR

SEQ ID NO: 256064 - protein, 9 aa, Homo Sapiens
SSHLARHQQ

SEQ ID NO: 256065 - protein, 9 aa, Homo Sapiens
MDSYSKQRM

SEQ ID NO: 256066 - protein, 9 aa, Homo Sapiens
PEGYRTLPI

SEQ ID NO: 256067 - protein, 9 aa, Homo Sapiens
VFLSVGGTV

SEQ ID NO: 256068 - protein, 9 aa, Homo Sapiens
LLGLGNKSF

SEQ ID NO: 256069 - protein, 9 aa, Homo Sapiens
VWENNMKMI

SEQ ID NO: 256070 - protein, 9 aa, Homo Sapiens
MRENNPDMV

SEQ ID NO: 256071 - protein, 9 aa, Homo Sapiens
FRECCATRP

SEQ ID NO: 256072 - protein, 9 aa, Homo Sapiens
SHPITEDEY

SEQ ID NO: 256073 - protein, 9 aa, Homo Sapiens
ARVFLRQNS

SEQ ID NO: 256074 - protein, 9 aa, Homo Sapiens
MSSFTKCEI

SEQ ID NO: 256075 - protein, 9 aa, Homo Sapiens
AMSLITNNI

SEQ ID NO: 256076 - protein, 9 aa, Homo Sapiens
RVTAAKFIQ

SEQ ID NO: 256077 - protein, 9 aa, Homo Sapiens
PSTLLPQPP

SEQ ID NO: 256078 - protein, 9 aa, Homo Sapiens
MQCLETVFK

SEQ ID NO: 256079 - protein, 9 aa, Homo Sapiens
EEHEKRIAL

SEQ ID NO: 256080 - protein, 9 aa, Homo Sapiens
KELFTKYQD

SEQ ID NO: 256081 - protein, 9 aa, Homo Sapiens
DVVQELLTY

SEQ ID NO: 256082 - protein, 9 aa, Homo Sapiens
SKANFCTGI

SEQ ID NO: 256083 - protein, 9 aa, Homo Sapiens
RIIHTAKKT

SEQ ID NO: 256084 - protein, 9 aa, Homo Sapiens
MLMNAQLQL

SEQ ID NO: 256085 - protein, 9 aa, Homo Sapiens
IYVFYTVVT

SEQ ID NO: 256086 - protein, 9 aa, Homo Sapiens
RSECFLLSM

SEQ ID NO: 256087 - protein, 9 aa, Homo Sapiens
AIKKKCQGI

SEQ ID NO: 256088 - protein, 9 aa, Homo Sapiens
PRHNSDGII

SEQ ID NO: 256089 - protein, 9 aa, Homo Sapiens
VNRDAKQIQ

SEQ ID NO: 256090 - protein, 9 aa, Homo Sapiens
VTFSYEKSN

SEQ ID NO: 256091 - protein, 9 aa, Homo Sapiens
QNSNTTPRV

SEQ ID NO: 256092 - protein, 9 aa, Homo Sapiens
RTHTGEKPL

SEQ ID NO: 256093 - protein, 9 aa, Homo Sapiens
SQAAFPLAF

SEQ ID NO: 256094 - protein, 9 aa, Homo Sapiens
AAGLPRNEI

SEQ ID NO: 256095 - protein, 9 aa, Homo Sapiens
ACLGGKLWS

SEQ ID NO: 256096 - protein, 9 aa, Homo Sapiens
GCAFPKEFA

SEQ ID NO: 256097 - protein, 9 aa, Homo Sapiens
GKAFNRYSH

SEQ ID NO: 256098 - protein, 9 aa, Homo Sapiens
IVKSGGRIS

SEQ ID NO: 256099 - protein, 9 aa, Homo Sapiens
FPQGQNKTK

SEQ ID NO: 256100 - protein, 9 aa, Homo Sapiens
SDGFIVNTI

SEQ ID NO: 256101 - protein, 9 aa, Homo Sapiens
LWKHGIPFA

SEQ ID NO: 256102 - protein, 9 aa, Homo Sapiens
FGLDRSLRP

SEQ ID NO: 256103 - protein, 9 aa, Homo Sapiens
SAENFSQIP

SEQ ID NO: 256104 - protein, 9 aa, Homo Sapiens
RKVLTSSRH

SEQ ID NO: 256105 - protein, 9 aa, Homo Sapiens
AELFLKNLK

SEQ ID NO: 256106 - protein, 9 aa, Homo Sapiens
PITTREQLS

SEQ ID NO: 256107 - protein, 9 aa, Homo Sapiens
YLYLDNNQI

SEQ ID NO: 256108 - protein, 9 aa, Homo Sapiens
TGEKPLECT

SEQ ID NO: 256109 - protein, 9 aa, Homo Sapiens
SQCCQSACC

SEQ ID NO: 256110 - protein, 9 aa, Homo Sapiens
PVFDTSDPE

SEQ ID NO: 256111 - protein, 9 aa, Homo Sapiens
VEEKDKGTA

SEQ ID NO: 256112 - protein, 9 aa, Homo Sapiens
CSDYLEKAM

SEQ ID NO: 256113 - protein, 9 aa, Homo Sapiens
EDEAYLRQI

SEQ ID NO: 256114 - protein, 9 aa, Homo Sapiens
PTLLAGHPL

SEQ ID NO: 256115 - protein, 9 aa, Homo Sapiens
NRQVMMKFN

SEQ ID NO: 256116 - protein, 9 aa, Homo Sapiens
IQAKEYIKP

SEQ ID NO: 256117 - protein, 9 aa, Homo Sapiens
LVPGDFLFM

SEQ ID NO: 256118 - protein, 9 aa, Homo Sapiens
GRLGRQGNK

SEQ ID NO: 256119 - protein, 9 aa, Homo Sapiens
KIIITYINA

SEQ ID NO: 256120 - protein, 9 aa, Homo Sapiens
NVQFRWSWE

SEQ ID NO: 256121 - protein, 9 aa, Homo Sapiens
EFVILGFSS

SEQ ID NO: 256122 - protein, 9 aa, Homo Sapiens
RIHYRLQLL

SEQ ID NO: 256123 - protein, 9 aa, Homo Sapiens
NYPTDPALP

SEQ ID NO: 256124 - protein, 9 aa, Homo Sapiens
VKLRKRPRY

SEQ ID NO: 256125 - protein, 9 aa, Homo Sapiens
DKCGKAFNN

SEQ ID NO: 256126 - protein, 9 aa, Homo Sapiens
LPKYLIYGP

SEQ ID NO: 256127 - protein, 9 aa, Homo Sapiens
IHYPPYTEW

SEQ ID NO: 256128 - protein, 9 aa, Homo Sapiens
GSIQGLTEG

SEQ ID NO: 256129 - protein, 9 aa, Homo Sapiens
LFILGSKGL

SEQ ID NO: 256130 - protein, 9 aa, Homo Sapiens
SNIYSDSSS

SEQ ID NO: 256131 - protein, 9 aa, Homo Sapiens
NQTLLETLQ

SEQ ID NO: 256132 - protein, 9 aa, Homo Sapiens
DSNHQRKGF

SEQ ID NO: 256133 - protein, 9 aa, Homo Sapiens
LLCRTIKKQ

SEQ ID NO: 256134 - protein, 9 aa, Homo Sapiens
LNTTSRQQI

SEQ ID NO: 256135 - protein, 9 aa, Homo Sapiens
LSEQDGVDF

SEQ ID NO: 256136 - protein, 9 aa, Homo Sapiens
QDSLPITIC

SEQ ID NO: 256137 - protein, 9 aa, Homo Sapiens
DVPVHISAH

SEQ ID NO: 256138 - protein, 9 aa, Homo Sapiens
LRLVALPGE

SEQ ID NO: 256139 - protein, 9 aa, Homo Sapiens
RILLSREIL

SEQ ID NO: 256140 - protein, 9 aa, Homo Sapiens
PLTRWARQR

SEQ ID NO: 256141 - protein, 9 aa, Homo Sapiens
KQSRFGGSY

SEQ ID NO: 256142 - protein, 9 aa, Homo Sapiens
GHIQEIQHD

SEQ ID NO: 256143 - protein, 9 aa, Homo Sapiens
CTADNSVGF

SEQ ID NO: 256144 - protein, 9 aa, Homo Sapiens
RLTPYQSQG

SEQ ID NO: 256145 - protein, 9 aa, Homo Sapiens
ILHNTKGKR

SEQ ID NO: 256146 - protein, 9 aa, Homo Sapiens
KLEKRRRAT

SEQ ID NO: 256147 - protein, 9 aa, Homo Sapiens
LRGEELSQR

SEQ ID NO: 256148 - protein, 9 aa, Homo Sapiens
WEKSVEQTQ

SEQ ID NO: 256149 - protein, 9 aa, Homo Sapiens
QPRALSPAS

SEQ ID NO: 256150 - protein, 9 aa, Homo Sapiens
FDSKPHLPG

SEQ ID NO: 256151 - protein, 9 aa, Homo Sapiens
MLQENCEGR

SEQ ID NO: 256152 - protein, 9 aa, Homo Sapiens
NTDELNFPT

SEQ ID NO: 256153 - protein, 9 aa, Homo Sapiens
CRQEVNACD

SEQ ID NO: 256154 - protein, 9 aa, Homo Sapiens
DKSFDIFCD

SEQ ID NO: 256155 - protein, 9 aa, Homo Sapiens
TKSPEPGCT

SEQ ID NO: 256156 - protein, 9 aa, Homo Sapiens
NMALFGLTE

SEQ ID NO: 256157 - protein, 9 aa, Homo Sapiens
QIGREVKIY

SEQ ID NO: 256158 - protein, 9 aa, Homo Sapiens
QHKIIHTGA

SEQ ID NO: 256159 - protein, 9 aa, Homo Sapiens
SYPRDVVNC

SEQ ID NO: 256160 - protein, 9 aa, Homo Sapiens
ESTMYKGKS

SEQ ID NO: 256161 - protein, 9 aa, Homo Sapiens
MRQHQQFMD

SEQ ID NO: 256162 - protein, 9 aa, Homo Sapiens
MFQKHNSKP

SEQ ID NO: 256163 - protein, 9 aa, Homo Sapiens
PDVPPPRPP

SEQ ID NO: 256164 - protein, 9 aa, Homo Sapiens
TIFLFFKPS

SEQ ID NO: 256165 - protein, 9 aa, Homo Sapiens
GHKRARKIT

SEQ ID NO: 256166 - protein, 9 aa, Homo Sapiens
FDVHRGEDV

SEQ ID NO: 256167 - protein, 9 aa, Homo Sapiens
KGRGMVQVQ

SEQ ID NO: 256168 - protein, 9 aa, Homo Sapiens
LHATLDIVE

SEQ ID NO: 256169 - protein, 9 aa, Homo Sapiens
YFASLQEYV

SEQ ID NO: 256170 - protein, 9 aa, Homo Sapiens
NLKNIRCLE

SEQ ID NO: 256171 - protein, 9 aa, Homo Sapiens
LLASNSLLN

SEQ ID NO: 256172 - protein, 9 aa, Homo Sapiens
LTHDRIKDV

SEQ ID NO: 256173 - protein, 9 aa, Homo Sapiens
KQKDIQSCL

SEQ ID NO: 256174 - protein, 9 aa, Homo Sapiens
KVHIVSIKD

SEQ ID NO: 256175 - protein, 9 aa, Homo Sapiens
TTERFDMAR

SEQ ID NO: 256176 - protein, 9 aa, Homo Sapiens
GQWDEVLQL

SEQ ID NO: 256177 - protein, 9 aa, Homo Sapiens
NYPKRNDLR

SEQ ID NO: 256178 - protein, 9 aa, Homo Sapiens
ARLTFQNPP

SEQ ID NO: 256179 - protein, 9 aa, Homo Sapiens
RHKMYKLSP

SEQ ID NO: 256180 - protein, 9 aa, Homo Sapiens
WQHNRKQAN

SEQ ID NO: 256181 - protein, 9 aa, Homo Sapiens
TQTGREKAT

SEQ ID NO: 256182 - protein, 9 aa, Homo Sapiens
CLPLPGYRL

SEQ ID NO: 256183 - protein, 9 aa, Homo Sapiens
DIPFEHDKE

SEQ ID NO: 256184 - protein, 9 aa, Homo Sapiens
NKFFVEESA

SEQ ID NO: 256185 - protein, 9 aa, Homo Sapiens
VLKISDGVQ

SEQ ID NO: 256186 - protein, 9 aa, Homo Sapiens
NPGRKIADM

SEQ ID NO: 256187 - protein, 9 aa, Homo Sapiens
LGIGASCVS

SEQ ID NO: 256188 - protein, 9 aa, Homo Sapiens
VSGKVTTKN

SEQ ID NO: 256189 - protein, 9 aa, Homo Sapiens
VKPHLCSLS

SEQ ID NO: 256190 - protein, 9 aa, Homo Sapiens
SEDSNDSSS

SEQ ID NO: 256191 - protein, 9 aa, Homo Sapiens
QFQMPDLRA

SEQ ID NO: 256192 - protein, 9 aa, Homo Sapiens
RQRLTSTPN

SEQ ID NO: 256193 - protein, 9 aa, Homo Sapiens
TSRRQCRHS

SEQ ID NO: 256194 - protein, 9 aa, Homo Sapiens
CGQIYIETS

SEQ ID NO: 256195 - protein, 9 aa, Homo Sapiens
LVVKELWRL

SEQ ID NO: 256196 - protein, 9 aa, Homo Sapiens
YVAELSILE

SEQ ID NO: 256197 - protein, 9 aa, Homo Sapiens
HLTIPTVVT

SEQ ID NO: 256198 - protein, 9 aa, Homo Sapiens
VYIQYLKSV

SEQ ID NO: 256199 - protein, 9 aa, Homo Sapiens
ATGIFAGFV

SEQ ID NO: 256200 - protein, 9 aa, Homo Sapiens
CTSQKAVCL

SEQ ID NO: 256201 - protein, 9 aa, Homo Sapiens
KSTKKESFE

SEQ ID NO: 256202 - protein, 9 aa, Homo Sapiens
VILKIEPPL

SEQ ID NO: 256203 - protein, 9 aa, Homo Sapiens
DLKTNVVRV

SEQ ID NO: 256204 - protein, 9 aa, Homo Sapiens
RDITSNKKL

SEQ ID NO: 256205 - protein, 9 aa, Homo Sapiens
MRRAWILLS

SEQ ID NO: 256206 - protein, 9 aa, Homo Sapiens
ELEKHRQAK

SEQ ID NO: 256207 - protein, 9 aa, Homo Sapiens
LMEITVSLS

SEQ ID NO: 256208 - protein, 9 aa, Homo Sapiens
DRCKMKNNF

SEQ ID NO: 256209 - protein, 9 aa, Homo Sapiens
GGEKALEIS

SEQ ID NO: 256210 - protein, 9 aa, Homo Sapiens
LCCICGGNK

SEQ ID NO: 256211 - protein, 9 aa, Homo Sapiens
MLEDGPHSA

SEQ ID NO: 256212 - protein, 9 aa, Homo Sapiens
SRDDYPAIL

SEQ ID NO: 256213 - protein, 9 aa, Homo Sapiens
KQSCVLQQC

SEQ ID NO: 256214 - protein, 9 aa, Homo Sapiens
LGAIYRSTS

SEQ ID NO: 256215 - protein, 9 aa, Homo Sapiens
DVNGHFVKR

SEQ ID NO: 256216 - protein, 9 aa, Homo Sapiens
NVGNGNQFS

SEQ ID NO: 256217 - protein, 9 aa, Homo Sapiens
FLPVRWVVK

SEQ ID NO: 256218 - protein, 9 aa, Homo Sapiens
RTLEASSRH

SEQ ID NO: 256219 - protein, 9 aa, Homo Sapiens
KQNREKGKG

SEQ ID NO: 256220 - protein, 9 aa, Homo Sapiens
YAQNVLRKH

SEQ ID NO: 256221 - protein, 9 aa, Homo Sapiens
SPVYRIDHT

SEQ ID NO: 256222 - protein, 9 aa, Homo Sapiens
NSVGNYLSR

SEQ ID NO: 256223 - protein, 9 aa, Homo Sapiens
LDESLCGRT

SEQ ID NO: 256224 - protein, 9 aa, Homo Sapiens
PGIEKFEGW

SEQ ID NO: 256225 - protein, 9 aa, Homo Sapiens
DHDYVYLRS

SEQ ID NO: 256226 - protein, 9 aa, Homo Sapiens
PKSENSSTH

SEQ ID NO: 256227 - protein, 9 aa, Homo Sapiens
GLTELPWGG

SEQ ID NO: 256228 - protein, 9 aa, Homo Sapiens
PSLLKRHEK

SEQ ID NO: 256229 - protein, 9 aa, Homo Sapiens
HDRLHARGI

SEQ ID NO: 256230 - protein, 9 aa, Homo Sapiens
TYCMCQDKK

SEQ ID NO: 256231 - protein, 9 aa, Homo Sapiens
VTLLDAIIC

SEQ ID NO: 256232 - protein, 9 aa, Homo Sapiens
CDINIRKDL

SEQ ID NO: 256233 - protein, 9 aa, Homo Sapiens
SIFEEEIMS

SEQ ID NO: 256234 - protein, 9 aa, Homo Sapiens
ADWPTPILA

SEQ ID NO: 256235 - protein, 9 aa, Homo Sapiens
PWNTLPKYY

SEQ ID NO: 256236 - protein, 9 aa, Homo Sapiens
GGYSAFAGV

SEQ ID NO: 256237 - protein, 9 aa, Homo Sapiens
PQSFLCRAL

SEQ ID NO: 256238 - protein, 9 aa, Homo Sapiens
PVSLAAAKL

SEQ ID NO: 256239 - protein, 9 aa, Homo Sapiens
SKTSFFLSR

SEQ ID NO: 256240 - protein, 9 aa, Homo Sapiens
AQVQINKQH

SEQ ID NO: 256241 - protein, 9 aa, Homo Sapiens
SDSRLHSAI

SEQ ID NO: 256242 - protein, 9 aa, Homo Sapiens
ITALVFLDN

SEQ ID NO: 256243 - protein, 9 aa, Homo Sapiens
KTAELYVKE

SEQ ID NO: 256244 - protein, 9 aa, Homo Sapiens
YRHGARVDK

SEQ ID NO: 256245 - protein, 9 aa, Homo Sapiens
MEFPGVDGC

SEQ ID NO: 256246 - protein, 9 aa, Homo Sapiens
ADMQGKLAT

SEQ ID NO: 256247 - protein, 9 aa, Homo Sapiens
QMDFGHTEE

SEQ ID NO: 256248 - protein, 9 aa, Homo Sapiens
EVYAAAADV

SEQ ID NO: 256249 - protein, 9 aa, Homo Sapiens
YMLEQRDVE

SEQ ID NO: 256250 - protein, 9 aa, Homo Sapiens
LNNDKKSAL

SEQ ID NO: 256251 - protein, 9 aa, Homo Sapiens
EGLFKVDYS

SEQ ID NO: 256252 - protein, 9 aa, Homo Sapiens
DLDRINASS

SEQ ID NO: 256253 - protein, 9 aa, Homo Sapiens
FILNILNMV

SEQ ID NO: 256254 - protein, 9 aa, Homo Sapiens
DVMLISLSY

SEQ ID NO: 256255 - protein, 9 aa, Homo Sapiens
VDGEEHVSF

SEQ ID NO: 256256 - protein, 9 aa, Homo Sapiens
VENGGYKTI

SEQ ID NO: 256257 - protein, 9 aa, Homo Sapiens
GSKKRFKED

SEQ ID NO: 256258 - protein, 9 aa, Homo Sapiens
VATLLNILA

SEQ ID NO: 256259 - protein, 9 aa, Homo Sapiens
SLPSTDSCD

SEQ ID NO: 256260 - protein, 9 aa, Homo Sapiens
TISTLTSCQ

SEQ ID NO: 256261 - protein, 9 aa, Homo Sapiens
TGPYGFIKS

SEQ ID NO: 256262 - protein, 9 aa, Homo Sapiens
LVARRRGIP

SEQ ID NO: 256263 - protein, 9 aa, Homo Sapiens
REHWQKNLT

SEQ ID NO: 256264 - protein, 9 aa, Homo Sapiens
TFTCTRTQA

SEQ ID NO: 256265 - protein, 9 aa, Homo Sapiens
EKLTALKEK

SEQ ID NO: 256266 - protein, 9 aa, Homo Sapiens
PKYIYATDQ

SEQ ID NO: 256267 - protein, 9 aa, Homo Sapiens
FFVPSWRKD

SEQ ID NO: 256268 - protein, 9 aa, Homo Sapiens
ETNTEPFQE

SEQ ID NO: 256269 - protein, 9 aa, Homo Sapiens
PVRMNMIGL

SEQ ID NO: 256270 - protein, 9 aa, Homo Sapiens
DLQIRKSQH

SEQ ID NO: 256271 - protein, 9 aa, Homo Sapiens
EHFRGLEER

SEQ ID NO: 256272 - protein, 9 aa, Homo Sapiens
KSEDSEKKL

SEQ ID NO: 256273 - protein, 9 aa, Homo Sapiens
MYYFFSNLS

SEQ ID NO: 256274 - protein, 9 aa, Homo Sapiens
LGIIGNNTI

SEQ ID NO: 256275 - protein, 9 aa, Homo Sapiens
DQKSNGLNE

SEQ ID NO: 256276 - protein, 9 aa, Homo Sapiens
HLKFIAGFR

SEQ ID NO: 256277 - protein, 9 aa, Homo Sapiens
NIPISIEFV

SEQ ID NO: 256278 - protein, 9 aa, Homo Sapiens
HTLAVEILP

SEQ ID NO: 256279 - protein, 9 aa, Homo Sapiens
KKKILNKEK

SEQ ID NO: 256280 - protein, 9 aa, Homo Sapiens
MAGISDDDS

SEQ ID NO: 256281 - protein, 9 aa, Homo Sapiens
LSKEEFPDV

SEQ ID NO: 256282 - protein, 9 aa, Homo Sapiens
NVVWSKCET

SEQ ID NO: 256283 - protein, 9 aa, Homo Sapiens
PGNHVQIRG

SEQ ID NO: 256284 - protein, 9 aa, Homo Sapiens
CLASQEVIQ

SEQ ID NO: 256285 - protein, 9 aa, Homo Sapiens
AKRLPCNHV

SEQ ID NO: 256286 - protein, 9 aa, Homo Sapiens
ETNNKYESK

SEQ ID NO: 256287 - protein, 9 aa, Homo Sapiens
NSLPPIDLA

SEQ ID NO: 256288 - protein, 9 aa, Homo Sapiens
LQKYYNGLN

SEQ ID NO: 256289 - protein, 9 aa, Homo Sapiens
YRKIRFVGR

SEQ ID NO: 256290 - protein, 9 aa, Homo Sapiens
NGRWRFYWK

SEQ ID NO: 256291 - protein, 9 aa, Homo Sapiens
QNHLQEIRS

SEQ ID NO: 256292 - protein, 9 aa, Homo Sapiens
FEAKKSFLL

SEQ ID NO: 256293 - protein, 9 aa, Homo Sapiens
NPLLNGRYK

SEQ ID NO: 256294 - protein, 9 aa, Homo Sapiens
LLHFWLPFG

SEQ ID NO: 256295 - protein, 9 aa, Homo Sapiens
EDIYKSELR

SEQ ID NO: 256296 - protein, 9 aa, Homo Sapiens
HGNVSLHYA

SEQ ID NO: 256297 - protein, 9 aa, Homo Sapiens
PPSTLLPQP

SEQ ID NO: 256298 - protein, 9 aa, Homo Sapiens
EKANEAVKS

SEQ ID NO: 256299 - protein, 9 aa, Homo Sapiens
GKNRGFGFV

SEQ ID NO: 256300 - protein, 9 aa, Homo Sapiens
PEHPGFNAL

SEQ ID NO: 256301 - protein, 9 aa, Homo Sapiens
DIRKDKADV

SEQ ID NO: 256302 - protein, 9 aa, Homo Sapiens
GISQDTQTL

SEQ ID NO: 256303 - protein, 9 aa, Homo Sapiens
RGDGSGFGK

SEQ ID NO: 256304 - protein, 9 aa, Homo Sapiens
PKLNVAFVA

SEQ ID NO: 256305 - protein, 9 aa, Homo Sapiens
MIEINPMAE

SEQ ID NO: 256306 - protein, 9 aa, Homo Sapiens
TFDCDEGKC

SEQ ID NO: 256307 - protein, 9 aa, Homo Sapiens
DTSLVLTPS

SEQ ID NO: 256308 - protein, 9 aa, Homo Sapiens
AADDDSDST

SEQ ID NO: 256309 - protein, 9 aa, Homo Sapiens
LNWNYHFVN

SEQ ID NO: 256310 - protein, 9 aa, Homo Sapiens
ACKLGVPVF

SEQ ID NO: 256311 - protein, 9 aa, Homo Sapiens
SAEYSSNWE

SEQ ID NO: 256312 - protein, 9 aa, Homo Sapiens
KTAQLLYLQ

SEQ ID NO: 256313 - protein, 9 aa, Homo Sapiens
WQDRHGKTF

SEQ ID NO: 256314 - protein, 9 aa, Homo Sapiens
RQWRCDQEP

SEQ ID NO: 256315 - protein, 9 aa, Homo Sapiens
PTASLIAKL

SEQ ID NO: 256316 - protein, 9 aa, Homo Sapiens
KLWCQQIPG

SEQ ID NO: 256317 - protein, 9 aa, Homo Sapiens
VELECFRFL

SEQ ID NO: 256318 - protein, 9 aa, Homo Sapiens
YGVWQNVSM

SEQ ID NO: 256319 - protein, 9 aa, Homo Sapiens
FKRVFVNLD

SEQ ID NO: 256320 - protein, 9 aa, Homo Sapiens
ILGFSSFGE

SEQ ID NO: 256321 - protein, 9 aa, Homo Sapiens
ETKNKTVCF

SEQ ID NO: 256322 - protein, 9 aa, Homo Sapiens
QYTLGDKIH

SEQ ID NO: 256323 - protein, 9 aa, Homo Sapiens
TVLIPPHAR

SEQ ID NO: 256324 - protein, 9 aa, Homo Sapiens
QKLIPEFIN

SEQ ID NO: 256325 - protein, 9 aa, Homo Sapiens
SQSTVLTHK

SEQ ID NO: 256326 - protein, 9 aa, Homo Sapiens
DHEQRYWQN

SEQ ID NO: 256327 - protein, 9 aa, Homo Sapiens
LDINGNHDA

SEQ ID NO: 256328 - protein, 9 aa, Homo Sapiens
MLQPQVKEE

SEQ ID NO: 256329 - protein, 9 aa, Homo Sapiens
TGNFFIFLK

SEQ ID NO: 256330 - protein, 9 aa, Homo Sapiens
VEYFMRIWA

SEQ ID NO: 256331 - protein, 9 aa, Homo Sapiens
EGRKSNIHK

SEQ ID NO: 256332 - protein, 9 aa, Homo Sapiens
DHVPSSRKV

SEQ ID NO: 256333 - protein, 9 aa, Homo Sapiens
EYCLDDQKA

SEQ ID NO: 256334 - protein, 9 aa, Homo Sapiens
AVLLLCGGL

SEQ ID NO: 256335 - protein, 9 aa, Homo Sapiens
PVKVWGSIQ

SEQ ID NO: 256336 - protein, 9 aa, Homo Sapiens
ISHNKMNGS

SEQ ID NO: 256337 - protein, 9 aa, Homo Sapiens
SQFITVKYQ

SEQ ID NO: 256338 - protein, 9 aa, Homo Sapiens
SSDLNIEHE

SEQ ID NO: 256339 - protein, 9 aa, Homo Sapiens
DSPPTKQEM

SEQ ID NO: 256340 - protein, 9 aa, Homo Sapiens
CQEGWNRFI

SEQ ID NO: 256341 - protein, 9 aa, Homo Sapiens
ISDACQDPR

SEQ ID NO: 256342 - protein, 9 aa, Homo Sapiens
GSEGTSQRD

SEQ ID NO: 256343 - protein, 9 aa, Homo Sapiens
DEAQSNRGI

SEQ ID NO: 256344 - protein, 9 aa, Homo Sapiens
CEGEEPRSD

SEQ ID NO: 256345 - protein, 9 aa, Homo Sapiens
LQYYLSYTE

SEQ ID NO: 256346 - protein, 9 aa, Homo Sapiens
NSRLLKRSF

SEQ ID NO: 256347 - protein, 9 aa, Homo Sapiens
HMPEDVQEK

SEQ ID NO: 256348 - protein, 9 aa, Homo Sapiens
KYTESRKYF

SEQ ID NO: 256349 - protein, 9 aa, Homo Sapiens
ALRNFSACG

SEQ ID NO: 256350 - protein, 9 aa, Homo Sapiens
LMSRRFCIQ

SEQ ID NO: 256351 - protein, 9 aa, Homo Sapiens
MWRFDGNKP

SEQ ID NO: 256352 - protein, 9 aa, Homo Sapiens
VKVVAANDI

SEQ ID NO: 256353 - protein, 9 aa, Homo Sapiens
AFALGFVKL

SEQ ID NO: 256354 - protein, 9 aa, Homo Sapiens
EDDCENDFQ

SEQ ID NO: 256355 - protein, 9 aa, Homo Sapiens
FHDCQNNSF

SEQ ID NO: 256356 - protein, 9 aa, Homo Sapiens
LSFSYSSLM

SEQ ID NO: 256357 - protein, 9 aa, Homo Sapiens
KSVCTSVNS

SEQ ID NO: 256358 - protein, 9 aa, Homo Sapiens
KPQQHGLRP

SEQ ID NO: 256359 - protein, 9 aa, Homo Sapiens
ENLEISDNS

SEQ ID NO: 256360 - protein, 9 aa, Homo Sapiens
CPDGFQLDG

SEQ ID NO: 256361 - protein, 9 aa, Homo Sapiens
LRRIGLDLA

SEQ ID NO: 256362 - protein, 9 aa, Homo Sapiens
PISEGRSGP

SEQ ID NO: 256363 - protein, 9 aa, Homo Sapiens
SPVVVVAFC

SEQ ID NO: 256364 - protein, 9 aa, Homo Sapiens
QDKNLMENV

SEQ ID NO: 256365 - protein, 9 aa, Homo Sapiens
EFELSDMFY

SEQ ID NO: 256366 - protein, 9 aa, Homo Sapiens
KIPSDYNSG

SEQ ID NO: 256367 - protein, 9 aa, Homo Sapiens
FVERRLIGL

SEQ ID NO: 256368 - protein, 9 aa, Homo Sapiens
SSRDSVPSL

SEQ ID NO: 256369 - protein, 9 aa, Homo Sapiens
FGKLKNLNC

SEQ ID NO: 256370 - protein, 9 aa, Homo Sapiens
QPISLDRLV

SEQ ID NO: 256371 - protein, 9 aa, Homo Sapiens
NDLLGYPKT

SEQ ID NO: 256372 - protein, 9 aa, Homo Sapiens
SYFRSVRAI

SEQ ID NO: 256373 - protein, 9 aa, Homo Sapiens
RDQRYLYFK

SEQ ID NO: 256374 - protein, 9 aa, Homo Sapiens
CEFLTGQID

SEQ ID NO: 256375 - protein, 9 aa, Homo Sapiens
KGDFRIYSI

SEQ ID NO: 256376 - protein, 9 aa, Homo Sapiens
SVSVQEEKK

SEQ ID NO: 256377 - protein, 9 aa, Homo Sapiens
PPPPRYKQF

SEQ ID NO: 256378 - protein, 9 aa, Homo Sapiens
EKDTRCLGV

SEQ ID NO: 256379 - protein, 9 aa, Homo Sapiens
VHNLLERRL

SEQ ID NO: 256380 - protein, 9 aa, Homo Sapiens
ERPYKCNGC

SEQ ID NO: 256381 - protein, 9 aa, Homo Sapiens
ALHKKTQSK

SEQ ID NO: 256382 - protein, 9 aa, Homo Sapiens
RDLHHYMEQ

SEQ ID NO: 256383 - protein, 9 aa, Homo Sapiens
NDLQTICAG

SEQ ID NO: 256384 - protein, 9 aa, Homo Sapiens
LPPYTSYEQ

SEQ ID NO: 256385 - protein, 9 aa, Homo Sapiens
VNLNKHVYG

SEQ ID NO: 256386 - protein, 9 aa, Homo Sapiens
VSELIAETT

SEQ ID NO: 256387 - protein, 9 aa, Homo Sapiens
VDGSNLITK

SEQ ID NO: 256388 - protein, 9 aa, Homo Sapiens
YIVAEFCFS

SEQ ID NO: 256389 - protein, 9 aa, Homo Sapiens
AHAEKASKM

SEQ ID NO: 256390 - protein, 9 aa, Homo Sapiens
DGAYSRVLA

SEQ ID NO: 256391 - protein, 9 aa, Homo Sapiens
DPVIKRCLA

SEQ ID NO: 256392 - protein, 9 aa, Homo Sapiens
KYSTPNLQQ

SEQ ID NO: 256393 - protein, 9 aa, Homo Sapiens
MKTLKPTEM

SEQ ID NO: 256394 - protein, 9 aa, Homo Sapiens
SPLPGFPGA

SEQ ID NO: 256395 - protein, 9 aa, Homo Sapiens
NEIMLVRSS

SEQ ID NO: 256396 - protein, 9 aa, Homo Sapiens
KWFGDEHIQ

SEQ ID NO: 256397 - protein, 9 aa, Homo Sapiens
YCTVALNCA

SEQ ID NO: 256398 - protein, 9 aa, Homo Sapiens
LAETLYSTG

SEQ ID NO: 256399 - protein, 9 aa, Homo Sapiens
ENETLQANE

SEQ ID NO: 256400 - protein, 9 aa, Homo Sapiens
PLYLHLRQT

SEQ ID NO: 256401 - protein, 9 aa, Homo Sapiens
AGAQDALSD

SEQ ID NO: 256402 - protein, 9 aa, Homo Sapiens
PPRGPGRSR

SEQ ID NO: 256403 - protein, 9 aa, Homo Sapiens
YLTSFLGIT

SEQ ID NO: 256404 - protein, 9 aa, Homo Sapiens
PWGDYDNSA

SEQ ID NO: 256405 - protein, 9 aa, Homo Sapiens
GTPVIANKT

SEQ ID NO: 256406 - protein, 9 aa, Homo Sapiens
RWSKSHFRE

SEQ ID NO: 256407 - protein, 9 aa, Homo Sapiens
KGDGLSNRI

SEQ ID NO: 256408 - protein, 9 aa, Homo Sapiens
QASAGDTRQ

SEQ ID NO: 256409 - protein, 9 aa, Homo Sapiens
PKSTVESLY

SEQ ID NO: 256410 - protein, 9 aa, Homo Sapiens
RLWPQDEPR

SEQ ID NO: 256411 - protein, 9 aa, Homo Sapiens
QLHILINDA

SEQ ID NO: 256412 - protein, 9 aa, Homo Sapiens
QLDGNKTCQ

SEQ ID NO: 256413 - protein, 9 aa, Homo Sapiens
PDSGKAQDF

SEQ ID NO: 256414 - protein, 9 aa, Homo Sapiens
TSWPKANPG

SEQ ID NO: 256415 - protein, 9 aa, Homo Sapiens
RRKDMLAEK

SEQ ID NO: 256416 - protein, 9 aa, Homo Sapiens
KPLVSKKER

SEQ ID NO: 256417 - protein, 9 aa, Homo Sapiens
FPCFSPCGW

SEQ ID NO: 256418 - protein, 9 aa, Homo Sapiens
GGDFNEFPA

SEQ ID NO: 256419 - protein, 9 aa, Homo Sapiens
GVTEWYKLR

SEQ ID NO: 256420 - protein, 9 aa, Homo Sapiens
VRMATAICQ

SEQ ID NO: 256421 - protein, 9 aa, Homo Sapiens
VLQIPMWSK

SEQ ID NO: 256422 - protein, 9 aa, Homo Sapiens
IPKLLDLPM

SEQ ID NO: 256423 - protein, 9 aa, Homo Sapiens
NNACGVQSS

SEQ ID NO: 256424 - protein, 9 aa, Homo Sapiens
QPNNIHDAR

SEQ ID NO: 256425 - protein, 9 aa, Homo Sapiens
EDAQQSSTE

SEQ ID NO: 256426 - protein, 9 aa, Homo Sapiens
SASVTDSSW

SEQ ID NO: 256427 - protein, 9 aa, Homo Sapiens
DKGEKEEED

SEQ ID NO: 256428 - protein, 9 aa, Homo Sapiens
APPSQERLW

SEQ ID NO: 256429 - protein, 9 aa, Homo Sapiens
DKLKEMSPG

SEQ ID NO: 256430 - protein, 9 aa, Homo Sapiens
QADEVKSMF

SEQ ID NO: 256431 - protein, 9 aa, Homo Sapiens
CMYLRPTSS

SEQ ID NO: 256432 - protein, 9 aa, Homo Sapiens
SVKQMLKSV

SEQ ID NO: 256433 - protein, 9 aa, Homo Sapiens
RREVVQRGR

SEQ ID NO: 256434 - protein, 9 aa, Homo Sapiens
HHWISQMEL

SEQ ID NO: 256435 - protein, 9 aa, Homo Sapiens
ERLRTRKKR

SEQ ID NO: 256436 - protein, 9 aa, Homo Sapiens
IRYSVWEEI

SEQ ID NO: 256437 - protein, 9 aa, Homo Sapiens
AASHGVGQH

SEQ ID NO: 256438 - protein, 9 aa, Homo Sapiens
PQLRQSDPH

SEQ ID NO: 256439 - protein, 9 aa, Homo Sapiens
PIGKSWIYK

SEQ ID NO: 256440 - protein, 9 aa, Homo Sapiens
VQEMSQAKK

SEQ ID NO: 256441 - protein, 9 aa, Homo Sapiens
GKSPIMADL

SEQ ID NO: 256442 - protein, 9 aa, Homo Sapiens
QTIRQFITQ

SEQ ID NO: 256443 - protein, 9 aa, Homo Sapiens
WHEKTLAVG

SEQ ID NO: 256444 - protein, 9 aa, Homo Sapiens
KQFCSLRNV

SEQ ID NO: 256445 - protein, 9 aa, Homo Sapiens
LTRNSSILG

SEQ ID NO: 256446 - protein, 9 aa, Homo Sapiens
SFEEESEIL

SEQ ID NO: 256447 - protein, 9 aa, Homo Sapiens
QYMHFQNVS

SEQ ID NO: 256448 - protein, 9 aa, Homo Sapiens
AQLGTVIYL

SEQ ID NO: 256449 - protein, 9 aa, Homo Sapiens
TFPNNSALK

SEQ ID NO: 256450 - protein, 9 aa, Homo Sapiens
LQENCEGRA

SEQ ID NO: 256451 - protein, 9 aa, Homo Sapiens
CCATRPELS

SEQ ID NO: 256452 - protein, 9 aa, Homo Sapiens
SNLAKDQRT

SEQ ID NO: 256453 - protein, 9 aa, Homo Sapiens
KIIHTERET

SEQ ID NO: 256454 - protein, 9 aa, Homo Sapiens
TWKSPLGTV

SEQ ID NO: 256455 - protein, 9 aa, Homo Sapiens
KHKMTQRMA

SEQ ID NO: 256456 - protein, 9 aa, Homo Sapiens
ESGVEICIA

SEQ ID NO: 256457 - protein, 9 aa, Homo Sapiens
VQIGPKECV

SEQ ID NO: 256458 - protein, 9 aa, Homo Sapiens
PYSDDEKFM

SEQ ID NO: 256459 - protein, 9 aa, Homo Sapiens
RVALTGKIN

SEQ ID NO: 256460 - protein, 9 aa, Homo Sapiens
DVAFEWKTK

SEQ ID NO: 256461 - protein, 9 aa, Homo Sapiens
SEKQPSGAD

SEQ ID NO: 256462 - protein, 9 aa, Homo Sapiens
LHCSWNYRL

SEQ ID NO: 256463 - protein, 9 aa, Homo Sapiens
KVLEKEENL

SEQ ID NO: 256464 - protein, 9 aa, Homo Sapiens
GTIKDKILF

SEQ ID NO: 256465 - protein, 9 aa, Homo Sapiens
SIISFQAVC

SEQ ID NO: 256466 - protein, 9 aa, Homo Sapiens
RQSLLRTNT

SEQ ID NO: 256467 - protein, 9 aa, Homo Sapiens
RAEPKSIYK

SEQ ID NO: 256468 - protein, 9 aa, Homo Sapiens
KRPWPLCGL

SEQ ID NO: 256469 - protein, 9 aa, Homo Sapiens
NSYHSSLFG

SEQ ID NO: 256470 - protein, 9 aa, Homo Sapiens
MIRKSPDSP

SEQ ID NO: 256471 - protein, 9 aa, Homo Sapiens
RQSYHGTMD

SEQ ID NO: 256472 - protein, 9 aa, Homo Sapiens
CDLPEELSL

SEQ ID NO: 256473 - protein, 9 aa, Homo Sapiens
LTRGSKTKK

SEQ ID NO: 256474 - protein, 9 aa, Homo Sapiens
YEDGDRLRI

SEQ ID NO: 256475 - protein, 9 aa, Homo Sapiens
PVHVNRFVV

SEQ ID NO: 256476 - protein, 9 aa, Homo Sapiens
QYGHLISGS

SEQ ID NO: 256477 - protein, 9 aa, Homo Sapiens
LTGLQTFYM

SEQ ID NO: 256478 - protein, 9 aa, Homo Sapiens
PKLLDLPMQ

SEQ ID NO: 256479 - protein, 9 aa, Homo Sapiens
VFFDYSKVS

SEQ ID NO: 256480 - protein, 9 aa, Homo Sapiens
LFEEEKLVI

SEQ ID NO: 256481 - protein, 9 aa, Homo Sapiens
AKIGSDPLQ

SEQ ID NO: 256482 - protein, 9 aa, Homo Sapiens
QLSESADEV

SEQ ID NO: 256483 - protein, 9 aa, Homo Sapiens
SSRHTLKGD

SEQ ID NO: 256484 - protein, 9 aa, Homo Sapiens
LFELFVLLK

SEQ ID NO: 256485 - protein, 9 aa, Homo Sapiens
ESFTFQIYK

SEQ ID NO: 256486 - protein, 9 aa, Homo Sapiens
KHWAKIIKN

SEQ ID NO: 256487 - protein, 9 aa, Homo Sapiens
MSPIKLHLS

SEQ ID NO: 256488 - protein, 9 aa, Homo Sapiens
VSEASDVVL

SEQ ID NO: 256489 - protein, 9 aa, Homo Sapiens
PMMITNAKR

SEQ ID NO: 256490 - protein, 9 aa, Homo Sapiens
LLYKKRPVQ

SEQ ID NO: 256491 - protein, 9 aa, Homo Sapiens
KAMLVANSL

SEQ ID NO: 256492 - protein, 9 aa, Homo Sapiens
FTRSIAEIG

SEQ ID NO: 256493 - protein, 9 aa, Homo Sapiens
KQIATTDLR

SEQ ID NO: 256494 - protein, 9 aa, Homo Sapiens
LINLTRIRS

SEQ ID NO: 256495 - protein, 9 aa, Homo Sapiens
LLFLLEGVR

SEQ ID NO: 256496 - protein, 9 aa, Homo Sapiens
KFQSLLTVI

SEQ ID NO: 256497 - protein, 9 aa, Homo Sapiens
VSLYEYFHM

SEQ ID NO: 256498 - protein, 9 aa, Homo Sapiens
LCDHCAVTE

SEQ ID NO: 256499 - protein, 9 aa, Homo Sapiens
PFHLCSYIA

SEQ ID NO: 256500 - protein, 9 aa, Homo Sapiens
IYGRTALIL

SEQ ID NO: 256501 - protein, 9 aa, Homo Sapiens
HPESLLSEF

SEQ ID NO: 256502 - protein, 9 aa, Homo Sapiens
VKKLYDVMI

SEQ ID NO: 256503 - protein, 9 aa, Homo Sapiens
LNLEEIREF

SEQ ID NO: 256504 - protein, 9 aa, Homo Sapiens
EESDPSYKR

SEQ ID NO: 256505 - protein, 9 aa, Homo Sapiens
KPGMCAALS

SEQ ID NO: 256506 - protein, 9 aa, Homo Sapiens
WVGTNKYLT

SEQ ID NO: 256507 - protein, 9 aa, Homo Sapiens
FYDLSERIA

SEQ ID NO: 256508 - protein, 9 aa, Homo Sapiens
IPENIYGGS

SEQ ID NO: 256509 - protein, 9 aa, Homo Sapiens
TLLDEPFQS

SEQ ID NO: 256510 - protein, 9 aa, Homo Sapiens
VFYLSVMAL

SEQ ID NO: 256511 - protein, 9 aa, Homo Sapiens
KKESRETCS

SEQ ID NO: 256512 - protein, 9 aa, Homo Sapiens
HHCLAHLLM

SEQ ID NO: 256513 - protein, 9 aa, Homo Sapiens
ESAPARHRK

SEQ ID NO: 256514 - protein, 9 aa, Homo Sapiens
DDEVSELMR

SEQ ID NO: 256515 - protein, 9 aa, Homo Sapiens
LGSFQCLCH

SEQ ID NO: 256516 - protein, 9 aa, Homo Sapiens
VLSFLGAAL

SEQ ID NO: 256517 - protein, 9 aa, Homo Sapiens
LVGVGEEVG

SEQ ID NO: 256518 - protein, 9 aa, Homo Sapiens
KLPKYGVKV

SEQ ID NO: 256519 - protein, 9 aa, Homo Sapiens
LQTLLGDNE

SEQ ID NO: 256520 - protein, 9 aa, Homo Sapiens
FYLKSKPPK

SEQ ID NO: 256521 - protein, 9 aa, Homo Sapiens
SYYHRFGMT

SEQ ID NO: 256522 - protein, 9 aa, Homo Sapiens
DHFRGKAMA

SEQ ID NO: 256523 - protein, 9 aa, Homo Sapiens
QQLETCIDD

SEQ ID NO: 256524 - protein, 9 aa, Homo Sapiens
VVVNGKEYP

SEQ ID NO: 256525 - protein, 9 aa, Homo Sapiens
WKINYFSGG

SEQ ID NO: 256526 - protein, 9 aa, Homo Sapiens
HSLAWNLVI

SEQ ID NO: 256527 - protein, 9 aa, Homo Sapiens
NINAVCRAH

SEQ ID NO: 256528 - protein, 9 aa, Homo Sapiens
PLRNVSSEG

SEQ ID NO: 256529 - protein, 9 aa, Homo Sapiens
EGLDWEYKD

SEQ ID NO: 256530 - protein, 9 aa, Homo Sapiens
KEVVPQLPV

SEQ ID NO: 256531 - protein, 9 aa, Homo Sapiens
NLEYHSSWT

SEQ ID NO: 256532 - protein, 9 aa, Homo Sapiens
DRALVKHKL

SEQ ID NO: 256533 - protein, 9 aa, Homo Sapiens
AFCLGKHSG

SEQ ID NO: 256534 - protein, 9 aa, Homo Sapiens
QNFEHLNSD

SEQ ID NO: 256535 - protein, 9 aa, Homo Sapiens
ESEEKKALI

SEQ ID NO: 256536 - protein, 9 aa, Homo Sapiens
SQSRSNLPL

SEQ ID NO: 256537 - protein, 9 aa, Homo Sapiens
IFKFQSLLT

SEQ ID NO: 256538 - protein, 9 aa, Homo Sapiens
DKVLNKRIL

SEQ ID NO: 256539 - protein, 9 aa, Homo Sapiens
RLDLPPYTS

SEQ ID NO: 256540 - protein, 9 aa, Homo Sapiens
GKRKGQENL

SEQ ID NO: 256541 - protein, 9 aa, Homo Sapiens
LTEEKESDF

SEQ ID NO: 256542 - protein, 9 aa, Homo Sapiens
MGKISAPSG

SEQ ID NO: 256543 - protein, 9 aa, Homo Sapiens
AHFTDEENR

SEQ ID NO: 256544 - protein, 9 aa, Homo Sapiens
HNSPFIVHQ

SEQ ID NO: 256545 - protein, 9 aa, Homo Sapiens
VTSPLFILL

SEQ ID NO: 256546 - protein, 9 aa, Homo Sapiens
TLPAPLYHI

SEQ ID NO: 256547 - protein, 9 aa, Homo Sapiens
EWHWMDPIQ

SEQ ID NO: 256548 - protein, 9 aa, Homo Sapiens
NKDCFERPR

SEQ ID NO: 256549 - protein, 9 aa, Homo Sapiens
QQNNSKGSS

SEQ ID NO: 256550 - protein, 9 aa, Homo Sapiens
HAKEKFLKE

SEQ ID NO: 256551 - protein, 9 aa, Homo Sapiens
RTCLCFLLL

SEQ ID NO: 256552 - protein, 9 aa, Homo Sapiens
DLFCNPSMR

SEQ ID NO: 256553 - protein, 9 aa, Homo Sapiens
PWPLCGLPA

SEQ ID NO: 256554 - protein, 9 aa, Homo Sapiens
SSETYAIEL

SEQ ID NO: 256555 - protein, 9 aa, Homo Sapiens
SHMLVALGE

SEQ ID NO: 256556 - protein, 9 aa, Homo Sapiens
DSCRIIKQA

SEQ ID NO: 256557 - protein, 9 aa, Homo Sapiens
RALCPTCLL

SEQ ID NO: 256558 - protein, 9 aa, Homo Sapiens
LAHTIGRKP

SEQ ID NO: 256559 - protein, 9 aa, Homo Sapiens
QKSRQPRPN

SEQ ID NO: 256560 - protein, 9 aa, Homo Sapiens
FSATDSFNH

SEQ ID NO: 256561 - protein, 9 aa, Homo Sapiens
LKHITSEEL

SEQ ID NO: 256562 - protein, 9 aa, Homo Sapiens
DYSAAPRGQ

SEQ ID NO: 256563 - protein, 9 aa, Homo Sapiens
MGHTMDKRR

SEQ ID NO: 256564 - protein, 9 aa, Homo Sapiens
CSISEDSEQ

SEQ ID NO: 256565 - protein, 9 aa, Homo Sapiens
PENSVKEVF

SEQ ID NO: 256566 - protein, 9 aa, Homo Sapiens
KASVNYLKY

SEQ ID NO: 256567 - protein, 9 aa, Homo Sapiens
CEKTVTKLG

SEQ ID NO: 256568 - protein, 9 aa, Homo Sapiens
TGMGWDGSD

SEQ ID NO: 256569 - protein, 9 aa, Homo Sapiens
SEQPENAAS

SEQ ID NO: 256570 - protein, 9 aa, Homo Sapiens
VILPAPIKN

SEQ ID NO: 256571 - protein, 9 aa, Homo Sapiens
PRPSSCSKS

SEQ ID NO: 256572 - protein, 9 aa, Homo Sapiens
QKPELNIVP

SEQ ID NO: 256573 - protein, 9 aa, Homo Sapiens
IHLKRFHFV

SEQ ID NO: 256574 - protein, 9 aa, Homo Sapiens
AGRDSTNAF

SEQ ID NO: 256575 - protein, 9 aa, Homo Sapiens
VITMIKIML

SEQ ID NO: 256576 - protein, 9 aa, Homo Sapiens
LYTLSGLAQ

SEQ ID NO: 256577 - protein, 9 aa, Homo Sapiens
VIQAIEPRI

SEQ ID NO: 256578 - protein, 9 aa, Homo Sapiens
MKPSPSFMT

SEQ ID NO: 256579 - protein, 9 aa, Homo Sapiens
QFIYPHIES

SEQ ID NO: 256580 - protein, 9 aa, Homo Sapiens
SEQKIKQSV

SEQ ID NO: 256581 - protein, 9 aa, Homo Sapiens
WQDLKEFMR

SEQ ID NO: 256582 - protein, 9 aa, Homo Sapiens
RFSGSPLHM

SEQ ID NO: 256583 - protein, 9 aa, Homo Sapiens
FPISLIGYW

SEQ ID NO: 256584 - protein, 9 aa, Homo Sapiens
ISDSSTSSY

SEQ ID NO: 256585 - protein, 9 aa, Homo Sapiens
FLTKKRREI

SEQ ID NO: 256586 - protein, 9 aa, Homo Sapiens
LKIWSVTRR

SEQ ID NO: 256587 - protein, 9 aa, Homo Sapiens
RNSFVFNIQ

SEQ ID NO: 256588 - protein, 9 aa, Homo Sapiens
SSKTTSKKR

SEQ ID NO: 256589 - protein, 9 aa, Homo Sapiens
LNLTPIQIT

SEQ ID NO: 256590 - protein, 9 aa, Homo Sapiens
DIPDIHERE

SEQ ID NO: 256591 - protein, 9 aa, Homo Sapiens
WATTYVSDW

SEQ ID NO: 256592 - protein, 9 aa, Homo Sapiens
LLNYAVTVV

SEQ ID NO: 256593 - protein, 9 aa, Homo Sapiens
VELEVCDLP

SEQ ID NO: 256594 - protein, 9 aa, Homo Sapiens
HRCACYMPT

SEQ ID NO: 256595 - protein, 9 aa, Homo Sapiens
MCTQVAKWP

SEQ ID NO: 256596 - protein, 9 aa, Homo Sapiens
LILDPVLLV

SEQ ID NO: 256597 - protein, 9 aa, Homo Sapiens
LCYVNGLCV

SEQ ID NO: 256598 - protein, 9 aa, Homo Sapiens
ASQHISLST

SEQ ID NO: 256599 - protein, 9 aa, Homo Sapiens
WHQFALRLS

SEQ ID NO: 256600 - protein, 9 aa, Homo Sapiens
DISFPVFVV

SEQ ID NO: 256601 - protein, 9 aa, Homo Sapiens
DFFERNSFS

SEQ ID NO: 256602 - protein, 9 aa, Homo Sapiens
ARLTNLKYM

SEQ ID NO: 256603 - protein, 9 aa, Homo Sapiens
KFLLDRRNY

SEQ ID NO: 256604 - protein, 9 aa, Homo Sapiens
LVFLDNRIV

SEQ ID NO: 256605 - protein, 9 aa, Homo Sapiens
FNIMRENNP

SEQ ID NO: 256606 - protein, 9 aa, Homo Sapiens
KCPTVVWTW

SEQ ID NO: 256607 - protein, 9 aa, Homo Sapiens
RDAKEALDI

SEQ ID NO: 256608 - protein, 9 aa, Homo Sapiens
LCKLLFCRI

SEQ ID NO: 256609 - protein, 9 aa, Homo Sapiens
TTVQKSKEM

SEQ ID NO: 256610 - protein, 9 aa, Homo Sapiens
IENVSSVEA

SEQ ID NO: 256611 - protein, 9 aa, Homo Sapiens
RFLDAAEHG

SEQ ID NO: 256612 - protein, 9 aa, Homo Sapiens
AAEPVPAGF

SEQ ID NO: 256613 - protein, 9 aa, Homo Sapiens
ASSESMRKI

SEQ ID NO: 256614 - protein, 9 aa, Homo Sapiens
YKPVWNRRH

SEQ ID NO: 256615 - protein, 9 aa, Homo Sapiens
EESERATSD

SEQ ID NO: 256616 - protein, 9 aa, Homo Sapiens
EEAGVPSIE

SEQ ID NO: 256617 - protein, 9 aa, Homo Sapiens
HELYGEKHA

SEQ ID NO: 256618 - protein, 9 aa, Homo Sapiens
WPFCVLTIT

SEQ ID NO: 256619 - protein, 9 aa, Homo Sapiens
LEEVARTAD

SEQ ID NO: 256620 - protein, 9 aa, Homo Sapiens
EVHLEFTML

SEQ ID NO: 256621 - protein, 9 aa, Homo Sapiens
TKKVLQQMP

SEQ ID NO: 256622 - protein, 9 aa, Homo Sapiens
PVIQRLQGV

SEQ ID NO: 256623 - protein, 9 aa, Homo Sapiens
DVKPRLEGE

SEQ ID NO: 256624 - protein, 9 aa, Homo Sapiens
FAKPYNLYS

SEQ ID NO: 256625 - protein, 9 aa, Homo Sapiens
RGYFKDKAS

SEQ ID NO: 256626 - protein, 9 aa, Homo Sapiens
SRRTGAGSN

SEQ ID NO: 256627 - protein, 9 aa, Homo Sapiens
MIQIINKCC

SEQ ID NO: 256628 - protein, 9 aa, Homo Sapiens
LKTELHSTA

SEQ ID NO: 256629 - protein, 9 aa, Homo Sapiens
LPLLTAIVS

SEQ ID NO: 256630 - protein, 9 aa, Homo Sapiens
SLTGSLTGN

SEQ ID NO: 256631 - protein, 9 aa, Homo Sapiens
QVTQNVLIL

SEQ ID NO: 256632 - protein, 9 aa, Homo Sapiens
IITNAGWSF

SEQ ID NO: 256633 - protein, 9 aa, Homo Sapiens
PKEKKRNIP

SEQ ID NO: 256634 - protein, 9 aa, Homo Sapiens
AEAEKPPTP

SEQ ID NO: 256635 - protein, 9 aa, Homo Sapiens
QNEMKMIKD

SEQ ID NO: 256636 - protein, 9 aa, Homo Sapiens
KDAFMKANS

SEQ ID NO: 256637 - protein, 9 aa, Homo Sapiens
FIYRPIQQR

SEQ ID NO: 256638 - protein, 9 aa, Homo Sapiens
SCKDTLVQH

SEQ ID NO: 256639 - protein, 9 aa, Homo Sapiens
LIFGGHQGT

SEQ ID NO: 256640 - protein, 9 aa, Homo Sapiens
VSAQACNET

SEQ ID NO: 256641 - protein, 9 aa, Homo Sapiens
HLYDKWIKD

SEQ ID NO: 256642 - protein, 9 aa, Homo Sapiens
LKIKLAVQM

SEQ ID NO: 256643 - protein, 9 aa, Homo Sapiens
KRFGPNAIL

SEQ ID NO: 256644 - protein, 9 aa, Homo Sapiens
ISQLELTPH

SEQ ID NO: 256645 - protein, 9 aa, Homo Sapiens
LATGLNNGH

SEQ ID NO: 256646 - protein, 9 aa, Homo Sapiens
EESGEQGGR

SEQ ID NO: 256647 - protein, 9 aa, Homo Sapiens
RAHLPCVGP

SEQ ID NO: 256648 - protein, 9 aa, Homo Sapiens
ITRVTADIY

SEQ ID NO: 256649 - protein, 9 aa, Homo Sapiens
CQKCSHFQS

SEQ ID NO: 256650 - protein, 9 aa, Homo Sapiens
LLERSPESF

SEQ ID NO: 256651 - protein, 9 aa, Homo Sapiens
NEQDFCKIV

SEQ ID NO: 256652 - protein, 9 aa, Homo Sapiens
EAEIYYLTN

SEQ ID NO: 256653 - protein, 9 aa, Homo Sapiens
LSDDKSKSN

SEQ ID NO: 256654 - protein, 9 aa, Homo Sapiens
IIFSHNSPF

SEQ ID NO: 256655 - protein, 9 aa, Homo Sapiens
NIYHALGSR

SEQ ID NO: 256656 - protein, 9 aa, Homo Sapiens
PSNRNVMET

SEQ ID NO: 256657 - protein, 9 aa, Homo Sapiens
SALQRSLCS

SEQ ID NO: 256658 - protein, 9 aa, Homo Sapiens
RNELPEIPE

SEQ ID NO: 256659 - protein, 9 aa, Homo Sapiens
IVLGTGGIK

SEQ ID NO: 256660 - protein, 9 aa, Homo Sapiens
PSPGPYPTP

SEQ ID NO: 256661 - protein, 9 aa, Homo Sapiens
QKNVKAKNK

SEQ ID NO: 256662 - protein, 9 aa, Homo Sapiens
NYHFVNLMQ

SEQ ID NO: 256663 - protein, 9 aa, Homo Sapiens
DTSVKINDL

SEQ ID NO: 256664 - protein, 9 aa, Homo Sapiens
EHLKLKDWK

SEQ ID NO: 256665 - protein, 9 aa, Homo Sapiens
LTCVYIPQV

SEQ ID NO: 256666 - protein, 9 aa, Homo Sapiens
NFRELPCLK

SEQ ID NO: 256667 - protein, 9 aa, Homo Sapiens
NILVDRQAK

SEQ ID NO: 256668 - protein, 9 aa, Homo Sapiens
LYFCGQIEI

SEQ ID NO: 256669 - protein, 9 aa, Homo Sapiens
TLFVKVKRT

SEQ ID NO: 256670 - protein, 9 aa, Homo Sapiens
SSCYISCDR

SEQ ID NO: 256671 - protein, 9 aa, Homo Sapiens
RLTGEYSRN

SEQ ID NO: 256672 - protein, 9 aa, Homo Sapiens
RDKKCMTLD

SEQ ID NO: 256673 - protein, 9 aa, Homo Sapiens
LVQTAPKKN

SEQ ID NO: 256674 - protein, 9 aa, Homo Sapiens
DTLDAGNYD

SEQ ID NO: 256675 - protein, 9 aa, Homo Sapiens
SWCLLYAGF

SEQ ID NO: 256676 - protein, 9 aa, Homo Sapiens
LALDASQHI

SEQ ID NO: 256677 - protein, 9 aa, Homo Sapiens
LVGDKLSRA

SEQ ID NO: 256678 - protein, 9 aa, Homo Sapiens
KCGKAFSCK

SEQ ID NO: 256679 - protein, 9 aa, Homo Sapiens
PFPTRIASS

SEQ ID NO: 256680 - protein, 9 aa, Homo Sapiens
RYILLRPTM

SEQ ID NO: 256681 - protein, 9 aa, Homo Sapiens
RQVDSRGVP

SEQ ID NO: 256682 - protein, 9 aa, Homo Sapiens
NYSKIDYFP

SEQ ID NO: 256683 - protein, 9 aa, Homo Sapiens
RRRVKGDKK

SEQ ID NO: 256684 - protein, 9 aa, Homo Sapiens
WTKRNDMQL

SEQ ID NO: 256685 - protein, 9 aa, Homo Sapiens
DTVLNLKQF

SEQ ID NO: 256686 - protein, 9 aa, Homo Sapiens
IIMNSVVPS

SEQ ID NO: 256687 - protein, 9 aa, Homo Sapiens
SRDLTPSRP

SEQ ID NO: 256688 - protein, 9 aa, Homo Sapiens
LQSSKKRFI

SEQ ID NO: 256689 - protein, 9 aa, Homo Sapiens
RNYIEKEGI

SEQ ID NO: 256690 - protein, 9 aa, Homo Sapiens
YEPSIYRSL

SEQ ID NO: 256691 - protein, 9 aa, Homo Sapiens
HTQTGREKA

SEQ ID NO: 256692 - protein, 9 aa, Homo Sapiens
MTTVGYGYM

SEQ ID NO: 256693 - protein, 9 aa, Homo Sapiens
LSLSLSTPP

SEQ ID NO: 256694 - protein, 9 aa, Homo Sapiens
FSHNSPFIV

SEQ ID NO: 256695 - protein, 9 aa, Homo Sapiens
VSGALLGRE

SEQ ID NO: 256696 - protein, 9 aa, Homo Sapiens
VNIYIDKNK

SEQ ID NO: 256697 - protein, 9 aa, Homo Sapiens
QGLCTFGFY

SEQ ID NO: 256698 - protein, 9 aa, Homo Sapiens
PQQSLEPIG

SEQ ID NO: 256699 - protein, 9 aa, Homo Sapiens
WLENKWGHN

SEQ ID NO: 256700 - protein, 9 aa, Homo Sapiens
AINVEKAIK

SEQ ID NO: 256701 - protein, 9 aa, Homo Sapiens
IAQMFFIHG

SEQ ID NO: 256702 - protein, 9 aa, Homo Sapiens
GKAMLLEIC

SEQ ID NO: 256703 - protein, 9 aa, Homo Sapiens
LRTLRFPAE

SEQ ID NO: 256704 - protein, 9 aa, Homo Sapiens
CATGIIIVM

SEQ ID NO: 256705 - protein, 9 aa, Homo Sapiens
GMLWLFALA

SEQ ID NO: 256706 - protein, 9 aa, Homo Sapiens
AKRDDKRMP

SEQ ID NO: 256707 - protein, 9 aa, Homo Sapiens
VDHCEHLKK

SEQ ID NO: 256708 - protein, 9 aa, Homo Sapiens
QENTTYLKT

SEQ ID NO: 256709 - protein, 9 aa, Homo Sapiens
GELTVTYAT

SEQ ID NO: 256710 - protein, 9 aa, Homo Sapiens
HDIMVYFGR

SEQ ID NO: 256711 - protein, 9 aa, Homo Sapiens
NEVWMVDCY

SEQ ID NO: 256712 - protein, 9 aa, Homo Sapiens
GALTKVVGR

SEQ ID NO: 256713 - protein, 9 aa, Homo Sapiens
ESLLSEFDY

SEQ ID NO: 256714 - protein, 9 aa, Homo Sapiens
KVCRDKGWT

SEQ ID NO: 256715 - protein, 9 aa, Homo Sapiens
ADRPLIYFL

SEQ ID NO: 256716 - protein, 9 aa, Homo Sapiens
HNLISPEDY

SEQ ID NO: 256717 - protein, 9 aa, Homo Sapiens
LRSVNSREF

SEQ ID NO: 256718 - protein, 9 aa, Homo Sapiens
FTHLRFQEF

SEQ ID NO: 256719 - protein, 9 aa, Homo Sapiens
DIKEANLFG

SEQ ID NO: 256720 - protein, 9 aa, Homo Sapiens
KLLNRLPKD

SEQ ID NO: 256721 - protein, 9 aa, Homo Sapiens
FPPPPLLAM

SEQ ID NO: 256722 - protein, 9 aa, Homo Sapiens
IHAPNLPYR

SEQ ID NO: 256723 - protein, 9 aa, Homo Sapiens
LTQTALNLT

SEQ ID NO: 256724 - protein, 9 aa, Homo Sapiens
LQGCWLLYY

SEQ ID NO: 256725 - protein, 9 aa, Homo Sapiens
GPTQSPLFT

SEQ ID NO: 256726 - protein, 9 aa, Homo Sapiens
GWSPSKHTQ

SEQ ID NO: 256727 - protein, 9 aa, Homo Sapiens
DKGALQEGR

SEQ ID NO: 256728 - protein, 9 aa, Homo Sapiens
ENEASQYGR

SEQ ID NO: 256729 - protein, 9 aa, Homo Sapiens
LVWSAPEDV

SEQ ID NO: 256730 - protein, 9 aa, Homo Sapiens
VWGKMMSGH

SEQ ID NO: 256731 - protein, 9 aa, Homo Sapiens
TLKTSECGK

SEQ ID NO: 256732 - protein, 9 aa, Homo Sapiens
SKSVSSTNF

SEQ ID NO: 256733 - protein, 9 aa, Homo Sapiens
ASSLRIMIC

SEQ ID NO: 256734 - protein, 9 aa, Homo Sapiens
RPRNAALGP

SEQ ID NO: 256735 - protein, 9 aa, Homo Sapiens
IFQDLQSSD

SEQ ID NO: 256736 - protein, 9 aa, Homo Sapiens
AMDRTSLQS

SEQ ID NO: 256737 - protein, 9 aa, Homo Sapiens
FDKGFKVPG

SEQ ID NO: 256738 - protein, 9 aa, Homo Sapiens
KIINTNKLS

SEQ ID NO: 256739 - protein, 9 aa, Homo Sapiens
HEQEVNTLH

SEQ ID NO: 256740 - protein, 9 aa, Homo Sapiens
PWRLYNKIS

SEQ ID NO: 256741 - protein, 9 aa, Homo Sapiens
LLDDLTMDI

SEQ ID NO: 256742 - protein, 9 aa, Homo Sapiens
DGAHCLRLD

SEQ ID NO: 256743 - protein, 9 aa, Homo Sapiens
EENNFGSSH

SEQ ID NO: 256744 - protein, 9 aa, Homo Sapiens
KIVQYMIEV

SEQ ID NO: 256745 - protein, 9 aa, Homo Sapiens
GLTAPLYFC

SEQ ID NO: 256746 - protein, 9 aa, Homo Sapiens
RPEKIVQMT

SEQ ID NO: 256747 - protein, 9 aa, Homo Sapiens
LMVDGEDTT

SEQ ID NO: 256748 - protein, 9 aa, Homo Sapiens
AEENDLLEE

SEQ ID NO: 256749 - protein, 9 aa, Homo Sapiens
PARHRKKRR

SEQ ID NO: 256750 - protein, 9 aa, Homo Sapiens
NLLVNSQND

SEQ ID NO: 256751 - protein, 9 aa, Homo Sapiens
SLISNKRNI

SEQ ID NO: 256752 - protein, 9 aa, Homo Sapiens
DEELGLLDS

SEQ ID NO: 256753 - protein, 9 aa, Homo Sapiens
IVNMLVGNR

SEQ ID NO: 256754 - protein, 9 aa, Homo Sapiens
PTMPREGHP

SEQ ID NO: 256755 - protein, 9 aa, Homo Sapiens
HNNSTGSGR

SEQ ID NO: 256756 - protein, 9 aa, Homo Sapiens
YNSGIINTQ

SEQ ID NO: 256757 - protein, 9 aa, Homo Sapiens
NTFSVSAHL

SEQ ID NO: 256758 - protein, 9 aa, Homo Sapiens
VNSLQLKAF

SEQ ID NO: 256759 - protein, 9 aa, Homo Sapiens
LIEGQVMAK

SEQ ID NO: 256760 - protein, 9 aa, Homo Sapiens
GSPTLFNCL

SEQ ID NO: 256761 - protein, 9 aa, Homo Sapiens
FKSSCYINV

SEQ ID NO: 256762 - protein, 9 aa, Homo Sapiens
PQKEVITLD

SEQ ID NO: 256763 - protein, 9 aa, Homo Sapiens
GTGTLPNIA

SEQ ID NO: 256764 - protein, 9 aa, Homo Sapiens
SLANVVKSH

SEQ ID NO: 256765 - protein, 9 aa, Homo Sapiens
EKQDLTTRL

SEQ ID NO: 256766 - protein, 9 aa, Homo Sapiens
DQSLVKSTI

SEQ ID NO: 256767 - protein, 9 aa, Homo Sapiens
PLLWLLQFI

SEQ ID NO: 256768 - protein, 9 aa, Homo Sapiens
EVRSSADLQ

SEQ ID NO: 256769 - protein, 9 aa, Homo Sapiens
QQPTQAAVR

SEQ ID NO: 256770 - protein, 9 aa, Homo Sapiens
VHGLLSCDL

SEQ ID NO: 256771 - protein, 9 aa, Homo Sapiens
LVCCECSLL

SEQ ID NO: 256772 - protein, 9 aa, Homo Sapiens
HQQYQQELH

SEQ ID NO: 256773 - protein, 9 aa, Homo Sapiens
HLSVNQEIF

SEQ ID NO: 256774 - protein, 9 aa, Homo Sapiens
RRRPQSRPQ

SEQ ID NO: 256775 - protein, 9 aa, Homo Sapiens
KDEDFLSLT

SEQ ID NO: 256776 - protein, 9 aa, Homo Sapiens
GRLQEFLAA

SEQ ID NO: 256777 - protein, 9 aa, Homo Sapiens
PSLSNKDRG

SEQ ID NO: 256778 - protein, 9 aa, Homo Sapiens
RGKAFSCLS

SEQ ID NO: 256779 - protein, 9 aa, Homo Sapiens
SRVPVIRYK

SEQ ID NO: 256780 - protein, 9 aa, Homo Sapiens
AVWHQNGGC

SEQ ID NO: 256781 - protein, 9 aa, Homo Sapiens
ATSFTHICA

SEQ ID NO: 256782 - protein, 9 aa, Homo Sapiens
LKYNPVVIN

SEQ ID NO: 256783 - protein, 9 aa, Homo Sapiens
VPQGQQPPP

SEQ ID NO: 256784 - protein, 9 aa, Homo Sapiens
GNRIKALRS

SEQ ID NO: 256785 - protein, 9 aa, Homo Sapiens
PGQSIGIQK

SEQ ID NO: 256786 - protein, 9 aa, Homo Sapiens
PHQTCCPDL

SEQ ID NO: 256787 - protein, 9 aa, Homo Sapiens
MAPEIIAET

SEQ ID NO: 256788 - protein, 9 aa, Homo Sapiens
HFAVQTILT

SEQ ID NO: 256789 - protein, 9 aa, Homo Sapiens
SAEERLRRR

SEQ ID NO: 256790 - protein, 9 aa, Homo Sapiens
RSHMPDTRF

SEQ ID NO: 256791 - protein, 9 aa, Homo Sapiens
KLSLKLDAK

SEQ ID NO: 256792 - protein, 9 aa, Homo Sapiens
PPEGTKSYK

SEQ ID NO: 256793 - protein, 9 aa, Homo Sapiens
LISPVLSQV

SEQ ID NO: 256794 - protein, 9 aa, Homo Sapiens
DLNRMHSQN

SEQ ID NO: 256795 - protein, 9 aa, Homo Sapiens
LTGEYSRNT

SEQ ID NO: 256796 - protein, 9 aa, Homo Sapiens
STLFNVGGI

SEQ ID NO: 256797 - protein, 9 aa, Homo Sapiens
EVFARLSTN

SEQ ID NO: 256798 - protein, 9 aa, Homo Sapiens
RYASDNVNK

SEQ ID NO: 256799 - protein, 9 aa, Homo Sapiens
SPSFMTSQL

SEQ ID NO: 256800 - protein, 9 aa, Homo Sapiens
EEIRFSLRL

SEQ ID NO: 256801 - protein, 9 aa, Homo Sapiens
KYWKDQHVI

SEQ ID NO: 256802 - protein, 9 aa, Homo Sapiens
LRAEEIAII

SEQ ID NO: 256803 - protein, 9 aa, Homo Sapiens
KLQKYYNGL

SEQ ID NO: 256804 - protein, 9 aa, Homo Sapiens
VAYSGIWDN

SEQ ID NO: 256805 - protein, 9 aa, Homo Sapiens
LVMLHFDLR

SEQ ID NO: 256806 - protein, 9 aa, Homo Sapiens
LRKDPINAG

SEQ ID NO: 256807 - protein, 9 aa, Homo Sapiens
KICDELCKN

SEQ ID NO: 256808 - protein, 9 aa, Homo Sapiens
MSCQGFTKD

SEQ ID NO: 256809 - protein, 9 aa, Homo Sapiens
VHLHSFFVV

SEQ ID NO: 256810 - protein, 9 aa, Homo Sapiens
SDYLIPPMD

SEQ ID NO: 256811 - protein, 9 aa, Homo Sapiens
NESINNYLQ

SEQ ID NO: 256812 - protein, 9 aa, Homo Sapiens
LGVCLLLNH

SEQ ID NO: 256813 - protein, 9 aa, Homo Sapiens
ALCVAEVWM

SEQ ID NO: 256814 - protein, 9 aa, Homo Sapiens
DPVSPILVQ

SEQ ID NO: 256815 - protein, 9 aa, Homo Sapiens
KPDSCPPVP

SEQ ID NO: 256816 - protein, 9 aa, Homo Sapiens
GIYVLSSCR

SEQ ID NO: 256817 - protein, 9 aa, Homo Sapiens
TLPAGFQNF

SEQ ID NO: 256818 - protein, 9 aa, Homo Sapiens
RYLTSSKIM

SEQ ID NO: 256819 - protein, 9 aa, Homo Sapiens
DILNIKMSH

SEQ ID NO: 256820 - protein, 9 aa, Homo Sapiens
DKLAAAERV

SEQ ID NO: 256821 - protein, 9 aa, Homo Sapiens
EDVHWHKSK

SEQ ID NO: 256822 - protein, 9 aa, Homo Sapiens
GVYSFWFHV

SEQ ID NO: 256823 - protein, 9 aa, Homo Sapiens
QSRNLKPWM

SEQ ID NO: 256824 - protein, 9 aa, Homo Sapiens
HVPGLNNTS

SEQ ID NO: 256825 - protein, 9 aa, Homo Sapiens
LLGTLSPYS

SEQ ID NO: 256826 - protein, 9 aa, Homo Sapiens
VTNASTFSS

SEQ ID NO: 256827 - protein, 9 aa, Homo Sapiens
LSPNSYYEL

SEQ ID NO: 256828 - protein, 9 aa, Homo Sapiens
PLRSQFQAR

SEQ ID NO: 256829 - protein, 9 aa, Homo Sapiens
YCVNQCKSK

SEQ ID NO: 256830 - protein, 9 aa, Homo Sapiens
QMQNEKEQD

SEQ ID NO: 256831 - protein, 9 aa, Homo Sapiens
QKHNTDTVV

SEQ ID NO: 256832 - protein, 9 aa, Homo Sapiens
VNAFQRHQR

SEQ ID NO: 256833 - protein, 9 aa, Homo Sapiens
DEVSELMRQ

SEQ ID NO: 256834 - protein, 9 aa, Homo Sapiens
PVHLSVNQE

SEQ ID NO: 256835 - protein, 9 aa, Homo Sapiens
SYLTKHKTR

SEQ ID NO: 256836 - protein, 9 aa, Homo Sapiens
SSSSICKYN

SEQ ID NO: 256837 - protein, 9 aa, Homo Sapiens
CDQIATVQH

SEQ ID NO: 256838 - protein, 9 aa, Homo Sapiens
WNLNMLQCR

SEQ ID NO: 256839 - protein, 9 aa, Homo Sapiens
SACHFLWKL

SEQ ID NO: 256840 - protein, 9 aa, Homo Sapiens
LYGGIVFGN

SEQ ID NO: 256841 - protein, 9 aa, Homo Sapiens
LIRLSHPNI

SEQ ID NO: 256842 - protein, 9 aa, Homo Sapiens
YGQIQQVKS

SEQ ID NO: 256843 - protein, 9 aa, Homo Sapiens
NKLVQLNKL

SEQ ID NO: 256844 - protein, 9 aa, Homo Sapiens
LNHPKTQQY

SEQ ID NO: 256845 - protein, 9 aa, Homo Sapiens
LKEQVTQNV

SEQ ID NO: 256846 - protein, 9 aa, Homo Sapiens
GSMLQLTFC

SEQ ID NO: 256847 - protein, 9 aa, Homo Sapiens
RYPHSLWVG

SEQ ID NO: 256848 - protein, 9 aa, Homo Sapiens
LDEKRKSLD

SEQ ID NO: 256849 - protein, 9 aa, Homo Sapiens
FFQKYYQLL

SEQ ID NO: 256850 - protein, 9 aa, Homo Sapiens
YIQWKPPND

SEQ ID NO: 256851 - protein, 9 aa, Homo Sapiens
EGYRTLPIN

SEQ ID NO: 256852 - protein, 9 aa, Homo Sapiens
QSQVQQLIS

SEQ ID NO: 256853 - protein, 9 aa, Homo Sapiens
DTSYDNREK

SEQ ID NO: 256854 - protein, 9 aa, Homo Sapiens
IFKPIQSKK

SEQ ID NO: 256855 - protein, 9 aa, Homo Sapiens
SASRAAWKA

SEQ ID NO: 256856 - protein, 9 aa, Homo Sapiens
NSRMNNKLW

SEQ ID NO: 256857 - protein, 9 aa, Homo Sapiens
SEVKAHTAP

SEQ ID NO: 256858 - protein, 9 aa, Homo Sapiens
SLLHKHEDS

SEQ ID NO: 256859 - protein, 9 aa, Homo Sapiens
HKCSLKSLE

SEQ ID NO: 256860 - protein, 9 aa, Homo Sapiens
VGSKRRQTG

SEQ ID NO: 256861 - protein, 9 aa, Homo Sapiens
LKFHNPASL

SEQ ID NO: 256862 - protein, 9 aa, Homo Sapiens
NFLLVGIIE

SEQ ID NO: 256863 - protein, 9 aa, Homo Sapiens
WIPIDNSIC

SEQ ID NO: 256864 - protein, 9 aa, Homo Sapiens
NSVAVPRLI

SEQ ID NO: 256865 - protein, 9 aa, Homo Sapiens
PGKTEDKSR

SEQ ID NO: 256866 - protein, 9 aa, Homo Sapiens
MCHDVIVMA

SEQ ID NO: 256867 - protein, 9 aa, Homo Sapiens
QSQYLIVHC

SEQ ID NO: 256868 - protein, 9 aa, Homo Sapiens
SALIQHQII

SEQ ID NO: 256869 - protein, 9 aa, Homo Sapiens
LGLWEVGTG

SEQ ID NO: 256870 - protein, 9 aa, Homo Sapiens
RHKQLESAG

SEQ ID NO: 256871 - protein, 9 aa, Homo Sapiens
SFFGGSGSK

SEQ ID NO: 256872 - protein, 9 aa, Homo Sapiens
SEQHRNCAQ

SEQ ID NO: 256873 - protein, 9 aa, Homo Sapiens
KWFILIYKL

SEQ ID NO: 256874 - protein, 9 aa, Homo Sapiens
HFLEAEFLI

SEQ ID NO: 256875 - protein, 9 aa, Homo Sapiens
FFKFEASGS

SEQ ID NO: 256876 - protein, 9 aa, Homo Sapiens
LLISLAHVD

SEQ ID NO: 256877 - protein, 9 aa, Homo Sapiens
LISFRLKPG

SEQ ID NO: 256878 - protein, 9 aa, Homo Sapiens
SSGCLHGSF

SEQ ID NO: 256879 - protein, 9 aa, Homo Sapiens
FNKQLLYDE

SEQ ID NO: 256880 - protein, 9 aa, Homo Sapiens
DFQDIYSEC

SEQ ID NO: 256881 - protein, 9 aa, Homo Sapiens
AAAGLRDDG

SEQ ID NO: 256882 - protein, 9 aa, Homo Sapiens
MVSSTSWTE

SEQ ID NO: 256883 - protein, 9 aa, Homo Sapiens
AQVHLQKVK

SEQ ID NO: 256884 - protein, 9 aa, Homo Sapiens
KVGMQIPRV

SEQ ID NO: 256885 - protein, 9 aa, Homo Sapiens
HPEFEEAYR

SEQ ID NO: 256886 - protein, 9 aa, Homo Sapiens
KPYMCRECE

SEQ ID NO: 256887 - protein, 9 aa, Homo Sapiens
TGQKGKYAS

SEQ ID NO: 256888 - protein, 9 aa, Homo Sapiens
YPGETEDKS

SEQ ID NO: 256889 - protein, 9 aa, Homo Sapiens
GFPVKIGIP

SEQ ID NO: 256890 - protein, 9 aa, Homo Sapiens
ASHYSELLE

SEQ ID NO: 256891 - protein, 9 aa, Homo Sapiens
HLDRDEEDI

SEQ ID NO: 256892 - protein, 9 aa, Homo Sapiens
VGSEGTSQR

SEQ ID NO: 256893 - protein, 9 aa, Homo Sapiens
QCIEQNLTS

SEQ ID NO: 256894 - protein, 9 aa, Homo Sapiens
LLTYKEVAR

SEQ ID NO: 256895 - protein, 9 aa, Homo Sapiens
ASIQAAFSD

SEQ ID NO: 256896 - protein, 9 aa, Homo Sapiens
KLNDFKALD

SEQ ID NO: 256897 - protein, 9 aa, Homo Sapiens
QIEVTFDIY

SEQ ID NO: 256898 - protein, 9 aa, Homo Sapiens
DHPEITYQL

SEQ ID NO: 256899 - protein, 9 aa, Homo Sapiens
VRGCRPEKI

SEQ ID NO: 256900 - protein, 9 aa, Homo Sapiens
PVEKETETM

SEQ ID NO: 256901 - protein, 9 aa, Homo Sapiens
ESNPRIFLP

SEQ ID NO: 256902 - protein, 9 aa, Homo Sapiens
YTSPTWSAS

SEQ ID NO: 256903 - protein, 9 aa, Homo Sapiens
TSEPLRQEQ

SEQ ID NO: 256904 - protein, 9 aa, Homo Sapiens
NVGGKYVNL

SEQ ID NO: 256905 - protein, 9 aa, Homo Sapiens
HYTARMNLR

SEQ ID NO: 256906 - protein, 9 aa, Homo Sapiens
HHSENNWNR

SEQ ID NO: 256907 - protein, 9 aa, Homo Sapiens
GKAMRKAAS

SEQ ID NO: 256908 - protein, 9 aa, Homo Sapiens
KAIKVLISF

SEQ ID NO: 256909 - protein, 9 aa, Homo Sapiens
VSIFRDVNN

SEQ ID NO: 256910 - protein, 9 aa, Homo Sapiens
PPLAPSKGR

SEQ ID NO: 256911 - protein, 9 aa, Homo Sapiens
AKRKASEEA

SEQ ID NO: 256912 - protein, 9 aa, Homo Sapiens
ACMPVLVLM

SEQ ID NO: 256913 - protein, 9 aa, Homo Sapiens
LPTGEVLET

SEQ ID NO: 256914 - protein, 9 aa, Homo Sapiens
YIHHVVSVA

SEQ ID NO: 256915 - protein, 9 aa, Homo Sapiens
SQAFYSLKS

SEQ ID NO: 256916 - protein, 9 aa, Homo Sapiens
YGNKLGLTS

SEQ ID NO: 256917 - protein, 9 aa, Homo Sapiens
TFQASLSFQ

SEQ ID NO: 256918 - protein, 9 aa, Homo Sapiens
NSHTDSDSM

SEQ ID NO: 256919 - protein, 9 aa, Homo Sapiens
FLKCIQESE

SEQ ID NO: 256920 - protein, 9 aa, Homo Sapiens
KEGTARSGG

SEQ ID NO: 256921 - protein, 9 aa, Homo Sapiens
PGRPSSGQI

SEQ ID NO: 256922 - protein, 9 aa, Homo Sapiens
VWVLFELAR

SEQ ID NO: 256923 - protein, 9 aa, Homo Sapiens
AISTSIPVV

SEQ ID NO: 256924 - protein, 9 aa, Homo Sapiens
DAICNNKFF

SEQ ID NO: 256925 - protein, 9 aa, Homo Sapiens
AQQGKHSLR

SEQ ID NO: 256926 - protein, 9 aa, Homo Sapiens
EKVKSYSMP

SEQ ID NO: 256927 - protein, 9 aa, Homo Sapiens
AAYAHKLPK

SEQ ID NO: 256928 - protein, 9 aa, Homo Sapiens
VILGFSSFG

SEQ ID NO: 256929 - protein, 9 aa, Homo Sapiens
FGVLTGLAT

SEQ ID NO: 256930 - protein, 9 aa, Homo Sapiens
QVKTQSQLS

SEQ ID NO: 256931 - protein, 9 aa, Homo Sapiens
TKIKGSVYE

SEQ ID NO: 256932 - protein, 9 aa, Homo Sapiens
HAKRLSTRL

SEQ ID NO: 256933 - protein, 9 aa, Homo Sapiens
TGTVHRINN

SEQ ID NO: 256934 - protein, 9 aa, Homo Sapiens
ALHEQPELQ

SEQ ID NO: 256935 - protein, 9 aa, Homo Sapiens
PEILISRLY

SEQ ID NO: 256936 - protein, 9 aa, Homo Sapiens
GVEVVTENY

SEQ ID NO: 256937 - protein, 9 aa, Homo Sapiens
MEESSSVGM

SEQ ID NO: 256938 - protein, 9 aa, Homo Sapiens
SKRAILNVM

SEQ ID NO: 256939 - protein, 9 aa, Homo Sapiens
RWLSDLAKH

SEQ ID NO: 256940 - protein, 9 aa, Homo Sapiens
IRKKIEPDA

SEQ ID NO: 256941 - protein, 9 aa, Homo Sapiens
TWSASVTDS

SEQ ID NO: 256942 - protein, 9 aa, Homo Sapiens
GSMGEISAY

SEQ ID NO: 256943 - protein, 9 aa, Homo Sapiens
DPINAGLKG

SEQ ID NO: 256944 - protein, 9 aa, Homo Sapiens
QGRKVEGAP

SEQ ID NO: 256945 - protein, 9 aa, Homo Sapiens
EEMETYQES

SEQ ID NO: 256946 - protein, 9 aa, Homo Sapiens
ILIIEGVLL

SEQ ID NO: 256947 - protein, 9 aa, Homo Sapiens
FGSSYIRIF

SEQ ID NO: 256948 - protein, 9 aa, Homo Sapiens
FATGCSSIL

SEQ ID NO: 256949 - protein, 9 aa, Homo Sapiens
TQGAKIVYL

SEQ ID NO: 256950 - protein, 9 aa, Homo Sapiens
PWTVRPFSK

SEQ ID NO: 256951 - protein, 9 aa, Homo Sapiens
MELCGATRR

SEQ ID NO: 256952 - protein, 9 aa, Homo Sapiens
IQIIDFGLA

SEQ ID NO: 256953 - protein, 9 aa, Homo Sapiens
KTFSGATML

SEQ ID NO: 256954 - protein, 9 aa, Homo Sapiens
FSYYIHPVC

SEQ ID NO: 256955 - protein, 9 aa, Homo Sapiens
SETPINENA

SEQ ID NO: 256956 - protein, 9 aa, Homo Sapiens
NPTKHQRSH

SEQ ID NO: 256957 - protein, 9 aa, Homo Sapiens
KLQLDLSIV

SEQ ID NO: 256958 - protein, 9 aa, Homo Sapiens
ECIAHCKSN

SEQ ID NO: 256959 - protein, 9 aa, Homo Sapiens
SVSLLEEIE

SEQ ID NO: 256960 - protein, 9 aa, Homo Sapiens
CPQCQDFVP

SEQ ID NO: 256961 - protein, 9 aa, Homo Sapiens
VISCSHFVP

SEQ ID NO: 256962 - protein, 9 aa, Homo Sapiens
DTEGEYNRA

SEQ ID NO: 256963 - protein, 9 aa, Homo Sapiens
EAYKHFKPE

SEQ ID NO: 256964 - protein, 9 aa, Homo Sapiens
KAYSWTETL

SEQ ID NO: 256965 - protein, 9 aa, Homo Sapiens
DTTPPALAS

SEQ ID NO: 256966 - protein, 9 aa, Homo Sapiens
SLEKFFLRS

SEQ ID NO: 256967 - protein, 9 aa, Homo Sapiens
DFENSMKIY

SEQ ID NO: 256968 - protein, 9 aa, Homo Sapiens
KLCPRPDEV

SEQ ID NO: 256969 - protein, 9 aa, Homo Sapiens
LLKLSREKK

SEQ ID NO: 256970 - protein, 9 aa, Homo Sapiens
DMLVMEQLM

SEQ ID NO: 256971 - protein, 9 aa, Homo Sapiens
GSFQCLCHV

SEQ ID NO: 256972 - protein, 9 aa, Homo Sapiens
KPKHYLTDA

SEQ ID NO: 256973 - protein, 9 aa, Homo Sapiens
KLNKKSLRS

SEQ ID NO: 256974 - protein, 9 aa, Homo Sapiens
GKAEYNVLP

SEQ ID NO: 256975 - protein, 9 aa, Homo Sapiens
LNHNSDLIG

SEQ ID NO: 256976 - protein, 9 aa, Homo Sapiens
ESMLNTNPS

SEQ ID NO: 256977 - protein, 9 aa, Homo Sapiens
GMLGYPGYQ

SEQ ID NO: 256978 - protein, 9 aa, Homo Sapiens
NFDALISKM

SEQ ID NO: 256979 - protein, 9 aa, Homo Sapiens
LLISIKMRL

SEQ ID NO: 256980 - protein, 9 aa, Homo Sapiens
YQRLQGNDL

SEQ ID NO: 256981 - protein, 9 aa, Homo Sapiens
HICMVNIAL

SEQ ID NO: 256982 - protein, 9 aa, Homo Sapiens
PRVIHLHEV

SEQ ID NO: 256983 - protein, 9 aa, Homo Sapiens
YLLLEEGSK

SEQ ID NO: 256984 - protein, 9 aa, Homo Sapiens
ALQKHGEDY

SEQ ID NO: 256985 - protein, 9 aa, Homo Sapiens
WQKTAKGAE

SEQ ID NO: 256986 - protein, 9 aa, Homo Sapiens
ENEEDKNVI

SEQ ID NO: 256987 - protein, 9 aa, Homo Sapiens
PVIQFKGQH

SEQ ID NO: 256988 - protein, 9 aa, Homo Sapiens
VDSLDFNTK

SEQ ID NO: 256989 - protein, 9 aa, Homo Sapiens
VLKVFGKEQ

SEQ ID NO: 256990 - protein, 9 aa, Homo Sapiens
HTTAAPVDS

SEQ ID NO: 256991 - protein, 9 aa, Homo Sapiens
EESFQESKR

SEQ ID NO: 256992 - protein, 9 aa, Homo Sapiens
NCQNKSLSR

SEQ ID NO: 256993 - protein, 9 aa, Homo Sapiens
FMSTVSYME

SEQ ID NO: 256994 - protein, 9 aa, Homo Sapiens
NAQFSTLIF

SEQ ID NO: 256995 - protein, 9 aa, Homo Sapiens
QVNTFALAS

SEQ ID NO: 256996 - protein, 9 aa, Homo Sapiens
SRMNNKLWY

SEQ ID NO: 256997 - protein, 9 aa, Homo Sapiens
LSLHQAFSD

SEQ ID NO: 256998 - protein, 9 aa, Homo Sapiens
GIPLFHVLN

SEQ ID NO: 256999 - protein, 9 aa, Homo Sapiens
DSLTNVDLG

SEQ ID NO: 257000 - protein, 9 aa, Homo Sapiens
GITLFLSAC

SEQ ID NO: 257001 - protein, 9 aa, Homo Sapiens
IFLNMEHES

SEQ ID NO: 257002 - protein, 9 aa, Homo Sapiens
MRREVVQRG

SEQ ID NO: 257003 - protein, 9 aa, Homo Sapiens
NMGNPMAKH

SEQ ID NO: 257004 - protein, 9 aa, Homo Sapiens
LWGLVNTAG

SEQ ID NO: 257005 - protein, 9 aa, Homo Sapiens
FVFVCLFVC

SEQ ID NO: 257006 - protein, 9 aa, Homo Sapiens
TLELIKGTL

SEQ ID NO: 257007 - protein, 9 aa, Homo Sapiens
WDSDTCSTS

SEQ ID NO: 257008 - protein, 9 aa, Homo Sapiens
QVIKECSIT

SEQ ID NO: 257009 - protein, 9 aa, Homo Sapiens
TFLHKRKTE

SEQ ID NO: 257010 - protein, 9 aa, Homo Sapiens
AANRTCLCF

SEQ ID NO: 257011 - protein, 9 aa, Homo Sapiens
CIIAKHIGK

SEQ ID NO: 257012 - protein, 9 aa, Homo Sapiens
VCHAGIDTD

SEQ ID NO: 257013 - protein, 9 aa, Homo Sapiens
PMSGVSVRA

SEQ ID NO: 257014 - protein, 9 aa, Homo Sapiens
SVGCCSEQQ

SEQ ID NO: 257015 - protein, 9 aa, Homo Sapiens
LVDGVYCIP

SEQ ID NO: 257016 - protein, 9 aa, Homo Sapiens
LEHLYYNGV

SEQ ID NO: 257017 - protein, 9 aa, Homo Sapiens
CDIWFRQFN

SEQ ID NO: 257018 - protein, 9 aa, Homo Sapiens
KKYQVELLE

SEQ ID NO: 257019 - protein, 9 aa, Homo Sapiens
KDSLDNMTC

SEQ ID NO: 257020 - protein, 9 aa, Homo Sapiens
AELQEMASC

SEQ ID NO: 257021 - protein, 9 aa, Homo Sapiens
ERLAELRRI

SEQ ID NO: 257022 - protein, 9 aa, Homo Sapiens
SMNDRNYAD

SEQ ID NO: 257023 - protein, 9 aa, Homo Sapiens
GKEYILPAL

SEQ ID NO: 257024 - protein, 9 aa, Homo Sapiens
TRSSQFGSL

SEQ ID NO: 257025 - protein, 9 aa, Homo Sapiens
FLPGGTLCQ

SEQ ID NO: 257026 - protein, 9 aa, Homo Sapiens
GSYFSQRAG

SEQ ID NO: 257027 - protein, 9 aa, Homo Sapiens
PASGAYIVF

SEQ ID NO: 257028 - protein, 9 aa, Homo Sapiens
IYSLMNKDV

SEQ ID NO: 257029 - protein, 9 aa, Homo Sapiens
EYNRASSEN

SEQ ID NO: 257030 - protein, 9 aa, Homo Sapiens
QNSSTSLSN

SEQ ID NO: 257031 - protein, 9 aa, Homo Sapiens
SLGELFLDG

SEQ ID NO: 257032 - protein, 9 aa, Homo Sapiens
CEKAFRKPY

SEQ ID NO: 257033 - protein, 9 aa, Homo Sapiens
VLEKQKKVI

SEQ ID NO: 257034 - protein, 9 aa, Homo Sapiens
NEKKPECGS

SEQ ID NO: 257035 - protein, 9 aa, Homo Sapiens
DLKSGVCTL

SEQ ID NO: 257036 - protein, 9 aa, Homo Sapiens
VAVYLIRKE

SEQ ID NO: 257037 - protein, 9 aa, Homo Sapiens
NKFPHYSPM

SEQ ID NO: 257038 - protein, 9 aa, Homo Sapiens
TSVGFFFHI

SEQ ID NO: 257039 - protein, 9 aa, Homo Sapiens
GVTLVIYIA

SEQ ID NO: 257040 - protein, 9 aa, Homo Sapiens
WCRDLKIIY

SEQ ID NO: 257041 - protein, 9 aa, Homo Sapiens
MLTPWIVAV

SEQ ID NO: 257042 - protein, 9 aa, Homo Sapiens
VYEQYKKED

SEQ ID NO: 257043 - protein, 9 aa, Homo Sapiens
GEHDSQVSE

SEQ ID NO: 257044 - protein, 9 aa, Homo Sapiens
LINKACDES

SEQ ID NO: 257045 - protein, 9 aa, Homo Sapiens
DDGGKVLLP

SEQ ID NO: 257046 - protein, 9 aa, Homo Sapiens
PGMCAALSP

SEQ ID NO: 257047 - protein, 9 aa, Homo Sapiens
LSFNDIHYF

SEQ ID NO: 257048 - protein, 9 aa, Homo Sapiens
IEPSEDSCE

SEQ ID NO: 257049 - protein, 9 aa, Homo Sapiens
WALGCVLYK

SEQ ID NO: 257050 - protein, 9 aa, Homo Sapiens
SPSPGPFQP

SEQ ID NO: 257051 - protein, 9 aa, Homo Sapiens
CFINHQCVH

SEQ ID NO: 257052 - protein, 9 aa, Homo Sapiens
SSHFCPHVK

SEQ ID NO: 257053 - protein, 9 aa, Homo Sapiens
EARWEQPQL

SEQ ID NO: 257054 - protein, 9 aa, Homo Sapiens
GSILGNLKY

SEQ ID NO: 257055 - protein, 9 aa, Homo Sapiens
FETDVADDD

SEQ ID NO: 257056 - protein, 9 aa, Homo Sapiens
QLSELKEKL

SEQ ID NO: 257057 - protein, 9 aa, Homo Sapiens
KECIQEPSY

SEQ ID NO: 257058 - protein, 9 aa, Homo Sapiens
GKLWSILRD

SEQ ID NO: 257059 - protein, 9 aa, Homo Sapiens
ILKESISYI

SEQ ID NO: 257060 - protein, 9 aa, Homo Sapiens
STQSRMDWG

SEQ ID NO: 257061 - protein, 9 aa, Homo Sapiens
CQSACCQPT

SEQ ID NO: 257062 - protein, 9 aa, Homo Sapiens
SYDADVTVS

SEQ ID NO: 257063 - protein, 9 aa, Homo Sapiens
NFRMFFTSG

SEQ ID NO: 257064 - protein, 9 aa, Homo Sapiens
RLMGTNLSK

SEQ ID NO: 257065 - protein, 9 aa, Homo Sapiens
NTMFTDCYI

SEQ ID NO: 257066 - protein, 9 aa, Homo Sapiens
MKLSIIHHD

SEQ ID NO: 257067 - protein, 9 aa, Homo Sapiens
FGTPQDSPE

SEQ ID NO: 257068 - protein, 9 aa, Homo Sapiens
ASFEKDKHS

SEQ ID NO: 257069 - protein, 9 aa, Homo Sapiens
RCCIPNTSK

SEQ ID NO: 257070 - protein, 9 aa, Homo Sapiens
GTALPFSAR

SEQ ID NO: 257071 - protein, 9 aa, Homo Sapiens
DFRNILRIG

SEQ ID NO: 257072 - protein, 9 aa, Homo Sapiens
HGSLGAAGR

SEQ ID NO: 257073 - protein, 9 aa, Homo Sapiens
SPERFPVPS

SEQ ID NO: 257074 - protein, 9 aa, Homo Sapiens
QLSCLLESN

SEQ ID NO: 257075 - protein, 9 aa, Homo Sapiens
LKSKLVIWD

SEQ ID NO: 257076 - protein, 9 aa, Homo Sapiens
IEPKKLAGV

SEQ ID NO: 257077 - protein, 9 aa, Homo Sapiens
TPCFNYMHE

SEQ ID NO: 257078 - protein, 9 aa, Homo Sapiens
RKVEESLMM

SEQ ID NO: 257079 - protein, 9 aa, Homo Sapiens
YVEYFWWPM

SEQ ID NO: 257080 - protein, 9 aa, Homo Sapiens
YGFIKSPGY

SEQ ID NO: 257081 - protein, 9 aa, Homo Sapiens
NAQLVYNIT

SEQ ID NO: 257082 - protein, 9 aa, Homo Sapiens
PEGTLLGAG

SEQ ID NO: 257083 - protein, 9 aa, Homo Sapiens
LAANRTCLC

SEQ ID NO: 257084 - protein, 9 aa, Homo Sapiens
NDAGVMMCP

SEQ ID NO: 257085 - protein, 9 aa, Homo Sapiens
VKSGPNRSH

SEQ ID NO: 257086 - protein, 9 aa, Homo Sapiens
EIDSHNFAI

SEQ ID NO: 257087 - protein, 9 aa, Homo Sapiens
KEHGEIEVT

SEQ ID NO: 257088 - protein, 9 aa, Homo Sapiens
PQMNTLKKR

SEQ ID NO: 257089 - protein, 9 aa, Homo Sapiens
KPTSFLCLT

SEQ ID NO: 257090 - protein, 9 aa, Homo Sapiens
ATANNCFEL

SEQ ID NO: 257091 - protein, 9 aa, Homo Sapiens
LQGLREDAL

SEQ ID NO: 257092 - protein, 9 aa, Homo Sapiens
LTEDEKKEI

SEQ ID NO: 257093 - protein, 9 aa, Homo Sapiens
VTDKSRQKE

SEQ ID NO: 257094 - protein, 9 aa, Homo Sapiens
SKEMQVRQR

SEQ ID NO: 257095 - protein, 9 aa, Homo Sapiens
FKNTLYDQH

SEQ ID NO: 257096 - protein, 9 aa, Homo Sapiens
TSLELFSKK

SEQ ID NO: 257097 - protein, 9 aa, Homo Sapiens
LMVQAIKTD

SEQ ID NO: 257098 - protein, 9 aa, Homo Sapiens
PVCLVTVDG

SEQ ID NO: 257099 - protein, 9 aa, Homo Sapiens
SLTNVDLGG

SEQ ID NO: 257100 - protein, 9 aa, Homo Sapiens
AMFRPSVEV

SEQ ID NO: 257101 - protein, 9 aa, Homo Sapiens
GWVMFVSVS

SEQ ID NO: 257102 - protein, 9 aa, Homo Sapiens
RNRDGPADV

SEQ ID NO: 257103 - protein, 9 aa, Homo Sapiens
NRADPNIQY

SEQ ID NO: 257104 - protein, 9 aa, Homo Sapiens
GKLFLLHHK

SEQ ID NO: 257105 - protein, 9 aa, Homo Sapiens
CHKGPKKVS

SEQ ID NO: 257106 - protein, 9 aa, Homo Sapiens
RDNTLYYYN

SEQ ID NO: 257107 - protein, 9 aa, Homo Sapiens
KGESVWLNL

SEQ ID NO: 257108 - protein, 9 aa, Homo Sapiens
KTEDMKRYL

SEQ ID NO: 257109 - protein, 9 aa, Homo Sapiens
DWSQGAIIA

SEQ ID NO: 257110 - protein, 9 aa, Homo Sapiens
GIPITGRRS

SEQ ID NO: 257111 - protein, 9 aa, Homo Sapiens
LEACFDVHR

SEQ ID NO: 257112 - protein, 9 aa, Homo Sapiens
LATRYLLPC

SEQ ID NO: 257113 - protein, 9 aa, Homo Sapiens
RKQVLKIYN

SEQ ID NO: 257114 - protein, 9 aa, Homo Sapiens
SPHKAVTRP

SEQ ID NO: 257115 - protein, 9 aa, Homo Sapiens
ESRETCSIA

SEQ ID NO: 257116 - protein, 9 aa, Homo Sapiens
KGHDTPRLI

SEQ ID NO: 257117 - protein, 9 aa, Homo Sapiens
INQEQTEAL

SEQ ID NO: 257118 - protein, 9 aa, Homo Sapiens
HNLTSTKKV

SEQ ID NO: 257119 - protein, 9 aa, Homo Sapiens
PNMDSSVPW

SEQ ID NO: 257120 - protein, 9 aa, Homo Sapiens
VGRKDLLCR

SEQ ID NO: 257121 - protein, 9 aa, Homo Sapiens
TLYEDRAFQ

SEQ ID NO: 257122 - protein, 9 aa, Homo Sapiens
YNAVGAMTD

SEQ ID NO: 257123 - protein, 9 aa, Homo Sapiens
SWRGEGNTT

SEQ ID NO: 257124 - protein, 9 aa, Homo Sapiens
RKVKCASCI

SEQ ID NO: 257125 - protein, 9 aa, Homo Sapiens
IWDSQERAF

SEQ ID NO: 257126 - protein, 9 aa, Homo Sapiens
LARHQQIHT

SEQ ID NO: 257127 - protein, 9 aa, Homo Sapiens
GTDEERPDL

SEQ ID NO: 257128 - protein, 9 aa, Homo Sapiens
HFLDSKLVP

SEQ ID NO: 257129 - protein, 9 aa, Homo Sapiens
EGHKHKKKE

SEQ ID NO: 257130 - protein, 9 aa, Homo Sapiens
KLQTDIHEL

SEQ ID NO: 257131 - protein, 9 aa, Homo Sapiens
AIPNVTVPS

SEQ ID NO: 257132 - protein, 9 aa, Homo Sapiens
HDSQVSEIL

SEQ ID NO: 257133 - protein, 9 aa, Homo Sapiens
KIPLNGRPI

SEQ ID NO: 257134 - protein, 9 aa, Homo Sapiens
VVTVMGNIS

SEQ ID NO: 257135 - protein, 9 aa, Homo Sapiens
TLPKYYILL

SEQ ID NO: 257136 - protein, 9 aa, Homo Sapiens
PYSFQPDVY

SEQ ID NO: 257137 - protein, 9 aa, Homo Sapiens
FYDKCGKNP

SEQ ID NO: 257138 - protein, 9 aa, Homo Sapiens
GDNKHLIFR

SEQ ID NO: 257139 - protein, 9 aa, Homo Sapiens
LLYPDLILI

SEQ ID NO: 257140 - protein, 9 aa, Homo Sapiens
LISTEDGEE

SEQ ID NO: 257141 - protein, 9 aa, Homo Sapiens
SHKQVKSLP

SEQ ID NO: 257142 - protein, 9 aa, Homo Sapiens
KESMDANEP

SEQ ID NO: 257143 - protein, 9 aa, Homo Sapiens
RNSSILGPH

SEQ ID NO: 257144 - protein, 9 aa, Homo Sapiens
LKEKEQQKL

SEQ ID NO: 257145 - protein, 9 aa, Homo Sapiens
EKPKIGDAK

SEQ ID NO: 257146 - protein, 9 aa, Homo Sapiens
EDLRSKANI

SEQ ID NO: 257147 - protein, 9 aa, Homo Sapiens
KSIKIILIV

SEQ ID NO: 257148 - protein, 9 aa, Homo Sapiens
SDMVSQAGL

SEQ ID NO: 257149 - protein, 9 aa, Homo Sapiens
TGEKFYKCT

SEQ ID NO: 257150 - protein, 9 aa, Homo Sapiens
SLLEPSVNI

SEQ ID NO: 257151 - protein, 9 aa, Homo Sapiens
VEQCVNETS

SEQ ID NO: 257152 - protein, 9 aa, Homo Sapiens
INIRKDLYA

SEQ ID NO: 257153 - protein, 9 aa, Homo Sapiens
VDKMQDRLD

SEQ ID NO: 257154 - protein, 9 aa, Homo Sapiens
DVSNVIKKV

SEQ ID NO: 257155 - protein, 9 aa, Homo Sapiens
GYGMLSIRV

SEQ ID NO: 257156 - protein, 9 aa, Homo Sapiens
CANIKHQQN

SEQ ID NO: 257157 - protein, 9 aa, Homo Sapiens
PLWIDWQWQ

SEQ ID NO: 257158 - protein, 9 aa, Homo Sapiens
HVEQMAINW

SEQ ID NO: 257159 - protein, 9 aa, Homo Sapiens
DGKLKCWYC

SEQ ID NO: 257160 - protein, 9 aa, Homo Sapiens
NLNCTALCE

SEQ ID NO: 257161 - protein, 9 aa, Homo Sapiens
AGKLPLQPH

SEQ ID NO: 257162 - protein, 9 aa, Homo Sapiens
PFLETVFSE

SEQ ID NO: 257163 - protein, 9 aa, Homo Sapiens
ATSVQNLAN

SEQ ID NO: 257164 - protein, 9 aa, Homo Sapiens
LYNIVMPHR

SEQ ID NO: 257165 - protein, 9 aa, Homo Sapiens
KHEHVIGLL

SEQ ID NO: 257166 - protein, 9 aa, Homo Sapiens
GTDEAEDPE

SEQ ID NO: 257167 - protein, 9 aa, Homo Sapiens
VCQSGYFSS

SEQ ID NO: 257168 - protein, 9 aa, Homo Sapiens
EIDLLNGDL

SEQ ID NO: 257169 - protein, 9 aa, Homo Sapiens
VAELSILEA

SEQ ID NO: 257170 - protein, 9 aa, Homo Sapiens
KAFSCKDTL

SEQ ID NO: 257171 - protein, 9 aa, Homo Sapiens
DKQYMKSLQ

SEQ ID NO: 257172 - protein, 9 aa, Homo Sapiens
GRFQELDIR

SEQ ID NO: 257173 - protein, 9 aa, Homo Sapiens
GKPFIYVNA

SEQ ID NO: 257174 - protein, 9 aa, Homo Sapiens
MLKEALGPI

SEQ ID NO: 257175 - protein, 9 aa, Homo Sapiens
RKANPSSLV

SEQ ID NO: 257176 - protein, 9 aa, Homo Sapiens
DDAKAAKDA

SEQ ID NO: 257177 - protein, 9 aa, Homo Sapiens
SLNWNHDSE

SEQ ID NO: 257178 - protein, 9 aa, Homo Sapiens
GGKCRNVSV

SEQ ID NO: 257179 - protein, 9 aa, Homo Sapiens
ECDKTLKRL

SEQ ID NO: 257180 - protein, 9 aa, Homo Sapiens
GICKSFTNF

SEQ ID NO: 257181 - protein, 9 aa, Homo Sapiens
GTVQVQWEI

SEQ ID NO: 257182 - protein, 9 aa, Homo Sapiens
CKSHSKFMK

SEQ ID NO: 257183 - protein, 9 aa, Homo Sapiens
RTRGVFSFL

SEQ ID NO: 257184 - protein, 9 aa, Homo Sapiens
WSIIMNSVV

SEQ ID NO: 257185 - protein, 9 aa, Homo Sapiens
VQIYVGEVV

SEQ ID NO: 257186 - protein, 9 aa, Homo Sapiens
NRPSFYHLS

SEQ ID NO: 257187 - protein, 9 aa, Homo Sapiens
VILAFDVKI

SEQ ID NO: 257188 - protein, 9 aa, Homo Sapiens
TPYNYPVPI

SEQ ID NO: 257189 - protein, 9 aa, Homo Sapiens
ELFSKKSDC

SEQ ID NO: 257190 - protein, 9 aa, Homo Sapiens
QQTKPQMQE

SEQ ID NO: 257191 - protein, 9 aa, Homo Sapiens
RALPDNEFK

SEQ ID NO: 257192 - protein, 9 aa, Homo Sapiens
TTLRCRAFN

SEQ ID NO: 257193 - protein, 9 aa, Homo Sapiens
DTRCLGVTA

SEQ ID NO: 257194 - protein, 9 aa, Homo Sapiens
DREVQLGRN

SEQ ID NO: 257195 - protein, 9 aa, Homo Sapiens
LDLQSPNQQ

SEQ ID NO: 257196 - protein, 9 aa, Homo Sapiens
RKVCIDTIP

SEQ ID NO: 257197 - protein, 9 aa, Homo Sapiens
FGSFVEVQG

SEQ ID NO: 257198 - protein, 9 aa, Homo Sapiens
ESSTNVDMI

SEQ ID NO: 257199 - protein, 9 aa, Homo Sapiens
SFENVMATK

SEQ ID NO: 257200 - protein, 9 aa, Homo Sapiens
AAIESVQGV

SEQ ID NO: 257201 - protein, 9 aa, Homo Sapiens
FQNENVSSS

SEQ ID NO: 257202 - protein, 9 aa, Homo Sapiens
IAHVGSDDE

SEQ ID NO: 257203 - protein, 9 aa, Homo Sapiens
KFQESNDTT

SEQ ID NO: 257204 - protein, 9 aa, Homo Sapiens
DGGFFPQTL

SEQ ID NO: 257205 - protein, 9 aa, Homo Sapiens
KKSEAASET

SEQ ID NO: 257206 - protein, 9 aa, Homo Sapiens
DSDTCSTSS

SEQ ID NO: 257207 - protein, 9 aa, Homo Sapiens
AQRFCDNII

SEQ ID NO: 257208 - protein, 9 aa, Homo Sapiens
YGFSDPLTG

SEQ ID NO: 257209 - protein, 9 aa, Homo Sapiens
AGALRNFSA

SEQ ID NO: 257210 - protein, 9 aa, Homo Sapiens
EIFHPFVKD

SEQ ID NO: 257211 - protein, 9 aa, Homo Sapiens
HIKCLESQI

SEQ ID NO: 257212 - protein, 9 aa, Homo Sapiens
HTYIKFFVP

SEQ ID NO: 257213 - protein, 9 aa, Homo Sapiens
LNDLQTICA

SEQ ID NO: 257214 - protein, 9 aa, Homo Sapiens
FRMFFTSGS

SEQ ID NO: 257215 - protein, 9 aa, Homo Sapiens
IPIIQIISH

SEQ ID NO: 257216 - protein, 9 aa, Homo Sapiens
TQMLKLQHL

SEQ ID NO: 257217 - protein, 9 aa, Homo Sapiens
TFDLQIIGF

SEQ ID NO: 257218 - protein, 9 aa, Homo Sapiens
TIYLYRFLP

SEQ ID NO: 257219 - protein, 9 aa, Homo Sapiens
PSRSQFITV

SEQ ID NO: 257220 - protein, 9 aa, Homo Sapiens
EDTAFRTDN

SEQ ID NO: 257221 - protein, 9 aa, Homo Sapiens
CGGVKGMLH

SEQ ID NO: 257222 - protein, 9 aa, Homo Sapiens
HSYEQKAKE

SEQ ID NO: 257223 - protein, 9 aa, Homo Sapiens
IPLNVRYIV

SEQ ID NO: 257224 - protein, 9 aa, Homo Sapiens
PRPHKVRCN

SEQ ID NO: 257225 - protein, 9 aa, Homo Sapiens
HSYIDVEGP

SEQ ID NO: 257226 - protein, 9 aa, Homo Sapiens
AQKENTAAK

SEQ ID NO: 257227 - protein, 9 aa, Homo Sapiens
LDSQTCYLE

SEQ ID NO: 257228 - protein, 9 aa, Homo Sapiens
VIANKTNRG

SEQ ID NO: 257229 - protein, 9 aa, Homo Sapiens
SEELSALKT

SEQ ID NO: 257230 - protein, 9 aa, Homo Sapiens
YYSLEYLNN

SEQ ID NO: 257231 - protein, 9 aa, Homo Sapiens
LGGPGIPGM

SEQ ID NO: 257232 - protein, 9 aa, Homo Sapiens
QPAIENIQV

SEQ ID NO: 257233 - protein, 9 aa, Homo Sapiens
ALYRQRSQT

SEQ ID NO: 257234 - protein, 9 aa, Homo Sapiens
GHCQALVPE

SEQ ID NO: 257235 - protein, 9 aa, Homo Sapiens
STLSIPPGM

SEQ ID NO: 257236 - protein, 9 aa, Homo Sapiens
ALLDPSQNN

SEQ ID NO: 257237 - protein, 9 aa, Homo Sapiens
LMPQDSGVY

SEQ ID NO: 257238 - protein, 9 aa, Homo Sapiens
HMEMVQIEE

SEQ ID NO: 257239 - protein, 9 aa, Homo Sapiens
QLFNKVVPH

SEQ ID NO: 257240 - protein, 9 aa, Homo Sapiens
YYATVNELA

SEQ ID NO: 257241 - protein, 9 aa, Homo Sapiens
QQVSYGQRL

SEQ ID NO: 257242 - protein, 9 aa, Homo Sapiens
EVRGCRPEK

SEQ ID NO: 257243 - protein, 9 aa, Homo Sapiens
VLDQHATSP

SEQ ID NO: 257244 - protein, 9 aa, Homo Sapiens
SLTRNTNIL

SEQ ID NO: 257245 - protein, 9 aa, Homo Sapiens
QKRKVQRYL

SEQ ID NO: 257246 - protein, 9 aa, Homo Sapiens
EELQKLLNF

SEQ ID NO: 257247 - protein, 9 aa, Homo Sapiens
LLLVSLTSL

SEQ ID NO: 257248 - protein, 9 aa, Homo Sapiens
RNHQPPQTK

SEQ ID NO: 257249 - protein, 9 aa, Homo Sapiens
IGKRGSDSI

SEQ ID NO: 257250 - protein, 9 aa, Homo Sapiens
IQKAQQSGR

SEQ ID NO: 257251 - protein, 9 aa, Homo Sapiens
ATVRTVLKQ

SEQ ID NO: 257252 - protein, 9 aa, Homo Sapiens
TMEHISDKV

SEQ ID NO: 257253 - protein, 9 aa, Homo Sapiens
LFVLEEHMG

SEQ ID NO: 257254 - protein, 9 aa, Homo Sapiens
RPDLFDLNS

SEQ ID NO: 257255 - protein, 9 aa, Homo Sapiens
EELNTLLGR

SEQ ID NO: 257256 - protein, 9 aa, Homo Sapiens
CKEIGAIAH

SEQ ID NO: 257257 - protein, 9 aa, Homo Sapiens
HNPWTVRPF

SEQ ID NO: 257258 - protein, 9 aa, Homo Sapiens
ITMMGNVGM

SEQ ID NO: 257259 - protein, 9 aa, Homo Sapiens
ILLILWLPF

SEQ ID NO: 257260 - protein, 9 aa, Homo Sapiens
NQENTTYLK

SEQ ID NO: 257261 - protein, 9 aa, Homo Sapiens
ISNQIRSRP

SEQ ID NO: 257262 - protein, 9 aa, Homo Sapiens
QKFELHPQI

SEQ ID NO: 257263 - protein, 9 aa, Homo Sapiens
DVFFQQKWK

SEQ ID NO: 257264 - protein, 9 aa, Homo Sapiens
KGTVQSKLH

SEQ ID NO: 257265 - protein, 9 aa, Homo Sapiens
TIKSQGQDV

SEQ ID NO: 257266 - protein, 9 aa, Homo Sapiens
LNMSDWEVQ

SEQ ID NO: 257267 - protein, 9 aa, Homo Sapiens
IQGAKLIWS

SEQ ID NO: 257268 - protein, 9 aa, Homo Sapiens
QPELMILAS

SEQ ID NO: 257269 - protein, 9 aa, Homo Sapiens
PESMVRVEA

SEQ ID NO: 257270 - protein, 9 aa, Homo Sapiens
LVAPDGKVA

SEQ ID NO: 257271 - protein, 9 aa, Homo Sapiens
NDPNREMVA

SEQ ID NO: 257272 - protein, 9 aa, Homo Sapiens
TLNLLPQLS

SEQ ID NO: 257273 - protein, 9 aa, Homo Sapiens
HHQAFVKAS

SEQ ID NO: 257274 - protein, 9 aa, Homo Sapiens
TEAQNIRKD

SEQ ID NO: 257275 - protein, 9 aa, Homo Sapiens
GRPLNAEKR

SEQ ID NO: 257276 - protein, 9 aa, Homo Sapiens
PFCCMYIIA

SEQ ID NO: 257277 - protein, 9 aa, Homo Sapiens
APTATVAPQ

SEQ ID NO: 257278 - protein, 9 aa, Homo Sapiens
HKKLELTKM

SEQ ID NO: 257279 - protein, 9 aa, Homo Sapiens
PSADGETSE

SEQ ID NO: 257280 - protein, 9 aa, Homo Sapiens
LIKKCKPEY

SEQ ID NO: 257281 - protein, 9 aa, Homo Sapiens
RMRLYIRRM

SEQ ID NO: 257282 - protein, 9 aa, Homo Sapiens
AASTATEEK

SEQ ID NO: 257283 - protein, 9 aa, Homo Sapiens
DKLGEKAFG

SEQ ID NO: 257284 - protein, 9 aa, Homo Sapiens
LINLHIMHT

SEQ ID NO: 257285 - protein, 9 aa, Homo Sapiens
CVLTITLRE

SEQ ID NO: 257286 - protein, 9 aa, Homo Sapiens
FQFGQPSLF

SEQ ID NO: 257287 - protein, 9 aa, Homo Sapiens
LTPPVPDSF

SEQ ID NO: 257288 - protein, 9 aa, Homo Sapiens
GKTPKFSIK

SEQ ID NO: 257289 - protein, 9 aa, Homo Sapiens
YQGFQAGKH

SEQ ID NO: 257290 - protein, 9 aa, Homo Sapiens
DVVMNDSLF

SEQ ID NO: 257291 - protein, 9 aa, Homo Sapiens
FWKIALPVG

SEQ ID NO: 257292 - protein, 9 aa, Homo Sapiens
TLLETQKVE

SEQ ID NO: 257293 - protein, 9 aa, Homo Sapiens
GYMYPITVP

SEQ ID NO: 257294 - protein, 9 aa, Homo Sapiens
KVDELVACI

SEQ ID NO: 257295 - protein, 9 aa, Homo Sapiens
AFGLDRSLR

SEQ ID NO: 257296 - protein, 9 aa, Homo Sapiens
RTDFKEEPD

SEQ ID NO: 257297 - protein, 9 aa, Homo Sapiens
HVNDDLNTV

SEQ ID NO: 257298 - protein, 9 aa, Homo Sapiens
NFEKPKLTF

SEQ ID NO: 257299 - protein, 9 aa, Homo Sapiens
QTVSQVVHA

SEQ ID NO: 257300 - protein, 9 aa, Homo Sapiens
TYAHPLFYR

SEQ ID NO: 257301 - protein, 9 aa, Homo Sapiens
YIWVQFIYP

SEQ ID NO: 257302 - protein, 9 aa, Homo Sapiens
NDLVAFEHQ

SEQ ID NO: 257303 - protein, 9 aa, Homo Sapiens
YREFLKLQT

SEQ ID NO: 257304 - protein, 9 aa, Homo Sapiens
NLPEKLTAL

SEQ ID NO: 257305 - protein, 9 aa, Homo Sapiens
HNYRGILYR

SEQ ID NO: 257306 - protein, 9 aa, Homo Sapiens
LINKYKQNT

SEQ ID NO: 257307 - protein, 9 aa, Homo Sapiens
PWECNCTLL

SEQ ID NO: 257308 - protein, 9 aa, Homo Sapiens
RRYFSDEEG

SEQ ID NO: 257309 - protein, 9 aa, Homo Sapiens
DSYHFEQLS

SEQ ID NO: 257310 - protein, 9 aa, Homo Sapiens
SRSQSRSNL

SEQ ID NO: 257311 - protein, 9 aa, Homo Sapiens
DFLRLSTHE

SEQ ID NO: 257312 - protein, 9 aa, Homo Sapiens
YINRRERLV

SEQ ID NO: 257313 - protein, 9 aa, Homo Sapiens
LAPSKGRPT

SEQ ID NO: 257314 - protein, 9 aa, Homo Sapiens
KLIKKKRNR

SEQ ID NO: 257315 - protein, 9 aa, Homo Sapiens
PSFVIQMDL

SEQ ID NO: 257316 - protein, 9 aa, Homo Sapiens
PVGDTKWLT

SEQ ID NO: 257317 - protein, 9 aa, Homo Sapiens
ILAFYNNAS

SEQ ID NO: 257318 - protein, 9 aa, Homo Sapiens
GALRTLRFP

SEQ ID NO: 257319 - protein, 9 aa, Homo Sapiens
LGNSENFIL

SEQ ID NO: 257320 - protein, 9 aa, Homo Sapiens
LKQDTYGNI

SEQ ID NO: 257321 - protein, 9 aa, Homo Sapiens
YRRGPHVPV

SEQ ID NO: 257322 - protein, 9 aa, Homo Sapiens
LSFNRIEHA

SEQ ID NO: 257323 - protein, 9 aa, Homo Sapiens
KEVNTTIYV

SEQ ID NO: 257324 - protein, 9 aa, Homo Sapiens
TNCSTVSKS

SEQ ID NO: 257325 - protein, 9 aa, Homo Sapiens
KIRSLTINN

SEQ ID NO: 257326 - protein, 9 aa, Homo Sapiens
QKAARNMSC

SEQ ID NO: 257327 - protein, 9 aa, Homo Sapiens
IDSLKTTQP

SEQ ID NO: 257328 - protein, 9 aa, Homo Sapiens
IVGAPRYKH

SEQ ID NO: 257329 - protein, 9 aa, Homo Sapiens
DAELEDGEG

SEQ ID NO: 257330 - protein, 9 aa, Homo Sapiens
CILSHLVSY

SEQ ID NO: 257331 - protein, 9 aa, Homo Sapiens
IYFIDCVRE

SEQ ID NO: 257332 - protein, 9 aa, Homo Sapiens
HIGSDCPDP

SEQ ID NO: 257333 - protein, 9 aa, Homo Sapiens
RPVIPSSES

SEQ ID NO: 257334 - protein, 9 aa, Homo Sapiens
FVVRRLFKS

SEQ ID NO: 257335 - protein, 9 aa, Homo Sapiens
DVTMLMRKR

SEQ ID NO: 257336 - protein, 9 aa, Homo Sapiens
RLSYGCDPN

SEQ ID NO: 257337 - protein, 9 aa, Homo Sapiens
EYFWWPMLL

SEQ ID NO: 257338 - protein, 9 aa, Homo Sapiens
HATRMRTFM

SEQ ID NO: 257339 - protein, 9 aa, Homo Sapiens
ECNIHTSPF

SEQ ID NO: 257340 - protein, 9 aa, Homo Sapiens
FLCYVNGLC

SEQ ID NO: 257341 - protein, 9 aa, Homo Sapiens
NFNVNYLRK

SEQ ID NO: 257342 - protein, 9 aa, Homo Sapiens
RKTYKMPLG

SEQ ID NO: 257343 - protein, 9 aa, Homo Sapiens
TSKSWMEDT

SEQ ID NO: 257344 - protein, 9 aa, Homo Sapiens
NAIFESLYY

SEQ ID NO: 257345 - protein, 9 aa, Homo Sapiens
LLWLLQFIF

SEQ ID NO: 257346 - protein, 9 aa, Homo Sapiens
EDEFLRNNE

SEQ ID NO: 257347 - protein, 9 aa, Homo Sapiens
ILPAGFKPT

SEQ ID NO: 257348 - protein, 9 aa, Homo Sapiens
EIHGRIKDF

SEQ ID NO: 257349 - protein, 9 aa, Homo Sapiens
RNVGPNTTS

SEQ ID NO: 257350 - protein, 9 aa, Homo Sapiens
PKEPALDPT

SEQ ID NO: 257351 - protein, 9 aa, Homo Sapiens
GILDFQICG

SEQ ID NO: 257352 - protein, 9 aa, Homo Sapiens
QVQEKDYLA

SEQ ID NO: 257353 - protein, 9 aa, Homo Sapiens
VFNTGIGQH

SEQ ID NO: 257354 - protein, 9 aa, Homo Sapiens
RLASLSQLW

SEQ ID NO: 257355 - protein, 9 aa, Homo Sapiens
FHKLANQYH

SEQ ID NO: 257356 - protein, 9 aa, Homo Sapiens
RDELRRHII

SEQ ID NO: 257357 - protein, 9 aa, Homo Sapiens
SPLQGLTTQ

SEQ ID NO: 257358 - protein, 9 aa, Homo Sapiens
PCSDSCYFD

SEQ ID NO: 257359 - protein, 9 aa, Homo Sapiens
NGLTRHRII

SEQ ID NO: 257360 - protein, 9 aa, Homo Sapiens
PDLRAEEIA

SEQ ID NO: 257361 - protein, 9 aa, Homo Sapiens
PLGTVKEAV

SEQ ID NO: 257362 - protein, 9 aa, Homo Sapiens
AGGNVEDQL

SEQ ID NO: 257363 - protein, 9 aa, Homo Sapiens
LQNPLDNLE

SEQ ID NO: 257364 - protein, 9 aa, Homo Sapiens
YHGDQGSHP

SEQ ID NO: 257365 - protein, 9 aa, Homo Sapiens
VMHTTDILG

SEQ ID NO: 257366 - protein, 9 aa, Homo Sapiens
RNGKNHVSN

SEQ ID NO: 257367 - protein, 9 aa, Homo Sapiens
NFITMKRSR

SEQ ID NO: 257368 - protein, 9 aa, Homo Sapiens
KNRSLCRNT

SEQ ID NO: 257369 - protein, 9 aa, Homo Sapiens
GLVFNTGIG

SEQ ID NO: 257370 - protein, 9 aa, Homo Sapiens
TAYQSTDIT

SEQ ID NO: 257371 - protein, 9 aa, Homo Sapiens
LDKDFGYLI

SEQ ID NO: 257372 - protein, 9 aa, Homo Sapiens
LRDRLFRQL

SEQ ID NO: 257373 - protein, 9 aa, Homo Sapiens
MSNTSLVTA

SEQ ID NO: 257374 - protein, 9 aa, Homo Sapiens
FLVISCSHF

SEQ ID NO: 257375 - protein, 9 aa, Homo Sapiens
NMTLVILIQ

SEQ ID NO: 257376 - protein, 9 aa, Homo Sapiens
RSFAEIYDP

SEQ ID NO: 257377 - protein, 9 aa, Homo Sapiens
SKVMDVVFQ

SEQ ID NO: 257378 - protein, 9 aa, Homo Sapiens
PAPIKNIMD

SEQ ID NO: 257379 - protein, 9 aa, Homo Sapiens
ILGSTIRTG

SEQ ID NO: 257380 - protein, 9 aa, Homo Sapiens
AYSWTETLI

SEQ ID NO: 257381 - protein, 9 aa, Homo Sapiens
TLSKYVKNA

SEQ ID NO: 257382 - protein, 9 aa, Homo Sapiens
FLNTLTVAS

SEQ ID NO: 257383 - protein, 9 aa, Homo Sapiens
SWIKKLLKS

SEQ ID NO: 257384 - protein, 9 aa, Homo Sapiens
WVRNISYFW

SEQ ID NO: 257385 - protein, 9 aa, Homo Sapiens
GSEHLQTLK

SEQ ID NO: 257386 - protein, 9 aa, Homo Sapiens
WYCPVLRPM

SEQ ID NO: 257387 - protein, 9 aa, Homo Sapiens
RHPYKCKEC

SEQ ID NO: 257388 - protein, 9 aa, Homo Sapiens
KQLESAGIA

SEQ ID NO: 257389 - protein, 9 aa, Homo Sapiens
MSVLELLRA

SEQ ID NO: 257390 - protein, 9 aa, Homo Sapiens
AGLLGTLVQ

SEQ ID NO: 257391 - protein, 9 aa, Homo Sapiens
QNPIQLTGD

SEQ ID NO: 257392 - protein, 9 aa, Homo Sapiens
PPDKVVVNT

SEQ ID NO: 257393 - protein, 9 aa, Homo Sapiens
GVVLYLGKT

SEQ ID NO: 257394 - protein, 9 aa, Homo Sapiens
YVQVNTFAL

SEQ ID NO: 257395 - protein, 9 aa, Homo Sapiens
PEHKLHLAK

SEQ ID NO: 257396 - protein, 9 aa, Homo Sapiens
LLNIVYVTG

SEQ ID NO: 257397 - protein, 9 aa, Homo Sapiens
HGNILNGVR

SEQ ID NO: 257398 - protein, 9 aa, Homo Sapiens
GPGGKMHGN

SEQ ID NO: 257399 - protein, 9 aa, Homo Sapiens
LHTEAVWAA

SEQ ID NO: 257400 - protein, 9 aa, Homo Sapiens
KRKKHRKHF

SEQ ID NO: 257401 - protein, 9 aa, Homo Sapiens
DISISYSGC

SEQ ID NO: 257402 - protein, 9 aa, Homo Sapiens
NCARYMPQN

SEQ ID NO: 257403 - protein, 9 aa, Homo Sapiens
LLHTQLKDQ

SEQ ID NO: 257404 - protein, 9 aa, Homo Sapiens
VVQIQKLQH

SEQ ID NO: 257405 - protein, 9 aa, Homo Sapiens
YTESRKYFR

SEQ ID NO: 257406 - protein, 9 aa, Homo Sapiens
ALIQHQIIH

SEQ ID NO: 257407 - protein, 9 aa, Homo Sapiens
RRPDQKDLL

SEQ ID NO: 257408 - protein, 9 aa, Homo Sapiens
GPAWGSKEM

SEQ ID NO: 257409 - protein, 9 aa, Homo Sapiens
LQPGAHFQV

SEQ ID NO: 257410 - protein, 9 aa, Homo Sapiens
TAQVHPGES

SEQ ID NO: 257411 - protein, 9 aa, Homo Sapiens
NCNNSLTEL

SEQ ID NO: 257412 - protein, 9 aa, Homo Sapiens
KDAQERSRA

SEQ ID NO: 257413 - protein, 9 aa, Homo Sapiens
GVSMRTNIK

SEQ ID NO: 257414 - protein, 9 aa, Homo Sapiens
LELIRDAPT

SEQ ID NO: 257415 - protein, 9 aa, Homo Sapiens
MRTNIKAKL

SEQ ID NO: 257416 - protein, 9 aa, Homo Sapiens
FNVNYLRKI

SEQ ID NO: 257417 - protein, 9 aa, Homo Sapiens
NCFRQLFVC

SEQ ID NO: 257418 - protein, 9 aa, Homo Sapiens
IQGYDAKSD

SEQ ID NO: 257419 - protein, 9 aa, Homo Sapiens
DASQHISLS

SEQ ID NO: 257420 - protein, 9 aa, Homo Sapiens
IQKVMEQTF

SEQ ID NO: 257421 - protein, 9 aa, Homo Sapiens
TTQPENVDG

SEQ ID NO: 257422 - protein, 9 aa, Homo Sapiens
ENVYAEGFI

SEQ ID NO: 257423 - protein, 9 aa, Homo Sapiens
VIWDINKHG

SEQ ID NO: 257424 - protein, 9 aa, Homo Sapiens
SSTQLQGCL

SEQ ID NO: 257425 - protein, 9 aa, Homo Sapiens
LKIRKGMRV

SEQ ID NO: 257426 - protein, 9 aa, Homo Sapiens
EDGPSSEKL

SEQ ID NO: 257427 - protein, 9 aa, Homo Sapiens
YIYAFAHRI

SEQ ID NO: 257428 - protein, 9 aa, Homo Sapiens
CALIMKITC

SEQ ID NO: 257429 - protein, 9 aa, Homo Sapiens
SLYSRFHGM

SEQ ID NO: 257430 - protein, 9 aa, Homo Sapiens
CNHHQAFVK

SEQ ID NO: 257431 - protein, 9 aa, Homo Sapiens
PVFEDIKYE

SEQ ID NO: 257432 - protein, 9 aa, Homo Sapiens
RSVSDYSVP

SEQ ID NO: 257433 - protein, 9 aa, Homo Sapiens
NSDFIAGFC

SEQ ID NO: 257434 - protein, 9 aa, Homo Sapiens
VVPPPLVDN

SEQ ID NO: 257435 - protein, 9 aa, Homo Sapiens
NLQVAKLKP

SEQ ID NO: 257436 - protein, 9 aa, Homo Sapiens
PDKPLPAVS

SEQ ID NO: 257437 - protein, 9 aa, Homo Sapiens
WRHHIKNLK

SEQ ID NO: 257438 - protein, 9 aa, Homo Sapiens
QSQTQPVYL

SEQ ID NO: 257439 - protein, 9 aa, Homo Sapiens
DDEEDKGEK

SEQ ID NO: 257440 - protein, 9 aa, Homo Sapiens
NIYIYHFAH

SEQ ID NO: 257441 - protein, 9 aa, Homo Sapiens
LEIVLKLLS

SEQ ID NO: 257442 - protein, 9 aa, Homo Sapiens
NYLSFLIVQ

SEQ ID NO: 257443 - protein, 9 aa, Homo Sapiens
EKELAEVKV

SEQ ID NO: 257444 - protein, 9 aa, Homo Sapiens
TNHQPAHFY

SEQ ID NO: 257445 - protein, 9 aa, Homo Sapiens
VKLSNNMKV

SEQ ID NO: 257446 - protein, 9 aa, Homo Sapiens
WQQIANYLT

SEQ ID NO: 257447 - protein, 9 aa, Homo Sapiens
HIWRNKTED

SEQ ID NO: 257448 - protein, 9 aa, Homo Sapiens
EDIFLNMEH

SEQ ID NO: 257449 - protein, 9 aa, Homo Sapiens
LQRRLMGTN

SEQ ID NO: 257450 - protein, 9 aa, Homo Sapiens
IRPDHPHPR

SEQ ID NO: 257451 - protein, 9 aa, Homo Sapiens
CQNKSLSRS

SEQ ID NO: 257452 - protein, 9 aa, Homo Sapiens
APEIFQRCN

SEQ ID NO: 257453 - protein, 9 aa, Homo Sapiens
HTFPYRGGS

SEQ ID NO: 257454 - protein, 9 aa, Homo Sapiens
VRSRLECHR

SEQ ID NO: 257455 - protein, 9 aa, Homo Sapiens
RLRVREVAK

SEQ ID NO: 257456 - protein, 9 aa, Homo Sapiens
EQRMRSRSK

SEQ ID NO: 257457 - protein, 9 aa, Homo Sapiens
ILKVEYEFD

SEQ ID NO: 257458 - protein, 9 aa, Homo Sapiens
EISLDEQVE

SEQ ID NO: 257459 - protein, 9 aa, Homo Sapiens
SVRDDVFGM

SEQ ID NO: 257460 - protein, 9 aa, Homo Sapiens
ILVGIFILT

SEQ ID NO: 257461 - protein, 9 aa, Homo Sapiens
CICCRRRKI

SEQ ID NO: 257462 - protein, 9 aa, Homo Sapiens
INEGLMDDK

SEQ ID NO: 257463 - protein, 9 aa, Homo Sapiens
EAVDPLGDY

SEQ ID NO: 257464 - protein, 9 aa, Homo Sapiens
PPLRNVSSE

SEQ ID NO: 257465 - protein, 9 aa, Homo Sapiens
HSYSVIIDI

SEQ ID NO: 257466 - protein, 9 aa, Homo Sapiens
KNRYFPVFE

SEQ ID NO: 257467 - protein, 9 aa, Homo Sapiens
GIFSVLSLT

SEQ ID NO: 257468 - protein, 9 aa, Homo Sapiens
GCNTSVENG

SEQ ID NO: 257469 - protein, 9 aa, Homo Sapiens
PEDDLDTKR

SEQ ID NO: 257470 - protein, 9 aa, Homo Sapiens
RNLMQETHD

SEQ ID NO: 257471 - protein, 9 aa, Homo Sapiens
EQNQALLQT

SEQ ID NO: 257472 - protein, 9 aa, Homo Sapiens
DRNDLLTSA

SEQ ID NO: 257473 - protein, 9 aa, Homo Sapiens
SGDLLSDLL

SEQ ID NO: 257474 - protein, 9 aa, Homo Sapiens
MFYFCRKGM

SEQ ID NO: 257475 - protein, 9 aa, Homo Sapiens
LNELKTELH

SEQ ID NO: 257476 - protein, 9 aa, Homo Sapiens
AEAKAASQG

SEQ ID NO: 257477 - protein, 9 aa, Homo Sapiens
YLQNILGLD

SEQ ID NO: 257478 - protein, 9 aa, Homo Sapiens
VERVKTMLL

SEQ ID NO: 257479 - protein, 9 aa, Homo Sapiens
CQALVPEYS

SEQ ID NO: 257480 - protein, 9 aa, Homo Sapiens
RESNKLADM

SEQ ID NO: 257481 - protein, 9 aa, Homo Sapiens
PLEMDGTET

SEQ ID NO: 257482 - protein, 9 aa, Homo Sapiens
RRIIPDMLQ

SEQ ID NO: 257483 - protein, 9 aa, Homo Sapiens
RSYRKEWEE

SEQ ID NO: 257484 - protein, 9 aa, Homo Sapiens
GSDYQYIGK

SEQ ID NO: 257485 - protein, 9 aa, Homo Sapiens
LKSHARGHA

SEQ ID NO: 257486 - protein, 9 aa, Homo Sapiens
KLQKEHNLN

SEQ ID NO: 257487 - protein, 9 aa, Homo Sapiens
LFLKNLKLF

SEQ ID NO: 257488 - protein, 9 aa, Homo Sapiens
KLTDIIDND

SEQ ID NO: 257489 - protein, 9 aa, Homo Sapiens
AVVESSRRL

SEQ ID NO: 257490 - protein, 9 aa, Homo Sapiens
ELFVLLKAL

SEQ ID NO: 257491 - protein, 9 aa, Homo Sapiens
RYCVNQCKS

SEQ ID NO: 257492 - protein, 9 aa, Homo Sapiens
IFKNYDAEK

SEQ ID NO: 257493 - protein, 9 aa, Homo Sapiens
EVPQENGLE

SEQ ID NO: 257494 - protein, 9 aa, Homo Sapiens
SSGSDGADS

SEQ ID NO: 257495 - protein, 9 aa, Homo Sapiens
LRDRSHIKK

SEQ ID NO: 257496 - protein, 9 aa, Homo Sapiens
QQQTPQPSI

SEQ ID NO: 257497 - protein, 9 aa, Homo Sapiens
QKDFVDINI

SEQ ID NO: 257498 - protein, 9 aa, Homo Sapiens
GGIFSVTEG

SEQ ID NO: 257499 - protein, 9 aa, Homo Sapiens
VLYLGKTFL

SEQ ID NO: 257500 - protein, 9 aa, Homo Sapiens
VAAVIESLE

SEQ ID NO: 257501 - protein, 9 aa, Homo Sapiens
GKCPTVVWT

SEQ ID NO: 257502 - protein, 9 aa, Homo Sapiens
FPEYSQDPT

SEQ ID NO: 257503 - protein, 9 aa, Homo Sapiens
MVKFKVPDV

SEQ ID NO: 257504 - protein, 9 aa, Homo Sapiens
ELASEIMAY

SEQ ID NO: 257505 - protein, 9 aa, Homo Sapiens
FRLEKVYCV

SEQ ID NO: 257506 - protein, 9 aa, Homo Sapiens
SFIDDEEED

SEQ ID NO: 257507 - protein, 9 aa, Homo Sapiens
TYRGVKEVT

SEQ ID NO: 257508 - protein, 9 aa, Homo Sapiens
VATVLESLE

SEQ ID NO: 257509 - protein, 9 aa, Homo Sapiens
PVPRGLPGL

SEQ ID NO: 257510 - protein, 9 aa, Homo Sapiens
GAMDVSEFL

SEQ ID NO: 257511 - protein, 9 aa, Homo Sapiens
RQNDLTYVT

SEQ ID NO: 257512 - protein, 9 aa, Homo Sapiens
PYTSYEQLK

SEQ ID NO: 257513 - protein, 9 aa, Homo Sapiens
KKKEKGKSK

SEQ ID NO: 257514 - protein, 9 aa, Homo Sapiens
AILKKGHSV

SEQ ID NO: 257515 - protein, 9 aa, Homo Sapiens
IDGMEIPGN

SEQ ID NO: 257516 - protein, 9 aa, Homo Sapiens
ESEAFLSQS

SEQ ID NO: 257517 - protein, 9 aa, Homo Sapiens
YDKLGEKAF

SEQ ID NO: 257518 - protein, 9 aa, Homo Sapiens
DQVMKFSEK

SEQ ID NO: 257519 - protein, 9 aa, Homo Sapiens
IIHVYQNIK

SEQ ID NO: 257520 - protein, 9 aa, Homo Sapiens
SSREERLWF

SEQ ID NO: 257521 - protein, 9 aa, Homo Sapiens
VMDSGQKEH

SEQ ID NO: 257522 - protein, 9 aa, Homo Sapiens
INKLFGFIP

SEQ ID NO: 257523 - protein, 9 aa, Homo Sapiens
SRPLTDRGK

SEQ ID NO: 257524 - protein, 9 aa, Homo Sapiens
NPHTQKAWK

SEQ ID NO: 257525 - protein, 9 aa, Homo Sapiens
GFQLTQQEI

SEQ ID NO: 257526 - protein, 9 aa, Homo Sapiens
HFVRSEFYQ

SEQ ID NO: 257527 - protein, 9 aa, Homo Sapiens
AIESVQGVK

SEQ ID NO: 257528 - protein, 9 aa, Homo Sapiens
AVAVILLAF

SEQ ID NO: 257529 - protein, 9 aa, Homo Sapiens
ENPKHLNLA

SEQ ID NO: 257530 - protein, 9 aa, Homo Sapiens
PSKVEEDEL

SEQ ID NO: 257531 - protein, 9 aa, Homo Sapiens
NVSVPADTP

SEQ ID NO: 257532 - protein, 9 aa, Homo Sapiens
FVVITLTAI

SEQ ID NO: 257533 - protein, 9 aa, Homo Sapiens
HCQIIEPNI

SEQ ID NO: 257534 - protein, 9 aa, Homo Sapiens
VKHSGVDNM

SEQ ID NO: 257535 - protein, 9 aa, Homo Sapiens
KRINSSDEL

SEQ ID NO: 257536 - protein, 9 aa, Homo Sapiens
SGGTYQDTK

SEQ ID NO: 257537 - protein, 9 aa, Homo Sapiens
HFCAGSLVN

SEQ ID NO: 257538 - protein, 9 aa, Homo Sapiens
MSRSKKFLI

SEQ ID NO: 257539 - protein, 9 aa, Homo Sapiens
DRPKVPADI

SEQ ID NO: 257540 - protein, 9 aa, Homo Sapiens
RRLVKEAAV

SEQ ID NO: 257541 - protein, 9 aa, Homo Sapiens
LIFQAESFE

SEQ ID NO: 257542 - protein, 9 aa, Homo Sapiens
AVLICFDSS

SEQ ID NO: 257543 - protein, 9 aa, Homo Sapiens
LSQTRYFIL

SEQ ID NO: 257544 - protein, 9 aa, Homo Sapiens
LEFGSPGKT

SEQ ID NO: 257545 - protein, 9 aa, Homo Sapiens
GYFHNLFLN

SEQ ID NO: 257546 - protein, 9 aa, Homo Sapiens
LELQDLLLD

SEQ ID NO: 257547 - protein, 9 aa, Homo Sapiens
NCSFNTYVQ

SEQ ID NO: 257548 - protein, 9 aa, Homo Sapiens
IGSANFGEA

SEQ ID NO: 257549 - protein, 9 aa, Homo Sapiens
LKAITEKDK

SEQ ID NO: 257550 - protein, 9 aa, Homo Sapiens
LQSIQAVPD

SEQ ID NO: 257551 - protein, 9 aa, Homo Sapiens
TLREIVGAS

SEQ ID NO: 257552 - protein, 9 aa, Homo Sapiens
ASALQIHEC

SEQ ID NO: 257553 - protein, 9 aa, Homo Sapiens
LKNVLPKQN

SEQ ID NO: 257554 - protein, 9 aa, Homo Sapiens
KPSYYHRFG

SEQ ID NO: 257555 - protein, 9 aa, Homo Sapiens
MSSGQMEFL

SEQ ID NO: 257556 - protein, 9 aa, Homo Sapiens
LRGNYQKAV

SEQ ID NO: 257557 - protein, 9 aa, Homo Sapiens
GGHKTTASA

SEQ ID NO: 257558 - protein, 9 aa, Homo Sapiens
DLELKKSLG

SEQ ID NO: 257559 - protein, 9 aa, Homo Sapiens
IWAIILKRN

SEQ ID NO: 257560 - protein, 9 aa, Homo Sapiens
NEFMQIPCV

SEQ ID NO: 257561 - protein, 9 aa, Homo Sapiens
RLCKRKEIR

SEQ ID NO: 257562 - protein, 9 aa, Homo Sapiens
LCKDSLDNM

SEQ ID NO: 257563 - protein, 9 aa, Homo Sapiens
PSFMTSQLD

SEQ ID NO: 257564 - protein, 9 aa, Homo Sapiens
TPQEISEVV

SEQ ID NO: 257565 - protein, 9 aa, Homo Sapiens
YSNKNAVVK

SEQ ID NO: 257566 - protein, 9 aa, Homo Sapiens
TVWDWQKTA

SEQ ID NO: 257567 - protein, 9 aa, Homo Sapiens
FIGPNAGEV

SEQ ID NO: 257568 - protein, 9 aa, Homo Sapiens
HPAERISAE

SEQ ID NO: 257569 - protein, 9 aa, Homo Sapiens
CCQSACCQP

SEQ ID NO: 257570 - protein, 9 aa, Homo Sapiens
QTEGAEATP

SEQ ID NO: 257571 - protein, 9 aa, Homo Sapiens
ELGYPFGYV

SEQ ID NO: 257572 - protein, 9 aa, Homo Sapiens
IAPPERGGA

SEQ ID NO: 257573 - protein, 9 aa, Homo Sapiens
DLRSKANIA

SEQ ID NO: 257574 - protein, 9 aa, Homo Sapiens
PAKLLKKFA

SEQ ID NO: 257575 - protein, 9 aa, Homo Sapiens
GFSLDRTKD

SEQ ID NO: 257576 - protein, 9 aa, Homo Sapiens
CVEMKQNFE

SEQ ID NO: 257577 - protein, 9 aa, Homo Sapiens
TSNVKMVQG

SEQ ID NO: 257578 - protein, 9 aa, Homo Sapiens
EEDCQELLS

SEQ ID NO: 257579 - protein, 9 aa, Homo Sapiens
NLPPIQNGN

SEQ ID NO: 257580 - protein, 9 aa, Homo Sapiens
AEILYVPRG

SEQ ID NO: 257581 - protein, 9 aa, Homo Sapiens
HHYEQQQEN

SEQ ID NO: 257582 - protein, 9 aa, Homo Sapiens
RDTLREIVG

SEQ ID NO: 257583 - protein, 9 aa, Homo Sapiens
RPNCLSEVP

SEQ ID NO: 257584 - protein, 9 aa, Homo Sapiens
SLASSSNAP

SEQ ID NO: 257585 - protein, 9 aa, Homo Sapiens
LELPFMMVP

SEQ ID NO: 257586 - protein, 9 aa, Homo Sapiens
QVKISDLIT

SEQ ID NO: 257587 - protein, 9 aa, Homo Sapiens
NVIKKVKCI

SEQ ID NO: 257588 - protein, 9 aa, Homo Sapiens
LGILGSTIR

SEQ ID NO: 257589 - protein, 9 aa, Homo Sapiens
SIQWLTVHK

SEQ ID NO: 257590 - protein, 9 aa, Homo Sapiens
TRKEEWDKM

SEQ ID NO: 257591 - protein, 9 aa, Homo Sapiens
IIQQDFLDT

SEQ ID NO: 257592 - protein, 9 aa, Homo Sapiens
TAKKNHDIS

SEQ ID NO: 257593 - protein, 9 aa, Homo Sapiens
RACSGPFMG

SEQ ID NO: 257594 - protein, 9 aa, Homo Sapiens
RKTKGANGT

SEQ ID NO: 257595 - protein, 9 aa, Homo Sapiens
LTLEEVQAK

SEQ ID NO: 257596 - protein, 9 aa, Homo Sapiens
YCTCNPGFT

SEQ ID NO: 257597 - protein, 9 aa, Homo Sapiens
AFKFNQDLE

SEQ ID NO: 257598 - protein, 9 aa, Homo Sapiens
SKGAADDDS

SEQ ID NO: 257599 - protein, 9 aa, Homo Sapiens
QQPSLRITK

SEQ ID NO: 257600 - protein, 9 aa, Homo Sapiens
ITFIERVKN

SEQ ID NO: 257601 - protein, 9 aa, Homo Sapiens
FTSFFHSEP

SEQ ID NO: 257602 - protein, 9 aa, Homo Sapiens
PPGAFIGLH

SEQ ID NO: 257603 - protein, 9 aa, Homo Sapiens
SHVHSNGYY

SEQ ID NO: 257604 - protein, 9 aa, Homo Sapiens
NYDAEKYGP

SEQ ID NO: 257605 - protein, 9 aa, Homo Sapiens
NADNDWFQL

SEQ ID NO: 257606 - protein, 9 aa, Homo Sapiens
LTLAEKDRK

SEQ ID NO: 257607 - protein, 9 aa, Homo Sapiens
AESTGPKPR

SEQ ID NO: 257608 - protein, 9 aa, Homo Sapiens
KLQWNESEP

SEQ ID NO: 257609 - protein, 9 aa, Homo Sapiens
MDSDFSHAI

SEQ ID NO: 257610 - protein, 9 aa, Homo Sapiens
FIYQTSYRG

SEQ ID NO: 257611 - protein, 9 aa, Homo Sapiens
YDNREKSKR

SEQ ID NO: 257612 - protein, 9 aa, Homo Sapiens
QHAVDTIRR

SEQ ID NO: 257613 - protein, 9 aa, Homo Sapiens
WPNPQAFRA

SEQ ID NO: 257614 - protein, 9 aa, Homo Sapiens
QMADNIYND

SEQ ID NO: 257615 - protein, 9 aa, Homo Sapiens
NHVTIPKEQ

SEQ ID NO: 257616 - protein, 9 aa, Homo Sapiens
KNVLPKQNK

SEQ ID NO: 257617 - protein, 9 aa, Homo Sapiens
IAQNEQDAY

SEQ ID NO: 257618 - protein, 9 aa, Homo Sapiens
FQGPQGDKG

SEQ ID NO: 257619 - protein, 9 aa, Homo Sapiens
DHIEPKKLA

SEQ ID NO: 257620 - protein, 9 aa, Homo Sapiens
DYYSSRCLV

SEQ ID NO: 257621 - protein, 9 aa, Homo Sapiens
VSVGARKNT

SEQ ID NO: 257622 - protein, 9 aa, Homo Sapiens
DKWIKDADP

SEQ ID NO: 257623 - protein, 9 aa, Homo Sapiens
ESMKVQGSP

SEQ ID NO: 257624 - protein, 9 aa, Homo Sapiens
QQSLEPIGT

SEQ ID NO: 257625 - protein, 9 aa, Homo Sapiens
CDHHCPWVG

SEQ ID NO: 257626 - protein, 9 aa, Homo Sapiens
EAIAGEYAL

SEQ ID NO: 257627 - protein, 9 aa, Homo Sapiens
HLLSEESEN

SEQ ID NO: 257628 - protein, 9 aa, Homo Sapiens
IAQLRVFGT

SEQ ID NO: 257629 - protein, 9 aa, Homo Sapiens
SKVKEKKRK

SEQ ID NO: 257630 - protein, 9 aa, Homo Sapiens
KIYWNLDNY

SEQ ID NO: 257631 - protein, 9 aa, Homo Sapiens
YQLGRVVDE

SEQ ID NO: 257632 - protein, 9 aa, Homo Sapiens
YIHKLIVTE

SEQ ID NO: 257633 - protein, 9 aa, Homo Sapiens
KETAKENKE

SEQ ID NO: 257634 - protein, 9 aa, Homo Sapiens
HRNCAQSNQ

SEQ ID NO: 257635 - protein, 9 aa, Homo Sapiens
YSESLCCLC

SEQ ID NO: 257636 - protein, 9 aa, Homo Sapiens
KRMLPPANS

SEQ ID NO: 257637 - protein, 9 aa, Homo Sapiens
VKKGEDPFQ

SEQ ID NO: 257638 - protein, 9 aa, Homo Sapiens
VGGTVLYCT

SEQ ID NO: 257639 - protein, 9 aa, Homo Sapiens
MEDYFHCKH

SEQ ID NO: 257640 - protein, 9 aa, Homo Sapiens
CFDMFVRFM

SEQ ID NO: 257641 - protein, 9 aa, Homo Sapiens
QQSHLECRV

SEQ ID NO: 257642 - protein, 9 aa, Homo Sapiens
GLKVFEYYA

SEQ ID NO: 257643 - protein, 9 aa, Homo Sapiens
VLRNEIQRY

SEQ ID NO: 257644 - protein, 9 aa, Homo Sapiens
QIARLIPHG

SEQ ID NO: 257645 - protein, 9 aa, Homo Sapiens
QGSHPRPAR

SEQ ID NO: 257646 - protein, 9 aa, Homo Sapiens
MLINSFGAI

SEQ ID NO: 257647 - protein, 9 aa, Homo Sapiens
KIRKGMRVV

SEQ ID NO: 257648 - protein, 9 aa, Homo Sapiens
VYLRSSSGV

SEQ ID NO: 257649 - protein, 9 aa, Homo Sapiens
NPCTLVKMN

SEQ ID NO: 257650 - protein, 9 aa, Homo Sapiens
SNRMWKLFE

SEQ ID NO: 257651 - protein, 9 aa, Homo Sapiens
NLFKGLSCA

SEQ ID NO: 257652 - protein, 9 aa, Homo Sapiens
SEKVKKIIN

SEQ ID NO: 257653 - protein, 9 aa, Homo Sapiens
QIPRVCYHE

SEQ ID NO: 257654 - protein, 9 aa, Homo Sapiens
SNEPPNTFT

SEQ ID NO: 257655 - protein, 9 aa, Homo Sapiens
IRLHPLHKI

SEQ ID NO: 257656 - protein, 9 aa, Homo Sapiens
ETQPPGRQV

SEQ ID NO: 257657 - protein, 9 aa, Homo Sapiens
IKWIYFVRG

SEQ ID NO: 257658 - protein, 8 aa, Homo Sapiens
GRGEDSVL

SEQ ID NO: 257659 - protein, 9 aa, Homo Sapiens
GSRPLTDRG

SEQ ID NO: 257660 - protein, 9 aa, Homo Sapiens
EKRRKNIQL

SEQ ID NO: 257661 - protein, 9 aa, Homo Sapiens
ERDEEAAET

SEQ ID NO: 257662 - protein, 9 aa, Homo Sapiens
TLVTCWGDE

SEQ ID NO: 257663 - protein, 9 aa, Homo Sapiens
FKGSWVNTF

SEQ ID NO: 257664 - protein, 9 aa, Homo Sapiens
RRDDHGGRQ

SEQ ID NO: 257665 - protein, 9 aa, Homo Sapiens
TAWLVGEHR

SEQ ID NO: 257666 - protein, 9 aa, Homo Sapiens
QGLDVDTKA

SEQ ID NO: 257667 - protein, 9 aa, Homo Sapiens
KNLLKAAMK

SEQ ID NO: 257668 - protein, 9 aa, Homo Sapiens
EANFVIHRR

SEQ ID NO: 257669 - protein, 9 aa, Homo Sapiens
LCPKEFSYE

SEQ ID NO: 257670 - protein, 9 aa, Homo Sapiens
SMRTNIKAK

SEQ ID NO: 257671 - protein, 9 aa, Homo Sapiens
KTGDVVEIL

SEQ ID NO: 257672 - protein, 9 aa, Homo Sapiens
CKADADEGI

SEQ ID NO: 257673 - protein, 9 aa, Homo Sapiens
HKNGKGSTR

SEQ ID NO: 257674 - protein, 9 aa, Homo Sapiens
QGFGDPAGK

SEQ ID NO: 257675 - protein, 9 aa, Homo Sapiens
NILQTPISE

SEQ ID NO: 257676 - protein, 9 aa, Homo Sapiens
VKGQWENKF

SEQ ID NO: 257677 - protein, 9 aa, Homo Sapiens
GFSQKSHTF

SEQ ID NO: 257678 - protein, 9 aa, Homo Sapiens
LRDAVTSVQ

SEQ ID NO: 257679 - protein, 9 aa, Homo Sapiens
YLKTVLHII

SEQ ID NO: 257680 - protein, 9 aa, Homo Sapiens
NFTGTTVGF

SEQ ID NO: 257681 - protein, 9 aa, Homo Sapiens
YVCTADNSV

SEQ ID NO: 257682 - protein, 9 aa, Homo Sapiens
SVVMDKFGF

SEQ ID NO: 257683 - protein, 9 aa, Homo Sapiens
LTMVISCFG

SEQ ID NO: 257684 - protein, 9 aa, Homo Sapiens
TNKYLTEEA

SEQ ID NO: 257685 - protein, 9 aa, Homo Sapiens
DEGHGLKVE

SEQ ID NO: 257686 - protein, 9 aa, Homo Sapiens
FIALGLCNS

SEQ ID NO: 257687 - protein, 9 aa, Homo Sapiens
RTAIKHVKA

SEQ ID NO: 257688 - protein, 9 aa, Homo Sapiens
GVDGNFILR

SEQ ID NO: 257689 - protein, 9 aa, Homo Sapiens
ISMYVKPSA

SEQ ID NO: 257690 - protein, 9 aa, Homo Sapiens
DDDYDNSTP

SEQ ID NO: 257691 - protein, 9 aa, Homo Sapiens
LECQFMPPE

SEQ ID NO: 257692 - protein, 9 aa, Homo Sapiens
RILPQVITE

SEQ ID NO: 257693 - protein, 9 aa, Homo Sapiens
WLRDFLMHW

SEQ ID NO: 257694 - protein, 9 aa, Homo Sapiens
VTMGKISAP

SEQ ID NO: 257695 - protein, 9 aa, Homo Sapiens
FSFWSGLYA

SEQ ID NO: 257696 - protein, 9 aa, Homo Sapiens
CSDGYPDVA

SEQ ID NO: 257697 - protein, 9 aa, Homo Sapiens
KQLREHMQQ

SEQ ID NO: 257698 - protein, 9 aa, Homo Sapiens
PLIPGLSKK

SEQ ID NO: 257699 - protein, 9 aa, Homo Sapiens
KKVSYFVFG

SEQ ID NO: 257700 - protein, 9 aa, Homo Sapiens
NRGFSQKSH

SEQ ID NO: 257701 - protein, 9 aa, Homo Sapiens
NRVNKTKPA

SEQ ID NO: 257702 - protein, 9 aa, Homo Sapiens
HERGNNHKE

SEQ ID NO: 257703 - protein, 9 aa, Homo Sapiens
KERGVISYT

SEQ ID NO: 257704 - protein, 9 aa, Homo Sapiens
HNSAFECGT

SEQ ID NO: 257705 - protein, 9 aa, Homo Sapiens
SKHFENSLL

SEQ ID NO: 257706 - protein, 9 aa, Homo Sapiens
THNLQLSKN

SEQ ID NO: 257707 - protein, 9 aa, Homo Sapiens
NYSGQQQSD

SEQ ID NO: 257708 - protein, 9 aa, Homo Sapiens
KRRDKTCMF

SEQ ID NO: 257709 - protein, 9 aa, Homo Sapiens
TQITNTAYQ

SEQ ID NO: 257710 - protein, 9 aa, Homo Sapiens
FGKCPTVVW

SEQ ID NO: 257711 - protein, 9 aa, Homo Sapiens
KDFGYHTAF

SEQ ID NO: 257712 - protein, 9 aa, Homo Sapiens
FSSFVPSAW

SEQ ID NO: 257713 - protein, 9 aa, Homo Sapiens
SLLNPELIW

SEQ ID NO: 257714 - protein, 9 aa, Homo Sapiens
TLINKACDE

SEQ ID NO: 257715 - protein, 9 aa, Homo Sapiens
GVLNNKTLG

SEQ ID NO: 257716 - protein, 9 aa, Homo Sapiens
AWEINDVAG

SEQ ID NO: 257717 - protein, 9 aa, Homo Sapiens
QSIKDYFQK

SEQ ID NO: 257718 - protein, 9 aa, Homo Sapiens
SLNSYISSS

SEQ ID NO: 257719 - protein, 9 aa, Homo Sapiens
PMDFGTVRD

SEQ ID NO: 257720 - protein, 9 aa, Homo Sapiens
CLNGNFRGR

SEQ ID NO: 257721 - protein, 9 aa, Homo Sapiens
AVAASLQKV

SEQ ID NO: 257722 - protein, 9 aa, Homo Sapiens
GLSCPLQVQ

SEQ ID NO: 257723 - protein, 9 aa, Homo Sapiens
YKWMVCKKI

SEQ ID NO: 257724 - protein, 9 aa, Homo Sapiens
GERPYECKY

SEQ ID NO: 257725 - protein, 9 aa, Homo Sapiens
ECQFMPPEK

SEQ ID NO: 257726 - protein, 9 aa, Homo Sapiens
FCPHVKLKA

SEQ ID NO: 257727 - protein, 9 aa, Homo Sapiens
FIDDEEEDY

SEQ ID NO: 257728 - protein, 9 aa, Homo Sapiens
FIQCLLSSC

SEQ ID NO: 257729 - protein, 9 aa, Homo Sapiens
KENKIIDRV

SEQ ID NO: 257730 - protein, 9 aa, Homo Sapiens
WIIKQEPVL

SEQ ID NO: 257731 - protein, 9 aa, Homo Sapiens
GSLGKLTGS

SEQ ID NO: 257732 - protein, 9 aa, Homo Sapiens
AIASHENVD

SEQ ID NO: 257733 - protein, 9 aa, Homo Sapiens
KTLATKEKE

SEQ ID NO: 257734 - protein, 9 aa, Homo Sapiens
QNGGCNTSV

SEQ ID NO: 257735 - protein, 9 aa, Homo Sapiens
FMLIVVSYG

SEQ ID NO: 257736 - protein, 9 aa, Homo Sapiens
YLFPLLFIY

SEQ ID NO: 257737 - protein, 9 aa, Homo Sapiens
GEKTINLNV

SEQ ID NO: 257738 - protein, 9 aa, Homo Sapiens
AKIYWNLDN

SEQ ID NO: 257739 - protein, 9 aa, Homo Sapiens
VSREKKERL

SEQ ID NO: 257740 - protein, 9 aa, Homo Sapiens
DPSKVPLTP

SEQ ID NO: 257741 - protein, 9 aa, Homo Sapiens
AAKLLSPRQ

SEQ ID NO: 257742 - protein, 9 aa, Homo Sapiens
MESLFNTET

SEQ ID NO: 257743 - protein, 9 aa, Homo Sapiens
QLRHPKYNT

SEQ ID NO: 257744 - protein, 9 aa, Homo Sapiens
QIIGFAAEQ

SEQ ID NO: 257745 - protein, 9 aa, Homo Sapiens
NQIQAKEYI

SEQ ID NO: 257746 - protein, 9 aa, Homo Sapiens
LTIYHVSDL

SEQ ID NO: 257747 - protein, 9 aa, Homo Sapiens
ESFNKTWDI

SEQ ID NO: 257748 - protein, 9 aa, Homo Sapiens
IRNDEELNT

SEQ ID NO: 257749 - protein, 9 aa, Homo Sapiens
KMKAVASRL

SEQ ID NO: 257750 - protein, 9 aa, Homo Sapiens
QDPDVGVNL

SEQ ID NO: 257751 - protein, 9 aa, Homo Sapiens
MKPRRNVED

SEQ ID NO: 257752 - protein, 9 aa, Homo Sapiens
KESETCVQF

SEQ ID NO: 257753 - protein, 9 aa, Homo Sapiens
QTAPKKNKN

SEQ ID NO: 257754 - protein, 9 aa, Homo Sapiens
LSCIFPEGI

SEQ ID NO: 257755 - protein, 9 aa, Homo Sapiens
GKVHLTATH

SEQ ID NO: 257756 - protein, 9 aa, Homo Sapiens
SDRPQMKIF

SEQ ID NO: 257757 - protein, 9 aa, Homo Sapiens
RIIDSNDQA

SEQ ID NO: 257758 - protein, 9 aa, Homo Sapiens
NPMNPNKYL

SEQ ID NO: 257759 - protein, 9 aa, Homo Sapiens
FYQIISGQK

SEQ ID NO: 257760 - protein, 9 aa, Homo Sapiens
SRPGYQHWA

SEQ ID NO: 257761 - protein, 9 aa, Homo Sapiens
NMVFCLLAT

SEQ ID NO: 257762 - protein, 9 aa, Homo Sapiens
VLKLLSENT

SEQ ID NO: 257763 - protein, 9 aa, Homo Sapiens
PHHPGPFLL

SEQ ID NO: 257764 - protein, 9 aa, Homo Sapiens
QEDEQDNCK

SEQ ID NO: 257765 - protein, 9 aa, Homo Sapiens
LMEKASIML

SEQ ID NO: 257766 - protein, 9 aa, Homo Sapiens
STEISLDEQ

SEQ ID NO: 257767 - protein, 9 aa, Homo Sapiens
KPWKHLICV

SEQ ID NO: 257768 - protein, 9 aa, Homo Sapiens
ETLTQEVEK

SEQ ID NO: 257769 - protein, 9 aa, Homo Sapiens
EIVEAKEIM

SEQ ID NO: 257770 - protein, 9 aa, Homo Sapiens
WYNTIFLFF

SEQ ID NO: 257771 - protein, 9 aa, Homo Sapiens
LLSRCPRLP

SEQ ID NO: 257772 - protein, 9 aa, Homo Sapiens
RVLLTGVQK

SEQ ID NO: 257773 - protein, 9 aa, Homo Sapiens
VGAVSLTTS

SEQ ID NO: 257774 - protein, 9 aa, Homo Sapiens
WFFLPSLSQ

SEQ ID NO: 257775 - protein, 9 aa, Homo Sapiens
GSEIYIWDL

SEQ ID NO: 257776 - protein, 9 aa, Homo Sapiens
PVRNVSKFS

SEQ ID NO: 257777 - protein, 9 aa, Homo Sapiens
SPLYLPFVP

SEQ ID NO: 257778 - protein, 9 aa, Homo Sapiens
KINASLLPQ

SEQ ID NO: 257779 - protein, 9 aa, Homo Sapiens
LTFTDKWNT

SEQ ID NO: 257780 - protein, 9 aa, Homo Sapiens
HIMEMWLLI

SEQ ID NO: 257781 - protein, 9 aa, Homo Sapiens
GTVTVITRY

SEQ ID NO: 257782 - protein, 9 aa, Homo Sapiens
HFNSLIDLR

SEQ ID NO: 257783 - protein, 9 aa, Homo Sapiens
VDVFYLSVM

SEQ ID NO: 257784 - protein, 9 aa, Homo Sapiens
LKSVFCNTN

SEQ ID NO: 257785 - protein, 9 aa, Homo Sapiens
TQKVTFEDS

SEQ ID NO: 257786 - protein, 9 aa, Homo Sapiens
SPFSSLRWY

SEQ ID NO: 257787 - protein, 9 aa, Homo Sapiens
ANVEGLGTA

SEQ ID NO: 257788 - protein, 9 aa, Homo Sapiens
KSGRNLSDL

SEQ ID NO: 257789 - protein, 9 aa, Homo Sapiens
QESDYLATS

SEQ ID NO: 257790 - protein, 9 aa, Homo Sapiens
DEGHVQAGQ

SEQ ID NO: 257791 - protein, 9 aa, Homo Sapiens
RVLGVYLLW

SEQ ID NO: 257792 - protein, 9 aa, Homo Sapiens
NVLKQNVLV

SEQ ID NO: 257793 - protein, 9 aa, Homo Sapiens
LLVLLCRHN

SEQ ID NO: 257794 - protein, 9 aa, Homo Sapiens
HVNQVIMMK

SEQ ID NO: 257795 - protein, 9 aa, Homo Sapiens
EKDPEKCLG

SEQ ID NO: 257796 - protein, 9 aa, Homo Sapiens
LLFRINRLA

SEQ ID NO: 257797 - protein, 9 aa, Homo Sapiens
NFQCLNCSA

SEQ ID NO: 257798 - protein, 9 aa, Homo Sapiens
QNEARMETL

SEQ ID NO: 257799 - protein, 9 aa, Homo Sapiens
SQMSYLVET

SEQ ID NO: 257800 - protein, 9 aa, Homo Sapiens
FFGIDMVVY

SEQ ID NO: 257801 - protein, 9 aa, Homo Sapiens
KTPCEGRLE

SEQ ID NO: 257802 - protein, 9 aa, Homo Sapiens
RRLDDQRAI

SEQ ID NO: 257803 - protein, 9 aa, Homo Sapiens
LFRQLRRIG

SEQ ID NO: 257804 - protein, 9 aa, Homo Sapiens
LDFYHFLGS

SEQ ID NO: 257805 - protein, 9 aa, Homo Sapiens
PDKVVVNTK

SEQ ID NO: 257806 - protein, 9 aa, Homo Sapiens
DISLLRCQY

SEQ ID NO: 257807 - protein, 9 aa, Homo Sapiens
YMAPEIIAE

SEQ ID NO: 257808 - protein, 9 aa, Homo Sapiens
AVSTNVLKQ

SEQ ID NO: 257809 - protein, 9 aa, Homo Sapiens
EHISDKVSP

SEQ ID NO: 257810 - protein, 9 aa, Homo Sapiens
GNFKNSERC

SEQ ID NO: 257811 - protein, 9 aa, Homo Sapiens
HHRYLSHLP

SEQ ID NO: 257812 - protein, 9 aa, Homo Sapiens
PELPVTSFG

SEQ ID NO: 257813 - protein, 9 aa, Homo Sapiens
GGNYSRHRV

SEQ ID NO: 257814 - protein, 9 aa, Homo Sapiens
SSVCYYSHF

SEQ ID NO: 257815 - protein, 9 aa, Homo Sapiens
RIIVCYLVK

SEQ ID NO: 257816 - protein, 9 aa, Homo Sapiens
GDGSGFGKF

SEQ ID NO: 257817 - protein, 9 aa, Homo Sapiens
SNSPWAVKK

SEQ ID NO: 257818 - protein, 9 aa, Homo Sapiens
FVSYTVEVI

SEQ ID NO: 257819 - protein, 9 aa, Homo Sapiens
NMVIYYIDK

SEQ ID NO: 257820 - protein, 9 aa, Homo Sapiens
QKDFLAMFS

SEQ ID NO: 257821 - protein, 9 aa, Homo Sapiens
NYNEAKFVT

SEQ ID NO: 257822 - protein, 9 aa, Homo Sapiens
AKNIDTSPP

SEQ ID NO: 257823 - protein, 9 aa, Homo Sapiens
IVESLTCLC

SEQ ID NO: 257824 - protein, 9 aa, Homo Sapiens
FSLGKHVGN

SEQ ID NO: 257825 - protein, 9 aa, Homo Sapiens
TFFISWGSI

SEQ ID NO: 257826 - protein, 9 aa, Homo Sapiens
NPASLESMV

SEQ ID NO: 257827 - protein, 9 aa, Homo Sapiens
EQVSELNTQ

SEQ ID NO: 257828 - protein, 9 aa, Homo Sapiens
TLQHIPLTV

SEQ ID NO: 257829 - protein, 9 aa, Homo Sapiens
NRPPTLAIT

SEQ ID NO: 257830 - protein, 9 aa, Homo Sapiens
LNGELPLCS

SEQ ID NO: 257831 - protein, 9 aa, Homo Sapiens
VHHQILATE

SEQ ID NO: 257832 - protein, 9 aa, Homo Sapiens
SLSLSTPPL

SEQ ID NO: 257833 - protein, 9 aa, Homo Sapiens
TSFVMEYVG

SEQ ID NO: 257834 - protein, 9 aa, Homo Sapiens
VLIQTRGGN

SEQ ID NO: 257835 - protein, 9 aa, Homo Sapiens
QLRESVVQM

SEQ ID NO: 257836 - protein, 9 aa, Homo Sapiens
RDSTPTVLH

SEQ ID NO: 257837 - protein, 9 aa, Homo Sapiens
LNESDDDDQ

SEQ ID NO: 257838 - protein, 9 aa, Homo Sapiens
VQLSEDITR

SEQ ID NO: 257839 - protein, 9 aa, Homo Sapiens
AIIVSIFQE

SEQ ID NO: 257840 - protein, 9 aa, Homo Sapiens
TINGPQSSK

SEQ ID NO: 257841 - protein, 9 aa, Homo Sapiens
RASVIWIGY

SEQ ID NO: 257842 - protein, 9 aa, Homo Sapiens
NQLDNLFCD

SEQ ID NO: 257843 - protein, 9 aa, Homo Sapiens
TSIICNKIP

SEQ ID NO: 257844 - protein, 9 aa, Homo Sapiens
QNTLIALVT

SEQ ID NO: 257845 - protein, 9 aa, Homo Sapiens
VFIGGTKPP

SEQ ID NO: 257846 - protein, 9 aa, Homo Sapiens
EVTNGTNSA

SEQ ID NO: 257847 - protein, 9 aa, Homo Sapiens
RINSSDELQ

SEQ ID NO: 257848 - protein, 9 aa, Homo Sapiens
KESKVMCTS

SEQ ID NO: 257849 - protein, 9 aa, Homo Sapiens
IGQELSKCN

SEQ ID NO: 257850 - protein, 9 aa, Homo Sapiens
ACVHKMLRQ

SEQ ID NO: 257851 - protein, 9 aa, Homo Sapiens
HKRARKITS

SEQ ID NO: 257852 - protein, 9 aa, Homo Sapiens
ECGAPRWND

SEQ ID NO: 257853 - protein, 9 aa, Homo Sapiens
VTKLNQLPV

SEQ ID NO: 257854 - protein, 9 aa, Homo Sapiens
TSMGLSCPL

SEQ ID NO: 257855 - protein, 9 aa, Homo Sapiens
CEPYKILFK

SEQ ID NO: 257856 - protein, 9 aa, Homo Sapiens
LIRDAPTLE

SEQ ID NO: 257857 - protein, 9 aa, Homo Sapiens
SGGSGENGW

SEQ ID NO: 257858 - protein, 9 aa, Homo Sapiens
IIPLKNVLC

SEQ ID NO: 257859 - protein, 9 aa, Homo Sapiens
VHDMLKKGW

SEQ ID NO: 257860 - protein, 9 aa, Homo Sapiens
EGLIQAQSI

SEQ ID NO: 257861 - protein, 9 aa, Homo Sapiens
SKVFYYKMT

SEQ ID NO: 257862 - protein, 9 aa, Homo Sapiens
KAPAVVLHM

SEQ ID NO: 257863 - protein, 9 aa, Homo Sapiens
LAVVLVVSR

SEQ ID NO: 257864 - protein, 9 aa, Homo Sapiens
SGGKSTHQA

SEQ ID NO: 257865 - protein, 9 aa, Homo Sapiens
EALICNCDR

SEQ ID NO: 257866 - protein, 9 aa, Homo Sapiens
ATKKGEKEL

SEQ ID NO: 257867 - protein, 9 aa, Homo Sapiens
TGHLLLLAL

SEQ ID NO: 257868 - protein, 9 aa, Homo Sapiens
TDYRTAISG

SEQ ID NO: 257869 - protein, 9 aa, Homo Sapiens
NGSGISGTT

SEQ ID NO: 257870 - protein, 9 aa, Homo Sapiens
EKDEDFLSL

SEQ ID NO: 257871 - protein, 9 aa, Homo Sapiens
KRCARHYKK

SEQ ID NO: 257872 - protein, 9 aa, Homo Sapiens
TANVQGDTL

SEQ ID NO: 257873 - protein, 9 aa, Homo Sapiens
FYYKMTGDY

SEQ ID NO: 257874 - protein, 9 aa, Homo Sapiens
VASEHYNQP

SEQ ID NO: 257875 - protein, 9 aa, Homo Sapiens
EEETKEALA

SEQ ID NO: 257876 - protein, 9 aa, Homo Sapiens
LSVKLSPFG

SEQ ID NO: 257877 - protein, 9 aa, Homo Sapiens
WLFMPLDET

SEQ ID NO: 257878 - protein, 9 aa, Homo Sapiens
LPYLSPYHS

SEQ ID NO: 257879 - protein, 9 aa, Homo Sapiens
NKAALEMCQ

SEQ ID NO: 257880 - protein, 9 aa, Homo Sapiens
LCKLQDTKS

SEQ ID NO: 257881 - protein, 9 aa, Homo Sapiens
RCIAKCDHH

SEQ ID NO: 257882 - protein, 9 aa, Homo Sapiens
KKLLDILQH

SEQ ID NO: 257883 - protein, 9 aa, Homo Sapiens
LHVKNVCQL

SEQ ID NO: 257884 - protein, 9 aa, Homo Sapiens
AALQVTKPY

SEQ ID NO: 257885 - protein, 9 aa, Homo Sapiens
AYQQMVLDA

SEQ ID NO: 257886 - protein, 9 aa, Homo Sapiens
TPGFIDKTF

SEQ ID NO: 257887 - protein, 9 aa, Homo Sapiens
TDCKVVNVL

SEQ ID NO: 257888 - protein, 9 aa, Homo Sapiens
LRNRFKHEQ

SEQ ID NO: 257889 - protein, 9 aa, Homo Sapiens
VDHLFQNKL

SEQ ID NO: 257890 - protein, 9 aa, Homo Sapiens
GSNKPERRP

SEQ ID NO: 257891 - protein, 9 aa, Homo Sapiens
YDLNDSFID

SEQ ID NO: 257892 - protein, 9 aa, Homo Sapiens
RLATKTELK

SEQ ID NO: 257893 - protein, 9 aa, Homo Sapiens
PGYTGKVHL

SEQ ID NO: 257894 - protein, 9 aa, Homo Sapiens
ANVFEKKDK

SEQ ID NO: 257895 - protein, 9 aa, Homo Sapiens
NNLYRYVMQ

SEQ ID NO: 257896 - protein, 9 aa, Homo Sapiens
NHNYRIRYR

SEQ ID NO: 257897 - protein, 9 aa, Homo Sapiens
DINFEPVVQ

SEQ ID NO: 257898 - protein, 9 aa, Homo Sapiens
AIRVFFMLH

SEQ ID NO: 257899 - protein, 9 aa, Homo Sapiens
SENSSTHSS

SEQ ID NO: 257900 - protein, 9 aa, Homo Sapiens
QLETCIDDA

SEQ ID NO: 257901 - protein, 9 aa, Homo Sapiens
APPFGSSYI

SEQ ID NO: 257902 - protein, 9 aa, Homo Sapiens
VVFGVEYFM

SEQ ID NO: 257903 - protein, 9 aa, Homo Sapiens
NKMMKLLKN

SEQ ID NO: 257904 - protein, 9 aa, Homo Sapiens
EANMWRQEE

SEQ ID NO: 257905 - protein, 9 aa, Homo Sapiens
YQCDKCGKA

SEQ ID NO: 257906 - protein, 9 aa, Homo Sapiens
SNLEVPPGR

SEQ ID NO: 257907 - protein, 9 aa, Homo Sapiens
SQRNSLCVK

SEQ ID NO: 257908 - protein, 9 aa, Homo Sapiens
LSQPEVYVA

SEQ ID NO: 257909 - protein, 9 aa, Homo Sapiens
SQKKSCSGT

SEQ ID NO: 257910 - protein, 9 aa, Homo Sapiens
QDVDATNPI

SEQ ID NO: 257911 - protein, 9 aa, Homo Sapiens
MVFKKRQPS

SEQ ID NO: 257912 - protein, 9 aa, Homo Sapiens
TCDCLPKFL

SEQ ID NO: 257913 - protein, 9 aa, Homo Sapiens
SQAQYPVVK

SEQ ID NO: 257914 - protein, 9 aa, Homo Sapiens
LNNYSYNEI

SEQ ID NO: 257915 - protein, 9 aa, Homo Sapiens
INISPNGKY

SEQ ID NO: 257916 - protein, 9 aa, Homo Sapiens
EQKRNPQAV

SEQ ID NO: 257917 - protein, 9 aa, Homo Sapiens
PTLFNCLMY

SEQ ID NO: 257918 - protein, 9 aa, Homo Sapiens
TSGSRSQRD

SEQ ID NO: 257919 - protein, 9 aa, Homo Sapiens
ITGRRSTFQ

SEQ ID NO: 257920 - protein, 9 aa, Homo Sapiens
SSFVSMYTH

SEQ ID NO: 257921 - protein, 9 aa, Homo Sapiens
LPPIKFHAG

SEQ ID NO: 257922 - protein, 9 aa, Homo Sapiens
QLKVNHEAL

SEQ ID NO: 257923 - protein, 9 aa, Homo Sapiens
VFMATPNLS

SEQ ID NO: 257924 - protein, 9 aa, Homo Sapiens
EHCEEHVAL

SEQ ID NO: 257925 - protein, 9 aa, Homo Sapiens
AGSLVNEQW

SEQ ID NO: 257926 - protein, 9 aa, Homo Sapiens
NRRWMRDNV

SEQ ID NO: 257927 - protein, 9 aa, Homo Sapiens
HLIVHKIIH

SEQ ID NO: 257928 - protein, 9 aa, Homo Sapiens
STKPKQDNE

SEQ ID NO: 257929 - protein, 9 aa, Homo Sapiens
LTKDSCFLT

SEQ ID NO: 257930 - protein, 9 aa, Homo Sapiens
SWSWCRIPS

SEQ ID NO: 257931 - protein, 9 aa, Homo Sapiens
DSRDTVRLN

SEQ ID NO: 257932 - protein, 9 aa, Homo Sapiens
DKSAATAEK

SEQ ID NO: 257933 - protein, 9 aa, Homo Sapiens
YDITNNSDQ

SEQ ID NO: 257934 - protein, 9 aa, Homo Sapiens
LHPLLIIAT

SEQ ID NO: 257935 - protein, 9 aa, Homo Sapiens
MLGKCDPTS

SEQ ID NO: 257936 - protein, 9 aa, Homo Sapiens
FTATAKFRE

SEQ ID NO: 257937 - protein, 9 aa, Homo Sapiens
EEFPDVDEE

SEQ ID NO: 257938 - protein, 9 aa, Homo Sapiens
SSLKLNDFK

SEQ ID NO: 257939 - protein, 9 aa, Homo Sapiens
GLEVLRAEH

SEQ ID NO: 257940 - protein, 9 aa, Homo Sapiens
IMDDNNNRT

SEQ ID NO: 257941 - protein, 9 aa, Homo Sapiens
EGTKSYKDS

SEQ ID NO: 257942 - protein, 9 aa, Homo Sapiens
LVHANTPLP

SEQ ID NO: 257943 - protein, 9 aa, Homo Sapiens
VMETKNSGS

SEQ ID NO: 257944 - protein, 9 aa, Homo Sapiens
SSILTNISS

SEQ ID NO: 257945 - protein, 9 aa, Homo Sapiens
DMLYNFYPL

SEQ ID NO: 257946 - protein, 9 aa, Homo Sapiens
EIFEKINAS

SEQ ID NO: 257947 - protein, 9 aa, Homo Sapiens
GELEASVKN

SEQ ID NO: 257948 - protein, 9 aa, Homo Sapiens
ENKDLLGEL

SEQ ID NO: 257949 - protein, 9 aa, Homo Sapiens
AKKINVHIE

SEQ ID NO: 257950 - protein, 9 aa, Homo Sapiens
PSWIDTFII

SEQ ID NO: 257951 - protein, 9 aa, Homo Sapiens
PLQKFTPEI

SEQ ID NO: 257952 - protein, 9 aa, Homo Sapiens
TCNNTVGND

SEQ ID NO: 257953 - protein, 9 aa, Homo Sapiens
RAKITDPSA

SEQ ID NO: 257954 - protein, 9 aa, Homo Sapiens
PEDEFLRNN

SEQ ID NO: 257955 - protein, 9 aa, Homo Sapiens
PLGVPISGP

SEQ ID NO: 257956 - protein, 9 aa, Homo Sapiens
PPRVPFAMR

SEQ ID NO: 257957 - protein, 9 aa, Homo Sapiens
LHDALSLAY

SEQ ID NO: 257958 - protein, 9 aa, Homo Sapiens
RKITSMETA

SEQ ID NO: 257959 - protein, 9 aa, Homo Sapiens
SKTMEFGKT

SEQ ID NO: 257960 - protein, 9 aa, Homo Sapiens
KLHLFKDGK

SEQ ID NO: 257961 - protein, 9 aa, Homo Sapiens
NVKNDRDRV

SEQ ID NO: 257962 - protein, 9 aa, Homo Sapiens
SKDVLAGRP

SEQ ID NO: 257963 - protein, 9 aa, Homo Sapiens
TAAKFIQEM

SEQ ID NO: 257964 - protein, 9 aa, Homo Sapiens
IRMSCVKGW

SEQ ID NO: 257965 - protein, 9 aa, Homo Sapiens
SQFQARDIY

SEQ ID NO: 257966 - protein, 9 aa, Homo Sapiens
YAHFRAKLA

SEQ ID NO: 257967 - protein, 9 aa, Homo Sapiens
ELHKFLETE

SEQ ID NO: 257968 - protein, 9 aa, Homo Sapiens
VRDIGRCAI

SEQ ID NO: 257969 - protein, 9 aa, Homo Sapiens
RSQSRSNLP

SEQ ID NO: 257970 - protein, 9 aa, Homo Sapiens
IFFFHCIWM

SEQ ID NO: 257971 - protein, 9 aa, Homo Sapiens
HQIVHTREK

SEQ ID NO: 257972 - protein, 9 aa, Homo Sapiens
SLLRTNTSC

SEQ ID NO: 257973 - protein, 9 aa, Homo Sapiens
PCRCNKCGK

SEQ ID NO: 257974 - protein, 9 aa, Homo Sapiens
MVTNSVGNT

SEQ ID NO: 257975 - protein, 9 aa, Homo Sapiens
GTYRNLSTW

SEQ ID NO: 257976 - protein, 9 aa, Homo Sapiens
DYLLEKDND

SEQ ID NO: 257977 - protein, 9 aa, Homo Sapiens
WQEARGALQ

SEQ ID NO: 257978 - protein, 9 aa, Homo Sapiens
PRLPAKRKA

SEQ ID NO: 257979 - protein, 9 aa, Homo Sapiens
DRGRTPGSS

SEQ ID NO: 257980 - protein, 9 aa, Homo Sapiens
NETEIEVSI

SEQ ID NO: 257981 - protein, 9 aa, Homo Sapiens
SLIGNKCEE

SEQ ID NO: 257982 - protein, 9 aa, Homo Sapiens
GSVANHQVR

SEQ ID NO: 257983 - protein, 9 aa, Homo Sapiens
DQDKQLQDL

SEQ ID NO: 257984 - protein, 9 aa, Homo Sapiens
HDDPIRLLG

SEQ ID NO: 257985 - protein, 9 aa, Homo Sapiens
ANIVNLNKH

SEQ ID NO: 257986 - protein, 9 aa, Homo Sapiens
GEIIDLYKM

SEQ ID NO: 257987 - protein, 9 aa, Homo Sapiens
VLLPTSPGL

SEQ ID NO: 257988 - protein, 9 aa, Homo Sapiens
LDLSIVKIW

SEQ ID NO: 257989 - protein, 9 aa, Homo Sapiens
LQTKNHKLA

SEQ ID NO: 257990 - protein, 9 aa, Homo Sapiens
YGRSKDKNI

SEQ ID NO: 257991 - protein, 9 aa, Homo Sapiens
TSNEPSVRQ

SEQ ID NO: 257992 - protein, 9 aa, Homo Sapiens
LTEPCLLHF

SEQ ID NO: 257993 - protein, 9 aa, Homo Sapiens
ARWIVHGLV

SEQ ID NO: 257994 - protein, 9 aa, Homo Sapiens
EQQQENLAR

SEQ ID NO: 257995 - protein, 9 aa, Homo Sapiens
RHLRNFFFI

SEQ ID NO: 257996 - protein, 9 aa, Homo Sapiens
IMEGVTTLV

SEQ ID NO: 257997 - protein, 9 aa, Homo Sapiens
SGKNRGFGF

SEQ ID NO: 257998 - protein, 9 aa, Homo Sapiens
SSDLTKHKR

SEQ ID NO: 257999 - protein, 9 aa, Homo Sapiens
LVERRWHAA

SEQ ID NO: 258000 - protein, 9 aa, Homo Sapiens
EEENQCKES

SEQ ID NO: 258001 - protein, 9 aa, Homo Sapiens
DGFIVNTIL

SEQ ID NO: 258002 - protein, 9 aa, Homo Sapiens
AKALMGHFQ

SEQ ID NO: 258003 - protein, 9 aa, Homo Sapiens
AWDVKMLLG

SEQ ID NO: 258004 - protein, 9 aa, Homo Sapiens
ALIVLGTGG

SEQ ID NO: 258005 - protein, 9 aa, Homo Sapiens
SQVQHIHIK

SEQ ID NO: 258006 - protein, 9 aa, Homo Sapiens
TALSRPGTR

SEQ ID NO: 258007 - protein, 9 aa, Homo Sapiens
VFHTSCLRS

SEQ ID NO: 258008 - protein, 9 aa, Homo Sapiens
TSRHTSEKL

SEQ ID NO: 258009 - protein, 9 aa, Homo Sapiens
VQRWKDSWK

SEQ ID NO: 258010 - protein, 9 aa, Homo Sapiens
TPAYPQQNY

SEQ ID NO: 258011 - protein, 9 aa, Homo Sapiens
TIHFQSDIS

SEQ ID NO: 258012 - protein, 9 aa, Homo Sapiens
VLGKVKLCE

SEQ ID NO: 258013 - protein, 9 aa, Homo Sapiens
AICIHYCDV

SEQ ID NO: 258014 - protein, 9 aa, Homo Sapiens
FLMGAMRGS

SEQ ID NO: 258015 - protein, 9 aa, Homo Sapiens
NNSVQYKLL

SEQ ID NO: 258016 - protein, 9 aa, Homo Sapiens
HWVVRGKKY

SEQ ID NO: 258017 - protein, 9 aa, Homo Sapiens
FEFSSAVPK

SEQ ID NO: 258018 - protein, 9 aa, Homo Sapiens
SIDSLIDVF

SEQ ID NO: 258019 - protein, 9 aa, Homo Sapiens
VRPRNAALG

SEQ ID NO: 258020 - protein, 9 aa, Homo Sapiens
VLTWGEEIE

SEQ ID NO: 258021 - protein, 9 aa, Homo Sapiens
PEKIVQMTE

SEQ ID NO: 258022 - protein, 9 aa, Homo Sapiens
GQRLSFDYR

SEQ ID NO: 258023 - protein, 9 aa, Homo Sapiens
RFGDAEWAL

SEQ ID NO: 258024 - protein, 9 aa, Homo Sapiens
WSCQLPCEQ

SEQ ID NO: 258025 - protein, 9 aa, Homo Sapiens
EASGAPEKV

SEQ ID NO: 258026 - protein, 9 aa, Homo Sapiens
PNTNGSHFF

SEQ ID NO: 258027 - protein, 9 aa, Homo Sapiens
ELENPEDTY

SEQ ID NO: 258028 - protein, 9 aa, Homo Sapiens
NTESYGDMN

SEQ ID NO: 258029 - protein, 9 aa, Homo Sapiens
NDNHPVFNE

SEQ ID NO: 258030 - protein, 9 aa, Homo Sapiens
GHEGSWFYI

SEQ ID NO: 258031 - protein, 9 aa, Homo Sapiens
VAICCPIHY

SEQ ID NO: 258032 - protein, 9 aa, Homo Sapiens
QKYVRLHEV

SEQ ID NO: 258033 - protein, 9 aa, Homo Sapiens
GVFQGPDIC

SEQ ID NO: 258034 - protein, 9 aa, Homo Sapiens
QSRTNLSYM

SEQ ID NO: 258035 - protein, 9 aa, Homo Sapiens
KAGHFSDTP

SEQ ID NO: 258036 - protein, 9 aa, Homo Sapiens
ALALHYFPE

SEQ ID NO: 258037 - protein, 9 aa, Homo Sapiens
ADMLIERSS

SEQ ID NO: 258038 - protein, 9 aa, Homo Sapiens
KDVRRICSL

SEQ ID NO: 258039 - protein, 9 aa, Homo Sapiens
STLTLHQQN

SEQ ID NO: 258040 - protein, 9 aa, Homo Sapiens
LILLGKAQQ

SEQ ID NO: 258041 - protein, 9 aa, Homo Sapiens
DEYFNCDIQ

SEQ ID NO: 258042 - protein, 9 aa, Homo Sapiens
KVPAGVQMN

SEQ ID NO: 258043 - protein, 9 aa, Homo Sapiens
ESQHVEHEL

SEQ ID NO: 258044 - protein, 9 aa, Homo Sapiens
MFQALNRPD

SEQ ID NO: 258045 - protein, 9 aa, Homo Sapiens
HEKTLAVGG

SEQ ID NO: 258046 - protein, 9 aa, Homo Sapiens
CQDWYYKAA

SEQ ID NO: 258047 - protein, 9 aa, Homo Sapiens
WPSDKGSLV

SEQ ID NO: 258048 - protein, 9 aa, Homo Sapiens
YKIFFVMGI

SEQ ID NO: 258049 - protein, 9 aa, Homo Sapiens
FKDNKPNYK

SEQ ID NO: 258050 - protein, 9 aa, Homo Sapiens
SGGFGSTGN

SEQ ID NO: 258051 - protein, 9 aa, Homo Sapiens
FWINFDHYY

SEQ ID NO: 258052 - protein, 9 aa, Homo Sapiens
IVTYVGRPF

SEQ ID NO: 258053 - protein, 9 aa, Homo Sapiens
SVLPNPTLA

SEQ ID NO: 258054 - protein, 9 aa, Homo Sapiens
AYDQAVAIS

SEQ ID NO: 258055 - protein, 9 aa, Homo Sapiens
NPIHGLVQS

SEQ ID NO: 258056 - protein, 9 aa, Homo Sapiens
QVFLNKNIF

SEQ ID NO: 258057 - protein, 9 aa, Homo Sapiens
VPGPPRVPF

SEQ ID NO: 258058 - protein, 9 aa, Homo Sapiens
CNYHNEEYV

SEQ ID NO: 258059 - protein, 9 aa, Homo Sapiens
VQPELYHSV

SEQ ID NO: 258060 - protein, 9 aa, Homo Sapiens
FLRFQGISW

SEQ ID NO: 258061 - protein, 9 aa, Homo Sapiens
MKKRCGSSK

SEQ ID NO: 258062 - protein, 9 aa, Homo Sapiens
ETCPAETTH

SEQ ID NO: 258063 - protein, 9 aa, Homo Sapiens
ADIPENIYG

SEQ ID NO: 258064 - protein, 9 aa, Homo Sapiens
VKRTALGCS

SEQ ID NO: 258065 - protein, 9 aa, Homo Sapiens
PMLVQALQK

SEQ ID NO: 258066 - protein, 9 aa, Homo Sapiens
KANVSVPAD

SEQ ID NO: 258067 - protein, 9 aa, Homo Sapiens
MNGFQSGMK

SEQ ID NO: 258068 - protein, 9 aa, Homo Sapiens
SFKLNLERH

SEQ ID NO: 258069 - protein, 9 aa, Homo Sapiens
ITVADQGEQ

SEQ ID NO: 258070 - protein, 9 aa, Homo Sapiens
ARRKIFLPK

SEQ ID NO: 258071 - protein, 9 aa, Homo Sapiens
IQAMNGFQS

SEQ ID NO: 258072 - protein, 9 aa, Homo Sapiens
NRQGILHRL

SEQ ID NO: 258073 - protein, 9 aa, Homo Sapiens
ESLGKSVVM

SEQ ID NO: 258074 - protein, 9 aa, Homo Sapiens
TPSASIREE

SEQ ID NO: 258075 - protein, 9 aa, Homo Sapiens
QINRNNTFQ

SEQ ID NO: 258076 - protein, 9 aa, Homo Sapiens
PYTCDECGK

SEQ ID NO: 258077 - protein, 9 aa, Homo Sapiens
PAPPATLPS

SEQ ID NO: 258078 - protein, 9 aa, Homo Sapiens
VADHREGIL

SEQ ID NO: 258079 - protein, 9 aa, Homo Sapiens
ALEVELGKP

SEQ ID NO: 258080 - protein, 9 aa, Homo Sapiens
KPNKVKDPL

SEQ ID NO: 258081 - protein, 9 aa, Homo Sapiens
QTLQIQQQT

SEQ ID NO: 258082 - protein, 9 aa, Homo Sapiens
VQELPQILG

SEQ ID NO: 258083 - protein, 9 aa, Homo Sapiens
NEPEDNFWM

SEQ ID NO: 258084 - protein, 9 aa, Homo Sapiens
FKFTIPDSL

SEQ ID NO: 258085 - protein, 9 aa, Homo Sapiens
TNEMLLKFY

SEQ ID NO: 258086 - protein, 9 aa, Homo Sapiens
EERFSLFTN

SEQ ID NO: 258087 - protein, 9 aa, Homo Sapiens
NLYGYPEVK

SEQ ID NO: 258088 - protein, 9 aa, Homo Sapiens
GDLRAESVT

SEQ ID NO: 258089 - protein, 9 aa, Homo Sapiens
GRNKGEFTH

SEQ ID NO: 258090 - protein, 9 aa, Homo Sapiens
QLWLQYQEE

SEQ ID NO: 258091 - protein, 9 aa, Homo Sapiens
RNYRHIPDK

SEQ ID NO: 258092 - protein, 9 aa, Homo Sapiens
SLEIRRWDI

SEQ ID NO: 258093 - protein, 9 aa, Homo Sapiens
PLWEAFELL

SEQ ID NO: 258094 - protein, 9 aa, Homo Sapiens
LAAEDPVRA

SEQ ID NO: 258095 - protein, 9 aa, Homo Sapiens
LPTLKWKPL

SEQ ID NO: 258096 - protein, 9 aa, Homo Sapiens
YFIRTTEAR

SEQ ID NO: 258097 - protein, 9 aa, Homo Sapiens
VYVQDCRSP

SEQ ID NO: 258098 - protein, 9 aa, Homo Sapiens
PRPREDLGA

SEQ ID NO: 258099 - protein, 9 aa, Homo Sapiens
KKAPKKIRI

SEQ ID NO: 258100 - protein, 9 aa, Homo Sapiens
LFIIAIVVT

SEQ ID NO: 258101 - protein, 9 aa, Homo Sapiens
DPKYVRYSK

SEQ ID NO: 258102 - protein, 9 aa, Homo Sapiens
LLETSSKEE

SEQ ID NO: 258103 - protein, 9 aa, Homo Sapiens
AQASAGDTR

SEQ ID NO: 258104 - protein, 9 aa, Homo Sapiens
WVKFQYPES

SEQ ID NO: 258105 - protein, 9 aa, Homo Sapiens
QLLRLKMFQ

SEQ ID NO: 258106 - protein, 9 aa, Homo Sapiens
MNRTYVISA

SEQ ID NO: 258107 - protein, 9 aa, Homo Sapiens
LPAIFTPFF

SEQ ID NO: 258108 - protein, 9 aa, Homo Sapiens
KEVFARLST

SEQ ID NO: 258109 - protein, 9 aa, Homo Sapiens
KKDKGYPKL

SEQ ID NO: 258110 - protein, 9 aa, Homo Sapiens
QAMKGNRVN

SEQ ID NO: 258111 - protein, 9 aa, Homo Sapiens
KGNQGRIGV

SEQ ID NO: 258112 - protein, 9 aa, Homo Sapiens
GNPPNAIIF

SEQ ID NO: 258113 - protein, 9 aa, Homo Sapiens
RCSKHHLNS

SEQ ID NO: 258114 - protein, 9 aa, Homo Sapiens
RTALGCSRI

SEQ ID NO: 258115 - protein, 9 aa, Homo Sapiens
PNFPHIDEF

SEQ ID NO: 258116 - protein, 9 aa, Homo Sapiens
LEIQYQEQI

SEQ ID NO: 258117 - protein, 9 aa, Homo Sapiens
GAWLSPAPE

SEQ ID NO: 258118 - protein, 9 aa, Homo Sapiens
EHHIMHTRE

SEQ ID NO: 258119 - protein, 9 aa, Homo Sapiens
EVDSDGDGK

SEQ ID NO: 258120 - protein, 9 aa, Homo Sapiens
NVTWDGKAL

SEQ ID NO: 258121 - protein, 9 aa, Homo Sapiens
NQSQKVDEL

SEQ ID NO: 258122 - protein, 9 aa, Homo Sapiens
TVCIPRFLL

SEQ ID NO: 258123 - protein, 9 aa, Homo Sapiens
GHQQIIHTR

SEQ ID NO: 258124 - protein, 9 aa, Homo Sapiens
TIYHVSDLM

SEQ ID NO: 258125 - protein, 9 aa, Homo Sapiens
EIPPKKEAS

SEQ ID NO: 258126 - protein, 9 aa, Homo Sapiens
QSAEERLRR

SEQ ID NO: 258127 - protein, 9 aa, Homo Sapiens
PRTRGVFSF

SEQ ID NO: 258128 - protein, 9 aa, Homo Sapiens
PHYSPMVKS

SEQ ID NO: 258129 - protein, 9 aa, Homo Sapiens
SASMLTLRV

SEQ ID NO: 258130 - protein, 9 aa, Homo Sapiens
AVDFLGHVG

SEQ ID NO: 258131 - protein, 9 aa, Homo Sapiens
SLYIIHLGI

SEQ ID NO: 258132 - protein, 9 aa, Homo Sapiens
EEYLQRLDF

SEQ ID NO: 258133 - protein, 9 aa, Homo Sapiens
DPYTISTLT

SEQ ID NO: 258134 - protein, 9 aa, Homo Sapiens
EKLIIHLWK

SEQ ID NO: 258135 - protein, 9 aa, Homo Sapiens
ERLQTLLGD

SEQ ID NO: 258136 - protein, 9 aa, Homo Sapiens
RARPLHALQ

SEQ ID NO: 258137 - protein, 9 aa, Homo Sapiens
NALSSSSED

SEQ ID NO: 258138 - protein, 9 aa, Homo Sapiens
EYRTLSGII

SEQ ID NO: 258139 - protein, 9 aa, Homo Sapiens
PQWSFACEQ

SEQ ID NO: 258140 - protein, 9 aa, Homo Sapiens
QATPDIPSG

SEQ ID NO: 258141 - protein, 9 aa, Homo Sapiens
NKQKKEAFL

SEQ ID NO: 258142 - protein, 9 aa, Homo Sapiens
TDCILSGIM

SEQ ID NO: 258143 - protein, 9 aa, Homo Sapiens
ILTGPYGFI

SEQ ID NO: 258144 - protein, 9 aa, Homo Sapiens
NQEQTEALS

SEQ ID NO: 258145 - protein, 9 aa, Homo Sapiens
GPLLFCTQC

SEQ ID NO: 258146 - protein, 9 aa, Homo Sapiens
IMFETSNVP

SEQ ID NO: 258147 - protein, 9 aa, Homo Sapiens
GDELKAKVM

SEQ ID NO: 258148 - protein, 9 aa, Homo Sapiens
DLSELFKER

SEQ ID NO: 258149 - protein, 9 aa, Homo Sapiens
TFFLYNQGP

SEQ ID NO: 258150 - protein, 9 aa, Homo Sapiens
VFKMLQENC

SEQ ID NO: 258151 - protein, 9 aa, Homo Sapiens
TSKKRGKKV

SEQ ID NO: 258152 - protein, 9 aa, Homo Sapiens
DYIADKKDA

SEQ ID NO: 258153 - protein, 9 aa, Homo Sapiens
FYGTVMCMY

SEQ ID NO: 258154 - protein, 9 aa, Homo Sapiens
IQISSKTGI

SEQ ID NO: 258155 - protein, 9 aa, Homo Sapiens
QKQEIKYAF

SEQ ID NO: 258156 - protein, 9 aa, Homo Sapiens
EQCIQWIVT

SEQ ID NO: 258157 - protein, 9 aa, Homo Sapiens
GRLELKTLG

SEQ ID NO: 258158 - protein, 9 aa, Homo Sapiens
EEYKWGMEQ

SEQ ID NO: 258159 - protein, 9 aa, Homo Sapiens
IGNVTYFFF

SEQ ID NO: 258160 - protein, 9 aa, Homo Sapiens
TMKRSRNHI

SEQ ID NO: 258161 - protein, 9 aa, Homo Sapiens
AVLMTLFAG

SEQ ID NO: 258162 - protein, 9 aa, Homo Sapiens
LIKLQDMER

SEQ ID NO: 258163 - protein, 9 aa, Homo Sapiens
IDNLHHVGS

SEQ ID NO: 258164 - protein, 9 aa, Homo Sapiens
QLTQQEIVA

SEQ ID NO: 258165 - protein, 9 aa, Homo Sapiens
NTLLGRVTI

SEQ ID NO: 258166 - protein, 9 aa, Homo Sapiens
LAIYPITLA

SEQ ID NO: 258167 - protein, 9 aa, Homo Sapiens
AGMGYHVSQ

SEQ ID NO: 258168 - protein, 9 aa, Homo Sapiens
VIRCKDGVV

SEQ ID NO: 258169 - protein, 9 aa, Homo Sapiens
GLLVSLTSR

SEQ ID NO: 258170 - protein, 9 aa, Homo Sapiens
DNCLLCLQD

SEQ ID NO: 258171 - protein, 9 aa, Homo Sapiens
NVERKYVAD

SEQ ID NO: 258172 - protein, 9 aa, Homo Sapiens
ANGTFHCDV

SEQ ID NO: 258173 - protein, 9 aa, Homo Sapiens
GSSPERFPV

SEQ ID NO: 258174 - protein, 9 aa, Homo Sapiens
LIVGSKVDM

SEQ ID NO: 258175 - protein, 9 aa, Homo Sapiens
KEREKTREK

SEQ ID NO: 258176 - protein, 9 aa, Homo Sapiens
IPEDSDQEV

SEQ ID NO: 258177 - protein, 9 aa, Homo Sapiens
YSVGVSGNL

SEQ ID NO: 258178 - protein, 9 aa, Homo Sapiens
DQWTALHCA

SEQ ID NO: 258179 - protein, 9 aa, Homo Sapiens
GLIPYLVAG

SEQ ID NO: 258180 - protein, 9 aa, Homo Sapiens
QTGVIPQGE

SEQ ID NO: 258181 - protein, 9 aa, Homo Sapiens
VNSLAAQHV

SEQ ID NO: 258182 - protein, 9 aa, Homo Sapiens
DLSWSMLLG

SEQ ID NO: 258183 - protein, 9 aa, Homo Sapiens
ENLLESRLE

SEQ ID NO: 258184 - protein, 9 aa, Homo Sapiens
INMAGEPRP

SEQ ID NO: 258185 - protein, 9 aa, Homo Sapiens
WMVDCYSPW

SEQ ID NO: 258186 - protein, 9 aa, Homo Sapiens
LITNNIMLI

SEQ ID NO: 258187 - protein, 9 aa, Homo Sapiens
TADSLPPSM

SEQ ID NO: 258188 - protein, 9 aa, Homo Sapiens
KLERERSYD

SEQ ID NO: 258189 - protein, 9 aa, Homo Sapiens
RASNYPKRN

SEQ ID NO: 258190 - protein, 9 aa, Homo Sapiens
FYFNNILNS

SEQ ID NO: 258191 - protein, 9 aa, Homo Sapiens
PAKEPRVTL

SEQ ID NO: 258192 - protein, 9 aa, Homo Sapiens
KHLVDGAHC

SEQ ID NO: 258193 - protein, 9 aa, Homo Sapiens
WSINGTQIA

SEQ ID NO: 258194 - protein, 9 aa, Homo Sapiens
TRSSRYGSS

SEQ ID NO: 258195 - protein, 9 aa, Homo Sapiens
QAAVRAANI

SEQ ID NO: 258196 - protein, 9 aa, Homo Sapiens
EMFRFAYYT

SEQ ID NO: 258197 - protein, 9 aa, Homo Sapiens
TAYFSESRA

SEQ ID NO: 258198 - protein, 9 aa, Homo Sapiens
SCPRVIHLH

SEQ ID NO: 258199 - protein, 9 aa, Homo Sapiens
ANYRYGREE

SEQ ID NO: 258200 - protein, 9 aa, Homo Sapiens
IIKYLLGEF

SEQ ID NO: 258201 - protein, 9 aa, Homo Sapiens
RKPYIFTLH

SEQ ID NO: 258202 - protein, 9 aa, Homo Sapiens
GVLLFMERE

SEQ ID NO: 258203 - protein, 9 aa, Homo Sapiens
GIIPENFSA

SEQ ID NO: 258204 - protein, 9 aa, Homo Sapiens
NREVLEQVA

SEQ ID NO: 258205 - protein, 9 aa, Homo Sapiens
EACLGGKLW

SEQ ID NO: 258206 - protein, 9 aa, Homo Sapiens
QRPKTLRLR

SEQ ID NO: 258207 - protein, 9 aa, Homo Sapiens
GPSMSLLSF

SEQ ID NO: 258208 - protein, 9 aa, Homo Sapiens
YVMVIQAIE

SEQ ID NO: 258209 - protein, 9 aa, Homo Sapiens
SAFGLDRSL

SEQ ID NO: 258210 - protein, 9 aa, Homo Sapiens
INAGLKGKS

SEQ ID NO: 258211 - protein, 9 aa, Homo Sapiens
LRVLLCHPG

SEQ ID NO: 258212 - protein, 9 aa, Homo Sapiens
FNIIITSLT

SEQ ID NO: 258213 - protein, 9 aa, Homo Sapiens
MDIGGTLVE

SEQ ID NO: 258214 - protein, 9 aa, Homo Sapiens
TLDPQILPR

SEQ ID NO: 258215 - protein, 9 aa, Homo Sapiens
RKDREMQIN

SEQ ID NO: 258216 - protein, 9 aa, Homo Sapiens
LQSVAPQQD

SEQ ID NO: 258217 - protein, 9 aa, Homo Sapiens
LSFLLFPQD

SEQ ID NO: 258218 - protein, 9 aa, Homo Sapiens
GRHTLDHLL

SEQ ID NO: 258219 - protein, 9 aa, Homo Sapiens
LEGLIAVVT

SEQ ID NO: 258220 - protein, 9 aa, Homo Sapiens
ADLTLCHIL

SEQ ID NO: 258221 - protein, 9 aa, Homo Sapiens
DCGYDRYED

SEQ ID NO: 258222 - protein, 9 aa, Homo Sapiens
CIWMPGQFA

SEQ ID NO: 258223 - protein, 9 aa, Homo Sapiens
SPGPFQPCE

SEQ ID NO: 258224 - protein, 9 aa, Homo Sapiens
DIAMNCIIA

SEQ ID NO: 258225 - protein, 9 aa, Homo Sapiens
PPPPLLAMR

SEQ ID NO: 258226 - protein, 9 aa, Homo Sapiens
EYPDKDKEI

SEQ ID NO: 258227 - protein, 9 aa, Homo Sapiens
HSFVTHAVH

SEQ ID NO: 258228 - protein, 9 aa, Homo Sapiens
IECMEEKCS

SEQ ID NO: 258229 - protein, 9 aa, Homo Sapiens
SKGLFLVSL

SEQ ID NO: 258230 - protein, 9 aa, Homo Sapiens
ENVETCPAE

SEQ ID NO: 258231 - protein, 9 aa, Homo Sapiens
TGFQSPIQK

SEQ ID NO: 258232 - protein, 9 aa, Homo Sapiens
LKEFLPEEY

SEQ ID NO: 258233 - protein, 9 aa, Homo Sapiens
HRAKIIITY

SEQ ID NO: 258234 - protein, 9 aa, Homo Sapiens
DVPQIPLEE

SEQ ID NO: 258235 - protein, 9 aa, Homo Sapiens
LSDHFQIHT

SEQ ID NO: 258236 - protein, 9 aa, Homo Sapiens
KRFKEDLKG

SEQ ID NO: 258237 - protein, 9 aa, Homo Sapiens
SVPEILISR

SEQ ID NO: 258238 - protein, 9 aa, Homo Sapiens
APSLPPESS

SEQ ID NO: 258239 - protein, 9 aa, Homo Sapiens
RYVKMSTFD

SEQ ID NO: 258240 - protein, 9 aa, Homo Sapiens
EYNPAISCV

SEQ ID NO: 258241 - protein, 9 aa, Homo Sapiens
GGQEASGGG

SEQ ID NO: 258242 - protein, 9 aa, Homo Sapiens
LNRNRKENR

SEQ ID NO: 258243 - protein, 9 aa, Homo Sapiens
LNTTCKKGG

SEQ ID NO: 258244 - protein, 9 aa, Homo Sapiens
SKDAIKKKC

SEQ ID NO: 258245 - protein, 9 aa, Homo Sapiens
GRWRFYWKM

SEQ ID NO: 258246 - protein, 9 aa, Homo Sapiens
HERKEETCT

SEQ ID NO: 258247 - protein, 9 aa, Homo Sapiens
ENAIESLEH

SEQ ID NO: 258248 - protein, 9 aa, Homo Sapiens
LRKFIFKDK

SEQ ID NO: 258249 - protein, 9 aa, Homo Sapiens
LPVIICVTT

SEQ ID NO: 258250 - protein, 9 aa, Homo Sapiens
KHEDSGCCV

SEQ ID NO: 258251 - protein, 9 aa, Homo Sapiens
YHVKETNDN

SEQ ID NO: 258252 - protein, 9 aa, Homo Sapiens
QLALNTPGE

SEQ ID NO: 258253 - protein, 9 aa, Homo Sapiens
VQNGTYTVN

SEQ ID NO: 258254 - protein, 9 aa, Homo Sapiens
TDSQRSGVT

SEQ ID NO: 258255 - protein, 9 aa, Homo Sapiens
LFEPWNTLP

SEQ ID NO: 258256 - protein, 9 aa, Homo Sapiens
MDRTSLQSA

SEQ ID NO: 258257 - protein, 9 aa, Homo Sapiens
LYCLTLNPE

SEQ ID NO: 258258 - protein, 9 aa, Homo Sapiens
STKAGMGRD

SEQ ID NO: 258259 - protein, 9 aa, Homo Sapiens
PLEKKMKLF

SEQ ID NO: 258260 - protein, 9 aa, Homo Sapiens
SCGEYIQAG

SEQ ID NO: 258261 - protein, 9 aa, Homo Sapiens
ELLFLLEGV

SEQ ID NO: 258262 - protein, 9 aa, Homo Sapiens
VAFVANLFN

SEQ ID NO: 258263 - protein, 9 aa, Homo Sapiens
EFQLWDAER

SEQ ID NO: 258264 - protein, 9 aa, Homo Sapiens
NIHTIEEII

SEQ ID NO: 258265 - protein, 9 aa, Homo Sapiens
FLVIGYILE

SEQ ID NO: 258266 - protein, 9 aa, Homo Sapiens
RQPQINSYV

SEQ ID NO: 258267 - protein, 9 aa, Homo Sapiens
EPGCFGEGD

SEQ ID NO: 258268 - protein, 9 aa, Homo Sapiens
KFELHPQIK

SEQ ID NO: 258269 - protein, 9 aa, Homo Sapiens
LNSDFIAGF

SEQ ID NO: 258270 - protein, 9 aa, Homo Sapiens
EMMKNAAAS

SEQ ID NO: 258271 - protein, 9 aa, Homo Sapiens
TNTSEPNQL

SEQ ID NO: 258272 - protein, 9 aa, Homo Sapiens
GQDARWLGG

SEQ ID NO: 258273 - protein, 9 aa, Homo Sapiens
EELCEYVSQ

SEQ ID NO: 258274 - protein, 9 aa, Homo Sapiens
RYVINLMHH

SEQ ID NO: 258275 - protein, 9 aa, Homo Sapiens
ALATNSAPT

SEQ ID NO: 258276 - protein, 9 aa, Homo Sapiens
TVYLFCADH

SEQ ID NO: 258277 - protein, 9 aa, Homo Sapiens
DNLFCDVPQ

SEQ ID NO: 258278 - protein, 9 aa, Homo Sapiens
SVTLYGKEK

SEQ ID NO: 258279 - protein, 9 aa, Homo Sapiens
IGLLGGQTS

SEQ ID NO: 258280 - protein, 9 aa, Homo Sapiens
RAIYGFVIF

SEQ ID NO: 258281 - protein, 9 aa, Homo Sapiens
ITGHLPVEP

SEQ ID NO: 258282 - protein, 9 aa, Homo Sapiens
IEDLFSLSQ

SEQ ID NO: 258283 - protein, 9 aa, Homo Sapiens
PQNGTITCV

SEQ ID NO: 258284 - protein, 9 aa, Homo Sapiens
HKEKKSNDL

SEQ ID NO: 258285 - protein, 9 aa, Homo Sapiens
DFSPWDPRT

SEQ ID NO: 258286 - protein, 9 aa, Homo Sapiens
PTSTQTSNE

SEQ ID NO: 258287 - protein, 9 aa, Homo Sapiens
APQQDFAKY

SEQ ID NO: 258288 - protein, 9 aa, Homo Sapiens
TCLCNIVFN

SEQ ID NO: 258289 - protein, 9 aa, Homo Sapiens
YMELSFAVQ

SEQ ID NO: 258290 - protein, 9 aa, Homo Sapiens
TEDNKSPHS

SEQ ID NO: 258291 - protein, 9 aa, Homo Sapiens
DPDFEGERG

SEQ ID NO: 258292 - protein, 9 aa, Homo Sapiens
GPVGTAGTA

SEQ ID NO: 258293 - protein, 9 aa, Homo Sapiens
GVAGFKMSP

SEQ ID NO: 258294 - protein, 9 aa, Homo Sapiens
DDKRMPAKE

SEQ ID NO: 258295 - protein, 9 aa, Homo Sapiens
LISNKRNIS

SEQ ID NO: 258296 - protein, 9 aa, Homo Sapiens
KLNQAFWES

SEQ ID NO: 258297 - protein, 9 aa, Homo Sapiens
MLKPAKNYS

SEQ ID NO: 258298 - protein, 9 aa, Homo Sapiens
LLYLFPLLF

SEQ ID NO: 258299 - protein, 9 aa, Homo Sapiens
KWTPLSGRK

SEQ ID NO: 258300 - protein, 9 aa, Homo Sapiens
IHGLSMPMD

SEQ ID NO: 258301 - protein, 9 aa, Homo Sapiens
EQQVAGLQL

SEQ ID NO: 258302 - protein, 9 aa, Homo Sapiens
SVQWFECTL

SEQ ID NO: 258303 - protein, 9 aa, Homo Sapiens
PGLETAHHW

SEQ ID NO: 258304 - protein, 9 aa, Homo Sapiens
TGLIPVNYV

SEQ ID NO: 258305 - protein, 9 aa, Homo Sapiens
HLDEKNLAQ

SEQ ID NO: 258306 - protein, 9 aa, Homo Sapiens
GNGIDSQYY

SEQ ID NO: 258307 - protein, 9 aa, Homo Sapiens
LISKAGTET

SEQ ID NO: 258308 - protein, 9 aa, Homo Sapiens
FQTQASLDK

SEQ ID NO: 258309 - protein, 9 aa, Homo Sapiens
NEDKHARQA

SEQ ID NO: 258310 - protein, 9 aa, Homo Sapiens
EEVFRGHEP

SEQ ID NO: 258311 - protein, 9 aa, Homo Sapiens
QPGAHFQVQ

SEQ ID NO: 258312 - protein, 9 aa, Homo Sapiens
TQNRITVSH

SEQ ID NO: 258313 - protein, 9 aa, Homo Sapiens
LQTLNVSHN

SEQ ID NO: 258314 - protein, 9 aa, Homo Sapiens
NKINRILKL

SEQ ID NO: 258315 - protein, 9 aa, Homo Sapiens
STFILLYIM

SEQ ID NO: 258316 - protein, 9 aa, Homo Sapiens
DVLIIHLKI

SEQ ID NO: 258317 - protein, 9 aa, Homo Sapiens
KKDELQSEI

SEQ ID NO: 258318 - protein, 9 aa, Homo Sapiens
SVEGEFSEG

SEQ ID NO: 258319 - protein, 9 aa, Homo Sapiens
PAVVLHMTK

SEQ ID NO: 258320 - protein, 9 aa, Homo Sapiens
SQKIEIRAQ

SEQ ID NO: 258321 - protein, 9 aa, Homo Sapiens
ASYKRIAPR

SEQ ID NO: 258322 - protein, 9 aa, Homo Sapiens
GHKHKKKEA

SEQ ID NO: 258323 - protein, 9 aa, Homo Sapiens
ITLRNLNGR

SEQ ID NO: 258324 - protein, 9 aa, Homo Sapiens
YLGPLEIHL

SEQ ID NO: 258325 - protein, 9 aa, Homo Sapiens
TKLLIAAHK

SEQ ID NO: 258326 - protein, 9 aa, Homo Sapiens
YIYHFAHWL

SEQ ID NO: 258327 - protein, 9 aa, Homo Sapiens
PVHPGVAMT

SEQ ID NO: 258328 - protein, 9 aa, Homo Sapiens
NIVPPATIW

SEQ ID NO: 258329 - protein, 9 aa, Homo Sapiens
FVEHHIMHT

SEQ ID NO: 258330 - protein, 9 aa, Homo Sapiens
MPDTRFSME

SEQ ID NO: 258331 - protein, 9 aa, Homo Sapiens
EIIWSYLMH

SEQ ID NO: 258332 - protein, 9 aa, Homo Sapiens
TDCRNTRVT

SEQ ID NO: 258333 - protein, 9 aa, Homo Sapiens
SLTENYHNY

SEQ ID NO: 258334 - protein, 9 aa, Homo Sapiens
ATKVRNLMA

SEQ ID NO: 258335 - protein, 9 aa, Homo Sapiens
SCVRVITSA

SEQ ID NO: 258336 - protein, 9 aa, Homo Sapiens
VNGVLPDCN

SEQ ID NO: 258337 - protein, 9 aa, Homo Sapiens
RAGTAARQD

SEQ ID NO: 258338 - protein, 9 aa, Homo Sapiens
FPALVARLP

SEQ ID NO: 258339 - protein, 9 aa, Homo Sapiens
FQPNENTGE

SEQ ID NO: 258340 - protein, 9 aa, Homo Sapiens
HNQCIKANE

SEQ ID NO: 258341 - protein, 9 aa, Homo Sapiens
IIVSSKYTL

SEQ ID NO: 258342 - protein, 9 aa, Homo Sapiens
LISACMAEI

SEQ ID NO: 258343 - protein, 9 aa, Homo Sapiens
VVGVEPHFF

SEQ ID NO: 258344 - protein, 9 aa, Homo Sapiens
SLLSDVSEV

SEQ ID NO: 258345 - protein, 9 aa, Homo Sapiens
RCNNVGVCI

SEQ ID NO: 258346 - protein, 9 aa, Homo Sapiens
CGAGTAPKS

SEQ ID NO: 258347 - protein, 9 aa, Homo Sapiens
ELLSQDQLP

SEQ ID NO: 258348 - protein, 9 aa, Homo Sapiens
SDITTVSTT

SEQ ID NO: 258349 - protein, 9 aa, Homo Sapiens
PLECTECGK

SEQ ID NO: 258350 - protein, 9 aa, Homo Sapiens
SNDLTAADV

SEQ ID NO: 258351 - protein, 9 aa, Homo Sapiens
RDNEIILFK

SEQ ID NO: 258352 - protein, 9 aa, Homo Sapiens
YLVHCKYYA

SEQ ID NO: 258353 - protein, 9 aa, Homo Sapiens
PAIFTPFFL

SEQ ID NO: 258354 - protein, 9 aa, Homo Sapiens
DYPLWEAFE

SEQ ID NO: 258355 - protein, 9 aa, Homo Sapiens
NIENYPLNL

SEQ ID NO: 258356 - protein, 9 aa, Homo Sapiens
GVVLCYWFN

SEQ ID NO: 258357 - protein, 9 aa, Homo Sapiens
HLLLFCLCE

SEQ ID NO: 258358 - protein, 9 aa, Homo Sapiens
LDLNSNAIM

SEQ ID NO: 258359 - protein, 9 aa, Homo Sapiens
PSYPNYDAL

SEQ ID NO: 258360 - protein, 9 aa, Homo Sapiens
VIIIDNLHH

SEQ ID NO: 258361 - protein, 9 aa, Homo Sapiens
RPISASKLS

SEQ ID NO: 258362 - protein, 9 aa, Homo Sapiens
YGFAKPYNL

SEQ ID NO: 258363 - protein, 9 aa, Homo Sapiens
LRKDKSKVA

SEQ ID NO: 258364 - protein, 9 aa, Homo Sapiens
AQQIMQLLC

SEQ ID NO: 258365 - protein, 9 aa, Homo Sapiens
GAEWNIMCW

SEQ ID NO: 258366 - protein, 9 aa, Homo Sapiens
LMLKFAIPS

SEQ ID NO: 258367 - protein, 9 aa, Homo Sapiens
MEEIIFNLA

SEQ ID NO: 258368 - protein, 9 aa, Homo Sapiens
SNSRPCKRT

SEQ ID NO: 258369 - protein, 9 aa, Homo Sapiens
IFFIASIVL

SEQ ID NO: 258370 - protein, 9 aa, Homo Sapiens
TPDLEKVVP

SEQ ID NO: 258371 - protein, 9 aa, Homo Sapiens
YRDGKFLHL

SEQ ID NO: 258372 - protein, 9 aa, Homo Sapiens
DLEKVNETD

SEQ ID NO: 258373 - protein, 9 aa, Homo Sapiens
GGLTELPWG

SEQ ID NO: 258374 - protein, 9 aa, Homo Sapiens
RSFNTFFPL

SEQ ID NO: 258375 - protein, 9 aa, Homo Sapiens
HLHLSKCWD

SEQ ID NO: 258376 - protein, 9 aa, Homo Sapiens
TPDSTRDGK

SEQ ID NO: 258377 - protein, 9 aa, Homo Sapiens
EQFYSPNIM

SEQ ID NO: 258378 - protein, 9 aa, Homo Sapiens
KRDDCLEWP

SEQ ID NO: 258379 - protein, 9 aa, Homo Sapiens
LGNPLLGSY

SEQ ID NO: 258380 - protein, 9 aa, Homo Sapiens
VHSNGYYTK

SEQ ID NO: 258381 - protein, 9 aa, Homo Sapiens
AGKHWLGNE

SEQ ID NO: 258382 - protein, 9 aa, Homo Sapiens
YIARNGSVV

SEQ ID NO: 258383 - protein, 9 aa, Homo Sapiens
GDIARRQLP

SEQ ID NO: 258384 - protein, 9 aa, Homo Sapiens
GWLFCRVRF

SEQ ID NO: 258385 - protein, 9 aa, Homo Sapiens
PDCIFFHLN

SEQ ID NO: 258386 - protein, 9 aa, Homo Sapiens
EKDKVDLEK

SEQ ID NO: 258387 - protein, 9 aa, Homo Sapiens
ITRLLCLLV

SEQ ID NO: 258388 - protein, 9 aa, Homo Sapiens
SLKSTSREQ

SEQ ID NO: 258389 - protein, 9 aa, Homo Sapiens
NNFGQSSDL

SEQ ID NO: 258390 - protein, 9 aa, Homo Sapiens
LSLLKKMHQ

SEQ ID NO: 258391 - protein, 9 aa, Homo Sapiens
ALSGPGLVC

SEQ ID NO: 258392 - protein, 9 aa, Homo Sapiens
LLEKDPEKC

SEQ ID NO: 258393 - protein, 9 aa, Homo Sapiens
QESFQAIHQ

SEQ ID NO: 258394 - protein, 9 aa, Homo Sapiens
FCNPSMRKR

SEQ ID NO: 258395 - protein, 9 aa, Homo Sapiens
RYQKCIKLK

SEQ ID NO: 258396 - protein, 9 aa, Homo Sapiens
TFTHLRFQE

SEQ ID NO: 258397 - protein, 9 aa, Homo Sapiens
QWKPPNDTN

SEQ ID NO: 258398 - protein, 9 aa, Homo Sapiens
KPGTDEAED

SEQ ID NO: 258399 - protein, 9 aa, Homo Sapiens
HWRNRNKKT

SEQ ID NO: 258400 - protein, 9 aa, Homo Sapiens
DVDEETGIL

SEQ ID NO: 258401 - protein, 9 aa, Homo Sapiens
VIRMMSLIT

SEQ ID NO: 258402 - protein, 9 aa, Homo Sapiens
TQSKDIFDQ

SEQ ID NO: 258403 - protein, 9 aa, Homo Sapiens
EQLETTCPQ

SEQ ID NO: 258404 - protein, 9 aa, Homo Sapiens
KKNQNAFLY

SEQ ID NO: 258405 - protein, 9 aa, Homo Sapiens
NDVNYLILE

SEQ ID NO: 258406 - protein, 9 aa, Homo Sapiens
RPDDLAIAT

SEQ ID NO: 258407 - protein, 9 aa, Homo Sapiens
IVRFGLSIT

SEQ ID NO: 258408 - protein, 9 aa, Homo Sapiens
GIEICYTVV

SEQ ID NO: 258409 - protein, 9 aa, Homo Sapiens
AGFRVRLLA

SEQ ID NO: 258410 - protein, 9 aa, Homo Sapiens
KGLTHQPGL

SEQ ID NO: 258411 - protein, 9 aa, Homo Sapiens
ALINVLIAV

SEQ ID NO: 258412 - protein, 9 aa, Homo Sapiens
GLRDLTHLY

SEQ ID NO: 258413 - protein, 9 aa, Homo Sapiens
DLSTLTAHI

SEQ ID NO: 258414 - protein, 9 aa, Homo Sapiens
AQTGAGPLA

SEQ ID NO: 258415 - protein, 9 aa, Homo Sapiens
VSKKSEVKY

SEQ ID NO: 258416 - protein, 9 aa, Homo Sapiens
PSRFLKPSK

SEQ ID NO: 258417 - protein, 9 aa, Homo Sapiens
SSKVKVKVC

SEQ ID NO: 258418 - protein, 9 aa, Homo Sapiens
TQAISDHYP

SEQ ID NO: 258419 - protein, 9 aa, Homo Sapiens
KCDHHCPWV

SEQ ID NO: 258420 - protein, 9 aa, Homo Sapiens
LNNLNLGGA

SEQ ID NO: 258421 - protein, 9 aa, Homo Sapiens
CQDFVPILK

SEQ ID NO: 258422 - protein, 9 aa, Homo Sapiens
KNLPIAESR

SEQ ID NO: 258423 - protein, 9 aa, Homo Sapiens
FWDKLIFAN

SEQ ID NO: 258424 - protein, 9 aa, Homo Sapiens
SPLMVDLHE

SEQ ID NO: 258425 - protein, 9 aa, Homo Sapiens
NMKKVWLPS

SEQ ID NO: 258426 - protein, 9 aa, Homo Sapiens
GEPATELSC

SEQ ID NO: 258427 - protein, 9 aa, Homo Sapiens
EKEARSKCR

SEQ ID NO: 258428 - protein, 9 aa, Homo Sapiens
KFIRDNFLD

SEQ ID NO: 258429 - protein, 9 aa, Homo Sapiens
PPNDTNGVI

SEQ ID NO: 258430 - protein, 9 aa, Homo Sapiens
TRVNSEQGH

SEQ ID NO: 258431 - protein, 9 aa, Homo Sapiens
SEWNTVERF

SEQ ID NO: 258432 - protein, 9 aa, Homo Sapiens
HPQTRVENS

SEQ ID NO: 258433 - protein, 9 aa, Homo Sapiens
QEDEFGIKQ

SEQ ID NO: 258434 - protein, 9 aa, Homo Sapiens
RASDYFNLA

SEQ ID NO: 258435 - protein, 9 aa, Homo Sapiens
WESNIKIVG

SEQ ID NO: 258436 - protein, 9 aa, Homo Sapiens
EDGCMLLIA

SEQ ID NO: 258437 - protein, 9 aa, Homo Sapiens
VEYEFDSPY

SEQ ID NO: 258438 - protein, 9 aa, Homo Sapiens
CIPNTSKMI

SEQ ID NO: 258439 - protein, 9 aa, Homo Sapiens
SQHFVQIPN

SEQ ID NO: 258440 - protein, 9 aa, Homo Sapiens
EPYKILFKA

SEQ ID NO: 258441 - protein, 9 aa, Homo Sapiens
KYDVWAKVV

SEQ ID NO: 258442 - protein, 9 aa, Homo Sapiens
SAFLQRLER

SEQ ID NO: 258443 - protein, 9 aa, Homo Sapiens
KKAYFTCST

SEQ ID NO: 258444 - protein, 9 aa, Homo Sapiens
KDSLDEEFF

SEQ ID NO: 258445 - protein, 9 aa, Homo Sapiens
ENDKPHDAE

SEQ ID NO: 258446 - protein, 9 aa, Homo Sapiens
ILAIFQALL

SEQ ID NO: 258447 - protein, 9 aa, Homo Sapiens
IKGSVLNSE

SEQ ID NO: 258448 - protein, 9 aa, Homo Sapiens
IVRQLLYNE

SEQ ID NO: 258449 - protein, 9 aa, Homo Sapiens
DKLYHLAKE

SEQ ID NO: 258450 - protein, 9 aa, Homo Sapiens
LLGSGTTAE

SEQ ID NO: 258451 - protein, 9 aa, Homo Sapiens
KGQSAGGIN

SEQ ID NO: 258452 - protein, 9 aa, Homo Sapiens
VLEVVSDKP

SEQ ID NO: 258453 - protein, 9 aa, Homo Sapiens
ACVKLRDMH

SEQ ID NO: 258454 - protein, 9 aa, Homo Sapiens
KMTTGHTYP

SEQ ID NO: 258455 - protein, 9 aa, Homo Sapiens
QNKLIQNQD

SEQ ID NO: 258456 - protein, 9 aa, Homo Sapiens
HPGNKSLVS

SEQ ID NO: 258457 - protein, 9 aa, Homo Sapiens
VRALNVLKY

SEQ ID NO: 258458 - protein, 9 aa, Homo Sapiens
TYNDALFQY

SEQ ID NO: 258459 - protein, 9 aa, Homo Sapiens
RTRCGKFEY

SEQ ID NO: 258460 - protein, 9 aa, Homo Sapiens
RQLEAALDE

SEQ ID NO: 258461 - protein, 9 aa, Homo Sapiens
GIDMVVYMV

SEQ ID NO: 258462 - protein, 9 aa, Homo Sapiens
HCPSFISGT

SEQ ID NO: 258463 - protein, 9 aa, Homo Sapiens
SYGVIHVML

SEQ ID NO: 258464 - protein, 9 aa, Homo Sapiens
YTPVSSDDG

SEQ ID NO: 258465 - protein, 9 aa, Homo Sapiens
TSTEKAHVD

SEQ ID NO: 258466 - protein, 9 aa, Homo Sapiens
EASTKIRMN

SEQ ID NO: 258467 - protein, 9 aa, Homo Sapiens
YLDDRYKME

SEQ ID NO: 258468 - protein, 9 aa, Homo Sapiens
LIAYVSNDS

SEQ ID NO: 258469 - protein, 9 aa, Homo Sapiens
NNIMENEYL

SEQ ID NO: 258470 - protein, 9 aa, Homo Sapiens
TVKEAVKVA

SEQ ID NO: 258471 - protein, 9 aa, Homo Sapiens
AVMLQGVDL

SEQ ID NO: 258472 - protein, 9 aa, Homo Sapiens
LPLISLSTV

SEQ ID NO: 258473 - protein, 9 aa, Homo Sapiens
FREHWQKNL

SEQ ID NO: 258474 - protein, 9 aa, Homo Sapiens
LVAVQAIRR

SEQ ID NO: 258475 - protein, 9 aa, Homo Sapiens
SDSIIVGRG

SEQ ID NO: 258476 - protein, 9 aa, Homo Sapiens
SSCIGAAIG

SEQ ID NO: 258477 - protein, 9 aa, Homo Sapiens
KDSCFLTIN

SEQ ID NO: 258478 - protein, 9 aa, Homo Sapiens
QMQQVQTHF

SEQ ID NO: 258479 - protein, 9 aa, Homo Sapiens
TGLSKTFPG

SEQ ID NO: 258480 - protein, 9 aa, Homo Sapiens
LNGNYFIQG

SEQ ID NO: 258481 - protein, 9 aa, Homo Sapiens
NCTALCEVI

SEQ ID NO: 258482 - protein, 9 aa, Homo Sapiens
QGVALSDLS

SEQ ID NO: 258483 - protein, 9 aa, Homo Sapiens
KWKHYKKEG

SEQ ID NO: 258484 - protein, 9 aa, Homo Sapiens
KVLSAQKAG

SEQ ID NO: 258485 - protein, 9 aa, Homo Sapiens
ELSVVTSEI

SEQ ID NO: 258486 - protein, 9 aa, Homo Sapiens
QPATNAILR

SEQ ID NO: 258487 - protein, 9 aa, Homo Sapiens
INASKQYLC

SEQ ID NO: 258488 - protein, 9 aa, Homo Sapiens
KHQCVQLND

SEQ ID NO: 258489 - protein, 9 aa, Homo Sapiens
SKSIKLIPV

SEQ ID NO: 258490 - protein, 9 aa, Homo Sapiens
EMWKPHVSN

SEQ ID NO: 258491 - protein, 9 aa, Homo Sapiens
MKFSEKAQN

SEQ ID NO: 258492 - protein, 9 aa, Homo Sapiens
RHNGYIHVE

SEQ ID NO: 258493 - protein, 9 aa, Homo Sapiens
ESFRSMQDD

SEQ ID NO: 258494 - protein, 9 aa, Homo Sapiens
IYLAAVKRL

SEQ ID NO: 258495 - protein, 9 aa, Homo Sapiens
EYPGKPGAQ

SEQ ID NO: 258496 - protein, 9 aa, Homo Sapiens
DNCEEEAGG

SEQ ID NO: 258497 - protein, 9 aa, Homo Sapiens
DDSASSNSE

SEQ ID NO: 258498 - protein, 9 aa, Homo Sapiens
GQCKKTQIL

SEQ ID NO: 258499 - protein, 9 aa, Homo Sapiens
FEVLKEVIP

SEQ ID NO: 258500 - protein, 9 aa, Homo Sapiens
DQNQKKPAS

SEQ ID NO: 258501 - protein, 9 aa, Homo Sapiens
YRFWIHTEV

SEQ ID NO: 258502 - protein, 9 aa, Homo Sapiens
VTGKCWVIA

SEQ ID NO: 258503 - protein, 9 aa, Homo Sapiens
GENGWVVSH

SEQ ID NO: 258504 - protein, 9 aa, Homo Sapiens
EKALEISGA

SEQ ID NO: 258505 - protein, 9 aa, Homo Sapiens
PPLALPVCP

SEQ ID NO: 258506 - protein, 9 aa, Homo Sapiens
NQLTKRVKN

SEQ ID NO: 258507 - protein, 9 aa, Homo Sapiens
RVFNIMREN

SEQ ID NO: 258508 - protein, 9 aa, Homo Sapiens
HQSYSQNTL

SEQ ID NO: 258509 - protein, 9 aa, Homo Sapiens
SRVLAGGFA

SEQ ID NO: 258510 - protein, 9 aa, Homo Sapiens
KQDTNSQSI

SEQ ID NO: 258511 - protein, 9 aa, Homo Sapiens
SIKTSFHVL

SEQ ID NO: 258512 - protein, 9 aa, Homo Sapiens
SFFQDKGRG

SEQ ID NO: 258513 - protein, 9 aa, Homo Sapiens
GKNDGDMHS

SEQ ID NO: 258514 - protein, 9 aa, Homo Sapiens
RVEAFLRPE

SEQ ID NO: 258515 - protein, 9 aa, Homo Sapiens
AVMKDILQA

SEQ ID NO: 258516 - protein, 9 aa, Homo Sapiens
RDKLSELHV

SEQ ID NO: 258517 - protein, 9 aa, Homo Sapiens
SKPTSETLG

SEQ ID NO: 258518 - protein, 9 aa, Homo Sapiens
DQLINRGTS

SEQ ID NO: 258519 - protein, 9 aa, Homo Sapiens
IGVYFVSSQ

SEQ ID NO: 258520 - protein, 9 aa, Homo Sapiens
FFNLVRLLL

SEQ ID NO: 258521 - protein, 9 aa, Homo Sapiens
SYLDKVLNK

SEQ ID NO: 258522 - protein, 9 aa, Homo Sapiens
HAAAFGIIA

SEQ ID NO: 258523 - protein, 9 aa, Homo Sapiens
KATKLGLFG

SEQ ID NO: 258524 - protein, 9 aa, Homo Sapiens
FYTMVTSML

SEQ ID NO: 258525 - protein, 9 aa, Homo Sapiens
PHTAVKYFV

SEQ ID NO: 258526 - protein, 9 aa, Homo Sapiens
IIDVRGHSS

SEQ ID NO: 258527 - protein, 9 aa, Homo Sapiens
SRRQSQKFG

SEQ ID NO: 258528 - protein, 9 aa, Homo Sapiens
YGFRLQGLD

SEQ ID NO: 258529 - protein, 9 aa, Homo Sapiens
VIQVKRLEW

SEQ ID NO: 258530 - protein, 9 aa, Homo Sapiens
TECINPQYY

SEQ ID NO: 258531 - protein, 9 aa, Homo Sapiens
DGLLMLLYV

SEQ ID NO: 258532 - protein, 9 aa, Homo Sapiens
PFASAKNHN

SEQ ID NO: 258533 - protein, 9 aa, Homo Sapiens
TKNVYIELT

SEQ ID NO: 258534 - protein, 9 aa, Homo Sapiens
YSYQMAVRL

SEQ ID NO: 258535 - protein, 9 aa, Homo Sapiens
GKAFSCKDT

SEQ ID NO: 258536 - protein, 9 aa, Homo Sapiens
RNILRIGNL

SEQ ID NO: 258537 - protein, 9 aa, Homo Sapiens
DGPADVWPL

SEQ ID NO: 258538 - protein, 9 aa, Homo Sapiens
IAGNQDGWE

SEQ ID NO: 258539 - protein, 9 aa, Homo Sapiens
ELILVGNQF

SEQ ID NO: 258540 - protein, 9 aa, Homo Sapiens
RDCLVELEC

SEQ ID NO: 258541 - protein, 9 aa, Homo Sapiens
NYIYVTYNG

SEQ ID NO: 258542 - protein, 9 aa, Homo Sapiens
VLQGCNKKA

SEQ ID NO: 258543 - protein, 9 aa, Homo Sapiens
THLKWLPSG

SEQ ID NO: 258544 - protein, 9 aa, Homo Sapiens
LNKAESGEC

SEQ ID NO: 258545 - protein, 9 aa, Homo Sapiens
RVRGESHIL

SEQ ID NO: 258546 - protein, 9 aa, Homo Sapiens
KITLYFNFV

SEQ ID NO: 258547 - protein, 9 aa, Homo Sapiens
GVFHPVIIY

SEQ ID NO: 258548 - protein, 9 aa, Homo Sapiens
SPSPLPGFP

SEQ ID NO: 258549 - protein, 9 aa, Homo Sapiens
QRHSIRKIN

SEQ ID NO: 258550 - protein, 9 aa, Homo Sapiens
DLLGYPKTK

SEQ ID NO: 258551 - protein, 9 aa, Homo Sapiens
LTIEATVWS

SEQ ID NO: 258552 - protein, 9 aa, Homo Sapiens
HSTFINHQI

SEQ ID NO: 258553 - protein, 9 aa, Homo Sapiens
VLALAKPPL

SEQ ID NO: 258554 - protein, 9 aa, Homo Sapiens
HRTSQNHSK

SEQ ID NO: 258555 - protein, 9 aa, Homo Sapiens
EVGIPPEHS

SEQ ID NO: 258556 - protein, 9 aa, Homo Sapiens
KKEIELEMA

SEQ ID NO: 258557 - protein, 9 aa, Homo Sapiens
LDPKPHVSG

SEQ ID NO: 258558 - protein, 9 aa, Homo Sapiens
IERKLFDKT

SEQ ID NO: 258559 - protein, 9 aa, Homo Sapiens
EAGPPLEAD

SEQ ID NO: 258560 - protein, 9 aa, Homo Sapiens
PSQNNLYRY

SEQ ID NO: 258561 - protein, 9 aa, Homo Sapiens
CRSPFIASV

SEQ ID NO: 258562 - protein, 9 aa, Homo Sapiens
ETVADHREG

SEQ ID NO: 258563 - protein, 9 aa, Homo Sapiens
VGIYDEGVG

SEQ ID NO: 258564 - protein, 9 aa, Homo Sapiens
VIAHSAVVH

SEQ ID NO: 258565 - protein, 9 aa, Homo Sapiens
EVCNLCILG

SEQ ID NO: 258566 - protein, 9 aa, Homo Sapiens
TTSRVTSTD

SEQ ID NO: 258567 - protein, 9 aa, Homo Sapiens
ITPERDSLM

SEQ ID NO: 258568 - protein, 9 aa, Homo Sapiens
DLTGSKVGV

SEQ ID NO: 258569 - protein, 9 aa, Homo Sapiens
ALLTKTNQI

SEQ ID NO: 258570 - protein, 9 aa, Homo Sapiens
GQIQQVKSH

SEQ ID NO: 258571 - protein, 9 aa, Homo Sapiens
RRMRLYIRR

SEQ ID NO: 258572 - protein, 9 aa, Homo Sapiens
YSLVPLQII

SEQ ID NO: 258573 - protein, 9 aa, Homo Sapiens
RVPQEELDL

SEQ ID NO: 258574 - protein, 9 aa, Homo Sapiens
SGVIAFFPA

SEQ ID NO: 258575 - protein, 9 aa, Homo Sapiens
VEVCVVYEN

SEQ ID NO: 258576 - protein, 9 aa, Homo Sapiens
PILSFLRTK

SEQ ID NO: 258577 - protein, 9 aa, Homo Sapiens
QPTWDVDLI

SEQ ID NO: 258578 - protein, 9 aa, Homo Sapiens
LGGQTSKAD

SEQ ID NO: 258579 - protein, 9 aa, Homo Sapiens
EDEEDEEGS

SEQ ID NO: 258580 - protein, 9 aa, Homo Sapiens
TNPQQLQPG

SEQ ID NO: 258581 - protein, 9 aa, Homo Sapiens
TLLEYHEGC

SEQ ID NO: 258582 - protein, 9 aa, Homo Sapiens
FTCTRTQAQ

SEQ ID NO: 258583 - protein, 9 aa, Homo Sapiens
REKRAFMGP

SEQ ID NO: 258584 - protein, 9 aa, Homo Sapiens
LIRHKKIHT

SEQ ID NO: 258585 - protein, 9 aa, Homo Sapiens
VNGFKYLHE

SEQ ID NO: 258586 - protein, 9 aa, Homo Sapiens
DKKSALQLE

SEQ ID NO: 258587 - protein, 9 aa, Homo Sapiens
MEDIAHRRS

SEQ ID NO: 258588 - protein, 9 aa, Homo Sapiens
GVFQILICN

SEQ ID NO: 258589 - protein, 9 aa, Homo Sapiens
RNVIIITWE

SEQ ID NO: 258590 - protein, 9 aa, Homo Sapiens
VEVVTENYH

SEQ ID NO: 258591 - protein, 9 aa, Homo Sapiens
ETQLRESVV

SEQ ID NO: 258592 - protein, 9 aa, Homo Sapiens
LLQTRFMTP

SEQ ID NO: 258593 - protein, 9 aa, Homo Sapiens
ERKQNREKG

SEQ ID NO: 258594 - protein, 9 aa, Homo Sapiens
SEQQEEDGL

SEQ ID NO: 258595 - protein, 9 aa, Homo Sapiens
DLIQSQVQQ

SEQ ID NO: 258596 - protein, 9 aa, Homo Sapiens
PVVINFEMQ

SEQ ID NO: 258597 - protein, 9 aa, Homo Sapiens
NKNHCSAIN

SEQ ID NO: 258598 - protein, 9 aa, Homo Sapiens
IRDEGKASS

SEQ ID NO: 258599 - protein, 9 aa, Homo Sapiens
ILNINTSDE

SEQ ID NO: 258600 - protein, 9 aa, Homo Sapiens
DCKADADEG

SEQ ID NO: 258601 - protein, 9 aa, Homo Sapiens
PCNCHFLRL

SEQ ID NO: 258602 - protein, 9 aa, Homo Sapiens
YFFVVVISV

SEQ ID NO: 258603 - protein, 9 aa, Homo Sapiens
GKLQDFTRD

SEQ ID NO: 258604 - protein, 9 aa, Homo Sapiens
LKELETEYA

SEQ ID NO: 258605 - protein, 9 aa, Homo Sapiens
VTAQQFHRH

SEQ ID NO: 258606 - protein, 9 aa, Homo Sapiens
RDLNISKRV

SEQ ID NO: 258607 - protein, 9 aa, Homo Sapiens
ATKRLFDLN

SEQ ID NO: 258608 - protein, 9 aa, Homo Sapiens
VELFISYVM

SEQ ID NO: 258609 - protein, 9 aa, Homo Sapiens
AATSFTHIC

SEQ ID NO: 258610 - protein, 9 aa, Homo Sapiens
CVKLRDMHW

SEQ ID NO: 258611 - protein, 9 aa, Homo Sapiens
NAAASYFSL

SEQ ID NO: 258612 - protein, 9 aa, Homo Sapiens
IESVTELCE

SEQ ID NO: 258613 - protein, 9 aa, Homo Sapiens
KSAEEREQL

SEQ ID NO: 258614 - protein, 9 aa, Homo Sapiens
TQTPGERSH

SEQ ID NO: 258615 - protein, 9 aa, Homo Sapiens
EEPDPGFKR

SEQ ID NO: 258616 - protein, 9 aa, Homo Sapiens
SKNSRGQTQ

SEQ ID NO: 258617 - protein, 9 aa, Homo Sapiens
ECLVKCMDY

SEQ ID NO: 258618 - protein, 9 aa, Homo Sapiens
SIELEKNFN

SEQ ID NO: 258619 - protein, 9 aa, Homo Sapiens
TKLSARPSS

SEQ ID NO: 258620 - protein, 9 aa, Homo Sapiens
QQPAPAMTS

SEQ ID NO: 258621 - protein, 9 aa, Homo Sapiens
NRIALTSSK

SEQ ID NO: 258622 - protein, 9 aa, Homo Sapiens
NEYLDVLSD

SEQ ID NO: 258623 - protein, 9 aa, Homo Sapiens
SISSGSERE

SEQ ID NO: 258624 - protein, 9 aa, Homo Sapiens
NKNKGKKGL

SEQ ID NO: 258625 - protein, 9 aa, Homo Sapiens
CTWAAALII

SEQ ID NO: 258626 - protein, 9 aa, Homo Sapiens
ERIHVNLEK

SEQ ID NO: 258627 - protein, 9 aa, Homo Sapiens
KLSNNMKVV

SEQ ID NO: 258628 - protein, 9 aa, Homo Sapiens
CEGRLELKT

SEQ ID NO: 258629 - protein, 9 aa, Homo Sapiens
QILKVEYEF

SEQ ID NO: 258630 - protein, 9 aa, Homo Sapiens
KTEQGKSQR

SEQ ID NO: 258631 - protein, 9 aa, Homo Sapiens
LQLKSKGLT

SEQ ID NO: 258632 - protein, 9 aa, Homo Sapiens
ELYQVMFMC

SEQ ID NO: 258633 - protein, 9 aa, Homo Sapiens
ASSKRMLPP

SEQ ID NO: 258634 - protein, 9 aa, Homo Sapiens
GSPPEDYRR

SEQ ID NO: 258635 - protein, 9 aa, Homo Sapiens
KVLPTSPTP

SEQ ID NO: 258636 - protein, 9 aa, Homo Sapiens
IVELDNTPN

SEQ ID NO: 258637 - protein, 9 aa, Homo Sapiens
SLLMIWAII

SEQ ID NO: 258638 - protein, 9 aa, Homo Sapiens
LLFNGCRSR

SEQ ID NO: 258639 - protein, 9 aa, Homo Sapiens
NAPDIFIIN

SEQ ID NO: 258640 - protein, 9 aa, Homo Sapiens
VRQRQLQQQ

SEQ ID NO: 258641 - protein, 9 aa, Homo Sapiens
MLIFGVVGN

SEQ ID NO: 258642 - protein, 9 aa, Homo Sapiens
CERLAGTKS

SEQ ID NO: 258643 - protein, 9 aa, Homo Sapiens
AVFCPPMKF

SEQ ID NO: 258644 - protein, 9 aa, Homo Sapiens
TDTVVDFMT

SEQ ID NO: 258645 - protein, 9 aa, Homo Sapiens
KDLTSIYEI

SEQ ID NO: 258646 - protein, 9 aa, Homo Sapiens
DGLDRCSHD

SEQ ID NO: 258647 - protein, 9 aa, Homo Sapiens
LYLKALEGL

SEQ ID NO: 258648 - protein, 9 aa, Homo Sapiens
KGREKTLAQ

SEQ ID NO: 258649 - protein, 9 aa, Homo Sapiens
ILSRIIIGD

SEQ ID NO: 258650 - protein, 9 aa, Homo Sapiens
QQMKNLEVL

SEQ ID NO: 258651 - protein, 9 aa, Homo Sapiens
SEGRSGPGC

SEQ ID NO: 258652 - protein, 9 aa, Homo Sapiens
CMHSTQDKY

SEQ ID NO: 258653 - protein, 9 aa, Homo Sapiens
APSVIVGHP

SEQ ID NO: 258654 - protein, 9 aa, Homo Sapiens
RAPEASRQD

SEQ ID NO: 258655 - protein, 9 aa, Homo Sapiens
SLYFDFKDT

SEQ ID NO: 258656 - protein, 9 aa, Homo Sapiens
HLSKENQTL

SEQ ID NO: 258657 - protein, 9 aa, Homo Sapiens
SYYFDRGDV

SEQ ID NO: 258658 - protein, 9 aa, Homo Sapiens
NKNENYKAL

SEQ ID NO: 258659 - protein, 9 aa, Homo Sapiens
IGCALCVAL

SEQ ID NO: 258660 - protein, 9 aa, Homo Sapiens
HPQPELFGD

SEQ ID NO: 258661 - protein, 9 aa, Homo Sapiens
VWQYESELE

SEQ ID NO: 258662 - protein, 9 aa, Homo Sapiens
LSFLIVQCL

SEQ ID NO: 258663 - protein, 9 aa, Homo Sapiens
GGGALHLIL

SEQ ID NO: 258664 - protein, 9 aa, Homo Sapiens
QYHGAWLSP

SEQ ID NO: 258665 - protein, 9 aa, Homo Sapiens
KKMNISLAF

SEQ ID NO: 258666 - protein, 9 aa, Homo Sapiens
WIVTFIHGQ

SEQ ID NO: 258667 - protein, 9 aa, Homo Sapiens
VHAAVLLLC

SEQ ID NO: 258668 - protein, 9 aa, Homo Sapiens
NQCGIIFSH

SEQ ID NO: 258669 - protein, 9 aa, Homo Sapiens
RGVVVFGES

SEQ ID NO: 258670 - protein, 9 aa, Homo Sapiens
QGSYGDVYG

SEQ ID NO: 258671 - protein, 9 aa, Homo Sapiens
VLIYGDPNF

SEQ ID NO: 258672 - protein, 9 aa, Homo Sapiens
WAAALIILN

SEQ ID NO: 258673 - protein, 9 aa, Homo Sapiens
YFDHFHSLA

SEQ ID NO: 258674 - protein, 9 aa, Homo Sapiens
HNMQNSAFP

SEQ ID NO: 258675 - protein, 9 aa, Homo Sapiens
TAPAPPIEP

SEQ ID NO: 258676 - protein, 9 aa, Homo Sapiens
AVGVGLYGN

SEQ ID NO: 258677 - protein, 9 aa, Homo Sapiens
AGVGTGATN

SEQ ID NO: 258678 - protein, 9 aa, Homo Sapiens
TPNQGRKVE

SEQ ID NO: 258679 - protein, 9 aa, Homo Sapiens
LLGKYIYIG

SEQ ID NO: 258680 - protein, 9 aa, Homo Sapiens
KLIVTEENY

SEQ ID NO: 258681 - protein, 9 aa, Homo Sapiens
PFIYSLMNK

SEQ ID NO: 258682 - protein, 9 aa, Homo Sapiens
CPVSFLAVS

SEQ ID NO: 258683 - protein, 9 aa, Homo Sapiens
AIEIFEKIN

SEQ ID NO: 258684 - protein, 9 aa, Homo Sapiens
SSKKNLLEG

SEQ ID NO: 258685 - protein, 9 aa, Homo Sapiens
LARHRIIHT

SEQ ID NO: 258686 - protein, 9 aa, Homo Sapiens
RAMFSICMV

SEQ ID NO: 258687 - protein, 9 aa, Homo Sapiens
PKDLGTPVL

SEQ ID NO: 258688 - protein, 9 aa, Homo Sapiens
SSHLHLSKC

SEQ ID NO: 258689 - protein, 9 aa, Homo Sapiens
AGPVNDGVT

SEQ ID NO: 258690 - protein, 9 aa, Homo Sapiens
HAGKISTEA

SEQ ID NO: 258691 - protein, 9 aa, Homo Sapiens
VALYRQRSQ

SEQ ID NO: 258692 - protein, 9 aa, Homo Sapiens
FQFKGTHID

SEQ ID NO: 258693 - protein, 9 aa, Homo Sapiens
KYAVLDCLL

SEQ ID NO: 258694 - protein, 9 aa, Homo Sapiens
VALNCAIRL

SEQ ID NO: 258695 - protein, 9 aa, Homo Sapiens
QKNQEDLLR

SEQ ID NO: 258696 - protein, 9 aa, Homo Sapiens
GRFKGSLMT

SEQ ID NO: 258697 - protein, 9 aa, Homo Sapiens
ALQVLPDSE

SEQ ID NO: 258698 - protein, 9 aa, Homo Sapiens
EWAKDKSSR

SEQ ID NO: 258699 - protein, 9 aa, Homo Sapiens
LSFMDAMNT

SEQ ID NO: 258700 - protein, 9 aa, Homo Sapiens
SCPLIGVLN

SEQ ID NO: 258701 - protein, 9 aa, Homo Sapiens
STNAFSAFV

SEQ ID NO: 258702 - protein, 9 aa, Homo Sapiens
PFPISLNWN

SEQ ID NO: 258703 - protein, 9 aa, Homo Sapiens
QHAELFLKN

SEQ ID NO: 258704 - protein, 9 aa, Homo Sapiens
ENQNESINN

SEQ ID NO: 258705 - protein, 9 aa, Homo Sapiens
SHNWRYATG

SEQ ID NO: 258706 - protein, 9 aa, Homo Sapiens
VFPRTRKWS

SEQ ID NO: 258707 - protein, 9 aa, Homo Sapiens
HLDLAFNAF

SEQ ID NO: 258708 - protein, 9 aa, Homo Sapiens
LLHRKDLEI

SEQ ID NO: 258709 - protein, 9 aa, Homo Sapiens
AFHNTYLED

SEQ ID NO: 258710 - protein, 9 aa, Homo Sapiens
LNANNRRLS

SEQ ID NO: 258711 - protein, 9 aa, Homo Sapiens
EDIPGEFTQ

SEQ ID NO: 258712 - protein, 9 aa, Homo Sapiens
GTDRCAQVP

SEQ ID NO: 258713 - protein, 9 aa, Homo Sapiens
VSVDFGYDY

SEQ ID NO: 258714 - protein, 9 aa, Homo Sapiens
SDHPHSPLS

SEQ ID NO: 258715 - protein, 9 aa, Homo Sapiens
SPHSDPYNQ

SEQ ID NO: 258716 - protein, 9 aa, Homo Sapiens
LPHHALQDK

SEQ ID NO: 258717 - protein, 9 aa, Homo Sapiens
HAEMVAINQ

SEQ ID NO: 258718 - protein, 9 aa, Homo Sapiens
EEGFVQLYN

SEQ ID NO: 258719 - protein, 9 aa, Homo Sapiens
SIGKLPVHR

SEQ ID NO: 258720 - protein, 9 aa, Homo Sapiens
SGKAQDFMK

SEQ ID NO: 258721 - protein, 9 aa, Homo Sapiens
GNCFNCGTW

SEQ ID NO: 258722 - protein, 9 aa, Homo Sapiens
TDAVRVVFR

SEQ ID NO: 258723 - protein, 9 aa, Homo Sapiens
PYSKDNNSG

SEQ ID NO: 258724 - protein, 9 aa, Homo Sapiens
KTCDCLPKF

SEQ ID NO: 258725 - protein, 9 aa, Homo Sapiens
SSNTEQNGL

SEQ ID NO: 258726 - protein, 9 aa, Homo Sapiens
PIDITLTQR

SEQ ID NO: 258727 - protein, 9 aa, Homo Sapiens
APSFLALTP

SEQ ID NO: 258728 - protein, 9 aa, Homo Sapiens
KIAIINVSF

SEQ ID NO: 258729 - protein, 9 aa, Homo Sapiens
YGSMITKIW

SEQ ID NO: 258730 - protein, 9 aa, Homo Sapiens
AFALAVLQR

SEQ ID NO: 258731 - protein, 9 aa, Homo Sapiens
RQLKRFRQA

SEQ ID NO: 258732 - protein, 9 aa, Homo Sapiens
AGGQHRNGI

SEQ ID NO: 258733 - protein, 9 aa, Homo Sapiens
HESNLVWMQ

SEQ ID NO: 258734 - protein, 9 aa, Homo Sapiens
EKQSSLTKI

SEQ ID NO: 258735 - protein, 9 aa, Homo Sapiens
SCQGFTKDN

SEQ ID NO: 258736 - protein, 9 aa, Homo Sapiens
KHVGNKFFL

SEQ ID NO: 258737 - protein, 9 aa, Homo Sapiens
VDFEWIRRA

SEQ ID NO: 258738 - protein, 9 aa, Homo Sapiens
QGLEVLRAE

SEQ ID NO: 258739 - protein, 9 aa, Homo Sapiens
SNLRNHGLQ

SEQ ID NO: 258740 - protein, 9 aa, Homo Sapiens
LKEFIKPEK

SEQ ID NO: 258741 - protein, 9 aa, Homo Sapiens
AGVIVCLYI

SEQ ID NO: 258742 - protein, 9 aa, Homo Sapiens
PAPPFGSSY

SEQ ID NO: 258743 - protein, 9 aa, Homo Sapiens
MTQIMFETS

SEQ ID NO: 258744 - protein, 9 aa, Homo Sapiens
IARKPITPE

SEQ ID NO: 258745 - protein, 9 aa, Homo Sapiens
GRCSGDKNI

SEQ ID NO: 258746 - protein, 9 aa, Homo Sapiens
LIIGTGFFI

SEQ ID NO: 258747 - protein, 9 aa, Homo Sapiens
PPCTIITSL

SEQ ID NO: 258748 - protein, 9 aa, Homo Sapiens
DMHYLPDMD

SEQ ID NO: 258749 - protein, 9 aa, Homo Sapiens
GLVWKSLDL

SEQ ID NO: 258750 - protein, 9 aa, Homo Sapiens
DIFDCLGPH

SEQ ID NO: 258751 - protein, 9 aa, Homo Sapiens
RIMQGAPEI

SEQ ID NO: 258752 - protein, 9 aa, Homo Sapiens
SATVRTVLK

SEQ ID NO: 258753 - protein, 9 aa, Homo Sapiens
LGRHTLDHL

SEQ ID NO: 258754 - protein, 9 aa, Homo Sapiens
FTTGDVNRD

SEQ ID NO: 258755 - protein, 9 aa, Homo Sapiens
QCKDNEDYN

SEQ ID NO: 258756 - protein, 9 aa, Homo Sapiens
LLGATVTTA

SEQ ID NO: 258757 - protein, 9 aa, Homo Sapiens
VLLLCNLSL

SEQ ID NO: 258758 - protein, 9 aa, Homo Sapiens
SRLELQAYP

SEQ ID NO: 258759 - protein, 9 aa, Homo Sapiens
LLLATGLDD

SEQ ID NO: 258760 - protein, 9 aa, Homo Sapiens
FNKIPLYLQ

SEQ ID NO: 258761 - protein, 9 aa, Homo Sapiens
NRVRGNLDN

SEQ ID NO: 258762 - protein, 9 aa, Homo Sapiens
ENRKIILAS

SEQ ID NO: 258763 - protein, 9 aa, Homo Sapiens
APSGGQTPG

SEQ ID NO: 258764 - protein, 9 aa, Homo Sapiens
GSKDLKGGG

SEQ ID NO: 258765 - protein, 9 aa, Homo Sapiens
MSLLHKHED

SEQ ID NO: 258766 - protein, 9 aa, Homo Sapiens
ASPPEGAPL

SEQ ID NO: 258767 - protein, 9 aa, Homo Sapiens
DDVVRVIFS

SEQ ID NO: 258768 - protein, 9 aa, Homo Sapiens
KKALEEALP

SEQ ID NO: 258769 - protein, 9 aa, Homo Sapiens
WFKYSVGVS

SEQ ID NO: 258770 - protein, 9 aa, Homo Sapiens
TLGINLVVG

SEQ ID NO: 258771 - protein, 9 aa, Homo Sapiens
CVKGWGAEY

SEQ ID NO: 258772 - protein, 9 aa, Homo Sapiens
NGTITCVQP

SEQ ID NO: 258773 - protein, 9 aa, Homo Sapiens
LRFQEFFAA

SEQ ID NO: 258774 - protein, 9 aa, Homo Sapiens
VGARKNTFA

SEQ ID NO: 258775 - protein, 9 aa, Homo Sapiens
GKRGSVCGG

SEQ ID NO: 258776 - protein, 9 aa, Homo Sapiens
GNHVQIRGN

SEQ ID NO: 258777 - protein, 9 aa, Homo Sapiens
ELPWGGGLK

SEQ ID NO: 258778 - protein, 9 aa, Homo Sapiens
TRRAVNSQF

SEQ ID NO: 258779 - protein, 9 aa, Homo Sapiens
EVIESVTEL

SEQ ID NO: 258780 - protein, 9 aa, Homo Sapiens
EENKGGLNK

SEQ ID NO: 258781 - protein, 9 aa, Homo Sapiens
EPRQIVIHR

SEQ ID NO: 258782 - protein, 9 aa, Homo Sapiens
FENADGRFK

SEQ ID NO: 258783 - protein, 9 aa, Homo Sapiens
VQTKIFEEH

SEQ ID NO: 258784 - protein, 9 aa, Homo Sapiens
VILIEYLPK

SEQ ID NO: 258785 - protein, 9 aa, Homo Sapiens
GMLLREAMH

SEQ ID NO: 258786 - protein, 9 aa, Homo Sapiens
RLLIEKLID

SEQ ID NO: 258787 - protein, 9 aa, Homo Sapiens
WLDGSTPAF

SEQ ID NO: 258788 - protein, 9 aa, Homo Sapiens
NMTFIKKPK

SEQ ID NO: 258789 - protein, 9 aa, Homo Sapiens
KLDLKTNVV

SEQ ID NO: 258790 - protein, 9 aa, Homo Sapiens
KLLKKFASV

SEQ ID NO: 258791 - protein, 9 aa, Homo Sapiens
GRRRSFAEI

SEQ ID NO: 258792 - protein, 9 aa, Homo Sapiens
KQGIVCFYG

SEQ ID NO: 258793 - protein, 9 aa, Homo Sapiens
LLIHQKVHT

SEQ ID NO: 258794 - protein, 9 aa, Homo Sapiens
VVANGGLTC

SEQ ID NO: 258795 - protein, 9 aa, Homo Sapiens
LWIDWQWQY

SEQ ID NO: 258796 - protein, 9 aa, Homo Sapiens
PRIIQNQNV

SEQ ID NO: 258797 - protein, 9 aa, Homo Sapiens
TYFDSVFQL

SEQ ID NO: 258798 - protein, 9 aa, Homo Sapiens
TYLEKDGNE

SEQ ID NO: 258799 - protein, 9 aa, Homo Sapiens
DGEEHVSFL

SEQ ID NO: 258800 - protein, 9 aa, Homo Sapiens
ILIMDLKEE

SEQ ID NO: 258801 - protein, 9 aa, Homo Sapiens
FHLIAPSQV

SEQ ID NO: 258802 - protein, 9 aa, Homo Sapiens
VWKTLIPPQ

SEQ ID NO: 258803 - protein, 9 aa, Homo Sapiens
YIGHTIWGS

SEQ ID NO: 258804 - protein, 9 aa, Homo Sapiens
LMQNQSSTK

SEQ ID NO: 258805 - protein, 9 aa, Homo Sapiens
DSGVYTCIA

SEQ ID NO: 258806 - protein, 9 aa, Homo Sapiens
DQPISLDRL

SEQ ID NO: 258807 - protein, 9 aa, Homo Sapiens
EKLIDNPRH

SEQ ID NO: 258808 - protein, 9 aa, Homo Sapiens
KEESPSALQ

SEQ ID NO: 258809 - protein, 9 aa, Homo Sapiens
ECSLLGSMA

SEQ ID NO: 258810 - protein, 9 aa, Homo Sapiens
FTLTLMHLY

SEQ ID NO: 258811 - protein, 9 aa, Homo Sapiens
SGSPACSYN

SEQ ID NO: 258812 - protein, 9 aa, Homo Sapiens
GLNTLFPDM

SEQ ID NO: 258813 - protein, 9 aa, Homo Sapiens
MRNVIRMMS

SEQ ID NO: 258814 - protein, 9 aa, Homo Sapiens
ETESLHGSL

SEQ ID NO: 258815 - protein, 9 aa, Homo Sapiens
QPDGFNLLC

SEQ ID NO: 258816 - protein, 9 aa, Homo Sapiens
SVKQNEARM

SEQ ID NO: 258817 - protein, 9 aa, Homo Sapiens
HRKHFKKPF

SEQ ID NO: 258818 - protein, 9 aa, Homo Sapiens
CVAEVWMDD

SEQ ID NO: 258819 - protein, 9 aa, Homo Sapiens
NLISPEDYY

SEQ ID NO: 258820 - protein, 9 aa, Homo Sapiens
GNTVKSTGD

SEQ ID NO: 258821 - protein, 9 aa, Homo Sapiens
GPSKLWNNR

SEQ ID NO: 258822 - protein, 9 aa, Homo Sapiens
LCGGLCMHV

SEQ ID NO: 258823 - protein, 9 aa, Homo Sapiens
FLAIYPITL

SEQ ID NO: 258824 - protein, 9 aa, Homo Sapiens
IRKNADDST

SEQ ID NO: 258825 - protein, 9 aa, Homo Sapiens
QTSKADYEL

SEQ ID NO: 258826 - protein, 9 aa, Homo Sapiens
YQITSGNTQ

SEQ ID NO: 258827 - protein, 9 aa, Homo Sapiens
SSTNVDMIL

SEQ ID NO: 258828 - protein, 9 aa, Homo Sapiens
LNIPISIEF

SEQ ID NO: 258829 - protein, 9 aa, Homo Sapiens
SYTCRHLRI

SEQ ID NO: 258830 - protein, 9 aa, Homo Sapiens
RPCSSYSLD

SEQ ID NO: 258831 - protein, 9 aa, Homo Sapiens
TRRMGTYSL

SEQ ID NO: 258832 - protein, 9 aa, Homo Sapiens
SHALSDSHH

SEQ ID NO: 258833 - protein, 9 aa, Homo Sapiens
IIYTDEAAA

SEQ ID NO: 258834 - protein, 9 aa, Homo Sapiens
NYYEEIVFL

SEQ ID NO: 258835 - protein, 9 aa, Homo Sapiens
FMNVSESHV

SEQ ID NO: 258836 - protein, 9 aa, Homo Sapiens
GDLLSDLLQ

SEQ ID NO: 258837 - protein, 9 aa, Homo Sapiens
SKKHTGKPS

SEQ ID NO: 258838 - protein, 9 aa, Homo Sapiens
NSKLWKHVR

SEQ ID NO: 258839 - protein, 9 aa, Homo Sapiens
PDKEPNSTD

SEQ ID NO: 258840 - protein, 9 aa, Homo Sapiens
FCRSPCTIS

SEQ ID NO: 258841 - protein, 9 aa, Homo Sapiens
SWIDTFIIT

SEQ ID NO: 258842 - protein, 9 aa, Homo Sapiens
LVCLAAALL

SEQ ID NO: 258843 - protein, 9 aa, Homo Sapiens
IKVSREEIF

SEQ ID NO: 258844 - protein, 9 aa, Homo Sapiens
HTSYLSQPQ

SEQ ID NO: 258845 - protein, 9 aa, Homo Sapiens
PCSLKIRVI

SEQ ID NO: 258846 - protein, 9 aa, Homo Sapiens
SRHDPSISF

SEQ ID NO: 258847 - protein, 9 aa, Homo Sapiens
GIRKRINNG

SEQ ID NO: 258848 - protein, 9 aa, Homo Sapiens
GSTTFCIFI

SEQ ID NO: 258849 - protein, 9 aa, Homo Sapiens
VTNRPPTLA

SEQ ID NO: 258850 - protein, 9 aa, Homo Sapiens
SNSRYSRCH

SEQ ID NO: 258851 - protein, 9 aa, Homo Sapiens
LLSKPPNPA

SEQ ID NO: 258852 - protein, 9 aa, Homo Sapiens
GSFVEVQGQ

SEQ ID NO: 258853 - protein, 9 aa, Homo Sapiens
TGIFAGFVI

SEQ ID NO: 258854 - protein, 9 aa, Homo Sapiens
VSPFSSLRW

SEQ ID NO: 258855 - protein, 9 aa, Homo Sapiens
CILIYLRAG

SEQ ID NO: 258856 - protein, 9 aa, Homo Sapiens
GTVICVTHR

SEQ ID NO: 258857 - protein, 9 aa, Homo Sapiens
IVKEKNAEL

SEQ ID NO: 258858 - protein, 9 aa, Homo Sapiens
NILGLDSLE

SEQ ID NO: 258859 - protein, 9 aa, Homo Sapiens
KQIVENLSP

SEQ ID NO: 258860 - protein, 9 aa, Homo Sapiens
YSDFERLHQ

SEQ ID NO: 258861 - protein, 9 aa, Homo Sapiens
WCAVGVNVS

SEQ ID NO: 258862 - protein, 9 aa, Homo Sapiens
GDNLPEALQ

SEQ ID NO: 258863 - protein, 9 aa, Homo Sapiens
LEGSAKGKL

SEQ ID NO: 258864 - protein, 9 aa, Homo Sapiens
IKEIKDLRA

SEQ ID NO: 258865 - protein, 9 aa, Homo Sapiens
QAPPSLPTI

SEQ ID NO: 258866 - protein, 9 aa, Homo Sapiens
VRSLIQASG

SEQ ID NO: 258867 - protein, 9 aa, Homo Sapiens
RLLECQFMP

SEQ ID NO: 258868 - protein, 9 aa, Homo Sapiens
YYNQAYLLL

SEQ ID NO: 258869 - protein, 9 aa, Homo Sapiens
SDIYLHLLN

SEQ ID NO: 258870 - protein, 9 aa, Homo Sapiens
STTAVWHQN

SEQ ID NO: 258871 - protein, 9 aa, Homo Sapiens
KWNDYLFEI

SEQ ID NO: 258872 - protein, 9 aa, Homo Sapiens
AIFGGEQFM

SEQ ID NO: 258873 - protein, 9 aa, Homo Sapiens
TCMFCHPSF

SEQ ID NO: 258874 - protein, 9 aa, Homo Sapiens
FIFFIASIV

SEQ ID NO: 258875 - protein, 9 aa, Homo Sapiens
PMDGHAMDF

SEQ ID NO: 258876 - protein, 9 aa, Homo Sapiens
LSLDNFIPG

SEQ ID NO: 258877 - protein, 9 aa, Homo Sapiens
WNIMCWECC

SEQ ID NO: 258878 - protein, 9 aa, Homo Sapiens
QNCLPHLKN

SEQ ID NO: 258879 - protein, 9 aa, Homo Sapiens
GAAQMKTLK

SEQ ID NO: 258880 - protein, 9 aa, Homo Sapiens
LVPEAAKGK

SEQ ID NO: 258881 - protein, 9 aa, Homo Sapiens
KIIFVPSYI

SEQ ID NO: 258882 - protein, 9 aa, Homo Sapiens
KLKSKLVIW

SEQ ID NO: 258883 - protein, 9 aa, Homo Sapiens
VAANDIKWQ

SEQ ID NO: 258884 - protein, 9 aa, Homo Sapiens
ICKTFNIKN

SEQ ID NO: 258885 - protein, 9 aa, Homo Sapiens
NRFIQDDQL

SEQ ID NO: 258886 - protein, 9 aa, Homo Sapiens
MDSPTQISE

SEQ ID NO: 258887 - protein, 9 aa, Homo Sapiens
NREKGKGQA

SEQ ID NO: 258888 - protein, 9 aa, Homo Sapiens
TSTSVLTTT

SEQ ID NO: 258889 - protein, 9 aa, Homo Sapiens
LKLLSENTN

SEQ ID NO: 258890 - protein, 9 aa, Homo Sapiens
LTQVSSLVL

SEQ ID NO: 258891 - protein, 9 aa, Homo Sapiens
DCLDGSDKR

SEQ ID NO: 258892 - protein, 9 aa, Homo Sapiens
PEGFKKSYS

SEQ ID NO: 258893 - protein, 9 aa, Homo Sapiens
RYDGALLDE

SEQ ID NO: 258894 - protein, 9 aa, Homo Sapiens
WGCYPGSQR

SEQ ID NO: 258895 - protein, 9 aa, Homo Sapiens
ENNVIFITN

SEQ ID NO: 258896 - protein, 9 aa, Homo Sapiens
LDDYDREGS

SEQ ID NO: 258897 - protein, 9 aa, Homo Sapiens
HLALVKSRE

SEQ ID NO: 258898 - protein, 9 aa, Homo Sapiens
FDIGPEFIQ

SEQ ID NO: 258899 - protein, 9 aa, Homo Sapiens
DIQKMKHEI

SEQ ID NO: 258900 - protein, 9 aa, Homo Sapiens
LGKTFLQPK

SEQ ID NO: 258901 - protein, 9 aa, Homo Sapiens
RNEIQRYSA

SEQ ID NO: 258902 - protein, 9 aa, Homo Sapiens
VQPDQEYFS

SEQ ID NO: 258903 - protein, 9 aa, Homo Sapiens
KFRLATRGE

SEQ ID NO: 258904 - protein, 9 aa, Homo Sapiens
FVYFEQLAL

SEQ ID NO: 258905 - protein, 9 aa, Homo Sapiens
SCEKTVTKL

SEQ ID NO: 258906 - protein, 9 aa, Homo Sapiens
TALHCAAQN

SEQ ID NO: 258907 - protein, 9 aa, Homo Sapiens
PNWNSISSG

SEQ ID NO: 258908 - protein, 9 aa, Homo Sapiens
SYFPTQAEL

SEQ ID NO: 258909 - protein, 9 aa, Homo Sapiens
DLTMDIYAF

SEQ ID NO: 258910 - protein, 9 aa, Homo Sapiens
RHLAGLLRA

SEQ ID NO: 258911 - protein, 9 aa, Homo Sapiens
HTTSAEKNT

SEQ ID NO: 258912 - protein, 9 aa, Homo Sapiens
NMKVVKTEY

SEQ ID NO: 258913 - protein, 9 aa, Homo Sapiens
WTPPRGHVE

SEQ ID NO: 258914 - protein, 9 aa, Homo Sapiens
RMETLNSFI

SEQ ID NO: 258915 - protein, 9 aa, Homo Sapiens
DTCEYRGKV

SEQ ID NO: 258916 - protein, 9 aa, Homo Sapiens
ESLHQNFML

SEQ ID NO: 258917 - protein, 9 aa, Homo Sapiens
ASVTFRATR

SEQ ID NO: 258918 - protein, 9 aa, Homo Sapiens
RLQMALEEH

SEQ ID NO: 258919 - protein, 9 aa, Homo Sapiens
WSLHKIYVC

SEQ ID NO: 258920 - protein, 9 aa, Homo Sapiens
NVNEYAPVF

SEQ ID NO: 258921 - protein, 9 aa, Homo Sapiens
AAVGAVSLT

SEQ ID NO: 258922 - protein, 9 aa, Homo Sapiens
LAGHRFSNA

SEQ ID NO: 258923 - protein, 9 aa, Homo Sapiens
CFSRQPTGP

SEQ ID NO: 258924 - protein, 9 aa, Homo Sapiens
DYCKVCQQG

SEQ ID NO: 258925 - protein, 9 aa, Homo Sapiens
VFSQVVLGV

SEQ ID NO: 258926 - protein, 9 aa, Homo Sapiens
LAAINYEGR

SEQ ID NO: 258927 - protein, 9 aa, Homo Sapiens
LKCWYCNYA

SEQ ID NO: 258928 - protein, 9 aa, Homo Sapiens
SATPGVDHV

SEQ ID NO: 258929 - protein, 9 aa, Homo Sapiens
ISNIITSGK

SEQ ID NO: 258930 - protein, 9 aa, Homo Sapiens
NVGKLSLDQ

SEQ ID NO: 258931 - protein, 9 aa, Homo Sapiens
DLAGGQHRN

SEQ ID NO: 258932 - protein, 9 aa, Homo Sapiens
PASLESMVA

SEQ ID NO: 258933 - protein, 9 aa, Homo Sapiens
RAVQKTSNL

SEQ ID NO: 258934 - protein, 9 aa, Homo Sapiens
IQYSKFMNL

SEQ ID NO: 258935 - protein, 9 aa, Homo Sapiens
PNDTNGVIT

SEQ ID NO: 258936 - protein, 9 aa, Homo Sapiens
TKSSQKVDV

SEQ ID NO: 258937 - protein, 9 aa, Homo Sapiens
SKRMLPPAN

SEQ ID NO: 258938 - protein, 9 aa, Homo Sapiens
ACFVAILTG

SEQ ID NO: 258939 - protein, 9 aa, Homo Sapiens
CRTEDKNFY

SEQ ID NO: 258940 - protein, 9 aa, Homo Sapiens
VFYHNQGCY

SEQ ID NO: 258941 - protein, 9 aa, Homo Sapiens
RNCSKLRKK

SEQ ID NO: 258942 - protein, 9 aa, Homo Sapiens
DEKKEIENL

SEQ ID NO: 258943 - protein, 9 aa, Homo Sapiens
VVSSENFDD

SEQ ID NO: 258944 - protein, 9 aa, Homo Sapiens
RLGNSWAEI

SEQ ID NO: 258945 - protein, 9 aa, Homo Sapiens
ARSSKAFPD

SEQ ID NO: 258946 - protein, 9 aa, Homo Sapiens
LQSNDTIRM

SEQ ID NO: 258947 - protein, 9 aa, Homo Sapiens
SLTELYACI

SEQ ID NO: 258948 - protein, 9 aa, Homo Sapiens
GQAQVMHGS

SEQ ID NO: 258949 - protein, 9 aa, Homo Sapiens
STCELVRTL

SEQ ID NO: 258950 - protein, 9 aa, Homo Sapiens
YKCTECAKA

SEQ ID NO: 258951 - protein, 9 aa, Homo Sapiens
YFAKDENIT

SEQ ID NO: 258952 - protein, 9 aa, Homo Sapiens
GRFQEHHGT

SEQ ID NO: 258953 - protein, 9 aa, Homo Sapiens
IIHLGISLG

SEQ ID NO: 258954 - protein, 9 aa, Homo Sapiens
YVKVLQELQ

SEQ ID NO: 258955 - protein, 9 aa, Homo Sapiens
YFSLNNWNA

SEQ ID NO: 258956 - protein, 9 aa, Homo Sapiens
KNERLQTLL

SEQ ID NO: 258957 - protein, 9 aa, Homo Sapiens
PPPGLTPFS

SEQ ID NO: 258958 - protein, 9 aa, Homo Sapiens
GKPEKFKRC

SEQ ID NO: 258959 - protein, 9 aa, Homo Sapiens
ECLFCVEQR

SEQ ID NO: 258960 - protein, 9 aa, Homo Sapiens
HLGEWWSHI

SEQ ID NO: 258961 - protein, 9 aa, Homo Sapiens
ITNCEQNSP

SEQ ID NO: 258962 - protein, 9 aa, Homo Sapiens
PIYEIMCMI

SEQ ID NO: 258963 - protein, 9 aa, Homo Sapiens
CIFTIHVSS

SEQ ID NO: 258964 - protein, 9 aa, Homo Sapiens
SILEADPFL

SEQ ID NO: 258965 - protein, 9 aa, Homo Sapiens
KWKCPGPII

SEQ ID NO: 258966 - protein, 9 aa, Homo Sapiens
YNSSCYISC

SEQ ID NO: 258967 - protein, 9 aa, Homo Sapiens
HCRIKVSRE

SEQ ID NO: 258968 - protein, 9 aa, Homo Sapiens
SHDRALVKH

SEQ ID NO: 258969 - protein, 9 aa, Homo Sapiens
FEDIKYETE

SEQ ID NO: 258970 - protein, 9 aa, Homo Sapiens
SEPNQLVQP

SEQ ID NO: 258971 - protein, 9 aa, Homo Sapiens
VDGVDEVVK

SEQ ID NO: 258972 - protein, 9 aa, Homo Sapiens
FSDTEEVFR

SEQ ID NO: 258973 - protein, 9 aa, Homo Sapiens
DIYSECNTW

SEQ ID NO: 258974 - protein, 9 aa, Homo Sapiens
LSCLLESNR

SEQ ID NO: 258975 - protein, 9 aa, Homo Sapiens
VNQVIMMKE

SEQ ID NO: 258976 - protein, 9 aa, Homo Sapiens
VDDTSVIDY

SEQ ID NO: 258977 - protein, 9 aa, Homo Sapiens
VIGNRESGS

SEQ ID NO: 258978 - protein, 9 aa, Homo Sapiens
ENQEKEDIL

SEQ ID NO: 258979 - protein, 9 aa, Homo Sapiens
KHICRFLDE

SEQ ID NO: 258980 - protein, 9 aa, Homo Sapiens
YVNLQIWDT

SEQ ID NO: 258981 - protein, 9 aa, Homo Sapiens
SNLARHCRI

SEQ ID NO: 258982 - protein, 9 aa, Homo Sapiens
KYFSKYWKK

SEQ ID NO: 258983 - protein, 9 aa, Homo Sapiens
LRRKCERIL

SEQ ID NO: 258984 - protein, 9 aa, Homo Sapiens
HLSHVISPF

SEQ ID NO: 258985 - protein, 9 aa, Homo Sapiens
YMYPITVPG

SEQ ID NO: 258986 - protein, 9 aa, Homo Sapiens
AGAPLITAT

SEQ ID NO: 258987 - protein, 9 aa, Homo Sapiens
QAPYGTVGA

SEQ ID NO: 258988 - protein, 9 aa, Homo Sapiens
GEMRKKIYD

SEQ ID NO: 258989 - protein, 9 aa, Homo Sapiens
LLVAQNLFN

SEQ ID NO: 258990 - protein, 9 aa, Homo Sapiens
PSVIVGHPL

SEQ ID NO: 258991 - protein, 9 aa, Homo Sapiens
SIPSRSFLL

SEQ ID NO: 258992 - protein, 9 aa, Homo Sapiens
DMECKGKRG

SEQ ID NO: 258993 - protein, 9 aa, Homo Sapiens
HSQTYTTSS

SEQ ID NO: 258994 - protein, 9 aa, Homo Sapiens
PPQAKVDFI

SEQ ID NO: 258995 - protein, 9 aa, Homo Sapiens
GTLLGAGFT

SEQ ID NO: 258996 - protein, 9 aa, Homo Sapiens
HSIRKINIR

SEQ ID NO: 258997 - protein, 9 aa, Homo Sapiens
DLFAVELLD

SEQ ID NO: 258998 - protein, 9 aa, Homo Sapiens
KRSGNFNFG

SEQ ID NO: 258999 - protein, 9 aa, Homo Sapiens
VSGSEQTFL

SEQ ID NO: 259000 - protein, 9 aa, Homo Sapiens
LQRFYKIRL

SEQ ID NO: 259001 - protein, 9 aa, Homo Sapiens
PYINSICYR

SEQ ID NO: 259002 - protein, 9 aa, Homo Sapiens
ASDNVNKLL

SEQ ID NO: 259003 - protein, 9 aa, Homo Sapiens
ERINRFIVS

SEQ ID NO: 259004 - protein, 9 aa, Homo Sapiens
SYICIVATI

SEQ ID NO: 259005 - protein, 9 aa, Homo Sapiens
NNKYESKNS

SEQ ID NO: 259006 - protein, 9 aa, Homo Sapiens
SVENGWISK

SEQ ID NO: 259007 - protein, 9 aa, Homo Sapiens
CLTECTKEE

SEQ ID NO: 259008 - protein, 9 aa, Homo Sapiens
QLGRCSVSP

SEQ ID NO: 259009 - protein, 9 aa, Homo Sapiens
KFVTFSLLF

SEQ ID NO: 259010 - protein, 9 aa, Homo Sapiens
MTCLESVTI

SEQ ID NO: 259011 - protein, 9 aa, Homo Sapiens
EPCRLYHRA

SEQ ID NO: 259012 - protein, 9 aa, Homo Sapiens
GDDSQDVCI

SEQ ID NO: 259013 - protein, 9 aa, Homo Sapiens
VKGTQICAY

SEQ ID NO: 259014 - protein, 9 aa, Homo Sapiens
SVLNTATTM

SEQ ID NO: 259015 - protein, 9 aa, Homo Sapiens
FVLMTSYLI

SEQ ID NO: 259016 - protein, 9 aa, Homo Sapiens
DGNQEFIAL

SEQ ID NO: 259017 - protein, 9 aa, Homo Sapiens
RSFNNFTLC

SEQ ID NO: 259018 - protein, 9 aa, Homo Sapiens
PEASIQAAF

SEQ ID NO: 259019 - protein, 9 aa, Homo Sapiens
GPVYSQSTV

SEQ ID NO: 259020 - protein, 9 aa, Homo Sapiens
YLFCADHKL

SEQ ID NO: 259021 - protein, 9 aa, Homo Sapiens
SRRDKLYHL

SEQ ID NO: 259022 - protein, 9 aa, Homo Sapiens
YCEPTSCQI

SEQ ID NO: 259023 - protein, 9 aa, Homo Sapiens
GTSWGRGGT

SEQ ID NO: 259024 - protein, 9 aa, Homo Sapiens
EDEEMVEAK

SEQ ID NO: 259025 - protein, 9 aa, Homo Sapiens
AHFMTTAMY

SEQ ID NO: 259026 - protein, 9 aa, Homo Sapiens
NGHSVCEDK

SEQ ID NO: 259027 - protein, 9 aa, Homo Sapiens
NNSKERPTY

SEQ ID NO: 259028 - protein, 9 aa, Homo Sapiens
LMAQEADDA

SEQ ID NO: 259029 - protein, 9 aa, Homo Sapiens
CLPLLQPTW

SEQ ID NO: 259030 - protein, 9 aa, Homo Sapiens
GWYFHSREY

SEQ ID NO: 259031 - protein, 9 aa, Homo Sapiens
KKERRMRLY

SEQ ID NO: 259032 - protein, 9 aa, Homo Sapiens
SINNYHPKI

SEQ ID NO: 259033 - protein, 9 aa, Homo Sapiens
CLTSQGKKP

SEQ ID NO: 259034 - protein, 9 aa, Homo Sapiens
QKYDADLES

SEQ ID NO: 259035 - protein, 9 aa, Homo Sapiens
SIKGSNNSS

SEQ ID NO: 259036 - protein, 9 aa, Homo Sapiens
IMHVSPTGL

SEQ ID NO: 259037 - protein, 9 aa, Homo Sapiens
VRSSFNSCL

SEQ ID NO: 259038 - protein, 9 aa, Homo Sapiens
STFKIHERT

SEQ ID NO: 259039 - protein, 9 aa, Homo Sapiens
SLHPSAGKL

SEQ ID NO: 259040 - protein, 9 aa, Homo Sapiens
GSKCEVQVT

SEQ ID NO: 259041 - protein, 9 aa, Homo Sapiens
IAKELGLPP

SEQ ID NO: 259042 - protein, 9 aa, Homo Sapiens
FLKSLLEAK

SEQ ID NO: 259043 - protein, 9 aa, Homo Sapiens
NSWAEIAKL

SEQ ID NO: 259044 - protein, 9 aa, Homo Sapiens
QNDLAVAYI

SEQ ID NO: 259045 - protein, 9 aa, Homo Sapiens
CKSVHEISL

SEQ ID NO: 259046 - protein, 9 aa, Homo Sapiens
HLYFAQVVF

SEQ ID NO: 259047 - protein, 9 aa, Homo Sapiens
LPEIPESIS

SEQ ID NO: 259048 - protein, 9 aa, Homo Sapiens
GIFAGFVIF

SEQ ID NO: 259049 - protein, 9 aa, Homo Sapiens
NVNARERRR

SEQ ID NO: 259050 - protein, 9 aa, Homo Sapiens
RICPHLCSL

SEQ ID NO: 259051 - protein, 9 aa, Homo Sapiens
VTFNTICKK

SEQ ID NO: 259052 - protein, 9 aa, Homo Sapiens
RIYIYWVHS

SEQ ID NO: 259053 - protein, 9 aa, Homo Sapiens
NENVSNCIQ

SEQ ID NO: 259054 - protein, 9 aa, Homo Sapiens
SQPAFYDLS

SEQ ID NO: 259055 - protein, 9 aa, Homo Sapiens
ITLAAFTLR

SEQ ID NO: 259056 - protein, 9 aa, Homo Sapiens
SLLTSNMFC

SEQ ID NO: 259057 - protein, 9 aa, Homo Sapiens
QRYWQNILV

SEQ ID NO: 259058 - protein, 9 aa, Homo Sapiens
KKQVHKKWK

SEQ ID NO: 259059 - protein, 9 aa, Homo Sapiens
NVDVPISRP

SEQ ID NO: 259060 - protein, 9 aa, Homo Sapiens
SCNWTKDEL

SEQ ID NO: 259061 - protein, 9 aa, Homo Sapiens
SMAELQDII

SEQ ID NO: 259062 - protein, 9 aa, Homo Sapiens
NAFIAGLFP

SEQ ID NO: 259063 - protein, 9 aa, Homo Sapiens
VVPILIIVN

SEQ ID NO: 259064 - protein, 9 aa, Homo Sapiens
PHQPLVTYT

SEQ ID NO: 259065 - protein, 9 aa, Homo Sapiens
PARAPAGPV

SEQ ID NO: 259066 - protein, 9 aa, Homo Sapiens
SQDETEQNQ

SEQ ID NO: 259067 - protein, 9 aa, Homo Sapiens
DQFDYKDQR

SEQ ID NO: 259068 - protein, 9 aa, Homo Sapiens
FAERLFALF

SEQ ID NO: 259069 - protein, 9 aa, Homo Sapiens
ASMYEQFYS

SEQ ID NO: 259070 - protein, 9 aa, Homo Sapiens
EEQRKMCKR

SEQ ID NO: 259071 - protein, 9 aa, Homo Sapiens
HMAADTLLQ

SEQ ID NO: 259072 - protein, 9 aa, Homo Sapiens
LNRGPENSK

SEQ ID NO: 259073 - protein, 9 aa, Homo Sapiens
ERLSLILES

SEQ ID NO: 259074 - protein, 9 aa, Homo Sapiens
AKSCGEYIQ

SEQ ID NO: 259075 - protein, 9 aa, Homo Sapiens
DSLRGTMQL

SEQ ID NO: 259076 - protein, 9 aa, Homo Sapiens
PFQLDGAEN

SEQ ID NO: 259077 - protein, 9 aa, Homo Sapiens
SKINLHQHQ

SEQ ID NO: 259078 - protein, 9 aa, Homo Sapiens
TDVSQPPPV

SEQ ID NO: 259079 - protein, 9 aa, Homo Sapiens
YRSQHLDNL

SEQ ID NO: 259080 - protein, 9 aa, Homo Sapiens
VNSEQGHFL

SEQ ID NO: 259081 - protein, 9 aa, Homo Sapiens
RRRKRSGNF

SEQ ID NO: 259082 - protein, 9 aa, Homo Sapiens
HPLMVIFQA

SEQ ID NO: 259083 - protein, 9 aa, Homo Sapiens
DTMPASLSQ

SEQ ID NO: 259084 - protein, 9 aa, Homo Sapiens
KGLRNCASD

SEQ ID NO: 259085 - protein, 9 aa, Homo Sapiens
DDDQIRGLT

SEQ ID NO: 259086 - protein, 9 aa, Homo Sapiens
LSFQNKIIS

SEQ ID NO: 259087 - protein, 9 aa, Homo Sapiens
HIFALNWCE

SEQ ID NO: 259088 - protein, 9 aa, Homo Sapiens
MFETSNVPA

SEQ ID NO: 259089 - protein, 9 aa, Homo Sapiens
MKHGGLHAF

SEQ ID NO: 259090 - protein, 9 aa, Homo Sapiens
FGPNAILVS

SEQ ID NO: 259091 - protein, 9 aa, Homo Sapiens
REEQDKMLS

SEQ ID NO: 259092 - protein, 9 aa, Homo Sapiens
TLCSTFTQA

SEQ ID NO: 259093 - protein, 9 aa, Homo Sapiens
KLFQCNVHV

SEQ ID NO: 259094 - protein, 9 aa, Homo Sapiens
SSAIVLWCY

SEQ ID NO: 259095 - protein, 9 aa, Homo Sapiens
KRINNGSYI

SEQ ID NO: 259096 - protein, 9 aa, Homo Sapiens
FKLENQDSD

SEQ ID NO: 259097 - protein, 9 aa, Homo Sapiens
IRGPGGKMH

SEQ ID NO: 259098 - protein, 9 aa, Homo Sapiens
CHRQLDKSK

SEQ ID NO: 259099 - protein, 9 aa, Homo Sapiens
SHVNMMASS

SEQ ID NO: 259100 - protein, 9 aa, Homo Sapiens
TSGEVEILD

SEQ ID NO: 259101 - protein, 9 aa, Homo Sapiens
RYIDQYAAI

SEQ ID NO: 259102 - protein, 9 aa, Homo Sapiens
HAHMCTHHT

SEQ ID NO: 259103 - protein, 9 aa, Homo Sapiens
RNQHVSTSR

SEQ ID NO: 259104 - protein, 9 aa, Homo Sapiens
AGLLRLTCC

SEQ ID NO: 259105 - protein, 9 aa, Homo Sapiens
KTNIQSSTR

SEQ ID NO: 259106 - protein, 9 aa, Homo Sapiens
WRTHDSEKP

SEQ ID NO: 259107 - protein, 9 aa, Homo Sapiens
ITSDISPEL

SEQ ID NO: 259108 - protein, 9 aa, Homo Sapiens
VPHPLIPVS

SEQ ID NO: 259109 - protein, 9 aa, Homo Sapiens
AEAFETTLG

SEQ ID NO: 259110 - protein, 9 aa, Homo Sapiens
AYLGEECPA

SEQ ID NO: 259111 - protein, 9 aa, Homo Sapiens
EKLSSFPYL

SEQ ID NO: 259112 - protein, 9 aa, Homo Sapiens
SWIYKRIPN

SEQ ID NO: 259113 - protein, 9 aa, Homo Sapiens
GTLGWIPID

SEQ ID NO: 259114 - protein, 9 aa, Homo Sapiens
AALSPAVGS

SEQ ID NO: 259115 - protein, 9 aa, Homo Sapiens
LSRLGQMGQ

SEQ ID NO: 259116 - protein, 9 aa, Homo Sapiens
ERKIWDSQE

SEQ ID NO: 259117 - protein, 9 aa, Homo Sapiens
HEYMGMCSM

SEQ ID NO: 259118 - protein, 9 aa, Homo Sapiens
ELPVGCTQG

SEQ ID NO: 259119 - protein, 9 aa, Homo Sapiens
DTFIITLLR

SEQ ID NO: 259120 - protein, 9 aa, Homo Sapiens
QSIALSPRL

SEQ ID NO: 259121 - protein, 9 aa, Homo Sapiens
DRCAQVPAV

SEQ ID NO: 259122 - protein, 9 aa, Homo Sapiens
DLPSLDTAI

SEQ ID NO: 259123 - protein, 9 aa, Homo Sapiens
WVIASHPPL

SEQ ID NO: 259124 - protein, 9 aa, Homo Sapiens
TKDGSNETI

SEQ ID NO: 259125 - protein, 9 aa, Homo Sapiens
DYPQNLLFD

SEQ ID NO: 259126 - protein, 9 aa, Homo Sapiens
YRYAHTLVT

SEQ ID NO: 259127 - protein, 9 aa, Homo Sapiens
NAFISVDHL

SEQ ID NO: 259128 - protein, 9 aa, Homo Sapiens
LSYAILGFA

SEQ ID NO: 259129 - protein, 9 aa, Homo Sapiens
MVGGDVGSL

SEQ ID NO: 259130 - protein, 9 aa, Homo Sapiens
VFKEGYNDL

SEQ ID NO: 259131 - protein, 9 aa, Homo Sapiens
YSAIAPNGA

SEQ ID NO: 259132 - protein, 9 aa, Homo Sapiens
QQMVLDAVT

SEQ ID NO: 259133 - protein, 9 aa, Homo Sapiens
RYDPNHVCN

SEQ ID NO: 259134 - protein, 9 aa, Homo Sapiens
PLYFCLGNL

SEQ ID NO: 259135 - protein, 9 aa, Homo Sapiens
ISRHSLNAG

SEQ ID NO: 259136 - protein, 9 aa, Homo Sapiens
SGKLQDFTR

SEQ ID NO: 259137 - protein, 9 aa, Homo Sapiens
KKKMGGDLN

SEQ ID NO: 259138 - protein, 9 aa, Homo Sapiens
AEEVVQEII

SEQ ID NO: 259139 - protein, 9 aa, Homo Sapiens
DKYDDEDDS

SEQ ID NO: 259140 - protein, 9 aa, Homo Sapiens
TNGHNETSN

SEQ ID NO: 259141 - protein, 9 aa, Homo Sapiens
LLILAIYCF

SEQ ID NO: 259142 - protein, 9 aa, Homo Sapiens
TYGLYFCGQ

SEQ ID NO: 259143 - protein, 9 aa, Homo Sapiens
LVFLGILHK

SEQ ID NO: 259144 - protein, 9 aa, Homo Sapiens
YNKISNLMR

SEQ ID NO: 259145 - protein, 9 aa, Homo Sapiens
KEVQRWKDS

SEQ ID NO: 259146 - protein, 9 aa, Homo Sapiens
PASYSSPSE

SEQ ID NO: 259147 - protein, 9 aa, Homo Sapiens
SAQKAGYGA

SEQ ID NO: 259148 - protein, 9 aa, Homo Sapiens
LQPVSIENI

SEQ ID NO: 259149 - protein, 9 aa, Homo Sapiens
DPFIYLPVP

SEQ ID NO: 259150 - protein, 9 aa, Homo Sapiens
PKIYRNVEF

SEQ ID NO: 259151 - protein, 9 aa, Homo Sapiens
DQTALKSPP

SEQ ID NO: 259152 - protein, 9 aa, Homo Sapiens
TIEKGKDDA

SEQ ID NO: 259153 - protein, 9 aa, Homo Sapiens
SDTWILDKD

SEQ ID NO: 259154 - protein, 9 aa, Homo Sapiens
NAIRRVFCD

SEQ ID NO: 259155 - protein, 9 aa, Homo Sapiens
LNKKAETGD

SEQ ID NO: 259156 - protein, 9 aa, Homo Sapiens
GCMLLIAVL

SEQ ID NO: 259157 - protein, 9 aa, Homo Sapiens
VTPGEKMVL

SEQ ID NO: 259158 - protein, 9 aa, Homo Sapiens
AFQTILTEM

SEQ ID NO: 259159 - protein, 9 aa, Homo Sapiens
MLVNSAQAD

SEQ ID NO: 259160 - protein, 9 aa, Homo Sapiens
NLTAGNEAV

SEQ ID NO: 259161 - protein, 9 aa, Homo Sapiens
QEAERLTLI

SEQ ID NO: 259162 - protein, 9 aa, Homo Sapiens
LEFTMLKAR

SEQ ID NO: 259163 - protein, 9 aa, Homo Sapiens
WFDVCDAFP

SEQ ID NO: 259164 - protein, 9 aa, Homo Sapiens
LQPRALSPA

SEQ ID NO: 259165 - protein, 9 aa, Homo Sapiens
QWNESEPSE

SEQ ID NO: 259166 - protein, 9 aa, Homo Sapiens
RRELGSKDL

SEQ ID NO: 259167 - protein, 9 aa, Homo Sapiens
SPWQDRHGK

SEQ ID NO: 259168 - protein, 9 aa, Homo Sapiens
MEFNLLISF

SEQ ID NO: 259169 - protein, 9 aa, Homo Sapiens
IQQEVDEER

SEQ ID NO: 259170 - protein, 9 aa, Homo Sapiens
EFNSLLTDH

SEQ ID NO: 259171 - protein, 9 aa, Homo Sapiens
ETMQEKAFG

SEQ ID NO: 259172 - protein, 9 aa, Homo Sapiens
HNEVWMVDC

SEQ ID NO: 259173 - protein, 9 aa, Homo Sapiens
ANVKGTQIC

SEQ ID NO: 259174 - protein, 9 aa, Homo Sapiens
TDNSQLHSH

SEQ ID NO: 259175 - protein, 9 aa, Homo Sapiens
CVNETSIII

SEQ ID NO: 259176 - protein, 9 aa, Homo Sapiens
PTPIMYWAK

SEQ ID NO: 259177 - protein, 9 aa, Homo Sapiens
AQFVPPLYY

SEQ ID NO: 259178 - protein, 9 aa, Homo Sapiens
QIVEKLIKK

SEQ ID NO: 259179 - protein, 9 aa, Homo Sapiens
PFKYGWDNL

SEQ ID NO: 259180 - protein, 9 aa, Homo Sapiens
REYPCSGSL

SEQ ID NO: 259181 - protein, 9 aa, Homo Sapiens
CHYKAPAVV

SEQ ID NO: 259182 - protein, 9 aa, Homo Sapiens
CISVKGIIY

SEQ ID NO: 259183 - protein, 9 aa, Homo Sapiens
YIRVFTCTH

SEQ ID NO: 259184 - protein, 9 aa, Homo Sapiens
KFLHLSKEN

SEQ ID NO: 259185 - protein, 9 aa, Homo Sapiens
EETSKEANI

SEQ ID NO: 259186 - protein, 9 aa, Homo Sapiens
YPSNFLKLV

SEQ ID NO: 259187 - protein, 9 aa, Homo Sapiens
PLRTYLRMP

SEQ ID NO: 259188 - protein, 9 aa, Homo Sapiens
NVLIAVNMV

SEQ ID NO: 259189 - protein, 9 aa, Homo Sapiens
NLDGTNWQA

SEQ ID NO: 259190 - protein, 9 aa, Homo Sapiens
KTDLTDPDI

SEQ ID NO: 259191 - protein, 9 aa, Homo Sapiens
SLGLHSRET

SEQ ID NO: 259192 - protein, 9 aa, Homo Sapiens
MRFAMKYRR

SEQ ID NO: 259193 - protein, 9 aa, Homo Sapiens
PFKALLEGL

SEQ ID NO: 259194 - protein, 9 aa, Homo Sapiens
LNLSFNDIH

SEQ ID NO: 259195 - protein, 9 aa, Homo Sapiens
AMSPWQRKK

SEQ ID NO: 259196 - protein, 9 aa, Homo Sapiens
NVDGYIWPW

SEQ ID NO: 259197 - protein, 9 aa, Homo Sapiens
GLFVAFYVA

SEQ ID NO: 259198 - protein, 9 aa, Homo Sapiens
RVQRSIRLM

SEQ ID NO: 259199 - protein, 9 aa, Homo Sapiens
IVLVNGTTI

SEQ ID NO: 259200 - protein, 9 aa, Homo Sapiens
NLQKELDSL

SEQ ID NO: 259201 - protein, 9 aa, Homo Sapiens
DCLPLGQCD

SEQ ID NO: 259202 - protein, 9 aa, Homo Sapiens
SGGCDTQCT

SEQ ID NO: 259203 - protein, 9 aa, Homo Sapiens
IHIVYDIPT

SEQ ID NO: 259204 - protein, 9 aa, Homo Sapiens
TQSGKDKEM

SEQ ID NO: 259205 - protein, 9 aa, Homo Sapiens
SRSKREQYK

SEQ ID NO: 259206 - protein, 9 aa, Homo Sapiens
WGGMITSLI

SEQ ID NO: 259207 - protein, 9 aa, Homo Sapiens
LKKSIKIIL

SEQ ID NO: 259208 - protein, 9 aa, Homo Sapiens
LPMDGHAMD

SEQ ID NO: 259209 - protein, 9 aa, Homo Sapiens
RLENVGAFN

SEQ ID NO: 259210 - protein, 9 aa, Homo Sapiens
PEIYFLGPK

SEQ ID NO: 259211 - protein, 9 aa, Homo Sapiens
SLRRDIKAF

SEQ ID NO: 259212 - protein, 9 aa, Homo Sapiens
DVAQVEIRG

SEQ ID NO: 259213 - protein, 9 aa, Homo Sapiens
TMIKLACGD

SEQ ID NO: 259214 - protein, 9 aa, Homo Sapiens
VYQRGRKKR

SEQ ID NO: 259215 - protein, 9 aa, Homo Sapiens
AVAHYKGTK

SEQ ID NO: 259216 - protein, 9 aa, Homo Sapiens
ELVHLDDSS

SEQ ID NO: 259217 - protein, 9 aa, Homo Sapiens
TPAAYRAIT

SEQ ID NO: 259218 - protein, 9 aa, Homo Sapiens
RKIFLPKVR

SEQ ID NO: 259219 - protein, 9 aa, Homo Sapiens
KKITLKCSQ

SEQ ID NO: 259220 - protein, 9 aa, Homo Sapiens
QVSSLVLYL

SEQ ID NO: 259221 - protein, 9 aa, Homo Sapiens
NHDISNDAG

SEQ ID NO: 259222 - protein, 9 aa, Homo Sapiens
DLENNQITA

SEQ ID NO: 259223 - protein, 9 aa, Homo Sapiens
VYAEGFIKT

SEQ ID NO: 259224 - protein, 9 aa, Homo Sapiens
SLESMVAIA

SEQ ID NO: 259225 - protein, 9 aa, Homo Sapiens
PHSANRGQR

SEQ ID NO: 259226 - protein, 9 aa, Homo Sapiens
AKDQRTHTL

SEQ ID NO: 259227 - protein, 9 aa, Homo Sapiens
TYIGEVLVF

SEQ ID NO: 259228 - protein, 9 aa, Homo Sapiens
DEDYIYMNK

SEQ ID NO: 259229 - protein, 9 aa, Homo Sapiens
NYVQERKNL

SEQ ID NO: 259230 - protein, 9 aa, Homo Sapiens
KDNLTQHKK

SEQ ID NO: 259231 - protein, 9 aa, Homo Sapiens
SPELLTYKE

SEQ ID NO: 259232 - protein, 9 aa, Homo Sapiens
SEDKEEALP

SEQ ID NO: 259233 - protein, 9 aa, Homo Sapiens
ASERDFIKL

SEQ ID NO: 259234 - protein, 9 aa, Homo Sapiens
PLPSTVPRT

SEQ ID NO: 259235 - protein, 9 aa, Homo Sapiens
WTPTLQYYL

SEQ ID NO: 259236 - protein, 9 aa, Homo Sapiens
TDKAISFLG

SEQ ID NO: 259237 - protein, 9 aa, Homo Sapiens
NIVKTSVKP

SEQ ID NO: 259238 - protein, 9 aa, Homo Sapiens
WDVDLILSL

SEQ ID NO: 259239 - protein, 9 aa, Homo Sapiens
ESPGSSEFV

SEQ ID NO: 259240 - protein, 9 aa, Homo Sapiens
EMAEKLFSS

SEQ ID NO: 259241 - protein, 9 aa, Homo Sapiens
HQDRNDLLT

SEQ ID NO: 259242 - protein, 9 aa, Homo Sapiens
LEITPQKNV

SEQ ID NO: 259243 - protein, 9 aa, Homo Sapiens
KKKIAIINV

SEQ ID NO: 259244 - protein, 9 aa, Homo Sapiens
GYRAAEKNF

SEQ ID NO: 259245 - protein, 9 aa, Homo Sapiens
LTVWDWQKT

SEQ ID NO: 259246 - protein, 9 aa, Homo Sapiens
NKYELQYVQ

SEQ ID NO: 259247 - protein, 9 aa, Homo Sapiens
ELYRTGNKS

SEQ ID NO: 259248 - protein, 9 aa, Homo Sapiens
YNILKQTCY

SEQ ID NO: 259249 - protein, 9 aa, Homo Sapiens
VCGREAEVV

SEQ ID NO: 259250 - protein, 9 aa, Homo Sapiens
ELQAKADTI

SEQ ID NO: 259251 - protein, 9 aa, Homo Sapiens
RACKESRPF

SEQ ID NO: 259252 - protein, 9 aa, Homo Sapiens
RHPQPELFG

SEQ ID NO: 259253 - protein, 9 aa, Homo Sapiens
KRLFCLNLP

SEQ ID NO: 259254 - protein, 9 aa, Homo Sapiens
ARMETLNSF

SEQ ID NO: 259255 - protein, 9 aa, Homo Sapiens
KRGKKVNMA

SEQ ID NO: 259256 - protein, 9 aa, Homo Sapiens
QQEAPSLPP

SEQ ID NO: 259257 - protein, 9 aa, Homo Sapiens
LADLSHLIC

SEQ ID NO: 259258 - protein, 9 aa, Homo Sapiens
FNSYIHRNS

SEQ ID NO: 259259 - protein, 9 aa, Homo Sapiens
KREKEKDKH

SEQ ID NO: 259260 - protein, 9 aa, Homo Sapiens
VLKWSGREL

SEQ ID NO: 259261 - protein, 9 aa, Homo Sapiens
SLPPESSME

SEQ ID NO: 259262 - protein, 9 aa, Homo Sapiens
LAMKRGEPD

SEQ ID NO: 259263 - protein, 9 aa, Homo Sapiens
ESDPRLTPY

SEQ ID NO: 259264 - protein, 9 aa, Homo Sapiens
KSYFPTQAE

SEQ ID NO: 259265 - protein, 9 aa, Homo Sapiens
GRVRYMLEQ

SEQ ID NO: 259266 - protein, 9 aa, Homo Sapiens
RREIKRSHS

SEQ ID NO: 259267 - protein, 9 aa, Homo Sapiens
VGRCHSYSV

SEQ ID NO: 259268 - protein, 9 aa, Homo Sapiens
MRSTVVYRY

SEQ ID NO: 259269 - protein, 9 aa, Homo Sapiens
TFGWHRAET

SEQ ID NO: 259270 - protein, 9 aa, Homo Sapiens
NTALISLVL

SEQ ID NO: 259271 - protein, 9 aa, Homo Sapiens
LLATKHPLE

SEQ ID NO: 259272 - protein, 9 aa, Homo Sapiens
PVQVKQETV

SEQ ID NO: 259273 - protein, 9 aa, Homo Sapiens
LEEHISQLE

SEQ ID NO: 259274 - protein, 9 aa, Homo Sapiens
RMNLRLCVQ

SEQ ID NO: 259275 - protein, 9 aa, Homo Sapiens
DQDKTDPLE

SEQ ID NO: 259276 - protein, 9 aa, Homo Sapiens
EILWNLLET

SEQ ID NO: 259277 - protein, 9 aa, Homo Sapiens
DAHKDHALR

SEQ ID NO: 259278 - protein, 9 aa, Homo Sapiens
LRCQYFLAQ

SEQ ID NO: 259279 - protein, 9 aa, Homo Sapiens
TKAIGIWAI

SEQ ID NO: 259280 - protein, 9 aa, Homo Sapiens
QRRLMGTNL

SEQ ID NO: 259281 - protein, 9 aa, Homo Sapiens
PHVKLKAQT

SEQ ID NO: 259282 - protein, 9 aa, Homo Sapiens
FQSLTYALA

SEQ ID NO: 259283 - protein, 9 aa, Homo Sapiens
AMTDAVRVV

SEQ ID NO: 259284 - protein, 9 aa, Homo Sapiens
ALTIHNRIH

SEQ ID NO: 259285 - protein, 9 aa, Homo Sapiens
QEKAVSEHL

SEQ ID NO: 259286 - protein, 9 aa, Homo Sapiens
LGYGSMITK

SEQ ID NO: 259287 - protein, 9 aa, Homo Sapiens
VMGNISIIV

SEQ ID NO: 259288 - protein, 9 aa, Homo Sapiens
YDLMERKLA

SEQ ID NO: 259289 - protein, 9 aa, Homo Sapiens
GQPFNTIKV

SEQ ID NO: 259290 - protein, 9 aa, Homo Sapiens
THFSKEKDI

SEQ ID NO: 259291 - protein, 9 aa, Homo Sapiens
SDSNHQRKG

SEQ ID NO: 259292 - protein, 9 aa, Homo Sapiens
SLCEHFGVR

SEQ ID NO: 259293 - protein, 9 aa, Homo Sapiens
HMSPIKLHL

SEQ ID NO: 259294 - protein, 9 aa, Homo Sapiens
IIVSIFQER

SEQ ID NO: 259295 - protein, 9 aa, Homo Sapiens
CLRKADKRS

SEQ ID NO: 259296 - protein, 9 aa, Homo Sapiens
SEQYDKDDE

SEQ ID NO: 259297 - protein, 9 aa, Homo Sapiens
EAKKSFLLG

SEQ ID NO: 259298 - protein, 9 aa, Homo Sapiens
TMSRSKKFL

SEQ ID NO: 259299 - protein, 9 aa, Homo Sapiens
PQNQHQDKD

SEQ ID NO: 259300 - protein, 9 aa, Homo Sapiens
RYLALCCQP

SEQ ID NO: 259301 - protein, 9 aa, Homo Sapiens
EDILELIKQ

SEQ ID NO: 259302 - protein, 9 aa, Homo Sapiens
MEQLMISMP

SEQ ID NO: 259303 - protein, 9 aa, Homo Sapiens
TMFTDCYIY

SEQ ID NO: 259304 - protein, 9 aa, Homo Sapiens
LRRHIIQWL

SEQ ID NO: 259305 - protein, 9 aa, Homo Sapiens
GTVHRINNT

SEQ ID NO: 259306 - protein, 9 aa, Homo Sapiens
YFNFVEKVQ

SEQ ID NO: 259307 - protein, 9 aa, Homo Sapiens
AAHKQKVVE

SEQ ID NO: 259308 - protein, 9 aa, Homo Sapiens
LGLDHCPSF

SEQ ID NO: 259309 - protein, 9 aa, Homo Sapiens
MHEYADKLA

SEQ ID NO: 259310 - protein, 9 aa, Homo Sapiens
GTKSPVREE

SEQ ID NO: 259311 - protein, 9 aa, Homo Sapiens
ARVDKYGPG

SEQ ID NO: 259312 - protein, 9 aa, Homo Sapiens
KKRKVKEMF

SEQ ID NO: 259313 - protein, 9 aa, Homo Sapiens
SFLALTPSL

SEQ ID NO: 259314 - protein, 9 aa, Homo Sapiens
SQSFKTQNK

SEQ ID NO: 259315 - protein, 9 aa, Homo Sapiens
FNKHSGTRG

SEQ ID NO: 259316 - protein, 9 aa, Homo Sapiens
IMGGMGLSN

SEQ ID NO: 259317 - protein, 9 aa, Homo Sapiens
TFKIHERTH

SEQ ID NO: 259318 - protein, 9 aa, Homo Sapiens
FKTQNKVCF

SEQ ID NO: 259319 - protein, 9 aa, Homo Sapiens
TEFINRLSQ

SEQ ID NO: 259320 - protein, 9 aa, Homo Sapiens
IELEMAKKK

SEQ ID NO: 259321 - protein, 9 aa, Homo Sapiens
ACACAEEDD

SEQ ID NO: 259322 - protein, 9 aa, Homo Sapiens
LVSITKDYE

SEQ ID NO: 259323 - protein, 9 aa, Homo Sapiens
LQAPPPGLT

SEQ ID NO: 259324 - protein, 9 aa, Homo Sapiens
EQNHQRASD

SEQ ID NO: 259325 - protein, 9 aa, Homo Sapiens
SYHFEQLSQ

SEQ ID NO: 259326 - protein, 9 aa, Homo Sapiens
PFLTGSSKQ

SEQ ID NO: 259327 - protein, 9 aa, Homo Sapiens
EIFALESAQ

SEQ ID NO: 259328 - protein, 9 aa, Homo Sapiens
FHIGVKPFK

SEQ ID NO: 259329 - protein, 9 aa, Homo Sapiens
ASYLDIYQE

SEQ ID NO: 259330 - protein, 9 aa, Homo Sapiens
KGKPIHIMW

SEQ ID NO: 259331 - protein, 9 aa, Homo Sapiens
YTAIRFTHA

SEQ ID NO: 259332 - protein, 9 aa, Homo Sapiens
TPIGKSWIY

SEQ ID NO: 259333 - protein, 9 aa, Homo Sapiens
CEALICNCD

SEQ ID NO: 259334 - protein, 9 aa, Homo Sapiens
GCNKLASFS

SEQ ID NO: 259335 - protein, 9 aa, Homo Sapiens
CFIIYACFS

SEQ ID NO: 259336 - protein, 9 aa, Homo Sapiens
FHKSGVISG

SEQ ID NO: 259337 - protein, 9 aa, Homo Sapiens
DRNHIENIL

SEQ ID NO: 259338 - protein, 9 aa, Homo Sapiens
PGEAPNDQG

SEQ ID NO: 259339 - protein, 9 aa, Homo Sapiens
KYETSLTTF

SEQ ID NO: 259340 - protein, 9 aa, Homo Sapiens
PHLCSLSSS

SEQ ID NO: 259341 - protein, 9 aa, Homo Sapiens
ETCSIAVDI

SEQ ID NO: 259342 - protein, 9 aa, Homo Sapiens
LQTTQNGRL

SEQ ID NO: 259343 - protein, 9 aa, Homo Sapiens
GQYTQLVWY

SEQ ID NO: 259344 - protein, 9 aa, Homo Sapiens
NCNLFIFME

SEQ ID NO: 259345 - protein, 9 aa, Homo Sapiens
GIYVVTVMG

SEQ ID NO: 259346 - protein, 9 aa, Homo Sapiens
EEEASKSVS

SEQ ID NO: 259347 - protein, 9 aa, Homo Sapiens
YGLYFCGQI

SEQ ID NO: 259348 - protein, 9 aa, Homo Sapiens
KTINLNVDV

SEQ ID NO: 259349 - protein, 9 aa, Homo Sapiens
CSYDSVIAL

SEQ ID NO: 259350 - protein, 9 aa, Homo Sapiens
HAFSAIKAI

SEQ ID NO: 259351 - protein, 9 aa, Homo Sapiens
EGRHFPRRP

SEQ ID NO: 259352 - protein, 9 aa, Homo Sapiens
MGAMRGSIH

SEQ ID NO: 259353 - protein, 9 aa, Homo Sapiens
LQIWNDGRV

SEQ ID NO: 259354 - protein, 9 aa, Homo Sapiens
IKGTLVFFL

SEQ ID NO: 259355 - protein, 9 aa, Homo Sapiens
INHEGEVNC

SEQ ID NO: 259356 - protein, 9 aa, Homo Sapiens
DKVRLLEQQ

SEQ ID NO: 259357 - protein, 9 aa, Homo Sapiens
AFESTMYKG

SEQ ID NO: 259358 - protein, 9 aa, Homo Sapiens
ELRETVDKN

SEQ ID NO: 259359 - protein, 9 aa, Homo Sapiens
YHAALKMDL

SEQ ID NO: 259360 - protein, 9 aa, Homo Sapiens
VGPSDLLVK

SEQ ID NO: 259361 - protein, 9 aa, Homo Sapiens
IRKNQATDF

SEQ ID NO: 259362 - protein, 9 aa, Homo Sapiens
NGVPVTRIC

SEQ ID NO: 259363 - protein, 9 aa, Homo Sapiens
IAPSLPTNN

SEQ ID NO: 259364 - protein, 9 aa, Homo Sapiens
NPPQNKKVS

SEQ ID NO: 259365 - protein, 9 aa, Homo Sapiens
IIQTLSGEQ

SEQ ID NO: 259366 - protein, 9 aa, Homo Sapiens
SFYLLYFVI

SEQ ID NO: 259367 - protein, 9 aa, Homo Sapiens
TKPENYDGG

SEQ ID NO: 259368 - protein, 9 aa, Homo Sapiens
MIYCLCYEG

SEQ ID NO: 259369 - protein, 9 aa, Homo Sapiens
AGVLLSLRL

SEQ ID NO: 259370 - protein, 9 aa, Homo Sapiens
FFHWSALKG

SEQ ID NO: 259371 - protein, 9 aa, Homo Sapiens
KQCPNPLAP

SEQ ID NO: 259372 - protein, 9 aa, Homo Sapiens
LTLHQQNHT

SEQ ID NO: 259373 - protein, 9 aa, Homo Sapiens
RDKLAAAER

SEQ ID NO: 259374 - protein, 9 aa, Homo Sapiens
IFIGGINRH

SEQ ID NO: 259375 - protein, 9 aa, Homo Sapiens
KPEDVLTSH

SEQ ID NO: 259376 - protein, 9 aa, Homo Sapiens
QELHNQCIK

SEQ ID NO: 259377 - protein, 9 aa, Homo Sapiens
IQNYLIRGR

SEQ ID NO: 259378 - protein, 9 aa, Homo Sapiens
GSWFGHIKG

SEQ ID NO: 259379 - protein, 9 aa, Homo Sapiens
ISCSHFVPA

SEQ ID NO: 259380 - protein, 9 aa, Homo Sapiens
RCHPSVYSL

SEQ ID NO: 259381 - protein, 9 aa, Homo Sapiens
DMARALPKP

SEQ ID NO: 259382 - protein, 9 aa, Homo Sapiens
SWTETLILS

SEQ ID NO: 259383 - protein, 9 aa, Homo Sapiens
RRRSFAEIY

SEQ ID NO: 259384 - protein, 9 aa, Homo Sapiens
SHTETSKSK

SEQ ID NO: 259385 - protein, 9 aa, Homo Sapiens
MNRGFSQKS

SEQ ID NO: 259386 - protein, 9 aa, Homo Sapiens
YKLRHDLEK

SEQ ID NO: 259387 - protein, 9 aa, Homo Sapiens
ETMESRKVK

SEQ ID NO: 259388 - protein, 9 aa, Homo Sapiens
LLAGHPLHL

SEQ ID NO: 259389 - protein, 9 aa, Homo Sapiens
KFCEACIEL

SEQ ID NO: 259390 - protein, 9 aa, Homo Sapiens
LLLDKDNEN

SEQ ID NO: 259391 - protein, 9 aa, Homo Sapiens
RNLERSATD

SEQ ID NO: 259392 - protein, 9 aa, Homo Sapiens
NLAPKQETS

SEQ ID NO: 259393 - protein, 9 aa, Homo Sapiens
TVGFGTQSR

SEQ ID NO: 259394 - protein, 9 aa, Homo Sapiens
SSAFQSPVP

SEQ ID NO: 259395 - protein, 9 aa, Homo Sapiens
TQENYTVQI

SEQ ID NO: 259396 - protein, 9 aa, Homo Sapiens
QAEKLEAQN

SEQ ID NO: 259397 - protein, 9 aa, Homo Sapiens
NLSPIDAED

SEQ ID NO: 259398 - protein, 9 aa, Homo Sapiens
IYPRVQTAV

SEQ ID NO: 259399 - protein, 9 aa, Homo Sapiens
PYLWSADTQ

SEQ ID NO: 259400 - protein, 9 aa, Homo Sapiens
LCIHKRKSI

SEQ ID NO: 259401 - protein, 9 aa, Homo Sapiens
AIATYPKSG

SEQ ID NO: 259402 - protein, 9 aa, Homo Sapiens
TSQKAVCLF

SEQ ID NO: 259403 - protein, 9 aa, Homo Sapiens
TCYLAPQNL

SEQ ID NO: 259404 - protein, 9 aa, Homo Sapiens
GCKIWVQGD

SEQ ID NO: 259405 - protein, 9 aa, Homo Sapiens
DPEKCLGFR

SEQ ID NO: 259406 - protein, 9 aa, Homo Sapiens
ESRSKREQY

SEQ ID NO: 259407 - protein, 9 aa, Homo Sapiens
AFHPIEPVF

SEQ ID NO: 259408 - protein, 9 aa, Homo Sapiens
SSSVGMLVP

SEQ ID NO: 259409 - protein, 9 aa, Homo Sapiens
LAWITQGQP

SEQ ID NO: 259410 - protein, 9 aa, Homo Sapiens
SGDVPVMDE

SEQ ID NO: 259411 - protein, 9 aa, Homo Sapiens
RELTKSLEY

SEQ ID NO: 259412 - protein, 9 aa, Homo Sapiens
AYPGLPGEL

SEQ ID NO: 259413 - protein, 9 aa, Homo Sapiens
LAEKDRKFV

SEQ ID NO: 259414 - protein, 9 aa, Homo Sapiens
TLFFAHGRL

SEQ ID NO: 259415 - protein, 9 aa, Homo Sapiens
VIVRPDDWS

SEQ ID NO: 259416 - protein, 9 aa, Homo Sapiens
KGGQPWQQW

SEQ ID NO: 259417 - protein, 9 aa, Homo Sapiens
EPGGGPIGV

SEQ ID NO: 259418 - protein, 9 aa, Homo Sapiens
WEEIDRGSF

SEQ ID NO: 259419 - protein, 9 aa, Homo Sapiens
KRCRVYLEE

SEQ ID NO: 259420 - protein, 9 aa, Homo Sapiens
GTQPHSCIF

SEQ ID NO: 259421 - protein, 9 aa, Homo Sapiens
QNMGICKRR

SEQ ID NO: 259422 - protein, 9 aa, Homo Sapiens
EVEAIALAA

SEQ ID NO: 259423 - protein, 9 aa, Homo Sapiens
LEGGTTSVS

SEQ ID NO: 259424 - protein, 9 aa, Homo Sapiens
WLATQTMNV

SEQ ID NO: 259425 - protein, 9 aa, Homo Sapiens
LQKKLYAKN

SEQ ID NO: 259426 - protein, 9 aa, Homo Sapiens
VETYPNGSQ

SEQ ID NO: 259427 - protein, 9 aa, Homo Sapiens
NPIFYGFLS

SEQ ID NO: 259428 - protein, 9 aa, Homo Sapiens
GRLLPQYMC

SEQ ID NO: 259429 - protein, 9 aa, Homo Sapiens
YNDLNQCLR

SEQ ID NO: 259430 - protein, 9 aa, Homo Sapiens
GSVLPCLGV

SEQ ID NO: 259431 - protein, 9 aa, Homo Sapiens
REGTETVAD

SEQ ID NO: 259432 - protein, 9 aa, Homo Sapiens
RSSSGSSKD

SEQ ID NO: 259433 - protein, 9 aa, Homo Sapiens
IMNKGVLMK

SEQ ID NO: 259434 - protein, 9 aa, Homo Sapiens
VAGVSLLLA

SEQ ID NO: 259435 - protein, 9 aa, Homo Sapiens
NRDGKLDFE

SEQ ID NO: 259436 - protein, 9 aa, Homo Sapiens
AKEKTQRGA

SEQ ID NO: 259437 - protein, 9 aa, Homo Sapiens
ACPQCQDFV

SEQ ID NO: 259438 - protein, 9 aa, Homo Sapiens
QFQARDIYY

SEQ ID NO: 259439 - protein, 9 aa, Homo Sapiens
ILVYCSLRL

SEQ ID NO: 259440 - protein, 9 aa, Homo Sapiens
KGTSLTTEN

SEQ ID NO: 259441 - protein, 9 aa, Homo Sapiens
VFLEAQKQQ

SEQ ID NO: 259442 - protein, 9 aa, Homo Sapiens
METRLFKLL

SEQ ID NO: 259443 - protein, 9 aa, Homo Sapiens
YLRTSTGRT

SEQ ID NO: 259444 - protein, 9 aa, Homo Sapiens
NTVGNDSCF

SEQ ID NO: 259445 - protein, 9 aa, Homo Sapiens
IDAATFISM

SEQ ID NO: 259446 - protein, 9 aa, Homo Sapiens
CPYSPAGRI

SEQ ID NO: 259447 - protein, 9 aa, Homo Sapiens
LCSYIAWYC

SEQ ID NO: 259448 - protein, 9 aa, Homo Sapiens
IQGLDVDTK

SEQ ID NO: 259449 - protein, 9 aa, Homo Sapiens
SPEVLQQNI

SEQ ID NO: 259450 - protein, 9 aa, Homo Sapiens
LPYGHTVTV

SEQ ID NO: 259451 - protein, 9 aa, Homo Sapiens
DHQNIAFGA

SEQ ID NO: 259452 - protein, 9 aa, Homo Sapiens
FTIILYFRV

SEQ ID NO: 259453 - protein, 9 aa, Homo Sapiens
NSIHFIILM

SEQ ID NO: 259454 - protein, 9 aa, Homo Sapiens
QVLILNYNL

SEQ ID NO: 259455 - protein, 9 aa, Homo Sapiens
AEKLIIHLW

SEQ ID NO: 259456 - protein, 9 aa, Homo Sapiens
TVYSISSLL

SEQ ID NO: 259457 - protein, 9 aa, Homo Sapiens
QLQCGYACC

SEQ ID NO: 259458 - protein, 9 aa, Homo Sapiens
VRQLLYNEF

SEQ ID NO: 259459 - protein, 9 aa, Homo Sapiens
RVDLENNQI

SEQ ID NO: 259460 - protein, 9 aa, Homo Sapiens
HQKPTPDLE

SEQ ID NO: 259461 - protein, 9 aa, Homo Sapiens
LDEGYGMSS

SEQ ID NO: 259462 - protein, 9 aa, Homo Sapiens
DRNDLSEDF

SEQ ID NO: 259463 - protein, 9 aa, Homo Sapiens
FPGNVETFI

SEQ ID NO: 259464 - protein, 9 aa, Homo Sapiens
VAATERECG

SEQ ID NO: 259465 - protein, 9 aa, Homo Sapiens
ILTYRGVKE

SEQ ID NO: 259466 - protein, 9 aa, Homo Sapiens
DVTPITQGV

SEQ ID NO: 259467 - protein, 9 aa, Homo Sapiens
KEDRARWQE

SEQ ID NO: 259468 - protein, 9 aa, Homo Sapiens
SLILKTTLF

SEQ ID NO: 259469 - protein, 9 aa, Homo Sapiens
LYAELQRAE

SEQ ID NO: 259470 - protein, 9 aa, Homo Sapiens
KNTLYDQHL

SEQ ID NO: 259471 - protein, 9 aa, Homo Sapiens
YLNHFSGVI

SEQ ID NO: 259472 - protein, 9 aa, Homo Sapiens
YPSVAVVQP

SEQ ID NO: 259473 - protein, 9 aa, Homo Sapiens
QHHRYLSHL

SEQ ID NO: 259474 - protein, 9 aa, Homo Sapiens
EDEDDEFLK

SEQ ID NO: 259475 - protein, 9 aa, Homo Sapiens
TSKLLFKKN

SEQ ID NO: 259476 - protein, 9 aa, Homo Sapiens
IQRTLNQFG

SEQ ID NO: 259477 - protein, 9 aa, Homo Sapiens
EERKGIPVR

SEQ ID NO: 259478 - protein, 9 aa, Homo Sapiens
LPQCSLTEL

SEQ ID NO: 259479 - protein, 9 aa, Homo Sapiens
YPHVRISPT

SEQ ID NO: 259480 - protein, 9 aa, Homo Sapiens
IKDFQGCMR

SEQ ID NO: 259481 - protein, 9 aa, Homo Sapiens
LDKSLGEKA

SEQ ID NO: 259482 - protein, 9 aa, Homo Sapiens
TCINSTWDA

SEQ ID NO: 259483 - protein, 9 aa, Homo Sapiens
TRMGDKAQQ

SEQ ID NO: 259484 - protein, 9 aa, Homo Sapiens
SSFLDYKNE

SEQ ID NO: 259485 - protein, 9 aa, Homo Sapiens
IKQGEGYIL

SEQ ID NO: 259486 - protein, 9 aa, Homo Sapiens
NQTSAVLQD

SEQ ID NO: 259487 - protein, 9 aa, Homo Sapiens
QNVLRKHKD

SEQ ID NO: 259488 - protein, 9 aa, Homo Sapiens
SKKIRQPID

SEQ ID NO: 259489 - protein, 9 aa, Homo Sapiens
AYSGHYIAR

SEQ ID NO: 259490 - protein, 9 aa, Homo Sapiens
LAKDFKDIT

SEQ ID NO: 259491 - protein, 9 aa, Homo Sapiens
ISSISLATA

SEQ ID NO: 259492 - protein, 9 aa, Homo Sapiens
CNSFLTLKT

SEQ ID NO: 259493 - protein, 9 aa, Homo Sapiens
LCSTPLSQA

SEQ ID NO: 259494 - protein, 9 aa, Homo Sapiens
LGRTLHQSG

SEQ ID NO: 259495 - protein, 9 aa, Homo Sapiens
MDEILLEKL

SEQ ID NO: 259496 - protein, 9 aa, Homo Sapiens
VKSGGRISL

SEQ ID NO: 259497 - protein, 9 aa, Homo Sapiens
GQLNTQEND

SEQ ID NO: 259498 - protein, 9 aa, Homo Sapiens
PQSIDLLTN

SEQ ID NO: 259499 - protein, 9 aa, Homo Sapiens
ELEASVKNV

SEQ ID NO: 259500 - protein, 9 aa, Homo Sapiens
ETLLETQKV

SEQ ID NO: 259501 - protein, 9 aa, Homo Sapiens
HFGAFTIKA

SEQ ID NO: 259502 - protein, 9 aa, Homo Sapiens
DLSIVKIWF

SEQ ID NO: 259503 - protein, 9 aa, Homo Sapiens
PGVDGCNQV

SEQ ID NO: 259504 - protein, 9 aa, Homo Sapiens
QTETHKSVP

SEQ ID NO: 259505 - protein, 9 aa, Homo Sapiens
ETLKETTHS

SEQ ID NO: 259506 - protein, 9 aa, Homo Sapiens
QRHASYHIG

SEQ ID NO: 259507 - protein, 9 aa, Homo Sapiens
CFKVITKDS

SEQ ID NO: 259508 - protein, 9 aa, Homo Sapiens
ALPFMLADF

SEQ ID NO: 259509 - protein, 9 aa, Homo Sapiens
TDQLEQLKK

SEQ ID NO: 259510 - protein, 9 aa, Homo Sapiens
FLAAQVQRR

SEQ ID NO: 259511 - protein, 9 aa, Homo Sapiens
VIHAKEEKS

SEQ ID NO: 259512 - protein, 9 aa, Homo Sapiens
NISYFWLDG

SEQ ID NO: 259513 - protein, 9 aa, Homo Sapiens
SSAAFAGSI

SEQ ID NO: 259514 - protein, 9 aa, Homo Sapiens
LICFDSSRP

SEQ ID NO: 259515 - protein, 9 aa, Homo Sapiens
FFTTSLLSN

SEQ ID NO: 259516 - protein, 9 aa, Homo Sapiens
KATTLIQDE

SEQ ID NO: 259517 - protein, 9 aa, Homo Sapiens
DDLTLCKAG

SEQ ID NO: 259518 - protein, 9 aa, Homo Sapiens
DYLFEIVQI

SEQ ID NO: 259519 - protein, 9 aa, Homo Sapiens
FFVLMTSYL

SEQ ID NO: 259520 - protein, 9 aa, Homo Sapiens
KKRREITDK

SEQ ID NO: 259521 - protein, 9 aa, Homo Sapiens
SPVELDLLG

SEQ ID NO: 259522 - protein, 9 aa, Homo Sapiens
ARRIGKDCG

SEQ ID NO: 259523 - protein, 9 aa, Homo Sapiens
QVAESVKYQ

SEQ ID NO: 259524 - protein, 9 aa, Homo Sapiens
AAKSKYSTP

SEQ ID NO: 259525 - protein, 9 aa, Homo Sapiens
EVNIFPQKK

SEQ ID NO: 259526 - protein, 9 aa, Homo Sapiens
LFMGNSFGS

SEQ ID NO: 259527 - protein, 9 aa, Homo Sapiens
MCVRPAQNH

SEQ ID NO: 259528 - protein, 9 aa, Homo Sapiens
WLRYNSGII

SEQ ID NO: 259529 - protein, 9 aa, Homo Sapiens
EAQNIRKDT

SEQ ID NO: 259530 - protein, 9 aa, Homo Sapiens
LSSQIRSNP

SEQ ID NO: 259531 - protein, 9 aa, Homo Sapiens
KSTWLHNIK

SEQ ID NO: 259532 - protein, 9 aa, Homo Sapiens
PHIVNNACG

SEQ ID NO: 259533 - protein, 9 aa, Homo Sapiens
DINGNHDAF

SEQ ID NO: 259534 - protein, 9 aa, Homo Sapiens
NNVNEYAPV

SEQ ID NO: 259535 - protein, 9 aa, Homo Sapiens
KDNEDYNDV

SEQ ID NO: 259536 - protein, 9 aa, Homo Sapiens
IGKTLYYFW

SEQ ID NO: 259537 - protein, 9 aa, Homo Sapiens
QKHWAKIIK

SEQ ID NO: 259538 - protein, 9 aa, Homo Sapiens
QFVRVLGRI

SEQ ID NO: 259539 - protein, 9 aa, Homo Sapiens
QELVERLER

SEQ ID NO: 259540 - protein, 9 aa, Homo Sapiens
TESMENGAL

SEQ ID NO: 259541 - protein, 9 aa, Homo Sapiens
RTLASYKRI

SEQ ID NO: 259542 - protein, 9 aa, Homo Sapiens
TCVDGKEFR

SEQ ID NO: 259543 - protein, 9 aa, Homo Sapiens
EQEANMWRQ

SEQ ID NO: 259544 - protein, 9 aa, Homo Sapiens
TTIPAVAGH

SEQ ID NO: 259545 - protein, 9 aa, Homo Sapiens
EKPKLTFSC

SEQ ID NO: 259546 - protein, 9 aa, Homo Sapiens
NALHVPQDG

SEQ ID NO: 259547 - protein, 9 aa, Homo Sapiens
PDSANPVAL

SEQ ID NO: 259548 - protein, 9 aa, Homo Sapiens
CGSSKGHDT

SEQ ID NO: 259549 - protein, 9 aa, Homo Sapiens
EISSQPKEL

SEQ ID NO: 259550 - protein, 9 aa, Homo Sapiens
NINRIRLQW

SEQ ID NO: 259551 - protein, 9 aa, Homo Sapiens
WDKCVKRKV

SEQ ID NO: 259552 - protein, 9 aa, Homo Sapiens
KKKGTSAFL

SEQ ID NO: 259553 - protein, 9 aa, Homo Sapiens
VYICLDFIE

SEQ ID NO: 259554 - protein, 9 aa, Homo Sapiens
GSRCQCTLD

SEQ ID NO: 259555 - protein, 9 aa, Homo Sapiens
YVVRFITRF

SEQ ID NO: 259556 - protein, 9 aa, Homo Sapiens
KTAKGAEIK

SEQ ID NO: 259557 - protein, 9 aa, Homo Sapiens
NINITKHLL

SEQ ID NO: 259558 - protein, 9 aa, Homo Sapiens
TLNPDCVRK

SEQ ID NO: 259559 - protein, 9 aa, Homo Sapiens
MIRYFTLNP

SEQ ID NO: 259560 - protein, 9 aa, Homo Sapiens
ASDLKTLLM

SEQ ID NO: 259561 - protein, 9 aa, Homo Sapiens
VTADSLPPS

SEQ ID NO: 259562 - protein, 9 aa, Homo Sapiens
VSLTSLYGF

SEQ ID NO: 259563 - protein, 9 aa, Homo Sapiens
NLLHQHHEL

SEQ ID NO: 259564 - protein, 9 aa, Homo Sapiens
HKLPKYGVK

SEQ ID NO: 259565 - protein, 9 aa, Homo Sapiens
VTKDILKLN

SEQ ID NO: 259566 - protein, 9 aa, Homo Sapiens
APPLALPVC

SEQ ID NO: 259567 - protein, 9 aa, Homo Sapiens
TPCPASTHD

SEQ ID NO: 259568 - protein, 9 aa, Homo Sapiens
EQRELVAQA

SEQ ID NO: 259569 - protein, 9 aa, Homo Sapiens
LEQEVAWQG

SEQ ID NO: 259570 - protein, 9 aa, Homo Sapiens
CIAHCKSNF

SEQ ID NO: 259571 - protein, 9 aa, Homo Sapiens
SSCCVPIYC

SEQ ID NO: 259572 - protein, 9 aa, Homo Sapiens
FIFKDKERT

SEQ ID NO: 259573 - protein, 9 aa, Homo Sapiens
CKNLSSLKL

SEQ ID NO: 259574 - protein, 9 aa, Homo Sapiens
FRAKEYESV

SEQ ID NO: 259575 - protein, 9 aa, Homo Sapiens
TNSASQVVG

SEQ ID NO: 259576 - protein, 9 aa, Homo Sapiens
ACPHRCACY

SEQ ID NO: 259577 - protein, 9 aa, Homo Sapiens
HSKSIQWLT

SEQ ID NO: 259578 - protein, 9 aa, Homo Sapiens
CGTIVVAAS

SEQ ID NO: 259579 - protein, 9 aa, Homo Sapiens
GTGATNTKK

SEQ ID NO: 259580 - protein, 9 aa, Homo Sapiens
SEINYLWRE

SEQ ID NO: 259581 - protein, 9 aa, Homo Sapiens
RRYNINYQI

SEQ ID NO: 259582 - protein, 9 aa, Homo Sapiens
SKPLEDIKA

SEQ ID NO: 259583 - protein, 9 aa, Homo Sapiens
TNKLSARDH

SEQ ID NO: 259584 - protein, 9 aa, Homo Sapiens
RCSENPEQI

SEQ ID NO: 259585 - protein, 9 aa, Homo Sapiens
GTSQDKAIT

SEQ ID NO: 259586 - protein, 9 aa, Homo Sapiens
KELQDAATY

SEQ ID NO: 259587 - protein, 9 aa, Homo Sapiens
SLVFQLKRR

SEQ ID NO: 259588 - protein, 9 aa, Homo Sapiens
QMPDLRAEE

SEQ ID NO: 259589 - protein, 9 aa, Homo Sapiens
QEKQIKAKI

SEQ ID NO: 259590 - protein, 9 aa, Homo Sapiens
DLWTQGKNT

SEQ ID NO: 259591 - protein, 9 aa, Homo Sapiens
LQLYPDNSE

SEQ ID NO: 259592 - protein, 9 aa, Homo Sapiens
RLSPYFYEE

SEQ ID NO: 259593 - protein, 9 aa, Homo Sapiens
LQVLILNYN

SEQ ID NO: 259594 - protein, 9 aa, Homo Sapiens
RIFERLRLK

SEQ ID NO: 259595 - protein, 9 aa, Homo Sapiens
EHEKIHTEE

SEQ ID NO: 259596 - protein, 9 aa, Homo Sapiens
DCRSPFIAS

SEQ ID NO: 259597 - protein, 9 aa, Homo Sapiens
KHEQIYTYV

SEQ ID NO: 259598 - protein, 9 aa, Homo Sapiens
AYHVARITG

SEQ ID NO: 259599 - protein, 9 aa, Homo Sapiens
ELSNRRSTP

SEQ ID NO: 259600 - protein, 9 aa, Homo Sapiens
LRGATQHIL

SEQ ID NO: 259601 - protein, 9 aa, Homo Sapiens
NANASRFSQ

SEQ ID NO: 259602 - protein, 9 aa, Homo Sapiens
NRRMKWKKY

SEQ ID NO: 259603 - protein, 9 aa, Homo Sapiens
QLEGIFFSC

SEQ ID NO: 259604 - protein, 9 aa, Homo Sapiens
QLNTQENDI

SEQ ID NO: 259605 - protein, 9 aa, Homo Sapiens
GISGTTAIN

SEQ ID NO: 259606 - protein, 9 aa, Homo Sapiens
AVCCENDID

SEQ ID NO: 259607 - protein, 9 aa, Homo Sapiens
KAHVDLFPK

SEQ ID NO: 259608 - protein, 9 aa, Homo Sapiens
VVLSESMND

SEQ ID NO: 259609 - protein, 9 aa, Homo Sapiens
CIQWIVTFI

SEQ ID NO: 259610 - protein, 9 aa, Homo Sapiens
VPVYVQFIH

SEQ ID NO: 259611 - protein, 9 aa, Homo Sapiens
AQDDAEKLG

SEQ ID NO: 259612 - protein, 9 aa, Homo Sapiens
SFNDIHYFP

SEQ ID NO: 259613 - protein, 9 aa, Homo Sapiens
LTVFREDLV

SEQ ID NO: 259614 - protein, 9 aa, Homo Sapiens
NIYLHLALV

SEQ ID NO: 259615 - protein, 9 aa, Homo Sapiens
MRLFSEPVT

SEQ ID NO: 259616 - protein, 9 aa, Homo Sapiens
PMAHPGTAA

SEQ ID NO: 259617 - protein, 9 aa, Homo Sapiens
QQFMDRTHY

SEQ ID NO: 259618 - protein, 9 aa, Homo Sapiens
FVILGFSSF

SEQ ID NO: 259619 - protein, 9 aa, Homo Sapiens
LEQLEYGGC

SEQ ID NO: 259620 - protein, 9 aa, Homo Sapiens
QSLTEEKTM

SEQ ID NO: 259621 - protein, 9 aa, Homo Sapiens
FENNIYYGA

SEQ ID NO: 259622 - protein, 9 aa, Homo Sapiens
SVAISVASY

SEQ ID NO: 259623 - protein, 9 aa, Homo Sapiens
SEMDLRCVE

SEQ ID NO: 259624 - protein, 9 aa, Homo Sapiens
PKETEHLFI

SEQ ID NO: 259625 - protein, 9 aa, Homo Sapiens
SKLAECIRW

SEQ ID NO: 259626 - protein, 9 aa, Homo Sapiens
QSLPKKVYL

SEQ ID NO: 259627 - protein, 9 aa, Homo Sapiens
KKLLESDDD

SEQ ID NO: 259628 - protein, 9 aa, Homo Sapiens
ACERALQYT

SEQ ID NO: 259629 - protein, 9 aa, Homo Sapiens
GNYQKAVKL

SEQ ID NO: 259630 - protein, 9 aa, Homo Sapiens
YVKTRSSWK

SEQ ID NO: 259631 - protein, 9 aa, Homo Sapiens
VDDGIDLNQ

SEQ ID NO: 259632 - protein, 9 aa, Homo Sapiens
EGVFKRKKE

SEQ ID NO: 259633 - protein, 9 aa, Homo Sapiens
SFDPSKTED

SEQ ID NO: 259634 - protein, 9 aa, Homo Sapiens
CVLTSILYI

SEQ ID NO: 259635 - protein, 9 aa, Homo Sapiens
TASTQYTTA

SEQ ID NO: 259636 - protein, 9 aa, Homo Sapiens
IQSLGMDID

SEQ ID NO: 259637 - protein, 9 aa, Homo Sapiens
PGCSLIHIN

SEQ ID NO: 259638 - protein, 9 aa, Homo Sapiens
LLKAKWLTS

SEQ ID NO: 259639 - protein, 9 aa, Homo Sapiens
LNPQVLQKK

SEQ ID NO: 259640 - protein, 9 aa, Homo Sapiens
EEEGEGGSG

SEQ ID NO: 259641 - protein, 9 aa, Homo Sapiens
GEDKFQWLG

SEQ ID NO: 259642 - protein, 9 aa, Homo Sapiens
RKGDKFVLK

SEQ ID NO: 259643 - protein, 9 aa, Homo Sapiens
FCYRWLLLD

SEQ ID NO: 259644 - protein, 9 aa, Homo Sapiens
QATDFQFGR

SEQ ID NO: 259645 - protein, 9 aa, Homo Sapiens
IEDLKAKKK

SEQ ID NO: 259646 - protein, 9 aa, Homo Sapiens
CKAVQETMQ

SEQ ID NO: 259647 - protein, 9 aa, Homo Sapiens
ATVTLDQVW

SEQ ID NO: 259648 - protein, 9 aa, Homo Sapiens
AFRMRSKMP

SEQ ID NO: 259649 - protein, 9 aa, Homo Sapiens
SLSQDSSSS

SEQ ID NO: 259650 - protein, 9 aa, Homo Sapiens
MKDFSSTAQ

SEQ ID NO: 259651 - protein, 9 aa, Homo Sapiens
QLSQPEVYV

SEQ ID NO: 259652 - protein, 9 aa, Homo Sapiens
FFTSGSLLL

SEQ ID NO: 259653 - protein, 9 aa, Homo Sapiens
KTINYAGLG

SEQ ID NO: 259654 - protein, 9 aa, Homo Sapiens
GFFCDCWPY

SEQ ID NO: 259655 - protein, 9 aa, Homo Sapiens
LSCDDIRSL

SEQ ID NO: 259656 - protein, 9 aa, Homo Sapiens
TPSLDEDGL

SEQ ID NO: 259657 - protein, 9 aa, Homo Sapiens
VQFIYPHIE

SEQ ID NO: 259658 - protein, 9 aa, Homo Sapiens
QHFCGRRNK

SEQ ID NO: 259659 - protein, 9 aa, Homo Sapiens
NHKLAEMLD

SEQ ID NO: 259660 - protein, 9 aa, Homo Sapiens
VTFAKKGEL

SEQ ID NO: 259661 - protein, 9 aa, Homo Sapiens
LSNINNHTG

SEQ ID NO: 259662 - protein, 9 aa, Homo Sapiens
AQPSPFLPV

SEQ ID NO: 259663 - protein, 9 aa, Homo Sapiens
SLWSRVWQL

SEQ ID NO: 259664 - protein, 9 aa, Homo Sapiens
ATGPRTESK

SEQ ID NO: 259665 - protein, 9 aa, Homo Sapiens
DKAFNRLSY

SEQ ID NO: 259666 - protein, 9 aa, Homo Sapiens
DWLAKLYRN

SEQ ID NO: 259667 - protein, 9 aa, Homo Sapiens
QLLFNTTKS

SEQ ID NO: 259668 - protein, 9 aa, Homo Sapiens
VTTNPHLRI

SEQ ID NO: 259669 - protein, 9 aa, Homo Sapiens
TFKQRKGES

SEQ ID NO: 259670 - protein, 9 aa, Homo Sapiens
CMPPPSADM

SEQ ID NO: 259671 - protein, 9 aa, Homo Sapiens
PLHLEYRFY

SEQ ID NO: 259672 - protein, 9 aa, Homo Sapiens
HPIEPVFIT

SEQ ID NO: 259673 - protein, 9 aa, Homo Sapiens
APATKRLFD

SEQ ID NO: 259674 - protein, 9 aa, Homo Sapiens
SPGSNKLVV

SEQ ID NO: 259675 - protein, 9 aa, Homo Sapiens
SVKKNNDNL

SEQ ID NO: 259676 - protein, 9 aa, Homo Sapiens
FVDDNEVYS

SEQ ID NO: 259677 - protein, 9 aa, Homo Sapiens
KTMEFGKTN

SEQ ID NO: 259678 - protein, 9 aa, Homo Sapiens
VNDKVSENF

SEQ ID NO: 259679 - protein, 9 aa, Homo Sapiens
FKESTCINS

SEQ ID NO: 259680 - protein, 9 aa, Homo Sapiens
DEKFMLLIE

SEQ ID NO: 259681 - protein, 9 aa, Homo Sapiens
NSKVFDGTS

SEQ ID NO: 259682 - protein, 9 aa, Homo Sapiens
LHVNDDLNT

SEQ ID NO: 259683 - protein, 9 aa, Homo Sapiens
NITGNPYYI

SEQ ID NO: 259684 - protein, 9 aa, Homo Sapiens
TNNVNNSFT

SEQ ID NO: 259685 - protein, 9 aa, Homo Sapiens
WDWQKTAKG

SEQ ID NO: 259686 - protein, 9 aa, Homo Sapiens
EEKPFKCNE

SEQ ID NO: 259687 - protein, 9 aa, Homo Sapiens
IRSRLINTF

SEQ ID NO: 259688 - protein, 9 aa, Homo Sapiens
TLLHATLDI

SEQ ID NO: 259689 - protein, 9 aa, Homo Sapiens
EERKWQEEE

SEQ ID NO: 259690 - protein, 9 aa, Homo Sapiens
ATVGGQVIK

SEQ ID NO: 259691 - protein, 9 aa, Homo Sapiens
VTSLNSTLQ

SEQ ID NO: 259692 - protein, 9 aa, Homo Sapiens
TLPQCSLTE

SEQ ID NO: 259693 - protein, 9 aa, Homo Sapiens
FFVELTMLY

SEQ ID NO: 259694 - protein, 9 aa, Homo Sapiens
SLEFYYSEL

SEQ ID NO: 259695 - protein, 9 aa, Homo Sapiens
TNNCPGAEV

SEQ ID NO: 259696 - protein, 9 aa, Homo Sapiens
MENEYLDVL

SEQ ID NO: 259697 - protein, 9 aa, Homo Sapiens
NNVFGSKNT

SEQ ID NO: 259698 - protein, 9 aa, Homo Sapiens
ELCGLPRDK

SEQ ID NO: 259699 - protein, 9 aa, Homo Sapiens
LFNRRRKRS

SEQ ID NO: 259700 - protein, 9 aa, Homo Sapiens
SIALSPRLE

SEQ ID NO: 259701 - protein, 9 aa, Homo Sapiens
LTGISMHGK

SEQ ID NO: 259702 - protein, 9 aa, Homo Sapiens
PPPPLAPSK

SEQ ID NO: 259703 - protein, 9 aa, Homo Sapiens
HVGSDDEGL

SEQ ID NO: 259704 - protein, 9 aa, Homo Sapiens
YFPDEKDSY

SEQ ID NO: 259705 - protein, 9 aa, Homo Sapiens
LRLTCCFCI

SEQ ID NO: 259706 - protein, 9 aa, Homo Sapiens
PTSDPVMLP

SEQ ID NO: 259707 - protein, 9 aa, Homo Sapiens
ATSIDGMEI

SEQ ID NO: 259708 - protein, 9 aa, Homo Sapiens
CGLEGNGID

SEQ ID NO: 259709 - protein, 9 aa, Homo Sapiens
SAFQSPVPC

SEQ ID NO: 259710 - protein, 9 aa, Homo Sapiens
NPNPSHHMT

SEQ ID NO: 259711 - protein, 9 aa, Homo Sapiens
IKHIPSDGH

SEQ ID NO: 259712 - protein, 9 aa, Homo Sapiens
EIIADVDDL

SEQ ID NO: 259713 - protein, 9 aa, Homo Sapiens
DFAVDKRVQ

SEQ ID NO: 259714 - protein, 9 aa, Homo Sapiens
LEILQTEDV

SEQ ID NO: 259715 - protein, 9 aa, Homo Sapiens
RHPGGRGGN

SEQ ID NO: 259716 - protein, 9 aa, Homo Sapiens
IFQAALKNY

SEQ ID NO: 259717 - protein, 9 aa, Homo Sapiens
SNVIKKVKC

SEQ ID NO: 259718 - protein, 9 aa, Homo Sapiens
FGEYMDDER

SEQ ID NO: 259719 - protein, 9 aa, Homo Sapiens
KLAVQMDKP

SEQ ID NO: 259720 - protein, 9 aa, Homo Sapiens
MNENLEISD

SEQ ID NO: 259721 - protein, 9 aa, Homo Sapiens
TTPSLPLFT

SEQ ID NO: 259722 - protein, 9 aa, Homo Sapiens
SVTNYIYVT

SEQ ID NO: 259723 - protein, 9 aa, Homo Sapiens
KGSNNSSEI

SEQ ID NO: 259724 - protein, 9 aa, Homo Sapiens
VAIKRINLD

SEQ ID NO: 259725 - protein, 9 aa, Homo Sapiens
LNQFGTPQD

SEQ ID NO: 259726 - protein, 9 aa, Homo Sapiens
TESHLFLTD

SEQ ID NO: 259727 - protein, 9 aa, Homo Sapiens
YIGEKTFSF

SEQ ID NO: 259728 - protein, 9 aa, Homo Sapiens
NSLLNRYAV

SEQ ID NO: 259729 - protein, 9 aa, Homo Sapiens
DGLMLKFAI

SEQ ID NO: 259730 - protein, 9 aa, Homo Sapiens
AISEAGPAH

SEQ ID NO: 259731 - protein, 9 aa, Homo Sapiens
QDLEIKRKC

SEQ ID NO: 259732 - protein, 9 aa, Homo Sapiens
VNIRKNQAT

SEQ ID NO: 259733 - protein, 9 aa, Homo Sapiens
NTNKLSARD

SEQ ID NO: 259734 - protein, 9 aa, Homo Sapiens
NLGCINAEY

SEQ ID NO: 259735 - protein, 9 aa, Homo Sapiens
DDPIRLLGL

SEQ ID NO: 259736 - protein, 9 aa, Homo Sapiens
NNMKMIELH

SEQ ID NO: 259737 - protein, 9 aa, Homo Sapiens
MWDKGGQPW

SEQ ID NO: 259738 - protein, 9 aa, Homo Sapiens
SFPHNGPSG

SEQ ID NO: 259739 - protein, 9 aa, Homo Sapiens
NMHTCPRWI

SEQ ID NO: 259740 - protein, 9 aa, Homo Sapiens
NPLAKSHPL

SEQ ID NO: 259741 - protein, 9 aa, Homo Sapiens
VHLTNVALQ

SEQ ID NO: 259742 - protein, 9 aa, Homo Sapiens
FMFPPSYVP

SEQ ID NO: 259743 - protein, 9 aa, Homo Sapiens
MDTESHLFL

SEQ ID NO: 259744 - protein, 9 aa, Homo Sapiens
AIGLDPYCG

SEQ ID NO: 259745 - protein, 9 aa, Homo Sapiens
FIRAPQMNI

SEQ ID NO: 259746 - protein, 9 aa, Homo Sapiens
ANDAPHFLE

SEQ ID NO: 259747 - protein, 9 aa, Homo Sapiens
DSKMQPDEV

SEQ ID NO: 259748 - protein, 9 aa, Homo Sapiens
HENLLESRL

SEQ ID NO: 259749 - protein, 9 aa, Homo Sapiens
NVGKKQKTD

SEQ ID NO: 259750 - protein, 9 aa, Homo Sapiens
SLLSDSRLH

SEQ ID NO: 259751 - protein, 9 aa, Homo Sapiens
LPDSQYCTY

SEQ ID NO: 259752 - protein, 9 aa, Homo Sapiens
DRIKDVKRH

SEQ ID NO: 259753 - protein, 9 aa, Homo Sapiens
ETQLRLVAL

SEQ ID NO: 259754 - protein, 9 aa, Homo Sapiens
VFEMVVNAA

SEQ ID NO: 259755 - protein, 9 aa, Homo Sapiens
SARDCHESG

SEQ ID NO: 259756 - protein, 9 aa, Homo Sapiens
WHQLQVIQG

SEQ ID NO: 259757 - protein, 9 aa, Homo Sapiens
FLLILISDG

SEQ ID NO: 259758 - protein, 9 aa, Homo Sapiens
STESLGLHS

SEQ ID NO: 259759 - protein, 9 aa, Homo Sapiens
LPSTDSCDR

SEQ ID NO: 259760 - protein, 9 aa, Homo Sapiens
VIGKRGSDS

SEQ ID NO: 259761 - protein, 9 aa, Homo Sapiens
ALDEGRQKV

SEQ ID NO: 259762 - protein, 9 aa, Homo Sapiens
RIVDEVMGC

SEQ ID NO: 259763 - protein, 9 aa, Homo Sapiens
DKRHLRKAR

SEQ ID NO: 259764 - protein, 9 aa, Homo Sapiens
RIGPRFGDA

SEQ ID NO: 259765 - protein, 9 aa, Homo Sapiens
EMNTEAEKV

SEQ ID NO: 259766 - protein, 9 aa, Homo Sapiens
LRFFFHLGV

SEQ ID NO: 259767 - protein, 9 aa, Homo Sapiens
TVCGTPTYM

SEQ ID NO: 259768 - protein, 9 aa, Homo Sapiens
VAPEEVTKY

SEQ ID NO: 259769 - protein, 9 aa, Homo Sapiens
QHIPLTVDH

SEQ ID NO: 259770 - protein, 9 aa, Homo Sapiens
LNCNLFIFM

SEQ ID NO: 259771 - protein, 9 aa, Homo Sapiens
SGSTGGGGG

SEQ ID NO: 259772 - protein, 9 aa, Homo Sapiens
KRQGYIHKL

SEQ ID NO: 259773 - protein, 9 aa, Homo Sapiens
VGIFILTVS

SEQ ID NO: 259774 - protein, 9 aa, Homo Sapiens
IMVARISDP

SEQ ID NO: 259775 - protein, 9 aa, Homo Sapiens
FNETEIEVS

SEQ ID NO: 259776 - protein, 9 aa, Homo Sapiens
PRRKKWCHG

SEQ ID NO: 259777 - protein, 9 aa, Homo Sapiens
HQSLVAQQE

SEQ ID NO: 259778 - protein, 9 aa, Homo Sapiens
YVGRDKKLG

SEQ ID NO: 259779 - protein, 9 aa, Homo Sapiens
TGAGSNGLQ

SEQ ID NO: 259780 - protein, 9 aa, Homo Sapiens
IRAGWLDKN

SEQ ID NO: 259781 - protein, 9 aa, Homo Sapiens
GHEPERTNK

SEQ ID NO: 259782 - protein, 9 aa, Homo Sapiens
GIGLGSIAS

SEQ ID NO: 259783 - protein, 9 aa, Homo Sapiens
KSIISAWNN

SEQ ID NO: 259784 - protein, 9 aa, Homo Sapiens
IFILTVSRP

SEQ ID NO: 259785 - protein, 9 aa, Homo Sapiens
RVEANPRDL

SEQ ID NO: 259786 - protein, 9 aa, Homo Sapiens
SVLQCRRIE

SEQ ID NO: 259787 - protein, 9 aa, Homo Sapiens
VVHAKEKFL

SEQ ID NO: 259788 - protein, 9 aa, Homo Sapiens
LLQSIQAVP

SEQ ID NO: 259789 - protein, 9 aa, Homo Sapiens
DVGRVRYML

SEQ ID NO: 259790 - protein, 9 aa, Homo Sapiens
FLMTCISLQ

SEQ ID NO: 259791 - protein, 9 aa, Homo Sapiens
TGVEFTKHL

SEQ ID NO: 259792 - protein, 9 aa, Homo Sapiens
SGQLSLIFV

SEQ ID NO: 259793 - protein, 9 aa, Homo Sapiens
IPYLVAGTP

SEQ ID NO: 259794 - protein, 9 aa, Homo Sapiens
GSALFNMVP

SEQ ID NO: 259795 - protein, 9 aa, Homo Sapiens
DIKGSVLNS

SEQ ID NO: 259796 - protein, 9 aa, Homo Sapiens
ELGPGHAGA

SEQ ID NO: 259797 - protein, 9 aa, Homo Sapiens
RYNINYQIK

SEQ ID NO: 259798 - protein, 9 aa, Homo Sapiens
RHTGERPYT

SEQ ID NO: 259799 - protein, 9 aa, Homo Sapiens
QNNYFNILD

SEQ ID NO: 259800 - protein, 9 aa, Homo Sapiens
VLVIPMIGP

SEQ ID NO: 259801 - protein, 9 aa, Homo Sapiens
SPIDAEDNY

SEQ ID NO: 259802 - protein, 9 aa, Homo Sapiens
AEIIKEAQK

SEQ ID NO: 259803 - protein, 9 aa, Homo Sapiens
VKTPNTEMR

SEQ ID NO: 259804 - protein, 9 aa, Homo Sapiens
DFLRFQGIS

SEQ ID NO: 259805 - protein, 9 aa, Homo Sapiens
LSGSKSMSM

SEQ ID NO: 259806 - protein, 9 aa, Homo Sapiens
GITEMFIKD

SEQ ID NO: 259807 - protein, 9 aa, Homo Sapiens
APRTWIFPA

SEQ ID NO: 259808 - protein, 9 aa, Homo Sapiens
KRKYLEDVT

SEQ ID NO: 259809 - protein, 9 aa, Homo Sapiens
ISRTETIIQ

SEQ ID NO: 259810 - protein, 9 aa, Homo Sapiens
QKQQMDIEN

SEQ ID NO: 259811 - protein, 9 aa, Homo Sapiens
VSTIKPRII

SEQ ID NO: 259812 - protein, 9 aa, Homo Sapiens
GVIPRIVQD

SEQ ID NO: 259813 - protein, 9 aa, Homo Sapiens
PDTKVNFYD

SEQ ID NO: 259814 - protein, 9 aa, Homo Sapiens
VIGSLKGNI

SEQ ID NO: 259815 - protein, 9 aa, Homo Sapiens
HSDIYLQNG

SEQ ID NO: 259816 - protein, 9 aa, Homo Sapiens
DPHLGTTST

SEQ ID NO: 259817 - protein, 9 aa, Homo Sapiens
SCNINITKH

SEQ ID NO: 259818 - protein, 9 aa, Homo Sapiens
AQHVESQQD

SEQ ID NO: 259819 - protein, 9 aa, Homo Sapiens
PVYLREAGV

SEQ ID NO: 259820 - protein, 9 aa, Homo Sapiens
KNMMISLSE

SEQ ID NO: 259821 - protein, 9 aa, Homo Sapiens
KLWMLELSA

SEQ ID NO: 259822 - protein, 9 aa, Homo Sapiens
VNDEIEANL

SEQ ID NO: 259823 - protein, 9 aa, Homo Sapiens
LILTVAQHS

SEQ ID NO: 259824 - protein, 9 aa, Homo Sapiens
PVALQCPIV

SEQ ID NO: 259825 - protein, 9 aa, Homo Sapiens
NKLSCLWIL

SEQ ID NO: 259826 - protein, 9 aa, Homo Sapiens
LTGSSKQMR

SEQ ID NO: 259827 - protein, 9 aa, Homo Sapiens
RTSMLSPNS

SEQ ID NO: 259828 - protein, 9 aa, Homo Sapiens
NGRPIYPNR

SEQ ID NO: 259829 - protein, 9 aa, Homo Sapiens
DLHDKLIMN

SEQ ID NO: 259830 - protein, 9 aa, Homo Sapiens
AFLTSKNCI

SEQ ID NO: 259831 - protein, 9 aa, Homo Sapiens
GIHFDPENP

SEQ ID NO: 259832 - protein, 9 aa, Homo Sapiens
RPCAAGDNK

SEQ ID NO: 259833 - protein, 9 aa, Homo Sapiens
LLYSDCGIG

SEQ ID NO: 259834 - protein, 9 aa, Homo Sapiens
KEKIQTVFE

SEQ ID NO: 259835 - protein, 9 aa, Homo Sapiens
LIAFEWLGE

SEQ ID NO: 259836 - protein, 9 aa, Homo Sapiens
GNILNGVRL

SEQ ID NO: 259837 - protein, 9 aa, Homo Sapiens
DVTFGKIRS

SEQ ID NO: 259838 - protein, 9 aa, Homo Sapiens
FCEDPNGIP

SEQ ID NO: 259839 - protein, 9 aa, Homo Sapiens
SSLHLHEII

SEQ ID NO: 259840 - protein, 9 aa, Homo Sapiens
EFYYSELYK

SEQ ID NO: 259841 - protein, 9 aa, Homo Sapiens
EADTETRPE

SEQ ID NO: 259842 - protein, 9 aa, Homo Sapiens
DSGENRKER

SEQ ID NO: 259843 - protein, 9 aa, Homo Sapiens
CGQDLNTTS

SEQ ID NO: 259844 - protein, 9 aa, Homo Sapiens
VKTRKCSLL

SEQ ID NO: 259845 - protein, 9 aa, Homo Sapiens
PVCPMSGVS

SEQ ID NO: 259846 - protein, 9 aa, Homo Sapiens
LTKEDTQDK

SEQ ID NO: 259847 - protein, 9 aa, Homo Sapiens
HLSQLLPQP

SEQ ID NO: 259848 - protein, 9 aa, Homo Sapiens
LGLPDYHRI

SEQ ID NO: 259849 - protein, 9 aa, Homo Sapiens
ALKGQDDYI

SEQ ID NO: 259850 - protein, 9 aa, Homo Sapiens
MKITCLEIY

SEQ ID NO: 259851 - protein, 9 aa, Homo Sapiens
QFINSKKAS

SEQ ID NO: 259852 - protein, 9 aa, Homo Sapiens
FFPVNYPTD

SEQ ID NO: 259853 - protein, 9 aa, Homo Sapiens
KGATKEALH

SEQ ID NO: 259854 - protein, 9 aa, Homo Sapiens
LSGKKRTQK

SEQ ID NO: 259855 - protein, 9 aa, Homo Sapiens
KVVKKRKTE

SEQ ID NO: 259856 - protein, 9 aa, Homo Sapiens
HFRSIPQQR

SEQ ID NO: 259857 - protein, 9 aa, Homo Sapiens
NNLLCLFCL

SEQ ID NO: 259858 - protein, 9 aa, Homo Sapiens
DPFQTDNLP

SEQ ID NO: 259859 - protein, 9 aa, Homo Sapiens
PNAEFKCEE

SEQ ID NO: 259860 - protein, 9 aa, Homo Sapiens
YKSAEEREQ

SEQ ID NO: 259861 - protein, 9 aa, Homo Sapiens
KYVADYYEQ

SEQ ID NO: 259862 - protein, 9 aa, Homo Sapiens
FASVQGFFL

SEQ ID NO: 259863 - protein, 9 aa, Homo Sapiens
LTGSLTGNT

SEQ ID NO: 259864 - protein, 9 aa, Homo Sapiens
IGHAINSYT

SEQ ID NO: 259865 - protein, 9 aa, Homo Sapiens
GNQEDAHDF

SEQ ID NO: 259866 - protein, 9 aa, Homo Sapiens
SVTKNETGP

SEQ ID NO: 259867 - protein, 9 aa, Homo Sapiens
AKEAQAARL

SEQ ID NO: 259868 - protein, 9 aa, Homo Sapiens
IDHHGNRHK

SEQ ID NO: 259869 - protein, 9 aa, Homo Sapiens
YIIHLGISL

SEQ ID NO: 259870 - protein, 9 aa, Homo Sapiens
KEFIKPEKF

SEQ ID NO: 259871 - protein, 9 aa, Homo Sapiens
LDRRNYPMA

SEQ ID NO: 259872 - protein, 9 aa, Homo Sapiens
TLVVIAVER

SEQ ID NO: 259873 - protein, 9 aa, Homo Sapiens
HGSFLAVSN

SEQ ID NO: 259874 - protein, 9 aa, Homo Sapiens
GDMIRKSGG

SEQ ID NO: 259875 - protein, 9 aa, Homo Sapiens
TVQKSKEMV

SEQ ID NO: 259876 - protein, 9 aa, Homo Sapiens
LKLQTRLEE

SEQ ID NO: 259877 - protein, 9 aa, Homo Sapiens
LPAKLLKKF

SEQ ID NO: 259878 - protein, 9 aa, Homo Sapiens
FENVTFTYH

SEQ ID NO: 259879 - protein, 9 aa, Homo Sapiens
MKRGEPDIY

SEQ ID NO: 259880 - protein, 9 aa, Homo Sapiens
SSLCDYIND

SEQ ID NO: 259881 - protein, 9 aa, Homo Sapiens
ILWNLLETS

SEQ ID NO: 259882 - protein, 9 aa, Homo Sapiens
IITLMLNHL

SEQ ID NO: 259883 - protein, 9 aa, Homo Sapiens
VPVTRICTT

SEQ ID NO: 259884 - protein, 9 aa, Homo Sapiens
LNMMKLLFD

SEQ ID NO: 259885 - protein, 9 aa, Homo Sapiens
EEPLNGEFY

SEQ ID NO: 259886 - protein, 9 aa, Homo Sapiens
AQINNLMSQ

SEQ ID NO: 259887 - protein, 9 aa, Homo Sapiens
CCCCTTLTA

SEQ ID NO: 259888 - protein, 9 aa, Homo Sapiens
PGTRTGPLM

SEQ ID NO: 259889 - protein, 9 aa, Homo Sapiens
ATGLNNGHI

SEQ ID NO: 259890 - protein, 9 aa, Homo Sapiens
KLHNKSSNE

SEQ ID NO: 259891 - protein, 9 aa, Homo Sapiens
LNANASRFS

SEQ ID NO: 259892 - protein, 9 aa, Homo Sapiens
CISVKDHRT

SEQ ID NO: 259893 - protein, 9 aa, Homo Sapiens
QRINVCNAP

SEQ ID NO: 259894 - protein, 9 aa, Homo Sapiens
CIKKGPQVT

SEQ ID NO: 259895 - protein, 9 aa, Homo Sapiens
TYTLDEKGG

SEQ ID NO: 259896 - protein, 9 aa, Homo Sapiens
CKYSYKGLW

SEQ ID NO: 259897 - protein, 9 aa, Homo Sapiens
TVICVTHRY

SEQ ID NO: 259898 - protein, 9 aa, Homo Sapiens
QTAIRSLNR

SEQ ID NO: 259899 - protein, 9 aa, Homo Sapiens
TSTCELVRT

SEQ ID NO: 259900 - protein, 9 aa, Homo Sapiens
DSSLPNITP

SEQ ID NO: 259901 - protein, 9 aa, Homo Sapiens
NKFKEQQPS

SEQ ID NO: 259902 - protein, 9 aa, Homo Sapiens
QLYDTQVIK

SEQ ID NO: 259903 - protein, 9 aa, Homo Sapiens
RLFEHGGFP

SEQ ID NO: 259904 - protein, 9 aa, Homo Sapiens
FLEAQKQQM

SEQ ID NO: 259905 - protein, 9 aa, Homo Sapiens
PQNELIPLI

SEQ ID NO: 259906 - protein, 9 aa, Homo Sapiens
KCKNKNKWY

SEQ ID NO: 259907 - protein, 9 aa, Homo Sapiens
GINRHQGKP

SEQ ID NO: 259908 - protein, 9 aa, Homo Sapiens
SENRKIILA

SEQ ID NO: 259909 - protein, 9 aa, Homo Sapiens
PYLEIRALL

SEQ ID NO: 259910 - protein, 9 aa, Homo Sapiens
FHWSALKGH

SEQ ID NO: 259911 - protein, 9 aa, Homo Sapiens
YWTILGLSH

SEQ ID NO: 259912 - protein, 9 aa, Homo Sapiens
KEKVIMVEL

SEQ ID NO: 259913 - protein, 9 aa, Homo Sapiens
QNECLFCVE

SEQ ID NO: 259914 - protein, 9 aa, Homo Sapiens
YFEPEPISF

SEQ ID NO: 259915 - protein, 9 aa, Homo Sapiens
EQASINNRQ

SEQ ID NO: 259916 - protein, 9 aa, Homo Sapiens
TLSHVNLPA

SEQ ID NO: 259917 - protein, 9 aa, Homo Sapiens
SKKNVFRKE

SEQ ID NO: 259918 - protein, 9 aa, Homo Sapiens
LLSDVSEVS

SEQ ID NO: 259919 - protein, 9 aa, Homo Sapiens
KTAQAPLAL

SEQ ID NO: 259920 - protein, 9 aa, Homo Sapiens
KGLWGLVNT

SEQ ID NO: 259921 - protein, 9 aa, Homo Sapiens
ENREVLEQV

SEQ ID NO: 259922 - protein, 9 aa, Homo Sapiens
LENGLSRPV

SEQ ID NO: 259923 - protein, 9 aa, Homo Sapiens
IEQDVNCLS

SEQ ID NO: 259924 - protein, 9 aa, Homo Sapiens
NIEVPGDDW

SEQ ID NO: 259925 - protein, 9 aa, Homo Sapiens
RMKHSSHKH

SEQ ID NO: 259926 - protein, 9 aa, Homo Sapiens
EDDLDTKRL

SEQ ID NO: 259927 - protein, 9 aa, Homo Sapiens
ALLVMLQSH

SEQ ID NO: 259928 - protein, 9 aa, Homo Sapiens
MMKNAAASY

SEQ ID NO: 259929 - protein, 9 aa, Homo Sapiens
KTIQMWLCK

SEQ ID NO: 259930 - protein, 9 aa, Homo Sapiens
PISLNWNHD

SEQ ID NO: 259931 - protein, 9 aa, Homo Sapiens
QDSSAMVGG

SEQ ID NO: 259932 - protein, 9 aa, Homo Sapiens
NQHFRQNSA

SEQ ID NO: 259933 - protein, 9 aa, Homo Sapiens
QLSHAKYNK

SEQ ID NO: 259934 - protein, 9 aa, Homo Sapiens
RDLGPPTKK

SEQ ID NO: 259935 - protein, 9 aa, Homo Sapiens
QLDFYHFLG

SEQ ID NO: 259936 - protein, 9 aa, Homo Sapiens
EQTFDLLIG

SEQ ID NO: 259937 - protein, 9 aa, Homo Sapiens
ILRDSESIP

SEQ ID NO: 259938 - protein, 9 aa, Homo Sapiens
APPATLPSE

SEQ ID NO: 259939 - protein, 9 aa, Homo Sapiens
LMAGISDDD

SEQ ID NO: 259940 - protein, 9 aa, Homo Sapiens
TTPALISWL

SEQ ID NO: 259941 - protein, 9 aa, Homo Sapiens
VLEQNFQTI

SEQ ID NO: 259942 - protein, 9 aa, Homo Sapiens
CCTTLTAIS

SEQ ID NO: 259943 - protein, 9 aa, Homo Sapiens
LLEMEDQKH

SEQ ID NO: 259944 - protein, 9 aa, Homo Sapiens
DSCFCNPGF

SEQ ID NO: 259945 - protein, 9 aa, Homo Sapiens
AEFLISLYL

SEQ ID NO: 259946 - protein, 9 aa, Homo Sapiens
AEKEVTELY

SEQ ID NO: 259947 - protein, 9 aa, Homo Sapiens
NKYMPQPPK

SEQ ID NO: 259948 - protein, 9 aa, Homo Sapiens
EMTYIKKNH

SEQ ID NO: 259949 - protein, 9 aa, Homo Sapiens
REAVNSLRE

SEQ ID NO: 259950 - protein, 9 aa, Homo Sapiens
CIDTIPNIM

SEQ ID NO: 259951 - protein, 9 aa, Homo Sapiens
DTTPSCNRA

SEQ ID NO: 259952 - protein, 9 aa, Homo Sapiens
KTILDQLET

SEQ ID NO: 259953 - protein, 9 aa, Homo Sapiens
SKIHGDLLE

SEQ ID NO: 259954 - protein, 9 aa, Homo Sapiens
WMINNRGEK

SEQ ID NO: 259955 - protein, 9 aa, Homo Sapiens
IMHTGEKPY

SEQ ID NO: 259956 - protein, 9 aa, Homo Sapiens
LAQQSLNME

SEQ ID NO: 259957 - protein, 9 aa, Homo Sapiens
LNLKQFLKT

SEQ ID NO: 259958 - protein, 9 aa, Homo Sapiens
EFPVLEWGD

SEQ ID NO: 259959 - protein, 9 aa, Homo Sapiens
YSFLILFLF

SEQ ID NO: 259960 - protein, 9 aa, Homo Sapiens
PIFPPMPKA

SEQ ID NO: 259961 - protein, 9 aa, Homo Sapiens
LPTIFYPET

SEQ ID NO: 259962 - protein, 9 aa, Homo Sapiens
RGIGDINIL

SEQ ID NO: 259963 - protein, 9 aa, Homo Sapiens
HHQEADKTR

SEQ ID NO: 259964 - protein, 9 aa, Homo Sapiens
SGPGLVCMV

SEQ ID NO: 259965 - protein, 9 aa, Homo Sapiens
NLVFLGILH

SEQ ID NO: 259966 - protein, 9 aa, Homo Sapiens
TMLKARQLE

SEQ ID NO: 259967 - protein, 9 aa, Homo Sapiens
HDCQNNSFP

SEQ ID NO: 259968 - protein, 9 aa, Homo Sapiens
FSLTYSFIQ

SEQ ID NO: 259969 - protein, 9 aa, Homo Sapiens
FIYARSKAL

SEQ ID NO: 259970 - protein, 9 aa, Homo Sapiens
TIEFNKMLK

SEQ ID NO: 259971 - protein, 9 aa, Homo Sapiens
APCYREPNL

SEQ ID NO: 259972 - protein, 9 aa, Homo Sapiens
GNVSNRFQL

SEQ ID NO: 259973 - protein, 9 aa, Homo Sapiens
ICLWEVSEG

SEQ ID NO: 259974 - protein, 9 aa, Homo Sapiens
FSAACVAGP

SEQ ID NO: 259975 - protein, 9 aa, Homo Sapiens
AFVRVKPTN

SEQ ID NO: 259976 - protein, 9 aa, Homo Sapiens
TITDEINFL

SEQ ID NO: 259977 - protein, 9 aa, Homo Sapiens
TAMNVNKIF

SEQ ID NO: 259978 - protein, 9 aa, Homo Sapiens
AQSNRGILT

SEQ ID NO: 259979 - protein, 9 aa, Homo Sapiens
NIMENEYLD

SEQ ID NO: 259980 - protein, 9 aa, Homo Sapiens
CEHSLSVPC

SEQ ID NO: 259981 - protein, 9 aa, Homo Sapiens
IYLTPNTDQ

SEQ ID NO: 259982 - protein, 9 aa, Homo Sapiens
SKCNPCGKV

SEQ ID NO: 259983 - protein, 9 aa, Homo Sapiens
GSWVNTFPV

SEQ ID NO: 259984 - protein, 9 aa, Homo Sapiens
LQKVLLYVR

SEQ ID NO: 259985 - protein, 9 aa, Homo Sapiens
RAVLGKVKL

SEQ ID NO: 259986 - protein, 9 aa, Homo Sapiens
LPTELGGCE

SEQ ID NO: 259987 - protein, 9 aa, Homo Sapiens
KKKCQGIKH

SEQ ID NO: 259988 - protein, 9 aa, Homo Sapiens
ADYIPKDGE

SEQ ID NO: 259989 - protein, 9 aa, Homo Sapiens
PSKDKLVCW

SEQ ID NO: 259990 - protein, 9 aa, Homo Sapiens
GIPEHETFV

SEQ ID NO: 259991 - protein, 9 aa, Homo Sapiens
HLIIHQIVH

SEQ ID NO: 259992 - protein, 9 aa, Homo Sapiens
NSGQLWSWM

SEQ ID NO: 259993 - protein, 9 aa, Homo Sapiens
ISNLMRKYQ

SEQ ID NO: 259994 - protein, 9 aa, Homo Sapiens
QNNKITKIK

SEQ ID NO: 259995 - protein, 9 aa, Homo Sapiens
ERPFPCMEC

SEQ ID NO: 259996 - protein, 9 aa, Homo Sapiens
CAKAKMKQP

SEQ ID NO: 259997 - protein, 9 aa, Homo Sapiens
RLQEFLAAY

SEQ ID NO: 259998 - protein, 9 aa, Homo Sapiens
PSSGLLVSL

SEQ ID NO: 259999 - protein, 9 aa, Homo Sapiens
SAFCEKTRF

SEQ ID NO: 260000 - protein, 9 aa, Homo Sapiens
YYFPVILKR

SEQ ID NO: 260001 - protein, 9 aa, Homo Sapiens
KEHLEGHKH

SEQ ID NO: 260002 - protein, 9 aa, Homo Sapiens
THLAHKFFP

SEQ ID NO: 260003 - protein, 9 aa, Homo Sapiens
KGKLQAELS

SEQ ID NO: 260004 - protein, 9 aa, Homo Sapiens
CSDGRLVWE

SEQ ID NO: 260005 - protein, 9 aa, Homo Sapiens
YKWGMEQGR

SEQ ID NO: 260006 - protein, 9 aa, Homo Sapiens
GVIPPNKFI

SEQ ID NO: 260007 - protein, 9 aa, Homo Sapiens
KVDKVVAQS

SEQ ID NO: 260008 - protein, 9 aa, Homo Sapiens
MTLYQFIQL

SEQ ID NO: 260009 - protein, 9 aa, Homo Sapiens
NEFCPGDFA

SEQ ID NO: 260010 - protein, 9 aa, Homo Sapiens
GKYFSRKGH

SEQ ID NO: 260011 - protein, 9 aa, Homo Sapiens
YPDRIEELS

SEQ ID NO: 260012 - protein, 9 aa, Homo Sapiens
HPRWEDNCE

SEQ ID NO: 260013 - protein, 9 aa, Homo Sapiens
NTNLFDNLI

SEQ ID NO: 260014 - protein, 9 aa, Homo Sapiens
SGFNVDHGI

SEQ ID NO: 260015 - protein, 9 aa, Homo Sapiens
FLTAVQNIS

SEQ ID NO: 260016 - protein, 9 aa, Homo Sapiens
TLLEYLEYE

SEQ ID NO: 260017 - protein, 9 aa, Homo Sapiens
FLSTLFASL

SEQ ID NO: 260018 - protein, 9 aa, Homo Sapiens
LEQDIATYR

SEQ ID NO: 260019 - protein, 9 aa, Homo Sapiens
EGDKKSVPF

SEQ ID NO: 260020 - protein, 9 aa, Homo Sapiens
TCIDDALRK

SEQ ID NO: 260021 - protein, 9 aa, Homo Sapiens
VDYSDSPTE

SEQ ID NO: 260022 - protein, 9 aa, Homo Sapiens
PLCSRCHII

SEQ ID NO: 260023 - protein, 9 aa, Homo Sapiens
NNPSLGNMI

SEQ ID NO: 260024 - protein, 9 aa, Homo Sapiens
ELYKARCDR

SEQ ID NO: 260025 - protein, 9 aa, Homo Sapiens
ELFTKYQDH

SEQ ID NO: 260026 - protein, 9 aa, Homo Sapiens
GPLDSTAID

SEQ ID NO: 260027 - protein, 9 aa, Homo Sapiens
EIWNQTSAV

SEQ ID NO: 260028 - protein, 9 aa, Homo Sapiens
PNLDMYGEC

SEQ ID NO: 260029 - protein, 9 aa, Homo Sapiens
ARCIFVENL

SEQ ID NO: 260030 - protein, 9 aa, Homo Sapiens
GLKVNCLDM

SEQ ID NO: 260031 - protein, 9 aa, Homo Sapiens
KKEQEELQV

SEQ ID NO: 260032 - protein, 9 aa, Homo Sapiens
LSDLAKHKI

SEQ ID NO: 260033 - protein, 9 aa, Homo Sapiens
APFSKALTF

SEQ ID NO: 260034 - protein, 9 aa, Homo Sapiens
ECGKYFSSE

SEQ ID NO: 260035 - protein, 9 aa, Homo Sapiens
ESFELMQTD

SEQ ID NO: 260036 - protein, 9 aa, Homo Sapiens
LDPSPFNVV

SEQ ID NO: 260037 - protein, 9 aa, Homo Sapiens
SLSLVFLVY

SEQ ID NO: 260038 - protein, 9 aa, Homo Sapiens
QLQDLWRTC

SEQ ID NO: 260039 - protein, 9 aa, Homo Sapiens
DNVPRLLTE

SEQ ID NO: 260040 - protein, 9 aa, Homo Sapiens
EQLLETIDQ

SEQ ID NO: 260041 - protein, 9 aa, Homo Sapiens
TIDFFEMCA

SEQ ID NO: 260042 - protein, 9 aa, Homo Sapiens
GSKSMSMAG

SEQ ID NO: 260043 - protein, 9 aa, Homo Sapiens
GFRATDCFG

SEQ ID NO: 260044 - protein, 9 aa, Homo Sapiens
HTPLRTYLR

SEQ ID NO: 260045 - protein, 9 aa, Homo Sapiens
HYNVNSHGC

SEQ ID NO: 260046 - protein, 9 aa, Homo Sapiens
RIYLQWLRR

SEQ ID NO: 260047 - protein, 9 aa, Homo Sapiens
NIHTSPFPG

SEQ ID NO: 260048 - protein, 9 aa, Homo Sapiens
TPKHKEQAI

SEQ ID NO: 260049 - protein, 9 aa, Homo Sapiens
FSPILTVLQ

SEQ ID NO: 260050 - protein, 9 aa, Homo Sapiens
KYQQVKTNT

SEQ ID NO: 260051 - protein, 9 aa, Homo Sapiens
LQETWLENK

SEQ ID NO: 260052 - protein, 9 aa, Homo Sapiens
KKLNNDLVG

SEQ ID NO: 260053 - protein, 9 aa, Homo Sapiens
ALAKPPLPC

SEQ ID NO: 260054 - protein, 9 aa, Homo Sapiens
GVLMKLIIF

SEQ ID NO: 260055 - protein, 9 aa, Homo Sapiens
LKKASTRRK

SEQ ID NO: 260056 - protein, 9 aa, Homo Sapiens
PHEFWDVIQ

SEQ ID NO: 260057 - protein, 9 aa, Homo Sapiens
SRESMIQLL

SEQ ID NO: 260058 - protein, 9 aa, Homo Sapiens
KIARKPITP

SEQ ID NO: 260059 - protein, 9 aa, Homo Sapiens
VMSELSDQI

SEQ ID NO: 260060 - protein, 9 aa, Homo Sapiens
ARQAACINS

SEQ ID NO: 260061 - protein, 9 aa, Homo Sapiens
TYFIWVSAK

SEQ ID NO: 260062 - protein, 9 aa, Homo Sapiens
GAQDALSDG

SEQ ID NO: 260063 - protein, 9 aa, Homo Sapiens
SWILYCLTL

SEQ ID NO: 260064 - protein, 9 aa, Homo Sapiens
VIKQGEGYI

SEQ ID NO: 260065 - protein, 9 aa, Homo Sapiens
RCRSLSECG

SEQ ID NO: 260066 - protein, 9 aa, Homo Sapiens
LKGQGTFYG

SEQ ID NO: 260067 - protein, 9 aa, Homo Sapiens
CGTPTYMAP

SEQ ID NO: 260068 - protein, 9 aa, Homo Sapiens
QHVKRGWVW

SEQ ID NO: 260069 - protein, 9 aa, Homo Sapiens
DTTYIHHVV

SEQ ID NO: 260070 - protein, 9 aa, Homo Sapiens
NCMLYKEDR

SEQ ID NO: 260071 - protein, 9 aa, Homo Sapiens
SGYISNYAY

SEQ ID NO: 260072 - protein, 9 aa, Homo Sapiens
LLGYLMITC

SEQ ID NO: 260073 - protein, 9 aa, Homo Sapiens
LSHSDRCWM

SEQ ID NO: 260074 - protein, 9 aa, Homo Sapiens
KYFVIIPLH

SEQ ID NO: 260075 - protein, 9 aa, Homo Sapiens
DPIQNNLTF

SEQ ID NO: 260076 - protein, 9 aa, Homo Sapiens
PQPRKKATY

SEQ ID NO: 260077 - protein, 9 aa, Homo Sapiens
DIWESLENA

SEQ ID NO: 260078 - protein, 9 aa, Homo Sapiens
MERGKAFSC

SEQ ID NO: 260079 - protein, 9 aa, Homo Sapiens
MLLATVEFA

SEQ ID NO: 260080 - protein, 9 aa, Homo Sapiens
LSKNVGIYD

SEQ ID NO: 260081 - protein, 9 aa, Homo Sapiens
IDQYAAIKK

SEQ ID NO: 260082 - protein, 9 aa, Homo Sapiens
PWRTHDSEK

SEQ ID NO: 260083 - protein, 9 aa, Homo Sapiens
CGLPRDKLA

SEQ ID NO: 260084 - protein, 9 aa, Homo Sapiens
KSHPLIDEI

SEQ ID NO: 260085 - protein, 9 aa, Homo Sapiens
FNVLLPPIK

SEQ ID NO: 260086 - protein, 9 aa, Homo Sapiens
LEKTGKAKA

SEQ ID NO: 260087 - protein, 9 aa, Homo Sapiens
AKQIQIIDF

SEQ ID NO: 260088 - protein, 9 aa, Homo Sapiens
VTHAFHAAC

SEQ ID NO: 260089 - protein, 9 aa, Homo Sapiens
SKLSDQITF

SEQ ID NO: 260090 - protein, 9 aa, Homo Sapiens
ERPYTCDEC

SEQ ID NO: 260091 - protein, 9 aa, Homo Sapiens
EAHEKYMEL

SEQ ID NO: 260092 - protein, 9 aa, Homo Sapiens
RRTTKLEHI

SEQ ID NO: 260093 - protein, 9 aa, Homo Sapiens
LREIFNALS

SEQ ID NO: 260094 - protein, 9 aa, Homo Sapiens
EFLRNNELS

SEQ ID NO: 260095 - protein, 9 aa, Homo Sapiens
LLNHFSRAV

SEQ ID NO: 260096 - protein, 9 aa, Homo Sapiens
ECHQQVHGL

SEQ ID NO: 260097 - protein, 9 aa, Homo Sapiens
LVSVDFGYD

SEQ ID NO: 260098 - protein, 9 aa, Homo Sapiens
FRQLFVCDV

SEQ ID NO: 260099 - protein, 9 aa, Homo Sapiens
CKREPGGRL

SEQ ID NO: 260100 - protein, 9 aa, Homo Sapiens
KENFYHVAN

SEQ ID NO: 260101 - protein, 9 aa, Homo Sapiens
MDKIVSTLY

SEQ ID NO: 260102 - protein, 9 aa, Homo Sapiens
RTMLFTSGQ

SEQ ID NO: 260103 - protein, 9 aa, Homo Sapiens
QEKRPAPFS

SEQ ID NO: 260104 - protein, 9 aa, Homo Sapiens
GVATYMVIE

SEQ ID NO: 260105 - protein, 9 aa, Homo Sapiens
RVFLRQNSS

SEQ ID NO: 260106 - protein, 9 aa, Homo Sapiens
ISKKHDQQL

SEQ ID NO: 260107 - protein, 9 aa, Homo Sapiens
WGSWGPCST

SEQ ID NO: 260108 - protein, 9 aa, Homo Sapiens
EHCSSPDLQ

SEQ ID NO: 260109 - protein, 9 aa, Homo Sapiens
FKLNSSTVE

SEQ ID NO: 260110 - protein, 9 aa, Homo Sapiens
RFCVEKGTI

SEQ ID NO: 260111 - protein, 9 aa, Homo Sapiens
HQWFLNNYP

SEQ ID NO: 260112 - protein, 9 aa, Homo Sapiens
NVFVLEMVL

SEQ ID NO: 260113 - protein, 9 aa, Homo Sapiens
PPLQPRALS

SEQ ID NO: 260114 - protein, 9 aa, Homo Sapiens
RWEDNCEEE

SEQ ID NO: 260115 - protein, 9 aa, Homo Sapiens
SGENGWVVS

SEQ ID NO: 260116 - protein, 9 aa, Homo Sapiens
QLRNTVALN

SEQ ID NO: 260117 - protein, 9 aa, Homo Sapiens
SHLERHRII

SEQ ID NO: 260118 - protein, 9 aa, Homo Sapiens
ILLDRYVAI

SEQ ID NO: 260119 - protein, 9 aa, Homo Sapiens
TENREMRAN

SEQ ID NO: 260120 - protein, 9 aa, Homo Sapiens
QRGTLTYFW

SEQ ID NO: 260121 - protein, 9 aa, Homo Sapiens
HYQADIEQM

SEQ ID NO: 260122 - protein, 9 aa, Homo Sapiens
AQKETDLSK

SEQ ID NO: 260123 - protein, 9 aa, Homo Sapiens
SYLVHCKYY

SEQ ID NO: 260124 - protein, 9 aa, Homo Sapiens
FQGADSEIM

SEQ ID NO: 260125 - protein, 9 aa, Homo Sapiens
PQDSGVYTC

SEQ ID NO: 260126 - protein, 9 aa, Homo Sapiens
QNAFRSLEY

SEQ ID NO: 260127 - protein, 9 aa, Homo Sapiens
HNKTVIRII

SEQ ID NO: 260128 - protein, 9 aa, Homo Sapiens
QPVLHCQII

SEQ ID NO: 260129 - protein, 9 aa, Homo Sapiens
VKLPRPAEL

SEQ ID NO: 260130 - protein, 9 aa, Homo Sapiens
SENTDIANY

SEQ ID NO: 260131 - protein, 9 aa, Homo Sapiens
GFPGFWYSW

SEQ ID NO: 260132 - protein, 9 aa, Homo Sapiens
DGTFLVRDN

SEQ ID NO: 260133 - protein, 9 aa, Homo Sapiens
EYQADGGQD

SEQ ID NO: 260134 - protein, 9 aa, Homo Sapiens
QQPSTYVGF

SEQ ID NO: 260135 - protein, 9 aa, Homo Sapiens
LKSNNIHTI

SEQ ID NO: 260136 - protein, 9 aa, Homo Sapiens
NDDLSTTQS

SEQ ID NO: 260137 - protein, 9 aa, Homo Sapiens
HVQTVQQNT

SEQ ID NO: 260138 - protein, 9 aa, Homo Sapiens
RKYLEDVTA

SEQ ID NO: 260139 - protein, 9 aa, Homo Sapiens
FIHGWPWVT

SEQ ID NO: 260140 - protein, 9 aa, Homo Sapiens
LLSPRQTAP

SEQ ID NO: 260141 - protein, 9 aa, Homo Sapiens
GPPRVPFAM

SEQ ID NO: 260142 - protein, 9 aa, Homo Sapiens
EEGAGGLHV

SEQ ID NO: 260143 - protein, 9 aa, Homo Sapiens
TGEEEKYAT

SEQ ID NO: 260144 - protein, 9 aa, Homo Sapiens
KTGKAKALT

SEQ ID NO: 260145 - protein, 9 aa, Homo Sapiens
LNTPGENIL

SEQ ID NO: 260146 - protein, 9 aa, Homo Sapiens
SLKRNHNNK

SEQ ID NO: 260147 - protein, 9 aa, Homo Sapiens
SHTSYLSQP

SEQ ID NO: 260148 - protein, 9 aa, Homo Sapiens
TESLHGSLG

SEQ ID NO: 260149 - protein, 9 aa, Homo Sapiens
SLTTSQLPS

SEQ ID NO: 260150 - protein, 9 aa, Homo Sapiens
WQAVVKGSL

SEQ ID NO: 260151 - protein, 9 aa, Homo Sapiens
RKWMGIKSE

SEQ ID NO: 260152 - protein, 9 aa, Homo Sapiens
EHWQKNLTD

SEQ ID NO: 260153 - protein, 9 aa, Homo Sapiens
LGILHKCMT

SEQ ID NO: 260154 - protein, 9 aa, Homo Sapiens
RRYPSMAMI

SEQ ID NO: 260155 - protein, 9 aa, Homo Sapiens
GTEQDMLYN

SEQ ID NO: 260156 - protein, 9 aa, Homo Sapiens
DAKQLNKSM

SEQ ID NO: 260157 - protein, 9 aa, Homo Sapiens
NESAEYSSN

SEQ ID NO: 260158 - protein, 9 aa, Homo Sapiens
KCRNVSVRG

SEQ ID NO: 260159 - protein, 9 aa, Homo Sapiens
IGVLNVIIT

SEQ ID NO: 260160 - protein, 9 aa, Homo Sapiens
GNLDNLFLQ

SEQ ID NO: 260161 - protein, 9 aa, Homo Sapiens
TYSNSRPCK

SEQ ID NO: 260162 - protein, 9 aa, Homo Sapiens
FNRRRKRSG

SEQ ID NO: 260163 - protein, 9 aa, Homo Sapiens
PVKTLLEYL

SEQ ID NO: 260164 - protein, 9 aa, Homo Sapiens
VVQDCSFVV

SEQ ID NO: 260165 - protein, 9 aa, Homo Sapiens
SEDSCETMM

SEQ ID NO: 260166 - protein, 9 aa, Homo Sapiens
YAIFVIFTL

SEQ ID NO: 260167 - protein, 9 aa, Homo Sapiens
QKVLLYVRR

SEQ ID NO: 260168 - protein, 8 aa, Homo Sapiens
SKQVSLPE

SEQ ID NO: 260169 - protein, 9 aa, Homo Sapiens
KTLKTSECG

SEQ ID NO: 260170 - protein, 9 aa, Homo Sapiens
QKVRIHLQQ

SEQ ID NO: 260171 - protein, 9 aa, Homo Sapiens
FIVQEVNIT

SEQ ID NO: 260172 - protein, 9 aa, Homo Sapiens
LKVNCLDMY

SEQ ID NO: 260173 - protein, 9 aa, Homo Sapiens
CLLFLMKAA

SEQ ID NO: 260174 - protein, 9 aa, Homo Sapiens
RTRLERHLE

SEQ ID NO: 260175 - protein, 9 aa, Homo Sapiens
SCKTETHAK

SEQ ID NO: 260176 - protein, 9 aa, Homo Sapiens
KQVLKIYNK

SEQ ID NO: 260177 - protein, 9 aa, Homo Sapiens
FSSPPSLLT

SEQ ID NO: 260178 - protein, 9 aa, Homo Sapiens
SQSGSSASS

SEQ ID NO: 260179 - protein, 9 aa, Homo Sapiens
KDCNKTSFF

SEQ ID NO: 260180 - protein, 9 aa, Homo Sapiens
WIPPQAKVD

SEQ ID NO: 260181 - protein, 9 aa, Homo Sapiens
NLTGYPDRP

SEQ ID NO: 260182 - protein, 9 aa, Homo Sapiens
MEDYHTDIQ

SEQ ID NO: 260183 - protein, 9 aa, Homo Sapiens
VVYMPDVWT

SEQ ID NO: 260184 - protein, 9 aa, Homo Sapiens
QRIEKQFIL

SEQ ID NO: 260185 - protein, 9 aa, Homo Sapiens
YCFKTSVDC

SEQ ID NO: 260186 - protein, 9 aa, Homo Sapiens
KQELSNPLS

SEQ ID NO: 260187 - protein, 9 aa, Homo Sapiens
LHPSAGKLA

SEQ ID NO: 260188 - protein, 9 aa, Homo Sapiens
AQNQNNYHC

SEQ ID NO: 260189 - protein, 9 aa, Homo Sapiens
GVAFKISKD

SEQ ID NO: 260190 - protein, 9 aa, Homo Sapiens
IPQYIHILL

SEQ ID NO: 260191 - protein, 9 aa, Homo Sapiens
SAIHMTKGA

SEQ ID NO: 260192 - protein, 9 aa, Homo Sapiens
KIVYLPECF

SEQ ID NO: 260193 - protein, 9 aa, Homo Sapiens
MLTSSGIEN

SEQ ID NO: 260194 - protein, 9 aa, Homo Sapiens
EDSNAKIDE

SEQ ID NO: 260195 - protein, 9 aa, Homo Sapiens
PCDKTFIFI

SEQ ID NO: 260196 - protein, 9 aa, Homo Sapiens
PDVKGEYDV

SEQ ID NO: 260197 - protein, 9 aa, Homo Sapiens
RLAAINYEG

SEQ ID NO: 260198 - protein, 9 aa, Homo Sapiens
QNSPKGCDI

SEQ ID NO: 260199 - protein, 9 aa, Homo Sapiens
VISCFGCMK

SEQ ID NO: 260200 - protein, 9 aa, Homo Sapiens
LTKDFIDKL

SEQ ID NO: 260201 - protein, 9 aa, Homo Sapiens
AEALEENKT

SEQ ID NO: 260202 - protein, 9 aa, Homo Sapiens
YKCPPHSLT

SEQ ID NO: 260203 - protein, 9 aa, Homo Sapiens
QTISDEESH

SEQ ID NO: 260204 - protein, 9 aa, Homo Sapiens
FKEVNYLHE

SEQ ID NO: 260205 - protein, 9 aa, Homo Sapiens
SQLELTPHL

SEQ ID NO: 260206 - protein, 9 aa, Homo Sapiens
PQTLNLTAG

SEQ ID NO: 260207 - protein, 9 aa, Homo Sapiens
RLMSHQITH

SEQ ID NO: 260208 - protein, 9 aa, Homo Sapiens
KPKGACKAF

SEQ ID NO: 260209 - protein, 9 aa, Homo Sapiens
DPVRADSMR

SEQ ID NO: 260210 - protein, 9 aa, Homo Sapiens
DLGAMDVST

SEQ ID NO: 260211 - protein, 9 aa, Homo Sapiens
AKMTFNPPV

SEQ ID NO: 260212 - protein, 9 aa, Homo Sapiens
KDTFNKTLN

SEQ ID NO: 260213 - protein, 9 aa, Homo Sapiens
YYLPPPESF

SEQ ID NO: 260214 - protein, 9 aa, Homo Sapiens
DVKTRTWSF

SEQ ID NO: 260215 - protein, 9 aa, Homo Sapiens
DRNYLIKLW

SEQ ID NO: 260216 - protein, 9 aa, Homo Sapiens
GLDDTNILP

SEQ ID NO: 260217 - protein, 9 aa, Homo Sapiens
LIISLAAGF

SEQ ID NO: 260218 - protein, 9 aa, Homo Sapiens
RKINIRNER

SEQ ID NO: 260219 - protein, 9 aa, Homo Sapiens
YIDKNKELR

SEQ ID NO: 260220 - protein, 9 aa, Homo Sapiens
ACSDVVGWQ

SEQ ID NO: 260221 - protein, 9 aa, Homo Sapiens
TDPPLNHKA

SEQ ID NO: 260222 - protein, 9 aa, Homo Sapiens
LILAAHLAV

SEQ ID NO: 260223 - protein, 9 aa, Homo Sapiens
AGLQLKLSR

SEQ ID NO: 260224 - protein, 9 aa, Homo Sapiens
KYNADLLSP

SEQ ID NO: 260225 - protein, 9 aa, Homo Sapiens
QLLDIQVDN

SEQ ID NO: 260226 - protein, 9 aa, Homo Sapiens
SKMYPSRDE

SEQ ID NO: 260227 - protein, 9 aa, Homo Sapiens
ESSSLCDYI

SEQ ID NO: 260228 - protein, 9 aa, Homo Sapiens
NCDIQVHYL

SEQ ID NO: 260229 - protein, 9 aa, Homo Sapiens
ALQAFKFRV

SEQ ID NO: 260230 - protein, 9 aa, Homo Sapiens
DVYEQYKKE

SEQ ID NO: 260231 - protein, 9 aa, Homo Sapiens
TIFLQVIDR

SEQ ID NO: 260232 - protein, 9 aa, Homo Sapiens
LNNVAETAC

SEQ ID NO: 260233 - protein, 9 aa, Homo Sapiens
PLETNTENS

SEQ ID NO: 260234 - protein, 9 aa, Homo Sapiens
LEGAEEFEE

SEQ ID NO: 260235 - protein, 9 aa, Homo Sapiens
QEQQQQLSS

SEQ ID NO: 260236 - protein, 9 aa, Homo Sapiens
TVIRIIIAR

SEQ ID NO: 260237 - protein, 9 aa, Homo Sapiens
QGYIHKLIV

SEQ ID NO: 260238 - protein, 9 aa, Homo Sapiens
IFQHFNSLI

SEQ ID NO: 260239 - protein, 9 aa, Homo Sapiens
KEIENLAAM

SEQ ID NO: 260240 - protein, 9 aa, Homo Sapiens
HRSFPLPGV

SEQ ID NO: 260241 - protein, 9 aa, Homo Sapiens
LVAQNLFNI

SEQ ID NO: 260242 - protein, 9 aa, Homo Sapiens
PTSQPLERK

SEQ ID NO: 260243 - protein, 9 aa, Homo Sapiens
VDFGQPSPD

SEQ ID NO: 260244 - protein, 9 aa, Homo Sapiens
YLEKAMSLE

SEQ ID NO: 260245 - protein, 9 aa, Homo Sapiens
LLLLKDIYR

SEQ ID NO: 260246 - protein, 9 aa, Homo Sapiens
LYNKISNLM

SEQ ID NO: 260247 - protein, 9 aa, Homo Sapiens
KRWQEARGA

SEQ ID NO: 260248 - protein, 9 aa, Homo Sapiens
KKHIQYKLL

SEQ ID NO: 260249 - protein, 9 aa, Homo Sapiens
EAGIPGHPA

SEQ ID NO: 260250 - protein, 9 aa, Homo Sapiens
RHKAYEREL

SEQ ID NO: 260251 - protein, 9 aa, Homo Sapiens
YPVPIRDDG

SEQ ID NO: 260252 - protein, 9 aa, Homo Sapiens
MLVANSLSL

SEQ ID NO: 260253 - protein, 9 aa, Homo Sapiens
ADTETRPEK

SEQ ID NO: 260254 - protein, 9 aa, Homo Sapiens
LTPFSCLSL

SEQ ID NO: 260255 - protein, 9 aa, Homo Sapiens
LGSSGCCGS

SEQ ID NO: 260256 - protein, 9 aa, Homo Sapiens
IQNAHNNST

SEQ ID NO: 260257 - protein, 9 aa, Homo Sapiens
GKNLNHNSD

SEQ ID NO: 260258 - protein, 9 aa, Homo Sapiens
YIYYGNTEI

SEQ ID NO: 260259 - protein, 9 aa, Homo Sapiens
ALYGSEEDE

SEQ ID NO: 260260 - protein, 9 aa, Homo Sapiens
QMATYLDRL

SEQ ID NO: 260261 - protein, 9 aa, Homo Sapiens
NTGSKLPVL

SEQ ID NO: 260262 - protein, 9 aa, Homo Sapiens
HKNRMSQML

SEQ ID NO: 260263 - protein, 9 aa, Homo Sapiens
FSDETFGPN

SEQ ID NO: 260264 - protein, 9 aa, Homo Sapiens
HCVNMLFLL

SEQ ID NO: 260265 - protein, 9 aa, Homo Sapiens
EYGSGAAFD

SEQ ID NO: 260266 - protein, 9 aa, Homo Sapiens
WLAKLYRNN

SEQ ID NO: 260267 - protein, 9 aa, Homo Sapiens
SVCRLISRE

SEQ ID NO: 260268 - protein, 9 aa, Homo Sapiens
TANTLYMSH

SEQ ID NO: 260269 - protein, 9 aa, Homo Sapiens
ILREIVINE

SEQ ID NO: 260270 - protein, 9 aa, Homo Sapiens
EFFKSALHA

SEQ ID NO: 260271 - protein, 9 aa, Homo Sapiens
FPKEKKRNI

SEQ ID NO: 260272 - protein, 9 aa, Homo Sapiens
VLLLCGGLC

SEQ ID NO: 260273 - protein, 9 aa, Homo Sapiens
SFDQPHQTC

SEQ ID NO: 260274 - protein, 9 aa, Homo Sapiens
FNGLLLALA

SEQ ID NO: 260275 - protein, 9 aa, Homo Sapiens
DVPEHRDRS

SEQ ID NO: 260276 - protein, 9 aa, Homo Sapiens
RHTGEKFYK

SEQ ID NO: 260277 - protein, 9 aa, Homo Sapiens
AYEKIELED

SEQ ID NO: 260278 - protein, 9 aa, Homo Sapiens
AFAHGNIYA

SEQ ID NO: 260279 - protein, 9 aa, Homo Sapiens
TALCEVITS

SEQ ID NO: 260280 - protein, 9 aa, Homo Sapiens
RPGVVLLTC

SEQ ID NO: 260281 - protein, 9 aa, Homo Sapiens
PITVEWRLR

SEQ ID NO: 260282 - protein, 9 aa, Homo Sapiens
IKETTTSPN

SEQ ID NO: 260283 - protein, 9 aa, Homo Sapiens
SVIFSDCQR

SEQ ID NO: 260284 - protein, 9 aa, Homo Sapiens
VCESKDLSA

SEQ ID NO: 260285 - protein, 9 aa, Homo Sapiens
QVHMEMVQI

SEQ ID NO: 260286 - protein, 9 aa, Homo Sapiens
CQADVKIGN

SEQ ID NO: 260287 - protein, 9 aa, Homo Sapiens
HWHKSKGQQ

SEQ ID NO: 260288 - protein, 9 aa, Homo Sapiens
VHAFKEGKD

SEQ ID NO: 260289 - protein, 9 aa, Homo Sapiens
GSRGDGSGF

SEQ ID NO: 260290 - protein, 9 aa, Homo Sapiens
SKLVSMAGH

SEQ ID NO: 260291 - protein, 9 aa, Homo Sapiens
IEHRAKIII

SEQ ID NO: 260292 - protein, 9 aa, Homo Sapiens
KRKVLGIKD

SEQ ID NO: 260293 - protein, 9 aa, Homo Sapiens
FSHHLSNVQ

SEQ ID NO: 260294 - protein, 9 aa, Homo Sapiens
RCQCPPGHE

SEQ ID NO: 260295 - protein, 9 aa, Homo Sapiens
PIINVKNDR

SEQ ID NO: 260296 - protein, 9 aa, Homo Sapiens
QISCTLARS

SEQ ID NO: 260297 - protein, 9 aa, Homo Sapiens
ALVKHKLKE

SEQ ID NO: 260298 - protein, 9 aa, Homo Sapiens
KPYIFTLHK

SEQ ID NO: 260299 - protein, 9 aa, Homo Sapiens
KVPSLTPLT

SEQ ID NO: 260300 - protein, 9 aa, Homo Sapiens
RLCLGPECL

SEQ ID NO: 260301 - protein, 9 aa, Homo Sapiens
WCRIPSEEA

SEQ ID NO: 260302 - protein, 9 aa, Homo Sapiens
EKYSEKEKD

SEQ ID NO: 260303 - protein, 9 aa, Homo Sapiens
KNFVPVSVC

SEQ ID NO: 260304 - protein, 9 aa, Homo Sapiens
GARLLASNS

SEQ ID NO: 260305 - protein, 9 aa, Homo Sapiens
NSFSIWSLE

SEQ ID NO: 260306 - protein, 9 aa, Homo Sapiens
KGILAIFQA

SEQ ID NO: 260307 - protein, 9 aa, Homo Sapiens
RNYLIKLWA

SEQ ID NO: 260308 - protein, 9 aa, Homo Sapiens
LLCNLSLVP

SEQ ID NO: 260309 - protein, 9 aa, Homo Sapiens
QCGKAFNIS

SEQ ID NO: 260310 - protein, 9 aa, Homo Sapiens
REWEEAECQ

SEQ ID NO: 260311 - protein, 9 aa, Homo Sapiens
VKPANKQED

SEQ ID NO: 260312 - protein, 9 aa, Homo Sapiens
IKYKYYFPV

SEQ ID NO: 260313 - protein, 9 aa, Homo Sapiens
ARKPDKAER

SEQ ID NO: 260314 - protein, 9 aa, Homo Sapiens
ESDFEFLSS

SEQ ID NO: 260315 - protein, 9 aa, Homo Sapiens
SYFRRFTLI

SEQ ID NO: 260316 - protein, 9 aa, Homo Sapiens
EIKITDFGI

SEQ ID NO: 260317 - protein, 9 aa, Homo Sapiens
DSGLSDPES

SEQ ID NO: 260318 - protein, 9 aa, Homo Sapiens
PEVLLTKIH

SEQ ID NO: 260319 - protein, 9 aa, Homo Sapiens
LLEYLEYEK

SEQ ID NO: 260320 - protein, 9 aa, Homo Sapiens
YLNQCLPPE

SEQ ID NO: 260321 - protein, 9 aa, Homo Sapiens
AEANQHTFH

SEQ ID NO: 260322 - protein, 9 aa, Homo Sapiens
YMDDERLKD

SEQ ID NO: 260323 - protein, 9 aa, Homo Sapiens
NSHVHYTDD

SEQ ID NO: 260324 - protein, 9 aa, Homo Sapiens
FQMSDDIDN

SEQ ID NO: 260325 - protein, 9 aa, Homo Sapiens
EEPQWSFAC

SEQ ID NO: 260326 - protein, 9 aa, Homo Sapiens
ATLKINYQI

SEQ ID NO: 260327 - protein, 9 aa, Homo Sapiens
LAVLSNRTP

SEQ ID NO: 260328 - protein, 9 aa, Homo Sapiens
LLSFTYRLD

SEQ ID NO: 260329 - protein, 9 aa, Homo Sapiens
SLESTRAAV

SEQ ID NO: 260330 - protein, 9 aa, Homo Sapiens
PLYLPFVPG

SEQ ID NO: 260331 - protein, 9 aa, Homo Sapiens
HNNEKYIPS

SEQ ID NO: 260332 - protein, 9 aa, Homo Sapiens
VCNRCIAKC

SEQ ID NO: 260333 - protein, 9 aa, Homo Sapiens
GMSSVPSAS

SEQ ID NO: 260334 - protein, 9 aa, Homo Sapiens
VKKGIFYHQ

SEQ ID NO: 260335 - protein, 9 aa, Homo Sapiens
DNSDDCQIL

SEQ ID NO: 260336 - protein, 9 aa, Homo Sapiens
DLLNGDLDD

SEQ ID NO: 260337 - protein, 9 aa, Homo Sapiens
TKSQSGSSA

SEQ ID NO: 260338 - protein, 9 aa, Homo Sapiens
CSFVVCTTG

SEQ ID NO: 260339 - protein, 9 aa, Homo Sapiens
MLQTIRQFI

SEQ ID NO: 260340 - protein, 9 aa, Homo Sapiens
QTEALSNLT

SEQ ID NO: 260341 - protein, 9 aa, Homo Sapiens
TTLINKACD

SEQ ID NO: 260342 - protein, 9 aa, Homo Sapiens
KDERIYITN

SEQ ID NO: 260343 - protein, 9 aa, Homo Sapiens
CNLPLLMLG

SEQ ID NO: 260344 - protein, 9 aa, Homo Sapiens
LWRLETQVL

SEQ ID NO: 260345 - protein, 9 aa, Homo Sapiens
MLNHLIYSL

SEQ ID NO: 260346 - protein, 9 aa, Homo Sapiens
TRSVKASYV

SEQ ID NO: 260347 - protein, 9 aa, Homo Sapiens
HPVFNETEI

SEQ ID NO: 260348 - protein, 9 aa, Homo Sapiens
LSKYFSKYW

SEQ ID NO: 260349 - protein, 9 aa, Homo Sapiens
EYWDFYIFE

SEQ ID NO: 260350 - protein, 9 aa, Homo Sapiens
QNLVSRGRE

SEQ ID NO: 260351 - protein, 9 aa, Homo Sapiens
SQKSLQLKS

SEQ ID NO: 260352 - protein, 9 aa, Homo Sapiens
KEDTFKWNL

SEQ ID NO: 260353 - protein, 9 aa, Homo Sapiens
TTIPFSECM

SEQ ID NO: 260354 - protein, 9 aa, Homo Sapiens
GAVTKEAAN

SEQ ID NO: 260355 - protein, 9 aa, Homo Sapiens
PHQASISGI

SEQ ID NO: 260356 - protein, 9 aa, Homo Sapiens
RVHPDGGLM

SEQ ID NO: 260357 - protein, 9 aa, Homo Sapiens
LKLQKKDFL

SEQ ID NO: 260358 - protein, 9 aa, Homo Sapiens
MLCGMGGFS

SEQ ID NO: 260359 - protein, 9 aa, Homo Sapiens
GWRTSGKWT

SEQ ID NO: 260360 - protein, 9 aa, Homo Sapiens
KDKLFDEES

SEQ ID NO: 260361 - protein, 9 aa, Homo Sapiens
PGYWDQHDL

SEQ ID NO: 260362 - protein, 9 aa, Homo Sapiens
SHNFAIRCN

SEQ ID NO: 260363 - protein, 9 aa, Homo Sapiens
LTVASEHYN

SEQ ID NO: 260364 - protein, 9 aa, Homo Sapiens
ERKANPSSL

SEQ ID NO: 260365 - protein, 9 aa, Homo Sapiens
AFCYMLPLV

SEQ ID NO: 260366 - protein, 9 aa, Homo Sapiens
ILYHNLMNS

SEQ ID NO: 260367 - protein, 9 aa, Homo Sapiens
TSKNFEEVV

SEQ ID NO: 260368 - protein, 9 aa, Homo Sapiens
ERSQIKNEE

SEQ ID NO: 260369 - protein, 9 aa, Homo Sapiens
DFVRKAVRD

SEQ ID NO: 260370 - protein, 9 aa, Homo Sapiens
LLDKDNENF

SEQ ID NO: 260371 - protein, 9 aa, Homo Sapiens
WPEGSDGTN

SEQ ID NO: 260372 - protein, 9 aa, Homo Sapiens
QKVTTNPHL

SEQ ID NO: 260373 - protein, 9 aa, Homo Sapiens
YFTGSEPMT

SEQ ID NO: 260374 - protein, 9 aa, Homo Sapiens
GSQIMGGMG

SEQ ID NO: 260375 - protein, 9 aa, Homo Sapiens
EDDDVFFGP

SEQ ID NO: 260376 - protein, 9 aa, Homo Sapiens
KISKIHEKV

SEQ ID NO: 260377 - protein, 9 aa, Homo Sapiens
EDFLSLTRN

SEQ ID NO: 260378 - protein, 9 aa, Homo Sapiens
EYDRYLTSS

SEQ ID NO: 260379 - protein, 9 aa, Homo Sapiens
TVESLYSRF

SEQ ID NO: 260380 - protein, 9 aa, Homo Sapiens
STNYNEIHK

SEQ ID NO: 260381 - protein, 9 aa, Homo Sapiens
WFKDMYTPL

SEQ ID NO: 260382 - protein, 9 aa, Homo Sapiens
SAPRPTQFL

SEQ ID NO: 260383 - protein, 9 aa, Homo Sapiens
SETYCMCQD

SEQ ID NO: 260384 - protein, 9 aa, Homo Sapiens
RQLLEHRDS

SEQ ID NO: 260385 - protein, 9 aa, Homo Sapiens
LINKKANLN

SEQ ID NO: 260386 - protein, 9 aa, Homo Sapiens
HGGFPPESN

SEQ ID NO: 260387 - protein, 9 aa, Homo Sapiens
GYPGIPGMD

SEQ ID NO: 260388 - protein, 9 aa, Homo Sapiens
WKDQHVICV

SEQ ID NO: 260389 - protein, 9 aa, Homo Sapiens
VEQEAGELS

SEQ ID NO: 260390 - protein, 9 aa, Homo Sapiens
EGAEKGRKA

SEQ ID NO: 260391 - protein, 9 aa, Homo Sapiens
KIGSDPLQL

SEQ ID NO: 260392 - protein, 9 aa, Homo Sapiens
KDRVNLVLS

SEQ ID NO: 260393 - protein, 9 aa, Homo Sapiens
KRPALHKKT

SEQ ID NO: 260394 - protein, 9 aa, Homo Sapiens
DYHRIIKQP

SEQ ID NO: 260395 - protein, 9 aa, Homo Sapiens
PFPQRHYLV

SEQ ID NO: 260396 - protein, 9 aa, Homo Sapiens
MAEPDGSNQ

SEQ ID NO: 260397 - protein, 9 aa, Homo Sapiens
FIYILGNCS

SEQ ID NO: 260398 - protein, 9 aa, Homo Sapiens
PDICCREHD

SEQ ID NO: 260399 - protein, 9 aa, Homo Sapiens
RAQRLWPQD

SEQ ID NO: 260400 - protein, 9 aa, Homo Sapiens
AGALQESLH

SEQ ID NO: 260401 - protein, 9 aa, Homo Sapiens
HKKDKKYKW

SEQ ID NO: 260402 - protein, 9 aa, Homo Sapiens
FFSFTPAWN

SEQ ID NO: 260403 - protein, 9 aa, Homo Sapiens
RDKKLGETL

SEQ ID NO: 260404 - protein, 9 aa, Homo Sapiens
PEDHIEPKK

SEQ ID NO: 260405 - protein, 9 aa, Homo Sapiens
EVVRAEIMI

SEQ ID NO: 260406 - protein, 9 aa, Homo Sapiens
CLKETQKHR

SEQ ID NO: 260407 - protein, 9 aa, Homo Sapiens
IMLVRSSFN

SEQ ID NO: 260408 - protein, 9 aa, Homo Sapiens
AVLSNRTPQ

SEQ ID NO: 260409 - protein, 9 aa, Homo Sapiens
QSKLFQCNV

SEQ ID NO: 260410 - protein, 9 aa, Homo Sapiens
FSVIADVRH

SEQ ID NO: 260411 - protein, 9 aa, Homo Sapiens
SRSTTLTTH

SEQ ID NO: 260412 - protein, 9 aa, Homo Sapiens
VQTEKHVVL

SEQ ID NO: 260413 - protein, 9 aa, Homo Sapiens
FKNFFVEAS

SEQ ID NO: 260414 - protein, 9 aa, Homo Sapiens
HTSEKLRVD

SEQ ID NO: 260415 - protein, 9 aa, Homo Sapiens
KRHCARNLL

SEQ ID NO: 260416 - protein, 9 aa, Homo Sapiens
VLHIIYGKF

SEQ ID NO: 260417 - protein, 9 aa, Homo Sapiens
CQGFTKDNG

SEQ ID NO: 260418 - protein, 9 aa, Homo Sapiens
LDDLVPEAA

SEQ ID NO: 260419 - protein, 9 aa, Homo Sapiens
DLQPSDLGA

SEQ ID NO: 260420 - protein, 9 aa, Homo Sapiens
QLEKVLKEI

SEQ ID NO: 260421 - protein, 9 aa, Homo Sapiens
EAKEIMASE

SEQ ID NO: 260422 - protein, 9 aa, Homo Sapiens
LDPVLLVGT

SEQ ID NO: 260423 - protein, 9 aa, Homo Sapiens
CPGCSSNSF

SEQ ID NO: 260424 - protein, 9 aa, Homo Sapiens
IVTQCCLFC

SEQ ID NO: 260425 - protein, 9 aa, Homo Sapiens
TSNGHQSKF

SEQ ID NO: 260426 - protein, 9 aa, Homo Sapiens
EDLFLENAI

SEQ ID NO: 260427 - protein, 9 aa, Homo Sapiens
RITLYLTEN

SEQ ID NO: 260428 - protein, 9 aa, Homo Sapiens
SQDSSSSAA

SEQ ID NO: 260429 - protein, 9 aa, Homo Sapiens
ELEARQATR

SEQ ID NO: 260430 - protein, 9 aa, Homo Sapiens
HLARHQQIH

SEQ ID NO: 260431 - protein, 9 aa, Homo Sapiens
NPIVHSQTY

SEQ ID NO: 260432 - protein, 9 aa, Homo Sapiens
PIRRKARSL

SEQ ID NO: 260433 - protein, 9 aa, Homo Sapiens
AVQETMQEK

SEQ ID NO: 260434 - protein, 9 aa, Homo Sapiens
GTDLQGLRE

SEQ ID NO: 260435 - protein, 9 aa, Homo Sapiens
ACFDVHRGE

SEQ ID NO: 260436 - protein, 9 aa, Homo Sapiens
GPRTVLFWA

SEQ ID NO: 260437 - protein, 9 aa, Homo Sapiens
GECKLCLNP

SEQ ID NO: 260438 - protein, 9 aa, Homo Sapiens
AQRKRMKMD

SEQ ID NO: 260439 - protein, 9 aa, Homo Sapiens
EVGRKDLLC

SEQ ID NO: 260440 - protein, 9 aa, Homo Sapiens
FQIHTGIKP

SEQ ID NO: 260441 - protein, 9 aa, Homo Sapiens
ASLKTCDCF

SEQ ID NO: 260442 - protein, 9 aa, Homo Sapiens
STLYTVVFP

SEQ ID NO: 260443 - protein, 9 aa, Homo Sapiens
KSVHEISLQ

SEQ ID NO: 260444 - protein, 9 aa, Homo Sapiens
YSSSASMCM

SEQ ID NO: 260445 - protein, 9 aa, Homo Sapiens
TYLEDMKTY

SEQ ID NO: 260446 - protein, 9 aa, Homo Sapiens
LHNKSSNED

SEQ ID NO: 260447 - protein, 9 aa, Homo Sapiens
NPQAFRACF

SEQ ID NO: 260448 - protein, 9 aa, Homo Sapiens
QWMTQSLTE

SEQ ID NO: 260449 - protein, 9 aa, Homo Sapiens
NTPRRLRLI

SEQ ID NO: 260450 - protein, 9 aa, Homo Sapiens
SKDDLIAYV

SEQ ID NO: 260451 - protein, 9 aa, Homo Sapiens
PDTQKLSDR

SEQ ID NO: 260452 - protein, 9 aa, Homo Sapiens
SNFCSLVDY

SEQ ID NO: 260453 - protein, 9 aa, Homo Sapiens
FQQDRHCNV

SEQ ID NO: 260454 - protein, 9 aa, Homo Sapiens
LERSATDSL

SEQ ID NO: 260455 - protein, 9 aa, Homo Sapiens
MEQANFTML

SEQ ID NO: 260456 - protein, 9 aa, Homo Sapiens
WAYEKIELE

SEQ ID NO: 260457 - protein, 9 aa, Homo Sapiens
PSKMRKFFS

SEQ ID NO: 260458 - protein, 9 aa, Homo Sapiens
VRLATKTEL

SEQ ID NO: 260459 - protein, 9 aa, Homo Sapiens
ADIWGDFTT

SEQ ID NO: 260460 - protein, 9 aa, Homo Sapiens
QVKSHFAAT

SEQ ID NO: 260461 - protein, 9 aa, Homo Sapiens
VGKQIVENL

SEQ ID NO: 260462 - protein, 9 aa, Homo Sapiens
SSDWLDGRG

SEQ ID NO: 260463 - protein, 9 aa, Homo Sapiens
YTQTCTKTP

SEQ ID NO: 260464 - protein, 9 aa, Homo Sapiens
QELAIERCF

SEQ ID NO: 260465 - protein, 9 aa, Homo Sapiens
LTALILATQ

SEQ ID NO: 260466 - protein, 9 aa, Homo Sapiens
NVITDMRTK

SEQ ID NO: 260467 - protein, 9 aa, Homo Sapiens
ERRKRYNVT

SEQ ID NO: 260468 - protein, 9 aa, Homo Sapiens
LICVLLHGS

SEQ ID NO: 260469 - protein, 9 aa, Homo Sapiens
FLMKAAKPA

SEQ ID NO: 260470 - protein, 9 aa, Homo Sapiens
TKLEAIARP

SEQ ID NO: 260471 - protein, 9 aa, Homo Sapiens
REIFAIDLR

SEQ ID NO: 260472 - protein, 9 aa, Homo Sapiens
EVNTLHCQL

SEQ ID NO: 260473 - protein, 9 aa, Homo Sapiens
CQSTLIPSE

SEQ ID NO: 260474 - protein, 9 aa, Homo Sapiens
TVILPAPIK

SEQ ID NO: 260475 - protein, 9 aa, Homo Sapiens
RELRNLERS

SEQ ID NO: 260476 - protein, 9 aa, Homo Sapiens
EEKLVISKE

SEQ ID NO: 260477 - protein, 9 aa, Homo Sapiens
NISLMHNGN

SEQ ID NO: 260478 - protein, 9 aa, Homo Sapiens
GTNLSKLRS

SEQ ID NO: 260479 - protein, 9 aa, Homo Sapiens
VKMLPVNLG

SEQ ID NO: 260480 - protein, 9 aa, Homo Sapiens
FQDLQSSDL

SEQ ID NO: 260481 - protein, 9 aa, Homo Sapiens
RNIISFDGC

SEQ ID NO: 260482 - protein, 9 aa, Homo Sapiens
VDWSFLYSV

SEQ ID NO: 260483 - protein, 9 aa, Homo Sapiens
MQSRLYAGG

SEQ ID NO: 260484 - protein, 9 aa, Homo Sapiens
LYIIRAKAI

SEQ ID NO: 260485 - protein, 9 aa, Homo Sapiens
NSVVPSDKG

SEQ ID NO: 260486 - protein, 9 aa, Homo Sapiens
HPQQTFLRP

SEQ ID NO: 260487 - protein, 9 aa, Homo Sapiens
FSLYLIHEI

SEQ ID NO: 260488 - protein, 9 aa, Homo Sapiens
EVTYYHKHG

SEQ ID NO: 260489 - protein, 9 aa, Homo Sapiens
AHGNIYAYM

SEQ ID NO: 260490 - protein, 9 aa, Homo Sapiens
KDSLPHFVR

SEQ ID NO: 260491 - protein, 9 aa, Homo Sapiens
EQTSNVKMV

SEQ ID NO: 260492 - protein, 9 aa, Homo Sapiens
RSKKELNHL

SEQ ID NO: 260493 - protein, 9 aa, Homo Sapiens
WREGPAQMR

SEQ ID NO: 260494 - protein, 9 aa, Homo Sapiens
YLTCPNDQT

SEQ ID NO: 260495 - protein, 9 aa, Homo Sapiens
EFDFLTVMK

SEQ ID NO: 260496 - protein, 9 aa, Homo Sapiens
LEGIGIFSV

SEQ ID NO: 260497 - protein, 9 aa, Homo Sapiens
RKDLEIQDY

SEQ ID NO: 260498 - protein, 9 aa, Homo Sapiens
SFLCLTLKM

SEQ ID NO: 260499 - protein, 9 aa, Homo Sapiens
ARQDAASQS

SEQ ID NO: 260500 - protein, 9 aa, Homo Sapiens
VFYCKNITT

SEQ ID NO: 260501 - protein, 9 aa, Homo Sapiens
AWMNYTAIR

SEQ ID NO: 260502 - protein, 9 aa, Homo Sapiens
TFIFICKRP

SEQ ID NO: 260503 - protein, 9 aa, Homo Sapiens
IVSTHSPYV

SEQ ID NO: 260504 - protein, 9 aa, Homo Sapiens
FKETFSKAA

SEQ ID NO: 260505 - protein, 9 aa, Homo Sapiens
SRKERLKLV

SEQ ID NO: 260506 - protein, 9 aa, Homo Sapiens
FLAIRWHDN

SEQ ID NO: 260507 - protein, 9 aa, Homo Sapiens
QPQLTDDYG

SEQ ID NO: 260508 - protein, 9 aa, Homo Sapiens
LQIMLQSGV

SEQ ID NO: 260509 - protein, 9 aa, Homo Sapiens
SSGQIISDS

SEQ ID NO: 260510 - protein, 9 aa, Homo Sapiens
QEELDLFLK

SEQ ID NO: 260511 - protein, 9 aa, Homo Sapiens
NSGGIPLFS

SEQ ID NO: 260512 - protein, 9 aa, Homo Sapiens
ATLAGNGLG

SEQ ID NO: 260513 - protein, 9 aa, Homo Sapiens
PTMSQFKMD

SEQ ID NO: 260514 - protein, 9 aa, Homo Sapiens
DVKTPNTEM

SEQ ID NO: 260515 - protein, 9 aa, Homo Sapiens
GKIRVSGKV

SEQ ID NO: 260516 - protein, 9 aa, Homo Sapiens
LWLSVCHFT

SEQ ID NO: 260517 - protein, 9 aa, Homo Sapiens
QLDNLFCDV

SEQ ID NO: 260518 - protein, 9 aa, Homo Sapiens
IHGLIKHFS

SEQ ID NO: 260519 - protein, 9 aa, Homo Sapiens
ECDRKLLSR

SEQ ID NO: 260520 - protein, 9 aa, Homo Sapiens
PPEEIKQME

SEQ ID NO: 260521 - protein, 9 aa, Homo Sapiens
KNSRGQTQS

SEQ ID NO: 260522 - protein, 9 aa, Homo Sapiens
KYESKNSFG

SEQ ID NO: 260523 - protein, 9 aa, Homo Sapiens
GPITTREQL

SEQ ID NO: 260524 - protein, 9 aa, Homo Sapiens
SRSAESKTM

SEQ ID NO: 260525 - protein, 9 aa, Homo Sapiens
LRQKSPEVP

SEQ ID NO: 260526 - protein, 9 aa, Homo Sapiens
TMQLESREE

SEQ ID NO: 260527 - protein, 9 aa, Homo Sapiens
FLDGALVME

SEQ ID NO: 260528 - protein, 9 aa, Homo Sapiens
LHNIKLLNK

SEQ ID NO: 260529 - protein, 9 aa, Homo Sapiens
GHISKKHTG

SEQ ID NO: 260530 - protein, 9 aa, Homo Sapiens
RLYLLSMAS

SEQ ID NO: 260531 - protein, 9 aa, Homo Sapiens
CPGDNAIFE

SEQ ID NO: 260532 - protein, 9 aa, Homo Sapiens
VYDDKDYRK

SEQ ID NO: 260533 - protein, 9 aa, Homo Sapiens
NPLETNNIC

SEQ ID NO: 260534 - protein, 9 aa, Homo Sapiens
NDEELNTLL

SEQ ID NO: 260535 - protein, 9 aa, Homo Sapiens
SDNVKEDTF

SEQ ID NO: 260536 - protein, 9 aa, Homo Sapiens
RTLNQFGTP

SEQ ID NO: 260537 - protein, 9 aa, Homo Sapiens
LVMYVVTLM

SEQ ID NO: 260538 - protein, 9 aa, Homo Sapiens
FILLYIMNQ

SEQ ID NO: 260539 - protein, 9 aa, Homo Sapiens
YYQLHRVFV

SEQ ID NO: 260540 - protein, 9 aa, Homo Sapiens
AATFIHSLH

SEQ ID NO: 260541 - protein, 9 aa, Homo Sapiens
ICAYFGASL

SEQ ID NO: 260542 - protein, 9 aa, Homo Sapiens
NKEKSDVGS

SEQ ID NO: 260543 - protein, 9 aa, Homo Sapiens
SPSSLDAVI

SEQ ID NO: 260544 - protein, 9 aa, Homo Sapiens
KSRFIFQLK

SEQ ID NO: 260545 - protein, 9 aa, Homo Sapiens
KTSNLIVLG

SEQ ID NO: 260546 - protein, 9 aa, Homo Sapiens
QQIPGTSSV

SEQ ID NO: 260547 - protein, 9 aa, Homo Sapiens
RRCPLGCGA

SEQ ID NO: 260548 - protein, 9 aa, Homo Sapiens
AKKMNISLA

SEQ ID NO: 260549 - protein, 9 aa, Homo Sapiens
PQIRDLESG

SEQ ID NO: 260550 - protein, 9 aa, Homo Sapiens
RLSFHNLKC

SEQ ID NO: 260551 - protein, 9 aa, Homo Sapiens
FIGFFSGIV

SEQ ID NO: 260552 - protein, 9 aa, Homo Sapiens
GYQRIADGY

SEQ ID NO: 260553 - protein, 9 aa, Homo Sapiens
VGCCSEQQE

SEQ ID NO: 260554 - protein, 9 aa, Homo Sapiens
QYVNKKFSK

SEQ ID NO: 260555 - protein, 9 aa, Homo Sapiens
DSTLSKYVK

SEQ ID NO: 260556 - protein, 9 aa, Homo Sapiens
YLVTGFELV

SEQ ID NO: 260557 - protein, 9 aa, Homo Sapiens
LEKKAKHQG

SEQ ID NO: 260558 - protein, 9 aa, Homo Sapiens
STFTQASPD

SEQ ID NO: 260559 - protein, 9 aa, Homo Sapiens
INLSFSYSS

SEQ ID NO: 260560 - protein, 9 aa, Homo Sapiens
KKNYNNLII

SEQ ID NO: 260561 - protein, 9 aa, Homo Sapiens
SYSNSKDGE

SEQ ID NO: 260562 - protein, 9 aa, Homo Sapiens
TRMRTFMYW

SEQ ID NO: 260563 - protein, 9 aa, Homo Sapiens
QSQGLGRLV

SEQ ID NO: 260564 - protein, 9 aa, Homo Sapiens
EVMPRTLEG

SEQ ID NO: 260565 - protein, 9 aa, Homo Sapiens
ANMHAHMCT

SEQ ID NO: 260566 - protein, 9 aa, Homo Sapiens
YLIKLWAKL

SEQ ID NO: 260567 - protein, 9 aa, Homo Sapiens
LFRNLKERG

SEQ ID NO: 260568 - protein, 9 aa, Homo Sapiens
FWWPEGMCI

SEQ ID NO: 260569 - protein, 9 aa, Homo Sapiens
TKTPLPNMD

SEQ ID NO: 260570 - protein, 9 aa, Homo Sapiens
ECTHTGEKP

SEQ ID NO: 260571 - protein, 9 aa, Homo Sapiens
KQSFSLTMY

SEQ ID NO: 260572 - protein, 9 aa, Homo Sapiens
AGPDKPRGT

SEQ ID NO: 260573 - protein, 9 aa, Homo Sapiens
AGNQDGWEW

SEQ ID NO: 260574 - protein, 9 aa, Homo Sapiens
EAQTGAGPL

SEQ ID NO: 260575 - protein, 9 aa, Homo Sapiens
SSAQYPFSS

SEQ ID NO: 260576 - protein, 9 aa, Homo Sapiens
HLEILQTED

SEQ ID NO: 260577 - protein, 9 aa, Homo Sapiens
KRRKLEMQF

SEQ ID NO: 260578 - protein, 9 aa, Homo Sapiens
KFFLRSGSE

SEQ ID NO: 260579 - protein, 9 aa, Homo Sapiens
SMVRVEAKK

SEQ ID NO: 260580 - protein, 9 aa, Homo Sapiens
RFAMKYRRG

SEQ ID NO: 260581 - protein, 9 aa, Homo Sapiens
LEVRGCRPE

SEQ ID NO: 260582 - protein, 9 aa, Homo Sapiens
RELWFGLVT

SEQ ID NO: 260583 - protein, 9 aa, Homo Sapiens
TIPAVMLIF

SEQ ID NO: 260584 - protein, 9 aa, Homo Sapiens
DNVAALPGI

SEQ ID NO: 260585 - protein, 9 aa, Homo Sapiens
GAMHLARGT

SEQ ID NO: 260586 - protein, 9 aa, Homo Sapiens
EPEVVFLQP

SEQ ID NO: 260587 - protein, 9 aa, Homo Sapiens
HRYVINLMH

SEQ ID NO: 260588 - protein, 9 aa, Homo Sapiens
LIYLITMMG

SEQ ID NO: 260589 - protein, 9 aa, Homo Sapiens
SFHIGSDCP

SEQ ID NO: 260590 - protein, 9 aa, Homo Sapiens
NVEDQLREE

SEQ ID NO: 260591 - protein, 9 aa, Homo Sapiens
ECTLDDSAN

SEQ ID NO: 260592 - protein, 9 aa, Homo Sapiens
ITSGNTQNR

SEQ ID NO: 260593 - protein, 9 aa, Homo Sapiens
IKALRSRIR

SEQ ID NO: 260594 - protein, 9 aa, Homo Sapiens
FAAHKEKIQ

SEQ ID NO: 260595 - protein, 9 aa, Homo Sapiens
TQIDLDDNP

SEQ ID NO: 260596 - protein, 9 aa, Homo Sapiens
LNIYSATYD

SEQ ID NO: 260597 - protein, 9 aa, Homo Sapiens
SYTQTCTKT

SEQ ID NO: 260598 - protein, 9 aa, Homo Sapiens
RKKTRRMGT

SEQ ID NO: 260599 - protein, 9 aa, Homo Sapiens
KTFIFICKR

SEQ ID NO: 260600 - protein, 9 aa, Homo Sapiens
GPDKDKHFS

SEQ ID NO: 260601 - protein, 9 aa, Homo Sapiens
RCQCTLDKG

SEQ ID NO: 260602 - protein, 9 aa, Homo Sapiens
AEEKAIAQQ

SEQ ID NO: 260603 - protein, 9 aa, Homo Sapiens
QLRRIQRQT

SEQ ID NO: 260604 - protein, 9 aa, Homo Sapiens
AAGYRHFDC

SEQ ID NO: 260605 - protein, 9 aa, Homo Sapiens
WSHIQVAIK

SEQ ID NO: 260606 - protein, 9 aa, Homo Sapiens
EKDLDKKKK

SEQ ID NO: 260607 - protein, 9 aa, Homo Sapiens
DLIQFFKTL

SEQ ID NO: 260608 - protein, 9 aa, Homo Sapiens
RFYKIRLPE

SEQ ID NO: 260609 - protein, 9 aa, Homo Sapiens
KGPSSALVQ

SEQ ID NO: 260610 - protein, 9 aa, Homo Sapiens
QNFGYKLVM

SEQ ID NO: 260611 - protein, 9 aa, Homo Sapiens
WDSQERAFW

SEQ ID NO: 260612 - protein, 9 aa, Homo Sapiens
PEENFLSVD

SEQ ID NO: 260613 - protein, 9 aa, Homo Sapiens
EVKTLVGFL

SEQ ID NO: 260614 - protein, 9 aa, Homo Sapiens
KIKQLCSGA

SEQ ID NO: 260615 - protein, 9 aa, Homo Sapiens
RLTDYINKV

SEQ ID NO: 260616 - protein, 9 aa, Homo Sapiens
RMGIVSNYE

SEQ ID NO: 260617 - protein, 9 aa, Homo Sapiens
GWICGQVLN

SEQ ID NO: 260618 - protein, 9 aa, Homo Sapiens
DCGIMDDKT

SEQ ID NO: 260619 - protein, 9 aa, Homo Sapiens
VTIIGGIIF

SEQ ID NO: 260620 - protein, 9 aa, Homo Sapiens
NPSKMRKFF

SEQ ID NO: 260621 - protein, 9 aa, Homo Sapiens
GFWYSWRYQ

SEQ ID NO: 260622 - protein, 9 aa, Homo Sapiens
QYICRLNWS

SEQ ID NO: 260623 - protein, 9 aa, Homo Sapiens
SDDDSLAKR

SEQ ID NO: 260624 - protein, 9 aa, Homo Sapiens
RAKNAQLST

SEQ ID NO: 260625 - protein, 9 aa, Homo Sapiens
GFFSGIVFI

SEQ ID NO: 260626 - protein, 9 aa, Homo Sapiens
GNEDTNTFL

SEQ ID NO: 260627 - protein, 9 aa, Homo Sapiens
DQELDITKN

SEQ ID NO: 260628 - protein, 9 aa, Homo Sapiens
TIVKLSDEY

SEQ ID NO: 260629 - protein, 9 aa, Homo Sapiens
VLKALDPKI

SEQ ID NO: 260630 - protein, 9 aa, Homo Sapiens
LVNFLDIDP

SEQ ID NO: 260631 - protein, 9 aa, Homo Sapiens
PSSGSTGGG

SEQ ID NO: 260632 - protein, 9 aa, Homo Sapiens
DIQVDNLIP

SEQ ID NO: 260633 - protein, 9 aa, Homo Sapiens
NTVERFKDN

SEQ ID NO: 260634 - protein, 9 aa, Homo Sapiens
KLFDKTCTE

SEQ ID NO: 260635 - protein, 9 aa, Homo Sapiens
LEMVVAMVL

SEQ ID NO: 260636 - protein, 9 aa, Homo Sapiens
GNYLRTSTG

SEQ ID NO: 260637 - protein, 9 aa, Homo Sapiens
PVLPSGQRN

SEQ ID NO: 260638 - protein, 9 aa, Homo Sapiens
CSDVESSSE

SEQ ID NO: 260639 - protein, 9 aa, Homo Sapiens
ALMTINRME

SEQ ID NO: 260640 - protein, 9 aa, Homo Sapiens
LLGGQTSKA

SEQ ID NO: 260641 - protein, 9 aa, Homo Sapiens
VLDKSWLRH

SEQ ID NO: 260642 - protein, 9 aa, Homo Sapiens
PDPQMDYLA

SEQ ID NO: 260643 - protein, 9 aa, Homo Sapiens
DKKLGETLS

SEQ ID NO: 260644 - protein, 9 aa, Homo Sapiens
KDKILFGTE

SEQ ID NO: 260645 - protein, 9 aa, Homo Sapiens
QLENGLSRP

SEQ ID NO: 260646 - protein, 9 aa, Homo Sapiens
EIEDYTHQF

SEQ ID NO: 260647 - protein, 9 aa, Homo Sapiens
VVFVYFWQA

SEQ ID NO: 260648 - protein, 9 aa, Homo Sapiens
LLQASFERM

SEQ ID NO: 260649 - protein, 9 aa, Homo Sapiens
GNNSVQYKL

SEQ ID NO: 260650 - protein, 9 aa, Homo Sapiens
LVKHKLKEM

SEQ ID NO: 260651 - protein, 9 aa, Homo Sapiens
WCQEELLVA

SEQ ID NO: 260652 - protein, 9 aa, Homo Sapiens
VESNPRIFL

SEQ ID NO: 260653 - protein, 9 aa, Homo Sapiens
ELIISNSSS

SEQ ID NO: 260654 - protein, 9 aa, Homo Sapiens
MYYFSELVL

SEQ ID NO: 260655 - protein, 9 aa, Homo Sapiens
GVLTGLATI

SEQ ID NO: 260656 - protein, 9 aa, Homo Sapiens
LCYWFNRND

SEQ ID NO: 260657 - protein, 9 aa, Homo Sapiens
IGEYTSPLS

SEQ ID NO: 260658 - protein, 9 aa, Homo Sapiens
GEYNFPKQV

SEQ ID NO: 260659 - protein, 9 aa, Homo Sapiens
TTGDVNRDG

SEQ ID NO: 260660 - protein, 9 aa, Homo Sapiens
ARRKGHRVV

SEQ ID NO: 260661 - protein, 9 aa, Homo Sapiens
YSYLPESSC

SEQ ID NO: 260662 - protein, 9 aa, Homo Sapiens
FSLTMYIEM

SEQ ID NO: 260663 - protein, 9 aa, Homo Sapiens
NSSCYISCD

SEQ ID NO: 260664 - protein, 9 aa, Homo Sapiens
KWCTNCPKG

SEQ ID NO: 260665 - protein, 9 aa, Homo Sapiens
YEFPEYSQD

SEQ ID NO: 260666 - protein, 9 aa, Homo Sapiens
SIVLIFLLN

SEQ ID NO: 260667 - protein, 9 aa, Homo Sapiens
YNIVMPHRV

SEQ ID NO: 260668 - protein, 9 aa, Homo Sapiens
PQDELFILG

SEQ ID NO: 260669 - protein, 9 aa, Homo Sapiens
LRHPVRLFW

SEQ ID NO: 260670 - protein, 9 aa, Homo Sapiens
CVVQIRSDL

SEQ ID NO: 260671 - protein, 9 aa, Homo Sapiens
VKPLYNWLL

SEQ ID NO: 260672 - protein, 9 aa, Homo Sapiens
YWICNNLIK

SEQ ID NO: 260673 - protein, 9 aa, Homo Sapiens
SEVKLLSFA

SEQ ID NO: 260674 - protein, 9 aa, Homo Sapiens
FSQKACACA

SEQ ID NO: 260675 - protein, 9 aa, Homo Sapiens
VPPLPSEIN

SEQ ID NO: 260676 - protein, 9 aa, Homo Sapiens
LSEEMTYIK

SEQ ID NO: 260677 - protein, 9 aa, Homo Sapiens
MVNHRLIGM

SEQ ID NO: 260678 - protein, 9 aa, Homo Sapiens
EEGEGGSGA

SEQ ID NO: 260679 - protein, 9 aa, Homo Sapiens
MESSSVSLL

SEQ ID NO: 260680 - protein, 9 aa, Homo Sapiens
KTPNRLKHI

SEQ ID NO: 260681 - protein, 9 aa, Homo Sapiens
EELTALILA

SEQ ID NO: 260682 - protein, 9 aa, Homo Sapiens
IEYCLDDQK

SEQ ID NO: 260683 - protein, 9 aa, Homo Sapiens
KTLISLENF

SEQ ID NO: 260684 - protein, 9 aa, Homo Sapiens
NTRSSQFGS

SEQ ID NO: 260685 - protein, 9 aa, Homo Sapiens
FLDFAESDQ

SEQ ID NO: 260686 - protein, 9 aa, Homo Sapiens
MYRLRTQDD

SEQ ID NO: 260687 - protein, 9 aa, Homo Sapiens
IVKLMEQIQ

SEQ ID NO: 260688 - protein, 9 aa, Homo Sapiens
VAIELSLEE

SEQ ID NO: 260689 - protein, 9 aa, Homo Sapiens
LIHEITHTG

SEQ ID NO: 260690 - protein, 9 aa, Homo Sapiens
NNLYRDVMQ

SEQ ID NO: 260691 - protein, 9 aa, Homo Sapiens
CQGASMYEQ

SEQ ID NO: 260692 - protein, 9 aa, Homo Sapiens
QQPDGFNLL

SEQ ID NO: 260693 - protein, 9 aa, Homo Sapiens
SKLIRQSYH

SEQ ID NO: 260694 - protein, 9 aa, Homo Sapiens
WENNMKMIE

SEQ ID NO: 260695 - protein, 9 aa, Homo Sapiens
RKETAKKKK

SEQ ID NO: 260696 - protein, 9 aa, Homo Sapiens
PLQGLTTQD

SEQ ID NO: 260697 - protein, 9 aa, Homo Sapiens
GWSWFIPEG

SEQ ID NO: 260698 - protein, 9 aa, Homo Sapiens
TNNCCKPAS

SEQ ID NO: 260699 - protein, 9 aa, Homo Sapiens
GASQSRVGC

SEQ ID NO: 260700 - protein, 9 aa, Homo Sapiens
DKGPSSALV

SEQ ID NO: 260701 - protein, 9 aa, Homo Sapiens
KEGIVKQES

SEQ ID NO: 260702 - protein, 9 aa, Homo Sapiens
SFKNTLYDQ

SEQ ID NO: 260703 - protein, 9 aa, Homo Sapiens
GNRLKVIFY

SEQ ID NO: 260704 - protein, 9 aa, Homo Sapiens
EIDLTGSKV

SEQ ID NO: 260705 - protein, 9 aa, Homo Sapiens
VLIEYPELQ

SEQ ID NO: 260706 - protein, 9 aa, Homo Sapiens
CNIHTSPFP

SEQ ID NO: 260707 - protein, 9 aa, Homo Sapiens
PCKKLFYSS

SEQ ID NO: 260708 - protein, 9 aa, Homo Sapiens
SIRKNYCKV

SEQ ID NO: 260709 - protein, 9 aa, Homo Sapiens
NTKSPEPGC

SEQ ID NO: 260710 - protein, 9 aa, Homo Sapiens
KKYPNLSHI

SEQ ID NO: 260711 - protein, 9 aa, Homo Sapiens
PSASPTSIQ

SEQ ID NO: 260712 - protein, 9 aa, Homo Sapiens
CAAQNGDES

SEQ ID NO: 260713 - protein, 9 aa, Homo Sapiens
DLEWKNKQT

SEQ ID NO: 260714 - protein, 9 aa, Homo Sapiens
TIQKTFTCT

SEQ ID NO: 260715 - protein, 9 aa, Homo Sapiens
IHILHTNAK

SEQ ID NO: 260716 - protein, 9 aa, Homo Sapiens
FPDITFKHI

SEQ ID NO: 260717 - protein, 9 aa, Homo Sapiens
IRFTHAEKI

SEQ ID NO: 260718 - protein, 9 aa, Homo Sapiens
TCSLSYIVG

SEQ ID NO: 260719 - protein, 9 aa, Homo Sapiens
LHIPMHLLL

SEQ ID NO: 260720 - protein, 9 aa, Homo Sapiens
MKKPCFDYS

SEQ ID NO: 260721 - protein, 9 aa, Homo Sapiens
AKSCPRVIH

SEQ ID NO: 260722 - protein, 9 aa, Homo Sapiens
PMHEYADKL

SEQ ID NO: 260723 - protein, 9 aa, Homo Sapiens
NSVLCHGIP

SEQ ID NO: 260724 - protein, 9 aa, Homo Sapiens
FWLDDCAQV

SEQ ID NO: 260725 - protein, 9 aa, Homo Sapiens
DPEGMGVIP

SEQ ID NO: 260726 - protein, 9 aa, Homo Sapiens
TKSVTEVDA

SEQ ID NO: 260727 - protein, 9 aa, Homo Sapiens
LEKQQEQQE

SEQ ID NO: 260728 - protein, 9 aa, Homo Sapiens
NTEPFQERI

SEQ ID NO: 260729 - protein, 9 aa, Homo Sapiens
PYVSSDGLG

SEQ ID NO: 260730 - protein, 9 aa, Homo Sapiens
RKDPINAGL

SEQ ID NO: 260731 - protein, 9 aa, Homo Sapiens
REIKKKIHN

SEQ ID NO: 260732 - protein, 9 aa, Homo Sapiens
RSYTYFKAG

SEQ ID NO: 260733 - protein, 9 aa, Homo Sapiens
HFVQIPNKP

SEQ ID NO: 260734 - protein, 9 aa, Homo Sapiens
ALRLNSEKL

SEQ ID NO: 260735 - protein, 9 aa, Homo Sapiens
SHAIFNETK

SEQ ID NO: 260736 - protein, 9 aa, Homo Sapiens
LTRVKVQYL

SEQ ID NO: 260737 - protein, 9 aa, Homo Sapiens
KVQYLVLEP

SEQ ID NO: 260738 - protein, 9 aa, Homo Sapiens
VCGIFFSIL

SEQ ID NO: 260739 - protein, 9 aa, Homo Sapiens
TEAEKVKSY

SEQ ID NO: 260740 - protein, 9 aa, Homo Sapiens
SPALTLDFA

SEQ ID NO: 260741 - protein, 9 aa, Homo Sapiens
RHRSEPSNY

SEQ ID NO: 260742 - protein, 9 aa, Homo Sapiens
RGKTPLMIA

SEQ ID NO: 260743 - protein, 9 aa, Homo Sapiens
SLLSNNSLI

SEQ ID NO: 260744 - protein, 9 aa, Homo Sapiens
KTGHYDLME

SEQ ID NO: 260745 - protein, 9 aa, Homo Sapiens
LGAADRWFI

SEQ ID NO: 260746 - protein, 9 aa, Homo Sapiens
GHSLSDYNI

SEQ ID NO: 260747 - protein, 9 aa, Homo Sapiens
RRQNDLTYV

SEQ ID NO: 260748 - protein, 9 aa, Homo Sapiens
KCSECGNAF

SEQ ID NO: 260749 - protein, 9 aa, Homo Sapiens
FSIYTTLFN

SEQ ID NO: 260750 - protein, 9 aa, Homo Sapiens
RPYRPKPGN

SEQ ID NO: 260751 - protein, 9 aa, Homo Sapiens
GYWVLQVIF

SEQ ID NO: 260752 - protein, 9 aa, Homo Sapiens
VSKPLEDIK

SEQ ID NO: 260753 - protein, 9 aa, Homo Sapiens
RAAERVEAF

SEQ ID NO: 260754 - protein, 9 aa, Homo Sapiens
DSTRDGKVY

SEQ ID NO: 260755 - protein, 9 aa, Homo Sapiens
PISASKLSP

SEQ ID NO: 260756 - protein, 9 aa, Homo Sapiens
QIQIIDFGL

SEQ ID NO: 260757 - protein, 9 aa, Homo Sapiens
ITGNPYYIR

SEQ ID NO: 260758 - protein, 9 aa, Homo Sapiens
KIFAQAFLG

SEQ ID NO: 260759 - protein, 9 aa, Homo Sapiens
TYQINLKSH

SEQ ID NO: 260760 - protein, 9 aa, Homo Sapiens
VALDLHGVV

SEQ ID NO: 260761 - protein, 9 aa, Homo Sapiens
DGDDFVWGL

SEQ ID NO: 260762 - protein, 9 aa, Homo Sapiens
PHSAVSHAG

SEQ ID NO: 260763 - protein, 9 aa, Homo Sapiens
NNLMSQLGT

SEQ ID NO: 260764 - protein, 9 aa, Homo Sapiens
GDYMVKTIV

SEQ ID NO: 260765 - protein, 9 aa, Homo Sapiens
LRQNSSTSL

SEQ ID NO: 260766 - protein, 9 aa, Homo Sapiens
DPAGKHWLG

SEQ ID NO: 260767 - protein, 9 aa, Homo Sapiens
SVGVLAEIV

SEQ ID NO: 260768 - protein, 9 aa, Homo Sapiens
YYSSSLLMI

SEQ ID NO: 260769 - protein, 9 aa, Homo Sapiens
SLGPSHTQC

SEQ ID NO: 260770 - protein, 9 aa, Homo Sapiens
KFFQDHNMA

SEQ ID NO: 260771 - protein, 9 aa, Homo Sapiens
NSALQRHRI

SEQ ID NO: 260772 - protein, 9 aa, Homo Sapiens
EQRAVLNEP

SEQ ID NO: 260773 - protein, 9 aa, Homo Sapiens
GSPQMLTKE

SEQ ID NO: 260774 - protein, 9 aa, Homo Sapiens
LSREKKAAK

SEQ ID NO: 260775 - protein, 9 aa, Homo Sapiens
DFGHTEEGD

SEQ ID NO: 260776 - protein, 9 aa, Homo Sapiens
SMGEISAYQ

SEQ ID NO: 260777 - protein, 9 aa, Homo Sapiens
TEMYRIVSQ

SEQ ID NO: 260778 - protein, 9 aa, Homo Sapiens
SNFTPDKFC

SEQ ID NO: 260779 - protein, 9 aa, Homo Sapiens
KCRQIVSAV

SEQ ID NO: 260780 - protein, 9 aa, Homo Sapiens
NCINALKSE

SEQ ID NO: 260781 - protein, 9 aa, Homo Sapiens
ATLPHEVTQ

SEQ ID NO: 260782 - protein, 9 aa, Homo Sapiens
VEDCKDEYF

SEQ ID NO: 260783 - protein, 9 aa, Homo Sapiens
KGLNLRRAA

SEQ ID NO: 260784 - protein, 9 aa, Homo Sapiens
GRKVEGAPT

SEQ ID NO: 260785 - protein, 9 aa, Homo Sapiens
KDKHSILIT

SEQ ID NO: 260786 - protein, 9 aa, Homo Sapiens
LGNPPPPPG

SEQ ID NO: 260787 - protein, 9 aa, Homo Sapiens
CMYHTAKTR

SEQ ID NO: 260788 - protein, 9 aa, Homo Sapiens
GIWAIGCIF

SEQ ID NO: 260789 - protein, 9 aa, Homo Sapiens
YSRNTKLEF

SEQ ID NO: 260790 - protein, 9 aa, Homo Sapiens
QQNPQRKAL

SEQ ID NO: 260791 - protein, 9 aa, Homo Sapiens
MLVLYVVIA

SEQ ID NO: 260792 - protein, 9 aa, Homo Sapiens
GVELEPVTE

SEQ ID NO: 260793 - protein, 9 aa, Homo Sapiens
TLARQRKLH

SEQ ID NO: 260794 - protein, 9 aa, Homo Sapiens
YREPNLSQK

SEQ ID NO: 260795 - protein, 9 aa, Homo Sapiens
TSHLGNVHD

SEQ ID NO: 260796 - protein, 9 aa, Homo Sapiens
PQINLSKRQ

SEQ ID NO: 260797 - protein, 9 aa, Homo Sapiens
GIVEYPICE

SEQ ID NO: 260798 - protein, 9 aa, Homo Sapiens
LILDAVRLQ

SEQ ID NO: 260799 - protein, 9 aa, Homo Sapiens
ALASIYYPD

SEQ ID NO: 260800 - protein, 9 aa, Homo Sapiens
TAGDFQDIY

SEQ ID NO: 260801 - protein, 9 aa, Homo Sapiens
SVNLLSKSL

SEQ ID NO: 260802 - protein, 9 aa, Homo Sapiens
VSGDAGPIV

SEQ ID NO: 260803 - protein, 9 aa, Homo Sapiens
VMPRTLEGC

SEQ ID NO: 260804 - protein, 9 aa, Homo Sapiens
CYFGKGAAS

SEQ ID NO: 260805 - protein, 9 aa, Homo Sapiens
MMCVRPAQN

SEQ ID NO: 260806 - protein, 9 aa, Homo Sapiens
TMKLPDISA

SEQ ID NO: 260807 - protein, 9 aa, Homo Sapiens
CNRARPLHA

SEQ ID NO: 260808 - protein, 9 aa, Homo Sapiens
TIPVVSAVG

SEQ ID NO: 260809 - protein, 9 aa, Homo Sapiens
TSKGACFSP

SEQ ID NO: 260810 - protein, 9 aa, Homo Sapiens
SCPGDKLWD

SEQ ID NO: 260811 - protein, 9 aa, Homo Sapiens
VNVWPVKII

SEQ ID NO: 260812 - protein, 9 aa, Homo Sapiens
IDIEQDVNC

SEQ ID NO: 260813 - protein, 9 aa, Homo Sapiens
EEFEVDDLN

SEQ ID NO: 260814 - protein, 9 aa, Homo Sapiens
LVTNRPPTL

SEQ ID NO: 260815 - protein, 9 aa, Homo Sapiens
KIIGIKKAI

SEQ ID NO: 260816 - protein, 9 aa, Homo Sapiens
GTNKYLTEE

SEQ ID NO: 260817 - protein, 9 aa, Homo Sapiens
YFSESRADE

SEQ ID NO: 260818 - protein, 9 aa, Homo Sapiens
PTIGASVMT

SEQ ID NO: 260819 - protein, 9 aa, Homo Sapiens
PDLVNWIIK

SEQ ID NO: 260820 - protein, 9 aa, Homo Sapiens
DQLLEKEGF

SEQ ID NO: 260821 - protein, 9 aa, Homo Sapiens
TKMNLMVQA

SEQ ID NO: 260822 - protein, 9 aa, Homo Sapiens
KEETCTPMP

SEQ ID NO: 260823 - protein, 9 aa, Homo Sapiens
AKNRSLCRN

SEQ ID NO: 260824 - protein, 9 aa, Homo Sapiens
DHYLTDAWN

SEQ ID NO: 260825 - protein, 9 aa, Homo Sapiens
CCQSEMFKY

SEQ ID NO: 260826 - protein, 9 aa, Homo Sapiens
NEAYHPAER

SEQ ID NO: 260827 - protein, 9 aa, Homo Sapiens
RHKRIHTGD

SEQ ID NO: 260828 - protein, 9 aa, Homo Sapiens
LPAPPFGSS

SEQ ID NO: 260829 - protein, 9 aa, Homo Sapiens
PAGDGNKPS

SEQ ID NO: 260830 - protein, 9 aa, Homo Sapiens
HLRFQEFFA

SEQ ID NO: 260831 - protein, 9 aa, Homo Sapiens
NYHIVYQLC

SEQ ID NO: 260832 - protein, 9 aa, Homo Sapiens
LKRSFSADG

SEQ ID NO: 260833 - protein, 9 aa, Homo Sapiens
KYKLANYRY

SEQ ID NO: 260834 - protein, 9 aa, Homo Sapiens
NNCHRSRLR

SEQ ID NO: 260835 - protein, 9 aa, Homo Sapiens
LVSLKRNHN

SEQ ID NO: 260836 - protein, 9 aa, Homo Sapiens
EPSFVFADM

SEQ ID NO: 260837 - protein, 9 aa, Homo Sapiens
RKGMRVVDR

SEQ ID NO: 260838 - protein, 9 aa, Homo Sapiens
EDSGCCVAH

SEQ ID NO: 260839 - protein, 9 aa, Homo Sapiens
DAVEAILNQ

SEQ ID NO: 260840 - protein, 9 aa, Homo Sapiens
LRRHRSEPS

SEQ ID NO: 260841 - protein, 9 aa, Homo Sapiens
TLHLCSTEN

SEQ ID NO: 260842 - protein, 9 aa, Homo Sapiens
EKRTFFHWS

SEQ ID NO: 260843 - protein, 9 aa, Homo Sapiens
VATYMVIEH

SEQ ID NO: 260844 - protein, 9 aa, Homo Sapiens
NDPDHLNKL

SEQ ID NO: 260845 - protein, 9 aa, Homo Sapiens
MEILSETKD

SEQ ID NO: 260846 - protein, 9 aa, Homo Sapiens
NSPYDGLCI

SEQ ID NO: 260847 - protein, 9 aa, Homo Sapiens
FTLDEIYGD

SEQ ID NO: 260848 - protein, 9 aa, Homo Sapiens
CYREPNLSQ

SEQ ID NO: 260849 - protein, 9 aa, Homo Sapiens
FKYPSVAVV

SEQ ID NO: 260850 - protein, 9 aa, Homo Sapiens
LEDLAMFQS

SEQ ID NO: 260851 - protein, 9 aa, Homo Sapiens
WLIGLDDSL

SEQ ID NO: 260852 - protein, 9 aa, Homo Sapiens
GNVEDQLRE

SEQ ID NO: 260853 - protein, 9 aa, Homo Sapiens
CAILLDRYV

SEQ ID NO: 260854 - protein, 9 aa, Homo Sapiens
GNFVGSNAV

SEQ ID NO: 260855 - protein, 9 aa, Homo Sapiens
ILLVRYQKC

SEQ ID NO: 260856 - protein, 9 aa, Homo Sapiens
SITLSNWWF

SEQ ID NO: 260857 - protein, 9 aa, Homo Sapiens
DLVCKKRVE

SEQ ID NO: 260858 - protein, 9 aa, Homo Sapiens
YLSANDVFP

SEQ ID NO: 260859 - protein, 9 aa, Homo Sapiens
PASGEELWP

SEQ ID NO: 260860 - protein, 9 aa, Homo Sapiens
TFDGKLKCW

SEQ ID NO: 260861 - protein, 9 aa, Homo Sapiens
HVKKRNMLN

SEQ ID NO: 260862 - protein, 9 aa, Homo Sapiens
FWFHVVKVY

SEQ ID NO: 260863 - protein, 9 aa, Homo Sapiens
LIEYFTYEE

SEQ ID NO: 260864 - protein, 9 aa, Homo Sapiens
KKELSMLNQ

SEQ ID NO: 260865 - protein, 9 aa, Homo Sapiens
NVKAKNKAK

SEQ ID NO: 260866 - protein, 9 aa, Homo Sapiens
LSEDDTVLN

SEQ ID NO: 260867 - protein, 9 aa, Homo Sapiens
MAFVYFEQL

SEQ ID NO: 260868 - protein, 9 aa, Homo Sapiens
KRVLGKILL

SEQ ID NO: 260869 - protein, 9 aa, Homo Sapiens
ESLLSNDLV

SEQ ID NO: 260870 - protein, 9 aa, Homo Sapiens
IGGLWNNNE

SEQ ID NO: 260871 - protein, 9 aa, Homo Sapiens
HFRGLEERK

SEQ ID NO: 260872 - protein, 9 aa, Homo Sapiens
SCSQSSDNK

SEQ ID NO: 260873 - protein, 9 aa, Homo Sapiens
EQCVNETSI

SEQ ID NO: 260874 - protein, 9 aa, Homo Sapiens
SLGLDHCPS

SEQ ID NO: 260875 - protein, 9 aa, Homo Sapiens
PQKGLSPFR

SEQ ID NO: 260876 - protein, 9 aa, Homo Sapiens
TCTIVFLLL

SEQ ID NO: 260877 - protein, 9 aa, Homo Sapiens
VTEDFSPWD

SEQ ID NO: 260878 - protein, 9 aa, Homo Sapiens
NWMMCVRPA

SEQ ID NO: 260879 - protein, 9 aa, Homo Sapiens
VDGYIWPWT

SEQ ID NO: 260880 - protein, 9 aa, Homo Sapiens
LFKRDVCGK

SEQ ID NO: 260881 - protein, 9 aa, Homo Sapiens
NAVAALSET

SEQ ID NO: 260882 - protein, 9 aa, Homo Sapiens
RNDMQLDSE

SEQ ID NO: 260883 - protein, 9 aa, Homo Sapiens
SVFSDADLR

SEQ ID NO: 260884 - protein, 9 aa, Homo Sapiens
YGSQIMGGM

SEQ ID NO: 260885 - protein, 9 aa, Homo Sapiens
HPDTNQDDA

SEQ ID NO: 260886 - protein, 9 aa, Homo Sapiens
LRQLKRFRQ

SEQ ID NO: 260887 - protein, 9 aa, Homo Sapiens
GPDGSALFN

SEQ ID NO: 260888 - protein, 9 aa, Homo Sapiens
KQDTYGNIY

SEQ ID NO: 260889 - protein, 9 aa, Homo Sapiens
VLLHPNMAA

SEQ ID NO: 260890 - protein, 9 aa, Homo Sapiens
HKRVVCNQE

SEQ ID NO: 260891 - protein, 9 aa, Homo Sapiens
NVGSRKYAV

SEQ ID NO: 260892 - protein, 9 aa, Homo Sapiens
KKVKCILKT

SEQ ID NO: 260893 - protein, 9 aa, Homo Sapiens
SRKSTKRTN

SEQ ID NO: 260894 - protein, 9 aa, Homo Sapiens
SSEHCFVAE

SEQ ID NO: 260895 - protein, 9 aa, Homo Sapiens
ELDNDIKVE

SEQ ID NO: 260896 - protein, 9 aa, Homo Sapiens
KGISDEDVL

SEQ ID NO: 260897 - protein, 9 aa, Homo Sapiens
SGAAFDADG

SEQ ID NO: 260898 - protein, 9 aa, Homo Sapiens
QERIIREVC

SEQ ID NO: 260899 - protein, 9 aa, Homo Sapiens
SASSSNHSQ

SEQ ID NO: 260900 - protein, 9 aa, Homo Sapiens
GGPECEELL

SEQ ID NO: 260901 - protein, 9 aa, Homo Sapiens
VVVAFCAGL

SEQ ID NO: 260902 - protein, 9 aa, Homo Sapiens
GFRVRLLAA

SEQ ID NO: 260903 - protein, 9 aa, Homo Sapiens
GKEFNHNYR

SEQ ID NO: 260904 - protein, 9 aa, Homo Sapiens
EMADRFACT

SEQ ID NO: 260905 - protein, 9 aa, Homo Sapiens
EMVVNAACK

SEQ ID NO: 260906 - protein, 9 aa, Homo Sapiens
GSVESNGRS

SEQ ID NO: 260907 - protein, 9 aa, Homo Sapiens
FLCREYPCS

SEQ ID NO: 260908 - protein, 9 aa, Homo Sapiens
RTDKGRDSS

SEQ ID NO: 260909 - protein, 9 aa, Homo Sapiens
ILPSNTHKD

SEQ ID NO: 260910 - protein, 9 aa, Homo Sapiens
AWFDQHQII

SEQ ID NO: 260911 - protein, 9 aa, Homo Sapiens
GGSGTNEFT

SEQ ID NO: 260912 - protein, 9 aa, Homo Sapiens
FFFFNLVRL

SEQ ID NO: 260913 - protein, 9 aa, Homo Sapiens
KLLLGQICS

SEQ ID NO: 260914 - protein, 9 aa, Homo Sapiens
LFCADHKLQ

SEQ ID NO: 260915 - protein, 9 aa, Homo Sapiens
VQLNDGHFM

SEQ ID NO: 260916 - protein, 9 aa, Homo Sapiens
ISLDRLVVK

SEQ ID NO: 260917 - protein, 9 aa, Homo Sapiens
HCFIPQEAV

SEQ ID NO: 260918 - protein, 9 aa, Homo Sapiens
LEKSRTRYP

SEQ ID NO: 260919 - protein, 9 aa, Homo Sapiens
GSVTLKDVI

SEQ ID NO: 260920 - protein, 9 aa, Homo Sapiens
IADGYHVPF

SEQ ID NO: 260921 - protein, 9 aa, Homo Sapiens
FFQIVICLG

SEQ ID NO: 260922 - protein, 9 aa, Homo Sapiens
RRSISSDRG

SEQ ID NO: 260923 - protein, 9 aa, Homo Sapiens
LLNILALVY

SEQ ID NO: 260924 - protein, 9 aa, Homo Sapiens
KMSSPEDDL

SEQ ID NO: 260925 - protein, 9 aa, Homo Sapiens
PVIANKTNR

SEQ ID NO: 260926 - protein, 9 aa, Homo Sapiens
RKKKIAIIN

SEQ ID NO: 260927 - protein, 9 aa, Homo Sapiens
EWRLRGPPP

SEQ ID NO: 260928 - protein, 9 aa, Homo Sapiens
GYILVKKTN

SEQ ID NO: 260929 - protein, 9 aa, Homo Sapiens
PPPCPVSFL

SEQ ID NO: 260930 - protein, 9 aa, Homo Sapiens
GHLKEVKIE

SEQ ID NO: 260931 - protein, 9 aa, Homo Sapiens
ETYLEKDGN

SEQ ID NO: 260932 - protein, 9 aa, Homo Sapiens
QCVHTGERP

SEQ ID NO: 260933 - protein, 9 aa, Homo Sapiens
FPEIYFLGP

SEQ ID NO: 260934 - protein, 9 aa, Homo Sapiens
GYFKDKASV

SEQ ID NO: 260935 - protein, 9 aa, Homo Sapiens
KDFSSTAQG

SEQ ID NO: 260936 - protein, 9 aa, Homo Sapiens
YCKGITLFL

SEQ ID NO: 260937 - protein, 9 aa, Homo Sapiens
VKQIKEGCL

SEQ ID NO: 260938 - protein, 9 aa, Homo Sapiens
VIKSLQKNG

SEQ ID NO: 260939 - protein, 9 aa, Homo Sapiens
LVNTAGISL

SEQ ID NO: 260940 - protein, 9 aa, Homo Sapiens
LWCQQIPGT

SEQ ID NO: 260941 - protein, 9 aa, Homo Sapiens
GQKYSVTSK

SEQ ID NO: 260942 - protein, 9 aa, Homo Sapiens
TVYFYELQD

SEQ ID NO: 260943 - protein, 9 aa, Homo Sapiens
EVNTTIYVI

SEQ ID NO: 260944 - protein, 9 aa, Homo Sapiens
TDTSFKNTL

SEQ ID NO: 260945 - protein, 9 aa, Homo Sapiens
KTELHSTAT

SEQ ID NO: 260946 - protein, 9 aa, Homo Sapiens
GSPLPGPHD

SEQ ID NO: 260947 - protein, 9 aa, Homo Sapiens
TMYIEMPYV

SEQ ID NO: 260948 - protein, 9 aa, Homo Sapiens
LTLFASHFS

SEQ ID NO: 260949 - protein, 9 aa, Homo Sapiens
VHGAFMFVA

SEQ ID NO: 260950 - protein, 9 aa, Homo Sapiens
EVSRPGYQH

SEQ ID NO: 260951 - protein, 9 aa, Homo Sapiens
STAIVIRCK

SEQ ID NO: 260952 - protein, 9 aa, Homo Sapiens
DVSSCYRQK

SEQ ID NO: 260953 - protein, 9 aa, Homo Sapiens
ELDYVIALD

SEQ ID NO: 260954 - protein, 9 aa, Homo Sapiens
VHATFRAVD

SEQ ID NO: 260955 - protein, 9 aa, Homo Sapiens
AIRWHDNVF

SEQ ID NO: 260956 - protein, 9 aa, Homo Sapiens
IIAFSCPQK

SEQ ID NO: 260957 - protein, 9 aa, Homo Sapiens
QAGIFKPRS

SEQ ID NO: 260958 - protein, 9 aa, Homo Sapiens
VSRFVLLGI

SEQ ID NO: 260959 - protein, 9 aa, Homo Sapiens
ASLVGPFTT

SEQ ID NO: 260960 - protein, 9 aa, Homo Sapiens
GLWECVLPE

SEQ ID NO: 260961 - protein, 9 aa, Homo Sapiens
IRVDLVMCP

SEQ ID NO: 260962 - protein, 9 aa, Homo Sapiens
MTELSRLRR

SEQ ID NO: 260963 - protein, 9 aa, Homo Sapiens
SEQIWKLRR

SEQ ID NO: 260964 - protein, 9 aa, Homo Sapiens
PMTFPGLFK

SEQ ID NO: 260965 - protein, 9 aa, Homo Sapiens
IYGSAVADT

SEQ ID NO: 260966 - protein, 9 aa, Homo Sapiens
SSFKMTTGH

SEQ ID NO: 260967 - protein, 9 aa, Homo Sapiens
ELWETRVLG

SEQ ID NO: 260968 - protein, 9 aa, Homo Sapiens
NGTQGAVGC

SEQ ID NO: 260969 - protein, 9 aa, Homo Sapiens
QVLRHLFSI

SEQ ID NO: 260970 - protein, 9 aa, Homo Sapiens
PLYAIFVIF

SEQ ID NO: 260971 - protein, 9 aa, Homo Sapiens
VRALIEGQV

SEQ ID NO: 260972 - protein, 9 aa, Homo Sapiens
APPPGLTPF

SEQ ID NO: 260973 - protein, 9 aa, Homo Sapiens
QEETTELGS

SEQ ID NO: 260974 - protein, 9 aa, Homo Sapiens
SPRQTAPRP

SEQ ID NO: 260975 - protein, 9 aa, Homo Sapiens
AILKSELTK

SEQ ID NO: 260976 - protein, 9 aa, Homo Sapiens
QQLEKYLYF

SEQ ID NO: 260977 - protein, 9 aa, Homo Sapiens
RTKQLREII

SEQ ID NO: 260978 - protein, 9 aa, Homo Sapiens
LNKRILNFL

SEQ ID NO: 260979 - protein, 9 aa, Homo Sapiens
MPGQFAPDH

SEQ ID NO: 260980 - protein, 9 aa, Homo Sapiens
VKTTESSLP

SEQ ID NO: 260981 - protein, 9 aa, Homo Sapiens
PCYREPNLS

SEQ ID NO: 260982 - protein, 9 aa, Homo Sapiens
IKELRDQSV

SEQ ID NO: 260983 - protein, 9 aa, Homo Sapiens
GATNNPSGQ

SEQ ID NO: 260984 - protein, 9 aa, Homo Sapiens
TIQVGEIIR

SEQ ID NO: 260985 - protein, 9 aa, Homo Sapiens
AYVTDFVDL

SEQ ID NO: 260986 - protein, 9 aa, Homo Sapiens
GIYAPTSSR

SEQ ID NO: 260987 - protein, 9 aa, Homo Sapiens
GHLVFTSIF

SEQ ID NO: 260988 - protein, 9 aa, Homo Sapiens
RIDSNRSET

SEQ ID NO: 260989 - protein, 9 aa, Homo Sapiens
RHSLNAGLV

SEQ ID NO: 260990 - protein, 9 aa, Homo Sapiens
YRTVGFGTQ

SEQ ID NO: 260991 - protein, 9 aa, Homo Sapiens
LNYVQERKN

SEQ ID NO: 260992 - protein, 9 aa, Homo Sapiens
YYKSRRNCS

SEQ ID NO: 260993 - protein, 9 aa, Homo Sapiens
IKAFGVHVS

SEQ ID NO: 260994 - protein, 9 aa, Homo Sapiens
RFMTPEFRN

SEQ ID NO: 260995 - protein, 9 aa, Homo Sapiens
RYIVYCTGV

SEQ ID NO: 260996 - protein, 9 aa, Homo Sapiens
LVRTLNGHK

SEQ ID NO: 260997 - protein, 9 aa, Homo Sapiens
KGTLQHAEL

SEQ ID NO: 260998 - protein, 9 aa, Homo Sapiens
IFNIAWSIN

SEQ ID NO: 260999 - protein, 9 aa, Homo Sapiens
GHVQAGQSL

SEQ ID NO: 261000 - protein, 9 aa, Homo Sapiens
LKEKYILVL

SEQ ID NO: 261001 - protein, 9 aa, Homo Sapiens
ALLKKHHHH

SEQ ID NO: 261002 - protein, 9 aa, Homo Sapiens
VVTSQLGRC

SEQ ID NO: 261003 - protein, 9 aa, Homo Sapiens
LNALGGPGI

SEQ ID NO: 261004 - protein, 9 aa, Homo Sapiens
SSYLSSSCK

SEQ ID NO: 261005 - protein, 9 aa, Homo Sapiens
LPTPIMYWA

SEQ ID NO: 261006 - protein, 9 aa, Homo Sapiens
ITEKDKIEK

SEQ ID NO: 261007 - protein, 9 aa, Homo Sapiens
LKAALDNKL

SEQ ID NO: 261008 - protein, 9 aa, Homo Sapiens
PNGTVTVIT

SEQ ID NO: 261009 - protein, 9 aa, Homo Sapiens
AQYKKFKVG

SEQ ID NO: 261010 - protein, 9 aa, Homo Sapiens
TTKSVEFTF

SEQ ID NO: 261011 - protein, 9 aa, Homo Sapiens
HQHHELCDI

SEQ ID NO: 261012 - protein, 9 aa, Homo Sapiens
SKIEQWLEQ

SEQ ID NO: 261013 - protein, 9 aa, Homo Sapiens
HFMNTSRME

SEQ ID NO: 261014 - protein, 9 aa, Homo Sapiens
EKINFLLGS

SEQ ID NO: 261015 - protein, 9 aa, Homo Sapiens
TLDHLLKLY

SEQ ID NO: 261016 - protein, 9 aa, Homo Sapiens
KWLTQVRNL

SEQ ID NO: 261017 - protein, 9 aa, Homo Sapiens
QPKPNTRSS

SEQ ID NO: 261018 - protein, 9 aa, Homo Sapiens
LDKGGESCS

SEQ ID NO: 261019 - protein, 9 aa, Homo Sapiens
RPQQELHNQ

SEQ ID NO: 261020 - protein, 9 aa, Homo Sapiens
LIYLRAGSK

SEQ ID NO: 261021 - protein, 9 aa, Homo Sapiens
SDPERKRFH

SEQ ID NO: 261022 - protein, 9 aa, Homo Sapiens
GLGGMASTF

SEQ ID NO: 261023 - protein, 9 aa, Homo Sapiens
STYNLINEG

SEQ ID NO: 261024 - protein, 9 aa, Homo Sapiens
VNGVGTQNA

SEQ ID NO: 261025 - protein, 9 aa, Homo Sapiens
ASKLSPGGG

SEQ ID NO: 261026 - protein, 9 aa, Homo Sapiens
INRRTIGVQ

SEQ ID NO: 261027 - protein, 9 aa, Homo Sapiens
IEILDASEV

SEQ ID NO: 261028 - protein, 9 aa, Homo Sapiens
NSVIIKCDG

SEQ ID NO: 261029 - protein, 9 aa, Homo Sapiens
MISAYGAAG

SEQ ID NO: 261030 - protein, 9 aa, Homo Sapiens
ICPIDITLT

SEQ ID NO: 261031 - protein, 9 aa, Homo Sapiens
VKLLNAKLQ

SEQ ID NO: 261032 - protein, 9 aa, Homo Sapiens
EGSRNSQFQ

SEQ ID NO: 261033 - protein, 9 aa, Homo Sapiens
LPLPMDGHA

SEQ ID NO: 261034 - protein, 9 aa, Homo Sapiens
LIYKDVEDI

SEQ ID NO: 261035 - protein, 9 aa, Homo Sapiens
KGNQTKNVY

SEQ ID NO: 261036 - protein, 9 aa, Homo Sapiens
SISSGYLRY

SEQ ID NO: 261037 - protein, 9 aa, Homo Sapiens
LHGMDMSVI

SEQ ID NO: 261038 - protein, 9 aa, Homo Sapiens
REGIVEYPI

SEQ ID NO: 261039 - protein, 9 aa, Homo Sapiens
YEDKNFPRT

SEQ ID NO: 261040 - protein, 9 aa, Homo Sapiens
KESFFAERL

SEQ ID NO: 261041 - protein, 9 aa, Homo Sapiens
RALIEGQVM

SEQ ID NO: 261042 - protein, 9 aa, Homo Sapiens
PPVENRRNR

SEQ ID NO: 261043 - protein, 9 aa, Homo Sapiens
KEMVLDFVN

SEQ ID NO: 261044 - protein, 9 aa, Homo Sapiens
NIQYYMMFK

SEQ ID NO: 261045 - protein, 9 aa, Homo Sapiens
PSLLSNNSL

SEQ ID NO: 261046 - protein, 9 aa, Homo Sapiens
SAVVHELQR

SEQ ID NO: 261047 - protein, 9 aa, Homo Sapiens
FDTAESPIS

SEQ ID NO: 261048 - protein, 9 aa, Homo Sapiens
PPHPSNLQL

SEQ ID NO: 261049 - protein, 9 aa, Homo Sapiens
YNTMIENLK

SEQ ID NO: 261050 - protein, 9 aa, Homo Sapiens
SLIHINYYL

SEQ ID NO: 261051 - protein, 9 aa, Homo Sapiens
LVFDEADQM

SEQ ID NO: 261052 - protein, 9 aa, Homo Sapiens
GSCLFIYVK

SEQ ID NO: 261053 - protein, 9 aa, Homo Sapiens
TPSVVSASL

SEQ ID NO: 261054 - protein, 9 aa, Homo Sapiens
TLNLTAGNE

SEQ ID NO: 261055 - protein, 9 aa, Homo Sapiens
VKKKSKKEK

SEQ ID NO: 261056 - protein, 9 aa, Homo Sapiens
RRWMGPTDP

SEQ ID NO: 261057 - protein, 9 aa, Homo Sapiens
MCRECEQGF

SEQ ID NO: 261058 - protein, 9 aa, Homo Sapiens
VSLQDKNCE

SEQ ID NO: 261059 - protein, 9 aa, Homo Sapiens
SHSLNELKT

SEQ ID NO: 261060 - protein, 9 aa, Homo Sapiens
LDKVYLYPL

SEQ ID NO: 261061 - protein, 9 aa, Homo Sapiens
GCHRQLDKS

SEQ ID NO: 261062 - protein, 9 aa, Homo Sapiens
YYFWSQEDK

SEQ ID NO: 261063 - protein, 9 aa, Homo Sapiens
DKEAISVVC

SEQ ID NO: 261064 - protein, 9 aa, Homo Sapiens
ASAQENYNA

SEQ ID NO: 261065 - protein, 9 aa, Homo Sapiens
KVPADIEKC

SEQ ID NO: 261066 - protein, 9 aa, Homo Sapiens
NKKIIFVPS

SEQ ID NO: 261067 - protein, 9 aa, Homo Sapiens
QVQIGALEE

SEQ ID NO: 261068 - protein, 9 aa, Homo Sapiens
QSEDSGGGD

SEQ ID NO: 261069 - protein, 9 aa, Homo Sapiens
IKTDLTDPD

SEQ ID NO: 261070 - protein, 9 aa, Homo Sapiens
QEVMEWNGW

SEQ ID NO: 261071 - protein, 9 aa, Homo Sapiens
VNSVATKTV

SEQ ID NO: 261072 - protein, 9 aa, Homo Sapiens
KELRDQSVS

SEQ ID NO: 261073 - protein, 9 aa, Homo Sapiens
KWLDINGNH

SEQ ID NO: 261074 - protein, 9 aa, Homo Sapiens
VFKDKPEAQ

SEQ ID NO: 261075 - protein, 9 aa, Homo Sapiens
YNSIITTHT

SEQ ID NO: 261076 - protein, 9 aa, Homo Sapiens
VLRKHKDLL

SEQ ID NO: 261077 - protein, 9 aa, Homo Sapiens
GNYAVWFRL

SEQ ID NO: 261078 - protein, 9 aa, Homo Sapiens
PHKVRCNCV

SEQ ID NO: 261079 - protein, 9 aa, Homo Sapiens
QLRTLLTYV

SEQ ID NO: 261080 - protein, 9 aa, Homo Sapiens
RNKRKKYPQ

SEQ ID NO: 261081 - protein, 9 aa, Homo Sapiens
DSERKAREV

SEQ ID NO: 261082 - protein, 9 aa, Homo Sapiens
INVKNDRDR

SEQ ID NO: 261083 - protein, 9 aa, Homo Sapiens
NTPLPAWHR

SEQ ID NO: 261084 - protein, 9 aa, Homo Sapiens
IAKEEQQKA

SEQ ID NO: 261085 - protein, 9 aa, Homo Sapiens
HKHKKKEAA

SEQ ID NO: 261086 - protein, 9 aa, Homo Sapiens
GLFETGSYF

SEQ ID NO: 261087 - protein, 9 aa, Homo Sapiens
GGNIKPTSF

SEQ ID NO: 261088 - protein, 9 aa, Homo Sapiens
ERKKDCKQV

SEQ ID NO: 261089 - protein, 9 aa, Homo Sapiens
KEANIRAKE

SEQ ID NO: 261090 - protein, 9 aa, Homo Sapiens
GRGRDIRSP

SEQ ID NO: 261091 - protein, 9 aa, Homo Sapiens
ALVKVVAVT

SEQ ID NO: 261092 - protein, 9 aa, Homo Sapiens
CRLVPSPDQ

SEQ ID NO: 261093 - protein, 9 aa, Homo Sapiens
FAGVIALSL

SEQ ID NO: 261094 - protein, 9 aa, Homo Sapiens
STNVLKQNV

SEQ ID NO: 261095 - protein, 9 aa, Homo Sapiens
NEQYCIFAN

SEQ ID NO: 261096 - protein, 9 aa, Homo Sapiens
NSFSKMNCS

SEQ ID NO: 261097 - protein, 9 aa, Homo Sapiens
SQARSSPAT

SEQ ID NO: 261098 - protein, 9 aa, Homo Sapiens
FISQLQNKF

SEQ ID NO: 261099 - protein, 9 aa, Homo Sapiens
HCSWNYRLP

SEQ ID NO: 261100 - protein, 9 aa, Homo Sapiens
ENGLEDPSI

SEQ ID NO: 261101 - protein, 9 aa, Homo Sapiens
KTESTNLIL

SEQ ID NO: 261102 - protein, 9 aa, Homo Sapiens
IRWFENDKE

SEQ ID NO: 261103 - protein, 9 aa, Homo Sapiens
NEFHIYIAK

SEQ ID NO: 261104 - protein, 9 aa, Homo Sapiens
FLDKFFLVA

SEQ ID NO: 261105 - protein, 9 aa, Homo Sapiens
PHLKNKDPK

SEQ ID NO: 261106 - protein, 9 aa, Homo Sapiens
EICLYRKDG

SEQ ID NO: 261107 - protein, 9 aa, Homo Sapiens
QESLEVAMQ

SEQ ID NO: 261108 - protein, 9 aa, Homo Sapiens
EKLADASES

SEQ ID NO: 261109 - protein, 9 aa, Homo Sapiens
PPNAIIFSY

SEQ ID NO: 261110 - protein, 9 aa, Homo Sapiens
NKKAETGDT

SEQ ID NO: 261111 - protein, 9 aa, Homo Sapiens
YLMFWFGVT

SEQ ID NO: 261112 - protein, 9 aa, Homo Sapiens
FSLGYGSMI

SEQ ID NO: 261113 - protein, 9 aa, Homo Sapiens
RMSCVKGWG

SEQ ID NO: 261114 - protein, 9 aa, Homo Sapiens
KRARKITSM

SEQ ID NO: 261115 - protein, 9 aa, Homo Sapiens
EGSAEASGA

SEQ ID NO: 261116 - protein, 9 aa, Homo Sapiens
FSYEKSNTT

SEQ ID NO: 261117 - protein, 9 aa, Homo Sapiens
IRICVSHTE

SEQ ID NO: 261118 - protein, 9 aa, Homo Sapiens
GGTQPHSCI

SEQ ID NO: 261119 - protein, 9 aa, Homo Sapiens
CIGKELSKM

SEQ ID NO: 261120 - protein, 9 aa, Homo Sapiens
ASESKFIFR

SEQ ID NO: 261121 - protein, 9 aa, Homo Sapiens
LPEDYGVLK

SEQ ID NO: 261122 - protein, 9 aa, Homo Sapiens
LDEKGGRVG

SEQ ID NO: 261123 - protein, 9 aa, Homo Sapiens
NSYYELYMA

SEQ ID NO: 261124 - protein, 9 aa, Homo Sapiens
KTKKNYNNL

SEQ ID NO: 261125 - protein, 9 aa, Homo Sapiens
AIQDKDRAK

SEQ ID NO: 261126 - protein, 9 aa, Homo Sapiens
SIHFIILMG

SEQ ID NO: 261127 - protein, 9 aa, Homo Sapiens
RTLPINSKT

SEQ ID NO: 261128 - protein, 9 aa, Homo Sapiens
DVNNHLNYE

SEQ ID NO: 261129 - protein, 9 aa, Homo Sapiens
EQGKSQRNS

SEQ ID NO: 261130 - protein, 9 aa, Homo Sapiens
QQNNLSSSA

SEQ ID NO: 261131 - protein, 9 aa, Homo Sapiens
KATMNILVI

SEQ ID NO: 261132 - protein, 9 aa, Homo Sapiens
CAVGVNVSG

SEQ ID NO: 261133 - protein, 9 aa, Homo Sapiens
DTGQMFAMK

SEQ ID NO: 261134 - protein, 9 aa, Homo Sapiens
EDGSVISEK

SEQ ID NO: 261135 - protein, 9 aa, Homo Sapiens
QKQELKYLF

SEQ ID NO: 261136 - protein, 9 aa, Homo Sapiens
GHAMDFSFL

SEQ ID NO: 261137 - protein, 9 aa, Homo Sapiens
QTQASLDKH

SEQ ID NO: 261138 - protein, 9 aa, Homo Sapiens
DDNEVYSAT

SEQ ID NO: 261139 - protein, 9 aa, Homo Sapiens
NTCTIDGLL

SEQ ID NO: 261140 - protein, 9 aa, Homo Sapiens
AVKALLVLL

SEQ ID NO: 261141 - protein, 9 aa, Homo Sapiens
RSVFASPES

SEQ ID NO: 261142 - protein, 9 aa, Homo Sapiens
YPQMNDFNI

SEQ ID NO: 261143 - protein, 9 aa, Homo Sapiens
PGIKLYPFI

SEQ ID NO: 261144 - protein, 9 aa, Homo Sapiens
PAVVEQWST

SEQ ID NO: 261145 - protein, 9 aa, Homo Sapiens
IYILGNCSK

SEQ ID NO: 261146 - protein, 9 aa, Homo Sapiens
SRYDGALLD

SEQ ID NO: 261147 - protein, 9 aa, Homo Sapiens
LEDDVAKKG

SEQ ID NO: 261148 - protein, 9 aa, Homo Sapiens
LDVKPRLEG

SEQ ID NO: 261149 - protein, 9 aa, Homo Sapiens
AVGVHKVGA

SEQ ID NO: 261150 - protein, 9 aa, Homo Sapiens
GQILNIPDT

SEQ ID NO: 261151 - protein, 9 aa, Homo Sapiens
TLGMRVAFP

SEQ ID NO: 261152 - protein, 9 aa, Homo Sapiens
NLVWMQGSA

SEQ ID NO: 261153 - protein, 9 aa, Homo Sapiens
KEKKSNDLT

SEQ ID NO: 261154 - protein, 9 aa, Homo Sapiens
RGKVSKDDC

SEQ ID NO: 261155 - protein, 9 aa, Homo Sapiens
DLTCEIKIK

SEQ ID NO: 261156 - protein, 9 aa, Homo Sapiens
ISVLVILST

SEQ ID NO: 261157 - protein, 9 aa, Homo Sapiens
MKEDVPAWE

SEQ ID NO: 261158 - protein, 9 aa, Homo Sapiens
ASAPIPKDL

SEQ ID NO: 261159 - protein, 9 aa, Homo Sapiens
EYVSQHLGE

SEQ ID NO: 261160 - protein, 9 aa, Homo Sapiens
HEMKQSNSK

SEQ ID NO: 261161 - protein, 9 aa, Homo Sapiens
KPSPSFMTS

SEQ ID NO: 261162 - protein, 9 aa, Homo Sapiens
YGVASCGAC

SEQ ID NO: 261163 - protein, 9 aa, Homo Sapiens
LSSSAGYLQ

SEQ ID NO: 261164 - protein, 9 aa, Homo Sapiens
AHHQVQSFA

SEQ ID NO: 261165 - protein, 9 aa, Homo Sapiens
VVQIYHRKA

SEQ ID NO: 261166 - protein, 9 aa, Homo Sapiens
YAPAHANTG

SEQ ID NO: 261167 - protein, 9 aa, Homo Sapiens
IHKLNNLIK

SEQ ID NO: 261168 - protein, 9 aa, Homo Sapiens
EDFHLSHVI

SEQ ID NO: 261169 - protein, 9 aa, Homo Sapiens
AKGMAFLTS

SEQ ID NO: 261170 - protein, 9 aa, Homo Sapiens
IFFQVGCLS

SEQ ID NO: 261171 - protein, 9 aa, Homo Sapiens
DNLLINQIE

SEQ ID NO: 261172 - protein, 9 aa, Homo Sapiens
AAEKVEENN

SEQ ID NO: 261173 - protein, 9 aa, Homo Sapiens
NYSKLVSMA

SEQ ID NO: 261174 - protein, 9 aa, Homo Sapiens
TCVYIPQVM

SEQ ID NO: 261175 - protein, 9 aa, Homo Sapiens
PLQLLQVDF

SEQ ID NO: 261176 - protein, 9 aa, Homo Sapiens
NLLETSSKE

SEQ ID NO: 261177 - protein, 9 aa, Homo Sapiens
ESFFQYERE

SEQ ID NO: 261178 - protein, 9 aa, Homo Sapiens
QYTQLVWYS

SEQ ID NO: 261179 - protein, 9 aa, Homo Sapiens
SSLSSSDRN

SEQ ID NO: 261180 - protein, 9 aa, Homo Sapiens
SQLWRLNSS

SEQ ID NO: 261181 - protein, 9 aa, Homo Sapiens
CEYCKKGFQ

SEQ ID NO: 261182 - protein, 9 aa, Homo Sapiens
YTCDECGKA

SEQ ID NO: 261183 - protein, 9 aa, Homo Sapiens
LHILGLECL

SEQ ID NO: 261184 - protein, 9 aa, Homo Sapiens
CFRFCIHHL

SEQ ID NO: 261185 - protein, 9 aa, Homo Sapiens
PVDLWIVGC

SEQ ID NO: 261186 - protein, 9 aa, Homo Sapiens
VWNRIYKVI

SEQ ID NO: 261187 - protein, 9 aa, Homo Sapiens
RQFQQIMFI

SEQ ID NO: 261188 - protein, 9 aa, Homo Sapiens
AQKKPPSSQ

SEQ ID NO: 261189 - protein, 9 aa, Homo Sapiens
VFQRVVAIC

SEQ ID NO: 261190 - protein, 9 aa, Homo Sapiens
LPTMPREGH

SEQ ID NO: 261191 - protein, 9 aa, Homo Sapiens
SNHVQELPY

SEQ ID NO: 261192 - protein, 9 aa, Homo Sapiens
VDEGHVSCV

SEQ ID NO: 261193 - protein, 9 aa, Homo Sapiens
LVANFLRVN

SEQ ID NO: 261194 - protein, 9 aa, Homo Sapiens
VVVISVLVI

SEQ ID NO: 261195 - protein, 9 aa, Homo Sapiens
SERKAREVC

SEQ ID NO: 261196 - protein, 9 aa, Homo Sapiens
PRDTAFILT

SEQ ID NO: 261197 - protein, 9 aa, Homo Sapiens
HEVPCFDIW

SEQ ID NO: 261198 - protein, 9 aa, Homo Sapiens
GVLEANRLW

SEQ ID NO: 261199 - protein, 9 aa, Homo Sapiens
DVMLENYSK

SEQ ID NO: 261200 - protein, 9 aa, Homo Sapiens
VVILRTVYR

SEQ ID NO: 261201 - protein, 9 aa, Homo Sapiens
RGDVALKNF

SEQ ID NO: 261202 - protein, 9 aa, Homo Sapiens
ELKNAVSKY

SEQ ID NO: 261203 - protein, 9 aa, Homo Sapiens
LQPQVKEEI

SEQ ID NO: 261204 - protein, 9 aa, Homo Sapiens
PSKCPYLNL

SEQ ID NO: 261205 - protein, 9 aa, Homo Sapiens
IIHQIVHTR

SEQ ID NO: 261206 - protein, 9 aa, Homo Sapiens
QPNLDTCAL

SEQ ID NO: 261207 - protein, 9 aa, Homo Sapiens
LPFHQWFLN

SEQ ID NO: 261208 - protein, 9 aa, Homo Sapiens
VNMNISTDK

SEQ ID NO: 261209 - protein, 9 aa, Homo Sapiens
ELDIRLASG

SEQ ID NO: 261210 - protein, 9 aa, Homo Sapiens
FPGLETAHH

SEQ ID NO: 261211 - protein, 9 aa, Homo Sapiens
IWAVIHSVK

SEQ ID NO: 261212 - protein, 9 aa, Homo Sapiens
RMKQSCVLQ

SEQ ID NO: 261213 - protein, 9 aa, Homo Sapiens
CESTVRTVN

SEQ ID NO: 261214 - protein, 9 aa, Homo Sapiens
IYAPAHANT

SEQ ID NO: 261215 - protein, 9 aa, Homo Sapiens
TTGGQEIHT

SEQ ID NO: 261216 - protein, 9 aa, Homo Sapiens
VGQWEDEGF

SEQ ID NO: 261217 - protein, 9 aa, Homo Sapiens
KKICLRCQK

SEQ ID NO: 261218 - protein, 9 aa, Homo Sapiens
DVINTFENV

SEQ ID NO: 261219 - protein, 9 aa, Homo Sapiens
ANVVSWKSR

SEQ ID NO: 261220 - protein, 9 aa, Homo Sapiens
GPQTPSECS

SEQ ID NO: 261221 - protein, 9 aa, Homo Sapiens
SEFGEYNFP

SEQ ID NO: 261222 - protein, 9 aa, Homo Sapiens
AECQAKNLP

SEQ ID NO: 261223 - protein, 9 aa, Homo Sapiens
AVLYLLDIP

SEQ ID NO: 261224 - protein, 9 aa, Homo Sapiens
LQNQIVTDP

SEQ ID NO: 261225 - protein, 9 aa, Homo Sapiens
DLFSPSLDG

SEQ ID NO: 261226 - protein, 9 aa, Homo Sapiens
SVTDASGRL

SEQ ID NO: 261227 - protein, 9 aa, Homo Sapiens
KENLDCRER

SEQ ID NO: 261228 - protein, 9 aa, Homo Sapiens
DEGSRNSQF

SEQ ID NO: 261229 - protein, 9 aa, Homo Sapiens
KEIIRGQVF

SEQ ID NO: 261230 - protein, 9 aa, Homo Sapiens
RDSSSDTYE

SEQ ID NO: 261231 - protein, 9 aa, Homo Sapiens
DFVRIVDEV

SEQ ID NO: 261232 - protein, 9 aa, Homo Sapiens
HCRNIGHRD

SEQ ID NO: 261233 - protein, 9 aa, Homo Sapiens
LKYKRVRLC

SEQ ID NO: 261234 - protein, 9 aa, Homo Sapiens
ESKNSFGQR

SEQ ID NO: 261235 - protein, 9 aa, Homo Sapiens
FQRVVAICI

SEQ ID NO: 261236 - protein, 9 aa, Homo Sapiens
PTVTWIHIS

SEQ ID NO: 261237 - protein, 9 aa, Homo Sapiens
KKCHAPETR

SEQ ID NO: 261238 - protein, 9 aa, Homo Sapiens
TTQIFNVYG

SEQ ID NO: 261239 - protein, 9 aa, Homo Sapiens
THIDTLLCT

SEQ ID NO: 261240 - protein, 9 aa, Homo Sapiens
QIDREELCG

SEQ ID NO: 261241 - protein, 9 aa, Homo Sapiens
MTTLDDRLL

SEQ ID NO: 261242 - protein, 9 aa, Homo Sapiens
NISKACLLL

SEQ ID NO: 261243 - protein, 9 aa, Homo Sapiens
NKYYLAEKH

SEQ ID NO: 261244 - protein, 9 aa, Homo Sapiens
KREENKKGG

SEQ ID NO: 261245 - protein, 9 aa, Homo Sapiens
APDPQRCTV

SEQ ID NO: 261246 - protein, 9 aa, Homo Sapiens
FKMLQENCE

SEQ ID NO: 261247 - protein, 9 aa, Homo Sapiens
LYDKIKELF

SEQ ID NO: 261248 - protein, 9 aa, Homo Sapiens
SSLILKTTL

SEQ ID NO: 261249 - protein, 9 aa, Homo Sapiens
ALLPLLQSN

SEQ ID NO: 261250 - protein, 9 aa, Homo Sapiens
PPPSSGSTG

SEQ ID NO: 261251 - protein, 9 aa, Homo Sapiens
YEMLYGKTP

SEQ ID NO: 261252 - protein, 9 aa, Homo Sapiens
SPRGEGTAL

SEQ ID NO: 261253 - protein, 9 aa, Homo Sapiens
NLLERRLMN

SEQ ID NO: 261254 - protein, 9 aa, Homo Sapiens
SDKVSPSGN

SEQ ID NO: 261255 - protein, 9 aa, Homo Sapiens
DSLEKYLYT

SEQ ID NO: 261256 - protein, 9 aa, Homo Sapiens
AYPETKHSA

SEQ ID NO: 261257 - protein, 9 aa, Homo Sapiens
MMDNLFDSL

SEQ ID NO: 261258 - protein, 9 aa, Homo Sapiens
QLARHRIIH

SEQ ID NO: 261259 - protein, 9 aa, Homo Sapiens
RKWEKHFYV

SEQ ID NO: 261260 - protein, 9 aa, Homo Sapiens
EVWMVDCYS

SEQ ID NO: 261261 - protein, 9 aa, Homo Sapiens
KFKVGDEKN

SEQ ID NO: 261262 - protein, 9 aa, Homo Sapiens
DWRKFKLEN

SEQ ID NO: 261263 - protein, 9 aa, Homo Sapiens
RNTKLEFSV

SEQ ID NO: 261264 - protein, 9 aa, Homo Sapiens
ETIIQFAFQ

SEQ ID NO: 261265 - protein, 9 aa, Homo Sapiens
GAVGCPGPD

SEQ ID NO: 261266 - protein, 9 aa, Homo Sapiens
SAEQINKKI

SEQ ID NO: 261267 - protein, 9 aa, Homo Sapiens
ILMNKMGIK

SEQ ID NO: 261268 - protein, 9 aa, Homo Sapiens
TGMQPCVFW

SEQ ID NO: 261269 - protein, 9 aa, Homo Sapiens
PLELQRRVH

SEQ ID NO: 261270 - protein, 9 aa, Homo Sapiens
GTGNATGED

SEQ ID NO: 261271 - protein, 9 aa, Homo Sapiens
WKADVTPIT

SEQ ID NO: 261272 - protein, 9 aa, Homo Sapiens
ETPLVLPYT

SEQ ID NO: 261273 - protein, 9 aa, Homo Sapiens
ANVQGDTLE

SEQ ID NO: 261274 - protein, 9 aa, Homo Sapiens
IYDKLGEKA

SEQ ID NO: 261275 - protein, 9 aa, Homo Sapiens
SDQLINRGT

SEQ ID NO: 261276 - protein, 9 aa, Homo Sapiens
PTAFYLLKS

SEQ ID NO: 261277 - protein, 9 aa, Homo Sapiens
QEHHGTSQD

SEQ ID NO: 261278 - protein, 9 aa, Homo Sapiens
SHFREWLYN

SEQ ID NO: 261279 - protein, 9 aa, Homo Sapiens
LPFPCFSPC

SEQ ID NO: 261280 - protein, 9 aa, Homo Sapiens
VDPLFQIQQ

SEQ ID NO: 261281 - protein, 9 aa, Homo Sapiens
LNIEHEKQV

SEQ ID NO: 261282 - protein, 9 aa, Homo Sapiens
FASLNFVME

SEQ ID NO: 261283 - protein, 9 aa, Homo Sapiens
YLPECFNSP

SEQ ID NO: 261284 - protein, 9 aa, Homo Sapiens
TPKFSIKTS

SEQ ID NO: 261285 - protein, 9 aa, Homo Sapiens
LISPLPPLL

SEQ ID NO: 261286 - protein, 9 aa, Homo Sapiens
LATDTCFLG

SEQ ID NO: 261287 - protein, 9 aa, Homo Sapiens
LSPQNGTIT

SEQ ID NO: 261288 - protein, 9 aa, Homo Sapiens
IDFFEMCAN

SEQ ID NO: 261289 - protein, 9 aa, Homo Sapiens
FGVQSHMFD

SEQ ID NO: 261290 - protein, 9 aa, Homo Sapiens
KVKEQNLVS

SEQ ID NO: 261291 - protein, 9 aa, Homo Sapiens
NLLERSPES

SEQ ID NO: 261292 - protein, 9 aa, Homo Sapiens
HGRIKDFMS

SEQ ID NO: 261293 - protein, 9 aa, Homo Sapiens
AATEEEPHN

SEQ ID NO: 261294 - protein, 9 aa, Homo Sapiens
FSSAVPKVV

SEQ ID NO: 261295 - protein, 9 aa, Homo Sapiens
CRNTRVTGD

SEQ ID NO: 261296 - protein, 9 aa, Homo Sapiens
DRALPDNEF

SEQ ID NO: 261297 - protein, 9 aa, Homo Sapiens
GPITSSEKP

SEQ ID NO: 261298 - protein, 9 aa, Homo Sapiens
QSSCCVPIY

SEQ ID NO: 261299 - protein, 9 aa, Homo Sapiens
EFALVEDKV

SEQ ID NO: 261300 - protein, 9 aa, Homo Sapiens
RCSGDKNIE

SEQ ID NO: 261301 - protein, 9 aa, Homo Sapiens
HSERSDNIS

SEQ ID NO: 261302 - protein, 9 aa, Homo Sapiens
HHLEPYFES

SEQ ID NO: 261303 - protein, 9 aa, Homo Sapiens
CLNPIKDFQ

SEQ ID NO: 261304 - protein, 9 aa, Homo Sapiens
ADTTPYLAL

SEQ ID NO: 261305 - protein, 9 aa, Homo Sapiens
REISKAQLP

SEQ ID NO: 261306 - protein, 9 aa, Homo Sapiens
GQFTQLITL

SEQ ID NO: 261307 - protein, 9 aa, Homo Sapiens
LSSFTLMKL

SEQ ID NO: 261308 - protein, 9 aa, Homo Sapiens
HGSQKERNR

SEQ ID NO: 261309 - protein, 9 aa, Homo Sapiens
RAKTIVKLS

SEQ ID NO: 261310 - protein, 9 aa, Homo Sapiens
SVGARKNTF

SEQ ID NO: 261311 - protein, 9 aa, Homo Sapiens
AYLRQIKME

SEQ ID NO: 261312 - protein, 9 aa, Homo Sapiens
VPTSSSRQR

SEQ ID NO: 261313 - protein, 9 aa, Homo Sapiens
SIHQVKTQS

SEQ ID NO: 261314 - protein, 9 aa, Homo Sapiens
LLQRINVCN

SEQ ID NO: 261315 - protein, 9 aa, Homo Sapiens
FLQSRPYHI

SEQ ID NO: 261316 - protein, 9 aa, Homo Sapiens
PSLCYSPKD

SEQ ID NO: 261317 - protein, 9 aa, Homo Sapiens
RSLDYVKIT

SEQ ID NO: 261318 - protein, 9 aa, Homo Sapiens
LPRICNWVS

SEQ ID NO: 261319 - protein, 9 aa, Homo Sapiens
YLEEEKVLE

SEQ ID NO: 261320 - protein, 9 aa, Homo Sapiens
NIMCWECCE

SEQ ID NO: 261321 - protein, 9 aa, Homo Sapiens
GEGGVTWIG

SEQ ID NO: 261322 - protein, 9 aa, Homo Sapiens
IKAKIEDLE

SEQ ID NO: 261323 - protein, 9 aa, Homo Sapiens
AAIASHENV

SEQ ID NO: 261324 - protein, 9 aa, Homo Sapiens
QPFRDGSSG

SEQ ID NO: 261325 - protein, 9 aa, Homo Sapiens
PSLHYSTLF

SEQ ID NO: 261326 - protein, 9 aa, Homo Sapiens
SRTVHQIIH

SEQ ID NO: 261327 - protein, 9 aa, Homo Sapiens
TLLNIIKLK

SEQ ID NO: 261328 - protein, 9 aa, Homo Sapiens
IHAKRLSTR

SEQ ID NO: 261329 - protein, 9 aa, Homo Sapiens
PTTTPSLPL

SEQ ID NO: 261330 - protein, 9 aa, Homo Sapiens
LPSLDTAIQ

SEQ ID NO: 261331 - protein, 9 aa, Homo Sapiens
THNSVASKT

SEQ ID NO: 261332 - protein, 9 aa, Homo Sapiens
QMISAEDCG

SEQ ID NO: 261333 - protein, 9 aa, Homo Sapiens
VVLVVSREL

SEQ ID NO: 261334 - protein, 9 aa, Homo Sapiens
FLSLTRNTN

SEQ ID NO: 261335 - protein, 9 aa, Homo Sapiens
VLLLLQVPA

SEQ ID NO: 261336 - protein, 9 aa, Homo Sapiens
RSLKVAAVI

SEQ ID NO: 261337 - protein, 9 aa, Homo Sapiens
VFEKVLKSH

SEQ ID NO: 261338 - protein, 9 aa, Homo Sapiens
KSKGLTLNS

SEQ ID NO: 261339 - protein, 9 aa, Homo Sapiens
FSAGFNIII

SEQ ID NO: 261340 - protein, 9 aa, Homo Sapiens
TITGNGAID

SEQ ID NO: 261341 - protein, 9 aa, Homo Sapiens
GWKNSIHHN

SEQ ID NO: 261342 - protein, 9 aa, Homo Sapiens
LFEKYLRDV

SEQ ID NO: 261343 - protein, 9 aa, Homo Sapiens
QSIQNYLIR

SEQ ID NO: 261344 - protein, 9 aa, Homo Sapiens
RQAEEYAHF

SEQ ID NO: 261345 - protein, 9 aa, Homo Sapiens
NAVGAMTDA

SEQ ID NO: 261346 - protein, 9 aa, Homo Sapiens
HQVIGYRAA

SEQ ID NO: 261347 - protein, 9 aa, Homo Sapiens
QKLLNFYEK

SEQ ID NO: 261348 - protein, 9 aa, Homo Sapiens
LTDDSKTAQ

SEQ ID NO: 261349 - protein, 9 aa, Homo Sapiens
EFAYTTFEK

SEQ ID NO: 261350 - protein, 9 aa, Homo Sapiens
LQIRKSQHS

SEQ ID NO: 261351 - protein, 9 aa, Homo Sapiens
RRDKTCMFC

SEQ ID NO: 261352 - protein, 9 aa, Homo Sapiens
PTSSPAAGS

SEQ ID NO: 261353 - protein, 9 aa, Homo Sapiens
EGRERAFIQ

SEQ ID NO: 261354 - protein, 9 aa, Homo Sapiens
PFDLPEILF

SEQ ID NO: 261355 - protein, 9 aa, Homo Sapiens
ATATYEGRW

SEQ ID NO: 261356 - protein, 9 aa, Homo Sapiens
HWAPEWKRV

SEQ ID NO: 261357 - protein, 9 aa, Homo Sapiens
IIENPDVPH

SEQ ID NO: 261358 - protein, 9 aa, Homo Sapiens
TKKHLKKNN

SEQ ID NO: 261359 - protein, 9 aa, Homo Sapiens
STRKAQAGA

SEQ ID NO: 261360 - protein, 9 aa, Homo Sapiens
IIASDNLWG

SEQ ID NO: 261361 - protein, 9 aa, Homo Sapiens
PEHPHANNG

SEQ ID NO: 261362 - protein, 9 aa, Homo Sapiens
SSSVWPNLT

SEQ ID NO: 261363 - protein, 9 aa, Homo Sapiens
LMLYMKEMR

SEQ ID NO: 261364 - protein, 9 aa, Homo Sapiens
FQSPIQKEW

SEQ ID NO: 261365 - protein, 9 aa, Homo Sapiens
ATEAQNTML

SEQ ID NO: 261366 - protein, 9 aa, Homo Sapiens
HSCIFSAFS

SEQ ID NO: 261367 - protein, 9 aa, Homo Sapiens
AEIGIAVQD

SEQ ID NO: 261368 - protein, 9 aa, Homo Sapiens
PPNMQCCLC

SEQ ID NO: 261369 - protein, 9 aa, Homo Sapiens
FTGMQPCVF

SEQ ID NO: 261370 - protein, 9 aa, Homo Sapiens
LEQNNTTEV

SEQ ID NO: 261371 - protein, 9 aa, Homo Sapiens
KLSQICLNT

SEQ ID NO: 261372 - protein, 9 aa, Homo Sapiens
NTFQASLSF

SEQ ID NO: 261373 - protein, 9 aa, Homo Sapiens
FEESNLRNH

SEQ ID NO: 261374 - protein, 9 aa, Homo Sapiens
GAKVEEDTE

SEQ ID NO: 261375 - protein, 9 aa, Homo Sapiens
TVLGKWQYC

SEQ ID NO: 261376 - protein, 9 aa, Homo Sapiens
LDYKAVPSQ

SEQ ID NO: 261377 - protein, 9 aa, Homo Sapiens
FPRGFKFNT

SEQ ID NO: 261378 - protein, 9 aa, Homo Sapiens
LNADIAAQK

SEQ ID NO: 261379 - protein, 9 aa, Homo Sapiens
LLDYLLLGL

SEQ ID NO: 261380 - protein, 9 aa, Homo Sapiens
KNDHNSGLI

SEQ ID NO: 261381 - protein, 9 aa, Homo Sapiens
GDVPVMDEL

SEQ ID NO: 261382 - protein, 9 aa, Homo Sapiens
SVRPCRCNK

SEQ ID NO: 261383 - protein, 9 aa, Homo Sapiens
FSPSSDYLL

SEQ ID NO: 261384 - protein, 9 aa, Homo Sapiens
RFYDRNYIE

SEQ ID NO: 261385 - protein, 9 aa, Homo Sapiens
DKKTEELFS

SEQ ID NO: 261386 - protein, 9 aa, Homo Sapiens
CQVHMEMVQ

SEQ ID NO: 261387 - protein, 9 aa, Homo Sapiens
PSGGFQGTM

SEQ ID NO: 261388 - protein, 9 aa, Homo Sapiens
SRHTLKGDL

SEQ ID NO: 261389 - protein, 9 aa, Homo Sapiens
RVTILCDKL

SEQ ID NO: 261390 - protein, 9 aa, Homo Sapiens
RILELELPS

SEQ ID NO: 261391 - protein, 9 aa, Homo Sapiens
NALNGIHFD

SEQ ID NO: 261392 - protein, 9 aa, Homo Sapiens
DSFKDKMEN

SEQ ID NO: 261393 - protein, 9 aa, Homo Sapiens
TWNYQNSTI

SEQ ID NO: 261394 - protein, 9 aa, Homo Sapiens
QAKCDSEED

SEQ ID NO: 261395 - protein, 9 aa, Homo Sapiens
YIETPFVKM

SEQ ID NO: 261396 - protein, 9 aa, Homo Sapiens
GQKYGGIPK

SEQ ID NO: 261397 - protein, 9 aa, Homo Sapiens
DSRKNSAIL

SEQ ID NO: 261398 - protein, 9 aa, Homo Sapiens
EPALDPTDC

SEQ ID NO: 261399 - protein, 9 aa, Homo Sapiens
SQEVIQKAQ

SEQ ID NO: 261400 - protein, 9 aa, Homo Sapiens
FKGFLDCLL

SEQ ID NO: 261401 - protein, 9 aa, Homo Sapiens
DYSKVSFWK

SEQ ID NO: 261402 - protein, 9 aa, Homo Sapiens
NFNAWNIKE

SEQ ID NO: 261403 - protein, 9 aa, Homo Sapiens
ICFVCGIFF

SEQ ID NO: 261404 - protein, 9 aa, Homo Sapiens
LDRYDPNHV

SEQ ID NO: 261405 - protein, 9 aa, Homo Sapiens
WIAGQAMEI

SEQ ID NO: 261406 - protein, 9 aa, Homo Sapiens
EFCFRFCIH

SEQ ID NO: 261407 - protein, 9 aa, Homo Sapiens
TSQEAERLT

SEQ ID NO: 261408 - protein, 9 aa, Homo Sapiens
KEPNSTDVE

SEQ ID NO: 261409 - protein, 9 aa, Homo Sapiens
LKLYQYLSL

SEQ ID NO: 261410 - protein, 9 aa, Homo Sapiens
MRLYIRRMV

SEQ ID NO: 261411 - protein, 9 aa, Homo Sapiens
LISLSTVKS

SEQ ID NO: 261412 - protein, 9 aa, Homo Sapiens
LPAKRKASE

SEQ ID NO: 261413 - protein, 9 aa, Homo Sapiens
INKYKQNTQ

SEQ ID NO: 261414 - protein, 9 aa, Homo Sapiens
LTPQEISEV

SEQ ID NO: 261415 - protein, 9 aa, Homo Sapiens
TASVMSAPV

SEQ ID NO: 261416 - protein, 9 aa, Homo Sapiens
PGFPGEIGK

SEQ ID NO: 261417 - protein, 9 aa, Homo Sapiens
VGSPWIPLH

SEQ ID NO: 261418 - protein, 9 aa, Homo Sapiens
HLEGHKHKK

SEQ ID NO: 261419 - protein, 9 aa, Homo Sapiens
SYQLLKATK

SEQ ID NO: 261420 - protein, 9 aa, Homo Sapiens
RRQRVCSGK

SEQ ID NO: 261421 - protein, 9 aa, Homo Sapiens
QVVHAKEKF

SEQ ID NO: 261422 - protein, 9 aa, Homo Sapiens
ARVGLWPLG

SEQ ID NO: 261423 - protein, 9 aa, Homo Sapiens
HHIMHTREN

SEQ ID NO: 261424 - protein, 9 aa, Homo Sapiens
DNITRQNQL

SEQ ID NO: 261425 - protein, 9 aa, Homo Sapiens
QKMIFYLNK

SEQ ID NO: 261426 - protein, 9 aa, Homo Sapiens
CVPFLNSYT

SEQ ID NO: 261427 - protein, 9 aa, Homo Sapiens
VVKLRKRPR

SEQ ID NO: 261428 - protein, 9 aa, Homo Sapiens
GSLALLCEL

SEQ ID NO: 261429 - protein, 9 aa, Homo Sapiens
IFLQQQAAH

SEQ ID NO: 261430 - protein, 9 aa, Homo Sapiens
KINITDMYK

SEQ ID NO: 261431 - protein, 9 aa, Homo Sapiens
TVTKLGNQL

SEQ ID NO: 261432 - protein, 9 aa, Homo Sapiens
PDIPSGLPL

SEQ ID NO: 261433 - protein, 9 aa, Homo Sapiens
KKNFERESF

SEQ ID NO: 261434 - protein, 9 aa, Homo Sapiens
DLDPWKSAY

SEQ ID NO: 261435 - protein, 9 aa, Homo Sapiens
KRDDKRMPA

SEQ ID NO: 261436 - protein, 9 aa, Homo Sapiens
EKVLIAQDK

SEQ ID NO: 261437 - protein, 9 aa, Homo Sapiens
YEQLIYAFF

SEQ ID NO: 261438 - protein, 9 aa, Homo Sapiens
HDFLQYTVD

SEQ ID NO: 261439 - protein, 9 aa, Homo Sapiens
KKHKKTSNH

SEQ ID NO: 261440 - protein, 9 aa, Homo Sapiens
FQQKWKDER

SEQ ID NO: 261441 - protein, 9 aa, Homo Sapiens
EEHVTGENF

SEQ ID NO: 261442 - protein, 9 aa, Homo Sapiens
NLPDSGKAQ

SEQ ID NO: 261443 - protein, 9 aa, Homo Sapiens
DTFLIREMS

SEQ ID NO: 261444 - protein, 9 aa, Homo Sapiens
SLQWEHMGK

SEQ ID NO: 261445 - protein, 9 aa, Homo Sapiens
LVKSYPGAQ

SEQ ID NO: 261446 - protein, 9 aa, Homo Sapiens
KTFFLYNQG

SEQ ID NO: 261447 - protein, 9 aa, Homo Sapiens
ANTGNMVIS

SEQ ID NO: 261448 - protein, 9 aa, Homo Sapiens
IELYRVVER

SEQ ID NO: 261449 - protein, 9 aa, Homo Sapiens
EQESLEVAM

SEQ ID NO: 261450 - protein, 9 aa, Homo Sapiens
IHERPQKIN

SEQ ID NO: 261451 - protein, 9 aa, Homo Sapiens
DNEVYSATF

SEQ ID NO: 261452 - protein, 9 aa, Homo Sapiens
GEKFDRQAS

SEQ ID NO: 261453 - protein, 9 aa, Homo Sapiens
STFGLSSKE

SEQ ID NO: 261454 - protein, 9 aa, Homo Sapiens
LELKLNSHP

SEQ ID NO: 261455 - protein, 9 aa, Homo Sapiens
KNDAKAPAS

SEQ ID NO: 261456 - protein, 9 aa, Homo Sapiens
IISGQKELH

SEQ ID NO: 261457 - protein, 9 aa, Homo Sapiens
TLQATRVQP

SEQ ID NO: 261458 - protein, 9 aa, Homo Sapiens
SRKGRGWRR

SEQ ID NO: 261459 - protein, 9 aa, Homo Sapiens
YGGVVLFSM

SEQ ID NO: 261460 - protein, 9 aa, Homo Sapiens
PAAEDAAVK

SEQ ID NO: 261461 - protein, 9 aa, Homo Sapiens
HPVYCVNGV

SEQ ID NO: 261462 - protein, 9 aa, Homo Sapiens
KPEERQQTP

SEQ ID NO: 261463 - protein, 9 aa, Homo Sapiens
KDHRTSQNH

SEQ ID NO: 261464 - protein, 9 aa, Homo Sapiens
VALAEIPGV

SEQ ID NO: 261465 - protein, 9 aa, Homo Sapiens
PGYRLREIT

SEQ ID NO: 261466 - protein, 9 aa, Homo Sapiens
CGVLASAKA

SEQ ID NO: 261467 - protein, 9 aa, Homo Sapiens
LPAVLHTLW

SEQ ID NO: 261468 - protein, 9 aa, Homo Sapiens
ESETCVQFA

SEQ ID NO: 261469 - protein, 9 aa, Homo Sapiens
QLITLPKTL

SEQ ID NO: 261470 - protein, 9 aa, Homo Sapiens
AQDKMATNT

SEQ ID NO: 261471 - protein, 9 aa, Homo Sapiens
QNKFYLDQV

SEQ ID NO: 261472 - protein, 9 aa, Homo Sapiens
YHKGRDADE

SEQ ID NO: 261473 - protein, 9 aa, Homo Sapiens
GEESSDMEQ

SEQ ID NO: 261474 - protein, 9 aa, Homo Sapiens
SKLWKHVRY

SEQ ID NO: 261475 - protein, 9 aa, Homo Sapiens
QREQQVTFT

SEQ ID NO: 261476 - protein, 9 aa, Homo Sapiens
SLVLYLGSI

SEQ ID NO: 261477 - protein, 9 aa, Homo Sapiens
PPPLAPSKG

SEQ ID NO: 261478 - protein, 9 aa, Homo Sapiens
SVGKDRSPL

SEQ ID NO: 261479 - protein, 9 aa, Homo Sapiens
YGNILLILQ

SEQ ID NO: 261480 - protein, 9 aa, Homo Sapiens
NHQPAHFYP

SEQ ID NO: 261481 - protein, 9 aa, Homo Sapiens
QINPTSTQT

SEQ ID NO: 261482 - protein, 9 aa, Homo Sapiens
LFALFDSDR

SEQ ID NO: 261483 - protein, 9 aa, Homo Sapiens
QFKRRIEDF

SEQ ID NO: 261484 - protein, 9 aa, Homo Sapiens
QAFTPDNPY

SEQ ID NO: 261485 - protein, 9 aa, Homo Sapiens
AWAGHPCSP

SEQ ID NO: 261486 - protein, 9 aa, Homo Sapiens
ELEQAQASA

SEQ ID NO: 261487 - protein, 9 aa, Homo Sapiens
TDDQIIVSY

SEQ ID NO: 261488 - protein, 9 aa, Homo Sapiens
IIDARRADE

SEQ ID NO: 261489 - protein, 9 aa, Homo Sapiens
CEITSTGDQ

SEQ ID NO: 261490 - protein, 9 aa, Homo Sapiens
PFYNQDHDK

SEQ ID NO: 261491 - protein, 9 aa, Homo Sapiens
LKSLEHKTQ

SEQ ID NO: 261492 - protein, 9 aa, Homo Sapiens
KVEEEQGYI

SEQ ID NO: 261493 - protein, 9 aa, Homo Sapiens
ILWNKFFQD

SEQ ID NO: 261494 - protein, 9 aa, Homo Sapiens
IWMCNTFRC

SEQ ID NO: 261495 - protein, 9 aa, Homo Sapiens
WLDGRGWAI

SEQ ID NO: 261496 - protein, 9 aa, Homo Sapiens
SEHKTSNAD

SEQ ID NO: 261497 - protein, 9 aa, Homo Sapiens
DFCSEAIGN

SEQ ID NO: 261498 - protein, 9 aa, Homo Sapiens
AKALVFNKD

SEQ ID NO: 261499 - protein, 9 aa, Homo Sapiens
GYWDQHDLS

SEQ ID NO: 261500 - protein, 9 aa, Homo Sapiens
LGFKHIPDE

SEQ ID NO: 261501 - protein, 9 aa, Homo Sapiens
ETNNCPGAE

SEQ ID NO: 261502 - protein, 9 aa, Homo Sapiens
MEVVTQGMS

SEQ ID NO: 261503 - protein, 9 aa, Homo Sapiens
LSEHRKQRR

SEQ ID NO: 261504 - protein, 9 aa, Homo Sapiens
NVIKDIKPL

SEQ ID NO: 261505 - protein, 9 aa, Homo Sapiens
ARAQQGKHS

SEQ ID NO: 261506 - protein, 9 aa, Homo Sapiens
GEKALEISG

SEQ ID NO: 261507 - protein, 9 aa, Homo Sapiens
GLCIALLVE

SEQ ID NO: 261508 - protein, 9 aa, Homo Sapiens
INTGKRSYG

SEQ ID NO: 261509 - protein, 9 aa, Homo Sapiens
SDPSYKRNI

SEQ ID NO: 261510 - protein, 9 aa, Homo Sapiens
ITNVGKKQK

SEQ ID NO: 261511 - protein, 9 aa, Homo Sapiens
PSTKVHIQA

SEQ ID NO: 261512 - protein, 9 aa, Homo Sapiens
TTCPQCHQT

SEQ ID NO: 261513 - protein, 9 aa, Homo Sapiens
RSGRLVTRA

SEQ ID NO: 261514 - protein, 9 aa, Homo Sapiens
HDIVSRLRD

SEQ ID NO: 261515 - protein, 9 aa, Homo Sapiens
VIQMDLSAD

SEQ ID NO: 261516 - protein, 9 aa, Homo Sapiens
YLQNPIIVQ

SEQ ID NO: 261517 - protein, 9 aa, Homo Sapiens
LPWVPARGG

SEQ ID NO: 261518 - protein, 9 aa, Homo Sapiens
VEHHIMHTR

SEQ ID NO: 261519 - protein, 9 aa, Homo Sapiens
RQEVNACDL

SEQ ID NO: 261520 - protein, 9 aa, Homo Sapiens
NNESGSRSN

SEQ ID NO: 261521 - protein, 9 aa, Homo Sapiens
SPDLQRNQK

SEQ ID NO: 261522 - protein, 9 aa, Homo Sapiens
FFDYYSKLK

SEQ ID NO: 261523 - protein, 9 aa, Homo Sapiens
PKKKTEVAK

SEQ ID NO: 261524 - protein, 9 aa, Homo Sapiens
MFQNMQNAE

SEQ ID NO: 261525 - protein, 9 aa, Homo Sapiens
INNQNKSVV

SEQ ID NO: 261526 - protein, 9 aa, Homo Sapiens
LTVTYATPD

SEQ ID NO: 261527 - protein, 9 aa, Homo Sapiens
STIQSKLFQ

SEQ ID NO: 261528 - protein, 9 aa, Homo Sapiens
NRPEMNYQG

SEQ ID NO: 261529 - protein, 9 aa, Homo Sapiens
KSQTSHTRH

SEQ ID NO: 261530 - protein, 9 aa, Homo Sapiens
TSQTDREIK

SEQ ID NO: 261531 - protein, 9 aa, Homo Sapiens
RAPPLHLEY

SEQ ID NO: 261532 - protein, 9 aa, Homo Sapiens
VTNGTNSAE

SEQ ID NO: 261533 - protein, 9 aa, Homo Sapiens
PSYPGYLQI

SEQ ID NO: 261534 - protein, 9 aa, Homo Sapiens
TRVRGESHI

SEQ ID NO: 261535 - protein, 9 aa, Homo Sapiens
ILGPEEEGA

SEQ ID NO: 261536 - protein, 9 aa, Homo Sapiens
IDIKGSVLN

SEQ ID NO: 261537 - protein, 9 aa, Homo Sapiens
AYGRNKSWL

SEQ ID NO: 261538 - protein, 9 aa, Homo Sapiens
CKDNEDYND

SEQ ID NO: 261539 - protein, 9 aa, Homo Sapiens
QYYQFTLPR

SEQ ID NO: 261540 - protein, 9 aa, Homo Sapiens
AQDAASSDN

SEQ ID NO: 261541 - protein, 9 aa, Homo Sapiens
RFNAFVLFL

SEQ ID NO: 261542 - protein, 9 aa, Homo Sapiens
RQNSSTSLS

SEQ ID NO: 261543 - protein, 9 aa, Homo Sapiens
PVRIITGEN

SEQ ID NO: 261544 - protein, 9 aa, Homo Sapiens
NFLQNMIEY

SEQ ID NO: 261545 - protein, 9 aa, Homo Sapiens
GKKRTQKLK

SEQ ID NO: 261546 - protein, 9 aa, Homo Sapiens
VLNTATTMK

SEQ ID NO: 261547 - protein, 9 aa, Homo Sapiens
DTRKMLSLS

SEQ ID NO: 261548 - protein, 9 aa, Homo Sapiens
HQPVLHCQI

SEQ ID NO: 261549 - protein, 9 aa, Homo Sapiens
VGPSMSLLS

SEQ ID NO: 261550 - protein, 9 aa, Homo Sapiens
CKQKCRDSY

SEQ ID NO: 261551 - protein, 9 aa, Homo Sapiens
YLKYTFTHT

SEQ ID NO: 261552 - protein, 9 aa, Homo Sapiens
KINYGACVA

SEQ ID NO: 261553 - protein, 9 aa, Homo Sapiens
EPSTYIQIN

SEQ ID NO: 261554 - protein, 9 aa, Homo Sapiens
TSDFLPSQP

SEQ ID NO: 261555 - protein, 9 aa, Homo Sapiens
VPGDFLFMS

SEQ ID NO: 261556 - protein, 9 aa, Homo Sapiens
VHFEEDVHK

SEQ ID NO: 261557 - protein, 9 aa, Homo Sapiens
GISPLVKIW

SEQ ID NO: 261558 - protein, 9 aa, Homo Sapiens
SSVDSLPDV

SEQ ID NO: 261559 - protein, 9 aa, Homo Sapiens
QKTYQINLK

SEQ ID NO: 261560 - protein, 9 aa, Homo Sapiens
GLHILGLEC

SEQ ID NO: 261561 - protein, 9 aa, Homo Sapiens
TQIFFFHCI

SEQ ID NO: 261562 - protein, 9 aa, Homo Sapiens
QYFDDIAYI

SEQ ID NO: 261563 - protein, 9 aa, Homo Sapiens
KLETNELQQ

SEQ ID NO: 261564 - protein, 9 aa, Homo Sapiens
EDGKRRTPD

SEQ ID NO: 261565 - protein, 9 aa, Homo Sapiens
ETGVSHSQK

SEQ ID NO: 261566 - protein, 9 aa, Homo Sapiens
LEFNLDIDP

SEQ ID NO: 261567 - protein, 9 aa, Homo Sapiens
VLDQVQVMP

SEQ ID NO: 261568 - protein, 9 aa, Homo Sapiens
DHDGKLYFA

SEQ ID NO: 261569 - protein, 9 aa, Homo Sapiens
AKTAFNVEE

SEQ ID NO: 261570 - protein, 9 aa, Homo Sapiens
IQLLDLSAF

SEQ ID NO: 261571 - protein, 9 aa, Homo Sapiens
TARNTSQEE

SEQ ID NO: 261572 - protein, 9 aa, Homo Sapiens
LWHQLALQV

SEQ ID NO: 261573 - protein, 9 aa, Homo Sapiens
EFTMLKARQ

SEQ ID NO: 261574 - protein, 9 aa, Homo Sapiens
KPEKCKNKN

SEQ ID NO: 261575 - protein, 9 aa, Homo Sapiens
TSLDDKVVS

SEQ ID NO: 261576 - protein, 9 aa, Homo Sapiens
QCQDFVPIL

SEQ ID NO: 261577 - protein, 9 aa, Homo Sapiens
VLAAFVEVN

SEQ ID NO: 261578 - protein, 9 aa, Homo Sapiens
GCLHGSFLA

SEQ ID NO: 261579 - protein, 9 aa, Homo Sapiens
QDMQEKLQN

SEQ ID NO: 261580 - protein, 9 aa, Homo Sapiens
GNTQNRFSI

SEQ ID NO: 261581 - protein, 9 aa, Homo Sapiens
IGPEFIQVG

SEQ ID NO: 261582 - protein, 9 aa, Homo Sapiens
NKVKDPLIK

SEQ ID NO: 261583 - protein, 9 aa, Homo Sapiens
PIDIKGSVL

SEQ ID NO: 261584 - protein, 9 aa, Homo Sapiens
QVQWEINIF

SEQ ID NO: 261585 - protein, 9 aa, Homo Sapiens
SFTKCEITS

SEQ ID NO: 261586 - protein, 9 aa, Homo Sapiens
MSKCAMKKY

SEQ ID NO: 261587 - protein, 9 aa, Homo Sapiens
PEDPSNHSF

SEQ ID NO: 261588 - protein, 9 aa, Homo Sapiens
EFLYVILLF

SEQ ID NO: 261589 - protein, 9 aa, Homo Sapiens
SESLGELFL

SEQ ID NO: 261590 - protein, 9 aa, Homo Sapiens
HTGDKPFKC

SEQ ID NO: 261591 - protein, 9 aa, Homo Sapiens
RFRQADEVK

SEQ ID NO: 261592 - protein, 9 aa, Homo Sapiens
KRLPRTLEA

SEQ ID NO: 261593 - protein, 9 aa, Homo Sapiens
SVGVFLYKM

SEQ ID NO: 261594 - protein, 9 aa, Homo Sapiens
HKHRITHTG

SEQ ID NO: 261595 - protein, 9 aa, Homo Sapiens
VYRPPPKVN

SEQ ID NO: 261596 - protein, 9 aa, Homo Sapiens
KEEVINRKI

SEQ ID NO: 261597 - protein, 9 aa, Homo Sapiens
LGRLQKKLY

SEQ ID NO: 261598 - protein, 9 aa, Homo Sapiens
ERDNRRRVE

SEQ ID NO: 261599 - protein, 9 aa, Homo Sapiens
GGGLKRAKV

SEQ ID NO: 261600 - protein, 9 aa, Homo Sapiens
VKLRDMHWA

SEQ ID NO: 261601 - protein, 9 aa, Homo Sapiens
EESHDEPEE

SEQ ID NO: 261602 - protein, 9 aa, Homo Sapiens
PSYKRNICS

SEQ ID NO: 261603 - protein, 9 aa, Homo Sapiens
SVLRMIKSG

SEQ ID NO: 261604 - protein, 9 aa, Homo Sapiens
ACYRRKGDY

SEQ ID NO: 261605 - protein, 9 aa, Homo Sapiens
INLDKSLGE

SEQ ID NO: 261606 - protein, 9 aa, Homo Sapiens
HDIRWNFDK

SEQ ID NO: 261607 - protein, 9 aa, Homo Sapiens
FNTFFPLLG

SEQ ID NO: 261608 - protein, 9 aa, Homo Sapiens
ELLCYICLS

SEQ ID NO: 261609 - protein, 9 aa, Homo Sapiens
LIAWEINDV

SEQ ID NO: 261610 - protein, 9 aa, Homo Sapiens
ADDLLSSSE

SEQ ID NO: 261611 - protein, 9 aa, Homo Sapiens
VKGNYLRTS

SEQ ID NO: 261612 - protein, 9 aa, Homo Sapiens
APQPYKCQQ

SEQ ID NO: 261613 - protein, 9 aa, Homo Sapiens
GHQELKQCP

SEQ ID NO: 261614 - protein, 9 aa, Homo Sapiens
ARSQSCEEQ

SEQ ID NO: 261615 - protein, 9 aa, Homo Sapiens
LIFANIQDS

SEQ ID NO: 261616 - protein, 9 aa, Homo Sapiens
GLGNKSFQR

SEQ ID NO: 261617 - protein, 9 aa, Homo Sapiens
YVANADYSS

SEQ ID NO: 261618 - protein, 9 aa, Homo Sapiens
MGNLLKVLA

SEQ ID NO: 261619 - protein, 9 aa, Homo Sapiens
SAEEEATLT

SEQ ID NO: 261620 - protein, 9 aa, Homo Sapiens
LSQDTWNMH

SEQ ID NO: 261621 - protein, 9 aa, Homo Sapiens
IFRKNYAKY

SEQ ID NO: 261622 - protein, 9 aa, Homo Sapiens
ISQKDTCHS

SEQ ID NO: 261623 - protein, 9 aa, Homo Sapiens
KDKERTRVK

SEQ ID NO: 261624 - protein, 9 aa, Homo Sapiens
TERLSALLD

SEQ ID NO: 261625 - protein, 9 aa, Homo Sapiens
HPDNSVRAH

SEQ ID NO: 261626 - protein, 9 aa, Homo Sapiens
RKEKKKKKK

SEQ ID NO: 261627 - protein, 9 aa, Homo Sapiens
YTMVTSMLN

SEQ ID NO: 261628 - protein, 9 aa, Homo Sapiens
PEFIQVGVV

SEQ ID NO: 261629 - protein, 9 aa, Homo Sapiens
RCDQEPCLV

SEQ ID NO: 261630 - protein, 9 aa, Homo Sapiens
PVNDGVTQT

SEQ ID NO: 261631 - protein, 9 aa, Homo Sapiens
ISMEDYGAE

SEQ ID NO: 261632 - protein, 9 aa, Homo Sapiens
HIEWAKDKS

SEQ ID NO: 261633 - protein, 9 aa, Homo Sapiens
SLNSDFIAG

SEQ ID NO: 261634 - protein, 9 aa, Homo Sapiens
EQNVYAIIM

SEQ ID NO: 261635 - protein, 9 aa, Homo Sapiens
FLNNLNLGG

SEQ ID NO: 261636 - protein, 9 aa, Homo Sapiens
KFMKDLKDM

SEQ ID NO: 261637 - protein, 9 aa, Homo Sapiens
WDRKRCRVY

SEQ ID NO: 261638 - protein, 9 aa, Homo Sapiens
QIATVQHEF

SEQ ID NO: 261639 - protein, 9 aa, Homo Sapiens
HQMGKAFYV

SEQ ID NO: 261640 - protein, 9 aa, Homo Sapiens
YTFAPRTWI

SEQ ID NO: 261641 - protein, 9 aa, Homo Sapiens
SFKTQNKVC

SEQ ID NO: 261642 - protein, 9 aa, Homo Sapiens
RNSLTIYHV

SEQ ID NO: 261643 - protein, 9 aa, Homo Sapiens
QISVSELIA

SEQ ID NO: 261644 - protein, 9 aa, Homo Sapiens
KRTRMMEIL

SEQ ID NO: 261645 - protein, 9 aa, Homo Sapiens
SVNAKKDVV

SEQ ID NO: 261646 - protein, 9 aa, Homo Sapiens
EIVQDIKEK

SEQ ID NO: 261647 - protein, 9 aa, Homo Sapiens
QIQQQTPQP

SEQ ID NO: 261648 - protein, 9 aa, Homo Sapiens
KEIKDLRAK

SEQ ID NO: 261649 - protein, 9 aa, Homo Sapiens
EAENVCSQR

SEQ ID NO: 261650 - protein, 9 aa, Homo Sapiens
CIKMQKTIQ

SEQ ID NO: 261651 - protein, 9 aa, Homo Sapiens
IETFILGSC

SEQ ID NO: 261652 - protein, 9 aa, Homo Sapiens
PDAPPQNRI

SEQ ID NO: 261653 - protein, 9 aa, Homo Sapiens
SYLDIYQEE

SEQ ID NO: 261654 - protein, 9 aa, Homo Sapiens
VFYVPGILS

SEQ ID NO: 261655 - protein, 9 aa, Homo Sapiens
DRLWQSLRS

SEQ ID NO: 261656 - protein, 9 aa, Homo Sapiens
DVQEKKENL

SEQ ID NO: 261657 - protein, 9 aa, Homo Sapiens
TIFYPETTD

SEQ ID NO: 261658 - protein, 9 aa, Homo Sapiens
NVGIYDEGV

SEQ ID NO: 261659 - protein, 9 aa, Homo Sapiens
PSTEKDLDK

SEQ ID NO: 261660 - protein, 9 aa, Homo Sapiens
YTLGDKIHG

SEQ ID NO: 261661 - protein, 9 aa, Homo Sapiens
QKYFVKYCV

SEQ ID NO: 261662 - protein, 9 aa, Homo Sapiens
PHNIYLHLA

SEQ ID NO: 261663 - protein, 9 aa, Homo Sapiens
RDKQQNNSK

SEQ ID NO: 261664 - protein, 9 aa, Homo Sapiens
LLKLKSFCT

SEQ ID NO: 261665 - protein, 9 aa, Homo Sapiens
YLRSSSGVL

SEQ ID NO: 261666 - protein, 9 aa, Homo Sapiens
QEERCTDVN

SEQ ID NO: 261667 - protein, 9 aa, Homo Sapiens
VEAGTQEVV

SEQ ID NO: 261668 - protein, 9 aa, Homo Sapiens
TWRQNTNSS

SEQ ID NO: 261669 - protein, 9 aa, Homo Sapiens
EQQVAARII

SEQ ID NO: 261670 - protein, 9 aa, Homo Sapiens
GNLSHVNMM

SEQ ID NO: 261671 - protein, 9 aa, Homo Sapiens
VPQHQEVWG

SEQ ID NO: 261672 - protein, 9 aa, Homo Sapiens
PMLGLTQIT

SEQ ID NO: 261673 - protein, 9 aa, Homo Sapiens
VTKYQPEKW

SEQ ID NO: 261674 - protein, 9 aa, Homo Sapiens
SGVNSERVK

SEQ ID NO: 261675 - protein, 9 aa, Homo Sapiens
GAAIASHEN

SEQ ID NO: 261676 - protein, 9 aa, Homo Sapiens
GINLVVGMT

SEQ ID NO: 261677 - protein, 9 aa, Homo Sapiens
GFFTICKRE

SEQ ID NO: 261678 - protein, 9 aa, Homo Sapiens
TLPRYVKAV

SEQ ID NO: 261679 - protein, 9 aa, Homo Sapiens
ISLVLMAGT

SEQ ID NO: 261680 - protein, 9 aa, Homo Sapiens
RDVTIELSL

SEQ ID NO: 261681 - protein, 9 aa, Homo Sapiens
PASSVSKEV

SEQ ID NO: 261682 - protein, 9 aa, Homo Sapiens
LLEGVRSLV

SEQ ID NO: 261683 - protein, 9 aa, Homo Sapiens
RLIGLDAGL

SEQ ID NO: 261684 - protein, 9 aa, Homo Sapiens
TQDKKTEEL

SEQ ID NO: 261685 - protein, 9 aa, Homo Sapiens
KLQDMERKA

SEQ ID NO: 261686 - protein, 9 aa, Homo Sapiens
NYFGHLAGC

SEQ ID NO: 261687 - protein, 9 aa, Homo Sapiens
PFSSPTSRM

SEQ ID NO: 261688 - protein, 9 aa, Homo Sapiens
AHQSVEGEF

SEQ ID NO: 261689 - protein, 9 aa, Homo Sapiens
TIPPGAFIG

SEQ ID NO: 261690 - protein, 9 aa, Homo Sapiens
GFLTEDKKN

SEQ ID NO: 261691 - protein, 9 aa, Homo Sapiens
KRMGIVSNY

SEQ ID NO: 261692 - protein, 9 aa, Homo Sapiens
EEEEQNIGK

SEQ ID NO: 261693 - protein, 9 aa, Homo Sapiens
CLLLVSLTS

SEQ ID NO: 261694 - protein, 9 aa, Homo Sapiens
PYVLVIPMI

SEQ ID NO: 261695 - protein, 9 aa, Homo Sapiens
VDEAIHFIN

SEQ ID NO: 261696 - protein, 9 aa, Homo Sapiens
PSVVSSGDN

SEQ ID NO: 261697 - protein, 9 aa, Homo Sapiens
GRRINSLPP

SEQ ID NO: 261698 - protein, 9 aa, Homo Sapiens
LSTGIADFF

SEQ ID NO: 261699 - protein, 9 aa, Homo Sapiens
ADYSSKTEL

SEQ ID NO: 261700 - protein, 9 aa, Homo Sapiens
SYILAGVNI

SEQ ID NO: 261701 - protein, 9 aa, Homo Sapiens
MCLNIAVTP

SEQ ID NO: 261702 - protein, 9 aa, Homo Sapiens
TERVISGKQ

SEQ ID NO: 261703 - protein, 9 aa, Homo Sapiens
DIVTRSRAD

SEQ ID NO: 261704 - protein, 9 aa, Homo Sapiens
ANVLKKIAE

SEQ ID NO: 261705 - protein, 9 aa, Homo Sapiens
TTGLIPVNY

SEQ ID NO: 261706 - protein, 9 aa, Homo Sapiens
VRLQCKLYS

SEQ ID NO: 261707 - protein, 9 aa, Homo Sapiens
KRKETWTAG

SEQ ID NO: 261708 - protein, 9 aa, Homo Sapiens
EKQIATTDL

SEQ ID NO: 261709 - protein, 9 aa, Homo Sapiens
FNPLAKSHP

SEQ ID NO: 261710 - protein, 9 aa, Homo Sapiens
HTADKPYKC

SEQ ID NO: 261711 - protein, 9 aa, Homo Sapiens
LRVREVAKE

SEQ ID NO: 261712 - protein, 9 aa, Homo Sapiens
QAEVDRLLG

SEQ ID NO: 261713 - protein, 9 aa, Homo Sapiens
GGPFKFKFH

SEQ ID NO: 261714 - protein, 9 aa, Homo Sapiens
EDLQPSDLG

SEQ ID NO: 261715 - protein, 9 aa, Homo Sapiens
AYIVQLSYA

SEQ ID NO: 261716 - protein, 9 aa, Homo Sapiens
DVLGDFQWR

SEQ ID NO: 261717 - protein, 9 aa, Homo Sapiens
ISEGRSGPG

SEQ ID NO: 261718 - protein, 9 aa, Homo Sapiens
MSNLDSSRD

SEQ ID NO: 261719 - protein, 9 aa, Homo Sapiens
MYEEQRVGS

SEQ ID NO: 261720 - protein, 9 aa, Homo Sapiens
LAHSNLTEM

SEQ ID NO: 261721 - protein, 9 aa, Homo Sapiens
NAVVGQYTQ

SEQ ID NO: 261722 - protein, 9 aa, Homo Sapiens
IASWGQRLE

SEQ ID NO: 261723 - protein, 9 aa, Homo Sapiens
LYIICAVIL

SEQ ID NO: 261724 - protein, 9 aa, Homo Sapiens
SAEYSIYIT

SEQ ID NO: 261725 - protein, 9 aa, Homo Sapiens
LFFLTGHDR

SEQ ID NO: 261726 - protein, 9 aa, Homo Sapiens
ITDEINFLR

SEQ ID NO: 261727 - protein, 9 aa, Homo Sapiens
KLYQYLSLL

SEQ ID NO: 261728 - protein, 9 aa, Homo Sapiens
GGVDVFYLS

SEQ ID NO: 261729 - protein, 9 aa, Homo Sapiens
EMLKPAKNY

SEQ ID NO: 261730 - protein, 9 aa, Homo Sapiens
YLNLSFNDI

SEQ ID NO: 261731 - protein, 9 aa, Homo Sapiens
GGIPKFSHR

SEQ ID NO: 261732 - protein, 9 aa, Homo Sapiens
ATEMLQNNP

SEQ ID NO: 261733 - protein, 9 aa, Homo Sapiens
ESLNSGYEF

SEQ ID NO: 261734 - protein, 9 aa, Homo Sapiens
YRTAISGIR

SEQ ID NO: 261735 - protein, 9 aa, Homo Sapiens
LTKTCFLDC

SEQ ID NO: 261736 - protein, 9 aa, Homo Sapiens
IPDLIDYKS

SEQ ID NO: 261737 - protein, 9 aa, Homo Sapiens
DRATKNTAD

SEQ ID NO: 261738 - protein, 9 aa, Homo Sapiens
LTDTQLFPH

SEQ ID NO: 261739 - protein, 9 aa, Homo Sapiens
VPMKERPVI

SEQ ID NO: 261740 - protein, 9 aa, Homo Sapiens
LRKCRKIDY

SEQ ID NO: 261741 - protein, 9 aa, Homo Sapiens
ILTVSRPRS

SEQ ID NO: 261742 - protein, 9 aa, Homo Sapiens
PKIFKSQID

SEQ ID NO: 261743 - protein, 9 aa, Homo Sapiens
LYVILLFFM

SEQ ID NO: 261744 - protein, 9 aa, Homo Sapiens
GLYYVRNDL

SEQ ID NO: 261745 - protein, 9 aa, Homo Sapiens
MLFPPVEAG

SEQ ID NO: 261746 - protein, 9 aa, Homo Sapiens
EYLTRNSSI

SEQ ID NO: 261747 - protein, 9 aa, Homo Sapiens
EKAREDKSF

SEQ ID NO: 261748 - protein, 9 aa, Homo Sapiens
AIIISGGPT

SEQ ID NO: 261749 - protein, 9 aa, Homo Sapiens
GVTDISAAD

SEQ ID NO: 261750 - protein, 9 aa, Homo Sapiens
IMTLYQFIQ

SEQ ID NO: 261751 - protein, 9 aa, Homo Sapiens
TSTQENKHK

SEQ ID NO: 261752 - protein, 9 aa, Homo Sapiens
HKDVRRICS

SEQ ID NO: 261753 - protein, 9 aa, Homo Sapiens
YNVTSKGAC

SEQ ID NO: 261754 - protein, 9 aa, Homo Sapiens
DLAMETWLR

SEQ ID NO: 261755 - protein, 9 aa, Homo Sapiens
NAQLQLERQ

SEQ ID NO: 261756 - protein, 9 aa, Homo Sapiens
FALTNIKIA

SEQ ID NO: 261757 - protein, 9 aa, Homo Sapiens
TEEEETIKS

SEQ ID NO: 261758 - protein, 9 aa, Homo Sapiens
DLEKKAKHQ

SEQ ID NO: 261759 - protein, 9 aa, Homo Sapiens
TLMHLYFAQ

SEQ ID NO: 261760 - protein, 9 aa, Homo Sapiens
TDYIPENAG

SEQ ID NO: 261761 - protein, 9 aa, Homo Sapiens
SIIIANVEE

SEQ ID NO: 261762 - protein, 9 aa, Homo Sapiens
LNMLQCRSC

SEQ ID NO: 261763 - protein, 9 aa, Homo Sapiens
NEQWILTAR

SEQ ID NO: 261764 - protein, 9 aa, Homo Sapiens
TGKGGDDKY

SEQ ID NO: 261765 - protein, 9 aa, Homo Sapiens
ELDNPHTQK

SEQ ID NO: 261766 - protein, 9 aa, Homo Sapiens
SSTGPSYYR

SEQ ID NO: 261767 - protein, 9 aa, Homo Sapiens
DPKIYRNVE

SEQ ID NO: 261768 - protein, 9 aa, Homo Sapiens
DYAHYSGSY

SEQ ID NO: 261769 - protein, 9 aa, Homo Sapiens
KQIPFSKTY

SEQ ID NO: 261770 - protein, 9 aa, Homo Sapiens
FNTLCSTFT

SEQ ID NO: 261771 - protein, 9 aa, Homo Sapiens
RRRTALRPG

SEQ ID NO: 261772 - protein, 9 aa, Homo Sapiens
CDCLPKFLV

SEQ ID NO: 261773 - protein, 9 aa, Homo Sapiens
CAFHDCQNN

SEQ ID NO: 261774 - protein, 9 aa, Homo Sapiens
GIWMINNRG

SEQ ID NO: 261775 - protein, 9 aa, Homo Sapiens
ALQVLDFVQ

SEQ ID NO: 261776 - protein, 9 aa, Homo Sapiens
SYLSQPQML

SEQ ID NO: 261777 - protein, 9 aa, Homo Sapiens
EGDKVTLIC

SEQ ID NO: 261778 - protein, 9 aa, Homo Sapiens
YTTELKLSP

SEQ ID NO: 261779 - protein, 9 aa, Homo Sapiens
AQRKWEKHF

SEQ ID NO: 261780 - protein, 9 aa, Homo Sapiens
YNDDDLLKI

SEQ ID NO: 261781 - protein, 9 aa, Homo Sapiens
LNHKLEEFR

SEQ ID NO: 261782 - protein, 9 aa, Homo Sapiens
PAAGSPQKP

SEQ ID NO: 261783 - protein, 9 aa, Homo Sapiens
FGNQEDAHD

SEQ ID NO: 261784 - protein, 9 aa, Homo Sapiens
VQRLWREEH

SEQ ID NO: 261785 - protein, 9 aa, Homo Sapiens
IIHNREKAY

SEQ ID NO: 261786 - protein, 9 aa, Homo Sapiens
TFNTNLTGY

SEQ ID NO: 261787 - protein, 9 aa, Homo Sapiens
GDIDSYLVQ

SEQ ID NO: 261788 - protein, 9 aa, Homo Sapiens
PNTINVPPE

SEQ ID NO: 261789 - protein, 9 aa, Homo Sapiens
TCALHEQPE

SEQ ID NO: 261790 - protein, 9 aa, Homo Sapiens
CRAFNYYPQ

SEQ ID NO: 261791 - protein, 9 aa, Homo Sapiens
VQYKLLGAG

SEQ ID NO: 261792 - protein, 9 aa, Homo Sapiens
QIQRREVHE

SEQ ID NO: 261793 - protein, 9 aa, Homo Sapiens
GLVKVIGIS

SEQ ID NO: 261794 - protein, 9 aa, Homo Sapiens
STEKAHVDL

SEQ ID NO: 261795 - protein, 9 aa, Homo Sapiens
NRRYPSMAM

SEQ ID NO: 261796 - protein, 9 aa, Homo Sapiens
SHIKKTLML

SEQ ID NO: 261797 - protein, 9 aa, Homo Sapiens
ITEMFIKDA

SEQ ID NO: 261798 - protein, 9 aa, Homo Sapiens
KDSYGVIHV

SEQ ID NO: 261799 - protein, 9 aa, Homo Sapiens
LEAQTGAGP

SEQ ID NO: 261800 - protein, 9 aa, Homo Sapiens
VCYYSHFID

SEQ ID NO: 261801 - protein, 9 aa, Homo Sapiens
PLYLTGLFG

SEQ ID NO: 261802 - protein, 9 aa, Homo Sapiens
EMTCYQQQS

SEQ ID NO: 261803 - protein, 9 aa, Homo Sapiens
GSLNAYLHS

SEQ ID NO: 261804 - protein, 9 aa, Homo Sapiens
KSTRERFAL

SEQ ID NO: 261805 - protein, 9 aa, Homo Sapiens
KHNNGGLIK

SEQ ID NO: 261806 - protein, 9 aa, Homo Sapiens
IDDINVTQQ

SEQ ID NO: 261807 - protein, 9 aa, Homo Sapiens
LQLTFCDSN

SEQ ID NO: 261808 - protein, 9 aa, Homo Sapiens
TQQSPLMVD

SEQ ID NO: 261809 - protein, 9 aa, Homo Sapiens
RNKGEFTHL

SEQ ID NO: 261810 - protein, 9 aa, Homo Sapiens
NGVGTQNAH

SEQ ID NO: 261811 - protein, 9 aa, Homo Sapiens
SSHYGDFLP

SEQ ID NO: 261812 - protein, 9 aa, Homo Sapiens
FFAHGRLVY

SEQ ID NO: 261813 - protein, 9 aa, Homo Sapiens
FPLRGMHPR

SEQ ID NO: 261814 - protein, 9 aa, Homo Sapiens
TRIMGHAVQ

SEQ ID NO: 261815 - protein, 9 aa, Homo Sapiens
VKGMLHKEK

SEQ ID NO: 261816 - protein, 9 aa, Homo Sapiens
IRRWDIIDL

SEQ ID NO: 261817 - protein, 9 aa, Homo Sapiens
NKPLQQQLS

SEQ ID NO: 261818 - protein, 9 aa, Homo Sapiens
KYMALNIGN

SEQ ID NO: 261819 - protein, 9 aa, Homo Sapiens
DSTTMHELE

SEQ ID NO: 261820 - protein, 9 aa, Homo Sapiens
TTQNGRLYA

SEQ ID NO: 261821 - protein, 9 aa, Homo Sapiens
KEMSPGFRL

SEQ ID NO: 261822 - protein, 9 aa, Homo Sapiens
GIVCFYGKT

SEQ ID NO: 261823 - protein, 9 aa, Homo Sapiens
QKIKQSVSD

SEQ ID NO: 261824 - protein, 9 aa, Homo Sapiens
YVRRVFIVD

SEQ ID NO: 261825 - protein, 9 aa, Homo Sapiens
SPISSFFGG

SEQ ID NO: 261826 - protein, 9 aa, Homo Sapiens
YFPPSWIAV

SEQ ID NO: 261827 - protein, 9 aa, Homo Sapiens
QLEQLSHAK

SEQ ID NO: 261828 - protein, 9 aa, Homo Sapiens
VEASRIMTL

SEQ ID NO: 261829 - protein, 9 aa, Homo Sapiens
PAPFSSSWV

SEQ ID NO: 261830 - protein, 9 aa, Homo Sapiens
NANNRRLSS

SEQ ID NO: 261831 - protein, 9 aa, Homo Sapiens
VMQEEFSCD

SEQ ID NO: 261832 - protein, 9 aa, Homo Sapiens
AAKVILKKI

SEQ ID NO: 261833 - protein, 9 aa, Homo Sapiens
STDCRNTRV

SEQ ID NO: 261834 - protein, 9 aa, Homo Sapiens
NSCANPIFY

SEQ ID NO: 261835 - protein, 9 aa, Homo Sapiens
QNLITKMNL

SEQ ID NO: 261836 - protein, 9 aa, Homo Sapiens
LKDPKYVRY

SEQ ID NO: 261837 - protein, 9 aa, Homo Sapiens
LLISPVLSQ

SEQ ID NO: 261838 - protein, 9 aa, Homo Sapiens
DADVTLGNT

SEQ ID NO: 261839 - protein, 9 aa, Homo Sapiens
PTDFSGLWR

SEQ ID NO: 261840 - protein, 9 aa, Homo Sapiens
LQGTSGPDL

SEQ ID NO: 261841 - protein, 9 aa, Homo Sapiens
STQDFFDEP

SEQ ID NO: 261842 - protein, 9 aa, Homo Sapiens
FLFKPENST

SEQ ID NO: 261843 - protein, 9 aa, Homo Sapiens
EAGLKCATG

SEQ ID NO: 261844 - protein, 9 aa, Homo Sapiens
RELKENLDC

SEQ ID NO: 261845 - protein, 9 aa, Homo Sapiens
SELFLDKFF

SEQ ID NO: 261846 - protein, 9 aa, Homo Sapiens
DKVTLICSA

SEQ ID NO: 261847 - protein, 9 aa, Homo Sapiens
ENTTYLKTI

SEQ ID NO: 261848 - protein, 9 aa, Homo Sapiens
KLFEKYLRD

SEQ ID NO: 261849 - protein, 9 aa, Homo Sapiens
KTQMDDKKP

SEQ ID NO: 261850 - protein, 9 aa, Homo Sapiens
RSSEILNKL

SEQ ID NO: 261851 - protein, 9 aa, Homo Sapiens
KYFSSEGHL

SEQ ID NO: 261852 - protein, 9 aa, Homo Sapiens
IENRAKAGY

SEQ ID NO: 261853 - protein, 9 aa, Homo Sapiens
SLSLVGALL

SEQ ID NO: 261854 - protein, 9 aa, Homo Sapiens
QLVKAERKF

SEQ ID NO: 261855 - protein, 9 aa, Homo Sapiens
VLNEPLDEL

SEQ ID NO: 261856 - protein, 9 aa, Homo Sapiens
DDQKALERD

SEQ ID NO: 261857 - protein, 9 aa, Homo Sapiens
DVDKKAMME

SEQ ID NO: 261858 - protein, 9 aa, Homo Sapiens
LIIHLWKHG

SEQ ID NO: 261859 - protein, 9 aa, Homo Sapiens
VYFYELQDN

SEQ ID NO: 261860 - protein, 9 aa, Homo Sapiens
GKTCGLAWG

SEQ ID NO: 261861 - protein, 9 aa, Homo Sapiens
TKSPVREEP

SEQ ID NO: 261862 - protein, 9 aa, Homo Sapiens
RFQNHVHLM

SEQ ID NO: 261863 - protein, 9 aa, Homo Sapiens
QADLSLDDK

SEQ ID NO: 261864 - protein, 9 aa, Homo Sapiens
HTDSDSMDK

SEQ ID NO: 261865 - protein, 9 aa, Homo Sapiens
VVLEFDFLT

SEQ ID NO: 261866 - protein, 9 aa, Homo Sapiens
FCTDQGIWI

SEQ ID NO: 261867 - protein, 9 aa, Homo Sapiens
LMVSVAAGL

SEQ ID NO: 261868 - protein, 9 aa, Homo Sapiens
QRNEEFDWP

SEQ ID NO: 261869 - protein, 9 aa, Homo Sapiens
GRAFTQKSE

SEQ ID NO: 261870 - protein, 9 aa, Homo Sapiens
IITSYNAWV

SEQ ID NO: 261871 - protein, 9 aa, Homo Sapiens
VRSIFLQQQ

SEQ ID NO: 261872 - protein, 9 aa, Homo Sapiens
GLTIIACFD

SEQ ID NO: 261873 - protein, 9 aa, Homo Sapiens
LIQAVCCEN

SEQ ID NO: 261874 - protein, 9 aa, Homo Sapiens
QQELHQMGK

SEQ ID NO: 261875 - protein, 9 aa, Homo Sapiens
FRIYSIRDE

SEQ ID NO: 261876 - protein, 9 aa, Homo Sapiens
CRLISREKI

SEQ ID NO: 261877 - protein, 9 aa, Homo Sapiens
PLYVKEIHY

SEQ ID NO: 261878 - protein, 9 aa, Homo Sapiens
RGRDTHVYT

SEQ ID NO: 261879 - protein, 9 aa, Homo Sapiens
HQTKAMAHL

SEQ ID NO: 261880 - protein, 9 aa, Homo Sapiens
ITYQLRNDS

SEQ ID NO: 261881 - protein, 9 aa, Homo Sapiens
STKNYPSTR

SEQ ID NO: 261882 - protein, 9 aa, Homo Sapiens
ECRVNRNNL

SEQ ID NO: 261883 - protein, 9 aa, Homo Sapiens
GTGTDRCAQ

SEQ ID NO: 261884 - protein, 9 aa, Homo Sapiens
MMLCVTGNF

SEQ ID NO: 261885 - protein, 9 aa, Homo Sapiens
KRGWVWNQL

SEQ ID NO: 261886 - protein, 9 aa, Homo Sapiens
VYPCRCVRP

SEQ ID NO: 261887 - protein, 9 aa, Homo Sapiens
KEKGIHILE

SEQ ID NO: 261888 - protein, 9 aa, Homo Sapiens
PAVQREERI

SEQ ID NO: 261889 - protein, 9 aa, Homo Sapiens
YFEDIKIVK

SEQ ID NO: 261890 - protein, 9 aa, Homo Sapiens
ERLLGTFSL

SEQ ID NO: 261891 - protein, 9 aa, Homo Sapiens
FMDQYKYER

SEQ ID NO: 261892 - protein, 9 aa, Homo Sapiens
VPIGRFQNH

SEQ ID NO: 261893 - protein, 9 aa, Homo Sapiens
PFHQWFLNN

SEQ ID NO: 261894 - protein, 9 aa, Homo Sapiens
QNISIETNE

SEQ ID NO: 261895 - protein, 9 aa, Homo Sapiens
PIQDPKTEQ

SEQ ID NO: 261896 - protein, 9 aa, Homo Sapiens
LSQSIPEER

SEQ ID NO: 261897 - protein, 9 aa, Homo Sapiens
GLANKKRAK

SEQ ID NO: 261898 - protein, 9 aa, Homo Sapiens
LSPHIKYPS

SEQ ID NO: 261899 - protein, 9 aa, Homo Sapiens
PPMCHLTVQ

SEQ ID NO: 261900 - protein, 9 aa, Homo Sapiens
ISIGIFYGS

SEQ ID NO: 261901 - protein, 9 aa, Homo Sapiens
VKVNLSDRV

SEQ ID NO: 261902 - protein, 9 aa, Homo Sapiens
FGQMQQVQT

SEQ ID NO: 261903 - protein, 9 aa, Homo Sapiens
AMPQFFMDQ

SEQ ID NO: 261904 - protein, 9 aa, Homo Sapiens
SSLNKGNKL

SEQ ID NO: 261905 - protein, 9 aa, Homo Sapiens
LTDIDSTLD

SEQ ID NO: 261906 - protein, 9 aa, Homo Sapiens
MGTNLSKLR

SEQ ID NO: 261907 - protein, 9 aa, Homo Sapiens
RDSLRGTMQ

SEQ ID NO: 261908 - protein, 9 aa, Homo Sapiens
TAQNPVSNT

SEQ ID NO: 261909 - protein, 9 aa, Homo Sapiens
RAKFRQIVL

SEQ ID NO: 261910 - protein, 9 aa, Homo Sapiens
QVTSPVIQR

SEQ ID NO: 261911 - protein, 9 aa, Homo Sapiens
LPTIPPIQV

SEQ ID NO: 261912 - protein, 9 aa, Homo Sapiens
TQLRESVVQ

SEQ ID NO: 261913 - protein, 9 aa, Homo Sapiens
QFIYILGNC

SEQ ID NO: 261914 - protein, 9 aa, Homo Sapiens
LERVYNLVK

SEQ ID NO: 261915 - protein, 9 aa, Homo Sapiens
NSAISMTMR

SEQ ID NO: 261916 - protein, 9 aa, Homo Sapiens
MHTTDILGI

SEQ ID NO: 261917 - protein, 9 aa, Homo Sapiens
PDTEGAVRS

SEQ ID NO: 261918 - protein, 9 aa, Homo Sapiens
SSSDLNIEH

SEQ ID NO: 261919 - protein, 9 aa, Homo Sapiens
FLSGSKKAN

SEQ ID NO: 261920 - protein, 9 aa, Homo Sapiens
KFQGSVTLK

SEQ ID NO: 261921 - protein, 9 aa, Homo Sapiens
EIKQMEQKL

SEQ ID NO: 261922 - protein, 9 aa, Homo Sapiens
SRKYFREKS

SEQ ID NO: 261923 - protein, 9 aa, Homo Sapiens
EQGYPGIPG

SEQ ID NO: 261924 - protein, 9 aa, Homo Sapiens
VQYNAQKSQ

SEQ ID NO: 261925 - protein, 9 aa, Homo Sapiens
REALERTEQ

SEQ ID NO: 261926 - protein, 9 aa, Homo Sapiens
GPPEPPYIF

SEQ ID NO: 261927 - protein, 9 aa, Homo Sapiens
GEAGGLMVF

SEQ ID NO: 261928 - protein, 9 aa, Homo Sapiens
GQYSAIAPN

SEQ ID NO: 261929 - protein, 9 aa, Homo Sapiens
EDDTVLNLK

SEQ ID NO: 261930 - protein, 9 aa, Homo Sapiens
TLLFVVLFA

SEQ ID NO: 261931 - protein, 9 aa, Homo Sapiens
VCVNIHGIF

SEQ ID NO: 261932 - protein, 9 aa, Homo Sapiens
SGTATSSLG

SEQ ID NO: 261933 - protein, 9 aa, Homo Sapiens
ILYIGEKTF

SEQ ID NO: 261934 - protein, 9 aa, Homo Sapiens
GNSIKHRCS

SEQ ID NO: 261935 - protein, 9 aa, Homo Sapiens
QVDGDNETP

SEQ ID NO: 261936 - protein, 9 aa, Homo Sapiens
ELSNLNHKL

SEQ ID NO: 261937 - protein, 9 aa, Homo Sapiens
GIVRQGLQC

SEQ ID NO: 261938 - protein, 9 aa, Homo Sapiens
SMELFERYH

SEQ ID NO: 261939 - protein, 9 aa, Homo Sapiens
GLDVDTKAA

SEQ ID NO: 261940 - protein, 9 aa, Homo Sapiens
VTQEEAPFV

SEQ ID NO: 261941 - protein, 9 aa, Homo Sapiens
LYDADGNGY

SEQ ID NO: 261942 - protein, 9 aa, Homo Sapiens
DMEQISIIE

SEQ ID NO: 261943 - protein, 9 aa, Homo Sapiens
PMQAPPSLP

SEQ ID NO: 261944 - protein, 9 aa, Homo Sapiens
QVVDNSELA

SEQ ID NO: 261945 - protein, 9 aa, Homo Sapiens
SLAAGFSCC

SEQ ID NO: 261946 - protein, 9 aa, Homo Sapiens
RALQYTLGD

SEQ ID NO: 261947 - protein, 9 aa, Homo Sapiens
NHLAQAVHV

SEQ ID NO: 261948 - protein, 9 aa, Homo Sapiens
CDKTLKRLS

SEQ ID NO: 261949 - protein, 9 aa, Homo Sapiens
QISKSPDGA

SEQ ID NO: 261950 - protein, 9 aa, Homo Sapiens
LGPSQNNLY

SEQ ID NO: 261951 - protein, 9 aa, Homo Sapiens
TLYVADVKS

SEQ ID NO: 261952 - protein, 9 aa, Homo Sapiens
DPNIQYKSG

SEQ ID NO: 261953 - protein, 9 aa, Homo Sapiens
NLITKMNLM

SEQ ID NO: 261954 - protein, 9 aa, Homo Sapiens
CDFVALLKL

SEQ ID NO: 261955 - protein, 9 aa, Homo Sapiens
LSGSVPLLA

SEQ ID NO: 261956 - protein, 9 aa, Homo Sapiens
DDWQEAHGR

SEQ ID NO: 261957 - protein, 9 aa, Homo Sapiens
TTAAHYLVG

SEQ ID NO: 261958 - protein, 9 aa, Homo Sapiens
LLASSWKHP

SEQ ID NO: 261959 - protein, 9 aa, Homo Sapiens
VSELMRQCW

SEQ ID NO: 261960 - protein, 9 aa, Homo Sapiens
KMYPSRDEY

SEQ ID NO: 261961 - protein, 9 aa, Homo Sapiens
NISPAKQFN

SEQ ID NO: 261962 - protein, 9 aa, Homo Sapiens
LGRQGNKGE

SEQ ID NO: 261963 - protein, 9 aa, Homo Sapiens
DSHKRKGLP

SEQ ID NO: 261964 - protein, 9 aa, Homo Sapiens
LWGVAVVLC

SEQ ID NO: 261965 - protein, 9 aa, Homo Sapiens
VPLHPGLFT

SEQ ID NO: 261966 - protein, 9 aa, Homo Sapiens
LPKAEHWYM

SEQ ID NO: 261967 - protein, 9 aa, Homo Sapiens
QTDSHLHTP

SEQ ID NO: 261968 - protein, 9 aa, Homo Sapiens
KSDETEDIF

SEQ ID NO: 261969 - protein, 9 aa, Homo Sapiens
LRYAAAAAA

SEQ ID NO: 261970 - protein, 9 aa, Homo Sapiens
FKVMEPTWH

SEQ ID NO: 261971 - protein, 9 aa, Homo Sapiens
LVPSEEPSE

SEQ ID NO: 261972 - protein, 9 aa, Homo Sapiens
CRERVVLGI

SEQ ID NO: 261973 - protein, 9 aa, Homo Sapiens
ALYLVQIRQ

SEQ ID NO: 261974 - protein, 9 aa, Homo Sapiens
VPPPSSGST

SEQ ID NO: 261975 - protein, 9 aa, Homo Sapiens
ALIASWGQR

SEQ ID NO: 261976 - protein, 9 aa, Homo Sapiens
MVTSVQEEG

SEQ ID NO: 261977 - protein, 9 aa, Homo Sapiens
GLINNSRFY

SEQ ID NO: 261978 - protein, 9 aa, Homo Sapiens
KEEHEKRIA

SEQ ID NO: 261979 - protein, 9 aa, Homo Sapiens
YSVLIAKAS

SEQ ID NO: 261980 - protein, 9 aa, Homo Sapiens
IPNVTVPST

SEQ ID NO: 261981 - protein, 9 aa, Homo Sapiens
ASAYASAHL

SEQ ID NO: 261982 - protein, 9 aa, Homo Sapiens
EEKYATVQP

SEQ ID NO: 261983 - protein, 9 aa, Homo Sapiens
VVEDSVFLV

SEQ ID NO: 261984 - protein, 9 aa, Homo Sapiens
FPYLQKDGA

SEQ ID NO: 261985 - protein, 9 aa, Homo Sapiens
LSVCNSAPG

SEQ ID NO: 261986 - protein, 9 aa, Homo Sapiens
EFLAAYAPG

SEQ ID NO: 261987 - protein, 9 aa, Homo Sapiens
QELSNPLSG

SEQ ID NO: 261988 - protein, 9 aa, Homo Sapiens
TSMNGKEKL

SEQ ID NO: 261989 - protein, 9 aa, Homo Sapiens
LELDKVLED

SEQ ID NO: 261990 - protein, 9 aa, Homo Sapiens
SISHNKMNG

SEQ ID NO: 261991 - protein, 9 aa, Homo Sapiens
QGRYSDHGE

SEQ ID NO: 261992 - protein, 9 aa, Homo Sapiens
LDHFQSEKK

SEQ ID NO: 261993 - protein, 9 aa, Homo Sapiens
DLPPYTSYE

SEQ ID NO: 261994 - protein, 9 aa, Homo Sapiens
PFFVELTML

SEQ ID NO: 261995 - protein, 9 aa, Homo Sapiens
NEARMETLN

SEQ ID NO: 261996 - protein, 9 aa, Homo Sapiens
QEMDSSGES

SEQ ID NO: 261997 - protein, 9 aa, Homo Sapiens
NIISEKKTI

SEQ ID NO: 261998 - protein, 9 aa, Homo Sapiens
ETSHSYRTD

SEQ ID NO: 261999 - protein, 9 aa, Homo Sapiens
ATEICPLIA

SEQ ID NO: 262000 - protein, 9 aa, Homo Sapiens
KSKGTSLTT

SEQ ID NO: 262001 - protein, 9 aa, Homo Sapiens
ALSPTPKEV

SEQ ID NO: 262002 - protein, 9 aa, Homo Sapiens
YHVPFCLFA

SEQ ID NO: 262003 - protein, 9 aa, Homo Sapiens
HELMNDVNY

SEQ ID NO: 262004 - protein, 9 aa, Homo Sapiens
ATPPRPRED

SEQ ID NO: 262005 - protein, 9 aa, Homo Sapiens
ELCDPTEPC

SEQ ID NO: 262006 - protein, 9 aa, Homo Sapiens
LTLIQMTHF

SEQ ID NO: 262007 - protein, 9 aa, Homo Sapiens
LTSTEKAHV

SEQ ID NO: 262008 - protein, 9 aa, Homo Sapiens
PVLFATKVR

SEQ ID NO: 262009 - protein, 9 aa, Homo Sapiens
ASPVDSALS

SEQ ID NO: 262010 - protein, 9 aa, Homo Sapiens
EYIYAFAHR

SEQ ID NO: 262011 - protein, 9 aa, Homo Sapiens
ENLKAQEYE

SEQ ID NO: 262012 - protein, 9 aa, Homo Sapiens
DFVLWCDRR

SEQ ID NO: 262013 - protein, 9 aa, Homo Sapiens
CVIFQDHLL

SEQ ID NO: 262014 - protein, 9 aa, Homo Sapiens
DEAIHFINE

SEQ ID NO: 262015 - protein, 9 aa, Homo Sapiens
SIAEIGIAV

SEQ ID NO: 262016 - protein, 9 aa, Homo Sapiens
SESTEISLD

SEQ ID NO: 262017 - protein, 9 aa, Homo Sapiens
FLEPESVIK

SEQ ID NO: 262018 - protein, 9 aa, Homo Sapiens
TLIEDSGYK

SEQ ID NO: 262019 - protein, 9 aa, Homo Sapiens
NHVRDTLRE

SEQ ID NO: 262020 - protein, 9 aa, Homo Sapiens
SAPKSHVEK

SEQ ID NO: 262021 - protein, 9 aa, Homo Sapiens
QCQAFCLLK

SEQ ID NO: 262022 - protein, 9 aa, Homo Sapiens
KRIASQSGA

SEQ ID NO: 262023 - protein, 9 aa, Homo Sapiens
LMHVSTAYA

SEQ ID NO: 262024 - protein, 9 aa, Homo Sapiens
EYSRNTKLE

SEQ ID NO: 262025 - protein, 9 aa, Homo Sapiens
KAYGRNKSW

SEQ ID NO: 262026 - protein, 9 aa, Homo Sapiens
VLYSNHTRM

SEQ ID NO: 262027 - protein, 9 aa, Homo Sapiens
QLFCQKCSH

SEQ ID NO: 262028 - protein, 9 aa, Homo Sapiens
DSEEELIHK

SEQ ID NO: 262029 - protein, 9 aa, Homo Sapiens
NIQKELDFE

SEQ ID NO: 262030 - protein, 9 aa, Homo Sapiens
CFDVHRGED

SEQ ID NO: 262031 - protein, 9 aa, Homo Sapiens
SGGGLRLPF

SEQ ID NO: 262032 - protein, 9 aa, Homo Sapiens
VTHNPGTVK

SEQ ID NO: 262033 - protein, 9 aa, Homo Sapiens
LAWATYYLL

SEQ ID NO: 262034 - protein, 9 aa, Homo Sapiens
KFAEKFQEM

SEQ ID NO: 262035 - protein, 9 aa, Homo Sapiens
RPSSCSKSL

SEQ ID NO: 262036 - protein, 9 aa, Homo Sapiens
EVCPTLPAG

SEQ ID NO: 262037 - protein, 9 aa, Homo Sapiens
KRVIYLQGS

SEQ ID NO: 262038 - protein, 9 aa, Homo Sapiens
TPEIQTVPT

SEQ ID NO: 262039 - protein, 9 aa, Homo Sapiens
KNEFMQIPC

SEQ ID NO: 262040 - protein, 9 aa, Homo Sapiens
SDYAHYSGS

SEQ ID NO: 262041 - protein, 9 aa, Homo Sapiens
FTCTHVYIR

SEQ ID NO: 262042 - protein, 9 aa, Homo Sapiens
SSRDNEVDF

SEQ ID NO: 262043 - protein, 9 aa, Homo Sapiens
LARLQQLPF

SEQ ID NO: 262044 - protein, 9 aa, Homo Sapiens
RRAQRLWPQ

SEQ ID NO: 262045 - protein, 9 aa, Homo Sapiens
MSWKINYFS

SEQ ID NO: 262046 - protein, 9 aa, Homo Sapiens
KSLDLYLSD

SEQ ID NO: 262047 - protein, 9 aa, Homo Sapiens
SPQGTSWGR

SEQ ID NO: 262048 - protein, 9 aa, Homo Sapiens
LPIRRKARS

SEQ ID NO: 262049 - protein, 9 aa, Homo Sapiens
DSDSMDKSL

SEQ ID NO: 262050 - protein, 9 aa, Homo Sapiens
CASHYSELL

SEQ ID NO: 262051 - protein, 9 aa, Homo Sapiens
KNIRCLEHK

SEQ ID NO: 262052 - protein, 9 aa, Homo Sapiens
LEAALDEGR

SEQ ID NO: 262053 - protein, 9 aa, Homo Sapiens
CAKCEDVWQ

SEQ ID NO: 262054 - protein, 9 aa, Homo Sapiens
MYTPLSATR

SEQ ID NO: 262055 - protein, 9 aa, Homo Sapiens
QKDTLQNQK

SEQ ID NO: 262056 - protein, 9 aa, Homo Sapiens
LFYSSVSEG

SEQ ID NO: 262057 - protein, 9 aa, Homo Sapiens
SVPRAPSFL

SEQ ID NO: 262058 - protein, 9 aa, Homo Sapiens
ECNKAYRWL

SEQ ID NO: 262059 - protein, 9 aa, Homo Sapiens
VVTNVISLI

SEQ ID NO: 262060 - protein, 9 aa, Homo Sapiens
ILINDAGVM

SEQ ID NO: 262061 - protein, 9 aa, Homo Sapiens
QSPLMVDLH

SEQ ID NO: 262062 - protein, 9 aa, Homo Sapiens
SLKTTQPEN

SEQ ID NO: 262063 - protein, 9 aa, Homo Sapiens
LDSELFLDK

SEQ ID NO: 262064 - protein, 9 aa, Homo Sapiens
NRQWRCDQE

SEQ ID NO: 262065 - protein, 9 aa, Homo Sapiens
PKIANIFEI

SEQ ID NO: 262066 - protein, 9 aa, Homo Sapiens
EGSKPGIYV

SEQ ID NO: 262067 - protein, 9 aa, Homo Sapiens
QMAAAGGTV

SEQ ID NO: 262068 - protein, 9 aa, Homo Sapiens
WKRVYFGRC

SEQ ID NO: 262069 - protein, 9 aa, Homo Sapiens
LSSAIVLWC

SEQ ID NO: 262070 - protein, 9 aa, Homo Sapiens
CSTNNCCKP

SEQ ID NO: 262071 - protein, 9 aa, Homo Sapiens
EEEEEEEQN

SEQ ID NO: 262072 - protein, 9 aa, Homo Sapiens
SDSCYFDDP

SEQ ID NO: 262073 - protein, 9 aa, Homo Sapiens
CNHKEITYT

SEQ ID NO: 262074 - protein, 9 aa, Homo Sapiens
HGCKELENT

SEQ ID NO: 262075 - protein, 9 aa, Homo Sapiens
PSLLSDSRL

SEQ ID NO: 262076 - protein, 9 aa, Homo Sapiens
EIIFNLADT

SEQ ID NO: 262077 - protein, 9 aa, Homo Sapiens
LTRHRIIHT

SEQ ID NO: 262078 - protein, 9 aa, Homo Sapiens
FQIHEKTHS

SEQ ID NO: 262079 - protein, 9 aa, Homo Sapiens
IISQHENIF

SEQ ID NO: 262080 - protein, 9 aa, Homo Sapiens
GRKLTDIID

SEQ ID NO: 262081 - protein, 9 aa, Homo Sapiens
PDGGIAQLR

SEQ ID NO: 262082 - protein, 9 aa, Homo Sapiens
MTHNLQLSK

SEQ ID NO: 262083 - protein, 9 aa, Homo Sapiens
PLLQSNKDL

SEQ ID NO: 262084 - protein, 9 aa, Homo Sapiens
LLGFSLLLL

SEQ ID NO: 262085 - protein, 9 aa, Homo Sapiens
NLIAYFIPF

SEQ ID NO: 262086 - protein, 9 aa, Homo Sapiens
LPVLLPTSP

SEQ ID NO: 262087 - protein, 9 aa, Homo Sapiens
DAENNIENY

SEQ ID NO: 262088 - protein, 9 aa, Homo Sapiens
FIAIVFSAP

SEQ ID NO: 262089 - protein, 9 aa, Homo Sapiens
LKVLGIVFF

SEQ ID NO: 262090 - protein, 9 aa, Homo Sapiens
TRPKSATHL

SEQ ID NO: 262091 - protein, 9 aa, Homo Sapiens
GWMSVSGPQ

SEQ ID NO: 262092 - protein, 9 aa, Homo Sapiens
VIVGEGLNL

SEQ ID NO: 262093 - protein, 9 aa, Homo Sapiens
NAGLVGLSV

SEQ ID NO: 262094 - protein, 9 aa, Homo Sapiens
TSRTTRGKK

SEQ ID NO: 262095 - protein, 9 aa, Homo Sapiens
EMFQSAGIW

SEQ ID NO: 262096 - protein, 9 aa, Homo Sapiens
RTHTGEKHF

SEQ ID NO: 262097 - protein, 9 aa, Homo Sapiens
MHIEKKLNQ

SEQ ID NO: 262098 - protein, 9 aa, Homo Sapiens
KGCVPQLEK

SEQ ID NO: 262099 - protein, 9 aa, Homo Sapiens
TTVLNSQAY

SEQ ID NO: 262100 - protein, 9 aa, Homo Sapiens
NLCSYIFTH

SEQ ID NO: 262101 - protein, 9 aa, Homo Sapiens
HMTKRKRVV

SEQ ID NO: 262102 - protein, 9 aa, Homo Sapiens
HIFARGKRN

SEQ ID NO: 262103 - protein, 9 aa, Homo Sapiens
TNQIYRIFE

SEQ ID NO: 262104 - protein, 9 aa, Homo Sapiens
KHQIHIEKY

SEQ ID NO: 262105 - protein, 9 aa, Homo Sapiens
KAEMVVPDL

SEQ ID NO: 262106 - protein, 9 aa, Homo Sapiens
SSLESIRPS

SEQ ID NO: 262107 - protein, 9 aa, Homo Sapiens
LNSYTVQAD

SEQ ID NO: 262108 - protein, 9 aa, Homo Sapiens
SNKPERRPR

SEQ ID NO: 262109 - protein, 9 aa, Homo Sapiens
IGLDPYCGL

SEQ ID NO: 262110 - protein, 9 aa, Homo Sapiens
IKEMMKHAR

SEQ ID NO: 262111 - protein, 9 aa, Homo Sapiens
SKSMSMAGC

SEQ ID NO: 262112 - protein, 9 aa, Homo Sapiens
SVEVCILGP

SEQ ID NO: 262113 - protein, 9 aa, Homo Sapiens
LASRGFVVD

SEQ ID NO: 262114 - protein, 9 aa, Homo Sapiens
AVRKSRGKA

SEQ ID NO: 262115 - protein, 9 aa, Homo Sapiens
QLYMQIINL

SEQ ID NO: 262116 - protein, 9 aa, Homo Sapiens
VSLISNKRN

SEQ ID NO: 262117 - protein, 9 aa, Homo Sapiens
KPTLNNFYT

SEQ ID NO: 262118 - protein, 9 aa, Homo Sapiens
ADYQAVNDE

SEQ ID NO: 262119 - protein, 9 aa, Homo Sapiens
LSEGEAKKD

SEQ ID NO: 262120 - protein, 9 aa, Homo Sapiens
LTTRTDQES

SEQ ID NO: 262121 - protein, 9 aa, Homo Sapiens
NEMVPLGDS

SEQ ID NO: 262122 - protein, 9 aa, Homo Sapiens
KIEYISEEL

SEQ ID NO: 262123 - protein, 9 aa, Homo Sapiens
VTGSYDGDI

SEQ ID NO: 262124 - protein, 9 aa, Homo Sapiens
NKRRWQPPD

SEQ ID NO: 262125 - protein, 9 aa, Homo Sapiens
YSSTLTFQA

SEQ ID NO: 262126 - protein, 9 aa, Homo Sapiens
EELDEEVEQ

SEQ ID NO: 262127 - protein, 9 aa, Homo Sapiens
TGGMRESSQ

SEQ ID NO: 262128 - protein, 9 aa, Homo Sapiens
QPRAINHFF

SEQ ID NO: 262129 - protein, 9 aa, Homo Sapiens
IGHLTGLQT

SEQ ID NO: 262130 - protein, 9 aa, Homo Sapiens
KANETILAL

SEQ ID NO: 262131 - protein, 9 aa, Homo Sapiens
RYIYYGNTE

SEQ ID NO: 262132 - protein, 9 aa, Homo Sapiens
KNKGVHSST

SEQ ID NO: 262133 - protein, 9 aa, Homo Sapiens
KDVCSQSCL

SEQ ID NO: 262134 - protein, 9 aa, Homo Sapiens
ADRWFILQM

SEQ ID NO: 262135 - protein, 9 aa, Homo Sapiens
ATKYVELVT

SEQ ID NO: 262136 - protein, 9 aa, Homo Sapiens
RGEESSDME

SEQ ID NO: 262137 - protein, 9 aa, Homo Sapiens
AYQGSDFLR

SEQ ID NO: 262138 - protein, 9 aa, Homo Sapiens
WQWQYDANP

SEQ ID NO: 262139 - protein, 9 aa, Homo Sapiens
LSTPPLPSP

SEQ ID NO: 262140 - protein, 9 aa, Homo Sapiens
VPVFEDIKY

SEQ ID NO: 262141 - protein, 9 aa, Homo Sapiens
METKVQFLN

SEQ ID NO: 262142 - protein, 9 aa, Homo Sapiens
RAEVEVYKL

SEQ ID NO: 262143 - protein, 9 aa, Homo Sapiens
YSELYKLVT

SEQ ID NO: 262144 - protein, 9 aa, Homo Sapiens
GLLECEVYL

SEQ ID NO: 262145 - protein, 9 aa, Homo Sapiens
TMIQLHSKR

SEQ ID NO: 262146 - protein, 9 aa, Homo Sapiens
PWFRKAITL

SEQ ID NO: 262147 - protein, 9 aa, Homo Sapiens
CKESETCVQ

SEQ ID NO: 262148 - protein, 9 aa, Homo Sapiens
CDEAFSFKL

SEQ ID NO: 262149 - protein, 9 aa, Homo Sapiens
PGSQAPIVS

SEQ ID NO: 262150 - protein, 9 aa, Homo Sapiens
ASENKCIHT

SEQ ID NO: 262151 - protein, 9 aa, Homo Sapiens
RPNQTLSAP

SEQ ID NO: 262152 - protein, 9 aa, Homo Sapiens
YEKNKGKAE

SEQ ID NO: 262153 - protein, 9 aa, Homo Sapiens
IWIGYLAKS

SEQ ID NO: 262154 - protein, 9 aa, Homo Sapiens
AYQSTDITQ

SEQ ID NO: 262155 - protein, 9 aa, Homo Sapiens
KEQPTSSQA

SEQ ID NO: 262156 - protein, 9 aa, Homo Sapiens
FIFQTDTRI

SEQ ID NO: 262157 - protein, 9 aa, Homo Sapiens
SVASFSLWR

SEQ ID NO: 262158 - protein, 9 aa, Homo Sapiens
FDPTEVLEA

SEQ ID NO: 262159 - protein, 9 aa, Homo Sapiens
TTFPNNSAL

SEQ ID NO: 262160 - protein, 9 aa, Homo Sapiens
KEYVDGSNL

SEQ ID NO: 262161 - protein, 9 aa, Homo Sapiens
VFKKRQPSP

SEQ ID NO: 262162 - protein, 9 aa, Homo Sapiens
NENQFYLKE

SEQ ID NO: 262163 - protein, 9 aa, Homo Sapiens
LPYDVINTF

SEQ ID NO: 262164 - protein, 9 aa, Homo Sapiens
RRKEQEELA

SEQ ID NO: 262165 - protein, 9 aa, Homo Sapiens
LLFRLYLLS

SEQ ID NO: 262166 - protein, 9 aa, Homo Sapiens
KCELYTCLS

SEQ ID NO: 262167 - protein, 9 aa, Homo Sapiens
SCKLDKTQR

SEQ ID NO: 262168 - protein, 9 aa, Homo Sapiens
FGCAVCLEV

SEQ ID NO: 262169 - protein, 9 aa, Homo Sapiens
TYECRASNY

SEQ ID NO: 262170 - protein, 9 aa, Homo Sapiens
DKKSVPFWS

SEQ ID NO: 262171 - protein, 9 aa, Homo Sapiens
KFVVSDPNK

SEQ ID NO: 262172 - protein, 9 aa, Homo Sapiens
NTHDSGIVM

SEQ ID NO: 262173 - protein, 9 aa, Homo Sapiens
ASPESEDKE

SEQ ID NO: 262174 - protein, 9 aa, Homo Sapiens
LFERYHALE

SEQ ID NO: 262175 - protein, 9 aa, Homo Sapiens
CDCWPYLEI

SEQ ID NO: 262176 - protein, 9 aa, Homo Sapiens
MDLRACKES

SEQ ID NO: 262177 - protein, 9 aa, Homo Sapiens
YLGSATSIM

SEQ ID NO: 262178 - protein, 9 aa, Homo Sapiens
PSPISSFFG

SEQ ID NO: 262179 - protein, 9 aa, Homo Sapiens
DQRILERLE

SEQ ID NO: 262180 - protein, 9 aa, Homo Sapiens
PLHPEFEEA

SEQ ID NO: 262181 - protein, 9 aa, Homo Sapiens
ESTEMESGL

SEQ ID NO: 262182 - protein, 9 aa, Homo Sapiens
KLNNDLVGS

SEQ ID NO: 262183 - protein, 9 aa, Homo Sapiens
GMETLSHER

SEQ ID NO: 262184 - protein, 9 aa, Homo Sapiens
SRLDKSLQK

SEQ ID NO: 262185 - protein, 9 aa, Homo Sapiens
KIFQNHRVQ

SEQ ID NO: 262186 - protein, 9 aa, Homo Sapiens
IHLVGKWNG

SEQ ID NO: 262187 - protein, 9 aa, Homo Sapiens
DMILKFFDM

SEQ ID NO: 262188 - protein, 9 aa, Homo Sapiens
YSLMNKDVK

SEQ ID NO: 262189 - protein, 9 aa, Homo Sapiens
VPDGKKAMS

SEQ ID NO: 262190 - protein, 9 aa, Homo Sapiens
GFVVVLSIL

SEQ ID NO: 262191 - protein, 9 aa, Homo Sapiens
RDGPADVWP

SEQ ID NO: 262192 - protein, 9 aa, Homo Sapiens
FALAWPPQA

SEQ ID NO: 262193 - protein, 9 aa, Homo Sapiens
SHDEPEERP

SEQ ID NO: 262194 - protein, 9 aa, Homo Sapiens
TPEVTLVPP

SEQ ID NO: 262195 - protein, 9 aa, Homo Sapiens
SSLPMLTPW

SEQ ID NO: 262196 - protein, 9 aa, Homo Sapiens
KIEGPVEKE

SEQ ID NO: 262197 - protein, 9 aa, Homo Sapiens
GFQRPSEKN

SEQ ID NO: 262198 - protein, 9 aa, Homo Sapiens
DALSLAYQT

SEQ ID NO: 262199 - protein, 9 aa, Homo Sapiens
NHEELELLQ

SEQ ID NO: 262200 - protein, 9 aa, Homo Sapiens
KDKLELFVE

SEQ ID NO: 262201 - protein, 9 aa, Homo Sapiens
EKIHILHTN

SEQ ID NO: 262202 - protein, 9 aa, Homo Sapiens
PLCLKIASK

SEQ ID NO: 262203 - protein, 9 aa, Homo Sapiens
TAVKYFVII

SEQ ID NO: 262204 - protein, 9 aa, Homo Sapiens
SIRTIEKLA

SEQ ID NO: 262205 - protein, 9 aa, Homo Sapiens
FCSEAIGNL

SEQ ID NO: 262206 - protein, 9 aa, Homo Sapiens
LDVNIGMKG

SEQ ID NO: 262207 - protein, 9 aa, Homo Sapiens
GRAGDRART

SEQ ID NO: 262208 - protein, 9 aa, Homo Sapiens
LCDLITRLL

SEQ ID NO: 262209 - protein, 9 aa, Homo Sapiens
DHGGRQGYP

SEQ ID NO: 262210 - protein, 9 aa, Homo Sapiens
GGLNKKPLL

SEQ ID NO: 262211 - protein, 9 aa, Homo Sapiens
RKVIQNPGP

SEQ ID NO: 262212 - protein, 9 aa, Homo Sapiens
YAVTVMLGG

SEQ ID NO: 262213 - protein, 9 aa, Homo Sapiens
VTDASGRLC

SEQ ID NO: 262214 - protein, 9 aa, Homo Sapiens
DIDLIIYTD

SEQ ID NO: 262215 - protein, 9 aa, Homo Sapiens
VQTAVGSSE

SEQ ID NO: 262216 - protein, 9 aa, Homo Sapiens
IDKNKELRF

SEQ ID NO: 262217 - protein, 9 aa, Homo Sapiens
SHLAQHQNI

SEQ ID NO: 262218 - protein, 9 aa, Homo Sapiens
RYGVSLCWP

SEQ ID NO: 262219 - protein, 9 aa, Homo Sapiens
DDYIYLFKD

SEQ ID NO: 262220 - protein, 9 aa, Homo Sapiens
TQEVVGDYF

SEQ ID NO: 262221 - protein, 9 aa, Homo Sapiens
FLCKLQDTK

SEQ ID NO: 262222 - protein, 9 aa, Homo Sapiens
LPPLLAQEH

SEQ ID NO: 262223 - protein, 9 aa, Homo Sapiens
LEVIKQLRH

SEQ ID NO: 262224 - protein, 9 aa, Homo Sapiens
RRDNTLYYY

SEQ ID NO: 262225 - protein, 9 aa, Homo Sapiens
KRDVCGKEF

SEQ ID NO: 262226 - protein, 9 aa, Homo Sapiens
IEAKKKDQA

SEQ ID NO: 262227 - protein, 9 aa, Homo Sapiens
HKQLESAGI

SEQ ID NO: 262228 - protein, 9 aa, Homo Sapiens
NNYLSKEGD

SEQ ID NO: 262229 - protein, 9 aa, Homo Sapiens
IDPRYTGFL

SEQ ID NO: 262230 - protein, 9 aa, Homo Sapiens
SGGGPSKKD

SEQ ID NO: 262231 - protein, 9 aa, Homo Sapiens
LLDQARRDL

SEQ ID NO: 262232 - protein, 9 aa, Homo Sapiens
EDAAVKATA

SEQ ID NO: 262233 - protein, 9 aa, Homo Sapiens
VAEANQHTF

SEQ ID NO: 262234 - protein, 9 aa, Homo Sapiens
PMFEKDKLE

SEQ ID NO: 262235 - protein, 9 aa, Homo Sapiens
LSWRGLHIL

SEQ ID NO: 262236 - protein, 9 aa, Homo Sapiens
DGFQLDGNK

SEQ ID NO: 262237 - protein, 9 aa, Homo Sapiens
KVMWRFDGN

SEQ ID NO: 262238 - protein, 9 aa, Homo Sapiens
LPGGTLCQG

SEQ ID NO: 262239 - protein, 9 aa, Homo Sapiens
VERDIKSKE

SEQ ID NO: 262240 - protein, 9 aa, Homo Sapiens
FYFAAEHLY

SEQ ID NO: 262241 - protein, 9 aa, Homo Sapiens
LVQKRKKDL

SEQ ID NO: 262242 - protein, 9 aa, Homo Sapiens
STIRTGFML

SEQ ID NO: 262243 - protein, 9 aa, Homo Sapiens
LGYPKTKAF

SEQ ID NO: 262244 - protein, 9 aa, Homo Sapiens
LYSYMRIRG

SEQ ID NO: 262245 - protein, 9 aa, Homo Sapiens
TLILVATSV

SEQ ID NO: 262246 - protein, 9 aa, Homo Sapiens
GLQRYVSPE

SEQ ID NO: 262247 - protein, 9 aa, Homo Sapiens
ELYVPEHKL

SEQ ID NO: 262248 - protein, 9 aa, Homo Sapiens
FDENENVSN

SEQ ID NO: 262249 - protein, 9 aa, Homo Sapiens
LAGDVKVKT

SEQ ID NO: 262250 - protein, 9 aa, Homo Sapiens
NRLSEHIVL

SEQ ID NO: 262251 - protein, 9 aa, Homo Sapiens
LRTAFRVFD

SEQ ID NO: 262252 - protein, 9 aa, Homo Sapiens
PCLSPNCPN

SEQ ID NO: 262253 - protein, 9 aa, Homo Sapiens
GLSSKESMS

SEQ ID NO: 262254 - protein, 9 aa, Homo Sapiens
LGEFKALVA

SEQ ID NO: 262255 - protein, 9 aa, Homo Sapiens
HLKAASNSK

SEQ ID NO: 262256 - protein, 9 aa, Homo Sapiens
YTAIQRWYM

SEQ ID NO: 262257 - protein, 9 aa, Homo Sapiens
IVSSKKITE

SEQ ID NO: 262258 - protein, 9 aa, Homo Sapiens
LEAIAGEYA

SEQ ID NO: 262259 - protein, 9 aa, Homo Sapiens
GYFAILRKE

SEQ ID NO: 262260 - protein, 9 aa, Homo Sapiens
SFQPACSDV

SEQ ID NO: 262261 - protein, 9 aa, Homo Sapiens
GNPLLGSYM

SEQ ID NO: 262262 - protein, 9 aa, Homo Sapiens
DNIINAIVD

SEQ ID NO: 262263 - protein, 9 aa, Homo Sapiens
RQFLFVVFT

SEQ ID NO: 262264 - protein, 9 aa, Homo Sapiens
LPFCGPNHI

SEQ ID NO: 262265 - protein, 9 aa, Homo Sapiens
RRPHLPLTV

SEQ ID NO: 262266 - protein, 9 aa, Homo Sapiens
YKKNPAVTK

SEQ ID NO: 262267 - protein, 9 aa, Homo Sapiens
EAIGFHSVK

SEQ ID NO: 262268 - protein, 9 aa, Homo Sapiens
RKNYCKVSS

SEQ ID NO: 262269 - protein, 9 aa, Homo Sapiens
RVVQDCSFV

SEQ ID NO: 262270 - protein, 9 aa, Homo Sapiens
HLCSTENIY

SEQ ID NO: 262271 - protein, 9 aa, Homo Sapiens
LHEVPCFDI

SEQ ID NO: 262272 - protein, 9 aa, Homo Sapiens
GPSHTQCIA

SEQ ID NO: 262273 - protein, 9 aa, Homo Sapiens
KMSTFDIAS

SEQ ID NO: 262274 - protein, 9 aa, Homo Sapiens
PGELTPPVP

SEQ ID NO: 262275 - protein, 9 aa, Homo Sapiens
AARYPHITF

SEQ ID NO: 262276 - protein, 9 aa, Homo Sapiens
IVTQEEAPF

SEQ ID NO: 262277 - protein, 9 aa, Homo Sapiens
FGDAEWALR

SEQ ID NO: 262278 - protein, 9 aa, Homo Sapiens
ESKVMCTSP

SEQ ID NO: 262279 - protein, 9 aa, Homo Sapiens
HVHMEFPGV

SEQ ID NO: 262280 - protein, 9 aa, Homo Sapiens
NYRHIPDKK

SEQ ID NO: 262281 - protein, 9 aa, Homo Sapiens
KVIENVLSL

SEQ ID NO: 262282 - protein, 9 aa, Homo Sapiens
IVEKGMDYE

SEQ ID NO: 262283 - protein, 9 aa, Homo Sapiens
RQGEKEEYK

SEQ ID NO: 262284 - protein, 9 aa, Homo Sapiens
AQDESLKHR

SEQ ID NO: 262285 - protein, 9 aa, Homo Sapiens
YDGGNYEMF

SEQ ID NO: 262286 - protein, 9 aa, Homo Sapiens
DSFIDDEEE

SEQ ID NO: 262287 - protein, 9 aa, Homo Sapiens
ISCWPLPEY

SEQ ID NO: 262288 - protein, 9 aa, Homo Sapiens
ETEAIESDS

SEQ ID NO: 262289 - protein, 9 aa, Homo Sapiens
FNIWRKVKC

SEQ ID NO: 262290 - protein, 9 aa, Homo Sapiens
VLITVKQYP

SEQ ID NO: 262291 - protein, 9 aa, Homo Sapiens
FSQRKKMLD

SEQ ID NO: 262292 - protein, 9 aa, Homo Sapiens
HHSGVDICI

SEQ ID NO: 262293 - protein, 9 aa, Homo Sapiens
VELSDSEAS

SEQ ID NO: 262294 - protein, 9 aa, Homo Sapiens
LEKQKKVIA

SEQ ID NO: 262295 - protein, 9 aa, Homo Sapiens
ERFDMARAL

SEQ ID NO: 262296 - protein, 9 aa, Homo Sapiens
ATDYDYYSP

SEQ ID NO: 262297 - protein, 9 aa, Homo Sapiens
RNDEELNTL

SEQ ID NO: 262298 - protein, 9 aa, Homo Sapiens
IPPHLQWDV

SEQ ID NO: 262299 - protein, 9 aa, Homo Sapiens
ISLGFFCCK

SEQ ID NO: 262300 - protein, 9 aa, Homo Sapiens
KYDRVVHQR

SEQ ID NO: 262301 - protein, 9 aa, Homo Sapiens
DEGIFEIKT

SEQ ID NO: 262302 - protein, 9 aa, Homo Sapiens
QTCCLKLSV

SEQ ID NO: 262303 - protein, 9 aa, Homo Sapiens
KKIHLVFGF

SEQ ID NO: 262304 - protein, 9 aa, Homo Sapiens
QDKWERAFF

SEQ ID NO: 262305 - protein, 9 aa, Homo Sapiens
RRNIQVLES

SEQ ID NO: 262306 - protein, 9 aa, Homo Sapiens
TSSVCYYSH

SEQ ID NO: 262307 - protein, 9 aa, Homo Sapiens
YECRASNYP

SEQ ID NO: 262308 - protein, 9 aa, Homo Sapiens
LNAPFWTIK

SEQ ID NO: 262309 - protein, 9 aa, Homo Sapiens
TLMLNHLIY

SEQ ID NO: 262310 - protein, 9 aa, Homo Sapiens
DLRSTIHNT

SEQ ID NO: 262311 - protein, 9 aa, Homo Sapiens
LDENYLGSA

SEQ ID NO: 262312 - protein, 9 aa, Homo Sapiens
CHDVIVMAW

SEQ ID NO: 262313 - protein, 9 aa, Homo Sapiens
TKSSLICHH

SEQ ID NO: 262314 - protein, 9 aa, Homo Sapiens
MYDKYIDLE

SEQ ID NO: 262315 - protein, 9 aa, Homo Sapiens
LDVLFAEFE

SEQ ID NO: 262316 - protein, 9 aa, Homo Sapiens
LNHHYHLTC

SEQ ID NO: 262317 - protein, 9 aa, Homo Sapiens
ITEFTIIRV

SEQ ID NO: 262318 - protein, 9 aa, Homo Sapiens
LWIVGILTY

SEQ ID NO: 262319 - protein, 9 aa, Homo Sapiens
MKHEHVIGL

SEQ ID NO: 262320 - protein, 9 aa, Homo Sapiens
LNGCMYSLI

SEQ ID NO: 262321 - protein, 9 aa, Homo Sapiens
GSTFSNSEV

SEQ ID NO: 262322 - protein, 9 aa, Homo Sapiens
WKSAYSSLD

SEQ ID NO: 262323 - protein, 9 aa, Homo Sapiens
IVHKIIHTG

SEQ ID NO: 262324 - protein, 9 aa, Homo Sapiens
ELANQLAKD

SEQ ID NO: 262325 - protein, 9 aa, Homo Sapiens
GLATIASLL

SEQ ID NO: 262326 - protein, 9 aa, Homo Sapiens
LSLYKHFNS

SEQ ID NO: 262327 - protein, 9 aa, Homo Sapiens
LQSHKKLEL

SEQ ID NO: 262328 - protein, 9 aa, Homo Sapiens
LNHVYNEAI

SEQ ID NO: 262329 - protein, 9 aa, Homo Sapiens
AVTASVTFR

SEQ ID NO: 262330 - protein, 9 aa, Homo Sapiens
FMLMYDITN

SEQ ID NO: 262331 - protein, 9 aa, Homo Sapiens
PRLLTEEIN

SEQ ID NO: 262332 - protein, 9 aa, Homo Sapiens
GIHILEAML

SEQ ID NO: 262333 - protein, 9 aa, Homo Sapiens
GSSGSESSK

SEQ ID NO: 262334 - protein, 9 aa, Homo Sapiens
VEGIIEEDE

SEQ ID NO: 262335 - protein, 9 aa, Homo Sapiens
YLPLPMDGH

SEQ ID NO: 262336 - protein, 9 aa, Homo Sapiens
LVFVFEAGP

SEQ ID NO: 262337 - protein, 9 aa, Homo Sapiens
TSVALNANV

SEQ ID NO: 262338 - protein, 9 aa, Homo Sapiens
LCGLPRDKL

SEQ ID NO: 262339 - protein, 9 aa, Homo Sapiens
DCTSQIKEV

SEQ ID NO: 262340 - protein, 9 aa, Homo Sapiens
FRPISASKL

SEQ ID NO: 262341 - protein, 9 aa, Homo Sapiens
SEKVLIAQD

SEQ ID NO: 262342 - protein, 9 aa, Homo Sapiens
YNQDHDKLF

SEQ ID NO: 262343 - protein, 9 aa, Homo Sapiens
DNSQLHSHQ

SEQ ID NO: 262344 - protein, 9 aa, Homo Sapiens
PLGQSEGNG

SEQ ID NO: 262345 - protein, 9 aa, Homo Sapiens
FDDIIPREM

SEQ ID NO: 262346 - protein, 9 aa, Homo Sapiens
NVNSHGCQL

SEQ ID NO: 262347 - protein, 9 aa, Homo Sapiens
SFPMRYMNE

SEQ ID NO: 262348 - protein, 9 aa, Homo Sapiens
AVGCPGPDG

SEQ ID NO: 262349 - protein, 9 aa, Homo Sapiens
PGLQTHCYR

SEQ ID NO: 262350 - protein, 9 aa, Homo Sapiens
HNNLTDKHE

SEQ ID NO: 262351 - protein, 9 aa, Homo Sapiens
FIPPQRWQN

SEQ ID NO: 262352 - protein, 9 aa, Homo Sapiens
TAIDGMSVV

SEQ ID NO: 262353 - protein, 9 aa, Homo Sapiens
VIFRSNYPF

SEQ ID NO: 262354 - protein, 9 aa, Homo Sapiens
NCLLCLQDP

SEQ ID NO: 262355 - protein, 9 aa, Homo Sapiens
VPMLFNKNF

SEQ ID NO: 262356 - protein, 9 aa, Homo Sapiens
LDAMLKEAL

SEQ ID NO: 262357 - protein, 9 aa, Homo Sapiens
NAFICSYQL

SEQ ID NO: 262358 - protein, 9 aa, Homo Sapiens
QPDMCVYQR

SEQ ID NO: 262359 - protein, 9 aa, Homo Sapiens
YLYFFLGTV

SEQ ID NO: 262360 - protein, 9 aa, Homo Sapiens
LCAALRSYA

SEQ ID NO: 262361 - protein, 9 aa, Homo Sapiens
GVNSERVKR

SEQ ID NO: 262362 - protein, 9 aa, Homo Sapiens
SLQVCLTKN

SEQ ID NO: 262363 - protein, 9 aa, Homo Sapiens
KNKTVCFIG

SEQ ID NO: 262364 - protein, 9 aa, Homo Sapiens
KRQTLLDWL

SEQ ID NO: 262365 - protein, 9 aa, Homo Sapiens
DDNPWDCSC

SEQ ID NO: 262366 - protein, 9 aa, Homo Sapiens
EKGKSKVKE

SEQ ID NO: 262367 - protein, 9 aa, Homo Sapiens
SMAMIHSMT

SEQ ID NO: 262368 - protein, 9 aa, Homo Sapiens
INNLMSQLG

SEQ ID NO: 262369 - protein, 9 aa, Homo Sapiens
ERAIYGFVI

SEQ ID NO: 262370 - protein, 9 aa, Homo Sapiens
TLKLHVEML

SEQ ID NO: 262371 - protein, 9 aa, Homo Sapiens
SSFLKCIQE

SEQ ID NO: 262372 - protein, 9 aa, Homo Sapiens
NKFQGSVTL

SEQ ID NO: 262373 - protein, 9 aa, Homo Sapiens
EQFMLEETD

SEQ ID NO: 262374 - protein, 9 aa, Homo Sapiens
SSQRNCGAW

SEQ ID NO: 262375 - protein, 9 aa, Homo Sapiens
VKKELTYHN

SEQ ID NO: 262376 - protein, 9 aa, Homo Sapiens
MNELYHCFL

SEQ ID NO: 262377 - protein, 9 aa, Homo Sapiens
NSLLTDHMN

SEQ ID NO: 262378 - protein, 9 aa, Homo Sapiens
QQNIQGYDA

SEQ ID NO: 262379 - protein, 9 aa, Homo Sapiens
PKSKSVAIS

SEQ ID NO: 262380 - protein, 9 aa, Homo Sapiens
VANEEGFVQ

SEQ ID NO: 262381 - protein, 9 aa, Homo Sapiens
FSFTIFFSF

SEQ ID NO: 262382 - protein, 9 aa, Homo Sapiens
CYYLPPPES

SEQ ID NO: 262383 - protein, 9 aa, Homo Sapiens
AQNLFNIKK

SEQ ID NO: 262384 - protein, 9 aa, Homo Sapiens
YSVTSKTTR

SEQ ID NO: 262385 - protein, 9 aa, Homo Sapiens
LKPGTTPCQ

SEQ ID NO: 262386 - protein, 9 aa, Homo Sapiens
EIQTVPTPV

SEQ ID NO: 262387 - protein, 9 aa, Homo Sapiens
LTKKHLKKN

SEQ ID NO: 262388 - protein, 9 aa, Homo Sapiens
WNQTTHLWN

SEQ ID NO: 262389 - protein, 9 aa, Homo Sapiens
TLEGCISVK

SEQ ID NO: 262390 - protein, 9 aa, Homo Sapiens
YPFVQANQS

SEQ ID NO: 262391 - protein, 9 aa, Homo Sapiens
LFGHIQEIQ

SEQ ID NO: 262392 - protein, 9 aa, Homo Sapiens
GSLSQRQRL

SEQ ID NO: 262393 - protein, 9 aa, Homo Sapiens
PSFYVFSTH

SEQ ID NO: 262394 - protein, 9 aa, Homo Sapiens
GLSSLCEHF

SEQ ID NO: 262395 - protein, 9 aa, Homo Sapiens
LIIHQIVHT

SEQ ID NO: 262396 - protein, 9 aa, Homo Sapiens
YMGPKRFCR

SEQ ID NO: 262397 - protein, 9 aa, Homo Sapiens
RRHIIQWLE

SEQ ID NO: 262398 - protein, 9 aa, Homo Sapiens
LSNKDRGLK

SEQ ID NO: 262399 - protein, 9 aa, Homo Sapiens
RQSSKPKVR

SEQ ID NO: 262400 - protein, 9 aa, Homo Sapiens
KILAKKINV

SEQ ID NO: 262401 - protein, 9 aa, Homo Sapiens
GLGRLVWLG

SEQ ID NO: 262402 - protein, 9 aa, Homo Sapiens
LWKHVRYQM

SEQ ID NO: 262403 - protein, 9 aa, Homo Sapiens
LYDSSRTLH

SEQ ID NO: 262404 - protein, 9 aa, Homo Sapiens
ISYYNINRI

SEQ ID NO: 262405 - protein, 9 aa, Homo Sapiens
NWAQIINDA

SEQ ID NO: 262406 - protein, 9 aa, Homo Sapiens
HKRIYMEVR

SEQ ID NO: 262407 - protein, 9 aa, Homo Sapiens
PAIQNAHNN

SEQ ID NO: 262408 - protein, 9 aa, Homo Sapiens
SVESNGRST

SEQ ID NO: 262409 - protein, 9 aa, Homo Sapiens
KKMKLFPME

SEQ ID NO: 262410 - protein, 9 aa, Homo Sapiens
VRRIPCMHL

SEQ ID NO: 262411 - protein, 9 aa, Homo Sapiens
TETVADHRE

SEQ ID NO: 262412 - protein, 9 aa, Homo Sapiens
NFFVEASMS

SEQ ID NO: 262413 - protein, 9 aa, Homo Sapiens
TEDEKKEIE

SEQ ID NO: 262414 - protein, 9 aa, Homo Sapiens
ELILHYLLC

SEQ ID NO: 262415 - protein, 9 aa, Homo Sapiens
NLGMIIIIN

SEQ ID NO: 262416 - protein, 9 aa, Homo Sapiens
HHCAKCEDV

SEQ ID NO: 262417 - protein, 9 aa, Homo Sapiens
TQTCTKTPC

SEQ ID NO: 262418 - protein, 9 aa, Homo Sapiens
IEDIPGEFT

SEQ ID NO: 262419 - protein, 9 aa, Homo Sapiens
KAKLFIKEV

SEQ ID NO: 262420 - protein, 9 aa, Homo Sapiens
QSFRRICKS

SEQ ID NO: 262421 - protein, 9 aa, Homo Sapiens
CKECAKTLI

SEQ ID NO: 262422 - protein, 9 aa, Homo Sapiens
EQDNCKETA

SEQ ID NO: 262423 - protein, 9 aa, Homo Sapiens
KERLKLVKL

SEQ ID NO: 262424 - protein, 9 aa, Homo Sapiens
FHYNVNSHG

SEQ ID NO: 262425 - protein, 9 aa, Homo Sapiens
NMMASSAPL

SEQ ID NO: 262426 - protein, 9 aa, Homo Sapiens
GGEGGVTWI

SEQ ID NO: 262427 - protein, 9 aa, Homo Sapiens
YADYANYNY

SEQ ID NO: 262428 - protein, 9 aa, Homo Sapiens
KIKELETLL

SEQ ID NO: 262429 - protein, 9 aa, Homo Sapiens
HHAFAKLLA

SEQ ID NO: 262430 - protein, 9 aa, Homo Sapiens
NENRENYPA

SEQ ID NO: 262431 - protein, 9 aa, Homo Sapiens
QKENTAAKE

SEQ ID NO: 262432 - protein, 9 aa, Homo Sapiens
SQQLAAAVG

SEQ ID NO: 262433 - protein, 9 aa, Homo Sapiens
CDQADLSLD

SEQ ID NO: 262434 - protein, 9 aa, Homo Sapiens
KSQFQTAPP

SEQ ID NO: 262435 - protein, 9 aa, Homo Sapiens
EDKEEALPC

SEQ ID NO: 262436 - protein, 9 aa, Homo Sapiens
YSFGRSNIF

SEQ ID NO: 262437 - protein, 9 aa, Homo Sapiens
EANNFTFND

SEQ ID NO: 262438 - protein, 9 aa, Homo Sapiens
KCGDCEKIF

SEQ ID NO: 262439 - protein, 9 aa, Homo Sapiens
HATIFLQVI

SEQ ID NO: 262440 - protein, 9 aa, Homo Sapiens
STSPDCIFF

SEQ ID NO: 262441 - protein, 9 aa, Homo Sapiens
LMDTFLIRE

SEQ ID NO: 262442 - protein, 9 aa, Homo Sapiens
EISGGFGKE

SEQ ID NO: 262443 - protein, 9 aa, Homo Sapiens
DFTTSTGST

SEQ ID NO: 262444 - protein, 9 aa, Homo Sapiens
KVTTNPHLR

SEQ ID NO: 262445 - protein, 9 aa, Homo Sapiens
KDTCHSFFQ

SEQ ID NO: 262446 - protein, 9 aa, Homo Sapiens
FVCDFSPLL

SEQ ID NO: 262447 - protein, 9 aa, Homo Sapiens
KQIKAKIED

SEQ ID NO: 262448 - protein, 9 aa, Homo Sapiens
KLASSEPQM

SEQ ID NO: 262449 - protein, 9 aa, Homo Sapiens
DYNFLSLRW

SEQ ID NO: 262450 - protein, 9 aa, Homo Sapiens
TQAAVRAAN

SEQ ID NO: 262451 - protein, 9 aa, Homo Sapiens
QLLPLEMDG

SEQ ID NO: 262452 - protein, 9 aa, Homo Sapiens
SRLGQLRRI

SEQ ID NO: 262453 - protein, 9 aa, Homo Sapiens
KHRCSTKYW

SEQ ID NO: 262454 - protein, 9 aa, Homo Sapiens
GACYNTSQT

SEQ ID NO: 262455 - protein, 9 aa, Homo Sapiens
RGFHCESSV

SEQ ID NO: 262456 - protein, 9 aa, Homo Sapiens
IPNTSKMIT

SEQ ID NO: 262457 - protein, 9 aa, Homo Sapiens
YLAENEEEA

SEQ ID NO: 262458 - protein, 9 aa, Homo Sapiens
HDSDILCLE

SEQ ID NO: 262459 - protein, 9 aa, Homo Sapiens
PHGDEFLPV

SEQ ID NO: 262460 - protein, 9 aa, Homo Sapiens
IPTSDPVML

SEQ ID NO: 262461 - protein, 9 aa, Homo Sapiens
TPTHPPKEV

SEQ ID NO: 262462 - protein, 9 aa, Homo Sapiens
HSLHKRKIL

SEQ ID NO: 262463 - protein, 9 aa, Homo Sapiens
EDICPEKGS

SEQ ID NO: 262464 - protein, 9 aa, Homo Sapiens
FSPAVFVYT

SEQ ID NO: 262465 - protein, 9 aa, Homo Sapiens
VVLQKEEKI

SEQ ID NO: 262466 - protein, 9 aa, Homo Sapiens
ERLWALLAK

SEQ ID NO: 262467 - protein, 9 aa, Homo Sapiens
VCDKHYYGE

SEQ ID NO: 262468 - protein, 9 aa, Homo Sapiens
GPGNHVQIR

SEQ ID NO: 262469 - protein, 9 aa, Homo Sapiens
NAEAGLAPG

SEQ ID NO: 262470 - protein, 9 aa, Homo Sapiens
DSKETAPGG

SEQ ID NO: 262471 - protein, 9 aa, Homo Sapiens
EDMEHEDFM

SEQ ID NO: 262472 - protein, 9 aa, Homo Sapiens
YLTKHKTRH

SEQ ID NO: 262473 - protein, 9 aa, Homo Sapiens
HRDNNKPIN

SEQ ID NO: 262474 - protein, 9 aa, Homo Sapiens
NNQINRNNT

SEQ ID NO: 262475 - protein, 9 aa, Homo Sapiens
NYHSEMLAI

SEQ ID NO: 262476 - protein, 9 aa, Homo Sapiens
CPPETAVIL

SEQ ID NO: 262477 - protein, 9 aa, Homo Sapiens
CLSTIQSKL

SEQ ID NO: 262478 - protein, 9 aa, Homo Sapiens
RYEIYTGEE

SEQ ID NO: 262479 - protein, 9 aa, Homo Sapiens
SIFWINFDH

SEQ ID NO: 262480 - protein, 9 aa, Homo Sapiens
ELATLLHRK

SEQ ID NO: 262481 - protein, 9 aa, Homo Sapiens
RTPSASIRE

SEQ ID NO: 262482 - protein, 9 aa, Homo Sapiens
QLLASVSGK

SEQ ID NO: 262483 - protein, 9 aa, Homo Sapiens
QSGENGRWR

SEQ ID NO: 262484 - protein, 9 aa, Homo Sapiens
RHLLLFCLC

SEQ ID NO: 262485 - protein, 9 aa, Homo Sapiens
QGKKPAMAP

SEQ ID NO: 262486 - protein, 9 aa, Homo Sapiens
PAPPIEPIT

SEQ ID NO: 262487 - protein, 9 aa, Homo Sapiens
NHPKTQQYV

SEQ ID NO: 262488 - protein, 9 aa, Homo Sapiens
AGKLAMDSF

SEQ ID NO: 262489 - protein, 9 aa, Homo Sapiens
MMAFCSVAQ

SEQ ID NO: 262490 - protein, 9 aa, Homo Sapiens
VYRIDHTFE

SEQ ID NO: 262491 - protein, 9 aa, Homo Sapiens
EFDLLYGRA

SEQ ID NO: 262492 - protein, 9 aa, Homo Sapiens
ENSQSEDSG

SEQ ID NO: 262493 - protein, 9 aa, Homo Sapiens
EEEKGLELA

SEQ ID NO: 262494 - protein, 9 aa, Homo Sapiens
LSHNGKDIF

SEQ ID NO: 262495 - protein, 9 aa, Homo Sapiens
KAITEKDKI

SEQ ID NO: 262496 - protein, 9 aa, Homo Sapiens
WKFPQGQNK

SEQ ID NO: 262497 - protein, 9 aa, Homo Sapiens
GMTCLESVT

SEQ ID NO: 262498 - protein, 9 aa, Homo Sapiens
SKAQADSST

SEQ ID NO: 262499 - protein, 9 aa, Homo Sapiens
CETDNPMGG

SEQ ID NO: 262500 - protein, 9 aa, Homo Sapiens
EFPAELYPH

SEQ ID NO: 262501 - protein, 9 aa, Homo Sapiens
NFSVIADVR

SEQ ID NO: 262502 - protein, 9 aa, Homo Sapiens
ISCELYLGL

SEQ ID NO: 262503 - protein, 9 aa, Homo Sapiens
MQNILDLHN

SEQ ID NO: 262504 - protein, 9 aa, Homo Sapiens
RNDLLTSAL

SEQ ID NO: 262505 - protein, 9 aa, Homo Sapiens
GLGIGASCV

SEQ ID NO: 262506 - protein, 9 aa, Homo Sapiens
FASLQEYVI

SEQ ID NO: 262507 - protein, 9 aa, Homo Sapiens
EASKEREKT

SEQ ID NO: 262508 - protein, 9 aa, Homo Sapiens
DLEKTSITQ

SEQ ID NO: 262509 - protein, 9 aa, Homo Sapiens
VHVVDLFNR

SEQ ID NO: 262510 - protein, 9 aa, Homo Sapiens
ALKATSDNK

SEQ ID NO: 262511 - protein, 9 aa, Homo Sapiens
HLTELSLVR

SEQ ID NO: 262512 - protein, 9 aa, Homo Sapiens
PTEFLPRHN

SEQ ID NO: 262513 - protein, 9 aa, Homo Sapiens
KYTFTHTPS

SEQ ID NO: 262514 - protein, 9 aa, Homo Sapiens
DLQIIGFAA

SEQ ID NO: 262515 - protein, 9 aa, Homo Sapiens
LSNLNHKLE

SEQ ID NO: 262516 - protein, 9 aa, Homo Sapiens
LKSVIRVLW

SEQ ID NO: 262517 - protein, 9 aa, Homo Sapiens
SSSNAPISQ

SEQ ID NO: 262518 - protein, 9 aa, Homo Sapiens
DGIQPSPHK

SEQ ID NO: 262519 - protein, 9 aa, Homo Sapiens
LSMLNQKFS

SEQ ID NO: 262520 - protein, 9 aa, Homo Sapiens
ILVATSVQN

SEQ ID NO: 262521 - protein, 9 aa, Homo Sapiens
EDTPQGRYS

SEQ ID NO: 262522 - protein, 9 aa, Homo Sapiens
IKEVQRWKD

SEQ ID NO: 262523 - protein, 9 aa, Homo Sapiens
SSPDLINFG

SEQ ID NO: 262524 - protein, 9 aa, Homo Sapiens
DNKHLIFRE

SEQ ID NO: 262525 - protein, 9 aa, Homo Sapiens
YFPVFEKVL

SEQ ID NO: 262526 - protein, 9 aa, Homo Sapiens
YVKEIHYRK

SEQ ID NO: 262527 - protein, 9 aa, Homo Sapiens
YLQAARALM

SEQ ID NO: 262528 - protein, 9 aa, Homo Sapiens
LFSLAATYR

SEQ ID NO: 262529 - protein, 9 aa, Homo Sapiens
KAGPGLQTH

SEQ ID NO: 262530 - protein, 9 aa, Homo Sapiens
HGVVFPYFP

SEQ ID NO: 262531 - protein, 9 aa, Homo Sapiens
CETMMEHKN

SEQ ID NO: 262532 - protein, 9 aa, Homo Sapiens
NPTAEEILS

SEQ ID NO: 262533 - protein, 9 aa, Homo Sapiens
LYDTQVIKQ

SEQ ID NO: 262534 - protein, 9 aa, Homo Sapiens
GKKAMSIFS

SEQ ID NO: 262535 - protein, 9 aa, Homo Sapiens
PGSLCLRYA

SEQ ID NO: 262536 - protein, 9 aa, Homo Sapiens
ISSQPKELF

SEQ ID NO: 262537 - protein, 9 aa, Homo Sapiens
GCLNAYRRH

SEQ ID NO: 262538 - protein, 9 aa, Homo Sapiens
GAVPQGQQP

SEQ ID NO: 262539 - protein, 9 aa, Homo Sapiens
KWLTSKKNV

SEQ ID NO: 262540 - protein, 9 aa, Homo Sapiens
CDNHFHARR

SEQ ID NO: 262541 - protein, 9 aa, Homo Sapiens
NQTLNSSGA

SEQ ID NO: 262542 - protein, 9 aa, Homo Sapiens
AIRVDLVMC

SEQ ID NO: 262543 - protein, 9 aa, Homo Sapiens
HKHEDSGCC

SEQ ID NO: 262544 - protein, 9 aa, Homo Sapiens
SKEHFRGLE

SEQ ID NO: 262545 - protein, 9 aa, Homo Sapiens
NSLLSKLIR

SEQ ID NO: 262546 - protein, 9 aa, Homo Sapiens
RYAAAAAAA

SEQ ID NO: 262547 - protein, 9 aa, Homo Sapiens
ASMSLMAPT

SEQ ID NO: 262548 - protein, 9 aa, Homo Sapiens
DNIYNDEDP

SEQ ID NO: 262549 - protein, 9 aa, Homo Sapiens
QTNIEYGAV

SEQ ID NO: 262550 - protein, 9 aa, Homo Sapiens
WQYESELEP

SEQ ID NO: 262551 - protein, 9 aa, Homo Sapiens
REHPAEPSI

SEQ ID NO: 262552 - protein, 9 aa, Homo Sapiens
CIFPEGIVA

SEQ ID NO: 262553 - protein, 9 aa, Homo Sapiens
NYASMQALM

SEQ ID NO: 262554 - protein, 9 aa, Homo Sapiens
ILDLSETYL

SEQ ID NO: 262555 - protein, 9 aa, Homo Sapiens
TIDKKHRNG

SEQ ID NO: 262556 - protein, 9 aa, Homo Sapiens
VPARGGGEL

SEQ ID NO: 262557 - protein, 9 aa, Homo Sapiens
RMTIHFQSD

SEQ ID NO: 262558 - protein, 9 aa, Homo Sapiens
QREDGHSLS

SEQ ID NO: 262559 - protein, 9 aa, Homo Sapiens
PFFPVNYPT

SEQ ID NO: 262560 - protein, 9 aa, Homo Sapiens
YDKGDVILK

SEQ ID NO: 262561 - protein, 9 aa, Homo Sapiens
LKEKYMEFD

SEQ ID NO: 262562 - protein, 9 aa, Homo Sapiens
FGIKQAAEN

SEQ ID NO: 262563 - protein, 9 aa, Homo Sapiens
KGKKNEGLI

SEQ ID NO: 262564 - protein, 9 aa, Homo Sapiens
LLNVMNVLS

SEQ ID NO: 262565 - protein, 9 aa, Homo Sapiens
YTGKVHLTA

SEQ ID NO: 262566 - protein, 9 aa, Homo Sapiens
RTTLNKHHN

SEQ ID NO: 262567 - protein, 9 aa, Homo Sapiens
QPKVRRYFS

SEQ ID NO: 262568 - protein, 9 aa, Homo Sapiens
PVLGPQSEC

SEQ ID NO: 262569 - protein, 9 aa, Homo Sapiens
LMYVLAHSN

SEQ ID NO: 262570 - protein, 9 aa, Homo Sapiens
SVTRIMGHA

SEQ ID NO: 262571 - protein, 9 aa, Homo Sapiens
EESGFDPFQ

SEQ ID NO: 262572 - protein, 9 aa, Homo Sapiens
MFYPPPREG

SEQ ID NO: 262573 - protein, 9 aa, Homo Sapiens
EVKIEGARL

SEQ ID NO: 262574 - protein, 9 aa, Homo Sapiens
GDGLSNRIQ

SEQ ID NO: 262575 - protein, 9 aa, Homo Sapiens
KVRRYFSDE

SEQ ID NO: 262576 - protein, 9 aa, Homo Sapiens
NYHFTHQCN

SEQ ID NO: 262577 - protein, 9 aa, Homo Sapiens
ECSQSGKLA

SEQ ID NO: 262578 - protein, 9 aa, Homo Sapiens
YNISKKHDQ

SEQ ID NO: 262579 - protein, 9 aa, Homo Sapiens
SLTYSFIQC

SEQ ID NO: 262580 - protein, 9 aa, Homo Sapiens
QVWNILRSD

SEQ ID NO: 262581 - protein, 9 aa, Homo Sapiens
QKSNGLNEE

SEQ ID NO: 262582 - protein, 9 aa, Homo Sapiens
CPTCLLPLS

SEQ ID NO: 262583 - protein, 9 aa, Homo Sapiens
IKYLLGEFK

SEQ ID NO: 262584 - protein, 9 aa, Homo Sapiens
ELYRVVERL

SEQ ID NO: 262585 - protein, 9 aa, Homo Sapiens
PSGGDHFCL

SEQ ID NO: 262586 - protein, 9 aa, Homo Sapiens
QDADVTLGN

SEQ ID NO: 262587 - protein, 9 aa, Homo Sapiens
HEAALECLR

SEQ ID NO: 262588 - protein, 9 aa, Homo Sapiens
CADHKLQRY

SEQ ID NO: 262589 - protein, 9 aa, Homo Sapiens
PPKEVVPQL

SEQ ID NO: 262590 - protein, 9 aa, Homo Sapiens
PSLEDLFNL

SEQ ID NO: 262591 - protein, 9 aa, Homo Sapiens
KKCIKLLGE

SEQ ID NO: 262592 - protein, 9 aa, Homo Sapiens
FDSVFQLIE

SEQ ID NO: 262593 - protein, 9 aa, Homo Sapiens
SAGGINTGS

SEQ ID NO: 262594 - protein, 9 aa, Homo Sapiens
SWPHHPGPF

SEQ ID NO: 262595 - protein, 9 aa, Homo Sapiens
SWRLCLLLV

SEQ ID NO: 262596 - protein, 9 aa, Homo Sapiens
RDKLYHLAK

SEQ ID NO: 262597 - protein, 9 aa, Homo Sapiens
AYQQLLEEC

SEQ ID NO: 262598 - protein, 9 aa, Homo Sapiens
REHWFRFST

SEQ ID NO: 262599 - protein, 9 aa, Homo Sapiens
EIKRSHSRS

SEQ ID NO: 262600 - protein, 9 aa, Homo Sapiens
SMNDIYLTP

SEQ ID NO: 262601 - protein, 9 aa, Homo Sapiens
IASSPQESF

SEQ ID NO: 262602 - protein, 9 aa, Homo Sapiens
RAFIQWLRR

SEQ ID NO: 262603 - protein, 9 aa, Homo Sapiens
ADEMYDKYI

SEQ ID NO: 262604 - protein, 9 aa, Homo Sapiens
SHFSLGFVA

SEQ ID NO: 262605 - protein, 9 aa, Homo Sapiens
SPEDDLDTK

SEQ ID NO: 262606 - protein, 9 aa, Homo Sapiens
EPQDADVTL

SEQ ID NO: 262607 - protein, 9 aa, Homo Sapiens
IGGTDKGRI

SEQ ID NO: 262608 - protein, 9 aa, Homo Sapiens
AIQKELTCV

SEQ ID NO: 262609 - protein, 9 aa, Homo Sapiens
QDETEQNQA

SEQ ID NO: 262610 - protein, 9 aa, Homo Sapiens
KAFNRYSHL

SEQ ID NO: 262611 - protein, 9 aa, Homo Sapiens
CIHKRKSIA

SEQ ID NO: 262612 - protein, 9 aa, Homo Sapiens
KQREDGHSL

SEQ ID NO: 262613 - protein, 9 aa, Homo Sapiens
GDVAFVRDV

SEQ ID NO: 262614 - protein, 9 aa, Homo Sapiens
FADIPENIY

SEQ ID NO: 262615 - protein, 9 aa, Homo Sapiens
NTVFKDKVR

SEQ ID NO: 262616 - protein, 9 aa, Homo Sapiens
IRKQVLKIY

SEQ ID NO: 262617 - protein, 9 aa, Homo Sapiens
NVGSFTIKS

SEQ ID NO: 262618 - protein, 9 aa, Homo Sapiens
LWPGSSSSA

SEQ ID NO: 262619 - protein, 9 aa, Homo Sapiens
VVHEEDCQE

SEQ ID NO: 262620 - protein, 9 aa, Homo Sapiens
GQKTYQINL

SEQ ID NO: 262621 - protein, 9 aa, Homo Sapiens
NIVEEDPLH

SEQ ID NO: 262622 - protein, 9 aa, Homo Sapiens
KKEKPKIGD

SEQ ID NO: 262623 - protein, 9 aa, Homo Sapiens
IQESEAFLS

SEQ ID NO: 262624 - protein, 9 aa, Homo Sapiens
ILYAYWIGL

SEQ ID NO: 262625 - protein, 9 aa, Homo Sapiens
FSVCDMSFL

SEQ ID NO: 262626 - protein, 9 aa, Homo Sapiens
EERLWFREA

SEQ ID NO: 262627 - protein, 9 aa, Homo Sapiens
AHGRLAELE

SEQ ID NO: 262628 - protein, 9 aa, Homo Sapiens
TPRYDVPIY

SEQ ID NO: 262629 - protein, 9 aa, Homo Sapiens
KHIWNWRAC

SEQ ID NO: 262630 - protein, 9 aa, Homo Sapiens
VKNQERIIR

SEQ ID NO: 262631 - protein, 9 aa, Homo Sapiens
RVFRIMDDN

SEQ ID NO: 262632 - protein, 9 aa, Homo Sapiens
RISLKHPGK

SEQ ID NO: 262633 - protein, 9 aa, Homo Sapiens
SNDSSSEVK

SEQ ID NO: 262634 - protein, 9 aa, Homo Sapiens
ATPRAKAQM

SEQ ID NO: 262635 - protein, 9 aa, Homo Sapiens
SKHQCVQLN

SEQ ID NO: 262636 - protein, 9 aa, Homo Sapiens
RSGAFRKRH

SEQ ID NO: 262637 - protein, 9 aa, Homo Sapiens
SVGMLVPDI

SEQ ID NO: 262638 - protein, 9 aa, Homo Sapiens
KEIPCNCHF

SEQ ID NO: 262639 - protein, 9 aa, Homo Sapiens
VFGNATEIC

SEQ ID NO: 262640 - protein, 9 aa, Homo Sapiens
AGACPQCQD

SEQ ID NO: 262641 - protein, 9 aa, Homo Sapiens
QKLEVIKQL

SEQ ID NO: 262642 - protein, 9 aa, Homo Sapiens
QVDFSEVEI

SEQ ID NO: 262643 - protein, 9 aa, Homo Sapiens
KKNISEYSE

SEQ ID NO: 262644 - protein, 9 aa, Homo Sapiens
ENSILYHNL

SEQ ID NO: 262645 - protein, 9 aa, Homo Sapiens
YWNLDNYPM

SEQ ID NO: 262646 - protein, 9 aa, Homo Sapiens
VILHLITHT

SEQ ID NO: 262647 - protein, 9 aa, Homo Sapiens
TAENKENDL

SEQ ID NO: 262648 - protein, 9 aa, Homo Sapiens
SPINAFISV

SEQ ID NO: 262649 - protein, 9 aa, Homo Sapiens
SESPSSLDA

SEQ ID NO: 262650 - protein, 9 aa, Homo Sapiens
ALKEEEASK

SEQ ID NO: 262651 - protein, 9 aa, Homo Sapiens
VVVSGDTMK

SEQ ID NO: 262652 - protein, 9 aa, Homo Sapiens
NKKPLLSDA

SEQ ID NO: 262653 - protein, 9 aa, Homo Sapiens
LNANVVSWK

SEQ ID NO: 262654 - protein, 9 aa, Homo Sapiens
NLRLCVQLV

SEQ ID NO: 262655 - protein, 9 aa, Homo Sapiens
HQIHIEKYQ

SEQ ID NO: 262656 - protein, 9 aa, Homo Sapiens
IENPKHLNL

SEQ ID NO: 262657 - protein, 9 aa, Homo Sapiens
LCLRVAICK

SEQ ID NO: 262658 - protein, 9 aa, Homo Sapiens
LGTVKEAVK

SEQ ID NO: 262659 - protein, 9 aa, Homo Sapiens
VDKYEEVLH

SEQ ID NO: 262660 - protein, 9 aa, Homo Sapiens
LLDTCLCKD

SEQ ID NO: 262661 - protein, 9 aa, Homo Sapiens
SGSRSQRDV

SEQ ID NO: 262662 - protein, 9 aa, Homo Sapiens
LKKIVFRLK

SEQ ID NO: 262663 - protein, 9 aa, Homo Sapiens
GSCESENSK

SEQ ID NO: 262664 - protein, 9 aa, Homo Sapiens
AHVKAIKVL

SEQ ID NO: 262665 - protein, 9 aa, Homo Sapiens
AVEVCVVYE

SEQ ID NO: 262666 - protein, 9 aa, Homo Sapiens
ITGNGAIDF

SEQ ID NO: 262667 - protein, 9 aa, Homo Sapiens
AEIYDPSLK

SEQ ID NO: 262668 - protein, 9 aa, Homo Sapiens
DNAKKGRKY

SEQ ID NO: 262669 - protein, 9 aa, Homo Sapiens
TPFVKMLPV

SEQ ID NO: 262670 - protein, 9 aa, Homo Sapiens
LKEQKKRND

SEQ ID NO: 262671 - protein, 9 aa, Homo Sapiens
LASSIMPNM

SEQ ID NO: 262672 - protein, 9 aa, Homo Sapiens
MGGDLNEIE

SEQ ID NO: 262673 - protein, 9 aa, Homo Sapiens
FAFLFSFQN

SEQ ID NO: 262674 - protein, 9 aa, Homo Sapiens
NKKQNLKSE

SEQ ID NO: 262675 - protein, 9 aa, Homo Sapiens
QQDQELDIT

SEQ ID NO: 262676 - protein, 9 aa, Homo Sapiens
RYLQNPIIV

SEQ ID NO: 262677 - protein, 9 aa, Homo Sapiens
LSKPPNPAL

SEQ ID NO: 262678 - protein, 9 aa, Homo Sapiens
KGKSKVKEK

SEQ ID NO: 262679 - protein, 9 aa, Homo Sapiens
PVKRKDLLC

SEQ ID NO: 262680 - protein, 9 aa, Homo Sapiens
LFPLLFIYT

SEQ ID NO: 262681 - protein, 9 aa, Homo Sapiens
TLDEKGGRV

SEQ ID NO: 262682 - protein, 9 aa, Homo Sapiens
KLHVEMLAD

SEQ ID NO: 262683 - protein, 9 aa, Homo Sapiens
RVVHQRTHT

SEQ ID NO: 262684 - protein, 9 aa, Homo Sapiens
TLNPASKVL

SEQ ID NO: 262685 - protein, 9 aa, Homo Sapiens
FAKLYGSNG

SEQ ID NO: 262686 - protein, 9 aa, Homo Sapiens
VPGPGQYMI

SEQ ID NO: 262687 - protein, 9 aa, Homo Sapiens
LSKVLSEVV

SEQ ID NO: 262688 - protein, 9 aa, Homo Sapiens
KEIGAIAHV

SEQ ID NO: 262689 - protein, 9 aa, Homo Sapiens
MKKKRLRSS

SEQ ID NO: 262690 - protein, 9 aa, Homo Sapiens
KQPSGADSG

SEQ ID NO: 262691 - protein, 9 aa, Homo Sapiens
NCIIAKHIG

SEQ ID NO: 262692 - protein, 9 aa, Homo Sapiens
NHNISITHA

SEQ ID NO: 262693 - protein, 9 aa, Homo Sapiens
LEGNGIDSQ

SEQ ID NO: 262694 - protein, 9 aa, Homo Sapiens
GNSWAEIAK

SEQ ID NO: 262695 - protein, 9 aa, Homo Sapiens
TMVISCFGC

SEQ ID NO: 262696 - protein, 9 aa, Homo Sapiens
DYAPQPYKC

SEQ ID NO: 262697 - protein, 9 aa, Homo Sapiens
NYAVTVMLG

SEQ ID NO: 262698 - protein, 9 aa, Homo Sapiens
VKVDGGEVV

SEQ ID NO: 262699 - protein, 9 aa, Homo Sapiens
FSRQPTGPK

SEQ ID NO: 262700 - protein, 9 aa, Homo Sapiens
AHPLETLII

SEQ ID NO: 262701 - protein, 9 aa, Homo Sapiens
SFFVVGTLL

SEQ ID NO: 262702 - protein, 9 aa, Homo Sapiens
CRDLKIIYL

SEQ ID NO: 262703 - protein, 9 aa, Homo Sapiens
DELLNEFSE

SEQ ID NO: 262704 - protein, 9 aa, Homo Sapiens
DQGQNYNQA

SEQ ID NO: 262705 - protein, 9 aa, Homo Sapiens
FVITMIKIM

SEQ ID NO: 262706 - protein, 9 aa, Homo Sapiens
VQFLNNLNL

SEQ ID NO: 262707 - protein, 9 aa, Homo Sapiens
NPVSNTSDS

SEQ ID NO: 262708 - protein, 9 aa, Homo Sapiens
HDPEGMGVI

SEQ ID NO: 262709 - protein, 9 aa, Homo Sapiens
SVKPLYNWL

SEQ ID NO: 262710 - protein, 9 aa, Homo Sapiens
HFLDEGGHF

SEQ ID NO: 262711 - protein, 9 aa, Homo Sapiens
HTGNKPYEC

SEQ ID NO: 262712 - protein, 9 aa, Homo Sapiens
VKKRKTESS

SEQ ID NO: 262713 - protein, 9 aa, Homo Sapiens
TNELVIFVF

SEQ ID NO: 262714 - protein, 9 aa, Homo Sapiens
TESPESIKV

SEQ ID NO: 262715 - protein, 9 aa, Homo Sapiens
PLKYGSQME

SEQ ID NO: 262716 - protein, 9 aa, Homo Sapiens
KITILKEDS

SEQ ID NO: 262717 - protein, 9 aa, Homo Sapiens
FCGQIEINH

SEQ ID NO: 262718 - protein, 9 aa, Homo Sapiens
CYYINRRER

SEQ ID NO: 262719 - protein, 9 aa, Homo Sapiens
TKLNQLPVE

SEQ ID NO: 262720 - protein, 9 aa, Homo Sapiens
LGTYSEPKL

SEQ ID NO: 262721 - protein, 9 aa, Homo Sapiens
ERPQVANTR

SEQ ID NO: 262722 - protein, 9 aa, Homo Sapiens
WSAPEDVDT

SEQ ID NO: 262723 - protein, 9 aa, Homo Sapiens
GDCEKIFNH

SEQ ID NO: 262724 - protein, 9 aa, Homo Sapiens
FQDKGRGMV

SEQ ID NO: 262725 - protein, 9 aa, Homo Sapiens
ALFRDNLNK

SEQ ID NO: 262726 - protein, 9 aa, Homo Sapiens
VSQLNSEAS

SEQ ID NO: 262727 - protein, 9 aa, Homo Sapiens
IENPDVPHD

SEQ ID NO: 262728 - protein, 9 aa, Homo Sapiens
KKLLNRLPK

SEQ ID NO: 262729 - protein, 9 aa, Homo Sapiens
SMHGKIPTL

SEQ ID NO: 262730 - protein, 9 aa, Homo Sapiens
HDNLHLKIS

SEQ ID NO: 262731 - protein, 9 aa, Homo Sapiens
SGLKVNCLD

SEQ ID NO: 262732 - protein, 9 aa, Homo Sapiens
GLLRLTCCF

SEQ ID NO: 262733 - protein, 9 aa, Homo Sapiens
LLCDDTIEI

SEQ ID NO: 262734 - protein, 9 aa, Homo Sapiens
TIPHFFCDF

SEQ ID NO: 262735 - protein, 9 aa, Homo Sapiens
LAFSFLMTK

SEQ ID NO: 262736 - protein, 9 aa, Homo Sapiens
RHQGKPLPM

SEQ ID NO: 262737 - protein, 9 aa, Homo Sapiens
PKGTEPSAD

SEQ ID NO: 262738 - protein, 9 aa, Homo Sapiens
LDQIKVCRD

SEQ ID NO: 262739 - protein, 9 aa, Homo Sapiens
GPASATPPR

SEQ ID NO: 262740 - protein, 9 aa, Homo Sapiens
VQNLSVGLP

SEQ ID NO: 262741 - protein, 9 aa, Homo Sapiens
SSSVSLLEE

SEQ ID NO: 262742 - protein, 9 aa, Homo Sapiens
ESEKVPHNQ

SEQ ID NO: 262743 - protein, 9 aa, Homo Sapiens
DQDAPVTTN

SEQ ID NO: 262744 - protein, 9 aa, Homo Sapiens
TYKDYSAFH

SEQ ID NO: 262745 - protein, 9 aa, Homo Sapiens
GTFSLAVPI

SEQ ID NO: 262746 - protein, 9 aa, Homo Sapiens
GAGKTESTN

SEQ ID NO: 262747 - protein, 9 aa, Homo Sapiens
FPVFVVVTN

SEQ ID NO: 262748 - protein, 9 aa, Homo Sapiens
VEKANEAVK

SEQ ID NO: 262749 - protein, 9 aa, Homo Sapiens
EEDTSRQIV

SEQ ID NO: 262750 - protein, 9 aa, Homo Sapiens
PLKCSLASS

SEQ ID NO: 262751 - protein, 9 aa, Homo Sapiens
ANTPVHLSV

SEQ ID NO: 262752 - protein, 9 aa, Homo Sapiens
SAEEGYFTC

SEQ ID NO: 262753 - protein, 9 aa, Homo Sapiens
HVSVPDQIT

SEQ ID NO: 262754 - protein, 9 aa, Homo Sapiens
EVLKEVIPE

SEQ ID NO: 262755 - protein, 9 aa, Homo Sapiens
TFRKVIQTQ

SEQ ID NO: 262756 - protein, 9 aa, Homo Sapiens
FCHSRRVIH

SEQ ID NO: 262757 - protein, 9 aa, Homo Sapiens
RKAYGRNKS

SEQ ID NO: 262758 - protein, 9 aa, Homo Sapiens
SFPYLQKDG

SEQ ID NO: 262759 - protein, 9 aa, Homo Sapiens
EKNVLQKIL

SEQ ID NO: 262760 - protein, 9 aa, Homo Sapiens
VYKWFILIY

SEQ ID NO: 262761 - protein, 9 aa, Homo Sapiens
KVARNCIEI

SEQ ID NO: 262762 - protein, 9 aa, Homo Sapiens
NSENFILEV

SEQ ID NO: 262763 - protein, 9 aa, Homo Sapiens
PPTDFSGLW

SEQ ID NO: 262764 - protein, 9 aa, Homo Sapiens
PLECSLTET

SEQ ID NO: 262765 - protein, 9 aa, Homo Sapiens
LALIVLGTG

SEQ ID NO: 262766 - protein, 9 aa, Homo Sapiens
FQRKMRKFS

SEQ ID NO: 262767 - protein, 9 aa, Homo Sapiens
RHVLGLSAG

SEQ ID NO: 262768 - protein, 9 aa, Homo Sapiens
YHVARITGA

SEQ ID NO: 262769 - protein, 9 aa, Homo Sapiens
AHLAVEGMV

SEQ ID NO: 262770 - protein, 9 aa, Homo Sapiens
MSYADFVWS

SEQ ID NO: 262771 - protein, 9 aa, Homo Sapiens
SGLGFAIYW

SEQ ID NO: 262772 - protein, 9 aa, Homo Sapiens
RHQTFPSFF

SEQ ID NO: 262773 - protein, 9 aa, Homo Sapiens
LELKTLGAW

SEQ ID NO: 262774 - protein, 9 aa, Homo Sapiens
VRTQRQLGD

SEQ ID NO: 262775 - protein, 9 aa, Homo Sapiens
QVDSRGVPR

SEQ ID NO: 262776 - protein, 9 aa, Homo Sapiens
PNELSLHQA

SEQ ID NO: 262777 - protein, 9 aa, Homo Sapiens
SPPSLLTSP

SEQ ID NO: 262778 - protein, 9 aa, Homo Sapiens
IIADVDDLL

SEQ ID NO: 262779 - protein, 9 aa, Homo Sapiens
RFIHGLIKH

SEQ ID NO: 262780 - protein, 9 aa, Homo Sapiens
DIIDNDHEN

SEQ ID NO: 262781 - protein, 9 aa, Homo Sapiens
LSYAFGKCP

SEQ ID NO: 262782 - protein, 9 aa, Homo Sapiens
QKRNPQAVL

SEQ ID NO: 262783 - protein, 9 aa, Homo Sapiens
PGARWIVHG

SEQ ID NO: 262784 - protein, 9 aa, Homo Sapiens
DGGRESKWK

SEQ ID NO: 262785 - protein, 9 aa, Homo Sapiens
NCLDMYGEK

SEQ ID NO: 262786 - protein, 9 aa, Homo Sapiens
KDIKPLTFD

SEQ ID NO: 262787 - protein, 9 aa, Homo Sapiens
ESENLTELS

SEQ ID NO: 262788 - protein, 9 aa, Homo Sapiens
SNSKARQKG

SEQ ID NO: 262789 - protein, 9 aa, Homo Sapiens
FSEVKAHTA

SEQ ID NO: 262790 - protein, 9 aa, Homo Sapiens
CEHLKKVDT

SEQ ID NO: 262791 - protein, 9 aa, Homo Sapiens
LSESVSDHL

SEQ ID NO: 262792 - protein, 9 aa, Homo Sapiens
LPASAPTVS

SEQ ID NO: 262793 - protein, 9 aa, Homo Sapiens
ESSALEQQN

SEQ ID NO: 262794 - protein, 9 aa, Homo Sapiens
HPEPGILTD

SEQ ID NO: 262795 - protein, 9 aa, Homo Sapiens
IMKKRCGSS

SEQ ID NO: 262796 - protein, 9 aa, Homo Sapiens
TSLKIWSVT

SEQ ID NO: 262797 - protein, 9 aa, Homo Sapiens
DYTHQFNTE

SEQ ID NO: 262798 - protein, 9 aa, Homo Sapiens
FALPLGSPQ

SEQ ID NO: 262799 - protein, 9 aa, Homo Sapiens
GYGQKFCIA

SEQ ID NO: 262800 - protein, 9 aa, Homo Sapiens
LQQFFIKIC

SEQ ID NO: 262801 - protein, 9 aa, Homo Sapiens
MLNQKFSEE

SEQ ID NO: 262802 - protein, 9 aa, Homo Sapiens
VADNIINAI

SEQ ID NO: 262803 - protein, 9 aa, Homo Sapiens
EGAFLAAQV

SEQ ID NO: 262804 - protein, 9 aa, Homo Sapiens
INNTPLYFA

SEQ ID NO: 262805 - protein, 9 aa, Homo Sapiens
HKLNEVSQQ

SEQ ID NO: 262806 - protein, 9 aa, Homo Sapiens
YSYDTIGKT

SEQ ID NO: 262807 - protein, 9 aa, Homo Sapiens
GSISTLDYL

SEQ ID NO: 262808 - protein, 9 aa, Homo Sapiens
IRTIEKLAG

SEQ ID NO: 262809 - protein, 9 aa, Homo Sapiens
TSPSLLDDL

SEQ ID NO: 262810 - protein, 9 aa, Homo Sapiens
QSSCLGDEC

SEQ ID NO: 262811 - protein, 9 aa, Homo Sapiens
KCKEDFPRT

SEQ ID NO: 262812 - protein, 9 aa, Homo Sapiens
LENYSKLVS

SEQ ID NO: 262813 - protein, 9 aa, Homo Sapiens
TVAAMMNIT

SEQ ID NO: 262814 - protein, 9 aa, Homo Sapiens
RVAICKQEI

SEQ ID NO: 262815 - protein, 9 aa, Homo Sapiens
LQILLKLKL

SEQ ID NO: 262816 - protein, 9 aa, Homo Sapiens
DRSPLSTLT

SEQ ID NO: 262817 - protein, 9 aa, Homo Sapiens
IEVSRPGYQ

SEQ ID NO: 262818 - protein, 9 aa, Homo Sapiens
EFVILELGY

SEQ ID NO: 262819 - protein, 9 aa, Homo Sapiens
PALMVSSTS

SEQ ID NO: 262820 - protein, 9 aa, Homo Sapiens
PSEEPSEDP

SEQ ID NO: 262821 - protein, 9 aa, Homo Sapiens
MLQSHSREG

SEQ ID NO: 262822 - protein, 9 aa, Homo Sapiens
GQHQELRDP

SEQ ID NO: 262823 - protein, 9 aa, Homo Sapiens
EKEEVKEEI

SEQ ID NO: 262824 - protein, 9 aa, Homo Sapiens
ITVDVRDEL

SEQ ID NO: 262825 - protein, 9 aa, Homo Sapiens
YFRSVRAIR

SEQ ID NO: 262826 - protein, 9 aa, Homo Sapiens
DLLSRCPRL

SEQ ID NO: 262827 - protein, 9 aa, Homo Sapiens
MQVQLTLFL

SEQ ID NO: 262828 - protein, 9 aa, Homo Sapiens
TSVLLHPNM

SEQ ID NO: 262829 - protein, 9 aa, Homo Sapiens
NSDKGITPE

SEQ ID NO: 262830 - protein, 9 aa, Homo Sapiens
LQCFIHDVG

SEQ ID NO: 262831 - protein, 9 aa, Homo Sapiens
CSAHNKSVS

SEQ ID NO: 262832 - protein, 9 aa, Homo Sapiens
VDELNIKAG

SEQ ID NO: 262833 - protein, 9 aa, Homo Sapiens
KNDHAYRVF

SEQ ID NO: 262834 - protein, 9 aa, Homo Sapiens
NTLQTKLWL

SEQ ID NO: 262835 - protein, 9 aa, Homo Sapiens
VQFIHLALY

SEQ ID NO: 262836 - protein, 9 aa, Homo Sapiens
RLLEQQNKV

SEQ ID NO: 262837 - protein, 9 aa, Homo Sapiens
QSLGMDIDS

SEQ ID NO: 262838 - protein, 9 aa, Homo Sapiens
AEGRKKAYF

SEQ ID NO: 262839 - protein, 9 aa, Homo Sapiens
EKDYLASQL

SEQ ID NO: 262840 - protein, 9 aa, Homo Sapiens
KYDDEDDSG

SEQ ID NO: 262841 - protein, 9 aa, Homo Sapiens
SSYPGNILS

SEQ ID NO: 262842 - protein, 9 aa, Homo Sapiens
NLEEAKIIG

SEQ ID NO: 262843 - protein, 9 aa, Homo Sapiens
ARIYIYWVH

SEQ ID NO: 262844 - protein, 9 aa, Homo Sapiens
CLTLNPEHQ

SEQ ID NO: 262845 - protein, 9 aa, Homo Sapiens
RQKSKLVEE

SEQ ID NO: 262846 - protein, 9 aa, Homo Sapiens
IRHRGQKGL

SEQ ID NO: 262847 - protein, 9 aa, Homo Sapiens
MQERAGRKE

SEQ ID NO: 262848 - protein, 9 aa, Homo Sapiens
GPLQILLGR

SEQ ID NO: 262849 - protein, 9 aa, Homo Sapiens
MHVSPTGLL

SEQ ID NO: 262850 - protein, 9 aa, Homo Sapiens
SKLFQCNVH

SEQ ID NO: 262851 - protein, 9 aa, Homo Sapiens
LFILANALL

SEQ ID NO: 262852 - protein, 9 aa, Homo Sapiens
PEMNYQGRY

SEQ ID NO: 262853 - protein, 9 aa, Homo Sapiens
DVFMGFITP

SEQ ID NO: 262854 - protein, 9 aa, Homo Sapiens
LYAETEGTL

SEQ ID NO: 262855 - protein, 9 aa, Homo Sapiens
AKREENKKG

SEQ ID NO: 262856 - protein, 9 aa, Homo Sapiens
ELGKVAPTK

SEQ ID NO: 262857 - protein, 9 aa, Homo Sapiens
PSKGRPTPC

SEQ ID NO: 262858 - protein, 9 aa, Homo Sapiens
SLGLVACVS

SEQ ID NO: 262859 - protein, 9 aa, Homo Sapiens
SIYEIKPFP

SEQ ID NO: 262860 - protein, 9 aa, Homo Sapiens
VEVATYATC

SEQ ID NO: 262861 - protein, 9 aa, Homo Sapiens
EKEQNTPRR

SEQ ID NO: 262862 - protein, 9 aa, Homo Sapiens
LILVGNQFT

SEQ ID NO: 262863 - protein, 9 aa, Homo Sapiens
DVRDELSGI

SEQ ID NO: 262864 - protein, 9 aa, Homo Sapiens
ILDQLETEK

SEQ ID NO: 262865 - protein, 9 aa, Homo Sapiens
PAMTSHLIV

SEQ ID NO: 262866 - protein, 9 aa, Homo Sapiens
TLSGIIESL

SEQ ID NO: 262867 - protein, 9 aa, Homo Sapiens
AFLSLDHPS

SEQ ID NO: 262868 - protein, 9 aa, Homo Sapiens
RHPGILENA

SEQ ID NO: 262869 - protein, 9 aa, Homo Sapiens
QNGTIKDKI

SEQ ID NO: 262870 - protein, 9 aa, Homo Sapiens
QVSHLAQHQ

SEQ ID NO: 262871 - protein, 9 aa, Homo Sapiens
IEIFDNINF

SEQ ID NO: 262872 - protein, 9 aa, Homo Sapiens
RLPGQPGEG

SEQ ID NO: 262873 - protein, 9 aa, Homo Sapiens
KGIQKDFVD

SEQ ID NO: 262874 - protein, 9 aa, Homo Sapiens
PRRPKHMLV

SEQ ID NO: 262875 - protein, 9 aa, Homo Sapiens
TEDKNFYLN

SEQ ID NO: 262876 - protein, 9 aa, Homo Sapiens
IDKVRLLEQ

SEQ ID NO: 262877 - protein, 9 aa, Homo Sapiens
GFKFNTDEL

SEQ ID NO: 262878 - protein, 9 aa, Homo Sapiens
LESVKQMLK

SEQ ID NO: 262879 - protein, 9 aa, Homo Sapiens
IDLLNGDLD

SEQ ID NO: 262880 - protein, 9 aa, Homo Sapiens
ELKENLDCR

SEQ ID NO: 262881 - protein, 9 aa, Homo Sapiens
ILLSREILW

SEQ ID NO: 262882 - protein, 9 aa, Homo Sapiens
EETQLVKEL

SEQ ID NO: 262883 - protein, 9 aa, Homo Sapiens
SVNSCHSCT

SEQ ID NO: 262884 - protein, 9 aa, Homo Sapiens
LFNNIFYIV

SEQ ID NO: 262885 - protein, 9 aa, Homo Sapiens
LQSEINYLW

SEQ ID NO: 262886 - protein, 9 aa, Homo Sapiens
QKHCASHYS

SEQ ID NO: 262887 - protein, 9 aa, Homo Sapiens
AVKLCPSKT

SEQ ID NO: 262888 - protein, 9 aa, Homo Sapiens
LSDLTLGHV

SEQ ID NO: 262889 - protein, 9 aa, Homo Sapiens
LKCIQESEE

SEQ ID NO: 262890 - protein, 9 aa, Homo Sapiens
IYGTVYSIS

SEQ ID NO: 262891 - protein, 9 aa, Homo Sapiens
FLHEPFASV

SEQ ID NO: 262892 - protein, 9 aa, Homo Sapiens
NLKYRMYEE

SEQ ID NO: 262893 - protein, 9 aa, Homo Sapiens
TTQSTTVSD

SEQ ID NO: 262894 - protein, 9 aa, Homo Sapiens
EDYGAEKEN

SEQ ID NO: 262895 - protein, 9 aa, Homo Sapiens
LRSVPHFAE

SEQ ID NO: 262896 - protein, 9 aa, Homo Sapiens
PINAFISVD

SEQ ID NO: 262897 - protein, 9 aa, Homo Sapiens
RDHHIIHTG

SEQ ID NO: 262898 - protein, 9 aa, Homo Sapiens
PQYLQAARA

SEQ ID NO: 262899 - protein, 9 aa, Homo Sapiens
ESSQMSYLV

SEQ ID NO: 262900 - protein, 9 aa, Homo Sapiens
MSVSGPQHT

SEQ ID NO: 262901 - protein, 9 aa, Homo Sapiens
QLQVIQGDS

SEQ ID NO: 262902 - protein, 9 aa, Homo Sapiens
THKSVPGYL

SEQ ID NO: 262903 - protein, 9 aa, Homo Sapiens
SLTKIKGSV

SEQ ID NO: 262904 - protein, 9 aa, Homo Sapiens
NLSMQTHAT

SEQ ID NO: 262905 - protein, 9 aa, Homo Sapiens
VAHYKGTKH

SEQ ID NO: 262906 - protein, 9 aa, Homo Sapiens
MEKDSLPHF

SEQ ID NO: 262907 - protein, 9 aa, Homo Sapiens
FMGQRRSKG

SEQ ID NO: 262908 - protein, 9 aa, Homo Sapiens
LLHIIPYLS

SEQ ID NO: 262909 - protein, 9 aa, Homo Sapiens
ETHNSVASK

SEQ ID NO: 262910 - protein, 9 aa, Homo Sapiens
SLREELANV

SEQ ID NO: 262911 - protein, 9 aa, Homo Sapiens
ATPYGIKSF

SEQ ID NO: 262912 - protein, 9 aa, Homo Sapiens
LDYPMVSPP

SEQ ID NO: 262913 - protein, 9 aa, Homo Sapiens
RTRWWSPTE

SEQ ID NO: 262914 - protein, 9 aa, Homo Sapiens
VKELVTFKD

SEQ ID NO: 262915 - protein, 9 aa, Homo Sapiens
MEAMKYHVL

SEQ ID NO: 262916 - protein, 9 aa, Homo Sapiens
HTDQLQEYE

SEQ ID NO: 262917 - protein, 9 aa, Homo Sapiens
KVELEVCDL

SEQ ID NO: 262918 - protein, 9 aa, Homo Sapiens
GQFVVRRLF

SEQ ID NO: 262919 - protein, 9 aa, Homo Sapiens
AIVLWCYSN

SEQ ID NO: 262920 - protein, 9 aa, Homo Sapiens
VRNYRHIPD

SEQ ID NO: 262921 - protein, 9 aa, Homo Sapiens
NNLSPDSLS

SEQ ID NO: 262922 - protein, 9 aa, Homo Sapiens
RTPFASAKN

SEQ ID NO: 262923 - protein, 9 aa, Homo Sapiens
VTGAMHLAR

SEQ ID NO: 262924 - protein, 9 aa, Homo Sapiens
PKDLEAQTG

SEQ ID NO: 262925 - protein, 9 aa, Homo Sapiens
YSVWEEIDR

SEQ ID NO: 262926 - protein, 9 aa, Homo Sapiens
KKKIHLVFG

SEQ ID NO: 262927 - protein, 9 aa, Homo Sapiens
LMNMVIYYI

SEQ ID NO: 262928 - protein, 9 aa, Homo Sapiens
VIQHKIIHT

SEQ ID NO: 262929 - protein, 9 aa, Homo Sapiens
AVWQTSLTI

SEQ ID NO: 262930 - protein, 9 aa, Homo Sapiens
QTTQNGRLY

SEQ ID NO: 262931 - protein, 9 aa, Homo Sapiens
GNGYIDKNE

SEQ ID NO: 262932 - protein, 9 aa, Homo Sapiens
KSAYSSLDT

SEQ ID NO: 262933 - protein, 9 aa, Homo Sapiens
FTGIYTSES

SEQ ID NO: 262934 - protein, 9 aa, Homo Sapiens
LREELANVQ

SEQ ID NO: 262935 - protein, 9 aa, Homo Sapiens
QKKAHPVRT

SEQ ID NO: 262936 - protein, 9 aa, Homo Sapiens
PEGGGDNTD

SEQ ID NO: 262937 - protein, 9 aa, Homo Sapiens
DDVFFGPFG

SEQ ID NO: 262938 - protein, 9 aa, Homo Sapiens
LSRRLNTQA

SEQ ID NO: 262939 - protein, 9 aa, Homo Sapiens
DTNYNRPTI

SEQ ID NO: 262940 - protein, 9 aa, Homo Sapiens
TCLLPLSEK

SEQ ID NO: 262941 - protein, 9 aa, Homo Sapiens
KTENKEVIL

SEQ ID NO: 262942 - protein, 9 aa, Homo Sapiens
IDKKYPNLS

SEQ ID NO: 262943 - protein, 9 aa, Homo Sapiens
NGIPEWVYE

SEQ ID NO: 262944 - protein, 9 aa, Homo Sapiens
ISKMYPSRD

SEQ ID NO: 262945 - protein, 9 aa, Homo Sapiens
TTVAGCAVA

SEQ ID NO: 262946 - protein, 9 aa, Homo Sapiens
ESMRKIKSK

SEQ ID NO: 262947 - protein, 9 aa, Homo Sapiens
DQLYSFQDC

SEQ ID NO: 262948 - protein, 9 aa, Homo Sapiens
CVSAHRYSG

SEQ ID NO: 262949 - protein, 9 aa, Homo Sapiens
KTVTKLGNQ

SEQ ID NO: 262950 - protein, 9 aa, Homo Sapiens
HEISLQDLQ

SEQ ID NO: 262951 - protein, 9 aa, Homo Sapiens
TAFVEFEND

SEQ ID NO: 262952 - protein, 9 aa, Homo Sapiens
LIPQSSSNN

SEQ ID NO: 262953 - protein, 9 aa, Homo Sapiens
LQKVKGLGQ

SEQ ID NO: 262954 - protein, 9 aa, Homo Sapiens
YYHKHGSTF

SEQ ID NO: 262955 - protein, 9 aa, Homo Sapiens
FIILGLVQT

SEQ ID NO: 262956 - protein, 9 aa, Homo Sapiens
PGTPVVTSQ

SEQ ID NO: 262957 - protein, 9 aa, Homo Sapiens
VFLQATNKN

SEQ ID NO: 262958 - protein, 9 aa, Homo Sapiens
VMLLVNGAQ

SEQ ID NO: 262959 - protein, 9 aa, Homo Sapiens
DTISQAAFP

SEQ ID NO: 262960 - protein, 9 aa, Homo Sapiens
NYPAGRAQP

SEQ ID NO: 262961 - protein, 9 aa, Homo Sapiens
SFQIHEKTH

SEQ ID NO: 262962 - protein, 9 aa, Homo Sapiens
HTGFSGLRL

SEQ ID NO: 262963 - protein, 9 aa, Homo Sapiens
HITSEELSA

SEQ ID NO: 262964 - protein, 9 aa, Homo Sapiens
SSKEVKAAL

SEQ ID NO: 262965 - protein, 9 aa, Homo Sapiens
YKAPAVVLH

SEQ ID NO: 262966 - protein, 9 aa, Homo Sapiens
GDSKPELTI

SEQ ID NO: 262967 - protein, 9 aa, Homo Sapiens
YTISTLTSC

SEQ ID NO: 262968 - protein, 9 aa, Homo Sapiens
WLGEIINAG

SEQ ID NO: 262969 - protein, 9 aa, Homo Sapiens
FVFEVPSKD

SEQ ID NO: 262970 - protein, 9 aa, Homo Sapiens
IDNVAALPG

SEQ ID NO: 262971 - protein, 9 aa, Homo Sapiens
FGHIQEIQH

SEQ ID NO: 262972 - protein, 9 aa, Homo Sapiens
AYFSESRAD

SEQ ID NO: 262973 - protein, 9 aa, Homo Sapiens
IHATWRGYR

SEQ ID NO: 262974 - protein, 9 aa, Homo Sapiens
RPYVPYEQG

SEQ ID NO: 262975 - protein, 9 aa, Homo Sapiens
KTCSLSYIV

SEQ ID NO: 262976 - protein, 9 aa, Homo Sapiens
NDQGCLHPG

SEQ ID NO: 262977 - protein, 9 aa, Homo Sapiens
HNDPDHLNK

SEQ ID NO: 262978 - protein, 9 aa, Homo Sapiens
FITLSFTYI

SEQ ID NO: 262979 - protein, 9 aa, Homo Sapiens
TSAQVMKPP

SEQ ID NO: 262980 - protein, 9 aa, Homo Sapiens
DPLPRICNW

SEQ ID NO: 262981 - protein, 9 aa, Homo Sapiens
FIVGIYVLS

SEQ ID NO: 262982 - protein, 9 aa, Homo Sapiens
NRLALLITY

SEQ ID NO: 262983 - protein, 9 aa, Homo Sapiens
NVSGGKTRD

SEQ ID NO: 262984 - protein, 9 aa, Homo Sapiens
LPLKCSLAS

SEQ ID NO: 262985 - protein, 9 aa, Homo Sapiens
LASQEVIQK

SEQ ID NO: 262986 - protein, 9 aa, Homo Sapiens
TKNYPSTRV

SEQ ID NO: 262987 - protein, 9 aa, Homo Sapiens
TGGVTEWYK

SEQ ID NO: 262988 - protein, 9 aa, Homo Sapiens
HAAVLLLCG

SEQ ID NO: 262989 - protein, 9 aa, Homo Sapiens
KQGYTCKDC

SEQ ID NO: 262990 - protein, 9 aa, Homo Sapiens
IENQTFNER

SEQ ID NO: 262991 - protein, 9 aa, Homo Sapiens
RPIVIDGSS

SEQ ID NO: 262992 - protein, 9 aa, Homo Sapiens
VMLFEKMEE

SEQ ID NO: 262993 - protein, 9 aa, Homo Sapiens
KVVLNLFNC

SEQ ID NO: 262994 - protein, 9 aa, Homo Sapiens
KWSSTSPHI

SEQ ID NO: 262995 - protein, 9 aa, Homo Sapiens
PKPQMSLEF

SEQ ID NO: 262996 - protein, 9 aa, Homo Sapiens
NELEYFYLN

SEQ ID NO: 262997 - protein, 9 aa, Homo Sapiens
NVTQALSRF

SEQ ID NO: 262998 - protein, 9 aa, Homo Sapiens
VKEMFDAEY

SEQ ID NO: 262999 - protein, 9 aa, Homo Sapiens
ASECEAPGT

SEQ ID NO: 263000 - protein, 9 aa, Homo Sapiens
DVLAGRPLF

SEQ ID NO: 263001 - protein, 9 aa, Homo Sapiens
LRTRKKRER

SEQ ID NO: 263002 - protein, 9 aa, Homo Sapiens
GYPPRRDDH

SEQ ID NO: 263003 - protein, 9 aa, Homo Sapiens
SPGPTQSPL

SEQ ID NO: 263004 - protein, 9 aa, Homo Sapiens
YLIRKEWKR

SEQ ID NO: 263005 - protein, 9 aa, Homo Sapiens
GLLSCDLQE

SEQ ID NO: 263006 - protein, 9 aa, Homo Sapiens
VTVITRYRL

SEQ ID NO: 263007 - protein, 9 aa, Homo Sapiens
DDKQYMKSL

SEQ ID NO: 263008 - protein, 9 aa, Homo Sapiens
LMAIFKRHS

SEQ ID NO: 263009 - protein, 9 aa, Homo Sapiens
WDERAKITD

SEQ ID NO: 263010 - protein, 9 aa, Homo Sapiens
QKPTPDLEK

SEQ ID NO: 263011 - protein, 9 aa, Homo Sapiens
ISGKQELIQ

SEQ ID NO: 263012 - protein, 9 aa, Homo Sapiens
QPKRQKHLK

SEQ ID NO: 263013 - protein, 9 aa, Homo Sapiens
YNEALQSND

SEQ ID NO: 263014 - protein, 9 aa, Homo Sapiens
YQVFPMNPP

SEQ ID NO: 263015 - protein, 9 aa, Homo Sapiens
TCKDCGANC

SEQ ID NO: 263016 - protein, 9 aa, Homo Sapiens
KRVKETEAI

SEQ ID NO: 263017 - protein, 9 aa, Homo Sapiens
QSPLWIDWQ

SEQ ID NO: 263018 - protein, 9 aa, Homo Sapiens
NVNSRLLKR

SEQ ID NO: 263019 - protein, 9 aa, Homo Sapiens
ENIIRKFSA

SEQ ID NO: 263020 - protein, 9 aa, Homo Sapiens
DKGEIGLPG

SEQ ID NO: 263021 - protein, 9 aa, Homo Sapiens
VIVEAEDIY

SEQ ID NO: 263022 - protein, 9 aa, Homo Sapiens
HIFQDLQSS

SEQ ID NO: 263023 - protein, 9 aa, Homo Sapiens
TYIKFFVPS

SEQ ID NO: 263024 - protein, 9 aa, Homo Sapiens
TQFIGVYFV

SEQ ID NO: 263025 - protein, 9 aa, Homo Sapiens
HHQQIHTGE

SEQ ID NO: 263026 - protein, 9 aa, Homo Sapiens
KLLYRLVGS

SEQ ID NO: 263027 - protein, 9 aa, Homo Sapiens
GLDHCPSFI

SEQ ID NO: 263028 - protein, 9 aa, Homo Sapiens
NTKLSVKKN

SEQ ID NO: 263029 - protein, 9 aa, Homo Sapiens
QAKLRLYLE

SEQ ID NO: 263030 - protein, 9 aa, Homo Sapiens
GAIAHVHAE

SEQ ID NO: 263031 - protein, 9 aa, Homo Sapiens
DWSFLYSVL

SEQ ID NO: 263032 - protein, 9 aa, Homo Sapiens
PSVLQGLLH

SEQ ID NO: 263033 - protein, 9 aa, Homo Sapiens
HLRIISLNT

SEQ ID NO: 263034 - protein, 9 aa, Homo Sapiens
IEKLAGKIE

SEQ ID NO: 263035 - protein, 9 aa, Homo Sapiens
EINYLWREE

SEQ ID NO: 263036 - protein, 9 aa, Homo Sapiens
SESNIFERA

SEQ ID NO: 263037 - protein, 9 aa, Homo Sapiens
MVPHPLIPV

SEQ ID NO: 263038 - protein, 9 aa, Homo Sapiens
CDKLSGHPK

SEQ ID NO: 263039 - protein, 9 aa, Homo Sapiens
SQKDTCHSF

SEQ ID NO: 263040 - protein, 9 aa, Homo Sapiens
ISSSTKNYP

SEQ ID NO: 263041 - protein, 9 aa, Homo Sapiens
NPLQTTSQA

SEQ ID NO: 263042 - protein, 9 aa, Homo Sapiens
VQQLSNQEL

SEQ ID NO: 263043 - protein, 9 aa, Homo Sapiens
FDLSAEPPS

SEQ ID NO: 263044 - protein, 9 aa, Homo Sapiens
AGQATPDIP

SEQ ID NO: 263045 - protein, 9 aa, Homo Sapiens
FHLFCKDEG

SEQ ID NO: 263046 - protein, 9 aa, Homo Sapiens
SSLQENKIK

SEQ ID NO: 263047 - protein, 9 aa, Homo Sapiens
LYAKNERLL

SEQ ID NO: 263048 - protein, 9 aa, Homo Sapiens
TFDLSAEPP

SEQ ID NO: 263049 - protein, 9 aa, Homo Sapiens
PPTQAPTQS

SEQ ID NO: 263050 - protein, 9 aa, Homo Sapiens
WESGNWSHC

SEQ ID NO: 263051 - protein, 9 aa, Homo Sapiens
SEDDTVLNL

SEQ ID NO: 263052 - protein, 9 aa, Homo Sapiens
NIRCLEKQR

SEQ ID NO: 263053 - protein, 9 aa, Homo Sapiens
NSETKNLCF

SEQ ID NO: 263054 - protein, 9 aa, Homo Sapiens
QWDVPEDWE

SEQ ID NO: 263055 - protein, 9 aa, Homo Sapiens
ELRPAGNRL

SEQ ID NO: 263056 - protein, 9 aa, Homo Sapiens
YKGSTLNIH

SEQ ID NO: 263057 - protein, 9 aa, Homo Sapiens
EVVPQLPVY

SEQ ID NO: 263058 - protein, 9 aa, Homo Sapiens
NYDGGNYEM

SEQ ID NO: 263059 - protein, 9 aa, Homo Sapiens
TDIFLLTVM

SEQ ID NO: 263060 - protein, 9 aa, Homo Sapiens
FIYVKPKQT

SEQ ID NO: 263061 - protein, 9 aa, Homo Sapiens
PQDFEHSDV

SEQ ID NO: 263062 - protein, 9 aa, Homo Sapiens
LQDSLYAEL

SEQ ID NO: 263063 - protein, 9 aa, Homo Sapiens
AKCDSEEDT

SEQ ID NO: 263064 - protein, 9 aa, Homo Sapiens
ELCQGINSC

SEQ ID NO: 263065 - protein, 9 aa, Homo Sapiens
TTVIERTFR

SEQ ID NO: 263066 - protein, 9 aa, Homo Sapiens
SVEQTQIKG

SEQ ID NO: 263067 - protein, 9 aa, Homo Sapiens
LKGEEEPPV

SEQ ID NO: 263068 - protein, 9 aa, Homo Sapiens
GDRLRILPC

SEQ ID NO: 263069 - protein, 9 aa, Homo Sapiens
KRRRATAER

SEQ ID NO: 263070 - protein, 9 aa, Homo Sapiens
KQTERVISG

SEQ ID NO: 263071 - protein, 9 aa, Homo Sapiens
PNDQGCLHP

SEQ ID NO: 263072 - protein, 9 aa, Homo Sapiens
TVSSEGIFK

SEQ ID NO: 263073 - protein, 9 aa, Homo Sapiens
SDIYLQNGP

SEQ ID NO: 263074 - protein, 9 aa, Homo Sapiens
AVSLTTSQL

SEQ ID NO: 263075 - protein, 9 aa, Homo Sapiens
TNPCGSIYF

SEQ ID NO: 263076 - protein, 9 aa, Homo Sapiens
LQQDGLDKV

SEQ ID NO: 263077 - protein, 9 aa, Homo Sapiens
DKEPNSTDV

SEQ ID NO: 263078 - protein, 9 aa, Homo Sapiens
VQLQCGYAC

SEQ ID NO: 263079 - protein, 9 aa, Homo Sapiens
DNSELADEQ

SEQ ID NO: 263080 - protein, 9 aa, Homo Sapiens
DNDSLFYNR

SEQ ID NO: 263081 - protein, 9 aa, Homo Sapiens
LQAANIILP

SEQ ID NO: 263082 - protein, 9 aa, Homo Sapiens
IMLRIPNVQ

SEQ ID NO: 263083 - protein, 9 aa, Homo Sapiens
DGLCIALLV

SEQ ID NO: 263084 - protein, 9 aa, Homo Sapiens
RQVPAINRL

SEQ ID NO: 263085 - protein, 9 aa, Homo Sapiens
VSEGVSALK

SEQ ID NO: 263086 - protein, 9 aa, Homo Sapiens
QFHLFCKDE

SEQ ID NO: 263087 - protein, 9 aa, Homo Sapiens
EVGKRWQEA

SEQ ID NO: 263088 - protein, 9 aa, Homo Sapiens
VLASFSEYL

SEQ ID NO: 263089 - protein, 9 aa, Homo Sapiens
TFRLESESR

SEQ ID NO: 263090 - protein, 9 aa, Homo Sapiens
ALRADYDIA

SEQ ID NO: 263091 - protein, 9 aa, Homo Sapiens
NKLVVATEK

SEQ ID NO: 263092 - protein, 9 aa, Homo Sapiens
SKRVLGKIL

SEQ ID NO: 263093 - protein, 9 aa, Homo Sapiens
ARHYTKAIG

SEQ ID NO: 263094 - protein, 9 aa, Homo Sapiens
LPDCNMSEE

SEQ ID NO: 263095 - protein, 9 aa, Homo Sapiens
FYVFSTHPV

SEQ ID NO: 263096 - protein, 9 aa, Homo Sapiens
TWIILNKKA

SEQ ID NO: 263097 - protein, 9 aa, Homo Sapiens
LGERLTPQE

SEQ ID NO: 263098 - protein, 9 aa, Homo Sapiens
QWFECTLDD

SEQ ID NO: 263099 - protein, 9 aa, Homo Sapiens
HLITHTKEK

SEQ ID NO: 263100 - protein, 9 aa, Homo Sapiens
TGQPFNTIK

SEQ ID NO: 263101 - protein, 9 aa, Homo Sapiens
KDQRILERL

SEQ ID NO: 263102 - protein, 9 aa, Homo Sapiens
KQQEQQEIL

SEQ ID NO: 263103 - protein, 9 aa, Homo Sapiens
CILLYPDLI

SEQ ID NO: 263104 - protein, 9 aa, Homo Sapiens
DKLRNLSVS

SEQ ID NO: 263105 - protein, 9 aa, Homo Sapiens
PTKHQRSHT

SEQ ID NO: 263106 - protein, 9 aa, Homo Sapiens
SPQMLTKEN

SEQ ID NO: 263107 - protein, 9 aa, Homo Sapiens
PSPFNVVLL

SEQ ID NO: 263108 - protein, 9 aa, Homo Sapiens
MVVVSWRLC

SEQ ID NO: 263109 - protein, 9 aa, Homo Sapiens
DEGGHFKKS

SEQ ID NO: 263110 - protein, 9 aa, Homo Sapiens
YDLSSDYLI

SEQ ID NO: 263111 - protein, 9 aa, Homo Sapiens
TAGHNMQNS

SEQ ID NO: 263112 - protein, 9 aa, Homo Sapiens
QVGHEFSWR

SEQ ID NO: 263113 - protein, 9 aa, Homo Sapiens
SKKGRPQIQ

SEQ ID NO: 263114 - protein, 9 aa, Homo Sapiens
LPHSAVSHA

SEQ ID NO: 263115 - protein, 9 aa, Homo Sapiens
RDVVNCSTL

SEQ ID NO: 263116 - protein, 9 aa, Homo Sapiens
NAPVNTQLA

SEQ ID NO: 263117 - protein, 9 aa, Homo Sapiens
IIISGTKMA

SEQ ID NO: 263118 - protein, 9 aa, Homo Sapiens
AITLTDDFS

SEQ ID NO: 263119 - protein, 9 aa, Homo Sapiens
KTFLQPKHK

SEQ ID NO: 263120 - protein, 9 aa, Homo Sapiens
KYLGRYRLL

SEQ ID NO: 263121 - protein, 9 aa, Homo Sapiens
LFQNPDNKQ

SEQ ID NO: 263122 - protein, 9 aa, Homo Sapiens
PKLEKRRRA

SEQ ID NO: 263123 - protein, 9 aa, Homo Sapiens
RLGELTVTY

SEQ ID NO: 263124 - protein, 9 aa, Homo Sapiens
AFLYKDCVF

SEQ ID NO: 263125 - protein, 9 aa, Homo Sapiens
VGKKQKTDV

SEQ ID NO: 263126 - protein, 9 aa, Homo Sapiens
SVGKVKLTE

SEQ ID NO: 263127 - protein, 9 aa, Homo Sapiens
KHRQAKLRL

SEQ ID NO: 263128 - protein, 9 aa, Homo Sapiens
QLELTPHLC

SEQ ID NO: 263129 - protein, 9 aa, Homo Sapiens
YQDTTYIHH

SEQ ID NO: 263130 - protein, 9 aa, Homo Sapiens
SKSNIKQNS

SEQ ID NO: 263131 - protein, 9 aa, Homo Sapiens
DTTTQKHNT

SEQ ID NO: 263132 - protein, 9 aa, Homo Sapiens
DRRNYPMAQ

SEQ ID NO: 263133 - protein, 9 aa, Homo Sapiens
PNHIQHVFC

SEQ ID NO: 263134 - protein, 9 aa, Homo Sapiens
RAVTVLKEC

SEQ ID NO: 263135 - protein, 9 aa, Homo Sapiens
FYGEENAVL

SEQ ID NO: 263136 - protein, 9 aa, Homo Sapiens
KHKEVIESV

SEQ ID NO: 263137 - protein, 9 aa, Homo Sapiens
SLKVAAVIE

SEQ ID NO: 263138 - protein, 9 aa, Homo Sapiens
NSNAIMSIQ

SEQ ID NO: 263139 - protein, 9 aa, Homo Sapiens
DTWILDKDF

SEQ ID NO: 263140 - protein, 9 aa, Homo Sapiens
VPVMDELGY

SEQ ID NO: 263141 - protein, 9 aa, Homo Sapiens
LEEEWLALY

SEQ ID NO: 263142 - protein, 9 aa, Homo Sapiens
GDGKISFQE

SEQ ID NO: 263143 - protein, 9 aa, Homo Sapiens
VVVALDLHG

SEQ ID NO: 263144 - protein, 9 aa, Homo Sapiens
ENAEKALYG

SEQ ID NO: 263145 - protein, 9 aa, Homo Sapiens
AAVLDQHAT

SEQ ID NO: 263146 - protein, 9 aa, Homo Sapiens
KFKVLAKDG

SEQ ID NO: 263147 - protein, 9 aa, Homo Sapiens
YMSCGTIVV

SEQ ID NO: 263148 - protein, 9 aa, Homo Sapiens
PGITTLECE

SEQ ID NO: 263149 - protein, 9 aa, Homo Sapiens
PEAQRLNIN

SEQ ID NO: 263150 - protein, 9 aa, Homo Sapiens
SNKLETICY

SEQ ID NO: 263151 - protein, 9 aa, Homo Sapiens
TYATPDSVG

SEQ ID NO: 263152 - protein, 9 aa, Homo Sapiens
LLISNKEFE

SEQ ID NO: 263153 - protein, 9 aa, Homo Sapiens
SVQYPPDNL

SEQ ID NO: 263154 - protein, 9 aa, Homo Sapiens
RSTVVYRYA

SEQ ID NO: 263155 - protein, 9 aa, Homo Sapiens
NIIKILFAR

SEQ ID NO: 263156 - protein, 9 aa, Homo Sapiens
ECVCMSGGL

SEQ ID NO: 263157 - protein, 9 aa, Homo Sapiens
LKRHPQPEL

SEQ ID NO: 263158 - protein, 9 aa, Homo Sapiens
SALTQHQII

SEQ ID NO: 263159 - protein, 9 aa, Homo Sapiens
EANLELLNN

SEQ ID NO: 263160 - protein, 9 aa, Homo Sapiens
GRFVIEDIP

SEQ ID NO: 263161 - protein, 9 aa, Homo Sapiens
HKAAESELL

SEQ ID NO: 263162 - protein, 9 aa, Homo Sapiens
SHKASFLSR

SEQ ID NO: 263163 - protein, 9 aa, Homo Sapiens
FLHFFGGTD

SEQ ID NO: 263164 - protein, 9 aa, Homo Sapiens
STGIADFFN

SEQ ID NO: 263165 - protein, 9 aa, Homo Sapiens
RMFQKEQRE

SEQ ID NO: 263166 - protein, 9 aa, Homo Sapiens
SIMRDTMPK

SEQ ID NO: 263167 - protein, 9 aa, Homo Sapiens
KDFVDINIQ

SEQ ID NO: 263168 - protein, 9 aa, Homo Sapiens
TYAKLQQVP

SEQ ID NO: 263169 - protein, 9 aa, Homo Sapiens
LRITKCIGN

SEQ ID NO: 263170 - protein, 9 aa, Homo Sapiens
YQYIGKLHS

SEQ ID NO: 263171 - protein, 9 aa, Homo Sapiens
GFRHQTTKL

SEQ ID NO: 263172 - protein, 9 aa, Homo Sapiens
HTQPSEKIW

SEQ ID NO: 263173 - protein, 9 aa, Homo Sapiens
YRYARIYIY

SEQ ID NO: 263174 - protein, 9 aa, Homo Sapiens
DPSPFNVVL

SEQ ID NO: 263175 - protein, 9 aa, Homo Sapiens
VWALIASWG

SEQ ID NO: 263176 - protein, 9 aa, Homo Sapiens
SPNQQSTVL

SEQ ID NO: 263177 - protein, 9 aa, Homo Sapiens
GAALPNLTP

SEQ ID NO: 263178 - protein, 9 aa, Homo Sapiens
VQVVDNSEL

SEQ ID NO: 263179 - protein, 9 aa, Homo Sapiens
PTEEFEVLK

SEQ ID NO: 263180 - protein, 9 aa, Homo Sapiens
KAVTRPELL

SEQ ID NO: 263181 - protein, 9 aa, Homo Sapiens
FNISNKLFQ

SEQ ID NO: 263182 - protein, 8 aa, Homo Sapiens
DYSHQTSL

SEQ ID NO: 263183 - protein, 9 aa, Homo Sapiens
NLHWKNSNS

SEQ ID NO: 263184 - protein, 9 aa, Homo Sapiens
FPNNSALKQ

SEQ ID NO: 263185 - protein, 9 aa, Homo Sapiens
QRLTSTPNV

SEQ ID NO: 263186 - protein, 9 aa, Homo Sapiens
QTVSALFRD

SEQ ID NO: 263187 - protein, 9 aa, Homo Sapiens
QSSLLNLSL

SEQ ID NO: 263188 - protein, 9 aa, Homo Sapiens
LPAPLYHIN

SEQ ID NO: 263189 - protein, 9 aa, Homo Sapiens
VSENFRVII

SEQ ID NO: 263190 - protein, 9 aa, Homo Sapiens
IADPLFRSA

SEQ ID NO: 263191 - protein, 9 aa, Homo Sapiens
LHSGDDVSE

SEQ ID NO: 263192 - protein, 9 aa, Homo Sapiens
VGCPGPDGY

SEQ ID NO: 263193 - protein, 9 aa, Homo Sapiens
VMMKFNDIL

SEQ ID NO: 263194 - protein, 9 aa, Homo Sapiens
PLQILLGRT

SEQ ID NO: 263195 - protein, 9 aa, Homo Sapiens
IFEEHVTGE

SEQ ID NO: 263196 - protein, 9 aa, Homo Sapiens
PSVEVCILG

SEQ ID NO: 263197 - protein, 9 aa, Homo Sapiens
LPGELTPPV

SEQ ID NO: 263198 - protein, 9 aa, Homo Sapiens
QCLKNNSKE

SEQ ID NO: 263199 - protein, 9 aa, Homo Sapiens
RLKQDTYGN

SEQ ID NO: 263200 - protein, 9 aa, Homo Sapiens
RKQFAGVLL

SEQ ID NO: 263201 - protein, 9 aa, Homo Sapiens
SNGVLLFME

SEQ ID NO: 263202 - protein, 9 aa, Homo Sapiens
DKLSGHPKG

SEQ ID NO: 263203 - protein, 9 aa, Homo Sapiens
YRWLSDLAK

SEQ ID NO: 263204 - protein, 9 aa, Homo Sapiens
ELNPVKDVL

SEQ ID NO: 263205 - protein, 9 aa, Homo Sapiens
NLVHLTELS

SEQ ID NO: 263206 - protein, 9 aa, Homo Sapiens
TLHGNILNG

SEQ ID NO: 263207 - protein, 9 aa, Homo Sapiens
NLKYMALNI

SEQ ID NO: 263208 - protein, 9 aa, Homo Sapiens
AWATYYLLQ

SEQ ID NO: 263209 - protein, 9 aa, Homo Sapiens
NPLLGSYMF

SEQ ID NO: 263210 - protein, 9 aa, Homo Sapiens
GMPGLNEII

SEQ ID NO: 263211 - protein, 9 aa, Homo Sapiens
VNSVLCHGI

SEQ ID NO: 263212 - protein, 9 aa, Homo Sapiens
VIIYPDRIE

SEQ ID NO: 263213 - protein, 9 aa, Homo Sapiens
PPLATVLIP

SEQ ID NO: 263214 - protein, 9 aa, Homo Sapiens
PFLDHTGLT

SEQ ID NO: 263215 - protein, 9 aa, Homo Sapiens
EHMQQLDRE

SEQ ID NO: 263216 - protein, 9 aa, Homo Sapiens
LFSLSQYYC

SEQ ID NO: 263217 - protein, 9 aa, Homo Sapiens
KTSKNFEEV

SEQ ID NO: 263218 - protein, 9 aa, Homo Sapiens
HLSLMLEQR

SEQ ID NO: 263219 - protein, 9 aa, Homo Sapiens
IMEAMKYHV

SEQ ID NO: 263220 - protein, 9 aa, Homo Sapiens
QCLPPEHTI

SEQ ID NO: 263221 - protein, 9 aa, Homo Sapiens
GVLLSLRLL

SEQ ID NO: 263222 - protein, 9 aa, Homo Sapiens
GIPPEHSLE

SEQ ID NO: 263223 - protein, 9 aa, Homo Sapiens
IRKELNEYQ

SEQ ID NO: 263224 - protein, 9 aa, Homo Sapiens
TFSERLLGT

SEQ ID NO: 263225 - protein, 9 aa, Homo Sapiens
TSQASKQPP

SEQ ID NO: 263226 - protein, 9 aa, Homo Sapiens
MLADFDGVV

SEQ ID NO: 263227 - protein, 9 aa, Homo Sapiens
IRFLCPAIM

SEQ ID NO: 263228 - protein, 9 aa, Homo Sapiens
AKFDEEVHD

SEQ ID NO: 263229 - protein, 9 aa, Homo Sapiens
GGQSYTCPY

SEQ ID NO: 263230 - protein, 9 aa, Homo Sapiens
SSSNHSQSS

SEQ ID NO: 263231 - protein, 9 aa, Homo Sapiens
WIVYFTHIL

SEQ ID NO: 263232 - protein, 9 aa, Homo Sapiens
KKVLVWNRI

SEQ ID NO: 263233 - protein, 9 aa, Homo Sapiens
FHQWFLNNY

SEQ ID NO: 263234 - protein, 9 aa, Homo Sapiens
QETSNFCSL

SEQ ID NO: 263235 - protein, 9 aa, Homo Sapiens
GSPGKTEDK

SEQ ID NO: 263236 - protein, 9 aa, Homo Sapiens
TRPELLLDT

SEQ ID NO: 263237 - protein, 9 aa, Homo Sapiens
SGALSRLPQ

SEQ ID NO: 263238 - protein, 9 aa, Homo Sapiens
GAISRRIIV

SEQ ID NO: 263239 - protein, 9 aa, Homo Sapiens
RLINTFSLI

SEQ ID NO: 263240 - protein, 9 aa, Homo Sapiens
EYEDGDRLR

SEQ ID NO: 263241 - protein, 9 aa, Homo Sapiens
FCEARDVFA

SEQ ID NO: 263242 - protein, 9 aa, Homo Sapiens
QEGRVPVSR

SEQ ID NO: 263243 - protein, 9 aa, Homo Sapiens
PGRKFYMDK

SEQ ID NO: 263244 - protein, 9 aa, Homo Sapiens
LFHKSGVIS

SEQ ID NO: 263245 - protein, 9 aa, Homo Sapiens
MKQEMDKRL

SEQ ID NO: 263246 - protein, 9 aa, Homo Sapiens
FLKSDDGGK

SEQ ID NO: 263247 - protein, 9 aa, Homo Sapiens
GVLYVVKPL

SEQ ID NO: 263248 - protein, 9 aa, Homo Sapiens
DRTKDDGFS

SEQ ID NO: 263249 - protein, 9 aa, Homo Sapiens
NRRYREFLK

SEQ ID NO: 263250 - protein, 9 aa, Homo Sapiens
LLVNRDSIF

SEQ ID NO: 263251 - protein, 9 aa, Homo Sapiens
AKTGSLNAY

SEQ ID NO: 263252 - protein, 9 aa, Homo Sapiens
RVKETEAIE

SEQ ID NO: 263253 - protein, 9 aa, Homo Sapiens
ANMQELVER

SEQ ID NO: 263254 - protein, 9 aa, Homo Sapiens
LLGEFKALV

SEQ ID NO: 263255 - protein, 9 aa, Homo Sapiens
PKFIIYLLA

SEQ ID NO: 263256 - protein, 9 aa, Homo Sapiens
VTDYRTAIS

SEQ ID NO: 263257 - protein, 9 aa, Homo Sapiens
ASKQYLCVA

SEQ ID NO: 263258 - protein, 9 aa, Homo Sapiens
SGSYFSQRA

SEQ ID NO: 263259 - protein, 9 aa, Homo Sapiens
FDIYANGIL

SEQ ID NO: 263260 - protein, 9 aa, Homo Sapiens
IHNPLRYSY

SEQ ID NO: 263261 - protein, 9 aa, Homo Sapiens
IIGEYTSPL

SEQ ID NO: 263262 - protein, 9 aa, Homo Sapiens
KTLLEYLEY

SEQ ID NO: 263263 - protein, 9 aa, Homo Sapiens
TIQSKLFQC

SEQ ID NO: 263264 - protein, 9 aa, Homo Sapiens
VAEFIILGL

SEQ ID NO: 263265 - protein, 9 aa, Homo Sapiens
AKLFIKEVD

SEQ ID NO: 263266 - protein, 9 aa, Homo Sapiens
RIFFVPAKE

SEQ ID NO: 263267 - protein, 9 aa, Homo Sapiens
QLAAEPVPA

SEQ ID NO: 263268 - protein, 9 aa, Homo Sapiens
LLQVDFLRL

SEQ ID NO: 263269 - protein, 9 aa, Homo Sapiens
KIYSSMMDK

SEQ ID NO: 263270 - protein, 9 aa, Homo Sapiens
EIKEHSLLL

SEQ ID NO: 263271 - protein, 9 aa, Homo Sapiens
ESVKKNNDN

SEQ ID NO: 263272 - protein, 9 aa, Homo Sapiens
PESILLEMK

SEQ ID NO: 263273 - protein, 9 aa, Homo Sapiens
EALQAFKFR

SEQ ID NO: 263274 - protein, 9 aa, Homo Sapiens
VRLTTRSCI

SEQ ID NO: 263275 - protein, 9 aa, Homo Sapiens
DFTEYRLMI

SEQ ID NO: 263276 - protein, 9 aa, Homo Sapiens
LTNVALQKH

SEQ ID NO: 263277 - protein, 9 aa, Homo Sapiens
NQAFWESSI

SEQ ID NO: 263278 - protein, 9 aa, Homo Sapiens
AELKNAVSK

SEQ ID NO: 263279 - protein, 9 aa, Homo Sapiens
AFRKPYIFT

SEQ ID NO: 263280 - protein, 9 aa, Homo Sapiens
SNETIDSLE

SEQ ID NO: 263281 - protein, 9 aa, Homo Sapiens
RVTSSVCYY

SEQ ID NO: 263282 - protein, 9 aa, Homo Sapiens
ISDFETDVA

SEQ ID NO: 263283 - protein, 9 aa, Homo Sapiens
QSRLYAGGL

SEQ ID NO: 263284 - protein, 9 aa, Homo Sapiens
HEKNSHHIR

SEQ ID NO: 263285 - protein, 9 aa, Homo Sapiens
FLEEVARTA

SEQ ID NO: 263286 - protein, 9 aa, Homo Sapiens
DFTRKLWAC

SEQ ID NO: 263287 - protein, 9 aa, Homo Sapiens
NAIIPLPTL

SEQ ID NO: 263288 - protein, 9 aa, Homo Sapiens
AETLYSTGS

SEQ ID NO: 263289 - protein, 9 aa, Homo Sapiens
TKLSVKKNI

SEQ ID NO: 263290 - protein, 9 aa, Homo Sapiens
YLPFVPGRV

SEQ ID NO: 263291 - protein, 9 aa, Homo Sapiens
FDRVNVWSM

SEQ ID NO: 263292 - protein, 9 aa, Homo Sapiens
TPVTKLQHF

SEQ ID NO: 263293 - protein, 9 aa, Homo Sapiens
HVPVCLVTV

SEQ ID NO: 263294 - protein, 9 aa, Homo Sapiens
FIITLLRAT

SEQ ID NO: 263295 - protein, 9 aa, Homo Sapiens
CLVKCMDYG

SEQ ID NO: 263296 - protein, 9 aa, Homo Sapiens
NSEASLLEN

SEQ ID NO: 263297 - protein, 9 aa, Homo Sapiens
EYESVMETK

SEQ ID NO: 263298 - protein, 9 aa, Homo Sapiens
LEEILGKIR

SEQ ID NO: 263299 - protein, 9 aa, Homo Sapiens
SDYPVKTPI

SEQ ID NO: 263300 - protein, 9 aa, Homo Sapiens
PQMCRCLRE

SEQ ID NO: 263301 - protein, 9 aa, Homo Sapiens
NSGLIRHWG

SEQ ID NO: 263302 - protein, 9 aa, Homo Sapiens
DLYHRIQTL

SEQ ID NO: 263303 - protein, 9 aa, Homo Sapiens
KRWKRSSKE

SEQ ID NO: 263304 - protein, 9 aa, Homo Sapiens
ANRPYVPYE

SEQ ID NO: 263305 - protein, 9 aa, Homo Sapiens
GGGTMVVQH

SEQ ID NO: 263306 - protein, 9 aa, Homo Sapiens
IHHVVSVAG

SEQ ID NO: 263307 - protein, 9 aa, Homo Sapiens
CSTFTQASP

SEQ ID NO: 263308 - protein, 9 aa, Homo Sapiens
NKNSLLGME

SEQ ID NO: 263309 - protein, 9 aa, Homo Sapiens
SEAIGNLDV

SEQ ID NO: 263310 - protein, 9 aa, Homo Sapiens
DWMPTSALK

SEQ ID NO: 263311 - protein, 9 aa, Homo Sapiens
GTVKEAVKV

SEQ ID NO: 263312 - protein, 9 aa, Homo Sapiens
TEWNQQLLR

SEQ ID NO: 263313 - protein, 9 aa, Homo Sapiens
PESHFLKCP

SEQ ID NO: 263314 - protein, 9 aa, Homo Sapiens
MDLLQGAGN

SEQ ID NO: 263315 - protein, 9 aa, Homo Sapiens
LPQFYQASI

SEQ ID NO: 263316 - protein, 9 aa, Homo Sapiens
ATVFASAMM

SEQ ID NO: 263317 - protein, 9 aa, Homo Sapiens
KELQSNLEV

SEQ ID NO: 263318 - protein, 9 aa, Homo Sapiens
ELQYVQRPL

SEQ ID NO: 263319 - protein, 9 aa, Homo Sapiens
RPRQQNPQR

SEQ ID NO: 263320 - protein, 9 aa, Homo Sapiens
ESNIKIVGS

SEQ ID NO: 263321 - protein, 9 aa, Homo Sapiens
SCIFPEGIV

SEQ ID NO: 263322 - protein, 9 aa, Homo Sapiens
TRPKDLADL

SEQ ID NO: 263323 - protein, 9 aa, Homo Sapiens
ESTAPAPEF

SEQ ID NO: 263324 - protein, 9 aa, Homo Sapiens
SGVMLINLT

SEQ ID NO: 263325 - protein, 9 aa, Homo Sapiens
SYSSPSRGA

SEQ ID NO: 263326 - protein, 9 aa, Homo Sapiens
SFSKQATEI

SEQ ID NO: 263327 - protein, 9 aa, Homo Sapiens
GIVSWDSDT

SEQ ID NO: 263328 - protein, 9 aa, Homo Sapiens
KECSITLSN

SEQ ID NO: 263329 - protein, 9 aa, Homo Sapiens
ESFTSFVPN

SEQ ID NO: 263330 - protein, 9 aa, Homo Sapiens
VCQVCGFWS

SEQ ID NO: 263331 - protein, 9 aa, Homo Sapiens
QAKVLTWGE

SEQ ID NO: 263332 - protein, 9 aa, Homo Sapiens
CYSVFFNKL

SEQ ID NO: 263333 - protein, 9 aa, Homo Sapiens
AASGKLYQL

SEQ ID NO: 263334 - protein, 9 aa, Homo Sapiens
SLHKRKILP

SEQ ID NO: 263335 - protein, 9 aa, Homo Sapiens
ALPPFQPQL

SEQ ID NO: 263336 - protein, 9 aa, Homo Sapiens
SCESHRKSR

SEQ ID NO: 263337 - protein, 9 aa, Homo Sapiens
CEQNIEEAN

SEQ ID NO: 263338 - protein, 9 aa, Homo Sapiens
NSHHIRKNA

SEQ ID NO: 263339 - protein, 9 aa, Homo Sapiens
DVAYSGIWD

SEQ ID NO: 263340 - protein, 9 aa, Homo Sapiens
RQSDPHKRN

SEQ ID NO: 263341 - protein, 9 aa, Homo Sapiens
MTLSYLQNI

SEQ ID NO: 263342 - protein, 9 aa, Homo Sapiens
KNGSDNSHL

SEQ ID NO: 263343 - protein, 9 aa, Homo Sapiens
QENRQWRCD

SEQ ID NO: 263344 - protein, 9 aa, Homo Sapiens
LASSSNAPI

SEQ ID NO: 263345 - protein, 9 aa, Homo Sapiens
AQSPLYSQP

SEQ ID NO: 263346 - protein, 9 aa, Homo Sapiens
VIVMAWLKQ

SEQ ID NO: 263347 - protein, 9 aa, Homo Sapiens
VKPEKISNK

SEQ ID NO: 263348 - protein, 9 aa, Homo Sapiens
NSLVTLQDQ

SEQ ID NO: 263349 - protein, 9 aa, Homo Sapiens
VHLYDKWIK

SEQ ID NO: 263350 - protein, 9 aa, Homo Sapiens
CIEAHEKYM

SEQ ID NO: 263351 - protein, 9 aa, Homo Sapiens
GTETRPVNG

SEQ ID NO: 263352 - protein, 9 aa, Homo Sapiens
SKYWKKERN

SEQ ID NO: 263353 - protein, 9 aa, Homo Sapiens
HRCHPVERD

SEQ ID NO: 263354 - protein, 9 aa, Homo Sapiens
EVMHTTDIL

SEQ ID NO: 263355 - protein, 9 aa, Homo Sapiens
GQKGLRGPP

SEQ ID NO: 263356 - protein, 9 aa, Homo Sapiens
LNGEFYESC

SEQ ID NO: 263357 - protein, 9 aa, Homo Sapiens
LRQQLDLNN

SEQ ID NO: 263358 - protein, 9 aa, Homo Sapiens
NYLIRGREA

SEQ ID NO: 263359 - protein, 9 aa, Homo Sapiens
YFVKYCVEE

SEQ ID NO: 263360 - protein, 9 aa, Homo Sapiens
TSVQEEGPR

SEQ ID NO: 263361 - protein, 9 aa, Homo Sapiens
LTIPLPQAQ

SEQ ID NO: 263362 - protein, 9 aa, Homo Sapiens
CRIHYNTMI

SEQ ID NO: 263363 - protein, 9 aa, Homo Sapiens
LERERNKIR

SEQ ID NO: 263364 - protein, 9 aa, Homo Sapiens
PLVSKKERE

SEQ ID NO: 263365 - protein, 9 aa, Homo Sapiens
ADADEGIFE

SEQ ID NO: 263366 - protein, 9 aa, Homo Sapiens
DGKLYFADY

SEQ ID NO: 263367 - protein, 9 aa, Homo Sapiens
TAEEQEMMD

SEQ ID NO: 263368 - protein, 9 aa, Homo Sapiens
VALFKQIFG

SEQ ID NO: 263369 - protein, 9 aa, Homo Sapiens
ILIEYLPKT

SEQ ID NO: 263370 - protein, 9 aa, Homo Sapiens
LPWPCDSRY

SEQ ID NO: 263371 - protein, 9 aa, Homo Sapiens
AKSKTLDLI

SEQ ID NO: 263372 - protein, 9 aa, Homo Sapiens
EKEKANVSV

SEQ ID NO: 263373 - protein, 9 aa, Homo Sapiens
AQAARQKNI

SEQ ID NO: 263374 - protein, 9 aa, Homo Sapiens
LNNGRWHCQ

SEQ ID NO: 263375 - protein, 9 aa, Homo Sapiens
KAAMPYTVS

SEQ ID NO: 263376 - protein, 9 aa, Homo Sapiens
DYRKIRFVG

SEQ ID NO: 263377 - protein, 9 aa, Homo Sapiens
VVRHHQFRW

SEQ ID NO: 263378 - protein, 9 aa, Homo Sapiens
TPVSSDDGR

SEQ ID NO: 263379 - protein, 9 aa, Homo Sapiens
GNLYKFQAG

SEQ ID NO: 263380 - protein, 9 aa, Homo Sapiens
GFSAACVAG

SEQ ID NO: 263381 - protein, 9 aa, Homo Sapiens
EVDALALHY

SEQ ID NO: 263382 - protein, 9 aa, Homo Sapiens
GSRNSQFQM

SEQ ID NO: 263383 - protein, 9 aa, Homo Sapiens
AAVGLAQSL

SEQ ID NO: 263384 - protein, 9 aa, Homo Sapiens
AICKPLHYY

SEQ ID NO: 263385 - protein, 9 aa, Homo Sapiens
MVQAIKTDL

SEQ ID NO: 263386 - protein, 9 aa, Homo Sapiens
SLYGFSTAI

SEQ ID NO: 263387 - protein, 9 aa, Homo Sapiens
STCYSSTLT

SEQ ID NO: 263388 - protein, 9 aa, Homo Sapiens
SCDDIRSLC

SEQ ID NO: 263389 - protein, 9 aa, Homo Sapiens
GEEFALVED

SEQ ID NO: 263390 - protein, 9 aa, Homo Sapiens
GLFSPPTQA

SEQ ID NO: 263391 - protein, 9 aa, Homo Sapiens
NYNLLSSLP

SEQ ID NO: 263392 - protein, 9 aa, Homo Sapiens
LAAAVGLAQ

SEQ ID NO: 263393 - protein, 9 aa, Homo Sapiens
PLIVKRIRK

SEQ ID NO: 263394 - protein, 9 aa, Homo Sapiens
QRMPQYCLF

SEQ ID NO: 263395 - protein, 9 aa, Homo Sapiens
AMKGNRVNK

SEQ ID NO: 263396 - protein, 9 aa, Homo Sapiens
GQTSASFLW

SEQ ID NO: 263397 - protein, 9 aa, Homo Sapiens
RTIGVQHFE

SEQ ID NO: 263398 - protein, 9 aa, Homo Sapiens
LSADRYRSI

SEQ ID NO: 263399 - protein, 9 aa, Homo Sapiens
GVSVPRPHK

SEQ ID NO: 263400 - protein, 9 aa, Homo Sapiens
HAPCPREEA

SEQ ID NO: 263401 - protein, 9 aa, Homo Sapiens
TTASLMEKV

SEQ ID NO: 263402 - protein, 9 aa, Homo Sapiens
SDRYKNLSL

SEQ ID NO: 263403 - protein, 9 aa, Homo Sapiens
MEHDDQSLV

SEQ ID NO: 263404 - protein, 9 aa, Homo Sapiens
TDQDAPVTT

SEQ ID NO: 263405 - protein, 9 aa, Homo Sapiens
NYAQKQLSE

SEQ ID NO: 263406 - protein, 9 aa, Homo Sapiens
GSKVLVHLQ

SEQ ID NO: 263407 - protein, 9 aa, Homo Sapiens
LDVNNLENF

SEQ ID NO: 263408 - protein, 9 aa, Homo Sapiens
TQEGIINIQ

SEQ ID NO: 263409 - protein, 9 aa, Homo Sapiens
ASTATEEKL

SEQ ID NO: 263410 - protein, 9 aa, Homo Sapiens
GFDLCFILD

SEQ ID NO: 263411 - protein, 9 aa, Homo Sapiens
QLEGSTITG

SEQ ID NO: 263412 - protein, 9 aa, Homo Sapiens
KSKHHTTST

SEQ ID NO: 263413 - protein, 9 aa, Homo Sapiens
SVKNNYRRV

SEQ ID NO: 263414 - protein, 9 aa, Homo Sapiens
LNHLPQFST

SEQ ID NO: 263415 - protein, 9 aa, Homo Sapiens
ILTPKSLTR

SEQ ID NO: 263416 - protein, 9 aa, Homo Sapiens
DQMLTYYPS

SEQ ID NO: 263417 - protein, 9 aa, Homo Sapiens
SLCDYINDM

SEQ ID NO: 263418 - protein, 9 aa, Homo Sapiens
PDFEGERGK

SEQ ID NO: 263419 - protein, 9 aa, Homo Sapiens
LPESSCIGA

SEQ ID NO: 263420 - protein, 9 aa, Homo Sapiens
FQYWRNSLP

SEQ ID NO: 263421 - protein, 9 aa, Homo Sapiens
RGPGRSRKG

SEQ ID NO: 263422 - protein, 9 aa, Homo Sapiens
MREWEEAEC

SEQ ID NO: 263423 - protein, 9 aa, Homo Sapiens
LGMLWLFAL

SEQ ID NO: 263424 - protein, 9 aa, Homo Sapiens
KSLSREIND

SEQ ID NO: 263425 - protein, 9 aa, Homo Sapiens
LGLIRAKRE

SEQ ID NO: 263426 - protein, 9 aa, Homo Sapiens
STLLPQPPF

SEQ ID NO: 263427 - protein, 9 aa, Homo Sapiens
HSVHPASLN

SEQ ID NO: 263428 - protein, 9 aa, Homo Sapiens
CLGFRDETC

SEQ ID NO: 263429 - protein, 9 aa, Homo Sapiens
DDGDDFVWG

SEQ ID NO: 263430 - protein, 9 aa, Homo Sapiens
FGAGPASMS

SEQ ID NO: 263431 - protein, 9 aa, Homo Sapiens
MLVEKDKDN

SEQ ID NO: 263432 - protein, 9 aa, Homo Sapiens
EHHHWISQM

SEQ ID NO: 263433 - protein, 9 aa, Homo Sapiens
EVDLIQSQV

SEQ ID NO: 263434 - protein, 9 aa, Homo Sapiens
SCEVNVDDC

SEQ ID NO: 263435 - protein, 9 aa, Homo Sapiens
IEELQKLLN

SEQ ID NO: 263436 - protein, 9 aa, Homo Sapiens
DMLVYFNFF

SEQ ID NO: 263437 - protein, 9 aa, Homo Sapiens
MALFGLTEF

SEQ ID NO: 263438 - protein, 9 aa, Homo Sapiens
GAVDMNELY

SEQ ID NO: 263439 - protein, 9 aa, Homo Sapiens
IEGPVEKET

SEQ ID NO: 263440 - protein, 9 aa, Homo Sapiens
AVDEGHVSC

SEQ ID NO: 263441 - protein, 9 aa, Homo Sapiens
HVRMATAIC

SEQ ID NO: 263442 - protein, 9 aa, Homo Sapiens
SPFLPVRWV

SEQ ID NO: 263443 - protein, 9 aa, Homo Sapiens
PPTQKPKKS

SEQ ID NO: 263444 - protein, 9 aa, Homo Sapiens
LTQDKIIHT

SEQ ID NO: 263445 - protein, 9 aa, Homo Sapiens
QTKWKHYKK

SEQ ID NO: 263446 - protein, 9 aa, Homo Sapiens
EYLTVFKKT

SEQ ID NO: 263447 - protein, 9 aa, Homo Sapiens
RLQIPWLRG

SEQ ID NO: 263448 - protein, 9 aa, Homo Sapiens
QPRPNSQYN

SEQ ID NO: 263449 - protein, 9 aa, Homo Sapiens
RIADGYHVP

SEQ ID NO: 263450 - protein, 9 aa, Homo Sapiens
VLHCQIIEP

SEQ ID NO: 263451 - protein, 9 aa, Homo Sapiens
EIIQASKKL

SEQ ID NO: 263452 - protein, 9 aa, Homo Sapiens
ENNELIKEI

SEQ ID NO: 263453 - protein, 9 aa, Homo Sapiens
LEHKNRMSQ

SEQ ID NO: 263454 - protein, 9 aa, Homo Sapiens
GFSSFGNHQ

SEQ ID NO: 263455 - protein, 9 aa, Homo Sapiens
PHHALQDKK

SEQ ID NO: 263456 - protein, 9 aa, Homo Sapiens
IAQDKMATN

SEQ ID NO: 263457 - protein, 9 aa, Homo Sapiens
KNTEVQKRE

SEQ ID NO: 263458 - protein, 9 aa, Homo Sapiens
GRHGFFGRH

SEQ ID NO: 263459 - protein, 9 aa, Homo Sapiens
VHLQKVKGL

SEQ ID NO: 263460 - protein, 9 aa, Homo Sapiens
KTQFIGVYF

SEQ ID NO: 263461 - protein, 9 aa, Homo Sapiens
MSCASFLAR

SEQ ID NO: 263462 - protein, 9 aa, Homo Sapiens
YNVDFGQPS

SEQ ID NO: 263463 - protein, 9 aa, Homo Sapiens
EEMEQANFT

SEQ ID NO: 263464 - protein, 9 aa, Homo Sapiens
KYLIYGPVL

SEQ ID NO: 263465 - protein, 9 aa, Homo Sapiens
LLKKMHQTQ

SEQ ID NO: 263466 - protein, 9 aa, Homo Sapiens
VSLKEKLAD

SEQ ID NO: 263467 - protein, 9 aa, Homo Sapiens
QMVLDAVTL

SEQ ID NO: 263468 - protein, 9 aa, Homo Sapiens
KKIHIAEKP

SEQ ID NO: 263469 - protein, 9 aa, Homo Sapiens
MVAQLLDDF

SEQ ID NO: 263470 - protein, 9 aa, Homo Sapiens
ALKNKLSCL

SEQ ID NO: 263471 - protein, 9 aa, Homo Sapiens
KFGMNSGGG

SEQ ID NO: 263472 - protein, 9 aa, Homo Sapiens
TVYQASRMS

SEQ ID NO: 263473 - protein, 9 aa, Homo Sapiens
KYVKNAIDT

SEQ ID NO: 263474 - protein, 9 aa, Homo Sapiens
PRALSPASR

SEQ ID NO: 263475 - protein, 9 aa, Homo Sapiens
DAHTLAMDY

SEQ ID NO: 263476 - protein, 9 aa, Homo Sapiens
CHPVERDIK

SEQ ID NO: 263477 - protein, 9 aa, Homo Sapiens
ELKTEAKNE

SEQ ID NO: 263478 - protein, 9 aa, Homo Sapiens
RIGFNVVTL

SEQ ID NO: 263479 - protein, 9 aa, Homo Sapiens
IQWFDTAPS

SEQ ID NO: 263480 - protein, 9 aa, Homo Sapiens
ASDDDTPFD

SEQ ID NO: 263481 - protein, 9 aa, Homo Sapiens
NQSDIKEDT

SEQ ID NO: 263482 - protein, 9 aa, Homo Sapiens
VTHRYSDGW

SEQ ID NO: 263483 - protein, 9 aa, Homo Sapiens
CSCDLLSLK

SEQ ID NO: 263484 - protein, 9 aa, Homo Sapiens
NPKHLNLAT

SEQ ID NO: 263485 - protein, 9 aa, Homo Sapiens
AIGKQQEKI

SEQ ID NO: 263486 - protein, 9 aa, Homo Sapiens
LPILAPCEL

SEQ ID NO: 263487 - protein, 9 aa, Homo Sapiens
DSSNEPPNT

SEQ ID NO: 263488 - protein, 9 aa, Homo Sapiens
ESLCGRTLR

SEQ ID NO: 263489 - protein, 9 aa, Homo Sapiens
QLASKLSFQ

SEQ ID NO: 263490 - protein, 9 aa, Homo Sapiens
SSPVELDLL

SEQ ID NO: 263491 - protein, 9 aa, Homo Sapiens
TVCVGTVGT

SEQ ID NO: 263492 - protein, 9 aa, Homo Sapiens
HKKWKCPGP

SEQ ID NO: 263493 - protein, 9 aa, Homo Sapiens
LENVGAFNK

SEQ ID NO: 263494 - protein, 9 aa, Homo Sapiens
GGKMHGNLC

SEQ ID NO: 263495 - protein, 9 aa, Homo Sapiens
VGAFNKVSI

SEQ ID NO: 263496 - protein, 9 aa, Homo Sapiens
SESESNIFE

SEQ ID NO: 263497 - protein, 9 aa, Homo Sapiens
LQALDLFGN

SEQ ID NO: 263498 - protein, 9 aa, Homo Sapiens
HTRHICMVN

SEQ ID NO: 263499 - protein, 9 aa, Homo Sapiens
YGKEYQAKD

SEQ ID NO: 263500 - protein, 9 aa, Homo Sapiens
GYFTCRAQH

SEQ ID NO: 263501 - protein, 9 aa, Homo Sapiens
CPKGACIGR

SEQ ID NO: 263502 - protein, 9 aa, Homo Sapiens
ELPMTFPGL

SEQ ID NO: 263503 - protein, 9 aa, Homo Sapiens
DTNGNLDPW

SEQ ID NO: 263504 - protein, 9 aa, Homo Sapiens
YHDIVSRLR

SEQ ID NO: 263505 - protein, 9 aa, Homo Sapiens
KHDVEVLEQ

SEQ ID NO: 263506 - protein, 9 aa, Homo Sapiens
YISLGFFCC

SEQ ID NO: 263507 - protein, 9 aa, Homo Sapiens
IWIQLDHYC

SEQ ID NO: 263508 - protein, 9 aa, Homo Sapiens
GRPRKGSKM

SEQ ID NO: 263509 - protein, 9 aa, Homo Sapiens
GQFINSKKA

SEQ ID NO: 263510 - protein, 9 aa, Homo Sapiens
SQDVCIPVG

SEQ ID NO: 263511 - protein, 9 aa, Homo Sapiens
GHNVEDERW

SEQ ID NO: 263512 - protein, 9 aa, Homo Sapiens
EKNKWSHNN

SEQ ID NO: 263513 - protein, 9 aa, Homo Sapiens
NNDNLLKAL

SEQ ID NO: 263514 - protein, 9 aa, Homo Sapiens
DIRIWVAIP

SEQ ID NO: 263515 - protein, 9 aa, Homo Sapiens
AHKFFPKAK

SEQ ID NO: 263516 - protein, 9 aa, Homo Sapiens
RAAPGDPSG

SEQ ID NO: 263517 - protein, 9 aa, Homo Sapiens
SNEFHIYIA

SEQ ID NO: 263518 - protein, 9 aa, Homo Sapiens
GTLPNIALQ

SEQ ID NO: 263519 - protein, 9 aa, Homo Sapiens
ITFKQKMFM

SEQ ID NO: 263520 - protein, 9 aa, Homo Sapiens
DSAVATARC

SEQ ID NO: 263521 - protein, 9 aa, Homo Sapiens
AKEYESVME

SEQ ID NO: 263522 - protein, 9 aa, Homo Sapiens
IHALGGFTH

SEQ ID NO: 263523 - protein, 9 aa, Homo Sapiens
LPGYRLREI

SEQ ID NO: 263524 - protein, 9 aa, Homo Sapiens
EKSKGYGFS

SEQ ID NO: 263525 - protein, 9 aa, Homo Sapiens
IAQVLSEDG

SEQ ID NO: 263526 - protein, 9 aa, Homo Sapiens
LEDGPHSAN

SEQ ID NO: 263527 - protein, 9 aa, Homo Sapiens
PGDLIEVSR

SEQ ID NO: 263528 - protein, 9 aa, Homo Sapiens
SEKAQNMSK

SEQ ID NO: 263529 - protein, 9 aa, Homo Sapiens
AKFRQIVLA

SEQ ID NO: 263530 - protein, 9 aa, Homo Sapiens
RLERLFLHS

SEQ ID NO: 263531 - protein, 9 aa, Homo Sapiens
LHDKQKFYL

SEQ ID NO: 263532 - protein, 9 aa, Homo Sapiens
HERRKRYNV

SEQ ID NO: 263533 - protein, 9 aa, Homo Sapiens
TQVSHLAQH

SEQ ID NO: 263534 - protein, 9 aa, Homo Sapiens
KYGGIPKFS

SEQ ID NO: 263535 - protein, 9 aa, Homo Sapiens
SSDYLLSST

SEQ ID NO: 263536 - protein, 9 aa, Homo Sapiens
DLKSNNIHT

SEQ ID NO: 263537 - protein, 9 aa, Homo Sapiens
LLATVEFAL

SEQ ID NO: 263538 - protein, 9 aa, Homo Sapiens
SSPDLQRNQ

SEQ ID NO: 263539 - protein, 9 aa, Homo Sapiens
NIYNFPIHA

SEQ ID NO: 263540 - protein, 9 aa, Homo Sapiens
VHNFMMDNQ

SEQ ID NO: 263541 - protein, 9 aa, Homo Sapiens
PFQQDRHCN

SEQ ID NO: 263542 - protein, 9 aa, Homo Sapiens
YSPGPLDSK

SEQ ID NO: 263543 - protein, 9 aa, Homo Sapiens
KENTAAKEQ

SEQ ID NO: 263544 - protein, 9 aa, Homo Sapiens
RLVALPGEG

SEQ ID NO: 263545 - protein, 9 aa, Homo Sapiens
VVKKRKTES

SEQ ID NO: 263546 - protein, 9 aa, Homo Sapiens
SSAPYVSSD

SEQ ID NO: 263547 - protein, 9 aa, Homo Sapiens
KTLHLEPFK

SEQ ID NO: 263548 - protein, 9 aa, Homo Sapiens
LPSVTKNET

SEQ ID NO: 263549 - protein, 9 aa, Homo Sapiens
YSYRFVCDK

SEQ ID NO: 263550 - protein, 9 aa, Homo Sapiens
DQSAALLGQ

SEQ ID NO: 263551 - protein, 9 aa, Homo Sapiens
RGNLDNLFL

SEQ ID NO: 263552 - protein, 9 aa, Homo Sapiens
LKDVQNNKH

SEQ ID NO: 263553 - protein, 9 aa, Homo Sapiens
MVARISDPK

SEQ ID NO: 263554 - protein, 9 aa, Homo Sapiens
VDATNPIYE

SEQ ID NO: 263555 - protein, 9 aa, Homo Sapiens
TMLINNFYF

SEQ ID NO: 263556 - protein, 9 aa, Homo Sapiens
ERPDLLVNL

SEQ ID NO: 263557 - protein, 9 aa, Homo Sapiens
TGVPILVRL

SEQ ID NO: 263558 - protein, 9 aa, Homo Sapiens
PSETPINEN

SEQ ID NO: 263559 - protein, 9 aa, Homo Sapiens
WDLEKKAKH

SEQ ID NO: 263560 - protein, 9 aa, Homo Sapiens
LANKKRAKE

SEQ ID NO: 263561 - protein, 9 aa, Homo Sapiens
DEQSTYDQQ

SEQ ID NO: 263562 - protein, 9 aa, Homo Sapiens
RCPTGFPGT

SEQ ID NO: 263563 - protein, 9 aa, Homo Sapiens
LLLGVVQIY

SEQ ID NO: 263564 - protein, 9 aa, Homo Sapiens
PEILFFVAL

SEQ ID NO: 263565 - protein, 9 aa, Homo Sapiens
RPSSGQIIS

SEQ ID NO: 263566 - protein, 9 aa, Homo Sapiens
TLIVVGVGK

SEQ ID NO: 263567 - protein, 9 aa, Homo Sapiens
GGAPSVIVG

SEQ ID NO: 263568 - protein, 9 aa, Homo Sapiens
LFFGIDMVV

SEQ ID NO: 263569 - protein, 9 aa, Homo Sapiens
RKLFLVPSQ

SEQ ID NO: 263570 - protein, 9 aa, Homo Sapiens
DEHHHWISQ

SEQ ID NO: 263571 - protein, 9 aa, Homo Sapiens
GAPLARNQL

SEQ ID NO: 263572 - protein, 9 aa, Homo Sapiens
NNRQKIQKL

SEQ ID NO: 263573 - protein, 9 aa, Homo Sapiens
QVFNPLRFT

SEQ ID NO: 263574 - protein, 9 aa, Homo Sapiens
LEYLNNKYL

SEQ ID NO: 263575 - protein, 9 aa, Homo Sapiens
MASAPIPKD

SEQ ID NO: 263576 - protein, 9 aa, Homo Sapiens
LVSGNLSPI

SEQ ID NO: 263577 - protein, 9 aa, Homo Sapiens
REEPLTEQN

SEQ ID NO: 263578 - protein, 9 aa, Homo Sapiens
YKLANYRYG

SEQ ID NO: 263579 - protein, 9 aa, Homo Sapiens
QRVNINLSF

SEQ ID NO: 263580 - protein, 9 aa, Homo Sapiens
IGKELSKMQ

SEQ ID NO: 263581 - protein, 9 aa, Homo Sapiens
KEDSDIRCL

SEQ ID NO: 263582 - protein, 9 aa, Homo Sapiens
RKYNEALQS

SEQ ID NO: 263583 - protein, 9 aa, Homo Sapiens
FIYSLMNKD

SEQ ID NO: 263584 - protein, 9 aa, Homo Sapiens
KTQSQLSLL

SEQ ID NO: 263585 - protein, 9 aa, Homo Sapiens
LKITNLRLK

SEQ ID NO: 263586 - protein, 9 aa, Homo Sapiens
LEDLRSKAN

SEQ ID NO: 263587 - protein, 9 aa, Homo Sapiens
QMHLGTNGA

SEQ ID NO: 263588 - protein, 9 aa, Homo Sapiens
PEVKDTLRE

SEQ ID NO: 263589 - protein, 9 aa, Homo Sapiens
LKQCPNPLA

SEQ ID NO: 263590 - protein, 9 aa, Homo Sapiens
HGLSMPMDS

SEQ ID NO: 263591 - protein, 9 aa, Homo Sapiens
VSRNELPEI

SEQ ID NO: 263592 - protein, 9 aa, Homo Sapiens
VLGIKDSGD

SEQ ID NO: 263593 - protein, 9 aa, Homo Sapiens
ILESKYLYD

SEQ ID NO: 263594 - protein, 9 aa, Homo Sapiens
LPIFFGTSQ

SEQ ID NO: 263595 - protein, 9 aa, Homo Sapiens
YSAKSFQIH

SEQ ID NO: 263596 - protein, 9 aa, Homo Sapiens
SLRESKSKL

SEQ ID NO: 263597 - protein, 9 aa, Homo Sapiens
DKVSIYKLT

SEQ ID NO: 263598 - protein, 9 aa, Homo Sapiens
KQLQDLWRT

SEQ ID NO: 263599 - protein, 9 aa, Homo Sapiens
NPGAHFMTT

SEQ ID NO: 263600 - protein, 9 aa, Homo Sapiens
FQIASWKLA

SEQ ID NO: 263601 - protein, 9 aa, Homo Sapiens
CGVATYMVI

SEQ ID NO: 263602 - protein, 9 aa, Homo Sapiens
HLAVEGMVE

SEQ ID NO: 263603 - protein, 9 aa, Homo Sapiens
PVAIFYTIV

SEQ ID NO: 263604 - protein, 9 aa, Homo Sapiens
FMENIMLCG

SEQ ID NO: 263605 - protein, 9 aa, Homo Sapiens
ACSDTYNNE

SEQ ID NO: 263606 - protein, 9 aa, Homo Sapiens
TKRTNQSSK

SEQ ID NO: 263607 - protein, 9 aa, Homo Sapiens
FGLSSKESM

SEQ ID NO: 263608 - protein, 9 aa, Homo Sapiens
FERNSFSIW

SEQ ID NO: 263609 - protein, 9 aa, Homo Sapiens
LLNCSYTQT

SEQ ID NO: 263610 - protein, 9 aa, Homo Sapiens
PVMAIPPRD

SEQ ID NO: 263611 - protein, 9 aa, Homo Sapiens
VPSPVSLSA

SEQ ID NO: 263612 - protein, 9 aa, Homo Sapiens
HDPVTECIA

SEQ ID NO: 263613 - protein, 9 aa, Homo Sapiens
LALQVLDFV

SEQ ID NO: 263614 - protein, 9 aa, Homo Sapiens
QEREHPAEP

SEQ ID NO: 263615 - protein, 9 aa, Homo Sapiens
PDKPRGTQK

SEQ ID NO: 263616 - protein, 9 aa, Homo Sapiens
IVQDPMLLA

SEQ ID NO: 263617 - protein, 9 aa, Homo Sapiens
PGQEESDPS

SEQ ID NO: 263618 - protein, 9 aa, Homo Sapiens
RDSLEKEAS

SEQ ID NO: 263619 - protein, 9 aa, Homo Sapiens
SLPAGAQDA

SEQ ID NO: 263620 - protein, 9 aa, Homo Sapiens
AFNAFDALP

SEQ ID NO: 263621 - protein, 9 aa, Homo Sapiens
ENIMKLSII

SEQ ID NO: 263622 - protein, 9 aa, Homo Sapiens
ISGIQAELL

SEQ ID NO: 263623 - protein, 9 aa, Homo Sapiens
YILLRPTMQ

SEQ ID NO: 263624 - protein, 9 aa, Homo Sapiens
EFLGATNNP

SEQ ID NO: 263625 - protein, 9 aa, Homo Sapiens
NLCFLETAQ

SEQ ID NO: 263626 - protein, 9 aa, Homo Sapiens
IIINGEIIP

SEQ ID NO: 263627 - protein, 9 aa, Homo Sapiens
ILANALLER

SEQ ID NO: 263628 - protein, 9 aa, Homo Sapiens
NSQYNQRLF

SEQ ID NO: 263629 - protein, 9 aa, Homo Sapiens
YQISMCKLG

SEQ ID NO: 263630 - protein, 9 aa, Homo Sapiens
RYRAAHDKE

SEQ ID NO: 263631 - protein, 9 aa, Homo Sapiens
KLWNNRTRD

SEQ ID NO: 263632 - protein, 9 aa, Homo Sapiens
QELDIRLAS

SEQ ID NO: 263633 - protein, 9 aa, Homo Sapiens
QTPISEGRS

SEQ ID NO: 263634 - protein, 9 aa, Homo Sapiens
LYNWLLIYT

SEQ ID NO: 263635 - protein, 9 aa, Homo Sapiens
IGYGSCLFI

SEQ ID NO: 263636 - protein, 9 aa, Homo Sapiens
IKEDRARWQ

SEQ ID NO: 263637 - protein, 9 aa, Homo Sapiens
AQYPFSSPT

SEQ ID NO: 263638 - protein, 9 aa, Homo Sapiens
WNDYLFEIV

SEQ ID NO: 263639 - protein, 9 aa, Homo Sapiens
FKHIFITMF

SEQ ID NO: 263640 - protein, 9 aa, Homo Sapiens
NSYIKDFLS

SEQ ID NO: 263641 - protein, 9 aa, Homo Sapiens
ALTRKNKEV

SEQ ID NO: 263642 - protein, 9 aa, Homo Sapiens
PDIQKMKHE

SEQ ID NO: 263643 - protein, 9 aa, Homo Sapiens
SGLIKHQII

SEQ ID NO: 263644 - protein, 9 aa, Homo Sapiens
IIYGKFLGL

SEQ ID NO: 263645 - protein, 9 aa, Homo Sapiens
GSLKGNIVF

SEQ ID NO: 263646 - protein, 9 aa, Homo Sapiens
QDSLYAELQ

SEQ ID NO: 263647 - protein, 9 aa, Homo Sapiens
VPQNKGLPL

SEQ ID NO: 263648 - protein, 9 aa, Homo Sapiens
NIHTGQKPY

SEQ ID NO: 263649 - protein, 9 aa, Homo Sapiens
SKINASKNH

SEQ ID NO: 263650 - protein, 9 aa, Homo Sapiens
LLQPRLVVL

SEQ ID NO: 263651 - protein, 9 aa, Homo Sapiens
LAQIQVQIG

SEQ ID NO: 263652 - protein, 9 aa, Homo Sapiens
VIFVFGIVV

SEQ ID NO: 263653 - protein, 9 aa, Homo Sapiens
RKENFNQTL

SEQ ID NO: 263654 - protein, 9 aa, Homo Sapiens
VMDLPKGLP

SEQ ID NO: 263655 - protein, 9 aa, Homo Sapiens
EDYGRDLGP

SEQ ID NO: 263656 - protein, 9 aa, Homo Sapiens
PCFNYMHEC

SEQ ID NO: 263657 - protein, 9 aa, Homo Sapiens
MFEIICVIV

SEQ ID NO: 263658 - protein, 9 aa, Homo Sapiens
TVTTAETLT

SEQ ID NO: 263659 - protein, 9 aa, Homo Sapiens
EAGISCTYF

SEQ ID NO: 263660 - protein, 9 aa, Homo Sapiens
LKHIMEVVG

SEQ ID NO: 263661 - protein, 9 aa, Homo Sapiens
MDPISDYHF

SEQ ID NO: 263662 - protein, 9 aa, Homo Sapiens
TRRGYFGRS

SEQ ID NO: 263663 - protein, 9 aa, Homo Sapiens
YVHSFVTHA

SEQ ID NO: 263664 - protein, 9 aa, Homo Sapiens
PRYDVPIYM

SEQ ID NO: 263665 - protein, 9 aa, Homo Sapiens
KDLDKKKKE

SEQ ID NO: 263666 - protein, 9 aa, Homo Sapiens
ADIWALGCV

SEQ ID NO: 263667 - protein, 9 aa, Homo Sapiens
SQSLPKKVY

SEQ ID NO: 263668 - protein, 9 aa, Homo Sapiens
TIQLNITYV

SEQ ID NO: 263669 - protein, 9 aa, Homo Sapiens
DIPKGEMVT

SEQ ID NO: 263670 - protein, 9 aa, Homo Sapiens
FFMLFVMME

SEQ ID NO: 263671 - protein, 9 aa, Homo Sapiens
NAKDVVAVI

SEQ ID NO: 263672 - protein, 9 aa, Homo Sapiens
SEAQPCTPS

SEQ ID NO: 263673 - protein, 9 aa, Homo Sapiens
IFALNWCEK

SEQ ID NO: 263674 - protein, 9 aa, Homo Sapiens
LPDNDSLFY

SEQ ID NO: 263675 - protein, 9 aa, Homo Sapiens
FCPELTTDV

SEQ ID NO: 263676 - protein, 9 aa, Homo Sapiens
CPEKGSGVD

SEQ ID NO: 263677 - protein, 9 aa, Homo Sapiens
YCLCYEGKS

SEQ ID NO: 263678 - protein, 9 aa, Homo Sapiens
QMLIQENQE

SEQ ID NO: 263679 - protein, 9 aa, Homo Sapiens
SCKKRDDCL

SEQ ID NO: 263680 - protein, 9 aa, Homo Sapiens
SDDTPELCA

SEQ ID NO: 263681 - protein, 9 aa, Homo Sapiens
HQQPTTEGG

SEQ ID NO: 263682 - protein, 9 aa, Homo Sapiens
GAPCAIQIS

SEQ ID NO: 263683 - protein, 9 aa, Homo Sapiens
WNKIQCVSV

SEQ ID NO: 263684 - protein, 9 aa, Homo Sapiens
AITSAILAS

SEQ ID NO: 263685 - protein, 9 aa, Homo Sapiens
MESENLTEL

SEQ ID NO: 263686 - protein, 9 aa, Homo Sapiens
RTAQTQAEE

SEQ ID NO: 263687 - protein, 9 aa, Homo Sapiens
EVRDKLSEL

SEQ ID NO: 263688 - protein, 9 aa, Homo Sapiens
YNKLKSMSM

SEQ ID NO: 263689 - protein, 9 aa, Homo Sapiens
KESFFQYER

SEQ ID NO: 263690 - protein, 9 aa, Homo Sapiens
PLEADTETR

SEQ ID NO: 263691 - protein, 9 aa, Homo Sapiens
GRDIRSPAA

SEQ ID NO: 263692 - protein, 9 aa, Homo Sapiens
EDTNFCIQN

SEQ ID NO: 263693 - protein, 9 aa, Homo Sapiens
LLRAAPGDP

SEQ ID NO: 263694 - protein, 9 aa, Homo Sapiens
KKQDPDAPP

SEQ ID NO: 263695 - protein, 9 aa, Homo Sapiens
IALSEHRKQ

SEQ ID NO: 263696 - protein, 9 aa, Homo Sapiens
SKEEANFVI

SEQ ID NO: 263697 - protein, 9 aa, Homo Sapiens
TQLEGRPLN

SEQ ID NO: 263698 - protein, 9 aa, Homo Sapiens
VTDGEIILG

SEQ ID NO: 263699 - protein, 9 aa, Homo Sapiens
PDSCRIIKQ

SEQ ID NO: 263700 - protein, 9 aa, Homo Sapiens
LNQAFWESS

SEQ ID NO: 263701 - protein, 9 aa, Homo Sapiens
QNHIRIHTG

SEQ ID NO: 263702 - protein, 9 aa, Homo Sapiens
GLCYYLPPP

SEQ ID NO: 263703 - protein, 9 aa, Homo Sapiens
IKEKIHILH

SEQ ID NO: 263704 - protein, 9 aa, Homo Sapiens
IQLYGRKFS

SEQ ID NO: 263705 - protein, 9 aa, Homo Sapiens
GRERAFIQW

SEQ ID NO: 263706 - protein, 9 aa, Homo Sapiens
GGTSTSVLT

SEQ ID NO: 263707 - protein, 9 aa, Homo Sapiens
KKLPWPCDS

SEQ ID NO: 263708 - protein, 9 aa, Homo Sapiens
AIHMTKGAT

SEQ ID NO: 263709 - protein, 9 aa, Homo Sapiens
VYLEWNPLQ

SEQ ID NO: 263710 - protein, 9 aa, Homo Sapiens
PGWASTIES

SEQ ID NO: 263711 - protein, 9 aa, Homo Sapiens
WQKDTLQNQ

SEQ ID NO: 263712 - protein, 9 aa, Homo Sapiens
FACTEELGV

SEQ ID NO: 263713 - protein, 9 aa, Homo Sapiens
TASCHIVPV

SEQ ID NO: 263714 - protein, 9 aa, Homo Sapiens
TSGQSEVYL

SEQ ID NO: 263715 - protein, 9 aa, Homo Sapiens
GDYDPDDHP

SEQ ID NO: 263716 - protein, 9 aa, Homo Sapiens
LKFVKLHTL

SEQ ID NO: 263717 - protein, 9 aa, Homo Sapiens
ASFIDKVRL

SEQ ID NO: 263718 - protein, 9 aa, Homo Sapiens
EMEVVTQGM

SEQ ID NO: 263719 - protein, 9 aa, Homo Sapiens
QGTMEADRG

SEQ ID NO: 263720 - protein, 9 aa, Homo Sapiens
ISKRVLGKI

SEQ ID NO: 263721 - protein, 9 aa, Homo Sapiens
NSVKAIIQG

SEQ ID NO: 263722 - protein, 9 aa, Homo Sapiens
PASLSQTCC

SEQ ID NO: 263723 - protein, 9 aa, Homo Sapiens
SPHLHAPWD

SEQ ID NO: 263724 - protein, 9 aa, Homo Sapiens
DYMYWRTAL

SEQ ID NO: 263725 - protein, 9 aa, Homo Sapiens
GLHEFLVNL

SEQ ID NO: 263726 - protein, 9 aa, Homo Sapiens
VLPKQNKIE

SEQ ID NO: 263727 - protein, 9 aa, Homo Sapiens
KPKQDNEGG

SEQ ID NO: 263728 - protein, 9 aa, Homo Sapiens
NIAVTPLKR

SEQ ID NO: 263729 - protein, 9 aa, Homo Sapiens
RGDPDFEGE

SEQ ID NO: 263730 - protein, 9 aa, Homo Sapiens
ANFASLSGL

SEQ ID NO: 263731 - protein, 9 aa, Homo Sapiens
RPLDYTFAP

SEQ ID NO: 263732 - protein, 9 aa, Homo Sapiens
PTPASYAAP

SEQ ID NO: 263733 - protein, 9 aa, Homo Sapiens
VVGWQSPFL

SEQ ID NO: 263734 - protein, 9 aa, Homo Sapiens
YLPESSCIG

SEQ ID NO: 263735 - protein, 9 aa, Homo Sapiens
IMISFSLSI

SEQ ID NO: 263736 - protein, 9 aa, Homo Sapiens
MKFNNMLFP

SEQ ID NO: 263737 - protein, 9 aa, Homo Sapiens
QVHQYSSCL

SEQ ID NO: 263738 - protein, 9 aa, Homo Sapiens
SMEPNTQKN

SEQ ID NO: 263739 - protein, 9 aa, Homo Sapiens
QLTQAISDH

SEQ ID NO: 263740 - protein, 9 aa, Homo Sapiens
PTSCQISCT

SEQ ID NO: 263741 - protein, 9 aa, Homo Sapiens
EKLAGKIEF

SEQ ID NO: 263742 - protein, 9 aa, Homo Sapiens
TLEGAEEFE

SEQ ID NO: 263743 - protein, 9 aa, Homo Sapiens
LSKYVKNAI

SEQ ID NO: 263744 - protein, 9 aa, Homo Sapiens
ASSRQCQGD

SEQ ID NO: 263745 - protein, 9 aa, Homo Sapiens
RFAYYTLLK

SEQ ID NO: 263746 - protein, 9 aa, Homo Sapiens
NKIINKYLD

SEQ ID NO: 263747 - protein, 9 aa, Homo Sapiens
IDLISSLMI

SEQ ID NO: 263748 - protein, 9 aa, Homo Sapiens
VPFPISLNW

SEQ ID NO: 263749 - protein, 9 aa, Homo Sapiens
YEKRMQQHK

SEQ ID NO: 263750 - protein, 9 aa, Homo Sapiens
RSVKASYVL

SEQ ID NO: 263751 - protein, 9 aa, Homo Sapiens
CRILATMNP

SEQ ID NO: 263752 - protein, 9 aa, Homo Sapiens
SMVLVLLLV

SEQ ID NO: 263753 - protein, 9 aa, Homo Sapiens
RRGVTQIGY

SEQ ID NO: 263754 - protein, 9 aa, Homo Sapiens
AKVGQDSEL

SEQ ID NO: 263755 - protein, 9 aa, Homo Sapiens
VKDVVEKKN

SEQ ID NO: 263756 - protein, 9 aa, Homo Sapiens
KTESSCKAK

SEQ ID NO: 263757 - protein, 9 aa, Homo Sapiens
FCSIAFKNQ

SEQ ID NO: 263758 - protein, 9 aa, Homo Sapiens
QMTQNYSTM

SEQ ID NO: 263759 - protein, 9 aa, Homo Sapiens
EVLGLQRYV

SEQ ID NO: 263760 - protein, 9 aa, Homo Sapiens
VGYGYMYPI

SEQ ID NO: 263761 - protein, 9 aa, Homo Sapiens
SKKKLREVE

SEQ ID NO: 263762 - protein, 9 aa, Homo Sapiens
DNSEQLELI

SEQ ID NO: 263763 - protein, 9 aa, Homo Sapiens
TAPAPEFIT

SEQ ID NO: 263764 - protein, 9 aa, Homo Sapiens
AENNIENYP

SEQ ID NO: 263765 - protein, 9 aa, Homo Sapiens
IEYFTYEEL

SEQ ID NO: 263766 - protein, 9 aa, Homo Sapiens
QRKGTYRNL

SEQ ID NO: 263767 - protein, 9 aa, Homo Sapiens
ETAKKNHDI

SEQ ID NO: 263768 - protein, 9 aa, Homo Sapiens
QYIHILLAN

SEQ ID NO: 263769 - protein, 9 aa, Homo Sapiens
ISNTGSKHL

SEQ ID NO: 263770 - protein, 9 aa, Homo Sapiens
RHRIIHTAK

SEQ ID NO: 263771 - protein, 9 aa, Homo Sapiens
EELLSQMAA

SEQ ID NO: 263772 - protein, 9 aa, Homo Sapiens
ADGGQDRKS

SEQ ID NO: 263773 - protein, 9 aa, Homo Sapiens
EEKVLEKEE

SEQ ID NO: 263774 - protein, 9 aa, Homo Sapiens
NTENSSSVT

SEQ ID NO: 263775 - protein, 9 aa, Homo Sapiens
DDEYAPMIT

SEQ ID NO: 263776 - protein, 9 aa, Homo Sapiens
FPQRHYLVS

SEQ ID NO: 263777 - protein, 9 aa, Homo Sapiens
RTWTDYTQC

SEQ ID NO: 263778 - protein, 9 aa, Homo Sapiens
SVQDLICDH

SEQ ID NO: 263779 - protein, 9 aa, Homo Sapiens
CLYSPGPLD

SEQ ID NO: 263780 - protein, 9 aa, Homo Sapiens
GVFLVMYVV

SEQ ID NO: 263781 - protein, 9 aa, Homo Sapiens
SMLNTNPSL

SEQ ID NO: 263782 - protein, 9 aa, Homo Sapiens
TISLASEQY

SEQ ID NO: 263783 - protein, 9 aa, Homo Sapiens
SVHWPIFKW

SEQ ID NO: 263784 - protein, 9 aa, Homo Sapiens
DLDKLQPEL

SEQ ID NO: 263785 - protein, 9 aa, Homo Sapiens
HDTFSDSPV

SEQ ID NO: 263786 - protein, 9 aa, Homo Sapiens
QTGAGPLAR

SEQ ID NO: 263787 - protein, 9 aa, Homo Sapiens
LTSHPLKQR

SEQ ID NO: 263788 - protein, 9 aa, Homo Sapiens
EPHTMSRSK

SEQ ID NO: 263789 - protein, 9 aa, Homo Sapiens
DANVEGLGT

SEQ ID NO: 263790 - protein, 9 aa, Homo Sapiens
AAAFGIIAF

SEQ ID NO: 263791 - protein, 9 aa, Homo Sapiens
QEKEQESPD

SEQ ID NO: 263792 - protein, 9 aa, Homo Sapiens
PSKVSEGKD

SEQ ID NO: 263793 - protein, 9 aa, Homo Sapiens
AFKFKVLAK

SEQ ID NO: 263794 - protein, 9 aa, Homo Sapiens
QALDLFGNG

SEQ ID NO: 263795 - protein, 9 aa, Homo Sapiens
IIKQGYTCK

SEQ ID NO: 263796 - protein, 9 aa, Homo Sapiens
TSNVPAMYV

SEQ ID NO: 263797 - protein, 9 aa, Homo Sapiens
VLAQVYKQS

SEQ ID NO: 263798 - protein, 9 aa, Homo Sapiens
HPHSPLSRS

SEQ ID NO: 263799 - protein, 9 aa, Homo Sapiens
SAIFKFQSL

SEQ ID NO: 263800 - protein, 9 aa, Homo Sapiens
LFDIYAIVG

SEQ ID NO: 263801 - protein, 9 aa, Homo Sapiens
EECKDLIKC

SEQ ID NO: 263802 - protein, 9 aa, Homo Sapiens
REHMQQLDR

SEQ ID NO: 263803 - protein, 9 aa, Homo Sapiens
GIIDYGICL

SEQ ID NO: 263804 - protein, 9 aa, Homo Sapiens
PASATPPRP

SEQ ID NO: 263805 - protein, 9 aa, Homo Sapiens
VATARCPRW

SEQ ID NO: 263806 - protein, 9 aa, Homo Sapiens
STIHNTYHS

SEQ ID NO: 263807 - protein, 9 aa, Homo Sapiens
FMATPNLSR

SEQ ID NO: 263808 - protein, 9 aa, Homo Sapiens
CFCFLRKEN

SEQ ID NO: 263809 - protein, 9 aa, Homo Sapiens
IIATCNHSL

SEQ ID NO: 263810 - protein, 9 aa, Homo Sapiens
EAVKEAIAA

SEQ ID NO: 263811 - protein, 9 aa, Homo Sapiens
FDEADQMFD

SEQ ID NO: 263812 - protein, 9 aa, Homo Sapiens
YKSPASGAY

SEQ ID NO: 263813 - protein, 9 aa, Homo Sapiens
LFSEPVTTP

SEQ ID NO: 263814 - protein, 9 aa, Homo Sapiens
QQQGNQERH

SEQ ID NO: 263815 - protein, 9 aa, Homo Sapiens
LADASESEA

SEQ ID NO: 263816 - protein, 9 aa, Homo Sapiens
RSRLRVPLL

SEQ ID NO: 263817 - protein, 9 aa, Homo Sapiens
ERAFIQWLR

SEQ ID NO: 263818 - protein, 9 aa, Homo Sapiens
APAPEFITL

SEQ ID NO: 263819 - protein, 9 aa, Homo Sapiens
IHDWADGKC

SEQ ID NO: 263820 - protein, 9 aa, Homo Sapiens
SNDTIRMID

SEQ ID NO: 263821 - protein, 9 aa, Homo Sapiens
QLPEDAFNN

SEQ ID NO: 263822 - protein, 9 aa, Homo Sapiens
KNGKEEVIN

SEQ ID NO: 263823 - protein, 9 aa, Homo Sapiens
GRFDENENV

SEQ ID NO: 263824 - protein, 9 aa, Homo Sapiens
KNRMSQMLE

SEQ ID NO: 263825 - protein, 9 aa, Homo Sapiens
KTPRSAYLL

SEQ ID NO: 263826 - protein, 9 aa, Homo Sapiens
LREKAKNVF

SEQ ID NO: 263827 - protein, 9 aa, Homo Sapiens
QKQKDIQSC

SEQ ID NO: 263828 - protein, 9 aa, Homo Sapiens
LLLILGKLF

SEQ ID NO: 263829 - protein, 9 aa, Homo Sapiens
EHDSQVSEI

SEQ ID NO: 263830 - protein, 9 aa, Homo Sapiens
TNPSLRPSA

SEQ ID NO: 263831 - protein, 9 aa, Homo Sapiens
DKSIMTYVA

SEQ ID NO: 263832 - protein, 9 aa, Homo Sapiens
MNLMVQARV

SEQ ID NO: 263833 - protein, 9 aa, Homo Sapiens
DLSTLFNVG

SEQ ID NO: 263834 - protein, 9 aa, Homo Sapiens
HFSLLYTII

SEQ ID NO: 263835 - protein, 9 aa, Homo Sapiens
VAMHTSTSY

SEQ ID NO: 263836 - protein, 9 aa, Homo Sapiens
SYSSPSETT

SEQ ID NO: 263837 - protein, 9 aa, Homo Sapiens
FQRHMITHT

SEQ ID NO: 263838 - protein, 9 aa, Homo Sapiens
FKPENSTFE

SEQ ID NO: 263839 - protein, 9 aa, Homo Sapiens
LNVCFKVIT

SEQ ID NO: 263840 - protein, 9 aa, Homo Sapiens
DSSCIRIHK

SEQ ID NO: 263841 - protein, 9 aa, Homo Sapiens
DVRVVGVEP

SEQ ID NO: 263842 - protein, 9 aa, Homo Sapiens
GPNMNHIAL

SEQ ID NO: 263843 - protein, 9 aa, Homo Sapiens
DEVLQLIQP

SEQ ID NO: 263844 - protein, 9 aa, Homo Sapiens
RWTPIGMPP

SEQ ID NO: 263845 - protein, 9 aa, Homo Sapiens
SRPGVVESY

SEQ ID NO: 263846 - protein, 9 aa, Homo Sapiens
ASCAKAKMK

SEQ ID NO: 263847 - protein, 9 aa, Homo Sapiens
QSSTRDWKD

SEQ ID NO: 263848 - protein, 9 aa, Homo Sapiens
SAKNHNYFP

SEQ ID NO: 263849 - protein, 9 aa, Homo Sapiens
AAGAGAGRQ

SEQ ID NO: 263850 - protein, 9 aa, Homo Sapiens
IITTHTTLE

SEQ ID NO: 263851 - protein, 9 aa, Homo Sapiens
FDTTPNKLV

SEQ ID NO: 263852 - protein, 9 aa, Homo Sapiens
QAPIVSPSD

SEQ ID NO: 263853 - protein, 9 aa, Homo Sapiens
HGLLSCDLQ

SEQ ID NO: 263854 - protein, 9 aa, Homo Sapiens
KKLLAMIMW

SEQ ID NO: 263855 - protein, 9 aa, Homo Sapiens
ESLGELFLD

SEQ ID NO: 263856 - protein, 9 aa, Homo Sapiens
FEDIKIVKE

SEQ ID NO: 263857 - protein, 9 aa, Homo Sapiens
NGQTIYLYR

SEQ ID NO: 263858 - protein, 9 aa, Homo Sapiens
WHRAETLGA

SEQ ID NO: 263859 - protein, 9 aa, Homo Sapiens
SGQMEFLEC

SEQ ID NO: 263860 - protein, 9 aa, Homo Sapiens
NDQACPRMD

SEQ ID NO: 263861 - protein, 9 aa, Homo Sapiens
ARQRKLHLF

SEQ ID NO: 263862 - protein, 9 aa, Homo Sapiens
DMIRKSPDS

SEQ ID NO: 263863 - protein, 9 aa, Homo Sapiens
SSVAMSHGN

SEQ ID NO: 263864 - protein, 9 aa, Homo Sapiens
LVGGFSQPY

SEQ ID NO: 263865 - protein, 9 aa, Homo Sapiens
SHCIFTIHV

SEQ ID NO: 263866 - protein, 9 aa, Homo Sapiens
DVLSEQDGV

SEQ ID NO: 263867 - protein, 9 aa, Homo Sapiens
HSENNWNRE

SEQ ID NO: 263868 - protein, 9 aa, Homo Sapiens
PFRPRPHQQ

SEQ ID NO: 263869 - protein, 9 aa, Homo Sapiens
SIGQELSKC

SEQ ID NO: 263870 - protein, 9 aa, Homo Sapiens
KVAGAWDPT

SEQ ID NO: 263871 - protein, 9 aa, Homo Sapiens
PLDIPVLFK

SEQ ID NO: 263872 - protein, 9 aa, Homo Sapiens
LSVQEGDNY

SEQ ID NO: 263873 - protein, 9 aa, Homo Sapiens
NKSWLCFTM

SEQ ID NO: 263874 - protein, 9 aa, Homo Sapiens
VAQDDAEKL

SEQ ID NO: 263875 - protein, 9 aa, Homo Sapiens
PGRFQELDI

SEQ ID NO: 263876 - protein, 9 aa, Homo Sapiens
SCSYDSVIA

SEQ ID NO: 263877 - protein, 9 aa, Homo Sapiens
LLQTPVVRP

SEQ ID NO: 263878 - protein, 9 aa, Homo Sapiens
LPLEMDGTE

SEQ ID NO: 263879 - protein, 9 aa, Homo Sapiens
EGVDGNFIL

SEQ ID NO: 263880 - protein, 9 aa, Homo Sapiens
ASLVDQKPE

SEQ ID NO: 263881 - protein, 9 aa, Homo Sapiens
LDEPFQSTE

SEQ ID NO: 263882 - protein, 9 aa, Homo Sapiens
VESIVLIFL

SEQ ID NO: 263883 - protein, 9 aa, Homo Sapiens
LCPTCLLPL

SEQ ID NO: 263884 - protein, 9 aa, Homo Sapiens
QHFNSYDIS

SEQ ID NO: 263885 - protein, 9 aa, Homo Sapiens
VKDHRTSQN

SEQ ID NO: 263886 - protein, 9 aa, Homo Sapiens
NTLLLEHKA

SEQ ID NO: 263887 - protein, 9 aa, Homo Sapiens
PASDDTPEL

SEQ ID NO: 263888 - protein, 9 aa, Homo Sapiens
FERLHQNLQ

SEQ ID NO: 263889 - protein, 9 aa, Homo Sapiens
EDEESLEST

SEQ ID NO: 263890 - protein, 9 aa, Homo Sapiens
RVRYMLEQR

SEQ ID NO: 263891 - protein, 9 aa, Homo Sapiens
MSPWQRKKM

SEQ ID NO: 263892 - protein, 9 aa, Homo Sapiens
NTKVDLFAV

SEQ ID NO: 263893 - protein, 9 aa, Homo Sapiens
RGEHCVHTL

SEQ ID NO: 263894 - protein, 9 aa, Homo Sapiens
AAMAYDQAV

SEQ ID NO: 263895 - protein, 9 aa, Homo Sapiens
CHSAAEFRE

SEQ ID NO: 263896 - protein, 9 aa, Homo Sapiens
LVVYPASAS

SEQ ID NO: 263897 - protein, 9 aa, Homo Sapiens
LPTNIVPPA

SEQ ID NO: 263898 - protein, 9 aa, Homo Sapiens
QIHKEKVIM

SEQ ID NO: 263899 - protein, 9 aa, Homo Sapiens
MMDNQLTKR

SEQ ID NO: 263900 - protein, 9 aa, Homo Sapiens
NNHKENVAK

SEQ ID NO: 263901 - protein, 9 aa, Homo Sapiens
FRAMFSICM

SEQ ID NO: 263902 - protein, 9 aa, Homo Sapiens
DYDYYSPTG

SEQ ID NO: 263903 - protein, 9 aa, Homo Sapiens
VQHLEMVVA

SEQ ID NO: 263904 - protein, 9 aa, Homo Sapiens
HPAPPATLP

SEQ ID NO: 263905 - protein, 9 aa, Homo Sapiens
QSAWTFQIL

SEQ ID NO: 263906 - protein, 9 aa, Homo Sapiens
ITTHPLSLL

SEQ ID NO: 263907 - protein, 9 aa, Homo Sapiens
GLSEQGNLE

SEQ ID NO: 263908 - protein, 9 aa, Homo Sapiens
FVGFGALLN

SEQ ID NO: 263909 - protein, 9 aa, Homo Sapiens
EVINRKIPY

SEQ ID NO: 263910 - protein, 9 aa, Homo Sapiens
TQRGLRPGC

SEQ ID NO: 263911 - protein, 9 aa, Homo Sapiens
KYKYYFPVI

SEQ ID NO: 263912 - protein, 9 aa, Homo Sapiens
SIRICVSHT

SEQ ID NO: 263913 - protein, 9 aa, Homo Sapiens
WVKIYEDFS

SEQ ID NO: 263914 - protein, 9 aa, Homo Sapiens
TSNELDDQG

SEQ ID NO: 263915 - protein, 9 aa, Homo Sapiens
CFIPQEAVY

SEQ ID NO: 263916 - protein, 9 aa, Homo Sapiens
DTTLKVWDT

SEQ ID NO: 263917 - protein, 9 aa, Homo Sapiens
IDMKQEMDK

SEQ ID NO: 263918 - protein, 9 aa, Homo Sapiens
LVLPVSLHL

SEQ ID NO: 263919 - protein, 9 aa, Homo Sapiens
SRPGSHKAS

SEQ ID NO: 263920 - protein, 9 aa, Homo Sapiens
NSYISSSAR

SEQ ID NO: 263921 - protein, 9 aa, Homo Sapiens
PVRDMDDGS

SEQ ID NO: 263922 - protein, 9 aa, Homo Sapiens
ITLEGHSKC

SEQ ID NO: 263923 - protein, 9 aa, Homo Sapiens
CGSIYFTTS

SEQ ID NO: 263924 - protein, 9 aa, Homo Sapiens
SPDDKYSLH

SEQ ID NO: 263925 - protein, 9 aa, Homo Sapiens
QDIYSECNT

SEQ ID NO: 263926 - protein, 9 aa, Homo Sapiens
TVGAVSGGE

SEQ ID NO: 263927 - protein, 9 aa, Homo Sapiens
PTDAFGNIV

SEQ ID NO: 263928 - protein, 9 aa, Homo Sapiens
ALCSLDLAG

SEQ ID NO: 263929 - protein, 9 aa, Homo Sapiens
CWPYLEIRA

SEQ ID NO: 263930 - protein, 9 aa, Homo Sapiens
VPEILISRL

SEQ ID NO: 263931 - protein, 9 aa, Homo Sapiens
AYAHKLPKY

SEQ ID NO: 263932 - protein, 9 aa, Homo Sapiens
NQIINNCIN

SEQ ID NO: 263933 - protein, 9 aa, Homo Sapiens
MLYLAEVMV

SEQ ID NO: 263934 - protein, 9 aa, Homo Sapiens
MTHGKNSLN

SEQ ID NO: 263935 - protein, 9 aa, Homo Sapiens
SIIDQGLTC

SEQ ID NO: 263936 - protein, 9 aa, Homo Sapiens
KKTEELFSV

SEQ ID NO: 263937 - protein, 9 aa, Homo Sapiens
MEPQNAQLV

SEQ ID NO: 263938 - protein, 9 aa, Homo Sapiens
KVKLYDSDK

SEQ ID NO: 263939 - protein, 9 aa, Homo Sapiens
PISKCGDLY

SEQ ID NO: 263940 - protein, 9 aa, Homo Sapiens
ESKDKGISD

SEQ ID NO: 263941 - protein, 9 aa, Homo Sapiens
TLKCSQTMG

SEQ ID NO: 263942 - protein, 9 aa, Homo Sapiens
LPPKPALEA

SEQ ID NO: 263943 - protein, 9 aa, Homo Sapiens
PPPSLYMSP

SEQ ID NO: 263944 - protein, 9 aa, Homo Sapiens
SFSIWSLEL

SEQ ID NO: 263945 - protein, 9 aa, Homo Sapiens
SSKKRFIFL

SEQ ID NO: 263946 - protein, 9 aa, Homo Sapiens
TSIYEIKPF

SEQ ID NO: 263947 - protein, 9 aa, Homo Sapiens
CTIRGCDKS

SEQ ID NO: 263948 - protein, 9 aa, Homo Sapiens
VCCECSLLG

SEQ ID NO: 263949 - protein, 9 aa, Homo Sapiens
DLCFILDKS

SEQ ID NO: 263950 - protein, 9 aa, Homo Sapiens
SDFPFPTRI

SEQ ID NO: 263951 - protein, 9 aa, Homo Sapiens
FDVQKLFLY

SEQ ID NO: 263952 - protein, 9 aa, Homo Sapiens
VSQQCEDID

SEQ ID NO: 263953 - protein, 9 aa, Homo Sapiens
PDPQRCTVD

SEQ ID NO: 263954 - protein, 9 aa, Homo Sapiens
LHLLNDLQA

SEQ ID NO: 263955 - protein, 9 aa, Homo Sapiens
NTAYPREDT

SEQ ID NO: 263956 - protein, 9 aa, Homo Sapiens
RATHPNNKP

SEQ ID NO: 263957 - protein, 9 aa, Homo Sapiens
DLSSDIRKQ

SEQ ID NO: 263958 - protein, 9 aa, Homo Sapiens
SVNSVATKT

SEQ ID NO: 263959 - protein, 9 aa, Homo Sapiens
EQSSKCLSY

SEQ ID NO: 263960 - protein, 9 aa, Homo Sapiens
LVVLEFDFL

SEQ ID NO: 263961 - protein, 9 aa, Homo Sapiens
CDHLKESFF

SEQ ID NO: 263962 - protein, 9 aa, Homo Sapiens
LQPELMILA

SEQ ID NO: 263963 - protein, 9 aa, Homo Sapiens
QEEAPFVIV

SEQ ID NO: 263964 - protein, 9 aa, Homo Sapiens
EGRKHEMLL

SEQ ID NO: 263965 - protein, 9 aa, Homo Sapiens
VQEIICDDE

SEQ ID NO: 263966 - protein, 9 aa, Homo Sapiens
LPKLDEIRD

SEQ ID NO: 263967 - protein, 9 aa, Homo Sapiens
GWGQGAPFI

SEQ ID NO: 263968 - protein, 9 aa, Homo Sapiens
GRYIDQYAA

SEQ ID NO: 263969 - protein, 9 aa, Homo Sapiens
ESLFNTETP

SEQ ID NO: 263970 - protein, 9 aa, Homo Sapiens
VTCGGVKGM

SEQ ID NO: 263971 - protein, 9 aa, Homo Sapiens
IHENIIRKF

SEQ ID NO: 263972 - protein, 9 aa, Homo Sapiens
EKLSETIST

SEQ ID NO: 263973 - protein, 9 aa, Homo Sapiens
IYIDKNKEL

SEQ ID NO: 263974 - protein, 9 aa, Homo Sapiens
NQRTTLIIH

SEQ ID NO: 263975 - protein, 9 aa, Homo Sapiens
TGATNTKKK

SEQ ID NO: 263976 - protein, 9 aa, Homo Sapiens
IEYRTESAL

SEQ ID NO: 263977 - protein, 9 aa, Homo Sapiens
DITNNSDQM

SEQ ID NO: 263978 - protein, 9 aa, Homo Sapiens
WGQNGRAEG

SEQ ID NO: 263979 - protein, 9 aa, Homo Sapiens
CPNYEDKNF

SEQ ID NO: 263980 - protein, 9 aa, Homo Sapiens
YYDEYFNCD

SEQ ID NO: 263981 - protein, 9 aa, Homo Sapiens
EKQLREHMQ

SEQ ID NO: 263982 - protein, 9 aa, Homo Sapiens
YSNSRPCKR

SEQ ID NO: 263983 - protein, 9 aa, Homo Sapiens
NLKNMALFG

SEQ ID NO: 263984 - protein, 9 aa, Homo Sapiens
EGSEYRVKM

SEQ ID NO: 263985 - protein, 9 aa, Homo Sapiens
YLALSQELE

SEQ ID NO: 263986 - protein, 9 aa, Homo Sapiens
WGSIQGLTE

SEQ ID NO: 263987 - protein, 9 aa, Homo Sapiens
AVFDAKQLN

SEQ ID NO: 263988 - protein, 9 aa, Homo Sapiens
AAGSYLNYS

SEQ ID NO: 263989 - protein, 9 aa, Homo Sapiens
ENIYKEFYR

SEQ ID NO: 263990 - protein, 9 aa, Homo Sapiens
SDLSTLSNT

SEQ ID NO: 263991 - protein, 9 aa, Homo Sapiens
IQVNDDDVR

SEQ ID NO: 263992 - protein, 9 aa, Homo Sapiens
SASVFTLVV

SEQ ID NO: 263993 - protein, 9 aa, Homo Sapiens
IEELGGWRT

SEQ ID NO: 263994 - protein, 9 aa, Homo Sapiens
YKHEGVRGL

SEQ ID NO: 263995 - protein, 9 aa, Homo Sapiens
IELISQEPD

SEQ ID NO: 263996 - protein, 9 aa, Homo Sapiens
LDFPFLCLY

SEQ ID NO: 263997 - protein, 9 aa, Homo Sapiens
MKVIKSLQK

SEQ ID NO: 263998 - protein, 9 aa, Homo Sapiens
SLTLPWRTH

SEQ ID NO: 263999 - protein, 9 aa, Homo Sapiens
TIVTSILRI

SEQ ID NO: 264000 - protein, 9 aa, Homo Sapiens
RLLSDAACI

SEQ ID NO: 264001 - protein, 9 aa, Homo Sapiens
NYKFWKHLV

SEQ ID NO: 264002 - protein, 9 aa, Homo Sapiens
ESNGRSTAT

SEQ ID NO: 264003 - protein, 9 aa, Homo Sapiens
AIKQYMHFQ

SEQ ID NO: 264004 - protein, 9 aa, Homo Sapiens
ENTISFAGC

SEQ ID NO: 264005 - protein, 9 aa, Homo Sapiens
NGKEEVINR

SEQ ID NO: 264006 - protein, 9 aa, Homo Sapiens
YHGAWLSPA

SEQ ID NO: 264007 - protein, 9 aa, Homo Sapiens
NELHDKQKF

SEQ ID NO: 264008 - protein, 9 aa, Homo Sapiens
AFYLLKSIW

SEQ ID NO: 264009 - protein, 9 aa, Homo Sapiens
STFSSTQSR

SEQ ID NO: 264010 - protein, 9 aa, Homo Sapiens
SEDSEKKLS

SEQ ID NO: 264011 - protein, 9 aa, Homo Sapiens
YQQLLEECD

SEQ ID NO: 264012 - protein, 9 aa, Homo Sapiens
PGGKMHGNL

SEQ ID NO: 264013 - protein, 9 aa, Homo Sapiens
LLIVHKPSY

SEQ ID NO: 264014 - protein, 9 aa, Homo Sapiens
ETRDYPQNL

SEQ ID NO: 264015 - protein, 9 aa, Homo Sapiens
VNINLSFSY

SEQ ID NO: 264016 - protein, 9 aa, Homo Sapiens
LNSNAIMSI

SEQ ID NO: 264017 - protein, 9 aa, Homo Sapiens
GAIDFVLWC

SEQ ID NO: 264018 - protein, 9 aa, Homo Sapiens
ANAIRRVFC

SEQ ID NO: 264019 - protein, 9 aa, Homo Sapiens
FLRQSIALS

SEQ ID NO: 264020 - protein, 9 aa, Homo Sapiens
VFLASKANF

SEQ ID NO: 264021 - protein, 9 aa, Homo Sapiens
VPVSRSCRV

SEQ ID NO: 264022 - protein, 9 aa, Homo Sapiens
EIKKEPDKP

SEQ ID NO: 264023 - protein, 9 aa, Homo Sapiens
SIAVATLHK

SEQ ID NO: 264024 - protein, 9 aa, Homo Sapiens
SHIMEMWLL

SEQ ID NO: 264025 - protein, 9 aa, Homo Sapiens
VLWVLVFVP

SEQ ID NO: 264026 - protein, 9 aa, Homo Sapiens
HFPFWLWIE

SEQ ID NO: 264027 - protein, 9 aa, Homo Sapiens
TEICPLIAA

SEQ ID NO: 264028 - protein, 9 aa, Homo Sapiens
LNVAPVGDT

SEQ ID NO: 264029 - protein, 9 aa, Homo Sapiens
IQIELDHER

SEQ ID NO: 264030 - protein, 9 aa, Homo Sapiens
ENQTFNERI

SEQ ID NO: 264031 - protein, 9 aa, Homo Sapiens
IWFCIVPPM

SEQ ID NO: 264032 - protein, 9 aa, Homo Sapiens
MIKGAVGDW

SEQ ID NO: 264033 - protein, 9 aa, Homo Sapiens
LFFVLYGGI

SEQ ID NO: 264034 - protein, 9 aa, Homo Sapiens
YVSLSGFVV

SEQ ID NO: 264035 - protein, 9 aa, Homo Sapiens
QNILVDRQA

SEQ ID NO: 264036 - protein, 9 aa, Homo Sapiens
FHFVNDQWI

SEQ ID NO: 264037 - protein, 9 aa, Homo Sapiens
IRLKKKMGG

SEQ ID NO: 264038 - protein, 9 aa, Homo Sapiens
REEAGVPSI

SEQ ID NO: 264039 - protein, 9 aa, Homo Sapiens
PFNVVLLQE

SEQ ID NO: 264040 - protein, 9 aa, Homo Sapiens
GPQSSKGHS

SEQ ID NO: 264041 - protein, 9 aa, Homo Sapiens
TENSENDIT

SEQ ID NO: 264042 - protein, 9 aa, Homo Sapiens
NNPDMVAGE

SEQ ID NO: 264043 - protein, 9 aa, Homo Sapiens
QQGKHSLRN

SEQ ID NO: 264044 - protein, 9 aa, Homo Sapiens
ELNEAAAQF

SEQ ID NO: 264045 - protein, 9 aa, Homo Sapiens
DVAKKGAIC

SEQ ID NO: 264046 - protein, 9 aa, Homo Sapiens
METYQESVR

SEQ ID NO: 264047 - protein, 9 aa, Homo Sapiens
TIYNQEIES

SEQ ID NO: 264048 - protein, 9 aa, Homo Sapiens
PVEAVNKGF

SEQ ID NO: 264049 - protein, 9 aa, Homo Sapiens
KDFMSTVSY

SEQ ID NO: 264050 - protein, 9 aa, Homo Sapiens
AYVSVVLQL

SEQ ID NO: 264051 - protein, 9 aa, Homo Sapiens
VPSTTCHLP

SEQ ID NO: 264052 - protein, 9 aa, Homo Sapiens
QTSNNCNNS

SEQ ID NO: 264053 - protein, 9 aa, Homo Sapiens
ATATVNAMI

SEQ ID NO: 264054 - protein, 9 aa, Homo Sapiens
DSIQDLEIK

SEQ ID NO: 264055 - protein, 9 aa, Homo Sapiens
KHQRVHTAD

SEQ ID NO: 264056 - protein, 9 aa, Homo Sapiens
SNLEALLVQ

SEQ ID NO: 264057 - protein, 9 aa, Homo Sapiens
QKTFTCTRT

SEQ ID NO: 264058 - protein, 9 aa, Homo Sapiens
HKSSLKQVE

SEQ ID NO: 264059 - protein, 9 aa, Homo Sapiens
VNQVLENTA

SEQ ID NO: 264060 - protein, 9 aa, Homo Sapiens
SNAIMSIQE

SEQ ID NO: 264061 - protein, 9 aa, Homo Sapiens
VSSKEPGSA

SEQ ID NO: 264062 - protein, 9 aa, Homo Sapiens
KGLPLLQVQ

SEQ ID NO: 264063 - protein, 9 aa, Homo Sapiens
AEPKSIYKY

SEQ ID NO: 264064 - protein, 9 aa, Homo Sapiens
PHELGEFAM

SEQ ID NO: 264065 - protein, 9 aa, Homo Sapiens
EEGEDVRRI

SEQ ID NO: 264066 - protein, 9 aa, Homo Sapiens
EISGAQRSA

SEQ ID NO: 264067 - protein, 9 aa, Homo Sapiens
FWSQEDKFP

SEQ ID NO: 264068 - protein, 9 aa, Homo Sapiens
KLVVFVYFW

SEQ ID NO: 264069 - protein, 9 aa, Homo Sapiens
WVFGGPPCT

SEQ ID NO: 264070 - protein, 9 aa, Homo Sapiens
QRVAISTLQ

SEQ ID NO: 264071 - protein, 9 aa, Homo Sapiens
STDSAEQIN

SEQ ID NO: 264072 - protein, 9 aa, Homo Sapiens
LTRNRSKGR

SEQ ID NO: 264073 - protein, 9 aa, Homo Sapiens
SVSDYSVPR

SEQ ID NO: 264074 - protein, 9 aa, Homo Sapiens
LLLSKVLSE

SEQ ID NO: 264075 - protein, 9 aa, Homo Sapiens
GPGKSPARG

SEQ ID NO: 264076 - protein, 9 aa, Homo Sapiens
FQSAGIWMI

SEQ ID NO: 264077 - protein, 9 aa, Homo Sapiens
RNRFKHEQI

SEQ ID NO: 264078 - protein, 9 aa, Homo Sapiens
GYDIEARDT

SEQ ID NO: 264079 - protein, 9 aa, Homo Sapiens
RLDLCQRIV

SEQ ID NO: 264080 - protein, 9 aa, Homo Sapiens
DRLLSGSVP

SEQ ID NO: 264081 - protein, 9 aa, Homo Sapiens
WGPPNMQCC

SEQ ID NO: 264082 - protein, 9 aa, Homo Sapiens
TELKLSPFS

SEQ ID NO: 264083 - protein, 9 aa, Homo Sapiens
GPRSHPSAS

SEQ ID NO: 264084 - protein, 9 aa, Homo Sapiens
VWAARWAPC

SEQ ID NO: 264085 - protein, 9 aa, Homo Sapiens
NPRIFLPPG

SEQ ID NO: 264086 - protein, 9 aa, Homo Sapiens
AFYRYAIHS

SEQ ID NO: 264087 - protein, 9 aa, Homo Sapiens
KEKTQRGAG

SEQ ID NO: 264088 - protein, 9 aa, Homo Sapiens
HEFAYTTFE

SEQ ID NO: 264089 - protein, 9 aa, Homo Sapiens
LNEIASEPL

SEQ ID NO: 264090 - protein, 9 aa, Homo Sapiens
KIYRNVEFD

SEQ ID NO: 264091 - protein, 9 aa, Homo Sapiens
NVFVTLLAA

SEQ ID NO: 264092 - protein, 9 aa, Homo Sapiens
DEKIKLGST

SEQ ID NO: 264093 - protein, 9 aa, Homo Sapiens
SPAGRIILN

SEQ ID NO: 264094 - protein, 9 aa, Homo Sapiens
NLEALLVQI

SEQ ID NO: 264095 - protein, 9 aa, Homo Sapiens
CHPKNVPPD

SEQ ID NO: 264096 - protein, 9 aa, Homo Sapiens
VAAKKKDEG

SEQ ID NO: 264097 - protein, 9 aa, Homo Sapiens
PRHKMKVIK

SEQ ID NO: 264098 - protein, 9 aa, Homo Sapiens
QNLQKELDS

SEQ ID NO: 264099 - protein, 9 aa, Homo Sapiens
GGHRGLVNK

SEQ ID NO: 264100 - protein, 9 aa, Homo Sapiens
ERVLITVKQ

SEQ ID NO: 264101 - protein, 9 aa, Homo Sapiens
RINIVSSKK

SEQ ID NO: 264102 - protein, 9 aa, Homo Sapiens
KSDIYLHLL

SEQ ID NO: 264103 - protein, 9 aa, Homo Sapiens
NKKMNREYT

SEQ ID NO: 264104 - protein, 9 aa, Homo Sapiens
MVIYYIDKA

SEQ ID NO: 264105 - protein, 9 aa, Homo Sapiens
ICHHRSHTG

SEQ ID NO: 264106 - protein, 9 aa, Homo Sapiens
ICATRWSST

SEQ ID NO: 264107 - protein, 9 aa, Homo Sapiens
HANEKTLLS

SEQ ID NO: 264108 - protein, 9 aa, Homo Sapiens
ALPMSLLNF

SEQ ID NO: 264109 - protein, 9 aa, Homo Sapiens
RKQNREKGK

SEQ ID NO: 264110 - protein, 9 aa, Homo Sapiens
GLSPFRKQG

SEQ ID NO: 264111 - protein, 9 aa, Homo Sapiens
NKISNLMRK

SEQ ID NO: 264112 - protein, 9 aa, Homo Sapiens
RNFSACGGF

SEQ ID NO: 264113 - protein, 9 aa, Homo Sapiens
TICSLSHQQ

SEQ ID NO: 264114 - protein, 9 aa, Homo Sapiens
HQDYCKVCQ

SEQ ID NO: 264115 - protein, 9 aa, Homo Sapiens
SKPPPVREI

SEQ ID NO: 264116 - protein, 9 aa, Homo Sapiens
EEGYFTCRA

SEQ ID NO: 264117 - protein, 9 aa, Homo Sapiens
KLVDPLCSI

SEQ ID NO: 264118 - protein, 9 aa, Homo Sapiens
TVRRDIAPP

SEQ ID NO: 264119 - protein, 9 aa, Homo Sapiens
AELIMNNTG

SEQ ID NO: 264120 - protein, 9 aa, Homo Sapiens
SELYKLVTG

SEQ ID NO: 264121 - protein, 9 aa, Homo Sapiens
LCYYLPPPE

SEQ ID NO: 264122 - protein, 9 aa, Homo Sapiens
QEESDPSYK

SEQ ID NO: 264123 - protein, 9 aa, Homo Sapiens
GVDEVVKKK

SEQ ID NO: 264124 - protein, 9 aa, Homo Sapiens
ELLSEGESE

SEQ ID NO: 264125 - protein, 9 aa, Homo Sapiens
GLGNPPPPP

SEQ ID NO: 264126 - protein, 9 aa, Homo Sapiens
EKGRKLEEL

SEQ ID NO: 264127 - protein, 9 aa, Homo Sapiens
RVENDYNDL

SEQ ID NO: 264128 - protein, 9 aa, Homo Sapiens
HLQQIRRNI

SEQ ID NO: 264129 - protein, 9 aa, Homo Sapiens
ADLLSRCPR

SEQ ID NO: 264130 - protein, 9 aa, Homo Sapiens
MADRFACTE

SEQ ID NO: 264131 - protein, 9 aa, Homo Sapiens
SPQFYNSEG

SEQ ID NO: 264132 - protein, 9 aa, Homo Sapiens
PIKRNSLIE

SEQ ID NO: 264133 - protein, 9 aa, Homo Sapiens
SWRNHHCAH

SEQ ID NO: 264134 - protein, 9 aa, Homo Sapiens
QLETPGELP

SEQ ID NO: 264135 - protein, 9 aa, Homo Sapiens
SFTMLINNF

SEQ ID NO: 264136 - protein, 9 aa, Homo Sapiens
NKRILNFLT

SEQ ID NO: 264137 - protein, 9 aa, Homo Sapiens
VGNYLSRKM

SEQ ID NO: 264138 - protein, 9 aa, Homo Sapiens
KEVGAVSVA

SEQ ID NO: 264139 - protein, 9 aa, Homo Sapiens
EGYGMSSVP

SEQ ID NO: 264140 - protein, 9 aa, Homo Sapiens
LGDMIRKSG

SEQ ID NO: 264141 - protein, 9 aa, Homo Sapiens
SLCGRTLRN

SEQ ID NO: 264142 - protein, 9 aa, Homo Sapiens
FKDKMENFD

SEQ ID NO: 264143 - protein, 9 aa, Homo Sapiens
RPWIRELML

SEQ ID NO: 264144 - protein, 9 aa, Homo Sapiens
VSTVLPQID

SEQ ID NO: 264145 - protein, 9 aa, Homo Sapiens
ESHLFLTDF

SEQ ID NO: 264146 - protein, 9 aa, Homo Sapiens
KGYFDAHTL

SEQ ID NO: 264147 - protein, 9 aa, Homo Sapiens
VLFRFCVVM

SEQ ID NO: 264148 - protein, 9 aa, Homo Sapiens
VNSQNDLAV

SEQ ID NO: 264149 - protein, 9 aa, Homo Sapiens
SGEVEILDP

SEQ ID NO: 264150 - protein, 9 aa, Homo Sapiens
LINAYKEDP

SEQ ID NO: 264151 - protein, 9 aa, Homo Sapiens
ALVEDKVLC

SEQ ID NO: 264152 - protein, 9 aa, Homo Sapiens
LNKEKSDVG

SEQ ID NO: 264153 - protein, 9 aa, Homo Sapiens
LPSDSGLSD

SEQ ID NO: 264154 - protein, 9 aa, Homo Sapiens
CQRTHFVIS

SEQ ID NO: 264155 - protein, 9 aa, Homo Sapiens
YLVGTPYYM

SEQ ID NO: 264156 - protein, 9 aa, Homo Sapiens
EPKLTPKGA

SEQ ID NO: 264157 - protein, 9 aa, Homo Sapiens
FNALDQLSQ

SEQ ID NO: 264158 - protein, 9 aa, Homo Sapiens
TPNKYELQY

SEQ ID NO: 264159 - protein, 9 aa, Homo Sapiens
LDLKTNVVR

SEQ ID NO: 264160 - protein, 9 aa, Homo Sapiens
TSPVIQRLQ

SEQ ID NO: 264161 - protein, 9 aa, Homo Sapiens
RKEETCTPM

SEQ ID NO: 264162 - protein, 9 aa, Homo Sapiens
SQHENIFPS

SEQ ID NO: 264163 - protein, 9 aa, Homo Sapiens
ANTLIEDSG

SEQ ID NO: 264164 - protein, 9 aa, Homo Sapiens
NLTQHKIIH

SEQ ID NO: 264165 - protein, 9 aa, Homo Sapiens
WNWLNFTVI

SEQ ID NO: 264166 - protein, 9 aa, Homo Sapiens
IIDQGLTCR

SEQ ID NO: 264167 - protein, 9 aa, Homo Sapiens
STRDGKVYI

SEQ ID NO: 264168 - protein, 9 aa, Homo Sapiens
RHALATRYL

SEQ ID NO: 264169 - protein, 9 aa, Homo Sapiens
MPDLRAEEI

SEQ ID NO: 264170 - protein, 9 aa, Homo Sapiens
ESTVRTVNN

SEQ ID NO: 264171 - protein, 9 aa, Homo Sapiens
IENVYAEGF

SEQ ID NO: 264172 - protein, 9 aa, Homo Sapiens
IMHCKAGQS

SEQ ID NO: 264173 - protein, 9 aa, Homo Sapiens
GVCEGVGWH

SEQ ID NO: 264174 - protein, 9 aa, Homo Sapiens
IAAGYRHFD

SEQ ID NO: 264175 - protein, 9 aa, Homo Sapiens
YNVNSHGCQ

SEQ ID NO: 264176 - protein, 9 aa, Homo Sapiens
SDYLEKAMS

SEQ ID NO: 264177 - protein, 9 aa, Homo Sapiens
MDDNNNRTL

SEQ ID NO: 264178 - protein, 9 aa, Homo Sapiens
SQVGHEFSW

SEQ ID NO: 264179 - protein, 9 aa, Homo Sapiens
TIPFSECMI

SEQ ID NO: 264180 - protein, 9 aa, Homo Sapiens
VSAATASGD

SEQ ID NO: 264181 - protein, 9 aa, Homo Sapiens
INKNLIDRE

SEQ ID NO: 264182 - protein, 9 aa, Homo Sapiens
FRSNYPFPS

SEQ ID NO: 264183 - protein, 9 aa, Homo Sapiens
RASYLDIYQ

SEQ ID NO: 264184 - protein, 9 aa, Homo Sapiens
VKHKLQAHI

SEQ ID NO: 264185 - protein, 9 aa, Homo Sapiens
QRAVLNEPL

SEQ ID NO: 264186 - protein, 9 aa, Homo Sapiens
ICIACFYGR

SEQ ID NO: 264187 - protein, 9 aa, Homo Sapiens
PWDGEKGFK

SEQ ID NO: 264188 - protein, 9 aa, Homo Sapiens
NMSKKTVYC

SEQ ID NO: 264189 - protein, 9 aa, Homo Sapiens
LIGLENFLL

SEQ ID NO: 264190 - protein, 9 aa, Homo Sapiens
DNINFQFKT

SEQ ID NO: 264191 - protein, 9 aa, Homo Sapiens
LMTIVLLLL

SEQ ID NO: 264192 - protein, 9 aa, Homo Sapiens
LWVGKLVDS

SEQ ID NO: 264193 - protein, 9 aa, Homo Sapiens
RLSKLPKAE

SEQ ID NO: 264194 - protein, 9 aa, Homo Sapiens
AHIEWAKDK

SEQ ID NO: 264195 - protein, 9 aa, Homo Sapiens
DYIHIIIQQ

SEQ ID NO: 264196 - protein, 9 aa, Homo Sapiens
LSPSLSNKD

SEQ ID NO: 264197 - protein, 9 aa, Homo Sapiens
PCVLSSPRK

SEQ ID NO: 264198 - protein, 9 aa, Homo Sapiens
GWQHNRKQA

SEQ ID NO: 264199 - protein, 9 aa, Homo Sapiens
GRSECFLLS

SEQ ID NO: 264200 - protein, 9 aa, Homo Sapiens
DMHGEKYKP

SEQ ID NO: 264201 - protein, 9 aa, Homo Sapiens
GSIYFTTSK

SEQ ID NO: 264202 - protein, 9 aa, Homo Sapiens
KYRRGPHVP

SEQ ID NO: 264203 - protein, 9 aa, Homo Sapiens
CSGVTGAMH

SEQ ID NO: 264204 - protein, 9 aa, Homo Sapiens
VLTGQPFNT

SEQ ID NO: 264205 - protein, 9 aa, Homo Sapiens
RGVQKLGCW

SEQ ID NO: 264206 - protein, 9 aa, Homo Sapiens
VANDAPHFL

SEQ ID NO: 264207 - protein, 9 aa, Homo Sapiens
KCASCILNN

SEQ ID NO: 264208 - protein, 9 aa, Homo Sapiens
FYGFKHIFI

SEQ ID NO: 264209 - protein, 9 aa, Homo Sapiens
LSERVLITV

SEQ ID NO: 264210 - protein, 9 aa, Homo Sapiens
PPRPPQGRS

SEQ ID NO: 264211 - protein, 9 aa, Homo Sapiens
YKQVRKSLE

SEQ ID NO: 264212 - protein, 9 aa, Homo Sapiens
MLIDIARKP

SEQ ID NO: 264213 - protein, 9 aa, Homo Sapiens
WELGIPLYG

SEQ ID NO: 264214 - protein, 9 aa, Homo Sapiens
IQQLLNKIN

SEQ ID NO: 264215 - protein, 9 aa, Homo Sapiens
PKPASPKNN

SEQ ID NO: 264216 - protein, 9 aa, Homo Sapiens
KGNVQNIHT

SEQ ID NO: 264217 - protein, 9 aa, Homo Sapiens
SPSPMRIDS

SEQ ID NO: 264218 - protein, 9 aa, Homo Sapiens
YQYLLPGRV

SEQ ID NO: 264219 - protein, 9 aa, Homo Sapiens
PRGPRERRE

SEQ ID NO: 264220 - protein, 9 aa, Homo Sapiens
YTIGDLGHA

SEQ ID NO: 264221 - protein, 9 aa, Homo Sapiens
EDGHSLSDY

SEQ ID NO: 264222 - protein, 9 aa, Homo Sapiens
RWARQRQPP

SEQ ID NO: 264223 - protein, 9 aa, Homo Sapiens
LYIILKTLL

SEQ ID NO: 264224 - protein, 9 aa, Homo Sapiens
SERSPEDPT

SEQ ID NO: 264225 - protein, 9 aa, Homo Sapiens
QENEDKHAR

SEQ ID NO: 264226 - protein, 9 aa, Homo Sapiens
ILGFGEDKL

SEQ ID NO: 264227 - protein, 9 aa, Homo Sapiens
EVGRCSGDK

SEQ ID NO: 264228 - protein, 9 aa, Homo Sapiens
ADEGIFEIK

SEQ ID NO: 264229 - protein, 9 aa, Homo Sapiens
QKCLKGAAA

SEQ ID NO: 264230 - protein, 9 aa, Homo Sapiens
FTKFKEYVD

SEQ ID NO: 264231 - protein, 9 aa, Homo Sapiens
HGGYSAFAG

SEQ ID NO: 264232 - protein, 9 aa, Homo Sapiens
EPRPYRPKP

SEQ ID NO: 264233 - protein, 9 aa, Homo Sapiens
KFNKIPLYL

SEQ ID NO: 264234 - protein, 9 aa, Homo Sapiens
SPIINVKND

SEQ ID NO: 264235 - protein, 9 aa, Homo Sapiens
NAIENAKQY

SEQ ID NO: 264236 - protein, 9 aa, Homo Sapiens
FHIFSGYLH

SEQ ID NO: 264237 - protein, 9 aa, Homo Sapiens
SPAAGSPQK

SEQ ID NO: 264238 - protein, 9 aa, Homo Sapiens
NQARDDYKT

SEQ ID NO: 264239 - protein, 9 aa, Homo Sapiens
LDVDTKAAV

SEQ ID NO: 264240 - protein, 9 aa, Homo Sapiens
SRNLTCRAL

SEQ ID NO: 264241 - protein, 9 aa, Homo Sapiens
VVHQQTHTG

SEQ ID NO: 264242 - protein, 9 aa, Homo Sapiens
LSESMNDRN

SEQ ID NO: 264243 - protein, 9 aa, Homo Sapiens
NSLNANFNT

SEQ ID NO: 264244 - protein, 9 aa, Homo Sapiens
EYNFVFPSK

SEQ ID NO: 264245 - protein, 9 aa, Homo Sapiens
HYAALSGLE

SEQ ID NO: 264246 - protein, 9 aa, Homo Sapiens
WDGKALSFT

SEQ ID NO: 264247 - protein, 9 aa, Homo Sapiens
PPICSSLQA

SEQ ID NO: 264248 - protein, 9 aa, Homo Sapiens
MLFMGLACS

SEQ ID NO: 264249 - protein, 9 aa, Homo Sapiens
ITGLLECEV

SEQ ID NO: 264250 - protein, 9 aa, Homo Sapiens
QLSVDYLLE

SEQ ID NO: 264251 - protein, 9 aa, Homo Sapiens
RIMLRIPNV

SEQ ID NO: 264252 - protein, 9 aa, Homo Sapiens
EQEYKEKGR

SEQ ID NO: 264253 - protein, 9 aa, Homo Sapiens
QSYPASGHT

SEQ ID NO: 264254 - protein, 9 aa, Homo Sapiens
QDPDAPPQN

SEQ ID NO: 264255 - protein, 9 aa, Homo Sapiens
LFERKSSEL

SEQ ID NO: 264256 - protein, 9 aa, Homo Sapiens
LCAIVGVSV

SEQ ID NO: 264257 - protein, 9 aa, Homo Sapiens
SAANIALMN

SEQ ID NO: 264258 - protein, 9 aa, Homo Sapiens
DILGITQAS

SEQ ID NO: 264259 - protein, 9 aa, Homo Sapiens
SNFDKELLN

SEQ ID NO: 264260 - protein, 9 aa, Homo Sapiens
NLFSTNNSS

SEQ ID NO: 264261 - protein, 9 aa, Homo Sapiens
RVTADIYLA

SEQ ID NO: 264262 - protein, 9 aa, Homo Sapiens
ASVQWFECT

SEQ ID NO: 264263 - protein, 9 aa, Homo Sapiens
TPYGIKSFD

SEQ ID NO: 264264 - protein, 9 aa, Homo Sapiens
IQNGNFRKK

SEQ ID NO: 264265 - protein, 9 aa, Homo Sapiens
GAHIEWAKD

SEQ ID NO: 264266 - protein, 9 aa, Homo Sapiens
PLCDNHFHA

SEQ ID NO: 264267 - protein, 9 aa, Homo Sapiens
DNVNQALHY

SEQ ID NO: 264268 - protein, 9 aa, Homo Sapiens
CMVTSVQEE

SEQ ID NO: 264269 - protein, 9 aa, Homo Sapiens
TSNKKLFSL

SEQ ID NO: 264270 - protein, 9 aa, Homo Sapiens
LQFDLCKHI

SEQ ID NO: 264271 - protein, 9 aa, Homo Sapiens
NCMWLQVLE

SEQ ID NO: 264272 - protein, 9 aa, Homo Sapiens
YIHILQAAF

SEQ ID NO: 264273 - protein, 9 aa, Homo Sapiens
IHTEDKPLS

SEQ ID NO: 264274 - protein, 9 aa, Homo Sapiens
SPILVQGRI

SEQ ID NO: 264275 - protein, 9 aa, Homo Sapiens
APFSSSWVK

SEQ ID NO: 264276 - protein, 9 aa, Homo Sapiens
DGEFWTAFK

SEQ ID NO: 264277 - protein, 9 aa, Homo Sapiens
KVKEMFDAE

SEQ ID NO: 264278 - protein, 9 aa, Homo Sapiens
QNPKSRGKS

SEQ ID NO: 264279 - protein, 9 aa, Homo Sapiens
DDRCKMKNN

SEQ ID NO: 264280 - protein, 9 aa, Homo Sapiens
VSFPHNGPS

SEQ ID NO: 264281 - protein, 9 aa, Homo Sapiens
FYLSVMALD

SEQ ID NO: 264282 - protein, 9 aa, Homo Sapiens
RQQNPQRKA

SEQ ID NO: 264283 - protein, 9 aa, Homo Sapiens
FRTVLVNVD

SEQ ID NO: 264284 - protein, 9 aa, Homo Sapiens
IGYPYRDKI

SEQ ID NO: 264285 - protein, 9 aa, Homo Sapiens
LVDIFVSSV

SEQ ID NO: 264286 - protein, 9 aa, Homo Sapiens
NVETCPAET

SEQ ID NO: 264287 - protein, 9 aa, Homo Sapiens
QSACCQPTC

SEQ ID NO: 264288 - protein, 9 aa, Homo Sapiens
QNIPKSSST

SEQ ID NO: 264289 - protein, 9 aa, Homo Sapiens
VRQHHRYLS

SEQ ID NO: 264290 - protein, 9 aa, Homo Sapiens
VLPEVEVAL

SEQ ID NO: 264291 - protein, 9 aa, Homo Sapiens
KEDTEAAIR

SEQ ID NO: 264292 - protein, 9 aa, Homo Sapiens
REKSQRLES

SEQ ID NO: 264293 - protein, 9 aa, Homo Sapiens
EEEDRALPD

SEQ ID NO: 264294 - protein, 9 aa, Homo Sapiens
EWLALYSTR

SEQ ID NO: 264295 - protein, 9 aa, Homo Sapiens
RWNFDKFLV

SEQ ID NO: 264296 - protein, 9 aa, Homo Sapiens
EVPCFDIWH

SEQ ID NO: 264297 - protein, 9 aa, Homo Sapiens
EHHFTQMQE

SEQ ID NO: 264298 - protein, 9 aa, Homo Sapiens
RPLKDRVNL

SEQ ID NO: 264299 - protein, 9 aa, Homo Sapiens
RFGQMQQVQ

SEQ ID NO: 264300 - protein, 9 aa, Homo Sapiens
MEGMLFPPV

SEQ ID NO: 264301 - protein, 9 aa, Homo Sapiens
INVCNAPHW

SEQ ID NO: 264302 - protein, 9 aa, Homo Sapiens
INNMKTQFK

SEQ ID NO: 264303 - protein, 9 aa, Homo Sapiens
TKFKEYVDG

SEQ ID NO: 264304 - protein, 9 aa, Homo Sapiens
LLDWLFSFL

SEQ ID NO: 264305 - protein, 9 aa, Homo Sapiens
GHSKCVGIL

SEQ ID NO: 264306 - protein, 9 aa, Homo Sapiens
SLETQPPGR

SEQ ID NO: 264307 - protein, 9 aa, Homo Sapiens
SSKIEEACK

SEQ ID NO: 264308 - protein, 9 aa, Homo Sapiens
YAETEGTLI

SEQ ID NO: 264309 - protein, 9 aa, Homo Sapiens
VFVNPYQEL

SEQ ID NO: 264310 - protein, 9 aa, Homo Sapiens
QSAGIWMIN

SEQ ID NO: 264311 - protein, 9 aa, Homo Sapiens
DVDCYLTEV

SEQ ID NO: 264312 - protein, 9 aa, Homo Sapiens
PKSSSTQQD

SEQ ID NO: 264313 - protein, 9 aa, Homo Sapiens
KPLAVPPGY

SEQ ID NO: 264314 - protein, 9 aa, Homo Sapiens
NACDLPEWC

SEQ ID NO: 264315 - protein, 9 aa, Homo Sapiens
AIVAVIARF

SEQ ID NO: 264316 - protein, 9 aa, Homo Sapiens
LAMDSFPSH

SEQ ID NO: 264317 - protein, 9 aa, Homo Sapiens
LHTLWVESD

SEQ ID NO: 264318 - protein, 9 aa, Homo Sapiens
WEEAECQAK

SEQ ID NO: 264319 - protein, 9 aa, Homo Sapiens
LAQKYNCGF

SEQ ID NO: 264320 - protein, 9 aa, Homo Sapiens
KSETKEISW

SEQ ID NO: 264321 - protein, 9 aa, Homo Sapiens
QVLQILLKL

SEQ ID NO: 264322 - protein, 9 aa, Homo Sapiens
CCHKGPKKV

SEQ ID NO: 264323 - protein, 9 aa, Homo Sapiens
DAHSDYAHY

SEQ ID NO: 264324 - protein, 9 aa, Homo Sapiens
TSDKPYYCT

SEQ ID NO: 264325 - protein, 9 aa, Homo Sapiens
ADSGTLARA

SEQ ID NO: 264326 - protein, 9 aa, Homo Sapiens
NKGNQGRIG

SEQ ID NO: 264327 - protein, 9 aa, Homo Sapiens
QNKSKSLSY

SEQ ID NO: 264328 - protein, 9 aa, Homo Sapiens
VVDFGKTSS

SEQ ID NO: 264329 - protein, 9 aa, Homo Sapiens
IRTGFMLRL

SEQ ID NO: 264330 - protein, 9 aa, Homo Sapiens
CKIWVQGDW

SEQ ID NO: 264331 - protein, 9 aa, Homo Sapiens
HAGIDTDPE

SEQ ID NO: 264332 - protein, 9 aa, Homo Sapiens
QLESISSGS

SEQ ID NO: 264333 - protein, 9 aa, Homo Sapiens
GMLNQTLLE

SEQ ID NO: 264334 - protein, 9 aa, Homo Sapiens
EAEFQMKEF

SEQ ID NO: 264335 - protein, 9 aa, Homo Sapiens
TPGVDHVPS

SEQ ID NO: 264336 - protein, 9 aa, Homo Sapiens
IHASFIVAR

SEQ ID NO: 264337 - protein, 9 aa, Homo Sapiens
PLPLGHIKQ

SEQ ID NO: 264338 - protein, 9 aa, Homo Sapiens
YNFRMFFTS

SEQ ID NO: 264339 - protein, 9 aa, Homo Sapiens
QMIYKLPEL

SEQ ID NO: 264340 - protein, 9 aa, Homo Sapiens
EEVKGQETF

SEQ ID NO: 264341 - protein, 9 aa, Homo Sapiens
YGLGNPPPP

SEQ ID NO: 264342 - protein, 9 aa, Homo Sapiens
TKQEMKKAG

SEQ ID NO: 264343 - protein, 9 aa, Homo Sapiens
PTSGLWTVP

SEQ ID NO: 264344 - protein, 9 aa, Homo Sapiens
FIMSVKNNY

SEQ ID NO: 264345 - protein, 9 aa, Homo Sapiens
HDAEINKII

SEQ ID NO: 264346 - protein, 9 aa, Homo Sapiens
CKQEIEDRL

SEQ ID NO: 264347 - protein, 9 aa, Homo Sapiens
ACDQADLSL

SEQ ID NO: 264348 - protein, 9 aa, Homo Sapiens
PDNLRVMVS

SEQ ID NO: 264349 - protein, 9 aa, Homo Sapiens
WADDGKAIL

SEQ ID NO: 264350 - protein, 9 aa, Homo Sapiens
FPAPEQFKT

SEQ ID NO: 264351 - protein, 9 aa, Homo Sapiens
EFYLRQPSP

SEQ ID NO: 264352 - protein, 9 aa, Homo Sapiens
RFVFMATPN

SEQ ID NO: 264353 - protein, 9 aa, Homo Sapiens
HLCCEFLTG

SEQ ID NO: 264354 - protein, 9 aa, Homo Sapiens
VLVNVDGEE

SEQ ID NO: 264355 - protein, 9 aa, Homo Sapiens
HYSPSDEKT

SEQ ID NO: 264356 - protein, 9 aa, Homo Sapiens
GLCTFGFYE

SEQ ID NO: 264357 - protein, 9 aa, Homo Sapiens
TKICHVDAH

SEQ ID NO: 264358 - protein, 9 aa, Homo Sapiens
SPNSYYELY

SEQ ID NO: 264359 - protein, 9 aa, Homo Sapiens
VLNCNLFIF

SEQ ID NO: 264360 - protein, 9 aa, Homo Sapiens
EGFVTEMCM

SEQ ID NO: 264361 - protein, 9 aa, Homo Sapiens
KEITKDREY

SEQ ID NO: 264362 - protein, 9 aa, Homo Sapiens
LPTCSRLTS

SEQ ID NO: 264363 - protein, 9 aa, Homo Sapiens
PQYYKKPIQ

SEQ ID NO: 264364 - protein, 9 aa, Homo Sapiens
HTEAVWAAR

SEQ ID NO: 264365 - protein, 9 aa, Homo Sapiens
LAAFTLRTQ

SEQ ID NO: 264366 - protein, 9 aa, Homo Sapiens
QLEKYLYFY

SEQ ID NO: 264367 - protein, 9 aa, Homo Sapiens
KRTVSTVLP

SEQ ID NO: 264368 - protein, 9 aa, Homo Sapiens
SHSGKAMRK

SEQ ID NO: 264369 - protein, 9 aa, Homo Sapiens
VDLWIVGCI

SEQ ID NO: 264370 - protein, 9 aa, Homo Sapiens
ASSQSSSVD

SEQ ID NO: 264371 - protein, 9 aa, Homo Sapiens
SEGEAKKDS

SEQ ID NO: 264372 - protein, 9 aa, Homo Sapiens
NSYTWGISW

SEQ ID NO: 264373 - protein, 9 aa, Homo Sapiens
NLILQFLAA

SEQ ID NO: 264374 - protein, 9 aa, Homo Sapiens
NRAKAGYNV

SEQ ID NO: 264375 - protein, 9 aa, Homo Sapiens
FLAVSSQDA

SEQ ID NO: 264376 - protein, 9 aa, Homo Sapiens
AAVRAANIV

SEQ ID NO: 264377 - protein, 9 aa, Homo Sapiens
SMSYYFDRG

SEQ ID NO: 264378 - protein, 9 aa, Homo Sapiens
IKIILIVVA

SEQ ID NO: 264379 - protein, 9 aa, Homo Sapiens
AKHQGPQEQ

SEQ ID NO: 264380 - protein, 9 aa, Homo Sapiens
SELCGLPRD

SEQ ID NO: 264381 - protein, 9 aa, Homo Sapiens
GRDKKLGET

SEQ ID NO: 264382 - protein, 9 aa, Homo Sapiens
VRPDDWSQG

SEQ ID NO: 264383 - protein, 9 aa, Homo Sapiens
GGGDNTDSQ

SEQ ID NO: 264384 - protein, 9 aa, Homo Sapiens
PLAQQMNHL

SEQ ID NO: 264385 - protein, 9 aa, Homo Sapiens
SKLQLDLSI

SEQ ID NO: 264386 - protein, 9 aa, Homo Sapiens
GEDEGSGAE

SEQ ID NO: 264387 - protein, 9 aa, Homo Sapiens
RIKALRSRI

SEQ ID NO: 264388 - protein, 9 aa, Homo Sapiens
KTSKRARPP

SEQ ID NO: 264389 - protein, 9 aa, Homo Sapiens
TSYEQLKEK

SEQ ID NO: 264390 - protein, 9 aa, Homo Sapiens
ALPTLSAHI

SEQ ID NO: 264391 - protein, 9 aa, Homo Sapiens
KKRAKELEA

SEQ ID NO: 264392 - protein, 9 aa, Homo Sapiens
LAECWAALL

SEQ ID NO: 264393 - protein, 9 aa, Homo Sapiens
VLSEVVMQV

SEQ ID NO: 264394 - protein, 9 aa, Homo Sapiens
RPLTDRGKK

SEQ ID NO: 264395 - protein, 9 aa, Homo Sapiens
NDLNQCLRT

SEQ ID NO: 264396 - protein, 9 aa, Homo Sapiens
QLVRDAMEE

SEQ ID NO: 264397 - protein, 9 aa, Homo Sapiens
LQINKLYVT

SEQ ID NO: 264398 - protein, 9 aa, Homo Sapiens
RVVERLAKA

SEQ ID NO: 264399 - protein, 9 aa, Homo Sapiens
YFVDKAAAW

SEQ ID NO: 264400 - protein, 9 aa, Homo Sapiens
FSPDDKYSL

SEQ ID NO: 264401 - protein, 9 aa, Homo Sapiens
YASAHLTEP

SEQ ID NO: 264402 - protein, 9 aa, Homo Sapiens
NNLGFTPAD

SEQ ID NO: 264403 - protein, 9 aa, Homo Sapiens
ESCEVNVDD

SEQ ID NO: 264404 - protein, 9 aa, Homo Sapiens
EQDIATYRS

SEQ ID NO: 264405 - protein, 9 aa, Homo Sapiens
QIIHAGEAS

SEQ ID NO: 264406 - protein, 9 aa, Homo Sapiens
KTFIRAPQM

SEQ ID NO: 264407 - protein, 9 aa, Homo Sapiens
RPYTCDECG

SEQ ID NO: 264408 - protein, 9 aa, Homo Sapiens
SGNLSPIDA

SEQ ID NO: 264409 - protein, 9 aa, Homo Sapiens
YHTRPHTQV

SEQ ID NO: 264410 - protein, 9 aa, Homo Sapiens
TARECLVKC

SEQ ID NO: 264411 - protein, 9 aa, Homo Sapiens
WINRCQNRD

SEQ ID NO: 264412 - protein, 9 aa, Homo Sapiens
RWMRDNVPG

SEQ ID NO: 264413 - protein, 9 aa, Homo Sapiens
EFGGSACFT

SEQ ID NO: 264414 - protein, 9 aa, Homo Sapiens
EGPKAHISK

SEQ ID NO: 264415 - protein, 9 aa, Homo Sapiens
SQMAAAGGT

SEQ ID NO: 264416 - protein, 9 aa, Homo Sapiens
IHFDPENPQ

SEQ ID NO: 264417 - protein, 9 aa, Homo Sapiens
LKTQETAKE

SEQ ID NO: 264418 - protein, 9 aa, Homo Sapiens
LFDLNSVVC

SEQ ID NO: 264419 - protein, 9 aa, Homo Sapiens
SAQVMKPPL

SEQ ID NO: 264420 - protein, 9 aa, Homo Sapiens
SDSGTCQIP

SEQ ID NO: 264421 - protein, 9 aa, Homo Sapiens
TRVLGVYLL

SEQ ID NO: 264422 - protein, 9 aa, Homo Sapiens
QVVLGVCAG

SEQ ID NO: 264423 - protein, 9 aa, Homo Sapiens
MSSDKISIK

SEQ ID NO: 264424 - protein, 9 aa, Homo Sapiens
VGRDKFKRL

SEQ ID NO: 264425 - protein, 9 aa, Homo Sapiens
ENGKARANN

SEQ ID NO: 264426 - protein, 9 aa, Homo Sapiens
ELPEIPESI

SEQ ID NO: 264427 - protein, 9 aa, Homo Sapiens
RNVLTAFSQ

SEQ ID NO: 264428 - protein, 9 aa, Homo Sapiens
VADTLDNSR

SEQ ID NO: 264429 - protein, 9 aa, Homo Sapiens
SRRLVKEAA

SEQ ID NO: 264430 - protein, 9 aa, Homo Sapiens
THQVQEKDY

SEQ ID NO: 264431 - protein, 9 aa, Homo Sapiens
CAPKKIPSL

SEQ ID NO: 264432 - protein, 9 aa, Homo Sapiens
IRDAPTLES

SEQ ID NO: 264433 - protein, 9 aa, Homo Sapiens
CETPKSSGK

SEQ ID NO: 264434 - protein, 9 aa, Homo Sapiens
ISINNYHPK

SEQ ID NO: 264435 - protein, 9 aa, Homo Sapiens
RLKPALRKG

SEQ ID NO: 264436 - protein, 9 aa, Homo Sapiens
MRTKQLREI

SEQ ID NO: 264437 - protein, 9 aa, Homo Sapiens
FFMLHSLSL

SEQ ID NO: 264438 - protein, 9 aa, Homo Sapiens
TEPLENQFK

SEQ ID NO: 264439 - protein, 9 aa, Homo Sapiens
KLETICYLA

SEQ ID NO: 264440 - protein, 9 aa, Homo Sapiens
GLKNGSFSG

SEQ ID NO: 264441 - protein, 9 aa, Homo Sapiens
HLHEYMGMC

SEQ ID NO: 264442 - protein, 9 aa, Homo Sapiens
VGLAQSLAS

SEQ ID NO: 264443 - protein, 9 aa, Homo Sapiens
NGGLTCTIV

SEQ ID NO: 264444 - protein, 9 aa, Homo Sapiens
RQRIAQVLS

SEQ ID NO: 264445 - protein, 9 aa, Homo Sapiens
NYAKFKKMC

SEQ ID NO: 264446 - protein, 9 aa, Homo Sapiens
CDNAKKGRK

SEQ ID NO: 264447 - protein, 9 aa, Homo Sapiens
AYSRVLAGG

SEQ ID NO: 264448 - protein, 9 aa, Homo Sapiens
GEHHRGIGL

SEQ ID NO: 264449 - protein, 9 aa, Homo Sapiens
YYLLQSFQK

SEQ ID NO: 264450 - protein, 9 aa, Homo Sapiens
GQVIKPSLI

SEQ ID NO: 264451 - protein, 9 aa, Homo Sapiens
KQEGMAGLL

SEQ ID NO: 264452 - protein, 9 aa, Homo Sapiens
VHSTDKGPS

SEQ ID NO: 264453 - protein, 9 aa, Homo Sapiens
VKNVCQLES

SEQ ID NO: 264454 - protein, 9 aa, Homo Sapiens
LEKKLEREQ

SEQ ID NO: 264455 - protein, 9 aa, Homo Sapiens
GGGLENLGS

SEQ ID NO: 264456 - protein, 9 aa, Homo Sapiens
FFCSSGTLP

SEQ ID NO: 264457 - protein, 9 aa, Homo Sapiens
HLPVEPNNH

SEQ ID NO: 264458 - protein, 9 aa, Homo Sapiens
NGLLLALAP

SEQ ID NO: 264459 - protein, 9 aa, Homo Sapiens
DEIRDEGKA

SEQ ID NO: 264460 - protein, 9 aa, Homo Sapiens
KPPPVREIP

SEQ ID NO: 264461 - protein, 9 aa, Homo Sapiens
ISIKMRLEK

SEQ ID NO: 264462 - protein, 9 aa, Homo Sapiens
LNPRKCMAA

SEQ ID NO: 264463 - protein, 9 aa, Homo Sapiens
KLGLFGVWA

SEQ ID NO: 264464 - protein, 9 aa, Homo Sapiens
QNPTAEEIL

SEQ ID NO: 264465 - protein, 9 aa, Homo Sapiens
NLKYMLESE

SEQ ID NO: 264466 - protein, 9 aa, Homo Sapiens
ILKGLTHQP

SEQ ID NO: 264467 - protein, 9 aa, Homo Sapiens
DKMKGQMLG

SEQ ID NO: 264468 - protein, 9 aa, Homo Sapiens
TQISEHVFL

SEQ ID NO: 264469 - protein, 9 aa, Homo Sapiens
SSLAFALAV

SEQ ID NO: 264470 - protein, 9 aa, Homo Sapiens
NSHTETSKS

SEQ ID NO: 264471 - protein, 9 aa, Homo Sapiens
IEHAGANYL

SEQ ID NO: 264472 - protein, 9 aa, Homo Sapiens
RRRLVQKRK

SEQ ID NO: 264473 - protein, 9 aa, Homo Sapiens
KTTAAHYLV

SEQ ID NO: 264474 - protein, 9 aa, Homo Sapiens
ANYLTRCQD

SEQ ID NO: 264475 - protein, 9 aa, Homo Sapiens
WNQIFSKNE

SEQ ID NO: 264476 - protein, 9 aa, Homo Sapiens
RAIIIINGE

SEQ ID NO: 264477 - protein, 9 aa, Homo Sapiens
HSQAPDGMQ

SEQ ID NO: 264478 - protein, 9 aa, Homo Sapiens
QALTVKFLT

SEQ ID NO: 264479 - protein, 9 aa, Homo Sapiens
PDKVLKFGM

SEQ ID NO: 264480 - protein, 9 aa, Homo Sapiens
QVTKPYLDI

SEQ ID NO: 264481 - protein, 9 aa, Homo Sapiens
PVRGEEPMF

SEQ ID NO: 264482 - protein, 9 aa, Homo Sapiens
DKMQDRLDI

SEQ ID NO: 264483 - protein, 9 aa, Homo Sapiens
DSVELAVEA

SEQ ID NO: 264484 - protein, 9 aa, Homo Sapiens
EEPHNDNLY

SEQ ID NO: 264485 - protein, 9 aa, Homo Sapiens
NHFVIDIQK

SEQ ID NO: 264486 - protein, 9 aa, Homo Sapiens
RVEKANEAV

SEQ ID NO: 264487 - protein, 9 aa, Homo Sapiens
YGVGTPIGY

SEQ ID NO: 264488 - protein, 9 aa, Homo Sapiens
NITPAGTSL

SEQ ID NO: 264489 - protein, 9 aa, Homo Sapiens
GDSKEIVRW

SEQ ID NO: 264490 - protein, 9 aa, Homo Sapiens
NPLPLVPVQ

SEQ ID NO: 264491 - protein, 9 aa, Homo Sapiens
HKLIRKSTF

SEQ ID NO: 264492 - protein, 9 aa, Homo Sapiens
SKHLPDVHK

SEQ ID NO: 264493 - protein, 9 aa, Homo Sapiens
VKLLYIVAE

SEQ ID NO: 264494 - protein, 9 aa, Homo Sapiens
STTLGKLMP

SEQ ID NO: 264495 - protein, 9 aa, Homo Sapiens
CRTIKKQRK

SEQ ID NO: 264496 - protein, 9 aa, Homo Sapiens
AGALETETK

SEQ ID NO: 264497 - protein, 9 aa, Homo Sapiens
RWKRSSKEL

SEQ ID NO: 264498 - protein, 9 aa, Homo Sapiens
KIERDAQEM

SEQ ID NO: 264499 - protein, 9 aa, Homo Sapiens
RKPGMCAAL

SEQ ID NO: 264500 - protein, 9 aa, Homo Sapiens
FLENAIGKP

SEQ ID NO: 264501 - protein, 9 aa, Homo Sapiens
ISAYQRLAG

SEQ ID NO: 264502 - protein, 9 aa, Homo Sapiens
CLVVLEFDF

SEQ ID NO: 264503 - protein, 9 aa, Homo Sapiens
ESNESAEYS

SEQ ID NO: 264504 - protein, 9 aa, Homo Sapiens
PVINGRYLQ

SEQ ID NO: 264505 - protein, 9 aa, Homo Sapiens
SFLDLCFTM

SEQ ID NO: 264506 - protein, 9 aa, Homo Sapiens
MLSVSTPQT

SEQ ID NO: 264507 - protein, 9 aa, Homo Sapiens
CQARFLQGF

SEQ ID NO: 264508 - protein, 9 aa, Homo Sapiens
KNRGFGFVY

SEQ ID NO: 264509 - protein, 9 aa, Homo Sapiens
TVALNCAIR

SEQ ID NO: 264510 - protein, 9 aa, Homo Sapiens
IHNRIHTGE

SEQ ID NO: 264511 - protein, 9 aa, Homo Sapiens
DSANMTDDI

SEQ ID NO: 264512 - protein, 9 aa, Homo Sapiens
KILFARGED

SEQ ID NO: 264513 - protein, 9 aa, Homo Sapiens
NPKWPNAYF

SEQ ID NO: 264514 - protein, 9 aa, Homo Sapiens
LKIDEVYKV

SEQ ID NO: 264515 - protein, 9 aa, Homo Sapiens
IIHLSIHQR

SEQ ID NO: 264516 - protein, 9 aa, Homo Sapiens
DGRYVSNDD

SEQ ID NO: 264517 - protein, 9 aa, Homo Sapiens
CLWRPQGAF

SEQ ID NO: 264518 - protein, 9 aa, Homo Sapiens
NIGMETLSH

SEQ ID NO: 264519 - protein, 9 aa, Homo Sapiens
TPEKDMMVY

SEQ ID NO: 264520 - protein, 9 aa, Homo Sapiens
NKKTSIKMW

SEQ ID NO: 264521 - protein, 9 aa, Homo Sapiens
RLIGLENFL

SEQ ID NO: 264522 - protein, 9 aa, Homo Sapiens
GAEAPESST

SEQ ID NO: 264523 - protein, 9 aa, Homo Sapiens
RNTSQEEGS

SEQ ID NO: 264524 - protein, 9 aa, Homo Sapiens
GTLSGTAEP

SEQ ID NO: 264525 - protein, 9 aa, Homo Sapiens
RIGRLTDEG

SEQ ID NO: 264526 - protein, 9 aa, Homo Sapiens
LKKFASVQG

SEQ ID NO: 264527 - protein, 9 aa, Homo Sapiens
ETYISCPLI

SEQ ID NO: 264528 - protein, 9 aa, Homo Sapiens
EVTELYVQN

SEQ ID NO: 264529 - protein, 9 aa, Homo Sapiens
SIIHQDETW

SEQ ID NO: 264530 - protein, 9 aa, Homo Sapiens
DLCLVAVHE

SEQ ID NO: 264531 - protein, 9 aa, Homo Sapiens
TFPEFLGFK

SEQ ID NO: 264532 - protein, 9 aa, Homo Sapiens
HILLVGDPG

SEQ ID NO: 264533 - protein, 9 aa, Homo Sapiens
AVAEFIILG

SEQ ID NO: 264534 - protein, 9 aa, Homo Sapiens
WRGLHILGL

SEQ ID NO: 264535 - protein, 9 aa, Homo Sapiens
YGGVCHAGI

SEQ ID NO: 264536 - protein, 9 aa, Homo Sapiens
SYLGMGPQH

SEQ ID NO: 264537 - protein, 9 aa, Homo Sapiens
HLWKHGIPF

SEQ ID NO: 264538 - protein, 9 aa, Homo Sapiens
GTETGLLSA

SEQ ID NO: 264539 - protein, 9 aa, Homo Sapiens
LTGQCNFGS

SEQ ID NO: 264540 - protein, 9 aa, Homo Sapiens
ESNTSRHTS

SEQ ID NO: 264541 - protein, 9 aa, Homo Sapiens
QEYFSLNNW

SEQ ID NO: 264542 - protein, 9 aa, Homo Sapiens
TPPSPFRNS

SEQ ID NO: 264543 - protein, 9 aa, Homo Sapiens
WISQMELLP

SEQ ID NO: 264544 - protein, 9 aa, Homo Sapiens
NNSANPIIY

SEQ ID NO: 264545 - protein, 9 aa, Homo Sapiens
AYPCRSYTY

SEQ ID NO: 264546 - protein, 9 aa, Homo Sapiens
QSRSMNDIY

SEQ ID NO: 264547 - protein, 9 aa, Homo Sapiens
PSYLDKVLN

SEQ ID NO: 264548 - protein, 9 aa, Homo Sapiens
SRSRSQLSE

SEQ ID NO: 264549 - protein, 9 aa, Homo Sapiens
QSLTYALAR

SEQ ID NO: 264550 - protein, 9 aa, Homo Sapiens
NFGSKEDAT

SEQ ID NO: 264551 - protein, 9 aa, Homo Sapiens
GEEPMFVVT

SEQ ID NO: 264552 - protein, 9 aa, Homo Sapiens
LVIGYILEK

SEQ ID NO: 264553 - protein, 9 aa, Homo Sapiens
YIEKEGIKY

SEQ ID NO: 264554 - protein, 9 aa, Homo Sapiens
DADPEVCKT

SEQ ID NO: 264555 - protein, 9 aa, Homo Sapiens
DFEHSDVDG

SEQ ID NO: 264556 - protein, 9 aa, Homo Sapiens
FKRKKEDFI

SEQ ID NO: 264557 - protein, 9 aa, Homo Sapiens
AKPKKKTEV

SEQ ID NO: 264558 - protein, 9 aa, Homo Sapiens
KCSHFQSEI

SEQ ID NO: 264559 - protein, 9 aa, Homo Sapiens
KEGLHDLEH

SEQ ID NO: 264560 - protein, 9 aa, Homo Sapiens
LDYLLLGLL

SEQ ID NO: 264561 - protein, 9 aa, Homo Sapiens
YLFFALWIP

SEQ ID NO: 264562 - protein, 9 aa, Homo Sapiens
RIALSEHRK

SEQ ID NO: 264563 - protein, 9 aa, Homo Sapiens
QKWTGDVEE

SEQ ID NO: 264564 - protein, 9 aa, Homo Sapiens
IVEAEDIYK

SEQ ID NO: 264565 - protein, 9 aa, Homo Sapiens
RLRGENFQC

SEQ ID NO: 264566 - protein, 9 aa, Homo Sapiens
YQEETTELG

SEQ ID NO: 264567 - protein, 9 aa, Homo Sapiens
EETCTPMPS

SEQ ID NO: 264568 - protein, 9 aa, Homo Sapiens
QEVKTLVGF

SEQ ID NO: 264569 - protein, 9 aa, Homo Sapiens
ATRYLLPCS

SEQ ID NO: 264570 - protein, 9 aa, Homo Sapiens
VNYHPPQFG

SEQ ID NO: 264571 - protein, 9 aa, Homo Sapiens
TAIVIRCKD

SEQ ID NO: 264572 - protein, 9 aa, Homo Sapiens
YIGKLHSDQ

SEQ ID NO: 264573 - protein, 9 aa, Homo Sapiens
HGLWTWRYQ

SEQ ID NO: 264574 - protein, 9 aa, Homo Sapiens
LEDGTLIVV

SEQ ID NO: 264575 - protein, 9 aa, Homo Sapiens
NTKLEFSVY

SEQ ID NO: 264576 - protein, 9 aa, Homo Sapiens
ETSNCRKVP

SEQ ID NO: 264577 - protein, 9 aa, Homo Sapiens
QPSEFVILG

SEQ ID NO: 264578 - protein, 9 aa, Homo Sapiens
NELWNKYKD

SEQ ID NO: 264579 - protein, 9 aa, Homo Sapiens
TKSYKDSWD

SEQ ID NO: 264580 - protein, 9 aa, Homo Sapiens
LNTTILCVG

SEQ ID NO: 264581 - protein, 9 aa, Homo Sapiens
PPLSAIPSV

SEQ ID NO: 264582 - protein, 9 aa, Homo Sapiens
GYCNNESGS

SEQ ID NO: 264583 - protein, 9 aa, Homo Sapiens
GTVYSISSL

SEQ ID NO: 264584 - protein, 9 aa, Homo Sapiens
PFQTDNLPE

SEQ ID NO: 264585 - protein, 9 aa, Homo Sapiens
LVKVVAVTF

SEQ ID NO: 264586 - protein, 9 aa, Homo Sapiens
LCKRSPAAL

SEQ ID NO: 264587 - protein, 9 aa, Homo Sapiens
GILDKVLAH

SEQ ID NO: 264588 - protein, 9 aa, Homo Sapiens
SKNELHYLS

SEQ ID NO: 264589 - protein, 9 aa, Homo Sapiens
YNYPVPIRD

SEQ ID NO: 264590 - protein, 9 aa, Homo Sapiens
MVWEQNVYA

SEQ ID NO: 264591 - protein, 9 aa, Homo Sapiens
KDDVPVENY

SEQ ID NO: 264592 - protein, 9 aa, Homo Sapiens
ITLELIKGT

SEQ ID NO: 264593 - protein, 9 aa, Homo Sapiens
KLPSGMEIY

SEQ ID NO: 264594 - protein, 9 aa, Homo Sapiens
QINEAKIAE

SEQ ID NO: 264595 - protein, 9 aa, Homo Sapiens
LLLDVNEDG

SEQ ID NO: 264596 - protein, 9 aa, Homo Sapiens
QVSQLLCLE

SEQ ID NO: 264597 - protein, 9 aa, Homo Sapiens
RTGFMLRLF

SEQ ID NO: 264598 - protein, 9 aa, Homo Sapiens
HGPDKDKHF

SEQ ID NO: 264599 - protein, 9 aa, Homo Sapiens
TEAAIRSIL

SEQ ID NO: 264600 - protein, 9 aa, Homo Sapiens
GSNMKNMNQ

SEQ ID NO: 264601 - protein, 9 aa, Homo Sapiens
GSMITKIWW

SEQ ID NO: 264602 - protein, 9 aa, Homo Sapiens
VERIHVNLE

SEQ ID NO: 264603 - protein, 9 aa, Homo Sapiens
WDEASFQTE

SEQ ID NO: 264604 - protein, 9 aa, Homo Sapiens
IATCNHSLL

SEQ ID NO: 264605 - protein, 9 aa, Homo Sapiens
VLGLEIKEE

SEQ ID NO: 264606 - protein, 9 aa, Homo Sapiens
TEMQLMAIF

SEQ ID NO: 264607 - protein, 9 aa, Homo Sapiens
SHDIDLIIY

SEQ ID NO: 264608 - protein, 9 aa, Homo Sapiens
ELETLLETQ

SEQ ID NO: 264609 - protein, 9 aa, Homo Sapiens
QPENAASPD

SEQ ID NO: 264610 - protein, 9 aa, Homo Sapiens
QTEDVKPYQ

SEQ ID NO: 264611 - protein, 9 aa, Homo Sapiens
QVLENTAEG

SEQ ID NO: 264612 - protein, 9 aa, Homo Sapiens
VHFLDSKLV

SEQ ID NO: 264613 - protein, 9 aa, Homo Sapiens
IDSGGGNIK

SEQ ID NO: 264614 - protein, 9 aa, Homo Sapiens
NQHSSETYA

SEQ ID NO: 264615 - protein, 9 aa, Homo Sapiens
SYYYTDNHA

SEQ ID NO: 264616 - protein, 9 aa, Homo Sapiens
GIDKFMKDL

SEQ ID NO: 264617 - protein, 9 aa, Homo Sapiens
GFLCRDISI

SEQ ID NO: 264618 - protein, 9 aa, Homo Sapiens
SKNSFGQRV

SEQ ID NO: 264619 - protein, 9 aa, Homo Sapiens
RGVYSFWFH

SEQ ID NO: 264620 - protein, 9 aa, Homo Sapiens
RVPQLIFKK

SEQ ID NO: 264621 - protein, 9 aa, Homo Sapiens
LEEMEQANF

SEQ ID NO: 264622 - protein, 9 aa, Homo Sapiens
NAGQKKHAL

SEQ ID NO: 264623 - protein, 9 aa, Homo Sapiens
ETNLKCKMS

SEQ ID NO: 264624 - protein, 9 aa, Homo Sapiens
HQLALQVLD

SEQ ID NO: 264625 - protein, 9 aa, Homo Sapiens
LCETPKSSG

SEQ ID NO: 264626 - protein, 9 aa, Homo Sapiens
PLAYLWQKN

SEQ ID NO: 264627 - protein, 9 aa, Homo Sapiens
HIMHTRENL

SEQ ID NO: 264628 - protein, 9 aa, Homo Sapiens
MSSKEVKAA

SEQ ID NO: 264629 - protein, 9 aa, Homo Sapiens
LRASLERVS

SEQ ID NO: 264630 - protein, 9 aa, Homo Sapiens
IILDIATKR

SEQ ID NO: 264631 - protein, 9 aa, Homo Sapiens
AQVHPGESN

SEQ ID NO: 264632 - protein, 9 aa, Homo Sapiens
QIIHSREKP

SEQ ID NO: 264633 - protein, 9 aa, Homo Sapiens
PNHVCNASD

SEQ ID NO: 264634 - protein, 9 aa, Homo Sapiens
QAFYSLKSL

SEQ ID NO: 264635 - protein, 9 aa, Homo Sapiens
ERIMQGAPE

SEQ ID NO: 264636 - protein, 9 aa, Homo Sapiens
YSKVSFWKQ

SEQ ID NO: 264637 - protein, 9 aa, Homo Sapiens
KRLRSSKKR

SEQ ID NO: 264638 - protein, 9 aa, Homo Sapiens
TINTESTLK

SEQ ID NO: 264639 - protein, 9 aa, Homo Sapiens
GGDVGSLAL

SEQ ID NO: 264640 - protein, 9 aa, Homo Sapiens
QKCIKLKQV

SEQ ID NO: 264641 - protein, 9 aa, Homo Sapiens
ENKLEENPY

SEQ ID NO: 264642 - protein, 9 aa, Homo Sapiens
KLFRNLKER

SEQ ID NO: 264643 - protein, 9 aa, Homo Sapiens
AKINKGGLN

SEQ ID NO: 264644 - protein, 9 aa, Homo Sapiens
RVLKISDGV

SEQ ID NO: 264645 - protein, 9 aa, Homo Sapiens
TQMIYKLPE

SEQ ID NO: 264646 - protein, 9 aa, Homo Sapiens
SVDLQGDSF

SEQ ID NO: 264647 - protein, 9 aa, Homo Sapiens
PSISHNKMN

SEQ ID NO: 264648 - protein, 9 aa, Homo Sapiens
FTSTQENKH

SEQ ID NO: 264649 - protein, 9 aa, Homo Sapiens
KFKYPSVAV

SEQ ID NO: 264650 - protein, 9 aa, Homo Sapiens
LTPKGACAT

SEQ ID NO: 264651 - protein, 9 aa, Homo Sapiens
MQTHATRMR

SEQ ID NO: 264652 - protein, 9 aa, Homo Sapiens
VCDHSWALG

SEQ ID NO: 264653 - protein, 9 aa, Homo Sapiens
GQRSHFQHV

SEQ ID NO: 264654 - protein, 9 aa, Homo Sapiens
DEIKLCQEN

SEQ ID NO: 264655 - protein, 9 aa, Homo Sapiens
AFQDGDKLG

SEQ ID NO: 264656 - protein, 9 aa, Homo Sapiens
TVYYVPCIL

SEQ ID NO: 264657 - protein, 9 aa, Homo Sapiens
GMLASYQSY

SEQ ID NO: 264658 - protein, 9 aa, Homo Sapiens
RVVLNMQFL

SEQ ID NO: 264659 - protein, 9 aa, Homo Sapiens
LTLDFATYL

SEQ ID NO: 264660 - protein, 9 aa, Homo Sapiens
QRGRKKRVP

SEQ ID NO: 264661 - protein, 9 aa, Homo Sapiens
QTILTEMYR

SEQ ID NO: 264662 - protein, 9 aa, Homo Sapiens
DSLSTGIAD

SEQ ID NO: 264663 - protein, 9 aa, Homo Sapiens
VMATKYGPV

SEQ ID NO: 264664 - protein, 9 aa, Homo Sapiens
TVALNADIA

SEQ ID NO: 264665 - protein, 9 aa, Homo Sapiens
GRIKDFMST

SEQ ID NO: 264666 - protein, 9 aa, Homo Sapiens
EFWTAFKDF

SEQ ID NO: 264667 - protein, 9 aa, Homo Sapiens
QILQEMRKI

SEQ ID NO: 264668 - protein, 9 aa, Homo Sapiens
IGLYEKRMQ

SEQ ID NO: 264669 - protein, 9 aa, Homo Sapiens
DGKALSFTE

SEQ ID NO: 264670 - protein, 9 aa, Homo Sapiens
CNKAYRWLS

SEQ ID NO: 264671 - protein, 9 aa, Homo Sapiens
TDMRTKHFV

SEQ ID NO: 264672 - protein, 9 aa, Homo Sapiens
QEEKGKVDK

SEQ ID NO: 264673 - protein, 9 aa, Homo Sapiens
TVKQYPKFN

SEQ ID NO: 264674 - protein, 9 aa, Homo Sapiens
EIVRWRTKQ

SEQ ID NO: 264675 - protein, 9 aa, Homo Sapiens
NMQCCLCAS

SEQ ID NO: 264676 - protein, 9 aa, Homo Sapiens
SLQSHKKLE

SEQ ID NO: 264677 - protein, 9 aa, Homo Sapiens
LKYRHRQVP

SEQ ID NO: 264678 - protein, 9 aa, Homo Sapiens
TYRLDPGGQ

SEQ ID NO: 264679 - protein, 9 aa, Homo Sapiens
TCSIAVDIS

SEQ ID NO: 264680 - protein, 9 aa, Homo Sapiens
PVTKLQHFN

SEQ ID NO: 264681 - protein, 9 aa, Homo Sapiens
PPLVDNSAE

SEQ ID NO: 264682 - protein, 9 aa, Homo Sapiens
MINGTVITE

SEQ ID NO: 264683 - protein, 9 aa, Homo Sapiens
KTCNSFLTL

SEQ ID NO: 264684 - protein, 9 aa, Homo Sapiens
VFDEADQMF

SEQ ID NO: 264685 - protein, 9 aa, Homo Sapiens
RKTKTTVER

SEQ ID NO: 264686 - protein, 9 aa, Homo Sapiens
SFEKDKHSI

SEQ ID NO: 264687 - protein, 9 aa, Homo Sapiens
LDAELDNDI

SEQ ID NO: 264688 - protein, 9 aa, Homo Sapiens
SQVVHAKEK

SEQ ID NO: 264689 - protein, 9 aa, Homo Sapiens
RSSADLQIR

SEQ ID NO: 264690 - protein, 9 aa, Homo Sapiens
KNQATDFQF

SEQ ID NO: 264691 - protein, 9 aa, Homo Sapiens
KRVYFGRCS

SEQ ID NO: 264692 - protein, 9 aa, Homo Sapiens
DCFHAVNKA

SEQ ID NO: 264693 - protein, 9 aa, Homo Sapiens
RRSFSKQAT

SEQ ID NO: 264694 - protein, 9 aa, Homo Sapiens
TGSMLQLTF

SEQ ID NO: 264695 - protein, 9 aa, Homo Sapiens
RLASVIPAS

SEQ ID NO: 264696 - protein, 9 aa, Homo Sapiens
VNSERVKRI

SEQ ID NO: 264697 - protein, 9 aa, Homo Sapiens
PGPTQSPLF

SEQ ID NO: 264698 - protein, 9 aa, Homo Sapiens
HFQEAIYFI

SEQ ID NO: 264699 - protein, 9 aa, Homo Sapiens
EGGTTSVSS

SEQ ID NO: 264700 - protein, 9 aa, Homo Sapiens
DNDGSGAES

SEQ ID NO: 264701 - protein, 9 aa, Homo Sapiens
TFSLAVPIF

SEQ ID NO: 264702 - protein, 9 aa, Homo Sapiens
TKQLREIIW

SEQ ID NO: 264703 - protein, 9 aa, Homo Sapiens
FHIASQKNV

SEQ ID NO: 264704 - protein, 9 aa, Homo Sapiens
KLSDCIFIW

SEQ ID NO: 264705 - protein, 9 aa, Homo Sapiens
QATGFQLNE

SEQ ID NO: 264706 - protein, 9 aa, Homo Sapiens
RMNKLMELT

SEQ ID NO: 264707 - protein, 9 aa, Homo Sapiens
NFEMQPIHE

SEQ ID NO: 264708 - protein, 9 aa, Homo Sapiens
FMNLLAMSL

SEQ ID NO: 264709 - protein, 9 aa, Homo Sapiens
TGIGLGSIA

SEQ ID NO: 264710 - protein, 9 aa, Homo Sapiens
STGRHKALS

SEQ ID NO: 264711 - protein, 9 aa, Homo Sapiens
YMPTHLAPY

SEQ ID NO: 264712 - protein, 9 aa, Homo Sapiens
EGILRYFLS

SEQ ID NO: 264713 - protein, 9 aa, Homo Sapiens
NQFGTPQDS

SEQ ID NO: 264714 - protein, 9 aa, Homo Sapiens
ENSGSKVLV

SEQ ID NO: 264715 - protein, 9 aa, Homo Sapiens
CDDYVFIEF

SEQ ID NO: 264716 - protein, 9 aa, Homo Sapiens
YEDVHWHKS

SEQ ID NO: 264717 - protein, 9 aa, Homo Sapiens
LLLIAGGNV

SEQ ID NO: 264718 - protein, 9 aa, Homo Sapiens
QKPKKSVNA

SEQ ID NO: 264719 - protein, 9 aa, Homo Sapiens
QSPLFTFEL

SEQ ID NO: 264720 - protein, 9 aa, Homo Sapiens
AALDEGRQK

SEQ ID NO: 264721 - protein, 9 aa, Homo Sapiens
ERSDCERMN

SEQ ID NO: 264722 - protein, 9 aa, Homo Sapiens
MMDGATSSF

SEQ ID NO: 264723 - protein, 9 aa, Homo Sapiens
VQDQDKQLQ

SEQ ID NO: 264724 - protein, 9 aa, Homo Sapiens
GLSLDNFIP

SEQ ID NO: 264725 - protein, 9 aa, Homo Sapiens
DGKFLHLSK

SEQ ID NO: 264726 - protein, 9 aa, Homo Sapiens
DTKFRDLFL

SEQ ID NO: 264727 - protein, 8 aa, Homo Sapiens
RKKTRLDG

SEQ ID NO: 264728 - protein, 9 aa, Homo Sapiens
QQVAARIID

SEQ ID NO: 264729 - protein, 9 aa, Homo Sapiens
SLQEYVIEK

SEQ ID NO: 264730 - protein, 9 aa, Homo Sapiens
KCYKCPPHS

SEQ ID NO: 264731 - protein, 9 aa, Homo Sapiens
FSQRAVSDA

SEQ ID NO: 264732 - protein, 9 aa, Homo Sapiens
NVCSQRGLV

SEQ ID NO: 264733 - protein, 9 aa, Homo Sapiens
IKHVQTVQQ

SEQ ID NO: 264734 - protein, 9 aa, Homo Sapiens
GGINRHQGK

SEQ ID NO: 264735 - protein, 9 aa, Homo Sapiens
RAAPHRIRL

SEQ ID NO: 264736 - protein, 9 aa, Homo Sapiens
KLPSVLLFR

SEQ ID NO: 264737 - protein, 9 aa, Homo Sapiens
GKTPFYAES

SEQ ID NO: 264738 - protein, 9 aa, Homo Sapiens
NMLSVALSQ

SEQ ID NO: 264739 - protein, 9 aa, Homo Sapiens
EFIDFSDTE

SEQ ID NO: 264740 - protein, 9 aa, Homo Sapiens
SEKCCLTEC

SEQ ID NO: 264741 - protein, 9 aa, Homo Sapiens
LPDNEFKKQ

SEQ ID NO: 264742 - protein, 9 aa, Homo Sapiens
IFAFTLPFC

SEQ ID NO: 264743 - protein, 9 aa, Homo Sapiens
LNYKYFSKE

SEQ ID NO: 264744 - protein, 9 aa, Homo Sapiens
SCWPLPEYR

SEQ ID NO: 264745 - protein, 9 aa, Homo Sapiens
NKRNISFSG

SEQ ID NO: 264746 - protein, 9 aa, Homo Sapiens
VTVLKECIR

SEQ ID NO: 264747 - protein, 9 aa, Homo Sapiens
SLKIRKGMR

SEQ ID NO: 264748 - protein, 9 aa, Homo Sapiens
PQTSNNCNN

SEQ ID NO: 264749 - protein, 9 aa, Homo Sapiens
KQQLLSYAI

SEQ ID NO: 264750 - protein, 9 aa, Homo Sapiens
HRFCVEKGT

SEQ ID NO: 264751 - protein, 9 aa, Homo Sapiens
EVFQPMLIE

SEQ ID NO: 264752 - protein, 9 aa, Homo Sapiens
GRGVCMYHT

SEQ ID NO: 264753 - protein, 9 aa, Homo Sapiens
ELSAFLEQQ

SEQ ID NO: 264754 - protein, 9 aa, Homo Sapiens
QIQISSKTG

SEQ ID NO: 264755 - protein, 9 aa, Homo Sapiens
SSLTKYMTG

SEQ ID NO: 264756 - protein, 9 aa, Homo Sapiens
VDGAHCLRL

SEQ ID NO: 264757 - protein, 9 aa, Homo Sapiens
TYGNIYNFP

SEQ ID NO: 264758 - protein, 9 aa, Homo Sapiens
KPRFHEVPI

SEQ ID NO: 264759 - protein, 9 aa, Homo Sapiens
EVLQETLKY

SEQ ID NO: 264760 - protein, 9 aa, Homo Sapiens
QFILYAYWI

SEQ ID NO: 264761 - protein, 9 aa, Homo Sapiens
EQEQSSKCL

SEQ ID NO: 264762 - protein, 9 aa, Homo Sapiens
ASLILTSQI

SEQ ID NO: 264763 - protein, 9 aa, Homo Sapiens
KVVGPLLFC

SEQ ID NO: 264764 - protein, 9 aa, Homo Sapiens
CNWKMGHTM

SEQ ID NO: 264765 - protein, 9 aa, Homo Sapiens
MHHHQAPSG

SEQ ID NO: 264766 - protein, 9 aa, Homo Sapiens
SFQPDVYAF

SEQ ID NO: 264767 - protein, 9 aa, Homo Sapiens
IPSVVSSGD

SEQ ID NO: 264768 - protein, 9 aa, Homo Sapiens
QELKYLFRD

SEQ ID NO: 264769 - protein, 9 aa, Homo Sapiens
CKLDPGQFI

SEQ ID NO: 264770 - protein, 9 aa, Homo Sapiens
VDEVMGCFS

SEQ ID NO: 264771 - protein, 9 aa, Homo Sapiens
QRNCGAWSK

SEQ ID NO: 264772 - protein, 9 aa, Homo Sapiens
AAWKACCHP

SEQ ID NO: 264773 - protein, 9 aa, Homo Sapiens
MLRASSLFQ

SEQ ID NO: 264774 - protein, 9 aa, Homo Sapiens
RLIPHGPMP

SEQ ID NO: 264775 - protein, 9 aa, Homo Sapiens
EDSFLKSYF

SEQ ID NO: 264776 - protein, 9 aa, Homo Sapiens
NIIRKFSAK

SEQ ID NO: 264777 - protein, 9 aa, Homo Sapiens
RKKDCKQVI

SEQ ID NO: 264778 - protein, 9 aa, Homo Sapiens
NPEPSTYIQ

SEQ ID NO: 264779 - protein, 9 aa, Homo Sapiens
GKAFRYLSS

SEQ ID NO: 264780 - protein, 9 aa, Homo Sapiens
QGHFLIVPF

SEQ ID NO: 264781 - protein, 9 aa, Homo Sapiens
VVCTTGWLA

SEQ ID NO: 264782 - protein, 9 aa, Homo Sapiens
RGLISRASR

SEQ ID NO: 264783 - protein, 9 aa, Homo Sapiens
DHFQIHTGI

SEQ ID NO: 264784 - protein, 9 aa, Homo Sapiens
RTHKERSTY

SEQ ID NO: 264785 - protein, 9 aa, Homo Sapiens
LRDINKDRN

SEQ ID NO: 264786 - protein, 9 aa, Homo Sapiens
YFFFFFGRS

SEQ ID NO: 264787 - protein, 9 aa, Homo Sapiens
MSPQELASF

SEQ ID NO: 264788 - protein, 9 aa, Homo Sapiens
ITLYFNFVE

SEQ ID NO: 264789 - protein, 9 aa, Homo Sapiens
RSSTQLQGC

SEQ ID NO: 264790 - protein, 9 aa, Homo Sapiens
APMTLLEFE

SEQ ID NO: 264791 - protein, 9 aa, Homo Sapiens
KEAGALETE

SEQ ID NO: 264792 - protein, 9 aa, Homo Sapiens
LRHLFSIAA

SEQ ID NO: 264793 - protein, 9 aa, Homo Sapiens
DINGILERG

SEQ ID NO: 264794 - protein, 9 aa, Homo Sapiens
LSAHNAANQ

SEQ ID NO: 264795 - protein, 9 aa, Homo Sapiens
MVCLGTFFI

SEQ ID NO: 264796 - protein, 9 aa, Homo Sapiens
MRSKMPLKD

SEQ ID NO: 264797 - protein, 9 aa, Homo Sapiens
GTTCINGEY

SEQ ID NO: 264798 - protein, 9 aa, Homo Sapiens
KEEIDLLNG

SEQ ID NO: 264799 - protein, 9 aa, Homo Sapiens
DQVWNILRS

SEQ ID NO: 264800 - protein, 9 aa, Homo Sapiens
NPAPHLHFS

SEQ ID NO: 264801 - protein, 9 aa, Homo Sapiens
SDKISIKLV

SEQ ID NO: 264802 - protein, 9 aa, Homo Sapiens
NTINVPPEE

SEQ ID NO: 264803 - protein, 9 aa, Homo Sapiens
GFLVIGYIL

SEQ ID NO: 264804 - protein, 9 aa, Homo Sapiens
PSVVSASLA

SEQ ID NO: 264805 - protein, 9 aa, Homo Sapiens
SQDPTMYLA

SEQ ID NO: 264806 - protein, 9 aa, Homo Sapiens
LSQDSSSSA

SEQ ID NO: 264807 - protein, 9 aa, Homo Sapiens
FIQWFKKLF

SEQ ID NO: 264808 - protein, 9 aa, Homo Sapiens
LFLSQKARR

SEQ ID NO: 264809 - protein, 9 aa, Homo Sapiens
AAVLLLCGG

SEQ ID NO: 264810 - protein, 9 aa, Homo Sapiens
VEVFGKLKN

SEQ ID NO: 264811 - protein, 9 aa, Homo Sapiens
VLEDVRNGI

SEQ ID NO: 264812 - protein, 9 aa, Homo Sapiens
IDERGPSPL

SEQ ID NO: 264813 - protein, 9 aa, Homo Sapiens
NNFKDLMPK

SEQ ID NO: 264814 - protein, 9 aa, Homo Sapiens
KEENSKVMD

SEQ ID NO: 264815 - protein, 9 aa, Homo Sapiens
PLIAGYITY

SEQ ID NO: 264816 - protein, 9 aa, Homo Sapiens
IVDGKMMTI

SEQ ID NO: 264817 - protein, 9 aa, Homo Sapiens
SPDLINFGR

SEQ ID NO: 264818 - protein, 9 aa, Homo Sapiens
HDKLFELIL

SEQ ID NO: 264819 - protein, 9 aa, Homo Sapiens
KQLREIIWS

SEQ ID NO: 264820 - protein, 9 aa, Homo Sapiens
YFIDCVREK

SEQ ID NO: 264821 - protein, 9 aa, Homo Sapiens
SKLWNNRTR

SEQ ID NO: 264822 - protein, 9 aa, Homo Sapiens
GYSLLTCKI

SEQ ID NO: 264823 - protein, 9 aa, Homo Sapiens
EIMLVRSSF

SEQ ID NO: 264824 - protein, 9 aa, Homo Sapiens
QMFEELRLV

SEQ ID NO: 264825 - protein, 9 aa, Homo Sapiens
GNHQITLFV

SEQ ID NO: 264826 - protein, 9 aa, Homo Sapiens
WNTSTCELV

SEQ ID NO: 264827 - protein, 9 aa, Homo Sapiens
PVPDKEPNS

SEQ ID NO: 264828 - protein, 9 aa, Homo Sapiens
MKEYFKERD

SEQ ID NO: 264829 - protein, 9 aa, Homo Sapiens
LGQSEGNGG

SEQ ID NO: 264830 - protein, 9 aa, Homo Sapiens
PELPLISLS

SEQ ID NO: 264831 - protein, 9 aa, Homo Sapiens
QACPRMDDE

SEQ ID NO: 264832 - protein, 9 aa, Homo Sapiens
TIRGIYIHA

SEQ ID NO: 264833 - protein, 9 aa, Homo Sapiens
ANIILPSNT

SEQ ID NO: 264834 - protein, 9 aa, Homo Sapiens
PPPLSAIPS

SEQ ID NO: 264835 - protein, 9 aa, Homo Sapiens
SYQWDVPED

SEQ ID NO: 264836 - protein, 9 aa, Homo Sapiens
HKRIHTGDK

SEQ ID NO: 264837 - protein, 9 aa, Homo Sapiens
GRGGLALTL

SEQ ID NO: 264838 - protein, 9 aa, Homo Sapiens
SENLQEIKK

SEQ ID NO: 264839 - protein, 9 aa, Homo Sapiens
PSQPRYSWE

SEQ ID NO: 264840 - protein, 9 aa, Homo Sapiens
SEKLSLVNT

SEQ ID NO: 264841 - protein, 9 aa, Homo Sapiens
IAAIVIGTV

SEQ ID NO: 264842 - protein, 9 aa, Homo Sapiens
SQKVTTNPH

SEQ ID NO: 264843 - protein, 9 aa, Homo Sapiens
LSQPSEFVI

SEQ ID NO: 264844 - protein, 9 aa, Homo Sapiens
NGYYTKCKC

SEQ ID NO: 264845 - protein, 9 aa, Homo Sapiens
QGTSGPDLT

SEQ ID NO: 264846 - protein, 9 aa, Homo Sapiens
PVLSYYYTD

SEQ ID NO: 264847 - protein, 9 aa, Homo Sapiens
KPPASFKST

SEQ ID NO: 264848 - protein, 9 aa, Homo Sapiens
KKEITKDRE

SEQ ID NO: 264849 - protein, 9 aa, Homo Sapiens
WLTVHKNGG

SEQ ID NO: 264850 - protein, 9 aa, Homo Sapiens
VSATLSYGT

SEQ ID NO: 264851 - protein, 9 aa, Homo Sapiens
PYVPYEQGA

SEQ ID NO: 264852 - protein, 9 aa, Homo Sapiens
NREMRANEK

SEQ ID NO: 264853 - protein, 9 aa, Homo Sapiens
ELDLRRNIQ

SEQ ID NO: 264854 - protein, 9 aa, Homo Sapiens
GQMQQVQTH

SEQ ID NO: 264855 - protein, 9 aa, Homo Sapiens
LYKKRPVQI

SEQ ID NO: 264856 - protein, 9 aa, Homo Sapiens
SYILTSNRV

SEQ ID NO: 264857 - protein, 9 aa, Homo Sapiens
TSVYAEDAP

SEQ ID NO: 264858 - protein, 9 aa, Homo Sapiens
VFILMLVLY

SEQ ID NO: 264859 - protein, 9 aa, Homo Sapiens
GLRRWGCYP

SEQ ID NO: 264860 - protein, 9 aa, Homo Sapiens
IWVSAKDCV

SEQ ID NO: 264861 - protein, 9 aa, Homo Sapiens
IVYLPECFN

SEQ ID NO: 264862 - protein, 9 aa, Homo Sapiens
INTMVNNLS

SEQ ID NO: 264863 - protein, 9 aa, Homo Sapiens
NWRTEIIED

SEQ ID NO: 264864 - protein, 9 aa, Homo Sapiens
YLTNMEGNI

SEQ ID NO: 264865 - protein, 9 aa, Homo Sapiens
SHELKVHDM

SEQ ID NO: 264866 - protein, 9 aa, Homo Sapiens
APLEIVLKL

SEQ ID NO: 264867 - protein, 9 aa, Homo Sapiens
IKRKDLSLN

SEQ ID NO: 264868 - protein, 9 aa, Homo Sapiens
NSAILENAN

SEQ ID NO: 264869 - protein, 9 aa, Homo Sapiens
QVKYSRLSS

SEQ ID NO: 264870 - protein, 9 aa, Homo Sapiens
INARRRIIP

SEQ ID NO: 264871 - protein, 9 aa, Homo Sapiens
FSDRATKNT

SEQ ID NO: 264872 - protein, 9 aa, Homo Sapiens
YKDVMLDNY

SEQ ID NO: 264873 - protein, 9 aa, Homo Sapiens
CETIFFTIS

SEQ ID NO: 264874 - protein, 9 aa, Homo Sapiens
SQKSCEQNI

SEQ ID NO: 264875 - protein, 9 aa, Homo Sapiens
RVAISTLQK

SEQ ID NO: 264876 - protein, 9 aa, Homo Sapiens
SRPVESIVT

SEQ ID NO: 264877 - protein, 9 aa, Homo Sapiens
ENPDVPHDF

SEQ ID NO: 264878 - protein, 9 aa, Homo Sapiens
RNTVINSEC

SEQ ID NO: 264879 - protein, 9 aa, Homo Sapiens
VCNQEEKIK

SEQ ID NO: 264880 - protein, 9 aa, Homo Sapiens
RTELQLESI

SEQ ID NO: 264881 - protein, 9 aa, Homo Sapiens
LSKVRSLTL

SEQ ID NO: 264882 - protein, 9 aa, Homo Sapiens
AVEDCKDEY

SEQ ID NO: 264883 - protein, 9 aa, Homo Sapiens
SKKQSVVGM

SEQ ID NO: 264884 - protein, 9 aa, Homo Sapiens
MSHQITHTG

SEQ ID NO: 264885 - protein, 9 aa, Homo Sapiens
SWIAVGVHK

SEQ ID NO: 264886 - protein, 9 aa, Homo Sapiens
VPKVVLNLF

SEQ ID NO: 264887 - protein, 9 aa, Homo Sapiens
PQMHLGTNG

SEQ ID NO: 264888 - protein, 9 aa, Homo Sapiens
THRLLKDPL

SEQ ID NO: 264889 - protein, 9 aa, Homo Sapiens
HYSGSYNDY

SEQ ID NO: 264890 - protein, 9 aa, Homo Sapiens
QIHKHISIE

SEQ ID NO: 264891 - protein, 9 aa, Homo Sapiens
IGDAKSSSK

SEQ ID NO: 264892 - protein, 9 aa, Homo Sapiens
MYPSRDEYE

SEQ ID NO: 264893 - protein, 9 aa, Homo Sapiens
LSLKLDAKD

SEQ ID NO: 264894 - protein, 9 aa, Homo Sapiens
VTCWGDEFV

SEQ ID NO: 264895 - protein, 9 aa, Homo Sapiens
GGFGKELFN

SEQ ID NO: 264896 - protein, 9 aa, Homo Sapiens
CSKGLFLVS

SEQ ID NO: 264897 - protein, 9 aa, Homo Sapiens
NITDVAQVE

SEQ ID NO: 264898 - protein, 9 aa, Homo Sapiens
IISITASTY

SEQ ID NO: 264899 - protein, 9 aa, Homo Sapiens
NPLRYSYIL

SEQ ID NO: 264900 - protein, 9 aa, Homo Sapiens
QDYEIEILD

SEQ ID NO: 264901 - protein, 9 aa, Homo Sapiens
KGEWPPAHL

SEQ ID NO: 264902 - protein, 9 aa, Homo Sapiens
STNVPFSWK

SEQ ID NO: 264903 - protein, 9 aa, Homo Sapiens
AGLGGMAST

SEQ ID NO: 264904 - protein, 9 aa, Homo Sapiens
ISYISRTNQ

SEQ ID NO: 264905 - protein, 9 aa, Homo Sapiens
TVQINSAKL

SEQ ID NO: 264906 - protein, 9 aa, Homo Sapiens
LSGLHKFCL

SEQ ID NO: 264907 - protein, 9 aa, Homo Sapiens
YLNLLVNSQ

SEQ ID NO: 264908 - protein, 9 aa, Homo Sapiens
YQDTKASES

SEQ ID NO: 264909 - protein, 9 aa, Homo Sapiens
ITNNSDQMV

SEQ ID NO: 264910 - protein, 9 aa, Homo Sapiens
GDGPLPRAS

SEQ ID NO: 264911 - protein, 9 aa, Homo Sapiens
VQQPDGFNL

SEQ ID NO: 264912 - protein, 9 aa, Homo Sapiens
VTLLYLKKN

SEQ ID NO: 264913 - protein, 9 aa, Homo Sapiens
FGLGIGASC

SEQ ID NO: 264914 - protein, 9 aa, Homo Sapiens
QESNDTTQL

SEQ ID NO: 264915 - protein, 9 aa, Homo Sapiens
EENNDTKSI

SEQ ID NO: 264916 - protein, 9 aa, Homo Sapiens
PVSIENINL

SEQ ID NO: 264917 - protein, 9 aa, Homo Sapiens
TKHKTRHTG

SEQ ID NO: 264918 - protein, 9 aa, Homo Sapiens
GEGPMPFRT

SEQ ID NO: 264919 - protein, 9 aa, Homo Sapiens
DERNYHIVY

SEQ ID NO: 264920 - protein, 9 aa, Homo Sapiens
REENKKGGE

SEQ ID NO: 264921 - protein, 9 aa, Homo Sapiens
KISTEALEN

SEQ ID NO: 264922 - protein, 9 aa, Homo Sapiens
KELLNEKPR

SEQ ID NO: 264923 - protein, 9 aa, Homo Sapiens
CAAGDNKKR

SEQ ID NO: 264924 - protein, 9 aa, Homo Sapiens
KIHNFDCQW

SEQ ID NO: 264925 - protein, 9 aa, Homo Sapiens
EAVGAPLKV

SEQ ID NO: 264926 - protein, 9 aa, Homo Sapiens
GTPAKINKG

SEQ ID NO: 264927 - protein, 9 aa, Homo Sapiens
MCQKPRPLQ

SEQ ID NO: 264928 - protein, 9 aa, Homo Sapiens
AAKGKPELQ

SEQ ID NO: 264929 - protein, 9 aa, Homo Sapiens
HCASHYSEL

SEQ ID NO: 264930 - protein, 9 aa, Homo Sapiens
ITPGPSQLC

SEQ ID NO: 264931 - protein, 9 aa, Homo Sapiens
AAKGKPELT

SEQ ID NO: 264932 - protein, 9 aa, Homo Sapiens
YSYLVHCKY

SEQ ID NO: 264933 - protein, 9 aa, Homo Sapiens
QDQDKQLQD

SEQ ID NO: 264934 - protein, 9 aa, Homo Sapiens
FPDDFKPEV

SEQ ID NO: 264935 - protein, 9 aa, Homo Sapiens
YLPPPESFG

SEQ ID NO: 264936 - protein, 9 aa, Homo Sapiens
RFMETRLFK

SEQ ID NO: 264937 - protein, 9 aa, Homo Sapiens
NISITHATV

SEQ ID NO: 264938 - protein, 9 aa, Homo Sapiens
KDKASETEE

SEQ ID NO: 264939 - protein, 9 aa, Homo Sapiens
DMMAFCSVA

SEQ ID NO: 264940 - protein, 9 aa, Homo Sapiens
NVVQIQKLQ

SEQ ID NO: 264941 - protein, 9 aa, Homo Sapiens
SDDEEDKGE

SEQ ID NO: 264942 - protein, 9 aa, Homo Sapiens
PSPHKAVTR

SEQ ID NO: 264943 - protein, 9 aa, Homo Sapiens
HDGNDLCLV

SEQ ID NO: 264944 - protein, 9 aa, Homo Sapiens
TGIKSMDQC

SEQ ID NO: 264945 - protein, 9 aa, Homo Sapiens
QRKMRKFSE

SEQ ID NO: 264946 - protein, 9 aa, Homo Sapiens
QIKNLEKEK

SEQ ID NO: 264947 - protein, 9 aa, Homo Sapiens
LQLEQLSHA

SEQ ID NO: 264948 - protein, 9 aa, Homo Sapiens
PFMMVPHPL

SEQ ID NO: 264949 - protein, 9 aa, Homo Sapiens
QYKSGKTAL

SEQ ID NO: 264950 - protein, 9 aa, Homo Sapiens
TSVDCLWRE

SEQ ID NO: 264951 - protein, 9 aa, Homo Sapiens
KTEKLEKER

SEQ ID NO: 264952 - protein, 9 aa, Homo Sapiens
EFAFIDMPG

SEQ ID NO: 264953 - protein, 9 aa, Homo Sapiens
LESKLVDWI

SEQ ID NO: 264954 - protein, 9 aa, Homo Sapiens
TGLSAFIFF

SEQ ID NO: 264955 - protein, 9 aa, Homo Sapiens
VNSGVMLIN

SEQ ID NO: 264956 - protein, 9 aa, Homo Sapiens
NAEDVHHQI

SEQ ID NO: 264957 - protein, 9 aa, Homo Sapiens
GKKNEGLIC

SEQ ID NO: 264958 - protein, 9 aa, Homo Sapiens
PVNTQLAIE

SEQ ID NO: 264959 - protein, 9 aa, Homo Sapiens
GDDDYPDKD

SEQ ID NO: 264960 - protein, 9 aa, Homo Sapiens
LPAGFKPTP

SEQ ID NO: 264961 - protein, 9 aa, Homo Sapiens
ERFLDAAEH

SEQ ID NO: 264962 - protein, 9 aa, Homo Sapiens
DFKLNSSTV

SEQ ID NO: 264963 - protein, 9 aa, Homo Sapiens
KENINDKHF

SEQ ID NO: 264964 - protein, 9 aa, Homo Sapiens
LSEVTPKCE

SEQ ID NO: 264965 - protein, 9 aa, Homo Sapiens
KMQPDEVFG

SEQ ID NO: 264966 - protein, 9 aa, Homo Sapiens
LPQFCSKKL

SEQ ID NO: 264967 - protein, 9 aa, Homo Sapiens
LQLHQNVHV

SEQ ID NO: 264968 - protein, 9 aa, Homo Sapiens
SVNASFKGA

SEQ ID NO: 264969 - protein, 9 aa, Homo Sapiens
RGPPLVVIH

SEQ ID NO: 264970 - protein, 9 aa, Homo Sapiens
QYLLIAALG

SEQ ID NO: 264971 - protein, 9 aa, Homo Sapiens
YVKGQWENK

SEQ ID NO: 264972 - protein, 9 aa, Homo Sapiens
LALIAWEIN

SEQ ID NO: 264973 - protein, 9 aa, Homo Sapiens
GGLWNNNEK

SEQ ID NO: 264974 - protein, 9 aa, Homo Sapiens
LATKTELKK

SEQ ID NO: 264975 - protein, 9 aa, Homo Sapiens
VFLNKNIFL

SEQ ID NO: 264976 - protein, 9 aa, Homo Sapiens
HNFDCQWRD

SEQ ID NO: 264977 - protein, 9 aa, Homo Sapiens
AMHIEKKLN

SEQ ID NO: 264978 - protein, 9 aa, Homo Sapiens
SSSDRNDLS

SEQ ID NO: 264979 - protein, 9 aa, Homo Sapiens
FIIAEIVEA

SEQ ID NO: 264980 - protein, 9 aa, Homo Sapiens
QAKVDFILL

SEQ ID NO: 264981 - protein, 9 aa, Homo Sapiens
FKVPDVELL

SEQ ID NO: 264982 - protein, 9 aa, Homo Sapiens
TKRNDMQLD

SEQ ID NO: 264983 - protein, 9 aa, Homo Sapiens
LCFTMSCVP

SEQ ID NO: 264984 - protein, 9 aa, Homo Sapiens
DLNQCLRTT

SEQ ID NO: 264985 - protein, 9 aa, Homo Sapiens
NEPLDELVG

SEQ ID NO: 264986 - protein, 9 aa, Homo Sapiens
LKVTPEIQT

SEQ ID NO: 264987 - protein, 9 aa, Homo Sapiens
NCSCDLLSL

SEQ ID NO: 264988 - protein, 9 aa, Homo Sapiens
EKTDTVEVT

SEQ ID NO: 264989 - protein, 9 aa, Homo Sapiens
KEAVGQLTP

SEQ ID NO: 264990 - protein, 9 aa, Homo Sapiens
ELEPLPFTS

SEQ ID NO: 264991 - protein, 9 aa, Homo Sapiens
SLGVHLSKV

SEQ ID NO: 264992 - protein, 9 aa, Homo Sapiens
VVITLTAIG

SEQ ID NO: 264993 - protein, 9 aa, Homo Sapiens
EIVPASKPP

SEQ ID NO: 264994 - protein, 9 aa, Homo Sapiens
LKWSGRELI

SEQ ID NO: 264995 - protein, 9 aa, Homo Sapiens
DIGDNVEDP

SEQ ID NO: 264996 - protein, 9 aa, Homo Sapiens
YPRAGSPNL

SEQ ID NO: 264997 - protein, 9 aa, Homo Sapiens
SMAILSLTF

SEQ ID NO: 264998 - protein, 9 aa, Homo Sapiens
REDKSFDIF

SEQ ID NO: 264999 - protein, 9 aa, Homo Sapiens
CDELCKNGE

SEQ ID NO: 265000 - protein, 9 aa, Homo Sapiens
EETKLMGFV

SEQ ID NO: 265001 - protein, 9 aa, Homo Sapiens
AVTSAQVMK

SEQ ID NO: 265002 - protein, 9 aa, Homo Sapiens
ESAQFLLLL

SEQ ID NO: 265003 - protein, 9 aa, Homo Sapiens
EVLAFADSQ

SEQ ID NO: 265004 - protein, 9 aa, Homo Sapiens
EKVLKEIDS

SEQ ID NO: 265005 - protein, 9 aa, Homo Sapiens
SELRTAFRV

SEQ ID NO: 265006 - protein, 9 aa, Homo Sapiens
LKISRSLFD

SEQ ID NO: 265007 - protein, 9 aa, Homo Sapiens
KYSLHRITI

SEQ ID NO: 265008 - protein, 9 aa, Homo Sapiens
FLHFPCSMI

SEQ ID NO: 265009 - protein, 9 aa, Homo Sapiens
LQVKYGVWQ

SEQ ID NO: 265010 - protein, 9 aa, Homo Sapiens
KTLAEISDH

SEQ ID NO: 265011 - protein, 9 aa, Homo Sapiens
EPSQKTGDV

SEQ ID NO: 265012 - protein, 9 aa, Homo Sapiens
RPLCDNHFH

SEQ ID NO: 265013 - protein, 9 aa, Homo Sapiens
IIVNVSLVQ

SEQ ID NO: 265014 - protein, 9 aa, Homo Sapiens
HVSNTVSGF

SEQ ID NO: 265015 - protein, 9 aa, Homo Sapiens
IKTQETETL

SEQ ID NO: 265016 - protein, 9 aa, Homo Sapiens
DINIRKDLY

SEQ ID NO: 265017 - protein, 9 aa, Homo Sapiens
RMMSLITLP

SEQ ID NO: 265018 - protein, 9 aa, Homo Sapiens
IFQAESFEE

SEQ ID NO: 265019 - protein, 9 aa, Homo Sapiens
CRIPSEEAS

SEQ ID NO: 265020 - protein, 9 aa, Homo Sapiens
EPFQERISH

SEQ ID NO: 265021 - protein, 9 aa, Homo Sapiens
CMNVGGFLV

SEQ ID NO: 265022 - protein, 9 aa, Homo Sapiens
IYVRTSGSR

SEQ ID NO: 265023 - protein, 9 aa, Homo Sapiens
NMNHIALGS

SEQ ID NO: 265024 - protein, 9 aa, Homo Sapiens
REKEKDKHK

SEQ ID NO: 265025 - protein, 9 aa, Homo Sapiens
ADVKSASER

SEQ ID NO: 265026 - protein, 9 aa, Homo Sapiens
KNAVLSEAI

SEQ ID NO: 265027 - protein, 9 aa, Homo Sapiens
TEVLEAGEG

SEQ ID NO: 265028 - protein, 9 aa, Homo Sapiens
CLNIAVTPL

SEQ ID NO: 265029 - protein, 9 aa, Homo Sapiens
ETKVQFLNN

SEQ ID NO: 265030 - protein, 9 aa, Homo Sapiens
NDTRKMLSL

SEQ ID NO: 265031 - protein, 9 aa, Homo Sapiens
LTATHLKWL

SEQ ID NO: 265032 - protein, 9 aa, Homo Sapiens
GSLKSTSRE

SEQ ID NO: 265033 - protein, 9 aa, Homo Sapiens
GCVLYKLCY

SEQ ID NO: 265034 - protein, 9 aa, Homo Sapiens
ADGLQADAL

SEQ ID NO: 265035 - protein, 9 aa, Homo Sapiens
FFRYVKMST

SEQ ID NO: 265036 - protein, 9 aa, Homo Sapiens
GLEDPSISF

SEQ ID NO: 265037 - protein, 9 aa, Homo Sapiens
PLRWGPLWR

SEQ ID NO: 265038 - protein, 9 aa, Homo Sapiens
YLHLLNDLQ

SEQ ID NO: 265039 - protein, 9 aa, Homo Sapiens
ILEKVAATL

SEQ ID NO: 265040 - protein, 9 aa, Homo Sapiens
YAFKDNSNV

SEQ ID NO: 265041 - protein, 9 aa, Homo Sapiens
RGQFLWRGE

SEQ ID NO: 265042 - protein, 9 aa, Homo Sapiens
HPPEAFHLI

SEQ ID NO: 265043 - protein, 9 aa, Homo Sapiens
SYIISWLIF

SEQ ID NO: 265044 - protein, 9 aa, Homo Sapiens
KDLAVVLVV

SEQ ID NO: 265045 - protein, 9 aa, Homo Sapiens
PHPSNLQLQ

SEQ ID NO: 265046 - protein, 9 aa, Homo Sapiens
ENIDNIKIN

SEQ ID NO: 265047 - protein, 9 aa, Homo Sapiens
FPTESTWGW

SEQ ID NO: 265048 - protein, 9 aa, Homo Sapiens
SLTDPPLNH

SEQ ID NO: 265049 - protein, 9 aa, Homo Sapiens
LEKLENKII

SEQ ID NO: 265050 - protein, 9 aa, Homo Sapiens
KDPRKWIRP

SEQ ID NO: 265051 - protein, 9 aa, Homo Sapiens
WFYNILAVV

SEQ ID NO: 265052 - protein, 9 aa, Homo Sapiens
EGYNDLNQC

SEQ ID NO: 265053 - protein, 9 aa, Homo Sapiens
HDVVMNDSL

SEQ ID NO: 265054 - protein, 9 aa, Homo Sapiens
VLYYYLTNK

SEQ ID NO: 265055 - protein, 9 aa, Homo Sapiens
EAIWELNEY

SEQ ID NO: 265056 - protein, 9 aa, Homo Sapiens
VQIEKELSG

SEQ ID NO: 265057 - protein, 9 aa, Homo Sapiens
AVLGKVKLC

SEQ ID NO: 265058 - protein, 9 aa, Homo Sapiens
GSLDEKRKS

SEQ ID NO: 265059 - protein, 9 aa, Homo Sapiens
NWTKDELLN

SEQ ID NO: 265060 - protein, 9 aa, Homo Sapiens
INNFYFLFD

SEQ ID NO: 265061 - protein, 9 aa, Homo Sapiens
SSRPGIPAA

SEQ ID NO: 265062 - protein, 9 aa, Homo Sapiens
EKTLAVGGL

SEQ ID NO: 265063 - protein, 9 aa, Homo Sapiens
TGESIAVKT

SEQ ID NO: 265064 - protein, 9 aa, Homo Sapiens
LSVTDASGR

SEQ ID NO: 265065 - protein, 9 aa, Homo Sapiens
PSLYIIHLG

SEQ ID NO: 265066 - protein, 9 aa, Homo Sapiens
LIQSVKKLY

SEQ ID NO: 265067 - protein, 9 aa, Homo Sapiens
MHFKVNRDI

SEQ ID NO: 265068 - protein, 9 aa, Homo Sapiens
IKQYMHFQN

SEQ ID NO: 265069 - protein, 9 aa, Homo Sapiens
CISLQNLIL

SEQ ID NO: 265070 - protein, 9 aa, Homo Sapiens
ERQKYWWDA

SEQ ID NO: 265071 - protein, 9 aa, Homo Sapiens
WPVHREHGL

SEQ ID NO: 265072 - protein, 9 aa, Homo Sapiens
VAGAPLITA

SEQ ID NO: 265073 - protein, 9 aa, Homo Sapiens
DVRGHSSLQ

SEQ ID NO: 265074 - protein, 9 aa, Homo Sapiens
LPKLEKRRR

SEQ ID NO: 265075 - protein, 9 aa, Homo Sapiens
YPATTSFQY

SEQ ID NO: 265076 - protein, 9 aa, Homo Sapiens
IHIIIQQRN

SEQ ID NO: 265077 - protein, 9 aa, Homo Sapiens
AKLGICEPS

SEQ ID NO: 265078 - protein, 9 aa, Homo Sapiens
SSLQLHQNV

SEQ ID NO: 265079 - protein, 9 aa, Homo Sapiens
TLIRHQNIH

SEQ ID NO: 265080 - protein, 9 aa, Homo Sapiens
QIPLPHVTH

SEQ ID NO: 265081 - protein, 9 aa, Homo Sapiens
SATERETQR

SEQ ID NO: 265082 - protein, 9 aa, Homo Sapiens
HYSELLETT

SEQ ID NO: 265083 - protein, 9 aa, Homo Sapiens
RLWTTTNVL

SEQ ID NO: 265084 - protein, 9 aa, Homo Sapiens
FGVTSVLLL

SEQ ID NO: 265085 - protein, 9 aa, Homo Sapiens
IQRLFGHGA

SEQ ID NO: 265086 - protein, 9 aa, Homo Sapiens
YIWPWTKNR

SEQ ID NO: 265087 - protein, 9 aa, Homo Sapiens
AKRKGRKWK

SEQ ID NO: 265088 - protein, 9 aa, Homo Sapiens
PSPLRNIPL

SEQ ID NO: 265089 - protein, 9 aa, Homo Sapiens
FVQIPNKPD

SEQ ID NO: 265090 - protein, 9 aa, Homo Sapiens
VLQLIQPLE

SEQ ID NO: 265091 - protein, 9 aa, Homo Sapiens
PSGNIKTVA

SEQ ID NO: 265092 - protein, 9 aa, Homo Sapiens
TLLGAGFTE

SEQ ID NO: 265093 - protein, 9 aa, Homo Sapiens
VSNLDPNLS

SEQ ID NO: 265094 - protein, 9 aa, Homo Sapiens
PALTLDFAT

SEQ ID NO: 265095 - protein, 9 aa, Homo Sapiens
VGAPLKVYH

SEQ ID NO: 265096 - protein, 9 aa, Homo Sapiens
LMIVIKYKY

SEQ ID NO: 265097 - protein, 9 aa, Homo Sapiens
GLCMCGDNC

SEQ ID NO: 265098 - protein, 9 aa, Homo Sapiens
LDTTHFSKE

SEQ ID NO: 265099 - protein, 9 aa, Homo Sapiens
GKFLHLSKE

SEQ ID NO: 265100 - protein, 9 aa, Homo Sapiens
LPMTFPGLF

SEQ ID NO: 265101 - protein, 9 aa, Homo Sapiens
AKCEDVWQC

SEQ ID NO: 265102 - protein, 9 aa, Homo Sapiens
DISKGLSGM

SEQ ID NO: 265103 - protein, 9 aa, Homo Sapiens
KANPNRILP

SEQ ID NO: 265104 - protein, 9 aa, Homo Sapiens
LTSSKLLYI

SEQ ID NO: 265105 - protein, 9 aa, Homo Sapiens
HFINEREKP

SEQ ID NO: 265106 - protein, 9 aa, Homo Sapiens
TSETLGHGY

SEQ ID NO: 265107 - protein, 9 aa, Homo Sapiens
RGFFTICKR

SEQ ID NO: 265108 - protein, 9 aa, Homo Sapiens
EVTHVIVGD

SEQ ID NO: 265109 - protein, 9 aa, Homo Sapiens
LYALHWYRW

SEQ ID NO: 265110 - protein, 9 aa, Homo Sapiens
RHVQINAHA

SEQ ID NO: 265111 - protein, 9 aa, Homo Sapiens
VASKIHGDL

SEQ ID NO: 265112 - protein, 9 aa, Homo Sapiens
CEDSVPTTA

SEQ ID NO: 265113 - protein, 9 aa, Homo Sapiens
SIAVKTRKC

SEQ ID NO: 265114 - protein, 9 aa, Homo Sapiens
LLWAGPVND

SEQ ID NO: 265115 - protein, 9 aa, Homo Sapiens
IVKADENNV

SEQ ID NO: 265116 - protein, 9 aa, Homo Sapiens
IINIYIYHF

SEQ ID NO: 265117 - protein, 9 aa, Homo Sapiens
GNILLILQY

SEQ ID NO: 265118 - protein, 9 aa, Homo Sapiens
REMRANEKT

SEQ ID NO: 265119 - protein, 9 aa, Homo Sapiens
LVNGTVFAI

SEQ ID NO: 265120 - protein, 9 aa, Homo Sapiens
FFHIFSGYL

SEQ ID NO: 265121 - protein, 9 aa, Homo Sapiens
KDVQNNKHR

SEQ ID NO: 265122 - protein, 9 aa, Homo Sapiens
TRTHHLEPY

SEQ ID NO: 265123 - protein, 9 aa, Homo Sapiens
PFELSNLNH

SEQ ID NO: 265124 - protein, 9 aa, Homo Sapiens
LHFWLPFGF

SEQ ID NO: 265125 - protein, 9 aa, Homo Sapiens
SNSYQSLAP

SEQ ID NO: 265126 - protein, 9 aa, Homo Sapiens
CCDEEIRFS

SEQ ID NO: 265127 - protein, 9 aa, Homo Sapiens
ISLAHVDSQ

SEQ ID NO: 265128 - protein, 9 aa, Homo Sapiens
YPALQREQQ

SEQ ID NO: 265129 - protein, 9 aa, Homo Sapiens
LEKEASDDD

SEQ ID NO: 265130 - protein, 9 aa, Homo Sapiens
TSYLIILHF

SEQ ID NO: 265131 - protein, 9 aa, Homo Sapiens
LSYALRTIH

SEQ ID NO: 265132 - protein, 9 aa, Homo Sapiens
SRNRNCKQK

SEQ ID NO: 265133 - protein, 9 aa, Homo Sapiens
YRWLLLDFK

SEQ ID NO: 265134 - protein, 9 aa, Homo Sapiens
VQKRKKDLT

SEQ ID NO: 265135 - protein, 9 aa, Homo Sapiens
PVTSTIPVV

SEQ ID NO: 265136 - protein, 9 aa, Homo Sapiens
WSFACEQIL

SEQ ID NO: 265137 - protein, 9 aa, Homo Sapiens
SKSLSREIN

SEQ ID NO: 265138 - protein, 9 aa, Homo Sapiens
SELNTQKVT

SEQ ID NO: 265139 - protein, 9 aa, Homo Sapiens
KTHRYVINL

SEQ ID NO: 265140 - protein, 9 aa, Homo Sapiens
FWFGVTSVL

SEQ ID NO: 265141 - protein, 9 aa, Homo Sapiens
YPDMDTESH

SEQ ID NO: 265142 - protein, 9 aa, Homo Sapiens
TICKREPGG

SEQ ID NO: 265143 - protein, 9 aa, Homo Sapiens
FSLNSYISS

SEQ ID NO: 265144 - protein, 9 aa, Homo Sapiens
IDAGQIRFG

SEQ ID NO: 265145 - protein, 9 aa, Homo Sapiens
DKEVEIRKQ

SEQ ID NO: 265146 - protein, 9 aa, Homo Sapiens
DETEQNQAL

SEQ ID NO: 265147 - protein, 9 aa, Homo Sapiens
TRLFLVSAA

SEQ ID NO: 265148 - protein, 9 aa, Homo Sapiens
TDTQLFPHF

SEQ ID NO: 265149 - protein, 9 aa, Homo Sapiens
QRISIKKAL

SEQ ID NO: 265150 - protein, 9 aa, Homo Sapiens
ITLKCSQTM

SEQ ID NO: 265151 - protein, 9 aa, Homo Sapiens
DPQTETLGA

SEQ ID NO: 265152 - protein, 9 aa, Homo Sapiens
NVKKSIRKN

SEQ ID NO: 265153 - protein, 9 aa, Homo Sapiens
LVPCFIDTD

SEQ ID NO: 265154 - protein, 9 aa, Homo Sapiens
TETIIQFAF

SEQ ID NO: 265155 - protein, 9 aa, Homo Sapiens
IGPNAGEVT

SEQ ID NO: 265156 - protein, 9 aa, Homo Sapiens
MNVTATYTR

SEQ ID NO: 265157 - protein, 9 aa, Homo Sapiens
ESQKIEIRA

SEQ ID NO: 265158 - protein, 9 aa, Homo Sapiens
RAEICLYRK

SEQ ID NO: 265159 - protein, 9 aa, Homo Sapiens
HVGQEGPRC

SEQ ID NO: 265160 - protein, 9 aa, Homo Sapiens
IAPKFIIYL

SEQ ID NO: 265161 - protein, 9 aa, Homo Sapiens
QPPPVYLLE

SEQ ID NO: 265162 - protein, 9 aa, Homo Sapiens
MLDKARAKN

SEQ ID NO: 265163 - protein, 9 aa, Homo Sapiens
SSANEDDDV

SEQ ID NO: 265164 - protein, 9 aa, Homo Sapiens
PNYEDKNFP

SEQ ID NO: 265165 - protein, 9 aa, Homo Sapiens
GQDLNTTSR

SEQ ID NO: 265166 - protein, 9 aa, Homo Sapiens
PTNCLTLWA

SEQ ID NO: 265167 - protein, 9 aa, Homo Sapiens
SANVMYTIG

SEQ ID NO: 265168 - protein, 9 aa, Homo Sapiens
FDPFQLDGA

SEQ ID NO: 265169 - protein, 9 aa, Homo Sapiens
CVRLLPWPF

SEQ ID NO: 265170 - protein, 9 aa, Homo Sapiens
PFLNSYTVQ

SEQ ID NO: 265171 - protein, 9 aa, Homo Sapiens
PGSYYCTCN

SEQ ID NO: 265172 - protein, 9 aa, Homo Sapiens
GTEEIRQKI

SEQ ID NO: 265173 - protein, 9 aa, Homo Sapiens
LARQRKLHL

SEQ ID NO: 265174 - protein, 9 aa, Homo Sapiens
KLEMQFVLP

SEQ ID NO: 265175 - protein, 9 aa, Homo Sapiens
HFIILMGKN

SEQ ID NO: 265176 - protein, 9 aa, Homo Sapiens
AGPGALSVC

SEQ ID NO: 265177 - protein, 9 aa, Homo Sapiens
ACFDVIVSA

SEQ ID NO: 265178 - protein, 9 aa, Homo Sapiens
LSFTYINSM

SEQ ID NO: 265179 - protein, 9 aa, Homo Sapiens
TSPFPGIQV

SEQ ID NO: 265180 - protein, 9 aa, Homo Sapiens
FELPMTFPG

SEQ ID NO: 265181 - protein, 9 aa, Homo Sapiens
LTPKSLTRG

SEQ ID NO: 265182 - protein, 9 aa, Homo Sapiens
HTGISVLSV

SEQ ID NO: 265183 - protein, 9 aa, Homo Sapiens
DYRHGARVD

SEQ ID NO: 265184 - protein, 9 aa, Homo Sapiens
FGVIGSLKG

SEQ ID NO: 265185 - protein, 9 aa, Homo Sapiens
AEKLDLKTN

SEQ ID NO: 265186 - protein, 9 aa, Homo Sapiens
PPTAFYLLK

SEQ ID NO: 265187 - protein, 9 aa, Homo Sapiens
ILVHANTPL

SEQ ID NO: 265188 - protein, 9 aa, Homo Sapiens
FASFVCADM

SEQ ID NO: 265189 - protein, 9 aa, Homo Sapiens
LNDGQFRKA

SEQ ID NO: 265190 - protein, 9 aa, Homo Sapiens
YPKDIRINI

SEQ ID NO: 265191 - protein, 9 aa, Homo Sapiens
APSGVSIFC

SEQ ID NO: 265192 - protein, 9 aa, Homo Sapiens
CLSPGSLAV

SEQ ID NO: 265193 - protein, 9 aa, Homo Sapiens
GLPDYHRII

SEQ ID NO: 265194 - protein, 9 aa, Homo Sapiens
VYWEAVELD

SEQ ID NO: 265195 - protein, 9 aa, Homo Sapiens
KKEKGKSKV

SEQ ID NO: 265196 - protein, 9 aa, Homo Sapiens
IPPQRWQNI

SEQ ID NO: 265197 - protein, 9 aa, Homo Sapiens
KGMRVVDRQ

SEQ ID NO: 265198 - protein, 9 aa, Homo Sapiens
NAFIHSSAL

SEQ ID NO: 265199 - protein, 9 aa, Homo Sapiens
RSLCSTPLS

SEQ ID NO: 265200 - protein, 9 aa, Homo Sapiens
LMQETHDSI

SEQ ID NO: 265201 - protein, 9 aa, Homo Sapiens
LDAGVKLFF

SEQ ID NO: 265202 - protein, 9 aa, Homo Sapiens
IKVLISFII

SEQ ID NO: 265203 - protein, 9 aa, Homo Sapiens
KTTSKPYIN

SEQ ID NO: 265204 - protein, 9 aa, Homo Sapiens
APKKIPSLC

SEQ ID NO: 265205 - protein, 9 aa, Homo Sapiens
CIAKCDHHC

SEQ ID NO: 265206 - protein, 9 aa, Homo Sapiens
FEYLTRNSS

SEQ ID NO: 265207 - protein, 9 aa, Homo Sapiens
PHLLLSGER

SEQ ID NO: 265208 - protein, 9 aa, Homo Sapiens
CMSGGLCMC

SEQ ID NO: 265209 - protein, 9 aa, Homo Sapiens
KSVSSTNFS

SEQ ID NO: 265210 - protein, 9 aa, Homo Sapiens
RHHIKNLKI

SEQ ID NO: 265211 - protein, 9 aa, Homo Sapiens
IASHENVDK

SEQ ID NO: 265212 - protein, 9 aa, Homo Sapiens
IVAVIARFY

SEQ ID NO: 265213 - protein, 9 aa, Homo Sapiens
ELMILASDG

SEQ ID NO: 265214 - protein, 9 aa, Homo Sapiens
EKHFSCPLC

SEQ ID NO: 265215 - protein, 9 aa, Homo Sapiens
EPVFITASE

SEQ ID NO: 265216 - protein, 9 aa, Homo Sapiens
KSRGKSISI

SEQ ID NO: 265217 - protein, 9 aa, Homo Sapiens
AHIFEKISN

SEQ ID NO: 265218 - protein, 9 aa, Homo Sapiens
LKSELTKFK

SEQ ID NO: 265219 - protein, 9 aa, Homo Sapiens
NFSYTQPAI

SEQ ID NO: 265220 - protein, 9 aa, Homo Sapiens
LSPGALWTV

SEQ ID NO: 265221 - protein, 9 aa, Homo Sapiens
SRSQLSELT

SEQ ID NO: 265222 - protein, 9 aa, Homo Sapiens
NVATVLESL

SEQ ID NO: 265223 - protein, 9 aa, Homo Sapiens
CQEYLIKKI

SEQ ID NO: 265224 - protein, 9 aa, Homo Sapiens
VYMVMEYVP

SEQ ID NO: 265225 - protein, 9 aa, Homo Sapiens
AFLGMSLVI

SEQ ID NO: 265226 - protein, 9 aa, Homo Sapiens
HWQKNLTDA

SEQ ID NO: 265227 - protein, 9 aa, Homo Sapiens
KKEIKQLEE

SEQ ID NO: 265228 - protein, 9 aa, Homo Sapiens
FQLWDAERA

SEQ ID NO: 265229 - protein, 9 aa, Homo Sapiens
QFVRELVNL

SEQ ID NO: 265230 - protein, 9 aa, Homo Sapiens
FIGGINRHQ

SEQ ID NO: 265231 - protein, 9 aa, Homo Sapiens
IYKLRHDLE

SEQ ID NO: 265232 - protein, 9 aa, Homo Sapiens
YKHFKPEDP

SEQ ID NO: 265233 - protein, 9 aa, Homo Sapiens
TPIPCVCDH

SEQ ID NO: 265234 - protein, 9 aa, Homo Sapiens
DCKLNNGRW

SEQ ID NO: 265235 - protein, 9 aa, Homo Sapiens
EKKERLSLI

SEQ ID NO: 265236 - protein, 9 aa, Homo Sapiens
APGKPGHYQ

SEQ ID NO: 265237 - protein, 9 aa, Homo Sapiens
RNQDILIPT

SEQ ID NO: 265238 - protein, 9 aa, Homo Sapiens
EHEKQVYNA

SEQ ID NO: 265239 - protein, 9 aa, Homo Sapiens
RRAWILLSL

SEQ ID NO: 265240 - protein, 9 aa, Homo Sapiens
IDETNEIYD

SEQ ID NO: 265241 - protein, 9 aa, Homo Sapiens
EEEWLALYS

SEQ ID NO: 265242 - protein, 9 aa, Homo Sapiens
AQDALSDGL

SEQ ID NO: 265243 - protein, 9 aa, Homo Sapiens
QDPSAIKVE

SEQ ID NO: 265244 - protein, 9 aa, Homo Sapiens
TIKPRIIQN

SEQ ID NO: 265245 - protein, 9 aa, Homo Sapiens
PPTKYQLSQ

SEQ ID NO: 265246 - protein, 9 aa, Homo Sapiens
FSSSWVKHY

SEQ ID NO: 265247 - protein, 9 aa, Homo Sapiens
TGLRMMIFS

SEQ ID NO: 265248 - protein, 9 aa, Homo Sapiens
KSLEFGPEN

SEQ ID NO: 265249 - protein, 9 aa, Homo Sapiens
CNKTSFFFE

SEQ ID NO: 265250 - protein, 9 aa, Homo Sapiens
PVHATFRAV

SEQ ID NO: 265251 - protein, 9 aa, Homo Sapiens
LYTFMSMCR

SEQ ID NO: 265252 - protein, 9 aa, Homo Sapiens
LPSTQTGVI

SEQ ID NO: 265253 - protein, 9 aa, Homo Sapiens
GLWSVCVYG

SEQ ID NO: 265254 - protein, 9 aa, Homo Sapiens
EPSVNIETK

SEQ ID NO: 265255 - protein, 9 aa, Homo Sapiens
KKHVWLGEI

SEQ ID NO: 265256 - protein, 9 aa, Homo Sapiens
IDIARKPDK

SEQ ID NO: 265257 - protein, 9 aa, Homo Sapiens
CGNVAQTAI

SEQ ID NO: 265258 - protein, 9 aa, Homo Sapiens
LRLNSEKLS

SEQ ID NO: 265259 - protein, 9 aa, Homo Sapiens
GSKHLPDVH

SEQ ID NO: 265260 - protein, 9 aa, Homo Sapiens
QRFYKIRLP

SEQ ID NO: 265261 - protein, 9 aa, Homo Sapiens
GTQKQKDIQ

SEQ ID NO: 265262 - protein, 9 aa, Homo Sapiens
PVEDWEKGA

SEQ ID NO: 265263 - protein, 9 aa, Homo Sapiens
DKWNTDNTL

SEQ ID NO: 265264 - protein, 9 aa, Homo Sapiens
IIYPDRIEE

SEQ ID NO: 265265 - protein, 9 aa, Homo Sapiens
DEASFQTEV

SEQ ID NO: 265266 - protein, 9 aa, Homo Sapiens
VIEPLERGK

SEQ ID NO: 265267 - protein, 9 aa, Homo Sapiens
EIYFAPATS

SEQ ID NO: 265268 - protein, 9 aa, Homo Sapiens
GVTWIGFPW

SEQ ID NO: 265269 - protein, 9 aa, Homo Sapiens
IIITSLTVL

SEQ ID NO: 265270 - protein, 9 aa, Homo Sapiens
EGDEYEYED

SEQ ID NO: 265271 - protein, 9 aa, Homo Sapiens
CVQCSRSRS

SEQ ID NO: 265272 - protein, 9 aa, Homo Sapiens
DKLIMNQTS

SEQ ID NO: 265273 - protein, 9 aa, Homo Sapiens
TRWDEASFQ

SEQ ID NO: 265274 - protein, 9 aa, Homo Sapiens
SEAGPAHNS

SEQ ID NO: 265275 - protein, 9 aa, Homo Sapiens
VGPFTTPAL

SEQ ID NO: 265276 - protein, 9 aa, Homo Sapiens
YRDGGIPNI

SEQ ID NO: 265277 - protein, 9 aa, Homo Sapiens
ILNGRHPYK

SEQ ID NO: 265278 - protein, 9 aa, Homo Sapiens
GMGRDSAVG

SEQ ID NO: 265279 - protein, 9 aa, Homo Sapiens
EHPDKVLKF

SEQ ID NO: 265280 - protein, 9 aa, Homo Sapiens
QHGYRIQIH

SEQ ID NO: 265281 - protein, 9 aa, Homo Sapiens
GAHFMTTAM

SEQ ID NO: 265282 - protein, 9 aa, Homo Sapiens
CSLSVDNEN

SEQ ID NO: 265283 - protein, 9 aa, Homo Sapiens
PNMVVFVVQ

SEQ ID NO: 265284 - protein, 9 aa, Homo Sapiens
DNVNSRLLK

SEQ ID NO: 265285 - protein, 9 aa, Homo Sapiens
SKCITECVR

SEQ ID NO: 265286 - protein, 9 aa, Homo Sapiens
TVYVKSGPN

SEQ ID NO: 265287 - protein, 9 aa, Homo Sapiens
YPTPPPPQA

SEQ ID NO: 265288 - protein, 9 aa, Homo Sapiens
QQNLQKELD

SEQ ID NO: 265289 - protein, 9 aa, Homo Sapiens
AAQAKRETD

SEQ ID NO: 265290 - protein, 9 aa, Homo Sapiens
ECSAHNKSV

SEQ ID NO: 265291 - protein, 9 aa, Homo Sapiens
SILNHGRLL

SEQ ID NO: 265292 - protein, 9 aa, Homo Sapiens
AAKKKDEGP

SEQ ID NO: 265293 - protein, 9 aa, Homo Sapiens
ITVKQYPKF

SEQ ID NO: 265294 - protein, 9 aa, Homo Sapiens
TLSNWWFVA

SEQ ID NO: 265295 - protein, 9 aa, Homo Sapiens
ELHYLSKML

SEQ ID NO: 265296 - protein, 9 aa, Homo Sapiens
VTLDWSENA

SEQ ID NO: 265297 - protein, 9 aa, Homo Sapiens
LPRPEYNFL

SEQ ID NO: 265298 - protein, 9 aa, Homo Sapiens
RNQSRLKVE

SEQ ID NO: 265299 - protein, 9 aa, Homo Sapiens
TSVQNLANL

SEQ ID NO: 265300 - protein, 9 aa, Homo Sapiens
GLPRDKLAA

SEQ ID NO: 265301 - protein, 9 aa, Homo Sapiens
VNLQIWDTA

SEQ ID NO: 265302 - protein, 9 aa, Homo Sapiens
AVWAARWAP

SEQ ID NO: 265303 - protein, 9 aa, Homo Sapiens
HRQAKLRLY

SEQ ID NO: 265304 - protein, 9 aa, Homo Sapiens
VPQLIFKKG

SEQ ID NO: 265305 - protein, 9 aa, Homo Sapiens
DSEIMFAKT

SEQ ID NO: 265306 - protein, 9 aa, Homo Sapiens
CDDEVSELM

SEQ ID NO: 265307 - protein, 9 aa, Homo Sapiens
YNLLSSLPN

SEQ ID NO: 265308 - protein, 9 aa, Homo Sapiens
TKTPRSAYL

SEQ ID NO: 265309 - protein, 9 aa, Homo Sapiens
NTSAETRET

SEQ ID NO: 265310 - protein, 9 aa, Homo Sapiens
EGRLELKTL

SEQ ID NO: 265311 - protein, 9 aa, Homo Sapiens
CSNIPYFCL

SEQ ID NO: 265312 - protein, 9 aa, Homo Sapiens
IEISEGTGF

SEQ ID NO: 265313 - protein, 9 aa, Homo Sapiens
TQSRNLKPW

SEQ ID NO: 265314 - protein, 9 aa, Homo Sapiens
SAHLTEPGS

SEQ ID NO: 265315 - protein, 9 aa, Homo Sapiens
RSVSEKISS

SEQ ID NO: 265316 - protein, 9 aa, Homo Sapiens
SCFGCMKAA

SEQ ID NO: 265317 - protein, 9 aa, Homo Sapiens
HVLGLSAGL

SEQ ID NO: 265318 - protein, 9 aa, Homo Sapiens
TTSMNGKEK

SEQ ID NO: 265319 - protein, 9 aa, Homo Sapiens
RNSQFQMLF

SEQ ID NO: 265320 - protein, 9 aa, Homo Sapiens
AETEGTLIL

SEQ ID NO: 265321 - protein, 9 aa, Homo Sapiens
LKNAINKKF

SEQ ID NO: 265322 - protein, 9 aa, Homo Sapiens
SFFVLMTSY

SEQ ID NO: 265323 - protein, 9 aa, Homo Sapiens
KHKEQAIGA

SEQ ID NO: 265324 - protein, 9 aa, Homo Sapiens
DCENDFQCS

SEQ ID NO: 265325 - protein, 9 aa, Homo Sapiens
AGVHSGDVT

SEQ ID NO: 265326 - protein, 9 aa, Homo Sapiens
RKRRSISSD

SEQ ID NO: 265327 - protein, 9 aa, Homo Sapiens
CMHPHNALS

SEQ ID NO: 265328 - protein, 9 aa, Homo Sapiens
DREKDKVDL

SEQ ID NO: 265329 - protein, 9 aa, Homo Sapiens
DPEMLNSCS

SEQ ID NO: 265330 - protein, 9 aa, Homo Sapiens
ALRELRPAG

SEQ ID NO: 265331 - protein, 9 aa, Homo Sapiens
EIENLAAMD

SEQ ID NO: 265332 - protein, 9 aa, Homo Sapiens
ALTSKINLH

SEQ ID NO: 265333 - protein, 9 aa, Homo Sapiens
VREKQLREH

SEQ ID NO: 265334 - protein, 9 aa, Homo Sapiens
GQNYNQAYH

SEQ ID NO: 265335 - protein, 9 aa, Homo Sapiens
FLNVCFKVI

SEQ ID NO: 265336 - protein, 9 aa, Homo Sapiens
SGASQSRVG

SEQ ID NO: 265337 - protein, 9 aa, Homo Sapiens
RSIFLQQQA

SEQ ID NO: 265338 - protein, 9 aa, Homo Sapiens
FFLPILAPC

SEQ ID NO: 265339 - protein, 9 aa, Homo Sapiens
GPQRCPVYL

SEQ ID NO: 265340 - protein, 9 aa, Homo Sapiens
EHLSLMLEQ

SEQ ID NO: 265341 - protein, 9 aa, Homo Sapiens
VIHKLNNLI

SEQ ID NO: 265342 - protein, 9 aa, Homo Sapiens
IWQKIISSL

SEQ ID NO: 265343 - protein, 9 aa, Homo Sapiens
LIGLALIVL

SEQ ID NO: 265344 - protein, 9 aa, Homo Sapiens
PPAVKLHEE

SEQ ID NO: 265345 - protein, 9 aa, Homo Sapiens
SDMYLEYTR

SEQ ID NO: 265346 - protein, 9 aa, Homo Sapiens
EQNIEEANQ

SEQ ID NO: 265347 - protein, 9 aa, Homo Sapiens
IHQKVHTGE

SEQ ID NO: 265348 - protein, 9 aa, Homo Sapiens
FNTMFTDCY

SEQ ID NO: 265349 - protein, 9 aa, Homo Sapiens
PNLYRIGRL

SEQ ID NO: 265350 - protein, 9 aa, Homo Sapiens
VLSLNTSLI

SEQ ID NO: 265351 - protein, 9 aa, Homo Sapiens
RDKFKRLPY

SEQ ID NO: 265352 - protein, 9 aa, Homo Sapiens
KLVKLSRKH

SEQ ID NO: 265353 - protein, 9 aa, Homo Sapiens
CGAVDMNEL

SEQ ID NO: 265354 - protein, 9 aa, Homo Sapiens
VLQKKFRGK

SEQ ID NO: 265355 - protein, 9 aa, Homo Sapiens
STLSKYVKN

SEQ ID NO: 265356 - protein, 9 aa, Homo Sapiens
SAPYVSSDG

SEQ ID NO: 265357 - protein, 9 aa, Homo Sapiens
VHGSAAREE

SEQ ID NO: 265358 - protein, 9 aa, Homo Sapiens
LDNIFDWNV

SEQ ID NO: 265359 - protein, 9 aa, Homo Sapiens
FKTPATVGL

SEQ ID NO: 265360 - protein, 9 aa, Homo Sapiens
DNLFLQCPK

SEQ ID NO: 265361 - protein, 9 aa, Homo Sapiens
FEASGSPCL

SEQ ID NO: 265362 - protein, 9 aa, Homo Sapiens
MENIMLCGM

SEQ ID NO: 265363 - protein, 9 aa, Homo Sapiens
NDNWATVML

SEQ ID NO: 265364 - protein, 9 aa, Homo Sapiens
TSSTIEATT

SEQ ID NO: 265365 - protein, 9 aa, Homo Sapiens
MKTQFKETI

SEQ ID NO: 265366 - protein, 9 aa, Homo Sapiens
SRRLNTQAA

SEQ ID NO: 265367 - protein, 9 aa, Homo Sapiens
SIHICTTIL

SEQ ID NO: 265368 - protein, 9 aa, Homo Sapiens
TQELKWQKD

SEQ ID NO: 265369 - protein, 9 aa, Homo Sapiens
EYAHFRAKL

SEQ ID NO: 265370 - protein, 9 aa, Homo Sapiens
ALEINGLEE

SEQ ID NO: 265371 - protein, 9 aa, Homo Sapiens
PQSLLSDVS

SEQ ID NO: 265372 - protein, 9 aa, Homo Sapiens
TSEKLEEWN

SEQ ID NO: 265373 - protein, 9 aa, Homo Sapiens
VVNTKTEYE

SEQ ID NO: 265374 - protein, 9 aa, Homo Sapiens
QSNNTFNLE

SEQ ID NO: 265375 - protein, 9 aa, Homo Sapiens
QVHSGQKYF

SEQ ID NO: 265376 - protein, 9 aa, Homo Sapiens
RAYQYTALT

SEQ ID NO: 265377 - protein, 9 aa, Homo Sapiens
DNFSILETH

SEQ ID NO: 265378 - protein, 9 aa, Homo Sapiens
KLGEVYILS

SEQ ID NO: 265379 - protein, 9 aa, Homo Sapiens
KSTVESLYS

SEQ ID NO: 265380 - protein, 9 aa, Homo Sapiens
SKFSSINLD

SEQ ID NO: 265381 - protein, 9 aa, Homo Sapiens
RAAHDKEEA

SEQ ID NO: 265382 - protein, 9 aa, Homo Sapiens
HQHRSFPLP

SEQ ID NO: 265383 - protein, 9 aa, Homo Sapiens
VSSSLKLND

SEQ ID NO: 265384 - protein, 9 aa, Homo Sapiens
ESRKYFREK

SEQ ID NO: 265385 - protein, 9 aa, Homo Sapiens
HTNAKVGSK

SEQ ID NO: 265386 - protein, 9 aa, Homo Sapiens
VGAMTDAVR

SEQ ID NO: 265387 - protein, 9 aa, Homo Sapiens
LQILLGRTV

SEQ ID NO: 265388 - protein, 9 aa, Homo Sapiens
GFGKELFNP

SEQ ID NO: 265389 - protein, 9 aa, Homo Sapiens
GVAGVEAFA

SEQ ID NO: 265390 - protein, 9 aa, Homo Sapiens
TKLNSVRQR

SEQ ID NO: 265391 - protein, 9 aa, Homo Sapiens
EVERVKTML

SEQ ID NO: 265392 - protein, 9 aa, Homo Sapiens
GGQVRVAEL

SEQ ID NO: 265393 - protein, 9 aa, Homo Sapiens
GDFLFMSPM

SEQ ID NO: 265394 - protein, 9 aa, Homo Sapiens
LLRPWFYNI

SEQ ID NO: 265395 - protein, 9 aa, Homo Sapiens
KLHYHSKIL

SEQ ID NO: 265396 - protein, 9 aa, Homo Sapiens
HYRINTGKR

SEQ ID NO: 265397 - protein, 9 aa, Homo Sapiens
NEVYSATFQ

SEQ ID NO: 265398 - protein, 9 aa, Homo Sapiens
NKYSPCAWE

SEQ ID NO: 265399 - protein, 9 aa, Homo Sapiens
VREEYADFK

SEQ ID NO: 265400 - protein, 9 aa, Homo Sapiens
HKINYGACV

SEQ ID NO: 265401 - protein, 9 aa, Homo Sapiens
SSEPQMHLG

SEQ ID NO: 265402 - protein, 9 aa, Homo Sapiens
LVVGMTVQW

SEQ ID NO: 265403 - protein, 9 aa, Homo Sapiens
RPDTQKLSD

SEQ ID NO: 265404 - protein, 9 aa, Homo Sapiens
LEIVNLLER

SEQ ID NO: 265405 - protein, 9 aa, Homo Sapiens
QCFGNFFSN

SEQ ID NO: 265406 - protein, 9 aa, Homo Sapiens
VFSTHPVST

SEQ ID NO: 265407 - protein, 9 aa, Homo Sapiens
SVKVPAGVQ

SEQ ID NO: 265408 - protein, 9 aa, Homo Sapiens
EKIKYFQMD

SEQ ID NO: 265409 - protein, 9 aa, Homo Sapiens
AVQREERIS

SEQ ID NO: 265410 - protein, 9 aa, Homo Sapiens
STRLFLVSA

SEQ ID NO: 265411 - protein, 9 aa, Homo Sapiens
NRFKHEQIY

SEQ ID NO: 265412 - protein, 9 aa, Homo Sapiens
TNEGVLYVV

SEQ ID NO: 265413 - protein, 9 aa, Homo Sapiens
PFIDKVRFL

SEQ ID NO: 265414 - protein, 9 aa, Homo Sapiens
QPQNQHQDK

SEQ ID NO: 265415 - protein, 9 aa, Homo Sapiens
TESRKYFRE

SEQ ID NO: 265416 - protein, 9 aa, Homo Sapiens
CDQNQKKPA

SEQ ID NO: 265417 - protein, 9 aa, Homo Sapiens
PNTQKNVSE

SEQ ID NO: 265418 - protein, 9 aa, Homo Sapiens
ERQSFIRQF

SEQ ID NO: 265419 - protein, 9 aa, Homo Sapiens
VQCSRSRSQ

SEQ ID NO: 265420 - protein, 9 aa, Homo Sapiens
YMYMSCGTI

SEQ ID NO: 265421 - protein, 9 aa, Homo Sapiens
EPFQSTENS

SEQ ID NO: 265422 - protein, 9 aa, Homo Sapiens
HSPSKRSHH

SEQ ID NO: 265423 - protein, 9 aa, Homo Sapiens
MQFVLPCWP

SEQ ID NO: 265424 - protein, 9 aa, Homo Sapiens
NLIVLGLPW

SEQ ID NO: 265425 - protein, 9 aa, Homo Sapiens
HPGWSVVTQ

SEQ ID NO: 265426 - protein, 9 aa, Homo Sapiens
FVFADMIRK

SEQ ID NO: 265427 - protein, 9 aa, Homo Sapiens
QYNGTVGLW

SEQ ID NO: 265428 - protein, 9 aa, Homo Sapiens
CRHLRIYVY

SEQ ID NO: 265429 - protein, 9 aa, Homo Sapiens
DRLILDAPD

SEQ ID NO: 265430 - protein, 9 aa, Homo Sapiens
IPQCGECKL

SEQ ID NO: 265431 - protein, 9 aa, Homo Sapiens
IPLYDKGDV

SEQ ID NO: 265432 - protein, 9 aa, Homo Sapiens
LIGQIIFSL

SEQ ID NO: 265433 - protein, 9 aa, Homo Sapiens
NEDASTENS

SEQ ID NO: 265434 - protein, 9 aa, Homo Sapiens
EGVLLFNYK

SEQ ID NO: 265435 - protein, 9 aa, Homo Sapiens
ITSLTVLVS

SEQ ID NO: 265436 - protein, 9 aa, Homo Sapiens
VLDSTRQVE

SEQ ID NO: 265437 - protein, 9 aa, Homo Sapiens
NIDNIKINH

SEQ ID NO: 265438 - protein, 9 aa, Homo Sapiens
SDCQRDKVI

SEQ ID NO: 265439 - protein, 9 aa, Homo Sapiens
RKYCEHDFK

SEQ ID NO: 265440 - protein, 9 aa, Homo Sapiens
CSGAPGEHD

SEQ ID NO: 265441 - protein, 9 aa, Homo Sapiens
TKVQFLNNL

SEQ ID NO: 265442 - protein, 9 aa, Homo Sapiens
PLDYTFAPR

SEQ ID NO: 265443 - protein, 9 aa, Homo Sapiens
AFAAHKEKI

SEQ ID NO: 265444 - protein, 9 aa, Homo Sapiens
LVPLHPGLF

SEQ ID NO: 265445 - protein, 9 aa, Homo Sapiens
DEELSGGQE

SEQ ID NO: 265446 - protein, 9 aa, Homo Sapiens
SILGSIRIC

SEQ ID NO: 265447 - protein, 9 aa, Homo Sapiens
ILNLEVKEE

SEQ ID NO: 265448 - protein, 9 aa, Homo Sapiens
NRNNTFQTF

SEQ ID NO: 265449 - protein, 9 aa, Homo Sapiens
IHSARCIFV

SEQ ID NO: 265450 - protein, 9 aa, Homo Sapiens
RTPCPASTH

SEQ ID NO: 265451 - protein, 9 aa, Homo Sapiens
KGAASEGDA

SEQ ID NO: 265452 - protein, 9 aa, Homo Sapiens
HRLHIQGTH

SEQ ID NO: 265453 - protein, 9 aa, Homo Sapiens
SEAINKNLI

SEQ ID NO: 265454 - protein, 9 aa, Homo Sapiens
TGGQEIHTN

SEQ ID NO: 265455 - protein, 9 aa, Homo Sapiens
HWKKRLEPT

SEQ ID NO: 265456 - protein, 9 aa, Homo Sapiens
QLWDAERAK

SEQ ID NO: 265457 - protein, 9 aa, Homo Sapiens
YHINLHVRG

SEQ ID NO: 265458 - protein, 9 aa, Homo Sapiens
QIINLFKGL

SEQ ID NO: 265459 - protein, 9 aa, Homo Sapiens
AEIYYLTNM

SEQ ID NO: 265460 - protein, 9 aa, Homo Sapiens
RHGLCVNKG

SEQ ID NO: 265461 - protein, 9 aa, Homo Sapiens
DWIMATSAI

SEQ ID NO: 265462 - protein, 9 aa, Homo Sapiens
IWQQIANYL

SEQ ID NO: 265463 - protein, 9 aa, Homo Sapiens
DHNCEPYKI

SEQ ID NO: 265464 - protein, 9 aa, Homo Sapiens
GYQVALREK

SEQ ID NO: 265465 - protein, 9 aa, Homo Sapiens
LHLITHTKE

SEQ ID NO: 265466 - protein, 9 aa, Homo Sapiens
RELGCLNAY

SEQ ID NO: 265467 - protein, 9 aa, Homo Sapiens
CTLIFGGHQ

SEQ ID NO: 265468 - protein, 9 aa, Homo Sapiens
ESQGDLRMA

SEQ ID NO: 265469 - protein, 9 aa, Homo Sapiens
ARKPITPEC

SEQ ID NO: 265470 - protein, 9 aa, Homo Sapiens
SGNGSETTG

SEQ ID NO: 265471 - protein, 9 aa, Homo Sapiens
LLGERLTPQ

SEQ ID NO: 265472 - protein, 9 aa, Homo Sapiens
LLSNNSLIV

SEQ ID NO: 265473 - protein, 9 aa, Homo Sapiens
IDYDIVNNM

SEQ ID NO: 265474 - protein, 9 aa, Homo Sapiens
FWTIKLKED

SEQ ID NO: 265475 - protein, 9 aa, Homo Sapiens
YKANPNRIL

SEQ ID NO: 265476 - protein, 9 aa, Homo Sapiens
FSKALTFYR

SEQ ID NO: 265477 - protein, 9 aa, Homo Sapiens
VDEVVKKKS

SEQ ID NO: 265478 - protein, 9 aa, Homo Sapiens
SFTRPKSAT

SEQ ID NO: 265479 - protein, 9 aa, Homo Sapiens
LATLPHEVT

SEQ ID NO: 265480 - protein, 9 aa, Homo Sapiens
NNFVPYRDS

SEQ ID NO: 265481 - protein, 9 aa, Homo Sapiens
ECDMECKGK

SEQ ID NO: 265482 - protein, 9 aa, Homo Sapiens
EHESNLVWM

SEQ ID NO: 265483 - protein, 9 aa, Homo Sapiens
DAIIGNKMF

SEQ ID NO: 265484 - protein, 9 aa, Homo Sapiens
DGGTCQGQW

SEQ ID NO: 265485 - protein, 9 aa, Homo Sapiens
SGVLKLNKK

SEQ ID NO: 265486 - protein, 9 aa, Homo Sapiens
LVWMQGSAT

SEQ ID NO: 265487 - protein, 9 aa, Homo Sapiens
KNKIKLFPT

SEQ ID NO: 265488 - protein, 9 aa, Homo Sapiens
INITDMYKS

SEQ ID NO: 265489 - protein, 9 aa, Homo Sapiens
LNSCSSSSQ

SEQ ID NO: 265490 - protein, 9 aa, Homo Sapiens
FCQKCSHFQ

SEQ ID NO: 265491 - protein, 9 aa, Homo Sapiens
GEEVEETKL

SEQ ID NO: 265492 - protein, 9 aa, Homo Sapiens
LATKHPLEC

SEQ ID NO: 265493 - protein, 9 aa, Homo Sapiens
FSLVMKHLP

SEQ ID NO: 265494 - protein, 9 aa, Homo Sapiens
GVVVFGESI

SEQ ID NO: 265495 - protein, 9 aa, Homo Sapiens
DSGYSYDTI

SEQ ID NO: 265496 - protein, 9 aa, Homo Sapiens
SKRKLQWNE

SEQ ID NO: 265497 - protein, 9 aa, Homo Sapiens
LASFSEYLG

SEQ ID NO: 265498 - protein, 9 aa, Homo Sapiens
DVMLDKIIK

SEQ ID NO: 265499 - protein, 9 aa, Homo Sapiens
DSLKKIVFR

SEQ ID NO: 265500 - protein, 9 aa, Homo Sapiens
EKTSITQQP

SEQ ID NO: 265501 - protein, 9 aa, Homo Sapiens
RLASSNSYQ

SEQ ID NO: 265502 - protein, 9 aa, Homo Sapiens
NKTVCFIGE

SEQ ID NO: 265503 - protein, 9 aa, Homo Sapiens
TVGLPIGFS

SEQ ID NO: 265504 - protein, 9 aa, Homo Sapiens
EAVQGYVGS

SEQ ID NO: 265505 - protein, 9 aa, Homo Sapiens
SHREPKKLD

SEQ ID NO: 265506 - protein, 9 aa, Homo Sapiens
LAGLVFVFE

SEQ ID NO: 265507 - protein, 9 aa, Homo Sapiens
AQQMNHLSL

SEQ ID NO: 265508 - protein, 9 aa, Homo Sapiens
PCSTNNCCK

SEQ ID NO: 265509 - protein, 9 aa, Homo Sapiens
PPLNHKAYR

SEQ ID NO: 265510 - protein, 9 aa, Homo Sapiens
HLEMVVAMV

SEQ ID NO: 265511 - protein, 9 aa, Homo Sapiens
KLLIAAHKQ

SEQ ID NO: 265512 - protein, 9 aa, Homo Sapiens
HFLRLHIHR

SEQ ID NO: 265513 - protein, 9 aa, Homo Sapiens
PLMNMVIYY

SEQ ID NO: 265514 - protein, 9 aa, Homo Sapiens
GEAPNDQGC

SEQ ID NO: 265515 - protein, 9 aa, Homo Sapiens
ISRDDYPAI

SEQ ID NO: 265516 - protein, 9 aa, Homo Sapiens
FGNHQITLF

SEQ ID NO: 265517 - protein, 9 aa, Homo Sapiens
EIDDVYEQY

SEQ ID NO: 265518 - protein, 9 aa, Homo Sapiens
FTLLLQHLS

SEQ ID NO: 265519 - protein, 9 aa, Homo Sapiens
EVIQKAQQS

SEQ ID NO: 265520 - protein, 9 aa, Homo Sapiens
WKMKPRRNV

SEQ ID NO: 265521 - protein, 9 aa, Homo Sapiens
IYRPIQQRV

SEQ ID NO: 265522 - protein, 9 aa, Homo Sapiens
SKCGDLYVI

SEQ ID NO: 265523 - protein, 9 aa, Homo Sapiens
PSPLQGLTT

SEQ ID NO: 265524 - protein, 9 aa, Homo Sapiens
RTNTSCKHV

SEQ ID NO: 265525 - protein, 9 aa, Homo Sapiens
FLTMVISCF

SEQ ID NO: 265526 - protein, 9 aa, Homo Sapiens
GTFIELFPT

SEQ ID NO: 265527 - protein, 9 aa, Homo Sapiens
QLRKFQEEI

SEQ ID NO: 265528 - protein, 9 aa, Homo Sapiens
HEYADKLAA

SEQ ID NO: 265529 - protein, 9 aa, Homo Sapiens
KNELHYLSK

SEQ ID NO: 265530 - protein, 9 aa, Homo Sapiens
IRVHPDVRV

SEQ ID NO: 265531 - protein, 9 aa, Homo Sapiens
VEVFLPVFY

SEQ ID NO: 265532 - protein, 9 aa, Homo Sapiens
WIILNKKAE

SEQ ID NO: 265533 - protein, 9 aa, Homo Sapiens
QHFNSLIDL

SEQ ID NO: 265534 - protein, 9 aa, Homo Sapiens
QRTTTKWVA

SEQ ID NO: 265535 - protein, 9 aa, Homo Sapiens
DFSSTAQGN

SEQ ID NO: 265536 - protein, 9 aa, Homo Sapiens
VPDQITGRA

SEQ ID NO: 265537 - protein, 9 aa, Homo Sapiens
IGLDAGLYY

SEQ ID NO: 265538 - protein, 9 aa, Homo Sapiens
VEISYYNIN

SEQ ID NO: 265539 - protein, 9 aa, Homo Sapiens
PASQEENPH

SEQ ID NO: 265540 - protein, 9 aa, Homo Sapiens
NPSLKQQLL

SEQ ID NO: 265541 - protein, 9 aa, Homo Sapiens
ALFKQIFGD

SEQ ID NO: 265542 - protein, 9 aa, Homo Sapiens
KTFTCTRTQ

SEQ ID NO: 265543 - protein, 9 aa, Homo Sapiens
KWIGNMDRE

SEQ ID NO: 265544 - protein, 9 aa, Homo Sapiens
LILHYLLCD

SEQ ID NO: 265545 - protein, 9 aa, Homo Sapiens
TVFCKYKKN

SEQ ID NO: 265546 - protein, 9 aa, Homo Sapiens
ENHFVIDIQ

SEQ ID NO: 265547 - protein, 9 aa, Homo Sapiens
DFIKLTLEN

SEQ ID NO: 265548 - protein, 9 aa, Homo Sapiens
HIGHAINSY

SEQ ID NO: 265549 - protein, 9 aa, Homo Sapiens
VSLDAAGHE

SEQ ID NO: 265550 - protein, 9 aa, Homo Sapiens
EEQHKCSLK

SEQ ID NO: 265551 - protein, 9 aa, Homo Sapiens
AEDIYKSEL

SEQ ID NO: 265552 - protein, 9 aa, Homo Sapiens
GNLWQFENL

SEQ ID NO: 265553 - protein, 9 aa, Homo Sapiens
ENDLLEEIL

SEQ ID NO: 265554 - protein, 9 aa, Homo Sapiens
LCLASQEVI

SEQ ID NO: 265555 - protein, 9 aa, Homo Sapiens
YGDPNFTVA

SEQ ID NO: 265556 - protein, 9 aa, Homo Sapiens
KNNFKDLMP

SEQ ID NO: 265557 - protein, 9 aa, Homo Sapiens
KEKAIEVEC

SEQ ID NO: 265558 - protein, 9 aa, Homo Sapiens
DLQTICAGG

SEQ ID NO: 265559 - protein, 9 aa, Homo Sapiens
EVDGVDEVV

SEQ ID NO: 265560 - protein, 9 aa, Homo Sapiens
QKCSHFQSE

SEQ ID NO: 265561 - protein, 9 aa, Homo Sapiens
NQREEQDKM

SEQ ID NO: 265562 - protein, 9 aa, Homo Sapiens
QYSRKVFVG

SEQ ID NO: 265563 - protein, 9 aa, Homo Sapiens
KETDLSKNL

SEQ ID NO: 265564 - protein, 9 aa, Homo Sapiens
YAWFFLPSL

SEQ ID NO: 265565 - protein, 9 aa, Homo Sapiens
GHLQTCRLR

SEQ ID NO: 265566 - protein, 9 aa, Homo Sapiens
TWSREHLKL

SEQ ID NO: 265567 - protein, 9 aa, Homo Sapiens
SDLAQHQKV

SEQ ID NO: 265568 - protein, 9 aa, Homo Sapiens
RRFCIQLVA

SEQ ID NO: 265569 - protein, 9 aa, Homo Sapiens
EWQNTGFHY

SEQ ID NO: 265570 - protein, 9 aa, Homo Sapiens
EHILLFIRR

SEQ ID NO: 265571 - protein, 9 aa, Homo Sapiens
GPQSECSGA

SEQ ID NO: 265572 - protein, 9 aa, Homo Sapiens
DIEARKGQA

SEQ ID NO: 265573 - protein, 9 aa, Homo Sapiens
KVMPLVYMP

SEQ ID NO: 265574 - protein, 9 aa, Homo Sapiens
TMIKIMLIN

SEQ ID NO: 265575 - protein, 9 aa, Homo Sapiens
VAFVRDVTV

SEQ ID NO: 265576 - protein, 9 aa, Homo Sapiens
YLTPNTDQR

SEQ ID NO: 265577 - protein, 9 aa, Homo Sapiens
MQPDEVFGI

SEQ ID NO: 265578 - protein, 9 aa, Homo Sapiens
TLLGVATAT

SEQ ID NO: 265579 - protein, 9 aa, Homo Sapiens
ELREIFNAL

SEQ ID NO: 265580 - protein, 9 aa, Homo Sapiens
SGDLIFQYG

SEQ ID NO: 265581 - protein, 9 aa, Homo Sapiens
NISFLCKLQ

SEQ ID NO: 265582 - protein, 9 aa, Homo Sapiens
VKFVVSDPN

SEQ ID NO: 265583 - protein, 9 aa, Homo Sapiens
TSSQLMMDG

SEQ ID NO: 265584 - protein, 9 aa, Homo Sapiens
DDINVTQQS

SEQ ID NO: 265585 - protein, 9 aa, Homo Sapiens
REEIANTCN

SEQ ID NO: 265586 - protein, 9 aa, Homo Sapiens
LSVVSLFYV

SEQ ID NO: 265587 - protein, 9 aa, Homo Sapiens
KLIPDSCRI

SEQ ID NO: 265588 - protein, 9 aa, Homo Sapiens
RGDQGVPEY

SEQ ID NO: 265589 - protein, 9 aa, Homo Sapiens
NISIETNEK

SEQ ID NO: 265590 - protein, 9 aa, Homo Sapiens
HIGTEIAPD

SEQ ID NO: 265591 - protein, 9 aa, Homo Sapiens
EVSELMRQC

SEQ ID NO: 265592 - protein, 9 aa, Homo Sapiens
NNEKLEWAV

SEQ ID NO: 265593 - protein, 9 aa, Homo Sapiens
INIFLQQLN

SEQ ID NO: 265594 - protein, 9 aa, Homo Sapiens
LCTRKESKV

SEQ ID NO: 265595 - protein, 9 aa, Homo Sapiens
LPASQEENP

SEQ ID NO: 265596 - protein, 9 aa, Homo Sapiens
VEEVDALFK

SEQ ID NO: 265597 - protein, 9 aa, Homo Sapiens
EDTLCHFGF

SEQ ID NO: 265598 - protein, 9 aa, Homo Sapiens
KNEVDHCEH

SEQ ID NO: 265599 - protein, 9 aa, Homo Sapiens
HNKLVDPLC

SEQ ID NO: 265600 - protein, 9 aa, Homo Sapiens
KYQIGERIQ

SEQ ID NO: 265601 - protein, 9 aa, Homo Sapiens
KLVISKEGQ

SEQ ID NO: 265602 - protein, 9 aa, Homo Sapiens
RECQRQQLE

SEQ ID NO: 265603 - protein, 9 aa, Homo Sapiens
REQLETTCP

SEQ ID NO: 265604 - protein, 9 aa, Homo Sapiens
FEGWYFHSR

SEQ ID NO: 265605 - protein, 9 aa, Homo Sapiens
KRTPCPAST

SEQ ID NO: 265606 - protein, 9 aa, Homo Sapiens
IGNRESGSK

SEQ ID NO: 265607 - protein, 9 aa, Homo Sapiens
QVDGNQEFI

SEQ ID NO: 265608 - protein, 9 aa, Homo Sapiens
INASSRQCQ

SEQ ID NO: 265609 - protein, 9 aa, Homo Sapiens
LNLTKIKQL

SEQ ID NO: 265610 - protein, 9 aa, Homo Sapiens
MLNIGHLVF

SEQ ID NO: 265611 - protein, 9 aa, Homo Sapiens
FSQIIHLSI

SEQ ID NO: 265612 - protein, 9 aa, Homo Sapiens
DFEDSSLPT

SEQ ID NO: 265613 - protein, 9 aa, Homo Sapiens
RPFPCMECE

SEQ ID NO: 265614 - protein, 9 aa, Homo Sapiens
RGRQVDSRG

SEQ ID NO: 265615 - protein, 9 aa, Homo Sapiens
KLSAPTIPD

SEQ ID NO: 265616 - protein, 9 aa, Homo Sapiens
NTFPVEMTH

SEQ ID NO: 265617 - protein, 9 aa, Homo Sapiens
EESNEAEDS

SEQ ID NO: 265618 - protein, 9 aa, Homo Sapiens
DNVEDPYTS

SEQ ID NO: 265619 - protein, 9 aa, Homo Sapiens
CEHDFKMLF

SEQ ID NO: 265620 - protein, 9 aa, Homo Sapiens
SQGNPCTLV

SEQ ID NO: 265621 - protein, 9 aa, Homo Sapiens
KFMLKDDLK

SEQ ID NO: 265622 - protein, 9 aa, Homo Sapiens
KYKQEDSSD

SEQ ID NO: 265623 - protein, 9 aa, Homo Sapiens
QATNKNSLL

SEQ ID NO: 265624 - protein, 9 aa, Homo Sapiens
PSADPDNSG

SEQ ID NO: 265625 - protein, 9 aa, Homo Sapiens
FNVDGYIWP

SEQ ID NO: 265626 - protein, 9 aa, Homo Sapiens
DGRGFVDLI

SEQ ID NO: 265627 - protein, 9 aa, Homo Sapiens
YYCTCNPGF

SEQ ID NO: 265628 - protein, 9 aa, Homo Sapiens
QAFRACFLK

SEQ ID NO: 265629 - protein, 9 aa, Homo Sapiens
KGKVLIDIK

SEQ ID NO: 265630 - protein, 9 aa, Homo Sapiens
LRPDPQRPL

SEQ ID NO: 265631 - protein, 9 aa, Homo Sapiens
SLSSSRHTL

SEQ ID NO: 265632 - protein, 9 aa, Homo Sapiens
AELDNDIKV

SEQ ID NO: 265633 - protein, 9 aa, Homo Sapiens
KTQETAKEK

SEQ ID NO: 265634 - protein, 9 aa, Homo Sapiens
SSQLAGRKL

SEQ ID NO: 265635 - protein, 9 aa, Homo Sapiens
NPSYRNSLL

SEQ ID NO: 265636 - protein, 9 aa, Homo Sapiens
DTFLIVCYL

SEQ ID NO: 265637 - protein, 9 aa, Homo Sapiens
ECGKYFTSH

SEQ ID NO: 265638 - protein, 9 aa, Homo Sapiens
YLDMQTIKD

SEQ ID NO: 265639 - protein, 9 aa, Homo Sapiens
TSAILASVS

SEQ ID NO: 265640 - protein, 9 aa, Homo Sapiens
QEGRVFQDK

SEQ ID NO: 265641 - protein, 9 aa, Homo Sapiens
WQGDYGKFV

SEQ ID NO: 265642 - protein, 9 aa, Homo Sapiens
AAPEEECAL

SEQ ID NO: 265643 - protein, 9 aa, Homo Sapiens
MVLGVKGNY

SEQ ID NO: 265644 - protein, 9 aa, Homo Sapiens
ITDVAQVEI

SEQ ID NO: 265645 - protein, 9 aa, Homo Sapiens
ELIKQAQAR

SEQ ID NO: 265646 - protein, 9 aa, Homo Sapiens
PSLRITKCI

SEQ ID NO: 265647 - protein, 9 aa, Homo Sapiens
RKRQGYIHK

SEQ ID NO: 265648 - protein, 9 aa, Homo Sapiens
IPSSGLLVS

SEQ ID NO: 265649 - protein, 9 aa, Homo Sapiens
FQTAREKRA

SEQ ID NO: 265650 - protein, 9 aa, Homo Sapiens
QRSIRLMSV

SEQ ID NO: 265651 - protein, 9 aa, Homo Sapiens
RVFQDKWER

SEQ ID NO: 265652 - protein, 9 aa, Homo Sapiens
SRHTSEKLR

SEQ ID NO: 265653 - protein, 9 aa, Homo Sapiens
GLQDAANIH

SEQ ID NO: 265654 - protein, 9 aa, Homo Sapiens
FIFLRQSIA

SEQ ID NO: 265655 - protein, 9 aa, Homo Sapiens
NTAEGNPTG

SEQ ID NO: 265656 - protein, 9 aa, Homo Sapiens
GASLVDQKP

SEQ ID NO: 265657 - protein, 9 aa, Homo Sapiens
PQRHYLVSS

SEQ ID NO: 265658 - protein, 9 aa, Homo Sapiens
LQAAFRLLS

SEQ ID NO: 265659 - protein, 9 aa, Homo Sapiens
SNIKIVGSR

SEQ ID NO: 265660 - protein, 9 aa, Homo Sapiens
PTSAPRPTQ

SEQ ID NO: 265661 - protein, 9 aa, Homo Sapiens
LLAHHQVQS

SEQ ID NO: 265662 - protein, 9 aa, Homo Sapiens
QCGIIFSHN

SEQ ID NO: 265663 - protein, 9 aa, Homo Sapiens
GREGYTFQQ

SEQ ID NO: 265664 - protein, 9 aa, Homo Sapiens
NIIVSSKYT

SEQ ID NO: 265665 - protein, 9 aa, Homo Sapiens
WRTALLRAH

SEQ ID NO: 265666 - protein, 9 aa, Homo Sapiens
NVISLQLDK

SEQ ID NO: 265667 - protein, 9 aa, Homo Sapiens
HLQKVKGLG

SEQ ID NO: 265668 - protein, 9 aa, Homo Sapiens
PADVWPLDP

SEQ ID NO: 265669 - protein, 9 aa, Homo Sapiens
EDKSFDIFC

SEQ ID NO: 265670 - protein, 9 aa, Homo Sapiens
SVSAFFFSL

SEQ ID NO: 265671 - protein, 9 aa, Homo Sapiens
YAHKLPKYG

SEQ ID NO: 265672 - protein, 9 aa, Homo Sapiens
ESHRKSRKE

SEQ ID NO: 265673 - protein, 9 aa, Homo Sapiens
PSGVSIFCP

SEQ ID NO: 265674 - protein, 9 aa, Homo Sapiens
MYLPLKRRA

SEQ ID NO: 265675 - protein, 9 aa, Homo Sapiens
AHRKLCLPS

SEQ ID NO: 265676 - protein, 9 aa, Homo Sapiens
QFDEIILDI

SEQ ID NO: 265677 - protein, 9 aa, Homo Sapiens
TNLSYMELP

SEQ ID NO: 265678 - protein, 9 aa, Homo Sapiens
PPSYLLILD

SEQ ID NO: 265679 - protein, 9 aa, Homo Sapiens
NCDDIAMNC

SEQ ID NO: 265680 - protein, 9 aa, Homo Sapiens
FNLVRLLLN

SEQ ID NO: 265681 - protein, 9 aa, Homo Sapiens
SLKSSAQFM

SEQ ID NO: 265682 - protein, 9 aa, Homo Sapiens
GLFVLGITS

SEQ ID NO: 265683 - protein, 9 aa, Homo Sapiens
LTQRASNKK

SEQ ID NO: 265684 - protein, 9 aa, Homo Sapiens
LQNHLQEIR

SEQ ID NO: 265685 - protein, 9 aa, Homo Sapiens
PTIVTYVGR

SEQ ID NO: 265686 - protein, 9 aa, Homo Sapiens
EMCKLDPGQ

SEQ ID NO: 265687 - protein, 9 aa, Homo Sapiens
CSTMYLPLK

SEQ ID NO: 265688 - protein, 9 aa, Homo Sapiens
SGTTAINYK

SEQ ID NO: 265689 - protein, 9 aa, Homo Sapiens
QGTNFTLAK

SEQ ID NO: 265690 - protein, 9 aa, Homo Sapiens
NRIHTGERP

SEQ ID NO: 265691 - protein, 9 aa, Homo Sapiens
AHEKYMELS

SEQ ID NO: 265692 - protein, 9 aa, Homo Sapiens
VLLYLDMQT

SEQ ID NO: 265693 - protein, 9 aa, Homo Sapiens
DRLGQRVRL

SEQ ID NO: 265694 - protein, 9 aa, Homo Sapiens
YVSPEDIKK

SEQ ID NO: 265695 - protein, 9 aa, Homo Sapiens
KDLQLPPSD

SEQ ID NO: 265696 - protein, 9 aa, Homo Sapiens
TTKLEHILL

SEQ ID NO: 265697 - protein, 9 aa, Homo Sapiens
WSKSLPGFQ

SEQ ID NO: 265698 - protein, 9 aa, Homo Sapiens
KKSFLLGKK

SEQ ID NO: 265699 - protein, 9 aa, Homo Sapiens
AVAEWRRWM

SEQ ID NO: 265700 - protein, 9 aa, Homo Sapiens
FVNNLPLHE

SEQ ID NO: 265701 - protein, 9 aa, Homo Sapiens
SKTQSKDIF

SEQ ID NO: 265702 - protein, 9 aa, Homo Sapiens
VRLHEVPCF

SEQ ID NO: 265703 - protein, 9 aa, Homo Sapiens
CSPRRKSAG

SEQ ID NO: 265704 - protein, 9 aa, Homo Sapiens
MIDAADRER

SEQ ID NO: 265705 - protein, 9 aa, Homo Sapiens
LDLCTVFGE

SEQ ID NO: 265706 - protein, 9 aa, Homo Sapiens
GLWGLVNTA

SEQ ID NO: 265707 - protein, 9 aa, Homo Sapiens
LEQVKRFKA

SEQ ID NO: 265708 - protein, 9 aa, Homo Sapiens
KKKKKNKGN

SEQ ID NO: 265709 - protein, 9 aa, Homo Sapiens
SKSCLGSIL

SEQ ID NO: 265710 - protein, 9 aa, Homo Sapiens
DLQSLIKFA

SEQ ID NO: 265711 - protein, 9 aa, Homo Sapiens
PFPCFSPCG

SEQ ID NO: 265712 - protein, 9 aa, Homo Sapiens
EEEEGLEID

SEQ ID NO: 265713 - protein, 9 aa, Homo Sapiens
GARKNTFAL

SEQ ID NO: 265714 - protein, 9 aa, Homo Sapiens
QRNLSLSLS

SEQ ID NO: 265715 - protein, 9 aa, Homo Sapiens
LGNYKNFFF

SEQ ID NO: 265716 - protein, 9 aa, Homo Sapiens
SECGTAFSQ

SEQ ID NO: 265717 - protein, 9 aa, Homo Sapiens
HIKRKDLSL

SEQ ID NO: 265718 - protein, 9 aa, Homo Sapiens
NFLATLPHE

SEQ ID NO: 265719 - protein, 9 aa, Homo Sapiens
KEVNYLHER

SEQ ID NO: 265720 - protein, 9 aa, Homo Sapiens
KSPDRLAAI

SEQ ID NO: 265721 - protein, 9 aa, Homo Sapiens
TNALHVPQD

SEQ ID NO: 265722 - protein, 9 aa, Homo Sapiens
HYDVISCLN

SEQ ID NO: 265723 - protein, 9 aa, Homo Sapiens
DCFWKIALP

SEQ ID NO: 265724 - protein, 9 aa, Homo Sapiens
GTGKKITLK

SEQ ID NO: 265725 - protein, 9 aa, Homo Sapiens
VKSLKSHAR

SEQ ID NO: 265726 - protein, 9 aa, Homo Sapiens
HYRLTHAEI

SEQ ID NO: 265727 - protein, 9 aa, Homo Sapiens
LEKQLSELK

SEQ ID NO: 265728 - protein, 9 aa, Homo Sapiens
NKRILHNTK

SEQ ID NO: 265729 - protein, 9 aa, Homo Sapiens
KHHHHNEKK

SEQ ID NO: 265730 - protein, 9 aa, Homo Sapiens
CTNCPKGAC

SEQ ID NO: 265731 - protein, 9 aa, Homo Sapiens
LRKGDKFVL

SEQ ID NO: 265732 - protein, 9 aa, Homo Sapiens
KTTSKKRGK

SEQ ID NO: 265733 - protein, 9 aa, Homo Sapiens
VSGGKTRDG

SEQ ID NO: 265734 - protein, 9 aa, Homo Sapiens
ELGRLFRLQ

SEQ ID NO: 265735 - protein, 9 aa, Homo Sapiens
YNEAKFVTF

SEQ ID NO: 265736 - protein, 9 aa, Homo Sapiens
TGGIFSVTE

SEQ ID NO: 265737 - protein, 9 aa, Homo Sapiens
SINNRQKIQ

SEQ ID NO: 265738 - protein, 9 aa, Homo Sapiens
FKVDIPDIH

SEQ ID NO: 265739 - protein, 9 aa, Homo Sapiens
IVGIYVLSS

SEQ ID NO: 265740 - protein, 9 aa, Homo Sapiens
KTFQTQASL

SEQ ID NO: 265741 - protein, 9 aa, Homo Sapiens
WMEDTAFRT

SEQ ID NO: 265742 - protein, 9 aa, Homo Sapiens
TSIPAYTMP

SEQ ID NO: 265743 - protein, 9 aa, Homo Sapiens
QQENLARNL

SEQ ID NO: 265744 - protein, 9 aa, Homo Sapiens
KMQDRLDIL

SEQ ID NO: 265745 - protein, 9 aa, Homo Sapiens
IEFNKMLKS

SEQ ID NO: 265746 - protein, 9 aa, Homo Sapiens
PVLLKCNSL

SEQ ID NO: 265747 - protein, 9 aa, Homo Sapiens
DPTSKREHW

SEQ ID NO: 265748 - protein, 9 aa, Homo Sapiens
LNDNYPSFA

SEQ ID NO: 265749 - protein, 9 aa, Homo Sapiens
KATKKGEKE

SEQ ID NO: 265750 - protein, 9 aa, Homo Sapiens
DKITQFWLY

SEQ ID NO: 265751 - protein, 9 aa, Homo Sapiens
GPPTAFYLL

SEQ ID NO: 265752 - protein, 9 aa, Homo Sapiens
VNNLRKDKS

SEQ ID NO: 265753 - protein, 9 aa, Homo Sapiens
GDKLWDHNQ

SEQ ID NO: 265754 - protein, 9 aa, Homo Sapiens
KVIEELQKL

SEQ ID NO: 265755 - protein, 9 aa, Homo Sapiens
CRMQLVRGI

SEQ ID NO: 265756 - protein, 9 aa, Homo Sapiens
EGTAPEICT

SEQ ID NO: 265757 - protein, 9 aa, Homo Sapiens
LIMEGVTTL

SEQ ID NO: 265758 - protein, 9 aa, Homo Sapiens
ERNYHIVYQ

SEQ ID NO: 265759 - protein, 9 aa, Homo Sapiens
DCGIAQEIQ

SEQ ID NO: 265760 - protein, 9 aa, Homo Sapiens
RKNIQLLKD

SEQ ID NO: 265761 - protein, 9 aa, Homo Sapiens
PLPPKKWIG

SEQ ID NO: 265762 - protein, 9 aa, Homo Sapiens
AMYLNNVAE

SEQ ID NO: 265763 - protein, 9 aa, Homo Sapiens
VRKVIQNPG

SEQ ID NO: 265764 - protein, 9 aa, Homo Sapiens
LRFPAEPLG

SEQ ID NO: 265765 - protein, 9 aa, Homo Sapiens
YSYSYLVHC

SEQ ID NO: 265766 - protein, 9 aa, Homo Sapiens
GLSHVQNKS

SEQ ID NO: 265767 - protein, 9 aa, Homo Sapiens
LAPVGTTIF

SEQ ID NO: 265768 - protein, 9 aa, Homo Sapiens
FLYFSYLCV

SEQ ID NO: 265769 - protein, 9 aa, Homo Sapiens
DLSSQIRSN

SEQ ID NO: 265770 - protein, 9 aa, Homo Sapiens
VTLYGKEKV

SEQ ID NO: 265771 - protein, 9 aa, Homo Sapiens
HPCKKLFYS

SEQ ID NO: 265772 - protein, 9 aa, Homo Sapiens
GLGSSAAYL

SEQ ID NO: 265773 - protein, 9 aa, Homo Sapiens
YSVFFNKLA

SEQ ID NO: 265774 - protein, 9 aa, Homo Sapiens
LIRQSYHGT

SEQ ID NO: 265775 - protein, 9 aa, Homo Sapiens
ERTIQLNIT

SEQ ID NO: 265776 - protein, 9 aa, Homo Sapiens
GRFTTLVQD

SEQ ID NO: 265777 - protein, 9 aa, Homo Sapiens
SHFQEAIYF

SEQ ID NO: 265778 - protein, 9 aa, Homo Sapiens
ANNSIDKST

SEQ ID NO: 265779 - protein, 9 aa, Homo Sapiens
SIHKTQCAV

SEQ ID NO: 265780 - protein, 9 aa, Homo Sapiens
DDIAMNCII

SEQ ID NO: 265781 - protein, 9 aa, Homo Sapiens
DPNLSFEGT

SEQ ID NO: 265782 - protein, 9 aa, Homo Sapiens
GATKEALHA

SEQ ID NO: 265783 - protein, 9 aa, Homo Sapiens
IIAKEEQQK

SEQ ID NO: 265784 - protein, 9 aa, Homo Sapiens
QLGTVIYLP

SEQ ID NO: 265785 - protein, 9 aa, Homo Sapiens
AIYGFVIFL

SEQ ID NO: 265786 - protein, 9 aa, Homo Sapiens
LGHIKQMQE

SEQ ID NO: 265787 - protein, 9 aa, Homo Sapiens
WRTNPLDRP

SEQ ID NO: 265788 - protein, 9 aa, Homo Sapiens
HMEDYHTDI

SEQ ID NO: 265789 - protein, 9 aa, Homo Sapiens
HLGRVHFLV

SEQ ID NO: 265790 - protein, 9 aa, Homo Sapiens
QFLTAVQNI

SEQ ID NO: 265791 - protein, 9 aa, Homo Sapiens
MHYLPDMDP

SEQ ID NO: 265792 - protein, 9 aa, Homo Sapiens
CQPSGSGRA

SEQ ID NO: 265793 - protein, 9 aa, Homo Sapiens
NAEKALYGS

SEQ ID NO: 265794 - protein, 9 aa, Homo Sapiens
GLKVTGKSD

SEQ ID NO: 265795 - protein, 9 aa, Homo Sapiens
FVCQSTLIP

SEQ ID NO: 265796 - protein, 9 aa, Homo Sapiens
DIKSKEAEE

SEQ ID NO: 265797 - protein, 9 aa, Homo Sapiens
DVPHDFGNQ

SEQ ID NO: 265798 - protein, 9 aa, Homo Sapiens
QRHMITHTG

SEQ ID NO: 265799 - protein, 9 aa, Homo Sapiens
SPLDTTHFS

SEQ ID NO: 265800 - protein, 9 aa, Homo Sapiens
VLPVKTLLE

SEQ ID NO: 265801 - protein, 9 aa, Homo Sapiens
AAMFRQFQQ

SEQ ID NO: 265802 - protein, 9 aa, Homo Sapiens
EFPAPEQFK

SEQ ID NO: 265803 - protein, 9 aa, Homo Sapiens
FAPILSFLR

SEQ ID NO: 265804 - protein, 9 aa, Homo Sapiens
SLLALPQYL

SEQ ID NO: 265805 - protein, 9 aa, Homo Sapiens
KDPEVNEFQ

SEQ ID NO: 265806 - protein, 9 aa, Homo Sapiens
QTLGKQLNV

SEQ ID NO: 265807 - protein, 9 aa, Homo Sapiens
VVLCYWFNR

SEQ ID NO: 265808 - protein, 9 aa, Homo Sapiens
PLPGYRLRE

SEQ ID NO: 265809 - protein, 9 aa, Homo Sapiens
ICKREPGGR

SEQ ID NO: 265810 - protein, 9 aa, Homo Sapiens
DNLFDSLCS

SEQ ID NO: 265811 - protein, 9 aa, Homo Sapiens
LLINSRRME

SEQ ID NO: 265812 - protein, 9 aa, Homo Sapiens
RGGYKPVWN

SEQ ID NO: 265813 - protein, 9 aa, Homo Sapiens
VNIFPQKKC

SEQ ID NO: 265814 - protein, 9 aa, Homo Sapiens
KGFLDCLLK

SEQ ID NO: 265815 - protein, 9 aa, Homo Sapiens
KIENWDEQA

SEQ ID NO: 265816 - protein, 9 aa, Homo Sapiens
WATQERIYL

SEQ ID NO: 265817 - protein, 9 aa, Homo Sapiens
KSSCYINVR

SEQ ID NO: 265818 - protein, 9 aa, Homo Sapiens
ARRDLYRDV

SEQ ID NO: 265819 - protein, 9 aa, Homo Sapiens
ITLMGTLSG

SEQ ID NO: 265820 - protein, 9 aa, Homo Sapiens
LPEEHPSVH

SEQ ID NO: 265821 - protein, 9 aa, Homo Sapiens
VAMYGGVVL

SEQ ID NO: 265822 - protein, 9 aa, Homo Sapiens
LFLHSNKLS

SEQ ID NO: 265823 - protein, 9 aa, Homo Sapiens
LDNKLPVVE

SEQ ID NO: 265824 - protein, 9 aa, Homo Sapiens
LLAGAATFS

SEQ ID NO: 265825 - protein, 9 aa, Homo Sapiens
ATLAKQLEG

SEQ ID NO: 265826 - protein, 9 aa, Homo Sapiens
SKKFLIWLS

SEQ ID NO: 265827 - protein, 9 aa, Homo Sapiens
FSISADPWT

SEQ ID NO: 265828 - protein, 9 aa, Homo Sapiens
NKRSLNSKL

SEQ ID NO: 265829 - protein, 9 aa, Homo Sapiens
PGVPVPRGL

SEQ ID NO: 265830 - protein, 9 aa, Homo Sapiens
KNYKAEFAS

SEQ ID NO: 265831 - protein, 9 aa, Homo Sapiens
DIESTKGEL

SEQ ID NO: 265832 - protein, 9 aa, Homo Sapiens
LNEHKKIHI

SEQ ID NO: 265833 - protein, 9 aa, Homo Sapiens
HSTHRYLAL

SEQ ID NO: 265834 - protein, 9 aa, Homo Sapiens
QSLPKYLIY

SEQ ID NO: 265835 - protein, 9 aa, Homo Sapiens
CGQVLNNFS

SEQ ID NO: 265836 - protein, 9 aa, Homo Sapiens
SSAAYLVCL

SEQ ID NO: 265837 - protein, 9 aa, Homo Sapiens
KVLQGCNKK

SEQ ID NO: 265838 - protein, 9 aa, Homo Sapiens
SNVPAMYVA

SEQ ID NO: 265839 - protein, 9 aa, Homo Sapiens
VALQCPIVL

SEQ ID NO: 265840 - protein, 9 aa, Homo Sapiens
AVADTLDNS

SEQ ID NO: 265841 - protein, 9 aa, Homo Sapiens
QEAPSLPPE

SEQ ID NO: 265842 - protein, 9 aa, Homo Sapiens
YLSKMLEDL

SEQ ID NO: 265843 - protein, 9 aa, Homo Sapiens
RDLGKSGLR

SEQ ID NO: 265844 - protein, 9 aa, Homo Sapiens
TLRDHHIIH

SEQ ID NO: 265845 - protein, 9 aa, Homo Sapiens
QSNLEVPPG

SEQ ID NO: 265846 - protein, 9 aa, Homo Sapiens
PHTTAAPVD

SEQ ID NO: 265847 - protein, 9 aa, Homo Sapiens
KCHLIVHKI

SEQ ID NO: 265848 - protein, 9 aa, Homo Sapiens
HFQDKNLME

SEQ ID NO: 265849 - protein, 9 aa, Homo Sapiens
SMSMAGCAT

SEQ ID NO: 265850 - protein, 9 aa, Homo Sapiens
KELENTLKA

SEQ ID NO: 265851 - protein, 9 aa, Homo Sapiens
FQGGKLSAV

SEQ ID NO: 265852 - protein, 9 aa, Homo Sapiens
HNKKVEENS

SEQ ID NO: 265853 - protein, 9 aa, Homo Sapiens
ITRQNQLYD

SEQ ID NO: 265854 - protein, 9 aa, Homo Sapiens
TEDMKRYLH

SEQ ID NO: 265855 - protein, 9 aa, Homo Sapiens
KRKSNLSNS

SEQ ID NO: 265856 - protein, 9 aa, Homo Sapiens
GEVNCARYM

SEQ ID NO: 265857 - protein, 9 aa, Homo Sapiens
ILEGRHFPR

SEQ ID NO: 265858 - protein, 9 aa, Homo Sapiens
NTTTGISQD

SEQ ID NO: 265859 - protein, 9 aa, Homo Sapiens
SYIKEIKDL

SEQ ID NO: 265860 - protein, 9 aa, Homo Sapiens
LKTVLHIIY

SEQ ID NO: 265861 - protein, 9 aa, Homo Sapiens
ISYILAGVN

SEQ ID NO: 265862 - protein, 9 aa, Homo Sapiens
YDKCGKNPE

SEQ ID NO: 265863 - protein, 9 aa, Homo Sapiens
GVNVSGGKT

SEQ ID NO: 265864 - protein, 9 aa, Homo Sapiens
MNLSQAFYS

SEQ ID NO: 265865 - protein, 9 aa, Homo Sapiens
GGPVPNPNP

SEQ ID NO: 265866 - protein, 9 aa, Homo Sapiens
KEQRDAHIF

SEQ ID NO: 265867 - protein, 9 aa, Homo Sapiens
GPTSVYAED

SEQ ID NO: 265868 - protein, 9 aa, Homo Sapiens
VNKNVKCTA

SEQ ID NO: 265869 - protein, 9 aa, Homo Sapiens
ISRLKESKT

SEQ ID NO: 265870 - protein, 9 aa, Homo Sapiens
ITCLEIYYV

SEQ ID NO: 265871 - protein, 9 aa, Homo Sapiens
LFEHGGFPP

SEQ ID NO: 265872 - protein, 9 aa, Homo Sapiens
FFQQKWKDE

SEQ ID NO: 265873 - protein, 9 aa, Homo Sapiens
ATMKYIKGV

SEQ ID NO: 265874 - protein, 9 aa, Homo Sapiens
RGHVEPGED

SEQ ID NO: 265875 - protein, 9 aa, Homo Sapiens
GALSVCNSA

SEQ ID NO: 265876 - protein, 9 aa, Homo Sapiens
QQSFATPRA

SEQ ID NO: 265877 - protein, 9 aa, Homo Sapiens
DPQRCTVDG

SEQ ID NO: 265878 - protein, 9 aa, Homo Sapiens
LPRIHALGG

SEQ ID NO: 265879 - protein, 9 aa, Homo Sapiens
IMFAFFPDD

SEQ ID NO: 265880 - protein, 9 aa, Homo Sapiens
WNLPPCPFP

SEQ ID NO: 265881 - protein, 9 aa, Homo Sapiens
AQNEQDAYA

SEQ ID NO: 265882 - protein, 9 aa, Homo Sapiens
LAGLLRALL

SEQ ID NO: 265883 - protein, 9 aa, Homo Sapiens
SKEEFPDVD

SEQ ID NO: 265884 - protein, 9 aa, Homo Sapiens
CVRFIPVTD

SEQ ID NO: 265885 - protein, 9 aa, Homo Sapiens
ASFSEYLGA

SEQ ID NO: 265886 - protein, 9 aa, Homo Sapiens
NSLTIYHVS

SEQ ID NO: 265887 - protein, 9 aa, Homo Sapiens
LGKQHCLPE

SEQ ID NO: 265888 - protein, 9 aa, Homo Sapiens
SIVTQEEAP

SEQ ID NO: 265889 - protein, 9 aa, Homo Sapiens
PVNYVKILG

SEQ ID NO: 265890 - protein, 9 aa, Homo Sapiens
SLHGSLGKL

SEQ ID NO: 265891 - protein, 9 aa, Homo Sapiens
DFCCACAIT

SEQ ID NO: 265892 - protein, 9 aa, Homo Sapiens
SDNEMCKLD

SEQ ID NO: 265893 - protein, 9 aa, Homo Sapiens
ILLSYYTIV

SEQ ID NO: 265894 - protein, 9 aa, Homo Sapiens
ATRPINAHS

SEQ ID NO: 265895 - protein, 9 aa, Homo Sapiens
HFCSHLGVI

SEQ ID NO: 265896 - protein, 9 aa, Homo Sapiens
LFQCNVHVK

SEQ ID NO: 265897 - protein, 9 aa, Homo Sapiens
SEKLSSFPY

SEQ ID NO: 265898 - protein, 9 aa, Homo Sapiens
FIFSTRNNL

SEQ ID NO: 265899 - protein, 9 aa, Homo Sapiens
SFRSMQDDW

SEQ ID NO: 265900 - protein, 9 aa, Homo Sapiens
HDISNDAGE

SEQ ID NO: 265901 - protein, 9 aa, Homo Sapiens
QAAFRLLSQ

SEQ ID NO: 265902 - protein, 9 aa, Homo Sapiens
FINDVDCYL

SEQ ID NO: 265903 - protein, 9 aa, Homo Sapiens
QFLSKLSEY

SEQ ID NO: 265904 - protein, 9 aa, Homo Sapiens
THSRLAALQ

SEQ ID NO: 265905 - protein, 9 aa, Homo Sapiens
PTRSVKASY

SEQ ID NO: 265906 - protein, 9 aa, Homo Sapiens
HGLIKHFSE

SEQ ID NO: 265907 - protein, 9 aa, Homo Sapiens
LQATGFQLN

SEQ ID NO: 265908 - protein, 9 aa, Homo Sapiens
IFLCWFPLY

SEQ ID NO: 265909 - protein, 9 aa, Homo Sapiens
GSQKERNRI

SEQ ID NO: 265910 - protein, 9 aa, Homo Sapiens
PRNWHQKED

SEQ ID NO: 265911 - protein, 9 aa, Homo Sapiens
NVTLLYLKK

SEQ ID NO: 265912 - protein, 9 aa, Homo Sapiens
FNVGGIIGG

SEQ ID NO: 265913 - protein, 9 aa, Homo Sapiens
VQRGGGRGA

SEQ ID NO: 265914 - protein, 9 aa, Homo Sapiens
SAVATARCP

SEQ ID NO: 265915 - protein, 9 aa, Homo Sapiens
LQRELEQAQ

SEQ ID NO: 265916 - protein, 9 aa, Homo Sapiens
SLYMSPELR

SEQ ID NO: 265917 - protein, 9 aa, Homo Sapiens
LLKHMKHEH

SEQ ID NO: 265918 - protein, 9 aa, Homo Sapiens
NYNRPTIPQ

SEQ ID NO: 265919 - protein, 9 aa, Homo Sapiens
TLIPSESKG

SEQ ID NO: 265920 - protein, 9 aa, Homo Sapiens
LQNDLVDAS

SEQ ID NO: 265921 - protein, 9 aa, Homo Sapiens
SFLLFPQDI

SEQ ID NO: 265922 - protein, 9 aa, Homo Sapiens
TQEEFVKAA

SEQ ID NO: 265923 - protein, 9 aa, Homo Sapiens
SVQKSSGGK

SEQ ID NO: 265924 - protein, 9 aa, Homo Sapiens
EKPPTPKRW

SEQ ID NO: 265925 - protein, 9 aa, Homo Sapiens
INASKNHQD

SEQ ID NO: 265926 - protein, 9 aa, Homo Sapiens
LTPTGKEDT

SEQ ID NO: 265927 - protein, 9 aa, Homo Sapiens
KKRGKKVNM

SEQ ID NO: 265928 - protein, 9 aa, Homo Sapiens
DNNQIKTFQ

SEQ ID NO: 265929 - protein, 9 aa, Homo Sapiens
LPQLSKPYI

SEQ ID NO: 265930 - protein, 9 aa, Homo Sapiens
PQAGHCRIK

SEQ ID NO: 265931 - protein, 9 aa, Homo Sapiens
QENYTVQIP

SEQ ID NO: 265932 - protein, 9 aa, Homo Sapiens
LYLGKTFLQ

SEQ ID NO: 265933 - protein, 9 aa, Homo Sapiens
LTETGEVCE

SEQ ID NO: 265934 - protein, 9 aa, Homo Sapiens
FKTFVMGLN

SEQ ID NO: 265935 - protein, 9 aa, Homo Sapiens
KDVSSCYRQ

SEQ ID NO: 265936 - protein, 9 aa, Homo Sapiens
GSVSPHLHA

SEQ ID NO: 265937 - protein, 9 aa, Homo Sapiens
HRVQTEKHV

SEQ ID NO: 265938 - protein, 9 aa, Homo Sapiens
LKQQLLSYA

SEQ ID NO: 265939 - protein, 9 aa, Homo Sapiens
EVLEISSLL

SEQ ID NO: 265940 - protein, 9 aa, Homo Sapiens
EQRYWQNIL

SEQ ID NO: 265941 - protein, 9 aa, Homo Sapiens
DTFFQIVIC

SEQ ID NO: 265942 - protein, 9 aa, Homo Sapiens
CLKIASKPP

SEQ ID NO: 265943 - protein, 9 aa, Homo Sapiens
EESFKNLFW

SEQ ID NO: 265944 - protein, 9 aa, Homo Sapiens
KIFMAIAKK

SEQ ID NO: 265945 - protein, 9 aa, Homo Sapiens
LETQAEKLE

SEQ ID NO: 265946 - protein, 9 aa, Homo Sapiens
TAQLLYLQE

SEQ ID NO: 265947 - protein, 9 aa, Homo Sapiens
TTKLPLKFS

SEQ ID NO: 265948 - protein, 9 aa, Homo Sapiens
GLIQAQSIG

SEQ ID NO: 265949 - protein, 9 aa, Homo Sapiens
MYIALVWII

SEQ ID NO: 265950 - protein, 9 aa, Homo Sapiens
ANDMLPKNS

SEQ ID NO: 265951 - protein, 9 aa, Homo Sapiens
LEIKKEKNI

SEQ ID NO: 265952 - protein, 9 aa, Homo Sapiens
IKIVGSRLP

SEQ ID NO: 265953 - protein, 9 aa, Homo Sapiens
DIANYVVRF

SEQ ID NO: 265954 - protein, 9 aa, Homo Sapiens
VFVCLFVCF

SEQ ID NO: 265955 - protein, 9 aa, Homo Sapiens
RCIFVENLY

SEQ ID NO: 265956 - protein, 9 aa, Homo Sapiens
SFKVAGEAE

SEQ ID NO: 265957 - protein, 9 aa, Homo Sapiens
LEFVCEAIQ

SEQ ID NO: 265958 - protein, 9 aa, Homo Sapiens
LLVTKDILK

SEQ ID NO: 265959 - protein, 9 aa, Homo Sapiens
SIISAWNNG

SEQ ID NO: 265960 - protein, 9 aa, Homo Sapiens
DKGRDSSSD

SEQ ID NO: 265961 - protein, 9 aa, Homo Sapiens
IHYNTMIEN

SEQ ID NO: 265962 - protein, 9 aa, Homo Sapiens
ASINNRQKI

SEQ ID NO: 265963 - protein, 9 aa, Homo Sapiens
WNLVIQERL

SEQ ID NO: 265964 - protein, 9 aa, Homo Sapiens
GGLHEFLVN

SEQ ID NO: 265965 - protein, 9 aa, Homo Sapiens
ITELCKRSP

SEQ ID NO: 265966 - protein, 9 aa, Homo Sapiens
KENSRDDSG

SEQ ID NO: 265967 - protein, 9 aa, Homo Sapiens
VKGAPESHF

SEQ ID NO: 265968 - protein, 9 aa, Homo Sapiens
EANLFGSNA

SEQ ID NO: 265969 - protein, 9 aa, Homo Sapiens
PMLFNKNFV

SEQ ID NO: 265970 - protein, 9 aa, Homo Sapiens
GVVHLGEWW

SEQ ID NO: 265971 - protein, 9 aa, Homo Sapiens
VKKNISEYS

SEQ ID NO: 265972 - protein, 9 aa, Homo Sapiens
FKQLENSPL

SEQ ID NO: 265973 - protein, 9 aa, Homo Sapiens
NCGAMTHKN

SEQ ID NO: 265974 - protein, 9 aa, Homo Sapiens
IASQKNVKA

SEQ ID NO: 265975 - protein, 9 aa, Homo Sapiens
TLSVLQCRR

SEQ ID NO: 265976 - protein, 9 aa, Homo Sapiens
GRNLSDLWE

SEQ ID NO: 265977 - protein, 9 aa, Homo Sapiens
IGSDCPDPQ

SEQ ID NO: 265978 - protein, 9 aa, Homo Sapiens
PQLSGSFFL

SEQ ID NO: 265979 - protein, 9 aa, Homo Sapiens
NWNHDSEDT

SEQ ID NO: 265980 - protein, 9 aa, Homo Sapiens
RCTDVNNSK

SEQ ID NO: 265981 - protein, 9 aa, Homo Sapiens
LWVHRFEYK

SEQ ID NO: 265982 - protein, 9 aa, Homo Sapiens
LPRNEIAAQ

SEQ ID NO: 265983 - protein, 9 aa, Homo Sapiens
PLANHRDNE

SEQ ID NO: 265984 - protein, 9 aa, Homo Sapiens
DAQLFNKVV

SEQ ID NO: 265985 - protein, 9 aa, Homo Sapiens
GLSDPESEA

SEQ ID NO: 265986 - protein, 9 aa, Homo Sapiens
SLGQNRSYV

SEQ ID NO: 265987 - protein, 9 aa, Homo Sapiens
QVADAIIGN

SEQ ID NO: 265988 - protein, 9 aa, Homo Sapiens
EGMLQPQVK

SEQ ID NO: 265989 - protein, 9 aa, Homo Sapiens
RLHEVPCFD

SEQ ID NO: 265990 - protein, 9 aa, Homo Sapiens
DLTTRLQEQ

SEQ ID NO: 265991 - protein, 9 aa, Homo Sapiens
QNILIQVEE

SEQ ID NO: 265992 - protein, 9 aa, Homo Sapiens
NTLFPTKQS

SEQ ID NO: 265993 - protein, 9 aa, Homo Sapiens
ANKKRAKEL

SEQ ID NO: 265994 - protein, 9 aa, Homo Sapiens
TYSFIQCLL

SEQ ID NO: 265995 - protein, 9 aa, Homo Sapiens
SQGKKPAMA

SEQ ID NO: 265996 - protein, 9 aa, Homo Sapiens
WHIGVCSNN

SEQ ID NO: 265997 - protein, 9 aa, Homo Sapiens
LTTSDKFGC

SEQ ID NO: 265998 - protein, 9 aa, Homo Sapiens
HENIIRKFS

SEQ ID NO: 265999 - protein, 9 aa, Homo Sapiens
NRLWDNMRK

SEQ ID NO: 266000 - protein, 9 aa, Homo Sapiens
QFIHLALYS

SEQ ID NO: 266001 - protein, 9 aa, Homo Sapiens
EHDKEIIRG

SEQ ID NO: 266002 - protein, 9 aa, Homo Sapiens
TCGLAWGLE

SEQ ID NO: 266003 - protein, 9 aa, Homo Sapiens
SLIIHKIIH

SEQ ID NO: 266004 - protein, 9 aa, Homo Sapiens
EFPEYSQDP

SEQ ID NO: 266005 - protein, 9 aa, Homo Sapiens
VADQGEQQS

SEQ ID NO: 266006 - protein, 9 aa, Homo Sapiens
DLSERIASR

SEQ ID NO: 266007 - protein, 9 aa, Homo Sapiens
SIMKEDVPA

SEQ ID NO: 266008 - protein, 9 aa, Homo Sapiens
GKKPAMAPC

SEQ ID NO: 266009 - protein, 9 aa, Homo Sapiens
ITLTQRASN

SEQ ID NO: 266010 - protein, 9 aa, Homo Sapiens
YQEYKESAS

SEQ ID NO: 266011 - protein, 9 aa, Homo Sapiens
DADEGALNE

SEQ ID NO: 266012 - protein, 9 aa, Homo Sapiens
NALDQLSQV

SEQ ID NO: 266013 - protein, 9 aa, Homo Sapiens
RYKNLSLRY

SEQ ID NO: 266014 - protein, 9 aa, Homo Sapiens
QDDAEKLGF

SEQ ID NO: 266015 - protein, 9 aa, Homo Sapiens
RYLYFKDSL

SEQ ID NO: 266016 - protein, 9 aa, Homo Sapiens
DELKAKVMQ

SEQ ID NO: 266017 - protein, 9 aa, Homo Sapiens
GNTKSPEPG

SEQ ID NO: 266018 - protein, 9 aa, Homo Sapiens
HRKTINPVF

SEQ ID NO: 266019 - protein, 9 aa, Homo Sapiens
WATVMLNGQ

SEQ ID NO: 266020 - protein, 9 aa, Homo Sapiens
EAYSMAKMT

SEQ ID NO: 266021 - protein, 9 aa, Homo Sapiens
LSISKDDLI

SEQ ID NO: 266022 - protein, 9 aa, Homo Sapiens
WILYCLTLN

SEQ ID NO: 266023 - protein, 9 aa, Homo Sapiens
SLLRYKGPS

SEQ ID NO: 266024 - protein, 9 aa, Homo Sapiens
RRIGKDCGD

SEQ ID NO: 266025 - protein, 9 aa, Homo Sapiens
LVRGIRKEE

SEQ ID NO: 266026 - protein, 9 aa, Homo Sapiens
GNQNEKQIA

SEQ ID NO: 266027 - protein, 9 aa, Homo Sapiens
LPKVSFCGR

SEQ ID NO: 266028 - protein, 9 aa, Homo Sapiens
VPVCLVTVD

SEQ ID NO: 266029 - protein, 9 aa, Homo Sapiens
FHNLFLNTG

SEQ ID NO: 266030 - protein, 9 aa, Homo Sapiens
INGSGISGT

SEQ ID NO: 266031 - protein, 9 aa, Homo Sapiens
ALNDQNSKL

SEQ ID NO: 266032 - protein, 9 aa, Homo Sapiens
PGGEFNPHS

SEQ ID NO: 266033 - protein, 9 aa, Homo Sapiens
LTVKLRLLI

SEQ ID NO: 266034 - protein, 9 aa, Homo Sapiens
YVMKHYRLT

SEQ ID NO: 266035 - protein, 9 aa, Homo Sapiens
WLPSKHIWL

SEQ ID NO: 266036 - protein, 9 aa, Homo Sapiens
TESSKYGSL

SEQ ID NO: 266037 - protein, 9 aa, Homo Sapiens
KVVQEDGCM

SEQ ID NO: 266038 - protein, 9 aa, Homo Sapiens
WDLLIPQSS

SEQ ID NO: 266039 - protein, 9 aa, Homo Sapiens
ISSEGVFKR

SEQ ID NO: 266040 - protein, 9 aa, Homo Sapiens
IYIHALHLQ

SEQ ID NO: 266041 - protein, 9 aa, Homo Sapiens
DKDPESFVK

SEQ ID NO: 266042 - protein, 9 aa, Homo Sapiens
REQRRTQRY

SEQ ID NO: 266043 - protein, 9 aa, Homo Sapiens
PEVISHPER

SEQ ID NO: 266044 - protein, 9 aa, Homo Sapiens
VDLSDRLER

SEQ ID NO: 266045 - protein, 9 aa, Homo Sapiens
ISLIGYWVL

SEQ ID NO: 266046 - protein, 9 aa, Homo Sapiens
ERRMRLYIR

SEQ ID NO: 266047 - protein, 9 aa, Homo Sapiens
VDVRDELSG

SEQ ID NO: 266048 - protein, 9 aa, Homo Sapiens
RDRPDTQKL

SEQ ID NO: 266049 - protein, 9 aa, Homo Sapiens
PIHIMWSQR

SEQ ID NO: 266050 - protein, 9 aa, Homo Sapiens
KGAPTPKII

SEQ ID NO: 266051 - protein, 9 aa, Homo Sapiens
SVLEVVSDK

SEQ ID NO: 266052 - protein, 9 aa, Homo Sapiens
TIRQFITQV

SEQ ID NO: 266053 - protein, 9 aa, Homo Sapiens
FPMRYMNES

SEQ ID NO: 266054 - protein, 9 aa, Homo Sapiens
KPTVEELSR

SEQ ID NO: 266055 - protein, 9 aa, Homo Sapiens
KSKGYGFSD

SEQ ID NO: 266056 - protein, 9 aa, Homo Sapiens
AGFFNMWGF

SEQ ID NO: 266057 - protein, 9 aa, Homo Sapiens
AILLSYYTI

SEQ ID NO: 266058 - protein, 9 aa, Homo Sapiens
TWDIITSIV

SEQ ID NO: 266059 - protein, 9 aa, Homo Sapiens
NQPDMCVYQ

SEQ ID NO: 266060 - protein, 9 aa, Homo Sapiens
GKNTEVQKR

SEQ ID NO: 266061 - protein, 9 aa, Homo Sapiens
EIRDEGKAS

SEQ ID NO: 266062 - protein, 9 aa, Homo Sapiens
YSKIRYREN

SEQ ID NO: 266063 - protein, 9 aa, Homo Sapiens
PEYPGKPGA

SEQ ID NO: 266064 - protein, 9 aa, Homo Sapiens
MCTIRMSCV

SEQ ID NO: 266065 - protein, 9 aa, Homo Sapiens
SNPEYLSAN

SEQ ID NO: 266066 - protein, 9 aa, Homo Sapiens
GPVPNPNPT

SEQ ID NO: 266067 - protein, 9 aa, Homo Sapiens
RGVTQIGYC

SEQ ID NO: 266068 - protein, 9 aa, Homo Sapiens
YVQERKNLI

SEQ ID NO: 266069 - protein, 9 aa, Homo Sapiens
SLPMLTPWI

SEQ ID NO: 266070 - protein, 9 aa, Homo Sapiens
QKKQSESKS

SEQ ID NO: 266071 - protein, 9 aa, Homo Sapiens
CRSPCTISE

SEQ ID NO: 266072 - protein, 9 aa, Homo Sapiens
TWRYQEKKS

SEQ ID NO: 266073 - protein, 9 aa, Homo Sapiens
TETLTQEVE

SEQ ID NO: 266074 - protein, 9 aa, Homo Sapiens
QKTVSSEGI

SEQ ID NO: 266075 - protein, 9 aa, Homo Sapiens
RKERLKLVK

SEQ ID NO: 266076 - protein, 9 aa, Homo Sapiens
DPSNCSQYS

SEQ ID NO: 266077 - protein, 9 aa, Homo Sapiens
SELHVNYYV

SEQ ID NO: 266078 - protein, 9 aa, Homo Sapiens
ASNSLLNRY

SEQ ID NO: 266079 - protein, 9 aa, Homo Sapiens
YDDDENSIL

SEQ ID NO: 266080 - protein, 9 aa, Homo Sapiens
VQQPKENET

SEQ ID NO: 266081 - protein, 9 aa, Homo Sapiens
INKDRNDGY

SEQ ID NO: 266082 - protein, 9 aa, Homo Sapiens
WNTVERFKD

SEQ ID NO: 266083 - protein, 9 aa, Homo Sapiens
CAKCKSVHE

SEQ ID NO: 266084 - protein, 9 aa, Homo Sapiens
YIGSSPERF

SEQ ID NO: 266085 - protein, 9 aa, Homo Sapiens
ITHRLLKDP

SEQ ID NO: 266086 - protein, 9 aa, Homo Sapiens
IIESLITKT

SEQ ID NO: 266087 - protein, 9 aa, Homo Sapiens
TGLQTFYMA

SEQ ID NO: 266088 - protein, 9 aa, Homo Sapiens
STLIRHKKI

SEQ ID NO: 266089 - protein, 9 aa, Homo Sapiens
LWDILNEQN

SEQ ID NO: 266090 - protein, 9 aa, Homo Sapiens
RTVSYEVRG

SEQ ID NO: 266091 - protein, 9 aa, Homo Sapiens
VQINSAKLV

SEQ ID NO: 266092 - protein, 9 aa, Homo Sapiens
ISLEEGLFK

SEQ ID NO: 266093 - protein, 9 aa, Homo Sapiens
PEGEGLRYF

SEQ ID NO: 266094 - protein, 9 aa, Homo Sapiens
QSHLECRVN

SEQ ID NO: 266095 - protein, 9 aa, Homo Sapiens
MKHARNNYK

SEQ ID NO: 266096 - protein, 9 aa, Homo Sapiens
FGGPPCTII

SEQ ID NO: 266097 - protein, 9 aa, Homo Sapiens
SSPSRGAPR

SEQ ID NO: 266098 - protein, 9 aa, Homo Sapiens
FSDCINQAQ

SEQ ID NO: 266099 - protein, 9 aa, Homo Sapiens
QYQEQINNS

SEQ ID NO: 266100 - protein, 9 aa, Homo Sapiens
LHDKLIMNQ

SEQ ID NO: 266101 - protein, 9 aa, Homo Sapiens
EDPVRADSM

SEQ ID NO: 266102 - protein, 9 aa, Homo Sapiens
FCNTNQINF

SEQ ID NO: 266103 - protein, 9 aa, Homo Sapiens
SAEPPSKPS

SEQ ID NO: 266104 - protein, 9 aa, Homo Sapiens
NKNLEEAKI

SEQ ID NO: 266105 - protein, 9 aa, Homo Sapiens
PCLLHFQVL

SEQ ID NO: 266106 - protein, 9 aa, Homo Sapiens
KLNSVRQRQ

SEQ ID NO: 266107 - protein, 9 aa, Homo Sapiens
AGDVKVKTE

SEQ ID NO: 266108 - protein, 9 aa, Homo Sapiens
LFMSPMEQT

SEQ ID NO: 266109 - protein, 9 aa, Homo Sapiens
SNKFLKIMF

SEQ ID NO: 266110 - protein, 9 aa, Homo Sapiens
TFLPWVPAR

SEQ ID NO: 266111 - protein, 9 aa, Homo Sapiens
RAGSPNLPH

SEQ ID NO: 266112 - protein, 9 aa, Homo Sapiens
TLYFNFVEK

SEQ ID NO: 266113 - protein, 9 aa, Homo Sapiens
RRKCERILY

SEQ ID NO: 266114 - protein, 9 aa, Homo Sapiens
RSDCERMNE

SEQ ID NO: 266115 - protein, 9 aa, Homo Sapiens
MTQEEFVKA

SEQ ID NO: 266116 - protein, 9 aa, Homo Sapiens
KSRGKAKRR

SEQ ID NO: 266117 - protein, 9 aa, Homo Sapiens
EPCLLHFQV

SEQ ID NO: 266118 - protein, 9 aa, Homo Sapiens
DLEKVVPLK

SEQ ID NO: 266119 - protein, 9 aa, Homo Sapiens
MYLCIAFYR

SEQ ID NO: 266120 - protein, 9 aa, Homo Sapiens
SYNKLTDRG

SEQ ID NO: 266121 - protein, 9 aa, Homo Sapiens
ETNEIYDEN

SEQ ID NO: 266122 - protein, 9 aa, Homo Sapiens
MPGLNEIIS

SEQ ID NO: 266123 - protein, 9 aa, Homo Sapiens
ETHAKLALY

SEQ ID NO: 266124 - protein, 9 aa, Homo Sapiens
GSTSIGKWR

SEQ ID NO: 266125 - protein, 9 aa, Homo Sapiens
HDLRQKSPE

SEQ ID NO: 266126 - protein, 9 aa, Homo Sapiens
PLSDYPLWE

SEQ ID NO: 266127 - protein, 9 aa, Homo Sapiens
SKLVIWDIN

SEQ ID NO: 266128 - protein, 9 aa, Homo Sapiens
QKVKGLGQS

SEQ ID NO: 266129 - protein, 9 aa, Homo Sapiens
YSYFRSVRA

SEQ ID NO: 266130 - protein, 9 aa, Homo Sapiens
KKVAEIIKE

SEQ ID NO: 266131 - protein, 9 aa, Homo Sapiens
MRVNTVYDV

SEQ ID NO: 266132 - protein, 9 aa, Homo Sapiens
EYCKKGFQR

SEQ ID NO: 266133 - protein, 9 aa, Homo Sapiens
DIDSYLVQY

SEQ ID NO: 266134 - protein, 9 aa, Homo Sapiens
GTEPSADGE

SEQ ID NO: 266135 - protein, 9 aa, Homo Sapiens
RKLWCQQIP

SEQ ID NO: 266136 - protein, 9 aa, Homo Sapiens
FNSLIDLRR

SEQ ID NO: 266137 - protein, 9 aa, Homo Sapiens
NINRINEIQ

SEQ ID NO: 266138 - protein, 9 aa, Homo Sapiens
DSCDRYPTL

SEQ ID NO: 266139 - protein, 9 aa, Homo Sapiens
ELQEMASCQ

SEQ ID NO: 266140 - protein, 9 aa, Homo Sapiens
TLVGGTTMI

SEQ ID NO: 266141 - protein, 9 aa, Homo Sapiens
TSKMITIQF

SEQ ID NO: 266142 - protein, 9 aa, Homo Sapiens
FRNSVASGS

SEQ ID NO: 266143 - protein, 9 aa, Homo Sapiens
HFYRSPEVL

SEQ ID NO: 266144 - protein, 9 aa, Homo Sapiens
HGEIKWIYF

SEQ ID NO: 266145 - protein, 9 aa, Homo Sapiens
TLSTSTSTT

SEQ ID NO: 266146 - protein, 9 aa, Homo Sapiens
IPMWSKRVI

SEQ ID NO: 266147 - protein, 9 aa, Homo Sapiens
LNIHLKKGT

SEQ ID NO: 266148 - protein, 9 aa, Homo Sapiens
ELEPVTEPP

SEQ ID NO: 266149 - protein, 9 aa, Homo Sapiens
AGKNKNNFV

SEQ ID NO: 266150 - protein, 9 aa, Homo Sapiens
EYKIFFVMG

SEQ ID NO: 266151 - protein, 9 aa, Homo Sapiens
RDEEDIGAG

SEQ ID NO: 266152 - protein, 9 aa, Homo Sapiens
SLIVVGHSL

SEQ ID NO: 266153 - protein, 9 aa, Homo Sapiens
IKSMDQCRH

SEQ ID NO: 266154 - protein, 9 aa, Homo Sapiens
RCPRWLCAG

SEQ ID NO: 266155 - protein, 9 aa, Homo Sapiens
KTIMNSGFQ

SEQ ID NO: 266156 - protein, 9 aa, Homo Sapiens
NFDCQWRDD

SEQ ID NO: 266157 - protein, 9 aa, Homo Sapiens
EDSQAFTPD

SEQ ID NO: 266158 - protein, 9 aa, Homo Sapiens
IRNYQCIEQ

SEQ ID NO: 266159 - protein, 9 aa, Homo Sapiens
VVLQAVMKD

SEQ ID NO: 266160 - protein, 9 aa, Homo Sapiens
EPERTNKLL

SEQ ID NO: 266161 - protein, 9 aa, Homo Sapiens
LQTICAGGK

SEQ ID NO: 266162 - protein, 9 aa, Homo Sapiens
ARAPAGPVG

SEQ ID NO: 266163 - protein, 9 aa, Homo Sapiens
LLGREGYTF

SEQ ID NO: 266164 - protein, 9 aa, Homo Sapiens
PPGMLASYQ

SEQ ID NO: 266165 - protein, 9 aa, Homo Sapiens
YGGCYLCSD

SEQ ID NO: 266166 - protein, 9 aa, Homo Sapiens
PLYLQPHAS

SEQ ID NO: 266167 - protein, 9 aa, Homo Sapiens
QSFTRPKSA

SEQ ID NO: 266168 - protein, 9 aa, Homo Sapiens
DETDKEKDV

SEQ ID NO: 266169 - protein, 9 aa, Homo Sapiens
NRFIVQEVN

SEQ ID NO: 266170 - protein, 9 aa, Homo Sapiens
PQVANTRLC

SEQ ID NO: 266171 - protein, 9 aa, Homo Sapiens
IHSSDWPKL

SEQ ID NO: 266172 - protein, 9 aa, Homo Sapiens
LVVHQQTHT

SEQ ID NO: 266173 - protein, 9 aa, Homo Sapiens
IIIINGEII

SEQ ID NO: 266174 - protein, 9 aa, Homo Sapiens
ETIDSLEEV

SEQ ID NO: 266175 - protein, 9 aa, Homo Sapiens
IKMQKTIQM

SEQ ID NO: 266176 - protein, 9 aa, Homo Sapiens
LIDIARKPD

SEQ ID NO: 266177 - protein, 9 aa, Homo Sapiens
RDSTNAFSA

SEQ ID NO: 266178 - protein, 9 aa, Homo Sapiens
ENNVFGSKN

SEQ ID NO: 266179 - protein, 9 aa, Homo Sapiens
ASLNYKYFS

SEQ ID NO: 266180 - protein, 9 aa, Homo Sapiens
SDFLPKTHP

SEQ ID NO: 266181 - protein, 9 aa, Homo Sapiens
TIFFSFPHL

SEQ ID NO: 266182 - protein, 9 aa, Homo Sapiens
IMQGAPEIL

SEQ ID NO: 266183 - protein, 9 aa, Homo Sapiens
QALKEDFHL

SEQ ID NO: 266184 - protein, 9 aa, Homo Sapiens
KYVNLQIWD

SEQ ID NO: 266185 - protein, 9 aa, Homo Sapiens
WKTFFLYNQ

SEQ ID NO: 266186 - protein, 9 aa, Homo Sapiens
PEGKTFDRV

SEQ ID NO: 266187 - protein, 9 aa, Homo Sapiens
CESKDLSAT

SEQ ID NO: 266188 - protein, 9 aa, Homo Sapiens
EYFAKDENI

SEQ ID NO: 266189 - protein, 9 aa, Homo Sapiens
TGDVVEILN

SEQ ID NO: 266190 - protein, 9 aa, Homo Sapiens
STDMSSGQM

SEQ ID NO: 266191 - protein, 9 aa, Homo Sapiens
VDGCNQVDA

SEQ ID NO: 266192 - protein, 9 aa, Homo Sapiens
GIWLLGTTH

SEQ ID NO: 266193 - protein, 9 aa, Homo Sapiens
WIKKLLKSS

SEQ ID NO: 266194 - protein, 9 aa, Homo Sapiens
ANKQAVHTV

SEQ ID NO: 266195 - protein, 9 aa, Homo Sapiens
YICLSIYQD

SEQ ID NO: 266196 - protein, 9 aa, Homo Sapiens
VTERIMQGA

SEQ ID NO: 266197 - protein, 9 aa, Homo Sapiens
LIEKLIDNP

SEQ ID NO: 266198 - protein, 9 aa, Homo Sapiens
QLRLVALPG

SEQ ID NO: 266199 - protein, 9 aa, Homo Sapiens
DFVWGLICI

SEQ ID NO: 266200 - protein, 9 aa, Homo Sapiens
ATGIPSSQV

SEQ ID NO: 266201 - protein, 9 aa, Homo Sapiens
RAWILLSLG

SEQ ID NO: 266202 - protein, 9 aa, Homo Sapiens
TEIGVLIRL

SEQ ID NO: 266203 - protein, 9 aa, Homo Sapiens
DQTLPLMQR

SEQ ID NO: 266204 - protein, 9 aa, Homo Sapiens
IYIVSSQKI

SEQ ID NO: 266205 - protein, 9 aa, Homo Sapiens
FLRKENKII

SEQ ID NO: 266206 - protein, 9 aa, Homo Sapiens
QNKVCFPNL

SEQ ID NO: 266207 - protein, 9 aa, Homo Sapiens
EAATPYGIK

SEQ ID NO: 266208 - protein, 9 aa, Homo Sapiens
KLSGHPKGY

SEQ ID NO: 266209 - protein, 9 aa, Homo Sapiens
IRESAWKQH

SEQ ID NO: 266210 - protein, 9 aa, Homo Sapiens
SFWSGLYAE

SEQ ID NO: 266211 - protein, 9 aa, Homo Sapiens
VAIRAMDRT

SEQ ID NO: 266212 - protein, 9 aa, Homo Sapiens
GDDVPESIL

SEQ ID NO: 266213 - protein, 9 aa, Homo Sapiens
VLNGCMYSL

SEQ ID NO: 266214 - protein, 9 aa, Homo Sapiens
TILDQLETE

SEQ ID NO: 266215 - protein, 9 aa, Homo Sapiens
AVASRLLEK

SEQ ID NO: 266216 - protein, 9 aa, Homo Sapiens
HKTQCAVVA

SEQ ID NO: 266217 - protein, 9 aa, Homo Sapiens
WRPRRKKWC

SEQ ID NO: 266218 - protein, 9 aa, Homo Sapiens
VLPERRPML

SEQ ID NO: 266219 - protein, 9 aa, Homo Sapiens
NDDDVRLML

SEQ ID NO: 266220 - protein, 9 aa, Homo Sapiens
IVQLSYALR

SEQ ID NO: 266221 - protein, 9 aa, Homo Sapiens
PLFQIQQEV

SEQ ID NO: 266222 - protein, 9 aa, Homo Sapiens
RNNLNGILA

SEQ ID NO: 266223 - protein, 9 aa, Homo Sapiens
ISLLRCQYF

SEQ ID NO: 266224 - protein, 9 aa, Homo Sapiens
KFVIKDPDE

SEQ ID NO: 266225 - protein, 9 aa, Homo Sapiens
PVPYPDSLE

SEQ ID NO: 266226 - protein, 9 aa, Homo Sapiens
SDPLQLVRD

SEQ ID NO: 266227 - protein, 9 aa, Homo Sapiens
KEYESVMET

SEQ ID NO: 266228 - protein, 9 aa, Homo Sapiens
KRRVIRNQD

SEQ ID NO: 266229 - protein, 9 aa, Homo Sapiens
SAKILEESY

SEQ ID NO: 266230 - protein, 9 aa, Homo Sapiens
ASVMSAPVS

SEQ ID NO: 266231 - protein, 9 aa, Homo Sapiens
VTLLAAADL

SEQ ID NO: 266232 - protein, 9 aa, Homo Sapiens
IMHLCAILL

SEQ ID NO: 266233 - protein, 9 aa, Homo Sapiens
PLLQPTWDV

SEQ ID NO: 266234 - protein, 9 aa, Homo Sapiens
FKDRLKPAL

SEQ ID NO: 266235 - protein, 9 aa, Homo Sapiens
IMFAKTLEE

SEQ ID NO: 266236 - protein, 9 aa, Homo Sapiens
LCYICLSIY

SEQ ID NO: 266237 - protein, 9 aa, Homo Sapiens
CAAYAHKLP

SEQ ID NO: 266238 - protein, 9 aa, Homo Sapiens
IIWKLAAMG

SEQ ID NO: 266239 - protein, 9 aa, Homo Sapiens
KTYAFHNTY

SEQ ID NO: 266240 - protein, 9 aa, Homo Sapiens
NKHVYGPFY

SEQ ID NO: 266241 - protein, 9 aa, Homo Sapiens
YPEKTQMIY

SEQ ID NO: 266242 - protein, 9 aa, Homo Sapiens
VTCQPFRRK

SEQ ID NO: 266243 - protein, 9 aa, Homo Sapiens
LTATHPANS

SEQ ID NO: 266244 - protein, 9 aa, Homo Sapiens
LLPHHALQD

SEQ ID NO: 266245 - protein, 9 aa, Homo Sapiens
TKCEITSTG

SEQ ID NO: 266246 - protein, 9 aa, Homo Sapiens
EQIQNPEYS

SEQ ID NO: 266247 - protein, 9 aa, Homo Sapiens
NEKQIATTD

SEQ ID NO: 266248 - protein, 9 aa, Homo Sapiens
FPPMPKAEA

SEQ ID NO: 266249 - protein, 9 aa, Homo Sapiens
FKLQSVAPQ

SEQ ID NO: 266250 - protein, 9 aa, Homo Sapiens
CNILVNSNL

SEQ ID NO: 266251 - protein, 9 aa, Homo Sapiens
SSLFGFVLK

SEQ ID NO: 266252 - protein, 9 aa, Homo Sapiens
SKMKAVASR

SEQ ID NO: 266253 - protein, 9 aa, Homo Sapiens
DLNTTSRQQ

SEQ ID NO: 266254 - protein, 9 aa, Homo Sapiens
INDKMAEYT

SEQ ID NO: 266255 - protein, 9 aa, Homo Sapiens
LRALCSLDL

SEQ ID NO: 266256 - protein, 9 aa, Homo Sapiens
HFLMQSDNL

SEQ ID NO: 266257 - protein, 9 aa, Homo Sapiens
EDTNTFLLL

SEQ ID NO: 266258 - protein, 9 aa, Homo Sapiens
QRRYFIAAA

SEQ ID NO: 266259 - protein, 9 aa, Homo Sapiens
RIIPLSDNT

SEQ ID NO: 266260 - protein, 9 aa, Homo Sapiens
DHNMALLQM

SEQ ID NO: 266261 - protein, 9 aa, Homo Sapiens
VVWYFQINY

SEQ ID NO: 266262 - protein, 9 aa, Homo Sapiens
RVYNLVKET

SEQ ID NO: 266263 - protein, 9 aa, Homo Sapiens
LLGESQGDL

SEQ ID NO: 266264 - protein, 9 aa, Homo Sapiens
QLEKQKKCK

SEQ ID NO: 266265 - protein, 9 aa, Homo Sapiens
LLGEYLLSG

SEQ ID NO: 266266 - protein, 9 aa, Homo Sapiens
YSVRRKGKP

SEQ ID NO: 266267 - protein, 9 aa, Homo Sapiens
SKHHLNSLG

SEQ ID NO: 266268 - protein, 9 aa, Homo Sapiens
DKDYRKIRF

SEQ ID NO: 266269 - protein, 9 aa, Homo Sapiens
ARDTLVISA

SEQ ID NO: 266270 - protein, 9 aa, Homo Sapiens
EFTRDELFM

SEQ ID NO: 266271 - protein, 9 aa, Homo Sapiens
VSGNLSPID

SEQ ID NO: 266272 - protein, 9 aa, Homo Sapiens
PKGGVTDIS

SEQ ID NO: 266273 - protein, 9 aa, Homo Sapiens
IGTEIAPDK

SEQ ID NO: 266274 - protein, 9 aa, Homo Sapiens
IFDNINFQF

SEQ ID NO: 266275 - protein, 9 aa, Homo Sapiens
YDVPIYMSY

SEQ ID NO: 266276 - protein, 9 aa, Homo Sapiens
MHWKKRLEP

SEQ ID NO: 266277 - protein, 9 aa, Homo Sapiens
CQMREMEEN

SEQ ID NO: 266278 - protein, 9 aa, Homo Sapiens
AVSYNRLHS

SEQ ID NO: 266279 - protein, 9 aa, Homo Sapiens
VCLVTVDGG

SEQ ID NO: 266280 - protein, 9 aa, Homo Sapiens
LKFCTAAMS

SEQ ID NO: 266281 - protein, 9 aa, Homo Sapiens
FSKTQSKDI

SEQ ID NO: 266282 - protein, 9 aa, Homo Sapiens
SDPHKRNLD

SEQ ID NO: 266283 - protein, 9 aa, Homo Sapiens
GGGNIKYIL

SEQ ID NO: 266284 - protein, 9 aa, Homo Sapiens
PKCHSLTRI

SEQ ID NO: 266285 - protein, 9 aa, Homo Sapiens
SREHLKLSP

SEQ ID NO: 266286 - protein, 9 aa, Homo Sapiens
ALKVLGIVF

SEQ ID NO: 266287 - protein, 9 aa, Homo Sapiens
HGPFNPYEP

SEQ ID NO: 266288 - protein, 9 aa, Homo Sapiens
PSHTENRDP

SEQ ID NO: 266289 - protein, 9 aa, Homo Sapiens
DNKDSVSNI

SEQ ID NO: 266290 - protein, 9 aa, Homo Sapiens
KWSGRELIE

SEQ ID NO: 266291 - protein, 9 aa, Homo Sapiens
MLGLTQITN

SEQ ID NO: 266292 - protein, 9 aa, Homo Sapiens
GGMRESSQD

SEQ ID NO: 266293 - protein, 9 aa, Homo Sapiens
LYVKEIHYR

SEQ ID NO: 266294 - protein, 9 aa, Homo Sapiens
SYTQPAIEN

SEQ ID NO: 266295 - protein, 9 aa, Homo Sapiens
TGQCHCHQH

SEQ ID NO: 266296 - protein, 9 aa, Homo Sapiens
NVKCTAQEI

SEQ ID NO: 266297 - protein, 9 aa, Homo Sapiens
EAQRRKEQE

SEQ ID NO: 266298 - protein, 9 aa, Homo Sapiens
KKKCKEDFP

SEQ ID NO: 266299 - protein, 9 aa, Homo Sapiens
VSMYTHLWE

SEQ ID NO: 266300 - protein, 9 aa, Homo Sapiens
QARRDLYRD

SEQ ID NO: 266301 - protein, 9 aa, Homo Sapiens
AMHTSTSYS

SEQ ID NO: 266302 - protein, 9 aa, Homo Sapiens
VFLQPRGNE

SEQ ID NO: 266303 - protein, 9 aa, Homo Sapiens
RIEASNWHG

SEQ ID NO: 266304 - protein, 9 aa, Homo Sapiens
PLRGMHPRA

SEQ ID NO: 266305 - protein, 9 aa, Homo Sapiens
RDRSHIKKT

SEQ ID NO: 266306 - protein, 9 aa, Homo Sapiens
VFQGPDICC

SEQ ID NO: 266307 - protein, 9 aa, Homo Sapiens
GFRLQGLDA

SEQ ID NO: 266308 - protein, 9 aa, Homo Sapiens
ITKLSVCKD

SEQ ID NO: 266309 - protein, 9 aa, Homo Sapiens
GPQVTACHS

SEQ ID NO: 266310 - protein, 9 aa, Homo Sapiens
QYPVVKTNY

SEQ ID NO: 266311 - protein, 9 aa, Homo Sapiens
RGQKGLRGP

SEQ ID NO: 266312 - protein, 9 aa, Homo Sapiens
ESDDDDQIR

SEQ ID NO: 266313 - protein, 9 aa, Homo Sapiens
LSYCHEARD

SEQ ID NO: 266314 - protein, 9 aa, Homo Sapiens
TKLSVCKDL

SEQ ID NO: 266315 - protein, 9 aa, Homo Sapiens
YHEDVTMGK

SEQ ID NO: 266316 - protein, 9 aa, Homo Sapiens
HDGCSEAFE

SEQ ID NO: 266317 - protein, 9 aa, Homo Sapiens
DKLWDHNQC

SEQ ID NO: 266318 - protein, 9 aa, Homo Sapiens
EYFNCDIQV

SEQ ID NO: 266319 - protein, 9 aa, Homo Sapiens
FWSRLHTNV

SEQ ID NO: 266320 - protein, 9 aa, Homo Sapiens
LAAIKEAIR

SEQ ID NO: 266321 - protein, 9 aa, Homo Sapiens
YILARVIHD

SEQ ID NO: 266322 - protein, 9 aa, Homo Sapiens
ASKSREEVS

SEQ ID NO: 266323 - protein, 9 aa, Homo Sapiens
SSCLGDECK

SEQ ID NO: 266324 - protein, 9 aa, Homo Sapiens
FRNSFVFNI

SEQ ID NO: 266325 - protein, 9 aa, Homo Sapiens
VCMHPHNAL

SEQ ID NO: 266326 - protein, 9 aa, Homo Sapiens
YLAKRSVLN

SEQ ID NO: 266327 - protein, 9 aa, Homo Sapiens
FLTGQIDPL

SEQ ID NO: 266328 - protein, 9 aa, Homo Sapiens
EPEDPSNHS

SEQ ID NO: 266329 - protein, 9 aa, Homo Sapiens
AGGNIYLDF

SEQ ID NO: 266330 - protein, 9 aa, Homo Sapiens
GLELAYLEQ

SEQ ID NO: 266331 - protein, 9 aa, Homo Sapiens
KRCHPSVYS

SEQ ID NO: 266332 - protein, 9 aa, Homo Sapiens
RPHLPLTVP

SEQ ID NO: 266333 - protein, 9 aa, Homo Sapiens
ASRVCIDSE

SEQ ID NO: 266334 - protein, 9 aa, Homo Sapiens
SDPRLTPYQ

SEQ ID NO: 266335 - protein, 9 aa, Homo Sapiens
LDLNDNYPS

SEQ ID NO: 266336 - protein, 9 aa, Homo Sapiens
AFKIPFLIW

SEQ ID NO: 266337 - protein, 9 aa, Homo Sapiens
MRLLILREI

SEQ ID NO: 266338 - protein, 9 aa, Homo Sapiens
EDIKIVKEK

SEQ ID NO: 266339 - protein, 9 aa, Homo Sapiens
IKHRCSTKY

SEQ ID NO: 266340 - protein, 9 aa, Homo Sapiens
QSESKSQIK

SEQ ID NO: 266341 - protein, 9 aa, Homo Sapiens
RRMEMIVFL

SEQ ID NO: 266342 - protein, 9 aa, Homo Sapiens
CFDQINAVD

SEQ ID NO: 266343 - protein, 9 aa, Homo Sapiens
KEFMRQAGE

SEQ ID NO: 266344 - protein, 9 aa, Homo Sapiens
FKPQQHGLR

SEQ ID NO: 266345 - protein, 9 aa, Homo Sapiens
SGGFQGTME

SEQ ID NO: 266346 - protein, 9 aa, Homo Sapiens
LPMAHPGTA

SEQ ID NO: 266347 - protein, 9 aa, Homo Sapiens
IPKSSSTQQ

SEQ ID NO: 266348 - protein, 9 aa, Homo Sapiens
DLVSLKRNH

SEQ ID NO: 266349 - protein, 9 aa, Homo Sapiens
DKDSTLGQI

SEQ ID NO: 266350 - protein, 9 aa, Homo Sapiens
VIYLPLSGI

SEQ ID NO: 266351 - protein, 9 aa, Homo Sapiens
ITGFQSPIQ

SEQ ID NO: 266352 - protein, 9 aa, Homo Sapiens
VSYRGCVTI

SEQ ID NO: 266353 - protein, 9 aa, Homo Sapiens
FTNLVTGSP

SEQ ID NO: 266354 - protein, 9 aa, Homo Sapiens
TAVQNISIE

SEQ ID NO: 266355 - protein, 9 aa, Homo Sapiens
LCTVFGETD

SEQ ID NO: 266356 - protein, 9 aa, Homo Sapiens
IFSSREERL

SEQ ID NO: 266357 - protein, 9 aa, Homo Sapiens
IKELFHIDI

SEQ ID NO: 266358 - protein, 9 aa, Homo Sapiens
LASEIMAYY

SEQ ID NO: 266359 - protein, 9 aa, Homo Sapiens
TLGDMIRKS

SEQ ID NO: 266360 - protein, 9 aa, Homo Sapiens
GPGLVCMVT

SEQ ID NO: 266361 - protein, 9 aa, Homo Sapiens
LECQQKKKR

SEQ ID NO: 266362 - protein, 9 aa, Homo Sapiens
KRSPRGLSN

SEQ ID NO: 266363 - protein, 9 aa, Homo Sapiens
PMRYMNESQ

SEQ ID NO: 266364 - protein, 9 aa, Homo Sapiens
QNKKVSLLE

SEQ ID NO: 266365 - protein, 9 aa, Homo Sapiens
YLWSSSLSP

SEQ ID NO: 266366 - protein, 9 aa, Homo Sapiens
TSRFYDRNY

SEQ ID NO: 266367 - protein, 9 aa, Homo Sapiens
PDVELLLLT

SEQ ID NO: 266368 - protein, 9 aa, Homo Sapiens
TMLLKSNCV

SEQ ID NO: 266369 - protein, 9 aa, Homo Sapiens
PPDFLLVHD

SEQ ID NO: 266370 - protein, 9 aa, Homo Sapiens
RRAISPTRS

SEQ ID NO: 266371 - protein, 9 aa, Homo Sapiens
PSRFQPFRD

SEQ ID NO: 266372 - protein, 9 aa, Homo Sapiens
IMHMGLAGG

SEQ ID NO: 266373 - protein, 9 aa, Homo Sapiens
DALMTINRM

SEQ ID NO: 266374 - protein, 9 aa, Homo Sapiens
QGITAAFKP

SEQ ID NO: 266375 - protein, 9 aa, Homo Sapiens
PDRNLDKAL

SEQ ID NO: 266376 - protein, 9 aa, Homo Sapiens
PAHVSRVDA

SEQ ID NO: 266377 - protein, 9 aa, Homo Sapiens
DVANKQLKC

SEQ ID NO: 266378 - protein, 9 aa, Homo Sapiens
NLPATKLPL

SEQ ID NO: 266379 - protein, 9 aa, Homo Sapiens
HNFCEDPNG

SEQ ID NO: 266380 - protein, 9 aa, Homo Sapiens
SPTPKEVVK

SEQ ID NO: 266381 - protein, 9 aa, Homo Sapiens
DVPGGHSTL

SEQ ID NO: 266382 - protein, 9 aa, Homo Sapiens
IYTPKKYQV

SEQ ID NO: 266383 - protein, 9 aa, Homo Sapiens
SGLHKFCLG

SEQ ID NO: 266384 - protein, 9 aa, Homo Sapiens
FYRRAQRLW

SEQ ID NO: 266385 - protein, 9 aa, Homo Sapiens
QKAVCLFGC

SEQ ID NO: 266386 - protein, 9 aa, Homo Sapiens
KKGQVKRSV

SEQ ID NO: 266387 - protein, 9 aa, Homo Sapiens
CKKLFYSSV

SEQ ID NO: 266388 - protein, 9 aa, Homo Sapiens
DKNPYSFQP

SEQ ID NO: 266389 - protein, 9 aa, Homo Sapiens
IPPRDTAFI

SEQ ID NO: 266390 - protein, 9 aa, Homo Sapiens
QEEQNKLIQ

SEQ ID NO: 266391 - protein, 9 aa, Homo Sapiens
ACVPFLNSY

SEQ ID NO: 266392 - protein, 9 aa, Homo Sapiens
WPHHPGPFL

SEQ ID NO: 266393 - protein, 9 aa, Homo Sapiens
VILIQTDSH

SEQ ID NO: 266394 - protein, 9 aa, Homo Sapiens
LFIRFLCPA

SEQ ID NO: 266395 - protein, 9 aa, Homo Sapiens
GPPFFPVNY

SEQ ID NO: 266396 - protein, 9 aa, Homo Sapiens
FIQTSMGLS

SEQ ID NO: 266397 - protein, 9 aa, Homo Sapiens
TFSLGKHVG

SEQ ID NO: 266398 - protein, 9 aa, Homo Sapiens
INAHSPGFF

SEQ ID NO: 266399 - protein, 9 aa, Homo Sapiens
VQELLTYSS

SEQ ID NO: 266400 - protein, 9 aa, Homo Sapiens
TLAAMAYDQ

SEQ ID NO: 266401 - protein, 9 aa, Homo Sapiens
QIYVGEVVL

SEQ ID NO: 266402 - protein, 9 aa, Homo Sapiens
GTQEVVGDY

SEQ ID NO: 266403 - protein, 9 aa, Homo Sapiens
CINTMVNNL

SEQ ID NO: 266404 - protein, 9 aa, Homo Sapiens
FSQKYDRVV

SEQ ID NO: 266405 - protein, 9 aa, Homo Sapiens
MSASLNYKY

SEQ ID NO: 266406 - protein, 9 aa, Homo Sapiens
IKINHNLAL

SEQ ID NO: 266407 - protein, 9 aa, Homo Sapiens
NEKEQDMIS

SEQ ID NO: 266408 - protein, 9 aa, Homo Sapiens
LHGHPPLSG

SEQ ID NO: 266409 - protein, 9 aa, Homo Sapiens
IKEAIRISE

SEQ ID NO: 266410 - protein, 9 aa, Homo Sapiens
RSKRNWKCP

SEQ ID NO: 266411 - protein, 9 aa, Homo Sapiens
AGVEAFAKP

SEQ ID NO: 266412 - protein, 9 aa, Homo Sapiens
NISNIITSG

SEQ ID NO: 266413 - protein, 9 aa, Homo Sapiens
GSLSRNTSF

SEQ ID NO: 266414 - protein, 9 aa, Homo Sapiens
YGGFDLCFI

SEQ ID NO: 266415 - protein, 9 aa, Homo Sapiens
AFPDDVVRV

SEQ ID NO: 266416 - protein, 9 aa, Homo Sapiens
VKLSDEYLT

SEQ ID NO: 266417 - protein, 9 aa, Homo Sapiens
IIDTLMYLL

SEQ ID NO: 266418 - protein, 9 aa, Homo Sapiens
NWVRKVCID

SEQ ID NO: 266419 - protein, 9 aa, Homo Sapiens
LALRADYDI

SEQ ID NO: 266420 - protein, 9 aa, Homo Sapiens
PKFNKIPLY

SEQ ID NO: 266421 - protein, 9 aa, Homo Sapiens
ADPEVCKTM

SEQ ID NO: 266422 - protein, 9 aa, Homo Sapiens
CIAGFRRSM

SEQ ID NO: 266423 - protein, 9 aa, Homo Sapiens
QSLNMEQAN

SEQ ID NO: 266424 - protein, 9 aa, Homo Sapiens
GEGIFYCCL

SEQ ID NO: 266425 - protein, 9 aa, Homo Sapiens
RQWIVSHIM

SEQ ID NO: 266426 - protein, 9 aa, Homo Sapiens
QLVRLDLNS

SEQ ID NO: 266427 - protein, 9 aa, Homo Sapiens
SGSSTNGSS

SEQ ID NO: 266428 - protein, 9 aa, Homo Sapiens
EAGVPSIEM

SEQ ID NO: 266429 - protein, 9 aa, Homo Sapiens
VNACDLPEW

SEQ ID NO: 266430 - protein, 9 aa, Homo Sapiens
TLVIYIARL

SEQ ID NO: 266431 - protein, 9 aa, Homo Sapiens
LTQNVITDM

SEQ ID NO: 266432 - protein, 9 aa, Homo Sapiens
AVDPLGDYM

SEQ ID NO: 266433 - protein, 9 aa, Homo Sapiens
HNSDLIGFK

SEQ ID NO: 266434 - protein, 9 aa, Homo Sapiens
STTQSTTVS

SEQ ID NO: 266435 - protein, 9 aa, Homo Sapiens
NRKIILASN

SEQ ID NO: 266436 - protein, 9 aa, Homo Sapiens
GYIDKNELL

SEQ ID NO: 266437 - protein, 9 aa, Homo Sapiens
KYPSNFLKL

SEQ ID NO: 266438 - protein, 9 aa, Homo Sapiens
PCPDFTPQK

SEQ ID NO: 266439 - protein, 9 aa, Homo Sapiens
KRCLAWDKD

SEQ ID NO: 266440 - protein, 9 aa, Homo Sapiens
NRELSRMSR

SEQ ID NO: 266441 - protein, 9 aa, Homo Sapiens
FLSQSIPEE

SEQ ID NO: 266442 - protein, 9 aa, Homo Sapiens
YRHRFNNCM

SEQ ID NO: 266443 - protein, 9 aa, Homo Sapiens
TLQTKNHKL

SEQ ID NO: 266444 - protein, 9 aa, Homo Sapiens
YNSINNEKL

SEQ ID NO: 266445 - protein, 9 aa, Homo Sapiens
IVHMQAAPE

SEQ ID NO: 266446 - protein, 9 aa, Homo Sapiens
TNLQPKRPK

SEQ ID NO: 266447 - protein, 9 aa, Homo Sapiens
KPAKNYSAV

SEQ ID NO: 266448 - protein, 9 aa, Homo Sapiens
EKTVVEVLF

SEQ ID NO: 266449 - protein, 9 aa, Homo Sapiens
FQQALKDPN

SEQ ID NO: 266450 - protein, 9 aa, Homo Sapiens
VLFKMFIGS

SEQ ID NO: 266451 - protein, 9 aa, Homo Sapiens
MALLPLLQS

SEQ ID NO: 266452 - protein, 9 aa, Homo Sapiens
PLYHINLHV

SEQ ID NO: 266453 - protein, 9 aa, Homo Sapiens
VIKTQETET

SEQ ID NO: 266454 - protein, 9 aa, Homo Sapiens
GTVGAVSGG

SEQ ID NO: 266455 - protein, 9 aa, Homo Sapiens
NSQFPTSLP

SEQ ID NO: 266456 - protein, 9 aa, Homo Sapiens
NNFFKQEFI

SEQ ID NO: 266457 - protein, 9 aa, Homo Sapiens
EEEERKLFL

SEQ ID NO: 266458 - protein, 9 aa, Homo Sapiens
FFGRSECFL

SEQ ID NO: 266459 - protein, 9 aa, Homo Sapiens
FNLLSNTGA

SEQ ID NO: 266460 - protein, 9 aa, Homo Sapiens
NYTVSPFSS

SEQ ID NO: 266461 - protein, 9 aa, Homo Sapiens
GLTKLINAY

SEQ ID NO: 266462 - protein, 9 aa, Homo Sapiens
WPEQNIKYS

SEQ ID NO: 266463 - protein, 9 aa, Homo Sapiens
TNTQDPFLT

SEQ ID NO: 266464 - protein, 9 aa, Homo Sapiens
QFFMDQYKY

SEQ ID NO: 266465 - protein, 9 aa, Homo Sapiens
STKKESFEL

SEQ ID NO: 266466 - protein, 9 aa, Homo Sapiens
LQSHSREGR

SEQ ID NO: 266467 - protein, 9 aa, Homo Sapiens
IIYVFYTVV

SEQ ID NO: 266468 - protein, 9 aa, Homo Sapiens
SVTEFILKG

SEQ ID NO: 266469 - protein, 9 aa, Homo Sapiens
PIQLTGDLP

SEQ ID NO: 266470 - protein, 9 aa, Homo Sapiens
NNYPGSCGL

SEQ ID NO: 266471 - protein, 9 aa, Homo Sapiens
KGSKMRQHQ

SEQ ID NO: 266472 - protein, 9 aa, Homo Sapiens
FLQLLLPTQ

SEQ ID NO: 266473 - protein, 9 aa, Homo Sapiens
YPNGSQDVG

SEQ ID NO: 266474 - protein, 9 aa, Homo Sapiens
DSRGMFIAI

SEQ ID NO: 266475 - protein, 9 aa, Homo Sapiens
LLTCKITLP

SEQ ID NO: 266476 - protein, 9 aa, Homo Sapiens
RSNSKDVQN

SEQ ID NO: 266477 - protein, 9 aa, Homo Sapiens
VEVLFQRDS

SEQ ID NO: 266478 - protein, 9 aa, Homo Sapiens
LQGHFSVVL

SEQ ID NO: 266479 - protein, 9 aa, Homo Sapiens
KVEINCTRT

SEQ ID NO: 266480 - protein, 9 aa, Homo Sapiens
ISRIHLVGK

SEQ ID NO: 266481 - protein, 9 aa, Homo Sapiens
LLHKHEDSG

SEQ ID NO: 266482 - protein, 9 aa, Homo Sapiens
EIDTVGMAP

SEQ ID NO: 266483 - protein, 9 aa, Homo Sapiens
EENQCKESS

SEQ ID NO: 266484 - protein, 9 aa, Homo Sapiens
PPWSRNLTC

SEQ ID NO: 266485 - protein, 9 aa, Homo Sapiens
GNDDLSTTQ

SEQ ID NO: 266486 - protein, 9 aa, Homo Sapiens
VKNVDEAIH

SEQ ID NO: 266487 - protein, 9 aa, Homo Sapiens
SASQLETLC

SEQ ID NO: 266488 - protein, 9 aa, Homo Sapiens
HCIDILFAF

SEQ ID NO: 266489 - protein, 9 aa, Homo Sapiens
SIRPSSPLI

SEQ ID NO: 266490 - protein, 9 aa, Homo Sapiens
KCMMKDFSS

SEQ ID NO: 266491 - protein, 9 aa, Homo Sapiens
EQGGGLENL

SEQ ID NO: 266492 - protein, 9 aa, Homo Sapiens
SKLKAELKL

SEQ ID NO: 266493 - protein, 9 aa, Homo Sapiens
IVKNENIKL

SEQ ID NO: 266494 - protein, 9 aa, Homo Sapiens
LLVSLTSLY

SEQ ID NO: 266495 - protein, 9 aa, Homo Sapiens
KITKIKDGD

SEQ ID NO: 266496 - protein, 9 aa, Homo Sapiens
HNETSNCRK

SEQ ID NO: 266497 - protein, 9 aa, Homo Sapiens
EKIFNHRAN

SEQ ID NO: 266498 - protein, 9 aa, Homo Sapiens
FSEKAQNMS

SEQ ID NO: 266499 - protein, 9 aa, Homo Sapiens
IGETKKTGH

SEQ ID NO: 266500 - protein, 9 aa, Homo Sapiens
NIMRVISIN

SEQ ID NO: 266501 - protein, 9 aa, Homo Sapiens
KAPCYREPN

SEQ ID NO: 266502 - protein, 9 aa, Homo Sapiens
DLIMEGVTT

SEQ ID NO: 266503 - protein, 9 aa, Homo Sapiens
LVWVLFELA

SEQ ID NO: 266504 - protein, 9 aa, Homo Sapiens
YTEPLENQF

SEQ ID NO: 266505 - protein, 9 aa, Homo Sapiens
PDQLEAVDK

SEQ ID NO: 266506 - protein, 9 aa, Homo Sapiens
RRDIKAFGV

SEQ ID NO: 266507 - protein, 9 aa, Homo Sapiens
GRPVSLPWL

SEQ ID NO: 266508 - protein, 9 aa, Homo Sapiens
PLKFSDAET

SEQ ID NO: 266509 - protein, 9 aa, Homo Sapiens
LDLEKQLSE

SEQ ID NO: 266510 - protein, 9 aa, Homo Sapiens
MLPLVLCAA

SEQ ID NO: 266511 - protein, 9 aa, Homo Sapiens
AFRYLSSLH

SEQ ID NO: 266512 - protein, 9 aa, Homo Sapiens
KALSFTEEG

SEQ ID NO: 266513 - protein, 9 aa, Homo Sapiens
LSSSNPWGP

SEQ ID NO: 266514 - protein, 9 aa, Homo Sapiens
TSFGCAVCL

SEQ ID NO: 266515 - protein, 9 aa, Homo Sapiens
NYCKVSSSS

SEQ ID NO: 266516 - protein, 9 aa, Homo Sapiens
THPVSTFDW

SEQ ID NO: 266517 - protein, 9 aa, Homo Sapiens
KARSLPDRT

SEQ ID NO: 266518 - protein, 9 aa, Homo Sapiens
KPITPECVK

SEQ ID NO: 266519 - protein, 9 aa, Homo Sapiens
GKSVVMRHS

SEQ ID NO: 266520 - protein, 9 aa, Homo Sapiens
QVQINKQHE

SEQ ID NO: 266521 - protein, 9 aa, Homo Sapiens
INGNIYIAR

SEQ ID NO: 266522 - protein, 9 aa, Homo Sapiens
PLHKIEAKE

SEQ ID NO: 266523 - protein, 9 aa, Homo Sapiens
NKEFEEYKE

SEQ ID NO: 266524 - protein, 9 aa, Homo Sapiens
LENQRKFLN

SEQ ID NO: 266525 - protein, 9 aa, Homo Sapiens
EAQPCTPSS

SEQ ID NO: 266526 - protein, 9 aa, Homo Sapiens
DQITFIERV

SEQ ID NO: 266527 - protein, 9 aa, Homo Sapiens
RKSIAVATL

SEQ ID NO: 266528 - protein, 9 aa, Homo Sapiens
DGQAESIIT

SEQ ID NO: 266529 - protein, 9 aa, Homo Sapiens
PSAGKLAMD

SEQ ID NO: 266530 - protein, 9 aa, Homo Sapiens
TISYISRTN

SEQ ID NO: 266531 - protein, 9 aa, Homo Sapiens
VLTSSRHLM

SEQ ID NO: 266532 - protein, 9 aa, Homo Sapiens
DPEHPHANN

SEQ ID NO: 266533 - protein, 9 aa, Homo Sapiens
EVAVLETSS

SEQ ID NO: 266534 - protein, 9 aa, Homo Sapiens
MISAEDCGF

SEQ ID NO: 266535 - protein, 9 aa, Homo Sapiens
GLRGPPPAG

SEQ ID NO: 266536 - protein, 9 aa, Homo Sapiens
TRELWFGLV

SEQ ID NO: 266537 - protein, 9 aa, Homo Sapiens
DGYHVPFCL

SEQ ID NO: 266538 - protein, 9 aa, Homo Sapiens
RDSAVGSVT

SEQ ID NO: 266539 - protein, 9 aa, Homo Sapiens
TFCQSGMDN

SEQ ID NO: 266540 - protein, 9 aa, Homo Sapiens
YQSTDITQL

SEQ ID NO: 266541 - protein, 9 aa, Homo Sapiens
LHPHCKIAL

SEQ ID NO: 266542 - protein, 9 aa, Homo Sapiens
LESIRPSSP

SEQ ID NO: 266543 - protein, 9 aa, Homo Sapiens
TLILSGDVL

SEQ ID NO: 266544 - protein, 9 aa, Homo Sapiens
TSSLRISNI

SEQ ID NO: 266545 - protein, 9 aa, Homo Sapiens
PRQQNPQRK

SEQ ID NO: 266546 - protein, 9 aa, Homo Sapiens
ATDGMAVWK

SEQ ID NO: 266547 - protein, 9 aa, Homo Sapiens
IYLAKRSVL

SEQ ID NO: 266548 - protein, 9 aa, Homo Sapiens
VYFASLQEY

SEQ ID NO: 266549 - protein, 9 aa, Homo Sapiens
VAVTFFSVQ

SEQ ID NO: 266550 - protein, 9 aa, Homo Sapiens
RAEVERVKT

SEQ ID NO: 266551 - protein, 9 aa, Homo Sapiens
LLEAKQTTK

SEQ ID NO: 266552 - protein, 9 aa, Homo Sapiens
QAFWESSIV

SEQ ID NO: 266553 - protein, 9 aa, Homo Sapiens
KNKECEALI

SEQ ID NO: 266554 - protein, 9 aa, Homo Sapiens
PRVQTAVGS

SEQ ID NO: 266555 - protein, 9 aa, Homo Sapiens
NSSTAIVIR

SEQ ID NO: 266556 - protein, 9 aa, Homo Sapiens
VAITFSHSE

SEQ ID NO: 266557 - protein, 9 aa, Homo Sapiens
LLPSIGVST

SEQ ID NO: 266558 - protein, 9 aa, Homo Sapiens
SPAAIPFGT

SEQ ID NO: 266559 - protein, 9 aa, Homo Sapiens
QRELVAQAL

SEQ ID NO: 266560 - protein, 9 aa, Homo Sapiens
EITKDREYM

SEQ ID NO: 266561 - protein, 9 aa, Homo Sapiens
AVHGELPPV

SEQ ID NO: 266562 - protein, 9 aa, Homo Sapiens
WKLAAMGCA

SEQ ID NO: 266563 - protein, 9 aa, Homo Sapiens
ISVKGIIYS

SEQ ID NO: 266564 - protein, 9 aa, Homo Sapiens
GPLPRASSI

SEQ ID NO: 266565 - protein, 9 aa, Homo Sapiens
LSKKLKRSN

SEQ ID NO: 266566 - protein, 9 aa, Homo Sapiens
SAIDLSSDI

SEQ ID NO: 266567 - protein, 9 aa, Homo Sapiens
NSDLAQHQK

SEQ ID NO: 266568 - protein, 9 aa, Homo Sapiens
VDGNQEFIA

SEQ ID NO: 266569 - protein, 9 aa, Homo Sapiens
AAKIINTNK

SEQ ID NO: 266570 - protein, 9 aa, Homo Sapiens
HQPPQTKAL

SEQ ID NO: 266571 - protein, 9 aa, Homo Sapiens
HNERENFRS

SEQ ID NO: 266572 - protein, 9 aa, Homo Sapiens
DQNVKFRKW

SEQ ID NO: 266573 - protein, 9 aa, Homo Sapiens
SPLHMPYSE

SEQ ID NO: 266574 - protein, 9 aa, Homo Sapiens
QDLTGIKSM

SEQ ID NO: 266575 - protein, 9 aa, Homo Sapiens
NTFKWTKKE

SEQ ID NO: 266576 - protein, 9 aa, Homo Sapiens
TVHQIIHTG

SEQ ID NO: 266577 - protein, 9 aa, Homo Sapiens
LHLGGDSFW

SEQ ID NO: 266578 - protein, 9 aa, Homo Sapiens
PTIVKLMEQ

SEQ ID NO: 266579 - protein, 9 aa, Homo Sapiens
HQQTRDTYE

SEQ ID NO: 266580 - protein, 9 aa, Homo Sapiens
LINDAGVMM

SEQ ID NO: 266581 - protein, 9 aa, Homo Sapiens
GGDLNEIEI

SEQ ID NO: 266582 - protein, 9 aa, Homo Sapiens
LLFWKTFFL

SEQ ID NO: 266583 - protein, 9 aa, Homo Sapiens
PNTFTFDTV

SEQ ID NO: 266584 - protein, 9 aa, Homo Sapiens
TKLQHFNSY

SEQ ID NO: 266585 - protein, 9 aa, Homo Sapiens
LAFLPIFFG

SEQ ID NO: 266586 - protein, 9 aa, Homo Sapiens
AFTKYCKTW

SEQ ID NO: 266587 - protein, 9 aa, Homo Sapiens
LSQLLPQPR

SEQ ID NO: 266588 - protein, 9 aa, Homo Sapiens
VMRHSWKDF

SEQ ID NO: 266589 - protein, 9 aa, Homo Sapiens
SFTSIHQIL

SEQ ID NO: 266590 - protein, 9 aa, Homo Sapiens
IWVQGDWIR

SEQ ID NO: 266591 - protein, 9 aa, Homo Sapiens
QRYVSPEDI

SEQ ID NO: 266592 - protein, 9 aa, Homo Sapiens
SDTQLKQHM

SEQ ID NO: 266593 - protein, 9 aa, Homo Sapiens
EFTSHALYS

SEQ ID NO: 266594 - protein, 9 aa, Homo Sapiens
QLCSTHASN

SEQ ID NO: 266595 - protein, 9 aa, Homo Sapiens
VTLNIPISI

SEQ ID NO: 266596 - protein, 9 aa, Homo Sapiens
TFNERIEER

SEQ ID NO: 266597 - protein, 9 aa, Homo Sapiens
RRIKPFTLE

SEQ ID NO: 266598 - protein, 9 aa, Homo Sapiens
SEISSATES

SEQ ID NO: 266599 - protein, 9 aa, Homo Sapiens
YGIDKFMKD

SEQ ID NO: 266600 - protein, 9 aa, Homo Sapiens
ELHDKQKFY

SEQ ID NO: 266601 - protein, 9 aa, Homo Sapiens
VDSSAPEDS

SEQ ID NO: 266602 - protein, 9 aa, Homo Sapiens
PLVERIHVN

SEQ ID NO: 266603 - protein, 9 aa, Homo Sapiens
VGVSRPGRD

SEQ ID NO: 266604 - protein, 9 aa, Homo Sapiens
KFSDAETDQ

SEQ ID NO: 266605 - protein, 9 aa, Homo Sapiens
NDRGKTPLM

SEQ ID NO: 266606 - protein, 9 aa, Homo Sapiens
LAAEPVPAG

SEQ ID NO: 266607 - protein, 9 aa, Homo Sapiens
IGLDDSLQD

SEQ ID NO: 266608 - protein, 9 aa, Homo Sapiens
NIKQNSVPP

SEQ ID NO: 266609 - protein, 9 aa, Homo Sapiens
VHAKEKFLK

SEQ ID NO: 266610 - protein, 9 aa, Homo Sapiens
QIIHFLENP

SEQ ID NO: 266611 - protein, 9 aa, Homo Sapiens
TQEERVKGR

SEQ ID NO: 266612 - protein, 9 aa, Homo Sapiens
QKFSKCSIL

SEQ ID NO: 266613 - protein, 9 aa, Homo Sapiens
EQQKLKKLP

SEQ ID NO: 266614 - protein, 9 aa, Homo Sapiens
QVYKPPALR

SEQ ID NO: 266615 - protein, 9 aa, Homo Sapiens
ALLGQMCFQ

SEQ ID NO: 266616 - protein, 9 aa, Homo Sapiens
QEELQVKIS

SEQ ID NO: 266617 - protein, 9 aa, Homo Sapiens
QGAKIVYLP

SEQ ID NO: 266618 - protein, 9 aa, Homo Sapiens
YSTMFAEGN

SEQ ID NO: 266619 - protein, 9 aa, Homo Sapiens
TREKEEKKR

SEQ ID NO: 266620 - protein, 9 aa, Homo Sapiens
RQEQEANMW

SEQ ID NO: 266621 - protein, 9 aa, Homo Sapiens
HPHCKIALF

SEQ ID NO: 266622 - protein, 9 aa, Homo Sapiens
KRPRYYPTE

SEQ ID NO: 266623 - protein, 9 aa, Homo Sapiens
FQTQTSLVQ

SEQ ID NO: 266624 - protein, 9 aa, Homo Sapiens
DLFLENAIG

SEQ ID NO: 266625 - protein, 9 aa, Homo Sapiens
RLSLILESA

SEQ ID NO: 266626 - protein, 9 aa, Homo Sapiens
EDVNVTFKD

SEQ ID NO: 266627 - protein, 9 aa, Homo Sapiens
ISNKEFEEY

SEQ ID NO: 266628 - protein, 9 aa, Homo Sapiens
KSYPGAQLD

SEQ ID NO: 266629 - protein, 9 aa, Homo Sapiens
PIHLHQIHH

SEQ ID NO: 266630 - protein, 9 aa, Homo Sapiens
GPEFAHSYI

SEQ ID NO: 266631 - protein, 9 aa, Homo Sapiens
CNTMFSSVC

SEQ ID NO: 266632 - protein, 9 aa, Homo Sapiens
MDGHAMDFS

SEQ ID NO: 266633 - protein, 9 aa, Homo Sapiens
RRTTNRMLA

SEQ ID NO: 266634 - protein, 9 aa, Homo Sapiens
WHLDEKNLA

SEQ ID NO: 266635 - protein, 9 aa, Homo Sapiens
TGALTQNRM

SEQ ID NO: 266636 - protein, 9 aa, Homo Sapiens
DGHLQGLFI

SEQ ID NO: 266637 - protein, 9 aa, Homo Sapiens
ELYHSVQGA

SEQ ID NO: 266638 - protein, 9 aa, Homo Sapiens
LTRFNKQLL

SEQ ID NO: 266639 - protein, 9 aa, Homo Sapiens
SKCAMKKYI

SEQ ID NO: 266640 - protein, 9 aa, Homo Sapiens
LLDYINKEI

SEQ ID NO: 266641 - protein, 9 aa, Homo Sapiens
DEGILWNKF

SEQ ID NO: 266642 - protein, 9 aa, Homo Sapiens
FEPEPISFT

SEQ ID NO: 266643 - protein, 9 aa, Homo Sapiens
PSLFLDNFS

SEQ ID NO: 266644 - protein, 9 aa, Homo Sapiens
GLRLPFIGF

SEQ ID NO: 266645 - protein, 9 aa, Homo Sapiens
HKVSFQDKE

SEQ ID NO: 266646 - protein, 9 aa, Homo Sapiens
EMLRVASSY

SEQ ID NO: 266647 - protein, 9 aa, Homo Sapiens
LSSLHIHER

SEQ ID NO: 266648 - protein, 9 aa, Homo Sapiens
IYTSESLVK

SEQ ID NO: 266649 - protein, 9 aa, Homo Sapiens
ALGLAQPTS

SEQ ID NO: 266650 - protein, 9 aa, Homo Sapiens
SEKRLNIFF

SEQ ID NO: 266651 - protein, 9 aa, Homo Sapiens
GHRDLKAEN

SEQ ID NO: 266652 - protein, 9 aa, Homo Sapiens
KTLLDFILK

SEQ ID NO: 266653 - protein, 9 aa, Homo Sapiens
SQTSHTRHI

SEQ ID NO: 266654 - protein, 9 aa, Homo Sapiens
STGTTCING

SEQ ID NO: 266655 - protein, 9 aa, Homo Sapiens
DCHEIQIYE

SEQ ID NO: 266656 - protein, 9 aa, Homo Sapiens
HHYSNKWHR

SEQ ID NO: 266657 - protein, 9 aa, Homo Sapiens
HARTPELSN

SEQ ID NO: 266658 - protein, 9 aa, Homo Sapiens
NRHQGKPLP

SEQ ID NO: 266659 - protein, 9 aa, Homo Sapiens
LDAKEMQIV

SEQ ID NO: 266660 - protein, 9 aa, Homo Sapiens
LKVAAVIES

SEQ ID NO: 266661 - protein, 9 aa, Homo Sapiens
GVSHSQKFS

SEQ ID NO: 266662 - protein, 9 aa, Homo Sapiens
GKVDKQYKS

SEQ ID NO: 266663 - protein, 9 aa, Homo Sapiens
MLLGQFSFD

SEQ ID NO: 266664 - protein, 9 aa, Homo Sapiens
EKCLGFRDE

SEQ ID NO: 266665 - protein, 9 aa, Homo Sapiens
CHPSVYSLS

SEQ ID NO: 266666 - protein, 9 aa, Homo Sapiens
NCHFLRLHI

SEQ ID NO: 266667 - protein, 9 aa, Homo Sapiens
LAKDQRTHT

SEQ ID NO: 266668 - protein, 9 aa, Homo Sapiens
IILNKKAET

SEQ ID NO: 266669 - protein, 9 aa, Homo Sapiens
EMKKLPLLN

SEQ ID NO: 266670 - protein, 9 aa, Homo Sapiens
ALLLVTKDI

SEQ ID NO: 266671 - protein, 9 aa, Homo Sapiens
AHELENPED

SEQ ID NO: 266672 - protein, 9 aa, Homo Sapiens
QIMFETSNV

SEQ ID NO: 266673 - protein, 9 aa, Homo Sapiens
ISTLDYLDF

SEQ ID NO: 266674 - protein, 9 aa, Homo Sapiens
TFILPIFFL

SEQ ID NO: 266675 - protein, 9 aa, Homo Sapiens
NKIRPNWQL

SEQ ID NO: 266676 - protein, 9 aa, Homo Sapiens
GDGRYVSND

SEQ ID NO: 266677 - protein, 9 aa, Homo Sapiens
QLKHIMEVV

SEQ ID NO: 266678 - protein, 9 aa, Homo Sapiens
DTNLTHLYL

SEQ ID NO: 266679 - protein, 9 aa, Homo Sapiens
YSQSAEERL

SEQ ID NO: 266680 - protein, 9 aa, Homo Sapiens
SVEFHERGN

SEQ ID NO: 266681 - protein, 9 aa, Homo Sapiens
VPGSLCLRT

SEQ ID NO: 266682 - protein, 9 aa, Homo Sapiens
ACAAGYFHN

SEQ ID NO: 266683 - protein, 9 aa, Homo Sapiens
SDGDGKISF

SEQ ID NO: 266684 - protein, 9 aa, Homo Sapiens
KSRSAQSPP

SEQ ID NO: 266685 - protein, 9 aa, Homo Sapiens
VHGELPPVT

SEQ ID NO: 266686 - protein, 9 aa, Homo Sapiens
TQRGAGSNA

SEQ ID NO: 266687 - protein, 9 aa, Homo Sapiens
LLLCPSISH

SEQ ID NO: 266688 - protein, 9 aa, Homo Sapiens
SGFCLYSPG

SEQ ID NO: 266689 - protein, 9 aa, Homo Sapiens
HKLAEMLDQ

SEQ ID NO: 266690 - protein, 9 aa, Homo Sapiens
AEEQEMMDN

SEQ ID NO: 266691 - protein, 9 aa, Homo Sapiens
SCQISCTLA

SEQ ID NO: 266692 - protein, 9 aa, Homo Sapiens
KHVKKEKTE

SEQ ID NO: 266693 - protein, 9 aa, Homo Sapiens
IGGIIFLAF

SEQ ID NO: 266694 - protein, 9 aa, Homo Sapiens
VEAVGAPLK

SEQ ID NO: 266695 - protein, 9 aa, Homo Sapiens
IYLHLALVK

SEQ ID NO: 266696 - protein, 9 aa, Homo Sapiens
ESAAHAIVL

SEQ ID NO: 266697 - protein, 9 aa, Homo Sapiens
DMQGKLATF

SEQ ID NO: 266698 - protein, 9 aa, Homo Sapiens
TSAETRETL

SEQ ID NO: 266699 - protein, 9 aa, Homo Sapiens
KDPAHFNLY

SEQ ID NO: 266700 - protein, 9 aa, Homo Sapiens
TCSRLTSSP

SEQ ID NO: 266701 - protein, 9 aa, Homo Sapiens
VLGKILLST

SEQ ID NO: 266702 - protein, 9 aa, Homo Sapiens
QHKIIHIRE

SEQ ID NO: 266703 - protein, 9 aa, Homo Sapiens
SKDSYGVIH

SEQ ID NO: 266704 - protein, 9 aa, Homo Sapiens
EVDKEAISV

SEQ ID NO: 266705 - protein, 9 aa, Homo Sapiens
RELEQAQAS

SEQ ID NO: 266706 - protein, 9 aa, Homo Sapiens
CQSQSSTFS

SEQ ID NO: 266707 - protein, 9 aa, Homo Sapiens
FTSGQSEVY

SEQ ID NO: 266708 - protein, 9 aa, Homo Sapiens
LSFASGQRT

SEQ ID NO: 266709 - protein, 9 aa, Homo Sapiens
PRMDDEDEG

SEQ ID NO: 266710 - protein, 9 aa, Homo Sapiens
LELPEDEDE

SEQ ID NO: 266711 - protein, 9 aa, Homo Sapiens
YVRTSGSRS

SEQ ID NO: 266712 - protein, 9 aa, Homo Sapiens
SVKEVFRAP

SEQ ID NO: 266713 - protein, 9 aa, Homo Sapiens
EQTFLIGLG

SEQ ID NO: 266714 - protein, 9 aa, Homo Sapiens
GYTCKDCGA

SEQ ID NO: 266715 - protein, 9 aa, Homo Sapiens
GTEEKSVIS

SEQ ID NO: 266716 - protein, 9 aa, Homo Sapiens
FILDPFQYL

SEQ ID NO: 266717 - protein, 9 aa, Homo Sapiens
KNMALFGLT

SEQ ID NO: 266718 - protein, 9 aa, Homo Sapiens
CVAGPENRT

SEQ ID NO: 266719 - protein, 9 aa, Homo Sapiens
NLLKVLACT

SEQ ID NO: 266720 - protein, 9 aa, Homo Sapiens
PSQEREHPA

SEQ ID NO: 266721 - protein, 9 aa, Homo Sapiens
HEQTKAFKF

SEQ ID NO: 266722 - protein, 9 aa, Homo Sapiens
EGMAGLLGT

SEQ ID NO: 266723 - protein, 9 aa, Homo Sapiens
HEEELLSQD

SEQ ID NO: 266724 - protein, 9 aa, Homo Sapiens
GLCDHCAVT

SEQ ID NO: 266725 - protein, 9 aa, Homo Sapiens
QSEQIWKLR

SEQ ID NO: 266726 - protein, 9 aa, Homo Sapiens
VDNSAEKQA

SEQ ID NO: 266727 - protein, 9 aa, Homo Sapiens
SQICLNTEW

SEQ ID NO: 266728 - protein, 9 aa, Homo Sapiens
NVTQQSFNF

SEQ ID NO: 266729 - protein, 9 aa, Homo Sapiens
PPEDYRRGQ

SEQ ID NO: 266730 - protein, 9 aa, Homo Sapiens
NMMVPPLPS

SEQ ID NO: 266731 - protein, 9 aa, Homo Sapiens
STVESLYSR

SEQ ID NO: 266732 - protein, 9 aa, Homo Sapiens
VLEAIAGEY

SEQ ID NO: 266733 - protein, 9 aa, Homo Sapiens
LALDPSPFN

SEQ ID NO: 266734 - protein, 9 aa, Homo Sapiens
HSANKFFVE

SEQ ID NO: 266735 - protein, 9 aa, Homo Sapiens
PEIQTVPTP

SEQ ID NO: 266736 - protein, 9 aa, Homo Sapiens
ICSLKVSGQ

SEQ ID NO: 266737 - protein, 9 aa, Homo Sapiens
VTAAVLVSF

SEQ ID NO: 266738 - protein, 9 aa, Homo Sapiens
HPPAGDGNK

SEQ ID NO: 266739 - protein, 9 aa, Homo Sapiens
LRAGLSLDN

SEQ ID NO: 266740 - protein, 9 aa, Homo Sapiens
KYFVKYCVE

SEQ ID NO: 266741 - protein, 9 aa, Homo Sapiens
STSNASPPE

SEQ ID NO: 266742 - protein, 9 aa, Homo Sapiens
VIFSDCQRD

SEQ ID NO: 266743 - protein, 9 aa, Homo Sapiens
PRNIEVPGD

SEQ ID NO: 266744 - protein, 9 aa, Homo Sapiens
LNTGSFNLL

SEQ ID NO: 266745 - protein, 9 aa, Homo Sapiens
KLADMEEPP

SEQ ID NO: 266746 - protein, 9 aa, Homo Sapiens
GQIRFGAVS

SEQ ID NO: 266747 - protein, 9 aa, Homo Sapiens
WRRWMGPTD

SEQ ID NO: 266748 - protein, 9 aa, Homo Sapiens
ITIIGLSIH

SEQ ID NO: 266749 - protein, 9 aa, Homo Sapiens
YSLLQALDF

SEQ ID NO: 266750 - protein, 9 aa, Homo Sapiens
LKSAGGLVF

SEQ ID NO: 266751 - protein, 9 aa, Homo Sapiens
AKNAQLSTG

SEQ ID NO: 266752 - protein, 9 aa, Homo Sapiens
HFGTPVIAN

SEQ ID NO: 266753 - protein, 9 aa, Homo Sapiens
FCSHLGVIE

SEQ ID NO: 266754 - protein, 9 aa, Homo Sapiens
AKKLYDAKV

SEQ ID NO: 266755 - protein, 9 aa, Homo Sapiens
CINALKSES

SEQ ID NO: 266756 - protein, 9 aa, Homo Sapiens
PLGLKLQRF

SEQ ID NO: 266757 - protein, 9 aa, Homo Sapiens
NRASSENCY

SEQ ID NO: 266758 - protein, 9 aa, Homo Sapiens
TYVSDWWEE

SEQ ID NO: 266759 - protein, 9 aa, Homo Sapiens
KTGALTQNR

SEQ ID NO: 266760 - protein, 9 aa, Homo Sapiens
SLSEEMTYI

SEQ ID NO: 266761 - protein, 9 aa, Homo Sapiens
NELPNFPHI

SEQ ID NO: 266762 - protein, 9 aa, Homo Sapiens
LVNFLAKNM

SEQ ID NO: 266763 - protein, 9 aa, Homo Sapiens
AKITDPSAV

SEQ ID NO: 266764 - protein, 9 aa, Homo Sapiens
GLKDNNHLR

SEQ ID NO: 266765 - protein, 9 aa, Homo Sapiens
NGERVEQYS

SEQ ID NO: 266766 - protein, 9 aa, Homo Sapiens
WDEPEGLLA

SEQ ID NO: 266767 - protein, 9 aa, Homo Sapiens
AWVAWINRC

SEQ ID NO: 266768 - protein, 9 aa, Homo Sapiens
DLIEHQIIH

SEQ ID NO: 266769 - protein, 9 aa, Homo Sapiens
GIASCLYML

SEQ ID NO: 266770 - protein, 9 aa, Homo Sapiens
YLFGGDEIA

SEQ ID NO: 266771 - protein, 9 aa, Homo Sapiens
QQPDKVAEA

SEQ ID NO: 266772 - protein, 9 aa, Homo Sapiens
AGSPQKPQG

SEQ ID NO: 266773 - protein, 9 aa, Homo Sapiens
SVHPASLNG

SEQ ID NO: 266774 - protein, 9 aa, Homo Sapiens
VSEDNITEF

SEQ ID NO: 266775 - protein, 9 aa, Homo Sapiens
SLIDRGRTP

SEQ ID NO: 266776 - protein, 9 aa, Homo Sapiens
STVQHLEMV

SEQ ID NO: 266777 - protein, 9 aa, Homo Sapiens
SGTRGWQAA

SEQ ID NO: 266778 - protein, 9 aa, Homo Sapiens
SQIIHLSIH

SEQ ID NO: 266779 - protein, 9 aa, Homo Sapiens
GVNGFGRSG

SEQ ID NO: 266780 - protein, 9 aa, Homo Sapiens
CYSPWCHPC

SEQ ID NO: 266781 - protein, 9 aa, Homo Sapiens
KSKGQQLDG

SEQ ID NO: 266782 - protein, 9 aa, Homo Sapiens
ISGQKELHD

SEQ ID NO: 266783 - protein, 9 aa, Homo Sapiens
ASVMTKTVP

SEQ ID NO: 266784 - protein, 9 aa, Homo Sapiens
HNWSPDIQG

SEQ ID NO: 266785 - protein, 9 aa, Homo Sapiens
SEEAANEDK

SEQ ID NO: 266786 - protein, 9 aa, Homo Sapiens
VFGIVVGTS

SEQ ID NO: 266787 - protein, 9 aa, Homo Sapiens
NPASSSEFY

SEQ ID NO: 266788 - protein, 9 aa, Homo Sapiens
HNCEPYKIL

SEQ ID NO: 266789 - protein, 9 aa, Homo Sapiens
GNAKQQPDK

SEQ ID NO: 266790 - protein, 9 aa, Homo Sapiens
YHRYKFIIQ

SEQ ID NO: 266791 - protein, 9 aa, Homo Sapiens
RTKVLHKKF

SEQ ID NO: 266792 - protein, 9 aa, Homo Sapiens
YFYRGCLDW

SEQ ID NO: 266793 - protein, 9 aa, Homo Sapiens
DIRWNFDKF

SEQ ID NO: 266794 - protein, 9 aa, Homo Sapiens
VDTSTRTHH

SEQ ID NO: 266795 - protein, 9 aa, Homo Sapiens
IIDLYKMKA

SEQ ID NO: 266796 - protein, 9 aa, Homo Sapiens
LTSECTTLA

SEQ ID NO: 266797 - protein, 9 aa, Homo Sapiens
FKNLFWSIF

SEQ ID NO: 266798 - protein, 9 aa, Homo Sapiens
ETVIFHARV

SEQ ID NO: 266799 - protein, 9 aa, Homo Sapiens
PGQFAPDHD

SEQ ID NO: 266800 - protein, 9 aa, Homo Sapiens
PLCSIKEKE

SEQ ID NO: 266801 - protein, 9 aa, Homo Sapiens
PWKSAYSSL

SEQ ID NO: 266802 - protein, 9 aa, Homo Sapiens
CRNIGHRDL

SEQ ID NO: 266803 - protein, 9 aa, Homo Sapiens
LVLGGIILA

SEQ ID NO: 266804 - protein, 9 aa, Homo Sapiens
GHRGLVNKW

SEQ ID NO: 266805 - protein, 9 aa, Homo Sapiens
DSTLGQIQN

SEQ ID NO: 266806 - protein, 9 aa, Homo Sapiens
KQDNEGGEK

SEQ ID NO: 266807 - protein, 9 aa, Homo Sapiens
RGEARIQQR

SEQ ID NO: 266808 - protein, 9 aa, Homo Sapiens
RSAKGRWIT

SEQ ID NO: 266809 - protein, 9 aa, Homo Sapiens
VPPSVGQWE

SEQ ID NO: 266810 - protein, 9 aa, Homo Sapiens
LVPEYSKAA

SEQ ID NO: 266811 - protein, 9 aa, Homo Sapiens
ASGIFGGLS

SEQ ID NO: 266812 - protein, 9 aa, Homo Sapiens
TNVLCTLPA

SEQ ID NO: 266813 - protein, 9 aa, Homo Sapiens
RQFLQWTEL

SEQ ID NO: 266814 - protein, 9 aa, Homo Sapiens
YCVVLVIWG

SEQ ID NO: 266815 - protein, 9 aa, Homo Sapiens
LNLLQPRLV

SEQ ID NO: 266816 - protein, 9 aa, Homo Sapiens
EIMFQYDTE

SEQ ID NO: 266817 - protein, 9 aa, Homo Sapiens
HWSNKLIAE

SEQ ID NO: 266818 - protein, 9 aa, Homo Sapiens
MPEDVQEKK

SEQ ID NO: 266819 - protein, 9 aa, Homo Sapiens
VQGTAFNLR

SEQ ID NO: 266820 - protein, 9 aa, Homo Sapiens
ALGARRKIF

SEQ ID NO: 266821 - protein, 9 aa, Homo Sapiens
YCMCQDKKY

SEQ ID NO: 266822 - protein, 9 aa, Homo Sapiens
SLSYTGEKK

SEQ ID NO: 266823 - protein, 9 aa, Homo Sapiens
STLTFQAGF

SEQ ID NO: 266824 - protein, 9 aa, Homo Sapiens
SPGFRLALP

SEQ ID NO: 266825 - protein, 9 aa, Homo Sapiens
LCVQSDYTE

SEQ ID NO: 266826 - protein, 9 aa, Homo Sapiens
EQESPDKLD

SEQ ID NO: 266827 - protein, 9 aa, Homo Sapiens
PSSHPDKPL

SEQ ID NO: 266828 - protein, 9 aa, Homo Sapiens
MVKFLINKK

SEQ ID NO: 266829 - protein, 9 aa, Homo Sapiens
PTFIILGFS

SEQ ID NO: 266830 - protein, 9 aa, Homo Sapiens
QIINIYIYH

SEQ ID NO: 266831 - protein, 9 aa, Homo Sapiens
ENSKNTEFL

SEQ ID NO: 266832 - protein, 9 aa, Homo Sapiens
DITLTQRAS

SEQ ID NO: 266833 - protein, 9 aa, Homo Sapiens
ILKVEDSER

SEQ ID NO: 266834 - protein, 9 aa, Homo Sapiens
ALAGQATPD

SEQ ID NO: 266835 - protein, 9 aa, Homo Sapiens
KVNFYDWKR

SEQ ID NO: 266836 - protein, 9 aa, Homo Sapiens
PANPSILSW

SEQ ID NO: 266837 - protein, 9 aa, Homo Sapiens
PAKNKKEQE

SEQ ID NO: 266838 - protein, 9 aa, Homo Sapiens
FEGESCEVN

SEQ ID NO: 266839 - protein, 9 aa, Homo Sapiens
WKSQHQEDT

SEQ ID NO: 266840 - protein, 9 aa, Homo Sapiens
SQTRYFILP

SEQ ID NO: 266841 - protein, 9 aa, Homo Sapiens
NLNALDIYG

SEQ ID NO: 266842 - protein, 9 aa, Homo Sapiens
EDPLHSGDD

SEQ ID NO: 266843 - protein, 9 aa, Homo Sapiens
QRCNCGPGL

SEQ ID NO: 266844 - protein, 9 aa, Homo Sapiens
IIYLLAKIK

SEQ ID NO: 266845 - protein, 9 aa, Homo Sapiens
ADLMVSVAA

SEQ ID NO: 266846 - protein, 9 aa, Homo Sapiens
KSVVPEKPN

SEQ ID NO: 266847 - protein, 9 aa, Homo Sapiens
FGERLLECQ

SEQ ID NO: 266848 - protein, 9 aa, Homo Sapiens
SRGNTWSRE

SEQ ID NO: 266849 - protein, 9 aa, Homo Sapiens
CLRTFSCMF

SEQ ID NO: 266850 - protein, 9 aa, Homo Sapiens
GAQLGTVIY

SEQ ID NO: 266851 - protein, 9 aa, Homo Sapiens
ICMVESGAD

SEQ ID NO: 266852 - protein, 9 aa, Homo Sapiens
EDEQDNCKE

SEQ ID NO: 266853 - protein, 9 aa, Homo Sapiens
TPNTEMRTS

SEQ ID NO: 266854 - protein, 9 aa, Homo Sapiens
EVCEDLKLP

SEQ ID NO: 266855 - protein, 9 aa, Homo Sapiens
PRANWSSLR

SEQ ID NO: 266856 - protein, 9 aa, Homo Sapiens
RMLTLNNYQ

SEQ ID NO: 266857 - protein, 9 aa, Homo Sapiens
LNSEASLLE

SEQ ID NO: 266858 - protein, 9 aa, Homo Sapiens
IFQSLTKRN

SEQ ID NO: 266859 - protein, 9 aa, Homo Sapiens
SAQYPFSSP

SEQ ID NO: 266860 - protein, 9 aa, Homo Sapiens
ETNEGVLYV

SEQ ID NO: 266861 - protein, 9 aa, Homo Sapiens
LVAVKRAVM

SEQ ID NO: 266862 - protein, 9 aa, Homo Sapiens
ELSLHQAFS

SEQ ID NO: 266863 - protein, 9 aa, Homo Sapiens
LGTDLQGLR

SEQ ID NO: 266864 - protein, 9 aa, Homo Sapiens
LLALMYGLD

SEQ ID NO: 266865 - protein, 9 aa, Homo Sapiens
YEALNNLTP

SEQ ID NO: 266866 - protein, 9 aa, Homo Sapiens
PTITDTMKF

SEQ ID NO: 266867 - protein, 9 aa, Homo Sapiens
RENNPDMVA

SEQ ID NO: 266868 - protein, 9 aa, Homo Sapiens
LICVLNKCD

SEQ ID NO: 266869 - protein, 9 aa, Homo Sapiens
VIQGDSKYT

SEQ ID NO: 266870 - protein, 9 aa, Homo Sapiens
IKKFSKTQS

SEQ ID NO: 266871 - protein, 9 aa, Homo Sapiens
TKLWLSHRP

SEQ ID NO: 266872 - protein, 9 aa, Homo Sapiens
LSPNQTKFT

SEQ ID NO: 266873 - protein, 9 aa, Homo Sapiens
SLGKHVGNK

SEQ ID NO: 266874 - protein, 9 aa, Homo Sapiens
HQRTNSGEK

SEQ ID NO: 266875 - protein, 9 aa, Homo Sapiens
ELSEQLEQV

SEQ ID NO: 266876 - protein, 9 aa, Homo Sapiens
PGSLCLRTF

SEQ ID NO: 266877 - protein, 9 aa, Homo Sapiens
NIGHRDLKA

SEQ ID NO: 266878 - protein, 9 aa, Homo Sapiens
KNYGNGKTF

SEQ ID NO: 266879 - protein, 9 aa, Homo Sapiens
LNAEHAETD

SEQ ID NO: 266880 - protein, 9 aa, Homo Sapiens
KKLYDVMIL

SEQ ID NO: 266881 - protein, 9 aa, Homo Sapiens
YQTSSGQYS

SEQ ID NO: 266882 - protein, 9 aa, Homo Sapiens
ASATPGVDH

SEQ ID NO: 266883 - protein, 9 aa, Homo Sapiens
VEDSERKAR

SEQ ID NO: 266884 - protein, 9 aa, Homo Sapiens
LHPGLFTLE

SEQ ID NO: 266885 - protein, 9 aa, Homo Sapiens
RGLVNKWTT

SEQ ID NO: 266886 - protein, 9 aa, Homo Sapiens
GDIMPISEL

SEQ ID NO: 266887 - protein, 9 aa, Homo Sapiens
WNFDKFLVG

SEQ ID NO: 266888 - protein, 9 aa, Homo Sapiens
KKNKNKGKK

SEQ ID NO: 266889 - protein, 9 aa, Homo Sapiens
SINNYLQFL

SEQ ID NO: 266890 - protein, 9 aa, Homo Sapiens
SGVSVRAGL

SEQ ID NO: 266891 - protein, 9 aa, Homo Sapiens
LLVQIGPKE

SEQ ID NO: 266892 - protein, 9 aa, Homo Sapiens
ETKKVLQQM

SEQ ID NO: 266893 - protein, 9 aa, Homo Sapiens
GLDEGHVQA

SEQ ID NO: 266894 - protein, 9 aa, Homo Sapiens
NSIAIVGVN

SEQ ID NO: 266895 - protein, 9 aa, Homo Sapiens
QEVPLCYLL

SEQ ID NO: 266896 - protein, 9 aa, Homo Sapiens
NIISFDGCI

SEQ ID NO: 266897 - protein, 9 aa, Homo Sapiens
RYFIAAAKI

SEQ ID NO: 266898 - protein, 9 aa, Homo Sapiens
YTNLYLERG

SEQ ID NO: 266899 - protein, 9 aa, Homo Sapiens
SIYKYQPGK

SEQ ID NO: 266900 - protein, 9 aa, Homo Sapiens
IQKQELKYL

SEQ ID NO: 266901 - protein, 9 aa, Homo Sapiens
GDTMKLPDI

SEQ ID NO: 266902 - protein, 9 aa, Homo Sapiens
HNFMMDNQL

SEQ ID NO: 266903 - protein, 9 aa, Homo Sapiens
IFRSNYPFP

SEQ ID NO: 266904 - protein, 9 aa, Homo Sapiens
ELLSQMAAA

SEQ ID NO: 266905 - protein, 9 aa, Homo Sapiens
ASKWALIFS

SEQ ID NO: 266906 - protein, 9 aa, Homo Sapiens
CHCRNIGHR

SEQ ID NO: 266907 - protein, 9 aa, Homo Sapiens
KQLTTDPDL

SEQ ID NO: 266908 - protein, 9 aa, Homo Sapiens
LYLSESVSD

SEQ ID NO: 266909 - protein, 9 aa, Homo Sapiens
RLNYQLIYH

SEQ ID NO: 266910 - protein, 9 aa, Homo Sapiens
FYNILAVVL

SEQ ID NO: 266911 - protein, 9 aa, Homo Sapiens
ESVWLNLRN

SEQ ID NO: 266912 - protein, 9 aa, Homo Sapiens
GLWEVGTGA

SEQ ID NO: 266913 - protein, 9 aa, Homo Sapiens
IVNNACGVQ

SEQ ID NO: 266914 - protein, 9 aa, Homo Sapiens
LCSGAPGEH

SEQ ID NO: 266915 - protein, 9 aa, Homo Sapiens
TISANSTHA

SEQ ID NO: 266916 - protein, 9 aa, Homo Sapiens
KCGKNPELS

SEQ ID NO: 266917 - protein, 9 aa, Homo Sapiens
QLEKSRTRY

SEQ ID NO: 266918 - protein, 9 aa, Homo Sapiens
SFGCNSTII

SEQ ID NO: 266919 - protein, 9 aa, Homo Sapiens
GLVNTAGIS

SEQ ID NO: 266920 - protein, 9 aa, Homo Sapiens
NKKFSKQYK

SEQ ID NO: 266921 - protein, 9 aa, Homo Sapiens
VIPPNKFIS

SEQ ID NO: 266922 - protein, 9 aa, Homo Sapiens
SPLTLGMRV

SEQ ID NO: 266923 - protein, 9 aa, Homo Sapiens
SYEKSNTTA

SEQ ID NO: 266924 - protein, 9 aa, Homo Sapiens
IQQRVYSLL

SEQ ID NO: 266925 - protein, 9 aa, Homo Sapiens
IQWIVTFIH

SEQ ID NO: 266926 - protein, 9 aa, Homo Sapiens
HNMALLQMA

SEQ ID NO: 266927 - protein, 9 aa, Homo Sapiens
NGTYTVNIV

SEQ ID NO: 266928 - protein, 9 aa, Homo Sapiens
DVLNCNLFI

SEQ ID NO: 266929 - protein, 9 aa, Homo Sapiens
IVIRCKDGV

SEQ ID NO: 266930 - protein, 9 aa, Homo Sapiens
DTINKLKNE

SEQ ID NO: 266931 - protein, 9 aa, Homo Sapiens
QGGDPTGAG

SEQ ID NO: 266932 - protein, 9 aa, Homo Sapiens
LPHMAEPSV

SEQ ID NO: 266933 - protein, 9 aa, Homo Sapiens
SVPCRGAEA

SEQ ID NO: 266934 - protein, 9 aa, Homo Sapiens
AIFKFQSLL

SEQ ID NO: 266935 - protein, 9 aa, Homo Sapiens
NIFERATSF

SEQ ID NO: 266936 - protein, 9 aa, Homo Sapiens
LKLQLLEHS

SEQ ID NO: 266937 - protein, 9 aa, Homo Sapiens
ISSQRNCGA

SEQ ID NO: 266938 - protein, 9 aa, Homo Sapiens
SCSTMYLPL

SEQ ID NO: 266939 - protein, 9 aa, Homo Sapiens
VNGQTIYLY

SEQ ID NO: 266940 - protein, 9 aa, Homo Sapiens
SDLLQSPSS

SEQ ID NO: 266941 - protein, 9 aa, Homo Sapiens
GLSPVIFSD

SEQ ID NO: 266942 - protein, 9 aa, Homo Sapiens
RHIPDKKLF

SEQ ID NO: 266943 - protein, 9 aa, Homo Sapiens
YPITLAGNL

SEQ ID NO: 266944 - protein, 9 aa, Homo Sapiens
PALVTYNTG

SEQ ID NO: 266945 - protein, 9 aa, Homo Sapiens
YETSLTTFS

SEQ ID NO: 266946 - protein, 9 aa, Homo Sapiens
LYSPFKPIN

SEQ ID NO: 266947 - protein, 9 aa, Homo Sapiens
TPNRLLQIW

SEQ ID NO: 266948 - protein, 9 aa, Homo Sapiens
GLLKATTLI

SEQ ID NO: 266949 - protein, 9 aa, Homo Sapiens
FLHLSKENQ

SEQ ID NO: 266950 - protein, 9 aa, Homo Sapiens
HLPLTVPFP

SEQ ID NO: 266951 - protein, 9 aa, Homo Sapiens
SETKTIYYS

SEQ ID NO: 266952 - protein, 9 aa, Homo Sapiens
LDHLATDNQ

SEQ ID NO: 266953 - protein, 9 aa, Homo Sapiens
EDFSPWDPR

SEQ ID NO: 266954 - protein, 9 aa, Homo Sapiens
NIDLRVTSK

SEQ ID NO: 266955 - protein, 9 aa, Homo Sapiens
YHNNEKYIP

SEQ ID NO: 266956 - protein, 9 aa, Homo Sapiens
KDYIECAKK

SEQ ID NO: 266957 - protein, 9 aa, Homo Sapiens
LMMDGATSS

SEQ ID NO: 266958 - protein, 9 aa, Homo Sapiens
CVKLVVFVY

SEQ ID NO: 266959 - protein, 9 aa, Homo Sapiens
TKTTVERKG

SEQ ID NO: 266960 - protein, 9 aa, Homo Sapiens
DLFLPKGTE

SEQ ID NO: 266961 - protein, 9 aa, Homo Sapiens
FTPDNPYHQ

SEQ ID NO: 266962 - protein, 9 aa, Homo Sapiens
LSNQIGKHY

SEQ ID NO: 266963 - protein, 9 aa, Homo Sapiens
KNSGQLWSW

SEQ ID NO: 266964 - protein, 9 aa, Homo Sapiens
NCLTLWAAY

SEQ ID NO: 266965 - protein, 9 aa, Homo Sapiens
KNYLPICAT

SEQ ID NO: 266966 - protein, 9 aa, Homo Sapiens
YVADYYEQM

SEQ ID NO: 266967 - protein, 9 aa, Homo Sapiens
LHVLLVGGF

SEQ ID NO: 266968 - protein, 9 aa, Homo Sapiens
DLGDSSASS

SEQ ID NO: 266969 - protein, 9 aa, Homo Sapiens
LSDRVFKAV

SEQ ID NO: 266970 - protein, 9 aa, Homo Sapiens
QTASTQYTT

SEQ ID NO: 266971 - protein, 9 aa, Homo Sapiens
FLCEGEEPR

SEQ ID NO: 266972 - protein, 9 aa, Homo Sapiens
PEVDTTPPA

SEQ ID NO: 266973 - protein, 9 aa, Homo Sapiens
QNQKAFDLD

SEQ ID NO: 266974 - protein, 9 aa, Homo Sapiens
GDDGGFFPQ

SEQ ID NO: 266975 - protein, 9 aa, Homo Sapiens
FFQGTRATL

SEQ ID NO: 266976 - protein, 9 aa, Homo Sapiens
LFYLKSKPP

SEQ ID NO: 266977 - protein, 9 aa, Homo Sapiens
HLFEDYFFH

SEQ ID NO: 266978 - protein, 9 aa, Homo Sapiens
IPEHETFVL

SEQ ID NO: 266979 - protein, 9 aa, Homo Sapiens
LITTHPLSL

SEQ ID NO: 266980 - protein, 9 aa, Homo Sapiens
PLESHLKAA

SEQ ID NO: 266981 - protein, 9 aa, Homo Sapiens
NTLCSTFTQ

SEQ ID NO: 266982 - protein, 9 aa, Homo Sapiens
GSAEEGYFT

SEQ ID NO: 266983 - protein, 9 aa, Homo Sapiens
VTSFGCAVC

SEQ ID NO: 266984 - protein, 9 aa, Homo Sapiens
DCIIDEDHS

SEQ ID NO: 266985 - protein, 9 aa, Homo Sapiens
LFLMKAAKP

SEQ ID NO: 266986 - protein, 9 aa, Homo Sapiens
QDALGIASC

SEQ ID NO: 266987 - protein, 9 aa, Homo Sapiens
LSLMLEQRT

SEQ ID NO: 266988 - protein, 9 aa, Homo Sapiens
QTQPVYLAN

SEQ ID NO: 266989 - protein, 9 aa, Homo Sapiens
GNQEPGDQT

SEQ ID NO: 266990 - protein, 9 aa, Homo Sapiens
PVSPLESHL

SEQ ID NO: 266991 - protein, 9 aa, Homo Sapiens
VDGRHNGYI

SEQ ID NO: 266992 - protein, 9 aa, Homo Sapiens
DKDNIFQQH

SEQ ID NO: 266993 - protein, 9 aa, Homo Sapiens
VLTKCNVQK

SEQ ID NO: 266994 - protein, 9 aa, Homo Sapiens
YERELGKVA

SEQ ID NO: 266995 - protein, 9 aa, Homo Sapiens
IFSVTEGAV

SEQ ID NO: 266996 - protein, 9 aa, Homo Sapiens
PGEIGKPGA

SEQ ID NO: 266997 - protein, 9 aa, Homo Sapiens
FYVTVIGLY

SEQ ID NO: 266998 - protein, 9 aa, Homo Sapiens
PGSLSRNTS

SEQ ID NO: 266999 - protein, 9 aa, Homo Sapiens
DEWKAIQDK

SEQ ID NO: 267000 - protein, 9 aa, Homo Sapiens
IYFTTSKFS

SEQ ID NO: 267001 - protein, 9 aa, Homo Sapiens
PNPSHHMTK

SEQ ID NO: 267002 - protein, 9 aa, Homo Sapiens
KEVEIRKQV

SEQ ID NO: 267003 - protein, 9 aa, Homo Sapiens
IFQFKGTHI

SEQ ID NO: 267004 - protein, 9 aa, Homo Sapiens
KESTFGLSS

SEQ ID NO: 267005 - protein, 9 aa, Homo Sapiens
NPCYFTGSE

SEQ ID NO: 267006 - protein, 9 aa, Homo Sapiens
ENYHTLYDL

SEQ ID NO: 267007 - protein, 9 aa, Homo Sapiens
LQVRLDRSR

SEQ ID NO: 267008 - protein, 9 aa, Homo Sapiens
GVRRVAVRP

SEQ ID NO: 267009 - protein, 9 aa, Homo Sapiens
AEYNVLPAS

SEQ ID NO: 267010 - protein, 9 aa, Homo Sapiens
KEDTQDKLG

SEQ ID NO: 267011 - protein, 9 aa, Homo Sapiens
YSSCLPEEK

SEQ ID NO: 267012 - protein, 9 aa, Homo Sapiens
TILISKAGT

SEQ ID NO: 267013 - protein, 9 aa, Homo Sapiens
QYSSYLSSS

SEQ ID NO: 267014 - protein, 9 aa, Homo Sapiens
QWIVTFIHG

SEQ ID NO: 267015 - protein, 9 aa, Homo Sapiens
TNALKDHAK

SEQ ID NO: 267016 - protein, 9 aa, Homo Sapiens
LCEGEEPRS

SEQ ID NO: 267017 - protein, 9 aa, Homo Sapiens
PTFLPDNDS

SEQ ID NO: 267018 - protein, 9 aa, Homo Sapiens
IFSTRNNLG

SEQ ID NO: 267019 - protein, 9 aa, Homo Sapiens
PTCLLPLSE

SEQ ID NO: 267020 - protein, 9 aa, Homo Sapiens
DINKDRNDG

SEQ ID NO: 267021 - protein, 9 aa, Homo Sapiens
YIPQVMIEP

SEQ ID NO: 267022 - protein, 9 aa, Homo Sapiens
VPRGLPGLP

SEQ ID NO: 267023 - protein, 9 aa, Homo Sapiens
GGFRILPQV

SEQ ID NO: 267024 - protein, 9 aa, Homo Sapiens
WRNSLPPID

SEQ ID NO: 267025 - protein, 9 aa, Homo Sapiens
CIIDEDHSG

SEQ ID NO: 267026 - protein, 9 aa, Homo Sapiens
VANFLRVNR

SEQ ID NO: 267027 - protein, 9 aa, Homo Sapiens
TRIWMCNTF

SEQ ID NO: 267028 - protein, 9 aa, Homo Sapiens
ALQYTLGDK

SEQ ID NO: 267029 - protein, 9 aa, Homo Sapiens
STQDFFLIV

SEQ ID NO: 267030 - protein, 9 aa, Homo Sapiens
DLLCTIMGE

SEQ ID NO: 267031 - protein, 9 aa, Homo Sapiens
LPPANSLDI

SEQ ID NO: 267032 - protein, 9 aa, Homo Sapiens
KQGSPLEAQ

SEQ ID NO: 267033 - protein, 9 aa, Homo Sapiens
EASIQAAFS

SEQ ID NO: 267034 - protein, 9 aa, Homo Sapiens
ADKRSQCKE

SEQ ID NO: 267035 - protein, 9 aa, Homo Sapiens
DYTFAPRTW

SEQ ID NO: 267036 - protein, 9 aa, Homo Sapiens
HMCTHHTDT

SEQ ID NO: 267037 - protein, 9 aa, Homo Sapiens
DKTRQSKRN

SEQ ID NO: 267038 - protein, 9 aa, Homo Sapiens
RCLGLGTAF

SEQ ID NO: 267039 - protein, 9 aa, Homo Sapiens
KGACIGRNG

SEQ ID NO: 267040 - protein, 9 aa, Homo Sapiens
LIYMSTRTN

SEQ ID NO: 267041 - protein, 9 aa, Homo Sapiens
TLLLLSEDC

SEQ ID NO: 267042 - protein, 9 aa, Homo Sapiens
GPNIPKQFV

SEQ ID NO: 267043 - protein, 9 aa, Homo Sapiens
MVIGNRESG

SEQ ID NO: 267044 - protein, 9 aa, Homo Sapiens
KLGSTETKI

SEQ ID NO: 267045 - protein, 9 aa, Homo Sapiens
VDDLLSKPK

SEQ ID NO: 267046 - protein, 9 aa, Homo Sapiens
RNDGYVLRL

SEQ ID NO: 267047 - protein, 9 aa, Homo Sapiens
KTGEEEKYA

SEQ ID NO: 267048 - protein, 9 aa, Homo Sapiens
QHVSTSRVF

SEQ ID NO: 267049 - protein, 9 aa, Homo Sapiens
RVQESFQAI

SEQ ID NO: 267050 - protein, 9 aa, Homo Sapiens
VITAVNNFI

SEQ ID NO: 267051 - protein, 9 aa, Homo Sapiens
SKSWMEDTA

SEQ ID NO: 267052 - protein, 9 aa, Homo Sapiens
FLLLLSSFL

SEQ ID NO: 267053 - protein, 9 aa, Homo Sapiens
LSDLSSFQR

SEQ ID NO: 267054 - protein, 9 aa, Homo Sapiens
LDNLNKDIE

SEQ ID NO: 267055 - protein, 9 aa, Homo Sapiens
LAFALAVLQ

SEQ ID NO: 267056 - protein, 9 aa, Homo Sapiens
PYPATTSFQ

SEQ ID NO: 267057 - protein, 9 aa, Homo Sapiens
DYRRGQVAS

SEQ ID NO: 267058 - protein, 9 aa, Homo Sapiens
LRRVPDELT

SEQ ID NO: 267059 - protein, 9 aa, Homo Sapiens
EVKQEMIEA

SEQ ID NO: 267060 - protein, 9 aa, Homo Sapiens
GQLLCVREC

SEQ ID NO: 267061 - protein, 9 aa, Homo Sapiens
VLMTSYLII

SEQ ID NO: 267062 - protein, 9 aa, Homo Sapiens
AGRFINYFV

SEQ ID NO: 267063 - protein, 9 aa, Homo Sapiens
PELASEIMA

SEQ ID NO: 267064 - protein, 9 aa, Homo Sapiens
RKRPRYYPT

SEQ ID NO: 267065 - protein, 9 aa, Homo Sapiens
PKSSKSIKL

SEQ ID NO: 267066 - protein, 9 aa, Homo Sapiens
LDPRETAIM

SEQ ID NO: 267067 - protein, 9 aa, Homo Sapiens
RILHNTKGK

SEQ ID NO: 267068 - protein, 9 aa, Homo Sapiens
FKSQIDNIN

SEQ ID NO: 267069 - protein, 9 aa, Homo Sapiens
KTCMFCHPS

SEQ ID NO: 267070 - protein, 9 aa, Homo Sapiens
IEQLCSTHA

SEQ ID NO: 267071 - protein, 9 aa, Homo Sapiens
ASCEKTVTK

SEQ ID NO: 267072 - protein, 9 aa, Homo Sapiens
RISIKFVSN

SEQ ID NO: 267073 - protein, 9 aa, Homo Sapiens
ANKDTEKES

SEQ ID NO: 267074 - protein, 9 aa, Homo Sapiens
YQIISGQKE

SEQ ID NO: 267075 - protein, 9 aa, Homo Sapiens
MVSGSEQTF

SEQ ID NO: 267076 - protein, 9 aa, Homo Sapiens
LQQIRRNIA

SEQ ID NO: 267077 - protein, 9 aa, Homo Sapiens
FCHCRNIGH

SEQ ID NO: 267078 - protein, 9 aa, Homo Sapiens
KAAEDSNAK

SEQ ID NO: 267079 - protein, 9 aa, Homo Sapiens
EATTGNRHV

SEQ ID NO: 267080 - protein, 9 aa, Homo Sapiens
RNGGVCQEG

SEQ ID NO: 267081 - protein, 9 aa, Homo Sapiens
GSGSGEGED

SEQ ID NO: 267082 - protein, 9 aa, Homo Sapiens
VSDALMTIN

SEQ ID NO: 267083 - protein, 9 aa, Homo Sapiens
LLGQFSFDI

SEQ ID NO: 267084 - protein, 9 aa, Homo Sapiens
GSLGMQGRL

SEQ ID NO: 267085 - protein, 9 aa, Homo Sapiens
CDPKPGAKR

SEQ ID NO: 267086 - protein, 9 aa, Homo Sapiens
NIMLCGMGG

SEQ ID NO: 267087 - protein, 9 aa, Homo Sapiens
MYWYKQDSN

SEQ ID NO: 267088 - protein, 9 aa, Homo Sapiens
SQAPIVSPS

SEQ ID NO: 267089 - protein, 9 aa, Homo Sapiens
EQLCSTHAS

SEQ ID NO: 267090 - protein, 9 aa, Homo Sapiens
TYINSMLDP

SEQ ID NO: 267091 - protein, 9 aa, Homo Sapiens
SSALEQQNI

SEQ ID NO: 267092 - protein, 9 aa, Homo Sapiens
ICCRRRKIS

SEQ ID NO: 267093 - protein, 9 aa, Homo Sapiens
KGGDDSKLC

SEQ ID NO: 267094 - protein, 9 aa, Homo Sapiens
ASSNSYQSL

SEQ ID NO: 267095 - protein, 9 aa, Homo Sapiens
EITEKSLHS

SEQ ID NO: 267096 - protein, 9 aa, Homo Sapiens
GSEGPSGPC

SEQ ID NO: 267097 - protein, 9 aa, Homo Sapiens
DYGRDLGPP

SEQ ID NO: 267098 - protein, 9 aa, Homo Sapiens
HGNIPVVRK

SEQ ID NO: 267099 - protein, 9 aa, Homo Sapiens
HNGKTCGLA

SEQ ID NO: 267100 - protein, 9 aa, Homo Sapiens
LVGHKKIHT

SEQ ID NO: 267101 - protein, 9 aa, Homo Sapiens
WFQKHWAKI

SEQ ID NO: 267102 - protein, 9 aa, Homo Sapiens
EKVEENNFG

SEQ ID NO: 267103 - protein, 9 aa, Homo Sapiens
QRKDREMQI

SEQ ID NO: 267104 - protein, 9 aa, Homo Sapiens
IAVRKSRGK

SEQ ID NO: 267105 - protein, 9 aa, Homo Sapiens
NGGCNTSVE

SEQ ID NO: 267106 - protein, 9 aa, Homo Sapiens
RFKVLMLAY

SEQ ID NO: 267107 - protein, 9 aa, Homo Sapiens
NNFIDGYVV

SEQ ID NO: 267108 - protein, 9 aa, Homo Sapiens
IRKGMRVVD

SEQ ID NO: 267109 - protein, 9 aa, Homo Sapiens
MKFKRRHQT

SEQ ID NO: 267110 - protein, 9 aa, Homo Sapiens
QILLKLKLL

SEQ ID NO: 267111 - protein, 9 aa, Homo Sapiens
AGIPGHPAP

SEQ ID NO: 267112 - protein, 9 aa, Homo Sapiens
TLGGNTVKS

SEQ ID NO: 267113 - protein, 9 aa, Homo Sapiens
TYVFLRQAV

SEQ ID NO: 267114 - protein, 9 aa, Homo Sapiens
KSIRKNYCK

SEQ ID NO: 267115 - protein, 9 aa, Homo Sapiens
ILRLRRKCE

SEQ ID NO: 267116 - protein, 9 aa, Homo Sapiens
KQIDNVAAL

SEQ ID NO: 267117 - protein, 9 aa, Homo Sapiens
RLSTRLFLV

SEQ ID NO: 267118 - protein, 9 aa, Homo Sapiens
KKRQEVMEW

SEQ ID NO: 267119 - protein, 9 aa, Homo Sapiens
ILSEVTPKC

SEQ ID NO: 267120 - protein, 9 aa, Homo Sapiens
DDLTMDIYA

SEQ ID NO: 267121 - protein, 9 aa, Homo Sapiens
LVGQDGGVC

SEQ ID NO: 267122 - protein, 9 aa, Homo Sapiens
FQIARLIPH

SEQ ID NO: 267123 - protein, 9 aa, Homo Sapiens
CELCKHSFA

SEQ ID NO: 267124 - protein, 9 aa, Homo Sapiens
WTKSQTTIS

SEQ ID NO: 267125 - protein, 9 aa, Homo Sapiens
LIMDLKEEK

SEQ ID NO: 267126 - protein, 9 aa, Homo Sapiens
PLCVIPTSD

SEQ ID NO: 267127 - protein, 9 aa, Homo Sapiens
YLDRLLSLS

SEQ ID NO: 267128 - protein, 9 aa, Homo Sapiens
HRSRLDKSL

SEQ ID NO: 267129 - protein, 9 aa, Homo Sapiens
FPQSIDLLT

SEQ ID NO: 267130 - protein, 9 aa, Homo Sapiens
TQPHSCIFS

SEQ ID NO: 267131 - protein, 9 aa, Homo Sapiens
GQKYVRLHE

SEQ ID NO: 267132 - protein, 9 aa, Homo Sapiens
LSIVKIWFK

SEQ ID NO: 267133 - protein, 9 aa, Homo Sapiens
VERDFSVCI

SEQ ID NO: 267134 - protein, 9 aa, Homo Sapiens
YTKAIGIWA

SEQ ID NO: 267135 - protein, 9 aa, Homo Sapiens
SLPTIPPIQ

SEQ ID NO: 267136 - protein, 9 aa, Homo Sapiens
AEKVEENNF

SEQ ID NO: 267137 - protein, 9 aa, Homo Sapiens
KCEEYIQPP

SEQ ID NO: 267138 - protein, 9 aa, Homo Sapiens
VALNADIAA

SEQ ID NO: 267139 - protein, 9 aa, Homo Sapiens
DIEQDVNCL

SEQ ID NO: 267140 - protein, 9 aa, Homo Sapiens
ITDYGKLYH

SEQ ID NO: 267141 - protein, 9 aa, Homo Sapiens
DYKAVPSQT

SEQ ID NO: 267142 - protein, 9 aa, Homo Sapiens
AESTEMESG

SEQ ID NO: 267143 - protein, 9 aa, Homo Sapiens
KYNPVVINF

SEQ ID NO: 267144 - protein, 9 aa, Homo Sapiens
YSTDSDQCY

SEQ ID NO: 267145 - protein, 9 aa, Homo Sapiens
TPARCPQPR

SEQ ID NO: 267146 - protein, 9 aa, Homo Sapiens
AKTFYTDLM

SEQ ID NO: 267147 - protein, 9 aa, Homo Sapiens
EVRKKSKKE

SEQ ID NO: 267148 - protein, 9 aa, Homo Sapiens
PRGPGRSRK

SEQ ID NO: 267149 - protein, 9 aa, Homo Sapiens
TSVLEVVSD

SEQ ID NO: 267150 - protein, 9 aa, Homo Sapiens
QHQEDTYEL

SEQ ID NO: 267151 - protein, 9 aa, Homo Sapiens
CLCRGDSSG

SEQ ID NO: 267152 - protein, 9 aa, Homo Sapiens
DIERKLFDK

SEQ ID NO: 267153 - protein, 9 aa, Homo Sapiens
QPPDFLLVH

SEQ ID NO: 267154 - protein, 9 aa, Homo Sapiens
PTSPTPASY

SEQ ID NO: 267155 - protein, 9 aa, Homo Sapiens
ARHALATRY

SEQ ID NO: 267156 - protein, 9 aa, Homo Sapiens
DWPTPILAE

SEQ ID NO: 267157 - protein, 9 aa, Homo Sapiens
ASTNVPFSW

SEQ ID NO: 267158 - protein, 9 aa, Homo Sapiens
TQKPKKSVN

SEQ ID NO: 267159 - protein, 9 aa, Homo Sapiens
IDSNDQATV

SEQ ID NO: 267160 - protein, 9 aa, Homo Sapiens
AHVDSQLHT

SEQ ID NO: 267161 - protein, 9 aa, Homo Sapiens
AHRRSEELR

SEQ ID NO: 267162 - protein, 9 aa, Homo Sapiens
QLNEEVTHV

SEQ ID NO: 267163 - protein, 9 aa, Homo Sapiens
TGFPGTDCN

SEQ ID NO: 267164 - protein, 9 aa, Homo Sapiens
VLMHVSTAY

SEQ ID NO: 267165 - protein, 9 aa, Homo Sapiens
NAACCQDEK

SEQ ID NO: 267166 - protein, 9 aa, Homo Sapiens
SETAIMNNS

SEQ ID NO: 267167 - protein, 9 aa, Homo Sapiens
INYQLELAL

SEQ ID NO: 267168 - protein, 9 aa, Homo Sapiens
MFKVMEPTW

SEQ ID NO: 267169 - protein, 9 aa, Homo Sapiens
RFSQVFCLY

SEQ ID NO: 267170 - protein, 9 aa, Homo Sapiens
SNLYPSGLP

SEQ ID NO: 267171 - protein, 9 aa, Homo Sapiens
YPGIPGMDG

SEQ ID NO: 267172 - protein, 9 aa, Homo Sapiens
SDVDSSSSL

SEQ ID NO: 267173 - protein, 9 aa, Homo Sapiens
YLFKRLTLK

SEQ ID NO: 267174 - protein, 9 aa, Homo Sapiens
RQKPTPKHK

SEQ ID NO: 267175 - protein, 9 aa, Homo Sapiens
IQDIQKSMA

SEQ ID NO: 267176 - protein, 9 aa, Homo Sapiens
QEANMWRQE

SEQ ID NO: 267177 - protein, 9 aa, Homo Sapiens
RIFLPPGTQ

SEQ ID NO: 267178 - protein, 9 aa, Homo Sapiens
LFVAFYVAG

SEQ ID NO: 267179 - protein, 9 aa, Homo Sapiens
DKLSVFCWT

SEQ ID NO: 267180 - protein, 9 aa, Homo Sapiens
QNEQTLGHF

SEQ ID NO: 267181 - protein, 9 aa, Homo Sapiens
DKPLSERLK

SEQ ID NO: 267182 - protein, 9 aa, Homo Sapiens
CRSLSECGA

SEQ ID NO: 267183 - protein, 9 aa, Homo Sapiens
KERTRVKLE

SEQ ID NO: 267184 - protein, 9 aa, Homo Sapiens
RDEKRKWTL

SEQ ID NO: 267185 - protein, 9 aa, Homo Sapiens
ERLQEELNT

SEQ ID NO: 267186 - protein, 9 aa, Homo Sapiens
KKKEVVTPP

SEQ ID NO: 267187 - protein, 9 aa, Homo Sapiens
DAPVTTNNP

SEQ ID NO: 267188 - protein, 9 aa, Homo Sapiens
LREKGLRTA

SEQ ID NO: 267189 - protein, 9 aa, Homo Sapiens
EQYPNTFIQ

SEQ ID NO: 267190 - protein, 9 aa, Homo Sapiens
YGICLNRSE

SEQ ID NO: 267191 - protein, 9 aa, Homo Sapiens
PQILPRGPD

SEQ ID NO: 267192 - protein, 9 aa, Homo Sapiens
EICNKRYIR

SEQ ID NO: 267193 - protein, 9 aa, Homo Sapiens
SCANPIFYG

SEQ ID NO: 267194 - protein, 9 aa, Homo Sapiens
HIVQELPQI

SEQ ID NO: 267195 - protein, 9 aa, Homo Sapiens
DYIDQLKHI

SEQ ID NO: 267196 - protein, 9 aa, Homo Sapiens
VKCASCILN

SEQ ID NO: 267197 - protein, 9 aa, Homo Sapiens
NHHQAFVKA

SEQ ID NO: 267198 - protein, 9 aa, Homo Sapiens
LWFKDMYTP

SEQ ID NO: 267199 - protein, 9 aa, Homo Sapiens
IEASLATDL

SEQ ID NO: 267200 - protein, 9 aa, Homo Sapiens
IHLQQQPPP

SEQ ID NO: 267201 - protein, 9 aa, Homo Sapiens
EHQPVLHCQ

SEQ ID NO: 267202 - protein, 9 aa, Homo Sapiens
ECASPRTFP

SEQ ID NO: 267203 - protein, 9 aa, Homo Sapiens
PSKPPFQFG

SEQ ID NO: 267204 - protein, 9 aa, Homo Sapiens
ARQLEIKHI

SEQ ID NO: 267205 - protein, 9 aa, Homo Sapiens
HAINSYTWG

SEQ ID NO: 267206 - protein, 9 aa, Homo Sapiens
ILNLWKARH

SEQ ID NO: 267207 - protein, 9 aa, Homo Sapiens
ILKVWNSIT

SEQ ID NO: 267208 - protein, 9 aa, Homo Sapiens
PARCECSAH

SEQ ID NO: 267209 - protein, 9 aa, Homo Sapiens
MSLMAPTPV

SEQ ID NO: 267210 - protein, 9 aa, Homo Sapiens
VCESDSLND

SEQ ID NO: 267211 - protein, 9 aa, Homo Sapiens
KKALIYQFS

SEQ ID NO: 267212 - protein, 9 aa, Homo Sapiens
YPDSIQDLE

SEQ ID NO: 267213 - protein, 9 aa, Homo Sapiens
FAILLSCLP

SEQ ID NO: 267214 - protein, 9 aa, Homo Sapiens
NAQLSTGRG

SEQ ID NO: 267215 - protein, 9 aa, Homo Sapiens
QVSSFLDYK

SEQ ID NO: 267216 - protein, 9 aa, Homo Sapiens
DNIKWEKTS

SEQ ID NO: 267217 - protein, 9 aa, Homo Sapiens
SCLLESNRK

SEQ ID NO: 267218 - protein, 9 aa, Homo Sapiens
QLLYDEIEA

SEQ ID NO: 267219 - protein, 9 aa, Homo Sapiens
EVLIEYPEL

SEQ ID NO: 267220 - protein, 9 aa, Homo Sapiens
YGVRNRKHL

SEQ ID NO: 267221 - protein, 9 aa, Homo Sapiens
GKCWVIASH

SEQ ID NO: 267222 - protein, 9 aa, Homo Sapiens
QHVEHELYG

SEQ ID NO: 267223 - protein, 9 aa, Homo Sapiens
DGVIQYSSQ

SEQ ID NO: 267224 - protein, 9 aa, Homo Sapiens
VYVQFIHLA

SEQ ID NO: 267225 - protein, 9 aa, Homo Sapiens
AYVAMIPRC

SEQ ID NO: 267226 - protein, 9 aa, Homo Sapiens
NYRGILYRL

SEQ ID NO: 267227 - protein, 9 aa, Homo Sapiens
YLPRPEYNF

SEQ ID NO: 267228 - protein, 9 aa, Homo Sapiens
KEKYDVWAK

SEQ ID NO: 267229 - protein, 9 aa, Homo Sapiens
RIKKFCEAC

SEQ ID NO: 267230 - protein, 9 aa, Homo Sapiens
TLHVLLVGG

SEQ ID NO: 267231 - protein, 9 aa, Homo Sapiens
PFYQSHQSL

SEQ ID NO: 267232 - protein, 9 aa, Homo Sapiens
YWDKCVKRK

SEQ ID NO: 267233 - protein, 9 aa, Homo Sapiens
KINEEACNM

SEQ ID NO: 267234 - protein, 9 aa, Homo Sapiens
GLRPVKVNV

SEQ ID NO: 267235 - protein, 9 aa, Homo Sapiens
SSLICHHRS

SEQ ID NO: 267236 - protein, 9 aa, Homo Sapiens
RKRKKEQPT

SEQ ID NO: 267237 - protein, 9 aa, Homo Sapiens
SAGDLGDSS

SEQ ID NO: 267238 - protein, 9 aa, Homo Sapiens
CTHTGEKPF

SEQ ID NO: 267239 - protein, 9 aa, Homo Sapiens
ASKMALLPL

SEQ ID NO: 267240 - protein, 9 aa, Homo Sapiens
GFPGLETAH

SEQ ID NO: 267241 - protein, 9 aa, Homo Sapiens
YASKLKRLE

SEQ ID NO: 267242 - protein, 9 aa, Homo Sapiens
SRSQFITVK

SEQ ID NO: 267243 - protein, 9 aa, Homo Sapiens
CQLPCEQKL

SEQ ID NO: 267244 - protein, 9 aa, Homo Sapiens
NLMESSSVS

SEQ ID NO: 267245 - protein, 9 aa, Homo Sapiens
KTLPAPLYH

SEQ ID NO: 267246 - protein, 9 aa, Homo Sapiens
QAFPISLIG

SEQ ID NO: 267247 - protein, 9 aa, Homo Sapiens
SRFQPFRDG

SEQ ID NO: 267248 - protein, 9 aa, Homo Sapiens
EMFKYEFSN

SEQ ID NO: 267249 - protein, 9 aa, Homo Sapiens
QDKYLHLEG

SEQ ID NO: 267250 - protein, 9 aa, Homo Sapiens
FAAEHLYDM

SEQ ID NO: 267251 - protein, 9 aa, Homo Sapiens
DDVAKKGAI

SEQ ID NO: 267252 - protein, 9 aa, Homo Sapiens
RVLAGGFAD

SEQ ID NO: 267253 - protein, 9 aa, Homo Sapiens
ITRYRLVPS

SEQ ID NO: 267254 - protein, 9 aa, Homo Sapiens
PNLRRLNFT

SEQ ID NO: 267255 - protein, 9 aa, Homo Sapiens
IQEANNFTF

SEQ ID NO: 267256 - protein, 9 aa, Homo Sapiens
KKLSPEKEF

SEQ ID NO: 267257 - protein, 9 aa, Homo Sapiens
IHISPKAVG

SEQ ID NO: 267258 - protein, 9 aa, Homo Sapiens
QGGRRIGFN

SEQ ID NO: 267259 - protein, 9 aa, Homo Sapiens
EKLEQLGRY

SEQ ID NO: 267260 - protein, 9 aa, Homo Sapiens
PKDLADLEV

SEQ ID NO: 267261 - protein, 9 aa, Homo Sapiens
VKVVKPKRQ

SEQ ID NO: 267262 - protein, 9 aa, Homo Sapiens
KGTVPWFPR

SEQ ID NO: 267263 - protein, 9 aa, Homo Sapiens
YRFIKCCCF

SEQ ID NO: 267264 - protein, 9 aa, Homo Sapiens
CAEVNIFPQ

SEQ ID NO: 267265 - protein, 9 aa, Homo Sapiens
LDEDGSMIN

SEQ ID NO: 267266 - protein, 9 aa, Homo Sapiens
NTINPGAHF

SEQ ID NO: 267267 - protein, 9 aa, Homo Sapiens
SIADPLFRS

SEQ ID NO: 267268 - protein, 9 aa, Homo Sapiens
HDFGNQGST

SEQ ID NO: 267269 - protein, 9 aa, Homo Sapiens
NKIFMAIAK

SEQ ID NO: 267270 - protein, 9 aa, Homo Sapiens
PFSSGGPFK

SEQ ID NO: 267271 - protein, 9 aa, Homo Sapiens
PNNVPYSAK

SEQ ID NO: 267272 - protein, 9 aa, Homo Sapiens
SSGCCENLG

SEQ ID NO: 267273 - protein, 9 aa, Homo Sapiens
LAPTATVAP

SEQ ID NO: 267274 - protein, 9 aa, Homo Sapiens
TTTSPNKYY

SEQ ID NO: 267275 - protein, 9 aa, Homo Sapiens
RTLDPQILP

SEQ ID NO: 267276 - protein, 9 aa, Homo Sapiens
VWVGPQRCP

SEQ ID NO: 267277 - protein, 9 aa, Homo Sapiens
SSGQYSAIA

SEQ ID NO: 267278 - protein, 9 aa, Homo Sapiens
VLFLHYLGF

SEQ ID NO: 267279 - protein, 9 aa, Homo Sapiens
LLDTSNEPS

SEQ ID NO: 267280 - protein, 9 aa, Homo Sapiens
VDMLVNSAQ

SEQ ID NO: 267281 - protein, 9 aa, Homo Sapiens
YRVVERLAK

SEQ ID NO: 267282 - protein, 9 aa, Homo Sapiens
LQDAANIHQ

SEQ ID NO: 267283 - protein, 9 aa, Homo Sapiens
WEKNGSDNS

SEQ ID NO: 267284 - protein, 9 aa, Homo Sapiens
MHPHNALSD

SEQ ID NO: 267285 - protein, 9 aa, Homo Sapiens
TQPAIENIQ

SEQ ID NO: 267286 - protein, 9 aa, Homo Sapiens
IQVDNLIPI

SEQ ID NO: 267287 - protein, 9 aa, Homo Sapiens
AKFVTFSLL

SEQ ID NO: 267288 - protein, 9 aa, Homo Sapiens
IKDSFHSSR

SEQ ID NO: 267289 - protein, 9 aa, Homo Sapiens
IYVNAFQRH

SEQ ID NO: 267290 - protein, 9 aa, Homo Sapiens
LDFISKRDF

SEQ ID NO: 267291 - protein, 9 aa, Homo Sapiens
KDVAREWKS

SEQ ID NO: 267292 - protein, 9 aa, Homo Sapiens
VHLGEWWSH

SEQ ID NO: 267293 - protein, 9 aa, Homo Sapiens
PQEESERAT

SEQ ID NO: 267294 - protein, 9 aa, Homo Sapiens
KGANGTFHC

SEQ ID NO: 267295 - protein, 9 aa, Homo Sapiens
FIDKKYPNL

SEQ ID NO: 267296 - protein, 9 aa, Homo Sapiens
ETTHSMVES

SEQ ID NO: 267297 - protein, 9 aa, Homo Sapiens
ENVKMATDI

SEQ ID NO: 267298 - protein, 9 aa, Homo Sapiens
KKTYFCAAD

SEQ ID NO: 267299 - protein, 9 aa, Homo Sapiens
GTTAENKEN

SEQ ID NO: 267300 - protein, 9 aa, Homo Sapiens
HDTPRLIKN

SEQ ID NO: 267301 - protein, 9 aa, Homo Sapiens
DSQEDEFGI

SEQ ID NO: 267302 - protein, 9 aa, Homo Sapiens
KGITLFLSA

SEQ ID NO: 267303 - protein, 9 aa, Homo Sapiens
LPVHRFCVE

SEQ ID NO: 267304 - protein, 9 aa, Homo Sapiens
YSSVSEGFQ

SEQ ID NO: 267305 - protein, 9 aa, Homo Sapiens
LALNTPGEN

SEQ ID NO: 267306 - protein, 9 aa, Homo Sapiens
AATFISMQN

SEQ ID NO: 267307 - protein, 9 aa, Homo Sapiens
AEQINKKIE

SEQ ID NO: 267308 - protein, 9 aa, Homo Sapiens
DGFEGESCE

SEQ ID NO: 267309 - protein, 9 aa, Homo Sapiens
LGGIILAVA

SEQ ID NO: 267310 - protein, 9 aa, Homo Sapiens
PIDNSICVQ

SEQ ID NO: 267311 - protein, 9 aa, Homo Sapiens
EEEGDDQAG

SEQ ID NO: 267312 - protein, 9 aa, Homo Sapiens
VRYQKCIKL

SEQ ID NO: 267313 - protein, 9 aa, Homo Sapiens
GECGKYFSR

SEQ ID NO: 267314 - protein, 9 aa, Homo Sapiens
RAQAGSDYN

SEQ ID NO: 267315 - protein, 9 aa, Homo Sapiens
NYLKYTFTH

SEQ ID NO: 267316 - protein, 9 aa, Homo Sapiens
QRSLCSTPL

SEQ ID NO: 267317 - protein, 9 aa, Homo Sapiens
PLDVNQELI

SEQ ID NO: 267318 - protein, 9 aa, Homo Sapiens
KRSLNSKLW

SEQ ID NO: 267319 - protein, 9 aa, Homo Sapiens
EKRKEQTET

SEQ ID NO: 267320 - protein, 9 aa, Homo Sapiens
LVCKKRVEA

SEQ ID NO: 267321 - protein, 9 aa, Homo Sapiens
YENYSQQLQ

SEQ ID NO: 267322 - protein, 9 aa, Homo Sapiens
KKEIENLAA

SEQ ID NO: 267323 - protein, 9 aa, Homo Sapiens
LGSALFLLL

SEQ ID NO: 267324 - protein, 9 aa, Homo Sapiens
PITKYPKIV

SEQ ID NO: 267325 - protein, 9 aa, Homo Sapiens
YSEKEKDLK

SEQ ID NO: 267326 - protein, 9 aa, Homo Sapiens
LFGGHKTTA

SEQ ID NO: 267327 - protein, 9 aa, Homo Sapiens
FLFFLTGHD

SEQ ID NO: 267328 - protein, 9 aa, Homo Sapiens
GSPGRTFKQ

SEQ ID NO: 267329 - protein, 9 aa, Homo Sapiens
APEWKRVEA

SEQ ID NO: 267330 - protein, 9 aa, Homo Sapiens
TPDKFCHSS

SEQ ID NO: 267331 - protein, 9 aa, Homo Sapiens
QLKDQRILE

SEQ ID NO: 267332 - protein, 9 aa, Homo Sapiens
ISLEIKKEK

SEQ ID NO: 267333 - protein, 9 aa, Homo Sapiens
KDLQINKLY

SEQ ID NO: 267334 - protein, 9 aa, Homo Sapiens
MFSSVCSRN

SEQ ID NO: 267335 - protein, 9 aa, Homo Sapiens
MHSTQDKYL

SEQ ID NO: 267336 - protein, 9 aa, Homo Sapiens
DKYNSGVIC

SEQ ID NO: 267337 - protein, 9 aa, Homo Sapiens
YIVKNMATL

SEQ ID NO: 267338 - protein, 9 aa, Homo Sapiens
KGLWSVCVY

SEQ ID NO: 267339 - protein, 9 aa, Homo Sapiens
VELEEAIRI

SEQ ID NO: 267340 - protein, 9 aa, Homo Sapiens
REQHEEKPV

SEQ ID NO: 267341 - protein, 9 aa, Homo Sapiens
GMVRFREHW

SEQ ID NO: 267342 - protein, 9 aa, Homo Sapiens
KFAEAFETT

SEQ ID NO: 267343 - protein, 9 aa, Homo Sapiens
QFLWRGEVF

SEQ ID NO: 267344 - protein, 9 aa, Homo Sapiens
FVKHFCSHL

SEQ ID NO: 267345 - protein, 9 aa, Homo Sapiens
DDGTIQIQG

SEQ ID NO: 267346 - protein, 9 aa, Homo Sapiens
GLNLEEIRE

SEQ ID NO: 267347 - protein, 9 aa, Homo Sapiens
KDRNDGYVL

SEQ ID NO: 267348 - protein, 9 aa, Homo Sapiens
IKNRYFPVF

SEQ ID NO: 267349 - protein, 9 aa, Homo Sapiens
MQLKQPSVF

SEQ ID NO: 267350 - protein, 9 aa, Homo Sapiens
VSDKYQYFL

SEQ ID NO: 267351 - protein, 9 aa, Homo Sapiens
AVAAVLDQH

SEQ ID NO: 267352 - protein, 9 aa, Homo Sapiens
MASTFGLLE

SEQ ID NO: 267353 - protein, 9 aa, Homo Sapiens
GLEGGTTSV

SEQ ID NO: 267354 - protein, 9 aa, Homo Sapiens
ELSQRLQVV

SEQ ID NO: 267355 - protein, 9 aa, Homo Sapiens
GRHQHRSFP

SEQ ID NO: 267356 - protein, 9 aa, Homo Sapiens
SSLKDEIIQ

SEQ ID NO: 267357 - protein, 9 aa, Homo Sapiens
MLKAGATAT

SEQ ID NO: 267358 - protein, 9 aa, Homo Sapiens
ENGHSVCED

SEQ ID NO: 267359 - protein, 9 aa, Homo Sapiens
ATPGEYSVH

SEQ ID NO: 267360 - protein, 9 aa, Homo Sapiens
IPFLIWQKI

SEQ ID NO: 267361 - protein, 9 aa, Homo Sapiens
IKEKQHKKN

SEQ ID NO: 267362 - protein, 9 aa, Homo Sapiens
LQRRVHGGQ

SEQ ID NO: 267363 - protein, 9 aa, Homo Sapiens
WSVCVYGGG

SEQ ID NO: 267364 - protein, 9 aa, Homo Sapiens
EAFSFKLNL

SEQ ID NO: 267365 - protein, 9 aa, Homo Sapiens
AAMIAKDKD

SEQ ID NO: 267366 - protein, 9 aa, Homo Sapiens
IQAIEPRIT

SEQ ID NO: 267367 - protein, 9 aa, Homo Sapiens
ILEADPFLK

SEQ ID NO: 267368 - protein, 9 aa, Homo Sapiens
VKVKRTALG

SEQ ID NO: 267369 - protein, 9 aa, Homo Sapiens
NCPFSWIRH

SEQ ID NO: 267370 - protein, 9 aa, Homo Sapiens
NPENVETCP

SEQ ID NO: 267371 - protein, 9 aa, Homo Sapiens
NNSVIIKCD

SEQ ID NO: 267372 - protein, 9 aa, Homo Sapiens
PPALRKSNS

SEQ ID NO: 267373 - protein, 9 aa, Homo Sapiens
EENKPKENL

SEQ ID NO: 267374 - protein, 9 aa, Homo Sapiens
DTQKLSDRL

SEQ ID NO: 267375 - protein, 9 aa, Homo Sapiens
LDKSMCSHF

SEQ ID NO: 267376 - protein, 9 aa, Homo Sapiens
GATQHILDE

SEQ ID NO: 267377 - protein, 9 aa, Homo Sapiens
NYLGSATSI

SEQ ID NO: 267378 - protein, 9 aa, Homo Sapiens
TGIADFFNV

SEQ ID NO: 267379 - protein, 9 aa, Homo Sapiens
KSESEPDLF

SEQ ID NO: 267380 - protein, 9 aa, Homo Sapiens
TPELEARQA

SEQ ID NO: 267381 - protein, 9 aa, Homo Sapiens
LMAALYLVQ

SEQ ID NO: 267382 - protein, 9 aa, Homo Sapiens
QEIQHDQEL

SEQ ID NO: 267383 - protein, 9 aa, Homo Sapiens
LYVTDTNNH

SEQ ID NO: 267384 - protein, 9 aa, Homo Sapiens
SLGKLTGST

SEQ ID NO: 267385 - protein, 9 aa, Homo Sapiens
SDRLQIPWL

SEQ ID NO: 267386 - protein, 9 aa, Homo Sapiens
EKSKRDYTP

SEQ ID NO: 267387 - protein, 9 aa, Homo Sapiens
SLTYALARA

SEQ ID NO: 267388 - protein, 9 aa, Homo Sapiens
IENIQVRET

SEQ ID NO: 267389 - protein, 9 aa, Homo Sapiens
PVEDALEVE

SEQ ID NO: 267390 - protein, 9 aa, Homo Sapiens
RRSFAEIYD

SEQ ID NO: 267391 - protein, 9 aa, Homo Sapiens
INNYLQFLK

SEQ ID NO: 267392 - protein, 9 aa, Homo Sapiens
EINGLEEKL

SEQ ID NO: 267393 - protein, 9 aa, Homo Sapiens
SLFFLQSKG

SEQ ID NO: 267394 - protein, 9 aa, Homo Sapiens
EFEVLKEVI

SEQ ID NO: 267395 - protein, 9 aa, Homo Sapiens
PSSCSKSLH

SEQ ID NO: 267396 - protein, 9 aa, Homo Sapiens
LYVKEYKEV

SEQ ID NO: 267397 - protein, 9 aa, Homo Sapiens
LAQKGHDTP

SEQ ID NO: 267398 - protein, 9 aa, Homo Sapiens
HSGSLQIHE

SEQ ID NO: 267399 - protein, 9 aa, Homo Sapiens
SVISEKMFE

SEQ ID NO: 267400 - protein, 9 aa, Homo Sapiens
STHPVSTFD

SEQ ID NO: 267401 - protein, 9 aa, Homo Sapiens
MLLSFQHPP

SEQ ID NO: 267402 - protein, 9 aa, Homo Sapiens
GNVFVLEMV

SEQ ID NO: 267403 - protein, 9 aa, Homo Sapiens
RTSQEAERL

SEQ ID NO: 267404 - protein, 9 aa, Homo Sapiens
YIAKGCNPC

SEQ ID NO: 267405 - protein, 9 aa, Homo Sapiens
CWRTNPLDR

SEQ ID NO: 267406 - protein, 9 aa, Homo Sapiens
EYPELQING

SEQ ID NO: 267407 - protein, 9 aa, Homo Sapiens
ATYPKFLAN

SEQ ID NO: 267408 - protein, 9 aa, Homo Sapiens
QDKMLSLFH

SEQ ID NO: 267409 - protein, 9 aa, Homo Sapiens
QRGPAQKKP

SEQ ID NO: 267410 - protein, 9 aa, Homo Sapiens
PMWSKRVIY

SEQ ID NO: 267411 - protein, 9 aa, Homo Sapiens
LIIFNISNK

SEQ ID NO: 267412 - protein, 9 aa, Homo Sapiens
PVIPSSESF

SEQ ID NO: 267413 - protein, 9 aa, Homo Sapiens
NVRWFPFDV

SEQ ID NO: 267414 - protein, 9 aa, Homo Sapiens
AQHPYLHRH

SEQ ID NO: 267415 - protein, 9 aa, Homo Sapiens
TPLHLAAHN

SEQ ID NO: 267416 - protein, 9 aa, Homo Sapiens
ECGTYAEEE

SEQ ID NO: 267417 - protein, 9 aa, Homo Sapiens
MRKITPLHN

SEQ ID NO: 267418 - protein, 9 aa, Homo Sapiens
FEDSSLPTK

SEQ ID NO: 267419 - protein, 9 aa, Homo Sapiens
DAVLQTRVS

SEQ ID NO: 267420 - protein, 9 aa, Homo Sapiens
AASNGVLLF

SEQ ID NO: 267421 - protein, 9 aa, Homo Sapiens
KIINKYLDE

SEQ ID NO: 267422 - protein, 9 aa, Homo Sapiens
TDEELKTEA

SEQ ID NO: 267423 - protein, 9 aa, Homo Sapiens
MRGIHSQMD

SEQ ID NO: 267424 - protein, 9 aa, Homo Sapiens
VCTLIFGGH

SEQ ID NO: 267425 - protein, 9 aa, Homo Sapiens
EDQWTALHC

SEQ ID NO: 267426 - protein, 9 aa, Homo Sapiens
TLLNRNRKE

SEQ ID NO: 267427 - protein, 9 aa, Homo Sapiens
NKYQQVKTN

SEQ ID NO: 267428 - protein, 9 aa, Homo Sapiens
KIKDGDFKN

SEQ ID NO: 267429 - protein, 9 aa, Homo Sapiens
NHKEITYTK

SEQ ID NO: 267430 - protein, 9 aa, Homo Sapiens
KHFKPEDPT

SEQ ID NO: 267431 - protein, 9 aa, Homo Sapiens
SLSYIISWL

SEQ ID NO: 267432 - protein, 9 aa, Homo Sapiens
NLPIAESRP

SEQ ID NO: 267433 - protein, 9 aa, Homo Sapiens
HRRKLRQDL

SEQ ID NO: 267434 - protein, 9 aa, Homo Sapiens
LQTIRQFIT

SEQ ID NO: 267435 - protein, 9 aa, Homo Sapiens
LLTYSSDKA

SEQ ID NO: 267436 - protein, 9 aa, Homo Sapiens
KGFQLTQQE

SEQ ID NO: 267437 - protein, 9 aa, Homo Sapiens
INDMNASKI

SEQ ID NO: 267438 - protein, 9 aa, Homo Sapiens
VHSIIIANV

SEQ ID NO: 267439 - protein, 9 aa, Homo Sapiens
LHQSGSFIN

SEQ ID NO: 267440 - protein, 9 aa, Homo Sapiens
AKSSNYPCL

SEQ ID NO: 267441 - protein, 9 aa, Homo Sapiens
YFGKGAASE

SEQ ID NO: 267442 - protein, 9 aa, Homo Sapiens
GNTFSVSAH

SEQ ID NO: 267443 - protein, 9 aa, Homo Sapiens
ILYYCKGIT

SEQ ID NO: 267444 - protein, 9 aa, Homo Sapiens
NKNIFLQYN

SEQ ID NO: 267445 - protein, 9 aa, Homo Sapiens
LTAVQNISI

SEQ ID NO: 267446 - protein, 9 aa, Homo Sapiens
EYLTLISCP

SEQ ID NO: 267447 - protein, 9 aa, Homo Sapiens
VHRKTINPV

SEQ ID NO: 267448 - protein, 9 aa, Homo Sapiens
YSDIVIVED

SEQ ID NO: 267449 - protein, 9 aa, Homo Sapiens
RKETWTAGS

SEQ ID NO: 267450 - protein, 9 aa, Homo Sapiens
DTLVTKLNQ

SEQ ID NO: 267451 - protein, 9 aa, Homo Sapiens
TFGDSKEIV

SEQ ID NO: 267452 - protein, 9 aa, Homo Sapiens
DFMLFMGLA

SEQ ID NO: 267453 - protein, 9 aa, Homo Sapiens
LDWREGPAQ

SEQ ID NO: 267454 - protein, 9 aa, Homo Sapiens
KLKKAKALM

SEQ ID NO: 267455 - protein, 9 aa, Homo Sapiens
FAHTASSAW

SEQ ID NO: 267456 - protein, 9 aa, Homo Sapiens
IKHKRIYME

SEQ ID NO: 267457 - protein, 9 aa, Homo Sapiens
TLWVESDNY

SEQ ID NO: 267458 - protein, 9 aa, Homo Sapiens
VNRDNFTQT

SEQ ID NO: 267459 - protein, 9 aa, Homo Sapiens
KPGTTPCQV

SEQ ID NO: 267460 - protein, 9 aa, Homo Sapiens
NWIIKQEPV

SEQ ID NO: 267461 - protein, 9 aa, Homo Sapiens
EGFSSPPSL

SEQ ID NO: 267462 - protein, 9 aa, Homo Sapiens
AGQKQGIVC

SEQ ID NO: 267463 - protein, 9 aa, Homo Sapiens
LTRFVRLPL

SEQ ID NO: 267464 - protein, 9 aa, Homo Sapiens
VCFYGKTDF

SEQ ID NO: 267465 - protein, 9 aa, Homo Sapiens
QEPFWESGN

SEQ ID NO: 267466 - protein, 9 aa, Homo Sapiens
APLQKFTPE

SEQ ID NO: 267467 - protein, 9 aa, Homo Sapiens
FEEFLDRLG

SEQ ID NO: 267468 - protein, 9 aa, Homo Sapiens
SSGQLNTQE

SEQ ID NO: 267469 - protein, 9 aa, Homo Sapiens
NALIGQYVI

SEQ ID NO: 267470 - protein, 9 aa, Homo Sapiens
GWPRNWHQK

SEQ ID NO: 267471 - protein, 9 aa, Homo Sapiens
EYVILIEYL

SEQ ID NO: 267472 - protein, 9 aa, Homo Sapiens
RRDQRYLYF

SEQ ID NO: 267473 - protein, 9 aa, Homo Sapiens
KDPEKCLGF

SEQ ID NO: 267474 - protein, 9 aa, Homo Sapiens
LHIQGTHTI

SEQ ID NO: 267475 - protein, 9 aa, Homo Sapiens
SVAESSTNN

SEQ ID NO: 267476 - protein, 9 aa, Homo Sapiens
DLTAQRKRM

SEQ ID NO: 267477 - protein, 9 aa, Homo Sapiens
TVFAPILSF

SEQ ID NO: 267478 - protein, 9 aa, Homo Sapiens
YVFYTVVTP

SEQ ID NO: 267479 - protein, 9 aa, Homo Sapiens
FEQLSQRLK

SEQ ID NO: 267480 - protein, 9 aa, Homo Sapiens
PRTLEASSR

SEQ ID NO: 267481 - protein, 9 aa, Homo Sapiens
FQHMLVAEI

SEQ ID NO: 267482 - protein, 9 aa, Homo Sapiens
TKTIYYSEC

SEQ ID NO: 267483 - protein, 9 aa, Homo Sapiens
TLVFLVSGI

SEQ ID NO: 267484 - protein, 9 aa, Homo Sapiens
YVLAHSNLT

SEQ ID NO: 267485 - protein, 9 aa, Homo Sapiens
THNGKTCGL

SEQ ID NO: 267486 - protein, 9 aa, Homo Sapiens
KTPNTEMRT

SEQ ID NO: 267487 - protein, 9 aa, Homo Sapiens
YLAVLSNRT

SEQ ID NO: 267488 - protein, 9 aa, Homo Sapiens
SKDLRDELL

SEQ ID NO: 267489 - protein, 9 aa, Homo Sapiens
ILLEMKANF

SEQ ID NO: 267490 - protein, 9 aa, Homo Sapiens
GECKNLIYH

SEQ ID NO: 267491 - protein, 9 aa, Homo Sapiens
QDTYGNIYN

SEQ ID NO: 267492 - protein, 9 aa, Homo Sapiens
VLFAHNEYL

SEQ ID NO: 267493 - protein, 9 aa, Homo Sapiens
AEKPPTPKR

SEQ ID NO: 267494 - protein, 9 aa, Homo Sapiens
LSFLRTKEL

SEQ ID NO: 267495 - protein, 9 aa, Homo Sapiens
SQIPLPHVT

SEQ ID NO: 267496 - protein, 9 aa, Homo Sapiens
EYSHQELLR

SEQ ID NO: 267497 - protein, 9 aa, Homo Sapiens
HSANRGQRL

SEQ ID NO: 267498 - protein, 9 aa, Homo Sapiens
TSPEDHLLY

SEQ ID NO: 267499 - protein, 9 aa, Homo Sapiens
NTEVQKREG

SEQ ID NO: 267500 - protein, 9 aa, Homo Sapiens
TVKLLLGQI

SEQ ID NO: 267501 - protein, 9 aa, Homo Sapiens
QWANSFDPS

SEQ ID NO: 267502 - protein, 9 aa, Homo Sapiens
ADQMFDMGF

SEQ ID NO: 267503 - protein, 9 aa, Homo Sapiens
SREERLWFR

SEQ ID NO: 267504 - protein, 9 aa, Homo Sapiens
TNQINFNHD

SEQ ID NO: 267505 - protein, 9 aa, Homo Sapiens
RCQYFLAQI

SEQ ID NO: 267506 - protein, 9 aa, Homo Sapiens
STKIRMNVD

SEQ ID NO: 267507 - protein, 9 aa, Homo Sapiens
LTPCETDNP

SEQ ID NO: 267508 - protein, 9 aa, Homo Sapiens
DKMLSLFHS

SEQ ID NO: 267509 - protein, 9 aa, Homo Sapiens
PSKGCFCPP

SEQ ID NO: 267510 - protein, 9 aa, Homo Sapiens
QHEEKPVRM

SEQ ID NO: 267511 - protein, 9 aa, Homo Sapiens
DDFKKEGKM

SEQ ID NO: 267512 - protein, 9 aa, Homo Sapiens
FLPRHNSDG

SEQ ID NO: 267513 - protein, 9 aa, Homo Sapiens
HFRSGYQLT

SEQ ID NO: 267514 - protein, 9 aa, Homo Sapiens
QSTYDQQHD

SEQ ID NO: 267515 - protein, 9 aa, Homo Sapiens
IIMIIGNGG

SEQ ID NO: 267516 - protein, 9 aa, Homo Sapiens
HDHDGKLYF

SEQ ID NO: 267517 - protein, 9 aa, Homo Sapiens
SICKYNADL

SEQ ID NO: 267518 - protein, 9 aa, Homo Sapiens
LYGGEVLRR

SEQ ID NO: 267519 - protein, 9 aa, Homo Sapiens
KNLNYLSFL

SEQ ID NO: 267520 - protein, 9 aa, Homo Sapiens
MGYKTNFYS

SEQ ID NO: 267521 - protein, 9 aa, Homo Sapiens
SHLRHHYSN

SEQ ID NO: 267522 - protein, 9 aa, Homo Sapiens
NSEQGHFLI

SEQ ID NO: 267523 - protein, 9 aa, Homo Sapiens
RVSAATASG

SEQ ID NO: 267524 - protein, 9 aa, Homo Sapiens
TNNSSAAWD

SEQ ID NO: 267525 - protein, 9 aa, Homo Sapiens
TTSGNNFFK

SEQ ID NO: 267526 - protein, 9 aa, Homo Sapiens
FEKDKLELF

SEQ ID NO: 267527 - protein, 9 aa, Homo Sapiens
TERQKYWWD

SEQ ID NO: 267528 - protein, 9 aa, Homo Sapiens
LTGDLPGTS

SEQ ID NO: 267529 - protein, 9 aa, Homo Sapiens
EVEQEAGEL

SEQ ID NO: 267530 - protein, 9 aa, Homo Sapiens
KNPASSSEF

SEQ ID NO: 267531 - protein, 9 aa, Homo Sapiens
AGLCDHCAV

SEQ ID NO: 267532 - protein, 9 aa, Homo Sapiens
DMQKESKDN

SEQ ID NO: 267533 - protein, 9 aa, Homo Sapiens
CEELGAPAK

SEQ ID NO: 267534 - protein, 9 aa, Homo Sapiens
AQPSKVSEG

SEQ ID NO: 267535 - protein, 9 aa, Homo Sapiens
FPHYSPMVK

SEQ ID NO: 267536 - protein, 9 aa, Homo Sapiens
IKGKLIYIV

SEQ ID NO: 267537 - protein, 9 aa, Homo Sapiens
KVAATEREC

SEQ ID NO: 267538 - protein, 9 aa, Homo Sapiens
CWSGSETSG

SEQ ID NO: 267539 - protein, 9 aa, Homo Sapiens
RGLCSLTHL

SEQ ID NO: 267540 - protein, 9 aa, Homo Sapiens
TKQSLANID

SEQ ID NO: 267541 - protein, 9 aa, Homo Sapiens
IECAKKLYD

SEQ ID NO: 267542 - protein, 9 aa, Homo Sapiens
LVLLCRHNG

SEQ ID NO: 267543 - protein, 9 aa, Homo Sapiens
QQKAWKMQG

SEQ ID NO: 267544 - protein, 9 aa, Homo Sapiens
QIMQEKQIK

SEQ ID NO: 267545 - protein, 9 aa, Homo Sapiens
QTAIVQNQH

SEQ ID NO: 267546 - protein, 9 aa, Homo Sapiens
IYAFAHRIP

SEQ ID NO: 267547 - protein, 9 aa, Homo Sapiens
PRAGSPNLP

SEQ ID NO: 267548 - protein, 9 aa, Homo Sapiens
DHLFQNKLA

SEQ ID NO: 267549 - protein, 9 aa, Homo Sapiens
GGDSFWVSM

SEQ ID NO: 267550 - protein, 9 aa, Homo Sapiens
EESYQEQKP

SEQ ID NO: 267551 - protein, 9 aa, Homo Sapiens
RYSYILTSN

SEQ ID NO: 267552 - protein, 9 aa, Homo Sapiens
LPLGHIKQM

SEQ ID NO: 267553 - protein, 9 aa, Homo Sapiens
IPITGRRST

SEQ ID NO: 267554 - protein, 9 aa, Homo Sapiens
KVFRSGSKL

SEQ ID NO: 267555 - protein, 9 aa, Homo Sapiens
NSIMKCDIN

SEQ ID NO: 267556 - protein, 9 aa, Homo Sapiens
AVVEICITS

SEQ ID NO: 267557 - protein, 9 aa, Homo Sapiens
IQISKSPDG

SEQ ID NO: 267558 - protein, 9 aa, Homo Sapiens
ETKKEGTAR

SEQ ID NO: 267559 - protein, 9 aa, Homo Sapiens
LRPVNGGIN

SEQ ID NO: 267560 - protein, 9 aa, Homo Sapiens
YLLVIKNHK

SEQ ID NO: 267561 - protein, 9 aa, Homo Sapiens
TYLSALVRS

SEQ ID NO: 267562 - protein, 9 aa, Homo Sapiens
TNNPSGQPR

SEQ ID NO: 267563 - protein, 9 aa, Homo Sapiens
KKRFIFLGK

SEQ ID NO: 267564 - protein, 9 aa, Homo Sapiens
RYHRGGYKP

SEQ ID NO: 267565 - protein, 9 aa, Homo Sapiens
LRSKANIAF

SEQ ID NO: 267566 - protein, 9 aa, Homo Sapiens
LEIFALESA

SEQ ID NO: 267567 - protein, 9 aa, Homo Sapiens
PPEPPYIFH

SEQ ID NO: 267568 - protein, 9 aa, Homo Sapiens
KKFSKDVAR

SEQ ID NO: 267569 - protein, 9 aa, Homo Sapiens
TPGTPGSHN

SEQ ID NO: 267570 - protein, 9 aa, Homo Sapiens
ASMLTLRVI

SEQ ID NO: 267571 - protein, 9 aa, Homo Sapiens
LTVSRPRSS

SEQ ID NO: 267572 - protein, 9 aa, Homo Sapiens
LQSYPASGH

SEQ ID NO: 267573 - protein, 9 aa, Homo Sapiens
FGECCDVED

SEQ ID NO: 267574 - protein, 9 aa, Homo Sapiens
AVWFRLYGV

SEQ ID NO: 267575 - protein, 9 aa, Homo Sapiens
QDVHLKKEL

SEQ ID NO: 267576 - protein, 9 aa, Homo Sapiens
SFPSSNLYA

SEQ ID NO: 267577 - protein, 9 aa, Homo Sapiens
HLISTENTK

SEQ ID NO: 267578 - protein, 9 aa, Homo Sapiens
LLIAGGNVE

SEQ ID NO: 267579 - protein, 9 aa, Homo Sapiens
PGPRSHPSA

SEQ ID NO: 267580 - protein, 9 aa, Homo Sapiens
MIRKSGGHS

SEQ ID NO: 267581 - protein, 9 aa, Homo Sapiens
AHAIVLVNG

SEQ ID NO: 267582 - protein, 9 aa, Homo Sapiens
VDRCGDNKH

SEQ ID NO: 267583 - protein, 9 aa, Homo Sapiens
NCRLVPSPD

SEQ ID NO: 267584 - protein, 9 aa, Homo Sapiens
LQHIPLTVD

SEQ ID NO: 267585 - protein, 9 aa, Homo Sapiens
IQEEQASIN

SEQ ID NO: 267586 - protein, 9 aa, Homo Sapiens
HPLETLIIG

SEQ ID NO: 267587 - protein, 9 aa, Homo Sapiens
IQGDSKYTK

SEQ ID NO: 267588 - protein, 9 aa, Homo Sapiens
EELGGWRTS

SEQ ID NO: 267589 - protein, 9 aa, Homo Sapiens
NIVNLNKHV

SEQ ID NO: 267590 - protein, 9 aa, Homo Sapiens
NKINELTGI

SEQ ID NO: 267591 - protein, 9 aa, Homo Sapiens
LPSLGHVPR

SEQ ID NO: 267592 - protein, 9 aa, Homo Sapiens
RVWQYESEL

SEQ ID NO: 267593 - protein, 9 aa, Homo Sapiens
LLCPSISHN

SEQ ID NO: 267594 - protein, 9 aa, Homo Sapiens
WPKLFEKYL

SEQ ID NO: 267595 - protein, 9 aa, Homo Sapiens
ITKTLSPSR

SEQ ID NO: 267596 - protein, 9 aa, Homo Sapiens
DHDKLFELI

SEQ ID NO: 267597 - protein, 9 aa, Homo Sapiens
KSCLGSILT

SEQ ID NO: 267598 - protein, 9 aa, Homo Sapiens
CPASTHDSS

SEQ ID NO: 267599 - protein, 9 aa, Homo Sapiens
VSAHRYSGV

SEQ ID NO: 267600 - protein, 9 aa, Homo Sapiens
ITVADNIIN

SEQ ID NO: 267601 - protein, 9 aa, Homo Sapiens
QELQLYSVA

SEQ ID NO: 267602 - protein, 9 aa, Homo Sapiens
LVFVPYLYS

SEQ ID NO: 267603 - protein, 9 aa, Homo Sapiens
RELILHYLL

SEQ ID NO: 267604 - protein, 9 aa, Homo Sapiens
LFKLLMESI

SEQ ID NO: 267605 - protein, 9 aa, Homo Sapiens
HWCNNAPDI

SEQ ID NO: 267606 - protein, 9 aa, Homo Sapiens
LHVMCTDAT

SEQ ID NO: 267607 - protein, 9 aa, Homo Sapiens
YADFVWSLI

SEQ ID NO: 267608 - protein, 9 aa, Homo Sapiens
DPGRLTSHA

SEQ ID NO: 267609 - protein, 9 aa, Homo Sapiens
KNKSQDQWD

SEQ ID NO: 267610 - protein, 9 aa, Homo Sapiens
QARSSPATL

SEQ ID NO: 267611 - protein, 9 aa, Homo Sapiens
ILRFMETRL

SEQ ID NO: 267612 - protein, 9 aa, Homo Sapiens
ILASAPTVA

SEQ ID NO: 267613 - protein, 9 aa, Homo Sapiens
SRSGSRDLT

SEQ ID NO: 267614 - protein, 9 aa, Homo Sapiens
VGDLRAESV

SEQ ID NO: 267615 - protein, 9 aa, Homo Sapiens
ENEQAKKMN

SEQ ID NO: 267616 - protein, 9 aa, Homo Sapiens
LIQHQQVHT

SEQ ID NO: 267617 - protein, 9 aa, Homo Sapiens
TGMTCLESV

SEQ ID NO: 267618 - protein, 9 aa, Homo Sapiens
QRHTPLRTY

SEQ ID NO: 267619 - protein, 9 aa, Homo Sapiens
SLKIRVIHA

SEQ ID NO: 267620 - protein, 9 aa, Homo Sapiens
PECEELLSV

SEQ ID NO: 267621 - protein, 9 aa, Homo Sapiens
EMVLDFVNA

SEQ ID NO: 267622 - protein, 9 aa, Homo Sapiens
SLLISIKMR

SEQ ID NO: 267623 - protein, 9 aa, Homo Sapiens
QGQLETPGE

SEQ ID NO: 267624 - protein, 9 aa, Homo Sapiens
NKLIAEQLQ

SEQ ID NO: 267625 - protein, 9 aa, Homo Sapiens
NIKIVGSRL

SEQ ID NO: 267626 - protein, 9 aa, Homo Sapiens
TYRSFNTFF

SEQ ID NO: 267627 - protein, 9 aa, Homo Sapiens
LVVKVRAPT

SEQ ID NO: 267628 - protein, 9 aa, Homo Sapiens
AEDVNVTFK

SEQ ID NO: 267629 - protein, 9 aa, Homo Sapiens
ASCGACKAF

SEQ ID NO: 267630 - protein, 9 aa, Homo Sapiens
NKSHIRTLM

SEQ ID NO: 267631 - protein, 9 aa, Homo Sapiens
FKGSKKPDL

SEQ ID NO: 267632 - protein, 9 aa, Homo Sapiens
SKQRMPQEI

SEQ ID NO: 267633 - protein, 9 aa, Homo Sapiens
DFGQPSPDQ

SEQ ID NO: 267634 - protein, 9 aa, Homo Sapiens
RSNHPFRQS

SEQ ID NO: 267635 - protein, 9 aa, Homo Sapiens
EKVIEELQK

SEQ ID NO: 267636 - protein, 9 aa, Homo Sapiens
LALLRSVPH

SEQ ID NO: 267637 - protein, 9 aa, Homo Sapiens
NVHTAERPY

SEQ ID NO: 267638 - protein, 9 aa, Homo Sapiens
RISKRINSS

SEQ ID NO: 267639 - protein, 9 aa, Homo Sapiens
SNMNAFMVN

SEQ ID NO: 267640 - protein, 9 aa, Homo Sapiens
IEPVFITAS

SEQ ID NO: 267641 - protein, 9 aa, Homo Sapiens
SLEQNIRCL

SEQ ID NO: 267642 - protein, 9 aa, Homo Sapiens
FVVRSQHQQ

SEQ ID NO: 267643 - protein, 9 aa, Homo Sapiens
KAASTATEE

SEQ ID NO: 267644 - protein, 9 aa, Homo Sapiens
GTRATLVGG

SEQ ID NO: 267645 - protein, 9 aa, Homo Sapiens
DPDAEVCLN

SEQ ID NO: 267646 - protein, 9 aa, Homo Sapiens
EYSIYITCE

SEQ ID NO: 267647 - protein, 9 aa, Homo Sapiens
KLSAVLRAE

SEQ ID NO: 267648 - protein, 9 aa, Homo Sapiens
GACPQCQDF

SEQ ID NO: 267649 - protein, 9 aa, Homo Sapiens
CPHLCSLCN

SEQ ID NO: 267650 - protein, 9 aa, Homo Sapiens
EVCKSHSKF

SEQ ID NO: 267651 - protein, 9 aa, Homo Sapiens
RYVVGCHRQ

SEQ ID NO: 267652 - protein, 9 aa, Homo Sapiens
SNSEVEQVS

SEQ ID NO: 267653 - protein, 9 aa, Homo Sapiens
KLEHHFTQM

SEQ ID NO: 267654 - protein, 9 aa, Homo Sapiens
STFINHQII

SEQ ID NO: 267655 - protein, 9 aa, Homo Sapiens
YLKRASVIW

SEQ ID NO: 267656 - protein, 9 aa, Homo Sapiens
QKEVITLDE

SEQ ID NO: 267657 - protein, 9 aa, Homo Sapiens
PKQDNEGGE

SEQ ID NO: 267658 - protein, 9 aa, Homo Sapiens
DPPLRSQFQ

SEQ ID NO: 267659 - protein, 9 aa, Homo Sapiens
KEVKIEGAR

SEQ ID NO: 267660 - protein, 9 aa, Homo Sapiens
FYSSVSEGF

SEQ ID NO: 267661 - protein, 9 aa, Homo Sapiens
FSVRDDVFG

SEQ ID NO: 267662 - protein, 9 aa, Homo Sapiens
WPVLPSGQR

SEQ ID NO: 267663 - protein, 9 aa, Homo Sapiens
AQEYASKLK

SEQ ID NO: 267664 - protein, 9 aa, Homo Sapiens
NSFGSTPTL

SEQ ID NO: 267665 - protein, 9 aa, Homo Sapiens
DDLNYEDKL

SEQ ID NO: 267666 - protein, 9 aa, Homo Sapiens
SGHYIARVK

SEQ ID NO: 267667 - protein, 9 aa, Homo Sapiens
LFQSVRKVI

SEQ ID NO: 267668 - protein, 9 aa, Homo Sapiens
KRFTDNSQL

SEQ ID NO: 267669 - protein, 9 aa, Homo Sapiens
LAPDPVFDT

SEQ ID NO: 267670 - protein, 9 aa, Homo Sapiens
NKSLKVFKM

SEQ ID NO: 267671 - protein, 9 aa, Homo Sapiens
LFLIKVNTD

SEQ ID NO: 267672 - protein, 9 aa, Homo Sapiens
FSSSFQMHE

SEQ ID NO: 267673 - protein, 9 aa, Homo Sapiens
RNKMKLRKE

SEQ ID NO: 267674 - protein, 9 aa, Homo Sapiens
EIISDPEVL

SEQ ID NO: 267675 - protein, 9 aa, Homo Sapiens
FGNEDTNTF

SEQ ID NO: 267676 - protein, 9 aa, Homo Sapiens
GAIMVSSVA

SEQ ID NO: 267677 - protein, 9 aa, Homo Sapiens
PSLLDDLTM

SEQ ID NO: 267678 - protein, 9 aa, Homo Sapiens
KIRELDSCL

SEQ ID NO: 267679 - protein, 9 aa, Homo Sapiens
DLEIKRKCS

SEQ ID NO: 267680 - protein, 9 aa, Homo Sapiens
YEYEDMEHE

SEQ ID NO: 267681 - protein, 9 aa, Homo Sapiens
CLGKHSGRK

SEQ ID NO: 267682 - protein, 9 aa, Homo Sapiens
SDEKTRMKL

SEQ ID NO: 267683 - protein, 9 aa, Homo Sapiens
EQQNIQSQQ

SEQ ID NO: 267684 - protein, 9 aa, Homo Sapiens
LTYNPEGTL

SEQ ID NO: 267685 - protein, 9 aa, Homo Sapiens
LFMLFFSAF

SEQ ID NO: 267686 - protein, 9 aa, Homo Sapiens
KYPRAGSPN

SEQ ID NO: 267687 - protein, 9 aa, Homo Sapiens
HFFGGTDIF

SEQ ID NO: 267688 - protein, 9 aa, Homo Sapiens
VEQYSRKVF

SEQ ID NO: 267689 - protein, 9 aa, Homo Sapiens
DTNMMVPPL

SEQ ID NO: 267690 - protein, 9 aa, Homo Sapiens
KTCTEHAKA

SEQ ID NO: 267691 - protein, 9 aa, Homo Sapiens
AIHTFPYRG

SEQ ID NO: 267692 - protein, 9 aa, Homo Sapiens
FMLFVMMEA

SEQ ID NO: 267693 - protein, 9 aa, Homo Sapiens
MLGYPGYQA

SEQ ID NO: 267694 - protein, 9 aa, Homo Sapiens
IYSATYDRR

SEQ ID NO: 267695 - protein, 9 aa, Homo Sapiens
TVNPTLGVH

SEQ ID NO: 267696 - protein, 9 aa, Homo Sapiens
RYPIKRNSL

SEQ ID NO: 267697 - protein, 9 aa, Homo Sapiens
NGTIKDKIL

SEQ ID NO: 267698 - protein, 9 aa, Homo Sapiens
FMLTITHTM

SEQ ID NO: 267699 - protein, 9 aa, Homo Sapiens
TTSEYSDHP

SEQ ID NO: 267700 - protein, 9 aa, Homo Sapiens
TGGESFTFQ

SEQ ID NO: 267701 - protein, 9 aa, Homo Sapiens
KHKLQAHIG

SEQ ID NO: 267702 - protein, 9 aa, Homo Sapiens
VPESILLEM

SEQ ID NO: 267703 - protein, 9 aa, Homo Sapiens
DQTGMMKEL

SEQ ID NO: 267704 - protein, 9 aa, Homo Sapiens
ITESMENGA

SEQ ID NO: 267705 - protein, 9 aa, Homo Sapiens
EHPSVHEYY

SEQ ID NO: 267706 - protein, 9 aa, Homo Sapiens
QVTEISREV

SEQ ID NO: 267707 - protein, 9 aa, Homo Sapiens
TAQTQAEER

SEQ ID NO: 267708 - protein, 9 aa, Homo Sapiens
AQIQVQIGA

SEQ ID NO: 267709 - protein, 9 aa, Homo Sapiens
PAPQSFLCR

SEQ ID NO: 267710 - protein, 9 aa, Homo Sapiens
LRVNLDQLK

SEQ ID NO: 267711 - protein, 9 aa, Homo Sapiens
NHSANQLSI

SEQ ID NO: 267712 - protein, 9 aa, Homo Sapiens
LHCMVTSVQ

SEQ ID NO: 267713 - protein, 9 aa, Homo Sapiens
KPLNALMLY

SEQ ID NO: 267714 - protein, 9 aa, Homo Sapiens
KCEKDIAMR

SEQ ID NO: 267715 - protein, 9 aa, Homo Sapiens
GRVALTGKI

SEQ ID NO: 267716 - protein, 9 aa, Homo Sapiens
SCIYECIWN

SEQ ID NO: 267717 - protein, 9 aa, Homo Sapiens
SPVSATLSY

SEQ ID NO: 267718 - protein, 9 aa, Homo Sapiens
LNSPLYLPF

SEQ ID NO: 267719 - protein, 9 aa, Homo Sapiens
QQQSDYGPM

SEQ ID NO: 267720 - protein, 9 aa, Homo Sapiens
NRIKALRSR

SEQ ID NO: 267721 - protein, 9 aa, Homo Sapiens
ALVTYRSFN

SEQ ID NO: 267722 - protein, 9 aa, Homo Sapiens
VYLIRKEWK

SEQ ID NO: 267723 - protein, 9 aa, Homo Sapiens
EEVSKQSLV

SEQ ID NO: 267724 - protein, 9 aa, Homo Sapiens
PPEHSLETA

SEQ ID NO: 267725 - protein, 9 aa, Homo Sapiens
LVKCMDYGF

SEQ ID NO: 267726 - protein, 9 aa, Homo Sapiens
TIIGGIIFL

SEQ ID NO: 267727 - protein, 9 aa, Homo Sapiens
KVIQNPGPR

SEQ ID NO: 267728 - protein, 9 aa, Homo Sapiens
DLINTYLLH

SEQ ID NO: 267729 - protein, 9 aa, Homo Sapiens
TWLHNIKLL

SEQ ID NO: 267730 - protein, 9 aa, Homo Sapiens
EEYVSWWWC

SEQ ID NO: 267731 - protein, 9 aa, Homo Sapiens
YKQDSNKFL

SEQ ID NO: 267732 - protein, 9 aa, Homo Sapiens
EGNTTQIFN

SEQ ID NO: 267733 - protein, 9 aa, Homo Sapiens
VHMQAAPEE

SEQ ID NO: 267734 - protein, 9 aa, Homo Sapiens
KRKRLSKRG

SEQ ID NO: 267735 - protein, 9 aa, Homo Sapiens
LVHLTELSL

SEQ ID NO: 267736 - protein, 9 aa, Homo Sapiens
KLQRFLVTY

SEQ ID NO: 267737 - protein, 9 aa, Homo Sapiens
RDKKKGTVP

SEQ ID NO: 267738 - protein, 9 aa, Homo Sapiens
ADGETSEAE

SEQ ID NO: 267739 - protein, 9 aa, Homo Sapiens
NLLSNTGAA

SEQ ID NO: 267740 - protein, 9 aa, Homo Sapiens
QVGPNQAQL

SEQ ID NO: 267741 - protein, 9 aa, Homo Sapiens
AVAALSETS

SEQ ID NO: 267742 - protein, 9 aa, Homo Sapiens
KSIMKEDVP

SEQ ID NO: 267743 - protein, 9 aa, Homo Sapiens
EDPVIKRCL

SEQ ID NO: 267744 - protein, 9 aa, Homo Sapiens
KSYLEEEKV

SEQ ID NO: 267745 - protein, 9 aa, Homo Sapiens
TIIRSKKSP

SEQ ID NO: 267746 - protein, 9 aa, Homo Sapiens
GSPQKPQGA

SEQ ID NO: 267747 - protein, 9 aa, Homo Sapiens
EKNFNNFPR

SEQ ID NO: 267748 - protein, 9 aa, Homo Sapiens
ADVDDLLSK

SEQ ID NO: 267749 - protein, 9 aa, Homo Sapiens
DLSETYLEK

SEQ ID NO: 267750 - protein, 9 aa, Homo Sapiens
KFHLIAPSQ

SEQ ID NO: 267751 - protein, 9 aa, Homo Sapiens
CRDISISYS

SEQ ID NO: 267752 - protein, 9 aa, Homo Sapiens
LFEESNLRN

SEQ ID NO: 267753 - protein, 9 aa, Homo Sapiens
PTPKIIEYP

SEQ ID NO: 267754 - protein, 9 aa, Homo Sapiens
IADYIPKDG

SEQ ID NO: 267755 - protein, 9 aa, Homo Sapiens
PALEAGVAI

SEQ ID NO: 267756 - protein, 9 aa, Homo Sapiens
GLYQRQTEL

SEQ ID NO: 267757 - protein, 9 aa, Homo Sapiens
ALFNMVPRA

SEQ ID NO: 267758 - protein, 9 aa, Homo Sapiens
SGSKKANNS

SEQ ID NO: 267759 - protein, 9 aa, Homo Sapiens
LQRSLCSTP

SEQ ID NO: 267760 - protein, 9 aa, Homo Sapiens
WKAIQDKDR

SEQ ID NO: 267761 - protein, 9 aa, Homo Sapiens
WCLERLCLG

SEQ ID NO: 267762 - protein, 9 aa, Homo Sapiens
TLLLQHLSQ

SEQ ID NO: 267763 - protein, 9 aa, Homo Sapiens
RNYHIVYQL

SEQ ID NO: 267764 - protein, 9 aa, Homo Sapiens
RNGTKNSNK

SEQ ID NO: 267765 - protein, 9 aa, Homo Sapiens
ANHPLTVSS

SEQ ID NO: 267766 - protein, 9 aa, Homo Sapiens
NNTPLYFAD

SEQ ID NO: 267767 - protein, 9 aa, Homo Sapiens
SKNALRGLC

SEQ ID NO: 267768 - protein, 9 aa, Homo Sapiens
VPGGEFNPH

SEQ ID NO: 267769 - protein, 9 aa, Homo Sapiens
AWRKQIPFS

SEQ ID NO: 267770 - protein, 9 aa, Homo Sapiens
QDDYIYLFK

SEQ ID NO: 267771 - protein, 9 aa, Homo Sapiens
HSVPEINLD

SEQ ID NO: 267772 - protein, 9 aa, Homo Sapiens
KWSSRPGIP

SEQ ID NO: 267773 - protein, 9 aa, Homo Sapiens
LNMDSTERL

SEQ ID NO: 267774 - protein, 9 aa, Homo Sapiens
YDADLESKL

SEQ ID NO: 267775 - protein, 9 aa, Homo Sapiens
LELVPGDFL

SEQ ID NO: 267776 - protein, 9 aa, Homo Sapiens
EKQPSGADS

SEQ ID NO: 267777 - protein, 9 aa, Homo Sapiens
SKDKTYGVR

SEQ ID NO: 267778 - protein, 9 aa, Homo Sapiens
NINNHTGPS

SEQ ID NO: 267779 - protein, 9 aa, Homo Sapiens
YVLTKCNVQ

SEQ ID NO: 267780 - protein, 9 aa, Homo Sapiens
VGVIPPNKF

SEQ ID NO: 267781 - protein, 9 aa, Homo Sapiens
MSSVPSASN

SEQ ID NO: 267782 - protein, 9 aa, Homo Sapiens
RTTRGKKNR

SEQ ID NO: 267783 - protein, 9 aa, Homo Sapiens
SDSKDKTYG

SEQ ID NO: 267784 - protein, 9 aa, Homo Sapiens
AVVEQWSTV

SEQ ID NO: 267785 - protein, 9 aa, Homo Sapiens
EQIVKIYVQ

SEQ ID NO: 267786 - protein, 9 aa, Homo Sapiens
CECSAHNKS

SEQ ID NO: 267787 - protein, 9 aa, Homo Sapiens
LTDIIDNDH

SEQ ID NO: 267788 - protein, 9 aa, Homo Sapiens
GERLLECQF

SEQ ID NO: 267789 - protein, 9 aa, Homo Sapiens
VVVVDYRGR

SEQ ID NO: 267790 - protein, 9 aa, Homo Sapiens
LETEKKVLA

SEQ ID NO: 267791 - protein, 9 aa, Homo Sapiens
VVTVLLTPR

SEQ ID NO: 267792 - protein, 9 aa, Homo Sapiens
FIFFQVGCL

SEQ ID NO: 267793 - protein, 9 aa, Homo Sapiens
FRFKVLMLA

SEQ ID NO: 267794 - protein, 9 aa, Homo Sapiens
ESQSCKLDK

SEQ ID NO: 267795 - protein, 9 aa, Homo Sapiens
QAYLLLEEG

SEQ ID NO: 267796 - protein, 9 aa, Homo Sapiens
LKKLINAAK

SEQ ID NO: 267797 - protein, 9 aa, Homo Sapiens
FGISKIMDD

SEQ ID NO: 267798 - protein, 9 aa, Homo Sapiens
TFSSFVPSA

SEQ ID NO: 267799 - protein, 9 aa, Homo Sapiens
LIKTIISQH

SEQ ID NO: 267800 - protein, 9 aa, Homo Sapiens
PGEEIYCYY

SEQ ID NO: 267801 - protein, 9 aa, Homo Sapiens
ALSDLSTLS

SEQ ID NO: 267802 - protein, 9 aa, Homo Sapiens
FLQLHPIID

SEQ ID NO: 267803 - protein, 9 aa, Homo Sapiens
MMARCDPKP

SEQ ID NO: 267804 - protein, 9 aa, Homo Sapiens
INSECSQSG

SEQ ID NO: 267805 - protein, 9 aa, Homo Sapiens
LMSVLELLR

SEQ ID NO: 267806 - protein, 9 aa, Homo Sapiens
NVYSGIFFI

SEQ ID NO: 267807 - protein, 9 aa, Homo Sapiens
LAALHDRMT

SEQ ID NO: 267808 - protein, 9 aa, Homo Sapiens
NKKTFIILN

SEQ ID NO: 267809 - protein, 9 aa, Homo Sapiens
SCKPRLSFA

SEQ ID NO: 267810 - protein, 9 aa, Homo Sapiens
IIGCALCVA

SEQ ID NO: 267811 - protein, 9 aa, Homo Sapiens
FIHSLHKNI

SEQ ID NO: 267812 - protein, 9 aa, Homo Sapiens
FRKWMGIKS

SEQ ID NO: 267813 - protein, 9 aa, Homo Sapiens
SEIQWEKNI

SEQ ID NO: 267814 - protein, 9 aa, Homo Sapiens
SSPTDPKWF

SEQ ID NO: 267815 - protein, 9 aa, Homo Sapiens
EQVSSFLDY

SEQ ID NO: 267816 - protein, 9 aa, Homo Sapiens
LVLCLTIEA

SEQ ID NO: 267817 - protein, 9 aa, Homo Sapiens
SASENLGEL

SEQ ID NO: 267818 - protein, 9 aa, Homo Sapiens
SVYIGHTIW

SEQ ID NO: 267819 - protein, 9 aa, Homo Sapiens
NGDKSDQNA

SEQ ID NO: 267820 - protein, 9 aa, Homo Sapiens
NHIQHVFCD

SEQ ID NO: 267821 - protein, 9 aa, Homo Sapiens
LYSVLIAKA

SEQ ID NO: 267822 - protein, 9 aa, Homo Sapiens
IIFHSSDGM

SEQ ID NO: 267823 - protein, 9 aa, Homo Sapiens
IITYINAHG

SEQ ID NO: 267824 - protein, 9 aa, Homo Sapiens
LSPIDAEDN

SEQ ID NO: 267825 - protein, 9 aa, Homo Sapiens
QNEEVDKDY

SEQ ID NO: 267826 - protein, 9 aa, Homo Sapiens
GFELFEASA

SEQ ID NO: 267827 - protein, 9 aa, Homo Sapiens
GAGTAPKSS

SEQ ID NO: 267828 - protein, 9 aa, Homo Sapiens
VQRHDMRVH

SEQ ID NO: 267829 - protein, 9 aa, Homo Sapiens
LSAGSGKLQ

SEQ ID NO: 267830 - protein, 9 aa, Homo Sapiens
MQVWQMADN

SEQ ID NO: 267831 - protein, 9 aa, Homo Sapiens
QTAPTLSTS

SEQ ID NO: 267832 - protein, 9 aa, Homo Sapiens
PYVTCQPFR

SEQ ID NO: 267833 - protein, 9 aa, Homo Sapiens
NSSRKSTKR

SEQ ID NO: 267834 - protein, 9 aa, Homo Sapiens
QDMLYNFYP

SEQ ID NO: 267835 - protein, 9 aa, Homo Sapiens
YVPCILIYL

SEQ ID NO: 267836 - protein, 9 aa, Homo Sapiens
IHKEKVIMV

SEQ ID NO: 267837 - protein, 9 aa, Homo Sapiens
ISDQEKDKE

SEQ ID NO: 267838 - protein, 9 aa, Homo Sapiens
EHHQEADKT

SEQ ID NO: 267839 - protein, 9 aa, Homo Sapiens
RAETLGALL

SEQ ID NO: 267840 - protein, 9 aa, Homo Sapiens
GLRLPFQKQ

SEQ ID NO: 267841 - protein, 9 aa, Homo Sapiens
LNGIHFDPE

SEQ ID NO: 267842 - protein, 9 aa, Homo Sapiens
TRHAAVHDP

SEQ ID NO: 267843 - protein, 9 aa, Homo Sapiens
PRKTSYLSL

SEQ ID NO: 267844 - protein, 9 aa, Homo Sapiens
PLEHELRRE

SEQ ID NO: 267845 - protein, 9 aa, Homo Sapiens
EFPQKGLSP

SEQ ID NO: 267846 - protein, 9 aa, Homo Sapiens
SLLRCQYFL

SEQ ID NO: 267847 - protein, 9 aa, Homo Sapiens
RIQLLDLSA

SEQ ID NO: 267848 - protein, 9 aa, Homo Sapiens
GEGGGEGGV

SEQ ID NO: 267849 - protein, 9 aa, Homo Sapiens
YHSSWTLCG

SEQ ID NO: 267850 - protein, 9 aa, Homo Sapiens
KAIVKSGGR

SEQ ID NO: 267851 - protein, 9 aa, Homo Sapiens
AEPFNTDLQ

SEQ ID NO: 267852 - protein, 9 aa, Homo Sapiens
PYLEFRYNT

SEQ ID NO: 267853 - protein, 9 aa, Homo Sapiens
GFCLYSPGP

SEQ ID NO: 267854 - protein, 9 aa, Homo Sapiens
LTSSGIENK

SEQ ID NO: 267855 - protein, 9 aa, Homo Sapiens
TTLTAISMS

SEQ ID NO: 267856 - protein, 9 aa, Homo Sapiens
TLMTSKKTL

SEQ ID NO: 267857 - protein, 9 aa, Homo Sapiens
DLDNIFDWN

SEQ ID NO: 267858 - protein, 9 aa, Homo Sapiens
RQRSQTALS

SEQ ID NO: 267859 - protein, 9 aa, Homo Sapiens
LLHATLDIV

SEQ ID NO: 267860 - protein, 9 aa, Homo Sapiens
PFMIKGAVG

SEQ ID NO: 267861 - protein, 9 aa, Homo Sapiens
GDWIMATSA

SEQ ID NO: 267862 - protein, 9 aa, Homo Sapiens
RVENQTNKT

SEQ ID NO: 267863 - protein, 9 aa, Homo Sapiens
LPPPESFGS

SEQ ID NO: 267864 - protein, 9 aa, Homo Sapiens
IISHVSGYN

SEQ ID NO: 267865 - protein, 9 aa, Homo Sapiens
GTQSRNLKP

SEQ ID NO: 267866 - protein, 9 aa, Homo Sapiens
SKFIFRKNY

SEQ ID NO: 267867 - protein, 9 aa, Homo Sapiens
KKLPLLNGG

SEQ ID NO: 267868 - protein, 9 aa, Homo Sapiens
LVAAKKKDE

SEQ ID NO: 267869 - protein, 9 aa, Homo Sapiens
HELPVGCTQ

SEQ ID NO: 267870 - protein, 9 aa, Homo Sapiens
AEQFCKSFE

SEQ ID NO: 267871 - protein, 9 aa, Homo Sapiens
MKLLKNKQK

SEQ ID NO: 267872 - protein, 9 aa, Homo Sapiens
TIMNSGFQN

SEQ ID NO: 267873 - protein, 9 aa, Homo Sapiens
QWSKPTSET

SEQ ID NO: 267874 - protein, 9 aa, Homo Sapiens
QGKHSLRNE

SEQ ID NO: 267875 - protein, 9 aa, Homo Sapiens
SSLRWYKQD

SEQ ID NO: 267876 - protein, 9 aa, Homo Sapiens
FMVIGNRES

SEQ ID NO: 267877 - protein, 9 aa, Homo Sapiens
YSLRKKSLA

SEQ ID NO: 267878 - protein, 9 aa, Homo Sapiens
DGDPNAEAG

SEQ ID NO: 267879 - protein, 9 aa, Homo Sapiens
HKVFIPDDL

SEQ ID NO: 267880 - protein, 9 aa, Homo Sapiens
VFLNGNYFI

SEQ ID NO: 267881 - protein, 9 aa, Homo Sapiens
LPRDKLAAA

SEQ ID NO: 267882 - protein, 9 aa, Homo Sapiens
EISLQDLQK

SEQ ID NO: 267883 - protein, 9 aa, Homo Sapiens
PPVASEDGA

SEQ ID NO: 267884 - protein, 9 aa, Homo Sapiens
SHSKSSVSS

SEQ ID NO: 267885 - protein, 9 aa, Homo Sapiens
LVIIHAPNL

SEQ ID NO: 267886 - protein, 9 aa, Homo Sapiens
PHSPRIIPP

SEQ ID NO: 267887 - protein, 9 aa, Homo Sapiens
SRVGCLEQA

SEQ ID NO: 267888 - protein, 9 aa, Homo Sapiens
NPVSARCSD

SEQ ID NO: 267889 - protein, 9 aa, Homo Sapiens
KGRFDENEN

SEQ ID NO: 267890 - protein, 9 aa, Homo Sapiens
FFSDCINQA

SEQ ID NO: 267891 - protein, 9 aa, Homo Sapiens
VLKLTRNID

SEQ ID NO: 267892 - protein, 9 aa, Homo Sapiens
SVNWPPGKM

SEQ ID NO: 267893 - protein, 9 aa, Homo Sapiens
AEIMISFSL

SEQ ID NO: 267894 - protein, 9 aa, Homo Sapiens
KVLQELQRL

SEQ ID NO: 267895 - protein, 9 aa, Homo Sapiens
WRALEQLLE

SEQ ID NO: 267896 - protein, 9 aa, Homo Sapiens
DLSEVLESE

SEQ ID NO: 267897 - protein, 9 aa, Homo Sapiens
RHTLDHLLK

SEQ ID NO: 267898 - protein, 9 aa, Homo Sapiens
WPPGKMFSN

SEQ ID NO: 267899 - protein, 9 aa, Homo Sapiens
EIDETNEIY

SEQ ID NO: 267900 - protein, 9 aa, Homo Sapiens
NKKFYRKFC

SEQ ID NO: 267901 - protein, 9 aa, Homo Sapiens
VLGVKGNYL

SEQ ID NO: 267902 - protein, 9 aa, Homo Sapiens
SVHEISLQD

SEQ ID NO: 267903 - protein, 9 aa, Homo Sapiens
WQRHGTLLL

SEQ ID NO: 267904 - protein, 9 aa, Homo Sapiens
SNMFCADEL

SEQ ID NO: 267905 - protein, 9 aa, Homo Sapiens
EYSDHPHSP

SEQ ID NO: 267906 - protein, 9 aa, Homo Sapiens
PLKIEYISE

SEQ ID NO: 267907 - protein, 9 aa, Homo Sapiens
PRFKPWLHP

SEQ ID NO: 267908 - protein, 9 aa, Homo Sapiens
PVILSMAIL

SEQ ID NO: 267909 - protein, 9 aa, Homo Sapiens
PVLMYLKEG

SEQ ID NO: 267910 - protein, 9 aa, Homo Sapiens
APCPREEAG

SEQ ID NO: 267911 - protein, 9 aa, Homo Sapiens
SKLPKAEHW

SEQ ID NO: 267912 - protein, 9 aa, Homo Sapiens
LNYLSFLIV

SEQ ID NO: 267913 - protein, 9 aa, Homo Sapiens
TSYLSQPQM

SEQ ID NO: 267914 - protein, 9 aa, Homo Sapiens
DSYGVIHVM

SEQ ID NO: 267915 - protein, 9 aa, Homo Sapiens
LSLTTRTDQ

SEQ ID NO: 267916 - protein, 9 aa, Homo Sapiens
YISNYAYAP

SEQ ID NO: 267917 - protein, 9 aa, Homo Sapiens
KCLKGAAAE

SEQ ID NO: 267918 - protein, 9 aa, Homo Sapiens
KATVEDETL

SEQ ID NO: 267919 - protein, 9 aa, Homo Sapiens
ANFVIHRRL

SEQ ID NO: 267920 - protein, 9 aa, Homo Sapiens
NKDSVSNIP

SEQ ID NO: 267921 - protein, 9 aa, Homo Sapiens
MAKMTFNPP

SEQ ID NO: 267922 - protein, 9 aa, Homo Sapiens
SLYDLDIEA

SEQ ID NO: 267923 - protein, 9 aa, Homo Sapiens
KTLYYFWSQ

SEQ ID NO: 267924 - protein, 9 aa, Homo Sapiens
AVSATYPKF

SEQ ID NO: 267925 - protein, 9 aa, Homo Sapiens
KRKKYPQMN

SEQ ID NO: 267926 - protein, 9 aa, Homo Sapiens
QDGDKLGTG

SEQ ID NO: 267927 - protein, 9 aa, Homo Sapiens
IPLNGRPIY

SEQ ID NO: 267928 - protein, 9 aa, Homo Sapiens
LLPQYMCEA

SEQ ID NO: 267929 - protein, 9 aa, Homo Sapiens
LIAVVTQDG

SEQ ID NO: 267930 - protein, 9 aa, Homo Sapiens
EAKLDESLK

SEQ ID NO: 267931 - protein, 9 aa, Homo Sapiens
GRHPGGRGG

SEQ ID NO: 267932 - protein, 9 aa, Homo Sapiens
TFKNFFVEA

SEQ ID NO: 267933 - protein, 9 aa, Homo Sapiens
ENSVKEVFR

SEQ ID NO: 267934 - protein, 9 aa, Homo Sapiens
STRNNLGFT

SEQ ID NO: 267935 - protein, 9 aa, Homo Sapiens
SGIWDNFHY

SEQ ID NO: 267936 - protein, 9 aa, Homo Sapiens
NQCLPPEHT

SEQ ID NO: 267937 - protein, 9 aa, Homo Sapiens
RRGYFGRSQ

SEQ ID NO: 267938 - protein, 9 aa, Homo Sapiens
LIKEIEPVL

SEQ ID NO: 267939 - protein, 9 aa, Homo Sapiens
GPKRFCRSP

SEQ ID NO: 267940 - protein, 9 aa, Homo Sapiens
SKDWMPTSA

SEQ ID NO: 267941 - protein, 9 aa, Homo Sapiens
LHLHEIIHT

SEQ ID NO: 267942 - protein, 9 aa, Homo Sapiens
KSNIHKSVQ

SEQ ID NO: 267943 - protein, 9 aa, Homo Sapiens
LKTASENAN

SEQ ID NO: 267944 - protein, 9 aa, Homo Sapiens
DALVYSAAS

SEQ ID NO: 267945 - protein, 9 aa, Homo Sapiens
HDDELTIQV

SEQ ID NO: 267946 - protein, 9 aa, Homo Sapiens
QETILISKA

SEQ ID NO: 267947 - protein, 9 aa, Homo Sapiens
YINKEIIPD

SEQ ID NO: 267948 - protein, 9 aa, Homo Sapiens
LWFDVCDAF

SEQ ID NO: 267949 - protein, 9 aa, Homo Sapiens
DRPSRMMFY

SEQ ID NO: 267950 - protein, 9 aa, Homo Sapiens
DVATLLNIL

SEQ ID NO: 267951 - protein, 9 aa, Homo Sapiens
ERALYLAEN

SEQ ID NO: 267952 - protein, 9 aa, Homo Sapiens
MRDTMPKKG

SEQ ID NO: 267953 - protein, 9 aa, Homo Sapiens
AANQGLRGP

SEQ ID NO: 267954 - protein, 9 aa, Homo Sapiens
GFTHHCLAH

SEQ ID NO: 267955 - protein, 9 aa, Homo Sapiens
DGELCQGIN

SEQ ID NO: 267956 - protein, 9 aa, Homo Sapiens
NIRKDTREF

SEQ ID NO: 267957 - protein, 9 aa, Homo Sapiens
SETCVQFAN

SEQ ID NO: 267958 - protein, 9 aa, Homo Sapiens
HNVKDTICI

SEQ ID NO: 267959 - protein, 9 aa, Homo Sapiens
NQDSDSIPP

SEQ ID NO: 267960 - protein, 9 aa, Homo Sapiens
QNEKEQDMI

SEQ ID NO: 267961 - protein, 9 aa, Homo Sapiens
AIFCLSADK

SEQ ID NO: 267962 - protein, 9 aa, Homo Sapiens
HLRTAIKHV

SEQ ID NO: 267963 - protein, 9 aa, Homo Sapiens
SYGSCISMY

SEQ ID NO: 267964 - protein, 9 aa, Homo Sapiens
VLQCRRIEL

SEQ ID NO: 267965 - protein, 9 aa, Homo Sapiens
LMTLFAGIF

SEQ ID NO: 267966 - protein, 9 aa, Homo Sapiens
GRGTKHYSL

SEQ ID NO: 267967 - protein, 9 aa, Homo Sapiens
VRSYVRQLH

SEQ ID NO: 267968 - protein, 9 aa, Homo Sapiens
EQKKRNDLC

SEQ ID NO: 267969 - protein, 9 aa, Homo Sapiens
DTNILPGNM

SEQ ID NO: 267970 - protein, 9 aa, Homo Sapiens
VDFRIPTSN

SEQ ID NO: 267971 - protein, 9 aa, Homo Sapiens
IATTLINKA

SEQ ID NO: 267972 - protein, 9 aa, Homo Sapiens
EKPLWFDVC

SEQ ID NO: 267973 - protein, 9 aa, Homo Sapiens
LPINVGVLN

SEQ ID NO: 267974 - protein, 9 aa, Homo Sapiens
IDLDDNPWD

SEQ ID NO: 267975 - protein, 9 aa, Homo Sapiens
YTNTHIKTV

SEQ ID NO: 267976 - protein, 9 aa, Homo Sapiens
MEVKANAFH

SEQ ID NO: 267977 - protein, 9 aa, Homo Sapiens
KRQKHLKYY

SEQ ID NO: 267978 - protein, 9 aa, Homo Sapiens
SPDASDFLT

SEQ ID NO: 267979 - protein, 9 aa, Homo Sapiens
APQNLPSTG

SEQ ID NO: 267980 - protein, 9 aa, Homo Sapiens
GAGPGALSV

SEQ ID NO: 267981 - protein, 9 aa, Homo Sapiens
SWCQEELLV

SEQ ID NO: 267982 - protein, 9 aa, Homo Sapiens
VIFSLSYII

SEQ ID NO: 267983 - protein, 9 aa, Homo Sapiens
PFNLKVGHE

SEQ ID NO: 267984 - protein, 9 aa, Homo Sapiens
DVTMGKISA

SEQ ID NO: 267985 - protein, 9 aa, Homo Sapiens
EEMTYIKKN

SEQ ID NO: 267986 - protein, 9 aa, Homo Sapiens
EDETLQGKI

SEQ ID NO: 267987 - protein, 9 aa, Homo Sapiens
GAMRGSIHA

SEQ ID NO: 267988 - protein, 9 aa, Homo Sapiens
QEACDQADL

SEQ ID NO: 267989 - protein, 9 aa, Homo Sapiens
PHREKYPRA

SEQ ID NO: 267990 - protein, 9 aa, Homo Sapiens
QTIEFNKML

SEQ ID NO: 267991 - protein, 9 aa, Homo Sapiens
TSKKNVCVS

SEQ ID NO: 267992 - protein, 9 aa, Homo Sapiens
LLFCLCELA

SEQ ID NO: 267993 - protein, 9 aa, Homo Sapiens
LQQVKDPLY

SEQ ID NO: 267994 - protein, 9 aa, Homo Sapiens
DVQRESEGD

SEQ ID NO: 267995 - protein, 9 aa, Homo Sapiens
QKALQSHLN

SEQ ID NO: 267996 - protein, 9 aa, Homo Sapiens
KVDVETSGI

SEQ ID NO: 267997 - protein, 9 aa, Homo Sapiens
PVFYGFKHI

SEQ ID NO: 267998 - protein, 9 aa, Homo Sapiens
IVLGKQLSE

SEQ ID NO: 267999 - protein, 9 aa, Homo Sapiens
TRLFCPQPK

SEQ ID NO: 268000 - protein, 9 aa, Homo Sapiens
EYNFPKQVF

SEQ ID NO: 268001 - protein, 9 aa, Homo Sapiens
ILYLRFGVQ

SEQ ID NO: 268002 - protein, 9 aa, Homo Sapiens
NFRVIIIKK

SEQ ID NO: 268003 - protein, 9 aa, Homo Sapiens
EELKISRSL

SEQ ID NO: 268004 - protein, 9 aa, Homo Sapiens
PSRQIAIGL

SEQ ID NO: 268005 - protein, 9 aa, Homo Sapiens
SKASASSSN

SEQ ID NO: 268006 - protein, 9 aa, Homo Sapiens
ISELENREV

SEQ ID NO: 268007 - protein, 9 aa, Homo Sapiens
VNGLFAFLS

SEQ ID NO: 268008 - protein, 9 aa, Homo Sapiens
VLKKIAEFS

SEQ ID NO: 268009 - protein, 9 aa, Homo Sapiens
EEINLLSVA

SEQ ID NO: 268010 - protein, 9 aa, Homo Sapiens
FQPDVYAFG

SEQ ID NO: 268011 - protein, 9 aa, Homo Sapiens
HFQSEIKRL

SEQ ID NO: 268012 - protein, 9 aa, Homo Sapiens
TRVVKLRKR

SEQ ID NO: 268013 - protein, 9 aa, Homo Sapiens
APPQKVLFR

SEQ ID NO: 268014 - protein, 9 aa, Homo Sapiens
LLGMRVNTV

SEQ ID NO: 268015 - protein, 9 aa, Homo Sapiens
GYRLREITE

SEQ ID NO: 268016 - protein, 9 aa, Homo Sapiens
SRQYHGAWL

SEQ ID NO: 268017 - protein, 9 aa, Homo Sapiens
PVIVESLTC

SEQ ID NO: 268018 - protein, 9 aa, Homo Sapiens
DQSVSVQEE

SEQ ID NO: 268019 - protein, 9 aa, Homo Sapiens
LYNKFFDYY

SEQ ID NO: 268020 - protein, 9 aa, Homo Sapiens
TAPKSSPRS

SEQ ID NO: 268021 - protein, 9 aa, Homo Sapiens
LLPEELTAL

SEQ ID NO: 268022 - protein, 9 aa, Homo Sapiens
GDEIARQQY

SEQ ID NO: 268023 - protein, 9 aa, Homo Sapiens
KSVEQTQIK

SEQ ID NO: 268024 - protein, 9 aa, Homo Sapiens
QPLVTYTTV

SEQ ID NO: 268025 - protein, 9 aa, Homo Sapiens
PYTLPRSQP

SEQ ID NO: 268026 - protein, 9 aa, Homo Sapiens
TFLIGLGKS

SEQ ID NO: 268027 - protein, 9 aa, Homo Sapiens
ASHKKDSSC

SEQ ID NO: 268028 - protein, 9 aa, Homo Sapiens
PSNHSFFSE

SEQ ID NO: 268029 - protein, 9 aa, Homo Sapiens
VNEHGNVSL

SEQ ID NO: 268030 - protein, 9 aa, Homo Sapiens
EHPHANNGR

SEQ ID NO: 268031 - protein, 9 aa, Homo Sapiens
RRAVWENNM

SEQ ID NO: 268032 - protein, 9 aa, Homo Sapiens
ILVSLSPMG

SEQ ID NO: 268033 - protein, 9 aa, Homo Sapiens
LAFISRCRD

SEQ ID NO: 268034 - protein, 9 aa, Homo Sapiens
WIDWQWQYD

SEQ ID NO: 268035 - protein, 9 aa, Homo Sapiens
ELKVHDMLK

SEQ ID NO: 268036 - protein, 9 aa, Homo Sapiens
QWDEVLQLI

SEQ ID NO: 268037 - protein, 9 aa, Homo Sapiens
PPSVGQWED

SEQ ID NO: 268038 - protein, 9 aa, Homo Sapiens
PKASLNIDL

SEQ ID NO: 268039 - protein, 9 aa, Homo Sapiens
REKREKEKD

SEQ ID NO: 268040 - protein, 9 aa, Homo Sapiens
LWKARHQHD

SEQ ID NO: 268041 - protein, 9 aa, Homo Sapiens
NHVHLMGDI

SEQ ID NO: 268042 - protein, 9 aa, Homo Sapiens
KKAMSIFSS

SEQ ID NO: 268043 - protein, 9 aa, Homo Sapiens
IIRFCHPNI

SEQ ID NO: 268044 - protein, 9 aa, Homo Sapiens
PLEQPERIC

SEQ ID NO: 268045 - protein, 9 aa, Homo Sapiens
TLYDQHLGK

SEQ ID NO: 268046 - protein, 9 aa, Homo Sapiens
APKKIRISI

SEQ ID NO: 268047 - protein, 9 aa, Homo Sapiens
VQKLFLYFS

SEQ ID NO: 268048 - protein, 9 aa, Homo Sapiens
LNEAAAQFT

SEQ ID NO: 268049 - protein, 9 aa, Homo Sapiens
VIRKQGIQK

SEQ ID NO: 268050 - protein, 9 aa, Homo Sapiens
QKGHDTPRL

SEQ ID NO: 268051 - protein, 9 aa, Homo Sapiens
PQGQNKTKP

SEQ ID NO: 268052 - protein, 9 aa, Homo Sapiens
RLVPGRHDT

SEQ ID NO: 268053 - protein, 9 aa, Homo Sapiens
PLCGLPAAG

SEQ ID NO: 268054 - protein, 9 aa, Homo Sapiens
KITLKCSQT

SEQ ID NO: 268055 - protein, 9 aa, Homo Sapiens
LVSIFRDVN

SEQ ID NO: 268056 - protein, 9 aa, Homo Sapiens
NDMLPKNSE

SEQ ID NO: 268057 - protein, 9 aa, Homo Sapiens
TQLFQMVRT

SEQ ID NO: 268058 - protein, 9 aa, Homo Sapiens
APCDKTFIF

SEQ ID NO: 268059 - protein, 9 aa, Homo Sapiens
GLIKHFSEN

SEQ ID NO: 268060 - protein, 9 aa, Homo Sapiens
TPCEGRLEL

SEQ ID NO: 268061 - protein, 9 aa, Homo Sapiens
WLLQFIFQT

SEQ ID NO: 268062 - protein, 9 aa, Homo Sapiens
RSATDSLST

SEQ ID NO: 268063 - protein, 9 aa, Homo Sapiens
KRTNRKKVT

SEQ ID NO: 268064 - protein, 9 aa, Homo Sapiens
ISIYTSSQG

SEQ ID NO: 268065 - protein, 9 aa, Homo Sapiens
DPAVDRPLR

SEQ ID NO: 268066 - protein, 9 aa, Homo Sapiens
ICLQLSCLL

SEQ ID NO: 268067 - protein, 9 aa, Homo Sapiens
ENCEGRAAP

SEQ ID NO: 268068 - protein, 9 aa, Homo Sapiens
DKEKEKIPF

SEQ ID NO: 268069 - protein, 9 aa, Homo Sapiens
YHSPGSPPR

SEQ ID NO: 268070 - protein, 9 aa, Homo Sapiens
LGLMTTENS

SEQ ID NO: 268071 - protein, 9 aa, Homo Sapiens
IGNLWQFEN

SEQ ID NO: 268072 - protein, 9 aa, Homo Sapiens
VAALSETSE

SEQ ID NO: 268073 - protein, 9 aa, Homo Sapiens
DHLKESFFQ

SEQ ID NO: 268074 - protein, 9 aa, Homo Sapiens
LVTFLLAWM

SEQ ID NO: 268075 - protein, 9 aa, Homo Sapiens
MDFGHTEEG

SEQ ID NO: 268076 - protein, 9 aa, Homo Sapiens
QNVVWSKCE

SEQ ID NO: 268077 - protein, 9 aa, Homo Sapiens
SPPQQVSFP

SEQ ID NO: 268078 - protein, 9 aa, Homo Sapiens
ESNKLETIC

SEQ ID NO: 268079 - protein, 9 aa, Homo Sapiens
VKIEGARLG

SEQ ID NO: 268080 - protein, 9 aa, Homo Sapiens
LEDSGSKKR

SEQ ID NO: 268081 - protein, 9 aa, Homo Sapiens
SEDIFQHLQ

SEQ ID NO: 268082 - protein, 9 aa, Homo Sapiens
AFIAGLFPP

SEQ ID NO: 268083 - protein, 9 aa, Homo Sapiens
MPKAEAAKS

SEQ ID NO: 268084 - protein, 9 aa, Homo Sapiens
NPIETFILG

SEQ ID NO: 268085 - protein, 9 aa, Homo Sapiens
VSFLKTDGS

SEQ ID NO: 268086 - protein, 9 aa, Homo Sapiens
NIHLKKGTE

SEQ ID NO: 268087 - protein, 9 aa, Homo Sapiens
TYKANPNRI

SEQ ID NO: 268088 - protein, 9 aa, Homo Sapiens
CKPIDIKGS

SEQ ID NO: 268089 - protein, 9 aa, Homo Sapiens
GGMEVCNLC

SEQ ID NO: 268090 - protein, 9 aa, Homo Sapiens
PGLPPGWEE

SEQ ID NO: 268091 - protein, 9 aa, Homo Sapiens
QDSLQLEQL

SEQ ID NO: 268092 - protein, 9 aa, Homo Sapiens
HSSWNLPPC

SEQ ID NO: 268093 - protein, 9 aa, Homo Sapiens
MANYAKFKK

SEQ ID NO: 268094 - protein, 9 aa, Homo Sapiens
TQETETLTQ

SEQ ID NO: 268095 - protein, 9 aa, Homo Sapiens
PTGFPGTDC

SEQ ID NO: 268096 - protein, 9 aa, Homo Sapiens
CTVFGETDA

SEQ ID NO: 268097 - protein, 9 aa, Homo Sapiens
TTAENKEND

SEQ ID NO: 268098 - protein, 9 aa, Homo Sapiens
FSLLLLVIS

SEQ ID NO: 268099 - protein, 9 aa, Homo Sapiens
QPKELFERK

SEQ ID NO: 268100 - protein, 9 aa, Homo Sapiens
DIIFHSSDG

SEQ ID NO: 268101 - protein, 9 aa, Homo Sapiens
HRGAMVIHA

SEQ ID NO: 268102 - protein, 9 aa, Homo Sapiens
IKTSFHVLY

SEQ ID NO: 268103 - protein, 9 aa, Homo Sapiens
GNATEICPL

SEQ ID NO: 268104 - protein, 9 aa, Homo Sapiens
GGQEIHTNN

SEQ ID NO: 268105 - protein, 9 aa, Homo Sapiens
TNVLKQNVL

SEQ ID NO: 268106 - protein, 9 aa, Homo Sapiens
SGISRNLLW

SEQ ID NO: 268107 - protein, 9 aa, Homo Sapiens
LPEFLLLGL

SEQ ID NO: 268108 - protein, 9 aa, Homo Sapiens
LGEWWSHIQ

SEQ ID NO: 268109 - protein, 9 aa, Homo Sapiens
QPAFYDLSE

SEQ ID NO: 268110 - protein, 9 aa, Homo Sapiens
LAQHQKVHS

SEQ ID NO: 268111 - protein, 9 aa, Homo Sapiens
AEKVKSYSM

SEQ ID NO: 268112 - protein, 9 aa, Homo Sapiens
NHATLAGNG

SEQ ID NO: 268113 - protein, 9 aa, Homo Sapiens
IVKIWFKNQ

SEQ ID NO: 268114 - protein, 9 aa, Homo Sapiens
NVFLQATNK

SEQ ID NO: 268115 - protein, 9 aa, Homo Sapiens
KLKTKLKYG

SEQ ID NO: 268116 - protein, 9 aa, Homo Sapiens
SQSCEEQAV

SEQ ID NO: 268117 - protein, 9 aa, Homo Sapiens
WDKMKMGQE

SEQ ID NO: 268118 - protein, 9 aa, Homo Sapiens
IHKTQCAVV

SEQ ID NO: 268119 - protein, 9 aa, Homo Sapiens
QAGPPICSS

SEQ ID NO: 268120 - protein, 9 aa, Homo Sapiens
QHQELRDPT

SEQ ID NO: 268121 - protein, 9 aa, Homo Sapiens
SSACGIAQA

SEQ ID NO: 268122 - protein, 9 aa, Homo Sapiens
NGKTCGLAW

SEQ ID NO: 268123 - protein, 9 aa, Homo Sapiens
AWILLSLGL

SEQ ID NO: 268124 - protein, 9 aa, Homo Sapiens
IKQNSVPPS

SEQ ID NO: 268125 - protein, 9 aa, Homo Sapiens
TECAKAFNQ

SEQ ID NO: 268126 - protein, 9 aa, Homo Sapiens
ERVGDKDKA

SEQ ID NO: 268127 - protein, 9 aa, Homo Sapiens
GTVLYCTFG

SEQ ID NO: 268128 - protein, 9 aa, Homo Sapiens
DNFEVVKQF

SEQ ID NO: 268129 - protein, 9 aa, Homo Sapiens
RCHSYSVII

SEQ ID NO: 268130 - protein, 9 aa, Homo Sapiens
NGYIDKNEL

SEQ ID NO: 268131 - protein, 9 aa, Homo Sapiens
KVRCNCVEC

SEQ ID NO: 268132 - protein, 9 aa, Homo Sapiens
SSYHSPGSP

SEQ ID NO: 268133 - protein, 9 aa, Homo Sapiens
KCSLIDKKK

SEQ ID NO: 268134 - protein, 9 aa, Homo Sapiens
LALVKSREI

SEQ ID NO: 268135 - protein, 9 aa, Homo Sapiens
TGHDRLHAR

SEQ ID NO: 268136 - protein, 9 aa, Homo Sapiens
VSPILVQGR

SEQ ID NO: 268137 - protein, 9 aa, Homo Sapiens
KEPLSSTAT

SEQ ID NO: 268138 - protein, 9 aa, Homo Sapiens
SLKAWLENM

SEQ ID NO: 268139 - protein, 9 aa, Homo Sapiens
PRPHQQPTT

SEQ ID NO: 268140 - protein, 9 aa, Homo Sapiens
WKHPEPGIL

SEQ ID NO: 268141 - protein, 9 aa, Homo Sapiens
YFDSVFQLI

SEQ ID NO: 268142 - protein, 9 aa, Homo Sapiens
PPYIFHQVT

SEQ ID NO: 268143 - protein, 9 aa, Homo Sapiens
DISNDAGEL

SEQ ID NO: 268144 - protein, 9 aa, Homo Sapiens
LKYMLESED

SEQ ID NO: 268145 - protein, 9 aa, Homo Sapiens
KLLYIYGAL

SEQ ID NO: 268146 - protein, 9 aa, Homo Sapiens
KYNSGVICE

SEQ ID NO: 268147 - protein, 9 aa, Homo Sapiens
KRKSLDVNQ

SEQ ID NO: 268148 - protein, 9 aa, Homo Sapiens
EDEEGISPL

SEQ ID NO: 268149 - protein, 9 aa, Homo Sapiens
IKLAVQMDK

SEQ ID NO: 268150 - protein, 9 aa, Homo Sapiens
NHGEIKWIY

SEQ ID NO: 268151 - protein, 9 aa, Homo Sapiens
SLPWRLQMA

SEQ ID NO: 268152 - protein, 9 aa, Homo Sapiens
YITCEPSPS

SEQ ID NO: 268153 - protein, 9 aa, Homo Sapiens
YIKKNHEEE

SEQ ID NO: 268154 - protein, 9 aa, Homo Sapiens
SALIQTLGK

SEQ ID NO: 268155 - protein, 9 aa, Homo Sapiens
EEGTKYRYF

SEQ ID NO: 268156 - protein, 9 aa, Homo Sapiens
FTRDELFME

SEQ ID NO: 268157 - protein, 9 aa, Homo Sapiens
RSMQDDWKL

SEQ ID NO: 268158 - protein, 9 aa, Homo Sapiens
SAQSPPGKP

SEQ ID NO: 268159 - protein, 9 aa, Homo Sapiens
HVSTIKPRI

SEQ ID NO: 268160 - protein, 9 aa, Homo Sapiens
HPDKPLPAV

SEQ ID NO: 268161 - protein, 9 aa, Homo Sapiens
EENNSENPK

SEQ ID NO: 268162 - protein, 9 aa, Homo Sapiens
YTARMNLRL

SEQ ID NO: 268163 - protein, 9 aa, Homo Sapiens
LVKNAQVQI

SEQ ID NO: 268164 - protein, 9 aa, Homo Sapiens
LGKGKKNEG

SEQ ID NO: 268165 - protein, 9 aa, Homo Sapiens
GKRISKRIN

SEQ ID NO: 268166 - protein, 9 aa, Homo Sapiens
FRLESESRS

SEQ ID NO: 268167 - protein, 9 aa, Homo Sapiens
SQITPWLFM

SEQ ID NO: 268168 - protein, 9 aa, Homo Sapiens
KFLLTGQCN

SEQ ID NO: 268169 - protein, 9 aa, Homo Sapiens
FDLPEILFF

SEQ ID NO: 268170 - protein, 9 aa, Homo Sapiens
YLLDIPKGE

SEQ ID NO: 268171 - protein, 9 aa, Homo Sapiens
EIFNALSSS

SEQ ID NO: 268172 - protein, 9 aa, Homo Sapiens
SNDTTQLIF

SEQ ID NO: 268173 - protein, 9 aa, Homo Sapiens
NGCRSREIF

SEQ ID NO: 268174 - protein, 9 aa, Homo Sapiens
YLDNNQIKT

SEQ ID NO: 268175 - protein, 9 aa, Homo Sapiens
VHQYSSCLP

SEQ ID NO: 268176 - protein, 9 aa, Homo Sapiens
VRSAYCAAA

SEQ ID NO: 268177 - protein, 9 aa, Homo Sapiens
FEDQTSLEL

SEQ ID NO: 268178 - protein, 9 aa, Homo Sapiens
EYNVIKDIK

SEQ ID NO: 268179 - protein, 9 aa, Homo Sapiens
KDYFMSKAL

SEQ ID NO: 268180 - protein, 9 aa, Homo Sapiens
ITVKYQIHT

SEQ ID NO: 268181 - protein, 9 aa, Homo Sapiens
TGGPVPNPN

SEQ ID NO: 268182 - protein, 9 aa, Homo Sapiens
VFPWHSRNK

SEQ ID NO: 268183 - protein, 9 aa, Homo Sapiens
IPTYASTYG

SEQ ID NO: 268184 - protein, 9 aa, Homo Sapiens
LRDFLMHWK

SEQ ID NO: 268185 - protein, 9 aa, Homo Sapiens
VLNNKTLGE

SEQ ID NO: 268186 - protein, 9 aa, Homo Sapiens
LNFGSFVEV

SEQ ID NO: 268187 - protein, 9 aa, Homo Sapiens
SGGDHFCLG

SEQ ID NO: 268188 - protein, 9 aa, Homo Sapiens
EEKESDFEF

SEQ ID NO: 268189 - protein, 9 aa, Homo Sapiens
NKAIHTGEK

SEQ ID NO: 268190 - protein, 9 aa, Homo Sapiens
NPCFRVWFN

SEQ ID NO: 268191 - protein, 9 aa, Homo Sapiens
GLYEKRMQQ

SEQ ID NO: 268192 - protein, 9 aa, Homo Sapiens
PEFTRDELF

SEQ ID NO: 268193 - protein, 9 aa, Homo Sapiens
RQVQRGPAQ

SEQ ID NO: 268194 - protein, 9 aa, Homo Sapiens
SERVLITVK

SEQ ID NO: 268195 - protein, 9 aa, Homo Sapiens
FRVHILYGR

SEQ ID NO: 268196 - protein, 9 aa, Homo Sapiens
VAVFYTMVT

SEQ ID NO: 268197 - protein, 9 aa, Homo Sapiens
DRIITPYTL

SEQ ID NO: 268198 - protein, 9 aa, Homo Sapiens
LSCLWILGL

SEQ ID NO: 268199 - protein, 9 aa, Homo Sapiens
PTNEMLLKF

SEQ ID NO: 268200 - protein, 9 aa, Homo Sapiens
FKGTHIDTL

SEQ ID NO: 268201 - protein, 9 aa, Homo Sapiens
YWSMYQRLQ

SEQ ID NO: 268202 - protein, 9 aa, Homo Sapiens
FISPYLNPD

SEQ ID NO: 268203 - protein, 9 aa, Homo Sapiens
NECENVSIK

SEQ ID NO: 268204 - protein, 9 aa, Homo Sapiens
SVTRRDSAL

SEQ ID NO: 268205 - protein, 9 aa, Homo Sapiens
LKAVFTEFL

SEQ ID NO: 268206 - protein, 9 aa, Homo Sapiens
LILKTTLFM

SEQ ID NO: 268207 - protein, 9 aa, Homo Sapiens
SLEFGYPGE

SEQ ID NO: 268208 - protein, 9 aa, Homo Sapiens
FNDTFYQQF

SEQ ID NO: 268209 - protein, 9 aa, Homo Sapiens
LLTSPSTPS

SEQ ID NO: 268210 - protein, 9 aa, Homo Sapiens
EDKNITLHC

SEQ ID NO: 268211 - protein, 9 aa, Homo Sapiens
PGRSRKGRG

SEQ ID NO: 268212 - protein, 9 aa, Homo Sapiens
RESGVLKLN

SEQ ID NO: 268213 - protein, 9 aa, Homo Sapiens
DGNKHIKDQ

SEQ ID NO: 268214 - protein, 9 aa, Homo Sapiens
PGVVLLTCR

SEQ ID NO: 268215 - protein, 9 aa, Homo Sapiens
RKGGMEVCN

SEQ ID NO: 268216 - protein, 9 aa, Homo Sapiens
LLLQTPVVR

SEQ ID NO: 268217 - protein, 9 aa, Homo Sapiens
RKRLSKRGP

SEQ ID NO: 268218 - protein, 9 aa, Homo Sapiens
PRLSFALER

SEQ ID NO: 268219 - protein, 9 aa, Homo Sapiens
PPPRPPQGR

SEQ ID NO: 268220 - protein, 9 aa, Homo Sapiens
IASWKLAPA

SEQ ID NO: 268221 - protein, 9 aa, Homo Sapiens
SLQLKSKGL

SEQ ID NO: 268222 - protein, 9 aa, Homo Sapiens
CHFLWKLHF

SEQ ID NO: 268223 - protein, 9 aa, Homo Sapiens
QKTEDMKRY

SEQ ID NO: 268224 - protein, 9 aa, Homo Sapiens
QADGGQDRK

SEQ ID NO: 268225 - protein, 9 aa, Homo Sapiens
AKCQMLIQE

SEQ ID NO: 268226 - protein, 9 aa, Homo Sapiens
YAVEDKPSQ

SEQ ID NO: 268227 - protein, 9 aa, Homo Sapiens
EEPPTKYQL

SEQ ID NO: 268228 - protein, 9 aa, Homo Sapiens
YLTDAWNTF

SEQ ID NO: 268229 - protein, 9 aa, Homo Sapiens
TVPFMLIVV

SEQ ID NO: 268230 - protein, 9 aa, Homo Sapiens
DTRDPSSHE

SEQ ID NO: 268231 - protein, 9 aa, Homo Sapiens
LCHSAAEFR

SEQ ID NO: 268232 - protein, 9 aa, Homo Sapiens
FKEYVDGSN

SEQ ID NO: 268233 - protein, 9 aa, Homo Sapiens
SIYRSLAKI

SEQ ID NO: 268234 - protein, 9 aa, Homo Sapiens
SFTHICAGQ

SEQ ID NO: 268235 - protein, 9 aa, Homo Sapiens
VELVTVADN

SEQ ID NO: 268236 - protein, 9 aa, Homo Sapiens
VRERKKEGK

SEQ ID NO: 268237 - protein, 9 aa, Homo Sapiens
PGILSFLTH

SEQ ID NO: 268238 - protein, 9 aa, Homo Sapiens
QTIYLYRFL

SEQ ID NO: 268239 - protein, 9 aa, Homo Sapiens
APTPKIIEY

SEQ ID NO: 268240 - protein, 9 aa, Homo Sapiens
CHFWRHGRN

SEQ ID NO: 268241 - protein, 9 aa, Homo Sapiens
APSLPTNNF

SEQ ID NO: 268242 - protein, 9 aa, Homo Sapiens
MIRPDHPHP

SEQ ID NO: 268243 - protein, 9 aa, Homo Sapiens
FPASYSSPS

SEQ ID NO: 268244 - protein, 9 aa, Homo Sapiens
KHYRLTHAE

SEQ ID NO: 268245 - protein, 9 aa, Homo Sapiens
SHARGHAKV

SEQ ID NO: 268246 - protein, 9 aa, Homo Sapiens
ELVRTLNGH

SEQ ID NO: 268247 - protein, 9 aa, Homo Sapiens
KKKNKGNKT

SEQ ID NO: 268248 - protein, 9 aa, Homo Sapiens
HATLAGNGL

SEQ ID NO: 268249 - protein, 9 aa, Homo Sapiens
ECEKVFRSG

SEQ ID NO: 268250 - protein, 9 aa, Homo Sapiens
LHQLFIARF

SEQ ID NO: 268251 - protein, 9 aa, Homo Sapiens
VFSDTSPIL

SEQ ID NO: 268252 - protein, 9 aa, Homo Sapiens
ISVSTGTTC

SEQ ID NO: 268253 - protein, 9 aa, Homo Sapiens
FTSQHFVQI

SEQ ID NO: 268254 - protein, 9 aa, Homo Sapiens
PPASFKSTK

SEQ ID NO: 268255 - protein, 9 aa, Homo Sapiens
FLELEKGVF

SEQ ID NO: 268256 - protein, 9 aa, Homo Sapiens
PEMANKLSQ

SEQ ID NO: 268257 - protein, 9 aa, Homo Sapiens
YSLLISIKM

SEQ ID NO: 268258 - protein, 9 aa, Homo Sapiens
FLQMQKRVL

SEQ ID NO: 268259 - protein, 9 aa, Homo Sapiens
LTCKITLPE

SEQ ID NO: 268260 - protein, 9 aa, Homo Sapiens
DSSENDDLR

SEQ ID NO: 268261 - protein, 9 aa, Homo Sapiens
LSRNPQPQP

SEQ ID NO: 268262 - protein, 9 aa, Homo Sapiens
DEFLRNNEL

SEQ ID NO: 268263 - protein, 9 aa, Homo Sapiens
GRLFISHAN

SEQ ID NO: 268264 - protein, 9 aa, Homo Sapiens
RLNKAALEM

SEQ ID NO: 268265 - protein, 9 aa, Homo Sapiens
QPDEVFGIF

SEQ ID NO: 268266 - protein, 9 aa, Homo Sapiens
VPFMLIVVS

SEQ ID NO: 268267 - protein, 9 aa, Homo Sapiens
TGTFESMPN

SEQ ID NO: 268268 - protein, 9 aa, Homo Sapiens
ILFARGEDD

SEQ ID NO: 268269 - protein, 9 aa, Homo Sapiens
LAVSYNRLH

SEQ ID NO: 268270 - protein, 9 aa, Homo Sapiens
ARLTGINDK

SEQ ID NO: 268271 - protein, 9 aa, Homo Sapiens
PNKYYLAEK

SEQ ID NO: 268272 - protein, 9 aa, Homo Sapiens
VIKHSPQSL

SEQ ID NO: 268273 - protein, 9 aa, Homo Sapiens
LRWGPLWRV

SEQ ID NO: 268274 - protein, 9 aa, Homo Sapiens
VHTADKPYK

SEQ ID NO: 268275 - protein, 9 aa, Homo Sapiens
ERERSYDLV

SEQ ID NO: 268276 - protein, 9 aa, Homo Sapiens
YQYYGLSHT

SEQ ID NO: 268277 - protein, 9 aa, Homo Sapiens
TGKSDAETL

SEQ ID NO: 268278 - protein, 9 aa, Homo Sapiens
MRPRVHGSA

SEQ ID NO: 268279 - protein, 9 aa, Homo Sapiens
PSIKDSNRC

SEQ ID NO: 268280 - protein, 9 aa, Homo Sapiens
LGFSAACVA

SEQ ID NO: 268281 - protein, 9 aa, Homo Sapiens
KAQAGARAG

SEQ ID NO: 268282 - protein, 9 aa, Homo Sapiens
MGMCSMKRG

SEQ ID NO: 268283 - protein, 9 aa, Homo Sapiens
TCVSAHRYS

SEQ ID NO: 268284 - protein, 9 aa, Homo Sapiens
GSLIAEIII

SEQ ID NO: 268285 - protein, 9 aa, Homo Sapiens
MLMYDITNE

SEQ ID NO: 268286 - protein, 9 aa, Homo Sapiens
INRKIPYIL

SEQ ID NO: 268287 - protein, 9 aa, Homo Sapiens
MSVILEQDI

SEQ ID NO: 268288 - protein, 9 aa, Homo Sapiens
HHHHNEKKR

SEQ ID NO: 268289 - protein, 9 aa, Homo Sapiens
IHFIILMGK

SEQ ID NO: 268290 - protein, 9 aa, Homo Sapiens
YAKFKKMCD

SEQ ID NO: 268291 - protein, 9 aa, Homo Sapiens
GKKEKEHGE

SEQ ID NO: 268292 - protein, 9 aa, Homo Sapiens
GQPVFLSQS

SEQ ID NO: 268293 - protein, 9 aa, Homo Sapiens
QRCTVDGSP

SEQ ID NO: 268294 - protein, 9 aa, Homo Sapiens
TQDLQEGED

SEQ ID NO: 268295 - protein, 9 aa, Homo Sapiens
FRAPGTIKD

SEQ ID NO: 268296 - protein, 9 aa, Homo Sapiens
LASEQYDKD

SEQ ID NO: 268297 - protein, 9 aa, Homo Sapiens
PTDYIKRIM

SEQ ID NO: 268298 - protein, 9 aa, Homo Sapiens
DNSSFARHQ

SEQ ID NO: 268299 - protein, 9 aa, Homo Sapiens
APEALHFSF

SEQ ID NO: 268300 - protein, 9 aa, Homo Sapiens
KKKAMLQGQ

SEQ ID NO: 268301 - protein, 9 aa, Homo Sapiens
FMGSPQLRQ

SEQ ID NO: 268302 - protein, 9 aa, Homo Sapiens
AINVGSFTI

SEQ ID NO: 268303 - protein, 9 aa, Homo Sapiens
MVIDTNYNR

SEQ ID NO: 268304 - protein, 9 aa, Homo Sapiens
LPKDHREDV

SEQ ID NO: 268305 - protein, 9 aa, Homo Sapiens
PGQFILILK

SEQ ID NO: 268306 - protein, 9 aa, Homo Sapiens
AAVASLTNI

SEQ ID NO: 268307 - protein, 9 aa, Homo Sapiens
NAIYVKGQW

SEQ ID NO: 268308 - protein, 9 aa, Homo Sapiens
TFSSSGCLH

SEQ ID NO: 268309 - protein, 9 aa, Homo Sapiens
TTLIIHMRI

SEQ ID NO: 268310 - protein, 9 aa, Homo Sapiens
YTLPRSQPM

SEQ ID NO: 268311 - protein, 9 aa, Homo Sapiens
AHPDLRSTI

SEQ ID NO: 268312 - protein, 9 aa, Homo Sapiens
RRWDIIDLE

SEQ ID NO: 268313 - protein, 9 aa, Homo Sapiens
QQLLNKINE

SEQ ID NO: 268314 - protein, 9 aa, Homo Sapiens
PGHAGAPEP

SEQ ID NO: 268315 - protein, 9 aa, Homo Sapiens
YVHSIIIAN

SEQ ID NO: 268316 - protein, 9 aa, Homo Sapiens
LNLLHQHHE

SEQ ID NO: 268317 - protein, 9 aa, Homo Sapiens
KNTSKLLFK

SEQ ID NO: 268318 - protein, 9 aa, Homo Sapiens
RHLRIYVYV

SEQ ID NO: 268319 - protein, 9 aa, Homo Sapiens
IAFKPKHYL

SEQ ID NO: 268320 - protein, 9 aa, Homo Sapiens
EKFGMNSGG

SEQ ID NO: 268321 - protein, 9 aa, Homo Sapiens
DQYAAIKKA

SEQ ID NO: 268322 - protein, 9 aa, Homo Sapiens
NAYFRQGVA

SEQ ID NO: 268323 - protein, 9 aa, Homo Sapiens
SLGHVPRRL

SEQ ID NO: 268324 - protein, 9 aa, Homo Sapiens
GYSQGNPCT

SEQ ID NO: 268325 - protein, 9 aa, Homo Sapiens
PEDTPQGRY

SEQ ID NO: 268326 - protein, 9 aa, Homo Sapiens
SMDANEPTK

SEQ ID NO: 268327 - protein, 9 aa, Homo Sapiens
RCLVIELEE

SEQ ID NO: 268328 - protein, 9 aa, Homo Sapiens
RSNIFIRNP

SEQ ID NO: 268329 - protein, 9 aa, Homo Sapiens
CHCHQHMVG

SEQ ID NO: 268330 - protein, 9 aa, Homo Sapiens
EKISSALKK

SEQ ID NO: 268331 - protein, 9 aa, Homo Sapiens
HIKIWDVYT

SEQ ID NO: 268332 - protein, 9 aa, Homo Sapiens
AKKKDEGPY

SEQ ID NO: 268333 - protein, 9 aa, Homo Sapiens
NFKDRLKPA

SEQ ID NO: 268334 - protein, 9 aa, Homo Sapiens
QVKRSVFAS

SEQ ID NO: 268335 - protein, 9 aa, Homo Sapiens
GKTSLAHQS

SEQ ID NO: 268336 - protein, 9 aa, Homo Sapiens
GTGMKYRDL

SEQ ID NO: 268337 - protein, 9 aa, Homo Sapiens
SFAEIYDPS

SEQ ID NO: 268338 - protein, 9 aa, Homo Sapiens
HNRKQANLN

SEQ ID NO: 268339 - protein, 9 aa, Homo Sapiens
KYCRKSFRQ

SEQ ID NO: 268340 - protein, 9 aa, Homo Sapiens
SFGECCDVE

SEQ ID NO: 268341 - protein, 9 aa, Homo Sapiens
LECENWLEQ

SEQ ID NO: 268342 - protein, 9 aa, Homo Sapiens
NVFIGGTKP

SEQ ID NO: 268343 - protein, 9 aa, Homo Sapiens
IILKEVEYQ

SEQ ID NO: 268344 - protein, 9 aa, Homo Sapiens
SQTCYLELE

SEQ ID NO: 268345 - protein, 9 aa, Homo Sapiens
SRAQLKKIL

SEQ ID NO: 268346 - protein, 9 aa, Homo Sapiens
LEMTCYQQQ

SEQ ID NO: 268347 - protein, 9 aa, Homo Sapiens
PSLAPEDHI

SEQ ID NO: 268348 - protein, 9 aa, Homo Sapiens
IIPENFSAF

SEQ ID NO: 268349 - protein, 9 aa, Homo Sapiens
KGAPESHFL

SEQ ID NO: 268350 - protein, 9 aa, Homo Sapiens
LTCGCQITT

SEQ ID NO: 268351 - protein, 9 aa, Homo Sapiens
TAVDFLGHV

SEQ ID NO: 268352 - protein, 9 aa, Homo Sapiens
IRAPQMNIN

SEQ ID NO: 268353 - protein, 9 aa, Homo Sapiens
NAHNNSTGS

SEQ ID NO: 268354 - protein, 9 aa, Homo Sapiens
LSESADEVR

SEQ ID NO: 268355 - protein, 9 aa, Homo Sapiens
REKGKGQAS

SEQ ID NO: 268356 - protein, 9 aa, Homo Sapiens
EEKAIAQQW

SEQ ID NO: 268357 - protein, 9 aa, Homo Sapiens
KQFYISANI

SEQ ID NO: 268358 - protein, 9 aa, Homo Sapiens
TTAINYKHS

SEQ ID NO: 268359 - protein, 9 aa, Homo Sapiens
KGVVLCYWF

SEQ ID NO: 268360 - protein, 9 aa, Homo Sapiens
SPLPGPHDP

SEQ ID NO: 268361 - protein, 9 aa, Homo Sapiens
EGRKKAYFT

SEQ ID NO: 268362 - protein, 9 aa, Homo Sapiens
YLTENKYSP

SEQ ID NO: 268363 - protein, 9 aa, Homo Sapiens
ASLRKDPIN

SEQ ID NO: 268364 - protein, 9 aa, Homo Sapiens
RLLILREIV

SEQ ID NO: 268365 - protein, 9 aa, Homo Sapiens
LQPRGNEVC

SEQ ID NO: 268366 - protein, 9 aa, Homo Sapiens
TCNLPLLML

SEQ ID NO: 268367 - protein, 9 aa, Homo Sapiens
EEHPSVHEY

SEQ ID NO: 268368 - protein, 9 aa, Homo Sapiens
SKKQDPDAP

SEQ ID NO: 268369 - protein, 9 aa, Homo Sapiens
GSKDDDDID

SEQ ID NO: 268370 - protein, 9 aa, Homo Sapiens
TARLTFQNP

SEQ ID NO: 268371 - protein, 9 aa, Homo Sapiens
CFHAVNKAM

SEQ ID NO: 268372 - protein, 9 aa, Homo Sapiens
SCKPSTFAY

SEQ ID NO: 268373 - protein, 9 aa, Homo Sapiens
GALISDFET

SEQ ID NO: 268374 - protein, 9 aa, Homo Sapiens
RDELSGIVS

SEQ ID NO: 268375 - protein, 9 aa, Homo Sapiens
LFKMFIGSA

SEQ ID NO: 268376 - protein, 9 aa, Homo Sapiens
SYPGNILSQ

SEQ ID NO: 268377 - protein, 9 aa, Homo Sapiens
GETQEWERI

SEQ ID NO: 268378 - protein, 9 aa, Homo Sapiens
STQSEKSKR

SEQ ID NO: 268379 - protein, 9 aa, Homo Sapiens
STSAHTLVT

SEQ ID NO: 268380 - protein, 9 aa, Homo Sapiens
ISHPERFSL

SEQ ID NO: 268381 - protein, 9 aa, Homo Sapiens
VAKQLARNN

SEQ ID NO: 268382 - protein, 9 aa, Homo Sapiens
KQCSNAFPF

SEQ ID NO: 268383 - protein, 9 aa, Homo Sapiens
GLEKTGKAK

SEQ ID NO: 268384 - protein, 9 aa, Homo Sapiens
TLQGKINDE

SEQ ID NO: 268385 - protein, 9 aa, Homo Sapiens
NIEYGAVED

SEQ ID NO: 268386 - protein, 9 aa, Homo Sapiens
AKDVVAVIM

SEQ ID NO: 268387 - protein, 9 aa, Homo Sapiens
DVDLWPAPV

SEQ ID NO: 268388 - protein, 9 aa, Homo Sapiens
TQLQGCLLS

SEQ ID NO: 268389 - protein, 9 aa, Homo Sapiens
DTAVLFLHY

SEQ ID NO: 268390 - protein, 9 aa, Homo Sapiens
WDNIYHALG

SEQ ID NO: 268391 - protein, 9 aa, Homo Sapiens
LCPSISHNK

SEQ ID NO: 268392 - protein, 9 aa, Homo Sapiens
PYSHPELFA

SEQ ID NO: 268393 - protein, 9 aa, Homo Sapiens
AGQSVVYVA

SEQ ID NO: 268394 - protein, 9 aa, Homo Sapiens
EYDIDNCHF

SEQ ID NO: 268395 - protein, 9 aa, Homo Sapiens
NVEDPYTSF

SEQ ID NO: 268396 - protein, 9 aa, Homo Sapiens
NTDHLQSQV

SEQ ID NO: 268397 - protein, 9 aa, Homo Sapiens
QVTHNPGTV

SEQ ID NO: 268398 - protein, 9 aa, Homo Sapiens
LKPNPGSNK

SEQ ID NO: 268399 - protein, 9 aa, Homo Sapiens
QPQLFWLSS

SEQ ID NO: 268400 - protein, 9 aa, Homo Sapiens
KKYKQEDSS

SEQ ID NO: 268401 - protein, 9 aa, Homo Sapiens
QSPLYSQPQ

SEQ ID NO: 268402 - protein, 9 aa, Homo Sapiens
IKHFSENIY

SEQ ID NO: 268403 - protein, 9 aa, Homo Sapiens
VIQKAQQSG

SEQ ID NO: 268404 - protein, 9 aa, Homo Sapiens
GLSAERLQL

SEQ ID NO: 268405 - protein, 9 aa, Homo Sapiens
GTLLGVATA

SEQ ID NO: 268406 - protein, 9 aa, Homo Sapiens
LFLQPLWEH

SEQ ID NO: 268407 - protein, 9 aa, Homo Sapiens
DNKQIEAKE

SEQ ID NO: 268408 - protein, 9 aa, Homo Sapiens
QTRTTKEAG

SEQ ID NO: 268409 - protein, 9 aa, Homo Sapiens
SLKSHARGH

SEQ ID NO: 268410 - protein, 9 aa, Homo Sapiens
EAEETAQKT

SEQ ID NO: 268411 - protein, 9 aa, Homo Sapiens
EMIQIINKC

SEQ ID NO: 268412 - protein, 9 aa, Homo Sapiens
KKTVYCFVN

SEQ ID NO: 268413 - protein, 9 aa, Homo Sapiens
FMEMYPAVF

SEQ ID NO: 268414 - protein, 9 aa, Homo Sapiens
QLYNTESQS

SEQ ID NO: 268415 - protein, 9 aa, Homo Sapiens
IKICDELCK

SEQ ID NO: 268416 - protein, 9 aa, Homo Sapiens
RPGDACGLQ

SEQ ID NO: 268417 - protein, 9 aa, Homo Sapiens
ADPNIQYKS

SEQ ID NO: 268418 - protein, 9 aa, Homo Sapiens
GAPGEHDSQ

SEQ ID NO: 268419 - protein, 9 aa, Homo Sapiens
PASLNEHKN

SEQ ID NO: 268420 - protein, 9 aa, Homo Sapiens
EDRSVKPHL

SEQ ID NO: 268421 - protein, 9 aa, Homo Sapiens
IETLKETTH

SEQ ID NO: 268422 - protein, 9 aa, Homo Sapiens
KSAVNCVPL

SEQ ID NO: 268423 - protein, 9 aa, Homo Sapiens
ILKKGHSVV

SEQ ID NO: 268424 - protein, 9 aa, Homo Sapiens
QWTCISRET

SEQ ID NO: 268425 - protein, 9 aa, Homo Sapiens
LKCSLASSL

SEQ ID NO: 268426 - protein, 9 aa, Homo Sapiens
LGVHLSKVR

SEQ ID NO: 268427 - protein, 9 aa, Homo Sapiens
EQVQINPTS

SEQ ID NO: 268428 - protein, 9 aa, Homo Sapiens
DSGSKKRFK

SEQ ID NO: 268429 - protein, 9 aa, Homo Sapiens
VQSSVDINS

SEQ ID NO: 268430 - protein, 9 aa, Homo Sapiens
RGIYIHALH

SEQ ID NO: 268431 - protein, 9 aa, Homo Sapiens
DVCATSQTD

SEQ ID NO: 268432 - protein, 9 aa, Homo Sapiens
PSGKRLPRT

SEQ ID NO: 268433 - protein, 9 aa, Homo Sapiens
RTRKWSKMN

SEQ ID NO: 268434 - protein, 9 aa, Homo Sapiens
IVHTREKPF

SEQ ID NO: 268435 - protein, 9 aa, Homo Sapiens
IPQNDLLGY

SEQ ID NO: 268436 - protein, 9 aa, Homo Sapiens
VLRQVGVSR

SEQ ID NO: 268437 - protein, 9 aa, Homo Sapiens
GQATPDIPS

SEQ ID NO: 268438 - protein, 9 aa, Homo Sapiens
YFDATESKY

SEQ ID NO: 268439 - protein, 9 aa, Homo Sapiens
LKTKDPFLE

SEQ ID NO: 268440 - protein, 9 aa, Homo Sapiens
AHSYIDVEG

SEQ ID NO: 268441 - protein, 9 aa, Homo Sapiens
SQDLALIAW

SEQ ID NO: 268442 - protein, 9 aa, Homo Sapiens
VVVYMPDVW

SEQ ID NO: 268443 - protein, 9 aa, Homo Sapiens
LCYDRIKFL

SEQ ID NO: 268444 - protein, 9 aa, Homo Sapiens
LPLIVKRIR

SEQ ID NO: 268445 - protein, 9 aa, Homo Sapiens
EMPWESNIK

SEQ ID NO: 268446 - protein, 9 aa, Homo Sapiens
RELGKVAPT

SEQ ID NO: 268447 - protein, 9 aa, Homo Sapiens
DVMPFLFDI

SEQ ID NO: 268448 - protein, 9 aa, Homo Sapiens
ETQRGLRPG

SEQ ID NO: 268449 - protein, 9 aa, Homo Sapiens
EGTNINRSI

SEQ ID NO: 268450 - protein, 9 aa, Homo Sapiens
DLKGGGGGP

SEQ ID NO: 268451 - protein, 9 aa, Homo Sapiens
KPEEPPQTL

SEQ ID NO: 268452 - protein, 9 aa, Homo Sapiens
NAKQQPDKV

SEQ ID NO: 268453 - protein, 9 aa, Homo Sapiens
REVINMRTI

SEQ ID NO: 268454 - protein, 9 aa, Homo Sapiens
GMASTFGLL

SEQ ID NO: 268455 - protein, 9 aa, Homo Sapiens
DKADVLCPG

SEQ ID NO: 268456 - protein, 9 aa, Homo Sapiens
LLQVKYGVW

SEQ ID NO: 268457 - protein, 9 aa, Homo Sapiens
QNGLKDNNH

SEQ ID NO: 268458 - protein, 9 aa, Homo Sapiens
LSKSLSREI

SEQ ID NO: 268459 - protein, 9 aa, Homo Sapiens
ASPEQTSNV

SEQ ID NO: 268460 - protein, 9 aa, Homo Sapiens
KDNAAALEE

SEQ ID NO: 268461 - protein, 9 aa, Homo Sapiens
QDKNCEPVV

SEQ ID NO: 268462 - protein, 9 aa, Homo Sapiens
QKYDRVVHQ

SEQ ID NO: 268463 - protein, 9 aa, Homo Sapiens
SDKFGCSQY

SEQ ID NO: 268464 - protein, 9 aa, Homo Sapiens
QNQSQKVDE

SEQ ID NO: 268465 - protein, 9 aa, Homo Sapiens
MVTCSQIIY

SEQ ID NO: 268466 - protein, 9 aa, Homo Sapiens
KIHILHTNA

SEQ ID NO: 268467 - protein, 8 aa, Homo Sapiens
KKMSNIYE

SEQ ID NO: 268468 - protein, 9 aa, Homo Sapiens
SGPFMGQRR

SEQ ID NO: 268469 - protein, 9 aa, Homo Sapiens
LHTQLKDQR

SEQ ID NO: 268470 - protein, 9 aa, Homo Sapiens
KNTSAETRE

SEQ ID NO: 268471 - protein, 9 aa, Homo Sapiens
QTCGNVSNR

SEQ ID NO: 268472 - protein, 9 aa, Homo Sapiens
SRPQSFFAA

SEQ ID NO: 268473 - protein, 9 aa, Homo Sapiens
LKLHVEMLA

SEQ ID NO: 268474 - protein, 9 aa, Homo Sapiens
LCLRTFSCM

SEQ ID NO: 268475 - protein, 9 aa, Homo Sapiens
SNSEDGDPN

SEQ ID NO: 268476 - protein, 9 aa, Homo Sapiens
KQDPDAPPQ

SEQ ID NO: 268477 - protein, 9 aa, Homo Sapiens
AQQLPKYTS

SEQ ID NO: 268478 - protein, 9 aa, Homo Sapiens
IEKGKDDAL

SEQ ID NO: 268479 - protein, 9 aa, Homo Sapiens
NFVIHRRLL

SEQ ID NO: 268480 - protein, 9 aa, Homo Sapiens
APDLRHFRA

SEQ ID NO: 268481 - protein, 9 aa, Homo Sapiens
RDNFTQTLP

SEQ ID NO: 268482 - protein, 9 aa, Homo Sapiens
MFLLVGDLR

SEQ ID NO: 268483 - protein, 9 aa, Homo Sapiens
IMLCGMGGF

SEQ ID NO: 268484 - protein, 9 aa, Homo Sapiens
ATGFQLNEQ

SEQ ID NO: 268485 - protein, 9 aa, Homo Sapiens
PRVHGSAAR

SEQ ID NO: 268486 - protein, 9 aa, Homo Sapiens
KTGVCLSNQ

SEQ ID NO: 268487 - protein, 9 aa, Homo Sapiens
NWRHLLLFC

SEQ ID NO: 268488 - protein, 9 aa, Homo Sapiens
REIPPRRRL

SEQ ID NO: 268489 - protein, 9 aa, Homo Sapiens
SPNMLSVAL

SEQ ID NO: 268490 - protein, 9 aa, Homo Sapiens
LVISISYIC

SEQ ID NO: 268491 - protein, 9 aa, Homo Sapiens
SQVKYSRLS

SEQ ID NO: 268492 - protein, 9 aa, Homo Sapiens
VRDELSGIV

SEQ ID NO: 268493 - protein, 9 aa, Homo Sapiens
AMLADTDLR

SEQ ID NO: 268494 - protein, 9 aa, Homo Sapiens
TSFLGITKK

SEQ ID NO: 268495 - protein, 9 aa, Homo Sapiens
RNAEFDCHE

SEQ ID NO: 268496 - protein, 9 aa, Homo Sapiens
IEEQEKMLQ

SEQ ID NO: 268497 - protein, 9 aa, Homo Sapiens
ALSQGITAA

SEQ ID NO: 268498 - protein, 9 aa, Homo Sapiens
LHWKNSNSF

SEQ ID NO: 268499 - protein, 9 aa, Homo Sapiens
SFLKTDGSF

SEQ ID NO: 268500 - protein, 9 aa, Homo Sapiens
VTFLLAWMI

SEQ ID NO: 268501 - protein, 9 aa, Homo Sapiens
ASVIWIGYL

SEQ ID NO: 268502 - protein, 9 aa, Homo Sapiens
HADTCTPKY

SEQ ID NO: 268503 - protein, 9 aa, Homo Sapiens
KLSREKKAA

SEQ ID NO: 268504 - protein, 9 aa, Homo Sapiens
KSHARGHAK

SEQ ID NO: 268505 - protein, 9 aa, Homo Sapiens
DISAADKAE

SEQ ID NO: 268506 - protein, 9 aa, Homo Sapiens
FVMMEAFLL

SEQ ID NO: 268507 - protein, 9 aa, Homo Sapiens
HLTKDFIDK

SEQ ID NO: 268508 - protein, 9 aa, Homo Sapiens
TEMESGLEL

SEQ ID NO: 268509 - protein, 9 aa, Homo Sapiens
AGLRDDGKC

SEQ ID NO: 268510 - protein, 9 aa, Homo Sapiens
DMSSFTKCE

SEQ ID NO: 268511 - protein, 9 aa, Homo Sapiens
RVTKFILMG

SEQ ID NO: 268512 - protein, 9 aa, Homo Sapiens
DDDDQIRGL

SEQ ID NO: 268513 - protein, 9 aa, Homo Sapiens
MKQSCVLQQ

SEQ ID NO: 268514 - protein, 9 aa, Homo Sapiens
NYAASIYNI

SEQ ID NO: 268515 - protein, 9 aa, Homo Sapiens
NARAQQGKH

SEQ ID NO: 268516 - protein, 9 aa, Homo Sapiens
PTAFQKFYE

SEQ ID NO: 268517 - protein, 9 aa, Homo Sapiens
MSPGFRLAL

SEQ ID NO: 268518 - protein, 9 aa, Homo Sapiens
QGNVGKLSL

SEQ ID NO: 268519 - protein, 9 aa, Homo Sapiens
ASFLWPLLE

SEQ ID NO: 268520 - protein, 9 aa, Homo Sapiens
RQGNKGEPG

SEQ ID NO: 268521 - protein, 9 aa, Homo Sapiens
ADPQALTVK

SEQ ID NO: 268522 - protein, 9 aa, Homo Sapiens
SEDGDPNAE

SEQ ID NO: 268523 - protein, 9 aa, Homo Sapiens
TPLPNMDSS

SEQ ID NO: 268524 - protein, 9 aa, Homo Sapiens
QLLDLSAFK

SEQ ID NO: 268525 - protein, 9 aa, Homo Sapiens
NELHYLSKM

SEQ ID NO: 268526 - protein, 9 aa, Homo Sapiens
LGNKEDVTG

SEQ ID NO: 268527 - protein, 9 aa, Homo Sapiens
CLRATHPNN

SEQ ID NO: 268528 - protein, 9 aa, Homo Sapiens
ITIYNQEIE

SEQ ID NO: 268529 - protein, 9 aa, Homo Sapiens
THYQADIEQ

SEQ ID NO: 268530 - protein, 9 aa, Homo Sapiens
RPALHKKTQ

SEQ ID NO: 268531 - protein, 9 aa, Homo Sapiens
TLCPSIKGT

SEQ ID NO: 268532 - protein, 9 aa, Homo Sapiens
DDKVVSIHQ

SEQ ID NO: 268533 - protein, 9 aa, Homo Sapiens
EHVALFKQI

SEQ ID NO: 268534 - protein, 9 aa, Homo Sapiens
LLGVVWYFQ

SEQ ID NO: 268535 - protein, 9 aa, Homo Sapiens
QNMQNAEII

SEQ ID NO: 268536 - protein, 9 aa, Homo Sapiens
TSALKSETF

SEQ ID NO: 268537 - protein, 9 aa, Homo Sapiens
ILTNPLYAI

SEQ ID NO: 268538 - protein, 9 aa, Homo Sapiens
GIIYSILKQ

SEQ ID NO: 268539 - protein, 9 aa, Homo Sapiens
PQNPIQLTG

SEQ ID NO: 268540 - protein, 9 aa, Homo Sapiens
LRNFFFIFF

SEQ ID NO: 268541 - protein, 9 aa, Homo Sapiens
ALFQYNGTV

SEQ ID NO: 268542 - protein, 9 aa, Homo Sapiens
EVTIEAQPS

SEQ ID NO: 268543 - protein, 9 aa, Homo Sapiens
SSSFQMHER

SEQ ID NO: 268544 - protein, 9 aa, Homo Sapiens
SKQSLVYGK

SEQ ID NO: 268545 - protein, 9 aa, Homo Sapiens
TSIEVELTN

SEQ ID NO: 268546 - protein, 9 aa, Homo Sapiens
EKFFQSLTY

SEQ ID NO: 268547 - protein, 9 aa, Homo Sapiens
SFLTSRRPH

SEQ ID NO: 268548 - protein, 9 aa, Homo Sapiens
FKMLFAPCC

SEQ ID NO: 268549 - protein, 9 aa, Homo Sapiens
WLGLINNSR

SEQ ID NO: 268550 - protein, 9 aa, Homo Sapiens
VGSDDEGLY

SEQ ID NO: 268551 - protein, 9 aa, Homo Sapiens
ISPNGKYVY

SEQ ID NO: 268552 - protein, 9 aa, Homo Sapiens
LIFSIRPLS

SEQ ID NO: 268553 - protein, 9 aa, Homo Sapiens
VVSALTVVF

SEQ ID NO: 268554 - protein, 9 aa, Homo Sapiens
EEDAQQSST

SEQ ID NO: 268555 - protein, 9 aa, Homo Sapiens
KEAIRISED

SEQ ID NO: 268556 - protein, 9 aa, Homo Sapiens
EASGSPCLE

SEQ ID NO: 268557 - protein, 9 aa, Homo Sapiens
MKHYRLTHA

SEQ ID NO: 268558 - protein, 9 aa, Homo Sapiens
RRMTHLAHK

SEQ ID NO: 268559 - protein, 9 aa, Homo Sapiens
PGPYPTPPP

SEQ ID NO: 268560 - protein, 9 aa, Homo Sapiens
LNKKPLLSD

SEQ ID NO: 268561 - protein, 9 aa, Homo Sapiens
CKGITLFLS

SEQ ID NO: 268562 - protein, 9 aa, Homo Sapiens
EDKNVISLQ

SEQ ID NO: 268563 - protein, 9 aa, Homo Sapiens
LHPEFEEAY

SEQ ID NO: 268564 - protein, 9 aa, Homo Sapiens
ARDTHHSQN

SEQ ID NO: 268565 - protein, 9 aa, Homo Sapiens
QTMNVTGQL

SEQ ID NO: 268566 - protein, 9 aa, Homo Sapiens
CNPCFRVWF

SEQ ID NO: 268567 - protein, 9 aa, Homo Sapiens
NEMLLKFYS

SEQ ID NO: 268568 - protein, 9 aa, Homo Sapiens
DGTDKYNSG

SEQ ID NO: 268569 - protein, 9 aa, Homo Sapiens
TKEALASNL

SEQ ID NO: 268570 - protein, 9 aa, Homo Sapiens
LIQTLGKQL

SEQ ID NO: 268571 - protein, 9 aa, Homo Sapiens
GLIKHQIIH

SEQ ID NO: 268572 - protein, 9 aa, Homo Sapiens
ERGAFLGMS

SEQ ID NO: 268573 - protein, 9 aa, Homo Sapiens
YHSKILNKN

SEQ ID NO: 268574 - protein, 9 aa, Homo Sapiens
RMTFTTMPT

SEQ ID NO: 268575 - protein, 9 aa, Homo Sapiens
TSGNTQNRF

SEQ ID NO: 268576 - protein, 9 aa, Homo Sapiens
LKPAKNYSA

SEQ ID NO: 268577 - protein, 9 aa, Homo Sapiens
LDKEENSKV

SEQ ID NO: 268578 - protein, 9 aa, Homo Sapiens
KGEDPFQTD

SEQ ID NO: 268579 - protein, 9 aa, Homo Sapiens
IKKEPDKPI

SEQ ID NO: 268580 - protein, 9 aa, Homo Sapiens
DYDIVNNMF

SEQ ID NO: 268581 - protein, 9 aa, Homo Sapiens
PSNERKLNQ

SEQ ID NO: 268582 - protein, 9 aa, Homo Sapiens
GSLTGNTLS

SEQ ID NO: 268583 - protein, 9 aa, Homo Sapiens
RPDHPHPRE

SEQ ID NO: 268584 - protein, 9 aa, Homo Sapiens
EVYWEAVEL

SEQ ID NO: 268585 - protein, 9 aa, Homo Sapiens
RTTKEAGSV

SEQ ID NO: 268586 - protein, 9 aa, Homo Sapiens
ALGITEMFI

SEQ ID NO: 268587 - protein, 9 aa, Homo Sapiens
GSEKRLNIF

SEQ ID NO: 268588 - protein, 9 aa, Homo Sapiens
DMQLDSEGI

SEQ ID NO: 268589 - protein, 9 aa, Homo Sapiens
FFIKIAAID

SEQ ID NO: 268590 - protein, 9 aa, Homo Sapiens
SEKLVWVLF

SEQ ID NO: 268591 - protein, 9 aa, Homo Sapiens
NKSYVHSAL

SEQ ID NO: 268592 - protein, 9 aa, Homo Sapiens
QSCVLQQCL

SEQ ID NO: 268593 - protein, 9 aa, Homo Sapiens
HPGLFTLEV

SEQ ID NO: 268594 - protein, 9 aa, Homo Sapiens
ECNCTLLGL

SEQ ID NO: 268595 - protein, 9 aa, Homo Sapiens
IEAKQKGYV

SEQ ID NO: 268596 - protein, 9 aa, Homo Sapiens
YRLMIFKLV

SEQ ID NO: 268597 - protein, 9 aa, Homo Sapiens
NSVQYKLLG

SEQ ID NO: 268598 - protein, 9 aa, Homo Sapiens
KIMKTLTLV

SEQ ID NO: 268599 - protein, 9 aa, Homo Sapiens
TDAAIFQSL

SEQ ID NO: 268600 - protein, 9 aa, Homo Sapiens
CSYNQSRER

SEQ ID NO: 268601 - protein, 9 aa, Homo Sapiens
IDEQDTPLV

SEQ ID NO: 268602 - protein, 9 aa, Homo Sapiens
NTLYYYNKQ

SEQ ID NO: 268603 - protein, 9 aa, Homo Sapiens
AYFTCSTHL

SEQ ID NO: 268604 - protein, 9 aa, Homo Sapiens
CKDEMSSVQ

SEQ ID NO: 268605 - protein, 9 aa, Homo Sapiens
IQWLTVHKN

SEQ ID NO: 268606 - protein, 9 aa, Homo Sapiens
RLLGILKEV

SEQ ID NO: 268607 - protein, 9 aa, Homo Sapiens
FDSRGMFIA

SEQ ID NO: 268608 - protein, 9 aa, Homo Sapiens
LVHPDTNQD

SEQ ID NO: 268609 - protein, 9 aa, Homo Sapiens
KNDPVLFAT

SEQ ID NO: 268610 - protein, 9 aa, Homo Sapiens
CHSSLSEMS

SEQ ID NO: 268611 - protein, 9 aa, Homo Sapiens
DMNRTYVIS

SEQ ID NO: 268612 - protein, 9 aa, Homo Sapiens
QKKIQKETS

SEQ ID NO: 268613 - protein, 9 aa, Homo Sapiens
IMPNMLGIF

SEQ ID NO: 268614 - protein, 9 aa, Homo Sapiens
PERKRFHFN

SEQ ID NO: 268615 - protein, 9 aa, Homo Sapiens
SFKGADPTK

SEQ ID NO: 268616 - protein, 9 aa, Homo Sapiens
PQMSLEFPT

SEQ ID NO: 268617 - protein, 9 aa, Homo Sapiens
LDRLGQRVR

SEQ ID NO: 268618 - protein, 9 aa, Homo Sapiens
FVNPYQELP

SEQ ID NO: 268619 - protein, 9 aa, Homo Sapiens
VLKSLVNNY

SEQ ID NO: 268620 - protein, 9 aa, Homo Sapiens
QNLQQDGLD

SEQ ID NO: 268621 - protein, 9 aa, Homo Sapiens
LPAHGPEAH

SEQ ID NO: 268622 - protein, 9 aa, Homo Sapiens
ELTALILAT

SEQ ID NO: 268623 - protein, 9 aa, Homo Sapiens
LLEMKANFS

SEQ ID NO: 268624 - protein, 9 aa, Homo Sapiens
LIDTFQNNS

SEQ ID NO: 268625 - protein, 9 aa, Homo Sapiens
CIAQMFFIH

SEQ ID NO: 268626 - protein, 9 aa, Homo Sapiens
VHTGDKPFK

SEQ ID NO: 268627 - protein, 9 aa, Homo Sapiens
MDTISDRLQ

SEQ ID NO: 268628 - protein, 9 aa, Homo Sapiens
IPPKSLGIE

SEQ ID NO: 268629 - protein, 9 aa, Homo Sapiens
VVFGNNGTL

SEQ ID NO: 268630 - protein, 9 aa, Homo Sapiens
PSVTNYIYV

SEQ ID NO: 268631 - protein, 9 aa, Homo Sapiens
EAEAKAASQ

SEQ ID NO: 268632 - protein, 9 aa, Homo Sapiens
RVVCNQEEK

SEQ ID NO: 268633 - protein, 9 aa, Homo Sapiens
LSLGLFAAG

SEQ ID NO: 268634 - protein, 9 aa, Homo Sapiens
LHPRPFGRP

SEQ ID NO: 268635 - protein, 9 aa, Homo Sapiens
RKIIPLKNV

SEQ ID NO: 268636 - protein, 9 aa, Homo Sapiens
PPRDTAFIL

SEQ ID NO: 268637 - protein, 9 aa, Homo Sapiens
SGAVESALN

SEQ ID NO: 268638 - protein, 9 aa, Homo Sapiens
IKECSITLS

SEQ ID NO: 268639 - protein, 9 aa, Homo Sapiens
SPSALQVLP

SEQ ID NO: 268640 - protein, 9 aa, Homo Sapiens
YQEQKPEHG

SEQ ID NO: 268641 - protein, 9 aa, Homo Sapiens
EGHPMYQRQ

SEQ ID NO: 268642 - protein, 9 aa, Homo Sapiens
SVGEKCACY

SEQ ID NO: 268643 - protein, 9 aa, Homo Sapiens
AKADAILKS

SEQ ID NO: 268644 - protein, 9 aa, Homo Sapiens
ESGEQGGRA

SEQ ID NO: 268645 - protein, 9 aa, Homo Sapiens
PSNMDCFWK

SEQ ID NO: 268646 - protein, 9 aa, Homo Sapiens
VQQAASPVD

SEQ ID NO: 268647 - protein, 9 aa, Homo Sapiens
YECTECGKH

SEQ ID NO: 268648 - protein, 9 aa, Homo Sapiens
EVERDLKKS

SEQ ID NO: 268649 - protein, 9 aa, Homo Sapiens
EQHKCSLKS

SEQ ID NO: 268650 - protein, 9 aa, Homo Sapiens
EDHDDLEKV

SEQ ID NO: 268651 - protein, 9 aa, Homo Sapiens
STFGLLEIA

SEQ ID NO: 268652 - protein, 9 aa, Homo Sapiens
DPPWSRNLT

SEQ ID NO: 268653 - protein, 9 aa, Homo Sapiens
GRGWAIKET

SEQ ID NO: 268654 - protein, 9 aa, Homo Sapiens
AKENIFQAF

SEQ ID NO: 268655 - protein, 9 aa, Homo Sapiens
NKIIYVFYT

SEQ ID NO: 268656 - protein, 9 aa, Homo Sapiens
LTQQEIVAL

SEQ ID NO: 268657 - protein, 9 aa, Homo Sapiens
FPIIRFCHP

SEQ ID NO: 268658 - protein, 9 aa, Homo Sapiens
LWGIVRQGL

SEQ ID NO: 268659 - protein, 9 aa, Homo Sapiens
TLSFTYINS

SEQ ID NO: 268660 - protein, 9 aa, Homo Sapiens
TDNSSPSAE

SEQ ID NO: 268661 - protein, 9 aa, Homo Sapiens
ISRRGHAAP

SEQ ID NO: 268662 - protein, 9 aa, Homo Sapiens
LKSEVMVPV

SEQ ID NO: 268663 - protein, 9 aa, Homo Sapiens
MVALSMVLV

SEQ ID NO: 268664 - protein, 9 aa, Homo Sapiens
WSMYQRLQG

SEQ ID NO: 268665 - protein, 9 aa, Homo Sapiens
CGANAIRRV

SEQ ID NO: 268666 - protein, 9 aa, Homo Sapiens
PEVNEFQRK

SEQ ID NO: 268667 - protein, 9 aa, Homo Sapiens
TIHVSSKEP

SEQ ID NO: 268668 - protein, 9 aa, Homo Sapiens
SGGNIIRVS

SEQ ID NO: 268669 - protein, 9 aa, Homo Sapiens
GLSQVSEVP

SEQ ID NO: 268670 - protein, 9 aa, Homo Sapiens
CANVPGSYY

SEQ ID NO: 268671 - protein, 9 aa, Homo Sapiens
PLKTTTSLE

SEQ ID NO: 268672 - protein, 9 aa, Homo Sapiens
GVLCATGII

SEQ ID NO: 268673 - protein, 9 aa, Homo Sapiens
IAKVKLYDS

SEQ ID NO: 268674 - protein, 9 aa, Homo Sapiens
THDNRVFTD

SEQ ID NO: 268675 - protein, 9 aa, Homo Sapiens
WISLPFCCM

SEQ ID NO: 268676 - protein, 9 aa, Homo Sapiens
RYSRCHSSR

SEQ ID NO: 268677 - protein, 9 aa, Homo Sapiens
WKQKHLPRF

SEQ ID NO: 268678 - protein, 9 aa, Homo Sapiens
WECVLPEED

SEQ ID NO: 268679 - protein, 9 aa, Homo Sapiens
NSAFMEPRY

SEQ ID NO: 268680 - protein, 9 aa, Homo Sapiens
FLLGKKNIS

SEQ ID NO: 268681 - protein, 9 aa, Homo Sapiens
FGEYNFPKQ

SEQ ID NO: 268682 - protein, 9 aa, Homo Sapiens
KKELNHLAV

SEQ ID NO: 268683 - protein, 9 aa, Homo Sapiens
SKVVGPLLF

SEQ ID NO: 268684 - protein, 9 aa, Homo Sapiens
LATVLIPPH

SEQ ID NO: 268685 - protein, 9 aa, Homo Sapiens
RDLSEVLES

SEQ ID NO: 268686 - protein, 9 aa, Homo Sapiens
LSKEGVERE

SEQ ID NO: 268687 - protein, 9 aa, Homo Sapiens
RHRQVPLEG

SEQ ID NO: 268688 - protein, 9 aa, Homo Sapiens
FSWDTVFTL

SEQ ID NO: 268689 - protein, 9 aa, Homo Sapiens
LTTSIQNHV

SEQ ID NO: 268690 - protein, 9 aa, Homo Sapiens
MESGLELKK

SEQ ID NO: 268691 - protein, 9 aa, Homo Sapiens
EHSLSVPCR

SEQ ID NO: 268692 - protein, 9 aa, Homo Sapiens
AHVSRVDAG

SEQ ID NO: 268693 - protein, 9 aa, Homo Sapiens
NRIDENWYE

SEQ ID NO: 268694 - protein, 9 aa, Homo Sapiens
VAWINRCQN

SEQ ID NO: 268695 - protein, 9 aa, Homo Sapiens
RPDTCNPCF

SEQ ID NO: 268696 - protein, 9 aa, Homo Sapiens
NTESTLKTT

SEQ ID NO: 268697 - protein, 9 aa, Homo Sapiens
VYRFVIPSK

SEQ ID NO: 268698 - protein, 9 aa, Homo Sapiens
EHVSFLKTD

SEQ ID NO: 268699 - protein, 9 aa, Homo Sapiens
QVHGLLSCD

SEQ ID NO: 268700 - protein, 9 aa, Homo Sapiens
CDKAFNRLS

SEQ ID NO: 268701 - protein, 9 aa, Homo Sapiens
FQCLNCSAS

SEQ ID NO: 268702 - protein, 9 aa, Homo Sapiens
KENPMTNCS

SEQ ID NO: 268703 - protein, 9 aa, Homo Sapiens
QAASPVDSA

SEQ ID NO: 268704 - protein, 9 aa, Homo Sapiens
KKVYLSSDT

SEQ ID NO: 268705 - protein, 9 aa, Homo Sapiens
GYFCEARDV

SEQ ID NO: 268706 - protein, 9 aa, Homo Sapiens
NQSSDLTKH

SEQ ID NO: 268707 - protein, 9 aa, Homo Sapiens
GRRDCLVEL

SEQ ID NO: 268708 - protein, 9 aa, Homo Sapiens
RLKRVDLEN

SEQ ID NO: 268709 - protein, 9 aa, Homo Sapiens
LRRNIQVLE

SEQ ID NO: 268710 - protein, 9 aa, Homo Sapiens
DNIYHALGS

SEQ ID NO: 268711 - protein, 9 aa, Homo Sapiens
QAEEVVQEI

SEQ ID NO: 268712 - protein, 9 aa, Homo Sapiens
NSVKEVFRA

SEQ ID NO: 268713 - protein, 9 aa, Homo Sapiens
EIYTGEETK

SEQ ID NO: 268714 - protein, 9 aa, Homo Sapiens
EAPSLPPES

SEQ ID NO: 268715 - protein, 9 aa, Homo Sapiens
LLYIMNQVN

SEQ ID NO: 268716 - protein, 9 aa, Homo Sapiens
KGRFTTLVQ

SEQ ID NO: 268717 - protein, 9 aa, Homo Sapiens
LTAIIVSIF

SEQ ID NO: 268718 - protein, 9 aa, Homo Sapiens
SAWNLYLPR

SEQ ID NO: 268719 - protein, 9 aa, Homo Sapiens
GYLRYVHSI

SEQ ID NO: 268720 - protein, 9 aa, Homo Sapiens
EFLDRLGQR

SEQ ID NO: 268721 - protein, 9 aa, Homo Sapiens
GVPVTRICT

SEQ ID NO: 268722 - protein, 9 aa, Homo Sapiens
QAASQSLGP

SEQ ID NO: 268723 - protein, 9 aa, Homo Sapiens
TRHRALIRI

SEQ ID NO: 268724 - protein, 9 aa, Homo Sapiens
LKVHDMLKK

SEQ ID NO: 268725 - protein, 9 aa, Homo Sapiens
VKIGNGQAG

SEQ ID NO: 268726 - protein, 9 aa, Homo Sapiens
ADQMLTYYP

SEQ ID NO: 268727 - protein, 9 aa, Homo Sapiens
PASKPPRAA

SEQ ID NO: 268728 - protein, 9 aa, Homo Sapiens
YTHQFNTED

SEQ ID NO: 268729 - protein, 9 aa, Homo Sapiens
NQDGWEWIK

SEQ ID NO: 268730 - protein, 9 aa, Homo Sapiens
KECEKVFRS

SEQ ID NO: 268731 - protein, 9 aa, Homo Sapiens
TNTHIKTVA

SEQ ID NO: 268732 - protein, 9 aa, Homo Sapiens
HVQELPYGG

SEQ ID NO: 268733 - protein, 9 aa, Homo Sapiens
KQKKKRNKE

SEQ ID NO: 268734 - protein, 9 aa, Homo Sapiens
PCRCVRPGK

SEQ ID NO: 268735 - protein, 9 aa, Homo Sapiens
EANTGNMVI

SEQ ID NO: 268736 - protein, 9 aa, Homo Sapiens
CINSTWDAK

SEQ ID NO: 268737 - protein, 9 aa, Homo Sapiens
GGGFMFPPS

SEQ ID NO: 268738 - protein, 9 aa, Homo Sapiens
RELRPAGNR

SEQ ID NO: 268739 - protein, 9 aa, Homo Sapiens
RKFLNDLEK

SEQ ID NO: 268740 - protein, 9 aa, Homo Sapiens
KTLLHFWLP

SEQ ID NO: 268741 - protein, 9 aa, Homo Sapiens
SYNGVLYEN

SEQ ID NO: 268742 - protein, 9 aa, Homo Sapiens
QSSVQDLIC

SEQ ID NO: 268743 - protein, 9 aa, Homo Sapiens
TKVLHKKFE

SEQ ID NO: 268744 - protein, 9 aa, Homo Sapiens
PCNMKRHVM

SEQ ID NO: 268745 - protein, 9 aa, Homo Sapiens
QNYLIRGRE

SEQ ID NO: 268746 - protein, 9 aa, Homo Sapiens
ERCGYGELL

SEQ ID NO: 268747 - protein, 9 aa, Homo Sapiens
LWQVEADAA

SEQ ID NO: 268748 - protein, 9 aa, Homo Sapiens
PKLTEGQYV

SEQ ID NO: 268749 - protein, 9 aa, Homo Sapiens
GDSFWVSMI

SEQ ID NO: 268750 - protein, 9 aa, Homo Sapiens
AMSYSLCKF

SEQ ID NO: 268751 - protein, 9 aa, Homo Sapiens
ITLPEPCHS

SEQ ID NO: 268752 - protein, 9 aa, Homo Sapiens
TNEIYDENS

SEQ ID NO: 268753 - protein, 9 aa, Homo Sapiens
LLLNHFSRA

SEQ ID NO: 268754 - protein, 9 aa, Homo Sapiens
TVLLPCSQE

SEQ ID NO: 268755 - protein, 9 aa, Homo Sapiens
KIFFVMGIT

SEQ ID NO: 268756 - protein, 9 aa, Homo Sapiens
TAAHYLVGT

SEQ ID NO: 268757 - protein, 9 aa, Homo Sapiens
MAEDSDGAV

SEQ ID NO: 268758 - protein, 9 aa, Homo Sapiens
RADTFDLQI

SEQ ID NO: 268759 - protein, 9 aa, Homo Sapiens
QHQVSEGVS

SEQ ID NO: 268760 - protein, 9 aa, Homo Sapiens
SADTQHSRV

SEQ ID NO: 268761 - protein, 9 aa, Homo Sapiens
LLFLMDVLL

SEQ ID NO: 268762 - protein, 9 aa, Homo Sapiens
GREAEVVMG

SEQ ID NO: 268763 - protein, 9 aa, Homo Sapiens
GKRRCIGKE

SEQ ID NO: 268764 - protein, 9 aa, Homo Sapiens
VYAAAADVL

SEQ ID NO: 268765 - protein, 9 aa, Homo Sapiens
HEKRIALEA

SEQ ID NO: 268766 - protein, 9 aa, Homo Sapiens
ASPKNNIKT

SEQ ID NO: 268767 - protein, 9 aa, Homo Sapiens
ERYNGSVLP

SEQ ID NO: 268768 - protein, 9 aa, Homo Sapiens
MRQHQREVH

SEQ ID NO: 268769 - protein, 9 aa, Homo Sapiens
KGHSVVHPP

SEQ ID NO: 268770 - protein, 9 aa, Homo Sapiens
PQSLNLMEF

SEQ ID NO: 268771 - protein, 9 aa, Homo Sapiens
IYITCEPSP

SEQ ID NO: 268772 - protein, 9 aa, Homo Sapiens
AFLSQSIPE

SEQ ID NO: 268773 - protein, 9 aa, Homo Sapiens
RKQEQRRHT

SEQ ID NO: 268774 - protein, 9 aa, Homo Sapiens
EGKCYCKPH

SEQ ID NO: 268775 - protein, 9 aa, Homo Sapiens
TLQTKLWLS

SEQ ID NO: 268776 - protein, 9 aa, Homo Sapiens
TQGNVGKLS

SEQ ID NO: 268777 - protein, 9 aa, Homo Sapiens
TVGMAPSSP

SEQ ID NO: 268778 - protein, 9 aa, Homo Sapiens
PHKAVTRPE

SEQ ID NO: 268779 - protein, 9 aa, Homo Sapiens
LHIIYGKFL

SEQ ID NO: 268780 - protein, 9 aa, Homo Sapiens
ALNWCEKPI

SEQ ID NO: 268781 - protein, 9 aa, Homo Sapiens
ITPLLSAVD

SEQ ID NO: 268782 - protein, 9 aa, Homo Sapiens
PTFLKAALD

SEQ ID NO: 268783 - protein, 9 aa, Homo Sapiens
FKIMKTLTL

SEQ ID NO: 268784 - protein, 9 aa, Homo Sapiens
KKIEARDGK

SEQ ID NO: 268785 - protein, 9 aa, Homo Sapiens
VVQEIICDD

SEQ ID NO: 268786 - protein, 9 aa, Homo Sapiens
FSFQNHIRI

SEQ ID NO: 268787 - protein, 9 aa, Homo Sapiens
RLSNANKQA

SEQ ID NO: 268788 - protein, 9 aa, Homo Sapiens
AYGDMYDLS

SEQ ID NO: 268789 - protein, 9 aa, Homo Sapiens
EAEENDLLE

SEQ ID NO: 268790 - protein, 9 aa, Homo Sapiens
DGTEEIRQK

SEQ ID NO: 268791 - protein, 9 aa, Homo Sapiens
RELYKARCD

SEQ ID NO: 268792 - protein, 9 aa, Homo Sapiens
GVKCMPYTT

SEQ ID NO: 268793 - protein, 9 aa, Homo Sapiens
GIKLYPFIY

SEQ ID NO: 268794 - protein, 9 aa, Homo Sapiens
LSENTDCLA

SEQ ID NO: 268795 - protein, 9 aa, Homo Sapiens
AQIEAKFDE

SEQ ID NO: 268796 - protein, 9 aa, Homo Sapiens
AELQDIIGK

SEQ ID NO: 268797 - protein, 9 aa, Homo Sapiens
AIIPLPTLK

SEQ ID NO: 268798 - protein, 9 aa, Homo Sapiens
DNYIINCAY

SEQ ID NO: 268799 - protein, 9 aa, Homo Sapiens
KLQTRLEEK

SEQ ID NO: 268800 - protein, 9 aa, Homo Sapiens
TLCDLIFDF

SEQ ID NO: 268801 - protein, 9 aa, Homo Sapiens
PGKSPARGS

SEQ ID NO: 268802 - protein, 9 aa, Homo Sapiens
LMERKLAQT

SEQ ID NO: 268803 - protein, 9 aa, Homo Sapiens
NILRIGNLW

SEQ ID NO: 268804 - protein, 9 aa, Homo Sapiens
CVAQLDFYH

SEQ ID NO: 268805 - protein, 9 aa, Homo Sapiens
EIASSPQES

SEQ ID NO: 268806 - protein, 9 aa, Homo Sapiens
SYCHEARDT

SEQ ID NO: 268807 - protein, 9 aa, Homo Sapiens
DRCSHDLSE

SEQ ID NO: 268808 - protein, 9 aa, Homo Sapiens
NEYTTELKL

SEQ ID NO: 268809 - protein, 9 aa, Homo Sapiens
IEALKDTFN

SEQ ID NO: 268810 - protein, 9 aa, Homo Sapiens
TYWNRIFIH

SEQ ID NO: 268811 - protein, 9 aa, Homo Sapiens
DHSLHKRKI

SEQ ID NO: 268812 - protein, 9 aa, Homo Sapiens
ITDFGMRKE

SEQ ID NO: 268813 - protein, 9 aa, Homo Sapiens
VGVLNGGQR

SEQ ID NO: 268814 - protein, 9 aa, Homo Sapiens
YICRLNWSD

SEQ ID NO: 268815 - protein, 9 aa, Homo Sapiens
EKSPTFSEN

SEQ ID NO: 268816 - protein, 9 aa, Homo Sapiens
TSVSSEFIV

SEQ ID NO: 268817 - protein, 9 aa, Homo Sapiens
RSVPHFAEA

SEQ ID NO: 268818 - protein, 9 aa, Homo Sapiens
TLIFEGRPN

SEQ ID NO: 268819 - protein, 9 aa, Homo Sapiens
TYDPYLIAM

SEQ ID NO: 268820 - protein, 9 aa, Homo Sapiens
ILNIPDTYA

SEQ ID NO: 268821 - protein, 9 aa, Homo Sapiens
LFGAGPASM

SEQ ID NO: 268822 - protein, 9 aa, Homo Sapiens
KKGASPEGF

SEQ ID NO: 268823 - protein, 9 aa, Homo Sapiens
CVNMLFLLF

SEQ ID NO: 268824 - protein, 9 aa, Homo Sapiens
EEVEETKLM

SEQ ID NO: 268825 - protein, 9 aa, Homo Sapiens
CPIIPKLLD

SEQ ID NO: 268826 - protein, 9 aa, Homo Sapiens
LALVDFCCA

SEQ ID NO: 268827 - protein, 9 aa, Homo Sapiens
VRKKFSKDV

SEQ ID NO: 268828 - protein, 9 aa, Homo Sapiens
VDIPDIHER

SEQ ID NO: 268829 - protein, 9 aa, Homo Sapiens
YYYTDNHAS

SEQ ID NO: 268830 - protein, 9 aa, Homo Sapiens
QIGNSHVHY

SEQ ID NO: 268831 - protein, 9 aa, Homo Sapiens
SRPLSMDRM

SEQ ID NO: 268832 - protein, 9 aa, Homo Sapiens
PVYRIDHTF

SEQ ID NO: 268833 - protein, 9 aa, Homo Sapiens
QSSKCLSYQ

SEQ ID NO: 268834 - protein, 9 aa, Homo Sapiens
NQPLETNTE

SEQ ID NO: 268835 - protein, 9 aa, Homo Sapiens
EEWDKMKMG

SEQ ID NO: 268836 - protein, 9 aa, Homo Sapiens
AVKNENQFY

SEQ ID NO: 268837 - protein, 9 aa, Homo Sapiens
AEKASKMTR

SEQ ID NO: 268838 - protein, 9 aa, Homo Sapiens
TAEEKAIAQ

SEQ ID NO: 268839 - protein, 9 aa, Homo Sapiens
GATGSKDDD

SEQ ID NO: 268840 - protein, 9 aa, Homo Sapiens
IQWKPPNDT

SEQ ID NO: 268841 - protein, 9 aa, Homo Sapiens
QLTAYLPDN

SEQ ID NO: 268842 - protein, 9 aa, Homo Sapiens
QIQVQIGAL

SEQ ID NO: 268843 - protein, 9 aa, Homo Sapiens
PSKTSFFLS

SEQ ID NO: 268844 - protein, 9 aa, Homo Sapiens
KKKHDCFNS

SEQ ID NO: 268845 - protein, 9 aa, Homo Sapiens
STKLHLMNV

SEQ ID NO: 268846 - protein, 9 aa, Homo Sapiens
SDYLATSID

SEQ ID NO: 268847 - protein, 9 aa, Homo Sapiens
LCHFGFEVY

SEQ ID NO: 268848 - protein, 9 aa, Homo Sapiens
EIYDPSLKT

SEQ ID NO: 268849 - protein, 9 aa, Homo Sapiens
IPLKNVLCC

SEQ ID NO: 268850 - protein, 9 aa, Homo Sapiens
VSFCGRRKG

SEQ ID NO: 268851 - protein, 9 aa, Homo Sapiens
IPCMHLFHQ

SEQ ID NO: 268852 - protein, 9 aa, Homo Sapiens
DKSWLRHPG

SEQ ID NO: 268853 - protein, 9 aa, Homo Sapiens
IMVSSVAEV

SEQ ID NO: 268854 - protein, 9 aa, Homo Sapiens
SLQDKNCEP

SEQ ID NO: 268855 - protein, 9 aa, Homo Sapiens
DKRHCARNL

SEQ ID NO: 268856 - protein, 9 aa, Homo Sapiens
QWLTVHKNG

SEQ ID NO: 268857 - protein, 9 aa, Homo Sapiens
KKEPDKPID

SEQ ID NO: 268858 - protein, 9 aa, Homo Sapiens
YINDMNASK

SEQ ID NO: 268859 - protein, 9 aa, Homo Sapiens
WRHLLLFCL

SEQ ID NO: 268860 - protein, 9 aa, Homo Sapiens
RERFALKIL

SEQ ID NO: 268861 - protein, 9 aa, Homo Sapiens
LLKKILLRK

SEQ ID NO: 268862 - protein, 9 aa, Homo Sapiens
NFCSLVDYV

SEQ ID NO: 268863 - protein, 9 aa, Homo Sapiens
TGISMHGKI

SEQ ID NO: 268864 - protein, 9 aa, Homo Sapiens
FVLLLCNLS

SEQ ID NO: 268865 - protein, 9 aa, Homo Sapiens
DFLMHWKKR

SEQ ID NO: 268866 - protein, 9 aa, Homo Sapiens
RCSTKYWMS

SEQ ID NO: 268867 - protein, 9 aa, Homo Sapiens
RTRQRVKRS

SEQ ID NO: 268868 - protein, 9 aa, Homo Sapiens
SMASSIITV

SEQ ID NO: 268869 - protein, 9 aa, Homo Sapiens
QAATEEEPH

SEQ ID NO: 268870 - protein, 9 aa, Homo Sapiens
DFSDTEEVF

SEQ ID NO: 268871 - protein, 9 aa, Homo Sapiens
LLKVHGAFM

SEQ ID NO: 268872 - protein, 9 aa, Homo Sapiens
SCNNTLLTE

SEQ ID NO: 268873 - protein, 9 aa, Homo Sapiens
MDDKKPRKC

SEQ ID NO: 268874 - protein, 9 aa, Homo Sapiens
ACTNHQPAH

SEQ ID NO: 268875 - protein, 9 aa, Homo Sapiens
PKPHVSGRP

SEQ ID NO: 268876 - protein, 9 aa, Homo Sapiens
ERKLFDKTC

SEQ ID NO: 268877 - protein, 9 aa, Homo Sapiens
RLSYNKLTD

SEQ ID NO: 268878 - protein, 9 aa, Homo Sapiens
LPTTITLAA

SEQ ID NO: 268879 - protein, 9 aa, Homo Sapiens
SISEDSEQR

SEQ ID NO: 268880 - protein, 9 aa, Homo Sapiens
ELCLEQNNT

SEQ ID NO: 268881 - protein, 9 aa, Homo Sapiens
KGKAEYNVL

SEQ ID NO: 268882 - protein, 9 aa, Homo Sapiens
DPLFRSAQP

SEQ ID NO: 268883 - protein, 9 aa, Homo Sapiens
AKAAKDAQE

SEQ ID NO: 268884 - protein, 9 aa, Homo Sapiens
RMSRSDAET

SEQ ID NO: 268885 - protein, 9 aa, Homo Sapiens
HPVVESLQK

SEQ ID NO: 268886 - protein, 9 aa, Homo Sapiens
NEQLKVNHE

SEQ ID NO: 268887 - protein, 9 aa, Homo Sapiens
ISSATESRK

SEQ ID NO: 268888 - protein, 9 aa, Homo Sapiens
CTENEASQY

SEQ ID NO: 268889 - protein, 9 aa, Homo Sapiens
VQSLCTISN

SEQ ID NO: 268890 - protein, 9 aa, Homo Sapiens
IGKLPVHRF

SEQ ID NO: 268891 - protein, 9 aa, Homo Sapiens
CSVIFHDQF

SEQ ID NO: 268892 - protein, 9 aa, Homo Sapiens
YYPHVRISP

SEQ ID NO: 268893 - protein, 9 aa, Homo Sapiens
ITFSHSEGP

SEQ ID NO: 268894 - protein, 9 aa, Homo Sapiens
GPLSTTAVW

SEQ ID NO: 268895 - protein, 9 aa, Homo Sapiens
FQLESNKEG

SEQ ID NO: 268896 - protein, 9 aa, Homo Sapiens
YDFFRYVKM

SEQ ID NO: 268897 - protein, 9 aa, Homo Sapiens
LVILSTLLI

SEQ ID NO: 268898 - protein, 9 aa, Homo Sapiens
SSSSLYGGE

SEQ ID NO: 268899 - protein, 9 aa, Homo Sapiens
EKGIHILEA

SEQ ID NO: 268900 - protein, 9 aa, Homo Sapiens
IFFPDAPWG

SEQ ID NO: 268901 - protein, 9 aa, Homo Sapiens
EDVLQRCQE

SEQ ID NO: 268902 - protein, 9 aa, Homo Sapiens
VIPSKAFAS

SEQ ID NO: 268903 - protein, 9 aa, Homo Sapiens
GESQGDLRM

SEQ ID NO: 268904 - protein, 9 aa, Homo Sapiens
QQEKIELMR

SEQ ID NO: 268905 - protein, 9 aa, Homo Sapiens
AIMLGKCDP

SEQ ID NO: 268906 - protein, 9 aa, Homo Sapiens
WMTQSLTEE

SEQ ID NO: 268907 - protein, 9 aa, Homo Sapiens
EPPIVARCV

SEQ ID NO: 268908 - protein, 9 aa, Homo Sapiens
DDTNILPGN

SEQ ID NO: 268909 - protein, 9 aa, Homo Sapiens
VQRGPAQKK

SEQ ID NO: 268910 - protein, 9 aa, Homo Sapiens
SPDSKAKTI

SEQ ID NO: 268911 - protein, 9 aa, Homo Sapiens
HPVIIYPDR

SEQ ID NO: 268912 - protein, 9 aa, Homo Sapiens
INRVVHNAG

SEQ ID NO: 268913 - protein, 9 aa, Homo Sapiens
TTILCVGPS

SEQ ID NO: 268914 - protein, 9 aa, Homo Sapiens
KKMCDLLFV

SEQ ID NO: 268915 - protein, 9 aa, Homo Sapiens
SLPGFQNLH

SEQ ID NO: 268916 - protein, 9 aa, Homo Sapiens
PVVESLQKQ

SEQ ID NO: 268917 - protein, 9 aa, Homo Sapiens
SSEMDLRCV

SEQ ID NO: 268918 - protein, 9 aa, Homo Sapiens
GNIYAYMEK

SEQ ID NO: 268919 - protein, 9 aa, Homo Sapiens
LTRHKIMHT

SEQ ID NO: 268920 - protein, 9 aa, Homo Sapiens
LPEFFRDCF

SEQ ID NO: 268921 - protein, 9 aa, Homo Sapiens
LLSKFRLAT

SEQ ID NO: 268922 - protein, 9 aa, Homo Sapiens
LEILLTSGL

SEQ ID NO: 268923 - protein, 9 aa, Homo Sapiens
GGLSQVSEV

SEQ ID NO: 268924 - protein, 9 aa, Homo Sapiens
SEKIWIEII

SEQ ID NO: 268925 - protein, 9 aa, Homo Sapiens
SEQASNIYS

SEQ ID NO: 268926 - protein, 9 aa, Homo Sapiens
IVEKLIKKC

SEQ ID NO: 268927 - protein, 9 aa, Homo Sapiens
EERRKRRSI

SEQ ID NO: 268928 - protein, 9 aa, Homo Sapiens
MADAVLAQV

SEQ ID NO: 268929 - protein, 9 aa, Homo Sapiens
QEEFVKAAG

SEQ ID NO: 268930 - protein, 9 aa, Homo Sapiens
EILNGRHPY

SEQ ID NO: 268931 - protein, 9 aa, Homo Sapiens
WRLRGENFQ

SEQ ID NO: 268932 - protein, 9 aa, Homo Sapiens
LNGGRPFLQ

SEQ ID NO: 268933 - protein, 9 aa, Homo Sapiens
WPDQSIKYS

SEQ ID NO: 268934 - protein, 9 aa, Homo Sapiens
VSIPGARWI

SEQ ID NO: 268935 - protein, 9 aa, Homo Sapiens
QSLMYPALQ

SEQ ID NO: 268936 - protein, 9 aa, Homo Sapiens
WENLNMSDW

SEQ ID NO: 268937 - protein, 9 aa, Homo Sapiens
RKAHVKRPA

SEQ ID NO: 268938 - protein, 9 aa, Homo Sapiens
GLLIIGIYC

SEQ ID NO: 268939 - protein, 9 aa, Homo Sapiens
YESYGIEHL

SEQ ID NO: 268940 - protein, 9 aa, Homo Sapiens
FIPDLIDYK

SEQ ID NO: 268941 - protein, 9 aa, Homo Sapiens
KAITLILSG

SEQ ID NO: 268942 - protein, 9 aa, Homo Sapiens
LLELIRDAP

SEQ ID NO: 268943 - protein, 9 aa, Homo Sapiens
TLQIMLQSG

SEQ ID NO: 268944 - protein, 9 aa, Homo Sapiens
IYQYIQSHF

SEQ ID NO: 268945 - protein, 9 aa, Homo Sapiens
KVFYYKMTG

SEQ ID NO: 268946 - protein, 9 aa, Homo Sapiens
GLDWEYKDA

SEQ ID NO: 268947 - protein, 9 aa, Homo Sapiens
GKTSLKIWS

SEQ ID NO: 268948 - protein, 9 aa, Homo Sapiens
TAPLYFCLG

SEQ ID NO: 268949 - protein, 9 aa, Homo Sapiens
EKPYMCREC

SEQ ID NO: 268950 - protein, 9 aa, Homo Sapiens
KPRLSFALE

SEQ ID NO: 268951 - protein, 9 aa, Homo Sapiens
SENPKNTDT

SEQ ID NO: 268952 - protein, 9 aa, Homo Sapiens
RTITGFQSP

SEQ ID NO: 268953 - protein, 9 aa, Homo Sapiens
DDDVFFGPF

SEQ ID NO: 268954 - protein, 9 aa, Homo Sapiens
VVNKLDREK

SEQ ID NO: 268955 - protein, 9 aa, Homo Sapiens
EYLQRLDFY

SEQ ID NO: 268956 - protein, 9 aa, Homo Sapiens
EKEKYDVWA

SEQ ID NO: 268957 - protein, 9 aa, Homo Sapiens
SKKNLLEGE

SEQ ID NO: 268958 - protein, 9 aa, Homo Sapiens
EFVNQVLEN

SEQ ID NO: 268959 - protein, 9 aa, Homo Sapiens
IFFQKYYQL

SEQ ID NO: 268960 - protein, 9 aa, Homo Sapiens
PINAHSPGF

SEQ ID NO: 268961 - protein, 9 aa, Homo Sapiens
YIECAKKLY

SEQ ID NO: 268962 - protein, 9 aa, Homo Sapiens
DFYHFLGST

SEQ ID NO: 268963 - protein, 9 aa, Homo Sapiens
VPETWIILN

SEQ ID NO: 268964 - protein, 9 aa, Homo Sapiens
LTGIKSMDQ

SEQ ID NO: 268965 - protein, 9 aa, Homo Sapiens
FETKKVLQQ

SEQ ID NO: 268966 - protein, 9 aa, Homo Sapiens
LAHVDSQLH

SEQ ID NO: 268967 - protein, 9 aa, Homo Sapiens
FVFMATPNL

SEQ ID NO: 268968 - protein, 9 aa, Homo Sapiens
KFIFRKNYA

SEQ ID NO: 268969 - protein, 9 aa, Homo Sapiens
SMSEDVRQH

SEQ ID NO: 268970 - protein, 9 aa, Homo Sapiens
SFTATAKFR

SEQ ID NO: 268971 - protein, 9 aa, Homo Sapiens
VTYTTVGPS

SEQ ID NO: 268972 - protein, 9 aa, Homo Sapiens
TVQVQWEIN

SEQ ID NO: 268973 - protein, 9 aa, Homo Sapiens
EAIALAALH

SEQ ID NO: 268974 - protein, 9 aa, Homo Sapiens
RSAAENAVL

SEQ ID NO: 268975 - protein, 9 aa, Homo Sapiens
HPKNVPPDI

SEQ ID NO: 268976 - protein, 9 aa, Homo Sapiens
SIYTSSQGS

SEQ ID NO: 268977 - protein, 9 aa, Homo Sapiens
KVSLQDKNC

SEQ ID NO: 268978 - protein, 9 aa, Homo Sapiens
SENANKGRE

SEQ ID NO: 268979 - protein, 9 aa, Homo Sapiens
SDMFYFCRK

SEQ ID NO: 268980 - protein, 9 aa, Homo Sapiens
GKEYQAKDV

SEQ ID NO: 268981 - protein, 9 aa, Homo Sapiens
PVNCFRQLF

SEQ ID NO: 268982 - protein, 9 aa, Homo Sapiens
ENDYSFEDL

SEQ ID NO: 268983 - protein, 9 aa, Homo Sapiens
TCQGQWQAG

SEQ ID NO: 268984 - protein, 9 aa, Homo Sapiens
VWGLICISY

SEQ ID NO: 268985 - protein, 9 aa, Homo Sapiens
LGSSAAYLV

SEQ ID NO: 268986 - protein, 9 aa, Homo Sapiens
KAPKKIRIS

SEQ ID NO: 268987 - protein, 9 aa, Homo Sapiens
NLEKEKYDV

SEQ ID NO: 268988 - protein, 9 aa, Homo Sapiens
QEYKESASS

SEQ ID NO: 268989 - protein, 9 aa, Homo Sapiens
YSGGNIIRV

SEQ ID NO: 268990 - protein, 9 aa, Homo Sapiens
TFHIVERLA

SEQ ID NO: 268991 - protein, 9 aa, Homo Sapiens
LEHLDLNSN

SEQ ID NO: 268992 - protein, 9 aa, Homo Sapiens
AWTGKIFAQ

SEQ ID NO: 268993 - protein, 9 aa, Homo Sapiens
FNEPEDNFW

SEQ ID NO: 268994 - protein, 9 aa, Homo Sapiens
SQESNRISQ

SEQ ID NO: 268995 - protein, 9 aa, Homo Sapiens
KAHISKLAE

SEQ ID NO: 268996 - protein, 9 aa, Homo Sapiens
GDTATKESY

SEQ ID NO: 268997 - protein, 9 aa, Homo Sapiens
LEAGVAIAA

SEQ ID NO: 268998 - protein, 9 aa, Homo Sapiens
NFKQCFRDF

SEQ ID NO: 268999 - protein, 9 aa, Homo Sapiens
SITLQATRV

SEQ ID NO: 269000 - protein, 9 aa, Homo Sapiens
DTMKLPDIS

SEQ ID NO: 269001 - protein, 9 aa, Homo Sapiens
VVFITVPFM

SEQ ID NO: 269002 - protein, 9 aa, Homo Sapiens
AKNTSKLLF

SEQ ID NO: 269003 - protein, 9 aa, Homo Sapiens
EAAETKFEA

SEQ ID NO: 269004 - protein, 9 aa, Homo Sapiens
MKMTNRAAR

SEQ ID NO: 269005 - protein, 9 aa, Homo Sapiens
LRADYDIAS

SEQ ID NO: 269006 - protein, 9 aa, Homo Sapiens
VSLILLGKA

SEQ ID NO: 269007 - protein, 9 aa, Homo Sapiens
SNLIVLGLP

SEQ ID NO: 269008 - protein, 9 aa, Homo Sapiens
FFFFFGRSE

SEQ ID NO: 269009 - protein, 9 aa, Homo Sapiens
AVPHTADQD

SEQ ID NO: 269010 - protein, 9 aa, Homo Sapiens
DDIVTEFGG

SEQ ID NO: 269011 - protein, 9 aa, Homo Sapiens
VLSESMNDR

SEQ ID NO: 269012 - protein, 9 aa, Homo Sapiens
CLGNLAFLD

SEQ ID NO: 269013 - protein, 9 aa, Homo Sapiens
KDYRKIRFV

SEQ ID NO: 269014 - protein, 9 aa, Homo Sapiens
SEDSGGGDN

SEQ ID NO: 269015 - protein, 9 aa, Homo Sapiens
IHGNDTSNT

SEQ ID NO: 269016 - protein, 9 aa, Homo Sapiens
MVLNFTTMD

SEQ ID NO: 269017 - protein, 9 aa, Homo Sapiens
QERSQIKNE

SEQ ID NO: 269018 - protein, 9 aa, Homo Sapiens
SAQKENTAA

SEQ ID NO: 269019 - protein, 9 aa, Homo Sapiens
LEISSLLIN

SEQ ID NO: 269020 - protein, 9 aa, Homo Sapiens
EISDDEEDK

SEQ ID NO: 269021 - protein, 9 aa, Homo Sapiens
SAGPGRVML

SEQ ID NO: 269022 - protein, 9 aa, Homo Sapiens
SVEETADLT

SEQ ID NO: 269023 - protein, 9 aa, Homo Sapiens
MKERDNRRR

SEQ ID NO: 269024 - protein, 9 aa, Homo Sapiens
IFNGIPEWV

SEQ ID NO: 269025 - protein, 9 aa, Homo Sapiens
YLLCDDTIE

SEQ ID NO: 269026 - protein, 9 aa, Homo Sapiens
GEGPKAHIS

SEQ ID NO: 269027 - protein, 9 aa, Homo Sapiens
GLPDLLELI

SEQ ID NO: 269028 - protein, 9 aa, Homo Sapiens
DEDINGILE

SEQ ID NO: 269029 - protein, 9 aa, Homo Sapiens
LRGENFQCL

SEQ ID NO: 269030 - protein, 9 aa, Homo Sapiens
VTFHIVERL

SEQ ID NO: 269031 - protein, 9 aa, Homo Sapiens
AKLYRNNLN

SEQ ID NO: 269032 - protein, 9 aa, Homo Sapiens
SRSGKTLGK

SEQ ID NO: 269033 - protein, 9 aa, Homo Sapiens
LINTYLLHM

SEQ ID NO: 269034 - protein, 9 aa, Homo Sapiens
PNIPKQFVP

SEQ ID NO: 269035 - protein, 9 aa, Homo Sapiens
RALCSLDLA

SEQ ID NO: 269036 - protein, 9 aa, Homo Sapiens
ICIVYPCRC

SEQ ID NO: 269037 - protein, 9 aa, Homo Sapiens
LYTEPLENQ

SEQ ID NO: 269038 - protein, 9 aa, Homo Sapiens
KKQSVVGML

SEQ ID NO: 269039 - protein, 9 aa, Homo Sapiens
ANPNRILPD

SEQ ID NO: 269040 - protein, 9 aa, Homo Sapiens
HKMVWNQTT

SEQ ID NO: 269041 - protein, 9 aa, Homo Sapiens
LFTKYQDHG

SEQ ID NO: 269042 - protein, 9 aa, Homo Sapiens
VPIYMSYDS

SEQ ID NO: 269043 - protein, 9 aa, Homo Sapiens
KRLSDVTGN

SEQ ID NO: 269044 - protein, 9 aa, Homo Sapiens
AALSEQSPV

SEQ ID NO: 269045 - protein, 9 aa, Homo Sapiens
WTKDELLNE

SEQ ID NO: 269046 - protein, 9 aa, Homo Sapiens
RQSFRRICK

SEQ ID NO: 269047 - protein, 9 aa, Homo Sapiens
CVALPMSLL

SEQ ID NO: 269048 - protein, 9 aa, Homo Sapiens
EQSNGGSPC

SEQ ID NO: 269049 - protein, 9 aa, Homo Sapiens
EVLKEKTKE

SEQ ID NO: 269050 - protein, 9 aa, Homo Sapiens
QEMEVVTQG

SEQ ID NO: 269051 - protein, 9 aa, Homo Sapiens
SNQREEQDK

SEQ ID NO: 269052 - protein, 9 aa, Homo Sapiens
NKDRGLKGA

SEQ ID NO: 269053 - protein, 9 aa, Homo Sapiens
RKKSKKEIK

SEQ ID NO: 269054 - protein, 9 aa, Homo Sapiens
AENQSKPEK

SEQ ID NO: 269055 - protein, 9 aa, Homo Sapiens
HFLEKQLKK

SEQ ID NO: 269056 - protein, 9 aa, Homo Sapiens
VVFLQPRGN

SEQ ID NO: 269057 - protein, 9 aa, Homo Sapiens
LLFCIFSRD

SEQ ID NO: 269058 - protein, 9 aa, Homo Sapiens
NSPLTGKFT

SEQ ID NO: 269059 - protein, 9 aa, Homo Sapiens
KVANKDTEK

SEQ ID NO: 269060 - protein, 9 aa, Homo Sapiens
VHLTELSLV

SEQ ID NO: 269061 - protein, 9 aa, Homo Sapiens
SYYSLEYLN

SEQ ID NO: 269062 - protein, 9 aa, Homo Sapiens
PPPLTDIDS

SEQ ID NO: 269063 - protein, 9 aa, Homo Sapiens
VSQVVHAKE

SEQ ID NO: 269064 - protein, 9 aa, Homo Sapiens
PFGRPVSLP

SEQ ID NO: 269065 - protein, 9 aa, Homo Sapiens
SIYTTLFNN

SEQ ID NO: 269066 - protein, 9 aa, Homo Sapiens
LSAFIFFIA

SEQ ID NO: 269067 - protein, 9 aa, Homo Sapiens
SLLLLPQQL

SEQ ID NO: 269068 - protein, 9 aa, Homo Sapiens
ALCILLYPD

SEQ ID NO: 269069 - protein, 9 aa, Homo Sapiens
DQHDLSWSM

SEQ ID NO: 269070 - protein, 9 aa, Homo Sapiens
FCRIRPIFV

SEQ ID NO: 269071 - protein, 9 aa, Homo Sapiens
KPYYCTIRG

SEQ ID NO: 269072 - protein, 9 aa, Homo Sapiens
TKNCLKHHV

SEQ ID NO: 269073 - protein, 9 aa, Homo Sapiens
ENQFYLKEV

SEQ ID NO: 269074 - protein, 9 aa, Homo Sapiens
LYHNLMNSE

SEQ ID NO: 269075 - protein, 9 aa, Homo Sapiens
INSHLPSGE

SEQ ID NO: 269076 - protein, 9 aa, Homo Sapiens
PDSTRDGKV

SEQ ID NO: 269077 - protein, 9 aa, Homo Sapiens
SFVVCTTGW

SEQ ID NO: 269078 - protein, 9 aa, Homo Sapiens
ECFIIYACF

SEQ ID NO: 269079 - protein, 9 aa, Homo Sapiens
HHLSNVQFR

SEQ ID NO: 269080 - protein, 9 aa, Homo Sapiens
RRLFELFVL

SEQ ID NO: 269081 - protein, 9 aa, Homo Sapiens
SPSFDQPHQ

SEQ ID NO: 269082 - protein, 9 aa, Homo Sapiens
FSRYGVSLC

SEQ ID NO: 269083 - protein, 9 aa, Homo Sapiens
EDSGSKKRF

SEQ ID NO: 269084 - protein, 9 aa, Homo Sapiens
HKNNIMENE

SEQ ID NO: 269085 - protein, 9 aa, Homo Sapiens
PSFISGTAP

SEQ ID NO: 269086 - protein, 9 aa, Homo Sapiens
YDTLDQLLQ

SEQ ID NO: 269087 - protein, 9 aa, Homo Sapiens
EAQDAASSD

SEQ ID NO: 269088 - protein, 9 aa, Homo Sapiens
HVHNFMMDN

SEQ ID NO: 269089 - protein, 9 aa, Homo Sapiens
RWDEASFQT

SEQ ID NO: 269090 - protein, 9 aa, Homo Sapiens
DPSNHSFFS

SEQ ID NO: 269091 - protein, 9 aa, Homo Sapiens
LRKSNSPGT

SEQ ID NO: 269092 - protein, 9 aa, Homo Sapiens
PASFKSTKS

SEQ ID NO: 269093 - protein, 9 aa, Homo Sapiens
NPTLAECWA

SEQ ID NO: 269094 - protein, 9 aa, Homo Sapiens
CSPDLVNWI

SEQ ID NO: 269095 - protein, 9 aa, Homo Sapiens
LWREEHLDN

SEQ ID NO: 269096 - protein, 9 aa, Homo Sapiens
DSLPDVSDD

SEQ ID NO: 269097 - protein, 9 aa, Homo Sapiens
WRCDQEPCL

SEQ ID NO: 269098 - protein, 9 aa, Homo Sapiens
CMWLQVLEL

SEQ ID NO: 269099 - protein, 9 aa, Homo Sapiens
VANSLSLVG

SEQ ID NO: 269100 - protein, 9 aa, Homo Sapiens
RSNDGAYSR

SEQ ID NO: 269101 - protein, 9 aa, Homo Sapiens
ALWTVAQAL

SEQ ID NO: 269102 - protein, 9 aa, Homo Sapiens
INEAKIAEC

SEQ ID NO: 269103 - protein, 9 aa, Homo Sapiens
MAAAKSKYS

SEQ ID NO: 269104 - protein, 9 aa, Homo Sapiens
PTLVDKMQD

SEQ ID NO: 269105 - protein, 9 aa, Homo Sapiens
VIAPSLPTN

SEQ ID NO: 269106 - protein, 9 aa, Homo Sapiens
SKIHEKVFS

SEQ ID NO: 269107 - protein, 9 aa, Homo Sapiens
NVPGSYYCT

SEQ ID NO: 269108 - protein, 9 aa, Homo Sapiens
LKTTQPENV

SEQ ID NO: 269109 - protein, 9 aa, Homo Sapiens
TTTKWVAMI

SEQ ID NO: 269110 - protein, 9 aa, Homo Sapiens
LLNPELIWP

SEQ ID NO: 269111 - protein, 9 aa, Homo Sapiens
LFNLCSRKF

SEQ ID NO: 269112 - protein, 9 aa, Homo Sapiens
LVKDDIAYV

SEQ ID NO: 269113 - protein, 9 aa, Homo Sapiens
QRKMCKRIL

SEQ ID NO: 269114 - protein, 9 aa, Homo Sapiens
YNAQKSQQM

SEQ ID NO: 269115 - protein, 9 aa, Homo Sapiens
EDEDSASES

SEQ ID NO: 269116 - protein, 9 aa, Homo Sapiens
MLRVASSYL

SEQ ID NO: 269117 - protein, 9 aa, Homo Sapiens
TSYDNREKS

SEQ ID NO: 269118 - protein, 9 aa, Homo Sapiens
SQSQYLIVH

SEQ ID NO: 269119 - protein, 9 aa, Homo Sapiens
FGEGDNLPE

SEQ ID NO: 269120 - protein, 9 aa, Homo Sapiens
CHQHMVGRR

SEQ ID NO: 269121 - protein, 9 aa, Homo Sapiens
LEPFKALLE

SEQ ID NO: 269122 - protein, 9 aa, Homo Sapiens
FSNCPFSWI

SEQ ID NO: 269123 - protein, 9 aa, Homo Sapiens
QSPDLVGPS

SEQ ID NO: 269124 - protein, 9 aa, Homo Sapiens
LDFFRSKKE

SEQ ID NO: 269125 - protein, 9 aa, Homo Sapiens
LDENFKQCF

SEQ ID NO: 269126 - protein, 9 aa, Homo Sapiens
VSQSISGYP

SEQ ID NO: 269127 - protein, 9 aa, Homo Sapiens
NAAKLNVSL

SEQ ID NO: 269128 - protein, 9 aa, Homo Sapiens
TNTSQESKA

SEQ ID NO: 269129 - protein, 9 aa, Homo Sapiens
LDPWKSAYS

SEQ ID NO: 269130 - protein, 9 aa, Homo Sapiens
IGKRLNIHL

SEQ ID NO: 269131 - protein, 9 aa, Homo Sapiens
GEYIQAGPN

SEQ ID NO: 269132 - protein, 9 aa, Homo Sapiens
YHTAKTRAL

SEQ ID NO: 269133 - protein, 9 aa, Homo Sapiens
IILGLVQTE

SEQ ID NO: 269134 - protein, 9 aa, Homo Sapiens
VPAIQNAHN

SEQ ID NO: 269135 - protein, 9 aa, Homo Sapiens
QAVHGELPP

SEQ ID NO: 269136 - protein, 9 aa, Homo Sapiens
TNKGDGLSN

SEQ ID NO: 269137 - protein, 9 aa, Homo Sapiens
LFVELFISY

SEQ ID NO: 269138 - protein, 9 aa, Homo Sapiens
GIWDNFHYW

SEQ ID NO: 269139 - protein, 9 aa, Homo Sapiens
HRGQKGLRG

SEQ ID NO: 269140 - protein, 9 aa, Homo Sapiens
AMFQSIPNC

SEQ ID NO: 269141 - protein, 9 aa, Homo Sapiens
IKGIEHLSL

SEQ ID NO: 269142 - protein, 9 aa, Homo Sapiens
SFNRIEHAG

SEQ ID NO: 269143 - protein, 9 aa, Homo Sapiens
EDKSTKGST

SEQ ID NO: 269144 - protein, 9 aa, Homo Sapiens
LKYDYPLDV

SEQ ID NO: 269145 - protein, 9 aa, Homo Sapiens
PFCVLTITL

SEQ ID NO: 269146 - protein, 9 aa, Homo Sapiens
TQICAYFGA

SEQ ID NO: 269147 - protein, 9 aa, Homo Sapiens
SREAVNRQV

SEQ ID NO: 269148 - protein, 9 aa, Homo Sapiens
NSIIDQGLT

SEQ ID NO: 269149 - protein, 9 aa, Homo Sapiens
VYFGRCSLS

SEQ ID NO: 269150 - protein, 9 aa, Homo Sapiens
SKMRKFFSF

SEQ ID NO: 269151 - protein, 9 aa, Homo Sapiens
RNNVTQALS

SEQ ID NO: 269152 - protein, 9 aa, Homo Sapiens
FEVPSKDKL

SEQ ID NO: 269153 - protein, 9 aa, Homo Sapiens
ESYQEQKPE

SEQ ID NO: 269154 - protein, 9 aa, Homo Sapiens
LQQNLRQLV

SEQ ID NO: 269155 - protein, 9 aa, Homo Sapiens
SSALTIHNR

SEQ ID NO: 269156 - protein, 9 aa, Homo Sapiens
CSRCHIISQ

SEQ ID NO: 269157 - protein, 9 aa, Homo Sapiens
NSVPNKDLE

SEQ ID NO: 269158 - protein, 9 aa, Homo Sapiens
NSHLAQHQN

SEQ ID NO: 269159 - protein, 9 aa, Homo Sapiens
WVVSHDFPK

SEQ ID NO: 269160 - protein, 9 aa, Homo Sapiens
QITNTAYQC

SEQ ID NO: 269161 - protein, 9 aa, Homo Sapiens
PINQSIKDT

SEQ ID NO: 269162 - protein, 9 aa, Homo Sapiens
CAWHWRNRN

SEQ ID NO: 269163 - protein, 9 aa, Homo Sapiens
IKPTSFLCL

SEQ ID NO: 269164 - protein, 9 aa, Homo Sapiens
QQYQQELHQ

SEQ ID NO: 269165 - protein, 9 aa, Homo Sapiens
ILDPNDPLG

SEQ ID NO: 269166 - protein, 9 aa, Homo Sapiens
TVPAMDPNA

SEQ ID NO: 269167 - protein, 9 aa, Homo Sapiens
RRETTRLFC

SEQ ID NO: 269168 - protein, 9 aa, Homo Sapiens
NFLLGVLQR

SEQ ID NO: 269169 - protein, 9 aa, Homo Sapiens
LRKHNLISP

SEQ ID NO: 269170 - protein, 9 aa, Homo Sapiens
SRLSQILRI

SEQ ID NO: 269171 - protein, 9 aa, Homo Sapiens
LCGLPAAGS

SEQ ID NO: 269172 - protein, 9 aa, Homo Sapiens
QHKCSLKSL

SEQ ID NO: 269173 - protein, 9 aa, Homo Sapiens
ITQVKNYLS

SEQ ID NO: 269174 - protein, 9 aa, Homo Sapiens
PYEPKCHSL

SEQ ID NO: 269175 - protein, 9 aa, Homo Sapiens
VITRYRLVP

SEQ ID NO: 269176 - protein, 9 aa, Homo Sapiens
AIKQCLWFP

SEQ ID NO: 269177 - protein, 9 aa, Homo Sapiens
KQSLVYGKK

SEQ ID NO: 269178 - protein, 9 aa, Homo Sapiens
GHYDLMERK

SEQ ID NO: 269179 - protein, 9 aa, Homo Sapiens
YLIPPMDLL

SEQ ID NO: 269180 - protein, 9 aa, Homo Sapiens
KYRMYEEQR

SEQ ID NO: 269181 - protein, 9 aa, Homo Sapiens
IVIGTVALA

SEQ ID NO: 269182 - protein, 9 aa, Homo Sapiens
LKTKKNYNN

SEQ ID NO: 269183 - protein, 9 aa, Homo Sapiens
CSKLRKKLV

SEQ ID NO: 269184 - protein, 9 aa, Homo Sapiens
PSSEKLEEE

SEQ ID NO: 269185 - protein, 9 aa, Homo Sapiens
TRNQHVSTS

SEQ ID NO: 269186 - protein, 9 aa, Homo Sapiens
SLEPRREVC

SEQ ID NO: 269187 - protein, 9 aa, Homo Sapiens
SISCLFCGR

SEQ ID NO: 269188 - protein, 9 aa, Homo Sapiens
TSQVILHLI

SEQ ID NO: 269189 - protein, 9 aa, Homo Sapiens
SITSDTAER

SEQ ID NO: 269190 - protein, 9 aa, Homo Sapiens
EEEPPVASE

SEQ ID NO: 269191 - protein, 9 aa, Homo Sapiens
EMYRIVSQK

SEQ ID NO: 269192 - protein, 9 aa, Homo Sapiens
RLFIGGKIN

SEQ ID NO: 269193 - protein, 9 aa, Homo Sapiens
SLPTKEKEA

SEQ ID NO: 269194 - protein, 9 aa, Homo Sapiens
RLKKMKTSE

SEQ ID NO: 269195 - protein, 9 aa, Homo Sapiens
TDCYIYNKP

SEQ ID NO: 269196 - protein, 9 aa, Homo Sapiens
ARCECSAHN

SEQ ID NO: 269197 - protein, 9 aa, Homo Sapiens
SFLQLHPII

SEQ ID NO: 269198 - protein, 9 aa, Homo Sapiens
SLALATNSA

SEQ ID NO: 269199 - protein, 9 aa, Homo Sapiens
ILLKLKLLV

SEQ ID NO: 269200 - protein, 9 aa, Homo Sapiens
GARRKIFLP

SEQ ID NO: 269201 - protein, 9 aa, Homo Sapiens
QDNCKETAK

SEQ ID NO: 269202 - protein, 9 aa, Homo Sapiens
QVIQIELDH

SEQ ID NO: 269203 - protein, 9 aa, Homo Sapiens
SPSSDYLLS

SEQ ID NO: 269204 - protein, 9 aa, Homo Sapiens
DLDTKRLSK

SEQ ID NO: 269205 - protein, 9 aa, Homo Sapiens
TLGGTSTSV

SEQ ID NO: 269206 - protein, 9 aa, Homo Sapiens
KNHKLAEML

SEQ ID NO: 269207 - protein, 9 aa, Homo Sapiens
LQGRLFISH

SEQ ID NO: 269208 - protein, 9 aa, Homo Sapiens
NSTIIKHQR

SEQ ID NO: 269209 - protein, 9 aa, Homo Sapiens
LRQSFRRIC

SEQ ID NO: 269210 - protein, 9 aa, Homo Sapiens
HNKILKGKA

SEQ ID NO: 269211 - protein, 9 aa, Homo Sapiens
SALKLYQYL

SEQ ID NO: 269212 - protein, 9 aa, Homo Sapiens
PVPKKSPTS

SEQ ID NO: 269213 - protein, 9 aa, Homo Sapiens
ESPVNCFRQ

SEQ ID NO: 269214 - protein, 9 aa, Homo Sapiens
YIKGVLMFV

SEQ ID NO: 269215 - protein, 9 aa, Homo Sapiens
QYGSRETYG

SEQ ID NO: 269216 - protein, 9 aa, Homo Sapiens
RYEKLFTVE

SEQ ID NO: 269217 - protein, 9 aa, Homo Sapiens
SSFESTANN

SEQ ID NO: 269218 - protein, 9 aa, Homo Sapiens
FINASKQYL

SEQ ID NO: 269219 - protein, 9 aa, Homo Sapiens
CLCKDSLDN

SEQ ID NO: 269220 - protein, 9 aa, Homo Sapiens
LSEFQRKYE

SEQ ID NO: 269221 - protein, 9 aa, Homo Sapiens
NVRYIVYCT

SEQ ID NO: 269222 - protein, 9 aa, Homo Sapiens
AKILWDYAP

SEQ ID NO: 269223 - protein, 9 aa, Homo Sapiens
YLHERSENC

SEQ ID NO: 269224 - protein, 9 aa, Homo Sapiens
AYHKGRDAD

SEQ ID NO: 269225 - protein, 9 aa, Homo Sapiens
HVQDVIKVP

SEQ ID NO: 269226 - protein, 9 aa, Homo Sapiens
GKMYRLRTQ

SEQ ID NO: 269227 - protein, 9 aa, Homo Sapiens
HRINKLFGF

SEQ ID NO: 269228 - protein, 9 aa, Homo Sapiens
DVFDIDDAQ

SEQ ID NO: 269229 - protein, 9 aa, Homo Sapiens
GCRMKWLID

SEQ ID NO: 269230 - protein, 9 aa, Homo Sapiens
SAPIPKDLG

SEQ ID NO: 269231 - protein, 9 aa, Homo Sapiens
ISRRIIVGS

SEQ ID NO: 269232 - protein, 9 aa, Homo Sapiens
IEKCQDRME

SEQ ID NO: 269233 - protein, 9 aa, Homo Sapiens
ENNSENPKN

SEQ ID NO: 269234 - protein, 9 aa, Homo Sapiens
NFCIQNCCG

SEQ ID NO: 269235 - protein, 9 aa, Homo Sapiens
KNMTFIKKP

SEQ ID NO: 269236 - protein, 9 aa, Homo Sapiens
ELRRHIIQW

SEQ ID NO: 269237 - protein, 9 aa, Homo Sapiens
EGIFYCCLS

SEQ ID NO: 269238 - protein, 9 aa, Homo Sapiens
LSEESENQH

SEQ ID NO: 269239 - protein, 9 aa, Homo Sapiens
HGTSPEDHL

SEQ ID NO: 269240 - protein, 9 aa, Homo Sapiens
EDDAKAAKD

SEQ ID NO: 269241 - protein, 9 aa, Homo Sapiens
LGKDCNKTS

SEQ ID NO: 269242 - protein, 9 aa, Homo Sapiens
NYHTLYDLD

SEQ ID NO: 269243 - protein, 9 aa, Homo Sapiens
FDCHEIQIY

SEQ ID NO: 269244 - protein, 9 aa, Homo Sapiens
GQTSKADYE

SEQ ID NO: 269245 - protein, 9 aa, Homo Sapiens
WNLDNYPMV

SEQ ID NO: 269246 - protein, 9 aa, Homo Sapiens
LVKIKRTSF

SEQ ID NO: 269247 - protein, 9 aa, Homo Sapiens
TRMGRHKPH

SEQ ID NO: 269248 - protein, 9 aa, Homo Sapiens
NETIDSLEE

SEQ ID NO: 269249 - protein, 9 aa, Homo Sapiens
IKQCLWFPF

SEQ ID NO: 269250 - protein, 9 aa, Homo Sapiens
LPYRTISEN

SEQ ID NO: 269251 - protein, 9 aa, Homo Sapiens
DPMRHQILP

SEQ ID NO: 269252 - protein, 9 aa, Homo Sapiens
STTLYVADV

SEQ ID NO: 269253 - protein, 9 aa, Homo Sapiens
LHGSFLAVS

SEQ ID NO: 269254 - protein, 9 aa, Homo Sapiens
GHECAVWLL

SEQ ID NO: 269255 - protein, 9 aa, Homo Sapiens
EEKLFTLTA

SEQ ID NO: 269256 - protein, 9 aa, Homo Sapiens
YKQNKRGRR

SEQ ID NO: 269257 - protein, 9 aa, Homo Sapiens
SSTLQSVST

SEQ ID NO: 269258 - protein, 9 aa, Homo Sapiens
FGHGEFSSS

SEQ ID NO: 269259 - protein, 9 aa, Homo Sapiens
DSLEPRREV

SEQ ID NO: 269260 - protein, 9 aa, Homo Sapiens
KFLFFLTGH

SEQ ID NO: 269261 - protein, 9 aa, Homo Sapiens
TLIRHKKIH

SEQ ID NO: 269262 - protein, 9 aa, Homo Sapiens
NKKVEENST

SEQ ID NO: 269263 - protein, 9 aa, Homo Sapiens
GGALHLILL

SEQ ID NO: 269264 - protein, 9 aa, Homo Sapiens
SGEGPMPFR

SEQ ID NO: 269265 - protein, 9 aa, Homo Sapiens
SPLWIDWQW

SEQ ID NO: 269266 - protein, 9 aa, Homo Sapiens
LYTINVYSG

SEQ ID NO: 269267 - protein, 9 aa, Homo Sapiens
PCETDNPMG

SEQ ID NO: 269268 - protein, 9 aa, Homo Sapiens
FLKSVFCNT

SEQ ID NO: 269269 - protein, 9 aa, Homo Sapiens
ERLAKAQET

SEQ ID NO: 269270 - protein, 9 aa, Homo Sapiens
KKLFYSSVS

SEQ ID NO: 269271 - protein, 9 aa, Homo Sapiens
FIRDNFLDF

SEQ ID NO: 269272 - protein, 9 aa, Homo Sapiens
EARKLIKKK

SEQ ID NO: 269273 - protein, 9 aa, Homo Sapiens
GAEEFEEKA

SEQ ID NO: 269274 - protein, 9 aa, Homo Sapiens
VLSNRTPQN

SEQ ID NO: 269275 - protein, 9 aa, Homo Sapiens
KLVWVLFEL

SEQ ID NO: 269276 - protein, 9 aa, Homo Sapiens
SSWKHPEPG

SEQ ID NO: 269277 - protein, 9 aa, Homo Sapiens
LMLNHLIYS

SEQ ID NO: 269278 - protein, 9 aa, Homo Sapiens
ICKDEMSSV

SEQ ID NO: 269279 - protein, 9 aa, Homo Sapiens
NLGRHTLDH

SEQ ID NO: 269280 - protein, 9 aa, Homo Sapiens
KRNKEPAND

SEQ ID NO: 269281 - protein, 9 aa, Homo Sapiens
LILFQSFLF

SEQ ID NO: 269282 - protein, 9 aa, Homo Sapiens
EHAHLKEIL

SEQ ID NO: 269283 - protein, 9 aa, Homo Sapiens
SAKGRWITN

SEQ ID NO: 269284 - protein, 9 aa, Homo Sapiens
IDFSDTEEV

SEQ ID NO: 269285 - protein, 9 aa, Homo Sapiens
HYLVGTPYY

SEQ ID NO: 269286 - protein, 9 aa, Homo Sapiens
VPNNLFFFF

SEQ ID NO: 269287 - protein, 9 aa, Homo Sapiens
NQGRIGVVI

SEQ ID NO: 269288 - protein, 9 aa, Homo Sapiens
IQCLLSSCS

SEQ ID NO: 269289 - protein, 9 aa, Homo Sapiens
YLVCLAAAL

SEQ ID NO: 269290 - protein, 9 aa, Homo Sapiens
YATVQPYTS

SEQ ID NO: 269291 - protein, 9 aa, Homo Sapiens
TAAMSYSLC

SEQ ID NO: 269292 - protein, 9 aa, Homo Sapiens
KHYSLIVVG

SEQ ID NO: 269293 - protein, 9 aa, Homo Sapiens
IGGINRHQG

SEQ ID NO: 269294 - protein, 9 aa, Homo Sapiens
HLKLYFPVI

SEQ ID NO: 269295 - protein, 9 aa, Homo Sapiens
DWFQLESNK

SEQ ID NO: 269296 - protein, 9 aa, Homo Sapiens
SDDMAFRLD

SEQ ID NO: 269297 - protein, 9 aa, Homo Sapiens
QYLYVRLID

SEQ ID NO: 269298 - protein, 9 aa, Homo Sapiens
LSFGYVHSF

SEQ ID NO: 269299 - protein, 9 aa, Homo Sapiens
MTFPGLFKI

SEQ ID NO: 269300 - protein, 9 aa, Homo Sapiens
NDLTAADVV

SEQ ID NO: 269301 - protein, 9 aa, Homo Sapiens
GGYGLSGFY

SEQ ID NO: 269302 - protein, 9 aa, Homo Sapiens
SDWQGQICY

SEQ ID NO: 269303 - protein, 9 aa, Homo Sapiens
AIKVPPSVG

SEQ ID NO: 269304 - protein, 9 aa, Homo Sapiens
SYMRIRGHL

SEQ ID NO: 269305 - protein, 9 aa, Homo Sapiens
WWKGEHHRG

SEQ ID NO: 269306 - protein, 9 aa, Homo Sapiens
PLNRRSALE

SEQ ID NO: 269307 - protein, 9 aa, Homo Sapiens
VNAAPTSFI

SEQ ID NO: 269308 - protein, 9 aa, Homo Sapiens
SIPASSLPM

SEQ ID NO: 269309 - protein, 9 aa, Homo Sapiens
EAYLRQIKM

SEQ ID NO: 269310 - protein, 9 aa, Homo Sapiens
VHLDRDEED

SEQ ID NO: 269311 - protein, 9 aa, Homo Sapiens
LGQPHNKSL

SEQ ID NO: 269312 - protein, 9 aa, Homo Sapiens
RPLTMTELS

SEQ ID NO: 269313 - protein, 9 aa, Homo Sapiens
SPNGKYVYI

SEQ ID NO: 269314 - protein, 9 aa, Homo Sapiens
SRQWIVSHI

SEQ ID NO: 269315 - protein, 9 aa, Homo Sapiens
FDNLLINQI

SEQ ID NO: 269316 - protein, 9 aa, Homo Sapiens
NIMLIAEWA

SEQ ID NO: 269317 - protein, 9 aa, Homo Sapiens
NKTMIALSI

SEQ ID NO: 269318 - protein, 9 aa, Homo Sapiens
AALGSALFL

SEQ ID NO: 269319 - protein, 9 aa, Homo Sapiens
RDVIGLSIQ

SEQ ID NO: 269320 - protein, 9 aa, Homo Sapiens
GLHGHPPLS

SEQ ID NO: 269321 - protein, 9 aa, Homo Sapiens
DVDVDKPDD

SEQ ID NO: 269322 - protein, 9 aa, Homo Sapiens
VSSEGIFKN

SEQ ID NO: 269323 - protein, 9 aa, Homo Sapiens
DHALRWRSD

SEQ ID NO: 269324 - protein, 9 aa, Homo Sapiens
VHPTGSSQS

SEQ ID NO: 269325 - protein, 9 aa, Homo Sapiens
DTAFILTGY

SEQ ID NO: 269326 - protein, 9 aa, Homo Sapiens
TSSSQARSS

SEQ ID NO: 269327 - protein, 9 aa, Homo Sapiens
IGQRMPQYC

SEQ ID NO: 269328 - protein, 9 aa, Homo Sapiens
DRCGDNKHL

SEQ ID NO: 269329 - protein, 9 aa, Homo Sapiens
TKLKYGQTI

SEQ ID NO: 269330 - protein, 9 aa, Homo Sapiens
QRDAHIFEK

SEQ ID NO: 269331 - protein, 9 aa, Homo Sapiens
WSWFIPEGL

SEQ ID NO: 269332 - protein, 9 aa, Homo Sapiens
QETATGPRT

SEQ ID NO: 269333 - protein, 9 aa, Homo Sapiens
LTAIGFGDY

SEQ ID NO: 269334 - protein, 9 aa, Homo Sapiens
FFRDCFLEG

SEQ ID NO: 269335 - protein, 9 aa, Homo Sapiens
LPTSPTPAS

SEQ ID NO: 269336 - protein, 9 aa, Homo Sapiens
SLPAYFLFI

SEQ ID NO: 269337 - protein, 9 aa, Homo Sapiens
LQRINVCNA

SEQ ID NO: 269338 - protein, 9 aa, Homo Sapiens
INRLTDYIN

SEQ ID NO: 269339 - protein, 9 aa, Homo Sapiens
GMKGLIFDR

SEQ ID NO: 269340 - protein, 9 aa, Homo Sapiens
KRHKAAESE

SEQ ID NO: 269341 - protein, 9 aa, Homo Sapiens
ALELDKVLE

SEQ ID NO: 269342 - protein, 9 aa, Homo Sapiens
EGKETKACA

SEQ ID NO: 269343 - protein, 9 aa, Homo Sapiens
HLTNVALQK

SEQ ID NO: 269344 - protein, 9 aa, Homo Sapiens
STPTLDKQY

SEQ ID NO: 269345 - protein, 9 aa, Homo Sapiens
SILNYVIYT

SEQ ID NO: 269346 - protein, 9 aa, Homo Sapiens
LCELMDMNI

SEQ ID NO: 269347 - protein, 9 aa, Homo Sapiens
QTAPRPRLG

SEQ ID NO: 269348 - protein, 9 aa, Homo Sapiens
FNCLMYKMS

SEQ ID NO: 269349 - protein, 9 aa, Homo Sapiens
MGCLLGQKR

SEQ ID NO: 269350 - protein, 9 aa, Homo Sapiens
GQLEKQKKC

SEQ ID NO: 269351 - protein, 9 aa, Homo Sapiens
IKVLQGCNK

SEQ ID NO: 269352 - protein, 9 aa, Homo Sapiens
SHTDSDSMD

SEQ ID NO: 269353 - protein, 9 aa, Homo Sapiens
ESIITKTPI

SEQ ID NO: 269354 - protein, 9 aa, Homo Sapiens
SHGIIRFYH

SEQ ID NO: 269355 - protein, 9 aa, Homo Sapiens
KSAGGLVFN

SEQ ID NO: 269356 - protein, 9 aa, Homo Sapiens
ITKLNEDLK

SEQ ID NO: 269357 - protein, 9 aa, Homo Sapiens
WFILIYKLS

SEQ ID NO: 269358 - protein, 9 aa, Homo Sapiens
LGFVKLPRP

SEQ ID NO: 269359 - protein, 9 aa, Homo Sapiens
LMESSSVSL

SEQ ID NO: 269360 - protein, 9 aa, Homo Sapiens
AKCKSVHEI

SEQ ID NO: 269361 - protein, 9 aa, Homo Sapiens
CVKKSTRER

SEQ ID NO: 269362 - protein, 9 aa, Homo Sapiens
QNVQDFKRA

SEQ ID NO: 269363 - protein, 9 aa, Homo Sapiens
PPRVGSPWI

SEQ ID NO: 269364 - protein, 9 aa, Homo Sapiens
INTNKLSAR

SEQ ID NO: 269365 - protein, 9 aa, Homo Sapiens
ISRNLLWLS

SEQ ID NO: 269366 - protein, 9 aa, Homo Sapiens
FNRIEHAGA

SEQ ID NO: 269367 - protein, 9 aa, Homo Sapiens
KEKANVSVP

SEQ ID NO: 269368 - protein, 9 aa, Homo Sapiens
PNNSALKQD

SEQ ID NO: 269369 - protein, 9 aa, Homo Sapiens
PLSSTATKM

SEQ ID NO: 269370 - protein, 9 aa, Homo Sapiens
QVANTRLCG

SEQ ID NO: 269371 - protein, 9 aa, Homo Sapiens
NKSFQRSER

SEQ ID NO: 269372 - protein, 9 aa, Homo Sapiens
TYDQQHDSY

SEQ ID NO: 269373 - protein, 9 aa, Homo Sapiens
QHRNCAQSN

SEQ ID NO: 269374 - protein, 9 aa, Homo Sapiens
STLAMSPWQ

SEQ ID NO: 269375 - protein, 9 aa, Homo Sapiens
VKMHFKVNR

SEQ ID NO: 269376 - protein, 9 aa, Homo Sapiens
EVLRAEHHG

SEQ ID NO: 269377 - protein, 9 aa, Homo Sapiens
TRHRIIHTG

SEQ ID NO: 269378 - protein, 9 aa, Homo Sapiens
QRQRLTSTP

SEQ ID NO: 269379 - protein, 9 aa, Homo Sapiens
RDLKKSEAA

SEQ ID NO: 269380 - protein, 9 aa, Homo Sapiens
NASTFSSEM

SEQ ID NO: 269381 - protein, 9 aa, Homo Sapiens
QSLLSDVSE

SEQ ID NO: 269382 - protein, 9 aa, Homo Sapiens
GNEAVLIEN

SEQ ID NO: 269383 - protein, 9 aa, Homo Sapiens
DKNLMENVE

SEQ ID NO: 269384 - protein, 9 aa, Homo Sapiens
SRGQFLWRG

SEQ ID NO: 269385 - protein, 9 aa, Homo Sapiens
LLARLTGIN

SEQ ID NO: 269386 - protein, 9 aa, Homo Sapiens
KTDTVEVTD

SEQ ID NO: 269387 - protein, 9 aa, Homo Sapiens
LEETSIPAY

SEQ ID NO: 269388 - protein, 9 aa, Homo Sapiens
LNKSESQRH

SEQ ID NO: 269389 - protein, 9 aa, Homo Sapiens
WKNSIHHNL

SEQ ID NO: 269390 - protein, 9 aa, Homo Sapiens
AWYCRWIYN

SEQ ID NO: 269391 - protein, 9 aa, Homo Sapiens
YGNIYNFPI

SEQ ID NO: 269392 - protein, 9 aa, Homo Sapiens
QDTINKLKN

SEQ ID NO: 269393 - protein, 9 aa, Homo Sapiens
AGKISTEAL

SEQ ID NO: 269394 - protein, 9 aa, Homo Sapiens
RPDISLDER

SEQ ID NO: 269395 - protein, 9 aa, Homo Sapiens
YVRQLHVID

SEQ ID NO: 269396 - protein, 9 aa, Homo Sapiens
SDYQYIGKL

SEQ ID NO: 269397 - protein, 9 aa, Homo Sapiens
RNAALGPGR

SEQ ID NO: 269398 - protein, 9 aa, Homo Sapiens
QQVHSGQKY

SEQ ID NO: 269399 - protein, 9 aa, Homo Sapiens
ASSYLGMGP

SEQ ID NO: 269400 - protein, 9 aa, Homo Sapiens
DFNEFPAPE

SEQ ID NO: 269401 - protein, 9 aa, Homo Sapiens
RKAQAGARA

SEQ ID NO: 269402 - protein, 9 aa, Homo Sapiens
VFCVASVGV

SEQ ID NO: 269403 - protein, 9 aa, Homo Sapiens
ESSGGGLRL

SEQ ID NO: 269404 - protein, 9 aa, Homo Sapiens
LDLKEFLPE

SEQ ID NO: 269405 - protein, 9 aa, Homo Sapiens
KNPKVSRGR

SEQ ID NO: 269406 - protein, 9 aa, Homo Sapiens
VDLFNRVNL

SEQ ID NO: 269407 - protein, 9 aa, Homo Sapiens
DYKEGDLRT

SEQ ID NO: 269408 - protein, 9 aa, Homo Sapiens
HLIATHSRN

SEQ ID NO: 269409 - protein, 9 aa, Homo Sapiens
SKSLPGFQN

SEQ ID NO: 269410 - protein, 9 aa, Homo Sapiens
SHRPDLFDL

SEQ ID NO: 269411 - protein, 9 aa, Homo Sapiens
LAKPPLPCA

SEQ ID NO: 269412 - protein, 9 aa, Homo Sapiens
TEPCLLHFQ

SEQ ID NO: 269413 - protein, 9 aa, Homo Sapiens
SFISGDINR

SEQ ID NO: 269414 - protein, 9 aa, Homo Sapiens
TFIRAPQMN

SEQ ID NO: 269415 - protein, 9 aa, Homo Sapiens
SLRGTMQLE

SEQ ID NO: 269416 - protein, 9 aa, Homo Sapiens
FHAVNKAMQ

SEQ ID NO: 269417 - protein, 9 aa, Homo Sapiens
REEPDHSTK

SEQ ID NO: 269418 - protein, 9 aa, Homo Sapiens
PEQVHQYSS

SEQ ID NO: 269419 - protein, 9 aa, Homo Sapiens
NDAGNKKTS

SEQ ID NO: 269420 - protein, 9 aa, Homo Sapiens
SLFNKTENK

SEQ ID NO: 269421 - protein, 9 aa, Homo Sapiens
TVFASAMMH

SEQ ID NO: 269422 - protein, 9 aa, Homo Sapiens
LGFKNVSIV

SEQ ID NO: 269423 - protein, 9 aa, Homo Sapiens
SIQNQKAFD

SEQ ID NO: 269424 - protein, 9 aa, Homo Sapiens
HWKNSNSFI

SEQ ID NO: 269425 - protein, 9 aa, Homo Sapiens
MQGLCTFGF

SEQ ID NO: 269426 - protein, 9 aa, Homo Sapiens
DVILKIEPP

SEQ ID NO: 269427 - protein, 9 aa, Homo Sapiens
WIAVGVHKV

SEQ ID NO: 269428 - protein, 9 aa, Homo Sapiens
FTYRLDPGG

SEQ ID NO: 269429 - protein, 9 aa, Homo Sapiens
EDNKSPHSD

SEQ ID NO: 269430 - protein, 9 aa, Homo Sapiens
DQTTARNTS

SEQ ID NO: 269431 - protein, 9 aa, Homo Sapiens
HLALPTCSR

SEQ ID NO: 269432 - protein, 9 aa, Homo Sapiens
DMKPSPSFM

SEQ ID NO: 269433 - protein, 9 aa, Homo Sapiens
EVYSATFQS

SEQ ID NO: 269434 - protein, 9 aa, Homo Sapiens
PAAQVAPIM

SEQ ID NO: 269435 - protein, 9 aa, Homo Sapiens
EKSRFIFQL

SEQ ID NO: 269436 - protein, 9 aa, Homo Sapiens
WMPTSALKS

SEQ ID NO: 269437 - protein, 9 aa, Homo Sapiens
REVAARYPH

SEQ ID NO: 269438 - protein, 9 aa, Homo Sapiens
KSYTCNDCG

SEQ ID NO: 269439 - protein, 9 aa, Homo Sapiens
SASMCMPPP

SEQ ID NO: 269440 - protein, 9 aa, Homo Sapiens
WALLDRKDK

SEQ ID NO: 269441 - protein, 9 aa, Homo Sapiens
DKGSLVFQL

SEQ ID NO: 269442 - protein, 9 aa, Homo Sapiens
VLSQVGHEF

SEQ ID NO: 269443 - protein, 9 aa, Homo Sapiens
DSMDKSLSK

SEQ ID NO: 269444 - protein, 9 aa, Homo Sapiens
KKINVHIEH

SEQ ID NO: 269445 - protein, 9 aa, Homo Sapiens
IQYKSGKTA

SEQ ID NO: 269446 - protein, 9 aa, Homo Sapiens
KCEITSTGD

SEQ ID NO: 269447 - protein, 9 aa, Homo Sapiens
KNVKAKNKA

SEQ ID NO: 269448 - protein, 9 aa, Homo Sapiens
SIVTLLDAI

SEQ ID NO: 269449 - protein, 9 aa, Homo Sapiens
YIIRAKAID

SEQ ID NO: 269450 - protein, 9 aa, Homo Sapiens
SLDYVKITL

SEQ ID NO: 269451 - protein, 9 aa, Homo Sapiens
VNPEPSTYI

SEQ ID NO: 269452 - protein, 9 aa, Homo Sapiens
ACHVFWWPE

SEQ ID NO: 269453 - protein, 9 aa, Homo Sapiens
LEKLPYAMG

SEQ ID NO: 269454 - protein, 9 aa, Homo Sapiens
VLNGGQRID

SEQ ID NO: 269455 - protein, 9 aa, Homo Sapiens
YEDMEHEDF

SEQ ID NO: 269456 - protein, 9 aa, Homo Sapiens
CGDNKHLIF

SEQ ID NO: 269457 - protein, 9 aa, Homo Sapiens
EVKGQETFA

SEQ ID NO: 269458 - protein, 9 aa, Homo Sapiens
ADMMAFCSV

SEQ ID NO: 269459 - protein, 9 aa, Homo Sapiens
IIPCHRRVL

SEQ ID NO: 269460 - protein, 9 aa, Homo Sapiens
GPFQPCEHL

SEQ ID NO: 269461 - protein, 9 aa, Homo Sapiens
HVKLKAQTY

SEQ ID NO: 269462 - protein, 9 aa, Homo Sapiens
TIKEGLHDL

SEQ ID NO: 269463 - protein, 9 aa, Homo Sapiens
MALKNKLSC

SEQ ID NO: 269464 - protein, 9 aa, Homo Sapiens
LTNLQPKRP

SEQ ID NO: 269465 - protein, 9 aa, Homo Sapiens
YLQAGKLFL

SEQ ID NO: 269466 - protein, 9 aa, Homo Sapiens
FQIQQEVDE

SEQ ID NO: 269467 - protein, 9 aa, Homo Sapiens
ALNCAIRLK

SEQ ID NO: 269468 - protein, 9 aa, Homo Sapiens
SCELYLGLR

SEQ ID NO: 269469 - protein, 9 aa, Homo Sapiens
GILSFLTHR

SEQ ID NO: 269470 - protein, 9 aa, Homo Sapiens
NANVVSWKS

SEQ ID NO: 269471 - protein, 9 aa, Homo Sapiens
GRGMVQVQC

SEQ ID NO: 269472 - protein, 9 aa, Homo Sapiens
EKLVISKEG

SEQ ID NO: 269473 - protein, 9 aa, Homo Sapiens
SVIALESLN

SEQ ID NO: 269474 - protein, 9 aa, Homo Sapiens
ILSLVQKKA

SEQ ID NO: 269475 - protein, 9 aa, Homo Sapiens
QCLLSSCSV

SEQ ID NO: 269476 - protein, 9 aa, Homo Sapiens
GPRFGDAEW

SEQ ID NO: 269477 - protein, 9 aa, Homo Sapiens
SEESCKLRH

SEQ ID NO: 269478 - protein, 9 aa, Homo Sapiens
WNQTSAVLQ

SEQ ID NO: 269479 - protein, 9 aa, Homo Sapiens
KGTETRPVN

SEQ ID NO: 269480 - protein, 9 aa, Homo Sapiens
YLKGALTKV

SEQ ID NO: 269481 - protein, 9 aa, Homo Sapiens
SFHKLANQY

SEQ ID NO: 269482 - protein, 9 aa, Homo Sapiens
KGLELAYLE

SEQ ID NO: 269483 - protein, 9 aa, Homo Sapiens
RKNKDKCDC

SEQ ID NO: 269484 - protein, 9 aa, Homo Sapiens
DLVILLSIF

SEQ ID NO: 269485 - protein, 9 aa, Homo Sapiens
RSFQNENVS

SEQ ID NO: 269486 - protein, 9 aa, Homo Sapiens
YLEWNPLQK

SEQ ID NO: 269487 - protein, 9 aa, Homo Sapiens
SIRLMSVLE

SEQ ID NO: 269488 - protein, 9 aa, Homo Sapiens
LNVSSCEIF

SEQ ID NO: 269489 - protein, 9 aa, Homo Sapiens
LDRTKDDGF

SEQ ID NO: 269490 - protein, 9 aa, Homo Sapiens
DIMVYFGRR

SEQ ID NO: 269491 - protein, 9 aa, Homo Sapiens
KFGTVSQEP

SEQ ID NO: 269492 - protein, 9 aa, Homo Sapiens
PVFYHNQGC

SEQ ID NO: 269493 - protein, 9 aa, Homo Sapiens
DTTSMNGKE

SEQ ID NO: 269494 - protein, 9 aa, Homo Sapiens
IPVEAVNKG

SEQ ID NO: 269495 - protein, 9 aa, Homo Sapiens
DVKEYEREH

SEQ ID NO: 269496 - protein, 9 aa, Homo Sapiens
GYQSRYILL

SEQ ID NO: 269497 - protein, 9 aa, Homo Sapiens
IPREMKRLK

SEQ ID NO: 269498 - protein, 9 aa, Homo Sapiens
GGSPCTTVP

SEQ ID NO: 269499 - protein, 9 aa, Homo Sapiens
VLSMRPRVH

SEQ ID NO: 269500 - protein, 9 aa, Homo Sapiens
KRWLGTCAN

SEQ ID NO: 269501 - protein, 9 aa, Homo Sapiens
MFFSNCPFS

SEQ ID NO: 269502 - protein, 9 aa, Homo Sapiens
ANMEEIKQL

SEQ ID NO: 269503 - protein, 9 aa, Homo Sapiens
LNQLPVELK

SEQ ID NO: 269504 - protein, 9 aa, Homo Sapiens
RSTNLNFSV

SEQ ID NO: 269505 - protein, 9 aa, Homo Sapiens
NLIRHQIIH

SEQ ID NO: 269506 - protein, 9 aa, Homo Sapiens
AKKNHDISN

SEQ ID NO: 269507 - protein, 9 aa, Homo Sapiens
KELFHIDIG

SEQ ID NO: 269508 - protein, 9 aa, Homo Sapiens
LGDYMVKTI

SEQ ID NO: 269509 - protein, 9 aa, Homo Sapiens
KSLKSHARG

SEQ ID NO: 269510 - protein, 9 aa, Homo Sapiens
IADKKDAYE

SEQ ID NO: 269511 - protein, 9 aa, Homo Sapiens
GARWIVHGL

SEQ ID NO: 269512 - protein, 9 aa, Homo Sapiens
HSRNITCIT

SEQ ID NO: 269513 - protein, 9 aa, Homo Sapiens
ALLDRKDKT

SEQ ID NO: 269514 - protein, 9 aa, Homo Sapiens
HMKHEHVIG

SEQ ID NO: 269515 - protein, 9 aa, Homo Sapiens
NIDNVETSW

SEQ ID NO: 269516 - protein, 9 aa, Homo Sapiens
MMDVAFVQL

SEQ ID NO: 269517 - protein, 9 aa, Homo Sapiens
LKHNRSSEI

SEQ ID NO: 269518 - protein, 9 aa, Homo Sapiens
QQMPNFTHI

SEQ ID NO: 269519 - protein, 9 aa, Homo Sapiens
AILSLTFLL

SEQ ID NO: 269520 - protein, 9 aa, Homo Sapiens
KTLAVGGLG

SEQ ID NO: 269521 - protein, 9 aa, Homo Sapiens
QIAIGLDPY

SEQ ID NO: 269522 - protein, 9 aa, Homo Sapiens
NNEKYIPSM

SEQ ID NO: 269523 - protein, 9 aa, Homo Sapiens
ALHAAVPSG

SEQ ID NO: 269524 - protein, 9 aa, Homo Sapiens
ITHKEKEHA

SEQ ID NO: 269525 - protein, 9 aa, Homo Sapiens
TCDCFSPYE

SEQ ID NO: 269526 - protein, 9 aa, Homo Sapiens
NYHIFYQII

SEQ ID NO: 269527 - protein, 9 aa, Homo Sapiens
VEVMHTTDI

SEQ ID NO: 269528 - protein, 9 aa, Homo Sapiens
ELSAVTDRC

SEQ ID NO: 269529 - protein, 9 aa, Homo Sapiens
AHVRMATAI

SEQ ID NO: 269530 - protein, 9 aa, Homo Sapiens
HQIIHSREK

SEQ ID NO: 269531 - protein, 9 aa, Homo Sapiens
LCGKTFQTQ

SEQ ID NO: 269532 - protein, 9 aa, Homo Sapiens
SILTNPLYA

SEQ ID NO: 269533 - protein, 9 aa, Homo Sapiens
LNIVYVTGR

SEQ ID NO: 269534 - protein, 9 aa, Homo Sapiens
TTSFQYPSQ

SEQ ID NO: 269535 - protein, 9 aa, Homo Sapiens
LLGQKRKVQ

SEQ ID NO: 269536 - protein, 9 aa, Homo Sapiens
RNRYRYVSP

SEQ ID NO: 269537 - protein, 9 aa, Homo Sapiens
CSQKYADYA

SEQ ID NO: 269538 - protein, 9 aa, Homo Sapiens
CTVALNCAI

SEQ ID NO: 269539 - protein, 9 aa, Homo Sapiens
MDKYEKIGK

SEQ ID NO: 269540 - protein, 9 aa, Homo Sapiens
KYLGPLEIH

SEQ ID NO: 269541 - protein, 9 aa, Homo Sapiens
ESGSKLLEI

SEQ ID NO: 269542 - protein, 9 aa, Homo Sapiens
SLYWLSTHK

SEQ ID NO: 269543 - protein, 9 aa, Homo Sapiens
PLDSQTCYL

SEQ ID NO: 269544 - protein, 9 aa, Homo Sapiens
IQTLGKQLN

SEQ ID NO: 269545 - protein, 9 aa, Homo Sapiens
RINEIQRIA

SEQ ID NO: 269546 - protein, 9 aa, Homo Sapiens
PCKPIDIKG

SEQ ID NO: 269547 - protein, 9 aa, Homo Sapiens
IFWFDAHKI

SEQ ID NO: 269548 - protein, 9 aa, Homo Sapiens
SGTTAENKE

SEQ ID NO: 269549 - protein, 9 aa, Homo Sapiens
DQTCCLKLS

SEQ ID NO: 269550 - protein, 9 aa, Homo Sapiens
SAPKQLRVR

SEQ ID NO: 269551 - protein, 9 aa, Homo Sapiens
GELLYVTDT

SEQ ID NO: 269552 - protein, 9 aa, Homo Sapiens
GMAPSSPIS

SEQ ID NO: 269553 - protein, 9 aa, Homo Sapiens
IPNIDYSYT

SEQ ID NO: 269554 - protein, 9 aa, Homo Sapiens
NMKRHVMVA

SEQ ID NO: 269555 - protein, 9 aa, Homo Sapiens
DLTHLYLAN

SEQ ID NO: 269556 - protein, 9 aa, Homo Sapiens
DARAVMLQG

SEQ ID NO: 269557 - protein, 9 aa, Homo Sapiens
PLPNKSIQS

SEQ ID NO: 269558 - protein, 9 aa, Homo Sapiens
QAREQRIRE

SEQ ID NO: 269559 - protein, 9 aa, Homo Sapiens
HVSQQQRQD

SEQ ID NO: 269560 - protein, 9 aa, Homo Sapiens
AGDNKKRPP

SEQ ID NO: 269561 - protein, 9 aa, Homo Sapiens
RPNWNSISS

SEQ ID NO: 269562 - protein, 9 aa, Homo Sapiens
GTHTIIDNT

SEQ ID NO: 269563 - protein, 9 aa, Homo Sapiens
FVFRMYEVK

SEQ ID NO: 269564 - protein, 9 aa, Homo Sapiens
FRGLEERKK

SEQ ID NO: 269565 - protein, 9 aa, Homo Sapiens
HLEEHISQL

SEQ ID NO: 269566 - protein, 9 aa, Homo Sapiens
KHNRSSEIL

SEQ ID NO: 269567 - protein, 9 aa, Homo Sapiens
FAGMDEMVA

SEQ ID NO: 269568 - protein, 9 aa, Homo Sapiens
DMWLFPDWA

SEQ ID NO: 269569 - protein, 9 aa, Homo Sapiens
PPRGHVEPG

SEQ ID NO: 269570 - protein, 9 aa, Homo Sapiens
LAMSPWQRK

SEQ ID NO: 269571 - protein, 9 aa, Homo Sapiens
REIQAQNFL

SEQ ID NO: 269572 - protein, 9 aa, Homo Sapiens
WIMATSAIP

SEQ ID NO: 269573 - protein, 9 aa, Homo Sapiens
SGLIRHWGF

SEQ ID NO: 269574 - protein, 9 aa, Homo Sapiens
KFASVQGFF

SEQ ID NO: 269575 - protein, 9 aa, Homo Sapiens
MWKPHVSNT

SEQ ID NO: 269576 - protein, 9 aa, Homo Sapiens
PGDQTALKS

SEQ ID NO: 269577 - protein, 9 aa, Homo Sapiens
VNKAMQYGF

SEQ ID NO: 269578 - protein, 9 aa, Homo Sapiens
ITYVPQNPT

SEQ ID NO: 269579 - protein, 9 aa, Homo Sapiens
SECHTKICH

SEQ ID NO: 269580 - protein, 9 aa, Homo Sapiens
TLYTVVFPM

SEQ ID NO: 269581 - protein, 9 aa, Homo Sapiens
NHDGNDLCL

SEQ ID NO: 269582 - protein, 9 aa, Homo Sapiens
MWLQLDRLS

SEQ ID NO: 269583 - protein, 9 aa, Homo Sapiens
TPSTKPKQD

SEQ ID NO: 269584 - protein, 9 aa, Homo Sapiens
LNWCEKPIQ

SEQ ID NO: 269585 - protein, 9 aa, Homo Sapiens
NVQGDTLED

SEQ ID NO: 269586 - protein, 9 aa, Homo Sapiens
THATVEDSG

SEQ ID NO: 269587 - protein, 9 aa, Homo Sapiens
MQEEFSCDG

SEQ ID NO: 269588 - protein, 9 aa, Homo Sapiens
QARPDDLAI

SEQ ID NO: 269589 - protein, 9 aa, Homo Sapiens
PVLFKIMKT

SEQ ID NO: 269590 - protein, 9 aa, Homo Sapiens
SSALYIIYM

SEQ ID NO: 269591 - protein, 9 aa, Homo Sapiens
WWPEGMCIQ

SEQ ID NO: 269592 - protein, 9 aa, Homo Sapiens
RKPSPFIFI

SEQ ID NO: 269593 - protein, 9 aa, Homo Sapiens
EATSSTSNV

SEQ ID NO: 269594 - protein, 9 aa, Homo Sapiens
LVGMYGRKG

SEQ ID NO: 269595 - protein, 9 aa, Homo Sapiens
TSNNCNNSL

SEQ ID NO: 269596 - protein, 9 aa, Homo Sapiens
VGKKFKLPV

SEQ ID NO: 269597 - protein, 9 aa, Homo Sapiens
MIGGLWNNN

SEQ ID NO: 269598 - protein, 9 aa, Homo Sapiens
YLYVRLIDS

SEQ ID NO: 269599 - protein, 9 aa, Homo Sapiens
GHGLKVEIN

SEQ ID NO: 269600 - protein, 9 aa, Homo Sapiens
LFGDVLSEQ

SEQ ID NO: 269601 - protein, 9 aa, Homo Sapiens
NCINTMVNN

SEQ ID NO: 269602 - protein, 9 aa, Homo Sapiens
HDPLLERYG

SEQ ID NO: 269603 - protein, 9 aa, Homo Sapiens
DSKKQSVVG

SEQ ID NO: 269604 - protein, 9 aa, Homo Sapiens
SNKDRGLKG

SEQ ID NO: 269605 - protein, 9 aa, Homo Sapiens
DWLHVKNVC

SEQ ID NO: 269606 - protein, 9 aa, Homo Sapiens
RETTRLFCP

SEQ ID NO: 269607 - protein, 9 aa, Homo Sapiens
STQLFQMVR

SEQ ID NO: 269608 - protein, 9 aa, Homo Sapiens
NTSLVTAFI

SEQ ID NO: 269609 - protein, 9 aa, Homo Sapiens
PCLKSRPFW

SEQ ID NO: 269610 - protein, 9 aa, Homo Sapiens
DIKWQTSGI

SEQ ID NO: 269611 - protein, 9 aa, Homo Sapiens
NISDEPEVD

SEQ ID NO: 269612 - protein, 9 aa, Homo Sapiens
HLNSLGQNR

SEQ ID NO: 269613 - protein, 9 aa, Homo Sapiens
TTTGISQDT

SEQ ID NO: 269614 - protein, 9 aa, Homo Sapiens
TSLIGVLIS

SEQ ID NO: 269615 - protein, 9 aa, Homo Sapiens
ADAVLAQVY

SEQ ID NO: 269616 - protein, 9 aa, Homo Sapiens
TELSRLRRQ

SEQ ID NO: 269617 - protein, 9 aa, Homo Sapiens
EKAFRKPYI

SEQ ID NO: 269618 - protein, 9 aa, Homo Sapiens
GHDTPRLIK

SEQ ID NO: 269619 - protein, 9 aa, Homo Sapiens
QIISGQKEL

SEQ ID NO: 269620 - protein, 9 aa, Homo Sapiens
RRQVPAINR

SEQ ID NO: 269621 - protein, 9 aa, Homo Sapiens
VFGNNGTLV

SEQ ID NO: 269622 - protein, 9 aa, Homo Sapiens
DNLAQQSLN

SEQ ID NO: 269623 - protein, 9 aa, Homo Sapiens
LSVPCRGAE

SEQ ID NO: 269624 - protein, 9 aa, Homo Sapiens
YFNTLCSTF

SEQ ID NO: 269625 - protein, 9 aa, Homo Sapiens
RDDHGGRQG

SEQ ID NO: 269626 - protein, 9 aa, Homo Sapiens
KELVTFKDV

SEQ ID NO: 269627 - protein, 9 aa, Homo Sapiens
RGYSFLILF

SEQ ID NO: 269628 - protein, 9 aa, Homo Sapiens
MRRLLNIVY

SEQ ID NO: 269629 - protein, 9 aa, Homo Sapiens
QKEHNLNMQ

SEQ ID NO: 269630 - protein, 9 aa, Homo Sapiens
EAFLRPEWS

SEQ ID NO: 269631 - protein, 9 aa, Homo Sapiens
NGSVKVPAG

SEQ ID NO: 269632 - protein, 9 aa, Homo Sapiens
TELSCRELE

SEQ ID NO: 269633 - protein, 9 aa, Homo Sapiens
MLASIMSSL

SEQ ID NO: 269634 - protein, 9 aa, Homo Sapiens
HKLHLAKTD

SEQ ID NO: 269635 - protein, 9 aa, Homo Sapiens
HQLFIARFL

SEQ ID NO: 269636 - protein, 9 aa, Homo Sapiens
TGAALTLTD

SEQ ID NO: 269637 - protein, 9 aa, Homo Sapiens
TRCLGVTAQ

SEQ ID NO: 269638 - protein, 9 aa, Homo Sapiens
PPIALRNVI

SEQ ID NO: 269639 - protein, 9 aa, Homo Sapiens
THPLSLLLL

SEQ ID NO: 269640 - protein, 9 aa, Homo Sapiens
ETEARTRLE

SEQ ID NO: 269641 - protein, 9 aa, Homo Sapiens
QSQKVDELV

SEQ ID NO: 269642 - protein, 9 aa, Homo Sapiens
TTDIKEANL

SEQ ID NO: 269643 - protein, 9 aa, Homo Sapiens
ISDVPVHIS

SEQ ID NO: 269644 - protein, 9 aa, Homo Sapiens
DIGGTLVEL

SEQ ID NO: 269645 - protein, 9 aa, Homo Sapiens
QILFPVAFA

SEQ ID NO: 269646 - protein, 9 aa, Homo Sapiens
DPLQLVRDA

SEQ ID NO: 269647 - protein, 9 aa, Homo Sapiens
TLTNRIDEN

SEQ ID NO: 269648 - protein, 9 aa, Homo Sapiens
RNYAQKQLS

SEQ ID NO: 269649 - protein, 9 aa, Homo Sapiens
ISWILYCLT

SEQ ID NO: 269650 - protein, 9 aa, Homo Sapiens
NTIKVKMQT

SEQ ID NO: 269651 - protein, 9 aa, Homo Sapiens
RPFGRPVSL

SEQ ID NO: 269652 - protein, 9 aa, Homo Sapiens
NEGLMDDKL

SEQ ID NO: 269653 - protein, 9 aa, Homo Sapiens
ANQSNRQFP

SEQ ID NO: 269654 - protein, 9 aa, Homo Sapiens
EFVKLSNNM

SEQ ID NO: 269655 - protein, 9 aa, Homo Sapiens
LKEDILELI

SEQ ID NO: 269656 - protein, 9 aa, Homo Sapiens
VRLKVLLDT

SEQ ID NO: 269657 - protein, 9 aa, Homo Sapiens
VSRKKTRRM

SEQ ID NO: 269658 - protein, 9 aa, Homo Sapiens
HHQFRWSEI

SEQ ID NO: 269659 - protein, 9 aa, Homo Sapiens
STRRKRRKN

SEQ ID NO: 269660 - protein, 9 aa, Homo Sapiens
RICKSRVSG

SEQ ID NO: 269661 - protein, 9 aa, Homo Sapiens
VCDFSPLLK

SEQ ID NO: 269662 - protein, 9 aa, Homo Sapiens
IHLGISLGI

SEQ ID NO: 269663 - protein, 9 aa, Homo Sapiens
ANPVALQCP

SEQ ID NO: 269664 - protein, 9 aa, Homo Sapiens
PLQPHEFWD

SEQ ID NO: 269665 - protein, 9 aa, Homo Sapiens
RMWNYMQLK

SEQ ID NO: 269666 - protein, 9 aa, Homo Sapiens
RWTTDEQLV

SEQ ID NO: 269667 - protein, 9 aa, Homo Sapiens
NLLFDNTTV

SEQ ID NO: 269668 - protein, 9 aa, Homo Sapiens
KTFDRVSRL

SEQ ID NO: 269669 - protein, 9 aa, Homo Sapiens
IFLFFKPSV

SEQ ID NO: 269670 - protein, 9 aa, Homo Sapiens
ATLLHRKDL

SEQ ID NO: 269671 - protein, 9 aa, Homo Sapiens
AKVILKKIR

SEQ ID NO: 269672 - protein, 9 aa, Homo Sapiens
TLGLRMEEI

SEQ ID NO: 269673 - protein, 9 aa, Homo Sapiens
PGRKRKKHR

SEQ ID NO: 269674 - protein, 9 aa, Homo Sapiens
AFVEVNNYP

SEQ ID NO: 269675 - protein, 9 aa, Homo Sapiens
GGVCHAGID

SEQ ID NO: 269676 - protein, 9 aa, Homo Sapiens
GHNMQNSAF

SEQ ID NO: 269677 - protein, 9 aa, Homo Sapiens
RECPHSKKK

SEQ ID NO: 269678 - protein, 9 aa, Homo Sapiens
WLPSGMKGL

SEQ ID NO: 269679 - protein, 9 aa, Homo Sapiens
VDSTTMHEL

SEQ ID NO: 269680 - protein, 9 aa, Homo Sapiens
VGIRKRINN

SEQ ID NO: 269681 - protein, 9 aa, Homo Sapiens
LKEMSPGFR

SEQ ID NO: 269682 - protein, 9 aa, Homo Sapiens
SHNNSPIIW

SEQ ID NO: 269683 - protein, 9 aa, Homo Sapiens
QCGKPFIYV

SEQ ID NO: 269684 - protein, 9 aa, Homo Sapiens
TLNNFYTLV

SEQ ID NO: 269685 - protein, 9 aa, Homo Sapiens
IESQDVMQP

SEQ ID NO: 269686 - protein, 9 aa, Homo Sapiens
LTELPWGGG

SEQ ID NO: 269687 - protein, 9 aa, Homo Sapiens
SNRNVMETF

SEQ ID NO: 269688 - protein, 9 aa, Homo Sapiens
AIKVEVATY

SEQ ID NO: 269689 - protein, 9 aa, Homo Sapiens
ITFMERVKN

SEQ ID NO: 269690 - protein, 9 aa, Homo Sapiens
GGQTSKADY

SEQ ID NO: 269691 - protein, 9 aa, Homo Sapiens
RKSNIHKSV

SEQ ID NO: 269692 - protein, 9 aa, Homo Sapiens
SLPHFVRSE

SEQ ID NO: 269693 - protein, 9 aa, Homo Sapiens
LIEYLPKTP

SEQ ID NO: 269694 - protein, 9 aa, Homo Sapiens
TYPNGSQDV

SEQ ID NO: 269695 - protein, 9 aa, Homo Sapiens
EHKLHLAKT

SEQ ID NO: 269696 - protein, 9 aa, Homo Sapiens
GKISTEALE

SEQ ID NO: 269697 - protein, 9 aa, Homo Sapiens
WDKMKDLQD

SEQ ID NO: 269698 - protein, 9 aa, Homo Sapiens
YPLGQSEGN

SEQ ID NO: 269699 - protein, 9 aa, Homo Sapiens
SKTLATKEK

SEQ ID NO: 269700 - protein, 9 aa, Homo Sapiens
YINIVAYYH

SEQ ID NO: 269701 - protein, 9 aa, Homo Sapiens
VKGICKSFT

SEQ ID NO: 269702 - protein, 9 aa, Homo Sapiens
NARRRIIPD

SEQ ID NO: 269703 - protein, 9 aa, Homo Sapiens
EKRITKLNE

SEQ ID NO: 269704 - protein, 9 aa, Homo Sapiens
KMHSKHFEN

SEQ ID NO: 269705 - protein, 9 aa, Homo Sapiens
HGRFQTARE

SEQ ID NO: 269706 - protein, 9 aa, Homo Sapiens
PEAIHFGAF

SEQ ID NO: 269707 - protein, 9 aa, Homo Sapiens
YRADLWMPA

SEQ ID NO: 269708 - protein, 9 aa, Homo Sapiens
VRSSADLQI

SEQ ID NO: 269709 - protein, 9 aa, Homo Sapiens
NALGGPGIP

SEQ ID NO: 269710 - protein, 9 aa, Homo Sapiens
KGLSGMQGG

SEQ ID NO: 269711 - protein, 9 aa, Homo Sapiens
KLSCDDIRS

SEQ ID NO: 269712 - protein, 9 aa, Homo Sapiens
TLTLMHLYF

SEQ ID NO: 269713 - protein, 9 aa, Homo Sapiens
VLTGLATIA

SEQ ID NO: 269714 - protein, 9 aa, Homo Sapiens
NNQITALGA

SEQ ID NO: 269715 - protein, 9 aa, Homo Sapiens
EQRARYLFF

SEQ ID NO: 269716 - protein, 9 aa, Homo Sapiens
VPFPQRHYL

SEQ ID NO: 269717 - protein, 9 aa, Homo Sapiens
VEANPRDLG

SEQ ID NO: 269718 - protein, 9 aa, Homo Sapiens
LNSVVCQQS

SEQ ID NO: 269719 - protein, 9 aa, Homo Sapiens
CRNGHRGVQ

SEQ ID NO: 269720 - protein, 9 aa, Homo Sapiens
ESNDTTQLI

SEQ ID NO: 269721 - protein, 9 aa, Homo Sapiens
VIHSVKEVQ

SEQ ID NO: 269722 - protein, 9 aa, Homo Sapiens
RPGTRTGPL

SEQ ID NO: 269723 - protein, 9 aa, Homo Sapiens
WTWVGTNKY

SEQ ID NO: 269724 - protein, 9 aa, Homo Sapiens
TKLVDRTRI

SEQ ID NO: 269725 - protein, 9 aa, Homo Sapiens
TKNLCFLET

SEQ ID NO: 269726 - protein, 9 aa, Homo Sapiens
KAISSASLL

SEQ ID NO: 269727 - protein, 9 aa, Homo Sapiens
NAPISQRRP

SEQ ID NO: 269728 - protein, 9 aa, Homo Sapiens
DCILALPQF

SEQ ID NO: 269729 - protein, 9 aa, Homo Sapiens
MIQTYLYFF

SEQ ID NO: 269730 - protein, 9 aa, Homo Sapiens
SLEEGLFKV

SEQ ID NO: 269731 - protein, 9 aa, Homo Sapiens
FPLDSQTCY

SEQ ID NO: 269732 - protein, 9 aa, Homo Sapiens
LVLKTLIQL

SEQ ID NO: 269733 - protein, 9 aa, Homo Sapiens
GSWGPCSTS

SEQ ID NO: 269734 - protein, 9 aa, Homo Sapiens
QSHELKVHD

SEQ ID NO: 269735 - protein, 9 aa, Homo Sapiens
YLYTFMSMC

SEQ ID NO: 269736 - protein, 9 aa, Homo Sapiens
YVLRLNSVS

SEQ ID NO: 269737 - protein, 9 aa, Homo Sapiens
RKLSTYIQL

SEQ ID NO: 269738 - protein, 9 aa, Homo Sapiens
AILVSLSPM

SEQ ID NO: 269739 - protein, 9 aa, Homo Sapiens
SGKEFNHNY

SEQ ID NO: 269740 - protein, 9 aa, Homo Sapiens
DDGRGFVDL

SEQ ID NO: 269741 - protein, 9 aa, Homo Sapiens
NLQRIVKSI

SEQ ID NO: 269742 - protein, 9 aa, Homo Sapiens
CDSLSTGIA

SEQ ID NO: 269743 - protein, 9 aa, Homo Sapiens
EVDHCEHLK

SEQ ID NO: 269744 - protein, 9 aa, Homo Sapiens
AGIFKPRSA

SEQ ID NO: 269745 - protein, 9 aa, Homo Sapiens
SNHSQSSSQ

SEQ ID NO: 269746 - protein, 9 aa, Homo Sapiens
SEPDLFSPS

SEQ ID NO: 269747 - protein, 9 aa, Homo Sapiens
HIFLQNCLP

SEQ ID NO: 269748 - protein, 9 aa, Homo Sapiens
RHLFSIAAR

SEQ ID NO: 269749 - protein, 9 aa, Homo Sapiens
QLPSNNRQL

SEQ ID NO: 269750 - protein, 9 aa, Homo Sapiens
GFPLNAIYV

SEQ ID NO: 269751 - protein, 9 aa, Homo Sapiens
NQQSPFREI

SEQ ID NO: 269752 - protein, 9 aa, Homo Sapiens
KKVGVIPPN

SEQ ID NO: 269753 - protein, 9 aa, Homo Sapiens
TLVSLISNK

SEQ ID NO: 269754 - protein, 9 aa, Homo Sapiens
GQEARWAVG

SEQ ID NO: 269755 - protein, 9 aa, Homo Sapiens
KRDSLEKEA

SEQ ID NO: 269756 - protein, 9 aa, Homo Sapiens
KLSPEKEFK

SEQ ID NO: 269757 - protein, 9 aa, Homo Sapiens
GVYWICNNL

SEQ ID NO: 269758 - protein, 9 aa, Homo Sapiens
TRFNKQLLY

SEQ ID NO: 269759 - protein, 9 aa, Homo Sapiens
YISCPLIGV

SEQ ID NO: 269760 - protein, 9 aa, Homo Sapiens
IHEISCKSL

SEQ ID NO: 269761 - protein, 9 aa, Homo Sapiens
PGFIDKTFV

SEQ ID NO: 269762 - protein, 9 aa, Homo Sapiens
LWNNNEKDM

SEQ ID NO: 269763 - protein, 9 aa, Homo Sapiens
YHCYEPSIY

SEQ ID NO: 269764 - protein, 9 aa, Homo Sapiens
YPDNSEQLE

SEQ ID NO: 269765 - protein, 9 aa, Homo Sapiens
YQGRYEITA

SEQ ID NO: 269766 - protein, 9 aa, Homo Sapiens
KRNDLCFLK

SEQ ID NO: 269767 - protein, 9 aa, Homo Sapiens
GPDVKGEYD

SEQ ID NO: 269768 - protein, 9 aa, Homo Sapiens
KLYQLRHPV

SEQ ID NO: 269769 - protein, 9 aa, Homo Sapiens
PHNWSRENI

SEQ ID NO: 269770 - protein, 9 aa, Homo Sapiens
YKHFNSPHP

SEQ ID NO: 269771 - protein, 9 aa, Homo Sapiens
QKITLYFNF

SEQ ID NO: 269772 - protein, 9 aa, Homo Sapiens
IGTVALACS

SEQ ID NO: 269773 - protein, 9 aa, Homo Sapiens
TASLMEKVR

SEQ ID NO: 269774 - protein, 9 aa, Homo Sapiens
AVISRHSLN

SEQ ID NO: 269775 - protein, 9 aa, Homo Sapiens
KLMSNLDSS

SEQ ID NO: 269776 - protein, 9 aa, Homo Sapiens
SLLSVEEAA

SEQ ID NO: 269777 - protein, 9 aa, Homo Sapiens
HISKKHTGK

SEQ ID NO: 269778 - protein, 9 aa, Homo Sapiens
GESCEVNVD

SEQ ID NO: 269779 - protein, 9 aa, Homo Sapiens
PVSSDDGRG

SEQ ID NO: 269780 - protein, 9 aa, Homo Sapiens
LESLLSNDL

SEQ ID NO: 269781 - protein, 9 aa, Homo Sapiens
SQPRHISVV

SEQ ID NO: 269782 - protein, 9 aa, Homo Sapiens
LVTGSPRLF

SEQ ID NO: 269783 - protein, 9 aa, Homo Sapiens
TFTQASPDQ

SEQ ID NO: 269784 - protein, 9 aa, Homo Sapiens
FVIDIQKNI

SEQ ID NO: 269785 - protein, 9 aa, Homo Sapiens
YHESSQMSY

SEQ ID NO: 269786 - protein, 9 aa, Homo Sapiens
NRDLAPEPR

SEQ ID NO: 269787 - protein, 9 aa, Homo Sapiens
GALNEIASE

SEQ ID NO: 269788 - protein, 9 aa, Homo Sapiens
DCQELLSVI

SEQ ID NO: 269789 - protein, 9 aa, Homo Sapiens
EVTKYQPEK

SEQ ID NO: 269790 - protein, 9 aa, Homo Sapiens
LSDRIGSTI

SEQ ID NO: 269791 - protein, 9 aa, Homo Sapiens
RKSRGKAKR

SEQ ID NO: 269792 - protein, 9 aa, Homo Sapiens
LLSREILWS

SEQ ID NO: 269793 - protein, 9 aa, Homo Sapiens
AKWPVDTQA

SEQ ID NO: 269794 - protein, 9 aa, Homo Sapiens
VQVTNGGIY

SEQ ID NO: 269795 - protein, 9 aa, Homo Sapiens
QDVNCLSPE

SEQ ID NO: 269796 - protein, 9 aa, Homo Sapiens
HVYNEAIIF

SEQ ID NO: 269797 - protein, 9 aa, Homo Sapiens
AVDKRVQSC

SEQ ID NO: 269798 - protein, 9 aa, Homo Sapiens
KPHDAEINK

SEQ ID NO: 269799 - protein, 9 aa, Homo Sapiens
IKKCEKDIA

SEQ ID NO: 269800 - protein, 9 aa, Homo Sapiens
PLSLLLLPQ

SEQ ID NO: 269801 - protein, 9 aa, Homo Sapiens
VQLLASVSG

SEQ ID NO: 269802 - protein, 9 aa, Homo Sapiens
GSKHKSSLK

SEQ ID NO: 269803 - protein, 9 aa, Homo Sapiens
GGSACFTLS

SEQ ID NO: 269804 - protein, 9 aa, Homo Sapiens
LKAGATATY

SEQ ID NO: 269805 - protein, 9 aa, Homo Sapiens
LSKCNPCGK

SEQ ID NO: 269806 - protein, 9 aa, Homo Sapiens
KRFNAFVLF

SEQ ID NO: 269807 - protein, 9 aa, Homo Sapiens
TCISRRGHA

SEQ ID NO: 269808 - protein, 9 aa, Homo Sapiens
LDQLETEKK

SEQ ID NO: 269809 - protein, 9 aa, Homo Sapiens
DFVDINIQN

SEQ ID NO: 269810 - protein, 9 aa, Homo Sapiens
TRKDFQKYF

SEQ ID NO: 269811 - protein, 9 aa, Homo Sapiens
SHNVKDTIC

SEQ ID NO: 269812 - protein, 9 aa, Homo Sapiens
NIFLQYNSD

SEQ ID NO: 269813 - protein, 9 aa, Homo Sapiens
WLDIFCCVR

SEQ ID NO: 269814 - protein, 9 aa, Homo Sapiens
VLKTQETAK

SEQ ID NO: 269815 - protein, 9 aa, Homo Sapiens
LKYFVNMNI

SEQ ID NO: 269816 - protein, 9 aa, Homo Sapiens
GKSPHNERE

SEQ ID NO: 269817 - protein, 9 aa, Homo Sapiens
QVLKWSGRE

SEQ ID NO: 269818 - protein, 9 aa, Homo Sapiens
SSDKISIKL

SEQ ID NO: 269819 - protein, 9 aa, Homo Sapiens
ARAVTVLKE

SEQ ID NO: 269820 - protein, 9 aa, Homo Sapiens
VVEHLMNSV

SEQ ID NO: 269821 - protein, 9 aa, Homo Sapiens
SEFFLASYN

SEQ ID NO: 269822 - protein, 9 aa, Homo Sapiens
VIRAGWLDK

SEQ ID NO: 269823 - protein, 9 aa, Homo Sapiens
SFIDKVRLL

SEQ ID NO: 269824 - protein, 9 aa, Homo Sapiens
CFDSSRPET

SEQ ID NO: 269825 - protein, 9 aa, Homo Sapiens
GILRLRRKC

SEQ ID NO: 269826 - protein, 9 aa, Homo Sapiens
HPQIKQLLG

SEQ ID NO: 269827 - protein, 9 aa, Homo Sapiens
NSINNEKLE

SEQ ID NO: 269828 - protein, 9 aa, Homo Sapiens
EERLRTRKK

SEQ ID NO: 269829 - protein, 9 aa, Homo Sapiens
RFSLFTNRN

SEQ ID NO: 269830 - protein, 9 aa, Homo Sapiens
VRKVCIDTI

SEQ ID NO: 269831 - protein, 9 aa, Homo Sapiens
DSGLSHVQN

SEQ ID NO: 269832 - protein, 9 aa, Homo Sapiens
SKDKLFDEE

SEQ ID NO: 269833 - protein, 9 aa, Homo Sapiens
GKTPLMIAC

SEQ ID NO: 269834 - protein, 9 aa, Homo Sapiens
EARDGKLVS

SEQ ID NO: 269835 - protein, 9 aa, Homo Sapiens
YAWPFLETV

SEQ ID NO: 269836 - protein, 9 aa, Homo Sapiens
SAKQGTSST

SEQ ID NO: 269837 - protein, 9 aa, Homo Sapiens
KQKYFYRGC

SEQ ID NO: 269838 - protein, 9 aa, Homo Sapiens
ITDTYKTIK

SEQ ID NO: 269839 - protein, 9 aa, Homo Sapiens
IVRWRTKQN

SEQ ID NO: 269840 - protein, 9 aa, Homo Sapiens
SAVADTLDN

SEQ ID NO: 269841 - protein, 9 aa, Homo Sapiens
NMDSTERLD

SEQ ID NO: 269842 - protein, 9 aa, Homo Sapiens
DYEMFPASY

SEQ ID NO: 269843 - protein, 9 aa, Homo Sapiens
YDPNHVCNA

SEQ ID NO: 269844 - protein, 9 aa, Homo Sapiens
MNMVIYYID

SEQ ID NO: 269845 - protein, 9 aa, Homo Sapiens
MEASTKIRM

SEQ ID NO: 269846 - protein, 9 aa, Homo Sapiens
NNFLLGVLQ

SEQ ID NO: 269847 - protein, 9 aa, Homo Sapiens
ICVLNKCDL

SEQ ID NO: 269848 - protein, 9 aa, Homo Sapiens
DIPIIQIIS

SEQ ID NO: 269849 - protein, 9 aa, Homo Sapiens
KESDKTGVC

SEQ ID NO: 269850 - protein, 9 aa, Homo Sapiens
PESEDKEEA

SEQ ID NO: 269851 - protein, 9 aa, Homo Sapiens
DNTPNNYLS

SEQ ID NO: 269852 - protein, 9 aa, Homo Sapiens
RIYSIRDEW

SEQ ID NO: 269853 - protein, 9 aa, Homo Sapiens
KIEDTLCHF

SEQ ID NO: 269854 - protein, 9 aa, Homo Sapiens
PRTFPRENK

SEQ ID NO: 269855 - protein, 9 aa, Homo Sapiens
NLNGEPGGG

SEQ ID NO: 269856 - protein, 9 aa, Homo Sapiens
YFVILCENK

SEQ ID NO: 269857 - protein, 9 aa, Homo Sapiens
QIHTGESSV

SEQ ID NO: 269858 - protein, 9 aa, Homo Sapiens
QIYTYVGSI

SEQ ID NO: 269859 - protein, 9 aa, Homo Sapiens
KKLDHFQSE

SEQ ID NO: 269860 - protein, 9 aa, Homo Sapiens
CSFEDLNND

SEQ ID NO: 269861 - protein, 9 aa, Homo Sapiens
KEAISVVCR

SEQ ID NO: 269862 - protein, 9 aa, Homo Sapiens
SNRISQDSE

SEQ ID NO: 269863 - protein, 9 aa, Homo Sapiens
ATESRKKPG

SEQ ID NO: 269864 - protein, 9 aa, Homo Sapiens
YRKKVAEII

SEQ ID NO: 269865 - protein, 9 aa, Homo Sapiens
SGLLVSLTS

SEQ ID NO: 269866 - protein, 9 aa, Homo Sapiens
KKNERLQTL

SEQ ID NO: 269867 - protein, 9 aa, Homo Sapiens
SEGDPMRHQ

SEQ ID NO: 269868 - protein, 9 aa, Homo Sapiens
KALRSRIRF

SEQ ID NO: 269869 - protein, 9 aa, Homo Sapiens
SERRQKNKN

SEQ ID NO: 269870 - protein, 9 aa, Homo Sapiens
RKYDTNGNL

SEQ ID NO: 269871 - protein, 9 aa, Homo Sapiens
CVLLFSISA

SEQ ID NO: 269872 - protein, 9 aa, Homo Sapiens
YNVPLPNKS

SEQ ID NO: 269873 - protein, 9 aa, Homo Sapiens
TYQYYGLSH

SEQ ID NO: 269874 - protein, 9 aa, Homo Sapiens
YNREECLQT

SEQ ID NO: 269875 - protein, 9 aa, Homo Sapiens
GFVYGGNCF

SEQ ID NO: 269876 - protein, 9 aa, Homo Sapiens
SRGKSISIE

SEQ ID NO: 269877 - protein, 9 aa, Homo Sapiens
LDWEYKDAP

SEQ ID NO: 269878 - protein, 9 aa, Homo Sapiens
CSAGPGRVM

SEQ ID NO: 269879 - protein, 9 aa, Homo Sapiens
GPGLQTHCY

SEQ ID NO: 269880 - protein, 9 aa, Homo Sapiens
SGYGFNEPK

SEQ ID NO: 269881 - protein, 9 aa, Homo Sapiens
LVFVNPYQE

SEQ ID NO: 269882 - protein, 9 aa, Homo Sapiens
KCATGDIIQ

SEQ ID NO: 269883 - protein, 9 aa, Homo Sapiens
TKWELRQQL

SEQ ID NO: 269884 - protein, 9 aa, Homo Sapiens
DNMLVKLQT

SEQ ID NO: 269885 - protein, 9 aa, Homo Sapiens
ERRQKNKNK

SEQ ID NO: 269886 - protein, 9 aa, Homo Sapiens
NYQIKELGT

SEQ ID NO: 269887 - protein, 9 aa, Homo Sapiens
HRKSHAGEN

SEQ ID NO: 269888 - protein, 9 aa, Homo Sapiens
PAFYDLSER

SEQ ID NO: 269889 - protein, 9 aa, Homo Sapiens
VCLNVLRLV

SEQ ID NO: 269890 - protein, 9 aa, Homo Sapiens
LTYSFIQCL

SEQ ID NO: 269891 - protein, 9 aa, Homo Sapiens
LYGDIIQQD

SEQ ID NO: 269892 - protein, 9 aa, Homo Sapiens
IMLVSPLKY

SEQ ID NO: 269893 - protein, 9 aa, Homo Sapiens
PSLDEDGLN

SEQ ID NO: 269894 - protein, 9 aa, Homo Sapiens
EWNIMCWEC

SEQ ID NO: 269895 - protein, 9 aa, Homo Sapiens
VLILVLKRL

SEQ ID NO: 269896 - protein, 9 aa, Homo Sapiens
MKWLIDEVN

SEQ ID NO: 269897 - protein, 9 aa, Homo Sapiens
ILNKEKSDV

SEQ ID NO: 269898 - protein, 9 aa, Homo Sapiens
VLKHNRSSE

SEQ ID NO: 269899 - protein, 9 aa, Homo Sapiens
ATNNPSGQP

SEQ ID NO: 269900 - protein, 9 aa, Homo Sapiens
FLKAVFTEF

SEQ ID NO: 269901 - protein, 9 aa, Homo Sapiens
NHGCSYTAI

SEQ ID NO: 269902 - protein, 9 aa, Homo Sapiens
LQFNLLYRF

SEQ ID NO: 269903 - protein, 9 aa, Homo Sapiens
GVHLSKVRS

SEQ ID NO: 269904 - protein, 9 aa, Homo Sapiens
ALVWIIFVM

SEQ ID NO: 269905 - protein, 9 aa, Homo Sapiens
SLLISNKEF

SEQ ID NO: 269906 - protein, 9 aa, Homo Sapiens
TSGLWTVPA

SEQ ID NO: 269907 - protein, 9 aa, Homo Sapiens
LLKCNSLES

SEQ ID NO: 269908 - protein, 9 aa, Homo Sapiens
SSDLRHVRV

SEQ ID NO: 269909 - protein, 9 aa, Homo Sapiens
GAVVKYETS

SEQ ID NO: 269910 - protein, 9 aa, Homo Sapiens
AKGKLQAEL

SEQ ID NO: 269911 - protein, 9 aa, Homo Sapiens
HQAPSGGQT

SEQ ID NO: 269912 - protein, 9 aa, Homo Sapiens
SPPPLSAIP

SEQ ID NO: 269913 - protein, 9 aa, Homo Sapiens
NQRNIIDTL

SEQ ID NO: 269914 - protein, 9 aa, Homo Sapiens
RKQRREVAK

SEQ ID NO: 269915 - protein, 9 aa, Homo Sapiens
ITTLIRECQ

SEQ ID NO: 269916 - protein, 9 aa, Homo Sapiens
TGISVLSVT

SEQ ID NO: 269917 - protein, 9 aa, Homo Sapiens
YFFSDCINQ

SEQ ID NO: 269918 - protein, 9 aa, Homo Sapiens
DCSDVESSS

SEQ ID NO: 269919 - protein, 9 aa, Homo Sapiens
LGELSDRIG

SEQ ID NO: 269920 - protein, 9 aa, Homo Sapiens
ITPYTLPRS

SEQ ID NO: 269921 - protein, 9 aa, Homo Sapiens
RFKETFSKA

SEQ ID NO: 269922 - protein, 9 aa, Homo Sapiens
DGSNQTVFV

SEQ ID NO: 269923 - protein, 9 aa, Homo Sapiens
TSCQISCTL

SEQ ID NO: 269924 - protein, 9 aa, Homo Sapiens
SDYNSGNYG

SEQ ID NO: 269925 - protein, 9 aa, Homo Sapiens
YCHEARDTH

SEQ ID NO: 269926 - protein, 9 aa, Homo Sapiens
LSAFKFNQD

SEQ ID NO: 269927 - protein, 9 aa, Homo Sapiens
VWLAFLPIF

SEQ ID NO: 269928 - protein, 9 aa, Homo Sapiens
PTKSSQKVD

SEQ ID NO: 269929 - protein, 9 aa, Homo Sapiens
NSMNGRHPG

SEQ ID NO: 269930 - protein, 9 aa, Homo Sapiens
LRLAVSLVL

SEQ ID NO: 269931 - protein, 9 aa, Homo Sapiens
EPLHLFEDY

SEQ ID NO: 269932 - protein, 9 aa, Homo Sapiens
NEMFINASK

SEQ ID NO: 269933 - protein, 9 aa, Homo Sapiens
VSISAFCEK

SEQ ID NO: 269934 - protein, 9 aa, Homo Sapiens
IQDLEIKRK

SEQ ID NO: 269935 - protein, 9 aa, Homo Sapiens
KDKASVNYL

SEQ ID NO: 269936 - protein, 9 aa, Homo Sapiens
EQLSHAKYN

SEQ ID NO: 269937 - protein, 9 aa, Homo Sapiens
DIFLCWFPL

SEQ ID NO: 269938 - protein, 9 aa, Homo Sapiens
FNSYHSSLF

SEQ ID NO: 269939 - protein, 9 aa, Homo Sapiens
NRHLHEYMG

SEQ ID NO: 269940 - protein, 9 aa, Homo Sapiens
LYMVVVSWR

SEQ ID NO: 269941 - protein, 9 aa, Homo Sapiens
PWLFMPLDE

SEQ ID NO: 269942 - protein, 9 aa, Homo Sapiens
NTSEPNQLV

SEQ ID NO: 269943 - protein, 9 aa, Homo Sapiens
VLGDFQWRN

SEQ ID NO: 269944 - protein, 9 aa, Homo Sapiens
IHVTVRRDI

SEQ ID NO: 269945 - protein, 9 aa, Homo Sapiens
ILNHGRLLP

SEQ ID NO: 269946 - protein, 9 aa, Homo Sapiens
NNTTEVWER

SEQ ID NO: 269947 - protein, 9 aa, Homo Sapiens
LSNHIPLRL

SEQ ID NO: 269948 - protein, 9 aa, Homo Sapiens
GLSNSPWAV

SEQ ID NO: 269949 - protein, 9 aa, Homo Sapiens
PWIRELMLG

SEQ ID NO: 269950 - protein, 9 aa, Homo Sapiens
QKYYNGLNQ

SEQ ID NO: 269951 - protein, 9 aa, Homo Sapiens
EQNKLIQNQ

SEQ ID NO: 269952 - protein, 9 aa, Homo Sapiens
ISTTLGKLM

SEQ ID NO: 269953 - protein, 9 aa, Homo Sapiens
QAEGAKVEE

SEQ ID NO: 269954 - protein, 9 aa, Homo Sapiens
TVNNKTLYS

SEQ ID NO: 269955 - protein, 9 aa, Homo Sapiens
SAIKVEVAT

SEQ ID NO: 269956 - protein, 9 aa, Homo Sapiens
WKGEHHRGI

SEQ ID NO: 269957 - protein, 9 aa, Homo Sapiens
LEWNPLQKD

SEQ ID NO: 269958 - protein, 9 aa, Homo Sapiens
QEEPKGADW

SEQ ID NO: 269959 - protein, 9 aa, Homo Sapiens
EFSVPERIA

SEQ ID NO: 269960 - protein, 9 aa, Homo Sapiens
PVCPDTMVS

SEQ ID NO: 269961 - protein, 9 aa, Homo Sapiens
ACLLTPLPS

SEQ ID NO: 269962 - protein, 9 aa, Homo Sapiens
VLNMQFLDE

SEQ ID NO: 269963 - protein, 9 aa, Homo Sapiens
TRERFALKI

SEQ ID NO: 269964 - protein, 9 aa, Homo Sapiens
EPYNSIITT

SEQ ID NO: 269965 - protein, 9 aa, Homo Sapiens
QEELGPGHA

SEQ ID NO: 269966 - protein, 9 aa, Homo Sapiens
QIILEKVAA

SEQ ID NO: 269967 - protein, 9 aa, Homo Sapiens
GVLGLVHAF

SEQ ID NO: 269968 - protein, 9 aa, Homo Sapiens
TGKIFAQAF

SEQ ID NO: 269969 - protein, 9 aa, Homo Sapiens
GVRRLPRIH

SEQ ID NO: 269970 - protein, 9 aa, Homo Sapiens
LVQIRQKKA

SEQ ID NO: 269971 - protein, 9 aa, Homo Sapiens
LETQLRLVA

SEQ ID NO: 269972 - protein, 9 aa, Homo Sapiens
DKFVLKEGQ

SEQ ID NO: 269973 - protein, 9 aa, Homo Sapiens
DECKNTVGS

SEQ ID NO: 269974 - protein, 9 aa, Homo Sapiens
VQALQKALE

SEQ ID NO: 269975 - protein, 9 aa, Homo Sapiens
LRGNRLKVI

SEQ ID NO: 269976 - protein, 9 aa, Homo Sapiens
EPATELSCR

SEQ ID NO: 269977 - protein, 9 aa, Homo Sapiens
DVARYLISL

SEQ ID NO: 269978 - protein, 9 aa, Homo Sapiens
NLNCPFLEG

SEQ ID NO: 269979 - protein, 9 aa, Homo Sapiens
LLSLKAWLE

SEQ ID NO: 269980 - protein, 9 aa, Homo Sapiens
ECEPPQRPQ

SEQ ID NO: 269981 - protein, 9 aa, Homo Sapiens
IWDEPEGLL

SEQ ID NO: 269982 - protein, 9 aa, Homo Sapiens
TPSPTEVQS

SEQ ID NO: 269983 - protein, 9 aa, Homo Sapiens
GLYLPKFKY

SEQ ID NO: 269984 - protein, 9 aa, Homo Sapiens
EEKREDKLE

SEQ ID NO: 269985 - protein, 9 aa, Homo Sapiens
NMHAHMCTH

SEQ ID NO: 269986 - protein, 9 aa, Homo Sapiens
KELWRLETQ

SEQ ID NO: 269987 - protein, 9 aa, Homo Sapiens
DQARRDLYR

SEQ ID NO: 269988 - protein, 9 aa, Homo Sapiens
VLKTLIQLT

SEQ ID NO: 269989 - protein, 9 aa, Homo Sapiens
ADTALFDIY

SEQ ID NO: 269990 - protein, 9 aa, Homo Sapiens
PFMGQRRSK

SEQ ID NO: 269991 - protein, 9 aa, Homo Sapiens
ELYVKEYKE

SEQ ID NO: 269992 - protein, 9 aa, Homo Sapiens
YLWQKNQED

SEQ ID NO: 269993 - protein, 9 aa, Homo Sapiens
SPPEGAPLA

SEQ ID NO: 269994 - protein, 9 aa, Homo Sapiens
TSIKMWFSP

SEQ ID NO: 269995 - protein, 9 aa, Homo Sapiens
CPIHYTTAM

SEQ ID NO: 269996 - protein, 9 aa, Homo Sapiens
VSGLCAIVG

SEQ ID NO: 269997 - protein, 9 aa, Homo Sapiens
KPLECTECG

SEQ ID NO: 269998 - protein, 9 aa, Homo Sapiens
PCINQVTEA

SEQ ID NO: 269999 - protein, 9 aa, Homo Sapiens
TGRRSTFQA

SEQ ID NO: 270000 - protein, 9 aa, Homo Sapiens
RVSLDAAGH

SEQ ID NO: 270001 - protein, 9 aa, Homo Sapiens
MPTPNLDMY

SEQ ID NO: 270002 - protein, 9 aa, Homo Sapiens
SKYVKNAID

SEQ ID NO: 270003 - protein, 9 aa, Homo Sapiens
LDPYDYEII

SEQ ID NO: 270004 - protein, 9 aa, Homo Sapiens
KAFIWPASL

SEQ ID NO: 270005 - protein, 9 aa, Homo Sapiens
RKLIKKKRN

SEQ ID NO: 270006 - protein, 9 aa, Homo Sapiens
AMLEFLWTF

SEQ ID NO: 270007 - protein, 9 aa, Homo Sapiens
GLSDRPQMK

SEQ ID NO: 270008 - protein, 9 aa, Homo Sapiens
YHTLYDLDR

SEQ ID NO: 270009 - protein, 9 aa, Homo Sapiens
ILNIKMSHF

SEQ ID NO: 270010 - protein, 9 aa, Homo Sapiens
NAGVHSGDV

SEQ ID NO: 270011 - protein, 9 aa, Homo Sapiens
PVTFAKKGE

SEQ ID NO: 270012 - protein, 9 aa, Homo Sapiens
KHVQTVQQN

SEQ ID NO: 270013 - protein, 9 aa, Homo Sapiens
AALVSKAQA

SEQ ID NO: 270014 - protein, 9 aa, Homo Sapiens
GFPGTDCNL

SEQ ID NO: 270015 - protein, 9 aa, Homo Sapiens
MYSLRNKEV

SEQ ID NO: 270016 - protein, 9 aa, Homo Sapiens
LRDLTHLYL

SEQ ID NO: 270017 - protein, 9 aa, Homo Sapiens
PGQRSHFQH

SEQ ID NO: 270018 - protein, 9 aa, Homo Sapiens
TDVTFGKIR

SEQ ID NO: 270019 - protein, 9 aa, Homo Sapiens
SLPHMAEPS

SEQ ID NO: 270020 - protein, 9 aa, Homo Sapiens
LNNKTLGEK

SEQ ID NO: 270021 - protein, 9 aa, Homo Sapiens
TPLPNLGPS

SEQ ID NO: 270022 - protein, 9 aa, Homo Sapiens
TRRTLEDHI

SEQ ID NO: 270023 - protein, 9 aa, Homo Sapiens
QEEGPRVLF

SEQ ID NO: 270024 - protein, 9 aa, Homo Sapiens
YEIYTGEET

SEQ ID NO: 270025 - protein, 9 aa, Homo Sapiens
WKMGHTMDK

SEQ ID NO: 270026 - protein, 9 aa, Homo Sapiens
CYGRYWSYD

SEQ ID NO: 270027 - protein, 9 aa, Homo Sapiens
REEVSSLIS

SEQ ID NO: 270028 - protein, 9 aa, Homo Sapiens
SVPEINLDT

SEQ ID NO: 270029 - protein, 9 aa, Homo Sapiens
PPFQFGQPS

SEQ ID NO: 270030 - protein, 9 aa, Homo Sapiens
RGVISYTEY

SEQ ID NO: 270031 - protein, 9 aa, Homo Sapiens
SPFREISKA

SEQ ID NO: 270032 - protein, 9 aa, Homo Sapiens
LHNTKGKRF

SEQ ID NO: 270033 - protein, 9 aa, Homo Sapiens
NSHGCQLLP

SEQ ID NO: 270034 - protein, 9 aa, Homo Sapiens
AFNISSTLN

SEQ ID NO: 270035 - protein, 9 aa, Homo Sapiens
NLYSPFKPI

SEQ ID NO: 270036 - protein, 9 aa, Homo Sapiens
EFLWTFRHS

SEQ ID NO: 270037 - protein, 9 aa, Homo Sapiens
QNTNSSRIE

SEQ ID NO: 270038 - protein, 9 aa, Homo Sapiens
EDTEAAIRS

SEQ ID NO: 270039 - protein, 9 aa, Homo Sapiens
TTLIRECQR

SEQ ID NO: 270040 - protein, 9 aa, Homo Sapiens
ADKLAALLP

SEQ ID NO: 270041 - protein, 9 aa, Homo Sapiens
FVQEAVSHG

SEQ ID NO: 270042 - protein, 9 aa, Homo Sapiens
CEEYAQNVL

SEQ ID NO: 270043 - protein, 9 aa, Homo Sapiens
RKARSLPDR

SEQ ID NO: 270044 - protein, 9 aa, Homo Sapiens
TLILESHNW

SEQ ID NO: 270045 - protein, 9 aa, Homo Sapiens
TKDYELPTC

SEQ ID NO: 270046 - protein, 9 aa, Homo Sapiens
STTGSRQSS

SEQ ID NO: 270047 - protein, 9 aa, Homo Sapiens
VGSRKYAVN

SEQ ID NO: 270048 - protein, 9 aa, Homo Sapiens
LCQVRNYRH

SEQ ID NO: 270049 - protein, 9 aa, Homo Sapiens
RGCRPEKIV

SEQ ID NO: 270050 - protein, 9 aa, Homo Sapiens
VISKEGQRD

SEQ ID NO: 270051 - protein, 9 aa, Homo Sapiens
HDNVFTSVR

SEQ ID NO: 270052 - protein, 9 aa, Homo Sapiens
EVQAKNPKV

SEQ ID NO: 270053 - protein, 9 aa, Homo Sapiens
SVQKKQSES

SEQ ID NO: 270054 - protein, 9 aa, Homo Sapiens
EVEEYPDKD

SEQ ID NO: 270055 - protein, 9 aa, Homo Sapiens
VEVDVAQVR

SEQ ID NO: 270056 - protein, 9 aa, Homo Sapiens
AQLEFQLWD

SEQ ID NO: 270057 - protein, 9 aa, Homo Sapiens
LYLIHEITH

SEQ ID NO: 270058 - protein, 9 aa, Homo Sapiens
GKAQQLPKY

SEQ ID NO: 270059 - protein, 9 aa, Homo Sapiens
FKLNLERHR

SEQ ID NO: 270060 - protein, 9 aa, Homo Sapiens
PWENLNMSD

SEQ ID NO: 270061 - protein, 9 aa, Homo Sapiens
LREADECIK

SEQ ID NO: 270062 - protein, 9 aa, Homo Sapiens
STCSTVSPV

SEQ ID NO: 270063 - protein, 9 aa, Homo Sapiens
LHTNAKVGS

SEQ ID NO: 270064 - protein, 9 aa, Homo Sapiens
SLAETLYST

SEQ ID NO: 270065 - protein, 9 aa, Homo Sapiens
GLIDKNLIA

SEQ ID NO: 270066 - protein, 9 aa, Homo Sapiens
QKVPSGKHK

SEQ ID NO: 270067 - protein, 9 aa, Homo Sapiens
IDLIIYTDE

SEQ ID NO: 270068 - protein, 9 aa, Homo Sapiens
LSNRTPQNL

SEQ ID NO: 270069 - protein, 9 aa, Homo Sapiens
LMTSYLIIL

SEQ ID NO: 270070 - protein, 9 aa, Homo Sapiens
KHRRIHAGE

SEQ ID NO: 270071 - protein, 9 aa, Homo Sapiens
AVTKEAANI

SEQ ID NO: 270072 - protein, 9 aa, Homo Sapiens
TVSLSVEIG

SEQ ID NO: 270073 - protein, 9 aa, Homo Sapiens
RARSQSCEE

SEQ ID NO: 270074 - protein, 9 aa, Homo Sapiens
KDPSKVPLT

SEQ ID NO: 270075 - protein, 9 aa, Homo Sapiens
DDKYSLHRI

SEQ ID NO: 270076 - protein, 9 aa, Homo Sapiens
PQENGLEDP

SEQ ID NO: 270077 - protein, 9 aa, Homo Sapiens
HRDNEHGVA

SEQ ID NO: 270078 - protein, 9 aa, Homo Sapiens
GLHEYLTLI

SEQ ID NO: 270079 - protein, 9 aa, Homo Sapiens
EVIVGEGLN

SEQ ID NO: 270080 - protein, 9 aa, Homo Sapiens
NNERKALKV

SEQ ID NO: 270081 - protein, 9 aa, Homo Sapiens
EHSDIYLQN

SEQ ID NO: 270082 - protein, 9 aa, Homo Sapiens
SLHQNFMLI

SEQ ID NO: 270083 - protein, 9 aa, Homo Sapiens
KTTQPENVD

SEQ ID NO: 270084 - protein, 9 aa, Homo Sapiens
NGETVIFHA

SEQ ID NO: 270085 - protein, 9 aa, Homo Sapiens
WQRKKMTRI

SEQ ID NO: 270086 - protein, 9 aa, Homo Sapiens
SSPGSIEIF

SEQ ID NO: 270087 - protein, 9 aa, Homo Sapiens
TTIDKKHRN

SEQ ID NO: 270088 - protein, 9 aa, Homo Sapiens
SKSKKQDPD

SEQ ID NO: 270089 - protein, 9 aa, Homo Sapiens
SKVLKLTRN

SEQ ID NO: 270090 - protein, 9 aa, Homo Sapiens
EKAMSLECG

SEQ ID NO: 270091 - protein, 9 aa, Homo Sapiens
ARVSPSPMR

SEQ ID NO: 270092 - protein, 9 aa, Homo Sapiens
QEELLVAVK

SEQ ID NO: 270093 - protein, 9 aa, Homo Sapiens
GYCAFYDKC

SEQ ID NO: 270094 - protein, 9 aa, Homo Sapiens
HNSGLIRDS

SEQ ID NO: 270095 - protein, 9 aa, Homo Sapiens
SMQALMHAV

SEQ ID NO: 270096 - protein, 9 aa, Homo Sapiens
LKHIWNWRA

SEQ ID NO: 270097 - protein, 9 aa, Homo Sapiens
RETCSIAVD

SEQ ID NO: 270098 - protein, 9 aa, Homo Sapiens
DLLCHDPDL

SEQ ID NO: 270099 - protein, 9 aa, Homo Sapiens
RYINIVAYY

SEQ ID NO: 270100 - protein, 9 aa, Homo Sapiens
TSLRESKSK

SEQ ID NO: 270101 - protein, 9 aa, Homo Sapiens
DSKVSLQDK

SEQ ID NO: 270102 - protein, 9 aa, Homo Sapiens
ENIGVAGFK

SEQ ID NO: 270103 - protein, 9 aa, Homo Sapiens
PWTKNRMWR

SEQ ID NO: 270104 - protein, 9 aa, Homo Sapiens
VWFRLYGVH

SEQ ID NO: 270105 - protein, 9 aa, Homo Sapiens
IPPGAFIGL

SEQ ID NO: 270106 - protein, 9 aa, Homo Sapiens
LPGHLPGSK

SEQ ID NO: 270107 - protein, 9 aa, Homo Sapiens
HFSKEKDIN

SEQ ID NO: 270108 - protein, 9 aa, Homo Sapiens
DASGRLCGF

SEQ ID NO: 270109 - protein, 9 aa, Homo Sapiens
YKDVRAYQQ

SEQ ID NO: 270110 - protein, 9 aa, Homo Sapiens
AYASAHLTE

SEQ ID NO: 270111 - protein, 9 aa, Homo Sapiens
AGEYFQKAA

SEQ ID NO: 270112 - protein, 9 aa, Homo Sapiens
QIDNVAALP

SEQ ID NO: 270113 - protein, 9 aa, Homo Sapiens
SATLLIQAA

SEQ ID NO: 270114 - protein, 9 aa, Homo Sapiens
ELDLLGDPS

SEQ ID NO: 270115 - protein, 9 aa, Homo Sapiens
ELKAKVMQH

SEQ ID NO: 270116 - protein, 9 aa, Homo Sapiens
TRLDRAQID

SEQ ID NO: 270117 - protein, 9 aa, Homo Sapiens
FDNMKKVWL

SEQ ID NO: 270118 - protein, 9 aa, Homo Sapiens
MGDGELCQG

SEQ ID NO: 270119 - protein, 9 aa, Homo Sapiens
VGDKDKASE

SEQ ID NO: 270120 - protein, 9 aa, Homo Sapiens
LANHRDNEH

SEQ ID NO: 270121 - protein, 9 aa, Homo Sapiens
AFAKLQTDI

SEQ ID NO: 270122 - protein, 9 aa, Homo Sapiens
SFLRTKELD

SEQ ID NO: 270123 - protein, 9 aa, Homo Sapiens
PTSYRPHLL

SEQ ID NO: 270124 - protein, 9 aa, Homo Sapiens
PSFTSIHQI

SEQ ID NO: 270125 - protein, 9 aa, Homo Sapiens
DDLNTVFLR

SEQ ID NO: 270126 - protein, 9 aa, Homo Sapiens
NTFTFDTVF

SEQ ID NO: 270127 - protein, 9 aa, Homo Sapiens
NGLDESLCG

SEQ ID NO: 270128 - protein, 9 aa, Homo Sapiens
LVELVYFEP

SEQ ID NO: 270129 - protein, 9 aa, Homo Sapiens
ILAKKINVH

SEQ ID NO: 270130 - protein, 9 aa, Homo Sapiens
ESLQWEHMG

SEQ ID NO: 270131 - protein, 9 aa, Homo Sapiens
GPDLTTVYV

SEQ ID NO: 270132 - protein, 9 aa, Homo Sapiens
AFTLPFCGP

SEQ ID NO: 270133 - protein, 9 aa, Homo Sapiens
IYFLGPKDA

SEQ ID NO: 270134 - protein, 9 aa, Homo Sapiens
MKTVSLSVE

SEQ ID NO: 270135 - protein, 9 aa, Homo Sapiens
TLVGTQDRI

SEQ ID NO: 270136 - protein, 9 aa, Homo Sapiens
LKAQEYEKG

SEQ ID NO: 270137 - protein, 9 aa, Homo Sapiens
QLLCEMQNP

SEQ ID NO: 270138 - protein, 9 aa, Homo Sapiens
EDTQDKLGE

SEQ ID NO: 270139 - protein, 9 aa, Homo Sapiens
EADANVEGL

SEQ ID NO: 270140 - protein, 9 aa, Homo Sapiens
ADENNVFGS

SEQ ID NO: 270141 - protein, 9 aa, Homo Sapiens
DKTVTSTDV

SEQ ID NO: 270142 - protein, 9 aa, Homo Sapiens
ITFPEFLGF

SEQ ID NO: 270143 - protein, 9 aa, Homo Sapiens
KVMEPTWHI

SEQ ID NO: 270144 - protein, 9 aa, Homo Sapiens
PSHLAYIDN

SEQ ID NO: 270145 - protein, 9 aa, Homo Sapiens
HRYLALPGV

SEQ ID NO: 270146 - protein, 9 aa, Homo Sapiens
SHYKNLKYY

SEQ ID NO: 270147 - protein, 9 aa, Homo Sapiens
YKKFKVGDE

SEQ ID NO: 270148 - protein, 9 aa, Homo Sapiens
TLLIISLAA

SEQ ID NO: 270149 - protein, 9 aa, Homo Sapiens
GLSRPVSQE

SEQ ID NO: 270150 - protein, 9 aa, Homo Sapiens
VIFIVTQCC

SEQ ID NO: 270151 - protein, 9 aa, Homo Sapiens
LSISCLFCG

SEQ ID NO: 270152 - protein, 9 aa, Homo Sapiens
EREQRRTQR

SEQ ID NO: 270153 - protein, 9 aa, Homo Sapiens
DELRRHIIQ

SEQ ID NO: 270154 - protein, 9 aa, Homo Sapiens
ELRSQHNKK

SEQ ID NO: 270155 - protein, 9 aa, Homo Sapiens
LNPDCVRKF

SEQ ID NO: 270156 - protein, 9 aa, Homo Sapiens
YTPQLSAEL

SEQ ID NO: 270157 - protein, 9 aa, Homo Sapiens
EMIVFLDKE

SEQ ID NO: 270158 - protein, 9 aa, Homo Sapiens
HNKSSNEDK

SEQ ID NO: 270159 - protein, 9 aa, Homo Sapiens
TQNGRLYAI

SEQ ID NO: 270160 - protein, 9 aa, Homo Sapiens
ADNIYNDED

SEQ ID NO: 270161 - protein, 9 aa, Homo Sapiens
KSWLCFTME

SEQ ID NO: 270162 - protein, 9 aa, Homo Sapiens
DNLWGSISA

SEQ ID NO: 270163 - protein, 9 aa, Homo Sapiens
DQIATVQHE

SEQ ID NO: 270164 - protein, 9 aa, Homo Sapiens
TSVNYHFTH

SEQ ID NO: 270165 - protein, 9 aa, Homo Sapiens
VSLRHRDNN

SEQ ID NO: 270166 - protein, 9 aa, Homo Sapiens
AYLLLEEGS

SEQ ID NO: 270167 - protein, 9 aa, Homo Sapiens
RAISPTRSS

SEQ ID NO: 270168 - protein, 9 aa, Homo Sapiens
VRDMNRTYV

SEQ ID NO: 270169 - protein, 9 aa, Homo Sapiens
GEFSVRDDV

SEQ ID NO: 270170 - protein, 9 aa, Homo Sapiens
YVILLFFMA

SEQ ID NO: 270171 - protein, 9 aa, Homo Sapiens
YGQRLSFDY

SEQ ID NO: 270172 - protein, 9 aa, Homo Sapiens
TFEDFVRIV

SEQ ID NO: 270173 - protein, 9 aa, Homo Sapiens
QNIKYSFEK

SEQ ID NO: 270174 - protein, 9 aa, Homo Sapiens
LHHIYGKFL

SEQ ID NO: 270175 - protein, 9 aa, Homo Sapiens
MCNTFRCGE

SEQ ID NO: 270176 - protein, 9 aa, Homo Sapiens
GILTGPYGF

SEQ ID NO: 270177 - protein, 9 aa, Homo Sapiens
TADNSVGFV

SEQ ID NO: 270178 - protein, 9 aa, Homo Sapiens
TRLEQDIAT

SEQ ID NO: 270179 - protein, 9 aa, Homo Sapiens
CWGKKKKKN

SEQ ID NO: 270180 - protein, 9 aa, Homo Sapiens
IFIIHVYQN

SEQ ID NO: 270181 - protein, 9 aa, Homo Sapiens
ALRMVWVAW

SEQ ID NO: 270182 - protein, 9 aa, Homo Sapiens
AQLLDDFKI

SEQ ID NO: 270183 - protein, 9 aa, Homo Sapiens
GAPAALSPT

SEQ ID NO: 270184 - protein, 9 aa, Homo Sapiens
CSQVIQHKI

SEQ ID NO: 270185 - protein, 9 aa, Homo Sapiens
QNELIPLIY

SEQ ID NO: 270186 - protein, 9 aa, Homo Sapiens
PEDAFNNFP

SEQ ID NO: 270187 - protein, 9 aa, Homo Sapiens
KVSFWKQLL

SEQ ID NO: 270188 - protein, 9 aa, Homo Sapiens
LQPNNIHDA

SEQ ID NO: 270189 - protein, 9 aa, Homo Sapiens
EQPENAASP

SEQ ID NO: 270190 - protein, 9 aa, Homo Sapiens
IMQVWQMAD

SEQ ID NO: 270191 - protein, 9 aa, Homo Sapiens
KEKEHGEIE

SEQ ID NO: 270192 - protein, 9 aa, Homo Sapiens
SEERVYVVG

SEQ ID NO: 270193 - protein, 9 aa, Homo Sapiens
MLNAGQDAS

SEQ ID NO: 270194 - protein, 9 aa, Homo Sapiens
HEKYMELSF

SEQ ID NO: 270195 - protein, 9 aa, Homo Sapiens
SHLMKKPCF

SEQ ID NO: 270196 - protein, 9 aa, Homo Sapiens
ALRVLLCHP

SEQ ID NO: 270197 - protein, 9 aa, Homo Sapiens
ELQAWTGKI

SEQ ID NO: 270198 - protein, 9 aa, Homo Sapiens
RWLLLDFKR

SEQ ID NO: 270199 - protein, 9 aa, Homo Sapiens
PDVARYLIS

SEQ ID NO: 270200 - protein, 9 aa, Homo Sapiens
VKRVLNNLS

SEQ ID NO: 270201 - protein, 9 aa, Homo Sapiens
RRIEDFSSI

SEQ ID NO: 270202 - protein, 9 aa, Homo Sapiens
QVMFMCCCC

SEQ ID NO: 270203 - protein, 9 aa, Homo Sapiens
VWISFIPTY

SEQ ID NO: 270204 - protein, 9 aa, Homo Sapiens
NVGGIIGGI

SEQ ID NO: 270205 - protein, 9 aa, Homo Sapiens
HQVSEGVSA

SEQ ID NO: 270206 - protein, 9 aa, Homo Sapiens
GLTTQDLQE

SEQ ID NO: 270207 - protein, 9 aa, Homo Sapiens
PTNTLLLEH

SEQ ID NO: 270208 - protein, 9 aa, Homo Sapiens
KRLLPSIGV

SEQ ID NO: 270209 - protein, 9 aa, Homo Sapiens
RKIADMQGK

SEQ ID NO: 270210 - protein, 9 aa, Homo Sapiens
ASVAESSTN

SEQ ID NO: 270211 - protein, 9 aa, Homo Sapiens
YRMYEEQRV

SEQ ID NO: 270212 - protein, 9 aa, Homo Sapiens
MSPELRCMP

SEQ ID NO: 270213 - protein, 9 aa, Homo Sapiens
TTSPVLGLE

SEQ ID NO: 270214 - protein, 9 aa, Homo Sapiens
EYPREDEQF

SEQ ID NO: 270215 - protein, 9 aa, Homo Sapiens
MNITFQNIV

SEQ ID NO: 270216 - protein, 9 aa, Homo Sapiens
AQVLSEDGD

SEQ ID NO: 270217 - protein, 9 aa, Homo Sapiens
CNKLASFSF

SEQ ID NO: 270218 - protein, 9 aa, Homo Sapiens
QNEAKLDES

SEQ ID NO: 270219 - protein, 9 aa, Homo Sapiens
IKEGLHDLE

SEQ ID NO: 270220 - protein, 9 aa, Homo Sapiens
LNEIISDPE

SEQ ID NO: 270221 - protein, 9 aa, Homo Sapiens
TCSEITKNI

SEQ ID NO: 270222 - protein, 9 aa, Homo Sapiens
TGTTCINGE

SEQ ID NO: 270223 - protein, 9 aa, Homo Sapiens
LFLMDVLLR

SEQ ID NO: 270224 - protein, 9 aa, Homo Sapiens
IGKIRVSGK

SEQ ID NO: 270225 - protein, 9 aa, Homo Sapiens
GIDFCSEAI

SEQ ID NO: 270226 - protein, 9 aa, Homo Sapiens
SLCSTPLSQ

SEQ ID NO: 270227 - protein, 9 aa, Homo Sapiens
FITQVKNYL

SEQ ID NO: 270228 - protein, 9 aa, Homo Sapiens
YKGLWSVCV

SEQ ID NO: 270229 - protein, 9 aa, Homo Sapiens
SCQLPCEQK

SEQ ID NO: 270230 - protein, 9 aa, Homo Sapiens
VVPEKPNKV

SEQ ID NO: 270231 - protein, 9 aa, Homo Sapiens
ERQSTYNLI

SEQ ID NO: 270232 - protein, 9 aa, Homo Sapiens
NQINRNNTF

SEQ ID NO: 270233 - protein, 9 aa, Homo Sapiens
NVAALHLYL

SEQ ID NO: 270234 - protein, 9 aa, Homo Sapiens
KELSKMQLF

SEQ ID NO: 270235 - protein, 9 aa, Homo Sapiens
IIFNISNKL

SEQ ID NO: 270236 - protein, 9 aa, Homo Sapiens
LMGETKVKQ

SEQ ID NO: 270237 - protein, 9 aa, Homo Sapiens
QTADADSES

SEQ ID NO: 270238 - protein, 9 aa, Homo Sapiens
IYPDRIEEL

SEQ ID NO: 270239 - protein, 9 aa, Homo Sapiens
IGSSPERFP

SEQ ID NO: 270240 - protein, 9 aa, Homo Sapiens
NESDPRLTP

SEQ ID NO: 270241 - protein, 9 aa, Homo Sapiens
QGADSEIMF

SEQ ID NO: 270242 - protein, 9 aa, Homo Sapiens
CCECSLLGS

SEQ ID NO: 270243 - protein, 9 aa, Homo Sapiens
FEINAFKLK

SEQ ID NO: 270244 - protein, 9 aa, Homo Sapiens
HVHLMGDIL

SEQ ID NO: 270245 - protein, 9 aa, Homo Sapiens
NGGRPFLQA

SEQ ID NO: 270246 - protein, 9 aa, Homo Sapiens
QIASWKLAP

SEQ ID NO: 270247 - protein, 9 aa, Homo Sapiens
LFKQIFGDQ

SEQ ID NO: 270248 - protein, 9 aa, Homo Sapiens
GRKFYMDKV

SEQ ID NO: 270249 - protein, 9 aa, Homo Sapiens
YERECKLPK

SEQ ID NO: 270250 - protein, 9 aa, Homo Sapiens
HSRNKNYKA

SEQ ID NO: 270251 - protein, 9 aa, Homo Sapiens
KCFSGEVYW

SEQ ID NO: 270252 - protein, 9 aa, Homo Sapiens
FTDEELGLL

SEQ ID NO: 270253 - protein, 9 aa, Homo Sapiens
YEVKGLQAY

SEQ ID NO: 270254 - protein, 9 aa, Homo Sapiens
GGVLNNKTL

SEQ ID NO: 270255 - protein, 9 aa, Homo Sapiens
PIATAGLHC

SEQ ID NO: 270256 - protein, 9 aa, Homo Sapiens
TGNTPFVCT

SEQ ID NO: 270257 - protein, 9 aa, Homo Sapiens
DPHLHIPMH

SEQ ID NO: 270258 - protein, 9 aa, Homo Sapiens
VSVPADTPL

SEQ ID NO: 270259 - protein, 9 aa, Homo Sapiens
SISTNKTQI

SEQ ID NO: 270260 - protein, 9 aa, Homo Sapiens
DFMTLFFAH

SEQ ID NO: 270261 - protein, 9 aa, Homo Sapiens
SYFSQKACA

SEQ ID NO: 270262 - protein, 9 aa, Homo Sapiens
EENAEKALY

SEQ ID NO: 270263 - protein, 9 aa, Homo Sapiens
EPKSTKKES

SEQ ID NO: 270264 - protein, 9 aa, Homo Sapiens
GMCLNIAVT

SEQ ID NO: 270265 - protein, 9 aa, Homo Sapiens
QEDILVPYS

SEQ ID NO: 270266 - protein, 9 aa, Homo Sapiens
QHLVIPWAP

SEQ ID NO: 270267 - protein, 9 aa, Homo Sapiens
TAVWHQNGG

SEQ ID NO: 270268 - protein, 9 aa, Homo Sapiens
EASENKCIH

SEQ ID NO: 270269 - protein, 9 aa, Homo Sapiens
SPLCVIPTS

SEQ ID NO: 270270 - protein, 9 aa, Homo Sapiens
EFLKEKEQQ

SEQ ID NO: 270271 - protein, 9 aa, Homo Sapiens
LQGIADYIP

SEQ ID NO: 270272 - protein, 9 aa, Homo Sapiens
HCSSPDLQR

SEQ ID NO: 270273 - protein, 9 aa, Homo Sapiens
PSPHKPPYN

SEQ ID NO: 270274 - protein, 9 aa, Homo Sapiens
SIMHLCAIL

SEQ ID NO: 270275 - protein, 9 aa, Homo Sapiens
LKPLAVPPG

SEQ ID NO: 270276 - protein, 9 aa, Homo Sapiens
HTSIRTIEK

SEQ ID NO: 270277 - protein, 9 aa, Homo Sapiens
QRKRMKMDK

SEQ ID NO: 270278 - protein, 9 aa, Homo Sapiens
CVLSSDLRH

SEQ ID NO: 270279 - protein, 9 aa, Homo Sapiens
LRFGVQVLQ

SEQ ID NO: 270280 - protein, 9 aa, Homo Sapiens
NSGGGPSKK

SEQ ID NO: 270281 - protein, 9 aa, Homo Sapiens
FISGDINRT

SEQ ID NO: 270282 - protein, 9 aa, Homo Sapiens
EANIRAKEK

SEQ ID NO: 270283 - protein, 9 aa, Homo Sapiens
VHWHKSKGQ

SEQ ID NO: 270284 - protein, 9 aa, Homo Sapiens
FCLGKHSGR

SEQ ID NO: 270285 - protein, 9 aa, Homo Sapiens
IELFPTSLS

SEQ ID NO: 270286 - protein, 9 aa, Homo Sapiens
VTQNVLILE

SEQ ID NO: 270287 - protein, 9 aa, Homo Sapiens
KNALNGIHF

SEQ ID NO: 270288 - protein, 9 aa, Homo Sapiens
AKENFYHVA

SEQ ID NO: 270289 - protein, 9 aa, Homo Sapiens
LNLATMDTI

SEQ ID NO: 270290 - protein, 9 aa, Homo Sapiens
QASINNRQK

SEQ ID NO: 270291 - protein, 9 aa, Homo Sapiens
ERDLTNRAS

SEQ ID NO: 270292 - protein, 9 aa, Homo Sapiens
FVYGGNCFN

SEQ ID NO: 270293 - protein, 9 aa, Homo Sapiens
VQTHFSTAY

SEQ ID NO: 270294 - protein, 9 aa, Homo Sapiens
KGPQVTACH

SEQ ID NO: 270295 - protein, 9 aa, Homo Sapiens
RTEDKNFYL

SEQ ID NO: 270296 - protein, 9 aa, Homo Sapiens
PIETFILGS

SEQ ID NO: 270297 - protein, 9 aa, Homo Sapiens
VNIGMKGLI

SEQ ID NO: 270298 - protein, 9 aa, Homo Sapiens
NPGHFLDVN

SEQ ID NO: 270299 - protein, 9 aa, Homo Sapiens
NKWSHNNSP

SEQ ID NO: 270300 - protein, 9 aa, Homo Sapiens
GTATSSLGT

SEQ ID NO: 270301 - protein, 9 aa, Homo Sapiens
WEAFQDGDK

SEQ ID NO: 270302 - protein, 9 aa, Homo Sapiens
LEIDERGPS

SEQ ID NO: 270303 - protein, 9 aa, Homo Sapiens
NGLFAFLSS

SEQ ID NO: 270304 - protein, 9 aa, Homo Sapiens
FLTCVSAHR

SEQ ID NO: 270305 - protein, 9 aa, Homo Sapiens
SVKGAPESH

SEQ ID NO: 270306 - protein, 9 aa, Homo Sapiens
FEAGPTGTG

SEQ ID NO: 270307 - protein, 9 aa, Homo Sapiens
VCILTACFL

SEQ ID NO: 270308 - protein, 9 aa, Homo Sapiens
VGQLMEPCR

SEQ ID NO: 270309 - protein, 9 aa, Homo Sapiens
RDSYSSPSR

SEQ ID NO: 270310 - protein, 9 aa, Homo Sapiens
LAINSGGIP

SEQ ID NO: 270311 - protein, 9 aa, Homo Sapiens
NALRGLCSL

SEQ ID NO: 270312 - protein, 9 aa, Homo Sapiens
DDYDREGSV

SEQ ID NO: 270313 - protein, 9 aa, Homo Sapiens
LFIVGIYVL

SEQ ID NO: 270314 - protein, 9 aa, Homo Sapiens
INENIYQIY

SEQ ID NO: 270315 - protein, 9 aa, Homo Sapiens
CTIRMSCVK

SEQ ID NO: 270316 - protein, 9 aa, Homo Sapiens
MQEEQNKLI

SEQ ID NO: 270317 - protein, 9 aa, Homo Sapiens
ISPYLNPDR

SEQ ID NO: 270318 - protein, 9 aa, Homo Sapiens
SVHEYYDPN

SEQ ID NO: 270319 - protein, 9 aa, Homo Sapiens
AFMFVAWMT

SEQ ID NO: 270320 - protein, 9 aa, Homo Sapiens
LCVGPSDLL

SEQ ID NO: 270321 - protein, 9 aa, Homo Sapiens
YFIITRYKI

SEQ ID NO: 270322 - protein, 9 aa, Homo Sapiens
LKHLCHSAA

SEQ ID NO: 270323 - protein, 9 aa, Homo Sapiens
ERLSALLDW

SEQ ID NO: 270324 - protein, 9 aa, Homo Sapiens
KYVAELSIL

SEQ ID NO: 270325 - protein, 9 aa, Homo Sapiens
CTEECKALS

SEQ ID NO: 270326 - protein, 9 aa, Homo Sapiens
NDDLNTVFL

SEQ ID NO: 270327 - protein, 9 aa, Homo Sapiens
SKPPKEELL

SEQ ID NO: 270328 - protein, 9 aa, Homo Sapiens
QLREHMQQL

SEQ ID NO: 270329 - protein, 9 aa, Homo Sapiens
TAMGKNYGN

SEQ ID NO: 270330 - protein, 9 aa, Homo Sapiens
RLLGTFSLA

SEQ ID NO: 270331 - protein, 9 aa, Homo Sapiens
ETLGFSAAC

SEQ ID NO: 270332 - protein, 9 aa, Homo Sapiens
VAQNNYFNI

SEQ ID NO: 270333 - protein, 9 aa, Homo Sapiens
NKKSISYVG

SEQ ID NO: 270334 - protein, 9 aa, Homo Sapiens
YGHLISGSL

SEQ ID NO: 270335 - protein, 9 aa, Homo Sapiens
DPQALTVKF

SEQ ID NO: 270336 - protein, 9 aa, Homo Sapiens
DNMVLLSKI

SEQ ID NO: 270337 - protein, 9 aa, Homo Sapiens
FVIPSIKDS

SEQ ID NO: 270338 - protein, 9 aa, Homo Sapiens
ALLRSVPHF

SEQ ID NO: 270339 - protein, 9 aa, Homo Sapiens
IYANGILNV

SEQ ID NO: 270340 - protein, 9 aa, Homo Sapiens
TNTKKKKIN

SEQ ID NO: 270341 - protein, 9 aa, Homo Sapiens
FGNIVFTGL

SEQ ID NO: 270342 - protein, 9 aa, Homo Sapiens
KDNNSGAGE

SEQ ID NO: 270343 - protein, 9 aa, Homo Sapiens
AQNSPKGCD

SEQ ID NO: 270344 - protein, 9 aa, Homo Sapiens
NEPPNTFTF

SEQ ID NO: 270345 - protein, 9 aa, Homo Sapiens
VWNQLFVLE

SEQ ID NO: 270346 - protein, 9 aa, Homo Sapiens
PGSIEIFFQ

SEQ ID NO: 270347 - protein, 9 aa, Homo Sapiens
YFIWVSAKD

SEQ ID NO: 270348 - protein, 9 aa, Homo Sapiens
PPLVVIHPK

SEQ ID NO: 270349 - protein, 9 aa, Homo Sapiens
QVGALHPAN

SEQ ID NO: 270350 - protein, 9 aa, Homo Sapiens
FIMDSYSKQ

SEQ ID NO: 270351 - protein, 9 aa, Homo Sapiens
GVCLYYRVM

SEQ ID NO: 270352 - protein, 9 aa, Homo Sapiens
GEAEKYNLV

SEQ ID NO: 270353 - protein, 9 aa, Homo Sapiens
KLYEKSLEF

SEQ ID NO: 270354 - protein, 9 aa, Homo Sapiens
PERIAIAVV

SEQ ID NO: 270355 - protein, 9 aa, Homo Sapiens
LGLVLGGII

SEQ ID NO: 270356 - protein, 9 aa, Homo Sapiens
AAVTSAQVM

SEQ ID NO: 270357 - protein, 9 aa, Homo Sapiens
FKYGWDNLS

SEQ ID NO: 270358 - protein, 9 aa, Homo Sapiens
LETTCPQCH

SEQ ID NO: 270359 - protein, 9 aa, Homo Sapiens
EPIGTRIAK

SEQ ID NO: 270360 - protein, 9 aa, Homo Sapiens
SKRTVSTVL

SEQ ID NO: 270361 - protein, 9 aa, Homo Sapiens
YVVGCHRQL

SEQ ID NO: 270362 - protein, 9 aa, Homo Sapiens
SVTSEENNS

SEQ ID NO: 270363 - protein, 9 aa, Homo Sapiens
AGAVDMLVN

SEQ ID NO: 270364 - protein, 9 aa, Homo Sapiens
INSGGIPLF

SEQ ID NO: 270365 - protein, 9 aa, Homo Sapiens
IHENLLESR

SEQ ID NO: 270366 - protein, 9 aa, Homo Sapiens
DDHEDHDDL

SEQ ID NO: 270367 - protein, 9 aa, Homo Sapiens
EICPLIAAA

SEQ ID NO: 270368 - protein, 9 aa, Homo Sapiens
KGWMSVSGP

SEQ ID NO: 270369 - protein, 9 aa, Homo Sapiens
LIRTIRTAQ

SEQ ID NO: 270370 - protein, 9 aa, Homo Sapiens
AKNPKVSRG

SEQ ID NO: 270371 - protein, 9 aa, Homo Sapiens
HGSGEFSHS

SEQ ID NO: 270372 - protein, 9 aa, Homo Sapiens
LIGLDDSLQ

SEQ ID NO: 270373 - protein, 9 aa, Homo Sapiens
ETEYAASKF

SEQ ID NO: 270374 - protein, 9 aa, Homo Sapiens
RLRKHQIHI

SEQ ID NO: 270375 - protein, 9 aa, Homo Sapiens
PKKSADNFI

SEQ ID NO: 270376 - protein, 9 aa, Homo Sapiens
SMAFESTMY

SEQ ID NO: 270377 - protein, 9 aa, Homo Sapiens
LLIQAAKNL

SEQ ID NO: 270378 - protein, 9 aa, Homo Sapiens
KEEPDPGFK

SEQ ID NO: 270379 - protein, 9 aa, Homo Sapiens
INSKKLNND

SEQ ID NO: 270380 - protein, 9 aa, Homo Sapiens
MQNSAFPPA

SEQ ID NO: 270381 - protein, 9 aa, Homo Sapiens
VGDIGDNVE

SEQ ID NO: 270382 - protein, 9 aa, Homo Sapiens
EHGNIPVVR

SEQ ID NO: 270383 - protein, 9 aa, Homo Sapiens
AQLVQFMLT

SEQ ID NO: 270384 - protein, 9 aa, Homo Sapiens
VIPRIVQDI

SEQ ID NO: 270385 - protein, 9 aa, Homo Sapiens
THGPDKDKH

SEQ ID NO: 270386 - protein, 9 aa, Homo Sapiens
STPVEEVDA

SEQ ID NO: 270387 - protein, 9 aa, Homo Sapiens
MVPPLPSEI

SEQ ID NO: 270388 - protein, 9 aa, Homo Sapiens
KLFDANYDG

SEQ ID NO: 270389 - protein, 9 aa, Homo Sapiens
RATKNTADH

SEQ ID NO: 270390 - protein, 9 aa, Homo Sapiens
SEGVSALKE

SEQ ID NO: 270391 - protein, 9 aa, Homo Sapiens
QYTTAVVVI

SEQ ID NO: 270392 - protein, 9 aa, Homo Sapiens
YPGAQLDIL

SEQ ID NO: 270393 - protein, 9 aa, Homo Sapiens
VSIPSRSFL

SEQ ID NO: 270394 - protein, 9 aa, Homo Sapiens
APTVNPTLG

SEQ ID NO: 270395 - protein, 9 aa, Homo Sapiens
SVFASPESV

SEQ ID NO: 270396 - protein, 9 aa, Homo Sapiens
PYKILFKAK

SEQ ID NO: 270397 - protein, 9 aa, Homo Sapiens
KGKTPEEIC

SEQ ID NO: 270398 - protein, 9 aa, Homo Sapiens
KAKHQGPQE

SEQ ID NO: 270399 - protein, 9 aa, Homo Sapiens
HYPPYTEWN

SEQ ID NO: 270400 - protein, 9 aa, Homo Sapiens
MATSAIPPS

SEQ ID NO: 270401 - protein, 9 aa, Homo Sapiens
NVTSKGACF

SEQ ID NO: 270402 - protein, 9 aa, Homo Sapiens
FLYNQGPEY

SEQ ID NO: 270403 - protein, 9 aa, Homo Sapiens
AEEEGDDQA

SEQ ID NO: 270404 - protein, 9 aa, Homo Sapiens
RKDVAQDDA

SEQ ID NO: 270405 - protein, 9 aa, Homo Sapiens
ESSATDYDY

SEQ ID NO: 270406 - protein, 9 aa, Homo Sapiens
NKLVDPLCS

SEQ ID NO: 270407 - protein, 9 aa, Homo Sapiens
GIPNIDYSY

SEQ ID NO: 270408 - protein, 9 aa, Homo Sapiens
NFGYKLVMV

SEQ ID NO: 270409 - protein, 9 aa, Homo Sapiens
GFKKSYSHS

SEQ ID NO: 270410 - protein, 9 aa, Homo Sapiens
ANAFHSPCQ

SEQ ID NO: 270411 - protein, 9 aa, Homo Sapiens
KMKLFPMEP

SEQ ID NO: 270412 - protein, 9 aa, Homo Sapiens
SMENGALDS

SEQ ID NO: 270413 - protein, 9 aa, Homo Sapiens
KTFIILNKG

SEQ ID NO: 270414 - protein, 9 aa, Homo Sapiens
PVVIKLSDL

SEQ ID NO: 270415 - protein, 9 aa, Homo Sapiens
NRLDMHGEK

SEQ ID NO: 270416 - protein, 9 aa, Homo Sapiens
EQPERICQR

SEQ ID NO: 270417 - protein, 9 aa, Homo Sapiens
YILNKHLKG

SEQ ID NO: 270418 - protein, 9 aa, Homo Sapiens
GSYYCTCNP

SEQ ID NO: 270419 - protein, 9 aa, Homo Sapiens
ASTRLEKDK

SEQ ID NO: 270420 - protein, 9 aa, Homo Sapiens
GVNLLQQYY

SEQ ID NO: 270421 - protein, 9 aa, Homo Sapiens
EPNQLVQPA

SEQ ID NO: 270422 - protein, 9 aa, Homo Sapiens
IAEKPYKCK

SEQ ID NO: 270423 - protein, 9 aa, Homo Sapiens
QTTAMFRPS

SEQ ID NO: 270424 - protein, 9 aa, Homo Sapiens
LIHQKVHTG

SEQ ID NO: 270425 - protein, 9 aa, Homo Sapiens
LFNKVVPHH

SEQ ID NO: 270426 - protein, 9 aa, Homo Sapiens
LELKTINYA

SEQ ID NO: 270427 - protein, 9 aa, Homo Sapiens
SKKKEDDVP

SEQ ID NO: 270428 - protein, 9 aa, Homo Sapiens
ANQHTFHLE

SEQ ID NO: 270429 - protein, 9 aa, Homo Sapiens
QGKTFIRAP

SEQ ID NO: 270430 - protein, 9 aa, Homo Sapiens
HKFLETEKD

SEQ ID NO: 270431 - protein, 9 aa, Homo Sapiens
AICFVCGIF

SEQ ID NO: 270432 - protein, 9 aa, Homo Sapiens
PNNIHDARF

SEQ ID NO: 270433 - protein, 9 aa, Homo Sapiens
QGSDFLRFQ

SEQ ID NO: 270434 - protein, 9 aa, Homo Sapiens
KTIKQYQQD

SEQ ID NO: 270435 - protein, 9 aa, Homo Sapiens
FFQKPDSCP

SEQ ID NO: 270436 - protein, 9 aa, Homo Sapiens
NIIITSLTV

SEQ ID NO: 270437 - protein, 9 aa, Homo Sapiens
TQNVITDMR

SEQ ID NO: 270438 - protein, 9 aa, Homo Sapiens
LGQVGALHP

SEQ ID NO: 270439 - protein, 9 aa, Homo Sapiens
DKEDNARKI

SEQ ID NO: 270440 - protein, 9 aa, Homo Sapiens
DVLPKAAST

SEQ ID NO: 270441 - protein, 9 aa, Homo Sapiens
IDGLLMLLY

SEQ ID NO: 270442 - protein, 9 aa, Homo Sapiens
GKDPAHFNL

SEQ ID NO: 270443 - protein, 9 aa, Homo Sapiens
EELDLFLKG

SEQ ID NO: 270444 - protein, 9 aa, Homo Sapiens
EHLEGHKHK

SEQ ID NO: 270445 - protein, 9 aa, Homo Sapiens
PVFVRCLTD

SEQ ID NO: 270446 - protein, 9 aa, Homo Sapiens
GSQPSMKQV

SEQ ID NO: 270447 - protein, 9 aa, Homo Sapiens
MRESSQDVI

SEQ ID NO: 270448 - protein, 9 aa, Homo Sapiens
SCGACKAFF

SEQ ID NO: 270449 - protein, 9 aa, Homo Sapiens
SDNLCSYIF

SEQ ID NO: 270450 - protein, 9 aa, Homo Sapiens
NEVYICLDF

SEQ ID NO: 270451 - protein, 9 aa, Homo Sapiens
YPDKDKEIK

SEQ ID NO: 270452 - protein, 9 aa, Homo Sapiens
MPDVWTIMP

SEQ ID NO: 270453 - protein, 9 aa, Homo Sapiens
KALDPKIYR

SEQ ID NO: 270454 - protein, 9 aa, Homo Sapiens
ERFKDNKPN

SEQ ID NO: 270455 - protein, 9 aa, Homo Sapiens
EYVDGSNLI

SEQ ID NO: 270456 - protein, 9 aa, Homo Sapiens
LSEAISLII

SEQ ID NO: 270457 - protein, 9 aa, Homo Sapiens
LCTIMGETF

SEQ ID NO: 270458 - protein, 9 aa, Homo Sapiens
TDTMPASLS

SEQ ID NO: 270459 - protein, 9 aa, Homo Sapiens
NEDGPSSEK

SEQ ID NO: 270460 - protein, 9 aa, Homo Sapiens
LEAIARPVT

SEQ ID NO: 270461 - protein, 9 aa, Homo Sapiens
SGEGSQPSH

SEQ ID NO: 270462 - protein, 9 aa, Homo Sapiens
DYFQKVILR

SEQ ID NO: 270463 - protein, 9 aa, Homo Sapiens
IHGRIKDFM

SEQ ID NO: 270464 - protein, 9 aa, Homo Sapiens
VDNLIPIEP

SEQ ID NO: 270465 - protein, 9 aa, Homo Sapiens
EDSCETMME

SEQ ID NO: 270466 - protein, 9 aa, Homo Sapiens
KSVAISVAS

SEQ ID NO: 270467 - protein, 9 aa, Homo Sapiens
LCQEKYQLQ

SEQ ID NO: 270468 - protein, 9 aa, Homo Sapiens
HHSFQTQEI

SEQ ID NO: 270469 - protein, 9 aa, Homo Sapiens
GRASCTLHC

SEQ ID NO: 270470 - protein, 9 aa, Homo Sapiens
IESLEHVQF

SEQ ID NO: 270471 - protein, 9 aa, Homo Sapiens
KLKLLVLED

SEQ ID NO: 270472 - protein, 9 aa, Homo Sapiens
SNNVERKKG

SEQ ID NO: 270473 - protein, 9 aa, Homo Sapiens
AGPVGTAGT

SEQ ID NO: 270474 - protein, 9 aa, Homo Sapiens
CQDCIRNKI

SEQ ID NO: 270475 - protein, 9 aa, Homo Sapiens
AGVSLLLAG

SEQ ID NO: 270476 - protein, 9 aa, Homo Sapiens
VEDLFLENA

SEQ ID NO: 270477 - protein, 9 aa, Homo Sapiens
DPYKMCWGG

SEQ ID NO: 270478 - protein, 9 aa, Homo Sapiens
LKDIYRTMN

SEQ ID NO: 270479 - protein, 9 aa, Homo Sapiens
QGQNKTKPE

SEQ ID NO: 270480 - protein, 9 aa, Homo Sapiens
RVTANLSLA

SEQ ID NO: 270481 - protein, 9 aa, Homo Sapiens
IQTYFIWVS

SEQ ID NO: 270482 - protein, 9 aa, Homo Sapiens
CKRSPAALR

SEQ ID NO: 270483 - protein, 9 aa, Homo Sapiens
GALHLILLP

SEQ ID NO: 270484 - protein, 9 aa, Homo Sapiens
YLTRNSSIL

SEQ ID NO: 270485 - protein, 9 aa, Homo Sapiens
ELVNPEPST

SEQ ID NO: 270486 - protein, 9 aa, Homo Sapiens
GYLMITCVT

SEQ ID NO: 270487 - protein, 9 aa, Homo Sapiens
RVCYHERLS

SEQ ID NO: 270488 - protein, 9 aa, Homo Sapiens
VLILLVRYQ

SEQ ID NO: 270489 - protein, 9 aa, Homo Sapiens
PDEVFGIFD

SEQ ID NO: 270490 - protein, 9 aa, Homo Sapiens
PLYYLVFTV

SEQ ID NO: 270491 - protein, 9 aa, Homo Sapiens
KMSSDKISI

SEQ ID NO: 270492 - protein, 9 aa, Homo Sapiens
VWPIKDPSK

SEQ ID NO: 270493 - protein, 9 aa, Homo Sapiens
PSGPCVLSS

SEQ ID NO: 270494 - protein, 9 aa, Homo Sapiens
QNIHTGQKP

SEQ ID NO: 270495 - protein, 9 aa, Homo Sapiens
TFTYHTRPH

SEQ ID NO: 270496 - protein, 9 aa, Homo Sapiens
SLCYSPKDE

SEQ ID NO: 270497 - protein, 9 aa, Homo Sapiens
PPVTFAKKG

SEQ ID NO: 270498 - protein, 9 aa, Homo Sapiens
KLEQLGRYQ

SEQ ID NO: 270499 - protein, 9 aa, Homo Sapiens
QKSNLDQAD

SEQ ID NO: 270500 - protein, 9 aa, Homo Sapiens
KNETGPYQC

SEQ ID NO: 270501 - protein, 9 aa, Homo Sapiens
SLSECGAPR

SEQ ID NO: 270502 - protein, 9 aa, Homo Sapiens
HHNLSLHSK

SEQ ID NO: 270503 - protein, 9 aa, Homo Sapiens
WRNHHCAHF

SEQ ID NO: 270504 - protein, 9 aa, Homo Sapiens
NIYTPKKYQ

SEQ ID NO: 270505 - protein, 9 aa, Homo Sapiens
EASLATDLK

SEQ ID NO: 270506 - protein, 9 aa, Homo Sapiens
FRYNTRVYK

SEQ ID NO: 270507 - protein, 9 aa, Homo Sapiens
CSLIDKKKH

SEQ ID NO: 270508 - protein, 9 aa, Homo Sapiens
RVPVRAFLP

SEQ ID NO: 270509 - protein, 9 aa, Homo Sapiens
SANDVFPCS

SEQ ID NO: 270510 - protein, 9 aa, Homo Sapiens
NRNCKQKCR

SEQ ID NO: 270511 - protein, 9 aa, Homo Sapiens
EDFYFSEAP

SEQ ID NO: 270512 - protein, 9 aa, Homo Sapiens
NIKIIQTLS

SEQ ID NO: 270513 - protein, 9 aa, Homo Sapiens
HPRPFGRPV

SEQ ID NO: 270514 - protein, 9 aa, Homo Sapiens
QSRNLNCTA

SEQ ID NO: 270515 - protein, 9 aa, Homo Sapiens
PGDNAIFES

SEQ ID NO: 270516 - protein, 9 aa, Homo Sapiens
TFDPFIYLP

SEQ ID NO: 270517 - protein, 9 aa, Homo Sapiens
LTKHRRIHA

SEQ ID NO: 270518 - protein, 9 aa, Homo Sapiens
QKAWKMQGV

SEQ ID NO: 270519 - protein, 9 aa, Homo Sapiens
KNKLSCLWI

SEQ ID NO: 270520 - protein, 9 aa, Homo Sapiens
CAHFTDEEN

SEQ ID NO: 270521 - protein, 9 aa, Homo Sapiens
NGTVCHPKY

SEQ ID NO: 270522 - protein, 9 aa, Homo Sapiens
ACIAQMFFI

SEQ ID NO: 270523 - protein, 9 aa, Homo Sapiens
QSVSTGSSR

SEQ ID NO: 270524 - protein, 9 aa, Homo Sapiens
DDHGGRQGY

SEQ ID NO: 270525 - protein, 9 aa, Homo Sapiens
RAWVAWINR

SEQ ID NO: 270526 - protein, 9 aa, Homo Sapiens
NKSESEPDL

SEQ ID NO: 270527 - protein, 9 aa, Homo Sapiens
QQDGLDKVH

SEQ ID NO: 270528 - protein, 9 aa, Homo Sapiens
KHFRSGYQL

SEQ ID NO: 270529 - protein, 9 aa, Homo Sapiens
SLICHHRSH

SEQ ID NO: 270530 - protein, 9 aa, Homo Sapiens
VTRSRADAE

SEQ ID NO: 270531 - protein, 9 aa, Homo Sapiens
ELPIHLHQI

SEQ ID NO: 270532 - protein, 9 aa, Homo Sapiens
DGTLIVVGV

SEQ ID NO: 270533 - protein, 9 aa, Homo Sapiens
GERKQFAGV

SEQ ID NO: 270534 - protein, 9 aa, Homo Sapiens
TVSQSISGY

SEQ ID NO: 270535 - protein, 9 aa, Homo Sapiens
TFSGGTYQD

SEQ ID NO: 270536 - protein, 9 aa, Homo Sapiens
TKVDLFAVE

SEQ ID NO: 270537 - protein, 9 aa, Homo Sapiens
KVLISLLET

SEQ ID NO: 270538 - protein, 9 aa, Homo Sapiens
VARLPIHMF

SEQ ID NO: 270539 - protein, 9 aa, Homo Sapiens
QSWSWCRIP

SEQ ID NO: 270540 - protein, 9 aa, Homo Sapiens
QLEKQQEQQ

SEQ ID NO: 270541 - protein, 9 aa, Homo Sapiens
FIYPHIESH

SEQ ID NO: 270542 - protein, 9 aa, Homo Sapiens
QTVECYNPH

SEQ ID NO: 270543 - protein, 9 aa, Homo Sapiens
TVFLRYERF

SEQ ID NO: 270544 - protein, 9 aa, Homo Sapiens
RNSAGNVKL

SEQ ID NO: 270545 - protein, 9 aa, Homo Sapiens
NRDNFTQTL

SEQ ID NO: 270546 - protein, 9 aa, Homo Sapiens
LQVKISDLI

SEQ ID NO: 270547 - protein, 9 aa, Homo Sapiens
AVASLTNII

SEQ ID NO: 270548 - protein, 9 aa, Homo Sapiens
ISTSSKAES

SEQ ID NO: 270549 - protein, 9 aa, Homo Sapiens
AVLQQLVVA

SEQ ID NO: 270550 - protein, 9 aa, Homo Sapiens
LENQNILIQ

SEQ ID NO: 270551 - protein, 9 aa, Homo Sapiens
NDWFQLESN

SEQ ID NO: 270552 - protein, 9 aa, Homo Sapiens
CLLRPWFYN

SEQ ID NO: 270553 - protein, 9 aa, Homo Sapiens
KTFTFRDPH

SEQ ID NO: 270554 - protein, 9 aa, Homo Sapiens
SEPVTTPCG

SEQ ID NO: 270555 - protein, 9 aa, Homo Sapiens
TWSFLLEEH

SEQ ID NO: 270556 - protein, 9 aa, Homo Sapiens
PILIIEGVL

SEQ ID NO: 270557 - protein, 9 aa, Homo Sapiens
WATYYLLQS

SEQ ID NO: 270558 - protein, 9 aa, Homo Sapiens
PRPFGRPVS

SEQ ID NO: 270559 - protein, 9 aa, Homo Sapiens
FIDMPGAAH

SEQ ID NO: 270560 - protein, 9 aa, Homo Sapiens
DHDDLEKVN

SEQ ID NO: 270561 - protein, 9 aa, Homo Sapiens
ATPIMNAKD

SEQ ID NO: 270562 - protein, 9 aa, Homo Sapiens
SNRSETGHS

SEQ ID NO: 270563 - protein, 9 aa, Homo Sapiens
FQNPDNKQI

SEQ ID NO: 270564 - protein, 9 aa, Homo Sapiens
LASSEPQMH

SEQ ID NO: 270565 - protein, 9 aa, Homo Sapiens
DMSSGQMEF

SEQ ID NO: 270566 - protein, 9 aa, Homo Sapiens
LIISNSSSF

SEQ ID NO: 270567 - protein, 9 aa, Homo Sapiens
VISHPERFS

SEQ ID NO: 270568 - protein, 9 aa, Homo Sapiens
CKITLPEPC

SEQ ID NO: 270569 - protein, 9 aa, Homo Sapiens
SNAKIDEKT

SEQ ID NO: 270570 - protein, 9 aa, Homo Sapiens
RQRQPPSPK

SEQ ID NO: 270571 - protein, 9 aa, Homo Sapiens
VWNILRSDT

SEQ ID NO: 270572 - protein, 9 aa, Homo Sapiens
STNGSSGSE

SEQ ID NO: 270573 - protein, 9 aa, Homo Sapiens
YGNGKTFLE

SEQ ID NO: 270574 - protein, 9 aa, Homo Sapiens
PVTSLNSTL

SEQ ID NO: 270575 - protein, 9 aa, Homo Sapiens
DGRFKGSLM

SEQ ID NO: 270576 - protein, 9 aa, Homo Sapiens
QQVQTHFST

SEQ ID NO: 270577 - protein, 9 aa, Homo Sapiens
CKTMCKRNE

SEQ ID NO: 270578 - protein, 9 aa, Homo Sapiens
TNVALQKHG

SEQ ID NO: 270579 - protein, 9 aa, Homo Sapiens
LHILQGDRH

SEQ ID NO: 270580 - protein, 9 aa, Homo Sapiens
LNAYRRHDL

SEQ ID NO: 270581 - protein, 9 aa, Homo Sapiens
YGVIHVMLN

SEQ ID NO: 270582 - protein, 9 aa, Homo Sapiens
HFENSLLLT

SEQ ID NO: 270583 - protein, 9 aa, Homo Sapiens
DKTCTEHAK

SEQ ID NO: 270584 - protein, 9 aa, Homo Sapiens
NPPLATVLI

SEQ ID NO: 270585 - protein, 9 aa, Homo Sapiens
RLNAFIAGL

SEQ ID NO: 270586 - protein, 9 aa, Homo Sapiens
ESLIGNKCE

SEQ ID NO: 270587 - protein, 9 aa, Homo Sapiens
TVPNMLGDF

SEQ ID NO: 270588 - protein, 9 aa, Homo Sapiens
ENQLQMATY

SEQ ID NO: 270589 - protein, 9 aa, Homo Sapiens
YSVTKSYIS

SEQ ID NO: 270590 - protein, 9 aa, Homo Sapiens
TVEVTDGEN

SEQ ID NO: 270591 - protein, 9 aa, Homo Sapiens
EPVPAGFFN

SEQ ID NO: 270592 - protein, 9 aa, Homo Sapiens
KLSNEFHIY

SEQ ID NO: 270593 - protein, 9 aa, Homo Sapiens
DIIPREMKR

SEQ ID NO: 270594 - protein, 9 aa, Homo Sapiens
KAALKSARD

SEQ ID NO: 270595 - protein, 9 aa, Homo Sapiens
LYRIGRLTD

SEQ ID NO: 270596 - protein, 9 aa, Homo Sapiens
GGESFTFQI

SEQ ID NO: 270597 - protein, 9 aa, Homo Sapiens
NEAAAQFTL

SEQ ID NO: 270598 - protein, 9 aa, Homo Sapiens
GASAYASAH

SEQ ID NO: 270599 - protein, 9 aa, Homo Sapiens
WVDNLNDTR

SEQ ID NO: 270600 - protein, 9 aa, Homo Sapiens
GLQQVKDPL

SEQ ID NO: 270601 - protein, 9 aa, Homo Sapiens
SQDEGILWN

SEQ ID NO: 270602 - protein, 9 aa, Homo Sapiens
IHELPVGCT

SEQ ID NO: 270603 - protein, 9 aa, Homo Sapiens
ERPYECKYC

SEQ ID NO: 270604 - protein, 9 aa, Homo Sapiens
FQDLTGIKS

SEQ ID NO: 270605 - protein, 9 aa, Homo Sapiens
QYMGPKRFC

SEQ ID NO: 270606 - protein, 9 aa, Homo Sapiens
PQPGPHTTA

SEQ ID NO: 270607 - protein, 9 aa, Homo Sapiens
YLALPGVSP

SEQ ID NO: 270608 - protein, 9 aa, Homo Sapiens
TCACLLTPL

SEQ ID NO: 270609 - protein, 9 aa, Homo Sapiens
EDAHDFLQY

SEQ ID NO: 270610 - protein, 9 aa, Homo Sapiens
RLDDQRAIV

SEQ ID NO: 270611 - protein, 9 aa, Homo Sapiens
THPNNKPFT

SEQ ID NO: 270612 - protein, 9 aa, Homo Sapiens
GDLRTMPES

SEQ ID NO: 270613 - protein, 9 aa, Homo Sapiens
KESLIGNKC

SEQ ID NO: 270614 - protein, 9 aa, Homo Sapiens
AGNGLGSAL

SEQ ID NO: 270615 - protein, 9 aa, Homo Sapiens
NLRKPVELG

SEQ ID NO: 270616 - protein, 9 aa, Homo Sapiens
FTRKSVVAY

SEQ ID NO: 270617 - protein, 9 aa, Homo Sapiens
RLNWTWISF

SEQ ID NO: 270618 - protein, 9 aa, Homo Sapiens
DVESNPRIF

SEQ ID NO: 270619 - protein, 9 aa, Homo Sapiens
ASTQYTTAV

SEQ ID NO: 270620 - protein, 9 aa, Homo Sapiens
SPQMNTLKK

SEQ ID NO: 270621 - protein, 9 aa, Homo Sapiens
NSHLIQHKR

SEQ ID NO: 270622 - protein, 9 aa, Homo Sapiens
PSNHVPNNL

SEQ ID NO: 270623 - protein, 9 aa, Homo Sapiens
HIKQMQEVY

SEQ ID NO: 270624 - protein, 9 aa, Homo Sapiens
TAISLVYRV

SEQ ID NO: 270625 - protein, 9 aa, Homo Sapiens
RDISISYSG

SEQ ID NO: 270626 - protein, 9 aa, Homo Sapiens
TSHLIVHQI

SEQ ID NO: 270627 - protein, 9 aa, Homo Sapiens
EIWLQKQGK

SEQ ID NO: 270628 - protein, 9 aa, Homo Sapiens
LEEFEVDDL

SEQ ID NO: 270629 - protein, 9 aa, Homo Sapiens
EDCLDGSDK

SEQ ID NO: 270630 - protein, 9 aa, Homo Sapiens
VIEASLATD

SEQ ID NO: 270631 - protein, 9 aa, Homo Sapiens
AIFTKAYQQ

SEQ ID NO: 270632 - protein, 9 aa, Homo Sapiens
LQSRLGDRD

SEQ ID NO: 270633 - protein, 9 aa, Homo Sapiens
FMKDLKDML

SEQ ID NO: 270634 - protein, 9 aa, Homo Sapiens
VDIEGHECA

SEQ ID NO: 270635 - protein, 9 aa, Homo Sapiens
NLDIDPNIY

SEQ ID NO: 270636 - protein, 9 aa, Homo Sapiens
LFCCAVLCL

SEQ ID NO: 270637 - protein, 9 aa, Homo Sapiens
AKVEEDTEN

SEQ ID NO: 270638 - protein, 9 aa, Homo Sapiens
QSGKNRGFG

SEQ ID NO: 270639 - protein, 9 aa, Homo Sapiens
IAKVSACHF

SEQ ID NO: 270640 - protein, 9 aa, Homo Sapiens
LNWNHDSED

SEQ ID NO: 270641 - protein, 9 aa, Homo Sapiens
IHMRIHDGK

SEQ ID NO: 270642 - protein, 9 aa, Homo Sapiens
VSCKKRDDC

SEQ ID NO: 270643 - protein, 9 aa, Homo Sapiens
QNHTGEKPY

SEQ ID NO: 270644 - protein, 9 aa, Homo Sapiens
NQTFNERIE

SEQ ID NO: 270645 - protein, 9 aa, Homo Sapiens
SKKTLLQTA

SEQ ID NO: 270646 - protein, 9 aa, Homo Sapiens
AEAPMTLLE

SEQ ID NO: 270647 - protein, 9 aa, Homo Sapiens
RKIEEAQSQ

SEQ ID NO: 270648 - protein, 9 aa, Homo Sapiens
ISKVGIRKR

SEQ ID NO: 270649 - protein, 9 aa, Homo Sapiens
PMELIVGKK

SEQ ID NO: 270650 - protein, 9 aa, Homo Sapiens
DVLKRKRLS

SEQ ID NO: 270651 - protein, 9 aa, Homo Sapiens
KDKGSSLPA

SEQ ID NO: 270652 - protein, 9 aa, Homo Sapiens
PYGFIKSPG

SEQ ID NO: 270653 - protein, 9 aa, Homo Sapiens
YMHFQNVSK

SEQ ID NO: 270654 - protein, 9 aa, Homo Sapiens
RYVSPFDHS

SEQ ID NO: 270655 - protein, 9 aa, Homo Sapiens
ELFISYVML

SEQ ID NO: 270656 - protein, 9 aa, Homo Sapiens
ELLLLCPSI

SEQ ID NO: 270657 - protein, 9 aa, Homo Sapiens
KSSQRKQRY

SEQ ID NO: 270658 - protein, 9 aa, Homo Sapiens
TENKEVILK

SEQ ID NO: 270659 - protein, 9 aa, Homo Sapiens
TRDYPQNLL

SEQ ID NO: 270660 - protein, 9 aa, Homo Sapiens
SVCEDSVPT

SEQ ID NO: 270661 - protein, 9 aa, Homo Sapiens
LHILINDAG

SEQ ID NO: 270662 - protein, 9 aa, Homo Sapiens
YPQQSLEPI

SEQ ID NO: 270663 - protein, 9 aa, Homo Sapiens
WSLKIRKGM

SEQ ID NO: 270664 - protein, 9 aa, Homo Sapiens
ASKLKRLEK

SEQ ID NO: 270665 - protein, 9 aa, Homo Sapiens
SDLTKVVVY

SEQ ID NO: 270666 - protein, 9 aa, Homo Sapiens
DGADSPSAA

SEQ ID NO: 270667 - protein, 9 aa, Homo Sapiens
KPLPFPCFS

SEQ ID NO: 270668 - protein, 9 aa, Homo Sapiens
FRHSEATEV

SEQ ID NO: 270669 - protein, 9 aa, Homo Sapiens
DKVYLYPLS

SEQ ID NO: 270670 - protein, 9 aa, Homo Sapiens
LRAKTIVKL

SEQ ID NO: 270671 - protein, 9 aa, Homo Sapiens
TKRTNRKKV

SEQ ID NO: 270672 - protein, 9 aa, Homo Sapiens
QIQAKEYIK

SEQ ID NO: 270673 - protein, 9 aa, Homo Sapiens
PISDYHFLS

SEQ ID NO: 270674 - protein, 9 aa, Homo Sapiens
SAFFFSLLF

SEQ ID NO: 270675 - protein, 9 aa, Homo Sapiens
NVSSEGEGQ

SEQ ID NO: 270676 - protein, 9 aa, Homo Sapiens
FSTRNNLGF

SEQ ID NO: 270677 - protein, 9 aa, Homo Sapiens
HSKHFENSL

SEQ ID NO: 270678 - protein, 9 aa, Homo Sapiens
DASERDFIK

SEQ ID NO: 270679 - protein, 9 aa, Homo Sapiens
NIQDSLGGR

SEQ ID NO: 270680 - protein, 9 aa, Homo Sapiens
RTSGEVEIL

SEQ ID NO: 270681 - protein, 9 aa, Homo Sapiens
PWIFEELLT

SEQ ID NO: 270682 - protein, 9 aa, Homo Sapiens
EKCKNKNKW

SEQ ID NO: 270683 - protein, 9 aa, Homo Sapiens
TLLNILALV

SEQ ID NO: 270684 - protein, 9 aa, Homo Sapiens
MHNWSPDIQ

SEQ ID NO: 270685 - protein, 9 aa, Homo Sapiens
PDPVFDTSD

SEQ ID NO: 270686 - protein, 9 aa, Homo Sapiens
GGGVKTAIR

SEQ ID NO: 270687 - protein, 9 aa, Homo Sapiens
STVICALTS

SEQ ID NO: 270688 - protein, 9 aa, Homo Sapiens
VYVTGRLLR

SEQ ID NO: 270689 - protein, 9 aa, Homo Sapiens
MAEPSVPYR

SEQ ID NO: 270690 - protein, 9 aa, Homo Sapiens
RQIAIGLDP

SEQ ID NO: 270691 - protein, 9 aa, Homo Sapiens
QLTANTLYM

SEQ ID NO: 270692 - protein, 9 aa, Homo Sapiens
LMLGSETPS

SEQ ID NO: 270693 - protein, 9 aa, Homo Sapiens
SGLYAETEG

SEQ ID NO: 270694 - protein, 9 aa, Homo Sapiens
HVSRVDAGW

SEQ ID NO: 270695 - protein, 9 aa, Homo Sapiens
FQTQEIPHT

SEQ ID NO: 270696 - protein, 9 aa, Homo Sapiens
LFASLNFVM

SEQ ID NO: 270697 - protein, 9 aa, Homo Sapiens
SSYLGMGPQ

SEQ ID NO: 270698 - protein, 9 aa, Homo Sapiens
PQVLQKKFR

SEQ ID NO: 270699 - protein, 9 aa, Homo Sapiens
SFRTVLVNV

SEQ ID NO: 270700 - protein, 9 aa, Homo Sapiens
KNPPLRNVS

SEQ ID NO: 270701 - protein, 9 aa, Homo Sapiens
RLKKKMGGD

SEQ ID NO: 270702 - protein, 9 aa, Homo Sapiens
DLALRADYD

SEQ ID NO: 270703 - protein, 9 aa, Homo Sapiens
ASKIHGDLL

SEQ ID NO: 270704 - protein, 9 aa, Homo Sapiens
HPLHKIEAK

SEQ ID NO: 270705 - protein, 9 aa, Homo Sapiens
EMKQSNSKA

SEQ ID NO: 270706 - protein, 9 aa, Homo Sapiens
SSCSQKYAD

SEQ ID NO: 270707 - protein, 9 aa, Homo Sapiens
GEEDAQQSS

SEQ ID NO: 270708 - protein, 9 aa, Homo Sapiens
SITTAIRET

SEQ ID NO: 270709 - protein, 9 aa, Homo Sapiens
YSAFAGVGE

SEQ ID NO: 270710 - protein, 9 aa, Homo Sapiens
EKNWLDIFC

SEQ ID NO: 270711 - protein, 9 aa, Homo Sapiens
LCPRSRALS

SEQ ID NO: 270712 - protein, 9 aa, Homo Sapiens
IFTKAYQQM

SEQ ID NO: 270713 - protein, 9 aa, Homo Sapiens
LKLLVLEDE

SEQ ID NO: 270714 - protein, 9 aa, Homo Sapiens
FAILRKETA

SEQ ID NO: 270715 - protein, 9 aa, Homo Sapiens
LMNSLEQNI

SEQ ID NO: 270716 - protein, 9 aa, Homo Sapiens
QGPDICCRE

SEQ ID NO: 270717 - protein, 9 aa, Homo Sapiens
LQQCLAPRL

SEQ ID NO: 270718 - protein, 9 aa, Homo Sapiens
SNHVPNNLF

SEQ ID NO: 270719 - protein, 9 aa, Homo Sapiens
GKRKNAIEN

SEQ ID NO: 270720 - protein, 9 aa, Homo Sapiens
ELQLESISS

SEQ ID NO: 270721 - protein, 9 aa, Homo Sapiens
KIFLPKVRA

SEQ ID NO: 270722 - protein, 9 aa, Homo Sapiens
ERKEETCTP

SEQ ID NO: 270723 - protein, 9 aa, Homo Sapiens
TQEDILVPY

SEQ ID NO: 270724 - protein, 9 aa, Homo Sapiens
SDGTVQTWS

SEQ ID NO: 270725 - protein, 9 aa, Homo Sapiens
LNLRRAAEE

SEQ ID NO: 270726 - protein, 9 aa, Homo Sapiens
AAFVEVNNY

SEQ ID NO: 270727 - protein, 9 aa, Homo Sapiens
TKDAKKVAN

SEQ ID NO: 270728 - protein, 9 aa, Homo Sapiens
GDKKKRDRD

SEQ ID NO: 270729 - protein, 9 aa, Homo Sapiens
AVFYTMVTS

SEQ ID NO: 270730 - protein, 9 aa, Homo Sapiens
TQTMNVTGQ

SEQ ID NO: 270731 - protein, 9 aa, Homo Sapiens
LVGDTATKE

SEQ ID NO: 270732 - protein, 9 aa, Homo Sapiens
QLEWRCCPD

SEQ ID NO: 270733 - protein, 9 aa, Homo Sapiens
ASVSHLSDL

SEQ ID NO: 270734 - protein, 9 aa, Homo Sapiens
IISQKDTCH

SEQ ID NO: 270735 - protein, 9 aa, Homo Sapiens
SYSESLCCL

SEQ ID NO: 270736 - protein, 9 aa, Homo Sapiens
ISPFMIKGA

SEQ ID NO: 270737 - protein, 9 aa, Homo Sapiens
KAYQQMVLD

SEQ ID NO: 270738 - protein, 9 aa, Homo Sapiens
TNNRYDITN

SEQ ID NO: 270739 - protein, 9 aa, Homo Sapiens
LMKIQFSRK

SEQ ID NO: 270740 - protein, 9 aa, Homo Sapiens
DENYLGSAT

SEQ ID NO: 270741 - protein, 9 aa, Homo Sapiens
VFIEFLKRC

SEQ ID NO: 270742 - protein, 9 aa, Homo Sapiens
ENFLSVDDI

SEQ ID NO: 270743 - protein, 9 aa, Homo Sapiens
RVANPKYII

SEQ ID NO: 270744 - protein, 9 aa, Homo Sapiens
LPERRGRPD

SEQ ID NO: 270745 - protein, 9 aa, Homo Sapiens
GTPIGYPYR

SEQ ID NO: 270746 - protein, 9 aa, Homo Sapiens
PSLPTIPPI

SEQ ID NO: 270747 - protein, 9 aa, Homo Sapiens
EFAHSYIDV

SEQ ID NO: 270748 - protein, 9 aa, Homo Sapiens
NQGRKVEGA

SEQ ID NO: 270749 - protein, 9 aa, Homo Sapiens
LYGRASCTL

SEQ ID NO: 270750 - protein, 9 aa, Homo Sapiens
FIETSNQSN

SEQ ID NO: 270751 - protein, 9 aa, Homo Sapiens
RRLMNRNFV

SEQ ID NO: 270752 - protein, 9 aa, Homo Sapiens
DTSVIDYDI

SEQ ID NO: 270753 - protein, 9 aa, Homo Sapiens
ACDALNDQN

SEQ ID NO: 270754 - protein, 9 aa, Homo Sapiens
RISSLESIR

SEQ ID NO: 270755 - protein, 9 aa, Homo Sapiens
ELDLKQERI

SEQ ID NO: 270756 - protein, 9 aa, Homo Sapiens
KKNKIKLFP

SEQ ID NO: 270757 - protein, 9 aa, Homo Sapiens
SVMKERDNR

SEQ ID NO: 270758 - protein, 9 aa, Homo Sapiens
TMSCVPQML

SEQ ID NO: 270759 - protein, 9 aa, Homo Sapiens
ERIQGLDVD

SEQ ID NO: 270760 - protein, 9 aa, Homo Sapiens
RGLHILGLE

SEQ ID NO: 270761 - protein, 9 aa, Homo Sapiens
HTGEKPLEC

SEQ ID NO: 270762 - protein, 9 aa, Homo Sapiens
GTLLLLSED

SEQ ID NO: 270763 - protein, 9 aa, Homo Sapiens
KDINKKLYS

SEQ ID NO: 270764 - protein, 9 aa, Homo Sapiens
WTQGLPWIF

SEQ ID NO: 270765 - protein, 9 aa, Homo Sapiens
AFLTDREVQ

SEQ ID NO: 270766 - protein, 9 aa, Homo Sapiens
SSRCLVIEL

SEQ ID NO: 270767 - protein, 9 aa, Homo Sapiens
TSFRRNVGR

SEQ ID NO: 270768 - protein, 9 aa, Homo Sapiens
EVYATAVLQ

SEQ ID NO: 270769 - protein, 9 aa, Homo Sapiens
VCAGYLNGK

SEQ ID NO: 270770 - protein, 9 aa, Homo Sapiens
GSAEASGAP

SEQ ID NO: 270771 - protein, 9 aa, Homo Sapiens
CGGNKSHIR

SEQ ID NO: 270772 - protein, 9 aa, Homo Sapiens
DAKQIQIID

SEQ ID NO: 270773 - protein, 9 aa, Homo Sapiens
LTVQINSAK

SEQ ID NO: 270774 - protein, 9 aa, Homo Sapiens
NGHLPHPSL

SEQ ID NO: 270775 - protein, 9 aa, Homo Sapiens
SCTAPAPPI

SEQ ID NO: 270776 - protein, 9 aa, Homo Sapiens
FRGNVTIKE

SEQ ID NO: 270777 - protein, 9 aa, Homo Sapiens
RRYFIAAAK

SEQ ID NO: 270778 - protein, 9 aa, Homo Sapiens
REKQDLTTR

SEQ ID NO: 270779 - protein, 9 aa, Homo Sapiens
VRPFSKTPL

SEQ ID NO: 270780 - protein, 9 aa, Homo Sapiens
TFLLLLSSF

SEQ ID NO: 270781 - protein, 9 aa, Homo Sapiens
ISGQLEGIF

SEQ ID NO: 270782 - protein, 9 aa, Homo Sapiens
RSPNPRVSP

SEQ ID NO: 270783 - protein, 9 aa, Homo Sapiens
IPNLRRLNF

SEQ ID NO: 270784 - protein, 9 aa, Homo Sapiens
IVMAWLKQQ

SEQ ID NO: 270785 - protein, 9 aa, Homo Sapiens
CLQNPLDNL

SEQ ID NO: 270786 - protein, 9 aa, Homo Sapiens
NLLSKSLSR

SEQ ID NO: 270787 - protein, 9 aa, Homo Sapiens
YSKNGANCW

SEQ ID NO: 270788 - protein, 9 aa, Homo Sapiens
CGNTFSVSA

SEQ ID NO: 270789 - protein, 9 aa, Homo Sapiens
LKFDTTPNK

SEQ ID NO: 270790 - protein, 9 aa, Homo Sapiens
PGVETYPNG

SEQ ID NO: 270791 - protein, 9 aa, Homo Sapiens
KYNKTCNSF

SEQ ID NO: 270792 - protein, 9 aa, Homo Sapiens
EWVKIYEDF

SEQ ID NO: 270793 - protein, 9 aa, Homo Sapiens
LPFIYQTSY

SEQ ID NO: 270794 - protein, 9 aa, Homo Sapiens
KTQNKVCFP

SEQ ID NO: 270795 - protein, 9 aa, Homo Sapiens
SDEECDRKL

SEQ ID NO: 270796 - protein, 9 aa, Homo Sapiens
SQRKQRYCV

SEQ ID NO: 270797 - protein, 9 aa, Homo Sapiens
YNSVKAIIQ

SEQ ID NO: 270798 - protein, 9 aa, Homo Sapiens
WCYSNAAAV

SEQ ID NO: 270799 - protein, 9 aa, Homo Sapiens
VNRDGKLDF

SEQ ID NO: 270800 - protein, 9 aa, Homo Sapiens
SFGRSPSIK

SEQ ID NO: 270801 - protein, 9 aa, Homo Sapiens
ENINDKHFP

SEQ ID NO: 270802 - protein, 9 aa, Homo Sapiens
ALGGPGIPG

SEQ ID NO: 270803 - protein, 9 aa, Homo Sapiens
QVIKPSLIS

SEQ ID NO: 270804 - protein, 9 aa, Homo Sapiens
VLQQANENR

SEQ ID NO: 270805 - protein, 9 aa, Homo Sapiens
YFSEAPMFT

SEQ ID NO: 270806 - protein, 9 aa, Homo Sapiens
PSRMMFYPP

SEQ ID NO: 270807 - protein, 9 aa, Homo Sapiens
LPLCSRCHI

SEQ ID NO: 270808 - protein, 9 aa, Homo Sapiens
KRIGKDPAH

SEQ ID NO: 270809 - protein, 9 aa, Homo Sapiens
TPPYPKIRR

SEQ ID NO: 270810 - protein, 9 aa, Homo Sapiens
RECTQFLTP

SEQ ID NO: 270811 - protein, 9 aa, Homo Sapiens
MTQSLTEEK

SEQ ID NO: 270812 - protein, 9 aa, Homo Sapiens
DLSHLICHE

SEQ ID NO: 270813 - protein, 9 aa, Homo Sapiens
TYGLWECVL

SEQ ID NO: 270814 - protein, 9 aa, Homo Sapiens
YQRGRKKRV

SEQ ID NO: 270815 - protein, 9 aa, Homo Sapiens
PATELSCRE

SEQ ID NO: 270816 - protein, 9 aa, Homo Sapiens
WRHGRNTCS

SEQ ID NO: 270817 - protein, 9 aa, Homo Sapiens
TLSCIFPEG

SEQ ID NO: 270818 - protein, 9 aa, Homo Sapiens
PHKPPYNSK

SEQ ID NO: 270819 - protein, 9 aa, Homo Sapiens
EQTEALSNL

SEQ ID NO: 270820 - protein, 9 aa, Homo Sapiens
RREDGSADG

SEQ ID NO: 270821 - protein, 9 aa, Homo Sapiens
KNLTINTES

SEQ ID NO: 270822 - protein, 9 aa, Homo Sapiens
EAGYFYYMA

SEQ ID NO: 270823 - protein, 9 aa, Homo Sapiens
KPTNDFAHE

SEQ ID NO: 270824 - protein, 9 aa, Homo Sapiens
LHEYLTLIS

SEQ ID NO: 270825 - protein, 9 aa, Homo Sapiens
GPVNDGVTQ

SEQ ID NO: 270826 - protein, 9 aa, Homo Sapiens
KATSDNKDS

SEQ ID NO: 270827 - protein, 9 aa, Homo Sapiens
ELTVFREDL

SEQ ID NO: 270828 - protein, 9 aa, Homo Sapiens
LNSYISSSA

SEQ ID NO: 270829 - protein, 9 aa, Homo Sapiens
RERELYKAR

SEQ ID NO: 270830 - protein, 9 aa, Homo Sapiens
THLYLANNH

SEQ ID NO: 270831 - protein, 9 aa, Homo Sapiens
VHCKYYAHL

SEQ ID NO: 270832 - protein, 9 aa, Homo Sapiens
EGPAQMRKR

SEQ ID NO: 270833 - protein, 9 aa, Homo Sapiens
PQSNDNMLV

SEQ ID NO: 270834 - protein, 9 aa, Homo Sapiens
STLADSLDH

SEQ ID NO: 270835 - protein, 9 aa, Homo Sapiens
GSGTNEFTF

SEQ ID NO: 270836 - protein, 9 aa, Homo Sapiens
RHVENGGYK

SEQ ID NO: 270837 - protein, 9 aa, Homo Sapiens
AKKLLKNLI

SEQ ID NO: 270838 - protein, 9 aa, Homo Sapiens
VPSSYPGNI

SEQ ID NO: 270839 - protein, 9 aa, Homo Sapiens
LSFLTHRFG

SEQ ID NO: 270840 - protein, 9 aa, Homo Sapiens
INKIQEAAS

SEQ ID NO: 270841 - protein, 9 aa, Homo Sapiens
LPNPTLAEC

SEQ ID NO: 270842 - protein, 9 aa, Homo Sapiens
VDVWNSITT

SEQ ID NO: 270843 - protein, 9 aa, Homo Sapiens
LIKHFSENI

SEQ ID NO: 270844 - protein, 9 aa, Homo Sapiens
RLYIRRMVK

SEQ ID NO: 270845 - protein, 9 aa, Homo Sapiens
SVDFGYDYL

SEQ ID NO: 270846 - protein, 9 aa, Homo Sapiens
RYKISVTLY

SEQ ID NO: 270847 - protein, 9 aa, Homo Sapiens
ISDEESHDE

SEQ ID NO: 270848 - protein, 9 aa, Homo Sapiens
ETNNICFYS

SEQ ID NO: 270849 - protein, 9 aa, Homo Sapiens
LTIHNRIHT

SEQ ID NO: 270850 - protein, 9 aa, Homo Sapiens
EDLTAQRKR

SEQ ID NO: 270851 - protein, 9 aa, Homo Sapiens
NDFLQLLLP

SEQ ID NO: 270852 - protein, 9 aa, Homo Sapiens
DESIIKSRD

SEQ ID NO: 270853 - protein, 9 aa, Homo Sapiens
SLHRITIKK

SEQ ID NO: 270854 - protein, 9 aa, Homo Sapiens
SNLVWMQGS

SEQ ID NO: 270855 - protein, 9 aa, Homo Sapiens
IKKTLMLNE

SEQ ID NO: 270856 - protein, 9 aa, Homo Sapiens
DARENIQRL

SEQ ID NO: 270857 - protein, 9 aa, Homo Sapiens
PCRNGGVCQ

SEQ ID NO: 270858 - protein, 9 aa, Homo Sapiens
KEHPRWEDN

SEQ ID NO: 270859 - protein, 9 aa, Homo Sapiens
LNYKFWKHL

SEQ ID NO: 270860 - protein, 9 aa, Homo Sapiens
KNAALNLGC

SEQ ID NO: 270861 - protein, 9 aa, Homo Sapiens
GFFFHIFSG

SEQ ID NO: 270862 - protein, 9 aa, Homo Sapiens
RKLHLFKDG

SEQ ID NO: 270863 - protein, 9 aa, Homo Sapiens
NGANCWYDK

SEQ ID NO: 270864 - protein, 9 aa, Homo Sapiens
KGRKALEQE

SEQ ID NO: 270865 - protein, 9 aa, Homo Sapiens
SLKEIKSIK

SEQ ID NO: 270866 - protein, 9 aa, Homo Sapiens
CSHLGVIES

SEQ ID NO: 270867 - protein, 9 aa, Homo Sapiens
EKLFKRDVC

SEQ ID NO: 270868 - protein, 9 aa, Homo Sapiens
LPCSQEWHW

SEQ ID NO: 270869 - protein, 9 aa, Homo Sapiens
NCCGPSVTV

SEQ ID NO: 270870 - protein, 9 aa, Homo Sapiens
SLAWNLVIQ

SEQ ID NO: 270871 - protein, 9 aa, Homo Sapiens
SPNPRVSPR

SEQ ID NO: 270872 - protein, 9 aa, Homo Sapiens
AGPIVATAG

SEQ ID NO: 270873 - protein, 9 aa, Homo Sapiens
MYPAVFCPP

SEQ ID NO: 270874 - protein, 9 aa, Homo Sapiens
VFFMLHSLS

SEQ ID NO: 270875 - protein, 9 aa, Homo Sapiens
AYSMAKMTF

SEQ ID NO: 270876 - protein, 9 aa, Homo Sapiens
GEGYILVKK

SEQ ID NO: 270877 - protein, 9 aa, Homo Sapiens
PMKERPVIP

SEQ ID NO: 270878 - protein, 9 aa, Homo Sapiens
CVPQLEKWL

SEQ ID NO: 270879 - protein, 9 aa, Homo Sapiens
VDHVPSSRK

SEQ ID NO: 270880 - protein, 9 aa, Homo Sapiens
NFVFPSKSF

SEQ ID NO: 270881 - protein, 9 aa, Homo Sapiens
TSYSVTKSY

SEQ ID NO: 270882 - protein, 9 aa, Homo Sapiens
FAHGNIYAY

SEQ ID NO: 270883 - protein, 9 aa, Homo Sapiens
WLHNIKLLN

SEQ ID NO: 270884 - protein, 9 aa, Homo Sapiens
LFLDKFFLV

SEQ ID NO: 270885 - protein, 9 aa, Homo Sapiens
KVKVKVCVN

SEQ ID NO: 270886 - protein, 9 aa, Homo Sapiens
PGGETEART

SEQ ID NO: 270887 - protein, 9 aa, Homo Sapiens
QAKSSNYPC

SEQ ID NO: 270888 - protein, 9 aa, Homo Sapiens
APTVSQPTA

SEQ ID NO: 270889 - protein, 9 aa, Homo Sapiens
KALYNSINN

SEQ ID NO: 270890 - protein, 9 aa, Homo Sapiens
DQRTHTLDN

SEQ ID NO: 270891 - protein, 9 aa, Homo Sapiens
SLSGVAQNN

SEQ ID NO: 270892 - protein, 9 aa, Homo Sapiens
DPWNWLNFT

SEQ ID NO: 270893 - protein, 9 aa, Homo Sapiens
LPFMLADFD

SEQ ID NO: 270894 - protein, 9 aa, Homo Sapiens
KLLQKVEAG

SEQ ID NO: 270895 - protein, 9 aa, Homo Sapiens
ITSFAFLRQ

SEQ ID NO: 270896 - protein, 9 aa, Homo Sapiens
HAPETRRKV

SEQ ID NO: 270897 - protein, 9 aa, Homo Sapiens
FWTAFKDFK

SEQ ID NO: 270898 - protein, 9 aa, Homo Sapiens
IRQRSQEGY

SEQ ID NO: 270899 - protein, 9 aa, Homo Sapiens
DITADLDNI

SEQ ID NO: 270900 - protein, 9 aa, Homo Sapiens
GNIYIARNG

SEQ ID NO: 270901 - protein, 9 aa, Homo Sapiens
AAHKEKIQT

SEQ ID NO: 270902 - protein, 9 aa, Homo Sapiens
QFKDSGLSH

SEQ ID NO: 270903 - protein, 9 aa, Homo Sapiens
TQVTHNPGT

SEQ ID NO: 270904 - protein, 9 aa, Homo Sapiens
SLIGLALIV

SEQ ID NO: 270905 - protein, 9 aa, Homo Sapiens
DLIKCMLRN

SEQ ID NO: 270906 - protein, 9 aa, Homo Sapiens
VTILCDKLS

SEQ ID NO: 270907 - protein, 9 aa, Homo Sapiens
LHPNMAARL

SEQ ID NO: 270908 - protein, 9 aa, Homo Sapiens
KKTSEDIFQ

SEQ ID NO: 270909 - protein, 9 aa, Homo Sapiens
MHRINKLFG

SEQ ID NO: 270910 - protein, 9 aa, Homo Sapiens
ANEEGFVQL

SEQ ID NO: 270911 - protein, 9 aa, Homo Sapiens
DKYLHLEGD

SEQ ID NO: 270912 - protein, 9 aa, Homo Sapiens
VRKSQGITT

SEQ ID NO: 270913 - protein, 9 aa, Homo Sapiens
CSLCMRLFS

SEQ ID NO: 270914 - protein, 9 aa, Homo Sapiens
FIPSLFLDN

SEQ ID NO: 270915 - protein, 9 aa, Homo Sapiens
SSLPRNIEV

SEQ ID NO: 270916 - protein, 9 aa, Homo Sapiens
EELLSQDQL

SEQ ID NO: 270917 - protein, 9 aa, Homo Sapiens
IPLPHVTHA

SEQ ID NO: 270918 - protein, 9 aa, Homo Sapiens
LFCPQPKEH

SEQ ID NO: 270919 - protein, 9 aa, Homo Sapiens
KREAVNSLR

SEQ ID NO: 270920 - protein, 9 aa, Homo Sapiens
SHLARHQQI

SEQ ID NO: 270921 - protein, 9 aa, Homo Sapiens
NTTCKKGGC

SEQ ID NO: 270922 - protein, 9 aa, Homo Sapiens
TPKSSGKKC

SEQ ID NO: 270923 - protein, 9 aa, Homo Sapiens
ALSWRGLHI

SEQ ID NO: 270924 - protein, 9 aa, Homo Sapiens
ENFILEVEK

SEQ ID NO: 270925 - protein, 9 aa, Homo Sapiens
SSEDSNDSS

SEQ ID NO: 270926 - protein, 9 aa, Homo Sapiens
IRLMSAGIL

SEQ ID NO: 270927 - protein, 9 aa, Homo Sapiens
IPCSLKIRV

SEQ ID NO: 270928 - protein, 9 aa, Homo Sapiens
MESLQWEHM

SEQ ID NO: 270929 - protein, 9 aa, Homo Sapiens
ESIPGVSLN

SEQ ID NO: 270930 - protein, 9 aa, Homo Sapiens
DFFLIVKTL

SEQ ID NO: 270931 - protein, 9 aa, Homo Sapiens
GIRKEEVDL

SEQ ID NO: 270932 - protein, 9 aa, Homo Sapiens
NGKNYHSEM

SEQ ID NO: 270933 - protein, 9 aa, Homo Sapiens
LPLEVSSEY

SEQ ID NO: 270934 - protein, 9 aa, Homo Sapiens
DGTNWQAVV

SEQ ID NO: 270935 - protein, 9 aa, Homo Sapiens
LKTSECGKS

SEQ ID NO: 270936 - protein, 9 aa, Homo Sapiens
MSHYRFIKC

SEQ ID NO: 270937 - protein, 9 aa, Homo Sapiens
SDGADSPSA

SEQ ID NO: 270938 - protein, 9 aa, Homo Sapiens
CRSQCCQSA

SEQ ID NO: 270939 - protein, 9 aa, Homo Sapiens
SFTYINSML

SEQ ID NO: 270940 - protein, 9 aa, Homo Sapiens
HGGLHAFLL

SEQ ID NO: 270941 - protein, 9 aa, Homo Sapiens
WGPLWRVLS

SEQ ID NO: 270942 - protein, 9 aa, Homo Sapiens
AIRSLNRTD

SEQ ID NO: 270943 - protein, 9 aa, Homo Sapiens
WPNAYFRQG

SEQ ID NO: 270944 - protein, 9 aa, Homo Sapiens
LTANTLYMS

SEQ ID NO: 270945 - protein, 9 aa, Homo Sapiens
FVRCLTDVY

SEQ ID NO: 270946 - protein, 9 aa, Homo Sapiens
EIKNCKHQI

SEQ ID NO: 270947 - protein, 9 aa, Homo Sapiens
WVRQAASQS

SEQ ID NO: 270948 - protein, 9 aa, Homo Sapiens
VFKAFCLGK

SEQ ID NO: 270949 - protein, 9 aa, Homo Sapiens
QNPLDNLEL

SEQ ID NO: 270950 - protein, 9 aa, Homo Sapiens
SSGTLPVVA

SEQ ID NO: 270951 - protein, 9 aa, Homo Sapiens
GIPSSQVKY

SEQ ID NO: 270952 - protein, 9 aa, Homo Sapiens
GTSDFLPSQ

SEQ ID NO: 270953 - protein, 9 aa, Homo Sapiens
EEPEDPSNH

SEQ ID NO: 270954 - protein, 9 aa, Homo Sapiens
RLLASNSLL

SEQ ID NO: 270955 - protein, 9 aa, Homo Sapiens
VWPSQRGTL

SEQ ID NO: 270956 - protein, 9 aa, Homo Sapiens
TDVKALRWQ

SEQ ID NO: 270957 - protein, 9 aa, Homo Sapiens
EEEQGYIEV

SEQ ID NO: 270958 - protein, 9 aa, Homo Sapiens
HDFLEDVYI

SEQ ID NO: 270959 - protein, 9 aa, Homo Sapiens
SKVSEGKDV

SEQ ID NO: 270960 - protein, 9 aa, Homo Sapiens
GFLQSRPYH

SEQ ID NO: 270961 - protein, 9 aa, Homo Sapiens
RDKTCMFCH

SEQ ID NO: 270962 - protein, 9 aa, Homo Sapiens
IVTKHKEVI

SEQ ID NO: 270963 - protein, 9 aa, Homo Sapiens
SGALISDFE

SEQ ID NO: 270964 - protein, 9 aa, Homo Sapiens
GQPGEGKPE

SEQ ID NO: 270965 - protein, 9 aa, Homo Sapiens
LRLNVNARE

SEQ ID NO: 270966 - protein, 9 aa, Homo Sapiens
VRKHEITHT

SEQ ID NO: 270967 - protein, 9 aa, Homo Sapiens
IRDQRTTTK

SEQ ID NO: 270968 - protein, 9 aa, Homo Sapiens
KEKDNPAPH

SEQ ID NO: 270969 - protein, 9 aa, Homo Sapiens
SAVPKVVLN

SEQ ID NO: 270970 - protein, 9 aa, Homo Sapiens
HFYFCYRWL

SEQ ID NO: 270971 - protein, 9 aa, Homo Sapiens
HPPQPSNRN

SEQ ID NO: 270972 - protein, 9 aa, Homo Sapiens
MAHQKPTPD

SEQ ID NO: 270973 - protein, 9 aa, Homo Sapiens
SKKRFKEDL

SEQ ID NO: 270974 - protein, 9 aa, Homo Sapiens
ITQATPPVA

SEQ ID NO: 270975 - protein, 9 aa, Homo Sapiens
EMEQANFTM

SEQ ID NO: 270976 - protein, 9 aa, Homo Sapiens
KLYHLAKET

SEQ ID NO: 270977 - protein, 9 aa, Homo Sapiens
ESFFAERLF

SEQ ID NO: 270978 - protein, 9 aa, Homo Sapiens
LFGVFLVMY

SEQ ID NO: 270979 - protein, 9 aa, Homo Sapiens
CPELTTDVK

SEQ ID NO: 270980 - protein, 9 aa, Homo Sapiens
LGEDNFEVV

SEQ ID NO: 270981 - protein, 9 aa, Homo Sapiens
AGLKCATGD

SEQ ID NO: 270982 - protein, 9 aa, Homo Sapiens
QCNFGSNCR

SEQ ID NO: 270983 - protein, 9 aa, Homo Sapiens
SQYCTYLDK

SEQ ID NO: 270984 - protein, 9 aa, Homo Sapiens
SANRGQRLL

SEQ ID NO: 270985 - protein, 9 aa, Homo Sapiens
LLGTFSLAV

SEQ ID NO: 270986 - protein, 9 aa, Homo Sapiens
YTVQIPEGR

SEQ ID NO: 270987 - protein, 9 aa, Homo Sapiens
ISISYICIV

SEQ ID NO: 270988 - protein, 9 aa, Homo Sapiens
IWEKSVEQT

SEQ ID NO: 270989 - protein, 9 aa, Homo Sapiens
KQESLVINL

SEQ ID NO: 270990 - protein, 9 aa, Homo Sapiens
IKRNSLIEL

SEQ ID NO: 270991 - protein, 9 aa, Homo Sapiens
IWIVYFTHI

SEQ ID NO: 270992 - protein, 9 aa, Homo Sapiens
IATTDLRQK

SEQ ID NO: 270993 - protein, 9 aa, Homo Sapiens
SVSKRKLQW

SEQ ID NO: 270994 - protein, 9 aa, Homo Sapiens
KQECLLNLH

SEQ ID NO: 270995 - protein, 9 aa, Homo Sapiens
AANIIQDES

SEQ ID NO: 270996 - protein, 9 aa, Homo Sapiens
GQRNEEFDW

SEQ ID NO: 270997 - protein, 9 aa, Homo Sapiens
QWVDNLNDT

SEQ ID NO: 270998 - protein, 9 aa, Homo Sapiens
QIAKVSACH

SEQ ID NO: 270999 - protein, 9 aa, Homo Sapiens
LSHTVGRLR

SEQ ID NO: 271000 - protein, 9 aa, Homo Sapiens
WLSWCLLYA

SEQ ID NO: 271001 - protein, 9 aa, Homo Sapiens
DCFNSYHSS

SEQ ID NO: 271002 - protein, 9 aa, Homo Sapiens
QESFRSMQD

SEQ ID NO: 271003 - protein, 9 aa, Homo Sapiens
LQDPSAIKV

SEQ ID NO: 271004 - protein, 9 aa, Homo Sapiens
YEPDSANPV

SEQ ID NO: 271005 - protein, 9 aa, Homo Sapiens
LKKELFTKY

SEQ ID NO: 271006 - protein, 9 aa, Homo Sapiens
MNSLQKSRT

SEQ ID NO: 271007 - protein, 9 aa, Homo Sapiens
IAKADAILK

SEQ ID NO: 271008 - protein, 9 aa, Homo Sapiens
LHLFEDYFF

SEQ ID NO: 271009 - protein, 9 aa, Homo Sapiens
ALTSSKLLY

SEQ ID NO: 271010 - protein, 9 aa, Homo Sapiens
NQLFVLEEH

SEQ ID NO: 271011 - protein, 9 aa, Homo Sapiens
NEEQNLLSV

SEQ ID NO: 271012 - protein, 9 aa, Homo Sapiens
QYMISAYGA

SEQ ID NO: 271013 - protein, 9 aa, Homo Sapiens
LEKYLYFYK

SEQ ID NO: 271014 - protein, 9 aa, Homo Sapiens
RIDTISQAA

SEQ ID NO: 271015 - protein, 9 aa, Homo Sapiens
ELNMMKLLF

SEQ ID NO: 271016 - protein, 9 aa, Homo Sapiens
DNLHLKISC

SEQ ID NO: 271017 - protein, 9 aa, Homo Sapiens
YTFTHTPSY

SEQ ID NO: 271018 - protein, 9 aa, Homo Sapiens
FKNSERCQG

SEQ ID NO: 271019 - protein, 9 aa, Homo Sapiens
GEHCVHTLG

SEQ ID NO: 271020 - protein, 9 aa, Homo Sapiens
WEDNCEEEA

SEQ ID NO: 271021 - protein, 9 aa, Homo Sapiens
AFNQSSDLT

SEQ ID NO: 271022 - protein, 9 aa, Homo Sapiens
LRLRRKCER

SEQ ID NO: 271023 - protein, 9 aa, Homo Sapiens
RINNGSYIA

SEQ ID NO: 271024 - protein, 9 aa, Homo Sapiens
QDNPMNPNK

SEQ ID NO: 271025 - protein, 9 aa, Homo Sapiens
DSFHSSRDS

SEQ ID NO: 271026 - protein, 9 aa, Homo Sapiens
TNILPGNMK

SEQ ID NO: 271027 - protein, 9 aa, Homo Sapiens
DQFDEIILD

SEQ ID NO: 271028 - protein, 9 aa, Homo Sapiens
KNIFLQYNS

SEQ ID NO: 271029 - protein, 9 aa, Homo Sapiens
SELENREVL

SEQ ID NO: 271030 - protein, 9 aa, Homo Sapiens
TDTFFRVHI

SEQ ID NO: 271031 - protein, 9 aa, Homo Sapiens
DAEARVGLW

SEQ ID NO: 271032 - protein, 9 aa, Homo Sapiens
CNPIHHLDY

SEQ ID NO: 271033 - protein, 9 aa, Homo Sapiens
AGPRTVLFW

SEQ ID NO: 271034 - protein, 9 aa, Homo Sapiens
RLIANAIQR

SEQ ID NO: 271035 - protein, 9 aa, Homo Sapiens
LIRGREACN

SEQ ID NO: 271036 - protein, 9 aa, Homo Sapiens
LLLISFRLK

SEQ ID NO: 271037 - protein, 9 aa, Homo Sapiens
LQKHGEDYN

SEQ ID NO: 271038 - protein, 9 aa, Homo Sapiens
IPQAKCDSE

SEQ ID NO: 271039 - protein, 9 aa, Homo Sapiens
TLCMNVGGF

SEQ ID NO: 271040 - protein, 9 aa, Homo Sapiens
TSRGQFLWR

SEQ ID NO: 271041 - protein, 9 aa, Homo Sapiens
IPHGPMPQN

SEQ ID NO: 271042 - protein, 9 aa, Homo Sapiens
VVKTNYGKI

SEQ ID NO: 271043 - protein, 9 aa, Homo Sapiens
LAPHKEQYK

SEQ ID NO: 271044 - protein, 9 aa, Homo Sapiens
TSLPPNTVF

SEQ ID NO: 271045 - protein, 9 aa, Homo Sapiens
YINVRWFPF

SEQ ID NO: 271046 - protein, 9 aa, Homo Sapiens
MEKFGMNSG

SEQ ID NO: 271047 - protein, 9 aa, Homo Sapiens
KGVHSSTNE

SEQ ID NO: 271048 - protein, 9 aa, Homo Sapiens
DAEEEGDDQ

SEQ ID NO: 271049 - protein, 9 aa, Homo Sapiens
DNYPSFATP

SEQ ID NO: 271050 - protein, 9 aa, Homo Sapiens
DAVLAQVYK

SEQ ID NO: 271051 - protein, 9 aa, Homo Sapiens
NGIWEVMPR

SEQ ID NO: 271052 - protein, 9 aa, Homo Sapiens
GAVSSPQIS

SEQ ID NO: 271053 - protein, 9 aa, Homo Sapiens
NTLLNNYSY

SEQ ID NO: 271054 - protein, 9 aa, Homo Sapiens
MLPKNSEES

SEQ ID NO: 271055 - protein, 9 aa, Homo Sapiens
RRTRQRVKR

SEQ ID NO: 271056 - protein, 9 aa, Homo Sapiens
LREQEKHIK

SEQ ID NO: 271057 - protein, 9 aa, Homo Sapiens
CLAPGVSSF

SEQ ID NO: 271058 - protein, 9 aa, Homo Sapiens
KWTGDVEEL

SEQ ID NO: 271059 - protein, 9 aa, Homo Sapiens
EDDSSENDD

SEQ ID NO: 271060 - protein, 9 aa, Homo Sapiens
NRDELRRHI

SEQ ID NO: 271061 - protein, 9 aa, Homo Sapiens
LLQIQSLGM

SEQ ID NO: 271062 - protein, 9 aa, Homo Sapiens
VELIITSYN

SEQ ID NO: 271063 - protein, 9 aa, Homo Sapiens
SQNPKSRGK

SEQ ID NO: 271064 - protein, 9 aa, Homo Sapiens
KLWAKLSAK

SEQ ID NO: 271065 - protein, 9 aa, Homo Sapiens
CYEGKSTPK

SEQ ID NO: 271066 - protein, 9 aa, Homo Sapiens
KDLMPKLTE

SEQ ID NO: 271067 - protein, 9 aa, Homo Sapiens
PLLNGGLQE

SEQ ID NO: 271068 - protein, 9 aa, Homo Sapiens
KPFIYVNAF

SEQ ID NO: 271069 - protein, 9 aa, Homo Sapiens
VSPLESHLK

SEQ ID NO: 271070 - protein, 9 aa, Homo Sapiens
SLPTNNFPV

SEQ ID NO: 271071 - protein, 9 aa, Homo Sapiens
QYCTYLDKS

SEQ ID NO: 271072 - protein, 9 aa, Homo Sapiens
TGYGFAKPY

SEQ ID NO: 271073 - protein, 9 aa, Homo Sapiens
RPEMNYQGR

SEQ ID NO: 271074 - protein, 9 aa, Homo Sapiens
SLSQYYCSK

SEQ ID NO: 271075 - protein, 9 aa, Homo Sapiens
VARLQDERT

SEQ ID NO: 271076 - protein, 9 aa, Homo Sapiens
WNYQNSTIG

SEQ ID NO: 271077 - protein, 9 aa, Homo Sapiens
RSSRYGSSC

SEQ ID NO: 271078 - protein, 9 aa, Homo Sapiens
TSILYYYFS

SEQ ID NO: 271079 - protein, 9 aa, Homo Sapiens
KESASSYQE

SEQ ID NO: 271080 - protein, 9 aa, Homo Sapiens
KNAIIIGER

SEQ ID NO: 271081 - protein, 9 aa, Homo Sapiens
KDEGQLICW

SEQ ID NO: 271082 - protein, 9 aa, Homo Sapiens
TIPTVVTVT

SEQ ID NO: 271083 - protein, 9 aa, Homo Sapiens
QLERKLKKA

SEQ ID NO: 271084 - protein, 9 aa, Homo Sapiens
TFGKIRSLT

SEQ ID NO: 271085 - protein, 9 aa, Homo Sapiens
KGRGRDIRS

SEQ ID NO: 271086 - protein, 9 aa, Homo Sapiens
RFCIQLVAV

SEQ ID NO: 271087 - protein, 9 aa, Homo Sapiens
REPRQIVIH

SEQ ID NO: 271088 - protein, 9 aa, Homo Sapiens
LKGDKGEIG

SEQ ID NO: 271089 - protein, 9 aa, Homo Sapiens
MLFNKNFVP

SEQ ID NO: 271090 - protein, 9 aa, Homo Sapiens
DHPHPREGQ

SEQ ID NO: 271091 - protein, 9 aa, Homo Sapiens
YDDEDDSGD

SEQ ID NO: 271092 - protein, 9 aa, Homo Sapiens
KIMLINSFG

SEQ ID NO: 271093 - protein, 9 aa, Homo Sapiens
KFSEVKAHT

SEQ ID NO: 271094 - protein, 9 aa, Homo Sapiens
HHIYGKFLG

SEQ ID NO: 271095 - protein, 9 aa, Homo Sapiens
AQKQQMDIE

SEQ ID NO: 271096 - protein, 9 aa, Homo Sapiens
PFWLPEPVP

SEQ ID NO: 271097 - protein, 9 aa, Homo Sapiens
KEIISPGIR

SEQ ID NO: 271098 - protein, 9 aa, Homo Sapiens
CKKRVEADR

SEQ ID NO: 271099 - protein, 9 aa, Homo Sapiens
IKFHAGYSL

SEQ ID NO: 271100 - protein, 9 aa, Homo Sapiens
KYLYFYKKT

SEQ ID NO: 271101 - protein, 9 aa, Homo Sapiens
ATPDIPSGL

SEQ ID NO: 271102 - protein, 9 aa, Homo Sapiens
GTLDADTCP

SEQ ID NO: 271103 - protein, 9 aa, Homo Sapiens
LMQNYEKIH

SEQ ID NO: 271104 - protein, 9 aa, Homo Sapiens
SSQESMKVQ

SEQ ID NO: 271105 - protein, 9 aa, Homo Sapiens
EVEYQMTSG

SEQ ID NO: 271106 - protein, 9 aa, Homo Sapiens
CLLYAGFIF

SEQ ID NO: 271107 - protein, 9 aa, Homo Sapiens
LSSLHLHEI

SEQ ID NO: 271108 - protein, 9 aa, Homo Sapiens
EENDLLEEI

SEQ ID NO: 271109 - protein, 9 aa, Homo Sapiens
QPDKVAEAI

SEQ ID NO: 271110 - protein, 9 aa, Homo Sapiens
VFQDKWERA

SEQ ID NO: 271111 - protein, 9 aa, Homo Sapiens
QSEKSKRDY

SEQ ID NO: 271112 - protein, 9 aa, Homo Sapiens
SQYYCSKTP

SEQ ID NO: 271113 - protein, 9 aa, Homo Sapiens
GATMLIHSS

SEQ ID NO: 271114 - protein, 9 aa, Homo Sapiens
GRLTDEGAV

SEQ ID NO: 271115 - protein, 9 aa, Homo Sapiens
PDSKAKTIT

SEQ ID NO: 271116 - protein, 9 aa, Homo Sapiens
YNTRVYKQT

SEQ ID NO: 271117 - protein, 9 aa, Homo Sapiens
STYLSALVR

SEQ ID NO: 271118 - protein, 9 aa, Homo Sapiens
IWDINKHGL

SEQ ID NO: 271119 - protein, 9 aa, Homo Sapiens
SPVRDMDDG

SEQ ID NO: 271120 - protein, 9 aa, Homo Sapiens
VGMLVPDIG

SEQ ID NO: 271121 - protein, 9 aa, Homo Sapiens
ALYDLSSDY

SEQ ID NO: 271122 - protein, 9 aa, Homo Sapiens
IPFEHDKEI

SEQ ID NO: 271123 - protein, 9 aa, Homo Sapiens
EMINNQNKS

SEQ ID NO: 271124 - protein, 9 aa, Homo Sapiens
TNGTNSAEF

SEQ ID NO: 271125 - protein, 9 aa, Homo Sapiens
KIVSTLYTV

SEQ ID NO: 271126 - protein, 9 aa, Homo Sapiens
FQKYYQLLE

SEQ ID NO: 271127 - protein, 9 aa, Homo Sapiens
CDYINDMNA

SEQ ID NO: 271128 - protein, 9 aa, Homo Sapiens
DKYSLHRIT

SEQ ID NO: 271129 - protein, 9 aa, Homo Sapiens
KFGADARAV

SEQ ID NO: 271130 - protein, 9 aa, Homo Sapiens
QVMIEPSGP

SEQ ID NO: 271131 - protein, 9 aa, Homo Sapiens
QRIMPVRNV

SEQ ID NO: 271132 - protein, 9 aa, Homo Sapiens
SNELDDQGH

SEQ ID NO: 271133 - protein, 9 aa, Homo Sapiens
KIIPLKNVL

SEQ ID NO: 271134 - protein, 9 aa, Homo Sapiens
PDAEVCLNV

SEQ ID NO: 271135 - protein, 9 aa, Homo Sapiens
NAEALEENK

SEQ ID NO: 271136 - protein, 9 aa, Homo Sapiens
SHSTTLYVA

SEQ ID NO: 271137 - protein, 9 aa, Homo Sapiens
GPYYFVNNL

SEQ ID NO: 271138 - protein, 9 aa, Homo Sapiens
TVFAIMSPG

SEQ ID NO: 271139 - protein, 9 aa, Homo Sapiens
FRRFTLIAL

SEQ ID NO: 271140 - protein, 9 aa, Homo Sapiens
KLENKIINK

SEQ ID NO: 271141 - protein, 9 aa, Homo Sapiens
TLSPSRRRK

SEQ ID NO: 271142 - protein, 9 aa, Homo Sapiens
SEESENQHK

SEQ ID NO: 271143 - protein, 9 aa, Homo Sapiens
HWTLCMNVG

SEQ ID NO: 271144 - protein, 9 aa, Homo Sapiens
EEIAFRVLR

SEQ ID NO: 271145 - protein, 9 aa, Homo Sapiens
VHSFVTHAV

SEQ ID NO: 271146 - protein, 9 aa, Homo Sapiens
LSWDPLHVQ

SEQ ID NO: 271147 - protein, 9 aa, Homo Sapiens
EIQRYSALT

SEQ ID NO: 271148 - protein, 9 aa, Homo Sapiens
DGSYRCQCP

SEQ ID NO: 271149 - protein, 9 aa, Homo Sapiens
GDVSEETME

SEQ ID NO: 271150 - protein, 9 aa, Homo Sapiens
LSPGFKRLF

SEQ ID NO: 271151 - protein, 9 aa, Homo Sapiens
DYLDFARYS

SEQ ID NO: 271152 - protein, 9 aa, Homo Sapiens
EAGTQEVVG

SEQ ID NO: 271153 - protein, 9 aa, Homo Sapiens
CFLEGDQRW

SEQ ID NO: 271154 - protein, 9 aa, Homo Sapiens
NMVVFVVQK

SEQ ID NO: 271155 - protein, 9 aa, Homo Sapiens
TTNPHLRII

SEQ ID NO: 271156 - protein, 9 aa, Homo Sapiens
TSESHPNSN

SEQ ID NO: 271157 - protein, 9 aa, Homo Sapiens
MHFQNVSKD

SEQ ID NO: 271158 - protein, 9 aa, Homo Sapiens
LSGFLCRDI

SEQ ID NO: 271159 - protein, 9 aa, Homo Sapiens
LLTPQDELF

SEQ ID NO: 271160 - protein, 9 aa, Homo Sapiens
QVDNLIPIE

SEQ ID NO: 271161 - protein, 9 aa, Homo Sapiens
PWPCDSRYF

SEQ ID NO: 271162 - protein, 9 aa, Homo Sapiens
PKKSVNAKK

SEQ ID NO: 271163 - protein, 9 aa, Homo Sapiens
EELKTEAKN

SEQ ID NO: 271164 - protein, 9 aa, Homo Sapiens
KDGSEQISH

SEQ ID NO: 271165 - protein, 9 aa, Homo Sapiens
KVKRTALGC

SEQ ID NO: 271166 - protein, 9 aa, Homo Sapiens
TYQESVRQR

SEQ ID NO: 271167 - protein, 9 aa, Homo Sapiens
KGPEIRKIF

SEQ ID NO: 271168 - protein, 9 aa, Homo Sapiens
EYTIDVFFQ

SEQ ID NO: 271169 - protein, 9 aa, Homo Sapiens
EIQHDQELQ

SEQ ID NO: 271170 - protein, 9 aa, Homo Sapiens
HYHVKETND

SEQ ID NO: 271171 - protein, 9 aa, Homo Sapiens
VQQSFATPR

SEQ ID NO: 271172 - protein, 9 aa, Homo Sapiens
KKNRHWHWS

SEQ ID NO: 271173 - protein, 9 aa, Homo Sapiens
LKTKLKYGQ

SEQ ID NO: 271174 - protein, 9 aa, Homo Sapiens
APRDLINTY

SEQ ID NO: 271175 - protein, 9 aa, Homo Sapiens
KNSHHIRKN

SEQ ID NO: 271176 - protein, 9 aa, Homo Sapiens
CYPGSQRSC

SEQ ID NO: 271177 - protein, 9 aa, Homo Sapiens
TLGQIQNLQ

SEQ ID NO: 271178 - protein, 9 aa, Homo Sapiens
HTVIFPLRN

SEQ ID NO: 271179 - protein, 9 aa, Homo Sapiens
LGVCLYYRV

SEQ ID NO: 271180 - protein, 9 aa, Homo Sapiens
AATEDIWES

SEQ ID NO: 271181 - protein, 9 aa, Homo Sapiens
EFPGVDGCN

SEQ ID NO: 271182 - protein, 9 aa, Homo Sapiens
IVKQESLVI

SEQ ID NO: 271183 - protein, 9 aa, Homo Sapiens
DITFKHIHE

SEQ ID NO: 271184 - protein, 9 aa, Homo Sapiens
QMLEDRDLF

SEQ ID NO: 271185 - protein, 9 aa, Homo Sapiens
EKQQEQQEI

SEQ ID NO: 271186 - protein, 9 aa, Homo Sapiens
SLDDKVVSI

SEQ ID NO: 271187 - protein, 9 aa, Homo Sapiens
QLESNKEGT

SEQ ID NO: 271188 - protein, 9 aa, Homo Sapiens
NHVFCLICI

SEQ ID NO: 271189 - protein, 9 aa, Homo Sapiens
TFFQIVICL

SEQ ID NO: 271190 - protein, 9 aa, Homo Sapiens
GLNPNPSHH

SEQ ID NO: 271191 - protein, 9 aa, Homo Sapiens
GAHVGKQAI

SEQ ID NO: 271192 - protein, 9 aa, Homo Sapiens
LDYINKEII

SEQ ID NO: 271193 - protein, 9 aa, Homo Sapiens
TGTLPNIAL

SEQ ID NO: 271194 - protein, 9 aa, Homo Sapiens
VISSSTKNY

SEQ ID NO: 271195 - protein, 9 aa, Homo Sapiens
LGVATATVN

SEQ ID NO: 271196 - protein, 9 aa, Homo Sapiens
FSQHTSRLC

SEQ ID NO: 271197 - protein, 9 aa, Homo Sapiens
KLNNLIKLE

SEQ ID NO: 271198 - protein, 9 aa, Homo Sapiens
MEVPDDSAL

SEQ ID NO: 271199 - protein, 9 aa, Homo Sapiens
SIRKINIRN

SEQ ID NO: 271200 - protein, 9 aa, Homo Sapiens
RLDFILMNK

SEQ ID NO: 271201 - protein, 9 aa, Homo Sapiens
ERVISGKQE

SEQ ID NO: 271202 - protein, 9 aa, Homo Sapiens
DAQSPLYSQ

SEQ ID NO: 271203 - protein, 9 aa, Homo Sapiens
VMIITESME

SEQ ID NO: 271204 - protein, 9 aa, Homo Sapiens
PKLDEIRDE

SEQ ID NO: 271205 - protein, 9 aa, Homo Sapiens
PPKPTPLTP

SEQ ID NO: 271206 - protein, 9 aa, Homo Sapiens
LQYISLGFF

SEQ ID NO: 271207 - protein, 9 aa, Homo Sapiens
FDLQIIGFA

SEQ ID NO: 271208 - protein, 9 aa, Homo Sapiens
CSGENNVIF

SEQ ID NO: 271209 - protein, 9 aa, Homo Sapiens
CKENINDKH

SEQ ID NO: 271210 - protein, 9 aa, Homo Sapiens
VRLITEKKD

SEQ ID NO: 271211 - protein, 9 aa, Homo Sapiens
VTYRNVKFN

SEQ ID NO: 271212 - protein, 9 aa, Homo Sapiens
DNITEFQHM

SEQ ID NO: 271213 - protein, 9 aa, Homo Sapiens
VSHAGSKSS

SEQ ID NO: 271214 - protein, 9 aa, Homo Sapiens
DDSKTAQAP

SEQ ID NO: 271215 - protein, 9 aa, Homo Sapiens
NFLPGLNFS

SEQ ID NO: 271216 - protein, 9 aa, Homo Sapiens
NSIHHNLSL

SEQ ID NO: 271217 - protein, 9 aa, Homo Sapiens
RSWQRHGTL

SEQ ID NO: 271218 - protein, 9 aa, Homo Sapiens
CNQEEKIKE

SEQ ID NO: 271219 - protein, 9 aa, Homo Sapiens
KRKDLLCHD

SEQ ID NO: 271220 - protein, 9 aa, Homo Sapiens
LTAFSQEMS

SEQ ID NO: 271221 - protein, 9 aa, Homo Sapiens
IILYDLHSE

SEQ ID NO: 271222 - protein, 9 aa, Homo Sapiens
FKQELRQKS

SEQ ID NO: 271223 - protein, 9 aa, Homo Sapiens
FRSYRKEWE

SEQ ID NO: 271224 - protein, 9 aa, Homo Sapiens
ENINLDLKH

SEQ ID NO: 271225 - protein, 9 aa, Homo Sapiens
GYGFNEPKQ

SEQ ID NO: 271226 - protein, 9 aa, Homo Sapiens
WLPFCGNHV

SEQ ID NO: 271227 - protein, 9 aa, Homo Sapiens
DQAVAISCP

SEQ ID NO: 271228 - protein, 9 aa, Homo Sapiens
SDQITFIER

SEQ ID NO: 271229 - protein, 9 aa, Homo Sapiens
DKLVCWVVS

SEQ ID NO: 271230 - protein, 9 aa, Homo Sapiens
FILILKKNT

SEQ ID NO: 271231 - protein, 9 aa, Homo Sapiens
TFNTICKKC

SEQ ID NO: 271232 - protein, 9 aa, Homo Sapiens
VLTSHPLKQ

SEQ ID NO: 271233 - protein, 9 aa, Homo Sapiens
EFHERGNNH

SEQ ID NO: 271234 - protein, 9 aa, Homo Sapiens
KHLGRVHFL

SEQ ID NO: 271235 - protein, 9 aa, Homo Sapiens
FVAFYVAGF

SEQ ID NO: 271236 - protein, 9 aa, Homo Sapiens
MYTIGDLGH

SEQ ID NO: 271237 - protein, 9 aa, Homo Sapiens
VKGALKNVL

SEQ ID NO: 271238 - protein, 9 aa, Homo Sapiens
CYGNKLGLT

SEQ ID NO: 271239 - protein, 9 aa, Homo Sapiens
VDVQNIVES

SEQ ID NO: 271240 - protein, 9 aa, Homo Sapiens
QASKQPPPS

SEQ ID NO: 271241 - protein, 9 aa, Homo Sapiens
MLIEYFTYE

SEQ ID NO: 271242 - protein, 9 aa, Homo Sapiens
SSPQAVPTS

SEQ ID NO: 271243 - protein, 9 aa, Homo Sapiens
SDNSHLRTE

SEQ ID NO: 271244 - protein, 9 aa, Homo Sapiens
NSLREELAN

SEQ ID NO: 271245 - protein, 9 aa, Homo Sapiens
IDTFQNNSK

SEQ ID NO: 271246 - protein, 9 aa, Homo Sapiens
LDKLRNLSV

SEQ ID NO: 271247 - protein, 9 aa, Homo Sapiens
NNASKFDGQ

SEQ ID NO: 271248 - protein, 9 aa, Homo Sapiens
WVELPITKY

SEQ ID NO: 271249 - protein, 9 aa, Homo Sapiens
QSKDVSDKY

SEQ ID NO: 271250 - protein, 9 aa, Homo Sapiens
IFQTQTSLV

SEQ ID NO: 271251 - protein, 9 aa, Homo Sapiens
HLTQHQNIH

SEQ ID NO: 271252 - protein, 9 aa, Homo Sapiens
MSLLSFYFG

SEQ ID NO: 271253 - protein, 9 aa, Homo Sapiens
LEIRRWDII

SEQ ID NO: 271254 - protein, 9 aa, Homo Sapiens
LMKAAKPAG

SEQ ID NO: 271255 - protein, 9 aa, Homo Sapiens
SGVAILMTI

SEQ ID NO: 271256 - protein, 9 aa, Homo Sapiens
HLGGDSFWV

SEQ ID NO: 271257 - protein, 9 aa, Homo Sapiens
ARRARSQSC

SEQ ID NO: 271258 - protein, 9 aa, Homo Sapiens
LPAYFLFIL

SEQ ID NO: 271259 - protein, 9 aa, Homo Sapiens
QTFYMASNN

SEQ ID NO: 271260 - protein, 9 aa, Homo Sapiens
RVFIVDSCD

SEQ ID NO: 271261 - protein, 9 aa, Homo Sapiens
HLFQNKLAA

SEQ ID NO: 271262 - protein, 9 aa, Homo Sapiens
CVQFANPSQ

SEQ ID NO: 271263 - protein, 9 aa, Homo Sapiens
KPESKINEE

SEQ ID NO: 271264 - protein, 9 aa, Homo Sapiens
LHYSTLFCS

SEQ ID NO: 271265 - protein, 9 aa, Homo Sapiens
MSDWEVQSP

SEQ ID NO: 271266 - protein, 9 aa, Homo Sapiens
IPLYLQPHA

SEQ ID NO: 271267 - protein, 9 aa, Homo Sapiens
VRAEIMISF

SEQ ID NO: 271268 - protein, 9 aa, Homo Sapiens
GEELGRGVQ

SEQ ID NO: 271269 - protein, 9 aa, Homo Sapiens
PKKSPTSQP

SEQ ID NO: 271270 - protein, 9 aa, Homo Sapiens
PAKINKGGL

SEQ ID NO: 271271 - protein, 9 aa, Homo Sapiens
YHQALLFKA

SEQ ID NO: 271272 - protein, 9 aa, Homo Sapiens
SCGDHPSKG

SEQ ID NO: 271273 - protein, 9 aa, Homo Sapiens
SLDAVISVF

SEQ ID NO: 271274 - protein, 9 aa, Homo Sapiens
PSGADSGTL

SEQ ID NO: 271275 - protein, 9 aa, Homo Sapiens
SGGLHEFLV

SEQ ID NO: 271276 - protein, 9 aa, Homo Sapiens
AYSKLLSRL

SEQ ID NO: 271277 - protein, 9 aa, Homo Sapiens
KLGLPDYHR

SEQ ID NO: 271278 - protein, 9 aa, Homo Sapiens
LHAPWDLGM

SEQ ID NO: 271279 - protein, 9 aa, Homo Sapiens
PDPGFKRLA

SEQ ID NO: 271280 - protein, 9 aa, Homo Sapiens
IQQVTLNIP

SEQ ID NO: 271281 - protein, 9 aa, Homo Sapiens
PAGPVGTAG

SEQ ID NO: 271282 - protein, 9 aa, Homo Sapiens
HYSPMVKSK

SEQ ID NO: 271283 - protein, 9 aa, Homo Sapiens
SKGRKFPEL

SEQ ID NO: 271284 - protein, 9 aa, Homo Sapiens
SPNAVVGQY

SEQ ID NO: 271285 - protein, 9 aa, Homo Sapiens
NHPLTVSSS

SEQ ID NO: 271286 - protein, 9 aa, Homo Sapiens
AAVIESLEM

SEQ ID NO: 271287 - protein, 9 aa, Homo Sapiens
PRPNSQYNQ

SEQ ID NO: 271288 - protein, 9 aa, Homo Sapiens
NAFHSPCQH

SEQ ID NO: 271289 - protein, 9 aa, Homo Sapiens
FENGKPKFD

SEQ ID NO: 271290 - protein, 9 aa, Homo Sapiens
RETEKENGP

SEQ ID NO: 271291 - protein, 9 aa, Homo Sapiens
HVKNVCQLE

SEQ ID NO: 271292 - protein, 9 aa, Homo Sapiens
NPLDNLELT

SEQ ID NO: 271293 - protein, 9 aa, Homo Sapiens
INLHQHQRI

SEQ ID NO: 271294 - protein, 9 aa, Homo Sapiens
EAYRFGAES

SEQ ID NO: 271295 - protein, 9 aa, Homo Sapiens
SNTLLNNYS

SEQ ID NO: 271296 - protein, 9 aa, Homo Sapiens
LCLSMTEHV

SEQ ID NO: 271297 - protein, 9 aa, Homo Sapiens
LTHLYLANN

SEQ ID NO: 271298 - protein, 9 aa, Homo Sapiens
TLLFKRVFV

SEQ ID NO: 271299 - protein, 9 aa, Homo Sapiens
TQIRNYQCI

SEQ ID NO: 271300 - protein, 9 aa, Homo Sapiens
YFGRRVLCY

SEQ ID NO: 271301 - protein, 9 aa, Homo Sapiens
DKGITPEGI

SEQ ID NO: 271302 - protein, 9 aa, Homo Sapiens
TGEKFDRQA

SEQ ID NO: 271303 - protein, 9 aa, Homo Sapiens
GKHSLRNEE

SEQ ID NO: 271304 - protein, 9 aa, Homo Sapiens
EETMESRKV

SEQ ID NO: 271305 - protein, 9 aa, Homo Sapiens
YILVLPLDL

SEQ ID NO: 271306 - protein, 9 aa, Homo Sapiens
FNISSTLNT

SEQ ID NO: 271307 - protein, 9 aa, Homo Sapiens
RRIFERLRL

SEQ ID NO: 271308 - protein, 9 aa, Homo Sapiens
FNTICKKCG

SEQ ID NO: 271309 - protein, 9 aa, Homo Sapiens
QLIVHQRTN

SEQ ID NO: 271310 - protein, 9 aa, Homo Sapiens
ETTKVVQNR

SEQ ID NO: 271311 - protein, 9 aa, Homo Sapiens
RGPAQKKPP

SEQ ID NO: 271312 - protein, 9 aa, Homo Sapiens
RHHQFRWSE

SEQ ID NO: 271313 - protein, 9 aa, Homo Sapiens
ERIIREVCR

SEQ ID NO: 271314 - protein, 9 aa, Homo Sapiens
NTVYDVDNK

SEQ ID NO: 271315 - protein, 9 aa, Homo Sapiens
TANEDICPE

SEQ ID NO: 271316 - protein, 9 aa, Homo Sapiens
KRISKRINS

SEQ ID NO: 271317 - protein, 9 aa, Homo Sapiens
SSVRERKKE

SEQ ID NO: 271318 - protein, 9 aa, Homo Sapiens
VFLFKPENS

SEQ ID NO: 271319 - protein, 9 aa, Homo Sapiens
PACSYNQSR

SEQ ID NO: 271320 - protein, 9 aa, Homo Sapiens
KDCKQVIQR

SEQ ID NO: 271321 - protein, 9 aa, Homo Sapiens
KYGSLEEDD

SEQ ID NO: 271322 - protein, 9 aa, Homo Sapiens
WELNEYLEQ

SEQ ID NO: 271323 - protein, 9 aa, Homo Sapiens
GMDEMVAPR

SEQ ID NO: 271324 - protein, 9 aa, Homo Sapiens
KEQVSELNT

SEQ ID NO: 271325 - protein, 9 aa, Homo Sapiens
VTKEAANII

SEQ ID NO: 271326 - protein, 9 aa, Homo Sapiens
NLWKARHQH

SEQ ID NO: 271327 - protein, 9 aa, Homo Sapiens
KKRNDLCFL

SEQ ID NO: 271328 - protein, 9 aa, Homo Sapiens
MQQVQTHFS

SEQ ID NO: 271329 - protein, 9 aa, Homo Sapiens
PFLMGAMRG

SEQ ID NO: 271330 - protein, 9 aa, Homo Sapiens
EQRRTQRYF

SEQ ID NO: 271331 - protein, 9 aa, Homo Sapiens
TQEEAPFVI

SEQ ID NO: 271332 - protein, 9 aa, Homo Sapiens
AFMKANSGY

SEQ ID NO: 271333 - protein, 9 aa, Homo Sapiens
FEKINASLL

SEQ ID NO: 271334 - protein, 9 aa, Homo Sapiens
ELGYFNDIT

SEQ ID NO: 271335 - protein, 9 aa, Homo Sapiens
PLKDRVNLV

SEQ ID NO: 271336 - protein, 9 aa, Homo Sapiens
SPASRWSKI

SEQ ID NO: 271337 - protein, 9 aa, Homo Sapiens
GEMNESVGV

SEQ ID NO: 271338 - protein, 9 aa, Homo Sapiens
YAQHIKEDR

SEQ ID NO: 271339 - protein, 9 aa, Homo Sapiens
GMRVNTVYD

SEQ ID NO: 271340 - protein, 9 aa, Homo Sapiens
IIAIVVYTA

SEQ ID NO: 271341 - protein, 9 aa, Homo Sapiens
ERRIKPFTL

SEQ ID NO: 271342 - protein, 9 aa, Homo Sapiens
SYTVQADLT

SEQ ID NO: 271343 - protein, 9 aa, Homo Sapiens
YQKCIKLKQ

SEQ ID NO: 271344 - protein, 9 aa, Homo Sapiens
CPRWLCAGA

SEQ ID NO: 271345 - protein, 9 aa, Homo Sapiens
HKGYFCEAR

SEQ ID NO: 271346 - protein, 9 aa, Homo Sapiens
FQKFYERGD

SEQ ID NO: 271347 - protein, 9 aa, Homo Sapiens
LEIVLFAHN

SEQ ID NO: 271348 - protein, 9 aa, Homo Sapiens
LKNDAKAPA

SEQ ID NO: 271349 - protein, 9 aa, Homo Sapiens
INKKLYSAE

SEQ ID NO: 271350 - protein, 9 aa, Homo Sapiens
KIRISIGSL

SEQ ID NO: 271351 - protein, 9 aa, Homo Sapiens
QIHGNDTSN

SEQ ID NO: 271352 - protein, 9 aa, Homo Sapiens
HLKIFRQEG

SEQ ID NO: 271353 - protein, 9 aa, Homo Sapiens
LSDSDMVSQ

SEQ ID NO: 271354 - protein, 9 aa, Homo Sapiens
DADEKRFEE

SEQ ID NO: 271355 - protein, 9 aa, Homo Sapiens
RKMCKRILV

SEQ ID NO: 271356 - protein, 9 aa, Homo Sapiens
NDVFPCSVY

SEQ ID NO: 271357 - protein, 9 aa, Homo Sapiens
YDRRTQERD

SEQ ID NO: 271358 - protein, 9 aa, Homo Sapiens
FVRVKPTND

SEQ ID NO: 271359 - protein, 9 aa, Homo Sapiens
ILLGYLMIT

SEQ ID NO: 271360 - protein, 9 aa, Homo Sapiens
TRMMEILSE

SEQ ID NO: 271361 - protein, 9 aa, Homo Sapiens
PTVSQPTAP

SEQ ID NO: 271362 - protein, 9 aa, Homo Sapiens
KKQNPSSGV

SEQ ID NO: 271363 - protein, 9 aa, Homo Sapiens
LQGLNLLHQ

SEQ ID NO: 271364 - protein, 9 aa, Homo Sapiens
FTMLKARQL

SEQ ID NO: 271365 - protein, 9 aa, Homo Sapiens
KRKGLPCDT

SEQ ID NO: 271366 - protein, 9 aa, Homo Sapiens
HAMAGNDDE

SEQ ID NO: 271367 - protein, 9 aa, Homo Sapiens
RHGFFGRHR

SEQ ID NO: 271368 - protein, 9 aa, Homo Sapiens
VSWDSDTCS

SEQ ID NO: 271369 - protein, 9 aa, Homo Sapiens
ERLKLVKLS

SEQ ID NO: 271370 - protein, 9 aa, Homo Sapiens
PPVITAAIN

SEQ ID NO: 271371 - protein, 9 aa, Homo Sapiens
ASLESMVAI

SEQ ID NO: 271372 - protein, 9 aa, Homo Sapiens
DMRTKHFVS

SEQ ID NO: 271373 - protein, 9 aa, Homo Sapiens
PFPGIQVRH

SEQ ID NO: 271374 - protein, 9 aa, Homo Sapiens
EYASKLKRL

SEQ ID NO: 271375 - protein, 9 aa, Homo Sapiens
MDLVQEEYL

SEQ ID NO: 271376 - protein, 9 aa, Homo Sapiens
QGNLEKQMR

SEQ ID NO: 271377 - protein, 9 aa, Homo Sapiens
EHPGFNALD

SEQ ID NO: 271378 - protein, 9 aa, Homo Sapiens
DFLSKCDNK

SEQ ID NO: 271379 - protein, 9 aa, Homo Sapiens
GSKRRQTGG

SEQ ID NO: 271380 - protein, 9 aa, Homo Sapiens
RCIGKELSK

SEQ ID NO: 271381 - protein, 9 aa, Homo Sapiens
ICLNRSERW

SEQ ID NO: 271382 - protein, 9 aa, Homo Sapiens
KLLDEDFVF

SEQ ID NO: 271383 - protein, 9 aa, Homo Sapiens
LERGSLKRQ

SEQ ID NO: 271384 - protein, 9 aa, Homo Sapiens
KKNISFLCR

SEQ ID NO: 271385 - protein, 9 aa, Homo Sapiens
LLDRYVAIQ

SEQ ID NO: 271386 - protein, 9 aa, Homo Sapiens
IPFVLKSLV

SEQ ID NO: 271387 - protein, 9 aa, Homo Sapiens
TEDGEESPQ

SEQ ID NO: 271388 - protein, 9 aa, Homo Sapiens
LQAKADTIT

SEQ ID NO: 271389 - protein, 9 aa, Homo Sapiens
NDAPHFLEK

SEQ ID NO: 271390 - protein, 9 aa, Homo Sapiens
GTTSVSSEF

SEQ ID NO: 271391 - protein, 9 aa, Homo Sapiens
WSTNQCFGN

SEQ ID NO: 271392 - protein, 9 aa, Homo Sapiens
FTGGMRESS

SEQ ID NO: 271393 - protein, 9 aa, Homo Sapiens
GGFDLCFIL

SEQ ID NO: 271394 - protein, 9 aa, Homo Sapiens
SPEQTSNVK

SEQ ID NO: 271395 - protein, 9 aa, Homo Sapiens
CTQFLTPLR

SEQ ID NO: 271396 - protein, 9 aa, Homo Sapiens
LTSGLGFAI

SEQ ID NO: 271397 - protein, 9 aa, Homo Sapiens
PIRLLGLIR

SEQ ID NO: 271398 - protein, 9 aa, Homo Sapiens
DVSQPPPVY

SEQ ID NO: 271399 - protein, 9 aa, Homo Sapiens
CNCTLLGLR

SEQ ID NO: 271400 - protein, 9 aa, Homo Sapiens
FCGTGTDRC

SEQ ID NO: 271401 - protein, 9 aa, Homo Sapiens
EVFRAPGTI

SEQ ID NO: 271402 - protein, 9 aa, Homo Sapiens
SVYEQLIYA

SEQ ID NO: 271403 - protein, 9 aa, Homo Sapiens
DHEDHDDLE

SEQ ID NO: 271404 - protein, 9 aa, Homo Sapiens
MNAKDVVAV

SEQ ID NO: 271405 - protein, 9 aa, Homo Sapiens
LPPKKWIGN

SEQ ID NO: 271406 - protein, 9 aa, Homo Sapiens
KNKWYKSAL

SEQ ID NO: 271407 - protein, 9 aa, Homo Sapiens
DGSGAESGY

SEQ ID NO: 271408 - protein, 9 aa, Homo Sapiens
KADKRSQCK

SEQ ID NO: 271409 - protein, 9 aa, Homo Sapiens
SALTIHNRI

SEQ ID NO: 271410 - protein, 9 aa, Homo Sapiens
PLPGPHDPA

SEQ ID NO: 271411 - protein, 9 aa, Homo Sapiens
SICMVESGA

SEQ ID NO: 271412 - protein, 9 aa, Homo Sapiens
PEWKRVEAN

SEQ ID NO: 271413 - protein, 9 aa, Homo Sapiens
LQLHPIIDA

SEQ ID NO: 271414 - protein, 9 aa, Homo Sapiens
QFAPDHDGL

SEQ ID NO: 271415 - protein, 9 aa, Homo Sapiens
SVSTGTTCI

SEQ ID NO: 271416 - protein, 9 aa, Homo Sapiens
IEEHCAKNR

SEQ ID NO: 271417 - protein, 9 aa, Homo Sapiens
RVVKLRKRP

SEQ ID NO: 271418 - protein, 9 aa, Homo Sapiens
CAFDQKEEG

SEQ ID NO: 271419 - protein, 9 aa, Homo Sapiens
LRIALSEHR

SEQ ID NO: 271420 - protein, 9 aa, Homo Sapiens
TTNNPARAV

SEQ ID NO: 271421 - protein, 9 aa, Homo Sapiens
QQQLSVNQI

SEQ ID NO: 271422 - protein, 9 aa, Homo Sapiens
FIFTYASHP

SEQ ID NO: 271423 - protein, 9 aa, Homo Sapiens
ANQARDDYK

SEQ ID NO: 271424 - protein, 9 aa, Homo Sapiens
TEDKPLSLS

SEQ ID NO: 271425 - protein, 9 aa, Homo Sapiens
LMEFNLLIS

SEQ ID NO: 271426 - protein, 9 aa, Homo Sapiens
SALKSETFS

SEQ ID NO: 271427 - protein, 9 aa, Homo Sapiens
YVNGLCVPA

SEQ ID NO: 271428 - protein, 9 aa, Homo Sapiens
LFSFQNHIR

SEQ ID NO: 271429 - protein, 9 aa, Homo Sapiens
LQLVRLDLN

SEQ ID NO: 271430 - protein, 9 aa, Homo Sapiens
QIKELGTLI

SEQ ID NO: 271431 - protein, 9 aa, Homo Sapiens
LNYLKYTFT

SEQ ID NO: 271432 - protein, 9 aa, Homo Sapiens
ILIYKLSYA

SEQ ID NO: 271433 - protein, 9 aa, Homo Sapiens
CVTHRYSDG

SEQ ID NO: 271434 - protein, 9 aa, Homo Sapiens
LRKRPRYYP

SEQ ID NO: 271435 - protein, 9 aa, Homo Sapiens
NTATTMKDV

SEQ ID NO: 271436 - protein, 9 aa, Homo Sapiens
DDDENSILY

SEQ ID NO: 271437 - protein, 9 aa, Homo Sapiens
EKRKWTLDL

SEQ ID NO: 271438 - protein, 9 aa, Homo Sapiens
ERVLPTCIS

SEQ ID NO: 271439 - protein, 9 aa, Homo Sapiens
VSENTISFA

SEQ ID NO: 271440 - protein, 9 aa, Homo Sapiens
VTNYIYVTY

SEQ ID NO: 271441 - protein, 9 aa, Homo Sapiens
ICPEKGSGV

SEQ ID NO: 271442 - protein, 9 aa, Homo Sapiens
EDSTLSKYV

SEQ ID NO: 271443 - protein, 9 aa, Homo Sapiens
DVLKSQFQT

SEQ ID NO: 271444 - protein, 9 aa, Homo Sapiens
KKSPTSQPL

SEQ ID NO: 271445 - protein, 9 aa, Homo Sapiens
NKMLKSTSD

SEQ ID NO: 271446 - protein, 9 aa, Homo Sapiens
KSRQYLKRV

SEQ ID NO: 271447 - protein, 9 aa, Homo Sapiens
DLPKGLPGL

SEQ ID NO: 271448 - protein, 9 aa, Homo Sapiens
PDHPLMVIF

SEQ ID NO: 271449 - protein, 9 aa, Homo Sapiens
KDVTFNTIC

SEQ ID NO: 271450 - protein, 9 aa, Homo Sapiens
YEIKPLALS

SEQ ID NO: 271451 - protein, 9 aa, Homo Sapiens
TTRSRKPLQ

SEQ ID NO: 271452 - protein, 9 aa, Homo Sapiens
QLHFMNTSR

SEQ ID NO: 271453 - protein, 9 aa, Homo Sapiens
LLCRHNGSM

SEQ ID NO: 271454 - protein, 9 aa, Homo Sapiens
EQFHYFIII

SEQ ID NO: 271455 - protein, 9 aa, Homo Sapiens
SHVNQVIMM

SEQ ID NO: 271456 - protein, 9 aa, Homo Sapiens
AYHPAERIS

SEQ ID NO: 271457 - protein, 9 aa, Homo Sapiens
ASFILVFCV

SEQ ID NO: 271458 - protein, 9 aa, Homo Sapiens
QLARNNVTQ

SEQ ID NO: 271459 - protein, 9 aa, Homo Sapiens
QPFNTIKVK

SEQ ID NO: 271460 - protein, 9 aa, Homo Sapiens
ELNFGSFVE

SEQ ID NO: 271461 - protein, 9 aa, Homo Sapiens
DTHVYTEYT

SEQ ID NO: 271462 - protein, 9 aa, Homo Sapiens
INQEECKGF

SEQ ID NO: 271463 - protein, 9 aa, Homo Sapiens
KQSSLTKIK

SEQ ID NO: 271464 - protein, 9 aa, Homo Sapiens
KKGNQTKNV

SEQ ID NO: 271465 - protein, 9 aa, Homo Sapiens
ALDPIDCNC

SEQ ID NO: 271466 - protein, 9 aa, Homo Sapiens
HQCYGNKLG

SEQ ID NO: 271467 - protein, 9 aa, Homo Sapiens
DRMDYDDDR

SEQ ID NO: 271468 - protein, 9 aa, Homo Sapiens
TSYLSLFFR

SEQ ID NO: 271469 - protein, 9 aa, Homo Sapiens
EEIDLLNGD

SEQ ID NO: 271470 - protein, 9 aa, Homo Sapiens
LFTSEPLRQ

SEQ ID NO: 271471 - protein, 9 aa, Homo Sapiens
SVPLLAAPQ

SEQ ID NO: 271472 - protein, 9 aa, Homo Sapiens
CSRLTSSPP

SEQ ID NO: 271473 - protein, 9 aa, Homo Sapiens
HTIIDNTDL

SEQ ID NO: 271474 - protein, 9 aa, Homo Sapiens
ISGSIEVVK

SEQ ID NO: 271475 - protein, 9 aa, Homo Sapiens
SGLSDPESE

SEQ ID NO: 271476 - protein, 9 aa, Homo Sapiens
SLTMYIEMP

SEQ ID NO: 271477 - protein, 9 aa, Homo Sapiens
YSLKSLKIL

SEQ ID NO: 271478 - protein, 9 aa, Homo Sapiens
TSIGKWRFR

SEQ ID NO: 271479 - protein, 9 aa, Homo Sapiens
SWGQRLETQ

SEQ ID NO: 271480 - protein, 9 aa, Homo Sapiens
YIIHFFRHR

SEQ ID NO: 271481 - protein, 9 aa, Homo Sapiens
FEEESEILR

SEQ ID NO: 271482 - protein, 9 aa, Homo Sapiens
TANNKSKAR

SEQ ID NO: 271483 - protein, 9 aa, Homo Sapiens
MDTQLSEFT

SEQ ID NO: 271484 - protein, 9 aa, Homo Sapiens
GYITYIQAN

SEQ ID NO: 271485 - protein, 9 aa, Homo Sapiens
VRLLKLSRE

SEQ ID NO: 271486 - protein, 9 aa, Homo Sapiens
ALERTEQLL

SEQ ID NO: 271487 - protein, 9 aa, Homo Sapiens
AIGIWAIGC

SEQ ID NO: 271488 - protein, 9 aa, Homo Sapiens
TDISTDKER

SEQ ID NO: 271489 - protein, 9 aa, Homo Sapiens
LLCERNDKV

SEQ ID NO: 271490 - protein, 9 aa, Homo Sapiens
GVLLFNYKP

SEQ ID NO: 271491 - protein, 9 aa, Homo Sapiens
AQSPPGKPQ

SEQ ID NO: 271492 - protein, 9 aa, Homo Sapiens
LLYLKKNKI

SEQ ID NO: 271493 - protein, 9 aa, Homo Sapiens
VGNLYSGQI

SEQ ID NO: 271494 - protein, 9 aa, Homo Sapiens
LEYNVIKDI

SEQ ID NO: 271495 - protein, 9 aa, Homo Sapiens
DIEPGEEIY

SEQ ID NO: 271496 - protein, 9 aa, Homo Sapiens
RKLQWNESE

SEQ ID NO: 271497 - protein, 9 aa, Homo Sapiens
DTFDLQIIG

SEQ ID NO: 271498 - protein, 9 aa, Homo Sapiens
MIKSGSVVA

SEQ ID NO: 271499 - protein, 9 aa, Homo Sapiens
RALEDRNSM

SEQ ID NO: 271500 - protein, 9 aa, Homo Sapiens
QMSLEFPTG

SEQ ID NO: 271501 - protein, 9 aa, Homo Sapiens
ALRKSNSPG

SEQ ID NO: 271502 - protein, 9 aa, Homo Sapiens
CVKITILKE

SEQ ID NO: 271503 - protein, 9 aa, Homo Sapiens
YDREGSVKS

SEQ ID NO: 271504 - protein, 9 aa, Homo Sapiens
RLGQRVRLK

SEQ ID NO: 271505 - protein, 9 aa, Homo Sapiens
DCRNTRVTG

SEQ ID NO: 271506 - protein, 9 aa, Homo Sapiens
LLNHPKTQQ

SEQ ID NO: 271507 - protein, 9 aa, Homo Sapiens
SHGVGQHQE

SEQ ID NO: 271508 - protein, 9 aa, Homo Sapiens
VHHAFAKLL

SEQ ID NO: 271509 - protein, 9 aa, Homo Sapiens
GGHSYLFKG

SEQ ID NO: 271510 - protein, 9 aa, Homo Sapiens
PKEVVPQLP

SEQ ID NO: 271511 - protein, 9 aa, Homo Sapiens
QLFVLEEHM

SEQ ID NO: 271512 - protein, 9 aa, Homo Sapiens
LGYPFGYVK

SEQ ID NO: 271513 - protein, 9 aa, Homo Sapiens
ISVDHLGGG

SEQ ID NO: 271514 - protein, 9 aa, Homo Sapiens
VILLAFQVF

SEQ ID NO: 271515 - protein, 9 aa, Homo Sapiens
QYAAIKKAW

SEQ ID NO: 271516 - protein, 9 aa, Homo Sapiens
VIDIQKNID

SEQ ID NO: 271517 - protein, 9 aa, Homo Sapiens
VQGVKNMDI

SEQ ID NO: 271518 - protein, 9 aa, Homo Sapiens
SYLSSSCKG

SEQ ID NO: 271519 - protein, 9 aa, Homo Sapiens
EALDLCTVF

SEQ ID NO: 271520 - protein, 9 aa, Homo Sapiens
FFHLGVKAY

SEQ ID NO: 271521 - protein, 9 aa, Homo Sapiens
QTSNVKMVQ

SEQ ID NO: 271522 - protein, 9 aa, Homo Sapiens
WKVLSREEK

SEQ ID NO: 271523 - protein, 9 aa, Homo Sapiens
SLPAHGPEA

SEQ ID NO: 271524 - protein, 9 aa, Homo Sapiens
NDKHFPFWL

SEQ ID NO: 271525 - protein, 9 aa, Homo Sapiens
YSAVIQRKH

SEQ ID NO: 271526 - protein, 9 aa, Homo Sapiens
SKEHPRWED

SEQ ID NO: 271527 - protein, 9 aa, Homo Sapiens
NQSIKDTFI

SEQ ID NO: 271528 - protein, 9 aa, Homo Sapiens
NEKRTFFHW

SEQ ID NO: 271529 - protein, 9 aa, Homo Sapiens
WCQQIPGTS

SEQ ID NO: 271530 - protein, 9 aa, Homo Sapiens
ASMKQYRKI

SEQ ID NO: 271531 - protein, 9 aa, Homo Sapiens
IDITLTQRA

SEQ ID NO: 271532 - protein, 9 aa, Homo Sapiens
GDKAQQTKP

SEQ ID NO: 271533 - protein, 9 aa, Homo Sapiens
DKSVPDDTK

SEQ ID NO: 271534 - protein, 9 aa, Homo Sapiens
SSPVKKVNC

SEQ ID NO: 271535 - protein, 9 aa, Homo Sapiens
NTMFSSVCS

SEQ ID NO: 271536 - protein, 9 aa, Homo Sapiens
LGEPEDYLG

SEQ ID NO: 271537 - protein, 9 aa, Homo Sapiens
NIIQDESTQ

SEQ ID NO: 271538 - protein, 9 aa, Homo Sapiens
LSGSKKANN

SEQ ID NO: 271539 - protein, 9 aa, Homo Sapiens
MSKALGIGR

SEQ ID NO: 271540 - protein, 9 aa, Homo Sapiens
LPLPKQGSP

SEQ ID NO: 271541 - protein, 9 aa, Homo Sapiens
KAQEYEKGK

SEQ ID NO: 271542 - protein, 9 aa, Homo Sapiens
PNQHFRQNS

SEQ ID NO: 271543 - protein, 9 aa, Homo Sapiens
DTIPETKNC

SEQ ID NO: 271544 - protein, 9 aa, Homo Sapiens
ACKESRPFS

SEQ ID NO: 271545 - protein, 9 aa, Homo Sapiens
YLLISNTGS

SEQ ID NO: 271546 - protein, 9 aa, Homo Sapiens
NFSYNSSCY

SEQ ID NO: 271547 - protein, 9 aa, Homo Sapiens
PGEQGPQGI

SEQ ID NO: 271548 - protein, 9 aa, Homo Sapiens
LGNTVYFTC

SEQ ID NO: 271549 - protein, 9 aa, Homo Sapiens
WCFDQINAV

SEQ ID NO: 271550 - protein, 9 aa, Homo Sapiens
DFGFSNACE

SEQ ID NO: 271551 - protein, 9 aa, Homo Sapiens
STQDKYLHL

SEQ ID NO: 271552 - protein, 9 aa, Homo Sapiens
QNILGLDSL

SEQ ID NO: 271553 - protein, 9 aa, Homo Sapiens
DHSISPFMI

SEQ ID NO: 271554 - protein, 9 aa, Homo Sapiens
RNYQCIEQN

SEQ ID NO: 271555 - protein, 9 aa, Homo Sapiens
GYGELLGTL

SEQ ID NO: 271556 - protein, 9 aa, Homo Sapiens
VKDPEARKL

SEQ ID NO: 271557 - protein, 9 aa, Homo Sapiens
CHIVPVFSL

SEQ ID NO: 271558 - protein, 9 aa, Homo Sapiens
PQAEVEQEA

SEQ ID NO: 271559 - protein, 9 aa, Homo Sapiens
MTCISLQNL

SEQ ID NO: 271560 - protein, 9 aa, Homo Sapiens
HTFQNECLF

SEQ ID NO: 271561 - protein, 9 aa, Homo Sapiens
KFRVGATDR

SEQ ID NO: 271562 - protein, 9 aa, Homo Sapiens
GTFFISWGS

SEQ ID NO: 271563 - protein, 9 aa, Homo Sapiens
SAHTLVTCW

SEQ ID NO: 271564 - protein, 9 aa, Homo Sapiens
IYAPTSSRA

SEQ ID NO: 271565 - protein, 9 aa, Homo Sapiens
EFIKPEKFT

SEQ ID NO: 271566 - protein, 9 aa, Homo Sapiens
ICDETNNCP

SEQ ID NO: 271567 - protein, 9 aa, Homo Sapiens
RDPWNWLNF

SEQ ID NO: 271568 - protein, 9 aa, Homo Sapiens
KLSELHVNY

SEQ ID NO: 271569 - protein, 9 aa, Homo Sapiens
VRNSLTIYH

SEQ ID NO: 271570 - protein, 9 aa, Homo Sapiens
SYDGDIVLW

SEQ ID NO: 271571 - protein, 9 aa, Homo Sapiens
INSLPPSHQ

SEQ ID NO: 271572 - protein, 9 aa, Homo Sapiens
ADECIKSED

SEQ ID NO: 271573 - protein, 9 aa, Homo Sapiens
VTMEHISDK

SEQ ID NO: 271574 - protein, 9 aa, Homo Sapiens
LDKKKEVVT

SEQ ID NO: 271575 - protein, 9 aa, Homo Sapiens
CGAWAGHPC

SEQ ID NO: 271576 - protein, 9 aa, Homo Sapiens
LETLPTTNM

SEQ ID NO: 271577 - protein, 9 aa, Homo Sapiens
ECKECAKTL

SEQ ID NO: 271578 - protein, 9 aa, Homo Sapiens
VARLARERE

SEQ ID NO: 271579 - protein, 9 aa, Homo Sapiens
GPENGDPVH

SEQ ID NO: 271580 - protein, 9 aa, Homo Sapiens
FIYVNAFQR

SEQ ID NO: 271581 - protein, 9 aa, Homo Sapiens
LNNYPGSCG

SEQ ID NO: 271582 - protein, 9 aa, Homo Sapiens
YCKKGFQRP

SEQ ID NO: 271583 - protein, 9 aa, Homo Sapiens
LDQARRDLY

SEQ ID NO: 271584 - protein, 9 aa, Homo Sapiens
PPEKKDKGY

SEQ ID NO: 271585 - protein, 9 aa, Homo Sapiens
ESINNYLQF

SEQ ID NO: 271586 - protein, 9 aa, Homo Sapiens
MLRIPNVQY

SEQ ID NO: 271587 - protein, 9 aa, Homo Sapiens
EFSDETFGP

SEQ ID NO: 271588 - protein, 9 aa, Homo Sapiens
NKTKNKGVH

SEQ ID NO: 271589 - protein, 9 aa, Homo Sapiens
VQSPPQQVS

SEQ ID NO: 271590 - protein, 9 aa, Homo Sapiens
DLLTQIDLD

SEQ ID NO: 271591 - protein, 9 aa, Homo Sapiens
VTYRSFNTF

SEQ ID NO: 271592 - protein, 9 aa, Homo Sapiens
PIDGFLQSR

SEQ ID NO: 271593 - protein, 9 aa, Homo Sapiens
DEPEGLLAG

SEQ ID NO: 271594 - protein, 9 aa, Homo Sapiens
INNERKALK

SEQ ID NO: 271595 - protein, 9 aa, Homo Sapiens
FQYDTESTV

SEQ ID NO: 271596 - protein, 9 aa, Homo Sapiens
QLGNSENFI

SEQ ID NO: 271597 - protein, 9 aa, Homo Sapiens
IASDNLWGS

SEQ ID NO: 271598 - protein, 9 aa, Homo Sapiens
RSSFEINAF

SEQ ID NO: 271599 - protein, 9 aa, Homo Sapiens
PTWSASVTD

SEQ ID NO: 271600 - protein, 9 aa, Homo Sapiens
EEAYRFGAE

SEQ ID NO: 271601 - protein, 9 aa, Homo Sapiens
ITDLNRMHS

SEQ ID NO: 271602 - protein, 9 aa, Homo Sapiens
DKVHLEPVR

SEQ ID NO: 271603 - protein, 9 aa, Homo Sapiens
CDLFCNPSM

SEQ ID NO: 271604 - protein, 9 aa, Homo Sapiens
DIVEDEDDE

SEQ ID NO: 271605 - protein, 9 aa, Homo Sapiens
KKANNSIDK

SEQ ID NO: 271606 - protein, 9 aa, Homo Sapiens
LTDTSVKIN

SEQ ID NO: 271607 - protein, 9 aa, Homo Sapiens
GAEKGRKAL

SEQ ID NO: 271608 - protein, 9 aa, Homo Sapiens
GSPISGQLE

SEQ ID NO: 271609 - protein, 9 aa, Homo Sapiens
LPEELTALI

SEQ ID NO: 271610 - protein, 9 aa, Homo Sapiens
TSDLEIVNL

SEQ ID NO: 271611 - protein, 9 aa, Homo Sapiens
ITVLEADAN

SEQ ID NO: 271612 - protein, 9 aa, Homo Sapiens
RHTSEKLRV

SEQ ID NO: 271613 - protein, 9 aa, Homo Sapiens
DLQGDSFLQ

SEQ ID NO: 271614 - protein, 9 aa, Homo Sapiens
ELCAALRSY

SEQ ID NO: 271615 - protein, 9 aa, Homo Sapiens
GSAKQGTSS

SEQ ID NO: 271616 - protein, 9 aa, Homo Sapiens
LGYFNDITE

SEQ ID NO: 271617 - protein, 9 aa, Homo Sapiens
QMLQQIAAD

SEQ ID NO: 271618 - protein, 9 aa, Homo Sapiens
LVFLNTLTV

SEQ ID NO: 271619 - protein, 9 aa, Homo Sapiens
QVMMKFNDI

SEQ ID NO: 271620 - protein, 9 aa, Homo Sapiens
GESYQPIKV

SEQ ID NO: 271621 - protein, 9 aa, Homo Sapiens
EKDKIEKER

SEQ ID NO: 271622 - protein, 9 aa, Homo Sapiens
YLHRHLPHA

SEQ ID NO: 271623 - protein, 9 aa, Homo Sapiens
NVYAEGFIK

SEQ ID NO: 271624 - protein, 9 aa, Homo Sapiens
QRQTELQDK

SEQ ID NO: 271625 - protein, 9 aa, Homo Sapiens
NYSRHRVQT

SEQ ID NO: 271626 - protein, 9 aa, Homo Sapiens
YNPYGPQTP

SEQ ID NO: 271627 - protein, 9 aa, Homo Sapiens
YFTCRAQHP

SEQ ID NO: 271628 - protein, 9 aa, Homo Sapiens
IVDFEWIRR

SEQ ID NO: 271629 - protein, 9 aa, Homo Sapiens
EHCAKNRSL

SEQ ID NO: 271630 - protein, 9 aa, Homo Sapiens
AVILLAFQV

SEQ ID NO: 271631 - protein, 9 aa, Homo Sapiens
SKTLQVSNT

SEQ ID NO: 271632 - protein, 9 aa, Homo Sapiens
YLRKIIGVV

SEQ ID NO: 271633 - protein, 9 aa, Homo Sapiens
SEYHMDDGS

SEQ ID NO: 271634 - protein, 9 aa, Homo Sapiens
TLEACFDVH

SEQ ID NO: 271635 - protein, 9 aa, Homo Sapiens
SDIRCLSQR

SEQ ID NO: 271636 - protein, 9 aa, Homo Sapiens
HQNFMLIIT

SEQ ID NO: 271637 - protein, 9 aa, Homo Sapiens
AVEAPVREE

SEQ ID NO: 271638 - protein, 9 aa, Homo Sapiens
KFKEYVDGS

SEQ ID NO: 271639 - protein, 9 aa, Homo Sapiens
KQMLKSVMQ

SEQ ID NO: 271640 - protein, 9 aa, Homo Sapiens
CINKIENWD

SEQ ID NO: 271641 - protein, 9 aa, Homo Sapiens
NDFGGHRGL

SEQ ID NO: 271642 - protein, 9 aa, Homo Sapiens
GPPLEADTE

SEQ ID NO: 271643 - protein, 9 aa, Homo Sapiens
ETEGNKEKK

SEQ ID NO: 271644 - protein, 9 aa, Homo Sapiens
KLAGKIEFE

SEQ ID NO: 271645 - protein, 9 aa, Homo Sapiens
GIEYCLDDQ

SEQ ID NO: 271646 - protein, 9 aa, Homo Sapiens
LDNTPNNYL

SEQ ID NO: 271647 - protein, 9 aa, Homo Sapiens
VKVVAVTFF

SEQ ID NO: 271648 - protein, 9 aa, Homo Sapiens
LIKHKRIYM

SEQ ID NO: 271649 - protein, 9 aa, Homo Sapiens
QLQKWTGDV

SEQ ID NO: 271650 - protein, 9 aa, Homo Sapiens
CKKTQILVG

SEQ ID NO: 271651 - protein, 9 aa, Homo Sapiens
LLPQLSKPY

SEQ ID NO: 271652 - protein, 9 aa, Homo Sapiens
HRMNENSHV

SEQ ID NO: 271653 - protein, 9 aa, Homo Sapiens
EIVLQSYPA

SEQ ID NO: 271654 - protein, 9 aa, Homo Sapiens
LLRTNTSCK

SEQ ID NO: 271655 - protein, 9 aa, Homo Sapiens
RKRSGNFNF

SEQ ID NO: 271656 - protein, 9 aa, Homo Sapiens
LKKCIKLLG

SEQ ID NO: 271657 - protein, 9 aa, Homo Sapiens
APLKVYHQQ

SEQ ID NO: 271658 - protein, 9 aa, Homo Sapiens
YNPAISCVR

SEQ ID NO: 271659 - protein, 9 aa, Homo Sapiens
PNAILVSLS

SEQ ID NO: 271660 - protein, 9 aa, Homo Sapiens
TRGLDIRKD

SEQ ID NO: 271661 - protein, 9 aa, Homo Sapiens
LWTTTNVLG

SEQ ID NO: 271662 - protein, 9 aa, Homo Sapiens
GNVGKLSLD

SEQ ID NO: 271663 - protein, 9 aa, Homo Sapiens
AVDKGRFTT

SEQ ID NO: 271664 - protein, 9 aa, Homo Sapiens
DKDQHEQNR

SEQ ID NO: 271665 - protein, 9 aa, Homo Sapiens
LKEALGPIN

SEQ ID NO: 271666 - protein, 9 aa, Homo Sapiens
LWCAVGVNV

SEQ ID NO: 271667 - protein, 9 aa, Homo Sapiens
RLPFQKQVR

SEQ ID NO: 271668 - protein, 9 aa, Homo Sapiens
GACVPFLNS

SEQ ID NO: 271669 - protein, 9 aa, Homo Sapiens
SERATSDES

SEQ ID NO: 271670 - protein, 9 aa, Homo Sapiens
SELTRPQDT

SEQ ID NO: 271671 - protein, 9 aa, Homo Sapiens
IRKNYCKVS

SEQ ID NO: 271672 - protein, 9 aa, Homo Sapiens
RLSSVDVSK

SEQ ID NO: 271673 - protein, 9 aa, Homo Sapiens
VVISVLVIL

SEQ ID NO: 271674 - protein, 9 aa, Homo Sapiens
LSCRELEAG

SEQ ID NO: 271675 - protein, 9 aa, Homo Sapiens
QEAGISCTY

SEQ ID NO: 271676 - protein, 9 aa, Homo Sapiens
GNPKLNVAF

SEQ ID NO: 271677 - protein, 9 aa, Homo Sapiens
ELHQMGKAF

SEQ ID NO: 271678 - protein, 9 aa, Homo Sapiens
MNPLSISCL

SEQ ID NO: 271679 - protein, 9 aa, Homo Sapiens
TELTPCETD

SEQ ID NO: 271680 - protein, 9 aa, Homo Sapiens
SSGSESSKN

SEQ ID NO: 271681 - protein, 9 aa, Homo Sapiens
FHFNSESES

SEQ ID NO: 271682 - protein, 9 aa, Homo Sapiens
SYCSTCAES

SEQ ID NO: 271683 - protein, 9 aa, Homo Sapiens
YPAVFCPPM

SEQ ID NO: 271684 - protein, 9 aa, Homo Sapiens
RLQTVVVYM

SEQ ID NO: 271685 - protein, 9 aa, Homo Sapiens
HSTQDKYLH

SEQ ID NO: 271686 - protein, 9 aa, Homo Sapiens
VVWSKCETI

SEQ ID NO: 271687 - protein, 9 aa, Homo Sapiens
RNAMYLNNV

SEQ ID NO: 271688 - protein, 9 aa, Homo Sapiens
HGTLLLLSE

SEQ ID NO: 271689 - protein, 9 aa, Homo Sapiens
PLFSLEFGY

SEQ ID NO: 271690 - protein, 9 aa, Homo Sapiens
FRMRSKMPL

SEQ ID NO: 271691 - protein, 9 aa, Homo Sapiens
DSAIMLGKC

SEQ ID NO: 271692 - protein, 9 aa, Homo Sapiens
FFNDVDVQN

SEQ ID NO: 271693 - protein, 9 aa, Homo Sapiens
TFQTQASLD

SEQ ID NO: 271694 - protein, 9 aa, Homo Sapiens
QYIQSHFYR

SEQ ID NO: 271695 - protein, 9 aa, Homo Sapiens
EEILSWSQN

SEQ ID NO: 271696 - protein, 9 aa, Homo Sapiens
MWDKMKDLQ

SEQ ID NO: 271697 - protein, 9 aa, Homo Sapiens
LFRECCATR

SEQ ID NO: 271698 - protein, 9 aa, Homo Sapiens
CMLLIAVLE

SEQ ID NO: 271699 - protein, 9 aa, Homo Sapiens
QEGRQQYLL

SEQ ID NO: 271700 - protein, 9 aa, Homo Sapiens
DGATSSFEN

SEQ ID NO: 271701 - protein, 9 aa, Homo Sapiens
KLSASQFWS

SEQ ID NO: 271702 - protein, 9 aa, Homo Sapiens
LRNVQPDFK

SEQ ID NO: 271703 - protein, 9 aa, Homo Sapiens
MSKLSDQIT

SEQ ID NO: 271704 - protein, 9 aa, Homo Sapiens
RMEMIVFLD

SEQ ID NO: 271705 - protein, 9 aa, Homo Sapiens
GNRPEMNYQ

SEQ ID NO: 271706 - protein, 9 aa, Homo Sapiens
NKPTVESLP

SEQ ID NO: 271707 - protein, 9 aa, Homo Sapiens
DNAIFESLY

SEQ ID NO: 271708 - protein, 9 aa, Homo Sapiens
EILDASEVE

SEQ ID NO: 271709 - protein, 9 aa, Homo Sapiens
ISLPFCCMY

SEQ ID NO: 271710 - protein, 9 aa, Homo Sapiens
QRKKMLDKA

SEQ ID NO: 271711 - protein, 9 aa, Homo Sapiens
KAYHSGEGP

SEQ ID NO: 271712 - protein, 9 aa, Homo Sapiens
ISTDKERTS

SEQ ID NO: 271713 - protein, 9 aa, Homo Sapiens
DTEELCEYV

SEQ ID NO: 271714 - protein, 9 aa, Homo Sapiens
QAGHCRIKV

SEQ ID NO: 271715 - protein, 9 aa, Homo Sapiens
TFRLNYQLI

SEQ ID NO: 271716 - protein, 9 aa, Homo Sapiens
LVTERIMQG

SEQ ID NO: 271717 - protein, 9 aa, Homo Sapiens
AMGCAFPKE

SEQ ID NO: 271718 - protein, 9 aa, Homo Sapiens
GKTLIGKRI

SEQ ID NO: 271719 - protein, 9 aa, Homo Sapiens
LANIGPKDK

SEQ ID NO: 271720 - protein, 9 aa, Homo Sapiens
LPKNSEESA

SEQ ID NO: 271721 - protein, 9 aa, Homo Sapiens
LRRGLISRA

SEQ ID NO: 271722 - protein, 9 aa, Homo Sapiens
ERLHQNLQR

SEQ ID NO: 271723 - protein, 9 aa, Homo Sapiens
ASRGFVVDV

SEQ ID NO: 271724 - protein, 9 aa, Homo Sapiens
CKTETHAKL

SEQ ID NO: 271725 - protein, 9 aa, Homo Sapiens
KENEDLISD

SEQ ID NO: 271726 - protein, 9 aa, Homo Sapiens
ELKTINYAG

SEQ ID NO: 271727 - protein, 9 aa, Homo Sapiens
GIVSNYEKI

SEQ ID NO: 271728 - protein, 9 aa, Homo Sapiens
TPLRTYLRM

SEQ ID NO: 271729 - protein, 9 aa, Homo Sapiens
FVVLFAIYL

SEQ ID NO: 271730 - protein, 9 aa, Homo Sapiens
TRTWSFLLE

SEQ ID NO: 271731 - protein, 9 aa, Homo Sapiens
GKAFNQSSD

SEQ ID NO: 271732 - protein, 9 aa, Homo Sapiens
KDPEARKLI

SEQ ID NO: 271733 - protein, 9 aa, Homo Sapiens
SEAEEGTGN

SEQ ID NO: 271734 - protein, 9 aa, Homo Sapiens
LLTRGSKTK

SEQ ID NO: 271735 - protein, 9 aa, Homo Sapiens
CLLPLSEKE

SEQ ID NO: 271736 - protein, 9 aa, Homo Sapiens
FCIHHLTVV

SEQ ID NO: 271737 - protein, 9 aa, Homo Sapiens
HGGRQGYPR

SEQ ID NO: 271738 - protein, 9 aa, Homo Sapiens
LALRRGYSF

SEQ ID NO: 271739 - protein, 9 aa, Homo Sapiens
AAEKNFHNI

SEQ ID NO: 271740 - protein, 9 aa, Homo Sapiens
SFPLKLFLR

SEQ ID NO: 271741 - protein, 9 aa, Homo Sapiens
RIPLNVRYI

SEQ ID NO: 271742 - protein, 9 aa, Homo Sapiens
DSANPVALQ

SEQ ID NO: 271743 - protein, 9 aa, Homo Sapiens
SIQNYLIRG

SEQ ID NO: 271744 - protein, 9 aa, Homo Sapiens
NITGHLPVE

SEQ ID NO: 271745 - protein, 9 aa, Homo Sapiens
GSPWIPLHH

SEQ ID NO: 271746 - protein, 9 aa, Homo Sapiens
NLSDRVFKA

SEQ ID NO: 271747 - protein, 9 aa, Homo Sapiens
LLSLVGIII

SEQ ID NO: 271748 - protein, 9 aa, Homo Sapiens
GRPFLQAFY

SEQ ID NO: 271749 - protein, 9 aa, Homo Sapiens
PNAIIFSYG

SEQ ID NO: 271750 - protein, 9 aa, Homo Sapiens
DGSNLITKL

SEQ ID NO: 271751 - protein, 9 aa, Homo Sapiens
ALLVQIGPK

SEQ ID NO: 271752 - protein, 9 aa, Homo Sapiens
WALIFSIRP

SEQ ID NO: 271753 - protein, 9 aa, Homo Sapiens
RIFSSVYEQ

SEQ ID NO: 271754 - protein, 9 aa, Homo Sapiens
HSKILNKNG

SEQ ID NO: 271755 - protein, 9 aa, Homo Sapiens
MRKRWKRSS

SEQ ID NO: 271756 - protein, 9 aa, Homo Sapiens
NEALQSNDT

SEQ ID NO: 271757 - protein, 9 aa, Homo Sapiens
IPSDYNSGN

SEQ ID NO: 271758 - protein, 9 aa, Homo Sapiens
ERKRKTKTT

SEQ ID NO: 271759 - protein, 9 aa, Homo Sapiens
HNLYMIMRE

SEQ ID NO: 271760 - protein, 9 aa, Homo Sapiens
APHFLEKQL

SEQ ID NO: 271761 - protein, 9 aa, Homo Sapiens
NQQSTVLRG

SEQ ID NO: 271762 - protein, 9 aa, Homo Sapiens
YKNLKYYRP

SEQ ID NO: 271763 - protein, 9 aa, Homo Sapiens
KPKKKTEVA

SEQ ID NO: 271764 - protein, 9 aa, Homo Sapiens
VVKKGNQTK

SEQ ID NO: 271765 - protein, 9 aa, Homo Sapiens
RNCGAWSKS

SEQ ID NO: 271766 - protein, 9 aa, Homo Sapiens
MDLINKYKQ

SEQ ID NO: 271767 - protein, 9 aa, Homo Sapiens
SPFMIKGAV

SEQ ID NO: 271768 - protein, 9 aa, Homo Sapiens
NFLAKNMMI

SEQ ID NO: 271769 - protein, 9 aa, Homo Sapiens
AKIINTNKL

SEQ ID NO: 271770 - protein, 9 aa, Homo Sapiens
EIGTNHTHV

SEQ ID NO: 271771 - protein, 9 aa, Homo Sapiens
IYECIWNKI

SEQ ID NO: 271772 - protein, 9 aa, Homo Sapiens
WFRQFNKIL

SEQ ID NO: 271773 - protein, 9 aa, Homo Sapiens
PEPISFTPN

SEQ ID NO: 271774 - protein, 9 aa, Homo Sapiens
SVHICGMNE

SEQ ID NO: 271775 - protein, 9 aa, Homo Sapiens
VHMEMVQIE

SEQ ID NO: 271776 - protein, 9 aa, Homo Sapiens
RVGDKDKAS

SEQ ID NO: 271777 - protein, 9 aa, Homo Sapiens
FCADHKLQR

SEQ ID NO: 271778 - protein, 9 aa, Homo Sapiens
LASECEAPG

SEQ ID NO: 271779 - protein, 9 aa, Homo Sapiens
EKPEERQQT

SEQ ID NO: 271780 - protein, 9 aa, Homo Sapiens
FISHGDLIQ

SEQ ID NO: 271781 - protein, 9 aa, Homo Sapiens
MKKMSKETC

SEQ ID NO: 271782 - protein, 9 aa, Homo Sapiens
KRKILPPVK

SEQ ID NO: 271783 - protein, 9 aa, Homo Sapiens
KIEHQPVLH

SEQ ID NO: 271784 - protein, 9 aa, Homo Sapiens
NSSNYASMQ

SEQ ID NO: 271785 - protein, 9 aa, Homo Sapiens
STHKFCRCY

SEQ ID NO: 271786 - protein, 9 aa, Homo Sapiens
DIARKPDKA

SEQ ID NO: 271787 - protein, 9 aa, Homo Sapiens
EGYFTCRAQ

SEQ ID NO: 271788 - protein, 9 aa, Homo Sapiens
MCSHFSFRA

SEQ ID NO: 271789 - protein, 9 aa, Homo Sapiens
TQHILDEAE

SEQ ID NO: 271790 - protein, 9 aa, Homo Sapiens
VFGEINFNI

SEQ ID NO: 271791 - protein, 9 aa, Homo Sapiens
DPFRFAPSS

SEQ ID NO: 271792 - protein, 9 aa, Homo Sapiens
SPWIPLHHS

SEQ ID NO: 271793 - protein, 9 aa, Homo Sapiens
DNPHTQKAW

SEQ ID NO: 271794 - protein, 9 aa, Homo Sapiens
WRNVGPNTT

SEQ ID NO: 271795 - protein, 9 aa, Homo Sapiens
EQLGRYQVS

SEQ ID NO: 271796 - protein, 9 aa, Homo Sapiens
KDKPEAQRL

SEQ ID NO: 271797 - protein, 9 aa, Homo Sapiens
GHSVCEDKF

SEQ ID NO: 271798 - protein, 9 aa, Homo Sapiens
YMDAQLFNK

SEQ ID NO: 271799 - protein, 9 aa, Homo Sapiens
ENQELHDGC

SEQ ID NO: 271800 - protein, 9 aa, Homo Sapiens
QKPTPKHKE

SEQ ID NO: 271801 - protein, 9 aa, Homo Sapiens
EACFDVHRG

SEQ ID NO: 271802 - protein, 9 aa, Homo Sapiens
EFKCEEYIQ

SEQ ID NO: 271803 - protein, 9 aa, Homo Sapiens
LLSFQHPPE

SEQ ID NO: 271804 - protein, 9 aa, Homo Sapiens
YGGIPKFSH

SEQ ID NO: 271805 - protein, 9 aa, Homo Sapiens
KTRLENQNI

SEQ ID NO: 271806 - protein, 9 aa, Homo Sapiens
LLLLLFVEL

SEQ ID NO: 271807 - protein, 9 aa, Homo Sapiens
ILSFLRTKE

SEQ ID NO: 271808 - protein, 9 aa, Homo Sapiens
EFGIKQAAE

SEQ ID NO: 271809 - protein, 9 aa, Homo Sapiens
AIALLFLMD

SEQ ID NO: 271810 - protein, 9 aa, Homo Sapiens
ERNQSRLKV

SEQ ID NO: 271811 - protein, 9 aa, Homo Sapiens
EWADPDNLS

SEQ ID NO: 271812 - protein, 9 aa, Homo Sapiens
RENYPAGRA

SEQ ID NO: 271813 - protein, 9 aa, Homo Sapiens
VILSTLLIG

SEQ ID NO: 271814 - protein, 9 aa, Homo Sapiens
AFHDCQNNS

SEQ ID NO: 271815 - protein, 9 aa, Homo Sapiens
DGGIAQLRV

SEQ ID NO: 271816 - protein, 9 aa, Homo Sapiens
SNMKNMNQS

SEQ ID NO: 271817 - protein, 9 aa, Homo Sapiens
EMLYGKTPF

SEQ ID NO: 271818 - protein, 9 aa, Homo Sapiens
RSNYPFPSR

SEQ ID NO: 271819 - protein, 9 aa, Homo Sapiens
LGILKEVEN

SEQ ID NO: 271820 - protein, 9 aa, Homo Sapiens
QIHTGKKEE

SEQ ID NO: 271821 - protein, 9 aa, Homo Sapiens
KRGEPDIYR

SEQ ID NO: 271822 - protein, 9 aa, Homo Sapiens
TEISDQEKD

SEQ ID NO: 271823 - protein, 9 aa, Homo Sapiens
GEGDNLPEA

SEQ ID NO: 271824 - protein, 9 aa, Homo Sapiens
DESLKHREQ

SEQ ID NO: 271825 - protein, 9 aa, Homo Sapiens
VERLIMVAR

SEQ ID NO: 271826 - protein, 9 aa, Homo Sapiens
ITEKSLHSI

SEQ ID NO: 271827 - protein, 9 aa, Homo Sapiens
PNRLLQIWN

SEQ ID NO: 271828 - protein, 9 aa, Homo Sapiens
NSKHALLPF

SEQ ID NO: 271829 - protein, 9 aa, Homo Sapiens
NASKQYLCV

SEQ ID NO: 271830 - protein, 9 aa, Homo Sapiens
FHNLKCDCS

SEQ ID NO: 271831 - protein, 9 aa, Homo Sapiens
HEQRYWQNI

SEQ ID NO: 271832 - protein, 9 aa, Homo Sapiens
TRHTGEKFY

SEQ ID NO: 271833 - protein, 9 aa, Homo Sapiens
HSPQSLLSD

SEQ ID NO: 271834 - protein, 9 aa, Homo Sapiens
SVVVKRYTG

SEQ ID NO: 271835 - protein, 9 aa, Homo Sapiens
SQEESIVTL

SEQ ID NO: 271836 - protein, 9 aa, Homo Sapiens
NLDKCQTSM

SEQ ID NO: 271837 - protein, 9 aa, Homo Sapiens
SYRGCVTIH

SEQ ID NO: 271838 - protein, 9 aa, Homo Sapiens
KKNKKLSLD

SEQ ID NO: 271839 - protein, 9 aa, Homo Sapiens
TYVCTADNS

SEQ ID NO: 271840 - protein, 9 aa, Homo Sapiens
TARCPRWLC

SEQ ID NO: 271841 - protein, 9 aa, Homo Sapiens
PVLHLISSP

SEQ ID NO: 271842 - protein, 9 aa, Homo Sapiens
VQYPPDNLR

SEQ ID NO: 271843 - protein, 9 aa, Homo Sapiens
AFLKAVFTE

SEQ ID NO: 271844 - protein, 9 aa, Homo Sapiens
NTEAEKVKS

SEQ ID NO: 271845 - protein, 9 aa, Homo Sapiens
MKEKILSEV

SEQ ID NO: 271846 - protein, 9 aa, Homo Sapiens
LCWFPLYYE

SEQ ID NO: 271847 - protein, 9 aa, Homo Sapiens
VGVNLLQQY

SEQ ID NO: 271848 - protein, 9 aa, Homo Sapiens
IGEVLVFVN

SEQ ID NO: 271849 - protein, 9 aa, Homo Sapiens
FSERLLGTF

SEQ ID NO: 271850 - protein, 9 aa, Homo Sapiens
LQLSKRTVS

SEQ ID NO: 271851 - protein, 9 aa, Homo Sapiens
QDIYVKTRS

SEQ ID NO: 271852 - protein, 9 aa, Homo Sapiens
QEVIVGEGL

SEQ ID NO: 271853 - protein, 9 aa, Homo Sapiens
GNQGRLGRQ

SEQ ID NO: 271854 - protein, 9 aa, Homo Sapiens
SSEWELNPV

SEQ ID NO: 271855 - protein, 9 aa, Homo Sapiens
ILLYPDLIL

SEQ ID NO: 271856 - protein, 9 aa, Homo Sapiens
NLHIMHTSY

SEQ ID NO: 271857 - protein, 9 aa, Homo Sapiens
YRQFLFVVF

SEQ ID NO: 271858 - protein, 9 aa, Homo Sapiens
MDQYKYERY

SEQ ID NO: 271859 - protein, 9 aa, Homo Sapiens
LNMQFLDEM

SEQ ID NO: 271860 - protein, 9 aa, Homo Sapiens
SCAPPPTPA

SEQ ID NO: 271861 - protein, 9 aa, Homo Sapiens
GLNNTSSFS

SEQ ID NO: 271862 - protein, 9 aa, Homo Sapiens
ILVRLGSSP

SEQ ID NO: 271863 - protein, 9 aa, Homo Sapiens
GKLKNLNCP

SEQ ID NO: 271864 - protein, 9 aa, Homo Sapiens
QPRYSWEWH

SEQ ID NO: 271865 - protein, 9 aa, Homo Sapiens
FAQQRDSKE

SEQ ID NO: 271866 - protein, 9 aa, Homo Sapiens
FVCLLPLLL

SEQ ID NO: 271867 - protein, 9 aa, Homo Sapiens
LDFETMSLY

SEQ ID NO: 271868 - protein, 9 aa, Homo Sapiens
NQVLENTAE

SEQ ID NO: 271869 - protein, 9 aa, Homo Sapiens
LFISSTCVA

SEQ ID NO: 271870 - protein, 9 aa, Homo Sapiens
SKSIQWLTV

SEQ ID NO: 271871 - protein, 9 aa, Homo Sapiens
GSCPEDEFL

SEQ ID NO: 271872 - protein, 9 aa, Homo Sapiens
DTFQNNSKV

SEQ ID NO: 271873 - protein, 9 aa, Homo Sapiens
TNLFDNLIE

SEQ ID NO: 271874 - protein, 9 aa, Homo Sapiens
GPGYWDQHD

SEQ ID NO: 271875 - protein, 9 aa, Homo Sapiens
VTANLSLAK

SEQ ID NO: 271876 - protein, 9 aa, Homo Sapiens
AIVSTHSPY

SEQ ID NO: 271877 - protein, 9 aa, Homo Sapiens
PPYTSYEQL

SEQ ID NO: 271878 - protein, 9 aa, Homo Sapiens
VLSENKEGK

SEQ ID NO: 271879 - protein, 9 aa, Homo Sapiens
FKNYDAEKY

SEQ ID NO: 271880 - protein, 9 aa, Homo Sapiens
AIISVSSVC

SEQ ID NO: 271881 - protein, 9 aa, Homo Sapiens
NEEQRMRSR

SEQ ID NO: 271882 - protein, 9 aa, Homo Sapiens
EVITLDELM

SEQ ID NO: 271883 - protein, 9 aa, Homo Sapiens
INNSLKELC

SEQ ID NO: 271884 - protein, 9 aa, Homo Sapiens
YPKFLANAL

SEQ ID NO: 271885 - protein, 9 aa, Homo Sapiens
IFVMWTFAQ

SEQ ID NO: 271886 - protein, 9 aa, Homo Sapiens
RALIRIMVS

SEQ ID NO: 271887 - protein, 9 aa, Homo Sapiens
KGMDYEVYK

SEQ ID NO: 271888 - protein, 9 aa, Homo Sapiens
NYQCIEQNL

SEQ ID NO: 271889 - protein, 9 aa, Homo Sapiens
DQPESMVRV

SEQ ID NO: 271890 - protein, 9 aa, Homo Sapiens
VIPSSESFT

SEQ ID NO: 271891 - protein, 9 aa, Homo Sapiens
VLLPPIKFH

SEQ ID NO: 271892 - protein, 9 aa, Homo Sapiens
LYSDCGIGE

SEQ ID NO: 271893 - protein, 9 aa, Homo Sapiens
ARIAFLQGK

SEQ ID NO: 271894 - protein, 9 aa, Homo Sapiens
WFDQHQIIH

SEQ ID NO: 271895 - protein, 9 aa, Homo Sapiens
KAKTITPLR

SEQ ID NO: 271896 - protein, 9 aa, Homo Sapiens
MRRSLEDGR

SEQ ID NO: 271897 - protein, 9 aa, Homo Sapiens
IETPFVKML

SEQ ID NO: 271898 - protein, 9 aa, Homo Sapiens
QATAQEIFQ

SEQ ID NO: 271899 - protein, 9 aa, Homo Sapiens
LNSHPITED

SEQ ID NO: 271900 - protein, 9 aa, Homo Sapiens
GRLAELEEK

SEQ ID NO: 271901 - protein, 9 aa, Homo Sapiens
APFGVQSHM

SEQ ID NO: 271902 - protein, 9 aa, Homo Sapiens
FQALLQNNT

SEQ ID NO: 271903 - protein, 9 aa, Homo Sapiens
QINYRQFFT

SEQ ID NO: 271904 - protein, 9 aa, Homo Sapiens
VTDRCLQVE

SEQ ID NO: 271905 - protein, 9 aa, Homo Sapiens
DQLEAVDKY

SEQ ID NO: 271906 - protein, 9 aa, Homo Sapiens
LNNLIKLEE

SEQ ID NO: 271907 - protein, 9 aa, Homo Sapiens
QNREKGKGQ

SEQ ID NO: 271908 - protein, 9 aa, Homo Sapiens
RAEAAQAKR

SEQ ID NO: 271909 - protein, 9 aa, Homo Sapiens
NADYSSKTE

SEQ ID NO: 271910 - protein, 9 aa, Homo Sapiens
ASSQLAGRK

SEQ ID NO: 271911 - protein, 9 aa, Homo Sapiens
KYLYDEVAA

SEQ ID NO: 271912 - protein, 9 aa, Homo Sapiens
AISLVYRVL

SEQ ID NO: 271913 - protein, 9 aa, Homo Sapiens
SWLRHPGIL

SEQ ID NO: 271914 - protein, 9 aa, Homo Sapiens
ALNLGCINA

SEQ ID NO: 271915 - protein, 9 aa, Homo Sapiens
PSEDSCETM

SEQ ID NO: 271916 - protein, 9 aa, Homo Sapiens
IRYLIQFLS

SEQ ID NO: 271917 - protein, 9 aa, Homo Sapiens
VALHLIATH

SEQ ID NO: 271918 - protein, 9 aa, Homo Sapiens
SRDHFRGKA

SEQ ID NO: 271919 - protein, 9 aa, Homo Sapiens
HRNGTKNSN

SEQ ID NO: 271920 - protein, 9 aa, Homo Sapiens
KLKSIACPS

SEQ ID NO: 271921 - protein, 9 aa, Homo Sapiens
IENYPLNLQ

SEQ ID NO: 271922 - protein, 9 aa, Homo Sapiens
SFLCREYPC

SEQ ID NO: 271923 - protein, 9 aa, Homo Sapiens
SPNHPGFKD

SEQ ID NO: 271924 - protein, 9 aa, Homo Sapiens
IIIQQRNGR

SEQ ID NO: 271925 - protein, 9 aa, Homo Sapiens
DEVPYVLVI

SEQ ID NO: 271926 - protein, 9 aa, Homo Sapiens
EDGSMSVTR

SEQ ID NO: 271927 - protein, 9 aa, Homo Sapiens
GPTENREMR

SEQ ID NO: 271928 - protein, 9 aa, Homo Sapiens
PMPADMLIE

SEQ ID NO: 271929 - protein, 9 aa, Homo Sapiens
DECIKSEDK

SEQ ID NO: 271930 - protein, 9 aa, Homo Sapiens
IISGGPTSV

SEQ ID NO: 271931 - protein, 9 aa, Homo Sapiens
GEKRRKNIQ

SEQ ID NO: 271932 - protein, 9 aa, Homo Sapiens
VEAHDSDIL

SEQ ID NO: 271933 - protein, 9 aa, Homo Sapiens
NKHSGTRGW

SEQ ID NO: 271934 - protein, 9 aa, Homo Sapiens
RISEFSRMV

SEQ ID NO: 271935 - protein, 9 aa, Homo Sapiens
ISVKPLYNW

SEQ ID NO: 271936 - protein, 9 aa, Homo Sapiens
YKYFSKEQQ

SEQ ID NO: 271937 - protein, 9 aa, Homo Sapiens
NKLSQMDQV

SEQ ID NO: 271938 - protein, 9 aa, Homo Sapiens
WKLFFRKLT

SEQ ID NO: 271939 - protein, 9 aa, Homo Sapiens
LPLLNGGLQ

SEQ ID NO: 271940 - protein, 9 aa, Homo Sapiens
VGAVSVAGA

SEQ ID NO: 271941 - protein, 9 aa, Homo Sapiens
SYFWLDGST

SEQ ID NO: 271942 - protein, 9 aa, Homo Sapiens
HFSVRLLKL

SEQ ID NO: 271943 - protein, 9 aa, Homo Sapiens
GFYCQNVQD

SEQ ID NO: 271944 - protein, 9 aa, Homo Sapiens
PHPFTITVF

SEQ ID NO: 271945 - protein, 9 aa, Homo Sapiens
HGLRPVKVN

SEQ ID NO: 271946 - protein, 9 aa, Homo Sapiens
YAKIEGPVE

SEQ ID NO: 271947 - protein, 9 aa, Homo Sapiens
GEEHVSFLK

SEQ ID NO: 271948 - protein, 9 aa, Homo Sapiens
QEFDPVVVI

SEQ ID NO: 271949 - protein, 9 aa, Homo Sapiens
NIKAKLHQM

SEQ ID NO: 271950 - protein, 9 aa, Homo Sapiens
ENKKGGERR

SEQ ID NO: 271951 - protein, 9 aa, Homo Sapiens
KSKSLSYTG

SEQ ID NO: 271952 - protein, 9 aa, Homo Sapiens
SFIKWHSVM

SEQ ID NO: 271953 - protein, 9 aa, Homo Sapiens
CENVSIKKK

SEQ ID NO: 271954 - protein, 9 aa, Homo Sapiens
CLCASCWTY

SEQ ID NO: 271955 - protein, 9 aa, Homo Sapiens
LNLEVKEEP

SEQ ID NO: 271956 - protein, 9 aa, Homo Sapiens
SKVSFWKQL

SEQ ID NO: 271957 - protein, 9 aa, Homo Sapiens
YRTESALSY

SEQ ID NO: 271958 - protein, 9 aa, Homo Sapiens
AGVKWYNHS

SEQ ID NO: 271959 - protein, 9 aa, Homo Sapiens
PWSRNLTCR

SEQ ID NO: 271960 - protein, 9 aa, Homo Sapiens
TIHENIGVA

SEQ ID NO: 271961 - protein, 9 aa, Homo Sapiens
GFVIFLSSQ

SEQ ID NO: 271962 - protein, 9 aa, Homo Sapiens
VLILECDVK

SEQ ID NO: 271963 - protein, 9 aa, Homo Sapiens
PIGYPYRDK

SEQ ID NO: 271964 - protein, 9 aa, Homo Sapiens
PFLPVRWVV

SEQ ID NO: 271965 - protein, 9 aa, Homo Sapiens
NGKQQTFPW

SEQ ID NO: 271966 - protein, 9 aa, Homo Sapiens
MDDEDEGRR

SEQ ID NO: 271967 - protein, 9 aa, Homo Sapiens
SKGCFCPPD

SEQ ID NO: 271968 - protein, 9 aa, Homo Sapiens
VLRSNGVPV

SEQ ID NO: 271969 - protein, 9 aa, Homo Sapiens
AEEYAHFRA

SEQ ID NO: 271970 - protein, 9 aa, Homo Sapiens
LSVQYPPDN

SEQ ID NO: 271971 - protein, 9 aa, Homo Sapiens
KSDDGGKVL

SEQ ID NO: 271972 - protein, 9 aa, Homo Sapiens
LSALQRSLC

SEQ ID NO: 271973 - protein, 9 aa, Homo Sapiens
QLVYNITLA

SEQ ID NO: 271974 - protein, 9 aa, Homo Sapiens
APEDHIEPK

SEQ ID NO: 271975 - protein, 9 aa, Homo Sapiens
ETCVQFANP

SEQ ID NO: 271976 - protein, 9 aa, Homo Sapiens
QLSNLARHQ

SEQ ID NO: 271977 - protein, 9 aa, Homo Sapiens
RHDLEKTSI

SEQ ID NO: 271978 - protein, 9 aa, Homo Sapiens
SENKEGKRS

SEQ ID NO: 271979 - protein, 9 aa, Homo Sapiens
IHILQAAFR

SEQ ID NO: 271980 - protein, 9 aa, Homo Sapiens
SDFFERNSF

SEQ ID NO: 271981 - protein, 9 aa, Homo Sapiens
LENQDSDSI

SEQ ID NO: 271982 - protein, 9 aa, Homo Sapiens
YIGEVLVFV

SEQ ID NO: 271983 - protein, 9 aa, Homo Sapiens
LGELSSSSS

SEQ ID NO: 271984 - protein, 9 aa, Homo Sapiens
FVRKAVRDI

SEQ ID NO: 271985 - protein, 9 aa, Homo Sapiens
IPSIKDSNR

SEQ ID NO: 271986 - protein, 9 aa, Homo Sapiens
PKQLNPFNL

SEQ ID NO: 271987 - protein, 9 aa, Homo Sapiens
LVHAFKEGK

SEQ ID NO: 271988 - protein, 9 aa, Homo Sapiens
GDFQDIYSE

SEQ ID NO: 271989 - protein, 9 aa, Homo Sapiens
ISDYHFLSQ

SEQ ID NO: 271990 - protein, 9 aa, Homo Sapiens
YSKLLSRLG

SEQ ID NO: 271991 - protein, 9 aa, Homo Sapiens
QWSVCRASN

SEQ ID NO: 271992 - protein, 9 aa, Homo Sapiens
NLVSRGREG

SEQ ID NO: 271993 - protein, 9 aa, Homo Sapiens
KFAPFIDKV

SEQ ID NO: 271994 - protein, 9 aa, Homo Sapiens
YLEPVYFYM

SEQ ID NO: 271995 - protein, 9 aa, Homo Sapiens
PVLFNSKLP

SEQ ID NO: 271996 - protein, 9 aa, Homo Sapiens
SASCTAPAP

SEQ ID NO: 271997 - protein, 9 aa, Homo Sapiens
YEKSNTTAL

SEQ ID NO: 271998 - protein, 9 aa, Homo Sapiens
IQFAFQASI

SEQ ID NO: 271999 - protein, 9 aa, Homo Sapiens
IYTNTHIKT

SEQ ID NO: 272000 - protein, 9 aa, Homo Sapiens
LFEDYFFHK

SEQ ID NO: 272001 - protein, 9 aa, Homo Sapiens
PQNDLLGYP

SEQ ID NO: 272002 - protein, 9 aa, Homo Sapiens
LIHKKRIIE

SEQ ID NO: 272003 - protein, 9 aa, Homo Sapiens
GGLATYQTA

SEQ ID NO: 272004 - protein, 9 aa, Homo Sapiens
FSSERGPQM

SEQ ID NO: 272005 - protein, 9 aa, Homo Sapiens
PRERREDGS

SEQ ID NO: 272006 - protein, 9 aa, Homo Sapiens
EDNITEFQH

SEQ ID NO: 272007 - protein, 9 aa, Homo Sapiens
EKEQQKLKK

SEQ ID NO: 272008 - protein, 9 aa, Homo Sapiens
QGINSCLIH

SEQ ID NO: 272009 - protein, 9 aa, Homo Sapiens
TEMQELERQ

SEQ ID NO: 272010 - protein, 9 aa, Homo Sapiens
EAFLSQSIP

SEQ ID NO: 272011 - protein, 9 aa, Homo Sapiens
RVGLWPLGS

SEQ ID NO: 272012 - protein, 9 aa, Homo Sapiens
CQGKTSECD

SEQ ID NO: 272013 - protein, 9 aa, Homo Sapiens
LAQRRRSST

SEQ ID NO: 272014 - protein, 9 aa, Homo Sapiens
RLSCAGIIL

SEQ ID NO: 272015 - protein, 9 aa, Homo Sapiens
KRRQTGGSL

SEQ ID NO: 272016 - protein, 9 aa, Homo Sapiens
NHKLEEFRA

SEQ ID NO: 272017 - protein, 9 aa, Homo Sapiens
DFEDYPMII

SEQ ID NO: 272018 - protein, 9 aa, Homo Sapiens
RRSALEKNL

SEQ ID NO: 272019 - protein, 9 aa, Homo Sapiens
RTLKKCIKL

SEQ ID NO: 272020 - protein, 9 aa, Homo Sapiens
DEEDEEGSE

SEQ ID NO: 272021 - protein, 9 aa, Homo Sapiens
KLRDMHWAL

SEQ ID NO: 272022 - protein, 9 aa, Homo Sapiens
IPKDGETIE

SEQ ID NO: 272023 - protein, 9 aa, Homo Sapiens
KFPHYSPMV

SEQ ID NO: 272024 - protein, 9 aa, Homo Sapiens
RMYEVKGLQ

SEQ ID NO: 272025 - protein, 9 aa, Homo Sapiens
IIAKADAIL

SEQ ID NO: 272026 - protein, 9 aa, Homo Sapiens
ELIPSEDFI

SEQ ID NO: 272027 - protein, 9 aa, Homo Sapiens
KQANLNSRT

SEQ ID NO: 272028 - protein, 9 aa, Homo Sapiens
IASRQYTVR

SEQ ID NO: 272029 - protein, 9 aa, Homo Sapiens
PSTNMFGRY

SEQ ID NO: 272030 - protein, 9 aa, Homo Sapiens
LRMEEIIFN

SEQ ID NO: 272031 - protein, 9 aa, Homo Sapiens
YRHRQVPLE

SEQ ID NO: 272032 - protein, 9 aa, Homo Sapiens
RVPFAMRNV

SEQ ID NO: 272033 - protein, 9 aa, Homo Sapiens
GGVTKADLS

SEQ ID NO: 272034 - protein, 9 aa, Homo Sapiens
SPGFKRLFC

SEQ ID NO: 272035 - protein, 9 aa, Homo Sapiens
NNICFYSTT

SEQ ID NO: 272036 - protein, 9 aa, Homo Sapiens
LPPFQPQLT

SEQ ID NO: 272037 - protein, 9 aa, Homo Sapiens
PEFAHSYID

SEQ ID NO: 272038 - protein, 9 aa, Homo Sapiens
CSFPDFFAL

SEQ ID NO: 272039 - protein, 9 aa, Homo Sapiens
SSNPWGPRP

SEQ ID NO: 272040 - protein, 9 aa, Homo Sapiens
SGGGALHLI

SEQ ID NO: 272041 - protein, 9 aa, Homo Sapiens
YFDRGDVAL

SEQ ID NO: 272042 - protein, 9 aa, Homo Sapiens
VDFSEVEIA

SEQ ID NO: 272043 - protein, 9 aa, Homo Sapiens
CLICIDLWL

SEQ ID NO: 272044 - protein, 9 aa, Homo Sapiens
IKDFLSKCS

SEQ ID NO: 272045 - protein, 9 aa, Homo Sapiens
VVPDLSELF

SEQ ID NO: 272046 - protein, 9 aa, Homo Sapiens
NSGCKIWVQ

SEQ ID NO: 272047 - protein, 9 aa, Homo Sapiens
YLLGEFKAL

SEQ ID NO: 272048 - protein, 9 aa, Homo Sapiens
NKLMELTNL

SEQ ID NO: 272049 - protein, 9 aa, Homo Sapiens
LATNSAPTS

SEQ ID NO: 272050 - protein, 9 aa, Homo Sapiens
DPRANWSSL

SEQ ID NO: 272051 - protein, 9 aa, Homo Sapiens
SAESKTMEF

SEQ ID NO: 272052 - protein, 9 aa, Homo Sapiens
GSPCTTVPK

SEQ ID NO: 272053 - protein, 9 aa, Homo Sapiens
HEGVRGLYK

SEQ ID NO: 272054 - protein, 9 aa, Homo Sapiens
IYAALYFSP

SEQ ID NO: 272055 - protein, 9 aa, Homo Sapiens
EDNFWMVMV

SEQ ID NO: 272056 - protein, 9 aa, Homo Sapiens
RLLHCSLQR

SEQ ID NO: 272057 - protein, 9 aa, Homo Sapiens
LQSPNQQST

SEQ ID NO: 272058 - protein, 9 aa, Homo Sapiens
AGKTESTNL

SEQ ID NO: 272059 - protein, 9 aa, Homo Sapiens
EHRDSIGLD

SEQ ID NO: 272060 - protein, 9 aa, Homo Sapiens
DSTERLDQD

SEQ ID NO: 272061 - protein, 9 aa, Homo Sapiens
SYYTIVTSI

SEQ ID NO: 272062 - protein, 9 aa, Homo Sapiens
KKEGTARSG

SEQ ID NO: 272063 - protein, 9 aa, Homo Sapiens
KRQLMEKKP

SEQ ID NO: 272064 - protein, 9 aa, Homo Sapiens
NIHTEDKPL

SEQ ID NO: 272065 - protein, 9 aa, Homo Sapiens
NNYHPKIRI

SEQ ID NO: 272066 - protein, 9 aa, Homo Sapiens
QYRKIIDSN

SEQ ID NO: 272067 - protein, 9 aa, Homo Sapiens
EEIYCYYGD

SEQ ID NO: 272068 - protein, 9 aa, Homo Sapiens
QSKDIFDQL

SEQ ID NO: 272069 - protein, 9 aa, Homo Sapiens
TINPVFNEQ

SEQ ID NO: 272070 - protein, 9 aa, Homo Sapiens
YQPKPQMSL

SEQ ID NO: 272071 - protein, 9 aa, Homo Sapiens
HTSKFCSML

SEQ ID NO: 272072 - protein, 9 aa, Homo Sapiens
ISPNRHKIR

SEQ ID NO: 272073 - protein, 9 aa, Homo Sapiens
PVLMYVLAH

SEQ ID NO: 272074 - protein, 9 aa, Homo Sapiens
KCSTQDFFL

SEQ ID NO: 272075 - protein, 9 aa, Homo Sapiens
EGVEREVIN

SEQ ID NO: 272076 - protein, 9 aa, Homo Sapiens
WWSPTEGLG

SEQ ID NO: 272077 - protein, 9 aa, Homo Sapiens
KQQNNSKGS

SEQ ID NO: 272078 - protein, 9 aa, Homo Sapiens
MARCDPKPG

SEQ ID NO: 272079 - protein, 9 aa, Homo Sapiens
APIFPPMPK

SEQ ID NO: 272080 - protein, 9 aa, Homo Sapiens
SAPPLALPV

SEQ ID NO: 272081 - protein, 9 aa, Homo Sapiens
KKNYLPICA

SEQ ID NO: 272082 - protein, 9 aa, Homo Sapiens
RLIHGLSMP

SEQ ID NO: 272083 - protein, 9 aa, Homo Sapiens
NYTCTYVWS

SEQ ID NO: 272084 - protein, 9 aa, Homo Sapiens
RDYPQNLLF

SEQ ID NO: 272085 - protein, 9 aa, Homo Sapiens
ARLLASNSL

SEQ ID NO: 272086 - protein, 9 aa, Homo Sapiens
EYADKLAAL

SEQ ID NO: 272087 - protein, 9 aa, Homo Sapiens
TECVRTALN

SEQ ID NO: 272088 - protein, 9 aa, Homo Sapiens
SFLKCIQES

SEQ ID NO: 272089 - protein, 9 aa, Homo Sapiens
PQRNLSLSL

SEQ ID NO: 272090 - protein, 9 aa, Homo Sapiens
RRRIIPDML

SEQ ID NO: 272091 - protein, 9 aa, Homo Sapiens
HKLIVTEEN

SEQ ID NO: 272092 - protein, 9 aa, Homo Sapiens
YDSSRTLHA

SEQ ID NO: 272093 - protein, 9 aa, Homo Sapiens
SDGTNINAV

SEQ ID NO: 272094 - protein, 9 aa, Homo Sapiens
RLRRKCERI

SEQ ID NO: 272095 - protein, 9 aa, Homo Sapiens
EREVINMRT

SEQ ID NO: 272096 - protein, 9 aa, Homo Sapiens
CIEQSDLLG

SEQ ID NO: 272097 - protein, 9 aa, Homo Sapiens
KGRDADECH

SEQ ID NO: 272098 - protein, 9 aa, Homo Sapiens
VLLTPQDEL

SEQ ID NO: 272099 - protein, 9 aa, Homo Sapiens
VNFEKPKLT

SEQ ID NO: 272100 - protein, 9 aa, Homo Sapiens
LPGLLITEG

SEQ ID NO: 272101 - protein, 9 aa, Homo Sapiens
TFKGPEIRK

SEQ ID NO: 272102 - protein, 9 aa, Homo Sapiens
LLWGIVRQG

SEQ ID NO: 272103 - protein, 9 aa, Homo Sapiens
LFGDLPRKP

SEQ ID NO: 272104 - protein, 9 aa, Homo Sapiens
DSAEQINKK

SEQ ID NO: 272105 - protein, 9 aa, Homo Sapiens
EAEEGTGNA

SEQ ID NO: 272106 - protein, 9 aa, Homo Sapiens
MGCAFPKEF

SEQ ID NO: 272107 - protein, 9 aa, Homo Sapiens
THKAKSQND

SEQ ID NO: 272108 - protein, 9 aa, Homo Sapiens
SVSRFVLLG

SEQ ID NO: 272109 - protein, 9 aa, Homo Sapiens
ATKEKEVKK

SEQ ID NO: 272110 - protein, 9 aa, Homo Sapiens
RQKSPEVPE

SEQ ID NO: 272111 - protein, 9 aa, Homo Sapiens
EVLVFVNPY

SEQ ID NO: 272112 - protein, 9 aa, Homo Sapiens
PNLAFIRLS

SEQ ID NO: 272113 - protein, 9 aa, Homo Sapiens
SQPPPVYLL

SEQ ID NO: 272114 - protein, 9 aa, Homo Sapiens
IVQDIKEKL

SEQ ID NO: 272115 - protein, 9 aa, Homo Sapiens
ALISKMYPS

SEQ ID NO: 272116 - protein, 9 aa, Homo Sapiens
PRDKQQNNS

SEQ ID NO: 272117 - protein, 9 aa, Homo Sapiens
QRARCQEIS

SEQ ID NO: 272118 - protein, 9 aa, Homo Sapiens
FILEVEKSS

SEQ ID NO: 272119 - protein, 9 aa, Homo Sapiens
AGATATYEG

SEQ ID NO: 272120 - protein, 9 aa, Homo Sapiens
NKMGIKSGF

SEQ ID NO: 272121 - protein, 9 aa, Homo Sapiens
LICNRVTDL

SEQ ID NO: 272122 - protein, 9 aa, Homo Sapiens
YSPEVDTTP

SEQ ID NO: 272123 - protein, 9 aa, Homo Sapiens
PPTNMKTVS

SEQ ID NO: 272124 - protein, 9 aa, Homo Sapiens
CDAVFKGFL

SEQ ID NO: 272125 - protein, 9 aa, Homo Sapiens
NIGHLVFTS

SEQ ID NO: 272126 - protein, 9 aa, Homo Sapiens
FENVMATKY

SEQ ID NO: 272127 - protein, 9 aa, Homo Sapiens
HGNDTSNTK

SEQ ID NO: 272128 - protein, 9 aa, Homo Sapiens
LTNKKIIFV

SEQ ID NO: 272129 - protein, 9 aa, Homo Sapiens
SDYINATFI

SEQ ID NO: 272130 - protein, 9 aa, Homo Sapiens
IRTIRTAQT

SEQ ID NO: 272131 - protein, 9 aa, Homo Sapiens
LMGTLSGTA

SEQ ID NO: 272132 - protein, 9 aa, Homo Sapiens
TRLHAMARY

SEQ ID NO: 272133 - protein, 9 aa, Homo Sapiens
KKKRNKEPA

SEQ ID NO: 272134 - protein, 9 aa, Homo Sapiens
TAHKIIHNR

SEQ ID NO: 272135 - protein, 9 aa, Homo Sapiens
PEDPTDDSR

SEQ ID NO: 272136 - protein, 9 aa, Homo Sapiens
TLFCSRSFH

SEQ ID NO: 272137 - protein, 9 aa, Homo Sapiens
ILNKHLKGK

SEQ ID NO: 272138 - protein, 9 aa, Homo Sapiens
ATKNTADHD

SEQ ID NO: 272139 - protein, 9 aa, Homo Sapiens
VLSYYYTDN

SEQ ID NO: 272140 - protein, 9 aa, Homo Sapiens
AEHLRTAIK

SEQ ID NO: 272141 - protein, 9 aa, Homo Sapiens
IDAALGFKN

SEQ ID NO: 272142 - protein, 9 aa, Homo Sapiens
RKGTYRNLS

SEQ ID NO: 272143 - protein, 9 aa, Homo Sapiens
SPSNHVPNN

SEQ ID NO: 272144 - protein, 9 aa, Homo Sapiens
NEAEDSEAE

SEQ ID NO: 272145 - protein, 9 aa, Homo Sapiens
GVGTPIGYP

SEQ ID NO: 272146 - protein, 9 aa, Homo Sapiens
VVSLFYVTV

SEQ ID NO: 272147 - protein, 9 aa, Homo Sapiens
ETKFEASRG

SEQ ID NO: 272148 - protein, 9 aa, Homo Sapiens
EPWWTLPKN

SEQ ID NO: 272149 - protein, 9 aa, Homo Sapiens
ADYDIASKE

SEQ ID NO: 272150 - protein, 9 aa, Homo Sapiens
KTMCKRNEF

SEQ ID NO: 272151 - protein, 9 aa, Homo Sapiens
ASLLENKPV

SEQ ID NO: 272152 - protein, 9 aa, Homo Sapiens
YTCDICGNN

SEQ ID NO: 272153 - protein, 9 aa, Homo Sapiens
DSKDKTYGV

SEQ ID NO: 272154 - protein, 9 aa, Homo Sapiens
KVCIDTIPN

SEQ ID NO: 272155 - protein, 9 aa, Homo Sapiens
NPPPPPGLL

SEQ ID NO: 272156 - protein, 9 aa, Homo Sapiens
GEYSVHICG

SEQ ID NO: 272157 - protein, 9 aa, Homo Sapiens
RKKHTTSAE

SEQ ID NO: 272158 - protein, 9 aa, Homo Sapiens
TVRIEMFQN

SEQ ID NO: 272159 - protein, 9 aa, Homo Sapiens
NKDLEWKNK

SEQ ID NO: 272160 - protein, 9 aa, Homo Sapiens
WRLYNKISN

SEQ ID NO: 272161 - protein, 9 aa, Homo Sapiens
GSPAVDKGR

SEQ ID NO: 272162 - protein, 9 aa, Homo Sapiens
PVLSQVGHE

SEQ ID NO: 272163 - protein, 9 aa, Homo Sapiens
PWFYNILAV

SEQ ID NO: 272164 - protein, 9 aa, Homo Sapiens
RLSEHIVLR

SEQ ID NO: 272165 - protein, 9 aa, Homo Sapiens
LTRPQDTIS

SEQ ID NO: 272166 - protein, 9 aa, Homo Sapiens
SFLLDENYL

SEQ ID NO: 272167 - protein, 9 aa, Homo Sapiens
LKTKERQST

SEQ ID NO: 272168 - protein, 9 aa, Homo Sapiens
PSDYNSGNY

SEQ ID NO: 272169 - protein, 9 aa, Homo Sapiens
KDKTERKIW

SEQ ID NO: 272170 - protein, 9 aa, Homo Sapiens
KCARSWVTV

SEQ ID NO: 272171 - protein, 9 aa, Homo Sapiens
LHLALVKSR

SEQ ID NO: 272172 - protein, 9 aa, Homo Sapiens
EVDYSDSPT

SEQ ID NO: 272173 - protein, 9 aa, Homo Sapiens
PYTISTLTS

SEQ ID NO: 272174 - protein, 9 aa, Homo Sapiens
CSDSVILNV

SEQ ID NO: 272175 - protein, 9 aa, Homo Sapiens
EVLLSADLT

SEQ ID NO: 272176 - protein, 9 aa, Homo Sapiens
EVVTQGMSH

SEQ ID NO: 272177 - protein, 9 aa, Homo Sapiens
VCKTMCKRN

SEQ ID NO: 272178 - protein, 9 aa, Homo Sapiens
CSERRQKNK

SEQ ID NO: 272179 - protein, 9 aa, Homo Sapiens
CPHSKKANL

SEQ ID NO: 272180 - protein, 9 aa, Homo Sapiens
GSAKGKLQA

SEQ ID NO: 272181 - protein, 9 aa, Homo Sapiens
QLRLNPHFI

SEQ ID NO: 272182 - protein, 9 aa, Homo Sapiens
QSTTVSDIA

SEQ ID NO: 272183 - protein, 9 aa, Homo Sapiens
KKKTYFCAA

SEQ ID NO: 272184 - protein, 9 aa, Homo Sapiens
SQRYKLGVC

SEQ ID NO: 272185 - protein, 9 aa, Homo Sapiens
QRRVHGGQV

SEQ ID NO: 272186 - protein, 9 aa, Homo Sapiens
FSQVFCLYL

SEQ ID NO: 272187 - protein, 9 aa, Homo Sapiens
MSVTRIMGH

SEQ ID NO: 272188 - protein, 9 aa, Homo Sapiens
EGMRGDGMA

SEQ ID NO: 272189 - protein, 9 aa, Homo Sapiens
SSKMKAVAS

SEQ ID NO: 272190 - protein, 9 aa, Homo Sapiens
SATPPRPRE

SEQ ID NO: 272191 - protein, 9 aa, Homo Sapiens
IPDIHEREG

SEQ ID NO: 272192 - protein, 9 aa, Homo Sapiens
RVEQYSRKV

SEQ ID NO: 272193 - protein, 9 aa, Homo Sapiens
LRLFEHGGF

SEQ ID NO: 272194 - protein, 9 aa, Homo Sapiens
VEAIWELNE

SEQ ID NO: 272195 - protein, 9 aa, Homo Sapiens
VKYAVLDCL

SEQ ID NO: 272196 - protein, 9 aa, Homo Sapiens
SPTIGASVM

SEQ ID NO: 272197 - protein, 9 aa, Homo Sapiens
SPLESHLKA

SEQ ID NO: 272198 - protein, 9 aa, Homo Sapiens
KNGHSQAQN

SEQ ID NO: 272199 - protein, 9 aa, Homo Sapiens
LTASKVQAS

SEQ ID NO: 272200 - protein, 9 aa, Homo Sapiens
KNIPKYNVD

SEQ ID NO: 272201 - protein, 9 aa, Homo Sapiens
AETTSLPPN

SEQ ID NO: 272202 - protein, 9 aa, Homo Sapiens
IWGSMGEIS

SEQ ID NO: 272203 - protein, 9 aa, Homo Sapiens
PQCQDFVPI

SEQ ID NO: 272204 - protein, 9 aa, Homo Sapiens
WDIIDLEDD

SEQ ID NO: 272205 - protein, 9 aa, Homo Sapiens
KMKPRRNVE

SEQ ID NO: 272206 - protein, 9 aa, Homo Sapiens
EYVIEKLEQ

SEQ ID NO: 272207 - protein, 9 aa, Homo Sapiens
RWLGGQAVG

SEQ ID NO: 272208 - protein, 9 aa, Homo Sapiens
VMNLHWKNS

SEQ ID NO: 272209 - protein, 9 aa, Homo Sapiens
MGLACSDPR

SEQ ID NO: 272210 - protein, 9 aa, Homo Sapiens
LNTLLGRVT

SEQ ID NO: 272211 - protein, 9 aa, Homo Sapiens
FQMDFGHTE

SEQ ID NO: 272212 - protein, 9 aa, Homo Sapiens
CRCNKCGKS

SEQ ID NO: 272213 - protein, 9 aa, Homo Sapiens
SRTTRGKKN

SEQ ID NO: 272214 - protein, 9 aa, Homo Sapiens
VAIFQHFNS

SEQ ID NO: 272215 - protein, 9 aa, Homo Sapiens
IHPNLYRIG

SEQ ID NO: 272216 - protein, 9 aa, Homo Sapiens
RKHQIHIEK

SEQ ID NO: 272217 - protein, 9 aa, Homo Sapiens
KSTGDRLEL

SEQ ID NO: 272218 - protein, 9 aa, Homo Sapiens
QGYPLHLEA

SEQ ID NO: 272219 - protein, 9 aa, Homo Sapiens
DLALIAWEI

SEQ ID NO: 272220 - protein, 9 aa, Homo Sapiens
HTRPHTQVL

SEQ ID NO: 272221 - protein, 9 aa, Homo Sapiens
GHVPRRLRL

SEQ ID NO: 272222 - protein, 9 aa, Homo Sapiens
VFDCKADAD

SEQ ID NO: 272223 - protein, 9 aa, Homo Sapiens
ELGEFAMLL

SEQ ID NO: 272224 - protein, 9 aa, Homo Sapiens
EKALYGSEE

SEQ ID NO: 272225 - protein, 9 aa, Homo Sapiens
PTLSAHIIV

SEQ ID NO: 272226 - protein, 9 aa, Homo Sapiens
CKDEYFAKD

SEQ ID NO: 272227 - protein, 9 aa, Homo Sapiens
SAALLGQMC

SEQ ID NO: 272228 - protein, 9 aa, Homo Sapiens
QEKKAMTAE

SEQ ID NO: 272229 - protein, 9 aa, Homo Sapiens
IAVPTTSGN

SEQ ID NO: 272230 - protein, 9 aa, Homo Sapiens
CGKAFNRYS

SEQ ID NO: 272231 - protein, 9 aa, Homo Sapiens
NLSFIDISI

SEQ ID NO: 272232 - protein, 9 aa, Homo Sapiens
PELFGDLPR

SEQ ID NO: 272233 - protein, 9 aa, Homo Sapiens
EGLMDDKLL

SEQ ID NO: 272234 - protein, 9 aa, Homo Sapiens
SMSCASFLA

SEQ ID NO: 272235 - protein, 9 aa, Homo Sapiens
VFIPSLFLD

SEQ ID NO: 272236 - protein, 9 aa, Homo Sapiens
SRNPQPQPT

SEQ ID NO: 272237 - protein, 9 aa, Homo Sapiens
DIEGHECAV

SEQ ID NO: 272238 - protein, 9 aa, Homo Sapiens
TSSQGSKKV

SEQ ID NO: 272239 - protein, 9 aa, Homo Sapiens
RIIPDMLQQ

SEQ ID NO: 272240 - protein, 9 aa, Homo Sapiens
SRVCIDSEF

SEQ ID NO: 272241 - protein, 9 aa, Homo Sapiens
MQDRLDILF

SEQ ID NO: 272242 - protein, 9 aa, Homo Sapiens
PNMQCCLCA

SEQ ID NO: 272243 - protein, 9 aa, Homo Sapiens
YSIYITCEP

SEQ ID NO: 272244 - protein, 9 aa, Homo Sapiens
SVVRHHQFR

SEQ ID NO: 272245 - protein, 9 aa, Homo Sapiens
APCSTNNCC

SEQ ID NO: 272246 - protein, 9 aa, Homo Sapiens
LHFSFSQKS

SEQ ID NO: 272247 - protein, 9 aa, Homo Sapiens
LRSTIHNTY

SEQ ID NO: 272248 - protein, 9 aa, Homo Sapiens
LQYQEETTE

SEQ ID NO: 272249 - protein, 9 aa, Homo Sapiens
LMSESQKLA

SEQ ID NO: 272250 - protein, 9 aa, Homo Sapiens
LKHAGKIST

SEQ ID NO: 272251 - protein, 9 aa, Homo Sapiens
LITLPKTLQ

SEQ ID NO: 272252 - protein, 9 aa, Homo Sapiens
VHLTATHPA

SEQ ID NO: 272253 - protein, 9 aa, Homo Sapiens
TDRNHIENI

SEQ ID NO: 272254 - protein, 9 aa, Homo Sapiens
RTNLSYMEL

SEQ ID NO: 272255 - protein, 9 aa, Homo Sapiens
SPGALWTVA

SEQ ID NO: 272256 - protein, 9 aa, Homo Sapiens
AYERELGKV

SEQ ID NO: 272257 - protein, 9 aa, Homo Sapiens
TRKRFNAFV

SEQ ID NO: 272258 - protein, 9 aa, Homo Sapiens
FRQIVLAVH

SEQ ID NO: 272259 - protein, 9 aa, Homo Sapiens
SLVDQKPEL

SEQ ID NO: 272260 - protein, 9 aa, Homo Sapiens
QPSHTENRD

SEQ ID NO: 272261 - protein, 9 aa, Homo Sapiens
QLMMDGATS

SEQ ID NO: 272262 - protein, 9 aa, Homo Sapiens
FMLTPSSHH

SEQ ID NO: 272263 - protein, 9 aa, Homo Sapiens
VYFSAIRKI

SEQ ID NO: 272264 - protein, 9 aa, Homo Sapiens
ITFNTNLTG

SEQ ID NO: 272265 - protein, 9 aa, Homo Sapiens
TRRLPEDYG

SEQ ID NO: 272266 - protein, 9 aa, Homo Sapiens
PPTPARCPQ

SEQ ID NO: 272267 - protein, 9 aa, Homo Sapiens
CYTVVVVPH

SEQ ID NO: 272268 - protein, 9 aa, Homo Sapiens
NMLVGNRID

SEQ ID NO: 272269 - protein, 9 aa, Homo Sapiens
MRRMEEMET

SEQ ID NO: 272270 - protein, 9 aa, Homo Sapiens
VHPDVRVVG

SEQ ID NO: 272271 - protein, 9 aa, Homo Sapiens
IMLKFWIPR

SEQ ID NO: 272272 - protein, 9 aa, Homo Sapiens
EPQWSFACE

SEQ ID NO: 272273 - protein, 9 aa, Homo Sapiens
NHHYHLTCG

SEQ ID NO: 272274 - protein, 9 aa, Homo Sapiens
EEDENIIGV

SEQ ID NO: 272275 - protein, 9 aa, Homo Sapiens
WKVVSSENF

SEQ ID NO: 272276 - protein, 9 aa, Homo Sapiens
NLSLSLSTP

SEQ ID NO: 272277 - protein, 9 aa, Homo Sapiens
DKIQQLEKY

SEQ ID NO: 272278 - protein, 9 aa, Homo Sapiens
DVNNLENFQ

SEQ ID NO: 272279 - protein, 9 aa, Homo Sapiens
QTRLDRAQI

SEQ ID NO: 272280 - protein, 9 aa, Homo Sapiens
LHGVVFPYF

SEQ ID NO: 272281 - protein, 9 aa, Homo Sapiens
ACIVCPYAN

SEQ ID NO: 272282 - protein, 9 aa, Homo Sapiens
VAKGMAFLT

SEQ ID NO: 272283 - protein, 9 aa, Homo Sapiens
FPNELSLHQ

SEQ ID NO: 272284 - protein, 9 aa, Homo Sapiens
DTFHDNDFE

SEQ ID NO: 272285 - protein, 9 aa, Homo Sapiens
KVHNRQPQI

SEQ ID NO: 272286 - protein, 9 aa, Homo Sapiens
ILVGLEDGT

SEQ ID NO: 272287 - protein, 9 aa, Homo Sapiens
EIDQVSYSA

SEQ ID NO: 272288 - protein, 9 aa, Homo Sapiens
ENILLFYFN

SEQ ID NO: 272289 - protein, 9 aa, Homo Sapiens
SLLTSPSTP

SEQ ID NO: 272290 - protein, 9 aa, Homo Sapiens
MFAMKMLHK

SEQ ID NO: 272291 - protein, 9 aa, Homo Sapiens
ISCFGCMKA

SEQ ID NO: 272292 - protein, 9 aa, Homo Sapiens
FLMQSDNLC

SEQ ID NO: 272293 - protein, 9 aa, Homo Sapiens
DKWDLLKLK

SEQ ID NO: 272294 - protein, 9 aa, Homo Sapiens
TSLGLDHCP

SEQ ID NO: 272295 - protein, 9 aa, Homo Sapiens
HQTFPSFFK

SEQ ID NO: 272296 - protein, 9 aa, Homo Sapiens
GTETVADHR

SEQ ID NO: 272297 - protein, 9 aa, Homo Sapiens
DFFEMCANL

SEQ ID NO: 272298 - protein, 9 aa, Homo Sapiens
VTLVIYIAR

SEQ ID NO: 272299 - protein, 9 aa, Homo Sapiens
SNFDRVNVW

SEQ ID NO: 272300 - protein, 9 aa, Homo Sapiens
STFSNSEVA

SEQ ID NO: 272301 - protein, 9 aa, Homo Sapiens
TKNTKKNSS

SEQ ID NO: 272302 - protein, 9 aa, Homo Sapiens
TYVKGRKND

SEQ ID NO: 272303 - protein, 9 aa, Homo Sapiens
EEQKQEIKY

SEQ ID NO: 272304 - protein, 9 aa, Homo Sapiens
TSPHIPRFS

SEQ ID NO: 272305 - protein, 9 aa, Homo Sapiens
LFVNSQIDR

SEQ ID NO: 272306 - protein, 9 aa, Homo Sapiens
FSKEFLSKP

SEQ ID NO: 272307 - protein, 9 aa, Homo Sapiens
LEKTSITQQ

SEQ ID NO: 272308 - protein, 9 aa, Homo Sapiens
GISDDDSLA

SEQ ID NO: 272309 - protein, 9 aa, Homo Sapiens
LLLALAPHK

SEQ ID NO: 272310 - protein, 9 aa, Homo Sapiens
LRQVGVSRP

SEQ ID NO: 272311 - protein, 9 aa, Homo Sapiens
MKEIYTSNR

SEQ ID NO: 272312 - protein, 9 aa, Homo Sapiens
NWQLERLVS

SEQ ID NO: 272313 - protein, 9 aa, Homo Sapiens
FEYLRGNYQ

SEQ ID NO: 272314 - protein, 9 aa, Homo Sapiens
QFSTLIFEG

SEQ ID NO: 272315 - protein, 9 aa, Homo Sapiens
KLNEVSQQC

SEQ ID NO: 272316 - protein, 9 aa, Homo Sapiens
NNHLNYEHR

SEQ ID NO: 272317 - protein, 9 aa, Homo Sapiens
PSLLTSPST

SEQ ID NO: 272318 - protein, 9 aa, Homo Sapiens
SKRARPPRP

SEQ ID NO: 272319 - protein, 9 aa, Homo Sapiens
SEDIDHLNK

SEQ ID NO: 272320 - protein, 9 aa, Homo Sapiens
GNENQELHD

SEQ ID NO: 272321 - protein, 9 aa, Homo Sapiens
CEMQNPRER

SEQ ID NO: 272322 - protein, 9 aa, Homo Sapiens
TFKGLKHLM

SEQ ID NO: 272323 - protein, 9 aa, Homo Sapiens
TLSAPKQLR

SEQ ID NO: 272324 - protein, 9 aa, Homo Sapiens
SMYEQFYSP

SEQ ID NO: 272325 - protein, 9 aa, Homo Sapiens
YQHVTKVDK

SEQ ID NO: 272326 - protein, 9 aa, Homo Sapiens
VVQNRCSSC

SEQ ID NO: 272327 - protein, 9 aa, Homo Sapiens
LYVADVKSA

SEQ ID NO: 272328 - protein, 9 aa, Homo Sapiens
QIIYNYNPE

SEQ ID NO: 272329 - protein, 9 aa, Homo Sapiens
SPRGLSNSP

SEQ ID NO: 272330 - protein, 9 aa, Homo Sapiens
KKLEREQRR

SEQ ID NO: 272331 - protein, 9 aa, Homo Sapiens
LLPLLQSNK

SEQ ID NO: 272332 - protein, 9 aa, Homo Sapiens
EFLNKPART

SEQ ID NO: 272333 - protein, 9 aa, Homo Sapiens
YLYTCLVEI

SEQ ID NO: 272334 - protein, 9 aa, Homo Sapiens
VYPPEKKDK

SEQ ID NO: 272335 - protein, 9 aa, Homo Sapiens
AEFREVIKA

SEQ ID NO: 272336 - protein, 9 aa, Homo Sapiens
HAAVHDPDK

SEQ ID NO: 272337 - protein, 9 aa, Homo Sapiens
DGIWLLGTT

SEQ ID NO: 272338 - protein, 9 aa, Homo Sapiens
ALDGFIITV

SEQ ID NO: 272339 - protein, 9 aa, Homo Sapiens
MHDPLLERY

SEQ ID NO: 272340 - protein, 9 aa, Homo Sapiens
AEKALYGSE

SEQ ID NO: 272341 - protein, 9 aa, Homo Sapiens
AIVLVNGTT

SEQ ID NO: 272342 - protein, 9 aa, Homo Sapiens
QTSASFLWP

SEQ ID NO: 272343 - protein, 9 aa, Homo Sapiens
FLTEDKKNG

SEQ ID NO: 272344 - protein, 9 aa, Homo Sapiens
GRWTKSQTT

SEQ ID NO: 272345 - protein, 9 aa, Homo Sapiens
NGILERGAK

SEQ ID NO: 272346 - protein, 9 aa, Homo Sapiens
KQLNPFNLK

SEQ ID NO: 272347 - protein, 9 aa, Homo Sapiens
RYPHITFEN

SEQ ID NO: 272348 - protein, 9 aa, Homo Sapiens
DLHGVVFPY

SEQ ID NO: 272349 - protein, 9 aa, Homo Sapiens
IKGAVGDWK

SEQ ID NO: 272350 - protein, 9 aa, Homo Sapiens
FTLLAIAMV

SEQ ID NO: 272351 - protein, 9 aa, Homo Sapiens
QINSYVEVA

SEQ ID NO: 272352 - protein, 9 aa, Homo Sapiens
FGRSGRLVT

SEQ ID NO: 272353 - protein, 9 aa, Homo Sapiens
VQIEEDEDR

SEQ ID NO: 272354 - protein, 9 aa, Homo Sapiens
QDMISPVSH

SEQ ID NO: 272355 - protein, 9 aa, Homo Sapiens
SGVYTCIAT

SEQ ID NO: 272356 - protein, 9 aa, Homo Sapiens
RAVLNEPLD

SEQ ID NO: 272357 - protein, 9 aa, Homo Sapiens
VSRVDAGWI

SEQ ID NO: 272358 - protein, 9 aa, Homo Sapiens
YKTIKQYQQ

SEQ ID NO: 272359 - protein, 9 aa, Homo Sapiens
EEVVSDSEL

SEQ ID NO: 272360 - protein, 9 aa, Homo Sapiens
LDNLFLQCP

SEQ ID NO: 272361 - protein, 9 aa, Homo Sapiens
CWECCEYDQ

SEQ ID NO: 272362 - protein, 9 aa, Homo Sapiens
EYSQDPTMY

SEQ ID NO: 272363 - protein, 9 aa, Homo Sapiens
LNYSNPMNP

SEQ ID NO: 272364 - protein, 9 aa, Homo Sapiens
AYLARKVSL

SEQ ID NO: 272365 - protein, 9 aa, Homo Sapiens
PRLVYKWFI

SEQ ID NO: 272366 - protein, 9 aa, Homo Sapiens
ETKVKQNGS

SEQ ID NO: 272367 - protein, 9 aa, Homo Sapiens
GSTIRTGFM

SEQ ID NO: 272368 - protein, 9 aa, Homo Sapiens
TNNLLCLFC

SEQ ID NO: 272369 - protein, 9 aa, Homo Sapiens
MKKAGERHK

SEQ ID NO: 272370 - protein, 9 aa, Homo Sapiens
RGPRERRED

SEQ ID NO: 272371 - protein, 9 aa, Homo Sapiens
GRYLQNPII

SEQ ID NO: 272372 - protein, 9 aa, Homo Sapiens
NLTILHVMC

SEQ ID NO: 272373 - protein, 9 aa, Homo Sapiens
KIKQSVSDI

SEQ ID NO: 272374 - protein, 9 aa, Homo Sapiens
FNIAWSING

SEQ ID NO: 272375 - protein, 9 aa, Homo Sapiens
KYLYLDNNQ

SEQ ID NO: 272376 - protein, 9 aa, Homo Sapiens
DEQDNCKET

SEQ ID NO: 272377 - protein, 9 aa, Homo Sapiens
TREQLSRHP

SEQ ID NO: 272378 - protein, 9 aa, Homo Sapiens
YLWRHHIKN

SEQ ID NO: 272379 - protein, 9 aa, Homo Sapiens
AERVEAFLR

SEQ ID NO: 272380 - protein, 9 aa, Homo Sapiens
CYLAPQNLP

SEQ ID NO: 272381 - protein, 9 aa, Homo Sapiens
RWRSDSAQD

SEQ ID NO: 272382 - protein, 9 aa, Homo Sapiens
CTCGNSNSW

SEQ ID NO: 272383 - protein, 9 aa, Homo Sapiens
PLRFTRENS

SEQ ID NO: 272384 - protein, 9 aa, Homo Sapiens
KAHPVRTNK

SEQ ID NO: 272385 - protein, 9 aa, Homo Sapiens
TSAKTAFNV

SEQ ID NO: 272386 - protein, 9 aa, Homo Sapiens
FIFTNLVTG

SEQ ID NO: 272387 - protein, 9 aa, Homo Sapiens
VGMTVQWTR

SEQ ID NO: 272388 - protein, 9 aa, Homo Sapiens
GKNVEAIWE

SEQ ID NO: 272389 - protein, 9 aa, Homo Sapiens
DIAVPTFKQ

SEQ ID NO: 272390 - protein, 9 aa, Homo Sapiens
SKVKVKVCV

SEQ ID NO: 272391 - protein, 9 aa, Homo Sapiens
YHVANWLVE

SEQ ID NO: 272392 - protein, 9 aa, Homo Sapiens
FQAESFEEE

SEQ ID NO: 272393 - protein, 9 aa, Homo Sapiens
SITQLIDVD

SEQ ID NO: 272394 - protein, 9 aa, Homo Sapiens
ALVINKAIH

SEQ ID NO: 272395 - protein, 9 aa, Homo Sapiens
EVRGCDVAF

SEQ ID NO: 272396 - protein, 9 aa, Homo Sapiens
ISTPNKYEL

SEQ ID NO: 272397 - protein, 9 aa, Homo Sapiens
KVTDKSRQK

SEQ ID NO: 272398 - protein, 9 aa, Homo Sapiens
MNNKLWYFE

SEQ ID NO: 272399 - protein, 9 aa, Homo Sapiens
LALMYGLDS

SEQ ID NO: 272400 - protein, 9 aa, Homo Sapiens
FSYILVYRQ

SEQ ID NO: 272401 - protein, 9 aa, Homo Sapiens
LVERIHVNL

SEQ ID NO: 272402 - protein, 9 aa, Homo Sapiens
ATWSIIMNS

SEQ ID NO: 272403 - protein, 9 aa, Homo Sapiens
KITDFGISK

SEQ ID NO: 272404 - protein, 9 aa, Homo Sapiens
NLFIFMEYF

SEQ ID NO: 272405 - protein, 9 aa, Homo Sapiens
HILQGDRHF

SEQ ID NO: 272406 - protein, 9 aa, Homo Sapiens
PLTGGRGKI

SEQ ID NO: 272407 - protein, 9 aa, Homo Sapiens
SQQCEDIDE

SEQ ID NO: 272408 - protein, 9 aa, Homo Sapiens
SLSYIVGAP

SEQ ID NO: 272409 - protein, 9 aa, Homo Sapiens
YGNDFLQLL

SEQ ID NO: 272410 - protein, 9 aa, Homo Sapiens
NVDTFLIVC

SEQ ID NO: 272411 - protein, 9 aa, Homo Sapiens
ELIKLSWLL

SEQ ID NO: 272412 - protein, 9 aa, Homo Sapiens
KLATAQDDV

SEQ ID NO: 272413 - protein, 9 aa, Homo Sapiens
KLNVAFVAN

SEQ ID NO: 272414 - protein, 9 aa, Homo Sapiens
VHPDGGLMA

SEQ ID NO: 272415 - protein, 9 aa, Homo Sapiens
MAVWKTLIP

SEQ ID NO: 272416 - protein, 9 aa, Homo Sapiens
IQDPKTEQD

SEQ ID NO: 272417 - protein, 9 aa, Homo Sapiens
LLCGGLCMH

SEQ ID NO: 272418 - protein, 9 aa, Homo Sapiens
KAMMEAGWD

SEQ ID NO: 272419 - protein, 9 aa, Homo Sapiens
SYIDVEGPF

SEQ ID NO: 272420 - protein, 9 aa, Homo Sapiens
TFMSMCRRV

SEQ ID NO: 272421 - protein, 9 aa, Homo Sapiens
NLGELSSSS

SEQ ID NO: 272422 - protein, 9 aa, Homo Sapiens
SKLKRLEKM

SEQ ID NO: 272423 - protein, 9 aa, Homo Sapiens
PYLVAGTPW

SEQ ID NO: 272424 - protein, 9 aa, Homo Sapiens
ILGLSHAFI

SEQ ID NO: 272425 - protein, 9 aa, Homo Sapiens
GVLNYLKYT

SEQ ID NO: 272426 - protein, 9 aa, Homo Sapiens
VATKVQRHD

SEQ ID NO: 272427 - protein, 9 aa, Homo Sapiens
ETHDSIVNK

SEQ ID NO: 272428 - protein, 9 aa, Homo Sapiens
MEMVQIEED

SEQ ID NO: 272429 - protein, 9 aa, Homo Sapiens
PRSHPSASS

SEQ ID NO: 272430 - protein, 9 aa, Homo Sapiens
STIPPGAFI

SEQ ID NO: 272431 - protein, 9 aa, Homo Sapiens
ITTPNRLLQ

SEQ ID NO: 272432 - protein, 9 aa, Homo Sapiens
DGSPGRKFY

SEQ ID NO: 272433 - protein, 9 aa, Homo Sapiens
LELTKMRAK

SEQ ID NO: 272434 - protein, 9 aa, Homo Sapiens
VSVRGITNL

SEQ ID NO: 272435 - protein, 9 aa, Homo Sapiens
FPCMECEKR

SEQ ID NO: 272436 - protein, 9 aa, Homo Sapiens
SHNSPFIVH

SEQ ID NO: 272437 - protein, 9 aa, Homo Sapiens
VPPLHPLLI

SEQ ID NO: 272438 - protein, 9 aa, Homo Sapiens
LQFIFQTDT

SEQ ID NO: 272439 - protein, 9 aa, Homo Sapiens
EDRLILDAP

SEQ ID NO: 272440 - protein, 9 aa, Homo Sapiens
AKSFQIHEK

SEQ ID NO: 272441 - protein, 9 aa, Homo Sapiens
LQEFLAAYA

SEQ ID NO: 272442 - protein, 9 aa, Homo Sapiens
ANCKDLAVV

SEQ ID NO: 272443 - protein, 9 aa, Homo Sapiens
IFLRQSIAL

SEQ ID NO: 272444 - protein, 9 aa, Homo Sapiens
VLGQPHNKS

SEQ ID NO: 272445 - protein, 9 aa, Homo Sapiens
STNPELRRH

SEQ ID NO: 272446 - protein, 9 aa, Homo Sapiens
LLSEQHRNC

SEQ ID NO: 272447 - protein, 9 aa, Homo Sapiens
NAIIIGERT

SEQ ID NO: 272448 - protein, 9 aa, Homo Sapiens
TETHAKLAL

SEQ ID NO: 272449 - protein, 9 aa, Homo Sapiens
GLEIDERGP

SEQ ID NO: 272450 - protein, 9 aa, Homo Sapiens
KLLHPDVIS

SEQ ID NO: 272451 - protein, 9 aa, Homo Sapiens
INKIENWDE

SEQ ID NO: 272452 - protein, 9 aa, Homo Sapiens
KSLHISNWT

SEQ ID NO: 272453 - protein, 9 aa, Homo Sapiens
FSGLRLPFI

SEQ ID NO: 272454 - protein, 9 aa, Homo Sapiens
KVNHEALEI

SEQ ID NO: 272455 - protein, 9 aa, Homo Sapiens
QEKYQLQVF

SEQ ID NO: 272456 - protein, 9 aa, Homo Sapiens
QLREIIWSY

SEQ ID NO: 272457 - protein, 9 aa, Homo Sapiens
LVRDNSKKT

SEQ ID NO: 272458 - protein, 9 aa, Homo Sapiens
EKFKQLENS

SEQ ID NO: 272459 - protein, 9 aa, Homo Sapiens
PTSRTTRGK

SEQ ID NO: 272460 - protein, 9 aa, Homo Sapiens
NQAPLEIVL

SEQ ID NO: 272461 - protein, 9 aa, Homo Sapiens
MLQEKKAMT

SEQ ID NO: 272462 - protein, 9 aa, Homo Sapiens
AFSQYSSFN

SEQ ID NO: 272463 - protein, 9 aa, Homo Sapiens
WKPYKKHRR

SEQ ID NO: 272464 - protein, 9 aa, Homo Sapiens
YHTAFAQQS

SEQ ID NO: 272465 - protein, 9 aa, Homo Sapiens
LQIPWLRGA

SEQ ID NO: 272466 - protein, 9 aa, Homo Sapiens
QIKEGCLKE

SEQ ID NO: 272467 - protein, 9 aa, Homo Sapiens
QCCLCASCW

SEQ ID NO: 272468 - protein, 9 aa, Homo Sapiens
TEYAASKFI

SEQ ID NO: 272469 - protein, 9 aa, Homo Sapiens
MQPCVFWTD

SEQ ID NO: 272470 - protein, 9 aa, Homo Sapiens
YVGSFVLKL

SEQ ID NO: 272471 - protein, 9 aa, Homo Sapiens
GKVTTKNIT

SEQ ID NO: 272472 - protein, 9 aa, Homo Sapiens
YGSCISMYV

SEQ ID NO: 272473 - protein, 9 aa, Homo Sapiens
YRNVKFNVW

SEQ ID NO: 272474 - protein, 9 aa, Homo Sapiens
KVCCALLMS

SEQ ID NO: 272475 - protein, 9 aa, Homo Sapiens
RKSQGITTN

SEQ ID NO: 272476 - protein, 9 aa, Homo Sapiens
IPEFINKIQ

SEQ ID NO: 272477 - protein, 9 aa, Homo Sapiens
DGMEIPGNL

SEQ ID NO: 272478 - protein, 9 aa, Homo Sapiens
LKRKRLSKR

SEQ ID NO: 272479 - protein, 9 aa, Homo Sapiens
SRRENELPN

SEQ ID NO: 272480 - protein, 9 aa, Homo Sapiens
GDLSGLPTG

SEQ ID NO: 272481 - protein, 9 aa, Homo Sapiens
RHTPLRTYL

SEQ ID NO: 272482 - protein, 9 aa, Homo Sapiens
NTKKKKINH

SEQ ID NO: 272483 - protein, 9 aa, Homo Sapiens
KTVSLSVEI

SEQ ID NO: 272484 - protein, 9 aa, Homo Sapiens
KINRILKLL

SEQ ID NO: 272485 - protein, 9 aa, Homo Sapiens
CMYEMLYGK

SEQ ID NO: 272486 - protein, 9 aa, Homo Sapiens
TEGRERAFI

SEQ ID NO: 272487 - protein, 9 aa, Homo Sapiens
YKEHLEGHK

SEQ ID NO: 272488 - protein, 9 aa, Homo Sapiens
DRRTQERDI

SEQ ID NO: 272489 - protein, 9 aa, Homo Sapiens
CSENPEQII

SEQ ID NO: 272490 - protein, 9 aa, Homo Sapiens
TKTSNLSEN

SEQ ID NO: 272491 - protein, 9 aa, Homo Sapiens
LQLQRMIRY

SEQ ID NO: 272492 - protein, 9 aa, Homo Sapiens
CEKTYSLLQ

SEQ ID NO: 272493 - protein, 9 aa, Homo Sapiens
PDIAVPTFK

SEQ ID NO: 272494 - protein, 9 aa, Homo Sapiens
TIEKLAGKI

SEQ ID NO: 272495 - protein, 9 aa, Homo Sapiens
WEHLRSWEA

SEQ ID NO: 272496 - protein, 9 aa, Homo Sapiens
KYDIDPSNG

SEQ ID NO: 272497 - protein, 9 aa, Homo Sapiens
PVPELQDSL

SEQ ID NO: 272498 - protein, 9 aa, Homo Sapiens
NGDPVHPGV

SEQ ID NO: 272499 - protein, 9 aa, Homo Sapiens
NQEFIALGL

SEQ ID NO: 272500 - protein, 9 aa, Homo Sapiens
QFLNNLNLG

SEQ ID NO: 272501 - protein, 9 aa, Homo Sapiens
EEVEQFMKE

SEQ ID NO: 272502 - protein, 9 aa, Homo Sapiens
ELIVFSQVV

SEQ ID NO: 272503 - protein, 9 aa, Homo Sapiens
ECKYCRKSF

SEQ ID NO: 272504 - protein, 9 aa, Homo Sapiens
TEVKGALKR

SEQ ID NO: 272505 - protein, 9 aa, Homo Sapiens
SATESRKKP

SEQ ID NO: 272506 - protein, 9 aa, Homo Sapiens
EYLNNKYLY

SEQ ID NO: 272507 - protein, 9 aa, Homo Sapiens
TAGLHCQLL

SEQ ID NO: 272508 - protein, 9 aa, Homo Sapiens
IFQRCNCGP

SEQ ID NO: 272509 - protein, 9 aa, Homo Sapiens
QQVKTNTSQ

SEQ ID NO: 272510 - protein, 9 aa, Homo Sapiens
CQELLSVIP

SEQ ID NO: 272511 - protein, 9 aa, Homo Sapiens
TNTENSSSV

SEQ ID NO: 272512 - protein, 9 aa, Homo Sapiens
GSKLLEIFA

SEQ ID NO: 272513 - protein, 9 aa, Homo Sapiens
NRRAQDESL

SEQ ID NO: 272514 - protein, 9 aa, Homo Sapiens
DERILELEL

SEQ ID NO: 272515 - protein, 9 aa, Homo Sapiens
PTQKPKKSV

SEQ ID NO: 272516 - protein, 9 aa, Homo Sapiens
LSKTFPGIT

SEQ ID NO: 272517 - protein, 9 aa, Homo Sapiens
DVGVNLLQQ

SEQ ID NO: 272518 - protein, 9 aa, Homo Sapiens
DEDGLNLEE

SEQ ID NO: 272519 - protein, 9 aa, Homo Sapiens
GENGRWRFY

SEQ ID NO: 272520 - protein, 9 aa, Homo Sapiens
TILEIVLFA

SEQ ID NO: 272521 - protein, 9 aa, Homo Sapiens
NIIDTLMYL

SEQ ID NO: 272522 - protein, 9 aa, Homo Sapiens
YICLDFIET

SEQ ID NO: 272523 - protein, 9 aa, Homo Sapiens
LIRQIFHPE

SEQ ID NO: 272524 - protein, 9 aa, Homo Sapiens
FVTSSSQAR

SEQ ID NO: 272525 - protein, 9 aa, Homo Sapiens
QVPAINRLA

SEQ ID NO: 272526 - protein, 9 aa, Homo Sapiens
PEDVLTSHP

SEQ ID NO: 272527 - protein, 9 aa, Homo Sapiens
LRRQVPAIN

SEQ ID NO: 272528 - protein, 9 aa, Homo Sapiens
ASQGRQDGS

SEQ ID NO: 272529 - protein, 9 aa, Homo Sapiens
PGKPGHYQY

SEQ ID NO: 272530 - protein, 9 aa, Homo Sapiens
FNTETPLTT

SEQ ID NO: 272531 - protein, 9 aa, Homo Sapiens
YINATFIKG

SEQ ID NO: 272532 - protein, 9 aa, Homo Sapiens
CKKCQDWYY

SEQ ID NO: 272533 - protein, 9 aa, Homo Sapiens
WISFIPTYA

SEQ ID NO: 272534 - protein, 9 aa, Homo Sapiens
CNTSVENGW

SEQ ID NO: 272535 - protein, 9 aa, Homo Sapiens
YRDSTPTVL

SEQ ID NO: 272536 - protein, 9 aa, Homo Sapiens
HIFSGYLHS

SEQ ID NO: 272537 - protein, 9 aa, Homo Sapiens
AEIIIVDDF

SEQ ID NO: 272538 - protein, 9 aa, Homo Sapiens
RLTHAEIIA

SEQ ID NO: 272539 - protein, 9 aa, Homo Sapiens
EDFASQVTH

SEQ ID NO: 272540 - protein, 9 aa, Homo Sapiens
VVLPHQPLV

SEQ ID NO: 272541 - protein, 9 aa, Homo Sapiens
YPREDEQFY

SEQ ID NO: 272542 - protein, 9 aa, Homo Sapiens
MNSGFQNTI

SEQ ID NO: 272543 - protein, 9 aa, Homo Sapiens
LPVKTLLEY

SEQ ID NO: 272544 - protein, 9 aa, Homo Sapiens
VSKRKLQWN

SEQ ID NO: 272545 - protein, 9 aa, Homo Sapiens
EISDQEKDK

SEQ ID NO: 272546 - protein, 9 aa, Homo Sapiens
MHIKEEKLF

SEQ ID NO: 272547 - protein, 9 aa, Homo Sapiens
KSPHSDPYN

SEQ ID NO: 272548 - protein, 9 aa, Homo Sapiens
VVQEDGCML

SEQ ID NO: 272549 - protein, 9 aa, Homo Sapiens
LYRQRSQTA

SEQ ID NO: 272550 - protein, 9 aa, Homo Sapiens
APAPPIEPI

SEQ ID NO: 272551 - protein, 9 aa, Homo Sapiens
NLSFEGTKL

SEQ ID NO: 272552 - protein, 9 aa, Homo Sapiens
ITDTFFRVH

SEQ ID NO: 272553 - protein, 9 aa, Homo Sapiens
VIGTVALAC

SEQ ID NO: 272554 - protein, 9 aa, Homo Sapiens
KSVNAKKDV

SEQ ID NO: 272555 - protein, 9 aa, Homo Sapiens
IAYNVTSKG

SEQ ID NO: 272556 - protein, 9 aa, Homo Sapiens
IYTTLFNNM

SEQ ID NO: 272557 - protein, 9 aa, Homo Sapiens
LQKAGPGLQ

SEQ ID NO: 272558 - protein, 9 aa, Homo Sapiens
KQERINRFI

SEQ ID NO: 272559 - protein, 9 aa, Homo Sapiens
KDLADLEVL

SEQ ID NO: 272560 - protein, 9 aa, Homo Sapiens
HQFALRLSC

SEQ ID NO: 272561 - protein, 9 aa, Homo Sapiens
LWEKNGSDN

SEQ ID NO: 272562 - protein, 9 aa, Homo Sapiens
VGVNVSGGK

SEQ ID NO: 272563 - protein, 9 aa, Homo Sapiens
VSPPVVVNG

SEQ ID NO: 272564 - protein, 9 aa, Homo Sapiens
GGPPCTIIT

SEQ ID NO: 272565 - protein, 9 aa, Homo Sapiens
ISFLQLHPI

SEQ ID NO: 272566 - protein, 9 aa, Homo Sapiens
FNKPCITDV

SEQ ID NO: 272567 - protein, 9 aa, Homo Sapiens
GWASTIESG

SEQ ID NO: 272568 - protein, 9 aa, Homo Sapiens
KHRRKLRQD

SEQ ID NO: 272569 - protein, 9 aa, Homo Sapiens
NNDLVCKKR

SEQ ID NO: 272570 - protein, 9 aa, Homo Sapiens
GSTETKILN

SEQ ID NO: 272571 - protein, 9 aa, Homo Sapiens
KANLNALDI

SEQ ID NO: 272572 - protein, 9 aa, Homo Sapiens
SSGGKSTHQ

SEQ ID NO: 272573 - protein, 9 aa, Homo Sapiens
GRESKWKRE

SEQ ID NO: 272574 - protein, 9 aa, Homo Sapiens
GKACPHRCA

SEQ ID NO: 272575 - protein, 9 aa, Homo Sapiens
YLNPDRMSH

SEQ ID NO: 272576 - protein, 9 aa, Homo Sapiens
HSGEGPMPF

SEQ ID NO: 272577 - protein, 9 aa, Homo Sapiens
NWLDIFCCV

SEQ ID NO: 272578 - protein, 9 aa, Homo Sapiens
IEEDEEDEE

SEQ ID NO: 272579 - protein, 9 aa, Homo Sapiens
FFSFTIFFS

SEQ ID NO: 272580 - protein, 9 aa, Homo Sapiens
RRSDTCEYR

SEQ ID NO: 272581 - protein, 9 aa, Homo Sapiens
VNARERRRM

SEQ ID NO: 272582 - protein, 9 aa, Homo Sapiens
PFSSYHNNE

SEQ ID NO: 272583 - protein, 9 aa, Homo Sapiens
QIRSDLKAE

SEQ ID NO: 272584 - protein, 9 aa, Homo Sapiens
YSSHIFQDL

SEQ ID NO: 272585 - protein, 9 aa, Homo Sapiens
GQTIYLYRF

SEQ ID NO: 272586 - protein, 9 aa, Homo Sapiens
KDSTLGQIQ

SEQ ID NO: 272587 - protein, 9 aa, Homo Sapiens
YDVMILTVF

SEQ ID NO: 272588 - protein, 9 aa, Homo Sapiens
VLQRMDMKP

SEQ ID NO: 272589 - protein, 9 aa, Homo Sapiens
KVRIHLQQQ

SEQ ID NO: 272590 - protein, 9 aa, Homo Sapiens
YYTVYQASR

SEQ ID NO: 272591 - protein, 9 aa, Homo Sapiens
KDTKFRDLF

SEQ ID NO: 272592 - protein, 9 aa, Homo Sapiens
VTDISAADK

SEQ ID NO: 272593 - protein, 9 aa, Homo Sapiens
LCNSVFSDA

SEQ ID NO: 272594 - protein, 9 aa, Homo Sapiens
CYKCPPHSL

SEQ ID NO: 272595 - protein, 9 aa, Homo Sapiens
VSLAAAKLF

SEQ ID NO: 272596 - protein, 9 aa, Homo Sapiens
PSSFVLNGC

SEQ ID NO: 272597 - protein, 9 aa, Homo Sapiens
LPINQSIKD

SEQ ID NO: 272598 - protein, 9 aa, Homo Sapiens
HFKPEDPTR

SEQ ID NO: 272599 - protein, 9 aa, Homo Sapiens
VQKMIFYLN

SEQ ID NO: 272600 - protein, 9 aa, Homo Sapiens
PEIFQRCNC

SEQ ID NO: 272601 - protein, 9 aa, Homo Sapiens
QSPNQQSTV

SEQ ID NO: 272602 - protein, 9 aa, Homo Sapiens
KFYPPDPVQ

SEQ ID NO: 272603 - protein, 9 aa, Homo Sapiens
SKEYNFITM

SEQ ID NO: 272604 - protein, 9 aa, Homo Sapiens
HASGSRPLT

SEQ ID NO: 272605 - protein, 9 aa, Homo Sapiens
AALSETSES

SEQ ID NO: 272606 - protein, 9 aa, Homo Sapiens
AGPITTREQ

SEQ ID NO: 272607 - protein, 9 aa, Homo Sapiens
RLWQSLRSE

SEQ ID NO: 272608 - protein, 9 aa, Homo Sapiens
VGPWGDYDN

SEQ ID NO: 272609 - protein, 9 aa, Homo Sapiens
LYGKTPFYA

SEQ ID NO: 272610 - protein, 9 aa, Homo Sapiens
KELFERKSS

SEQ ID NO: 272611 - protein, 9 aa, Homo Sapiens
TYPQAYPSE

SEQ ID NO: 272612 - protein, 9 aa, Homo Sapiens
PHRVCSIMM

SEQ ID NO: 272613 - protein, 9 aa, Homo Sapiens
QDAATYNSL

SEQ ID NO: 272614 - protein, 9 aa, Homo Sapiens
QDKDQHEQN

SEQ ID NO: 272615 - protein, 9 aa, Homo Sapiens
VYCSLRLLA

SEQ ID NO: 272616 - protein, 9 aa, Homo Sapiens
LLGYPKTKA

SEQ ID NO: 272617 - protein, 9 aa, Homo Sapiens
MDGAMGPWG

SEQ ID NO: 272618 - protein, 9 aa, Homo Sapiens
NGNLKEKYI

SEQ ID NO: 272619 - protein, 9 aa, Homo Sapiens
YRGAMGFML

SEQ ID NO: 272620 - protein, 9 aa, Homo Sapiens
PKASMKQYR

SEQ ID NO: 272621 - protein, 9 aa, Homo Sapiens
VRIEMFQNM

SEQ ID NO: 272622 - protein, 9 aa, Homo Sapiens
LSNNKISGL

SEQ ID NO: 272623 - protein, 9 aa, Homo Sapiens
REAVNRQVM

SEQ ID NO: 272624 - protein, 9 aa, Homo Sapiens
SFFFFNLVR

SEQ ID NO: 272625 - protein, 9 aa, Homo Sapiens
FQTYAKLQQ

SEQ ID NO: 272626 - protein, 9 aa, Homo Sapiens
RPCRCGAGT

SEQ ID NO: 272627 - protein, 9 aa, Homo Sapiens
KKEQPTSSQ

SEQ ID NO: 272628 - protein, 9 aa, Homo Sapiens
DNLELTYGY

SEQ ID NO: 272629 - protein, 9 aa, Homo Sapiens
DQIRGLTKE

SEQ ID NO: 272630 - protein, 9 aa, Homo Sapiens
DPPTLKNDA

SEQ ID NO: 272631 - protein, 9 aa, Homo Sapiens
STCAESMAT

SEQ ID NO: 272632 - protein, 9 aa, Homo Sapiens
FCQSQSSTF

SEQ ID NO: 272633 - protein, 9 aa, Homo Sapiens
ISVLSVTHL

SEQ ID NO: 272634 - protein, 9 aa, Homo Sapiens
NSFGCPSVR

SEQ ID NO: 272635 - protein, 9 aa, Homo Sapiens
RERSYDLVR

SEQ ID NO: 272636 - protein, 9 aa, Homo Sapiens
AWVSAQACN

SEQ ID NO: 272637 - protein, 9 aa, Homo Sapiens
ALGMLWLFA

SEQ ID NO: 272638 - protein, 9 aa, Homo Sapiens
FQRKYEETQ

SEQ ID NO: 272639 - protein, 9 aa, Homo Sapiens
EKRPAPFSS

SEQ ID NO: 272640 - protein, 9 aa, Homo Sapiens
YFCGQIEIN

SEQ ID NO: 272641 - protein, 9 aa, Homo Sapiens
IANAIQRSL

SEQ ID NO: 272642 - protein, 9 aa, Homo Sapiens
RHDGNKHIK

SEQ ID NO: 272643 - protein, 9 aa, Homo Sapiens
QNYNQAYHW

SEQ ID NO: 272644 - protein, 9 aa, Homo Sapiens
YLVRASYLD

SEQ ID NO: 272645 - protein, 9 aa, Homo Sapiens
HIYIHTHTF

SEQ ID NO: 272646 - protein, 9 aa, Homo Sapiens
PSYVRKHEI

SEQ ID NO: 272647 - protein, 9 aa, Homo Sapiens
SRALLLVTK

SEQ ID NO: 272648 - protein, 9 aa, Homo Sapiens
YDLSERIAS

SEQ ID NO: 272649 - protein, 9 aa, Homo Sapiens
FQHPPEAFH

SEQ ID NO: 272650 - protein, 9 aa, Homo Sapiens
AFYQSSKLT

SEQ ID NO: 272651 - protein, 9 aa, Homo Sapiens
DPITNSASQ

SEQ ID NO: 272652 - protein, 9 aa, Homo Sapiens
LKSKGLTLN

SEQ ID NO: 272653 - protein, 9 aa, Homo Sapiens
FKMDTYAKS

SEQ ID NO: 272654 - protein, 9 aa, Homo Sapiens
KPTCYLAPQ

SEQ ID NO: 272655 - protein, 9 aa, Homo Sapiens
AQPKTVILF

SEQ ID NO: 272656 - protein, 9 aa, Homo Sapiens
SDCIFIWFC

SEQ ID NO: 272657 - protein, 9 aa, Homo Sapiens
YRPNWNSIS

SEQ ID NO: 272658 - protein, 9 aa, Homo Sapiens
HPEASIQAA

SEQ ID NO: 272659 - protein, 9 aa, Homo Sapiens
YLFYLKSKP

SEQ ID NO: 272660 - protein, 9 aa, Homo Sapiens
TALKSLNKT

SEQ ID NO: 272661 - protein, 9 aa, Homo Sapiens
YRKDSPLVL

SEQ ID NO: 272662 - protein, 9 aa, Homo Sapiens
EKMLQEKKA

SEQ ID NO: 272663 - protein, 9 aa, Homo Sapiens
PKTQFIGVY

SEQ ID NO: 272664 - protein, 9 aa, Homo Sapiens
SPVKLKNFK

SEQ ID NO: 272665 - protein, 9 aa, Homo Sapiens
VFGVEYFMR

SEQ ID NO: 272666 - protein, 9 aa, Homo Sapiens
IKLASSEPQ

SEQ ID NO: 272667 - protein, 9 aa, Homo Sapiens
GSDYNFLSL

SEQ ID NO: 272668 - protein, 9 aa, Homo Sapiens
PCRLYHRAD

SEQ ID NO: 272669 - protein, 9 aa, Homo Sapiens
LPKKVYLSS

SEQ ID NO: 272670 - protein, 9 aa, Homo Sapiens
QDIATYRSL

SEQ ID NO: 272671 - protein, 9 aa, Homo Sapiens
EKYILVLPL

SEQ ID NO: 272672 - protein, 9 aa, Homo Sapiens
NISFNKHSG

SEQ ID NO: 272673 - protein, 9 aa, Homo Sapiens
NCPQKSNLD

SEQ ID NO: 272674 - protein, 9 aa, Homo Sapiens
MKGVGTRHR

SEQ ID NO: 272675 - protein, 9 aa, Homo Sapiens
VIKVPDFLS

SEQ ID NO: 272676 - protein, 9 aa, Homo Sapiens
LNFSVIADV

SEQ ID NO: 272677 - protein, 9 aa, Homo Sapiens
NPCPDFTPQ

SEQ ID NO: 272678 - protein, 9 aa, Homo Sapiens
KGRVALTGK

SEQ ID NO: 272679 - protein, 9 aa, Homo Sapiens
CQEISNQIR

SEQ ID NO: 272680 - protein, 9 aa, Homo Sapiens
GYGVFSQRF

SEQ ID NO: 272681 - protein, 9 aa, Homo Sapiens
ASLGKITDY

SEQ ID NO: 272682 - protein, 9 aa, Homo Sapiens
PFNTDLQLW

SEQ ID NO: 272683 - protein, 9 aa, Homo Sapiens
PRPGSHTID

SEQ ID NO: 272684 - protein, 9 aa, Homo Sapiens
GDTEGEYNR

SEQ ID NO: 272685 - protein, 9 aa, Homo Sapiens
GKRIASQSG

SEQ ID NO: 272686 - protein, 9 aa, Homo Sapiens
LLCELMDMN

SEQ ID NO: 272687 - protein, 9 aa, Homo Sapiens
SGETQEWER

SEQ ID NO: 272688 - protein, 9 aa, Homo Sapiens
HENPLETNN

SEQ ID NO: 272689 - protein, 9 aa, Homo Sapiens
PSLPPESSM

SEQ ID NO: 272690 - protein, 9 aa, Homo Sapiens
CSHFVPALK

SEQ ID NO: 272691 - protein, 9 aa, Homo Sapiens
EAHDSDILC

SEQ ID NO: 272692 - protein, 9 aa, Homo Sapiens
QFLQRFYKI

SEQ ID NO: 272693 - protein, 9 aa, Homo Sapiens
LRKENKIID

SEQ ID NO: 272694 - protein, 9 aa, Homo Sapiens
NVPPDIQKM

SEQ ID NO: 272695 - protein, 9 aa, Homo Sapiens
NLLDPRETA

SEQ ID NO: 272696 - protein, 9 aa, Homo Sapiens
LTPYLVTAE

SEQ ID NO: 272697 - protein, 9 aa, Homo Sapiens
RRICKSRVS

SEQ ID NO: 272698 - protein, 9 aa, Homo Sapiens
NLDKALSYI

SEQ ID NO: 272699 - protein, 9 aa, Homo Sapiens
PLSITKTLS

SEQ ID NO: 272700 - protein, 9 aa, Homo Sapiens
IKHINCHTT

SEQ ID NO: 272701 - protein, 9 aa, Homo Sapiens
HFPRRPKHM

SEQ ID NO: 272702 - protein, 9 aa, Homo Sapiens
SKDVQNLSV

SEQ ID NO: 272703 - protein, 9 aa, Homo Sapiens
EILQTEDVK

SEQ ID NO: 272704 - protein, 9 aa, Homo Sapiens
EEAECQAKN

SEQ ID NO: 272705 - protein, 9 aa, Homo Sapiens
SLSFTKNTK

SEQ ID NO: 272706 - protein, 9 aa, Homo Sapiens
IYMSTRTNK

SEQ ID NO: 272707 - protein, 9 aa, Homo Sapiens
GKRWQEARG

SEQ ID NO: 272708 - protein, 9 aa, Homo Sapiens
FLLNVMNVL

SEQ ID NO: 272709 - protein, 9 aa, Homo Sapiens
TLQRHASYH

SEQ ID NO: 272710 - protein, 9 aa, Homo Sapiens
NIAHQQHGV

SEQ ID NO: 272711 - protein, 9 aa, Homo Sapiens
GEEHTLAVE

SEQ ID NO: 272712 - protein, 9 aa, Homo Sapiens
HDMLKKGWD

SEQ ID NO: 272713 - protein, 9 aa, Homo Sapiens
LIAVNMVFC

SEQ ID NO: 272714 - protein, 9 aa, Homo Sapiens
IARNGSVVR

SEQ ID NO: 272715 - protein, 9 aa, Homo Sapiens
FTHHCLAHL

SEQ ID NO: 272716 - protein, 9 aa, Homo Sapiens
LTYVKGRKN

SEQ ID NO: 272717 - protein, 9 aa, Homo Sapiens
QWEHMGKRI

SEQ ID NO: 272718 - protein, 9 aa, Homo Sapiens
TYFIRTTEA

SEQ ID NO: 272719 - protein, 9 aa, Homo Sapiens
YPLSLPQAR

SEQ ID NO: 272720 - protein, 9 aa, Homo Sapiens
SSDYPVKTP

SEQ ID NO: 272721 - protein, 9 aa, Homo Sapiens
NDLIMEGVT

SEQ ID NO: 272722 - protein, 9 aa, Homo Sapiens
FYSVELIIT

SEQ ID NO: 272723 - protein, 9 aa, Homo Sapiens
MDLPSLDTA

SEQ ID NO: 272724 - protein, 9 aa, Homo Sapiens
EICYTVVVV

SEQ ID NO: 272725 - protein, 9 aa, Homo Sapiens
EREEQNEQT

SEQ ID NO: 272726 - protein, 9 aa, Homo Sapiens
GDQGSHPRP

SEQ ID NO: 272727 - protein, 9 aa, Homo Sapiens
RQRLRAEAA

SEQ ID NO: 272728 - protein, 9 aa, Homo Sapiens
VGRYIDQYA

SEQ ID NO: 272729 - protein, 9 aa, Homo Sapiens
LGPINFTMF

SEQ ID NO: 272730 - protein, 9 aa, Homo Sapiens
YILEKSSKS

SEQ ID NO: 272731 - protein, 9 aa, Homo Sapiens
QPPQTKALG

SEQ ID NO: 272732 - protein, 9 aa, Homo Sapiens
RRRATAERV

SEQ ID NO: 272733 - protein, 9 aa, Homo Sapiens
SPGSSEFVQ

SEQ ID NO: 272734 - protein, 9 aa, Homo Sapiens
PLISLSTVK

SEQ ID NO: 272735 - protein, 9 aa, Homo Sapiens
LVFYVPGIL

SEQ ID NO: 272736 - protein, 9 aa, Homo Sapiens
RLRRRKVHR

SEQ ID NO: 272737 - protein, 9 aa, Homo Sapiens
YPELQINGF

SEQ ID NO: 272738 - protein, 9 aa, Homo Sapiens
MRTGVEFTK

SEQ ID NO: 272739 - protein, 9 aa, Homo Sapiens
GLDRCSHDL

SEQ ID NO: 272740 - protein, 9 aa, Homo Sapiens
AINWLTGNF

SEQ ID NO: 272741 - protein, 9 aa, Homo Sapiens
STIPVVSAV

SEQ ID NO: 272742 - protein, 9 aa, Homo Sapiens
LYVVAGVSL

SEQ ID NO: 272743 - protein, 9 aa, Homo Sapiens
DTYGNIYNF

SEQ ID NO: 272744 - protein, 9 aa, Homo Sapiens
VHIVSIKDY

SEQ ID NO: 272745 - protein, 9 aa, Homo Sapiens
SFLMTKALL

SEQ ID NO: 272746 - protein, 9 aa, Homo Sapiens
RCYCEDGFK

SEQ ID NO: 272747 - protein, 9 aa, Homo Sapiens
ISRSLFDYH

SEQ ID NO: 272748 - protein, 9 aa, Homo Sapiens
TVITFKQKM

SEQ ID NO: 272749 - protein, 9 aa, Homo Sapiens
EIANTCNAV

SEQ ID NO: 272750 - protein, 9 aa, Homo Sapiens
IDSANMTDD

SEQ ID NO: 272751 - protein, 9 aa, Homo Sapiens
IRKINIRNE

SEQ ID NO: 272752 - protein, 9 aa, Homo Sapiens
AICNNKFFI

SEQ ID NO: 272753 - protein, 9 aa, Homo Sapiens
PKPKWTPLS

SEQ ID NO: 272754 - protein, 9 aa, Homo Sapiens
PTVTIIVDG

SEQ ID NO: 272755 - protein, 9 aa, Homo Sapiens
LKVELSDSE

SEQ ID NO: 272756 - protein, 9 aa, Homo Sapiens
EKFDRQASL

SEQ ID NO: 272757 - protein, 9 aa, Homo Sapiens
QAVAHYKGT

SEQ ID NO: 272758 - protein, 9 aa, Homo Sapiens
PGYGMLSIR

SEQ ID NO: 272759 - protein, 9 aa, Homo Sapiens
QYPFSSPTS

SEQ ID NO: 272760 - protein, 9 aa, Homo Sapiens
EDCLHLNIY

SEQ ID NO: 272761 - protein, 9 aa, Homo Sapiens
YDPDDHPEN

SEQ ID NO: 272762 - protein, 9 aa, Homo Sapiens
ELIEISEGT

SEQ ID NO: 272763 - protein, 9 aa, Homo Sapiens
RLWREEHLD

SEQ ID NO: 272764 - protein, 9 aa, Homo Sapiens
NIKIAVIRA

SEQ ID NO: 272765 - protein, 9 aa, Homo Sapiens
FFGHNVEDE

SEQ ID NO: 272766 - protein, 9 aa, Homo Sapiens
WGLVNTAGI

SEQ ID NO: 272767 - protein, 9 aa, Homo Sapiens
LERKQEQRR

SEQ ID NO: 272768 - protein, 9 aa, Homo Sapiens
KYGSQMESW

SEQ ID NO: 272769 - protein, 9 aa, Homo Sapiens
AHRIPPSYV

SEQ ID NO: 272770 - protein, 9 aa, Homo Sapiens
WGDFTTSTG

SEQ ID NO: 272771 - protein, 9 aa, Homo Sapiens
ANYAKFKKM

SEQ ID NO: 272772 - protein, 9 aa, Homo Sapiens
ELSRTKFRH

SEQ ID NO: 272773 - protein, 9 aa, Homo Sapiens
RKHEITHTG

SEQ ID NO: 272774 - protein, 9 aa, Homo Sapiens
SEVFPDILD

SEQ ID NO: 272775 - protein, 9 aa, Homo Sapiens
PMLSSAFGL

SEQ ID NO: 272776 - protein, 9 aa, Homo Sapiens
QNFQHISPN

SEQ ID NO: 272777 - protein, 9 aa, Homo Sapiens
DIDNIKWEK

SEQ ID NO: 272778 - protein, 9 aa, Homo Sapiens
ENSSTAIVI

SEQ ID NO: 272779 - protein, 9 aa, Homo Sapiens
GCPDERFVF

SEQ ID NO: 272780 - protein, 9 aa, Homo Sapiens
RIHALGGFT

SEQ ID NO: 272781 - protein, 9 aa, Homo Sapiens
LKLLCERND

SEQ ID NO: 272782 - protein, 9 aa, Homo Sapiens
PRPQAPPPS

SEQ ID NO: 272783 - protein, 9 aa, Homo Sapiens
LLDLSAFKF

SEQ ID NO: 272784 - protein, 9 aa, Homo Sapiens
MPTFGKGLN

SEQ ID NO: 272785 - protein, 9 aa, Homo Sapiens
HLAAHNNFE

SEQ ID NO: 272786 - protein, 9 aa, Homo Sapiens
KILPPVKRS

SEQ ID NO: 272787 - protein, 9 aa, Homo Sapiens
LNVDVPISR

SEQ ID NO: 272788 - protein, 9 aa, Homo Sapiens
IYIHTHTFY

SEQ ID NO: 272789 - protein, 9 aa, Homo Sapiens
ETNLQTAPT

SEQ ID NO: 272790 - protein, 9 aa, Homo Sapiens
DRNYIEKEG

SEQ ID NO: 272791 - protein, 9 aa, Homo Sapiens
DAADRERIE

SEQ ID NO: 272792 - protein, 9 aa, Homo Sapiens
IYVYVQDCR

SEQ ID NO: 272793 - protein, 9 aa, Homo Sapiens
GSTLNIHQI

SEQ ID NO: 272794 - protein, 9 aa, Homo Sapiens
RYREFLKLQ

SEQ ID NO: 272795 - protein, 9 aa, Homo Sapiens
QQIHKEKVI

SEQ ID NO: 272796 - protein, 9 aa, Homo Sapiens
VAWQGLEGS

SEQ ID NO: 272797 - protein, 9 aa, Homo Sapiens
LFAGIFYMC

SEQ ID NO: 272798 - protein, 9 aa, Homo Sapiens
RLCTERQKY

SEQ ID NO: 272799 - protein, 9 aa, Homo Sapiens
NHTKRKSST

SEQ ID NO: 272800 - protein, 9 aa, Homo Sapiens
KWIDDEEFF

SEQ ID NO: 272801 - protein, 9 aa, Homo Sapiens
HSPLTLGMR

SEQ ID NO: 272802 - protein, 9 aa, Homo Sapiens
TSSLTKYMT

SEQ ID NO: 272803 - protein, 9 aa, Homo Sapiens
REQYPNTFI

SEQ ID NO: 272804 - protein, 9 aa, Homo Sapiens
RAVDSSAPE

SEQ ID NO: 272805 - protein, 9 aa, Homo Sapiens
HCCDEEIRF

SEQ ID NO: 272806 - protein, 9 aa, Homo Sapiens
PFIYQTSYR

SEQ ID NO: 272807 - protein, 9 aa, Homo Sapiens
DSLRRDIKA

SEQ ID NO: 272808 - protein, 9 aa, Homo Sapiens
LCLGPECLR

SEQ ID NO: 272809 - protein, 9 aa, Homo Sapiens
SRRQCRHSP

SEQ ID NO: 272810 - protein, 9 aa, Homo Sapiens
CHEARDTHH

SEQ ID NO: 272811 - protein, 9 aa, Homo Sapiens
TESLISCWP

SEQ ID NO: 272812 - protein, 9 aa, Homo Sapiens
VLWKNNHNL

SEQ ID NO: 272813 - protein, 9 aa, Homo Sapiens
ITKKNKLVE

SEQ ID NO: 272814 - protein, 9 aa, Homo Sapiens
SGNILHLST

SEQ ID NO: 272815 - protein, 9 aa, Homo Sapiens
TLIIGTGFF

SEQ ID NO: 272816 - protein, 9 aa, Homo Sapiens
ERATSDESI

SEQ ID NO: 272817 - protein, 9 aa, Homo Sapiens
TEENKGGLN

SEQ ID NO: 272818 - protein, 9 aa, Homo Sapiens
FTPEDKVSI

SEQ ID NO: 272819 - protein, 9 aa, Homo Sapiens
MTNVFVTLL

SEQ ID NO: 272820 - protein, 9 aa, Homo Sapiens
SRRPHLPLT

SEQ ID NO: 272821 - protein, 9 aa, Homo Sapiens
NNSLNANFN

SEQ ID NO: 272822 - protein, 9 aa, Homo Sapiens
RVVHNAGPI

SEQ ID NO: 272823 - protein, 9 aa, Homo Sapiens
MFMCCCCCC

SEQ ID NO: 272824 - protein, 9 aa, Homo Sapiens
VVDVPEHRD

SEQ ID NO: 272825 - protein, 9 aa, Homo Sapiens
KSTSREQKK

SEQ ID NO: 272826 - protein, 9 aa, Homo Sapiens
RSTDDQIIV

SEQ ID NO: 272827 - protein, 9 aa, Homo Sapiens
VTFIHGQHS

SEQ ID NO: 272828 - protein, 9 aa, Homo Sapiens
EKTLAQILA

SEQ ID NO: 272829 - protein, 9 aa, Homo Sapiens
FHLGVKAYS

SEQ ID NO: 272830 - protein, 9 aa, Homo Sapiens
GALLGREGY

SEQ ID NO: 272831 - protein, 9 aa, Homo Sapiens
PENRPSFYH

SEQ ID NO: 272832 - protein, 9 aa, Homo Sapiens
EVAKEAQAA

SEQ ID NO: 272833 - protein, 9 aa, Homo Sapiens
ESYQPIKVA

SEQ ID NO: 272834 - protein, 9 aa, Homo Sapiens
VNEALKTGV

SEQ ID NO: 272835 - protein, 9 aa, Homo Sapiens
TFKWTKKEG

SEQ ID NO: 272836 - protein, 9 aa, Homo Sapiens
GHTIWGSVM

SEQ ID NO: 272837 - protein, 9 aa, Homo Sapiens
ILEAMLYAI

SEQ ID NO: 272838 - protein, 9 aa, Homo Sapiens
KAFTKYCKT

SEQ ID NO: 272839 - protein, 9 aa, Homo Sapiens
AFYDKCGKN

SEQ ID NO: 272840 - protein, 9 aa, Homo Sapiens
FYPFVDLIA

SEQ ID NO: 272841 - protein, 9 aa, Homo Sapiens
HTSTSYSVT

SEQ ID NO: 272842 - protein, 9 aa, Homo Sapiens
QRDSKETAP

SEQ ID NO: 272843 - protein, 9 aa, Homo Sapiens
CQRARCQEI

SEQ ID NO: 272844 - protein, 9 aa, Homo Sapiens
KCLSYQGQS

SEQ ID NO: 272845 - protein, 9 aa, Homo Sapiens
IFRLEKVYC

SEQ ID NO: 272846 - protein, 9 aa, Homo Sapiens
PERFPVPSP

SEQ ID NO: 272847 - protein, 9 aa, Homo Sapiens
MMTTASMSL

SEQ ID NO: 272848 - protein, 9 aa, Homo Sapiens
ADLSLDDKL

SEQ ID NO: 272849 - protein, 9 aa, Homo Sapiens
GKELSKMQL

SEQ ID NO: 272850 - protein, 9 aa, Homo Sapiens
SPVFLNGNY

SEQ ID NO: 272851 - protein, 9 aa, Homo Sapiens
DKREWVKIY

SEQ ID NO: 272852 - protein, 9 aa, Homo Sapiens
NSDLIGFKR

SEQ ID NO: 272853 - protein, 9 aa, Homo Sapiens
RYVAICCPI

SEQ ID NO: 272854 - protein, 9 aa, Homo Sapiens
VGTGAESPG

SEQ ID NO: 272855 - protein, 9 aa, Homo Sapiens
RDTGQMFAM

SEQ ID NO: 272856 - protein, 9 aa, Homo Sapiens
ASGEELWPG

SEQ ID NO: 272857 - protein, 9 aa, Homo Sapiens
VHKIIHTGE

SEQ ID NO: 272858 - protein, 9 aa, Homo Sapiens
VVVEDSVFL

SEQ ID NO: 272859 - protein, 9 aa, Homo Sapiens
QNRFASSKE

SEQ ID NO: 272860 - protein, 9 aa, Homo Sapiens
KYQLLNHSA

SEQ ID NO: 272861 - protein, 9 aa, Homo Sapiens
KIVLHEVEV

SEQ ID NO: 272862 - protein, 9 aa, Homo Sapiens
LITEKKDNA

SEQ ID NO: 272863 - protein, 9 aa, Homo Sapiens
RVVICYFGK

SEQ ID NO: 272864 - protein, 9 aa, Homo Sapiens
RQLRKGDKF

SEQ ID NO: 272865 - protein, 9 aa, Homo Sapiens
LLRLFEHGG

SEQ ID NO: 272866 - protein, 9 aa, Homo Sapiens
RIHLQQQPP

SEQ ID NO: 272867 - protein, 9 aa, Homo Sapiens
LGPQSECSG

SEQ ID NO: 272868 - protein, 9 aa, Homo Sapiens
LTADMDAEI

SEQ ID NO: 272869 - protein, 9 aa, Homo Sapiens
KFDEEVHDL

SEQ ID NO: 272870 - protein, 9 aa, Homo Sapiens
CSPLCVIPT

SEQ ID NO: 272871 - protein, 9 aa, Homo Sapiens
AKPYNLYSS

SEQ ID NO: 272872 - protein, 9 aa, Homo Sapiens
IYYIDKAKK

SEQ ID NO: 272873 - protein, 9 aa, Homo Sapiens
MTIVLLLLG

SEQ ID NO: 272874 - protein, 9 aa, Homo Sapiens
RGPENSKNT

SEQ ID NO: 272875 - protein, 9 aa, Homo Sapiens
TGGSTTFCI

SEQ ID NO: 272876 - protein, 9 aa, Homo Sapiens
AHGGYSAFA

SEQ ID NO: 272877 - protein, 9 aa, Homo Sapiens
AIPMPPIQF

SEQ ID NO: 272878 - protein, 9 aa, Homo Sapiens
KAALDNKLP

SEQ ID NO: 272879 - protein, 9 aa, Homo Sapiens
GAEDRLILD

SEQ ID NO: 272880 - protein, 9 aa, Homo Sapiens
RYSLRKKSL

SEQ ID NO: 272881 - protein, 9 aa, Homo Sapiens
EQKLLCGQH

SEQ ID NO: 272882 - protein, 9 aa, Homo Sapiens
TSVENGWIS

SEQ ID NO: 272883 - protein, 9 aa, Homo Sapiens
QQALKDPNQ

SEQ ID NO: 272884 - protein, 9 aa, Homo Sapiens
LQIQSLGMD

SEQ ID NO: 272885 - protein, 9 aa, Homo Sapiens
KTNNFNPPT

SEQ ID NO: 272886 - protein, 9 aa, Homo Sapiens
FSLFTNRNR

SEQ ID NO: 272887 - protein, 9 aa, Homo Sapiens
IAQQWLEYR

SEQ ID NO: 272888 - protein, 9 aa, Homo Sapiens
PKAHISKLA

SEQ ID NO: 272889 - protein, 9 aa, Homo Sapiens
YIGSEAEKN

SEQ ID NO: 272890 - protein, 9 aa, Homo Sapiens
YIYVTYNGQ

SEQ ID NO: 272891 - protein, 9 aa, Homo Sapiens
LNPKWPNAY

SEQ ID NO: 272892 - protein, 9 aa, Homo Sapiens
SKVGFLDHL

SEQ ID NO: 272893 - protein, 9 aa, Homo Sapiens
KKTISPQMN

SEQ ID NO: 272894 - protein, 9 aa, Homo Sapiens
RGQVASSLF

SEQ ID NO: 272895 - protein, 9 aa, Homo Sapiens
SVRKSQGIT

SEQ ID NO: 272896 - protein, 9 aa, Homo Sapiens
LSWLLAKAL

SEQ ID NO: 272897 - protein, 9 aa, Homo Sapiens
NGSQDVGLW

SEQ ID NO: 272898 - protein, 9 aa, Homo Sapiens
LAGDFQMKY

SEQ ID NO: 272899 - protein, 9 aa, Homo Sapiens
TYLDKSTEQ

SEQ ID NO: 272900 - protein, 9 aa, Homo Sapiens
WEKSNPTKH

SEQ ID NO: 272901 - protein, 9 aa, Homo Sapiens
FQDRMIADG

SEQ ID NO: 272902 - protein, 9 aa, Homo Sapiens
QIRKRGNRK

SEQ ID NO: 272903 - protein, 9 aa, Homo Sapiens
YDRGYDCGY

SEQ ID NO: 272904 - protein, 9 aa, Homo Sapiens
QNSAFPPAV

SEQ ID NO: 272905 - protein, 9 aa, Homo Sapiens
SRETEKENG

SEQ ID NO: 272906 - protein, 9 aa, Homo Sapiens
TKIFEEHVT

SEQ ID NO: 272907 - protein, 9 aa, Homo Sapiens
SDACQDPRF

SEQ ID NO: 272908 - protein, 9 aa, Homo Sapiens
HSQAQNSPK

SEQ ID NO: 272909 - protein, 9 aa, Homo Sapiens
QKHNSKPSV

SEQ ID NO: 272910 - protein, 9 aa, Homo Sapiens
TDIQDIQKS

SEQ ID NO: 272911 - protein, 9 aa, Homo Sapiens
DGFIITVTT

SEQ ID NO: 272912 - protein, 9 aa, Homo Sapiens
KHRITHTGE

SEQ ID NO: 272913 - protein, 9 aa, Homo Sapiens
NNIYYGAHV

SEQ ID NO: 272914 - protein, 9 aa, Homo Sapiens
RIPTSNLYP

SEQ ID NO: 272915 - protein, 9 aa, Homo Sapiens
ETLCNWMMC

SEQ ID NO: 272916 - protein, 9 aa, Homo Sapiens
FWRHGRNTC

SEQ ID NO: 272917 - protein, 9 aa, Homo Sapiens
CNFLFTDNC

SEQ ID NO: 272918 - protein, 9 aa, Homo Sapiens
PTPYTSSNS

SEQ ID NO: 272919 - protein, 9 aa, Homo Sapiens
WQIHHSENN

SEQ ID NO: 272920 - protein, 9 aa, Homo Sapiens
EQDMLYNFY

SEQ ID NO: 272921 - protein, 9 aa, Homo Sapiens
EKFMLLIEQ

SEQ ID NO: 272922 - protein, 9 aa, Homo Sapiens
GIEHLSLML

SEQ ID NO: 272923 - protein, 9 aa, Homo Sapiens
GALKNVLAK

SEQ ID NO: 272924 - protein, 9 aa, Homo Sapiens
EEQEKQEIA

SEQ ID NO: 272925 - protein, 9 aa, Homo Sapiens
FSVGEKCAC

SEQ ID NO: 272926 - protein, 9 aa, Homo Sapiens
SRKEKKKKK

SEQ ID NO: 272927 - protein, 9 aa, Homo Sapiens
EYRTESALS

SEQ ID NO: 272928 - protein, 9 aa, Homo Sapiens
FGVAGVEAF

SEQ ID NO: 272929 - protein, 9 aa, Homo Sapiens
IYLLAKIKT

SEQ ID NO: 272930 - protein, 9 aa, Homo Sapiens
VNGGKQFCS

SEQ ID NO: 272931 - protein, 9 aa, Homo Sapiens
EHLEILQTE

SEQ ID NO: 272932 - protein, 9 aa, Homo Sapiens
ERDMHYLPD

SEQ ID NO: 272933 - protein, 9 aa, Homo Sapiens
QYYLSYTEE

SEQ ID NO: 272934 - protein, 9 aa, Homo Sapiens
MRDNVPGEK

SEQ ID NO: 272935 - protein, 9 aa, Homo Sapiens
KTWDIITSI

SEQ ID NO: 272936 - protein, 9 aa, Homo Sapiens
RRAPQDFEH

SEQ ID NO: 272937 - protein, 9 aa, Homo Sapiens
SNGSVKVPA

SEQ ID NO: 272938 - protein, 9 aa, Homo Sapiens
FYSAKNTSK

SEQ ID NO: 272939 - protein, 9 aa, Homo Sapiens
NGNFRGRRY

SEQ ID NO: 272940 - protein, 9 aa, Homo Sapiens
RSHANRVKP

SEQ ID NO: 272941 - protein, 9 aa, Homo Sapiens
NGVFASFVC

SEQ ID NO: 272942 - protein, 9 aa, Homo Sapiens
TNGGIYEGV

SEQ ID NO: 272943 - protein, 9 aa, Homo Sapiens
DPEITINGP

SEQ ID NO: 272944 - protein, 9 aa, Homo Sapiens
NLFKMIKFC

SEQ ID NO: 272945 - protein, 9 aa, Homo Sapiens
RIMTLYQFI

SEQ ID NO: 272946 - protein, 9 aa, Homo Sapiens
DKNGRLYKL

SEQ ID NO: 272947 - protein, 9 aa, Homo Sapiens
FQRCNCGPG

SEQ ID NO: 272948 - protein, 9 aa, Homo Sapiens
HEPERTNKL

SEQ ID NO: 272949 - protein, 9 aa, Homo Sapiens
EAVRDKEVG

SEQ ID NO: 272950 - protein, 9 aa, Homo Sapiens
RVLNNLSPD

SEQ ID NO: 272951 - protein, 9 aa, Homo Sapiens
FTSEPLRQE

SEQ ID NO: 272952 - protein, 9 aa, Homo Sapiens
MVVTAAVLV

SEQ ID NO: 272953 - protein, 9 aa, Homo Sapiens
QDYAPQPYK

SEQ ID NO: 272954 - protein, 9 aa, Homo Sapiens
YGFGQHGLG

SEQ ID NO: 272955 - protein, 9 aa, Homo Sapiens
IVSRLRDDQ

SEQ ID NO: 272956 - protein, 9 aa, Homo Sapiens
DSDKSCRML

SEQ ID NO: 272957 - protein, 9 aa, Homo Sapiens
TICNYFDAT

SEQ ID NO: 272958 - protein, 9 aa, Homo Sapiens
HFMTTAMYD

SEQ ID NO: 272959 - protein, 9 aa, Homo Sapiens
EQQEILLQE

SEQ ID NO: 272960 - protein, 9 aa, Homo Sapiens
LSFIDISII

SEQ ID NO: 272961 - protein, 9 aa, Homo Sapiens
QCLLLSKVL

SEQ ID NO: 272962 - protein, 9 aa, Homo Sapiens
ESREFDMIR

SEQ ID NO: 272963 - protein, 9 aa, Homo Sapiens
SCKGMVTAM

SEQ ID NO: 272964 - protein, 9 aa, Homo Sapiens
VITLDELMA

SEQ ID NO: 272965 - protein, 9 aa, Homo Sapiens
VKADENNVF

SEQ ID NO: 272966 - protein, 9 aa, Homo Sapiens
NNKISGLKN

SEQ ID NO: 272967 - protein, 9 aa, Homo Sapiens
SLHYSTLFC

SEQ ID NO: 272968 - protein, 9 aa, Homo Sapiens
RLLAGAATF

SEQ ID NO: 272969 - protein, 9 aa, Homo Sapiens
GNMNSAISM

SEQ ID NO: 272970 - protein, 9 aa, Homo Sapiens
STDTMPASL

SEQ ID NO: 272971 - protein, 9 aa, Homo Sapiens
QVQSFAPHG

SEQ ID NO: 272972 - protein, 9 aa, Homo Sapiens
SLPMTHNLQ

SEQ ID NO: 272973 - protein, 9 aa, Homo Sapiens
HQQIHTGRK

SEQ ID NO: 272974 - protein, 9 aa, Homo Sapiens
IHFTLIQAV

SEQ ID NO: 272975 - protein, 9 aa, Homo Sapiens
DYLALSQEL

SEQ ID NO: 272976 - protein, 9 aa, Homo Sapiens
PGVVESYEI

SEQ ID NO: 272977 - protein, 9 aa, Homo Sapiens
DAILKSELT

SEQ ID NO: 272978 - protein, 9 aa, Homo Sapiens
KHIKEKQHK

SEQ ID NO: 272979 - protein, 9 aa, Homo Sapiens
FINKIQEAA

SEQ ID NO: 272980 - protein, 9 aa, Homo Sapiens
PYECKQCSN

SEQ ID NO: 272981 - protein, 9 aa, Homo Sapiens
SAVLRAEDI

SEQ ID NO: 272982 - protein, 9 aa, Homo Sapiens
CSKSLHISN

SEQ ID NO: 272983 - protein, 9 aa, Homo Sapiens
LFGFVLKPK

SEQ ID NO: 272984 - protein, 9 aa, Homo Sapiens
RERLVQLPC

SEQ ID NO: 272985 - protein, 9 aa, Homo Sapiens
QIIVSYLWI

SEQ ID NO: 272986 - protein, 9 aa, Homo Sapiens
ELGSLTTAS

SEQ ID NO: 272987 - protein, 9 aa, Homo Sapiens
SVQGVKNMD

SEQ ID NO: 272988 - protein, 9 aa, Homo Sapiens
EYMGMCSMK

SEQ ID NO: 272989 - protein, 9 aa, Homo Sapiens
LLYPVAFGF

SEQ ID NO: 272990 - protein, 9 aa, Homo Sapiens
RDSKVSLQD

SEQ ID NO: 272991 - protein, 9 aa, Homo Sapiens
FQTVCVGTV

SEQ ID NO: 272992 - protein, 9 aa, Homo Sapiens
EGVLYVVKP

SEQ ID NO: 272993 - protein, 9 aa, Homo Sapiens
HCAHFTDEE

SEQ ID NO: 272994 - protein, 9 aa, Homo Sapiens
CLLATDTCF

SEQ ID NO: 272995 - protein, 9 aa, Homo Sapiens
HFIPDLIDY

SEQ ID NO: 272996 - protein, 9 aa, Homo Sapiens
EMGYTSRSE

SEQ ID NO: 272997 - protein, 9 aa, Homo Sapiens
LSSKESMSC

SEQ ID NO: 272998 - protein, 9 aa, Homo Sapiens
DPSHLAYID

SEQ ID NO: 272999 - protein, 9 aa, Homo Sapiens
AVNRQVMMK

SEQ ID NO: 273000 - protein, 9 aa, Homo Sapiens
KKAHKVFIP

SEQ ID NO: 273001 - protein, 9 aa, Homo Sapiens
ILCVQSDYT

SEQ ID NO: 273002 - protein, 9 aa, Homo Sapiens
FLPLIDMLV

SEQ ID NO: 273003 - protein, 9 aa, Homo Sapiens
MDAENNIEN

SEQ ID NO: 273004 - protein, 9 aa, Homo Sapiens
EIMFAKTLE

SEQ ID NO: 273005 - protein, 9 aa, Homo Sapiens
SEEVKTQEE

SEQ ID NO: 273006 - protein, 9 aa, Homo Sapiens
RLDQRHSKL

SEQ ID NO: 273007 - protein, 9 aa, Homo Sapiens
IKKLLVSIT

SEQ ID NO: 273008 - protein, 9 aa, Homo Sapiens
PDSCPPVPG

SEQ ID NO: 273009 - protein, 9 aa, Homo Sapiens
CCLTECTKE

SEQ ID NO: 273010 - protein, 9 aa, Homo Sapiens
SQNIDAYHN

SEQ ID NO: 273011 - protein, 9 aa, Homo Sapiens
LSRLPQTPK

SEQ ID NO: 273012 - protein, 9 aa, Homo Sapiens
WSAGLTPYL

SEQ ID NO: 273013 - protein, 9 aa, Homo Sapiens
EVDFNEMSV

SEQ ID NO: 273014 - protein, 9 aa, Homo Sapiens
TNLKCKMSL

SEQ ID NO: 273015 - protein, 9 aa, Homo Sapiens
AEFQMKEFL

SEQ ID NO: 273016 - protein, 9 aa, Homo Sapiens
AEAAQAKRE

SEQ ID NO: 273017 - protein, 9 aa, Homo Sapiens
VQSVNHTKR

SEQ ID NO: 273018 - protein, 9 aa, Homo Sapiens
DIPSIITKN

SEQ ID NO: 273019 - protein, 9 aa, Homo Sapiens
EYFQKAAQG

SEQ ID NO: 273020 - protein, 9 aa, Homo Sapiens
CDLRVLGKL

SEQ ID NO: 273021 - protein, 9 aa, Homo Sapiens
KMDLLQGAG

SEQ ID NO: 273022 - protein, 9 aa, Homo Sapiens
KLFEQILKV

SEQ ID NO: 273023 - protein, 9 aa, Homo Sapiens
DSEKLVWVL

SEQ ID NO: 273024 - protein, 9 aa, Homo Sapiens
EILNRGPEN

SEQ ID NO: 273025 - protein, 9 aa, Homo Sapiens
DKTFIFICK

SEQ ID NO: 273026 - protein, 9 aa, Homo Sapiens
ECEKAFSQY

SEQ ID NO: 273027 - protein, 9 aa, Homo Sapiens
TGTAVSTIS

SEQ ID NO: 273028 - protein, 9 aa, Homo Sapiens
IEKLIDNPR

SEQ ID NO: 273029 - protein, 9 aa, Homo Sapiens
GISMHGKIP

SEQ ID NO: 273030 - protein, 9 aa, Homo Sapiens
KKASTRRKR

SEQ ID NO: 273031 - protein, 9 aa, Homo Sapiens
TQDKIIHTG

SEQ ID NO: 273032 - protein, 9 aa, Homo Sapiens
ARGKRNGKN

SEQ ID NO: 273033 - protein, 9 aa, Homo Sapiens
PNLDTCALH

SEQ ID NO: 273034 - protein, 9 aa, Homo Sapiens
TVVRYPIKR

SEQ ID NO: 273035 - protein, 9 aa, Homo Sapiens
LDFLDAELD

SEQ ID NO: 273036 - protein, 9 aa, Homo Sapiens
CDEGKCYCK

SEQ ID NO: 273037 - protein, 9 aa, Homo Sapiens
GAKIVYLPE

SEQ ID NO: 273038 - protein, 9 aa, Homo Sapiens
KEKDKHKHE

SEQ ID NO: 273039 - protein, 9 aa, Homo Sapiens
CFGCMKAAP

SEQ ID NO: 273040 - protein, 9 aa, Homo Sapiens
LANYRYGRE

SEQ ID NO: 273041 - protein, 9 aa, Homo Sapiens
KSWLRHPGI

SEQ ID NO: 273042 - protein, 9 aa, Homo Sapiens
VCTLRCLGL

SEQ ID NO: 273043 - protein, 9 aa, Homo Sapiens
LHLEPFKAL

SEQ ID NO: 273044 - protein, 9 aa, Homo Sapiens
TYLDRLLSL

SEQ ID NO: 273045 - protein, 9 aa, Homo Sapiens
ANSGYKWCP

SEQ ID NO: 273046 - protein, 9 aa, Homo Sapiens
FVSSVTIPK

SEQ ID NO: 273047 - protein, 9 aa, Homo Sapiens
MKKFAEAFE

SEQ ID NO: 273048 - protein, 9 aa, Homo Sapiens
QSVSDITLQ

SEQ ID NO: 273049 - protein, 9 aa, Homo Sapiens
HNITGNPYY

SEQ ID NO: 273050 - protein, 9 aa, Homo Sapiens
NYLSGSKSM

SEQ ID NO: 273051 - protein, 9 aa, Homo Sapiens
PNITPAGTS

SEQ ID NO: 273052 - protein, 9 aa, Homo Sapiens
ERKLKKAKA

SEQ ID NO: 273053 - protein, 9 aa, Homo Sapiens
RAQDIYVKT

SEQ ID NO: 273054 - protein, 9 aa, Homo Sapiens
GHGVVLSES

SEQ ID NO: 273055 - protein, 9 aa, Homo Sapiens
FDQHQIIHF

SEQ ID NO: 273056 - protein, 9 aa, Homo Sapiens
RCRAFNYYP

SEQ ID NO: 273057 - protein, 9 aa, Homo Sapiens
IQYQEQINN

SEQ ID NO: 273058 - protein, 9 aa, Homo Sapiens
AINNERKAL

SEQ ID NO: 273059 - protein, 9 aa, Homo Sapiens
YSKDSYGVI

SEQ ID NO: 273060 - protein, 9 aa, Homo Sapiens
QVQINPTST

SEQ ID NO: 273061 - protein, 9 aa, Homo Sapiens
LAWGLESRV

SEQ ID NO: 273062 - protein, 9 aa, Homo Sapiens
AACCQDEKA

SEQ ID NO: 273063 - protein, 9 aa, Homo Sapiens
RGKAKRRNQ

SEQ ID NO: 273064 - protein, 9 aa, Homo Sapiens
CKDEGQLIC

SEQ ID NO: 273065 - protein, 9 aa, Homo Sapiens
DKDNENFLS

SEQ ID NO: 273066 - protein, 9 aa, Homo Sapiens
LLLPSGSKG

SEQ ID NO: 273067 - protein, 9 aa, Homo Sapiens
HEMLLSKVK

SEQ ID NO: 273068 - protein, 9 aa, Homo Sapiens
FLTSKNCIH

SEQ ID NO: 273069 - protein, 9 aa, Homo Sapiens
IGLGSIASL

SEQ ID NO: 273070 - protein, 9 aa, Homo Sapiens
HIPSDGHCM

SEQ ID NO: 273071 - protein, 9 aa, Homo Sapiens
NEDLISDAT

SEQ ID NO: 273072 - protein, 9 aa, Homo Sapiens
EMSQAKKLL

SEQ ID NO: 273073 - protein, 9 aa, Homo Sapiens
GDKFVLKEG

SEQ ID NO: 273074 - protein, 9 aa, Homo Sapiens
FRKVIQTQG

SEQ ID NO: 273075 - protein, 9 aa, Homo Sapiens
KYNVDNVPR

SEQ ID NO: 273076 - protein, 9 aa, Homo Sapiens
GHSFPMRYM

SEQ ID NO: 273077 - protein, 9 aa, Homo Sapiens
TTSLEKVYD

SEQ ID NO: 273078 - protein, 9 aa, Homo Sapiens
FSFSSSFQM

SEQ ID NO: 273079 - protein, 9 aa, Homo Sapiens
QFLDFGFSN

SEQ ID NO: 273080 - protein, 9 aa, Homo Sapiens
EEVTKYQPE

SEQ ID NO: 273081 - protein, 9 aa, Homo Sapiens
ASTFGLLEI

SEQ ID NO: 273082 - protein, 9 aa, Homo Sapiens
RIEHAGANY

SEQ ID NO: 273083 - protein, 9 aa, Homo Sapiens
IKSRDNEII

SEQ ID NO: 273084 - protein, 9 aa, Homo Sapiens
RTISTTLGK

SEQ ID NO: 273085 - protein, 9 aa, Homo Sapiens
NEASQYGRF

SEQ ID NO: 273086 - protein, 9 aa, Homo Sapiens
PEDKPEDVL

SEQ ID NO: 273087 - protein, 9 aa, Homo Sapiens
FNNFPRQYF

SEQ ID NO: 273088 - protein, 9 aa, Homo Sapiens
GPKPRFHEV

SEQ ID NO: 273089 - protein, 9 aa, Homo Sapiens
FTLELKLNS

SEQ ID NO: 273090 - protein, 9 aa, Homo Sapiens
VSQAGLRSE

SEQ ID NO: 273091 - protein, 9 aa, Homo Sapiens
FIDFSDTEE

SEQ ID NO: 273092 - protein, 9 aa, Homo Sapiens
DNSHLRTEK

SEQ ID NO: 273093 - protein, 9 aa, Homo Sapiens
HEDHDDLEK

SEQ ID NO: 273094 - protein, 9 aa, Homo Sapiens
FLASKANFC

SEQ ID NO: 273095 - protein, 9 aa, Homo Sapiens
SAQFLLLLQ

SEQ ID NO: 273096 - protein, 9 aa, Homo Sapiens
DASTENSEN

SEQ ID NO: 273097 - protein, 9 aa, Homo Sapiens
FKGEAGGLM

SEQ ID NO: 273098 - protein, 9 aa, Homo Sapiens
VCMERGKAF

SEQ ID NO: 273099 - protein, 9 aa, Homo Sapiens
QAKLLLGQV

SEQ ID NO: 273100 - protein, 9 aa, Homo Sapiens
DTISDRLQI

SEQ ID NO: 273101 - protein, 9 aa, Homo Sapiens
LTEDKKNGI

SEQ ID NO: 273102 - protein, 9 aa, Homo Sapiens
PDKPIDREK

SEQ ID NO: 273103 - protein, 9 aa, Homo Sapiens
LFNIKKFTL

SEQ ID NO: 273104 - protein, 9 aa, Homo Sapiens
NPHLRIISL

SEQ ID NO: 273105 - protein, 9 aa, Homo Sapiens
IRAKLCPRP

SEQ ID NO: 273106 - protein, 9 aa, Homo Sapiens
CTPQNPPQN

SEQ ID NO: 273107 - protein, 9 aa, Homo Sapiens
DHARTPELS

SEQ ID NO: 273108 - protein, 9 aa, Homo Sapiens
LHLGAADRW

SEQ ID NO: 273109 - protein, 9 aa, Homo Sapiens
TFTRGSPGQ

SEQ ID NO: 273110 - protein, 9 aa, Homo Sapiens
EKYLYFYKK

SEQ ID NO: 273111 - protein, 9 aa, Homo Sapiens
NLQSSKKRF

SEQ ID NO: 273112 - protein, 9 aa, Homo Sapiens
VESVADIFD

SEQ ID NO: 273113 - protein, 9 aa, Homo Sapiens
SSFFGGSGS

SEQ ID NO: 273114 - protein, 9 aa, Homo Sapiens
LSTIQSKLF

SEQ ID NO: 273115 - protein, 9 aa, Homo Sapiens
RALLRCRRT

SEQ ID NO: 273116 - protein, 9 aa, Homo Sapiens
LADLEVLVK

SEQ ID NO: 273117 - protein, 9 aa, Homo Sapiens
SPGVVWFKY

SEQ ID NO: 273118 - protein, 9 aa, Homo Sapiens
DDEGLYAVS

SEQ ID NO: 273119 - protein, 9 aa, Homo Sapiens
YLLCDVLPE

SEQ ID NO: 273120 - protein, 9 aa, Homo Sapiens
KEARSKCRQ

SEQ ID NO: 273121 - protein, 9 aa, Homo Sapiens
LVMKHLPGP

SEQ ID NO: 273122 - protein, 9 aa, Homo Sapiens
VQHILAAMI

SEQ ID NO: 273123 - protein, 9 aa, Homo Sapiens
IGLPPARWT

SEQ ID NO: 273124 - protein, 9 aa, Homo Sapiens
QCEDIDECS

SEQ ID NO: 273125 - protein, 9 aa, Homo Sapiens
PTLGLFSNC

SEQ ID NO: 273126 - protein, 9 aa, Homo Sapiens
LGKCLGPFL

SEQ ID NO: 273127 - protein, 9 aa, Homo Sapiens
LLNELHKFL

SEQ ID NO: 273128 - protein, 9 aa, Homo Sapiens
VVDYSEQYQ

SEQ ID NO: 273129 - protein, 9 aa, Homo Sapiens
PETAVILAS

SEQ ID NO: 273130 - protein, 9 aa, Homo Sapiens
YLHLEGDPN

SEQ ID NO: 273131 - protein, 9 aa, Homo Sapiens
MLSDDKSKS

SEQ ID NO: 273132 - protein, 9 aa, Homo Sapiens
KRRIEDFSS

SEQ ID NO: 273133 - protein, 9 aa, Homo Sapiens
QSPFREISK

SEQ ID NO: 273134 - protein, 9 aa, Homo Sapiens
RGFSQKSHT

SEQ ID NO: 273135 - protein, 9 aa, Homo Sapiens
HILAAMIAK

SEQ ID NO: 273136 - protein, 9 aa, Homo Sapiens
RSPEDPTDD

SEQ ID NO: 273137 - protein, 9 aa, Homo Sapiens
QYYKKPIQE

SEQ ID NO: 273138 - protein, 9 aa, Homo Sapiens
LQLDEELRR

SEQ ID NO: 273139 - protein, 9 aa, Homo Sapiens
VKPVLFNSK

SEQ ID NO: 273140 - protein, 9 aa, Homo Sapiens
HNNIRYLIQ

SEQ ID NO: 273141 - protein, 9 aa, Homo Sapiens
DSADQMLTY

SEQ ID NO: 273142 - protein, 9 aa, Homo Sapiens
TEAIESDSF

SEQ ID NO: 273143 - protein, 9 aa, Homo Sapiens
SSTNGSSGS

SEQ ID NO: 273144 - protein, 9 aa, Homo Sapiens
SPAVDKGRF

SEQ ID NO: 273145 - protein, 9 aa, Homo Sapiens
KILASAPTV

SEQ ID NO: 273146 - protein, 9 aa, Homo Sapiens
RFKGSLMTK

SEQ ID NO: 273147 - protein, 9 aa, Homo Sapiens
LGLRMEEII

SEQ ID NO: 273148 - protein, 9 aa, Homo Sapiens
AGLHKHRIT

SEQ ID NO: 273149 - protein, 9 aa, Homo Sapiens
KDKEKYSEK

SEQ ID NO: 273150 - protein, 9 aa, Homo Sapiens
SGIVMQIID

SEQ ID NO: 273151 - protein, 9 aa, Homo Sapiens
PFILKPTLN

SEQ ID NO: 273152 - protein, 9 aa, Homo Sapiens
MLCPQRDNW

SEQ ID NO: 273153 - protein, 9 aa, Homo Sapiens
DLITRLLCL

SEQ ID NO: 273154 - protein, 9 aa, Homo Sapiens
IITSLTVLV

SEQ ID NO: 273155 - protein, 9 aa, Homo Sapiens
PTCSRLTSS

SEQ ID NO: 273156 - protein, 9 aa, Homo Sapiens
KCQKIQREL

SEQ ID NO: 273157 - protein, 9 aa, Homo Sapiens
RLNIFFSSA

SEQ ID NO: 273158 - protein, 9 aa, Homo Sapiens
KLFSSEKIM

SEQ ID NO: 273159 - protein, 9 aa, Homo Sapiens
VSQHLGEYE

SEQ ID NO: 273160 - protein, 9 aa, Homo Sapiens
KIGNGQAGV

SEQ ID NO: 273161 - protein, 9 aa, Homo Sapiens
SVSPHLHAP

SEQ ID NO: 273162 - protein, 9 aa, Homo Sapiens
FKYVEYFWW

SEQ ID NO: 273163 - protein, 9 aa, Homo Sapiens
ASFKSTKSA

SEQ ID NO: 273164 - protein, 9 aa, Homo Sapiens
TLLAIAMVA

SEQ ID NO: 273165 - protein, 9 aa, Homo Sapiens
LRLEQEVAW

SEQ ID NO: 273166 - protein, 9 aa, Homo Sapiens
NKLASFSFD

SEQ ID NO: 273167 - protein, 9 aa, Homo Sapiens
FHPIEPVFI

SEQ ID NO: 273168 - protein, 9 aa, Homo Sapiens
HPKIANIFE

SEQ ID NO: 273169 - protein, 9 aa, Homo Sapiens
DSESEASEN

SEQ ID NO: 273170 - protein, 9 aa, Homo Sapiens
TSDSNHQRK

SEQ ID NO: 273171 - protein, 9 aa, Homo Sapiens
KKEAEEKAC

SEQ ID NO: 273172 - protein, 9 aa, Homo Sapiens
VTIIVDGKM

SEQ ID NO: 273173 - protein, 9 aa, Homo Sapiens
THIYIHTHT

SEQ ID NO: 273174 - protein, 9 aa, Homo Sapiens
TSLPTELGG

SEQ ID NO: 273175 - protein, 9 aa, Homo Sapiens
ICDELCKNG

SEQ ID NO: 273176 - protein, 9 aa, Homo Sapiens
SNADIKSSE

SEQ ID NO: 273177 - protein, 9 aa, Homo Sapiens
SANLTTHKI

SEQ ID NO: 273178 - protein, 9 aa, Homo Sapiens
KRREITDKK

SEQ ID NO: 273179 - protein, 9 aa, Homo Sapiens
ETKLEAIAR

SEQ ID NO: 273180 - protein, 9 aa, Homo Sapiens
RRVHGGQVN

SEQ ID NO: 273181 - protein, 9 aa, Homo Sapiens
GSYMFRHVD

SEQ ID NO: 273182 - protein, 9 aa, Homo Sapiens
YLNNVAETA

SEQ ID NO: 273183 - protein, 9 aa, Homo Sapiens
SSKNELHYL

SEQ ID NO: 273184 - protein, 9 aa, Homo Sapiens
CLLTPLPST

SEQ ID NO: 273185 - protein, 9 aa, Homo Sapiens
TAEEILSWS

SEQ ID NO: 273186 - protein, 9 aa, Homo Sapiens
VETNSFSKM

SEQ ID NO: 273187 - protein, 9 aa, Homo Sapiens
AVILNLWKA

SEQ ID NO: 273188 - protein, 9 aa, Homo Sapiens
DVPESILLE

SEQ ID NO: 273189 - protein, 9 aa, Homo Sapiens
CARSWVTVL

SEQ ID NO: 273190 - protein, 9 aa, Homo Sapiens
PALAYHVAR

SEQ ID NO: 273191 - protein, 9 aa, Homo Sapiens
KLDREELCD

SEQ ID NO: 273192 - protein, 9 aa, Homo Sapiens
SQIDNINLT

SEQ ID NO: 273193 - protein, 9 aa, Homo Sapiens
LQKVSMDNR

SEQ ID NO: 273194 - protein, 9 aa, Homo Sapiens
KNEAADPQA

SEQ ID NO: 273195 - protein, 9 aa, Homo Sapiens
SAGKNKNNF

SEQ ID NO: 273196 - protein, 9 aa, Homo Sapiens
TRAAERVEA

SEQ ID NO: 273197 - protein, 9 aa, Homo Sapiens
QKVGLYQRQ

SEQ ID NO: 273198 - protein, 9 aa, Homo Sapiens
SNLPLPVPP

SEQ ID NO: 273199 - protein, 9 aa, Homo Sapiens
QDESLKHRE

SEQ ID NO: 273200 - protein, 9 aa, Homo Sapiens
ELENTLKAA

SEQ ID NO: 273201 - protein, 9 aa, Homo Sapiens
VQGIGWHLD

SEQ ID NO: 273202 - protein, 9 aa, Homo Sapiens
SQKNVKAKN

SEQ ID NO: 273203 - protein, 9 aa, Homo Sapiens
WCLWRPQGA

SEQ ID NO: 273204 - protein, 9 aa, Homo Sapiens
NKEPANDES

SEQ ID NO: 273205 - protein, 9 aa, Homo Sapiens
SSICKYNAD

SEQ ID NO: 273206 - protein, 9 aa, Homo Sapiens
DNREKSKRD

SEQ ID NO: 273207 - protein, 9 aa, Homo Sapiens
KEYIKPHVR

SEQ ID NO: 273208 - protein, 9 aa, Homo Sapiens
KKDSSCIRI

SEQ ID NO: 273209 - protein, 9 aa, Homo Sapiens
ILYFRVPVR

SEQ ID NO: 273210 - protein, 9 aa, Homo Sapiens
LGRLVWLGL

SEQ ID NO: 273211 - protein, 9 aa, Homo Sapiens
KCNVQKTRF

SEQ ID NO: 273212 - protein, 9 aa, Homo Sapiens
KIHTEEKPF

SEQ ID NO: 273213 - protein, 9 aa, Homo Sapiens
ELWPGSSSS

SEQ ID NO: 273214 - protein, 9 aa, Homo Sapiens
APAVVLHMT

SEQ ID NO: 273215 - protein, 9 aa, Homo Sapiens
KQNLKSEVM

SEQ ID NO: 273216 - protein, 9 aa, Homo Sapiens
LPLGSPQIP

SEQ ID NO: 273217 - protein, 9 aa, Homo Sapiens
FEYYARTWY

SEQ ID NO: 273218 - protein, 9 aa, Homo Sapiens
LLTSESRSK

SEQ ID NO: 273219 - protein, 9 aa, Homo Sapiens
ESEASENKC

SEQ ID NO: 273220 - protein, 9 aa, Homo Sapiens
TSRVTSTDH

SEQ ID NO: 273221 - protein, 9 aa, Homo Sapiens
TCDWKVDCR

SEQ ID NO: 273222 - protein, 9 aa, Homo Sapiens
MKYRDSTPT

SEQ ID NO: 273223 - protein, 9 aa, Homo Sapiens
GPAKEPRVT

SEQ ID NO: 273224 - protein, 9 aa, Homo Sapiens
GDLTKENKD

SEQ ID NO: 273225 - protein, 9 aa, Homo Sapiens
PKSINVFFK

SEQ ID NO: 273226 - protein, 9 aa, Homo Sapiens
QTEVSYLEI

SEQ ID NO: 273227 - protein, 9 aa, Homo Sapiens
EGDADEKRF

SEQ ID NO: 273228 - protein, 9 aa, Homo Sapiens
FQSLLETHN

SEQ ID NO: 273229 - protein, 9 aa, Homo Sapiens
KWIRPIKTT

SEQ ID NO: 273230 - protein, 9 aa, Homo Sapiens
KGTNYLANV

SEQ ID NO: 273231 - protein, 9 aa, Homo Sapiens
DRYASDNVN

SEQ ID NO: 273232 - protein, 9 aa, Homo Sapiens
KRKEQTETH

SEQ ID NO: 273233 - protein, 9 aa, Homo Sapiens
EAIHFGAFT

SEQ ID NO: 273234 - protein, 9 aa, Homo Sapiens
IPVYRFVIP

SEQ ID NO: 273235 - protein, 9 aa, Homo Sapiens
EKQTKWKHY

SEQ ID NO: 273236 - protein, 9 aa, Homo Sapiens
MFYFPAASP

SEQ ID NO: 273237 - protein, 9 aa, Homo Sapiens
VGADTTPYL

SEQ ID NO: 273238 - protein, 9 aa, Homo Sapiens
KEIPPKKEA

SEQ ID NO: 273239 - protein, 9 aa, Homo Sapiens
TVLDQPISL

SEQ ID NO: 273240 - protein, 9 aa, Homo Sapiens
AQPTSARRK

SEQ ID NO: 273241 - protein, 9 aa, Homo Sapiens
SRYSRCHSS

SEQ ID NO: 273242 - protein, 9 aa, Homo Sapiens
CKQQCAFDQ

SEQ ID NO: 273243 - protein, 9 aa, Homo Sapiens
LQHFNSYDI

SEQ ID NO: 273244 - protein, 9 aa, Homo Sapiens
VLELVPDIN

SEQ ID NO: 273245 - protein, 9 aa, Homo Sapiens
STNIVSENT

SEQ ID NO: 273246 - protein, 9 aa, Homo Sapiens
QPRLVVLQG

SEQ ID NO: 273247 - protein, 9 aa, Homo Sapiens
CPTTTPSLP

SEQ ID NO: 273248 - protein, 9 aa, Homo Sapiens
YVATLLMTI

SEQ ID NO: 273249 - protein, 9 aa, Homo Sapiens
LPEKLTALK

SEQ ID NO: 273250 - protein, 9 aa, Homo Sapiens
ATSLDDKVV

SEQ ID NO: 273251 - protein, 9 aa, Homo Sapiens
KLGVPVFYH

SEQ ID NO: 273252 - protein, 9 aa, Homo Sapiens
AKKGELRKS

SEQ ID NO: 273253 - protein, 9 aa, Homo Sapiens
HELKVHDML

SEQ ID NO: 273254 - protein, 9 aa, Homo Sapiens
WVGPQRCPV

SEQ ID NO: 273255 - protein, 9 aa, Homo Sapiens
LGMRVAFPD

SEQ ID NO: 273256 - protein, 9 aa, Homo Sapiens
ICVLLHGSS

SEQ ID NO: 273257 - protein, 9 aa, Homo Sapiens
CAESMATEG

SEQ ID NO: 273258 - protein, 9 aa, Homo Sapiens
VISEFVEHH

SEQ ID NO: 273259 - protein, 9 aa, Homo Sapiens
VNKGTETRP

SEQ ID NO: 273260 - protein, 9 aa, Homo Sapiens
PAELYPHIV

SEQ ID NO: 273261 - protein, 9 aa, Homo Sapiens
DHAYRVFKT

SEQ ID NO: 273262 - protein, 9 aa, Homo Sapiens
VCLTKNSTL

SEQ ID NO: 273263 - protein, 9 aa, Homo Sapiens
KYLLGEFKA

SEQ ID NO: 273264 - protein, 9 aa, Homo Sapiens
SIGSAIVAV

SEQ ID NO: 273265 - protein, 9 aa, Homo Sapiens
YVTDFVDLG

SEQ ID NO: 273266 - protein, 9 aa, Homo Sapiens
GPNQLDNLF

SEQ ID NO: 273267 - protein, 9 aa, Homo Sapiens
PNPQAFRAC

SEQ ID NO: 273268 - protein, 9 aa, Homo Sapiens
DECGNTFSV

SEQ ID NO: 273269 - protein, 9 aa, Homo Sapiens
SGQVVEHLM

SEQ ID NO: 273270 - protein, 9 aa, Homo Sapiens
FYNFRMFFT

SEQ ID NO: 273271 - protein, 9 aa, Homo Sapiens
LRYFLERYC

SEQ ID NO: 273272 - protein, 9 aa, Homo Sapiens
MPHRVCSIM

SEQ ID NO: 273273 - protein, 9 aa, Homo Sapiens
ILASNLAQF

SEQ ID NO: 273274 - protein, 9 aa, Homo Sapiens
KTMLLKSNC

SEQ ID NO: 273275 - protein, 9 aa, Homo Sapiens
ASLARNCMW

SEQ ID NO: 273276 - protein, 9 aa, Homo Sapiens
GAFVCQSTL

SEQ ID NO: 273277 - protein, 9 aa, Homo Sapiens
LMRKRWKRS

SEQ ID NO: 273278 - protein, 9 aa, Homo Sapiens
SSQVKYSRL

SEQ ID NO: 273279 - protein, 9 aa, Homo Sapiens
TMMGNVGMI

SEQ ID NO: 273280 - protein, 9 aa, Homo Sapiens
SGRLCGFLK

SEQ ID NO: 273281 - protein, 9 aa, Homo Sapiens
QEKDKEKEK

SEQ ID NO: 273282 - protein, 9 aa, Homo Sapiens
VYIVAFLGN

SEQ ID NO: 273283 - protein, 9 aa, Homo Sapiens
EEIEFRNAI

SEQ ID NO: 273284 - protein, 9 aa, Homo Sapiens
KVQLKELET

SEQ ID NO: 273285 - protein, 9 aa, Homo Sapiens
LALSLQVCL

SEQ ID NO: 273286 - protein, 9 aa, Homo Sapiens
ASSCSISED

SEQ ID NO: 273287 - protein, 9 aa, Homo Sapiens
TEISLDEQV

SEQ ID NO: 273288 - protein, 9 aa, Homo Sapiens
QSAGGINTG

SEQ ID NO: 273289 - protein, 9 aa, Homo Sapiens
YILAGVNIV

SEQ ID NO: 273290 - protein, 9 aa, Homo Sapiens
DDAEKLGFS

SEQ ID NO: 273291 - protein, 9 aa, Homo Sapiens
VVLKTQETA

SEQ ID NO: 273292 - protein, 9 aa, Homo Sapiens
EELDLRRNI

SEQ ID NO: 273293 - protein, 9 aa, Homo Sapiens
LKGRGRDIR

SEQ ID NO: 273294 - protein, 9 aa, Homo Sapiens
GVFKRKKED

SEQ ID NO: 273295 - protein, 9 aa, Homo Sapiens
VINRKIPYI

SEQ ID NO: 273296 - protein, 9 aa, Homo Sapiens
ICKQEIEDR

SEQ ID NO: 273297 - protein, 9 aa, Homo Sapiens
DILCLEYSK

SEQ ID NO: 273298 - protein, 9 aa, Homo Sapiens
KQLENSPLG

SEQ ID NO: 273299 - protein, 9 aa, Homo Sapiens
DGSWREGDK

SEQ ID NO: 273300 - protein, 9 aa, Homo Sapiens
IEYPELQIN

SEQ ID NO: 273301 - protein, 9 aa, Homo Sapiens
DSKLVPPSQ

SEQ ID NO: 273302 - protein, 9 aa, Homo Sapiens
DPRETAIMD

SEQ ID NO: 273303 - protein, 9 aa, Homo Sapiens
GYIHKLIVT

SEQ ID NO: 273304 - protein, 9 aa, Homo Sapiens
SMADAVLAQ

SEQ ID NO: 273305 - protein, 9 aa, Homo Sapiens
YHIVYQLCA

SEQ ID NO: 273306 - protein, 9 aa, Homo Sapiens
NNKITKIKD

SEQ ID NO: 273307 - protein, 9 aa, Homo Sapiens
VELPITKYP

SEQ ID NO: 273308 - protein, 9 aa, Homo Sapiens
VKVIGISNF

SEQ ID NO: 273309 - protein, 9 aa, Homo Sapiens
EVKAHTAPV

SEQ ID NO: 273310 - protein, 9 aa, Homo Sapiens
QAARQKNIS

SEQ ID NO: 273311 - protein, 9 aa, Homo Sapiens
TVTWKADVT

SEQ ID NO: 273312 - protein, 9 aa, Homo Sapiens
YIAGLLGLA

SEQ ID NO: 273313 - protein, 9 aa, Homo Sapiens
VKRVKETEA

SEQ ID NO: 273314 - protein, 9 aa, Homo Sapiens
LFSKKSDCS

SEQ ID NO: 273315 - protein, 9 aa, Homo Sapiens
MSCGTIVVA

SEQ ID NO: 273316 - protein, 9 aa, Homo Sapiens
IVGKKFKLP

SEQ ID NO: 273317 - protein, 9 aa, Homo Sapiens
GTPGSHNLE

SEQ ID NO: 273318 - protein, 9 aa, Homo Sapiens
KVFPALVAR

SEQ ID NO: 273319 - protein, 9 aa, Homo Sapiens
KREMGMYSI

SEQ ID NO: 273320 - protein, 9 aa, Homo Sapiens
EPDAVLQTR

SEQ ID NO: 273321 - protein, 9 aa, Homo Sapiens
KIITGLLEC

SEQ ID NO: 273322 - protein, 9 aa, Homo Sapiens
SFFQYEREK

SEQ ID NO: 273323 - protein, 9 aa, Homo Sapiens
ECAKTLISL

SEQ ID NO: 273324 - protein, 9 aa, Homo Sapiens
TSITTAIRE

SEQ ID NO: 273325 - protein, 9 aa, Homo Sapiens
YTPKKYQVE

SEQ ID NO: 273326 - protein, 9 aa, Homo Sapiens
GLGFAIYWF

SEQ ID NO: 273327 - protein, 9 aa, Homo Sapiens
SNKLIAEQL

SEQ ID NO: 273328 - protein, 9 aa, Homo Sapiens
EQAAKNLAK

SEQ ID NO: 273329 - protein, 9 aa, Homo Sapiens
KNFSQSQYL

SEQ ID NO: 273330 - protein, 9 aa, Homo Sapiens
IVSRNFGSY

SEQ ID NO: 273331 - protein, 9 aa, Homo Sapiens
HSSPEMPTT

SEQ ID NO: 273332 - protein, 9 aa, Homo Sapiens
PYECKYCRK

SEQ ID NO: 273333 - protein, 9 aa, Homo Sapiens
LLQSRLGDR

SEQ ID NO: 273334 - protein, 9 aa, Homo Sapiens
EGHECAVWL

SEQ ID NO: 273335 - protein, 9 aa, Homo Sapiens
SVETEGNKE

SEQ ID NO: 273336 - protein, 9 aa, Homo Sapiens
LAKSHPLID

SEQ ID NO: 273337 - protein, 9 aa, Homo Sapiens
KNISFLCRE

SEQ ID NO: 273338 - protein, 9 aa, Homo Sapiens
GPRYVVGCH

SEQ ID NO: 273339 - protein, 9 aa, Homo Sapiens
YLVETFVSK

SEQ ID NO: 273340 - protein, 9 aa, Homo Sapiens
EGGVTWIGF

SEQ ID NO: 273341 - protein, 9 aa, Homo Sapiens
KQLKCTETW

SEQ ID NO: 273342 - protein, 9 aa, Homo Sapiens
SFNTFFPLL

SEQ ID NO: 273343 - protein, 9 aa, Homo Sapiens
ALDVNIGMK

SEQ ID NO: 273344 - protein, 9 aa, Homo Sapiens
LTIIALSHR

SEQ ID NO: 273345 - protein, 9 aa, Homo Sapiens
FLREKSPTF

SEQ ID NO: 273346 - protein, 9 aa, Homo Sapiens
VEWRLRGPP

SEQ ID NO: 273347 - protein, 9 aa, Homo Sapiens
YLTEEAENW

SEQ ID NO: 273348 - protein, 9 aa, Homo Sapiens
VFSQRFEFE

SEQ ID NO: 273349 - protein, 9 aa, Homo Sapiens
PQRDNWKGT

SEQ ID NO: 273350 - protein, 9 aa, Homo Sapiens
PVSPILVQG

SEQ ID NO: 273351 - protein, 9 aa, Homo Sapiens
SLRNTEVKG

SEQ ID NO: 273352 - protein, 9 aa, Homo Sapiens
VTYEKHNNG

SEQ ID NO: 273353 - protein, 9 aa, Homo Sapiens
TINPGAHFM

SEQ ID NO: 273354 - protein, 9 aa, Homo Sapiens
PSILLILWL

SEQ ID NO: 273355 - protein, 9 aa, Homo Sapiens
LNQTTRLKL

SEQ ID NO: 273356 - protein, 9 aa, Homo Sapiens
VKLYDSDKS

SEQ ID NO: 273357 - protein, 9 aa, Homo Sapiens
SQAFTPDNP

SEQ ID NO: 273358 - protein, 9 aa, Homo Sapiens
VRDVTVLQN

SEQ ID NO: 273359 - protein, 9 aa, Homo Sapiens
YSVASFSLW

SEQ ID NO: 273360 - protein, 9 aa, Homo Sapiens
FFLTGHDRL

SEQ ID NO: 273361 - protein, 9 aa, Homo Sapiens
GTVRIEMFQ

SEQ ID NO: 273362 - protein, 9 aa, Homo Sapiens
TAGNVFVLE

SEQ ID NO: 273363 - protein, 9 aa, Homo Sapiens
SAGFNIIIT

SEQ ID NO: 273364 - protein, 9 aa, Homo Sapiens
KHFSCPLCP

SEQ ID NO: 273365 - protein, 9 aa, Homo Sapiens
SDPHLGTTS

SEQ ID NO: 273366 - protein, 9 aa, Homo Sapiens
LADSLDHSC

SEQ ID NO: 273367 - protein, 9 aa, Homo Sapiens
VPGLNNTSS

SEQ ID NO: 273368 - protein, 9 aa, Homo Sapiens
GKAMAPHYV

SEQ ID NO: 273369 - protein, 9 aa, Homo Sapiens
VCMSGGLCM

SEQ ID NO: 273370 - protein, 9 aa, Homo Sapiens
VVKVRAPTV

SEQ ID NO: 273371 - protein, 9 aa, Homo Sapiens
PFQSTENSA

SEQ ID NO: 273372 - protein, 9 aa, Homo Sapiens
RKELNEYQS

SEQ ID NO: 273373 - protein, 9 aa, Homo Sapiens
TAVVVIHFL

SEQ ID NO: 273374 - protein, 9 aa, Homo Sapiens
DLVRSAETH

SEQ ID NO: 273375 - protein, 9 aa, Homo Sapiens
VVTENYHTL

SEQ ID NO: 273376 - protein, 9 aa, Homo Sapiens
QYGRFLCCM

SEQ ID NO: 273377 - protein, 9 aa, Homo Sapiens
RIALTSSKL

SEQ ID NO: 273378 - protein, 9 aa, Homo Sapiens
KPNSLYTVG

SEQ ID NO: 273379 - protein, 9 aa, Homo Sapiens
TMTELSRLR

SEQ ID NO: 273380 - protein, 9 aa, Homo Sapiens
LKVLLDTSN

SEQ ID NO: 273381 - protein, 9 aa, Homo Sapiens
EKMLNIGHL

SEQ ID NO: 273382 - protein, 9 aa, Homo Sapiens
VWPVKIIGE

SEQ ID NO: 273383 - protein, 9 aa, Homo Sapiens
DKVLEDVRN

SEQ ID NO: 273384 - protein, 9 aa, Homo Sapiens
PAMLSVSTP

SEQ ID NO: 273385 - protein, 9 aa, Homo Sapiens
IVLRGATQH

SEQ ID NO: 273386 - protein, 9 aa, Homo Sapiens
KTILHHIYG

SEQ ID NO: 273387 - protein, 9 aa, Homo Sapiens
IDQGLTCRE

SEQ ID NO: 273388 - protein, 9 aa, Homo Sapiens
GRKYDTNGN

SEQ ID NO: 273389 - protein, 9 aa, Homo Sapiens
QLIYAFFGI

SEQ ID NO: 273390 - protein, 9 aa, Homo Sapiens
HESEIDKIV

SEQ ID NO: 273391 - protein, 9 aa, Homo Sapiens
LLGLSDRPQ

SEQ ID NO: 273392 - protein, 9 aa, Homo Sapiens
NTFNLEKQN

SEQ ID NO: 273393 - protein, 9 aa, Homo Sapiens
ETPINENAP

SEQ ID NO: 273394 - protein, 9 aa, Homo Sapiens
PNRLKHIWN

SEQ ID NO: 273395 - protein, 9 aa, Homo Sapiens
IAVAVILLA

SEQ ID NO: 273396 - protein, 9 aa, Homo Sapiens
AFWLDDCAQ

SEQ ID NO: 273397 - protein, 9 aa, Homo Sapiens
INLMHHAAR

SEQ ID NO: 273398 - protein, 9 aa, Homo Sapiens
PEKFKRCIR

SEQ ID NO: 273399 - protein, 9 aa, Homo Sapiens
QELEAEYLT

SEQ ID NO: 273400 - protein, 9 aa, Homo Sapiens
RREYQPKPQ

SEQ ID NO: 273401 - protein, 9 aa, Homo Sapiens
ESEFFLASY

SEQ ID NO: 273402 - protein, 9 aa, Homo Sapiens
AAVFLASKA

SEQ ID NO: 273403 - protein, 9 aa, Homo Sapiens
GNIVKTSVK

SEQ ID NO: 273404 - protein, 9 aa, Homo Sapiens
ARVIHDWAD

SEQ ID NO: 273405 - protein, 9 aa, Homo Sapiens
RLCYDRIKF

SEQ ID NO: 273406 - protein, 9 aa, Homo Sapiens
EVDDLNYED

SEQ ID NO: 273407 - protein, 9 aa, Homo Sapiens
LCGATRRGY

SEQ ID NO: 273408 - protein, 9 aa, Homo Sapiens
ENTAAKEQQ

SEQ ID NO: 273409 - protein, 9 aa, Homo Sapiens
LYIRRMVKT

SEQ ID NO: 273410 - protein, 9 aa, Homo Sapiens
LSVKKNISE

SEQ ID NO: 273411 - protein, 9 aa, Homo Sapiens
GNDTSNTKA

SEQ ID NO: 273412 - protein, 9 aa, Homo Sapiens
ETEQNQALL

SEQ ID NO: 273413 - protein, 9 aa, Homo Sapiens
TETSKSKVK

SEQ ID NO: 273414 - protein, 9 aa, Homo Sapiens
YPEKKIKRM

SEQ ID NO: 273415 - protein, 9 aa, Homo Sapiens
LILTSQIIS

SEQ ID NO: 273416 - protein, 9 aa, Homo Sapiens
IIFVPSYIN

SEQ ID NO: 273417 - protein, 9 aa, Homo Sapiens
FSLEFGYPG

SEQ ID NO: 273418 - protein, 9 aa, Homo Sapiens
VNVDGEEVA

SEQ ID NO: 273419 - protein, 9 aa, Homo Sapiens
FCTQCGPDG

SEQ ID NO: 273420 - protein, 9 aa, Homo Sapiens
AYRFGAESR

SEQ ID NO: 273421 - protein, 9 aa, Homo Sapiens
RIIKQAFQG

SEQ ID NO: 273422 - protein, 9 aa, Homo Sapiens
LEQAQASAG

SEQ ID NO: 273423 - protein, 9 aa, Homo Sapiens
RINLDKCQT

SEQ ID NO: 273424 - protein, 9 aa, Homo Sapiens
PDYHRIIKQ

SEQ ID NO: 273425 - protein, 9 aa, Homo Sapiens
KLLSFASGQ

SEQ ID NO: 273426 - protein, 9 aa, Homo Sapiens
MIISQKDTC

SEQ ID NO: 273427 - protein, 9 aa, Homo Sapiens
SEVERDLKK

SEQ ID NO: 273428 - protein, 9 aa, Homo Sapiens
MIFIGGINR

SEQ ID NO: 273429 - protein, 9 aa, Homo Sapiens
NRTCLCFLL

SEQ ID NO: 273430 - protein, 9 aa, Homo Sapiens
ASILESKYL

SEQ ID NO: 273431 - protein, 9 aa, Homo Sapiens
FILRDSESI

SEQ ID NO: 273432 - protein, 9 aa, Homo Sapiens
MPPIQFHQL

SEQ ID NO: 273433 - protein, 9 aa, Homo Sapiens
HVESQQDLE

SEQ ID NO: 273434 - protein, 9 aa, Homo Sapiens
VCPMSGVSV

SEQ ID NO: 273435 - protein, 9 aa, Homo Sapiens
NFGSNCRFS

SEQ ID NO: 273436 - protein, 9 aa, Homo Sapiens
LQQVPRLFE

SEQ ID NO: 273437 - protein, 9 aa, Homo Sapiens
ASFERMNVD

SEQ ID NO: 273438 - protein, 9 aa, Homo Sapiens
LRGPPPAGL

SEQ ID NO: 273439 - protein, 9 aa, Homo Sapiens
LRGPPPAGN

SEQ ID NO: 273440 - protein, 9 aa, Homo Sapiens
YIDQLKHIM

SEQ ID NO: 273441 - protein, 9 aa, Homo Sapiens
VKEYEREHV

SEQ ID NO: 273442 - protein, 9 aa, Homo Sapiens
TASKWALIF

SEQ ID NO: 273443 - protein, 9 aa, Homo Sapiens
TEDSDDINF

SEQ ID NO: 273444 - protein, 9 aa, Homo Sapiens
QNGQKTYQI

SEQ ID NO: 273445 - protein, 9 aa, Homo Sapiens
GGLFSPPTQ

SEQ ID NO: 273446 - protein, 9 aa, Homo Sapiens
EDPHLVNDP

SEQ ID NO: 273447 - protein, 9 aa, Homo Sapiens
LLNPIHGLV

SEQ ID NO: 273448 - protein, 9 aa, Homo Sapiens
AMIMWLQLD

SEQ ID NO: 273449 - protein, 9 aa, Homo Sapiens
GGLAWITQG

SEQ ID NO: 273450 - protein, 9 aa, Homo Sapiens
AFHSPCQHF

SEQ ID NO: 273451 - protein, 9 aa, Homo Sapiens
LKIIYLQNN

SEQ ID NO: 273452 - protein, 9 aa, Homo Sapiens
AQYPVVKTN

SEQ ID NO: 273453 - protein, 9 aa, Homo Sapiens
MCVYQRGRK

SEQ ID NO: 273454 - protein, 9 aa, Homo Sapiens
EETSIPAYT

SEQ ID NO: 273455 - protein, 9 aa, Homo Sapiens
SGCFDMFVR

SEQ ID NO: 273456 - protein, 9 aa, Homo Sapiens
TTVGYGYMY

SEQ ID NO: 273457 - protein, 9 aa, Homo Sapiens
DPSSHEMRG

SEQ ID NO: 273458 - protein, 9 aa, Homo Sapiens
GIIFLAFAF

SEQ ID NO: 273459 - protein, 9 aa, Homo Sapiens
SESPEGSPV

SEQ ID NO: 273460 - protein, 9 aa, Homo Sapiens
KLGNIVKTS

SEQ ID NO: 273461 - protein, 9 aa, Homo Sapiens
FVTEMCMRN

SEQ ID NO: 273462 - protein, 9 aa, Homo Sapiens
YVSNDDPGS

SEQ ID NO: 273463 - protein, 9 aa, Homo Sapiens
ILKQTCYIA

SEQ ID NO: 273464 - protein, 9 aa, Homo Sapiens
GMRGDGMAF

SEQ ID NO: 273465 - protein, 9 aa, Homo Sapiens
WIGNMDREF

SEQ ID NO: 273466 - protein, 9 aa, Homo Sapiens
TSDTWILDK

SEQ ID NO: 273467 - protein, 9 aa, Homo Sapiens
EPQNAQLVY

SEQ ID NO: 273468 - protein, 9 aa, Homo Sapiens
QNKLAAQLD

SEQ ID NO: 273469 - protein, 9 aa, Homo Sapiens
KSESEEKKA

SEQ ID NO: 273470 - protein, 9 aa, Homo Sapiens
NGIQFRALR

SEQ ID NO: 273471 - protein, 9 aa, Homo Sapiens
ICSLSHQQP

SEQ ID NO: 273472 - protein, 9 aa, Homo Sapiens
NETSNCRKV

SEQ ID NO: 273473 - protein, 9 aa, Homo Sapiens
PAHNSCGIT

SEQ ID NO: 273474 - protein, 9 aa, Homo Sapiens
VTWKADVTP

SEQ ID NO: 273475 - protein, 9 aa, Homo Sapiens
TILTEMYRI

SEQ ID NO: 273476 - protein, 9 aa, Homo Sapiens
IGVQHILAA

SEQ ID NO: 273477 - protein, 9 aa, Homo Sapiens
TVRTVNNKT

SEQ ID NO: 273478 - protein, 9 aa, Homo Sapiens
PNHPGFKDQ

SEQ ID NO: 273479 - protein, 9 aa, Homo Sapiens
RPDLQQLET

SEQ ID NO: 273480 - protein, 9 aa, Homo Sapiens
RVRGNLDNL

SEQ ID NO: 273481 - protein, 9 aa, Homo Sapiens
RCECSAHNK

SEQ ID NO: 273482 - protein, 9 aa, Homo Sapiens
KKEQANNKE

SEQ ID NO: 273483 - protein, 9 aa, Homo Sapiens
FLFSFQNHI

SEQ ID NO: 273484 - protein, 9 aa, Homo Sapiens
DITTVSTTG

SEQ ID NO: 273485 - protein, 9 aa, Homo Sapiens
TKETKRLRS

SEQ ID NO: 273486 - protein, 9 aa, Homo Sapiens
ISVDTEHSD

SEQ ID NO: 273487 - protein, 9 aa, Homo Sapiens
TVVYRYAHT

SEQ ID NO: 273488 - protein, 9 aa, Homo Sapiens
PPDLQNKVL

SEQ ID NO: 273489 - protein, 9 aa, Homo Sapiens
PIGRFQNHV

SEQ ID NO: 273490 - protein, 9 aa, Homo Sapiens
KINASKNHQ

SEQ ID NO: 273491 - protein, 9 aa, Homo Sapiens
QFFNEPEDN

SEQ ID NO: 273492 - protein, 9 aa, Homo Sapiens
GYHCYEPSI

SEQ ID NO: 273493 - protein, 9 aa, Homo Sapiens
DPDHPLMVI

SEQ ID NO: 273494 - protein, 9 aa, Homo Sapiens
EDKVLCRVH

SEQ ID NO: 273495 - protein, 9 aa, Homo Sapiens
LDKLQPELM

SEQ ID NO: 273496 - protein, 9 aa, Homo Sapiens
ALKYRHRQV

SEQ ID NO: 273497 - protein, 9 aa, Homo Sapiens
KMLFAPCCG

SEQ ID NO: 273498 - protein, 9 aa, Homo Sapiens
SMLSLSFFT

SEQ ID NO: 273499 - protein, 9 aa, Homo Sapiens
VERNIISFD

SEQ ID NO: 273500 - protein, 9 aa, Homo Sapiens
KVMCTSPPL

SEQ ID NO: 273501 - protein, 9 aa, Homo Sapiens
HKMYKLSPE

SEQ ID NO: 273502 - protein, 9 aa, Homo Sapiens
QAVHVQSGP

SEQ ID NO: 273503 - protein, 9 aa, Homo Sapiens
CLGDECKNT

SEQ ID NO: 273504 - protein, 9 aa, Homo Sapiens
TRDELFMEA

SEQ ID NO: 273505 - protein, 9 aa, Homo Sapiens
MLFMLTPSS

SEQ ID NO: 273506 - protein, 9 aa, Homo Sapiens
WSKEKQLRG

SEQ ID NO: 273507 - protein, 9 aa, Homo Sapiens
YKYQPGKSS

SEQ ID NO: 273508 - protein, 9 aa, Homo Sapiens
VLTLNAWES

SEQ ID NO: 273509 - protein, 9 aa, Homo Sapiens
LSYMELPFR

SEQ ID NO: 273510 - protein, 9 aa, Homo Sapiens
LESGVEICI

SEQ ID NO: 273511 - protein, 9 aa, Homo Sapiens
DMAFRLDRR

SEQ ID NO: 273512 - protein, 9 aa, Homo Sapiens
CELYTCLSP

SEQ ID NO: 273513 - protein, 9 aa, Homo Sapiens
INRILKLLA

SEQ ID NO: 273514 - protein, 9 aa, Homo Sapiens
KEKQLRGLQ

SEQ ID NO: 273515 - protein, 9 aa, Homo Sapiens
TVNEDASTE

SEQ ID NO: 273516 - protein, 9 aa, Homo Sapiens
AFEEFLDRL

SEQ ID NO: 273517 - protein, 9 aa, Homo Sapiens
NDGAYSRVL

SEQ ID NO: 273518 - protein, 9 aa, Homo Sapiens
VHFQDKNLM

SEQ ID NO: 273519 - protein, 9 aa, Homo Sapiens
WQRNITYKA

SEQ ID NO: 273520 - protein, 9 aa, Homo Sapiens
ARNNYKGYA

SEQ ID NO: 273521 - protein, 9 aa, Homo Sapiens
MDLVGDTAT

SEQ ID NO: 273522 - protein, 9 aa, Homo Sapiens
RVKGDKKKR

SEQ ID NO: 273523 - protein, 9 aa, Homo Sapiens
FTTPELVHA

SEQ ID NO: 273524 - protein, 9 aa, Homo Sapiens
TMVTSMLNP

SEQ ID NO: 273525 - protein, 9 aa, Homo Sapiens
NFLICIRIL

SEQ ID NO: 273526 - protein, 9 aa, Homo Sapiens
GQLMEPCRL

SEQ ID NO: 273527 - protein, 9 aa, Homo Sapiens
PASSLNKGN

SEQ ID NO: 273528 - protein, 9 aa, Homo Sapiens
VKYQNQHTM

SEQ ID NO: 273529 - protein, 9 aa, Homo Sapiens
ESGEQNKKS

SEQ ID NO: 273530 - protein, 9 aa, Homo Sapiens
PAIENIQVR

SEQ ID NO: 273531 - protein, 9 aa, Homo Sapiens
QILPIEQLC

SEQ ID NO: 273532 - protein, 9 aa, Homo Sapiens
INNYHPKIR

SEQ ID NO: 273533 - protein, 9 aa, Homo Sapiens
ALHAIGVEA

SEQ ID NO: 273534 - protein, 9 aa, Homo Sapiens
FDPFIYLPV

SEQ ID NO: 273535 - protein, 9 aa, Homo Sapiens
KHIHEISCK

SEQ ID NO: 273536 - protein, 9 aa, Homo Sapiens
TSSKGSDLE

SEQ ID NO: 273537 - protein, 9 aa, Homo Sapiens
DTCNPCFRV

SEQ ID NO: 273538 - protein, 9 aa, Homo Sapiens
HGRLAELEE

SEQ ID NO: 273539 - protein, 9 aa, Homo Sapiens
SSTFSISKI

SEQ ID NO: 273540 - protein, 9 aa, Homo Sapiens
SNRFQLGTC

SEQ ID NO: 273541 - protein, 9 aa, Homo Sapiens
PSPLPGFPG

SEQ ID NO: 273542 - protein, 9 aa, Homo Sapiens
KKESKLEIT

SEQ ID NO: 273543 - protein, 9 aa, Homo Sapiens
YQYQASGPN

SEQ ID NO: 273544 - protein, 9 aa, Homo Sapiens
EGEDVRRIP

SEQ ID NO: 273545 - protein, 9 aa, Homo Sapiens
IMNDEGEIE

SEQ ID NO: 273546 - protein, 9 aa, Homo Sapiens
RRPKHMLVV

SEQ ID NO: 273547 - protein, 9 aa, Homo Sapiens
TECIAHCKS

SEQ ID NO: 273548 - protein, 9 aa, Homo Sapiens
HNPASLESM

SEQ ID NO: 273549 - protein, 9 aa, Homo Sapiens
NLEEFEVDD

SEQ ID NO: 273550 - protein, 9 aa, Homo Sapiens
RLHGIDLRW

SEQ ID NO: 273551 - protein, 9 aa, Homo Sapiens
TGQIDPLNC

SEQ ID NO: 273552 - protein, 9 aa, Homo Sapiens
SQPSMKQVG

SEQ ID NO: 273553 - protein, 9 aa, Homo Sapiens
AKIEGPVEK

SEQ ID NO: 273554 - protein, 9 aa, Homo Sapiens
FYFPAASPH

SEQ ID NO: 273555 - protein, 9 aa, Homo Sapiens
FNRFSYLTQ

SEQ ID NO: 273556 - protein, 9 aa, Homo Sapiens
SEDCCKKCQ

SEQ ID NO: 273557 - protein, 9 aa, Homo Sapiens
PLQPRALSP

SEQ ID NO: 273558 - protein, 9 aa, Homo Sapiens
EMVEAKVGQ

SEQ ID NO: 273559 - protein, 9 aa, Homo Sapiens
FKEVNTTIY

SEQ ID NO: 273560 - protein, 9 aa, Homo Sapiens
EMESGLELK

SEQ ID NO: 273561 - protein, 9 aa, Homo Sapiens
WNPCPDFTP

SEQ ID NO: 273562 - protein, 9 aa, Homo Sapiens
KIEARDGKL

SEQ ID NO: 273563 - protein, 9 aa, Homo Sapiens
EHLDLNSNA

SEQ ID NO: 273564 - protein, 9 aa, Homo Sapiens
IDVFFQQKW

SEQ ID NO: 273565 - protein, 9 aa, Homo Sapiens
FAFFPDDFK

SEQ ID NO: 273566 - protein, 9 aa, Homo Sapiens
EENLPPIQN

SEQ ID NO: 273567 - protein, 9 aa, Homo Sapiens
ELSGIVSKG

SEQ ID NO: 273568 - protein, 9 aa, Homo Sapiens
LGLDDTNIL

SEQ ID NO: 273569 - protein, 9 aa, Homo Sapiens
EWLGLINNS

SEQ ID NO: 273570 - protein, 9 aa, Homo Sapiens
SHAIQKELT

SEQ ID NO: 273571 - protein, 9 aa, Homo Sapiens
DKCVKRKVM

SEQ ID NO: 273572 - protein, 9 aa, Homo Sapiens
ILVGDIGDN

SEQ ID NO: 273573 - protein, 9 aa, Homo Sapiens
NTGFHYDVI

SEQ ID NO: 273574 - protein, 9 aa, Homo Sapiens
TNKDGKGIQ

SEQ ID NO: 273575 - protein, 9 aa, Homo Sapiens
TLDQVWNIL

SEQ ID NO: 273576 - protein, 9 aa, Homo Sapiens
IPRFLLTIV

SEQ ID NO: 273577 - protein, 9 aa, Homo Sapiens
PEEECALEI

SEQ ID NO: 273578 - protein, 9 aa, Homo Sapiens
SDIKEDTSF

SEQ ID NO: 273579 - protein, 9 aa, Homo Sapiens
LWACLTINQ

SEQ ID NO: 273580 - protein, 9 aa, Homo Sapiens
NVPPEEECE

SEQ ID NO: 273581 - protein, 9 aa, Homo Sapiens
DTAESPISG

SEQ ID NO: 273582 - protein, 9 aa, Homo Sapiens
WAVGGVPLQ

SEQ ID NO: 273583 - protein, 9 aa, Homo Sapiens
IPEEPRKKL

SEQ ID NO: 273584 - protein, 9 aa, Homo Sapiens
ANAYTIPLD

SEQ ID NO: 273585 - protein, 9 aa, Homo Sapiens
VKETNDNPK

SEQ ID NO: 273586 - protein, 9 aa, Homo Sapiens
FHPVIIYPD

SEQ ID NO: 273587 - protein, 9 aa, Homo Sapiens
EQDFCKIVG

SEQ ID NO: 273588 - protein, 9 aa, Homo Sapiens
RDVNNHLNY

SEQ ID NO: 273589 - protein, 9 aa, Homo Sapiens
YAIRNLTKD

SEQ ID NO: 273590 - protein, 9 aa, Homo Sapiens
GHGEFSSSR

SEQ ID NO: 273591 - protein, 9 aa, Homo Sapiens
HSNGYYTKC

SEQ ID NO: 273592 - protein, 9 aa, Homo Sapiens
TKENKDLLG

SEQ ID NO: 273593 - protein, 9 aa, Homo Sapiens
ADTLVTKLN

SEQ ID NO: 273594 - protein, 9 aa, Homo Sapiens
TRLKLQLLE

SEQ ID NO: 273595 - protein, 9 aa, Homo Sapiens
AKIKELETL

SEQ ID NO: 273596 - protein, 9 aa, Homo Sapiens
VNNHLNYEH

SEQ ID NO: 273597 - protein, 9 aa, Homo Sapiens
GTNWQAVVK

SEQ ID NO: 273598 - protein, 9 aa, Homo Sapiens
YHLLSEESE

SEQ ID NO: 273599 - protein, 9 aa, Homo Sapiens
QLEQVKRFK

SEQ ID NO: 273600 - protein, 9 aa, Homo Sapiens
QETGEGSAE

SEQ ID NO: 273601 - protein, 9 aa, Homo Sapiens
HFLVIFPEK

SEQ ID NO: 273602 - protein, 9 aa, Homo Sapiens
RMWKLFENF

SEQ ID NO: 273603 - protein, 9 aa, Homo Sapiens
VGEDEEGIS

SEQ ID NO: 273604 - protein, 9 aa, Homo Sapiens
WSASGIFGG

SEQ ID NO: 273605 - protein, 9 aa, Homo Sapiens
YHGMCLNIA

SEQ ID NO: 273606 - protein, 9 aa, Homo Sapiens
SQRDDAPAS

SEQ ID NO: 273607 - protein, 9 aa, Homo Sapiens
TQSQLSLLD

SEQ ID NO: 273608 - protein, 9 aa, Homo Sapiens
RQKNKNKLP

SEQ ID NO: 273609 - protein, 9 aa, Homo Sapiens
GVGTRHRAL

SEQ ID NO: 273610 - protein, 9 aa, Homo Sapiens
RDFLMHWKK

SEQ ID NO: 273611 - protein, 9 aa, Homo Sapiens
FYYSELYKL

SEQ ID NO: 273612 - protein, 9 aa, Homo Sapiens
NGCMYSLIG

SEQ ID NO: 273613 - protein, 9 aa, Homo Sapiens
NNTFQTFPQ

SEQ ID NO: 273614 - protein, 9 aa, Homo Sapiens
LKRVDLENN

SEQ ID NO: 273615 - protein, 9 aa, Homo Sapiens
RNKKTEGTY

SEQ ID NO: 273616 - protein, 9 aa, Homo Sapiens
EINRVVHNA

SEQ ID NO: 273617 - protein, 9 aa, Homo Sapiens
EPPVASEDG

SEQ ID NO: 273618 - protein, 9 aa, Homo Sapiens
NDGSPGRKF

SEQ ID NO: 273619 - protein, 9 aa, Homo Sapiens
KKCQDWYYK

SEQ ID NO: 273620 - protein, 9 aa, Homo Sapiens
IQVILDMED

SEQ ID NO: 273621 - protein, 9 aa, Homo Sapiens
VCEKGCQSH

SEQ ID NO: 273622 - protein, 9 aa, Homo Sapiens
ALHISMEDY

SEQ ID NO: 273623 - protein, 9 aa, Homo Sapiens
GGTYQDTKA

SEQ ID NO: 273624 - protein, 9 aa, Homo Sapiens
LTGINDKMA

SEQ ID NO: 273625 - protein, 9 aa, Homo Sapiens
TTKLLYRLV

SEQ ID NO: 273626 - protein, 9 aa, Homo Sapiens
VCPDTMVSL

SEQ ID NO: 273627 - protein, 9 aa, Homo Sapiens
VLSGETQEW

SEQ ID NO: 273628 - protein, 9 aa, Homo Sapiens
FIIYACFSV

SEQ ID NO: 273629 - protein, 9 aa, Homo Sapiens
GSKKANNSI

SEQ ID NO: 273630 - protein, 9 aa, Homo Sapiens
TLSYLQNIL

SEQ ID NO: 273631 - protein, 9 aa, Homo Sapiens
SDDIDNIKW

SEQ ID NO: 273632 - protein, 9 aa, Homo Sapiens
YFKDKASVN

SEQ ID NO: 273633 - protein, 9 aa, Homo Sapiens
PPYTEWNQQ

SEQ ID NO: 273634 - protein, 9 aa, Homo Sapiens
RLNESHFIV

SEQ ID NO: 273635 - protein, 9 aa, Homo Sapiens
LTTQDLQEG

SEQ ID NO: 273636 - protein, 9 aa, Homo Sapiens
HQRKGFNAQ

SEQ ID NO: 273637 - protein, 9 aa, Homo Sapiens
EVNACDLPE

SEQ ID NO: 273638 - protein, 9 aa, Homo Sapiens
VLLFRKPSP

SEQ ID NO: 273639 - protein, 9 aa, Homo Sapiens
LVSILVHAN

SEQ ID NO: 273640 - protein, 9 aa, Homo Sapiens
NNGHIKIWD

SEQ ID NO: 273641 - protein, 9 aa, Homo Sapiens
AADRWFILQ

SEQ ID NO: 273642 - protein, 9 aa, Homo Sapiens
KELSMLNQK

SEQ ID NO: 273643 - protein, 9 aa, Homo Sapiens
ETPEVLHFD

SEQ ID NO: 273644 - protein, 9 aa, Homo Sapiens
IITLLRATN

SEQ ID NO: 273645 - protein, 9 aa, Homo Sapiens
SPNSTPAKN

SEQ ID NO: 273646 - protein, 9 aa, Homo Sapiens
DPEVADLLS

SEQ ID NO: 273647 - protein, 9 aa, Homo Sapiens
EFLISPLPP

SEQ ID NO: 273648 - protein, 9 aa, Homo Sapiens
LFNTTKSVE

SEQ ID NO: 273649 - protein, 9 aa, Homo Sapiens
IGHRDLKAE

SEQ ID NO: 273650 - protein, 9 aa, Homo Sapiens
AQVLGQPHN

SEQ ID NO: 273651 - protein, 9 aa, Homo Sapiens
MAHPGTAAL

SEQ ID NO: 273652 - protein, 9 aa, Homo Sapiens
TNNFNPPTR

SEQ ID NO: 273653 - protein, 9 aa, Homo Sapiens
VIDYDIVNN

SEQ ID NO: 273654 - protein, 9 aa, Homo Sapiens
VQAIKTDLT

SEQ ID NO: 273655 - protein, 9 aa, Homo Sapiens
GPGLPWLLL

SEQ ID NO: 273656 - protein, 9 aa, Homo Sapiens
GKFSEVKAH

SEQ ID NO: 273657 - protein, 9 aa, Homo Sapiens
NNSIDKSTE

SEQ ID NO: 273658 - protein, 9 aa, Homo Sapiens
GYGSMITKI

SEQ ID NO: 273659 - protein, 9 aa, Homo Sapiens
FKGWMSVSG

SEQ ID NO: 273660 - protein, 9 aa, Homo Sapiens
CHSSRSHSK

SEQ ID NO: 273661 - protein, 9 aa, Homo Sapiens
LQTHCYRAA

SEQ ID NO: 273662 - protein, 9 aa, Homo Sapiens
ELQEMDSSG

SEQ ID NO: 273663 - protein, 9 aa, Homo Sapiens
PVLGLEIKE

SEQ ID NO: 273664 - protein, 9 aa, Homo Sapiens
GPSQNNLYR

SEQ ID NO: 273665 - protein, 9 aa, Homo Sapiens
QEYVIEKLE

SEQ ID NO: 273666 - protein, 9 aa, Homo Sapiens
KPEVISHPE

SEQ ID NO: 273667 - protein, 9 aa, Homo Sapiens
AVLMDLINK

SEQ ID NO: 273668 - protein, 9 aa, Homo Sapiens
IVAIKKLLE

SEQ ID NO: 273669 - protein, 9 aa, Homo Sapiens
LYGEKHASL

SEQ ID NO: 273670 - protein, 9 aa, Homo Sapiens
GSQPSHTEN

SEQ ID NO: 273671 - protein, 9 aa, Homo Sapiens
VPGEAPNDQ

SEQ ID NO: 273672 - protein, 9 aa, Homo Sapiens
EINNMKTQF

SEQ ID NO: 273673 - protein, 9 aa, Homo Sapiens
YSRHKMYKL

SEQ ID NO: 273674 - protein, 9 aa, Homo Sapiens
ELSFFNPVC

SEQ ID NO: 273675 - protein, 9 aa, Homo Sapiens
MPWIHELPV

SEQ ID NO: 273676 - protein, 9 aa, Homo Sapiens
PSTKPKQDN

SEQ ID NO: 273677 - protein, 9 aa, Homo Sapiens
CAKNRSLCR

SEQ ID NO: 273678 - protein, 9 aa, Homo Sapiens
AGGGAVEGR

SEQ ID NO: 273679 - protein, 9 aa, Homo Sapiens
PPTARLTFQ

SEQ ID NO: 273680 - protein, 9 aa, Homo Sapiens
LQQNIQGYD

SEQ ID NO: 273681 - protein, 9 aa, Homo Sapiens
ISDPEVLAA

SEQ ID NO: 273682 - protein, 9 aa, Homo Sapiens
VEMLADQPR

SEQ ID NO: 273683 - protein, 9 aa, Homo Sapiens
TCNDCGKAF

SEQ ID NO: 273684 - protein, 9 aa, Homo Sapiens
NDAKAPASE

SEQ ID NO: 273685 - protein, 9 aa, Homo Sapiens
GLVLGGIIL

SEQ ID NO: 273686 - protein, 9 aa, Homo Sapiens
VCQLESEEK

SEQ ID NO: 273687 - protein, 9 aa, Homo Sapiens
VQASLYGKS

SEQ ID NO: 273688 - protein, 9 aa, Homo Sapiens
EGHGLKVEI

SEQ ID NO: 273689 - protein, 9 aa, Homo Sapiens
VWKTNHVTI

SEQ ID NO: 273690 - protein, 9 aa, Homo Sapiens
THKEKEHAH

SEQ ID NO: 273691 - protein, 9 aa, Homo Sapiens
KDKHKHEKI

SEQ ID NO: 273692 - protein, 9 aa, Homo Sapiens
WVMNLHWKN

SEQ ID NO: 273693 - protein, 9 aa, Homo Sapiens
DHCPSFISG

SEQ ID NO: 273694 - protein, 9 aa, Homo Sapiens
VVAICIHYC

SEQ ID NO: 273695 - protein, 9 aa, Homo Sapiens
VCGFWSRLH

SEQ ID NO: 273696 - protein, 9 aa, Homo Sapiens
YRQNRFASS

SEQ ID NO: 273697 - protein, 9 aa, Homo Sapiens
NMMISLSEC

SEQ ID NO: 273698 - protein, 9 aa, Homo Sapiens
HVKAIKVLI

SEQ ID NO: 273699 - protein, 9 aa, Homo Sapiens
KETTTSPNK

SEQ ID NO: 273700 - protein, 9 aa, Homo Sapiens
KYVKVKVNL

SEQ ID NO: 273701 - protein, 9 aa, Homo Sapiens
SSTLTLHQQ

SEQ ID NO: 273702 - protein, 9 aa, Homo Sapiens
ECSLVAQIA

SEQ ID NO: 273703 - protein, 9 aa, Homo Sapiens
DGSALFNMV

SEQ ID NO: 273704 - protein, 9 aa, Homo Sapiens
RGEELSQRL

SEQ ID NO: 273705 - protein, 9 aa, Homo Sapiens
NVPISVKQD

SEQ ID NO: 273706 - protein, 9 aa, Homo Sapiens
GQKGMGLIP

SEQ ID NO: 273707 - protein, 9 aa, Homo Sapiens
KKKGTVPWF

SEQ ID NO: 273708 - protein, 9 aa, Homo Sapiens
IHTGKKEEA

SEQ ID NO: 273709 - protein, 9 aa, Homo Sapiens
SYLPESSCI

SEQ ID NO: 273710 - protein, 9 aa, Homo Sapiens
MRLSKLPKA

SEQ ID NO: 273711 - protein, 9 aa, Homo Sapiens
PGIYVMTVT

SEQ ID NO: 273712 - protein, 9 aa, Homo Sapiens
QQSFNFAKK

SEQ ID NO: 273713 - protein, 9 aa, Homo Sapiens
PEGRRGVTQ

SEQ ID NO: 273714 - protein, 9 aa, Homo Sapiens
GLQLSKRTV

SEQ ID NO: 273715 - protein, 9 aa, Homo Sapiens
FALNWCEKP

SEQ ID NO: 273716 - protein, 9 aa, Homo Sapiens
MTSHLIVTS

SEQ ID NO: 273717 - protein, 9 aa, Homo Sapiens
LIQTRGGNS

SEQ ID NO: 273718 - protein, 9 aa, Homo Sapiens
LYEIITEDV

SEQ ID NO: 273719 - protein, 9 aa, Homo Sapiens
KDKPVLSLN

SEQ ID NO: 273720 - protein, 9 aa, Homo Sapiens
NTKGKRFTY

SEQ ID NO: 273721 - protein, 9 aa, Homo Sapiens
LRRTDRNHI

SEQ ID NO: 273722 - protein, 9 aa, Homo Sapiens
PAICSYQWD

SEQ ID NO: 273723 - protein, 9 aa, Homo Sapiens
FTDNCSFNT

SEQ ID NO: 273724 - protein, 9 aa, Homo Sapiens
DGNDLCLVA

SEQ ID NO: 273725 - protein, 9 aa, Homo Sapiens
IHQEFLSSL

SEQ ID NO: 273726 - protein, 9 aa, Homo Sapiens
RVQFEEKNI

SEQ ID NO: 273727 - protein, 9 aa, Homo Sapiens
ILLILQYIW

SEQ ID NO: 273728 - protein, 9 aa, Homo Sapiens
SEGYYNVDF

SEQ ID NO: 273729 - protein, 9 aa, Homo Sapiens
NVLCTLPAG

SEQ ID NO: 273730 - protein, 9 aa, Homo Sapiens
LSFTYRLDP

SEQ ID NO: 273731 - protein, 9 aa, Homo Sapiens
AEKLFSSEK

SEQ ID NO: 273732 - protein, 9 aa, Homo Sapiens
FENGKARAN

SEQ ID NO: 273733 - protein, 9 aa, Homo Sapiens
ASLMEKVRG

SEQ ID NO: 273734 - protein, 9 aa, Homo Sapiens
EPKQSRFGG

SEQ ID NO: 273735 - protein, 9 aa, Homo Sapiens
TVLSENKEG

SEQ ID NO: 273736 - protein, 9 aa, Homo Sapiens
VNGSLLVII

SEQ ID NO: 273737 - protein, 9 aa, Homo Sapiens
LYAQNVVQI

SEQ ID NO: 273738 - protein, 9 aa, Homo Sapiens
IYHFAHWLA

SEQ ID NO: 273739 - protein, 9 aa, Homo Sapiens
CRLRLSYGC

SEQ ID NO: 273740 - protein, 9 aa, Homo Sapiens
ERKLNQAFW

SEQ ID NO: 273741 - protein, 9 aa, Homo Sapiens
AHSAVVHEL

SEQ ID NO: 273742 - protein, 9 aa, Homo Sapiens
ARLRVTAAK

SEQ ID NO: 273743 - protein, 9 aa, Homo Sapiens
GANCWYDKS

SEQ ID NO: 273744 - protein, 9 aa, Homo Sapiens
QNGTYTVNI

SEQ ID NO: 273745 - protein, 9 aa, Homo Sapiens
LILHHFLPA

SEQ ID NO: 273746 - protein, 9 aa, Homo Sapiens
HCLAHLLMD

SEQ ID NO: 273747 - protein, 9 aa, Homo Sapiens
DEILNRGPE

SEQ ID NO: 273748 - protein, 9 aa, Homo Sapiens
SGKHKRGET

SEQ ID NO: 273749 - protein, 9 aa, Homo Sapiens
SKCDNKCKV

SEQ ID NO: 273750 - protein, 9 aa, Homo Sapiens
DYFFKEVNT

SEQ ID NO: 273751 - protein, 9 aa, Homo Sapiens
LHGFPGFWY

SEQ ID NO: 273752 - protein, 9 aa, Homo Sapiens
WLGGLAPPS

SEQ ID NO: 273753 - protein, 9 aa, Homo Sapiens
HTWPSPALT

SEQ ID NO: 273754 - protein, 9 aa, Homo Sapiens
PELYHSVQG

SEQ ID NO: 273755 - protein, 9 aa, Homo Sapiens
HNGLIKGQS

SEQ ID NO: 273756 - protein, 9 aa, Homo Sapiens
EALLVQIGP

SEQ ID NO: 273757 - protein, 9 aa, Homo Sapiens
DGVLPVKTL

SEQ ID NO: 273758 - protein, 9 aa, Homo Sapiens
NQFKKMKNN

SEQ ID NO: 273759 - protein, 9 aa, Homo Sapiens
GKTHRYVIN

SEQ ID NO: 273760 - protein, 9 aa, Homo Sapiens
GDIVLWNNS

SEQ ID NO: 273761 - protein, 9 aa, Homo Sapiens
KRGRRTRQR

SEQ ID NO: 273762 - protein, 9 aa, Homo Sapiens
MIMNKGVLM

SEQ ID NO: 273763 - protein, 9 aa, Homo Sapiens
VGHLTHDRI

SEQ ID NO: 273764 - protein, 9 aa, Homo Sapiens
NFSACGGFE

SEQ ID NO: 273765 - protein, 9 aa, Homo Sapiens
LVANSLSLV

SEQ ID NO: 273766 - protein, 9 aa, Homo Sapiens
FMLFFSAFL

SEQ ID NO: 273767 - protein, 9 aa, Homo Sapiens
ARKNTFALL

SEQ ID NO: 273768 - protein, 9 aa, Homo Sapiens
KSRAPPLHL

SEQ ID NO: 273769 - protein, 9 aa, Homo Sapiens
TDYDYYSPT

SEQ ID NO: 273770 - protein, 9 aa, Homo Sapiens
FYFFSFTIF

SEQ ID NO: 273771 - protein, 9 aa, Homo Sapiens
YEKIHVNEI

SEQ ID NO: 273772 - protein, 9 aa, Homo Sapiens
NQTRTTKEA

SEQ ID NO: 273773 - protein, 9 aa, Homo Sapiens
IRSHHSGVD

SEQ ID NO: 273774 - protein, 9 aa, Homo Sapiens
ARAYGDMYD

SEQ ID NO: 273775 - protein, 9 aa, Homo Sapiens
LKPNSLYTV

SEQ ID NO: 273776 - protein, 9 aa, Homo Sapiens
ESNLVWMQG

SEQ ID NO: 273777 - protein, 9 aa, Homo Sapiens
DKFKRLPYS

SEQ ID NO: 273778 - protein, 9 aa, Homo Sapiens
KDFQGCMRL

SEQ ID NO: 273779 - protein, 9 aa, Homo Sapiens
HFEQLSQRL

SEQ ID NO: 273780 - protein, 9 aa, Homo Sapiens
TPPRGHVEP

SEQ ID NO: 273781 - protein, 9 aa, Homo Sapiens
EPGTEEKSV

SEQ ID NO: 273782 - protein, 9 aa, Homo Sapiens
PANMMGPLA

SEQ ID NO: 273783 - protein, 9 aa, Homo Sapiens
LTGHDRLHA

SEQ ID NO: 273784 - protein, 9 aa, Homo Sapiens
DDSALQEFF

SEQ ID NO: 273785 - protein, 9 aa, Homo Sapiens
HNAANQGLR

SEQ ID NO: 273786 - protein, 9 aa, Homo Sapiens
IYMSYDSYP

SEQ ID NO: 273787 - protein, 9 aa, Homo Sapiens
DLQNKVLIS

SEQ ID NO: 273788 - protein, 9 aa, Homo Sapiens
QISNTLLNN

SEQ ID NO: 273789 - protein, 9 aa, Homo Sapiens
VKLCPSKTS

SEQ ID NO: 273790 - protein, 9 aa, Homo Sapiens
FISSTCVAY

SEQ ID NO: 273791 - protein, 9 aa, Homo Sapiens
YPPPHEEEL

SEQ ID NO: 273792 - protein, 9 aa, Homo Sapiens
FQYPSQPPV

SEQ ID NO: 273793 - protein, 9 aa, Homo Sapiens
ECYFPDEKD

SEQ ID NO: 273794 - protein, 9 aa, Homo Sapiens
EENMDKTII

SEQ ID NO: 273795 - protein, 9 aa, Homo Sapiens
EGDDQAGQN

SEQ ID NO: 273796 - protein, 9 aa, Homo Sapiens
PSSYPGNIL

SEQ ID NO: 273797 - protein, 9 aa, Homo Sapiens
GPVRSNHPF

SEQ ID NO: 273798 - protein, 9 aa, Homo Sapiens
KVEENNFGS

SEQ ID NO: 273799 - protein, 9 aa, Homo Sapiens
LQTLKRHKA

SEQ ID NO: 273800 - protein, 9 aa, Homo Sapiens
ERRLMNRNF

SEQ ID NO: 273801 - protein, 9 aa, Homo Sapiens
DQLEKQQEQ

SEQ ID NO: 273802 - protein, 9 aa, Homo Sapiens
SPIQKEWVM

SEQ ID NO: 273803 - protein, 9 aa, Homo Sapiens
GPAQKKPPS

SEQ ID NO: 273804 - protein, 9 aa, Homo Sapiens
IKGKPIHIM

SEQ ID NO: 273805 - protein, 9 aa, Homo Sapiens
KACACAEED

SEQ ID NO: 273806 - protein, 9 aa, Homo Sapiens
KSMDQCRHT

SEQ ID NO: 273807 - protein, 9 aa, Homo Sapiens
LEMQFVLPC

SEQ ID NO: 273808 - protein, 9 aa, Homo Sapiens
NILNGVRLK

SEQ ID NO: 273809 - protein, 9 aa, Homo Sapiens
NLNMSDWEV

SEQ ID NO: 273810 - protein, 9 aa, Homo Sapiens
QKLWERNIT

SEQ ID NO: 273811 - protein, 9 aa, Homo Sapiens
QVILDMEDK

SEQ ID NO: 273812 - protein, 9 aa, Homo Sapiens
RRKRRSFSK

SEQ ID NO: 273813 - protein, 9 aa, Homo Sapiens
NTNQINFNH

SEQ ID NO: 273814 - protein, 9 aa, Homo Sapiens
VDPSGGDHF

SEQ ID NO: 273815 - protein, 9 aa, Homo Sapiens
TLSGTAEPY

SEQ ID NO: 273816 - protein, 9 aa, Homo Sapiens
DWTQGLPWI

SEQ ID NO: 273817 - protein, 9 aa, Homo Sapiens
YTCNDCGKA

SEQ ID NO: 273818 - protein, 9 aa, Homo Sapiens
QKEQRELVA

SEQ ID NO: 273819 - protein, 9 aa, Homo Sapiens
QNNSFPYEN

SEQ ID NO: 273820 - protein, 9 aa, Homo Sapiens
MYGEILSPT

SEQ ID NO: 273821 - protein, 9 aa, Homo Sapiens
PVKLKNFKK

SEQ ID NO: 273822 - protein, 9 aa, Homo Sapiens
YPYRDKITI

SEQ ID NO: 273823 - protein, 9 aa, Homo Sapiens
SRPFRYKHK

SEQ ID NO: 273824 - protein, 9 aa, Homo Sapiens
VGDTEGEYN

SEQ ID NO: 273825 - protein, 9 aa, Homo Sapiens
GTLPVVAGI

SEQ ID NO: 273826 - protein, 9 aa, Homo Sapiens
YYDRGYDCG

SEQ ID NO: 273827 - protein, 9 aa, Homo Sapiens
LQKKGHKIK

SEQ ID NO: 273828 - protein, 9 aa, Homo Sapiens
LNGRHPYKC

SEQ ID NO: 273829 - protein, 9 aa, Homo Sapiens
SGSPLHMPY

SEQ ID NO: 273830 - protein, 9 aa, Homo Sapiens
QDISVETEG

SEQ ID NO: 273831 - protein, 9 aa, Homo Sapiens
QSSKPKVRD

SEQ ID NO: 273832 - protein, 9 aa, Homo Sapiens
LLRALLGEK

SEQ ID NO: 273833 - protein, 9 aa, Homo Sapiens
KEDATVFAS

SEQ ID NO: 273834 - protein, 9 aa, Homo Sapiens
LKCDCSTAN

SEQ ID NO: 273835 - protein, 9 aa, Homo Sapiens
QANQSNRQF

SEQ ID NO: 273836 - protein, 9 aa, Homo Sapiens
FLMVCLGTF

SEQ ID NO: 273837 - protein, 9 aa, Homo Sapiens
VTHQHAVDT

SEQ ID NO: 273838 - protein, 9 aa, Homo Sapiens
HSRRVIHRD

SEQ ID NO: 273839 - protein, 9 aa, Homo Sapiens
LNWTWISFE

SEQ ID NO: 273840 - protein, 9 aa, Homo Sapiens
IQAKLERVY

SEQ ID NO: 273841 - protein, 9 aa, Homo Sapiens
EGSPAAIPF

SEQ ID NO: 273842 - protein, 9 aa, Homo Sapiens
YDKWIKDAD

SEQ ID NO: 273843 - protein, 9 aa, Homo Sapiens
TSSKEEVIQ

SEQ ID NO: 273844 - protein, 9 aa, Homo Sapiens
AFRKRHVLG

SEQ ID NO: 273845 - protein, 9 aa, Homo Sapiens
LWFTWSMKT

SEQ ID NO: 273846 - protein, 9 aa, Homo Sapiens
VTSEENNSE

SEQ ID NO: 273847 - protein, 9 aa, Homo Sapiens
LFTDNCSFN

SEQ ID NO: 273848 - protein, 9 aa, Homo Sapiens
PWHQFALRL

SEQ ID NO: 273849 - protein, 9 aa, Homo Sapiens
MQKTIQMWL

SEQ ID NO: 273850 - protein, 9 aa, Homo Sapiens
IACFYGRIL

SEQ ID NO: 273851 - protein, 9 aa, Homo Sapiens
ATKMFLIVA

SEQ ID NO: 273852 - protein, 9 aa, Homo Sapiens
PSEDFITPL

SEQ ID NO: 273853 - protein, 9 aa, Homo Sapiens
HQNLQRQFR

SEQ ID NO: 273854 - protein, 9 aa, Homo Sapiens
EMLSSQESM

SEQ ID NO: 273855 - protein, 9 aa, Homo Sapiens
YGSQPHSRS

SEQ ID NO: 273856 - protein, 9 aa, Homo Sapiens
YPMAQTPPC

SEQ ID NO: 273857 - protein, 9 aa, Homo Sapiens
PPVEAGKEI

SEQ ID NO: 273858 - protein, 9 aa, Homo Sapiens
VFNIMRENN

SEQ ID NO: 273859 - protein, 9 aa, Homo Sapiens
VSARCSDSV

SEQ ID NO: 273860 - protein, 9 aa, Homo Sapiens
HGRLLPQYM

SEQ ID NO: 273861 - protein, 9 aa, Homo Sapiens
NISFLCREY

SEQ ID NO: 273862 - protein, 9 aa, Homo Sapiens
ANLNALDIY

SEQ ID NO: 273863 - protein, 9 aa, Homo Sapiens
KTNFYSSQG

SEQ ID NO: 273864 - protein, 9 aa, Homo Sapiens
RIEDFSSIA

SEQ ID NO: 273865 - protein, 9 aa, Homo Sapiens
GDPDFEGER

SEQ ID NO: 273866 - protein, 9 aa, Homo Sapiens
SWNPCPDFT

SEQ ID NO: 273867 - protein, 9 aa, Homo Sapiens
EIGIEMKFN

SEQ ID NO: 273868 - protein, 9 aa, Homo Sapiens
EACKLGVPV

SEQ ID NO: 273869 - protein, 9 aa, Homo Sapiens
KDPKSKHHT

SEQ ID NO: 273870 - protein, 9 aa, Homo Sapiens
ISTNKTQID

SEQ ID NO: 273871 - protein, 9 aa, Homo Sapiens
ECQAKNLPK

SEQ ID NO: 273872 - protein, 9 aa, Homo Sapiens
LEDRNSMTS

SEQ ID NO: 273873 - protein, 9 aa, Homo Sapiens
RNGLEKTGK

SEQ ID NO: 273874 - protein, 9 aa, Homo Sapiens
GVPEFILVG

SEQ ID NO: 273875 - protein, 9 aa, Homo Sapiens
EKPLECTEC

SEQ ID NO: 273876 - protein, 9 aa, Homo Sapiens
TKALLVFSP

SEQ ID NO: 273877 - protein, 9 aa, Homo Sapiens
IVDSCDELI

SEQ ID NO: 273878 - protein, 9 aa, Homo Sapiens
PYTNSKVTG

SEQ ID NO: 273879 - protein, 9 aa, Homo Sapiens
AATPYGIKS

SEQ ID NO: 273880 - protein, 9 aa, Homo Sapiens
SGSKYLKDV

SEQ ID NO: 273881 - protein, 9 aa, Homo Sapiens
AKIIEAKQK

SEQ ID NO: 273882 - protein, 9 aa, Homo Sapiens
QERINRFIV

SEQ ID NO: 273883 - protein, 9 aa, Homo Sapiens
IAEIGIAVQ

SEQ ID NO: 273884 - protein, 9 aa, Homo Sapiens
TATVAPQGE

SEQ ID NO: 273885 - protein, 9 aa, Homo Sapiens
FSDCQRDKV

SEQ ID NO: 273886 - protein, 9 aa, Homo Sapiens
QFKKMKNNI

SEQ ID NO: 273887 - protein, 9 aa, Homo Sapiens
YEYKSKRYE

SEQ ID NO: 273888 - protein, 9 aa, Homo Sapiens
RSLWFTWSM

SEQ ID NO: 273889 - protein, 9 aa, Homo Sapiens
KPENSTFEN

SEQ ID NO: 273890 - protein, 9 aa, Homo Sapiens
NDVDVQNIV

SEQ ID NO: 273891 - protein, 9 aa, Homo Sapiens
LAHRLWRWH

SEQ ID NO: 273892 - protein, 9 aa, Homo Sapiens
CGSLLWGIV

SEQ ID NO: 273893 - protein, 9 aa, Homo Sapiens
GMQPCVFWT

SEQ ID NO: 273894 - protein, 9 aa, Homo Sapiens
ACTEELGVL

SEQ ID NO: 273895 - protein, 9 aa, Homo Sapiens
MDNDTNNLA

SEQ ID NO: 273896 - protein, 9 aa, Homo Sapiens
DGPTYGSSA

SEQ ID NO: 273897 - protein, 9 aa, Homo Sapiens
IYKSELRKS

SEQ ID NO: 273898 - protein, 9 aa, Homo Sapiens
ADPLFRSAQ

SEQ ID NO: 273899 - protein, 9 aa, Homo Sapiens
VPIRDDGNM

SEQ ID NO: 273900 - protein, 9 aa, Homo Sapiens
LNCSYTQTC

SEQ ID NO: 273901 - protein, 9 aa, Homo Sapiens
AGDLHCDCY

SEQ ID NO: 273902 - protein, 9 aa, Homo Sapiens
KTLQVSNTQ

SEQ ID NO: 273903 - protein, 9 aa, Homo Sapiens
EKTCDCLPK

SEQ ID NO: 273904 - protein, 9 aa, Homo Sapiens
KKAENKLEE

SEQ ID NO: 273905 - protein, 9 aa, Homo Sapiens
QLHKLIRKS

SEQ ID NO: 273906 - protein, 9 aa, Homo Sapiens
EHMGKRINH

SEQ ID NO: 273907 - protein, 9 aa, Homo Sapiens
MVNLKKNIH

SEQ ID NO: 273908 - protein, 9 aa, Homo Sapiens
RNDLSEDFS

SEQ ID NO: 273909 - protein, 9 aa, Homo Sapiens
IVAFLGNML

SEQ ID NO: 273910 - protein, 9 aa, Homo Sapiens
MPADMLIER

SEQ ID NO: 273911 - protein, 9 aa, Homo Sapiens
KMFSESHKT

SEQ ID NO: 273912 - protein, 9 aa, Homo Sapiens
EGTLLGAGF

SEQ ID NO: 273913 - protein, 9 aa, Homo Sapiens
EVNYLHERS

SEQ ID NO: 273914 - protein, 9 aa, Homo Sapiens
SSKRSPIIN

SEQ ID NO: 273915 - protein, 9 aa, Homo Sapiens
EKQEWADPD

SEQ ID NO: 273916 - protein, 9 aa, Homo Sapiens
SKFLRRCNL

SEQ ID NO: 273917 - protein, 9 aa, Homo Sapiens
GEIGLPGFP

SEQ ID NO: 273918 - protein, 9 aa, Homo Sapiens
PQSDKGALQ

SEQ ID NO: 273919 - protein, 9 aa, Homo Sapiens
EHIKYRHKK

SEQ ID NO: 273920 - protein, 9 aa, Homo Sapiens
WKPHVSNTV

SEQ ID NO: 273921 - protein, 9 aa, Homo Sapiens
CLDGSDKRH

SEQ ID NO: 273922 - protein, 9 aa, Homo Sapiens
LHFPCSMII

SEQ ID NO: 273923 - protein, 9 aa, Homo Sapiens
LAYHVARIT

SEQ ID NO: 273924 - protein, 9 aa, Homo Sapiens
FIARFLGSM

SEQ ID NO: 273925 - protein, 9 aa, Homo Sapiens
TRTTKEAGS

SEQ ID NO: 273926 - protein, 9 aa, Homo Sapiens
CIHHLTVVT

SEQ ID NO: 273927 - protein, 9 aa, Homo Sapiens
LKWQKDTLQ

SEQ ID NO: 273928 - protein, 9 aa, Homo Sapiens
LEQVTHQHA

SEQ ID NO: 273929 - protein, 9 aa, Homo Sapiens
YKIKSDEQE

SEQ ID NO: 273930 - protein, 9 aa, Homo Sapiens
TNVHDIMVY

SEQ ID NO: 273931 - protein, 9 aa, Homo Sapiens
SIIMNSVVP

SEQ ID NO: 273932 - protein, 9 aa, Homo Sapiens
AARQDAASQ

SEQ ID NO: 273933 - protein, 9 aa, Homo Sapiens
SACTNHQPA

SEQ ID NO: 273934 - protein, 9 aa, Homo Sapiens
PTEKSRQYL

SEQ ID NO: 273935 - protein, 9 aa, Homo Sapiens
CGKALTSKI

SEQ ID NO: 273936 - protein, 9 aa, Homo Sapiens
LSNANKQAV

SEQ ID NO: 273937 - protein, 9 aa, Homo Sapiens
NNCCKPASC

SEQ ID NO: 273938 - protein, 9 aa, Homo Sapiens
KEGDLRTMP

SEQ ID NO: 273939 - protein, 9 aa, Homo Sapiens
RKKRRSTPL

SEQ ID NO: 273940 - protein, 9 aa, Homo Sapiens
FLAKNMMIS

SEQ ID NO: 273941 - protein, 9 aa, Homo Sapiens
TPIQITHSI

SEQ ID NO: 273942 - protein, 9 aa, Homo Sapiens
KVLLYVRRE

SEQ ID NO: 273943 - protein, 9 aa, Homo Sapiens
VMYVVTLMG

SEQ ID NO: 273944 - protein, 9 aa, Homo Sapiens
EPENRPSFY

SEQ ID NO: 273945 - protein, 9 aa, Homo Sapiens
LAPEKQRLF

SEQ ID NO: 273946 - protein, 9 aa, Homo Sapiens
KDRSPLSTL

SEQ ID NO: 273947 - protein, 9 aa, Homo Sapiens
DFLDAELDN

SEQ ID NO: 273948 - protein, 9 aa, Homo Sapiens
KLAENINTF

SEQ ID NO: 273949 - protein, 9 aa, Homo Sapiens
QIMGGMGLS

SEQ ID NO: 273950 - protein, 9 aa, Homo Sapiens
DDQAGQNIR

SEQ ID NO: 273951 - protein, 9 aa, Homo Sapiens
AISGLKVNC

SEQ ID NO: 273952 - protein, 9 aa, Homo Sapiens
SVVTSEINQ

SEQ ID NO: 273953 - protein, 9 aa, Homo Sapiens
FSCKDTLVQ

SEQ ID NO: 273954 - protein, 9 aa, Homo Sapiens
YNFITMKRS

SEQ ID NO: 273955 - protein, 9 aa, Homo Sapiens
TQTIHIVYD

SEQ ID NO: 273956 - protein, 9 aa, Homo Sapiens
AQLDFYHFL

SEQ ID NO: 273957 - protein, 9 aa, Homo Sapiens
YWKDQHVIC

SEQ ID NO: 273958 - protein, 9 aa, Homo Sapiens
PTLKWKPLI

SEQ ID NO: 273959 - protein, 9 aa, Homo Sapiens
SKKNVCVSL

SEQ ID NO: 273960 - protein, 9 aa, Homo Sapiens
QVILHLITH

SEQ ID NO: 273961 - protein, 9 aa, Homo Sapiens
IPGHPAPPA

SEQ ID NO: 273962 - protein, 9 aa, Homo Sapiens
KYVRYSKIR

SEQ ID NO: 273963 - protein, 9 aa, Homo Sapiens
PTPLPNLGP

SEQ ID NO: 273964 - protein, 9 aa, Homo Sapiens
EIKKRKKAA

SEQ ID NO: 273965 - protein, 9 aa, Homo Sapiens
KTRLEQDIA

SEQ ID NO: 273966 - protein, 9 aa, Homo Sapiens
GTTSTISTV

SEQ ID NO: 273967 - protein, 9 aa, Homo Sapiens
SCLYMLKTI

SEQ ID NO: 273968 - protein, 9 aa, Homo Sapiens
LLCTIMGET

SEQ ID NO: 273969 - protein, 9 aa, Homo Sapiens
NLIQEVIVG

SEQ ID NO: 273970 - protein, 9 aa, Homo Sapiens
GRKDLLCRT

SEQ ID NO: 273971 - protein, 9 aa, Homo Sapiens
SRTLHAFSA

SEQ ID NO: 273972 - protein, 9 aa, Homo Sapiens
PYKTNKGDG

SEQ ID NO: 273973 - protein, 9 aa, Homo Sapiens
AESMATEGL

SEQ ID NO: 273974 - protein, 9 aa, Homo Sapiens
LIGNKCEEF

SEQ ID NO: 273975 - protein, 9 aa, Homo Sapiens
KISNKSYVH

SEQ ID NO: 273976 - protein, 9 aa, Homo Sapiens
RLTDTYNKI

SEQ ID NO: 273977 - protein, 9 aa, Homo Sapiens
SRGEHCVHT

SEQ ID NO: 273978 - protein, 9 aa, Homo Sapiens
PGESYQPIK

SEQ ID NO: 273979 - protein, 9 aa, Homo Sapiens
HCQLLYITA

SEQ ID NO: 273980 - protein, 9 aa, Homo Sapiens
QSTVILPAP

SEQ ID NO: 273981 - protein, 9 aa, Homo Sapiens
YKCNECGQS

SEQ ID NO: 273982 - protein, 9 aa, Homo Sapiens
VGVCIYVDA

SEQ ID NO: 273983 - protein, 9 aa, Homo Sapiens
VNWPPGKMF

SEQ ID NO: 273984 - protein, 9 aa, Homo Sapiens
LSRRSHANR

SEQ ID NO: 273985 - protein, 9 aa, Homo Sapiens
PSIITKNLL

SEQ ID NO: 273986 - protein, 9 aa, Homo Sapiens
YKKRPVQIE

SEQ ID NO: 273987 - protein, 9 aa, Homo Sapiens
KTSVDCLWR

SEQ ID NO: 273988 - protein, 9 aa, Homo Sapiens
KVFSPLRKL

SEQ ID NO: 273989 - protein, 9 aa, Homo Sapiens
TKTSKRARP

SEQ ID NO: 273990 - protein, 9 aa, Homo Sapiens
FQLTQQEIV

SEQ ID NO: 273991 - protein, 9 aa, Homo Sapiens
WFENDKEIK

SEQ ID NO: 273992 - protein, 9 aa, Homo Sapiens
GKLPLQPHE

SEQ ID NO: 273993 - protein, 9 aa, Homo Sapiens
ADVLGLILR

SEQ ID NO: 273994 - protein, 9 aa, Homo Sapiens
DSESTEISL

SEQ ID NO: 273995 - protein, 9 aa, Homo Sapiens
ALLRIAHGT

SEQ ID NO: 273996 - protein, 9 aa, Homo Sapiens
RCLAWDKDL

SEQ ID NO: 273997 - protein, 9 aa, Homo Sapiens
GLVQSVVYH

SEQ ID NO: 273998 - protein, 9 aa, Homo Sapiens
TRVTKFILM

SEQ ID NO: 273999 - protein, 9 aa, Homo Sapiens
LDFAESDQF

SEQ ID NO: 274000 - protein, 9 aa, Homo Sapiens
HLLLSGERG

SEQ ID NO: 274001 - protein, 9 aa, Homo Sapiens
YKQEDSSDD

SEQ ID NO: 274002 - protein, 9 aa, Homo Sapiens
EISSATESR

SEQ ID NO: 274003 - protein, 9 aa, Homo Sapiens
RRYDVKTRT

SEQ ID NO: 274004 - protein, 9 aa, Homo Sapiens
LMFWFGVTS

SEQ ID NO: 274005 - protein, 9 aa, Homo Sapiens
FMVNLKKNI

SEQ ID NO: 274006 - protein, 9 aa, Homo Sapiens
RQDAASQSC

SEQ ID NO: 274007 - protein, 9 aa, Homo Sapiens
HGLKVEINC

SEQ ID NO: 274008 - protein, 9 aa, Homo Sapiens
DNRRRVEET

SEQ ID NO: 274009 - protein, 9 aa, Homo Sapiens
GDRNKRKKY

SEQ ID NO: 274010 - protein, 9 aa, Homo Sapiens
RYDITNNSD

SEQ ID NO: 274011 - protein, 9 aa, Homo Sapiens
WPEGMCIQA

SEQ ID NO: 274012 - protein, 9 aa, Homo Sapiens
PTPNLDMYG

SEQ ID NO: 274013 - protein, 9 aa, Homo Sapiens
ALLVLLLLQ

SEQ ID NO: 274014 - protein, 9 aa, Homo Sapiens
TETGEVCED

SEQ ID NO: 274015 - protein, 9 aa, Homo Sapiens
QKSCEQNIE

SEQ ID NO: 274016 - protein, 9 aa, Homo Sapiens
VRAYQYTAL

SEQ ID NO: 274017 - protein, 9 aa, Homo Sapiens
PEAINVGSF

SEQ ID NO: 274018 - protein, 9 aa, Homo Sapiens
LNVMNVLSI

SEQ ID NO: 274019 - protein, 9 aa, Homo Sapiens
IWMINNRGE

SEQ ID NO: 274020 - protein, 9 aa, Homo Sapiens
LPIFFLALV

SEQ ID NO: 274021 - protein, 9 aa, Homo Sapiens
PSSGVRLNQ

SEQ ID NO: 274022 - protein, 9 aa, Homo Sapiens
KGKRGSVCG

SEQ ID NO: 274023 - protein, 9 aa, Homo Sapiens
KLVIWDINK

SEQ ID NO: 274024 - protein, 9 aa, Homo Sapiens
NDQTCCLKL

SEQ ID NO: 274025 - protein, 9 aa, Homo Sapiens
HSTRLILDP

SEQ ID NO: 274026 - protein, 9 aa, Homo Sapiens
DENIIGVVG

SEQ ID NO: 274027 - protein, 9 aa, Homo Sapiens
FMTLFFAHG

SEQ ID NO: 274028 - protein, 9 aa, Homo Sapiens
KITNCEQNS

SEQ ID NO: 274029 - protein, 9 aa, Homo Sapiens
DKGDVILKI

SEQ ID NO: 274030 - protein, 9 aa, Homo Sapiens
VTPVIRAGW

SEQ ID NO: 274031 - protein, 9 aa, Homo Sapiens
RDTHHSQNP

SEQ ID NO: 274032 - protein, 9 aa, Homo Sapiens
HAARKPLDV

SEQ ID NO: 274033 - protein, 9 aa, Homo Sapiens
GIGSRGDGS

SEQ ID NO: 274034 - protein, 9 aa, Homo Sapiens
VYLWRHHIK

SEQ ID NO: 274035 - protein, 9 aa, Homo Sapiens
HRSNSKDVQ

SEQ ID NO: 274036 - protein, 9 aa, Homo Sapiens
VHNAGPIAN

SEQ ID NO: 274037 - protein, 9 aa, Homo Sapiens
VKYGVWQNV

SEQ ID NO: 274038 - protein, 9 aa, Homo Sapiens
DHLATDNQK

SEQ ID NO: 274039 - protein, 9 aa, Homo Sapiens
AQRLNINPD

SEQ ID NO: 274040 - protein, 9 aa, Homo Sapiens
SDSDPHESF

SEQ ID NO: 274041 - protein, 9 aa, Homo Sapiens
RSQIKNEEI

SEQ ID NO: 274042 - protein, 9 aa, Homo Sapiens
QASFERMNV

SEQ ID NO: 274043 - protein, 9 aa, Homo Sapiens
VENGWISKL

SEQ ID NO: 274044 - protein, 9 aa, Homo Sapiens
VGRDKKLGE

SEQ ID NO: 274045 - protein, 9 aa, Homo Sapiens
ECIENPKHL

SEQ ID NO: 274046 - protein, 9 aa, Homo Sapiens
SMTQEEFVK

SEQ ID NO: 274047 - protein, 9 aa, Homo Sapiens
PGTDEAEDP

SEQ ID NO: 274048 - protein, 9 aa, Homo Sapiens
SRVQPELYH

SEQ ID NO: 274049 - protein, 9 aa, Homo Sapiens
NADDTLSRR

SEQ ID NO: 274050 - protein, 9 aa, Homo Sapiens
KPIDIKGSV

SEQ ID NO: 274051 - protein, 9 aa, Homo Sapiens
GSDCPDPQA

SEQ ID NO: 274052 - protein, 9 aa, Homo Sapiens
IPSLEEPME

SEQ ID NO: 274053 - protein, 9 aa, Homo Sapiens
LQPFELPMT

SEQ ID NO: 274054 - protein, 9 aa, Homo Sapiens
VISINNYHP

SEQ ID NO: 274055 - protein, 9 aa, Homo Sapiens
PEVLQQNIQ

SEQ ID NO: 274056 - protein, 9 aa, Homo Sapiens
DYGFVSTLV

SEQ ID NO: 274057 - protein, 9 aa, Homo Sapiens
AQGVHLDRD

SEQ ID NO: 274058 - protein, 9 aa, Homo Sapiens
KMDTYAKSH

SEQ ID NO: 274059 - protein, 9 aa, Homo Sapiens
KPLEDIKAR

SEQ ID NO: 274060 - protein, 9 aa, Homo Sapiens
LETCIDDAL

SEQ ID NO: 274061 - protein, 9 aa, Homo Sapiens
CGIAQASHL

SEQ ID NO: 274062 - protein, 9 aa, Homo Sapiens
RLSFALERI

SEQ ID NO: 274063 - protein, 9 aa, Homo Sapiens
TQLPEDAFN

SEQ ID NO: 274064 - protein, 9 aa, Homo Sapiens
PSKLWNNRT

SEQ ID NO: 274065 - protein, 9 aa, Homo Sapiens
IIDNLHHVG

SEQ ID NO: 274066 - protein, 9 aa, Homo Sapiens
FGKGAASEG

SEQ ID NO: 274067 - protein, 9 aa, Homo Sapiens
AQVYKQSDL

SEQ ID NO: 274068 - protein, 9 aa, Homo Sapiens
VLVILSTLL

SEQ ID NO: 274069 - protein, 9 aa, Homo Sapiens
TLMEITIRH

SEQ ID NO: 274070 - protein, 9 aa, Homo Sapiens
TQQEIVALL

SEQ ID NO: 274071 - protein, 9 aa, Homo Sapiens
SDPNLFKMI

SEQ ID NO: 274072 - protein, 9 aa, Homo Sapiens
PERICQRTH

SEQ ID NO: 274073 - protein, 9 aa, Homo Sapiens
QRQYCSPRR

SEQ ID NO: 274074 - protein, 9 aa, Homo Sapiens
PQYCLFGNT

SEQ ID NO: 274075 - protein, 9 aa, Homo Sapiens
RGNVTIKEG

SEQ ID NO: 274076 - protein, 9 aa, Homo Sapiens
IIGIKKAIT

SEQ ID NO: 274077 - protein, 9 aa, Homo Sapiens
LEQLGRYQV

SEQ ID NO: 274078 - protein, 9 aa, Homo Sapiens
TRGKKNRSS

SEQ ID NO: 274079 - protein, 9 aa, Homo Sapiens
YYSIMNRRL

SEQ ID NO: 274080 - protein, 9 aa, Homo Sapiens
FEQILKVEY

SEQ ID NO: 274081 - protein, 9 aa, Homo Sapiens
SSGQNFQHI

SEQ ID NO: 274082 - protein, 9 aa, Homo Sapiens
LDCCGNIMQ

SEQ ID NO: 274083 - protein, 9 aa, Homo Sapiens
KSFSQKYDR

SEQ ID NO: 274084 - protein, 9 aa, Homo Sapiens
VLDNCINTM

SEQ ID NO: 274085 - protein, 9 aa, Homo Sapiens
SWIAGQAME

SEQ ID NO: 274086 - protein, 9 aa, Homo Sapiens
QVLLDVKPR

SEQ ID NO: 274087 - protein, 9 aa, Homo Sapiens
DTLLQQDFE

SEQ ID NO: 274088 - protein, 9 aa, Homo Sapiens
ETEDIFLNM

SEQ ID NO: 274089 - protein, 9 aa, Homo Sapiens
LQPHEFWDV

SEQ ID NO: 274090 - protein, 9 aa, Homo Sapiens
DDCENDFQC

SEQ ID NO: 274091 - protein, 9 aa, Homo Sapiens
KFLANALTK

SEQ ID NO: 274092 - protein, 9 aa, Homo Sapiens
PVIIYPDRI

SEQ ID NO: 274093 - protein, 9 aa, Homo Sapiens
ININPKFHT

SEQ ID NO: 274094 - protein, 9 aa, Homo Sapiens
KLDESLKEI

SEQ ID NO: 274095 - protein, 9 aa, Homo Sapiens
LGKHVGNKF

SEQ ID NO: 274096 - protein, 9 aa, Homo Sapiens
YLVLEPTQN

SEQ ID NO: 274097 - protein, 9 aa, Homo Sapiens
FDQFKRRIE

SEQ ID NO: 274098 - protein, 9 aa, Homo Sapiens
QFLFVVFTV

SEQ ID NO: 274099 - protein, 9 aa, Homo Sapiens
DEDGSMINS

SEQ ID NO: 274100 - protein, 9 aa, Homo Sapiens
FNKVSIVPT

SEQ ID NO: 274101 - protein, 9 aa, Homo Sapiens
YTLSGLAQI

SEQ ID NO: 274102 - protein, 9 aa, Homo Sapiens
ILFKAKNLI

SEQ ID NO: 274103 - protein, 9 aa, Homo Sapiens
LMEPCRLYH

SEQ ID NO: 274104 - protein, 9 aa, Homo Sapiens
SLKSLEHKT

SEQ ID NO: 274105 - protein, 9 aa, Homo Sapiens
REEDTSRQI

SEQ ID NO: 274106 - protein, 9 aa, Homo Sapiens
GSLCLRTFS

SEQ ID NO: 274107 - protein, 9 aa, Homo Sapiens
VHSSTNELT

SEQ ID NO: 274108 - protein, 9 aa, Homo Sapiens
NDKLKEMSP

SEQ ID NO: 274109 - protein, 9 aa, Homo Sapiens
LWTQGKNTE

SEQ ID NO: 274110 - protein, 9 aa, Homo Sapiens
SLNWGYQVA

SEQ ID NO: 274111 - protein, 9 aa, Homo Sapiens
PAGKHWLGN

SEQ ID NO: 274112 - protein, 9 aa, Homo Sapiens
ADLTCEIKI

SEQ ID NO: 274113 - protein, 9 aa, Homo Sapiens
SVDLSDRLE

SEQ ID NO: 274114 - protein, 9 aa, Homo Sapiens
EGQWLEWGS

SEQ ID NO: 274115 - protein, 9 aa, Homo Sapiens
GKSQRNSLC

SEQ ID NO: 274116 - protein, 9 aa, Homo Sapiens
SPAEYKILA

SEQ ID NO: 274117 - protein, 9 aa, Homo Sapiens
SASPTSIQT

SEQ ID NO: 274118 - protein, 9 aa, Homo Sapiens
EGCLKETQK

SEQ ID NO: 274119 - protein, 9 aa, Homo Sapiens
QHQQFMDRT

SEQ ID NO: 274120 - protein, 9 aa, Homo Sapiens
MNISTDKSW

SEQ ID NO: 274121 - protein, 9 aa, Homo Sapiens
WILVLELVP

SEQ ID NO: 274122 - protein, 9 aa, Homo Sapiens
LGDPSPSSK

SEQ ID NO: 274123 - protein, 9 aa, Homo Sapiens
SNIISEKKT

SEQ ID NO: 274124 - protein, 9 aa, Homo Sapiens
TSHLIVTSP

SEQ ID NO: 274125 - protein, 9 aa, Homo Sapiens
VAPNTLHLE

SEQ ID NO: 274126 - protein, 9 aa, Homo Sapiens
RERNKIRSE

SEQ ID NO: 274127 - protein, 9 aa, Homo Sapiens
SGATGSKDD

SEQ ID NO: 274128 - protein, 9 aa, Homo Sapiens
KQFILYAYW

SEQ ID NO: 274129 - protein, 9 aa, Homo Sapiens
EFSYESGVK

SEQ ID NO: 274130 - protein, 9 aa, Homo Sapiens
RLKLVKLSR

SEQ ID NO: 274131 - protein, 9 aa, Homo Sapiens
RSKKSPRVF

SEQ ID NO: 274132 - protein, 9 aa, Homo Sapiens
TLVILIQTD

SEQ ID NO: 274133 - protein, 9 aa, Homo Sapiens
TDKGRIHLM

SEQ ID NO: 274134 - protein, 9 aa, Homo Sapiens
AWLSPAPEP

SEQ ID NO: 274135 - protein, 9 aa, Homo Sapiens
FVTIGLDKI

SEQ ID NO: 274136 - protein, 9 aa, Homo Sapiens
MKRQTLLDW

SEQ ID NO: 274137 - protein, 9 aa, Homo Sapiens
PGVVWFKYS

SEQ ID NO: 274138 - protein, 9 aa, Homo Sapiens
CFQNMGICK

SEQ ID NO: 274139 - protein, 9 aa, Homo Sapiens
MVGCFGMGI

SEQ ID NO: 274140 - protein, 9 aa, Homo Sapiens
YLTVFKKTV

SEQ ID NO: 274141 - protein, 9 aa, Homo Sapiens
FVGYGQKFC

SEQ ID NO: 274142 - protein, 9 aa, Homo Sapiens
RELDSCLVR

SEQ ID NO: 274143 - protein, 9 aa, Homo Sapiens
NQVLDWCRQ

SEQ ID NO: 274144 - protein, 9 aa, Homo Sapiens
CNNVGVCIY

SEQ ID NO: 274145 - protein, 9 aa, Homo Sapiens
LMTTENSVA

SEQ ID NO: 274146 - protein, 9 aa, Homo Sapiens
KIIYLQNNL

SEQ ID NO: 274147 - protein, 9 aa, Homo Sapiens
NSERVKRIL

SEQ ID NO: 274148 - protein, 9 aa, Homo Sapiens
FSVKTNIQS

SEQ ID NO: 274149 - protein, 9 aa, Homo Sapiens
IKHYHVKET

SEQ ID NO: 274150 - protein, 9 aa, Homo Sapiens
ENIPKEMVL

SEQ ID NO: 274151 - protein, 9 aa, Homo Sapiens
SVQDQDKQL

SEQ ID NO: 274152 - protein, 9 aa, Homo Sapiens
DFNRELSRM

SEQ ID NO: 274153 - protein, 9 aa, Homo Sapiens
LSEVVMQVQ

SEQ ID NO: 274154 - protein, 9 aa, Homo Sapiens
LRNFSACGG

SEQ ID NO: 274155 - protein, 9 aa, Homo Sapiens
RFACTEELG

SEQ ID NO: 274156 - protein, 9 aa, Homo Sapiens
PADMLIERS

SEQ ID NO: 274157 - protein, 9 aa, Homo Sapiens
VPQHVPVCL

SEQ ID NO: 274158 - protein, 9 aa, Homo Sapiens
LLGQICSLK

SEQ ID NO: 274159 - protein, 9 aa, Homo Sapiens
PEEEGAGGL

SEQ ID NO: 274160 - protein, 9 aa, Homo Sapiens
DLKGRGRDI

SEQ ID NO: 274161 - protein, 9 aa, Homo Sapiens
EIKEEEPGA

SEQ ID NO: 274162 - protein, 9 aa, Homo Sapiens
DMERVANSL

SEQ ID NO: 274163 - protein, 9 aa, Homo Sapiens
MINNQNKSV

SEQ ID NO: 274164 - protein, 9 aa, Homo Sapiens
LTILHVMCT

SEQ ID NO: 274165 - protein, 9 aa, Homo Sapiens
HGEIEVTIQ

SEQ ID NO: 274166 - protein, 9 aa, Homo Sapiens
TFRNSFVFN

SEQ ID NO: 274167 - protein, 9 aa, Homo Sapiens
MSVVWIQEA

SEQ ID NO: 274168 - protein, 9 aa, Homo Sapiens
FFDYSKVSF

SEQ ID NO: 274169 - protein, 9 aa, Homo Sapiens
NAVLSEAIS

SEQ ID NO: 274170 - protein, 9 aa, Homo Sapiens
NYIRITSDI

SEQ ID NO: 274171 - protein, 9 aa, Homo Sapiens
EGPMPFRTG

SEQ ID NO: 274172 - protein, 9 aa, Homo Sapiens
PGAQLDILI

SEQ ID NO: 274173 - protein, 9 aa, Homo Sapiens
DIRWFENDK

SEQ ID NO: 274174 - protein, 9 aa, Homo Sapiens
SHLIQHQQV

SEQ ID NO: 274175 - protein, 9 aa, Homo Sapiens
NSLEVDLIQ

SEQ ID NO: 274176 - protein, 9 aa, Homo Sapiens
AMVGGDVGS

SEQ ID NO: 274177 - protein, 9 aa, Homo Sapiens
GNLLLISLA

SEQ ID NO: 274178 - protein, 9 aa, Homo Sapiens
PPQPSNRNV

SEQ ID NO: 274179 - protein, 9 aa, Homo Sapiens
VILEQDIFH

SEQ ID NO: 274180 - protein, 9 aa, Homo Sapiens
LTTSQGSWH

SEQ ID NO: 274181 - protein, 9 aa, Homo Sapiens
FSFKLNLER

SEQ ID NO: 274182 - protein, 9 aa, Homo Sapiens
LPRSQPMNK

SEQ ID NO: 274183 - protein, 9 aa, Homo Sapiens
EIARFIIND

SEQ ID NO: 274184 - protein, 9 aa, Homo Sapiens
MNDVNYLIL

SEQ ID NO: 274185 - protein, 9 aa, Homo Sapiens
ICGLQQVKD

SEQ ID NO: 274186 - protein, 9 aa, Homo Sapiens
FKSFPEIYF

SEQ ID NO: 274187 - protein, 9 aa, Homo Sapiens
TASVQWFEC

SEQ ID NO: 274188 - protein, 9 aa, Homo Sapiens
SSNLAKDQR

SEQ ID NO: 274189 - protein, 9 aa, Homo Sapiens
LCVIPTSDP

SEQ ID NO: 274190 - protein, 9 aa, Homo Sapiens
SRDNEIILF

SEQ ID NO: 274191 - protein, 9 aa, Homo Sapiens
AIFYTIVIP

SEQ ID NO: 274192 - protein, 9 aa, Homo Sapiens
QINQEECKG

SEQ ID NO: 274193 - protein, 9 aa, Homo Sapiens
QEHRAEICL

SEQ ID NO: 274194 - protein, 9 aa, Homo Sapiens
QPMDTNMMV

SEQ ID NO: 274195 - protein, 9 aa, Homo Sapiens
ADNFIDKHI

SEQ ID NO: 274196 - protein, 9 aa, Homo Sapiens
SKKRFIFLG

SEQ ID NO: 274197 - protein, 9 aa, Homo Sapiens
IFLQNCLPH

SEQ ID NO: 274198 - protein, 9 aa, Homo Sapiens
GSRSTDDQI

SEQ ID NO: 274199 - protein, 9 aa, Homo Sapiens
SKEKTCDCL

SEQ ID NO: 274200 - protein, 9 aa, Homo Sapiens
KTRTWSFLL

SEQ ID NO: 274201 - protein, 9 aa, Homo Sapiens
VKSIEIAKN

SEQ ID NO: 274202 - protein, 9 aa, Homo Sapiens
LANQYHPDS

SEQ ID NO: 274203 - protein, 9 aa, Homo Sapiens
NPKYIIHFF

SEQ ID NO: 274204 - protein, 9 aa, Homo Sapiens
GLKLNSVNP

SEQ ID NO: 274205 - protein, 9 aa, Homo Sapiens
PVMDELGYM

SEQ ID NO: 274206 - protein, 9 aa, Homo Sapiens
FILTVSRPR

SEQ ID NO: 274207 - protein, 9 aa, Homo Sapiens
RRVRLSRRL

SEQ ID NO: 274208 - protein, 9 aa, Homo Sapiens
DIASKEQDF

SEQ ID NO: 274209 - protein, 9 aa, Homo Sapiens
NKILAGFPN

SEQ ID NO: 274210 - protein, 9 aa, Homo Sapiens
QLNITYVPQ

SEQ ID NO: 274211 - protein, 9 aa, Homo Sapiens
LDHCPSFIS

SEQ ID NO: 274212 - protein, 9 aa, Homo Sapiens
DIFLLTVMA

SEQ ID NO: 274213 - protein, 9 aa, Homo Sapiens
CDHDYVYLR

SEQ ID NO: 274214 - protein, 9 aa, Homo Sapiens
SDKPYYCTI

SEQ ID NO: 274215 - protein, 9 aa, Homo Sapiens
LIPEFINKI

SEQ ID NO: 274216 - protein, 9 aa, Homo Sapiens
STMFAEGNI

SEQ ID NO: 274217 - protein, 9 aa, Homo Sapiens
KSLKRAEVE

SEQ ID NO: 274218 - protein, 9 aa, Homo Sapiens
LIKHVQTVQ

SEQ ID NO: 274219 - protein, 9 aa, Homo Sapiens
MLSPLNAAC

SEQ ID NO: 274220 - protein, 9 aa, Homo Sapiens
QPSNRNVME

SEQ ID NO: 274221 - protein, 9 aa, Homo Sapiens
GKHFRSGYQ

SEQ ID NO: 274222 - protein, 9 aa, Homo Sapiens
PAAIPFGTL

SEQ ID NO: 274223 - protein, 9 aa, Homo Sapiens
RLYLVTGFE

SEQ ID NO: 274224 - protein, 9 aa, Homo Sapiens
ENRQWRCDQ

SEQ ID NO: 274225 - protein, 9 aa, Homo Sapiens
LLALDPSPF

SEQ ID NO: 274226 - protein, 9 aa, Homo Sapiens
VNTGQKGKY

SEQ ID NO: 274227 - protein, 9 aa, Homo Sapiens
YEEMGIKPS

SEQ ID NO: 274228 - protein, 9 aa, Homo Sapiens
NPSSGVRLN

SEQ ID NO: 274229 - protein, 9 aa, Homo Sapiens
ITCYPFVQA

SEQ ID NO: 274230 - protein, 9 aa, Homo Sapiens
KNLFWSIFG

SEQ ID NO: 274231 - protein, 9 aa, Homo Sapiens
TCIQQNIPK

SEQ ID NO: 274232 - protein, 9 aa, Homo Sapiens
LYVQNENSV

SEQ ID NO: 274233 - protein, 9 aa, Homo Sapiens
AVHVVDLFN

SEQ ID NO: 274234 - protein, 9 aa, Homo Sapiens
QDPPDSGEN

SEQ ID NO: 274235 - protein, 9 aa, Homo Sapiens
ASLIAKLAT

SEQ ID NO: 274236 - protein, 9 aa, Homo Sapiens
SLLFLLCHL

SEQ ID NO: 274237 - protein, 9 aa, Homo Sapiens
SIMLKFWIP

SEQ ID NO: 274238 - protein, 9 aa, Homo Sapiens
KIHLSPGKF

SEQ ID NO: 274239 - protein, 9 aa, Homo Sapiens
PNHLIKHVQ

SEQ ID NO: 274240 - protein, 9 aa, Homo Sapiens
FMLHSLSLQ

SEQ ID NO: 274241 - protein, 9 aa, Homo Sapiens
KLPVHRFCV

SEQ ID NO: 274242 - protein, 9 aa, Homo Sapiens
KSPEPGCTK

SEQ ID NO: 274243 - protein, 9 aa, Homo Sapiens
PLPCAPGTS

SEQ ID NO: 274244 - protein, 9 aa, Homo Sapiens
SAIRKIGER

SEQ ID NO: 274245 - protein, 9 aa, Homo Sapiens
PKDSLIDRG

SEQ ID NO: 274246 - protein, 9 aa, Homo Sapiens
NKGGLNGVD

SEQ ID NO: 274247 - protein, 9 aa, Homo Sapiens
QLCSGARRS

SEQ ID NO: 274248 - protein, 9 aa, Homo Sapiens
KEHNKEPAS

SEQ ID NO: 274249 - protein, 9 aa, Homo Sapiens
SDNSDDCQI

SEQ ID NO: 274250 - protein, 9 aa, Homo Sapiens
AMKYRRGPH

SEQ ID NO: 274251 - protein, 9 aa, Homo Sapiens
TQQQLHFMN

SEQ ID NO: 274252 - protein, 9 aa, Homo Sapiens
YHTDIQDIQ

SEQ ID NO: 274253 - protein, 9 aa, Homo Sapiens
TQDAEARVG

SEQ ID NO: 274254 - protein, 9 aa, Homo Sapiens
YYARTWYWI

SEQ ID NO: 274255 - protein, 9 aa, Homo Sapiens
DHPLMVIFQ

SEQ ID NO: 274256 - protein, 9 aa, Homo Sapiens
MFRPSVEVC

SEQ ID NO: 274257 - protein, 9 aa, Homo Sapiens
CVSHTEVQG

SEQ ID NO: 274258 - protein, 9 aa, Homo Sapiens
QAVMKDILQ

SEQ ID NO: 274259 - protein, 9 aa, Homo Sapiens
QQHGLRPVK

SEQ ID NO: 274260 - protein, 9 aa, Homo Sapiens
QGKNVEAIW

SEQ ID NO: 274261 - protein, 9 aa, Homo Sapiens
YNRLHSSDW

SEQ ID NO: 274262 - protein, 9 aa, Homo Sapiens
SLPAPSKAR

SEQ ID NO: 274263 - protein, 9 aa, Homo Sapiens
LKDELLCYI

SEQ ID NO: 274264 - protein, 9 aa, Homo Sapiens
EDDIQQLLN

SEQ ID NO: 274265 - protein, 9 aa, Homo Sapiens
KDPESFVKV

SEQ ID NO: 274266 - protein, 9 aa, Homo Sapiens
MDTNMMVPP

SEQ ID NO: 274267 - protein, 9 aa, Homo Sapiens
GTNINAVCR

SEQ ID NO: 274268 - protein, 9 aa, Homo Sapiens
INWLTGNFY

SEQ ID NO: 274269 - protein, 9 aa, Homo Sapiens
LLATDTCFL

SEQ ID NO: 274270 - protein, 9 aa, Homo Sapiens
EPDFVPNEK

SEQ ID NO: 274271 - protein, 9 aa, Homo Sapiens
DDLGEDDEY

SEQ ID NO: 274272 - protein, 9 aa, Homo Sapiens
ASSPQESFT

SEQ ID NO: 274273 - protein, 9 aa, Homo Sapiens
PDDHPENYI

SEQ ID NO: 274274 - protein, 9 aa, Homo Sapiens
SEQSPVADR

SEQ ID NO: 274275 - protein, 9 aa, Homo Sapiens
GDMYDLSTN

SEQ ID NO: 274276 - protein, 9 aa, Homo Sapiens
AAMGCAFPK

SEQ ID NO: 274277 - protein, 9 aa, Homo Sapiens
GSTKEIFRR

SEQ ID NO: 274278 - protein, 9 aa, Homo Sapiens
YHEGCTWGV

SEQ ID NO: 274279 - protein, 9 aa, Homo Sapiens
KEKKRIKKL

SEQ ID NO: 274280 - protein, 9 aa, Homo Sapiens
DLSGLPTGE

SEQ ID NO: 274281 - protein, 9 aa, Homo Sapiens
TLQSVSTGS

SEQ ID NO: 274282 - protein, 9 aa, Homo Sapiens
LRTESLISC

SEQ ID NO: 274283 - protein, 9 aa, Homo Sapiens
LRPQFLLIL

SEQ ID NO: 274284 - protein, 9 aa, Homo Sapiens
GHMSGQVVE

SEQ ID NO: 274285 - protein, 9 aa, Homo Sapiens
RWVRQAASQ

SEQ ID NO: 274286 - protein, 9 aa, Homo Sapiens
NTNPSLRPS

SEQ ID NO: 274287 - protein, 9 aa, Homo Sapiens
IQIQGYPLH

SEQ ID NO: 274288 - protein, 9 aa, Homo Sapiens
ASTFKIHER

SEQ ID NO: 274289 - protein, 9 aa, Homo Sapiens
HLLLLALLM

SEQ ID NO: 274290 - protein, 9 aa, Homo Sapiens
SKSREEVSS

SEQ ID NO: 274291 - protein, 9 aa, Homo Sapiens
ANADYSSKT

SEQ ID NO: 274292 - protein, 9 aa, Homo Sapiens
NKRKSNLSN

SEQ ID NO: 274293 - protein, 9 aa, Homo Sapiens
IPKEHHRVV

SEQ ID NO: 274294 - protein, 9 aa, Homo Sapiens
KWCRDLKII

SEQ ID NO: 274295 - protein, 9 aa, Homo Sapiens
DLGPPTKKI

SEQ ID NO: 274296 - protein, 9 aa, Homo Sapiens
DVDSSSSLY

SEQ ID NO: 274297 - protein, 9 aa, Homo Sapiens
CHSRRVIHR

SEQ ID NO: 274298 - protein, 9 aa, Homo Sapiens
LHHFLPAGF

SEQ ID NO: 274299 - protein, 9 aa, Homo Sapiens
NVGVCIYVD

SEQ ID NO: 274300 - protein, 9 aa, Homo Sapiens
REKQLREHM

SEQ ID NO: 274301 - protein, 9 aa, Homo Sapiens
PVELDLLGD

SEQ ID NO: 274302 - protein, 9 aa, Homo Sapiens
EVDRCGDNK

SEQ ID NO: 274303 - protein, 9 aa, Homo Sapiens
MNGFAKLYG

SEQ ID NO: 274304 - protein, 9 aa, Homo Sapiens
PFRRKEMEI

SEQ ID NO: 274305 - protein, 9 aa, Homo Sapiens
MSLVILPHS

SEQ ID NO: 274306 - protein, 9 aa, Homo Sapiens
LINVLIAVN

SEQ ID NO: 274307 - protein, 9 aa, Homo Sapiens
ATLVTERIM

SEQ ID NO: 274308 - protein, 9 aa, Homo Sapiens
MDLRCVEMK

SEQ ID NO: 274309 - protein, 9 aa, Homo Sapiens
FNSRMNNKL

SEQ ID NO: 274310 - protein, 9 aa, Homo Sapiens
ISDEPEVDF

SEQ ID NO: 274311 - protein, 9 aa, Homo Sapiens
GHHELIKLS

SEQ ID NO: 274312 - protein, 9 aa, Homo Sapiens
GRQVMEGDR

SEQ ID NO: 274313 - protein, 9 aa, Homo Sapiens
KKPPVENRR

SEQ ID NO: 274314 - protein, 9 aa, Homo Sapiens
VLFILFITW

SEQ ID NO: 274315 - protein, 9 aa, Homo Sapiens
DILLVNRDS

SEQ ID NO: 274316 - protein, 9 aa, Homo Sapiens
SELQAWTGK

SEQ ID NO: 274317 - protein, 9 aa, Homo Sapiens
ILELPLPQF

SEQ ID NO: 274318 - protein, 9 aa, Homo Sapiens
ESLISCWPL

SEQ ID NO: 274319 - protein, 9 aa, Homo Sapiens
DAFMKANSG

SEQ ID NO: 274320 - protein, 9 aa, Homo Sapiens
GSSVAMSHG

SEQ ID NO: 274321 - protein, 9 aa, Homo Sapiens
LFLPKGTEV

SEQ ID NO: 274322 - protein, 9 aa, Homo Sapiens
LSQDEGILW

SEQ ID NO: 274323 - protein, 9 aa, Homo Sapiens
PCMECEKRF

SEQ ID NO: 274324 - protein, 9 aa, Homo Sapiens
AVVAGLLRL

SEQ ID NO: 274325 - protein, 9 aa, Homo Sapiens
IQVLRVVQN

SEQ ID NO: 274326 - protein, 9 aa, Homo Sapiens
HKEKEHAHL

SEQ ID NO: 274327 - protein, 9 aa, Homo Sapiens
LAGGQHRNG

SEQ ID NO: 274328 - protein, 9 aa, Homo Sapiens
YPKIVHFSV

SEQ ID NO: 274329 - protein, 9 aa, Homo Sapiens
VLGDGTDKT

SEQ ID NO: 274330 - protein, 9 aa, Homo Sapiens
RGKFSEVKA

SEQ ID NO: 274331 - protein, 9 aa, Homo Sapiens
LLSAVDEGH

SEQ ID NO: 274332 - protein, 9 aa, Homo Sapiens
QKRVLGHYV

SEQ ID NO: 274333 - protein, 9 aa, Homo Sapiens
VKTQSQLSL

SEQ ID NO: 274334 - protein, 9 aa, Homo Sapiens
ERFPVPSPP

SEQ ID NO: 274335 - protein, 9 aa, Homo Sapiens
TLDAKEMQI

SEQ ID NO: 274336 - protein, 9 aa, Homo Sapiens
TPDIPSGLP

SEQ ID NO: 274337 - protein, 9 aa, Homo Sapiens
PPKDLEAQT

SEQ ID NO: 274338 - protein, 9 aa, Homo Sapiens
RSRLYVGRD

SEQ ID NO: 274339 - protein, 9 aa, Homo Sapiens
TSHSYRTDN

SEQ ID NO: 274340 - protein, 9 aa, Homo Sapiens
GKGLNLRRA

SEQ ID NO: 274341 - protein, 9 aa, Homo Sapiens
LFLRYRPLI

SEQ ID NO: 274342 - protein, 9 aa, Homo Sapiens
HWYCPVLRP

SEQ ID NO: 274343 - protein, 9 aa, Homo Sapiens
WRVQKAPLQ

SEQ ID NO: 274344 - protein, 9 aa, Homo Sapiens
NYEKIHVNE

SEQ ID NO: 274345 - protein, 9 aa, Homo Sapiens
MKQYRKIID

SEQ ID NO: 274346 - protein, 9 aa, Homo Sapiens
KMLQEKKAM

SEQ ID NO: 274347 - protein, 9 aa, Homo Sapiens
RWVREKRRN

SEQ ID NO: 274348 - protein, 9 aa, Homo Sapiens
ILHSPLTLG

SEQ ID NO: 274349 - protein, 9 aa, Homo Sapiens
PTWHCIVSR

SEQ ID NO: 274350 - protein, 9 aa, Homo Sapiens
VTSMLNPLI

SEQ ID NO: 274351 - protein, 9 aa, Homo Sapiens
PEVLHFDEA

SEQ ID NO: 274352 - protein, 9 aa, Homo Sapiens
QQCSRPLSM

SEQ ID NO: 274353 - protein, 9 aa, Homo Sapiens
VDLIANFNQ

SEQ ID NO: 274354 - protein, 9 aa, Homo Sapiens
VGVSVFANM

SEQ ID NO: 274355 - protein, 9 aa, Homo Sapiens
DKQKFYLRQ

SEQ ID NO: 274356 - protein, 9 aa, Homo Sapiens
KIKLAVQMD

SEQ ID NO: 274357 - protein, 9 aa, Homo Sapiens
FDLCKHIAS

SEQ ID NO: 274358 - protein, 9 aa, Homo Sapiens
QKTLLLASG

SEQ ID NO: 274359 - protein, 9 aa, Homo Sapiens
SQEGRSLQN

SEQ ID NO: 274360 - protein, 9 aa, Homo Sapiens
QAAFSDAQM

SEQ ID NO: 274361 - protein, 9 aa, Homo Sapiens
QCIQWIVTF

SEQ ID NO: 274362 - protein, 9 aa, Homo Sapiens
NTLNHVYNE

SEQ ID NO: 274363 - protein, 9 aa, Homo Sapiens
GLSFQGPQG

SEQ ID NO: 274364 - protein, 9 aa, Homo Sapiens
AADVLGLIL

SEQ ID NO: 274365 - protein, 9 aa, Homo Sapiens
PCSFKVLQG

SEQ ID NO: 274366 - protein, 9 aa, Homo Sapiens
RSQTALSKG

SEQ ID NO: 274367 - protein, 9 aa, Homo Sapiens
VSNTSDSIS

SEQ ID NO: 274368 - protein, 9 aa, Homo Sapiens
RSKLVSIPS

SEQ ID NO: 274369 - protein, 9 aa, Homo Sapiens
KYLHECLEA

SEQ ID NO: 274370 - protein, 9 aa, Homo Sapiens
TGMMKELQT

SEQ ID NO: 274371 - protein, 9 aa, Homo Sapiens
KGKSPHNER

SEQ ID NO: 274372 - protein, 9 aa, Homo Sapiens
EEACKIYAR

SEQ ID NO: 274373 - protein, 9 aa, Homo Sapiens
AVFKGFLDC

SEQ ID NO: 274374 - protein, 9 aa, Homo Sapiens
SERDFIKLT

SEQ ID NO: 274375 - protein, 9 aa, Homo Sapiens
RLSLHCSWN

SEQ ID NO: 274376 - protein, 9 aa, Homo Sapiens
RDVCGKEFS

SEQ ID NO: 274377 - protein, 9 aa, Homo Sapiens
PQGIGGPPG

SEQ ID NO: 274378 - protein, 9 aa, Homo Sapiens
VRPKPLFHA

SEQ ID NO: 274379 - protein, 9 aa, Homo Sapiens
LPLVLCAAL

SEQ ID NO: 274380 - protein, 9 aa, Homo Sapiens
AFHYNVNSH

SEQ ID NO: 274381 - protein, 9 aa, Homo Sapiens
FMETRLFKL

SEQ ID NO: 274382 - protein, 9 aa, Homo Sapiens
DKYTKKKSD

SEQ ID NO: 274383 - protein, 9 aa, Homo Sapiens
DACQDPRFD

SEQ ID NO: 274384 - protein, 9 aa, Homo Sapiens
RNSSSVWPN

SEQ ID NO: 274385 - protein, 9 aa, Homo Sapiens
ILIIHFLVI

SEQ ID NO: 274386 - protein, 9 aa, Homo Sapiens
RNRNKKTEG

SEQ ID NO: 274387 - protein, 9 aa, Homo Sapiens
PLHPGLFTL

SEQ ID NO: 274388 - protein, 9 aa, Homo Sapiens
DGSGFGKFE

SEQ ID NO: 274389 - protein, 9 aa, Homo Sapiens
SGVAQNNYF

SEQ ID NO: 274390 - protein, 9 aa, Homo Sapiens
GKRLPRTLE

SEQ ID NO: 274391 - protein, 9 aa, Homo Sapiens
LMLAYAVCR

SEQ ID NO: 274392 - protein, 9 aa, Homo Sapiens
PSFLALTPS

SEQ ID NO: 274393 - protein, 9 aa, Homo Sapiens
IGFFSGIVF

SEQ ID NO: 274394 - protein, 9 aa, Homo Sapiens
SALQIHECT

SEQ ID NO: 274395 - protein, 9 aa, Homo Sapiens
VLSSDLRHV

SEQ ID NO: 274396 - protein, 9 aa, Homo Sapiens
IKDSNRCCC

SEQ ID NO: 274397 - protein, 9 aa, Homo Sapiens
NTSLIDMND

SEQ ID NO: 274398 - protein, 9 aa, Homo Sapiens
NLYMIMREC

SEQ ID NO: 274399 - protein, 9 aa, Homo Sapiens
SKVLVHLQH

SEQ ID NO: 274400 - protein, 9 aa, Homo Sapiens
CPHSKKKNF

SEQ ID NO: 274401 - protein, 9 aa, Homo Sapiens
YRTISENTM

SEQ ID NO: 274402 - protein, 9 aa, Homo Sapiens
MFTGHLLLL

SEQ ID NO: 274403 - protein, 9 aa, Homo Sapiens
KGSDLELKK

SEQ ID NO: 274404 - protein, 9 aa, Homo Sapiens
PDASDFLTD

SEQ ID NO: 274405 - protein, 9 aa, Homo Sapiens
ECEAPGTEE

SEQ ID NO: 274406 - protein, 9 aa, Homo Sapiens
GENNELIKE

SEQ ID NO: 274407 - protein, 9 aa, Homo Sapiens
QFRDVAIEL

SEQ ID NO: 274408 - protein, 9 aa, Homo Sapiens
CQCTLDKGG

SEQ ID NO: 274409 - protein, 9 aa, Homo Sapiens
QNKSLSRSF

SEQ ID NO: 274410 - protein, 9 aa, Homo Sapiens
SAAPRGQFG

SEQ ID NO: 274411 - protein, 9 aa, Homo Sapiens
LRGTMQLES

SEQ ID NO: 274412 - protein, 9 aa, Homo Sapiens
PAVDRPLRS

SEQ ID NO: 274413 - protein, 9 aa, Homo Sapiens
YYTDNHASI

SEQ ID NO: 274414 - protein, 9 aa, Homo Sapiens
IQVGEIIRN

SEQ ID NO: 274415 - protein, 9 aa, Homo Sapiens
ENFNQTLTS

SEQ ID NO: 274416 - protein, 9 aa, Homo Sapiens
TTPNQGRKV

SEQ ID NO: 274417 - protein, 9 aa, Homo Sapiens
TKVVGRVVF

SEQ ID NO: 274418 - protein, 9 aa, Homo Sapiens
RLFKLLMES

SEQ ID NO: 274419 - protein, 9 aa, Homo Sapiens
LAGEYFQKA

SEQ ID NO: 274420 - protein, 9 aa, Homo Sapiens
NEDKSAATA

SEQ ID NO: 274421 - protein, 9 aa, Homo Sapiens
VTPPYPKIR

SEQ ID NO: 274422 - protein, 9 aa, Homo Sapiens
IARVKDPQS

SEQ ID NO: 274423 - protein, 9 aa, Homo Sapiens
YPDKDKKRH

SEQ ID NO: 274424 - protein, 9 aa, Homo Sapiens
NTQKNVSEE

SEQ ID NO: 274425 - protein, 9 aa, Homo Sapiens
VSCNPSYRN

SEQ ID NO: 274426 - protein, 9 aa, Homo Sapiens
QINNSLKEL

SEQ ID NO: 274427 - protein, 9 aa, Homo Sapiens
IKPRIIQNQ

SEQ ID NO: 274428 - protein, 9 aa, Homo Sapiens
CAALSPAVG

SEQ ID NO: 274429 - protein, 9 aa, Homo Sapiens
RLKFVKLHT

SEQ ID NO: 274430 - protein, 9 aa, Homo Sapiens
WLLGNKEDV

SEQ ID NO: 274431 - protein, 9 aa, Homo Sapiens
TATHLKWLP

SEQ ID NO: 274432 - protein, 9 aa, Homo Sapiens
KMGREPEDN

SEQ ID NO: 274433 - protein, 9 aa, Homo Sapiens
NKAFLQPNN

SEQ ID NO: 274434 - protein, 9 aa, Homo Sapiens
KLRHLRFTY

SEQ ID NO: 274435 - protein, 9 aa, Homo Sapiens
YLEFRYNTR

SEQ ID NO: 274436 - protein, 9 aa, Homo Sapiens
AYRVFKTVN

SEQ ID NO: 274437 - protein, 9 aa, Homo Sapiens
PGVRRLPRI

SEQ ID NO: 274438 - protein, 9 aa, Homo Sapiens
SSVEALQET

SEQ ID NO: 274439 - protein, 9 aa, Homo Sapiens
LLSEFDYWD

SEQ ID NO: 274440 - protein, 9 aa, Homo Sapiens
NIHIRERSM

SEQ ID NO: 274441 - protein, 9 aa, Homo Sapiens
GDNTDSQRS

SEQ ID NO: 274442 - protein, 9 aa, Homo Sapiens
SSAQEAQKE

SEQ ID NO: 274443 - protein, 9 aa, Homo Sapiens
AASALIQTL

SEQ ID NO: 274444 - protein, 9 aa, Homo Sapiens
LTYTDAGGV

SEQ ID NO: 274445 - protein, 9 aa, Homo Sapiens
FLSSFTLMK

SEQ ID NO: 274446 - protein, 9 aa, Homo Sapiens
YLGKTFLQP

SEQ ID NO: 274447 - protein, 9 aa, Homo Sapiens
DYPMIILYD

SEQ ID NO: 274448 - protein, 9 aa, Homo Sapiens
MIMVVTAAV

SEQ ID NO: 274449 - protein, 9 aa, Homo Sapiens
ASVFTLVVI

SEQ ID NO: 274450 - protein, 9 aa, Homo Sapiens
VGMQIPRVC

SEQ ID NO: 274451 - protein, 9 aa, Homo Sapiens
KGSVESNGR

SEQ ID NO: 274452 - protein, 9 aa, Homo Sapiens
FNVVTLSGT

SEQ ID NO: 274453 - protein, 9 aa, Homo Sapiens
ACDLRVLGK

SEQ ID NO: 274454 - protein, 9 aa, Homo Sapiens
NGQKTYQIN

SEQ ID NO: 274455 - protein, 9 aa, Homo Sapiens
PPRYKQFSC

SEQ ID NO: 274456 - protein, 9 aa, Homo Sapiens
NTEAHVKAI

SEQ ID NO: 274457 - protein, 9 aa, Homo Sapiens
LEVEDLFLE

SEQ ID NO: 274458 - protein, 9 aa, Homo Sapiens
LFKGAYYLK

SEQ ID NO: 274459 - protein, 9 aa, Homo Sapiens
AGRKLSDAS

SEQ ID NO: 274460 - protein, 9 aa, Homo Sapiens
GGQVIKPSL

SEQ ID NO: 274461 - protein, 9 aa, Homo Sapiens
YTVEVIITN

SEQ ID NO: 274462 - protein, 9 aa, Homo Sapiens
NMALLQMAT

SEQ ID NO: 274463 - protein, 9 aa, Homo Sapiens
DSTAIDGMS

SEQ ID NO: 274464 - protein, 9 aa, Homo Sapiens
GEIFGHGEF

SEQ ID NO: 274465 - protein, 9 aa, Homo Sapiens
VCLTTSDKF

SEQ ID NO: 274466 - protein, 9 aa, Homo Sapiens
HIYGKFLGL

SEQ ID NO: 274467 - protein, 9 aa, Homo Sapiens
KQISKQLYF

SEQ ID NO: 274468 - protein, 9 aa, Homo Sapiens
IQPKLGNIV

SEQ ID NO: 274469 - protein, 9 aa, Homo Sapiens
SCTCGNSNS

SEQ ID NO: 274470 - protein, 9 aa, Homo Sapiens
TGISQDTQT

SEQ ID NO: 274471 - protein, 9 aa, Homo Sapiens
FVVVISVEV

SEQ ID NO: 274472 - protein, 9 aa, Homo Sapiens
LLGKKNISF

SEQ ID NO: 274473 - protein, 9 aa, Homo Sapiens
PPGKMFSNT

SEQ ID NO: 274474 - protein, 9 aa, Homo Sapiens
EKTQRGAGS

SEQ ID NO: 274475 - protein, 9 aa, Homo Sapiens
RVLDQVQVM

SEQ ID NO: 274476 - protein, 9 aa, Homo Sapiens
ATNKNSLLG

SEQ ID NO: 274477 - protein, 9 aa, Homo Sapiens
CGPNQLDNL

SEQ ID NO: 274478 - protein, 9 aa, Homo Sapiens
VIKPSLISW

SEQ ID NO: 274479 - protein, 9 aa, Homo Sapiens
PFIFREEDT

SEQ ID NO: 274480 - protein, 9 aa, Homo Sapiens
LLEKLPYAM

SEQ ID NO: 274481 - protein, 9 aa, Homo Sapiens
DEIIQASKK

SEQ ID NO: 274482 - protein, 9 aa, Homo Sapiens
SLLGMRVNT

SEQ ID NO: 274483 - protein, 9 aa, Homo Sapiens
QLGKQEPGS

SEQ ID NO: 274484 - protein, 9 aa, Homo Sapiens
LLNKINELT

SEQ ID NO: 274485 - protein, 9 aa, Homo Sapiens
KNASFQVEN

SEQ ID NO: 274486 - protein, 9 aa, Homo Sapiens
VFGSKGVKC

SEQ ID NO: 274487 - protein, 9 aa, Homo Sapiens
TSNLPEEEL

SEQ ID NO: 274488 - protein, 9 aa, Homo Sapiens
QNVNGQTIY

SEQ ID NO: 274489 - protein, 9 aa, Homo Sapiens
AREEEKGLE

SEQ ID NO: 274490 - protein, 9 aa, Homo Sapiens
FYAAEIAIS

SEQ ID NO: 274491 - protein, 9 aa, Homo Sapiens
CVCCHQHPQ

SEQ ID NO: 274492 - protein, 9 aa, Homo Sapiens
PPPHEEELL

SEQ ID NO: 274493 - protein, 9 aa, Homo Sapiens
KEACVHKML

SEQ ID NO: 274494 - protein, 9 aa, Homo Sapiens
RGTMQLESR

SEQ ID NO: 274495 - protein, 9 aa, Homo Sapiens
KLSDYFLLI

SEQ ID NO: 274496 - protein, 9 aa, Homo Sapiens
TRFVRLPLI

SEQ ID NO: 274497 - protein, 9 aa, Homo Sapiens
YDNSTPPYK

SEQ ID NO: 274498 - protein, 9 aa, Homo Sapiens
SSAIPQAKC

SEQ ID NO: 274499 - protein, 9 aa, Homo Sapiens
RDLESGVEI

SEQ ID NO: 274500 - protein, 9 aa, Homo Sapiens
LLKPLAVPP

SEQ ID NO: 274501 - protein, 9 aa, Homo Sapiens
LENVFIGGT

SEQ ID NO: 274502 - protein, 9 aa, Homo Sapiens
VEFHERGNN

SEQ ID NO: 274503 - protein, 9 aa, Homo Sapiens
ISFIKWHSV

SEQ ID NO: 274504 - protein, 9 aa, Homo Sapiens
SLFYVTVIG

SEQ ID NO: 274505 - protein, 9 aa, Homo Sapiens
LHSNKLSKI

SEQ ID NO: 274506 - protein, 9 aa, Homo Sapiens
QTDREIKVT

SEQ ID NO: 274507 - protein, 9 aa, Homo Sapiens
FLSVGGTVL

SEQ ID NO: 274508 - protein, 9 aa, Homo Sapiens
NNKEDSNIR

SEQ ID NO: 274509 - protein, 9 aa, Homo Sapiens
DPRKWIRPI

SEQ ID NO: 274510 - protein, 9 aa, Homo Sapiens
HELENPEDT

SEQ ID NO: 274511 - protein, 9 aa, Homo Sapiens
RQLLYNEFS

SEQ ID NO: 274512 - protein, 9 aa, Homo Sapiens
WINEAQDAA

SEQ ID NO: 274513 - protein, 9 aa, Homo Sapiens
QAQYPVVKT

SEQ ID NO: 274514 - protein, 9 aa, Homo Sapiens
SPGRTFKQS

SEQ ID NO: 274515 - protein, 9 aa, Homo Sapiens
LIVGKKFKL

SEQ ID NO: 274516 - protein, 9 aa, Homo Sapiens
FMNTSRMEK

SEQ ID NO: 274517 - protein, 9 aa, Homo Sapiens
TEEIRQKIT

SEQ ID NO: 274518 - protein, 9 aa, Homo Sapiens
EQPTSSQAN

SEQ ID NO: 274519 - protein, 9 aa, Homo Sapiens
PGGLLDYIN

SEQ ID NO: 274520 - protein, 9 aa, Homo Sapiens
IFLQYNSDN

SEQ ID NO: 274521 - protein, 9 aa, Homo Sapiens
LSYDADVTV

SEQ ID NO: 274522 - protein, 9 aa, Homo Sapiens
KGEEEPPVA

SEQ ID NO: 274523 - protein, 9 aa, Homo Sapiens
QSWVEFNAN

SEQ ID NO: 274524 - protein, 9 aa, Homo Sapiens
IQSQVQQLI

SEQ ID NO: 274525 - protein, 9 aa, Homo Sapiens
TDLNRMHSQ

SEQ ID NO: 274526 - protein, 9 aa, Homo Sapiens
GAVESALNY

SEQ ID NO: 274527 - protein, 9 aa, Homo Sapiens
MRHLAGLLR

SEQ ID NO: 274528 - protein, 9 aa, Homo Sapiens
GKVSKDDCS

SEQ ID NO: 274529 - protein, 9 aa, Homo Sapiens
NASTNVPFS

SEQ ID NO: 274530 - protein, 9 aa, Homo Sapiens
ELLVKIYGA

SEQ ID NO: 274531 - protein, 9 aa, Homo Sapiens
EDCGFIQRF

SEQ ID NO: 274532 - protein, 9 aa, Homo Sapiens
YLMITCVTI

SEQ ID NO: 274533 - protein, 9 aa, Homo Sapiens
PIEQLCSTH

SEQ ID NO: 274534 - protein, 9 aa, Homo Sapiens
TFDPTEVLE

SEQ ID NO: 274535 - protein, 9 aa, Homo Sapiens
NLKCKMSLE

SEQ ID NO: 274536 - protein, 9 aa, Homo Sapiens
TLGLFSNCS

SEQ ID NO: 274537 - protein, 9 aa, Homo Sapiens
MEMIVFLDK

SEQ ID NO: 274538 - protein, 9 aa, Homo Sapiens
LEGRPLNAE

SEQ ID NO: 274539 - protein, 9 aa, Homo Sapiens
YVVSGFNVD

SEQ ID NO: 274540 - protein, 9 aa, Homo Sapiens
NIRCLEHKV

SEQ ID NO: 274541 - protein, 9 aa, Homo Sapiens
FLDNRIVAA

SEQ ID NO: 274542 - protein, 9 aa, Homo Sapiens
ITATTTAVS

SEQ ID NO: 274543 - protein, 9 aa, Homo Sapiens
LGAALPNLT

SEQ ID NO: 274544 - protein, 9 aa, Homo Sapiens
QTVFVSIDI

SEQ ID NO: 274545 - protein, 9 aa, Homo Sapiens
FVLGPTPVR

SEQ ID NO: 274546 - protein, 9 aa, Homo Sapiens
IEEMINNQN

SEQ ID NO: 274547 - protein, 9 aa, Homo Sapiens
KTILNLEVK

SEQ ID NO: 274548 - protein, 9 aa, Homo Sapiens
IPMPPIQFH

SEQ ID NO: 274549 - protein, 9 aa, Homo Sapiens
LLPPIKFHA

SEQ ID NO: 274550 - protein, 9 aa, Homo Sapiens
FSSFGNHQI

SEQ ID NO: 274551 - protein, 9 aa, Homo Sapiens
SDYETFKNF

SEQ ID NO: 274552 - protein, 9 aa, Homo Sapiens
MVVYGNILL

SEQ ID NO: 274553 - protein, 9 aa, Homo Sapiens
QICYSTDSD

SEQ ID NO: 274554 - protein, 9 aa, Homo Sapiens
ETKVHRKTI

SEQ ID NO: 274555 - protein, 9 aa, Homo Sapiens
YMTGKEDNY

SEQ ID NO: 274556 - protein, 9 aa, Homo Sapiens
LLEKSRFIF

SEQ ID NO: 274557 - protein, 9 aa, Homo Sapiens
FIWVSAKDC

SEQ ID NO: 274558 - protein, 9 aa, Homo Sapiens
DHPENYISE

SEQ ID NO: 274559 - protein, 9 aa, Homo Sapiens
PVPGPRSHP

SEQ ID NO: 274560 - protein, 9 aa, Homo Sapiens
PDDFKPEVK

SEQ ID NO: 274561 - protein, 9 aa, Homo Sapiens
LGLVQFKYL

SEQ ID NO: 274562 - protein, 9 aa, Homo Sapiens
GNYSRHRVQ

SEQ ID NO: 274563 - protein, 9 aa, Homo Sapiens
VWPNLTSQE

SEQ ID NO: 274564 - protein, 9 aa, Homo Sapiens
SGGPFKFKF

SEQ ID NO: 274565 - protein, 9 aa, Homo Sapiens
TWILDKDFG

SEQ ID NO: 274566 - protein, 9 aa, Homo Sapiens
EGLLKATTL

SEQ ID NO: 274567 - protein, 9 aa, Homo Sapiens
DKRGKFSEV

SEQ ID NO: 274568 - protein, 9 aa, Homo Sapiens
RQAKLRLYL

SEQ ID NO: 274569 - protein, 9 aa, Homo Sapiens
KKDREKDKV

SEQ ID NO: 274570 - protein, 9 aa, Homo Sapiens
EEKEKPNEI

SEQ ID NO: 274571 - protein, 9 aa, Homo Sapiens
LKHLMQLNM

SEQ ID NO: 274572 - protein, 9 aa, Homo Sapiens
ETYQYYGLS

SEQ ID NO: 274573 - protein, 9 aa, Homo Sapiens
RPYECKYCR

SEQ ID NO: 274574 - protein, 9 aa, Homo Sapiens
PEENLPPIQ

SEQ ID NO: 274575 - protein, 9 aa, Homo Sapiens
SLWFTWSMK

SEQ ID NO: 274576 - protein, 9 aa, Homo Sapiens
CTHNLYMIM

SEQ ID NO: 274577 - protein, 9 aa, Homo Sapiens
EELKIPLNG

SEQ ID NO: 274578 - protein, 9 aa, Homo Sapiens
VVEVLFQRD

SEQ ID NO: 274579 - protein, 9 aa, Homo Sapiens
SEPKLTPKG

SEQ ID NO: 274580 - protein, 9 aa, Homo Sapiens
AYPQQNYTY

SEQ ID NO: 274581 - protein, 9 aa, Homo Sapiens
VTYFFFREN

SEQ ID NO: 274582 - protein, 9 aa, Homo Sapiens
SSSSDEDYI

SEQ ID NO: 274583 - protein, 9 aa, Homo Sapiens
SMNGRHPGG

SEQ ID NO: 274584 - protein, 9 aa, Homo Sapiens
EYFSLNNWN

SEQ ID NO: 274585 - protein, 9 aa, Homo Sapiens
AKLKPPPEA

SEQ ID NO: 274586 - protein, 9 aa, Homo Sapiens
SPLYSQPQP

SEQ ID NO: 274587 - protein, 9 aa, Homo Sapiens
ILQTEDVKP

SEQ ID NO: 274588 - protein, 9 aa, Homo Sapiens
GLPSLGHVP

SEQ ID NO: 274589 - protein, 9 aa, Homo Sapiens
APILSFLRT

SEQ ID NO: 274590 - protein, 9 aa, Homo Sapiens
HEKIHTEEK

SEQ ID NO: 274591 - protein, 9 aa, Homo Sapiens
TPQNPPQNK

SEQ ID NO: 274592 - protein, 9 aa, Homo Sapiens
KGKLIYIVS

SEQ ID NO: 274593 - protein, 9 aa, Homo Sapiens
KYPQMNDFN

SEQ ID NO: 274594 - protein, 9 aa, Homo Sapiens
FDNPQSDKG

SEQ ID NO: 274595 - protein, 9 aa, Homo Sapiens
WMMCVRPAQ

SEQ ID NO: 274596 - protein, 9 aa, Homo Sapiens
TTDPSDKKE

SEQ ID NO: 274597 - protein, 9 aa, Homo Sapiens
VCEGVGWHI

SEQ ID NO: 274598 - protein, 9 aa, Homo Sapiens
EHISQLELT

SEQ ID NO: 274599 - protein, 9 aa, Homo Sapiens
EHHRVVIGK

SEQ ID NO: 274600 - protein, 9 aa, Homo Sapiens
KHSETYCMC

SEQ ID NO: 274601 - protein, 9 aa, Homo Sapiens
HKRAQRLKL

SEQ ID NO: 274602 - protein, 9 aa, Homo Sapiens
LMLCPQRDN

SEQ ID NO: 274603 - protein, 9 aa, Homo Sapiens
CKIRLFIGG

SEQ ID NO: 274604 - protein, 9 aa, Homo Sapiens
FIHLALYSN

SEQ ID NO: 274605 - protein, 9 aa, Homo Sapiens
RDNVPGEKK

SEQ ID NO: 274606 - protein, 9 aa, Homo Sapiens
MFSDVSISA

SEQ ID NO: 274607 - protein, 9 aa, Homo Sapiens
PVIFSDWYN

SEQ ID NO: 274608 - protein, 9 aa, Homo Sapiens
YDPTVDVWN

SEQ ID NO: 274609 - protein, 9 aa, Homo Sapiens
ESAGIARPE

SEQ ID NO: 274610 - protein, 9 aa, Homo Sapiens
MQGSATGEK

SEQ ID NO: 274611 - protein, 9 aa, Homo Sapiens
AINQEQTEA

SEQ ID NO: 274612 - protein, 9 aa, Homo Sapiens
HSDYAHYSG

SEQ ID NO: 274613 - protein, 9 aa, Homo Sapiens
SNYEKIRTF

SEQ ID NO: 274614 - protein, 9 aa, Homo Sapiens
RRLLNIVYV

SEQ ID NO: 274615 - protein, 9 aa, Homo Sapiens
EIGLPGFPG

SEQ ID NO: 274616 - protein, 9 aa, Homo Sapiens
LARVSPSPM

SEQ ID NO: 274617 - protein, 9 aa, Homo Sapiens
LSYTGEKKE

SEQ ID NO: 274618 - protein, 9 aa, Homo Sapiens
FVVDVPEHR

SEQ ID NO: 274619 - protein, 9 aa, Homo Sapiens
VEHELYGEK

SEQ ID NO: 274620 - protein, 9 aa, Homo Sapiens
RPDQKDLLG

SEQ ID NO: 274621 - protein, 9 aa, Homo Sapiens
IVLFAHNEY

SEQ ID NO: 274622 - protein, 9 aa, Homo Sapiens
GLMDDKLLH

SEQ ID NO: 274623 - protein, 9 aa, Homo Sapiens
LEVDLIQSQ

SEQ ID NO: 274624 - protein, 9 aa, Homo Sapiens
VDRISIKFV

SEQ ID NO: 274625 - protein, 9 aa, Homo Sapiens
CALCVALPM

SEQ ID NO: 274626 - protein, 9 aa, Homo Sapiens
NLSVSSSVN

SEQ ID NO: 274627 - protein, 9 aa, Homo Sapiens
YLSESVSDH

SEQ ID NO: 274628 - protein, 9 aa, Homo Sapiens
RATDCFGGI

SEQ ID NO: 274629 - protein, 9 aa, Homo Sapiens
GYKTNFYSS

SEQ ID NO: 274630 - protein, 9 aa, Homo Sapiens
GLQLKLSRL

SEQ ID NO: 274631 - protein, 9 aa, Homo Sapiens
VWDWQKTAK

SEQ ID NO: 274632 - protein, 9 aa, Homo Sapiens
VNPTMSIDL

SEQ ID NO: 274633 - protein, 9 aa, Homo Sapiens
RVIHLHEVY

SEQ ID NO: 274634 - protein, 9 aa, Homo Sapiens
AQVMHGSLG

SEQ ID NO: 274635 - protein, 9 aa, Homo Sapiens
EAQKQQMDI

SEQ ID NO: 274636 - protein, 9 aa, Homo Sapiens
LSFCGANAI

SEQ ID NO: 274637 - protein, 9 aa, Homo Sapiens
QYLIVHCKT

SEQ ID NO: 274638 - protein, 9 aa, Homo Sapiens
GGFMFPPSY

SEQ ID NO: 274639 - protein, 9 aa, Homo Sapiens
SPDVMLDKI

SEQ ID NO: 274640 - protein, 9 aa, Homo Sapiens
DLSLDDKLL

SEQ ID NO: 274641 - protein, 9 aa, Homo Sapiens
EQKVGLYQR

SEQ ID NO: 274642 - protein, 9 aa, Homo Sapiens
EVRGTFLFI

SEQ ID NO: 274643 - protein, 9 aa, Homo Sapiens
ECMIMSGGC

SEQ ID NO: 274644 - protein, 9 aa, Homo Sapiens
KEFTSHALY

SEQ ID NO: 274645 - protein, 9 aa, Homo Sapiens
VVSDKPLSE

SEQ ID NO: 274646 - protein, 9 aa, Homo Sapiens
LVFCVASVG

SEQ ID NO: 274647 - protein, 9 aa, Homo Sapiens
RNRSKGRKF

SEQ ID NO: 274648 - protein, 9 aa, Homo Sapiens
PGSPLPGPH

SEQ ID NO: 274649 - protein, 9 aa, Homo Sapiens
NQWTCISRE

SEQ ID NO: 274650 - protein, 9 aa, Homo Sapiens
EIKYAFELF

SEQ ID NO: 274651 - protein, 9 aa, Homo Sapiens
SCNRARPLH

SEQ ID NO: 274652 - protein, 9 aa, Homo Sapiens
FELFVLLKA

SEQ ID NO: 274653 - protein, 9 aa, Homo Sapiens
IANTCNAVI

SEQ ID NO: 274654 - protein, 9 aa, Homo Sapiens
NSLVRLCYF

SEQ ID NO: 274655 - protein, 9 aa, Homo Sapiens
ALLDYLLLG

SEQ ID NO: 274656 - protein, 9 aa, Homo Sapiens
AQSQANQKA

SEQ ID NO: 274657 - protein, 9 aa, Homo Sapiens
TDKGPSSAL

SEQ ID NO: 274658 - protein, 9 aa, Homo Sapiens
GQLKAFWRE

SEQ ID NO: 274659 - protein, 9 aa, Homo Sapiens
YTFTGIYTS

SEQ ID NO: 274660 - protein, 9 aa, Homo Sapiens
SDPHESFTC

SEQ ID NO: 274661 - protein, 9 aa, Homo Sapiens
RRGPISMTK

SEQ ID NO: 274662 - protein, 9 aa, Homo Sapiens
TIELSLEEW

SEQ ID NO: 274663 - protein, 9 aa, Homo Sapiens
RLQGLDALL

SEQ ID NO: 274664 - protein, 9 aa, Homo Sapiens
TTRLQEQEK

SEQ ID NO: 274665 - protein, 9 aa, Homo Sapiens
SNCSTMDPV

SEQ ID NO: 274666 - protein, 9 aa, Homo Sapiens
ELLNNGEHF

SEQ ID NO: 274667 - protein, 9 aa, Homo Sapiens
TSAFLQRLE

SEQ ID NO: 274668 - protein, 9 aa, Homo Sapiens
RSISSDRGR

SEQ ID NO: 274669 - protein, 9 aa, Homo Sapiens
AAGWIGGAP

SEQ ID NO: 274670 - protein, 9 aa, Homo Sapiens
ESPTITDTM

SEQ ID NO: 274671 - protein, 9 aa, Homo Sapiens
VENSSTAIV

SEQ ID NO: 274672 - protein, 9 aa, Homo Sapiens
TKAGMGRDS

SEQ ID NO: 274673 - protein, 9 aa, Homo Sapiens
QISKQLYFL

SEQ ID NO: 274674 - protein, 9 aa, Homo Sapiens
GDSAHELEN

SEQ ID NO: 274675 - protein, 9 aa, Homo Sapiens
KQKLSLKLD

SEQ ID NO: 274676 - protein, 9 aa, Homo Sapiens
GRALLLQTP

SEQ ID NO: 274677 - protein, 9 aa, Homo Sapiens
AICKQEIED

SEQ ID NO: 274678 - protein, 9 aa, Homo Sapiens
WPASLNEHK

SEQ ID NO: 274679 - protein, 9 aa, Homo Sapiens
KEAFAKLQT

SEQ ID NO: 274680 - protein, 9 aa, Homo Sapiens
LDCRERVVL

SEQ ID NO: 274681 - protein, 9 aa, Homo Sapiens
FNLQSSKKR

SEQ ID NO: 274682 - protein, 9 aa, Homo Sapiens
VVMRHSWKD

SEQ ID NO: 274683 - protein, 9 aa, Homo Sapiens
VRRHMVKCQ

SEQ ID NO: 274684 - protein, 9 aa, Homo Sapiens
LASVINNTP

SEQ ID NO: 274685 - protein, 9 aa, Homo Sapiens
NTMLESLDE

SEQ ID NO: 274686 - protein, 9 aa, Homo Sapiens
KKIYDRKEL

SEQ ID NO: 274687 - protein, 9 aa, Homo Sapiens
EGLICKAPC

SEQ ID NO: 274688 - protein, 9 aa, Homo Sapiens
LGEGSYESV

SEQ ID NO: 274689 - protein, 9 aa, Homo Sapiens
YVLKVFGKE

SEQ ID NO: 274690 - protein, 9 aa, Homo Sapiens
DAFWLDDCA

SEQ ID NO: 274691 - protein, 9 aa, Homo Sapiens
TDQLQEYEK

SEQ ID NO: 274692 - protein, 9 aa, Homo Sapiens
KVVLRQVGV

SEQ ID NO: 274693 - protein, 9 aa, Homo Sapiens
VFDVLIYGD

SEQ ID NO: 274694 - protein, 9 aa, Homo Sapiens
QYPNTFIQR

SEQ ID NO: 274695 - protein, 9 aa, Homo Sapiens
NLNYLSFLI

SEQ ID NO: 274696 - protein, 9 aa, Homo Sapiens
GSDGTNINA

SEQ ID NO: 274697 - protein, 9 aa, Homo Sapiens
WEELKIPLN

SEQ ID NO: 274698 - protein, 9 aa, Homo Sapiens
KTQCAVVAC

SEQ ID NO: 274699 - protein, 9 aa, Homo Sapiens
VPNEKKPEC

SEQ ID NO: 274700 - protein, 9 aa, Homo Sapiens
SKIIQSIIH

SEQ ID NO: 274701 - protein, 9 aa, Homo Sapiens
AGLTPYLVT

SEQ ID NO: 274702 - protein, 9 aa, Homo Sapiens
LFLVSLLVE

SEQ ID NO: 274703 - protein, 9 aa, Homo Sapiens
LQELSREQA

SEQ ID NO: 274704 - protein, 9 aa, Homo Sapiens
PRETAIMDD

SEQ ID NO: 274705 - protein, 9 aa, Homo Sapiens
QFTLGSPLT

SEQ ID NO: 274706 - protein, 9 aa, Homo Sapiens
LMKKPCFDY

SEQ ID NO: 274707 - protein, 9 aa, Homo Sapiens
KWHQLQVIQ

SEQ ID NO: 274708 - protein, 9 aa, Homo Sapiens
AYCAAAVAS

SEQ ID NO: 274709 - protein, 9 aa, Homo Sapiens
NLSPNQTKF

SEQ ID NO: 274710 - protein, 9 aa, Homo Sapiens
QTYAKLQQV

SEQ ID NO: 274711 - protein, 9 aa, Homo Sapiens
SENTISFAG

SEQ ID NO: 274712 - protein, 9 aa, Homo Sapiens
RIYITNYYY

SEQ ID NO: 274713 - protein, 9 aa, Homo Sapiens
YQPIKVATQ

SEQ ID NO: 274714 - protein, 9 aa, Homo Sapiens
AFDQKEEGR

SEQ ID NO: 274715 - protein, 9 aa, Homo Sapiens
RLLGATVTT

SEQ ID NO: 274716 - protein, 9 aa, Homo Sapiens
NVTFIENRA

SEQ ID NO: 274717 - protein, 9 aa, Homo Sapiens
TKGATKEAL

SEQ ID NO: 274718 - protein, 9 aa, Homo Sapiens
QSGSFINSL

SEQ ID NO: 274719 - protein, 9 aa, Homo Sapiens
LLHLTQHKI

SEQ ID NO: 274720 - protein, 9 aa, Homo Sapiens
EMQIVLEGK

SEQ ID NO: 274721 - protein, 9 aa, Homo Sapiens
PRPPQGRSE

SEQ ID NO: 274722 - protein, 9 aa, Homo Sapiens
RFTANEDIC

SEQ ID NO: 274723 - protein, 9 aa, Homo Sapiens
SHLICHEAP

SEQ ID NO: 274724 - protein, 9 aa, Homo Sapiens
PKSIYKYQP

SEQ ID NO: 274725 - protein, 9 aa, Homo Sapiens
LKAASNSKE

SEQ ID NO: 274726 - protein, 9 aa, Homo Sapiens
PSRQKTLLL

SEQ ID NO: 274727 - protein, 9 aa, Homo Sapiens
VKYFVIIPL

SEQ ID NO: 274728 - protein, 9 aa, Homo Sapiens
RMIKSGSVV

SEQ ID NO: 274729 - protein, 9 aa, Homo Sapiens
IADMQGKLA

SEQ ID NO: 274730 - protein, 9 aa, Homo Sapiens
SSLTDDSKT

SEQ ID NO: 274731 - protein, 9 aa, Homo Sapiens
VVERDFSVC

SEQ ID NO: 274732 - protein, 9 aa, Homo Sapiens
IRVIHAKEE

SEQ ID NO: 274733 - protein, 9 aa, Homo Sapiens
KEALDIFET

SEQ ID NO: 274734 - protein, 9 aa, Homo Sapiens
DVFGNATEI

SEQ ID NO: 274735 - protein, 9 aa, Homo Sapiens
YGSCLFIYV

SEQ ID NO: 274736 - protein, 9 aa, Homo Sapiens
NNFPRQYFA

SEQ ID NO: 274737 - protein, 9 aa, Homo Sapiens
LQAPMYFFL

SEQ ID NO: 274738 - protein, 9 aa, Homo Sapiens
QDNIIRLMS

SEQ ID NO: 274739 - protein, 9 aa, Homo Sapiens
LQYILNKHL

SEQ ID NO: 274740 - protein, 9 aa, Homo Sapiens
IVARCVRFI

SEQ ID NO: 274741 - protein, 9 aa, Homo Sapiens
ARWLGGQAV

SEQ ID NO: 274742 - protein, 9 aa, Homo Sapiens
SRLEEQKVR

SEQ ID NO: 274743 - protein, 9 aa, Homo Sapiens
LSKALPTLS

SEQ ID NO: 274744 - protein, 9 aa, Homo Sapiens
EICTSPQSA

SEQ ID NO: 274745 - protein, 9 aa, Homo Sapiens
LYLHLRQTL

SEQ ID NO: 274746 - protein, 9 aa, Homo Sapiens
MGLSCPLQV

SEQ ID NO: 274747 - protein, 9 aa, Homo Sapiens
KAVQETMQE

SEQ ID NO: 274748 - protein, 9 aa, Homo Sapiens
QRSFNNFTL

SEQ ID NO: 274749 - protein, 9 aa, Homo Sapiens
SIMSSLTSI

SEQ ID NO: 274750 - protein, 9 aa, Homo Sapiens
VQVKQETVE

SEQ ID NO: 274751 - protein, 9 aa, Homo Sapiens
ARTLILVAT

SEQ ID NO: 274752 - protein, 9 aa, Homo Sapiens
DQHVICVTP

SEQ ID NO: 274753 - protein, 9 aa, Homo Sapiens
LQTKLWLSH

SEQ ID NO: 274754 - protein, 9 aa, Homo Sapiens
DDLAKQTNI

SEQ ID NO: 274755 - protein, 9 aa, Homo Sapiens
SVPERIAIA

SEQ ID NO: 274756 - protein, 9 aa, Homo Sapiens
KAESPQCTS

SEQ ID NO: 274757 - protein, 9 aa, Homo Sapiens
KQVHKKWKC

SEQ ID NO: 274758 - protein, 9 aa, Homo Sapiens
ASNYPKRND

SEQ ID NO: 274759 - protein, 9 aa, Homo Sapiens
KLSCLWILG

SEQ ID NO: 274760 - protein, 9 aa, Homo Sapiens
VVGCHRQLD

SEQ ID NO: 274761 - protein, 9 aa, Homo Sapiens
KKEGKETKA

SEQ ID NO: 274762 - protein, 9 aa, Homo Sapiens
HENEYDNSP

SEQ ID NO: 274763 - protein, 9 aa, Homo Sapiens
ITKMNLMVQ

SEQ ID NO: 274764 - protein, 9 aa, Homo Sapiens
GVGLYGNSE

SEQ ID NO: 274765 - protein, 9 aa, Homo Sapiens
CLSYQGQSR

SEQ ID NO: 274766 - protein, 9 aa, Homo Sapiens
KPNPGSNKP

SEQ ID NO: 274767 - protein, 9 aa, Homo Sapiens
VFGKEQAAK

SEQ ID NO: 274768 - protein, 9 aa, Homo Sapiens
TPKVKEQNL

SEQ ID NO: 274769 - protein, 9 aa, Homo Sapiens
RKKWCHGLG

SEQ ID NO: 274770 - protein, 9 aa, Homo Sapiens
IEIFEKINA

SEQ ID NO: 274771 - protein, 9 aa, Homo Sapiens
KIWVQGDWI

SEQ ID NO: 274772 - protein, 9 aa, Homo Sapiens
AFNVEEAFI

SEQ ID NO: 274773 - protein, 9 aa, Homo Sapiens
CLPSSNDSP

SEQ ID NO: 274774 - protein, 9 aa, Homo Sapiens
FNSLLTDHM

SEQ ID NO: 274775 - protein, 9 aa, Homo Sapiens
PELEARQAT

SEQ ID NO: 274776 - protein, 9 aa, Homo Sapiens
QGLGRLVWL

SEQ ID NO: 274777 - protein, 9 aa, Homo Sapiens
LLFNNIFYI

SEQ ID NO: 274778 - protein, 9 aa, Homo Sapiens
QCFRDFCFP

SEQ ID NO: 274779 - protein, 9 aa, Homo Sapiens
FISAFEANE

SEQ ID NO: 274780 - protein, 9 aa, Homo Sapiens
NRLLQIWND

SEQ ID NO: 274781 - protein, 9 aa, Homo Sapiens
EETGVSHSQ

SEQ ID NO: 274782 - protein, 9 aa, Homo Sapiens
QLKTKDPFL

SEQ ID NO: 274783 - protein, 9 aa, Homo Sapiens
QKVDVETSG

SEQ ID NO: 274784 - protein, 9 aa, Homo Sapiens
SLNSGYEFD

SEQ ID NO: 274785 - protein, 9 aa, Homo Sapiens
NTLTRFVRL

SEQ ID NO: 274786 - protein, 9 aa, Homo Sapiens
YKSGKTALI

SEQ ID NO: 274787 - protein, 9 aa, Homo Sapiens
PDKSVPDDT

SEQ ID NO: 274788 - protein, 9 aa, Homo Sapiens
DNQVRLCKR

SEQ ID NO: 274789 - protein, 9 aa, Homo Sapiens
FNKILAGFP

SEQ ID NO: 274790 - protein, 9 aa, Homo Sapiens
GLVHAFKEG

SEQ ID NO: 274791 - protein, 9 aa, Homo Sapiens
LVETNSFSK

SEQ ID NO: 274792 - protein, 9 aa, Homo Sapiens
PCSMIILSA

SEQ ID NO: 274793 - protein, 9 aa, Homo Sapiens
ADAILKSEL

SEQ ID NO: 274794 - protein, 9 aa, Homo Sapiens
MLLRPHVLM

SEQ ID NO: 274795 - protein, 9 aa, Homo Sapiens
PIVIDGSSV

SEQ ID NO: 274796 - protein, 9 aa, Homo Sapiens
VDGHQLFDL

SEQ ID NO: 274797 - protein, 9 aa, Homo Sapiens
RPPPHQASI

SEQ ID NO: 274798 - protein, 9 aa, Homo Sapiens
EKPKVFILH

SEQ ID NO: 274799 - protein, 9 aa, Homo Sapiens
ANGINISPN

SEQ ID NO: 274800 - protein, 9 aa, Homo Sapiens
KKCRILATM

SEQ ID NO: 274801 - protein, 9 aa, Homo Sapiens
RRKRYNVTA

SEQ ID NO: 274802 - protein, 9 aa, Homo Sapiens
SGCLHGSFL

SEQ ID NO: 274803 - protein, 9 aa, Homo Sapiens
ISPTIGASV

SEQ ID NO: 274804 - protein, 9 aa, Homo Sapiens
AMIRPDHPH

SEQ ID NO: 274805 - protein, 9 aa, Homo Sapiens
DPEGGGDNT

SEQ ID NO: 274806 - protein, 9 aa, Homo Sapiens
GREPEDNSK

SEQ ID NO: 274807 - protein, 9 aa, Homo Sapiens
PRRGEESSD

SEQ ID NO: 274808 - protein, 9 aa, Homo Sapiens
GTLQRHASY

SEQ ID NO: 274809 - protein, 9 aa, Homo Sapiens
CEVYLEYLQ

SEQ ID NO: 274810 - protein, 9 aa, Homo Sapiens
SGSKKRFKE

SEQ ID NO: 274811 - protein, 9 aa, Homo Sapiens
LWAGPVNDG

SEQ ID NO: 274812 - protein, 9 aa, Homo Sapiens
SRPNFLATL

SEQ ID NO: 274813 - protein, 9 aa, Homo Sapiens
GDVTLVTPP

SEQ ID NO: 274814 - protein, 9 aa, Homo Sapiens
NIYAYMEKS

SEQ ID NO: 274815 - protein, 9 aa, Homo Sapiens
FVPAKEVLN

SEQ ID NO: 274816 - protein, 9 aa, Homo Sapiens
VDFSDRATK

SEQ ID NO: 274817 - protein, 9 aa, Homo Sapiens
SVFGEINFN

SEQ ID NO: 274818 - protein, 9 aa, Homo Sapiens
SAIMLGKCD

SEQ ID NO: 274819 - protein, 9 aa, Homo Sapiens
RPLRSVFVG

SEQ ID NO: 274820 - protein, 9 aa, Homo Sapiens
PKIGDAKSS

SEQ ID NO: 274821 - protein, 9 aa, Homo Sapiens
AMYGGVVLF

SEQ ID NO: 274822 - protein, 9 aa, Homo Sapiens
PRLTPYQSQ

SEQ ID NO: 274823 - protein, 9 aa, Homo Sapiens
MLVTNRPPT

SEQ ID NO: 274824 - protein, 9 aa, Homo Sapiens
TLVTERIMQ

SEQ ID NO: 274825 - protein, 9 aa, Homo Sapiens
PMHNWSPDI

SEQ ID NO: 274826 - protein, 9 aa, Homo Sapiens
LELGYFNDI

SEQ ID NO: 274827 - protein, 9 aa, Homo Sapiens
LSFELSEFQ

SEQ ID NO: 274828 - protein, 9 aa, Homo Sapiens
SNGHQSKFM

SEQ ID NO: 274829 - protein, 9 aa, Homo Sapiens
LLKLETNEL

SEQ ID NO: 274830 - protein, 9 aa, Homo Sapiens
WRGEGNTTQ

SEQ ID NO: 274831 - protein, 9 aa, Homo Sapiens
IGPRFGDAE

SEQ ID NO: 274832 - protein, 9 aa, Homo Sapiens
SSSSEDSND

SEQ ID NO: 274833 - protein, 9 aa, Homo Sapiens
DTAPSGVSI

SEQ ID NO: 274834 - protein, 9 aa, Homo Sapiens
VLGTGLTDC

SEQ ID NO: 274835 - protein, 9 aa, Homo Sapiens
RGCVTIHRY

SEQ ID NO: 274836 - protein, 9 aa, Homo Sapiens
LKKTTIPFS

SEQ ID NO: 274837 - protein, 9 aa, Homo Sapiens
DYPKYIFSL

SEQ ID NO: 274838 - protein, 9 aa, Homo Sapiens
WMGPIFPII

SEQ ID NO: 274839 - protein, 9 aa, Homo Sapiens
AAYQESCVD

SEQ ID NO: 274840 - protein, 9 aa, Homo Sapiens
MYLKEGYKK

SEQ ID NO: 274841 - protein, 9 aa, Homo Sapiens
TALPASAPT

SEQ ID NO: 274842 - protein, 9 aa, Homo Sapiens
HNDKTKGQE

SEQ ID NO: 274843 - protein, 9 aa, Homo Sapiens
NDFAHEMIR

SEQ ID NO: 274844 - protein, 9 aa, Homo Sapiens
HKSKGQQLD

SEQ ID NO: 274845 - protein, 9 aa, Homo Sapiens
PPCPFPLPI

SEQ ID NO: 274846 - protein, 9 aa, Homo Sapiens
EDTHCILLR

SEQ ID NO: 274847 - protein, 9 aa, Homo Sapiens
NWATVMLNG

SEQ ID NO: 274848 - protein, 9 aa, Homo Sapiens
GNTALLNKA

SEQ ID NO: 274849 - protein, 9 aa, Homo Sapiens
ILKPTLNNF

SEQ ID NO: 274850 - protein, 9 aa, Homo Sapiens
IKWHSVMYK

SEQ ID NO: 274851 - protein, 9 aa, Homo Sapiens
RCCPDFRGG

SEQ ID NO: 274852 - protein, 9 aa, Homo Sapiens
SQHVEHELY

SEQ ID NO: 274853 - protein, 9 aa, Homo Sapiens
IQDKDRAKV

SEQ ID NO: 274854 - protein, 9 aa, Homo Sapiens
VATSVQNLA

SEQ ID NO: 274855 - protein, 9 aa, Homo Sapiens
ARRFFSKEF

SEQ ID NO: 274856 - protein, 9 aa, Homo Sapiens
YEYFHMSPI

SEQ ID NO: 274857 - protein, 9 aa, Homo Sapiens
LQTTSQASK

SEQ ID NO: 274858 - protein, 9 aa, Homo Sapiens
PGAHFQVQL

SEQ ID NO: 274859 - protein, 9 aa, Homo Sapiens
IHHCAKCED

SEQ ID NO: 274860 - protein, 9 aa, Homo Sapiens
FHYFIIINC

SEQ ID NO: 274861 - protein, 9 aa, Homo Sapiens
HNLLSTIPP

SEQ ID NO: 274862 - protein, 9 aa, Homo Sapiens
QHQDKDQHE

SEQ ID NO: 274863 - protein, 9 aa, Homo Sapiens
GLPTIFYPE

SEQ ID NO: 274864 - protein, 9 aa, Homo Sapiens
CDNMNKING

SEQ ID NO: 274865 - protein, 9 aa, Homo Sapiens
MASDADGPT

SEQ ID NO: 274866 - protein, 9 aa, Homo Sapiens
QPSEKIWIE

SEQ ID NO: 274867 - protein, 9 aa, Homo Sapiens
VVNDKVSEN

SEQ ID NO: 274868 - protein, 9 aa, Homo Sapiens
SQHISLSTR

SEQ ID NO: 274869 - protein, 9 aa, Homo Sapiens
PQQNYTYNV

SEQ ID NO: 274870 - protein, 9 aa, Homo Sapiens
LVIEASLAT

SEQ ID NO: 274871 - protein, 9 aa, Homo Sapiens
LCQPSGSGR

SEQ ID NO: 274872 - protein, 9 aa, Homo Sapiens
RREITDKKK

SEQ ID NO: 274873 - protein, 9 aa, Homo Sapiens
GLSLAQKYN

SEQ ID NO: 274874 - protein, 9 aa, Homo Sapiens
HTQKAWKIY

SEQ ID NO: 274875 - protein, 9 aa, Homo Sapiens
MVRTQRQLG

SEQ ID NO: 274876 - protein, 9 aa, Homo Sapiens
YLCTDKSNV

SEQ ID NO: 274877 - protein, 9 aa, Homo Sapiens
ENYLGSATS

SEQ ID NO: 274878 - protein, 9 aa, Homo Sapiens
SYTCPYSTT

SEQ ID NO: 274879 - protein, 9 aa, Homo Sapiens
EKLPYAMGI

SEQ ID NO: 274880 - protein, 9 aa, Homo Sapiens
KESRPFSNP

SEQ ID NO: 274881 - protein, 9 aa, Homo Sapiens
GIPLYGTVC

SEQ ID NO: 274882 - protein, 9 aa, Homo Sapiens
NSNTTPRVE

SEQ ID NO: 274883 - protein, 9 aa, Homo Sapiens
SVQEGDNYI

SEQ ID NO: 274884 - protein, 9 aa, Homo Sapiens
NKIKLFPTS

SEQ ID NO: 274885 - protein, 9 aa, Homo Sapiens
PEWVYEEEM

SEQ ID NO: 274886 - protein, 9 aa, Homo Sapiens
WNYMQLKQP

SEQ ID NO: 274887 - protein, 9 aa, Homo Sapiens
QITNLNYDT

SEQ ID NO: 274888 - protein, 9 aa, Homo Sapiens
VQELPYGGW

SEQ ID NO: 274889 - protein, 9 aa, Homo Sapiens
TPELSNRRS

SEQ ID NO: 274890 - protein, 9 aa, Homo Sapiens
LCILSHLVS

SEQ ID NO: 274891 - protein, 9 aa, Homo Sapiens
ASGHDTRDP

SEQ ID NO: 274892 - protein, 9 aa, Homo Sapiens
NNHAWKLHN

SEQ ID NO: 274893 - protein, 9 aa, Homo Sapiens
VMWRFDGNK

SEQ ID NO: 274894 - protein, 9 aa, Homo Sapiens
ISSKENEDL

SEQ ID NO: 274895 - protein, 9 aa, Homo Sapiens
LSVGSKRRQ

SEQ ID NO: 274896 - protein, 9 aa, Homo Sapiens
FGCLYEANY

SEQ ID NO: 274897 - protein, 9 aa, Homo Sapiens
QEEYLQRLD

SEQ ID NO: 274898 - protein, 9 aa, Homo Sapiens
EAQRLNINP

SEQ ID NO: 274899 - protein, 9 aa, Homo Sapiens
VMYTIGDLG

SEQ ID NO: 274900 - protein, 9 aa, Homo Sapiens
ASLFIRFLC

SEQ ID NO: 274901 - protein, 9 aa, Homo Sapiens
DKIEKERQS

SEQ ID NO: 274902 - protein, 9 aa, Homo Sapiens
AAPHRIRLH

SEQ ID NO: 274903 - protein, 9 aa, Homo Sapiens
VGNDSCFCN

SEQ ID NO: 274904 - protein, 9 aa, Homo Sapiens
INGPQSSKG

SEQ ID NO: 274905 - protein, 9 aa, Homo Sapiens
TSSYSSQSS

SEQ ID NO: 274906 - protein, 9 aa, Homo Sapiens
QDKTDPLEH

SEQ ID NO: 274907 - protein, 9 aa, Homo Sapiens
KLCPSLCSY

SEQ ID NO: 274908 - protein, 9 aa, Homo Sapiens
ARCVRFIPV

SEQ ID NO: 274909 - protein, 9 aa, Homo Sapiens
EDIEARKGQ

SEQ ID NO: 274910 - protein, 9 aa, Homo Sapiens
LGVALEING

SEQ ID NO: 274911 - protein, 9 aa, Homo Sapiens
AKKGAICTS

SEQ ID NO: 274912 - protein, 9 aa, Homo Sapiens
KRFEESDDK

SEQ ID NO: 274913 - protein, 9 aa, Homo Sapiens
KHSSHKHNS

SEQ ID NO: 274914 - protein, 9 aa, Homo Sapiens
LLFPQDING

SEQ ID NO: 274915 - protein, 9 aa, Homo Sapiens
YLDIYQEEI

SEQ ID NO: 274916 - protein, 9 aa, Homo Sapiens
HDQFDYKDQ

SEQ ID NO: 274917 - protein, 9 aa, Homo Sapiens
EGAGGLHVL

SEQ ID NO: 274918 - protein, 9 aa, Homo Sapiens
SEPENRPSF

SEQ ID NO: 274919 - protein, 9 aa, Homo Sapiens
PEHVCKVLL

SEQ ID NO: 274920 - protein, 9 aa, Homo Sapiens
GGDNTDSQR

SEQ ID NO: 274921 - protein, 9 aa, Homo Sapiens
AGDIPCCSS

SEQ ID NO: 274922 - protein, 9 aa, Homo Sapiens
LELKKSLGP

SEQ ID NO: 274923 - protein, 9 aa, Homo Sapiens
KVKVNLSDR

SEQ ID NO: 274924 - protein, 9 aa, Homo Sapiens
NVYMVMEYV

SEQ ID NO: 274925 - protein, 9 aa, Homo Sapiens
KNLNCPFLE

SEQ ID NO: 274926 - protein, 9 aa, Homo Sapiens
AGRGGASIY

SEQ ID NO: 274927 - protein, 9 aa, Homo Sapiens
AHVKRPALH

SEQ ID NO: 274928 - protein, 9 aa, Homo Sapiens
MPELQYFDD

SEQ ID NO: 274929 - protein, 9 aa, Homo Sapiens
TNVVFGNNG

SEQ ID NO: 274930 - protein, 9 aa, Homo Sapiens
LDLFGNGPP

SEQ ID NO: 274931 - protein, 9 aa, Homo Sapiens
KSFLLGKKN

SEQ ID NO: 274932 - protein, 9 aa, Homo Sapiens
ANCWYDKSL

SEQ ID NO: 274933 - protein, 9 aa, Homo Sapiens
TTYIHHVVS

SEQ ID NO: 274934 - protein, 9 aa, Homo Sapiens
QRYCVNQCK

SEQ ID NO: 274935 - protein, 9 aa, Homo Sapiens
TTSKKRGKK

SEQ ID NO: 274936 - protein, 9 aa, Homo Sapiens
GFVKLPRPA

SEQ ID NO: 274937 - protein, 9 aa, Homo Sapiens
KHLMKHGYP

SEQ ID NO: 274938 - protein, 9 aa, Homo Sapiens
KKQNLKSEV

SEQ ID NO: 274939 - protein, 9 aa, Homo Sapiens
SCYCGKIIS

SEQ ID NO: 274940 - protein, 9 aa, Homo Sapiens
FCAGSLVNE

SEQ ID NO: 274941 - protein, 9 aa, Homo Sapiens
ALTASKVQA

SEQ ID NO: 274942 - protein, 9 aa, Homo Sapiens
LIIEGVLLF

SEQ ID NO: 274943 - protein, 9 aa, Homo Sapiens
IPTVVTVTC

SEQ ID NO: 274944 - protein, 9 aa, Homo Sapiens
SLTPLTTSQ

SEQ ID NO: 274945 - protein, 9 aa, Homo Sapiens
FCIQNCCGR

SEQ ID NO: 274946 - protein, 9 aa, Homo Sapiens
GQFLQPAAL

SEQ ID NO: 274947 - protein, 9 aa, Homo Sapiens
LLGLLSQTA

SEQ ID NO: 274948 - protein, 9 aa, Homo Sapiens
CICGGNKSH

SEQ ID NO: 274949 - protein, 9 aa, Homo Sapiens
GRYVSNDDP

SEQ ID NO: 274950 - protein, 9 aa, Homo Sapiens
PIFFLALVV

SEQ ID NO: 274951 - protein, 9 aa, Homo Sapiens
KRTALGCSR

SEQ ID NO: 274952 - protein, 9 aa, Homo Sapiens
HTNELVIFV

SEQ ID NO: 274953 - protein, 9 aa, Homo Sapiens
GIATTLINK

SEQ ID NO: 274954 - protein, 9 aa, Homo Sapiens
TLNIPISIE

SEQ ID NO: 274955 - protein, 9 aa, Homo Sapiens
YHLTQHQNI

SEQ ID NO: 274956 - protein, 9 aa, Homo Sapiens
QISSEAAYH

SEQ ID NO: 274957 - protein, 9 aa, Homo Sapiens
QLLETIDQL

SEQ ID NO: 274958 - protein, 9 aa, Homo Sapiens
VTIMLYLAE

SEQ ID NO: 274959 - protein, 9 aa, Homo Sapiens
EFSRIIICN

SEQ ID NO: 274960 - protein, 9 aa, Homo Sapiens
TYMAPEIIA

SEQ ID NO: 274961 - protein, 9 aa, Homo Sapiens
APVPYPDSL

SEQ ID NO: 274962 - protein, 9 aa, Homo Sapiens
SVDSLPDVS

SEQ ID NO: 274963 - protein, 9 aa, Homo Sapiens
FKKEGKMYR

SEQ ID NO: 274964 - protein, 9 aa, Homo Sapiens
IRAMDRTSL

SEQ ID NO: 274965 - protein, 9 aa, Homo Sapiens
AHNNSTGSG

SEQ ID NO: 274966 - protein, 9 aa, Homo Sapiens
LLPGRVYDG

SEQ ID NO: 274967 - protein, 9 aa, Homo Sapiens
KKPDLKECI

SEQ ID NO: 274968 - protein, 9 aa, Homo Sapiens
NNIHTIEEI

SEQ ID NO: 274969 - protein, 9 aa, Homo Sapiens
PAEYVKVLQ

SEQ ID NO: 274970 - protein, 9 aa, Homo Sapiens
KNAQLSTGR

SEQ ID NO: 274971 - protein, 9 aa, Homo Sapiens
VYRMLMQKD

SEQ ID NO: 274972 - protein, 9 aa, Homo Sapiens
KGRKFPELV

SEQ ID NO: 274973 - protein, 9 aa, Homo Sapiens
KEKTKETKR

SEQ ID NO: 274974 - protein, 9 aa, Homo Sapiens
GFVSTLVFL

SEQ ID NO: 274975 - protein, 9 aa, Homo Sapiens
GLSDQLTQA

SEQ ID NO: 274976 - protein, 9 aa, Homo Sapiens
SGRNLSDLW

SEQ ID NO: 274977 - protein, 9 aa, Homo Sapiens
RASSLFQSN

SEQ ID NO: 274978 - protein, 9 aa, Homo Sapiens
IVEASRIMT

SEQ ID NO: 274979 - protein, 9 aa, Homo Sapiens
KEVRDKLSE

SEQ ID NO: 274980 - protein, 9 aa, Homo Sapiens
FISHANEKT

SEQ ID NO: 274981 - protein, 9 aa, Homo Sapiens
RRRSIQNQK

SEQ ID NO: 274982 - protein, 9 aa, Homo Sapiens
PDCDNLAPT

SEQ ID NO: 274983 - protein, 9 aa, Homo Sapiens
ELSREQAGD

SEQ ID NO: 274984 - protein, 9 aa, Homo Sapiens
NESLECQMR

SEQ ID NO: 274985 - protein, 9 aa, Homo Sapiens
AQDSRRRKT

SEQ ID NO: 274986 - protein, 9 aa, Homo Sapiens
TQVGICQDC

SEQ ID NO: 274987 - protein, 9 aa, Homo Sapiens
QYSPEVDTT

SEQ ID NO: 274988 - protein, 9 aa, Homo Sapiens
ICSDKTGAL

SEQ ID NO: 274989 - protein, 9 aa, Homo Sapiens
KFLFQNPDN

SEQ ID NO: 274990 - protein, 9 aa, Homo Sapiens
LNARSSLST

SEQ ID NO: 274991 - protein, 9 aa, Homo Sapiens
IFSKNERFN

SEQ ID NO: 274992 - protein, 9 aa, Homo Sapiens
KADAILKSE

SEQ ID NO: 274993 - protein, 9 aa, Homo Sapiens
LICIDLWLK

SEQ ID NO: 274994 - protein, 9 aa, Homo Sapiens
RLNPHFISA

SEQ ID NO: 274995 - protein, 9 aa, Homo Sapiens
DEILLEKLP

SEQ ID NO: 274996 - protein, 9 aa, Homo Sapiens
HQYSSCLPE

SEQ ID NO: 274997 - protein, 9 aa, Homo Sapiens
QTPQPSILQ

SEQ ID NO: 274998 - protein, 9 aa, Homo Sapiens
ESKSKLLQT

SEQ ID NO: 274999 - protein, 9 aa, Homo Sapiens
EEFFIKIAA

SEQ ID NO: 275000 - protein, 9 aa, Homo Sapiens
NSASQVVGL

SEQ ID NO: 275001 - protein, 9 aa, Homo Sapiens
NFLSVDDIL

SEQ ID NO: 275002 - protein, 9 aa, Homo Sapiens
EGYYNVDFG

SEQ ID NO: 275003 - protein, 9 aa, Homo Sapiens
FLLIAYNVT

SEQ ID NO: 275004 - protein, 9 aa, Homo Sapiens
LPGQPGEGK

SEQ ID NO: 275005 - protein, 9 aa, Homo Sapiens
AVSTISYIS

SEQ ID NO: 275006 - protein, 9 aa, Homo Sapiens
YQCIEQNLT

SEQ ID NO: 275007 - protein, 9 aa, Homo Sapiens
GDDSKLCPS

SEQ ID NO: 275008 - protein, 9 aa, Homo Sapiens
GSDITTVST

SEQ ID NO: 275009 - protein, 9 aa, Homo Sapiens
SKLCPSLCS

SEQ ID NO: 275010 - protein, 9 aa, Homo Sapiens
NRTMLFTSG

SEQ ID NO: 275011 - protein, 9 aa, Homo Sapiens
RRGLISRAS

SEQ ID NO: 275012 - protein, 9 aa, Homo Sapiens
SLVNNYYTL

SEQ ID NO: 275013 - protein, 9 aa, Homo Sapiens
YFVNNLPLH

SEQ ID NO: 275014 - protein, 9 aa, Homo Sapiens
IKFASQKSS

SEQ ID NO: 275015 - protein, 9 aa, Homo Sapiens
QIFHPEYGM

SEQ ID NO: 275016 - protein, 9 aa, Homo Sapiens
VVVLSILLG

SEQ ID NO: 275017 - protein, 9 aa, Homo Sapiens
KDSPFWLPE

SEQ ID NO: 275018 - protein, 9 aa, Homo Sapiens
LSFYFGIIA

SEQ ID NO: 275019 - protein, 9 aa, Homo Sapiens
STYVGFKEF

SEQ ID NO: 275020 - protein, 9 aa, Homo Sapiens
HSETYCMCQ

SEQ ID NO: 275021 - protein, 9 aa, Homo Sapiens
KLFFHFRCR

SEQ ID NO: 275022 - protein, 9 aa, Homo Sapiens
MMITNAKRL

SEQ ID NO: 275023 - protein, 9 aa, Homo Sapiens
VGAVSSPQI

SEQ ID NO: 275024 - protein, 9 aa, Homo Sapiens
AQFSTLIFE

SEQ ID NO: 275025 - protein, 9 aa, Homo Sapiens
PRVGSPWIP

SEQ ID NO: 275026 - protein, 9 aa, Homo Sapiens
HKRLGNSWA

SEQ ID NO: 275027 - protein, 9 aa, Homo Sapiens
TGSKDDDDI

SEQ ID NO: 275028 - protein, 9 aa, Homo Sapiens
QGRLFISHA

SEQ ID NO: 275029 - protein, 9 aa, Homo Sapiens
QDLQSSDLK

SEQ ID NO: 275030 - protein, 9 aa, Homo Sapiens
KVITKDSLN

SEQ ID NO: 275031 - protein, 9 aa, Homo Sapiens
SGMLVMLHF

SEQ ID NO: 275032 - protein, 9 aa, Homo Sapiens
ASCMKKKRL

SEQ ID NO: 275033 - protein, 9 aa, Homo Sapiens
QANHPLTVS

SEQ ID NO: 275034 - protein, 9 aa, Homo Sapiens
AQLTVDRIS

SEQ ID NO: 275035 - protein, 9 aa, Homo Sapiens
HGVGQHQEL

SEQ ID NO: 275036 - protein, 9 aa, Homo Sapiens
YHFTHQCNY

SEQ ID NO: 275037 - protein, 9 aa, Homo Sapiens
QCEVKYEKD

SEQ ID NO: 275038 - protein, 9 aa, Homo Sapiens
STTMHELEY

SEQ ID NO: 275039 - protein, 9 aa, Homo Sapiens
DNQTRTTKE

SEQ ID NO: 275040 - protein, 9 aa, Homo Sapiens
EFSSAVPKV

SEQ ID NO: 275041 - protein, 9 aa, Homo Sapiens
MLVQALQKA

SEQ ID NO: 275042 - protein, 9 aa, Homo Sapiens
KSPLGTVKE

SEQ ID NO: 275043 - protein, 9 aa, Homo Sapiens
KKKTEVAKK

SEQ ID NO: 275044 - protein, 9 aa, Homo Sapiens
VQLYSYMRI

SEQ ID NO: 275045 - protein, 9 aa, Homo Sapiens
RGVCMYHTA

SEQ ID NO: 275046 - protein, 9 aa, Homo Sapiens
ERIEASNWH

SEQ ID NO: 275047 - protein, 9 aa, Homo Sapiens
YQQVKTNTS

SEQ ID NO: 275048 - protein, 9 aa, Homo Sapiens
CSRGEHCVH

SEQ ID NO: 275049 - protein, 9 aa, Homo Sapiens
NGTFHCDVC

SEQ ID NO: 275050 - protein, 9 aa, Homo Sapiens
KKLSLDFVL

SEQ ID NO: 275051 - protein, 9 aa, Homo Sapiens
YTGSDYQYI

SEQ ID NO: 275052 - protein, 9 aa, Homo Sapiens
VNAIYVKGQ

SEQ ID NO: 275053 - protein, 9 aa, Homo Sapiens
QHLQSMFEI

SEQ ID NO: 275054 - protein, 9 aa, Homo Sapiens
ISDDDSLAK

SEQ ID NO: 275055 - protein, 9 aa, Homo Sapiens
ANVPGSYYC

SEQ ID NO: 275056 - protein, 9 aa, Homo Sapiens
RVVAICIHY

SEQ ID NO: 275057 - protein, 9 aa, Homo Sapiens
YGTPSVLPY

SEQ ID NO: 275058 - protein, 9 aa, Homo Sapiens
LHFAVQTIL

SEQ ID NO: 275059 - protein, 9 aa, Homo Sapiens
AVFVYTGGR

SEQ ID NO: 275060 - protein, 9 aa, Homo Sapiens
LKATTLIQD

SEQ ID NO: 275061 - protein, 9 aa, Homo Sapiens
TSDAFWLDD

SEQ ID NO: 275062 - protein, 9 aa, Homo Sapiens
GMPELQYFD

SEQ ID NO: 275063 - protein, 9 aa, Homo Sapiens
QQSSVQDLI

SEQ ID NO: 275064 - protein, 9 aa, Homo Sapiens
EGGGDNTDS

SEQ ID NO: 275065 - protein, 9 aa, Homo Sapiens
KTSFHVLYE

SEQ ID NO: 275066 - protein, 9 aa, Homo Sapiens
MIEPSEDSC

SEQ ID NO: 275067 - protein, 9 aa, Homo Sapiens
GEYGSGAAF

SEQ ID NO: 275068 - protein, 9 aa, Homo Sapiens
SKQYKATIG

SEQ ID NO: 275069 - protein, 9 aa, Homo Sapiens
GTLQHAELF

SEQ ID NO: 275070 - protein, 9 aa, Homo Sapiens
AQDIYVKTR

SEQ ID NO: 275071 - protein, 9 aa, Homo Sapiens
YYQSGGKIW

SEQ ID NO: 275072 - protein, 9 aa, Homo Sapiens
GGTMVVQHT

SEQ ID NO: 275073 - protein, 9 aa, Homo Sapiens
EGFQTVCVG

SEQ ID NO: 275074 - protein, 9 aa, Homo Sapiens
KDQRTHTLD

SEQ ID NO: 275075 - protein, 9 aa, Homo Sapiens
EDSEKKLSP

SEQ ID NO: 275076 - protein, 9 aa, Homo Sapiens
SLLVRSGST

SEQ ID NO: 275077 - protein, 9 aa, Homo Sapiens
EQYKKEDDL

SEQ ID NO: 275078 - protein, 9 aa, Homo Sapiens
RLSEGEAKK

SEQ ID NO: 275079 - protein, 9 aa, Homo Sapiens
YSISSLLIL

SEQ ID NO: 275080 - protein, 9 aa, Homo Sapiens
QTALNLTAP

SEQ ID NO: 275081 - protein, 9 aa, Homo Sapiens
LIPSESKGF

SEQ ID NO: 275082 - protein, 9 aa, Homo Sapiens
KAENKLEEN

SEQ ID NO: 275083 - protein, 9 aa, Homo Sapiens
ISKGSLKST

SEQ ID NO: 275084 - protein, 9 aa, Homo Sapiens
LGLSHAFIF

SEQ ID NO: 275085 - protein, 9 aa, Homo Sapiens
KMNREYTRN

SEQ ID NO: 275086 - protein, 9 aa, Homo Sapiens
LLAVLGPGL

SEQ ID NO: 275087 - protein, 9 aa, Homo Sapiens
LSLDFVLKQ

SEQ ID NO: 275088 - protein, 9 aa, Homo Sapiens
SPLLRCPLQ

SEQ ID NO: 275089 - protein, 9 aa, Homo Sapiens
LKSRPFWGS

SEQ ID NO: 275090 - protein, 9 aa, Homo Sapiens
LKKKMGGDL

SEQ ID NO: 275091 - protein, 9 aa, Homo Sapiens
ARRSKRNWK

SEQ ID NO: 275092 - protein, 9 aa, Homo Sapiens
KLRIIPLSD

SEQ ID NO: 275093 - protein, 9 aa, Homo Sapiens
CGNSSSIPC

SEQ ID NO: 275094 - protein, 9 aa, Homo Sapiens
YFCEARDVF

SEQ ID NO: 275095 - protein, 9 aa, Homo Sapiens
NKTGPTKKK

SEQ ID NO: 275096 - protein, 9 aa, Homo Sapiens
GKFEYDIDN

SEQ ID NO: 275097 - protein, 9 aa, Homo Sapiens
KGITPEGIL

SEQ ID NO: 275098 - protein, 9 aa, Homo Sapiens
RLPLPKQGS

SEQ ID NO: 275099 - protein, 9 aa, Homo Sapiens
NEALKTGVD

SEQ ID NO: 275100 - protein, 9 aa, Homo Sapiens
LQIQKVDVY

SEQ ID NO: 275101 - protein, 9 aa, Homo Sapiens
QNTMLESLD

SEQ ID NO: 275102 - protein, 9 aa, Homo Sapiens
RNIGHRDLK

SEQ ID NO: 275103 - protein, 9 aa, Homo Sapiens
LYGYPEVKD

SEQ ID NO: 275104 - protein, 9 aa, Homo Sapiens
FKRLTLKHD

SEQ ID NO: 275105 - protein, 9 aa, Homo Sapiens
RHTSKFCSM

SEQ ID NO: 275106 - protein, 9 aa, Homo Sapiens
NSSPVYRID

SEQ ID NO: 275107 - protein, 9 aa, Homo Sapiens
SAVVWPSQR

SEQ ID NO: 275108 - protein, 9 aa, Homo Sapiens
PKFLANALT

SEQ ID NO: 275109 - protein, 9 aa, Homo Sapiens
KPELNIVPR

SEQ ID NO: 275110 - protein, 9 aa, Homo Sapiens
PGLTPFSCL

SEQ ID NO: 275111 - protein, 9 aa, Homo Sapiens
IREKSYTCN

SEQ ID NO: 275112 - protein, 9 aa, Homo Sapiens
QRDTGQMFA

SEQ ID NO: 275113 - protein, 9 aa, Homo Sapiens
FTDCKVVNV

SEQ ID NO: 275114 - protein, 9 aa, Homo Sapiens
KQFAGVLLS

SEQ ID NO: 275115 - protein, 9 aa, Homo Sapiens
AQLSTGRGS

SEQ ID NO: 275116 - protein, 9 aa, Homo Sapiens
MKDYYSSRC

SEQ ID NO: 275117 - protein, 9 aa, Homo Sapiens
CNKRYIRES

SEQ ID NO: 275118 - protein, 9 aa, Homo Sapiens
FYVAGFDMI

SEQ ID NO: 275119 - protein, 9 aa, Homo Sapiens
QNFLSSFTL

SEQ ID NO: 275120 - protein, 9 aa, Homo Sapiens
ASTFSSEME

SEQ ID NO: 275121 - protein, 9 aa, Homo Sapiens
DVNVNFEKP

SEQ ID NO: 275122 - protein, 9 aa, Homo Sapiens
SNINNHTGP

SEQ ID NO: 275123 - protein, 9 aa, Homo Sapiens
WPFLETVFS

SEQ ID NO: 275124 - protein, 9 aa, Homo Sapiens
IYSTEANTG

SEQ ID NO: 275125 - protein, 9 aa, Homo Sapiens
MTKALLVFS

SEQ ID NO: 275126 - protein, 9 aa, Homo Sapiens
NLSFSYSSL

SEQ ID NO: 275127 - protein, 9 aa, Homo Sapiens
YETEEEKIG

SEQ ID NO: 275128 - protein, 9 aa, Homo Sapiens
QNRFSITSQ

SEQ ID NO: 275129 - protein, 9 aa, Homo Sapiens
VPFAMRNVY

SEQ ID NO: 275130 - protein, 9 aa, Homo Sapiens
TTSKDVCSQ

SEQ ID NO: 275131 - protein, 9 aa, Homo Sapiens
GSPAAIPFG

SEQ ID NO: 275132 - protein, 9 aa, Homo Sapiens
GCLLGQKRK

SEQ ID NO: 275133 - protein, 9 aa, Homo Sapiens
LLSEESENQ

SEQ ID NO: 275134 - protein, 9 aa, Homo Sapiens
DIDPRYTGF

SEQ ID NO: 275135 - protein, 9 aa, Homo Sapiens
FILIYKLSY

SEQ ID NO: 275136 - protein, 9 aa, Homo Sapiens
ITSITTAIR

SEQ ID NO: 275137 - protein, 9 aa, Homo Sapiens
KKNPAVTKL

SEQ ID NO: 275138 - protein, 9 aa, Homo Sapiens
KNKLPKLNS

SEQ ID NO: 275139 - protein, 9 aa, Homo Sapiens
MNAKEELSA

SEQ ID NO: 275140 - protein, 9 aa, Homo Sapiens
VFGGPPCTI

SEQ ID NO: 275141 - protein, 9 aa, Homo Sapiens
TFLCQEKYQ

SEQ ID NO: 275142 - protein, 9 aa, Homo Sapiens
PTQIRNYQC

SEQ ID NO: 275143 - protein, 9 aa, Homo Sapiens
LESEIPEDS

SEQ ID NO: 275144 - protein, 9 aa, Homo Sapiens
ESLTLPWRT

SEQ ID NO: 275145 - protein, 9 aa, Homo Sapiens
SSQRKQRYC

SEQ ID NO: 275146 - protein, 9 aa, Homo Sapiens
TPLTTSQGS

SEQ ID NO: 275147 - protein, 9 aa, Homo Sapiens
GNDSCFCNP

SEQ ID NO: 275148 - protein, 9 aa, Homo Sapiens
DKGSSLPAH

SEQ ID NO: 275149 - protein, 9 aa, Homo Sapiens
LYSFQDCYF

SEQ ID NO: 275150 - protein, 9 aa, Homo Sapiens
LRKGGMEVC

SEQ ID NO: 275151 - protein, 9 aa, Homo Sapiens
KYCKTWQDE

SEQ ID NO: 275152 - protein, 9 aa, Homo Sapiens
CGEYIQAGP

SEQ ID NO: 275153 - protein, 9 aa, Homo Sapiens
HYHGMCLNI

SEQ ID NO: 275154 - protein, 9 aa, Homo Sapiens
LNAYLHSKR

SEQ ID NO: 275155 - protein, 9 aa, Homo Sapiens
LKWSVCYSV

SEQ ID NO: 275156 - protein, 9 aa, Homo Sapiens
VSSFLDYKN

SEQ ID NO: 275157 - protein, 9 aa, Homo Sapiens
PPRPREDLG

SEQ ID NO: 275158 - protein, 9 aa, Homo Sapiens
MRPGYGMLS

SEQ ID NO: 275159 - protein, 9 aa, Homo Sapiens
IDSTLDSST

SEQ ID NO: 275160 - protein, 9 aa, Homo Sapiens
TADKPYKCN

SEQ ID NO: 275161 - protein, 9 aa, Homo Sapiens
GKPMELIVG

SEQ ID NO: 275162 - protein, 9 aa, Homo Sapiens
DVFYLSVMA

SEQ ID NO: 275163 - protein, 9 aa, Homo Sapiens
GSLAPEKQR

SEQ ID NO: 275164 - protein, 9 aa, Homo Sapiens
GRISLKHPG

SEQ ID NO: 275165 - protein, 9 aa, Homo Sapiens
IGAIAHVHA

SEQ ID NO: 275166 - protein, 9 aa, Homo Sapiens
KQEMIEALQ

SEQ ID NO: 275167 - protein, 9 aa, Homo Sapiens
LFSLDVNNL

SEQ ID NO: 275168 - protein, 9 aa, Homo Sapiens
ATFIKGVYG

SEQ ID NO: 275169 - protein, 9 aa, Homo Sapiens
FIAVTAYQS

SEQ ID NO: 275170 - protein, 9 aa, Homo Sapiens
YTINVYSGI

SEQ ID NO: 275171 - protein, 9 aa, Homo Sapiens
PNQTLSAPK

SEQ ID NO: 275172 - protein, 9 aa, Homo Sapiens
SSLPTKEKE

SEQ ID NO: 275173 - protein, 9 aa, Homo Sapiens
INLVVGMTV

SEQ ID NO: 275174 - protein, 9 aa, Homo Sapiens
AVRSEAERQ

SEQ ID NO: 275175 - protein, 9 aa, Homo Sapiens
KTPLMIACK

SEQ ID NO: 275176 - protein, 9 aa, Homo Sapiens
AIALAALHD

SEQ ID NO: 275177 - protein, 9 aa, Homo Sapiens
HANTGSKLP

SEQ ID NO: 275178 - protein, 9 aa, Homo Sapiens
SKPKVRDGM

SEQ ID NO: 275179 - protein, 9 aa, Homo Sapiens
VLFAIYLIT

SEQ ID NO: 275180 - protein, 9 aa, Homo Sapiens
KKHQDPPDS

SEQ ID NO: 275181 - protein, 9 aa, Homo Sapiens
STANNKSKA

SEQ ID NO: 275182 - protein, 9 aa, Homo Sapiens
LFEAYSMAK

SEQ ID NO: 275183 - protein, 9 aa, Homo Sapiens
PNKDAEDEG

SEQ ID NO: 275184 - protein, 9 aa, Homo Sapiens
IMKEDVPAW

SEQ ID NO: 275185 - protein, 9 aa, Homo Sapiens
DFFRYVKMS

SEQ ID NO: 275186 - protein, 9 aa, Homo Sapiens
YMQLKQPSV

SEQ ID NO: 275187 - protein, 9 aa, Homo Sapiens
EDKLGEVYI

SEQ ID NO: 275188 - protein, 9 aa, Homo Sapiens
FPNNYWDKC

SEQ ID NO: 275189 - protein, 9 aa, Homo Sapiens
EEDRLLSGS

SEQ ID NO: 275190 - protein, 9 aa, Homo Sapiens
PPEYGLGNP

SEQ ID NO: 275191 - protein, 9 aa, Homo Sapiens
GGNENQELH

SEQ ID NO: 275192 - protein, 9 aa, Homo Sapiens
LSQQLAAAV

SEQ ID NO: 275193 - protein, 9 aa, Homo Sapiens
DAYVMVIQA

SEQ ID NO: 275194 - protein, 9 aa, Homo Sapiens
LSQMAAAGG

SEQ ID NO: 275195 - protein, 9 aa, Homo Sapiens
DAEDDCEND

SEQ ID NO: 275196 - protein, 9 aa, Homo Sapiens
AAVGVGLYG

SEQ ID NO: 275197 - protein, 9 aa, Homo Sapiens
HSLNELKTE

SEQ ID NO: 275198 - protein, 9 aa, Homo Sapiens
WMLEAQFAK

SEQ ID NO: 275199 - protein, 9 aa, Homo Sapiens
RLSDVTGNK

SEQ ID NO: 275200 - protein, 9 aa, Homo Sapiens
VLKEKGIPF

SEQ ID NO: 275201 - protein, 9 aa, Homo Sapiens
LLYNEFSEV

SEQ ID NO: 275202 - protein, 9 aa, Homo Sapiens
PKFDVLKNH

SEQ ID NO: 275203 - protein, 9 aa, Homo Sapiens
WFVFRMYEV

SEQ ID NO: 275204 - protein, 9 aa, Homo Sapiens
KKFKVGDEK

SEQ ID NO: 275205 - protein, 9 aa, Homo Sapiens
KCTECAKAF

SEQ ID NO: 275206 - protein, 9 aa, Homo Sapiens
EEAAETKFE

SEQ ID NO: 275207 - protein, 9 aa, Homo Sapiens
KLDDQGDSE

SEQ ID NO: 275208 - protein, 9 aa, Homo Sapiens
TQDKYLHLE

SEQ ID NO: 275209 - protein, 9 aa, Homo Sapiens
PQLSKPYIT

SEQ ID NO: 275210 - protein, 9 aa, Homo Sapiens
TPNNYLSKE

SEQ ID NO: 275211 - protein, 9 aa, Homo Sapiens
PNKTMIALS

SEQ ID NO: 275212 - protein, 9 aa, Homo Sapiens
YMVVVSWRL

SEQ ID NO: 275213 - protein, 9 aa, Homo Sapiens
SCDLLSLKA

SEQ ID NO: 275214 - protein, 9 aa, Homo Sapiens
MSSEHCFVA

SEQ ID NO: 275215 - protein, 9 aa, Homo Sapiens
RLPCNHVFH

SEQ ID NO: 275216 - protein, 9 aa, Homo Sapiens
EEIVLQSYP

SEQ ID NO: 275217 - protein, 9 aa, Homo Sapiens
LDRMQFGAP

SEQ ID NO: 275218 - protein, 9 aa, Homo Sapiens
TVTYATPDS

SEQ ID NO: 275219 - protein, 9 aa, Homo Sapiens
GLYAETEGT

SEQ ID NO: 275220 - protein, 9 aa, Homo Sapiens
SLAFWIISI

SEQ ID NO: 275221 - protein, 9 aa, Homo Sapiens
STRERFALK

SEQ ID NO: 275222 - protein, 9 aa, Homo Sapiens
ISFIDHHGN

SEQ ID NO: 275223 - protein, 9 aa, Homo Sapiens
VERRLIGLE

SEQ ID NO: 275224 - protein, 9 aa, Homo Sapiens
DQRFKKVSY

SEQ ID NO: 275225 - protein, 9 aa, Homo Sapiens
LKIQSLMYP

SEQ ID NO: 275226 - protein, 9 aa, Homo Sapiens
PAYPQQNYT

SEQ ID NO: 275227 - protein, 9 aa, Homo Sapiens
EGTETVADH

SEQ ID NO: 275228 - protein, 9 aa, Homo Sapiens
SEQGNLEKQ

SEQ ID NO: 275229 - protein, 9 aa, Homo Sapiens
VYRVLLTGV

SEQ ID NO: 275230 - protein, 9 aa, Homo Sapiens
WRKFKLENQ

SEQ ID NO: 275231 - protein, 9 aa, Homo Sapiens
DGFLQSRPY

SEQ ID NO: 275232 - protein, 9 aa, Homo Sapiens
NLNNERTIL

SEQ ID NO: 275233 - protein, 9 aa, Homo Sapiens
GRRIGFNVV

SEQ ID NO: 275234 - protein, 9 aa, Homo Sapiens
RNLLSLVGI

SEQ ID NO: 275235 - protein, 9 aa, Homo Sapiens
IALSLALAT

SEQ ID NO: 275236 - protein, 9 aa, Homo Sapiens
LHSYPHTDQ

SEQ ID NO: 275237 - protein, 9 aa, Homo Sapiens
FAVKNENQF

SEQ ID NO: 275238 - protein, 9 aa, Homo Sapiens
SFLKSYFPT

SEQ ID NO: 275239 - protein, 9 aa, Homo Sapiens
VQIGALEEQ

SEQ ID NO: 275240 - protein, 9 aa, Homo Sapiens
VSPLKYGSQ

SEQ ID NO: 275241 - protein, 9 aa, Homo Sapiens
NKDAEDEGE

SEQ ID NO: 275242 - protein, 9 aa, Homo Sapiens
PLGQCDTIF

SEQ ID NO: 275243 - protein, 9 aa, Homo Sapiens
DKIKELFHI

SEQ ID NO: 275244 - protein, 9 aa, Homo Sapiens
TKMFLIVAP

SEQ ID NO: 275245 - protein, 9 aa, Homo Sapiens
HELSLEMKC

SEQ ID NO: 275246 - protein, 9 aa, Homo Sapiens
IPVINWAQI

SEQ ID NO: 275247 - protein, 9 aa, Homo Sapiens
HSLHKNIGG

SEQ ID NO: 275248 - protein, 9 aa, Homo Sapiens
LFLLHHKHP

SEQ ID NO: 275249 - protein, 9 aa, Homo Sapiens
ETWTAGSWK

SEQ ID NO: 275250 - protein, 9 aa, Homo Sapiens
EGQENAIES

SEQ ID NO: 275251 - protein, 9 aa, Homo Sapiens
SLEFGPENC

SEQ ID NO: 275252 - protein, 9 aa, Homo Sapiens
KKKTGECSD

SEQ ID NO: 275253 - protein, 9 aa, Homo Sapiens
HEDEVLAFA

SEQ ID NO: 275254 - protein, 9 aa, Homo Sapiens
ATQGAKIVY

SEQ ID NO: 275255 - protein, 9 aa, Homo Sapiens
PAMKQIDNV

SEQ ID NO: 275256 - protein, 9 aa, Homo Sapiens
LVQFKYLNM

SEQ ID NO: 275257 - protein, 9 aa, Homo Sapiens
NFAIRCNLA

SEQ ID NO: 275258 - protein, 9 aa, Homo Sapiens
MDSTERLDQ

SEQ ID NO: 275259 - protein, 9 aa, Homo Sapiens
EFIILGLVQ

SEQ ID NO: 275260 - protein, 9 aa, Homo Sapiens
NDSALKIKV

SEQ ID NO: 275261 - protein, 9 aa, Homo Sapiens
NNRRLSSQF

SEQ ID NO: 275262 - protein, 9 aa, Homo Sapiens
YQIIHAGEA

SEQ ID NO: 275263 - protein, 9 aa, Homo Sapiens
DPAHFNLYM

SEQ ID NO: 275264 - protein, 9 aa, Homo Sapiens
GVLPVKTLL

SEQ ID NO: 275265 - protein, 9 aa, Homo Sapiens
CEKVFRSGS

SEQ ID NO: 275266 - protein, 9 aa, Homo Sapiens
TLEEVQAKN

SEQ ID NO: 275267 - protein, 9 aa, Homo Sapiens
SEIDTVGMA

SEQ ID NO: 275268 - protein, 9 aa, Homo Sapiens
ADAIIGNKM

SEQ ID NO: 275269 - protein, 9 aa, Homo Sapiens
DNLSNQIGK

SEQ ID NO: 275270 - protein, 9 aa, Homo Sapiens
GNKSHLRKT

SEQ ID NO: 275271 - protein, 9 aa, Homo Sapiens
TFALASHFF

SEQ ID NO: 275272 - protein, 9 aa, Homo Sapiens
SPVRREIKR

SEQ ID NO: 275273 - protein, 9 aa, Homo Sapiens
NLSNQIGKH

SEQ ID NO: 275274 - protein, 9 aa, Homo Sapiens
ILLGESQGD

SEQ ID NO: 275275 - protein, 9 aa, Homo Sapiens
TFTYHKITH

SEQ ID NO: 275276 - protein, 9 aa, Homo Sapiens
DKNFYLNLG

SEQ ID NO: 275277 - protein, 9 aa, Homo Sapiens
TVRSDSKLE

SEQ ID NO: 275278 - protein, 9 aa, Homo Sapiens
KPKQECLLN

SEQ ID NO: 275279 - protein, 9 aa, Homo Sapiens
WLCDNCLLC

SEQ ID NO: 275280 - protein, 9 aa, Homo Sapiens
ETLGAMDVS

SEQ ID NO: 275281 - protein, 9 aa, Homo Sapiens
LFSNCSTMD

SEQ ID NO: 275282 - protein, 9 aa, Homo Sapiens
AGAGAGRQL

SEQ ID NO: 275283 - protein, 9 aa, Homo Sapiens
TKVQRHDMR

SEQ ID NO: 275284 - protein, 9 aa, Homo Sapiens
SSLLKPLAV

SEQ ID NO: 275285 - protein, 9 aa, Homo Sapiens
GALETETKL

SEQ ID NO: 275286 - protein, 9 aa, Homo Sapiens
SHFVPALKI

SEQ ID NO: 275287 - protein, 9 aa, Homo Sapiens
NENETLHNI

SEQ ID NO: 275288 - protein, 9 aa, Homo Sapiens
LFPWILLGY

SEQ ID NO: 275289 - protein, 9 aa, Homo Sapiens
DTAEDLTAQ

SEQ ID NO: 275290 - protein, 9 aa, Homo Sapiens
YLKNTSAET

SEQ ID NO: 275291 - protein, 9 aa, Homo Sapiens
VRHHQFRWS

SEQ ID NO: 275292 - protein, 9 aa, Homo Sapiens
PDLQQLETC

SEQ ID NO: 275293 - protein, 9 aa, Homo Sapiens
NLDSSRDNE

SEQ ID NO: 275294 - protein, 9 aa, Homo Sapiens
FGGHKTTAS

SEQ ID NO: 275295 - protein, 9 aa, Homo Sapiens
VTQAGVKWY

SEQ ID NO: 275296 - protein, 9 aa, Homo Sapiens
AKIIGIKKA

SEQ ID NO: 275297 - protein, 9 aa, Homo Sapiens
MFVFVCLFV

SEQ ID NO: 275298 - protein, 9 aa, Homo Sapiens
NNCINALKS

SEQ ID NO: 275299 - protein, 9 aa, Homo Sapiens
LSLILESAS

SEQ ID NO: 275300 - protein, 9 aa, Homo Sapiens
DNSVRAHTY

SEQ ID NO: 275301 - protein, 9 aa, Homo Sapiens
LNNSDSIVS

SEQ ID NO: 275302 - protein, 9 aa, Homo Sapiens
ATELYRTGN

SEQ ID NO: 275303 - protein, 9 aa, Homo Sapiens
STTFCIFIR

SEQ ID NO: 275304 - protein, 9 aa, Homo Sapiens
LSASQFWSD

SEQ ID NO: 275305 - protein, 9 aa, Homo Sapiens
HVQIRGNLA

SEQ ID NO: 275306 - protein, 9 aa, Homo Sapiens
SVSLTVTPE

SEQ ID NO: 275307 - protein, 9 aa, Homo Sapiens
ETLQGKIND

SEQ ID NO: 275308 - protein, 9 aa, Homo Sapiens
VNRDSIFRS

SEQ ID NO: 275309 - protein, 9 aa, Homo Sapiens
LHHFIPDLI

SEQ ID NO: 275310 - protein, 9 aa, Homo Sapiens
AVGGVPLQA

SEQ ID NO: 275311 - protein, 9 aa, Homo Sapiens
HQSKFMLKD

SEQ ID NO: 275312 - protein, 9 aa, Homo Sapiens
NIKNPMHNW

SEQ ID NO: 275313 - protein, 9 aa, Homo Sapiens
MYKDKYTKK

SEQ ID NO: 275314 - protein, 9 aa, Homo Sapiens
VLFWAPIMK

SEQ ID NO: 275315 - protein, 9 aa, Homo Sapiens
EPTKNLPLK

SEQ ID NO: 275316 - protein, 9 aa, Homo Sapiens
CWVIASHPP

SEQ ID NO: 275317 - protein, 9 aa, Homo Sapiens
AKKHKKICL

SEQ ID NO: 275318 - protein, 9 aa, Homo Sapiens
VKKVNCVIF

SEQ ID NO: 275319 - protein, 9 aa, Homo Sapiens
DKKAMMEAG

SEQ ID NO: 275320 - protein, 9 aa, Homo Sapiens
PAPGQDLVS

SEQ ID NO: 275321 - protein, 9 aa, Homo Sapiens
SWWATTYVS

SEQ ID NO: 275322 - protein, 9 aa, Homo Sapiens
ETVDKNGRL

SEQ ID NO: 275323 - protein, 9 aa, Homo Sapiens
YQVALREKK

SEQ ID NO: 275324 - protein, 9 aa, Homo Sapiens
LRTAIKHVK

SEQ ID NO: 275325 - protein, 9 aa, Homo Sapiens
CLFCGRFSI

SEQ ID NO: 275326 - protein, 9 aa, Homo Sapiens
DPNGIPKIH

SEQ ID NO: 275327 - protein, 9 aa, Homo Sapiens
VWQMADNIY

SEQ ID NO: 275328 - protein, 9 aa, Homo Sapiens
SDVVQELLT

SEQ ID NO: 275329 - protein, 9 aa, Homo Sapiens
ECKLQKYYN

SEQ ID NO: 275330 - protein, 9 aa, Homo Sapiens
DKKNGIWEV

SEQ ID NO: 275331 - protein, 9 aa, Homo Sapiens
HTQLLFCIF

SEQ ID NO: 275332 - protein, 9 aa, Homo Sapiens
SGAESGYTT

SEQ ID NO: 275333 - protein, 9 aa, Homo Sapiens
MMDTQLSEF

SEQ ID NO: 275334 - protein, 9 aa, Homo Sapiens
NRPLTAIIV

SEQ ID NO: 275335 - protein, 9 aa, Homo Sapiens
QTFSGGTYQ

SEQ ID NO: 275336 - protein, 9 aa, Homo Sapiens
KRAVQKTSN

SEQ ID NO: 275337 - protein, 9 aa, Homo Sapiens
LPPIQNGNF

SEQ ID NO: 275338 - protein, 9 aa, Homo Sapiens
APNINRINE

SEQ ID NO: 275339 - protein, 9 aa, Homo Sapiens
YSYMRIRGH

SEQ ID NO: 275340 - protein, 9 aa, Homo Sapiens
NPLYAIFVI

SEQ ID NO: 275341 - protein, 9 aa, Homo Sapiens
MSASQLETL

SEQ ID NO: 275342 - protein, 9 aa, Homo Sapiens
PKSATHLVI

SEQ ID NO: 275343 - protein, 9 aa, Homo Sapiens
VLVSFMPYH

SEQ ID NO: 275344 - protein, 9 aa, Homo Sapiens
MMSLITLPI

SEQ ID NO: 275345 - protein, 9 aa, Homo Sapiens
SFTSFVPNF

SEQ ID NO: 275346 - protein, 9 aa, Homo Sapiens
ELFEASAKE

SEQ ID NO: 275347 - protein, 9 aa, Homo Sapiens
LFVLGITSI

SEQ ID NO: 275348 - protein, 9 aa, Homo Sapiens
KDTSAGKEY

SEQ ID NO: 275349 - protein, 9 aa, Homo Sapiens
WSVTRRDSA

SEQ ID NO: 275350 - protein, 9 aa, Homo Sapiens
FTEVDNFHL

SEQ ID NO: 275351 - protein, 9 aa, Homo Sapiens
GDDQAGQNI

SEQ ID NO: 275352 - protein, 9 aa, Homo Sapiens
MPKKSADNF

SEQ ID NO: 275353 - protein, 9 aa, Homo Sapiens
EPCGIKHIN

SEQ ID NO: 275354 - protein, 9 aa, Homo Sapiens
VWVAWLFLF

SEQ ID NO: 275355 - protein, 9 aa, Homo Sapiens
QNIAFGALQ

SEQ ID NO: 275356 - protein, 9 aa, Homo Sapiens
SDDQKDDVP

SEQ ID NO: 275357 - protein, 9 aa, Homo Sapiens
DILGFSVGE

SEQ ID NO: 275358 - protein, 9 aa, Homo Sapiens
NLLSLVGII

SEQ ID NO: 275359 - protein, 9 aa, Homo Sapiens
LNFTGNLIE

SEQ ID NO: 275360 - protein, 9 aa, Homo Sapiens
LCQLQVNSD

SEQ ID NO: 275361 - protein, 9 aa, Homo Sapiens
SYASLGKIT

SEQ ID NO: 275362 - protein, 9 aa, Homo Sapiens
VIYAYMNFI

SEQ ID NO: 275363 - protein, 9 aa, Homo Sapiens
ECEKTYSLL

SEQ ID NO: 275364 - protein, 9 aa, Homo Sapiens
IYYGAHVGK

SEQ ID NO: 275365 - protein, 9 aa, Homo Sapiens
LTHNGTPQN

SEQ ID NO: 275366 - protein, 9 aa, Homo Sapiens
LDDKVVSIH

SEQ ID NO: 275367 - protein, 9 aa, Homo Sapiens
NHPGFKDQG

SEQ ID NO: 275368 - protein, 9 aa, Homo Sapiens
FSGIVFIIL

SEQ ID NO: 275369 - protein, 9 aa, Homo Sapiens
PDMWLFPDW

SEQ ID NO: 275370 - protein, 9 aa, Homo Sapiens
TVFSDTSPI

SEQ ID NO: 275371 - protein, 9 aa, Homo Sapiens
NIPKEMVLD

SEQ ID NO: 275372 - protein, 9 aa, Homo Sapiens
LFMEAIEAV

SEQ ID NO: 275373 - protein, 9 aa, Homo Sapiens
SLHQAFSDY

SEQ ID NO: 275374 - protein, 9 aa, Homo Sapiens
IYEIMCMIR

SEQ ID NO: 275375 - protein, 9 aa, Homo Sapiens
KDDLIAYVS

SEQ ID NO: 275376 - protein, 9 aa, Homo Sapiens
VIHRRLLYN

SEQ ID NO: 275377 - protein, 9 aa, Homo Sapiens
QELIPSEDF

SEQ ID NO: 275378 - protein, 9 aa, Homo Sapiens
DELQSEINY

SEQ ID NO: 275379 - protein, 9 aa, Homo Sapiens
RQSQKFGVG

SEQ ID NO: 275380 - protein, 9 aa, Homo Sapiens
ETPKSSGKK

SEQ ID NO: 275381 - protein, 9 aa, Homo Sapiens
LGCLNAYRR

SEQ ID NO: 275382 - protein, 9 aa, Homo Sapiens
LSEQASNIY

SEQ ID NO: 275383 - protein, 9 aa, Homo Sapiens
ALDASQHIS

SEQ ID NO: 275384 - protein, 9 aa, Homo Sapiens
RMPQYCLFG

SEQ ID NO: 275385 - protein, 9 aa, Homo Sapiens
MPQESFRSM

SEQ ID NO: 275386 - protein, 9 aa, Homo Sapiens
DLLLDYSFQ

SEQ ID NO: 275387 - protein, 9 aa, Homo Sapiens
LYIGEKTFS

SEQ ID NO: 275388 - protein, 9 aa, Homo Sapiens
VKYETSLTT

SEQ ID NO: 275389 - protein, 9 aa, Homo Sapiens
KQEEPKGAD

SEQ ID NO: 275390 - protein, 9 aa, Homo Sapiens
SVAAGLPNI

SEQ ID NO: 275391 - protein, 9 aa, Homo Sapiens
FLLFPQDIN

SEQ ID NO: 275392 - protein, 9 aa, Homo Sapiens
LILSLGLFA

SEQ ID NO: 275393 - protein, 9 aa, Homo Sapiens
TADMDAEIR

SEQ ID NO: 275394 - protein, 9 aa, Homo Sapiens
DALINVLIA

SEQ ID NO: 275395 - protein, 9 aa, Homo Sapiens
TTHSMVESI

SEQ ID NO: 275396 - protein, 9 aa, Homo Sapiens
AVPPGYTFP

SEQ ID NO: 275397 - protein, 9 aa, Homo Sapiens
EPTVHSSET

SEQ ID NO: 275398 - protein, 9 aa, Homo Sapiens
LFGGYILGG

SEQ ID NO: 275399 - protein, 9 aa, Homo Sapiens
MVMASAWCL

SEQ ID NO: 275400 - protein, 9 aa, Homo Sapiens
SLLRANQAR

SEQ ID NO: 275401 - protein, 9 aa, Homo Sapiens
IQNQKAFDL

SEQ ID NO: 275402 - protein, 9 aa, Homo Sapiens
YECKQCSNA

SEQ ID NO: 275403 - protein, 9 aa, Homo Sapiens
ASFIVARCR

SEQ ID NO: 275404 - protein, 9 aa, Homo Sapiens
PNDLYKNPA

SEQ ID NO: 275405 - protein, 9 aa, Homo Sapiens
NIIEIFDNI

SEQ ID NO: 275406 - protein, 9 aa, Homo Sapiens
DAATFISMQ

SEQ ID NO: 275407 - protein, 9 aa, Homo Sapiens
FEQLALKGK

SEQ ID NO: 275408 - protein, 9 aa, Homo Sapiens
CGRRNKYMP

SEQ ID NO: 275409 - protein, 9 aa, Homo Sapiens
FVSMYTHLW

SEQ ID NO: 275410 - protein, 9 aa, Homo Sapiens
SSVVALGTS

SEQ ID NO: 275411 - protein, 9 aa, Homo Sapiens
SFQTEVSYL

SEQ ID NO: 275412 - protein, 9 aa, Homo Sapiens
RKLEMQFVL

SEQ ID NO: 275413 - protein, 9 aa, Homo Sapiens
MLNSCSSSS

SEQ ID NO: 275414 - protein, 9 aa, Homo Sapiens
GITSILYYY

SEQ ID NO: 275415 - protein, 9 aa, Homo Sapiens
KHLMQLNMA

SEQ ID NO: 275416 - protein, 9 aa, Homo Sapiens
KRLSTRLFL

SEQ ID NO: 275417 - protein, 9 aa, Homo Sapiens
TLLHRKDLE

SEQ ID NO: 275418 - protein, 9 aa, Homo Sapiens
DDVFGMGKE

SEQ ID NO: 275419 - protein, 9 aa, Homo Sapiens
TPQGRYSDH

SEQ ID NO: 275420 - protein, 9 aa, Homo Sapiens
VATSKKNVC

SEQ ID NO: 275421 - protein, 9 aa, Homo Sapiens
SGACMGQGM

SEQ ID NO: 275422 - protein, 9 aa, Homo Sapiens
SMSPQELAS

SEQ ID NO: 275423 - protein, 9 aa, Homo Sapiens
FIIFGATGL

SEQ ID NO: 275424 - protein, 9 aa, Homo Sapiens
AIVRQLLYN

SEQ ID NO: 275425 - protein, 9 aa, Homo Sapiens
TQLNTTWLC

SEQ ID NO: 275426 - protein, 9 aa, Homo Sapiens
PSAPRDLIN

SEQ ID NO: 275427 - protein, 9 aa, Homo Sapiens
EVVQEIICD

SEQ ID NO: 275428 - protein, 9 aa, Homo Sapiens
NPVKDVLIL

SEQ ID NO: 275429 - protein, 9 aa, Homo Sapiens
FGSKGVKCM

SEQ ID NO: 275430 - protein, 9 aa, Homo Sapiens
LGQCDTIFT

SEQ ID NO: 275431 - protein, 9 aa, Homo Sapiens
HLNLATDKW

SEQ ID NO: 275432 - protein, 9 aa, Homo Sapiens
INTFLTSDN

SEQ ID NO: 275433 - protein, 9 aa, Homo Sapiens
LQPSDLGAM

SEQ ID NO: 275434 - protein, 9 aa, Homo Sapiens
GRQQYLLIA

SEQ ID NO: 275435 - protein, 9 aa, Homo Sapiens
VYFTHILGF

SEQ ID NO: 275436 - protein, 9 aa, Homo Sapiens
LESLTDPPL

SEQ ID NO: 275437 - protein, 9 aa, Homo Sapiens
KKGHSVVHP

SEQ ID NO: 275438 - protein, 9 aa, Homo Sapiens
NVDSIIEDY

SEQ ID NO: 275439 - protein, 9 aa, Homo Sapiens
GACMGQGMG

SEQ ID NO: 275440 - protein, 9 aa, Homo Sapiens
FNDVDVQNI

SEQ ID NO: 275441 - protein, 9 aa, Homo Sapiens
CHPGWSVVT

SEQ ID NO: 275442 - protein, 9 aa, Homo Sapiens
GSPQIPLPA

SEQ ID NO: 275443 - protein, 9 aa, Homo Sapiens
GQIEINHFY

SEQ ID NO: 275444 - protein, 9 aa, Homo Sapiens
EMGMYSITV

SEQ ID NO: 275445 - protein, 9 aa, Homo Sapiens
DWIAFQSNC

SEQ ID NO: 275446 - protein, 9 aa, Homo Sapiens
NVLAKALGV

SEQ ID NO: 275447 - protein, 9 aa, Homo Sapiens
VAHITEFTI

SEQ ID NO: 275448 - protein, 9 aa, Homo Sapiens
KAFSQYSSF

SEQ ID NO: 275449 - protein, 9 aa, Homo Sapiens
RLRAEAAQA

SEQ ID NO: 275450 - protein, 9 aa, Homo Sapiens
FSSGGPFKF

SEQ ID NO: 275451 - protein, 9 aa, Homo Sapiens
VSTLVFLVS

SEQ ID NO: 275452 - protein, 9 aa, Homo Sapiens
TIYYSECLT

SEQ ID NO: 275453 - protein, 9 aa, Homo Sapiens
QRLYVQVNT

SEQ ID NO: 275454 - protein, 9 aa, Homo Sapiens
DNPTPLPNL

SEQ ID NO: 275455 - protein, 9 aa, Homo Sapiens
TVVEVLFQR

SEQ ID NO: 275456 - protein, 9 aa, Homo Sapiens
SNHSFFSEI

SEQ ID NO: 275457 - protein, 9 aa, Homo Sapiens
SELIISNSS

SEQ ID NO: 275458 - protein, 9 aa, Homo Sapiens
FKQRHSIRK

SEQ ID NO: 275459 - protein, 9 aa, Homo Sapiens
IDEDCKLNN

SEQ ID NO: 275460 - protein, 9 aa, Homo Sapiens
SEQKRNPQA

SEQ ID NO: 275461 - protein, 9 aa, Homo Sapiens
KFRKWMGIK

SEQ ID NO: 275462 - protein, 9 aa, Homo Sapiens
KQNTMKFGK

SEQ ID NO: 275463 - protein, 9 aa, Homo Sapiens
LLSFASGQR

SEQ ID NO: 275464 - protein, 9 aa, Homo Sapiens
TATGYGFAK

SEQ ID NO: 275465 - protein, 9 aa, Homo Sapiens
SIVTLNVRR

SEQ ID NO: 275466 - protein, 9 aa, Homo Sapiens
VNISDACQD

SEQ ID NO: 275467 - protein, 9 aa, Homo Sapiens
NYLTRCQDS

SEQ ID NO: 275468 - protein, 9 aa, Homo Sapiens
PHMVPHHSN

SEQ ID NO: 275469 - protein, 9 aa, Homo Sapiens
RAGLSLDNF

SEQ ID NO: 275470 - protein, 9 aa, Homo Sapiens
EIGLPTIFY

SEQ ID NO: 275471 - protein, 9 aa, Homo Sapiens
RVVGVEPHF

SEQ ID NO: 275472 - protein, 9 aa, Homo Sapiens
AIRKKIEPD

SEQ ID NO: 275473 - protein, 9 aa, Homo Sapiens
RPNIPHQQT

SEQ ID NO: 275474 - protein, 9 aa, Homo Sapiens
LPMRTLDPQ

SEQ ID NO: 275475 - protein, 9 aa, Homo Sapiens
EKNKGKAEY

SEQ ID NO: 275476 - protein, 9 aa, Homo Sapiens
TDNPMGGYG

SEQ ID NO: 275477 - protein, 9 aa, Homo Sapiens
GEKPLECTE

SEQ ID NO: 275478 - protein, 9 aa, Homo Sapiens
EIQAREQRI

SEQ ID NO: 275479 - protein, 9 aa, Homo Sapiens
GGSYFMISH

SEQ ID NO: 275480 - protein, 9 aa, Homo Sapiens
FSGPVRSNH

SEQ ID NO: 275481 - protein, 9 aa, Homo Sapiens
NINDKHFPF

SEQ ID NO: 275482 - protein, 9 aa, Homo Sapiens
TIHNTYHSQ

SEQ ID NO: 275483 - protein, 9 aa, Homo Sapiens
EPLLMEYSH

SEQ ID NO: 275484 - protein, 9 aa, Homo Sapiens
SFACEQILA

SEQ ID NO: 275485 - protein, 9 aa, Homo Sapiens
FAEAFETTL

SEQ ID NO: 275486 - protein, 9 aa, Homo Sapiens
NYQNSTIGA

SEQ ID NO: 275487 - protein, 9 aa, Homo Sapiens
SMLTLRVIA

SEQ ID NO: 275488 - protein, 9 aa, Homo Sapiens
GIKSMDQCR

SEQ ID NO: 275489 - protein, 9 aa, Homo Sapiens
LEQQQGNQE

SEQ ID NO: 275490 - protein, 9 aa, Homo Sapiens
ILVHPDTNQ

SEQ ID NO: 275491 - protein, 9 aa, Homo Sapiens
KRKWTLDLE

SEQ ID NO: 275492 - protein, 9 aa, Homo Sapiens
RKKFSKDVA

SEQ ID NO: 275493 - protein, 9 aa, Homo Sapiens
PKHKEQAIG

SEQ ID NO: 275494 - protein, 9 aa, Homo Sapiens
LHKIEAKEP

SEQ ID NO: 275495 - protein, 9 aa, Homo Sapiens
RPPQGRSER

SEQ ID NO: 275496 - protein, 9 aa, Homo Sapiens
LEKKMKLFP

SEQ ID NO: 275497 - protein, 9 aa, Homo Sapiens
GEVYWEAVE

SEQ ID NO: 275498 - protein, 9 aa, Homo Sapiens
SKAAFLCQP

SEQ ID NO: 275499 - protein, 9 aa, Homo Sapiens
VQSQTQPVY

SEQ ID NO: 275500 - protein, 9 aa, Homo Sapiens
TPPAVKLHE

SEQ ID NO: 275501 - protein, 9 aa, Homo Sapiens
STFRNSFVF

SEQ ID NO: 275502 - protein, 9 aa, Homo Sapiens
GGETEARTR

SEQ ID NO: 275503 - protein, 9 aa, Homo Sapiens
CEIKIKQKL

SEQ ID NO: 275504 - protein, 9 aa, Homo Sapiens
SHAGSKSSV

SEQ ID NO: 275505 - protein, 9 aa, Homo Sapiens
AHYSGSYND

SEQ ID NO: 275506 - protein, 9 aa, Homo Sapiens
LVEGQVPHS

SEQ ID NO: 275507 - protein, 9 aa, Homo Sapiens
PLTTSQGSW

SEQ ID NO: 275508 - protein, 9 aa, Homo Sapiens
CADGFEGES

SEQ ID NO: 275509 - protein, 9 aa, Homo Sapiens
DYRTAISGI

SEQ ID NO: 275510 - protein, 9 aa, Homo Sapiens
IGVSTVLLK

SEQ ID NO: 275511 - protein, 9 aa, Homo Sapiens
KDNGEPGTR

SEQ ID NO: 275512 - protein, 9 aa, Homo Sapiens
RLPSTQTGV

SEQ ID NO: 275513 - protein, 9 aa, Homo Sapiens
KNILRFFFH

SEQ ID NO: 275514 - protein, 9 aa, Homo Sapiens
DTCALHEQP

SEQ ID NO: 275515 - protein, 9 aa, Homo Sapiens
IGGPPGLPG

SEQ ID NO: 275516 - protein, 9 aa, Homo Sapiens
LPRHNSDGI

SEQ ID NO: 275517 - protein, 9 aa, Homo Sapiens
YVAMIPRCI

SEQ ID NO: 275518 - protein, 9 aa, Homo Sapiens
GRLDFILMN

SEQ ID NO: 275519 - protein, 9 aa, Homo Sapiens
GTNSVGKDR

SEQ ID NO: 275520 - protein, 9 aa, Homo Sapiens
LPVEPNNHH

SEQ ID NO: 275521 - protein, 9 aa, Homo Sapiens
ILTNHKIIH

SEQ ID NO: 275522 - protein, 9 aa, Homo Sapiens
TVLNLKQFL

SEQ ID NO: 275523 - protein, 9 aa, Homo Sapiens
QKTIQMWLC

SEQ ID NO: 275524 - protein, 9 aa, Homo Sapiens
FKRRIEDFS

SEQ ID NO: 275525 - protein, 9 aa, Homo Sapiens
RINSLPPSH

SEQ ID NO: 275526 - protein, 9 aa, Homo Sapiens
QIHECTHTG

SEQ ID NO: 275527 - protein, 9 aa, Homo Sapiens
LKNAVSKYG

SEQ ID NO: 275528 - protein, 9 aa, Homo Sapiens
RSAESDQLI

SEQ ID NO: 275529 - protein, 9 aa, Homo Sapiens
GDYRFSGSP

SEQ ID NO: 275530 - protein, 9 aa, Homo Sapiens
FLKSDMYLE

SEQ ID NO: 275531 - protein, 9 aa, Homo Sapiens
CLRHVENGG

SEQ ID NO: 275532 - protein, 9 aa, Homo Sapiens
LFRFCVVMG

SEQ ID NO: 275533 - protein, 9 aa, Homo Sapiens
TKIRMNVDQ

SEQ ID NO: 275534 - protein, 9 aa, Homo Sapiens
RKSNSPGTA

SEQ ID NO: 275535 - protein, 9 aa, Homo Sapiens
VVKYAVLDC

SEQ ID NO: 275536 - protein, 9 aa, Homo Sapiens
KGVKVSPLQ

SEQ ID NO: 275537 - protein, 9 aa, Homo Sapiens
FNEPKQSRF

SEQ ID NO: 275538 - protein, 9 aa, Homo Sapiens
EVTRKRFNA

SEQ ID NO: 275539 - protein, 9 aa, Homo Sapiens
LVMEQLMIS

SEQ ID NO: 275540 - protein, 9 aa, Homo Sapiens
YQLSQPEVY

SEQ ID NO: 275541 - protein, 9 aa, Homo Sapiens
KRQEQEANM

SEQ ID NO: 275542 - protein, 9 aa, Homo Sapiens
QNVYAIIML

SEQ ID NO: 275543 - protein, 9 aa, Homo Sapiens
QYDKDDEAP

SEQ ID NO: 275544 - protein, 9 aa, Homo Sapiens
NNRQLIRQK

SEQ ID NO: 275545 - protein, 9 aa, Homo Sapiens
AESSTNNVN

SEQ ID NO: 275546 - protein, 9 aa, Homo Sapiens
DFTKAKLFI

SEQ ID NO: 275547 - protein, 9 aa, Homo Sapiens
ISLASAQEN

SEQ ID NO: 275548 - protein, 9 aa, Homo Sapiens
ARVRLQCKL

SEQ ID NO: 275549 - protein, 9 aa, Homo Sapiens
FVVVTNVIS

SEQ ID NO: 275550 - protein, 9 aa, Homo Sapiens
DGEKGFKDK

SEQ ID NO: 275551 - protein, 9 aa, Homo Sapiens
EALRHLDVL

SEQ ID NO: 275552 - protein, 9 aa, Homo Sapiens
ERELGKVAP

SEQ ID NO: 275553 - protein, 9 aa, Homo Sapiens
SSEDSITPS

SEQ ID NO: 275554 - protein, 9 aa, Homo Sapiens
MNELDTVVE

SEQ ID NO: 275555 - protein, 9 aa, Homo Sapiens
SVELIITSY

SEQ ID NO: 275556 - protein, 9 aa, Homo Sapiens
GSACFTLSL

SEQ ID NO: 275557 - protein, 9 aa, Homo Sapiens
ETGEGSAEA

SEQ ID NO: 275558 - protein, 9 aa, Homo Sapiens
QYYHNKILK

SEQ ID NO: 275559 - protein, 9 aa, Homo Sapiens
VQTISNKQR

SEQ ID NO: 275560 - protein, 9 aa, Homo Sapiens
FNRQGILHR

SEQ ID NO: 275561 - protein, 9 aa, Homo Sapiens
KESSHLHLS

SEQ ID NO: 275562 - protein, 9 aa, Homo Sapiens
LEPSVNIET

SEQ ID NO: 275563 - protein, 9 aa, Homo Sapiens
PEEEIVLQS

SEQ ID NO: 275564 - protein, 9 aa, Homo Sapiens
LELELPSSS

SEQ ID NO: 275565 - protein, 9 aa, Homo Sapiens
RDADECHQQ

SEQ ID NO: 275566 - protein, 9 aa, Homo Sapiens
VCFIGELTK

SEQ ID NO: 275567 - protein, 9 aa, Homo Sapiens
FNTIKVKMQ

SEQ ID NO: 275568 - protein, 9 aa, Homo Sapiens
ATVTTAETL

SEQ ID NO: 275569 - protein, 9 aa, Homo Sapiens
LERLCLGPE

SEQ ID NO: 275570 - protein, 9 aa, Homo Sapiens
DIKYETEEE

SEQ ID NO: 275571 - protein, 9 aa, Homo Sapiens
LQVTKPYLD

SEQ ID NO: 275572 - protein, 9 aa, Homo Sapiens
ECERLAGTK

SEQ ID NO: 275573 - protein, 9 aa, Homo Sapiens
QEMDKRLQE

SEQ ID NO: 275574 - protein, 9 aa, Homo Sapiens
RPHQQPTTE

SEQ ID NO: 275575 - protein, 9 aa, Homo Sapiens
CHGLGPRPP

SEQ ID NO: 275576 - protein, 9 aa, Homo Sapiens
ILELIKQAQ

SEQ ID NO: 275577 - protein, 9 aa, Homo Sapiens
SSTVQTEGA

SEQ ID NO: 275578 - protein, 9 aa, Homo Sapiens
MASESKFIF

SEQ ID NO: 275579 - protein, 9 aa, Homo Sapiens
AKEMQIVLE

SEQ ID NO: 275580 - protein, 9 aa, Homo Sapiens
LDVNQELIA

SEQ ID NO: 275581 - protein, 9 aa, Homo Sapiens
RKYALLGNY

SEQ ID NO: 275582 - protein, 9 aa, Homo Sapiens
GFKFDNLLI

SEQ ID NO: 275583 - protein, 9 aa, Homo Sapiens
SSVQDLICD

SEQ ID NO: 275584 - protein, 9 aa, Homo Sapiens
MNISPAKQF

SEQ ID NO: 275585 - protein, 9 aa, Homo Sapiens
FWLPEPVPS

SEQ ID NO: 275586 - protein, 9 aa, Homo Sapiens
KAFAAHKEK

SEQ ID NO: 275587 - protein, 9 aa, Homo Sapiens
MKTFLHKRK

SEQ ID NO: 275588 - protein, 9 aa, Homo Sapiens
RKDFQKYFV

SEQ ID NO: 275589 - protein, 9 aa, Homo Sapiens
ASLNIDLRV

SEQ ID NO: 275590 - protein, 9 aa, Homo Sapiens
EPELPLISL

SEQ ID NO: 275591 - protein, 9 aa, Homo Sapiens
VECIKAESA

SEQ ID NO: 275592 - protein, 9 aa, Homo Sapiens
EALERTEQL

SEQ ID NO: 275593 - protein, 9 aa, Homo Sapiens
VQGLEVLRA

SEQ ID NO: 275594 - protein, 9 aa, Homo Sapiens
QTFRLESES

SEQ ID NO: 275595 - protein, 9 aa, Homo Sapiens
DKGTARAGR

SEQ ID NO: 275596 - protein, 9 aa, Homo Sapiens
GLFKVDYSQ

SEQ ID NO: 275597 - protein, 9 aa, Homo Sapiens
FHIGSDCPD

SEQ ID NO: 275598 - protein, 9 aa, Homo Sapiens
VFSHLLSYI

SEQ ID NO: 275599 - protein, 9 aa, Homo Sapiens
RPVMIITES

SEQ ID NO: 275600 - protein, 9 aa, Homo Sapiens
QGDKGDQGV

SEQ ID NO: 275601 - protein, 9 aa, Homo Sapiens
KFLNDLEKQ

SEQ ID NO: 275602 - protein, 9 aa, Homo Sapiens
DLNIGSGAF

SEQ ID NO: 275603 - protein, 9 aa, Homo Sapiens
SNEMITNVG

SEQ ID NO: 275604 - protein, 9 aa, Homo Sapiens
WTDYTQCNV

SEQ ID NO: 275605 - protein, 9 aa, Homo Sapiens
VSLHYACFW

SEQ ID NO: 275606 - protein, 9 aa, Homo Sapiens
ANNTFYETL

SEQ ID NO: 275607 - protein, 9 aa, Homo Sapiens
FDIDDAQVL

SEQ ID NO: 275608 - protein, 9 aa, Homo Sapiens
SSEVVLDST

SEQ ID NO: 275609 - protein, 9 aa, Homo Sapiens
SGSPCLECP

SEQ ID NO: 275610 - protein, 9 aa, Homo Sapiens
RNPQAVLDV

SEQ ID NO: 275611 - protein, 9 aa, Homo Sapiens
SHKRSECPW

SEQ ID NO: 275612 - protein, 9 aa, Homo Sapiens
ESSKYGSLE

SEQ ID NO: 275613 - protein, 9 aa, Homo Sapiens
CQAKNLPKA

SEQ ID NO: 275614 - protein, 9 aa, Homo Sapiens
EVEQVSSFL

SEQ ID NO: 275615 - protein, 9 aa, Homo Sapiens
KGFQRPSEK

SEQ ID NO: 275616 - protein, 9 aa, Homo Sapiens
NKWHRFRFN

SEQ ID NO: 275617 - protein, 9 aa, Homo Sapiens
SYLTQHKII

SEQ ID NO: 275618 - protein, 9 aa, Homo Sapiens
TVSSSVVMG

SEQ ID NO: 275619 - protein, 9 aa, Homo Sapiens
GSCYCGKII

SEQ ID NO: 275620 - protein, 9 aa, Homo Sapiens
INLDTDKSE

SEQ ID NO: 275621 - protein, 9 aa, Homo Sapiens
PPPHQASIS

SEQ ID NO: 275622 - protein, 9 aa, Homo Sapiens
SPFRNSVAS

SEQ ID NO: 275623 - protein, 9 aa, Homo Sapiens
SLIGVLISH

SEQ ID NO: 275624 - protein, 9 aa, Homo Sapiens
LLKKKGTSA

SEQ ID NO: 275625 - protein, 9 aa, Homo Sapiens
EIAERVRKL

SEQ ID NO: 275626 - protein, 9 aa, Homo Sapiens
QILLTLQHI

SEQ ID NO: 275627 - protein, 9 aa, Homo Sapiens
IIARSEIDL

SEQ ID NO: 275628 - protein, 9 aa, Homo Sapiens
QYCSPRRKS

SEQ ID NO: 275629 - protein, 9 aa, Homo Sapiens
GCFDMFVRF

SEQ ID NO: 275630 - protein, 9 aa, Homo Sapiens
VSNDDPGSG

SEQ ID NO: 275631 - protein, 9 aa, Homo Sapiens
FGGLSQVSE

SEQ ID NO: 275632 - protein, 9 aa, Homo Sapiens
PYGPQTPSE

SEQ ID NO: 275633 - protein, 9 aa, Homo Sapiens
QVCLTTSDK

SEQ ID NO: 275634 - protein, 9 aa, Homo Sapiens
PKQIVDHSH

SEQ ID NO: 275635 - protein, 9 aa, Homo Sapiens
KILEESYQE

SEQ ID NO: 275636 - protein, 9 aa, Homo Sapiens
AVMAVPHTA

SEQ ID NO: 275637 - protein, 9 aa, Homo Sapiens
ADNIINAIV

SEQ ID NO: 275638 - protein, 9 aa, Homo Sapiens
KDREYMGSK

SEQ ID NO: 275639 - protein, 9 aa, Homo Sapiens
SFQNHIRIH

SEQ ID NO: 275640 - protein, 9 aa, Homo Sapiens
VEHPDKVLK

SEQ ID NO: 275641 - protein, 9 aa, Homo Sapiens
RLRLSYGCD

SEQ ID NO: 275642 - protein, 9 aa, Homo Sapiens
TNLILQFLA

SEQ ID NO: 275643 - protein, 9 aa, Homo Sapiens
SWCRIPSEE

SEQ ID NO: 275644 - protein, 9 aa, Homo Sapiens
ELGLPPVKL

SEQ ID NO: 275645 - protein, 9 aa, Homo Sapiens
FPVIQFKGQ

SEQ ID NO: 275646 - protein, 9 aa, Homo Sapiens
NITHKAKSQ

SEQ ID NO: 275647 - protein, 9 aa, Homo Sapiens
NERLQTLLG

SEQ ID NO: 275648 - protein, 9 aa, Homo Sapiens
PYENRFIVQ

SEQ ID NO: 275649 - protein, 9 aa, Homo Sapiens
GRDSAVGSV

SEQ ID NO: 275650 - protein, 9 aa, Homo Sapiens
VGGLCYYLP

SEQ ID NO: 275651 - protein, 9 aa, Homo Sapiens
PIVARCVRF

SEQ ID NO: 275652 - protein, 9 aa, Homo Sapiens
PYCQPRAIN

SEQ ID NO: 275653 - protein, 9 aa, Homo Sapiens
KGLKHLMQL

SEQ ID NO: 275654 - protein, 9 aa, Homo Sapiens
LLTAGKKCR

SEQ ID NO: 275655 - protein, 9 aa, Homo Sapiens
TKRNTIKKC

SEQ ID NO: 275656 - protein, 9 aa, Homo Sapiens
KITLRNLNG

SEQ ID NO: 275657 - protein, 9 aa, Homo Sapiens
EKPWKHLIC

SEQ ID NO: 275658 - protein, 9 aa, Homo Sapiens
YISYSNSKD

SEQ ID NO: 275659 - protein, 9 aa, Homo Sapiens
DEGEIEDDD

SEQ ID NO: 275660 - protein, 9 aa, Homo Sapiens
SSDNKFGAA

SEQ ID NO: 275661 - protein, 9 aa, Homo Sapiens
PLAKSHPLI

SEQ ID NO: 275662 - protein, 9 aa, Homo Sapiens
AFVFDKAIK

SEQ ID NO: 275663 - protein, 9 aa, Homo Sapiens
DGGKVLLPK

SEQ ID NO: 275664 - protein, 9 aa, Homo Sapiens
AYTAIQRWY

SEQ ID NO: 275665 - protein, 9 aa, Homo Sapiens
NKIFNGIPE

SEQ ID NO: 275666 - protein, 9 aa, Homo Sapiens
LCLPSSNDS

SEQ ID NO: 275667 - protein, 9 aa, Homo Sapiens
DTSCSTMYL

SEQ ID NO: 275668 - protein, 9 aa, Homo Sapiens
KALSHSDRC

SEQ ID NO: 275669 - protein, 9 aa, Homo Sapiens
IPQSSSNNN

SEQ ID NO: 275670 - protein, 9 aa, Homo Sapiens
PATKLPLEA

SEQ ID NO: 275671 - protein, 9 aa, Homo Sapiens
SDPQSNDNM

SEQ ID NO: 275672 - protein, 9 aa, Homo Sapiens
IVGCIFAEM

SEQ ID NO: 275673 - protein, 9 aa, Homo Sapiens
LTGNTLSSV

SEQ ID NO: 275674 - protein, 9 aa, Homo Sapiens
VPHSPRIIP

SEQ ID NO: 275675 - protein, 9 aa, Homo Sapiens
AGVKLFFHF

SEQ ID NO: 275676 - protein, 9 aa, Homo Sapiens
VPLQIILEK

SEQ ID NO: 275677 - protein, 9 aa, Homo Sapiens
DSGPQKQKL

SEQ ID NO: 275678 - protein, 9 aa, Homo Sapiens
DGRGWAIKE

SEQ ID NO: 275679 - protein, 9 aa, Homo Sapiens
CARHYKKSF

SEQ ID NO: 275680 - protein, 9 aa, Homo Sapiens
QKALRLNVN

SEQ ID NO: 275681 - protein, 9 aa, Homo Sapiens
GSDDEGLYA

SEQ ID NO: 275682 - protein, 9 aa, Homo Sapiens
DFKALDSVI

SEQ ID NO: 275683 - protein, 9 aa, Homo Sapiens
KNCKHQIKI

SEQ ID NO: 275684 - protein, 9 aa, Homo Sapiens
SYSQNTLIA

SEQ ID NO: 275685 - protein, 9 aa, Homo Sapiens
TAHHWISIP

SEQ ID NO: 275686 - protein, 9 aa, Homo Sapiens
PNEKKPECG

SEQ ID NO: 275687 - protein, 9 aa, Homo Sapiens
QTPGERSHP

SEQ ID NO: 275688 - protein, 9 aa, Homo Sapiens
KLPYAMGII

SEQ ID NO: 275689 - protein, 9 aa, Homo Sapiens
TWHHDCIID

SEQ ID NO: 275690 - protein, 9 aa, Homo Sapiens
ICVTTVPGK

SEQ ID NO: 275691 - protein, 9 aa, Homo Sapiens
TIPETKNCC

SEQ ID NO: 275692 - protein, 9 aa, Homo Sapiens
KNVFEKKYH

SEQ ID NO: 275693 - protein, 9 aa, Homo Sapiens
EPVTEPPLE

SEQ ID NO: 275694 - protein, 9 aa, Homo Sapiens
FNEQLKVNH

SEQ ID NO: 275695 - protein, 9 aa, Homo Sapiens
LDDRYKMED

SEQ ID NO: 275696 - protein, 9 aa, Homo Sapiens
VSAFTNVGN

SEQ ID NO: 275697 - protein, 9 aa, Homo Sapiens
QEKFKQLEN

SEQ ID NO: 275698 - protein, 9 aa, Homo Sapiens
FASQVTHTL

SEQ ID NO: 275699 - protein, 9 aa, Homo Sapiens
FQELDIRLA

SEQ ID NO: 275700 - protein, 9 aa, Homo Sapiens
KSSNYPCLV

SEQ ID NO: 275701 - protein, 9 aa, Homo Sapiens
QSPVPCINQ

SEQ ID NO: 275702 - protein, 9 aa, Homo Sapiens
HEHVIGLLD

SEQ ID NO: 275703 - protein, 9 aa, Homo Sapiens
RVFTCTHVY

SEQ ID NO: 275704 - protein, 9 aa, Homo Sapiens
LIDEQDTPL

SEQ ID NO: 275705 - protein, 9 aa, Homo Sapiens
NKEVFARLS

SEQ ID NO: 275706 - protein, 9 aa, Homo Sapiens
IYSCKVFIG

SEQ ID NO: 275707 - protein, 9 aa, Homo Sapiens
VSATFINSS

SEQ ID NO: 275708 - protein, 9 aa, Homo Sapiens
HQSVEGEFS

SEQ ID NO: 275709 - protein, 9 aa, Homo Sapiens
KGEHHRGIG

SEQ ID NO: 275710 - protein, 9 aa, Homo Sapiens
LIRQHQELI

SEQ ID NO: 275711 - protein, 9 aa, Homo Sapiens
KTNSSHYGD

SEQ ID NO: 275712 - protein, 9 aa, Homo Sapiens
AMLVEKDKD

SEQ ID NO: 275713 - protein, 9 aa, Homo Sapiens
IYLYRFLPN

SEQ ID NO: 275714 - protein, 9 aa, Homo Sapiens
SVIKTQETE

SEQ ID NO: 275715 - protein, 9 aa, Homo Sapiens
LTRNTNILP

SEQ ID NO: 275716 - protein, 9 aa, Homo Sapiens
IRLSHPNII

SEQ ID NO: 275717 - protein, 9 aa, Homo Sapiens
AWQGLEGSL

SEQ ID NO: 275718 - protein, 9 aa, Homo Sapiens
LHCAAQNGD

SEQ ID NO: 275719 - protein, 9 aa, Homo Sapiens
LSDLWEIEE

SEQ ID NO: 275720 - protein, 9 aa, Homo Sapiens
LLLEFPAEL

SEQ ID NO: 275721 - protein, 9 aa, Homo Sapiens
NFPLRGMHP

SEQ ID NO: 275722 - protein, 9 aa, Homo Sapiens
EGHSKCVGI

SEQ ID NO: 275723 - protein, 9 aa, Homo Sapiens
KCEEFNQST

SEQ ID NO: 275724 - protein, 9 aa, Homo Sapiens
VVWFKYSVG

SEQ ID NO: 275725 - protein, 9 aa, Homo Sapiens
QGNFPLRGM

SEQ ID NO: 275726 - protein, 9 aa, Homo Sapiens
QLGRNGVEE

SEQ ID NO: 275727 - protein, 9 aa, Homo Sapiens
SPCTTVPKI

SEQ ID NO: 275728 - protein, 9 aa, Homo Sapiens
WDNFHYWAS

SEQ ID NO: 275729 - protein, 9 aa, Homo Sapiens
HLHAPWDLG

SEQ ID NO: 275730 - protein, 9 aa, Homo Sapiens
ERLFALFDS

SEQ ID NO: 275731 - protein, 9 aa, Homo Sapiens
QKNKNKLPK

SEQ ID NO: 275732 - protein, 9 aa, Homo Sapiens
LNLGRHTLD

SEQ ID NO: 275733 - protein, 9 aa, Homo Sapiens
VYFWQAVVI

SEQ ID NO: 275734 - protein, 9 aa, Homo Sapiens
FLNKNIFLQ

SEQ ID NO: 275735 - protein, 9 aa, Homo Sapiens
RYPEKKIKR

SEQ ID NO: 275736 - protein, 9 aa, Homo Sapiens
AVSDALMTI

SEQ ID NO: 275737 - protein, 9 aa, Homo Sapiens
FSCDGKALE

SEQ ID NO: 275738 - protein, 9 aa, Homo Sapiens
KSMSPQELA

SEQ ID NO: 275739 - protein, 9 aa, Homo Sapiens
LSGSRTAGG

SEQ ID NO: 275740 - protein, 9 aa, Homo Sapiens
CLVTVDGGG

SEQ ID NO: 275741 - protein, 9 aa, Homo Sapiens
QIVIHRGST

SEQ ID NO: 275742 - protein, 9 aa, Homo Sapiens
SSTQDFFDE

SEQ ID NO: 275743 - protein, 9 aa, Homo Sapiens
GGTTSVSSE

SEQ ID NO: 275744 - protein, 9 aa, Homo Sapiens
DEEAAETKF

SEQ ID NO: 275745 - protein, 9 aa, Homo Sapiens
CLSCKPRLS

SEQ ID NO: 275746 - protein, 9 aa, Homo Sapiens
LQIVRFLDN

SEQ ID NO: 275747 - protein, 9 aa, Homo Sapiens
PVYEDFYFS

SEQ ID NO: 275748 - protein, 9 aa, Homo Sapiens
ITFKHIHEI

SEQ ID NO: 275749 - protein, 9 aa, Homo Sapiens
EFGYPGETE

SEQ ID NO: 275750 - protein, 9 aa, Homo Sapiens
QGKNTEVQK

SEQ ID NO: 275751 - protein, 9 aa, Homo Sapiens
IALAINSGG

SEQ ID NO: 275752 - protein, 9 aa, Homo Sapiens
KIAETDLEK

SEQ ID NO: 275753 - protein, 9 aa, Homo Sapiens
KGILIIHFL

SEQ ID NO: 275754 - protein, 9 aa, Homo Sapiens
AEEREQLVK

SEQ ID NO: 275755 - protein, 9 aa, Homo Sapiens
ISGTATSSL

SEQ ID NO: 275756 - protein, 9 aa, Homo Sapiens
GNPCTLVKM

SEQ ID NO: 275757 - protein, 9 aa, Homo Sapiens
SAWNNGKIR

SEQ ID NO: 275758 - protein, 9 aa, Homo Sapiens
AEYKILAVF

SEQ ID NO: 275759 - protein, 9 aa, Homo Sapiens
NLDNYPMVE

SEQ ID NO: 275760 - protein, 9 aa, Homo Sapiens
RVLGKILLS

SEQ ID NO: 275761 - protein, 9 aa, Homo Sapiens
IIHQDETWI

SEQ ID NO: 275762 - protein, 9 aa, Homo Sapiens
IRKQGIQKG

SEQ ID NO: 275763 - protein, 9 aa, Homo Sapiens
RLYVGRDKK

SEQ ID NO: 275764 - protein, 9 aa, Homo Sapiens
CTLGINLVV

SEQ ID NO: 275765 - protein, 9 aa, Homo Sapiens
GKLWNDILR

SEQ ID NO: 275766 - protein, 9 aa, Homo Sapiens
PMAEDSDGA

SEQ ID NO: 275767 - protein, 9 aa, Homo Sapiens
NCWYDKSLQ

SEQ ID NO: 275768 - protein, 9 aa, Homo Sapiens
CTDKSNVYR

SEQ ID NO: 275769 - protein, 9 aa, Homo Sapiens
KDGSNETID

SEQ ID NO: 275770 - protein, 9 aa, Homo Sapiens
SPQCTSLAW

SEQ ID NO: 275771 - protein, 9 aa, Homo Sapiens
QSLLETHNS

SEQ ID NO: 275772 - protein, 9 aa, Homo Sapiens
TVDKNGRLY

SEQ ID NO: 275773 - protein, 9 aa, Homo Sapiens
EELRQIVKQ

SEQ ID NO: 275774 - protein, 9 aa, Homo Sapiens
NTGNMVISK

SEQ ID NO: 275775 - protein, 9 aa, Homo Sapiens
VVVVAFCAG

SEQ ID NO: 275776 - protein, 9 aa, Homo Sapiens
HIPVTNAST

SEQ ID NO: 275777 - protein, 9 aa, Homo Sapiens
DLLEEKVHI

SEQ ID NO: 275778 - protein, 9 aa, Homo Sapiens
SLLGHPDNS

SEQ ID NO: 275779 - protein, 9 aa, Homo Sapiens
IDHLNKAEE

SEQ ID NO: 275780 - protein, 9 aa, Homo Sapiens
IDKNLIAYF

SEQ ID NO: 275781 - protein, 9 aa, Homo Sapiens
LLVMLQSHS

SEQ ID NO: 275782 - protein, 9 aa, Homo Sapiens
SPHNERENF

SEQ ID NO: 275783 - protein, 9 aa, Homo Sapiens
TVEDETLQG

SEQ ID NO: 275784 - protein, 9 aa, Homo Sapiens
EDTTSMNGK

SEQ ID NO: 275785 - protein, 9 aa, Homo Sapiens
SIVNPMDMQ

SEQ ID NO: 275786 - protein, 9 aa, Homo Sapiens
PHLQAPMYF

SEQ ID NO: 275787 - protein, 9 aa, Homo Sapiens
TEGEYNRAS

SEQ ID NO: 275788 - protein, 9 aa, Homo Sapiens
VIGGTDKGR

SEQ ID NO: 275789 - protein, 9 aa, Homo Sapiens
DRGDVALKN

SEQ ID NO: 275790 - protein, 9 aa, Homo Sapiens
EDSNDSSSE

SEQ ID NO: 275791 - protein, 9 aa, Homo Sapiens
TQHKIIHIR

SEQ ID NO: 275792 - protein, 9 aa, Homo Sapiens
SDFLTDTQL

SEQ ID NO: 275793 - protein, 9 aa, Homo Sapiens
FSEPVTTPC

SEQ ID NO: 275794 - protein, 9 aa, Homo Sapiens
EIPHTGKKR

SEQ ID NO: 275795 - protein, 9 aa, Homo Sapiens
FQSLTKRNA

SEQ ID NO: 275796 - protein, 9 aa, Homo Sapiens
WLEILLTSG

SEQ ID NO: 275797 - protein, 9 aa, Homo Sapiens
KFYRKFCPP

SEQ ID NO: 275798 - protein, 9 aa, Homo Sapiens
RIELTVLDK

SEQ ID NO: 275799 - protein, 9 aa, Homo Sapiens
CSHFSFRAG

SEQ ID NO: 275800 - protein, 9 aa, Homo Sapiens
LNILNMVFN

SEQ ID NO: 275801 - protein, 9 aa, Homo Sapiens
LYVLKVFGK

SEQ ID NO: 275802 - protein, 9 aa, Homo Sapiens
SQILRIKTS

SEQ ID NO: 275803 - protein, 9 aa, Homo Sapiens
TFGNTALLN

SEQ ID NO: 275804 - protein, 9 aa, Homo Sapiens
VICYFGKGA

SEQ ID NO: 275805 - protein, 9 aa, Homo Sapiens
DWLFSFLLV

SEQ ID NO: 275806 - protein, 9 aa, Homo Sapiens
IDNQTRTTK

SEQ ID NO: 275807 - protein, 9 aa, Homo Sapiens
LAVQMDKPQ

SEQ ID NO: 275808 - protein, 9 aa, Homo Sapiens
LLSQMAAAG

SEQ ID NO: 275809 - protein, 9 aa, Homo Sapiens
LENQFKKMK

SEQ ID NO: 275810 - protein, 9 aa, Homo Sapiens
TSGLGFAIY

SEQ ID NO: 275811 - protein, 9 aa, Homo Sapiens
YHMDDGSPI

SEQ ID NO: 275812 - protein, 9 aa, Homo Sapiens
FSTNLQKGV

SEQ ID NO: 275813 - protein, 9 aa, Homo Sapiens
YTALTSVQL

SEQ ID NO: 275814 - protein, 9 aa, Homo Sapiens
RDRPADSRD

SEQ ID NO: 275815 - protein, 9 aa, Homo Sapiens
NLDPIQNNL

SEQ ID NO: 275816 - protein, 9 aa, Homo Sapiens
PCFSPCGWT

SEQ ID NO: 275817 - protein, 9 aa, Homo Sapiens
CGKNLNHNS

SEQ ID NO: 275818 - protein, 9 aa, Homo Sapiens
VPCILIYLR

SEQ ID NO: 275819 - protein, 9 aa, Homo Sapiens
AMKYHVLPE

SEQ ID NO: 275820 - protein, 9 aa, Homo Sapiens
QANVERKYV

SEQ ID NO: 275821 - protein, 9 aa, Homo Sapiens
WFYHEDVTM

SEQ ID NO: 275822 - protein, 9 aa, Homo Sapiens
IWRNKTEDL

SEQ ID NO: 275823 - protein, 9 aa, Homo Sapiens
WVNFLRKPG

SEQ ID NO: 275824 - protein, 9 aa, Homo Sapiens
KNAVVKRMQ

SEQ ID NO: 275825 - protein, 9 aa, Homo Sapiens
GVRSLVRRH

SEQ ID NO: 275826 - protein, 9 aa, Homo Sapiens
SDSPTEKQW

SEQ ID NO: 275827 - protein, 9 aa, Homo Sapiens
KFFVPSWRK

SEQ ID NO: 275828 - protein, 9 aa, Homo Sapiens
LEPTLKSFG

SEQ ID NO: 275829 - protein, 9 aa, Homo Sapiens
TNLTAHKII

SEQ ID NO: 275830 - protein, 9 aa, Homo Sapiens
DIHEREGYE

SEQ ID NO: 275831 - protein, 9 aa, Homo Sapiens
PNLFKMIKF

SEQ ID NO: 275832 - protein, 9 aa, Homo Sapiens
QVQLTLFLH

SEQ ID NO: 275833 - protein, 9 aa, Homo Sapiens
SVEVMHTTD

SEQ ID NO: 275834 - protein, 9 aa, Homo Sapiens
VKLSWQEPE

SEQ ID NO: 275835 - protein, 9 aa, Homo Sapiens
CNECGQSFS

SEQ ID NO: 275836 - protein, 9 aa, Homo Sapiens
SDCERMNEE

SEQ ID NO: 275837 - protein, 9 aa, Homo Sapiens
NLDMYGECT

SEQ ID NO: 275838 - protein, 9 aa, Homo Sapiens
FVSRYDGAL

SEQ ID NO: 275839 - protein, 9 aa, Homo Sapiens
YSSCFPRYR

SEQ ID NO: 275840 - protein, 9 aa, Homo Sapiens
YQLLKATKL

SEQ ID NO: 275841 - protein, 9 aa, Homo Sapiens
AMNGFQSGM

SEQ ID NO: 275842 - protein, 9 aa, Homo Sapiens
KIRLFIGGK

SEQ ID NO: 275843 - protein, 9 aa, Homo Sapiens
LTDEELKTE

SEQ ID NO: 275844 - protein, 9 aa, Homo Sapiens
RKENKIIDR

SEQ ID NO: 275845 - protein, 9 aa, Homo Sapiens
SRQYLKRVF

SEQ ID NO: 275846 - protein, 9 aa, Homo Sapiens
AIAAIVIGT

SEQ ID NO: 275847 - protein, 9 aa, Homo Sapiens
QNLFNIKKF

SEQ ID NO: 275848 - protein, 9 aa, Homo Sapiens
FVHPTGSSQ

SEQ ID NO: 275849 - protein, 9 aa, Homo Sapiens
KKIYSSMMD

SEQ ID NO: 275850 - protein, 9 aa, Homo Sapiens
APLARNQLI

SEQ ID NO: 275851 - protein, 9 aa, Homo Sapiens
ELKKVSEAS

SEQ ID NO: 275852 - protein, 9 aa, Homo Sapiens
VYVVGKANS

SEQ ID NO: 275853 - protein, 9 aa, Homo Sapiens
VESIMRDTM

SEQ ID NO: 275854 - protein, 9 aa, Homo Sapiens
RAQKKRLNI

SEQ ID NO: 275855 - protein, 9 aa, Homo Sapiens
SQKHCASHY

SEQ ID NO: 275856 - protein, 9 aa, Homo Sapiens
NKQLLYDEI

SEQ ID NO: 275857 - protein, 9 aa, Homo Sapiens
CSEIDTVGM

SEQ ID NO: 275858 - protein, 9 aa, Homo Sapiens
VADGLQADA

SEQ ID NO: 275859 - protein, 9 aa, Homo Sapiens
ITNGAYTSL

SEQ ID NO: 275860 - protein, 9 aa, Homo Sapiens
MDMSVILEQ

SEQ ID NO: 275861 - protein, 9 aa, Homo Sapiens
IGVKPFKCS

SEQ ID NO: 275862 - protein, 9 aa, Homo Sapiens
TENSTGRNN

SEQ ID NO: 275863 - protein, 9 aa, Homo Sapiens
LTLGDMIRK

SEQ ID NO: 275864 - protein, 9 aa, Homo Sapiens
VYEHRSRLD

SEQ ID NO: 275865 - protein, 9 aa, Homo Sapiens
NSAEKQAKN

SEQ ID NO: 275866 - protein, 9 aa, Homo Sapiens
EKLFSSEKI

SEQ ID NO: 275867 - protein, 9 aa, Homo Sapiens
VCYSVFFNK

SEQ ID NO: 275868 - protein, 9 aa, Homo Sapiens
APMYFFLSF

SEQ ID NO: 275869 - protein, 9 aa, Homo Sapiens
EQNFQTILC

SEQ ID NO: 275870 - protein, 9 aa, Homo Sapiens
LCLVANFLR

SEQ ID NO: 275871 - protein, 9 aa, Homo Sapiens
SDNVNKLLV

SEQ ID NO: 275872 - protein, 9 aa, Homo Sapiens
TIGYNQRNI

SEQ ID NO: 275873 - protein, 9 aa, Homo Sapiens
MRGDGMAFA

SEQ ID NO: 275874 - protein, 9 aa, Homo Sapiens
YDVINTFEN

SEQ ID NO: 275875 - protein, 9 aa, Homo Sapiens
IASHPPLAE

SEQ ID NO: 275876 - protein, 9 aa, Homo Sapiens
RVYPDSIQD

SEQ ID NO: 275877 - protein, 9 aa, Homo Sapiens
NMLGDFLQQ

SEQ ID NO: 275878 - protein, 9 aa, Homo Sapiens
ECIFVIPSI

SEQ ID NO: 275879 - protein, 9 aa, Homo Sapiens
HNEKKRNNL

SEQ ID NO: 275880 - protein, 9 aa, Homo Sapiens
AGHCRIKVS

SEQ ID NO: 275881 - protein, 9 aa, Homo Sapiens
DKFQWLGGL

SEQ ID NO: 275882 - protein, 9 aa, Homo Sapiens
VIGQRMPQY

SEQ ID NO: 275883 - protein, 9 aa, Homo Sapiens
NITKHLLKW

SEQ ID NO: 275884 - protein, 9 aa, Homo Sapiens
RRTALRPGS

SEQ ID NO: 275885 - protein, 9 aa, Homo Sapiens
YLTLISCPG

SEQ ID NO: 275886 - protein, 9 aa, Homo Sapiens
NIQSQQENT

SEQ ID NO: 275887 - protein, 9 aa, Homo Sapiens
YPKTKAFIT

SEQ ID NO: 275888 - protein, 9 aa, Homo Sapiens
EDYEQAAKN

SEQ ID NO: 275889 - protein, 9 aa, Homo Sapiens
LFLHPHCKI

SEQ ID NO: 275890 - protein, 9 aa, Homo Sapiens
DIYLTPNTD

SEQ ID NO: 275891 - protein, 9 aa, Homo Sapiens
DDVRLMLWD

SEQ ID NO: 275892 - protein, 9 aa, Homo Sapiens
RSLKHLVDG

SEQ ID NO: 275893 - protein, 9 aa, Homo Sapiens
NYVNHEFAY

SEQ ID NO: 275894 - protein, 9 aa, Homo Sapiens
TAVDGRHNG

SEQ ID NO: 275895 - protein, 9 aa, Homo Sapiens
ISKQLYFLF

SEQ ID NO: 275896 - protein, 9 aa, Homo Sapiens
PKLQRQYCS

SEQ ID NO: 275897 - protein, 9 aa, Homo Sapiens
YRVKMHFKV

SEQ ID NO: 275898 - protein, 9 aa, Homo Sapiens
DDWSQGAII

SEQ ID NO: 275899 - protein, 9 aa, Homo Sapiens
FLGGVDKIT

SEQ ID NO: 275900 - protein, 9 aa, Homo Sapiens
EVQVTNGGI

SEQ ID NO: 275901 - protein, 9 aa, Homo Sapiens
KLKNVLPKQ

SEQ ID NO: 275902 - protein, 9 aa, Homo Sapiens
IINLFKGLS

SEQ ID NO: 275903 - protein, 9 aa, Homo Sapiens
VQWNQIFSK

SEQ ID NO: 275904 - protein, 9 aa, Homo Sapiens
IMDILNIKM

SEQ ID NO: 275905 - protein, 9 aa, Homo Sapiens
NMAGEPRPY

SEQ ID NO: 275906 - protein, 9 aa, Homo Sapiens
CRLNWSDSD

SEQ ID NO: 275907 - protein, 9 aa, Homo Sapiens
RHNSALVIN

SEQ ID NO: 275908 - protein, 9 aa, Homo Sapiens
GATATYEGR

SEQ ID NO: 275909 - protein, 9 aa, Homo Sapiens
KTTIPFSEC

SEQ ID NO: 275910 - protein, 9 aa, Homo Sapiens
NPIKDFQGC

SEQ ID NO: 275911 - protein, 9 aa, Homo Sapiens
LQQQLSVNQ

SEQ ID NO: 275912 - protein, 9 aa, Homo Sapiens
DYGAEKENT

SEQ ID NO: 275913 - protein, 9 aa, Homo Sapiens
EDENIIGVV

SEQ ID NO: 275914 - protein, 9 aa, Homo Sapiens
YKSKRYEDL

SEQ ID NO: 275915 - protein, 9 aa, Homo Sapiens
HTIWGSVMF

SEQ ID NO: 275916 - protein, 9 aa, Homo Sapiens
LELSAFLEQ

SEQ ID NO: 275917 - protein, 9 aa, Homo Sapiens
GWSVVTQSL

SEQ ID NO: 275918 - protein, 9 aa, Homo Sapiens
TKNKGVHSS

SEQ ID NO: 275919 - protein, 9 aa, Homo Sapiens
PLSGRKLQN

SEQ ID NO: 275920 - protein, 9 aa, Homo Sapiens
QWDVLDGLL

SEQ ID NO: 275921 - protein, 9 aa, Homo Sapiens
SALVINKAI

SEQ ID NO: 275922 - protein, 9 aa, Homo Sapiens
FIDKVRLLE

SEQ ID NO: 275923 - protein, 9 aa, Homo Sapiens
DDLSTTQST

SEQ ID NO: 275924 - protein, 9 aa, Homo Sapiens
NSQKSCEQN

SEQ ID NO: 275925 - protein, 9 aa, Homo Sapiens
TYRNVKFNV

SEQ ID NO: 275926 - protein, 9 aa, Homo Sapiens
FQSPVPCIN

SEQ ID NO: 275927 - protein, 9 aa, Homo Sapiens
QSIDLLTNL

SEQ ID NO: 275928 - protein, 9 aa, Homo Sapiens
DLWDILNEQ

SEQ ID NO: 275929 - protein, 9 aa, Homo Sapiens
MVSIRGFTM

SEQ ID NO: 275930 - protein, 9 aa, Homo Sapiens
QKHSYEQKA

SEQ ID NO: 275931 - protein, 9 aa, Homo Sapiens
FLDAAEHGN

SEQ ID NO: 275932 - protein, 9 aa, Homo Sapiens
LCRHVHRNI

SEQ ID NO: 275933 - protein, 9 aa, Homo Sapiens
ALEGLIAVV

SEQ ID NO: 275934 - protein, 9 aa, Homo Sapiens
LTRATYALC

SEQ ID NO: 275935 - protein, 9 aa, Homo Sapiens
AEARRSAAN

SEQ ID NO: 275936 - protein, 9 aa, Homo Sapiens
DTRRHFCPP

SEQ ID NO: 275937 - protein, 9 aa, Homo Sapiens
LNKKSLRSR

SEQ ID NO: 275938 - protein, 9 aa, Homo Sapiens
CLQTVECYN

SEQ ID NO: 275939 - protein, 9 aa, Homo Sapiens
VNGFGRSGR

SEQ ID NO: 275940 - protein, 9 aa, Homo Sapiens
VKLSENRAQ

SEQ ID NO: 275941 - protein, 9 aa, Homo Sapiens
LREMEDIAH

SEQ ID NO: 275942 - protein, 9 aa, Homo Sapiens
WIQMTHGKN

SEQ ID NO: 275943 - protein, 9 aa, Homo Sapiens
IVIQVKRLE

SEQ ID NO: 275944 - protein, 9 aa, Homo Sapiens
GLSITQLID

SEQ ID NO: 275945 - protein, 9 aa, Homo Sapiens
AMPYTVSIY

SEQ ID NO: 275946 - protein, 9 aa, Homo Sapiens
TEVLLSADL

SEQ ID NO: 275947 - protein, 9 aa, Homo Sapiens
TNMKTVSLS

SEQ ID NO: 275948 - protein, 9 aa, Homo Sapiens
WLRLAVSLV

SEQ ID NO: 275949 - protein, 9 aa, Homo Sapiens
LGQFVVRRL

SEQ ID NO: 275950 - protein, 9 aa, Homo Sapiens
KMSHFLKME

SEQ ID NO: 275951 - protein, 9 aa, Homo Sapiens
DHCEHLKKV

SEQ ID NO: 275952 - protein, 9 aa, Homo Sapiens
NSKDGETSL

SEQ ID NO: 275953 - protein, 9 aa, Homo Sapiens
KKHKCGDCE

SEQ ID NO: 275954 - protein, 9 aa, Homo Sapiens
SEITKNIDV

SEQ ID NO: 275955 - protein, 9 aa, Homo Sapiens
MSAPVSLAA

SEQ ID NO: 275956 - protein, 9 aa, Homo Sapiens
YRFVIPSKA

SEQ ID NO: 275957 - protein, 9 aa, Homo Sapiens
VTVPSTTCH

SEQ ID NO: 275958 - protein, 9 aa, Homo Sapiens
IFVFGIVVG

SEQ ID NO: 275959 - protein, 9 aa, Homo Sapiens
ETLHNITGN

SEQ ID NO: 275960 - protein, 9 aa, Homo Sapiens
ISFIPTYAS

SEQ ID NO: 275961 - protein, 9 aa, Homo Sapiens
NYSSEWELN

SEQ ID NO: 275962 - protein, 9 aa, Homo Sapiens
LVDQKPELN

SEQ ID NO: 275963 - protein, 9 aa, Homo Sapiens
YKNASFQVE

SEQ ID NO: 275964 - protein, 9 aa, Homo Sapiens
LLNKAESGE

SEQ ID NO: 275965 - protein, 9 aa, Homo Sapiens
YFWLDGSTP

SEQ ID NO: 275966 - protein, 9 aa, Homo Sapiens
IEGHECAVW

SEQ ID NO: 275967 - protein, 9 aa, Homo Sapiens
ESAEYSSNW

SEQ ID NO: 275968 - protein, 9 aa, Homo Sapiens
VRYMLEQRD

SEQ ID NO: 275969 - protein, 9 aa, Homo Sapiens
KTYSLLQAL

SEQ ID NO: 275970 - protein, 9 aa, Homo Sapiens
VINSECSQS

SEQ ID NO: 275971 - protein, 9 aa, Homo Sapiens
ILDASEVEK

SEQ ID NO: 275972 - protein, 9 aa, Homo Sapiens
MKHLRPQFL

SEQ ID NO: 275973 - protein, 9 aa, Homo Sapiens
LIHHCAKCE

SEQ ID NO: 275974 - protein, 9 aa, Homo Sapiens
IRLHGIDLR

SEQ ID NO: 275975 - protein, 9 aa, Homo Sapiens
CTIDGLLML

SEQ ID NO: 275976 - protein, 9 aa, Homo Sapiens
FNPIETFIL

SEQ ID NO: 275977 - protein, 9 aa, Homo Sapiens
TINVYSGIF

SEQ ID NO: 275978 - protein, 9 aa, Homo Sapiens
RHWGFHSAE

SEQ ID NO: 275979 - protein, 9 aa, Homo Sapiens
NRFQLGTCR

SEQ ID NO: 275980 - protein, 9 aa, Homo Sapiens
TSLLEENET

SEQ ID NO: 275981 - protein, 9 aa, Homo Sapiens
KVSEASDVV

SEQ ID NO: 275982 - protein, 9 aa, Homo Sapiens
GRSDNEMCK

SEQ ID NO: 275983 - protein, 9 aa, Homo Sapiens
SAACVAGPE

SEQ ID NO: 275984 - protein, 9 aa, Homo Sapiens
GVTVLSENK

SEQ ID NO: 275985 - protein, 9 aa, Homo Sapiens
DYDKVKLLE

SEQ ID NO: 275986 - protein, 9 aa, Homo Sapiens
LAKQLEGST

SEQ ID NO: 275987 - protein, 9 aa, Homo Sapiens
QRRTQRYFM

SEQ ID NO: 275988 - protein, 9 aa, Homo Sapiens
YRTHTGEKH

SEQ ID NO: 275989 - protein, 9 aa, Homo Sapiens
DGVDEVVKK

SEQ ID NO: 275990 - protein, 9 aa, Homo Sapiens
KIIFVITHR

SEQ ID NO: 275991 - protein, 9 aa, Homo Sapiens
YPKRNDLRQ

SEQ ID NO: 275992 - protein, 9 aa, Homo Sapiens
NHEFAYTTF

SEQ ID NO: 275993 - protein, 9 aa, Homo Sapiens
FNQSSDLTK

SEQ ID NO: 275994 - protein, 9 aa, Homo Sapiens
WTIKLKEDN

SEQ ID NO: 275995 - protein, 9 aa, Homo Sapiens
KQLHILIND

SEQ ID NO: 275996 - protein, 9 aa, Homo Sapiens
KHKCGDCEK

SEQ ID NO: 275997 - protein, 9 aa, Homo Sapiens
KKQELSNPL

SEQ ID NO: 275998 - protein, 9 aa, Homo Sapiens
ELGSKDLKG

SEQ ID NO: 275999 - protein, 9 aa, Homo Sapiens
VDAYVMVIQ

SEQ ID NO: 276000 - protein, 9 aa, Homo Sapiens
ETVYLEWNP

SEQ ID NO: 276001 - protein, 9 aa, Homo Sapiens
DGRWTKSQT

SEQ ID NO: 276002 - protein, 9 aa, Homo Sapiens
LLKNQECKG

SEQ ID NO: 276003 - protein, 9 aa, Homo Sapiens
LGVELEPVT

SEQ ID NO: 276004 - protein, 9 aa, Homo Sapiens
VPPGPPGPP

SEQ ID NO: 276005 - protein, 9 aa, Homo Sapiens
QIWKLRREL

SEQ ID NO: 276006 - protein, 9 aa, Homo Sapiens
AVGQLTPTG

SEQ ID NO: 276007 - protein, 9 aa, Homo Sapiens
PTDIKTEFI

SEQ ID NO: 276008 - protein, 9 aa, Homo Sapiens
KLNSVNPTM

SEQ ID NO: 276009 - protein, 9 aa, Homo Sapiens
FQTEVSYLE

SEQ ID NO: 276010 - protein, 9 aa, Homo Sapiens
YAPQPYKCQ

SEQ ID NO: 276011 - protein, 9 aa, Homo Sapiens
LEVAMQCLE

SEQ ID NO: 276012 - protein, 9 aa, Homo Sapiens
PFTTPALIS

SEQ ID NO: 276013 - protein, 9 aa, Homo Sapiens
DQKEEGRRK

SEQ ID NO: 276014 - protein, 9 aa, Homo Sapiens
LIYPSLNLE

SEQ ID NO: 276015 - protein, 9 aa, Homo Sapiens
WSVGVFLYK

SEQ ID NO: 276016 - protein, 9 aa, Homo Sapiens
IFVITHRLL

SEQ ID NO: 276017 - protein, 9 aa, Homo Sapiens
YQVDGNQEF

SEQ ID NO: 276018 - protein, 9 aa, Homo Sapiens
ERGRDTHVY

SEQ ID NO: 276019 - protein, 9 aa, Homo Sapiens
ERLNAFIAG

SEQ ID NO: 276020 - protein, 9 aa, Homo Sapiens
EHIANRAME

SEQ ID NO: 276021 - protein, 9 aa, Homo Sapiens
DSYSSPSRG

SEQ ID NO: 276022 - protein, 9 aa, Homo Sapiens
AALGFKNVS

SEQ ID NO: 276023 - protein, 9 aa, Homo Sapiens
ILHVMCTDA

SEQ ID NO: 276024 - protein, 9 aa, Homo Sapiens
ILLVGDPGT

SEQ ID NO: 276025 - protein, 9 aa, Homo Sapiens
ATYKDYSAF

SEQ ID NO: 276026 - protein, 9 aa, Homo Sapiens
IFITGTFLV

SEQ ID NO: 276027 - protein, 9 aa, Homo Sapiens
SACCQPTCC

SEQ ID NO: 276028 - protein, 9 aa, Homo Sapiens
AEMVVPDLS

SEQ ID NO: 276029 - protein, 9 aa, Homo Sapiens
STGSLGMQG

SEQ ID NO: 276030 - protein, 9 aa, Homo Sapiens
KCQDWYYKA

SEQ ID NO: 276031 - protein, 9 aa, Homo Sapiens
QQLWLQYQE

SEQ ID NO: 276032 - protein, 9 aa, Homo Sapiens
HIVYQLCAA

SEQ ID NO: 276033 - protein, 9 aa, Homo Sapiens
YEGKSTPKT

SEQ ID NO: 276034 - protein, 9 aa, Homo Sapiens
LSEHIVLRE

SEQ ID NO: 276035 - protein, 9 aa, Homo Sapiens
MQIINLFKG

SEQ ID NO: 276036 - protein, 9 aa, Homo Sapiens
GVDVFYLSV

SEQ ID NO: 276037 - protein, 9 aa, Homo Sapiens
PKLFEKYLR

SEQ ID NO: 276038 - protein, 9 aa, Homo Sapiens
PKKIPSLCY

SEQ ID NO: 276039 - protein, 9 aa, Homo Sapiens
QLETQLRLV

SEQ ID NO: 276040 - protein, 9 aa, Homo Sapiens
KSLVSQLDC

SEQ ID NO: 276041 - protein, 9 aa, Homo Sapiens
PEDYLGIVS

SEQ ID NO: 276042 - protein, 9 aa, Homo Sapiens
NTVVRYPIK

SEQ ID NO: 276043 - protein, 9 aa, Homo Sapiens
QRRDNTLYY

SEQ ID NO: 276044 - protein, 9 aa, Homo Sapiens
WACLTINQL

SEQ ID NO: 276045 - protein, 9 aa, Homo Sapiens
TKLPLKFSD

SEQ ID NO: 276046 - protein, 9 aa, Homo Sapiens
GLTCTIVFL

SEQ ID NO: 276047 - protein, 9 aa, Homo Sapiens
TVADNIINA

SEQ ID NO: 276048 - protein, 9 aa, Homo Sapiens
VPQIPLEET

SEQ ID NO: 276049 - protein, 9 aa, Homo Sapiens
GIYCAVHFT

SEQ ID NO: 276050 - protein, 9 aa, Homo Sapiens
ALFGLTEFQ

SEQ ID NO: 276051 - protein, 9 aa, Homo Sapiens
ADIEDLKAK

SEQ ID NO: 276052 - protein, 9 aa, Homo Sapiens
FTITVFEDS

SEQ ID NO: 276053 - protein, 9 aa, Homo Sapiens
LIDSLKTTQ

SEQ ID NO: 276054 - protein, 9 aa, Homo Sapiens
FDRGDVALK

SEQ ID NO: 276055 - protein, 9 aa, Homo Sapiens
ANAIQRSLE

SEQ ID NO: 276056 - protein, 9 aa, Homo Sapiens
HSHLEEGIR

SEQ ID NO: 276057 - protein, 9 aa, Homo Sapiens
YHKKCSTQD

SEQ ID NO: 276058 - protein, 9 aa, Homo Sapiens
RLLSGSVPL

SEQ ID NO: 276059 - protein, 9 aa, Homo Sapiens
SAGIWMINN

SEQ ID NO: 276060 - protein, 9 aa, Homo Sapiens
KVLCRIHYN

SEQ ID NO: 276061 - protein, 9 aa, Homo Sapiens
MGQRRSKGT

SEQ ID NO: 276062 - protein, 9 aa, Homo Sapiens
LATVGGQVI

SEQ ID NO: 276063 - protein, 9 aa, Homo Sapiens
KSNPTKHQR

SEQ ID NO: 276064 - protein, 9 aa, Homo Sapiens
GNNHKENVA

SEQ ID NO: 276065 - protein, 9 aa, Homo Sapiens
GIFILTVSR

SEQ ID NO: 276066 - protein, 9 aa, Homo Sapiens
KSEFGEYNF

SEQ ID NO: 276067 - protein, 9 aa, Homo Sapiens
EIYTSNRMW

SEQ ID NO: 276068 - protein, 9 aa, Homo Sapiens
AALPNLTPL

SEQ ID NO: 276069 - protein, 9 aa, Homo Sapiens
ASSISTVEP

SEQ ID NO: 276070 - protein, 9 aa, Homo Sapiens
RDPAVDRPL

SEQ ID NO: 276071 - protein, 9 aa, Homo Sapiens
EFMLMNAQL

SEQ ID NO: 276072 - protein, 9 aa, Homo Sapiens
ALCGAWAGH

SEQ ID NO: 276073 - protein, 9 aa, Homo Sapiens
IPVVSAVGG

SEQ ID NO: 276074 - protein, 9 aa, Homo Sapiens
CDMECKGKR

SEQ ID NO: 276075 - protein, 9 aa, Homo Sapiens
QDARWLGGQ

SEQ ID NO: 276076 - protein, 9 aa, Homo Sapiens
PGDKLWDHN

SEQ ID NO: 276077 - protein, 9 aa, Homo Sapiens
SSASMCMPP

SEQ ID NO: 276078 - protein, 9 aa, Homo Sapiens
GQQQSDYGP

SEQ ID NO: 276079 - protein, 9 aa, Homo Sapiens
RCVEMKQNF

SEQ ID NO: 276080 - protein, 9 aa, Homo Sapiens
LDFGFSNAC

SEQ ID NO: 276081 - protein, 9 aa, Homo Sapiens
WVAIPLDYE

SEQ ID NO: 276082 - protein, 9 aa, Homo Sapiens
GALWTVAQA

SEQ ID NO: 276083 - protein, 9 aa, Homo Sapiens
RERVHTGDK

SEQ ID NO: 276084 - protein, 9 aa, Homo Sapiens
PGRVYDGKM

SEQ ID NO: 276085 - protein, 9 aa, Homo Sapiens
VHKKWKCPG

SEQ ID NO: 276086 - protein, 9 aa, Homo Sapiens
TSVNSVLCH

SEQ ID NO: 276087 - protein, 9 aa, Homo Sapiens
EFRNAIFPN

SEQ ID NO: 276088 - protein, 9 aa, Homo Sapiens
DDRYKMEDG

SEQ ID NO: 276089 - protein, 9 aa, Homo Sapiens
AAYNVPLPN

SEQ ID NO: 276090 - protein, 9 aa, Homo Sapiens
LNDLIMEGV

SEQ ID NO: 276091 - protein, 9 aa, Homo Sapiens
GEFSHSPAI

SEQ ID NO: 276092 - protein, 9 aa, Homo Sapiens
EARSKCRQI

SEQ ID NO: 276093 - protein, 9 aa, Homo Sapiens
LVMLQSHSR

SEQ ID NO: 276094 - protein, 9 aa, Homo Sapiens
LASSSEDSI

SEQ ID NO: 276095 - protein, 9 aa, Homo Sapiens
TQTGVIPQG

SEQ ID NO: 276096 - protein, 9 aa, Homo Sapiens
GGKSQNYLT

SEQ ID NO: 276097 - protein, 9 aa, Homo Sapiens
NSALVINKA

SEQ ID NO: 276098 - protein, 9 aa, Homo Sapiens
DLESGVEIC

SEQ ID NO: 276099 - protein, 9 aa, Homo Sapiens
NPNKYLGSF

SEQ ID NO: 276100 - protein, 9 aa, Homo Sapiens
RMKKLMRNK

SEQ ID NO: 276101 - protein, 9 aa, Homo Sapiens
TSQIKEVQR

SEQ ID NO: 276102 - protein, 9 aa, Homo Sapiens
VKAAGLCGE

SEQ ID NO: 276103 - protein, 9 aa, Homo Sapiens
GYFDAHTLA

SEQ ID NO: 276104 - protein, 9 aa, Homo Sapiens
ELQTESLTQ

SEQ ID NO: 276105 - protein, 9 aa, Homo Sapiens
LSSLKDEII

SEQ ID NO: 276106 - protein, 9 aa, Homo Sapiens
DGHMSGQVV

SEQ ID NO: 276107 - protein, 9 aa, Homo Sapiens
HCVHTLGSF

SEQ ID NO: 276108 - protein, 9 aa, Homo Sapiens
QQKLKKLPP

SEQ ID NO: 276109 - protein, 9 aa, Homo Sapiens
IYLQNNLIG

SEQ ID NO: 276110 - protein, 9 aa, Homo Sapiens
EKVLWVLVF

SEQ ID NO: 276111 - protein, 9 aa, Homo Sapiens
RERKKEGKE

SEQ ID NO: 276112 - protein, 9 aa, Homo Sapiens
YHNEEYVSW

SEQ ID NO: 276113 - protein, 9 aa, Homo Sapiens
QDMERKANP

SEQ ID NO: 276114 - protein, 9 aa, Homo Sapiens
VQKKQSESK

SEQ ID NO: 276115 - protein, 9 aa, Homo Sapiens
VSFITQTPG

SEQ ID NO: 276116 - protein, 9 aa, Homo Sapiens
PDLVGPSTR

SEQ ID NO: 276117 - protein, 9 aa, Homo Sapiens
IVYFTHILG

SEQ ID NO: 276118 - protein, 9 aa, Homo Sapiens
ALLFNNIFY

SEQ ID NO: 276119 - protein, 9 aa, Homo Sapiens
AEHSQGLEK

SEQ ID NO: 276120 - protein, 9 aa, Homo Sapiens
CVNKGTETR

SEQ ID NO: 276121 - protein, 9 aa, Homo Sapiens
KKAMLQGQV

SEQ ID NO: 276122 - protein, 9 aa, Homo Sapiens
YPPRRDDHG

SEQ ID NO: 276123 - protein, 9 aa, Homo Sapiens
SEDFITPLK

SEQ ID NO: 276124 - protein, 9 aa, Homo Sapiens
LNDQACPRM

SEQ ID NO: 276125 - protein, 9 aa, Homo Sapiens
GVHLDRDEE

SEQ ID NO: 276126 - protein, 9 aa, Homo Sapiens
EKPNEIPTK

SEQ ID NO: 276127 - protein, 9 aa, Homo Sapiens
YGSAVADTL

SEQ ID NO: 276128 - protein, 9 aa, Homo Sapiens
YLSSDTTRK

SEQ ID NO: 276129 - protein, 9 aa, Homo Sapiens
GNTGIATTL

SEQ ID NO: 276130 - protein, 9 aa, Homo Sapiens
GEGEDEGSG

SEQ ID NO: 276131 - protein, 9 aa, Homo Sapiens
EIHYPPYTE

SEQ ID NO: 276132 - protein, 9 aa, Homo Sapiens
QSHMFDISA

SEQ ID NO: 276133 - protein, 9 aa, Homo Sapiens
KFMNLLAMS

SEQ ID NO: 276134 - protein, 9 aa, Homo Sapiens
PDRLAAINY

SEQ ID NO: 276135 - protein, 9 aa, Homo Sapiens
IISDPEVLA

SEQ ID NO: 276136 - protein, 9 aa, Homo Sapiens
GGLMAQEAD

SEQ ID NO: 276137 - protein, 9 aa, Homo Sapiens
YCKNITTFD

SEQ ID NO: 276138 - protein, 9 aa, Homo Sapiens
YDRMDYDDD

SEQ ID NO: 276139 - protein, 9 aa, Homo Sapiens
KNVEAIWEL

SEQ ID NO: 276140 - protein, 9 aa, Homo Sapiens
PDGSNQTVF

SEQ ID NO: 276141 - protein, 9 aa, Homo Sapiens
TQLVKELVT

SEQ ID NO: 276142 - protein, 9 aa, Homo Sapiens
RLQCKLYSS

SEQ ID NO: 276143 - protein, 9 aa, Homo Sapiens
CPAETTHRK

SEQ ID NO: 276144 - protein, 9 aa, Homo Sapiens
NNLRKDKSK

SEQ ID NO: 276145 - protein, 9 aa, Homo Sapiens
SQVTEISRE

SEQ ID NO: 276146 - protein, 9 aa, Homo Sapiens
KRKLNMDST

SEQ ID NO: 276147 - protein, 9 aa, Homo Sapiens
MSLITNNIM

SEQ ID NO: 276148 - protein, 9 aa, Homo Sapiens
QPVYLANTQ

SEQ ID NO: 276149 - protein, 9 aa, Homo Sapiens
VDWFLDRLW

SEQ ID NO: 276150 - protein, 9 aa, Homo Sapiens
NVFGSKNTA

SEQ ID NO: 276151 - protein, 9 aa, Homo Sapiens
RVLPTCISR

SEQ ID NO: 276152 - protein, 9 aa, Homo Sapiens
WKRELQQHE

SEQ ID NO: 276153 - protein, 9 aa, Homo Sapiens
KILFGTEFN

SEQ ID NO: 276154 - protein, 9 aa, Homo Sapiens
EWHIGVCSN

SEQ ID NO: 276155 - protein, 9 aa, Homo Sapiens
TGLDDSYLL

SEQ ID NO: 276156 - protein, 9 aa, Homo Sapiens
EDVLTSHPL

SEQ ID NO: 276157 - protein, 9 aa, Homo Sapiens
KATYKDYSA

SEQ ID NO: 276158 - protein, 9 aa, Homo Sapiens
ESVQGVKNM

SEQ ID NO: 276159 - protein, 9 aa, Homo Sapiens
QESNRISQD

SEQ ID NO: 276160 - protein, 9 aa, Homo Sapiens
VKISDPNLF

SEQ ID NO: 276161 - protein, 9 aa, Homo Sapiens
ALYFSPILT

SEQ ID NO: 276162 - protein, 9 aa, Homo Sapiens
FIQLHKLIR

SEQ ID NO: 276163 - protein, 9 aa, Homo Sapiens
SYRNSLLFN

SEQ ID NO: 276164 - protein, 9 aa, Homo Sapiens
LKLLQKVEA

SEQ ID NO: 276165 - protein, 9 aa, Homo Sapiens
DKGGESCSE

SEQ ID NO: 276166 - protein, 9 aa, Homo Sapiens
QEGMAGLLG

SEQ ID NO: 276167 - protein, 9 aa, Homo Sapiens
YLEEDDSSE

SEQ ID NO: 276168 - protein, 9 aa, Homo Sapiens
VDINSAEQG

SEQ ID NO: 276169 - protein, 9 aa, Homo Sapiens
HIKYPSNFL

SEQ ID NO: 276170 - protein, 9 aa, Homo Sapiens
LPHVTHAFH

SEQ ID NO: 276171 - protein, 9 aa, Homo Sapiens
APVGDTKWL

SEQ ID NO: 276172 - protein, 9 aa, Homo Sapiens
QIISDSVPL

SEQ ID NO: 276173 - protein, 9 aa, Homo Sapiens
NVIRKQGIQ

SEQ ID NO: 276174 - protein, 9 aa, Homo Sapiens
ELPKDPRKW

SEQ ID NO: 276175 - protein, 9 aa, Homo Sapiens
INKEIIPDF

SEQ ID NO: 276176 - protein, 9 aa, Homo Sapiens
SDPGRCFYV

SEQ ID NO: 276177 - protein, 9 aa, Homo Sapiens
QLLYNEFSE

SEQ ID NO: 276178 - protein, 9 aa, Homo Sapiens
RNLFVKDVP

SEQ ID NO: 276179 - protein, 9 aa, Homo Sapiens
LIEHQIIHT

SEQ ID NO: 276180 - protein, 9 aa, Homo Sapiens
ANKKQNLKS

SEQ ID NO: 276181 - protein, 9 aa, Homo Sapiens
DEESHDEPE

SEQ ID NO: 276182 - protein, 9 aa, Homo Sapiens
PSNGIPKLT

SEQ ID NO: 276183 - protein, 9 aa, Homo Sapiens
TTEAQNIRK

SEQ ID NO: 276184 - protein, 9 aa, Homo Sapiens
AAVKATAQP

SEQ ID NO: 276185 - protein, 9 aa, Homo Sapiens
ERRKRRSIS

SEQ ID NO: 276186 - protein, 9 aa, Homo Sapiens
LKSLVNNYY

SEQ ID NO: 276187 - protein, 9 aa, Homo Sapiens
QQYLLIAAL

SEQ ID NO: 276188 - protein, 9 aa, Homo Sapiens
PPLLAMRRS

SEQ ID NO: 276189 - protein, 9 aa, Homo Sapiens
EQGGRAGDR

SEQ ID NO: 276190 - protein, 9 aa, Homo Sapiens
NKWYKSALQ

SEQ ID NO: 276191 - protein, 9 aa, Homo Sapiens
LLGQMCFQI

SEQ ID NO: 276192 - protein, 9 aa, Homo Sapiens
HQEDTYELD

SEQ ID NO: 276193 - protein, 9 aa, Homo Sapiens
PRENKPCIK

SEQ ID NO: 276194 - protein, 9 aa, Homo Sapiens
DFGMRKENV

SEQ ID NO: 276195 - protein, 9 aa, Homo Sapiens
ICLDFIETS

SEQ ID NO: 276196 - protein, 9 aa, Homo Sapiens
GGCNTSVEN

SEQ ID NO: 276197 - protein, 9 aa, Homo Sapiens
QESCVDTTV

SEQ ID NO: 276198 - protein, 9 aa, Homo Sapiens
DFVALLKLS

SEQ ID NO: 276199 - protein, 9 aa, Homo Sapiens
VPVHISAHH

SEQ ID NO: 276200 - protein, 9 aa, Homo Sapiens
KQRYCVNQC

SEQ ID NO: 276201 - protein, 9 aa, Homo Sapiens
LCPELRVNL

SEQ ID NO: 276202 - protein, 9 aa, Homo Sapiens
FVITHRLLK

SEQ ID NO: 276203 - protein, 9 aa, Homo Sapiens
NYVIYTNTH

SEQ ID NO: 276204 - protein, 9 aa, Homo Sapiens
ISKGLSGMQ

SEQ ID NO: 276205 - protein, 9 aa, Homo Sapiens
EARIQQRIS

SEQ ID NO: 276206 - protein, 9 aa, Homo Sapiens
PNTFIQRDD

SEQ ID NO: 276207 - protein, 9 aa, Homo Sapiens
TQELTVFRE

SEQ ID NO: 276208 - protein, 9 aa, Homo Sapiens
NVAIFQHFN

SEQ ID NO: 276209 - protein, 9 aa, Homo Sapiens
EHRAEICLY

SEQ ID NO: 276210 - protein, 9 aa, Homo Sapiens
KKTSIKMWF

SEQ ID NO: 276211 - protein, 9 aa, Homo Sapiens
AAKNLAKAL

SEQ ID NO: 276212 - protein, 9 aa, Homo Sapiens
RKKIYDRKE

SEQ ID NO: 276213 - protein, 9 aa, Homo Sapiens
LVDPLCSIK

SEQ ID NO: 276214 - protein, 9 aa, Homo Sapiens
EKGRKALEQ

SEQ ID NO: 276215 - protein, 9 aa, Homo Sapiens
AIRSILYKE

SEQ ID NO: 276216 - protein, 9 aa, Homo Sapiens
IEHLSLMLE

SEQ ID NO: 276217 - protein, 9 aa, Homo Sapiens
VHQCYGNKL

SEQ ID NO: 276218 - protein, 9 aa, Homo Sapiens
VRKKSKKEI

SEQ ID NO: 276219 - protein, 9 aa, Homo Sapiens
GSDLTEDLP

SEQ ID NO: 276220 - protein, 9 aa, Homo Sapiens
LHKCMTKEL

SEQ ID NO: 276221 - protein, 9 aa, Homo Sapiens
VPSHSKSSV

SEQ ID NO: 276222 - protein, 9 aa, Homo Sapiens
VILLSIFEE

SEQ ID NO: 276223 - protein, 9 aa, Homo Sapiens
EGLVKVIGI

SEQ ID NO: 276224 - protein, 9 aa, Homo Sapiens
DLPISKIEQ

SEQ ID NO: 276225 - protein, 9 aa, Homo Sapiens
YFPTQAELD

SEQ ID NO: 276226 - protein, 9 aa, Homo Sapiens
DNEGGEKAA

SEQ ID NO: 276227 - protein, 9 aa, Homo Sapiens
KHGGLHAFL

SEQ ID NO: 276228 - protein, 9 aa, Homo Sapiens
FLSVCEDSV

SEQ ID NO: 276229 - protein, 9 aa, Homo Sapiens
GAPAKSAVN

SEQ ID NO: 276230 - protein, 9 aa, Homo Sapiens
LNIGHLVFT

SEQ ID NO: 276231 - protein, 9 aa, Homo Sapiens
PSRTAYFSE

SEQ ID NO: 276232 - protein, 9 aa, Homo Sapiens
LRVPDHQNI

SEQ ID NO: 276233 - protein, 9 aa, Homo Sapiens
RTAENQSKP

SEQ ID NO: 276234 - protein, 9 aa, Homo Sapiens
GLDESLCGR

SEQ ID NO: 276235 - protein, 9 aa, Homo Sapiens
ATLHGNILN

SEQ ID NO: 276236 - protein, 9 aa, Homo Sapiens
GIIEELEDV

SEQ ID NO: 276237 - protein, 9 aa, Homo Sapiens
PYSKRAILN

SEQ ID NO: 276238 - protein, 9 aa, Homo Sapiens
LRDPWNWLN

SEQ ID NO: 276239 - protein, 9 aa, Homo Sapiens
HGYRIQIHS

SEQ ID NO: 276240 - protein, 9 aa, Homo Sapiens
MWLTWPFCV

SEQ ID NO: 276241 - protein, 9 aa, Homo Sapiens
SFQHPPEAF

SEQ ID NO: 276242 - protein, 9 aa, Homo Sapiens
QLFLQPLWE

SEQ ID NO: 276243 - protein, 9 aa, Homo Sapiens
VQEEYLQRL

SEQ ID NO: 276244 - protein, 9 aa, Homo Sapiens
SLEVAMQCL

SEQ ID NO: 276245 - protein, 9 aa, Homo Sapiens
RITSWPKAN

SEQ ID NO: 276246 - protein, 9 aa, Homo Sapiens
LLSADLTGA

SEQ ID NO: 276247 - protein, 9 aa, Homo Sapiens
MNPNKYLGS

SEQ ID NO: 276248 - protein, 9 aa, Homo Sapiens
KALEISGAQ

SEQ ID NO: 276249 - protein, 9 aa, Homo Sapiens
DGEGAPDPQ

SEQ ID NO: 276250 - protein, 9 aa, Homo Sapiens
IPSRSFLLR

SEQ ID NO: 276251 - protein, 9 aa, Homo Sapiens
PPSLLTSPS

SEQ ID NO: 276252 - protein, 9 aa, Homo Sapiens
YYLICVLLH

SEQ ID NO: 276253 - protein, 9 aa, Homo Sapiens
EMVQIEEDE

SEQ ID NO: 276254 - protein, 9 aa, Homo Sapiens
SPRDKQQNN

SEQ ID NO: 276255 - protein, 9 aa, Homo Sapiens
KSRRNCSKL

SEQ ID NO: 276256 - protein, 9 aa, Homo Sapiens
PPFFPVNYP

SEQ ID NO: 276257 - protein, 9 aa, Homo Sapiens
RHKIMHTGE

SEQ ID NO: 276258 - protein, 9 aa, Homo Sapiens
TTSQGSWHG

SEQ ID NO: 276259 - protein, 9 aa, Homo Sapiens
VIFHARVSG

SEQ ID NO: 276260 - protein, 9 aa, Homo Sapiens
KDLEAQTGA

SEQ ID NO: 276261 - protein, 9 aa, Homo Sapiens
LMPKLTEGQ

SEQ ID NO: 276262 - protein, 9 aa, Homo Sapiens
ALVSKAQAD

SEQ ID NO: 276263 - protein, 9 aa, Homo Sapiens
LTKTWALLD

SEQ ID NO: 276264 - protein, 9 aa, Homo Sapiens
NEDNSFGCP

SEQ ID NO: 276265 - protein, 9 aa, Homo Sapiens
YVRLHEVPC

SEQ ID NO: 276266 - protein, 9 aa, Homo Sapiens
YHSSLFGFV

SEQ ID NO: 276267 - protein, 9 aa, Homo Sapiens
ESLKSHGII

SEQ ID NO: 276268 - protein, 9 aa, Homo Sapiens
KFKQFCSLR

SEQ ID NO: 276269 - protein, 9 aa, Homo Sapiens
KDLEWKNKQ

SEQ ID NO: 276270 - protein, 9 aa, Homo Sapiens
RSTATFPLR

SEQ ID NO: 276271 - protein, 9 aa, Homo Sapiens
PVVVNGKEY

SEQ ID NO: 276272 - protein, 9 aa, Homo Sapiens
TRKLWACLT

SEQ ID NO: 276273 - protein, 9 aa, Homo Sapiens
YVLCAATPP

SEQ ID NO: 276274 - protein, 9 aa, Homo Sapiens
TIIAIVVYT

SEQ ID NO: 276275 - protein, 9 aa, Homo Sapiens
AGKLHYHSK

SEQ ID NO: 276276 - protein, 9 aa, Homo Sapiens
QTTRLKLQL

SEQ ID NO: 276277 - protein, 9 aa, Homo Sapiens
MRLLHCSLQ

SEQ ID NO: 276278 - protein, 9 aa, Homo Sapiens
LWRALEQLL

SEQ ID NO: 276279 - protein, 9 aa, Homo Sapiens
LKPPPEALA

SEQ ID NO: 276280 - protein, 9 aa, Homo Sapiens
QKTAKGAEI

SEQ ID NO: 276281 - protein, 9 aa, Homo Sapiens
NPDQLEAVD

SEQ ID NO: 276282 - protein, 9 aa, Homo Sapiens
EGSDGTNIN

SEQ ID NO: 276283 - protein, 9 aa, Homo Sapiens
QLINRGTSI

SEQ ID NO: 276284 - protein, 9 aa, Homo Sapiens
LGSKDLKGG

SEQ ID NO: 276285 - protein, 9 aa, Homo Sapiens
MDDKLLHNV

SEQ ID NO: 276286 - protein, 9 aa, Homo Sapiens
YLSQPQMLL

SEQ ID NO: 276287 - protein, 9 aa, Homo Sapiens
LTNLKYMLE

SEQ ID NO: 276288 - protein, 9 aa, Homo Sapiens
QTLVGHQQI

SEQ ID NO: 276289 - protein, 9 aa, Homo Sapiens
SKKSEVKYL

SEQ ID NO: 276290 - protein, 9 aa, Homo Sapiens
CYQQQSRIQ

SEQ ID NO: 276291 - protein, 9 aa, Homo Sapiens
KHFENSLLL

SEQ ID NO: 276292 - protein, 9 aa, Homo Sapiens
PSVTKNETG

SEQ ID NO: 276293 - protein, 9 aa, Homo Sapiens
KIIHIRENS

SEQ ID NO: 276294 - protein, 9 aa, Homo Sapiens
AMAYDQAVA

SEQ ID NO: 276295 - protein, 9 aa, Homo Sapiens
DIGNVTYFF

SEQ ID NO: 276296 - protein, 9 aa, Homo Sapiens
KHLDLAFNA

SEQ ID NO: 276297 - protein, 9 aa, Homo Sapiens
GSTDCRNTR

SEQ ID NO: 276298 - protein, 9 aa, Homo Sapiens
LNAFIAGLF

SEQ ID NO: 276299 - protein, 9 aa, Homo Sapiens
RGSIHARRT

SEQ ID NO: 276300 - protein, 9 aa, Homo Sapiens
RKPITPECV

SEQ ID NO: 276301 - protein, 9 aa, Homo Sapiens
ENDMERKVE

SEQ ID NO: 276302 - protein, 9 aa, Homo Sapiens
GQEASGGGS

SEQ ID NO: 276303 - protein, 9 aa, Homo Sapiens
EDNFEVVKQ

SEQ ID NO: 276304 - protein, 9 aa, Homo Sapiens
IEVKTIMNS

SEQ ID NO: 276305 - protein, 9 aa, Homo Sapiens
DLPEILFFV

SEQ ID NO: 276306 - protein, 9 aa, Homo Sapiens
DSLDFNTKI

SEQ ID NO: 276307 - protein, 9 aa, Homo Sapiens
TDKHEAVLQ

SEQ ID NO: 276308 - protein, 9 aa, Homo Sapiens
GSLVNEQWI

SEQ ID NO: 276309 - protein, 9 aa, Homo Sapiens
RELANQLAK

SEQ ID NO: 276310 - protein, 9 aa, Homo Sapiens
CGKFEYDID

SEQ ID NO: 276311 - protein, 9 aa, Homo Sapiens
LETLCPQVI

SEQ ID NO: 276312 - protein, 9 aa, Homo Sapiens
LCSLTHLSL

SEQ ID NO: 276313 - protein, 9 aa, Homo Sapiens
AHSDYAHYS

SEQ ID NO: 276314 - protein, 9 aa, Homo Sapiens
DQGLTCREE

SEQ ID NO: 276315 - protein, 9 aa, Homo Sapiens
KESISYILA

SEQ ID NO: 276316 - protein, 9 aa, Homo Sapiens
VLYVVIAKK

SEQ ID NO: 276317 - protein, 9 aa, Homo Sapiens
PDPGVHYEY

SEQ ID NO: 276318 - protein, 9 aa, Homo Sapiens
FRQNSAENF

SEQ ID NO: 276319 - protein, 9 aa, Homo Sapiens
VLNNLSPDS

SEQ ID NO: 276320 - protein, 9 aa, Homo Sapiens
RSRSVSDYS

SEQ ID NO: 276321 - protein, 9 aa, Homo Sapiens
LVSIPGARW

SEQ ID NO: 276322 - protein, 9 aa, Homo Sapiens
LSSTENLNG

SEQ ID NO: 276323 - protein, 9 aa, Homo Sapiens
AWLVGEHRA

SEQ ID NO: 276324 - protein, 9 aa, Homo Sapiens
CTECAKAFN

SEQ ID NO: 276325 - protein, 9 aa, Homo Sapiens
GKLSLDQID

SEQ ID NO: 276326 - protein, 9 aa, Homo Sapiens
VGKTYGLWE

SEQ ID NO: 276327 - protein, 9 aa, Homo Sapiens
ESLSGKKRT

SEQ ID NO: 276328 - protein, 9 aa, Homo Sapiens
STQSSGYIS

SEQ ID NO: 276329 - protein, 9 aa, Homo Sapiens
HFKSESEEK

SEQ ID NO: 276330 - protein, 9 aa, Homo Sapiens
HNLNMQLFS

SEQ ID NO: 276331 - protein, 9 aa, Homo Sapiens
EILFFVALG

SEQ ID NO: 276332 - protein, 9 aa, Homo Sapiens
SAIRDQRTT

SEQ ID NO: 276333 - protein, 9 aa, Homo Sapiens
WRKQIPFSK

SEQ ID NO: 276334 - protein, 9 aa, Homo Sapiens
LISCWPLPE

SEQ ID NO: 276335 - protein, 9 aa, Homo Sapiens
KLSVCKDLQ

SEQ ID NO: 276336 - protein, 9 aa, Homo Sapiens
ARQRIPYQL

SEQ ID NO: 276337 - protein, 9 aa, Homo Sapiens
QNLQRQFRG

SEQ ID NO: 276338 - protein, 9 aa, Homo Sapiens
HATFRAVDS

SEQ ID NO: 276339 - protein, 9 aa, Homo Sapiens
PPSQERLWA

SEQ ID NO: 276340 - protein, 9 aa, Homo Sapiens
RPQDTISSS

SEQ ID NO: 276341 - protein, 9 aa, Homo Sapiens
KIFTPCFNY

SEQ ID NO: 276342 - protein, 9 aa, Homo Sapiens
KRLQEEKGK

SEQ ID NO: 276343 - protein, 9 aa, Homo Sapiens
KSRQPRPNS

SEQ ID NO: 276344 - protein, 9 aa, Homo Sapiens
QFDYKDQRF

SEQ ID NO: 276345 - protein, 9 aa, Homo Sapiens
LACFLDTRR

SEQ ID NO: 276346 - protein, 9 aa, Homo Sapiens
KSKPPKEEL

SEQ ID NO: 276347 - protein, 9 aa, Homo Sapiens
LLPAPPFGS

SEQ ID NO: 276348 - protein, 9 aa, Homo Sapiens
SYYIHPVCL

SEQ ID NO: 276349 - protein, 9 aa, Homo Sapiens
PKKVYLSSD

SEQ ID NO: 276350 - protein, 9 aa, Homo Sapiens
IRQSYHGTM

SEQ ID NO: 276351 - protein, 9 aa, Homo Sapiens
DGYVVLWMA

SEQ ID NO: 276352 - protein, 9 aa, Homo Sapiens
CPTLPAGFQ

SEQ ID NO: 276353 - protein, 9 aa, Homo Sapiens
ITKDREYMG

SEQ ID NO: 276354 - protein, 9 aa, Homo Sapiens
KPHLCSLSS

SEQ ID NO: 276355 - protein, 9 aa, Homo Sapiens
VEKGMDYEV

SEQ ID NO: 276356 - protein, 9 aa, Homo Sapiens
PSPINAFIS

SEQ ID NO: 276357 - protein, 9 aa, Homo Sapiens
LQADALYEL

SEQ ID NO: 276358 - protein, 9 aa, Homo Sapiens
PPQTLLREK

SEQ ID NO: 276359 - protein, 9 aa, Homo Sapiens
NEEINLLSV

SEQ ID NO: 276360 - protein, 9 aa, Homo Sapiens
ILVLIGQII

SEQ ID NO: 276361 - protein, 9 aa, Homo Sapiens
SSEKINFLL

SEQ ID NO: 276362 - protein, 9 aa, Homo Sapiens
DIFQHLQNI

SEQ ID NO: 276363 - protein, 9 aa, Homo Sapiens
MLDLQSPNQ

SEQ ID NO: 276364 - protein, 9 aa, Homo Sapiens
YNPVVINFE

SEQ ID NO: 276365 - protein, 9 aa, Homo Sapiens
GAPLITATT

SEQ ID NO: 276366 - protein, 9 aa, Homo Sapiens
KLFLVPSQL

SEQ ID NO: 276367 - protein, 9 aa, Homo Sapiens
PNTRSSQFG

SEQ ID NO: 276368 - protein, 9 aa, Homo Sapiens
QEESIVTLL

SEQ ID NO: 276369 - protein, 9 aa, Homo Sapiens
KLKCWYCNY

SEQ ID NO: 276370 - protein, 9 aa, Homo Sapiens
VVRYEKLFT

SEQ ID NO: 276371 - protein, 9 aa, Homo Sapiens
EPPYIFHQV

SEQ ID NO: 276372 - protein, 9 aa, Homo Sapiens
TPLVLPYTN

SEQ ID NO: 276373 - protein, 9 aa, Homo Sapiens
SQCKEIMLK

SEQ ID NO: 276374 - protein, 9 aa, Homo Sapiens
VNCARYMPQ

SEQ ID NO: 276375 - protein, 9 aa, Homo Sapiens
RGGLALTLV

SEQ ID NO: 276376 - protein, 9 aa, Homo Sapiens
CASCILNNI

SEQ ID NO: 276377 - protein, 9 aa, Homo Sapiens
PNATRDGVI

SEQ ID NO: 276378 - protein, 9 aa, Homo Sapiens
KKVGDWIMA

SEQ ID NO: 276379 - protein, 9 aa, Homo Sapiens
IFHSSDGML

SEQ ID NO: 276380 - protein, 9 aa, Homo Sapiens
HVSSKEPGS

SEQ ID NO: 276381 - protein, 9 aa, Homo Sapiens
VPRAPSFLA

SEQ ID NO: 276382 - protein, 9 aa, Homo Sapiens
LRDQSVSVQ

SEQ ID NO: 276383 - protein, 9 aa, Homo Sapiens
AQLEGAEKG

SEQ ID NO: 276384 - protein, 9 aa, Homo Sapiens
LVYRQFLFV

SEQ ID NO: 276385 - protein, 9 aa, Homo Sapiens
EFVKHFCSH

SEQ ID NO: 276386 - protein, 9 aa, Homo Sapiens
MYRIVSQKQ

SEQ ID NO: 276387 - protein, 9 aa, Homo Sapiens
DCYSPWCHP

SEQ ID NO: 276388 - protein, 9 aa, Homo Sapiens
AFIDMPGAA

SEQ ID NO: 276389 - protein, 9 aa, Homo Sapiens
KLKEDNISF

SEQ ID NO: 276390 - protein, 9 aa, Homo Sapiens
PQTLLREKI

SEQ ID NO: 276391 - protein, 9 aa, Homo Sapiens
LSDQITFME

SEQ ID NO: 276392 - protein, 9 aa, Homo Sapiens
VNDGVTQTP

SEQ ID NO: 276393 - protein, 9 aa, Homo Sapiens
ILKTLLDFI

SEQ ID NO: 276394 - protein, 9 aa, Homo Sapiens
IHIAEKPYK

SEQ ID NO: 276395 - protein, 9 aa, Homo Sapiens
ETKWELRQQ

SEQ ID NO: 276396 - protein, 9 aa, Homo Sapiens
NDILLVNRD

SEQ ID NO: 276397 - protein, 9 aa, Homo Sapiens
LATPIMNAK

SEQ ID NO: 276398 - protein, 9 aa, Homo Sapiens
NAAILKKGH

SEQ ID NO: 276399 - protein, 9 aa, Homo Sapiens
EDNARKIRT

SEQ ID NO: 276400 - protein, 9 aa, Homo Sapiens
AMMNITFQN

SEQ ID NO: 276401 - protein, 9 aa, Homo Sapiens
CNRVTDLDA

SEQ ID NO: 276402 - protein, 9 aa, Homo Sapiens
GDINRTSTL

SEQ ID NO: 276403 - protein, 9 aa, Homo Sapiens
LHYAALSGL

SEQ ID NO: 276404 - protein, 9 aa, Homo Sapiens
SIKHRCSTK

SEQ ID NO: 276405 - protein, 9 aa, Homo Sapiens
LEMEDQKHS

SEQ ID NO: 276406 - protein, 9 aa, Homo Sapiens
NRRERLVQL

SEQ ID NO: 276407 - protein, 9 aa, Homo Sapiens
NSMTPAHIV

SEQ ID NO: 276408 - protein, 9 aa, Homo Sapiens
LAMFQSIPN

SEQ ID NO: 276409 - protein, 9 aa, Homo Sapiens
ITGAGPGAL

SEQ ID NO: 276410 - protein, 9 aa, Homo Sapiens
CFTCVDGKE

SEQ ID NO: 276411 - protein, 9 aa, Homo Sapiens
LDIYQEEIR

SEQ ID NO: 276412 - protein, 9 aa, Homo Sapiens
NTQENDIPT

SEQ ID NO: 276413 - protein, 9 aa, Homo Sapiens
TYSSDKAYG

SEQ ID NO: 276414 - protein, 9 aa, Homo Sapiens
GCPGPDGYP

SEQ ID NO: 276415 - protein, 9 aa, Homo Sapiens
KEHHRVVIG

SEQ ID NO: 276416 - protein, 9 aa, Homo Sapiens
SMTMRSFKR

SEQ ID NO: 276417 - protein, 9 aa, Homo Sapiens
QIQSLGMDI

SEQ ID NO: 276418 - protein, 9 aa, Homo Sapiens
DLAVVLVVS

SEQ ID NO: 276419 - protein, 9 aa, Homo Sapiens
KYIYATDQE

SEQ ID NO: 276420 - protein, 9 aa, Homo Sapiens
ELTMLYSVI

SEQ ID NO: 276421 - protein, 9 aa, Homo Sapiens
SSAQFMGSP

SEQ ID NO: 276422 - protein, 9 aa, Homo Sapiens
LCSPDLVNW

SEQ ID NO: 276423 - protein, 9 aa, Homo Sapiens
RQKHLKYYL

SEQ ID NO: 276424 - protein, 9 aa, Homo Sapiens
NFYLNLGLL

SEQ ID NO: 276425 - protein, 9 aa, Homo Sapiens
HVANWLVER

SEQ ID NO: 276426 - protein, 9 aa, Homo Sapiens
AVHVQSGPE

SEQ ID NO: 276427 - protein, 9 aa, Homo Sapiens
FISVDHLGG

SEQ ID NO: 276428 - protein, 9 aa, Homo Sapiens
ARQQWCFDQ

SEQ ID NO: 276429 - protein, 9 aa, Homo Sapiens
ISTLTSCQM

SEQ ID NO: 276430 - protein, 9 aa, Homo Sapiens
LNGVLEANR

SEQ ID NO: 276431 - protein, 9 aa, Homo Sapiens
KKELFTKYQ

SEQ ID NO: 276432 - protein, 9 aa, Homo Sapiens
VAESVKYQN

SEQ ID NO: 276433 - protein, 9 aa, Homo Sapiens
SPEPPKPTP

SEQ ID NO: 276434 - protein, 9 aa, Homo Sapiens
RSHLMKKPC

SEQ ID NO: 276435 - protein, 9 aa, Homo Sapiens
MRTLDPQIL

SEQ ID NO: 276436 - protein, 9 aa, Homo Sapiens
NKTCNSFLT

SEQ ID NO: 276437 - protein, 9 aa, Homo Sapiens
LCTSRHLRN

SEQ ID NO: 276438 - protein, 9 aa, Homo Sapiens
LNSVRQRQL

SEQ ID NO: 276439 - protein, 9 aa, Homo Sapiens
TGFSGLRLP

SEQ ID NO: 276440 - protein, 9 aa, Homo Sapiens
ALYLAENEE

SEQ ID NO: 276441 - protein, 9 aa, Homo Sapiens
FGNATEICP

SEQ ID NO: 276442 - protein, 9 aa, Homo Sapiens
FDLIYEYKS

SEQ ID NO: 276443 - protein, 9 aa, Homo Sapiens
TVIYLPLSG

SEQ ID NO: 276444 - protein, 9 aa, Homo Sapiens
TQEIPHTGK

SEQ ID NO: 276445 - protein, 9 aa, Homo Sapiens
FKVITKDSL

SEQ ID NO: 276446 - protein, 9 aa, Homo Sapiens
KPLHYYSIM

SEQ ID NO: 276447 - protein, 9 aa, Homo Sapiens
KEDIEARKG

SEQ ID NO: 276448 - protein, 9 aa, Homo Sapiens
ELQQLQSKI

SEQ ID NO: 276449 - protein, 9 aa, Homo Sapiens
SPRICPHLC

SEQ ID NO: 276450 - protein, 9 aa, Homo Sapiens
QDRNDLLTS

SEQ ID NO: 276451 - protein, 9 aa, Homo Sapiens
PAVSLRHRD

SEQ ID NO: 276452 - protein, 9 aa, Homo Sapiens
QKERDKEAG

SEQ ID NO: 276453 - protein, 9 aa, Homo Sapiens
YSYKGLWSV

SEQ ID NO: 276454 - protein, 9 aa, Homo Sapiens
QDALSDGLQ

SEQ ID NO: 276455 - protein, 9 aa, Homo Sapiens
WGIIKQGYT

SEQ ID NO: 276456 - protein, 9 aa, Homo Sapiens
HIREKSYTC

SEQ ID NO: 276457 - protein, 9 aa, Homo Sapiens
PEINKIIYV

SEQ ID NO: 276458 - protein, 9 aa, Homo Sapiens
WMRDNVPGE

SEQ ID NO: 276459 - protein, 9 aa, Homo Sapiens
MYHTAKTRA

SEQ ID NO: 276460 - protein, 9 aa, Homo Sapiens
KGTLLGVAT

SEQ ID NO: 276461 - protein, 9 aa, Homo Sapiens
SALQKLKNV

SEQ ID NO: 276462 - protein, 9 aa, Homo Sapiens
VIAVERFRC

SEQ ID NO: 276463 - protein, 9 aa, Homo Sapiens
LLSDSRLHS

SEQ ID NO: 276464 - protein, 9 aa, Homo Sapiens
FEMVVNAAC

SEQ ID NO: 276465 - protein, 9 aa, Homo Sapiens
EKGKDDALS

SEQ ID NO: 276466 - protein, 9 aa, Homo Sapiens
TEKDLDKKK

SEQ ID NO: 276467 - protein, 9 aa, Homo Sapiens
PTKYQLSQP

SEQ ID NO: 276468 - protein, 9 aa, Homo Sapiens
KKPYCQKDF

SEQ ID NO: 276469 - protein, 9 aa, Homo Sapiens
PIITFPEFL

SEQ ID NO: 276470 - protein, 9 aa, Homo Sapiens
ESHILLVGD

SEQ ID NO: 276471 - protein, 9 aa, Homo Sapiens
NIFSKKGES

SEQ ID NO: 276472 - protein, 9 aa, Homo Sapiens
KDLHDKLIM

SEQ ID NO: 276473 - protein, 9 aa, Homo Sapiens
GKWRFRIQK

SEQ ID NO: 276474 - protein, 9 aa, Homo Sapiens
HQQIHTGES

SEQ ID NO: 276475 - protein, 9 aa, Homo Sapiens
GQKRKVQRY

SEQ ID NO: 276476 - protein, 9 aa, Homo Sapiens
SVSLQKQNT

SEQ ID NO: 276477 - protein, 9 aa, Homo Sapiens
FSTHPVSTF

SEQ ID NO: 276478 - protein, 9 aa, Homo Sapiens
TLLAGHPLH

SEQ ID NO: 276479 - protein, 9 aa, Homo Sapiens
PEEEKREDK

SEQ ID NO: 276480 - protein, 9 aa, Homo Sapiens
DLAQHQKVH

SEQ ID NO: 276481 - protein, 9 aa, Homo Sapiens
ANLSLAKRS

SEQ ID NO: 276482 - protein, 9 aa, Homo Sapiens
LICGLQQVK

SEQ ID NO: 276483 - protein, 9 aa, Homo Sapiens
LVISCSHFV

SEQ ID NO: 276484 - protein, 9 aa, Homo Sapiens
QNVSKDMEK

SEQ ID NO: 276485 - protein, 9 aa, Homo Sapiens
CVGILSWHP

SEQ ID NO: 276486 - protein, 9 aa, Homo Sapiens
PLIYFLREP

SEQ ID NO: 276487 - protein, 9 aa, Homo Sapiens
TVTIIGGII

SEQ ID NO: 276488 - protein, 9 aa, Homo Sapiens
RRGEESSDM

SEQ ID NO: 276489 - protein, 9 aa, Homo Sapiens
CLSCVTVPN

SEQ ID NO: 276490 - protein, 9 aa, Homo Sapiens
VKITLRNLN

SEQ ID NO: 276491 - protein, 9 aa, Homo Sapiens
GKIRSLTIN

SEQ ID NO: 276492 - protein, 9 aa, Homo Sapiens
IIIVDDFSE

SEQ ID NO: 276493 - protein, 9 aa, Homo Sapiens
INRHQGKPL

SEQ ID NO: 276494 - protein, 9 aa, Homo Sapiens
STQRVVVED

SEQ ID NO: 276495 - protein, 9 aa, Homo Sapiens
FLCETKLEA

SEQ ID NO: 276496 - protein, 9 aa, Homo Sapiens
TSRVFQSPL

SEQ ID NO: 276497 - protein, 9 aa, Homo Sapiens
IYNYNPEKT

SEQ ID NO: 276498 - protein, 9 aa, Homo Sapiens
KNVLAKALG

SEQ ID NO: 276499 - protein, 9 aa, Homo Sapiens
WDLSSPDLI

SEQ ID NO: 276500 - protein, 9 aa, Homo Sapiens
AGLEAQVES

SEQ ID NO: 276501 - protein, 9 aa, Homo Sapiens
MALKGQDDY

SEQ ID NO: 276502 - protein, 9 aa, Homo Sapiens
SYTMLVDWM

SEQ ID NO: 276503 - protein, 9 aa, Homo Sapiens
HLGQLALLD

SEQ ID NO: 276504 - protein, 9 aa, Homo Sapiens
EQANNKEDS

SEQ ID NO: 276505 - protein, 9 aa, Homo Sapiens
TTAVVVIHF

SEQ ID NO: 276506 - protein, 9 aa, Homo Sapiens
GEYIYAFAH

SEQ ID NO: 276507 - protein, 9 aa, Homo Sapiens
VGVNGFGRS

SEQ ID NO: 276508 - protein, 9 aa, Homo Sapiens
VSSLSSKFI

SEQ ID NO: 276509 - protein, 9 aa, Homo Sapiens
LWALLAKEG

SEQ ID NO: 276510 - protein, 9 aa, Homo Sapiens
FAKIKLEKE

SEQ ID NO: 276511 - protein, 9 aa, Homo Sapiens
HLLSNKKSI

SEQ ID NO: 276512 - protein, 9 aa, Homo Sapiens
LFCQSQSST

SEQ ID NO: 276513 - protein, 9 aa, Homo Sapiens
TMLFTSGQS

SEQ ID NO: 276514 - protein, 9 aa, Homo Sapiens
RFREHWQKN

SEQ ID NO: 276515 - protein, 9 aa, Homo Sapiens
DHPSKGCFC

SEQ ID NO: 276516 - protein, 9 aa, Homo Sapiens
PFFSAIDLS

SEQ ID NO: 276517 - protein, 9 aa, Homo Sapiens
FTHQCNYKC

SEQ ID NO: 276518 - protein, 9 aa, Homo Sapiens
NPPNAIIFS

SEQ ID NO: 276519 - protein, 9 aa, Homo Sapiens
LKYRMYEEQ

SEQ ID NO: 276520 - protein, 9 aa, Homo Sapiens
RWMGPTDPE

SEQ ID NO: 276521 - protein, 9 aa, Homo Sapiens
MNYTAIRFT

SEQ ID NO: 276522 - protein, 9 aa, Homo Sapiens
NIYAPAHAN

SEQ ID NO: 276523 - protein, 9 aa, Homo Sapiens
PIAESRPLD

SEQ ID NO: 276524 - protein, 9 aa, Homo Sapiens
KCEVQVTNG

SEQ ID NO: 276525 - protein, 9 aa, Homo Sapiens
VVLGGYSPP

SEQ ID NO: 276526 - protein, 9 aa, Homo Sapiens
MGPIFPIIR

SEQ ID NO: 276527 - protein, 9 aa, Homo Sapiens
IRHKKIHTR

SEQ ID NO: 276528 - protein, 9 aa, Homo Sapiens
DFDFLDAEL

SEQ ID NO: 276529 - protein, 9 aa, Homo Sapiens
NFKKIPMED

SEQ ID NO: 276530 - protein, 9 aa, Homo Sapiens
ANVERKYVA

SEQ ID NO: 276531 - protein, 9 aa, Homo Sapiens
IKLSDLTLG

SEQ ID NO: 276532 - protein, 9 aa, Homo Sapiens
ELPFMMVPH

SEQ ID NO: 276533 - protein, 9 aa, Homo Sapiens
QPESKTLQV

SEQ ID NO: 276534 - protein, 9 aa, Homo Sapiens
KSTKRTNQS

SEQ ID NO: 276535 - protein, 9 aa, Homo Sapiens
QDSGVYTCI

SEQ ID NO: 276536 - protein, 9 aa, Homo Sapiens
TGDKPFKCE

SEQ ID NO: 276537 - protein, 9 aa, Homo Sapiens
LLHGFPGFW

SEQ ID NO: 276538 - protein, 9 aa, Homo Sapiens
SEQWDNIYH

SEQ ID NO: 276539 - protein, 9 aa, Homo Sapiens
QSNRGILTL

SEQ ID NO: 276540 - protein, 9 aa, Homo Sapiens
EAIRISLEE

SEQ ID NO: 276541 - protein, 9 aa, Homo Sapiens
NANKQAVHT

SEQ ID NO: 276542 - protein, 9 aa, Homo Sapiens
EKGAEDRLI

SEQ ID NO: 276543 - protein, 9 aa, Homo Sapiens
YPRVQTAVG

SEQ ID NO: 276544 - protein, 9 aa, Homo Sapiens
KIILIVVAA

SEQ ID NO: 276545 - protein, 9 aa, Homo Sapiens
EIIIVDDFS

SEQ ID NO: 276546 - protein, 9 aa, Homo Sapiens
EKSLEFGPE

SEQ ID NO: 276547 - protein, 9 aa, Homo Sapiens
VNGKEYPLG

SEQ ID NO: 276548 - protein, 9 aa, Homo Sapiens
FQIVICLGE

SEQ ID NO: 276549 - protein, 9 aa, Homo Sapiens
HLCSLSSSL

SEQ ID NO: 276550 - protein, 9 aa, Homo Sapiens
NTGSFNLLS

SEQ ID NO: 276551 - protein, 9 aa, Homo Sapiens
SGIEICYTV

SEQ ID NO: 276552 - protein, 9 aa, Homo Sapiens
PFVQANQSN

SEQ ID NO: 276553 - protein, 9 aa, Homo Sapiens
QPFRRKEME

SEQ ID NO: 276554 - protein, 9 aa, Homo Sapiens
AFEWKTKVV

SEQ ID NO: 276555 - protein, 9 aa, Homo Sapiens
GGFSQPYLL

SEQ ID NO: 276556 - protein, 9 aa, Homo Sapiens
ASAKALVFN

SEQ ID NO: 276557 - protein, 9 aa, Homo Sapiens
NLSSLKLCL

SEQ ID NO: 276558 - protein, 9 aa, Homo Sapiens
FCQSGMDND

SEQ ID NO: 276559 - protein, 9 aa, Homo Sapiens
CHIGRFKSM

SEQ ID NO: 276560 - protein, 9 aa, Homo Sapiens
HASYHIGAF

SEQ ID NO: 276561 - protein, 9 aa, Homo Sapiens
HTLGSFHCY

SEQ ID NO: 276562 - protein, 9 aa, Homo Sapiens
IKTLEGAEE

SEQ ID NO: 276563 - protein, 9 aa, Homo Sapiens
QLELHLGGD

SEQ ID NO: 276564 - protein, 9 aa, Homo Sapiens
FRDGVRSLI

SEQ ID NO: 276565 - protein, 9 aa, Homo Sapiens
AEDRLILDA

SEQ ID NO: 276566 - protein, 9 aa, Homo Sapiens
YDIDNCHFQ

SEQ ID NO: 276567 - protein, 9 aa, Homo Sapiens
LEFRYNTRV

SEQ ID NO: 276568 - protein, 9 aa, Homo Sapiens
TSSKAESPQ

SEQ ID NO: 276569 - protein, 9 aa, Homo Sapiens
DHHGNRHKF

SEQ ID NO: 276570 - protein, 9 aa, Homo Sapiens
SSSDTYEED

SEQ ID NO: 276571 - protein, 9 aa, Homo Sapiens
IQAAFSDAQ

SEQ ID NO: 276572 - protein, 9 aa, Homo Sapiens
IGMETLSHE

SEQ ID NO: 276573 - protein, 9 aa, Homo Sapiens
PVVSQPQFT

SEQ ID NO: 276574 - protein, 9 aa, Homo Sapiens
MHSQNIDAY

SEQ ID NO: 276575 - protein, 9 aa, Homo Sapiens
LQVIDRLEE

SEQ ID NO: 276576 - protein, 9 aa, Homo Sapiens
IRAWVAWIN

SEQ ID NO: 276577 - protein, 9 aa, Homo Sapiens
YSVPRRDSL

SEQ ID NO: 276578 - protein, 9 aa, Homo Sapiens
EASTNFLPG

SEQ ID NO: 276579 - protein, 9 aa, Homo Sapiens
QQGNFPLRG

SEQ ID NO: 276580 - protein, 9 aa, Homo Sapiens
GDCSKGLFL

SEQ ID NO: 276581 - protein, 9 aa, Homo Sapiens
IINAGSQFE

SEQ ID NO: 276582 - protein, 9 aa, Homo Sapiens
YKEVARYQH

SEQ ID NO: 276583 - protein, 9 aa, Homo Sapiens
ESDKTGVCL

SEQ ID NO: 276584 - protein, 9 aa, Homo Sapiens
DCFLEGDQR

SEQ ID NO: 276585 - protein, 9 aa, Homo Sapiens
KKKIHNFDC

SEQ ID NO: 276586 - protein, 9 aa, Homo Sapiens
ISSTCVAYV

SEQ ID NO: 276587 - protein, 9 aa, Homo Sapiens
FHSSRDSVP

SEQ ID NO: 276588 - protein, 9 aa, Homo Sapiens
SHTIDFFEM

SEQ ID NO: 276589 - protein, 9 aa, Homo Sapiens
VVKPKRQKL

SEQ ID NO: 276590 - protein, 9 aa, Homo Sapiens
KLLAEGGIR

SEQ ID NO: 276591 - protein, 9 aa, Homo Sapiens
AGLSLDNFI

SEQ ID NO: 276592 - protein, 9 aa, Homo Sapiens
KSCLNITHK

SEQ ID NO: 276593 - protein, 9 aa, Homo Sapiens
TCALIMKIT

SEQ ID NO: 276594 - protein, 9 aa, Homo Sapiens
SEDWKRANI

SEQ ID NO: 276595 - protein, 9 aa, Homo Sapiens
RTWVKFQYP

SEQ ID NO: 276596 - protein, 9 aa, Homo Sapiens
RMDWGKVAF

SEQ ID NO: 276597 - protein, 9 aa, Homo Sapiens
SGHDTRDPS

SEQ ID NO: 276598 - protein, 9 aa, Homo Sapiens
LYDKGDVIL

SEQ ID NO: 276599 - protein, 9 aa, Homo Sapiens
FFSPSLLKR

SEQ ID NO: 276600 - protein, 9 aa, Homo Sapiens
AILYLRFGV

SEQ ID NO: 276601 - protein, 9 aa, Homo Sapiens
QDKDRAKVE

SEQ ID NO: 276602 - protein, 9 aa, Homo Sapiens
ESKLVDWII

SEQ ID NO: 276603 - protein, 9 aa, Homo Sapiens
TEYGLTFTD

SEQ ID NO: 276604 - protein, 9 aa, Homo Sapiens
LDESLKEIK

SEQ ID NO: 276605 - protein, 9 aa, Homo Sapiens
IKLRNSNLV

SEQ ID NO: 276606 - protein, 9 aa, Homo Sapiens
LGKVKLCEK

SEQ ID NO: 276607 - protein, 9 aa, Homo Sapiens
KLATRPINA

SEQ ID NO: 276608 - protein, 9 aa, Homo Sapiens
CPGDKLWDH

SEQ ID NO: 276609 - protein, 9 aa, Homo Sapiens
IMKITCLEI

SEQ ID NO: 276610 - protein, 9 aa, Homo Sapiens
LQTNTDHLQ

SEQ ID NO: 276611 - protein, 9 aa, Homo Sapiens
VRNQIYIQV

SEQ ID NO: 276612 - protein, 9 aa, Homo Sapiens
EQILELPLP

SEQ ID NO: 276613 - protein, 9 aa, Homo Sapiens
LSGTAEPYD

SEQ ID NO: 276614 - protein, 9 aa, Homo Sapiens
LIVKRIRKK

SEQ ID NO: 276615 - protein, 9 aa, Homo Sapiens
FGNRIKALR

SEQ ID NO: 276616 - protein, 9 aa, Homo Sapiens
QNVAALHLY

SEQ ID NO: 276617 - protein, 9 aa, Homo Sapiens
NNLPLHELI

SEQ ID NO: 276618 - protein, 9 aa, Homo Sapiens
KELEELRQI

SEQ ID NO: 276619 - protein, 9 aa, Homo Sapiens
NGELEASVK

SEQ ID NO: 276620 - protein, 9 aa, Homo Sapiens
LETLIIGTG

SEQ ID NO: 276621 - protein, 9 aa, Homo Sapiens
MGSTDCRNT

SEQ ID NO: 276622 - protein, 9 aa, Homo Sapiens
QFMGSPQLR

SEQ ID NO: 276623 - protein, 9 aa, Homo Sapiens
AMLQGQVLK

SEQ ID NO: 276624 - protein, 9 aa, Homo Sapiens
DRNDGYVLR

SEQ ID NO: 276625 - protein, 9 aa, Homo Sapiens
LNSKLWKHV

SEQ ID NO: 276626 - protein, 9 aa, Homo Sapiens
AIFQSLTKR

SEQ ID NO: 276627 - protein, 9 aa, Homo Sapiens
LKKVSEASD

SEQ ID NO: 276628 - protein, 9 aa, Homo Sapiens
RNIDNVETS

SEQ ID NO: 276629 - protein, 9 aa, Homo Sapiens
SGTLPVVAG

SEQ ID NO: 276630 - protein, 9 aa, Homo Sapiens
NASKFDGQP

SEQ ID NO: 276631 - protein, 9 aa, Homo Sapiens
FHLSHVISP

SEQ ID NO: 276632 - protein, 9 aa, Homo Sapiens
DISIIDDNE

SEQ ID NO: 276633 - protein, 9 aa, Homo Sapiens
IDKKHRNGT

SEQ ID NO: 276634 - protein, 9 aa, Homo Sapiens
VSDYSVPRR

SEQ ID NO: 276635 - protein, 9 aa, Homo Sapiens
FKFQSLLTV

SEQ ID NO: 276636 - protein, 9 aa, Homo Sapiens
GIFFSILGT

SEQ ID NO: 276637 - protein, 9 aa, Homo Sapiens
SRSMNDIYL

SEQ ID NO: 276638 - protein, 9 aa, Homo Sapiens
ENFKQCFRD

SEQ ID NO: 276639 - protein, 9 aa, Homo Sapiens
SSQMSYLVE

SEQ ID NO: 276640 - protein, 9 aa, Homo Sapiens
KHVGWEGAN

SEQ ID NO: 276641 - protein, 9 aa, Homo Sapiens
CSELVEGQV

SEQ ID NO: 276642 - protein, 9 aa, Homo Sapiens
KADENNVFG

SEQ ID NO: 276643 - protein, 9 aa, Homo Sapiens
KKRNIPSLT

SEQ ID NO: 276644 - protein, 9 aa, Homo Sapiens
IHSVKEVQS

SEQ ID NO: 276645 - protein, 9 aa, Homo Sapiens
GLMTTENSV

SEQ ID NO: 276646 - protein, 9 aa, Homo Sapiens
HILGLECLN

SEQ ID NO: 276647 - protein, 9 aa, Homo Sapiens
DLTDPDIHV

SEQ ID NO: 276648 - protein, 9 aa, Homo Sapiens
GDEINKRTA

SEQ ID NO: 276649 - protein, 9 aa, Homo Sapiens
KRIHTGEKA

SEQ ID NO: 276650 - protein, 9 aa, Homo Sapiens
QVRNYRHIP

SEQ ID NO: 276651 - protein, 9 aa, Homo Sapiens
ELHNQCIKA

SEQ ID NO: 276652 - protein, 9 aa, Homo Sapiens
EDCKDEYFA

SEQ ID NO: 276653 - protein, 9 aa, Homo Sapiens
HATWRGYRV

SEQ ID NO: 276654 - protein, 9 aa, Homo Sapiens
RTESLISCW

SEQ ID NO: 276655 - protein, 9 aa, Homo Sapiens
EFITLHDYT

SEQ ID NO: 276656 - protein, 9 aa, Homo Sapiens
EDKVSIYKL

SEQ ID NO: 276657 - protein, 9 aa, Homo Sapiens
QVKYGVWQN

SEQ ID NO: 276658 - protein, 9 aa, Homo Sapiens
SKSLSYTGE

SEQ ID NO: 276659 - protein, 9 aa, Homo Sapiens
SLVLCLTIE

SEQ ID NO: 276660 - protein, 9 aa, Homo Sapiens
KEPRVTLDW

SEQ ID NO: 276661 - protein, 9 aa, Homo Sapiens
YSFQEIILR

SEQ ID NO: 276662 - protein, 9 aa, Homo Sapiens
ISFLCREYP

SEQ ID NO: 276663 - protein, 9 aa, Homo Sapiens
FTGHLLLLA

SEQ ID NO: 276664 - protein, 9 aa, Homo Sapiens
ESVMETKNS

SEQ ID NO: 276665 - protein, 9 aa, Homo Sapiens
INSKKASEK

SEQ ID NO: 276666 - protein, 9 aa, Homo Sapiens
QHPQTRVEN

SEQ ID NO: 276667 - protein, 9 aa, Homo Sapiens
IAVKTRKCS

SEQ ID NO: 276668 - protein, 9 aa, Homo Sapiens
AGRRINSLP

SEQ ID NO: 276669 - protein, 9 aa, Homo Sapiens
VEADGLVWK

SEQ ID NO: 276670 - protein, 9 aa, Homo Sapiens
RLATRGEII

SEQ ID NO: 276671 - protein, 9 aa, Homo Sapiens
QKVLLYLDM

SEQ ID NO: 276672 - protein, 9 aa, Homo Sapiens
IMWLQLDRL

SEQ ID NO: 276673 - protein, 9 aa, Homo Sapiens
RQFNKILAG

SEQ ID NO: 276674 - protein, 9 aa, Homo Sapiens
EEGDDQAGQ

SEQ ID NO: 276675 - protein, 9 aa, Homo Sapiens
KKHRKHFKK

SEQ ID NO: 276676 - protein, 9 aa, Homo Sapiens
NIGVAGFKM

SEQ ID NO: 276677 - protein, 9 aa, Homo Sapiens
DAQQSSTEQ

SEQ ID NO: 276678 - protein, 9 aa, Homo Sapiens
FGSENACEI

SEQ ID NO: 276679 - protein, 9 aa, Homo Sapiens
NIMAQKCLK

SEQ ID NO: 276680 - protein, 9 aa, Homo Sapiens
VNMLVGNRI

SEQ ID NO: 276681 - protein, 9 aa, Homo Sapiens
IIEEDEEDE

SEQ ID NO: 276682 - protein, 9 aa, Homo Sapiens
FEERLRTRK

SEQ ID NO: 276683 - protein, 9 aa, Homo Sapiens
PYVCMERGK

SEQ ID NO: 276684 - protein, 9 aa, Homo Sapiens
EYAKIEGPV

SEQ ID NO: 276685 - protein, 9 aa, Homo Sapiens
GDDKYDDED

SEQ ID NO: 276686 - protein, 9 aa, Homo Sapiens
EVVRIYISR

SEQ ID NO: 276687 - protein, 9 aa, Homo Sapiens
PDNEFKKQI

SEQ ID NO: 276688 - protein, 9 aa, Homo Sapiens
PLLSAVDEG

SEQ ID NO: 276689 - protein, 9 aa, Homo Sapiens
SPHIKYPSN

SEQ ID NO: 276690 - protein, 9 aa, Homo Sapiens
HWISQMELL

SEQ ID NO: 276691 - protein, 9 aa, Homo Sapiens
YKRVRLCFV

SEQ ID NO: 276692 - protein, 9 aa, Homo Sapiens
RFGLSITQL

SEQ ID NO: 276693 - protein, 9 aa, Homo Sapiens
EAFQDGDKL

SEQ ID NO: 276694 - protein, 9 aa, Homo Sapiens
VRDMDDGSD

SEQ ID NO: 276695 - protein, 9 aa, Homo Sapiens
RANIIFRNF

SEQ ID NO: 276696 - protein, 9 aa, Homo Sapiens
SESEEKKAL

SEQ ID NO: 276697 - protein, 9 aa, Homo Sapiens
KMLNIGHLV

SEQ ID NO: 276698 - protein, 9 aa, Homo Sapiens
PNREMVAQL

SEQ ID NO: 276699 - protein, 9 aa, Homo Sapiens
HKLKEMAAA

SEQ ID NO: 276700 - protein, 9 aa, Homo Sapiens
IFNISNKLF

SEQ ID NO: 276701 - protein, 9 aa, Homo Sapiens
KKMSAPKSH

SEQ ID NO: 276702 - protein, 9 aa, Homo Sapiens
NVTFTYHTR

SEQ ID NO: 276703 - protein, 9 aa, Homo Sapiens
AVSRKKTRR

SEQ ID NO: 276704 - protein, 9 aa, Homo Sapiens
QTLNVSHNK

SEQ ID NO: 276705 - protein, 9 aa, Homo Sapiens
SHKKDSSCI

SEQ ID NO: 276706 - protein, 9 aa, Homo Sapiens
KEIYTSNRM

SEQ ID NO: 276707 - protein, 9 aa, Homo Sapiens
VMLQSHSRE

SEQ ID NO: 276708 - protein, 9 aa, Homo Sapiens
YYKKPIQEV

SEQ ID NO: 276709 - protein, 9 aa, Homo Sapiens
GCLYEANYY

SEQ ID NO: 276710 - protein, 9 aa, Homo Sapiens
LPFSSYHNN

SEQ ID NO: 276711 - protein, 9 aa, Homo Sapiens
LVAQQEALS

SEQ ID NO: 276712 - protein, 9 aa, Homo Sapiens
GIAQEIQEK

SEQ ID NO: 276713 - protein, 9 aa, Homo Sapiens
NSCDVPGGH

SEQ ID NO: 276714 - protein, 9 aa, Homo Sapiens
ILTPAHVSR

SEQ ID NO: 276715 - protein, 9 aa, Homo Sapiens
MVTSMLNPL

SEQ ID NO: 276716 - protein, 9 aa, Homo Sapiens
FYPPDPVQL

SEQ ID NO: 276717 - protein, 9 aa, Homo Sapiens
FIHERPQKI

SEQ ID NO: 276718 - protein, 9 aa, Homo Sapiens
IQTLSGEQI

SEQ ID NO: 276719 - protein, 9 aa, Homo Sapiens
NRTPFASAK

SEQ ID NO: 276720 - protein, 9 aa, Homo Sapiens
LWRVLSFSW

SEQ ID NO: 276721 - protein, 9 aa, Homo Sapiens
LFIPLPFAE

SEQ ID NO: 276722 - protein, 9 aa, Homo Sapiens
TVQQLSNQE

SEQ ID NO: 276723 - protein, 9 aa, Homo Sapiens
LTTTRRAVN

SEQ ID NO: 276724 - protein, 9 aa, Homo Sapiens
VQVLKWSGR

SEQ ID NO: 276725 - protein, 9 aa, Homo Sapiens
QRHGTLLLL

SEQ ID NO: 276726 - protein, 9 aa, Homo Sapiens
SCDSRYLCS

SEQ ID NO: 276727 - protein, 9 aa, Homo Sapiens
DDFGVAGVE

SEQ ID NO: 276728 - protein, 9 aa, Homo Sapiens
LVDAVIYAY

SEQ ID NO: 276729 - protein, 9 aa, Homo Sapiens
SLFTNRNRL

SEQ ID NO: 276730 - protein, 9 aa, Homo Sapiens
IKKEKNINR

SEQ ID NO: 276731 - protein, 9 aa, Homo Sapiens
GILWNKFFQ

SEQ ID NO: 276732 - protein, 9 aa, Homo Sapiens
FKFEASGSP

SEQ ID NO: 276733 - protein, 9 aa, Homo Sapiens
NDNMLVKLQ

SEQ ID NO: 276734 - protein, 9 aa, Homo Sapiens
HPHNALSDV

SEQ ID NO: 276735 - protein, 9 aa, Homo Sapiens
TVSALFRDN

SEQ ID NO: 276736 - protein, 9 aa, Homo Sapiens
TLMVDGEDT

SEQ ID NO: 276737 - protein, 9 aa, Homo Sapiens
SRQPRPNSQ

SEQ ID NO: 276738 - protein, 9 aa, Homo Sapiens
MLTLRVIAI

SEQ ID NO: 276739 - protein, 9 aa, Homo Sapiens
SADLTGAIK

SEQ ID NO: 276740 - protein, 9 aa, Homo Sapiens
CKVPLSDEN

SEQ ID NO: 276741 - protein, 9 aa, Homo Sapiens
ETNLDTYDP

SEQ ID NO: 276742 - protein, 9 aa, Homo Sapiens
IRQPIDKTA

SEQ ID NO: 276743 - protein, 9 aa, Homo Sapiens
LNPNPSHHM

SEQ ID NO: 276744 - protein, 9 aa, Homo Sapiens
FVFEAGPTG

SEQ ID NO: 276745 - protein, 9 aa, Homo Sapiens
EQNGLKDNN

SEQ ID NO: 276746 - protein, 9 aa, Homo Sapiens
DTFKGLKHL

SEQ ID NO: 276747 - protein, 9 aa, Homo Sapiens
VHQQTHTGE

SEQ ID NO: 276748 - protein, 9 aa, Homo Sapiens
LEALLVQIG

SEQ ID NO: 276749 - protein, 9 aa, Homo Sapiens
CGQIEINHF

SEQ ID NO: 276750 - protein, 9 aa, Homo Sapiens
RNSLPPIDL

SEQ ID NO: 276751 - protein, 9 aa, Homo Sapiens
TRPINAHSP

SEQ ID NO: 276752 - protein, 9 aa, Homo Sapiens
NANLRFLNK

SEQ ID NO: 276753 - protein, 9 aa, Homo Sapiens
FPVLGPQSE

SEQ ID NO: 276754 - protein, 9 aa, Homo Sapiens
QPVFLSQSK

SEQ ID NO: 276755 - protein, 9 aa, Homo Sapiens
DLVQEEYLQ

SEQ ID NO: 276756 - protein, 9 aa, Homo Sapiens
SNGVPVTRI

SEQ ID NO: 276757 - protein, 9 aa, Homo Sapiens
KTYFKNREN

SEQ ID NO: 276758 - protein, 9 aa, Homo Sapiens
LAFQVFIIM

SEQ ID NO: 276759 - protein, 9 aa, Homo Sapiens
GDHFCLGQL

SEQ ID NO: 276760 - protein, 9 aa, Homo Sapiens
RKLTKTSNL

SEQ ID NO: 276761 - protein, 9 aa, Homo Sapiens
GLISRASRC

SEQ ID NO: 276762 - protein, 9 aa, Homo Sapiens
PKKIRISIG

SEQ ID NO: 276763 - protein, 9 aa, Homo Sapiens
TGYPDRPGW

SEQ ID NO: 276764 - protein, 9 aa, Homo Sapiens
SSLKLCLNW

SEQ ID NO: 276765 - protein, 9 aa, Homo Sapiens
PDLFSPSLD

SEQ ID NO: 276766 - protein, 9 aa, Homo Sapiens
IGSLNWGYQ

SEQ ID NO: 276767 - protein, 9 aa, Homo Sapiens
INCHTTSIS

SEQ ID NO: 276768 - protein, 9 aa, Homo Sapiens
KMGHTMDKR

SEQ ID NO: 276769 - protein, 9 aa, Homo Sapiens
QRRELGCLN

SEQ ID NO: 276770 - protein, 9 aa, Homo Sapiens
AIHFINERE

SEQ ID NO: 276771 - protein, 9 aa, Homo Sapiens
TAFSQRSHL

SEQ ID NO: 276772 - protein, 9 aa, Homo Sapiens
GAFRKRHVL

SEQ ID NO: 276773 - protein, 9 aa, Homo Sapiens
ESKDNQWLG

SEQ ID NO: 276774 - protein, 9 aa, Homo Sapiens
GGRRIGFNV

SEQ ID NO: 276775 - protein, 9 aa, Homo Sapiens
LELLNNGEH

SEQ ID NO: 276776 - protein, 9 aa, Homo Sapiens
KAMLLEICW

SEQ ID NO: 276777 - protein, 9 aa, Homo Sapiens
GVEREVINM

SEQ ID NO: 276778 - protein, 9 aa, Homo Sapiens
VRVITSAFT

SEQ ID NO: 276779 - protein, 9 aa, Homo Sapiens
HLMKKPCFD

SEQ ID NO: 276780 - protein, 9 aa, Homo Sapiens
ICVTHRYSD

SEQ ID NO: 276781 - protein, 9 aa, Homo Sapiens
EDDDYDNST

SEQ ID NO: 276782 - protein, 9 aa, Homo Sapiens
PTYPQAYPS

SEQ ID NO: 276783 - protein, 9 aa, Homo Sapiens
ECSECGTAF

SEQ ID NO: 276784 - protein, 9 aa, Homo Sapiens
IHHLLFTFY

SEQ ID NO: 276785 - protein, 9 aa, Homo Sapiens
SVFQLIEEA

SEQ ID NO: 276786 - protein, 9 aa, Homo Sapiens
NACEITSFA

SEQ ID NO: 276787 - protein, 9 aa, Homo Sapiens
PQQVSFPHN

SEQ ID NO: 276788 - protein, 9 aa, Homo Sapiens
SKDETDKEK

SEQ ID NO: 276789 - protein, 9 aa, Homo Sapiens
LQEELNTNL

SEQ ID NO: 276790 - protein, 9 aa, Homo Sapiens
IQHQQVHTR

SEQ ID NO: 276791 - protein, 9 aa, Homo Sapiens
PSTYVGFKE

SEQ ID NO: 276792 - protein, 9 aa, Homo Sapiens
HNRNEEQRM

SEQ ID NO: 276793 - protein, 9 aa, Homo Sapiens
RAPTVNPTL

SEQ ID NO: 276794 - protein, 9 aa, Homo Sapiens
LETNNICFY

SEQ ID NO: 276795 - protein, 9 aa, Homo Sapiens
RQKTLLLAS

SEQ ID NO: 276796 - protein, 9 aa, Homo Sapiens
WSPSKHTQT

SEQ ID NO: 276797 - protein, 9 aa, Homo Sapiens
PLMVDLHEQ

SEQ ID NO: 276798 - protein, 9 aa, Homo Sapiens
DNKFGAACA

SEQ ID NO: 276799 - protein, 9 aa, Homo Sapiens
WNNGKIRAF

SEQ ID NO: 276800 - protein, 9 aa, Homo Sapiens
EGSYESVFK

SEQ ID NO: 276801 - protein, 9 aa, Homo Sapiens
DKKYPNLSH

SEQ ID NO: 276802 - protein, 9 aa, Homo Sapiens
QTCKVPLSD

SEQ ID NO: 276803 - protein, 9 aa, Homo Sapiens
ARCQEISNQ

SEQ ID NO: 276804 - protein, 9 aa, Homo Sapiens
EERKLFLVP

SEQ ID NO: 276805 - protein, 9 aa, Homo Sapiens
DYSSKTELL

SEQ ID NO: 276806 - protein, 9 aa, Homo Sapiens
LNAGLVGLS

SEQ ID NO: 276807 - protein, 9 aa, Homo Sapiens
NNYSYNEIH

SEQ ID NO: 276808 - protein, 9 aa, Homo Sapiens
SEVVLDSTR

SEQ ID NO: 276809 - protein, 9 aa, Homo Sapiens
LCSLDLAGN

SEQ ID NO: 276810 - protein, 9 aa, Homo Sapiens
NFIDKHIAE

SEQ ID NO: 276811 - protein, 9 aa, Homo Sapiens
EAMHDPLLE

SEQ ID NO: 276812 - protein, 9 aa, Homo Sapiens
SNQKPGTDE

SEQ ID NO: 276813 - protein, 9 aa, Homo Sapiens
ERSATDSLS

SEQ ID NO: 276814 - protein, 9 aa, Homo Sapiens
ELNIKAGEQ

SEQ ID NO: 276815 - protein, 9 aa, Homo Sapiens
RDPLKDCTY

SEQ ID NO: 276816 - protein, 9 aa, Homo Sapiens
QSVAPQQDF

SEQ ID NO: 276817 - protein, 9 aa, Homo Sapiens
ESTFGLSSK

SEQ ID NO: 276818 - protein, 9 aa, Homo Sapiens
YIRITSDIS

SEQ ID NO: 276819 - protein, 9 aa, Homo Sapiens
GPSQLCSGA

SEQ ID NO: 276820 - protein, 9 aa, Homo Sapiens
YFWSQEDKF

SEQ ID NO: 276821 - protein, 9 aa, Homo Sapiens
IDLYKMKAA

SEQ ID NO: 276822 - protein, 9 aa, Homo Sapiens
YHFAHWLAF

SEQ ID NO: 276823 - protein, 9 aa, Homo Sapiens
LKLSEDCLH

SEQ ID NO: 276824 - protein, 9 aa, Homo Sapiens
RGQTQSGKD

SEQ ID NO: 276825 - protein, 9 aa, Homo Sapiens
TKTWALLDR

SEQ ID NO: 276826 - protein, 9 aa, Homo Sapiens
HKRGETKPR

SEQ ID NO: 276827 - protein, 9 aa, Homo Sapiens
HVNEITRFS

SEQ ID NO: 276828 - protein, 9 aa, Homo Sapiens
ERCHTGNTP

SEQ ID NO: 276829 - protein, 9 aa, Homo Sapiens
ICQRTHFVI

SEQ ID NO: 276830 - protein, 9 aa, Homo Sapiens
DTHCILLRC

SEQ ID NO: 276831 - protein, 9 aa, Homo Sapiens
YINSICYRM

SEQ ID NO: 276832 - protein, 9 aa, Homo Sapiens
QEGWNRFIC

SEQ ID NO: 276833 - protein, 9 aa, Homo Sapiens
HEASNHVQE

SEQ ID NO: 276834 - protein, 9 aa, Homo Sapiens
NITKSEQKR

SEQ ID NO: 276835 - protein, 9 aa, Homo Sapiens
GDRIFFVPA

SEQ ID NO: 276836 - protein, 9 aa, Homo Sapiens
GNKSLVSQL

SEQ ID NO: 276837 - protein, 9 aa, Homo Sapiens
KDTICINYS

SEQ ID NO: 276838 - protein, 9 aa, Homo Sapiens
ARWAVGGVP

SEQ ID NO: 276839 - protein, 9 aa, Homo Sapiens
DVSGTDEER

SEQ ID NO: 276840 - protein, 9 aa, Homo Sapiens
ISPVLSQVG

SEQ ID NO: 276841 - protein, 9 aa, Homo Sapiens
LRTAGLFRR

SEQ ID NO: 276842 - protein, 9 aa, Homo Sapiens
EDILKKQEG

SEQ ID NO: 276843 - protein, 9 aa, Homo Sapiens
EKYLYTFMS

SEQ ID NO: 276844 - protein, 9 aa, Homo Sapiens
GSSTNGSSG

SEQ ID NO: 276845 - protein, 9 aa, Homo Sapiens
RQIHTGKKE

SEQ ID NO: 276846 - protein, 9 aa, Homo Sapiens
TALRELRPA

SEQ ID NO: 276847 - protein, 9 aa, Homo Sapiens
QSIGAQKAK

SEQ ID NO: 276848 - protein, 9 aa, Homo Sapiens
LHKHEDSGC

SEQ ID NO: 276849 - protein, 9 aa, Homo Sapiens
DDETTKVVQ

SEQ ID NO: 276850 - protein, 9 aa, Homo Sapiens
EFLKLQTRL

SEQ ID NO: 276851 - protein, 9 aa, Homo Sapiens
RDKEAGALE

SEQ ID NO: 276852 - protein, 9 aa, Homo Sapiens
EKLDLKTNV

SEQ ID NO: 276853 - protein, 9 aa, Homo Sapiens
KISDGVQHL

SEQ ID NO: 276854 - protein, 9 aa, Homo Sapiens
PFQIASWKL

SEQ ID NO: 276855 - protein, 9 aa, Homo Sapiens
LQYLENLDK

SEQ ID NO: 276856 - protein, 9 aa, Homo Sapiens
STLQSVSTG

SEQ ID NO: 276857 - protein, 9 aa, Homo Sapiens
RIFIHGWPW

SEQ ID NO: 276858 - protein, 9 aa, Homo Sapiens
NLQEIKKEL

SEQ ID NO: 276859 - protein, 9 aa, Homo Sapiens
GNVTIKEGL

SEQ ID NO: 276860 - protein, 9 aa, Homo Sapiens
NLNHNSDLI

SEQ ID NO: 276861 - protein, 9 aa, Homo Sapiens
KYADYANYN

SEQ ID NO: 276862 - protein, 9 aa, Homo Sapiens
AAINYEGRL

SEQ ID NO: 276863 - protein, 9 aa, Homo Sapiens
ANRTCLCFL

SEQ ID NO: 276864 - protein, 9 aa, Homo Sapiens
RETYGFGQH

SEQ ID NO: 276865 - protein, 9 aa, Homo Sapiens
VLMYLKEGY

SEQ ID NO: 276866 - protein, 9 aa, Homo Sapiens
GNNFGQSSD

SEQ ID NO: 276867 - protein, 9 aa, Homo Sapiens
SCPTTTPSL

SEQ ID NO: 276868 - protein, 9 aa, Homo Sapiens
NTDNSSPSA

SEQ ID NO: 276869 - protein, 9 aa, Homo Sapiens
AKDAQERSR

SEQ ID NO: 276870 - protein, 9 aa, Homo Sapiens
VICVTHRYS

SEQ ID NO: 276871 - protein, 9 aa, Homo Sapiens
VNKTKPAAH

SEQ ID NO: 276872 - protein, 9 aa, Homo Sapiens
IFFSILGTG

SEQ ID NO: 276873 - protein, 9 aa, Homo Sapiens
DALISKMYP

SEQ ID NO: 276874 - protein, 9 aa, Homo Sapiens
KKDQATAQE

SEQ ID NO: 276875 - protein, 9 aa, Homo Sapiens
KETFSKAAQ

SEQ ID NO: 276876 - protein, 9 aa, Homo Sapiens
DKSRQKEAD

SEQ ID NO: 276877 - protein, 9 aa, Homo Sapiens
NTSKMITIQ

SEQ ID NO: 276878 - protein, 9 aa, Homo Sapiens
SMSVTRIMG

SEQ ID NO: 276879 - protein, 9 aa, Homo Sapiens
GQIRYSVWE

SEQ ID NO: 276880 - protein, 9 aa, Homo Sapiens
RSSVCRLIS

SEQ ID NO: 276881 - protein, 9 aa, Homo Sapiens
RINTGKRSY

SEQ ID NO: 276882 - protein, 9 aa, Homo Sapiens
NKFISRLRK

SEQ ID NO: 276883 - protein, 9 aa, Homo Sapiens
KGHSKSIQW

SEQ ID NO: 276884 - protein, 9 aa, Homo Sapiens
ALRKIQGSY

SEQ ID NO: 276885 - protein, 9 aa, Homo Sapiens
FLHYLGFPY

SEQ ID NO: 276886 - protein, 9 aa, Homo Sapiens
KSSKSIKLI

SEQ ID NO: 276887 - protein, 9 aa, Homo Sapiens
KVEVATYAT

SEQ ID NO: 276888 - protein, 9 aa, Homo Sapiens
SNKRKSNLS

SEQ ID NO: 276889 - protein, 9 aa, Homo Sapiens
EVDVAQVRN

SEQ ID NO: 276890 - protein, 9 aa, Homo Sapiens
VQKLGCWNP

SEQ ID NO: 276891 - protein, 9 aa, Homo Sapiens
RETQRGLRP

SEQ ID NO: 276892 - protein, 9 aa, Homo Sapiens
LIRAKLCPR

SEQ ID NO: 276893 - protein, 9 aa, Homo Sapiens
YIHIIIQQR

SEQ ID NO: 276894 - protein, 9 aa, Homo Sapiens
PSLTPLTTS

SEQ ID NO: 276895 - protein, 9 aa, Homo Sapiens
SNLKKKCKE

SEQ ID NO: 276896 - protein, 9 aa, Homo Sapiens
VNYVKILGK

SEQ ID NO: 276897 - protein, 9 aa, Homo Sapiens
CPSKTSFFL

SEQ ID NO: 276898 - protein, 9 aa, Homo Sapiens
EENETLQAN

SEQ ID NO: 276899 - protein, 9 aa, Homo Sapiens
IRSLTINNM

SEQ ID NO: 276900 - protein, 9 aa, Homo Sapiens
CELYLGLRF

SEQ ID NO: 276901 - protein, 9 aa, Homo Sapiens
HMFDISAVY

SEQ ID NO: 276902 - protein, 9 aa, Homo Sapiens
QIIHLSIHQ

SEQ ID NO: 276903 - protein, 9 aa, Homo Sapiens
AAVMAVPHT

SEQ ID NO: 276904 - protein, 9 aa, Homo Sapiens
LQPLWEHLR

SEQ ID NO: 276905 - protein, 9 aa, Homo Sapiens
ELFSVVTTD

SEQ ID NO: 276906 - protein, 9 aa, Homo Sapiens
VMGLNLVIA

SEQ ID NO: 276907 - protein, 9 aa, Homo Sapiens
CTPMPSPYY

SEQ ID NO: 276908 - protein, 9 aa, Homo Sapiens
HNEEYVSWW

SEQ ID NO: 276909 - protein, 9 aa, Homo Sapiens
KHIMEVVGT

SEQ ID NO: 276910 - protein, 9 aa, Homo Sapiens
LTAIVSTHS

SEQ ID NO: 276911 - protein, 9 aa, Homo Sapiens
AALLRAAPG

SEQ ID NO: 276912 - protein, 9 aa, Homo Sapiens
CMAEILYVP

SEQ ID NO: 276913 - protein, 9 aa, Homo Sapiens
PGLFTLEVY

SEQ ID NO: 276914 - protein, 9 aa, Homo Sapiens
DLKAKKKEL

SEQ ID NO: 276915 - protein, 9 aa, Homo Sapiens
FSSKMKAVA

SEQ ID NO: 276916 - protein, 9 aa, Homo Sapiens
KDLKDMLGF

SEQ ID NO: 276917 - protein, 9 aa, Homo Sapiens
VQMTFLWLL

SEQ ID NO: 276918 - protein, 9 aa, Homo Sapiens
IRKFDLLFP

SEQ ID NO: 276919 - protein, 9 aa, Homo Sapiens
LKMFQEDHG

SEQ ID NO: 276920 - protein, 9 aa, Homo Sapiens
VDKDYQKKM

SEQ ID NO: 276921 - protein, 9 aa, Homo Sapiens
YQNIKYREK

SEQ ID NO: 276922 - protein, 9 aa, Homo Sapiens
PGAPCAIQI

SEQ ID NO: 276923 - protein, 9 aa, Homo Sapiens
ATVEDETLQ

SEQ ID NO: 276924 - protein, 9 aa, Homo Sapiens
GKVRDMNRT

SEQ ID NO: 276925 - protein, 9 aa, Homo Sapiens
PQNLPSTGF

SEQ ID NO: 276926 - protein, 9 aa, Homo Sapiens
TPYCTVALN

SEQ ID NO: 276927 - protein, 9 aa, Homo Sapiens
SNNRQIHTG

SEQ ID NO: 276928 - protein, 9 aa, Homo Sapiens
SWPKANPGS

SEQ ID NO: 276929 - protein, 9 aa, Homo Sapiens
QSHLNNSDS

SEQ ID NO: 276930 - protein, 9 aa, Homo Sapiens
KKRLRSSKK

SEQ ID NO: 276931 - protein, 9 aa, Homo Sapiens
CDEEIRFSL

SEQ ID NO: 276932 - protein, 9 aa, Homo Sapiens
EFINKIQEA

SEQ ID NO: 276933 - protein, 9 aa, Homo Sapiens
ANNKSKARP

SEQ ID NO: 276934 - protein, 9 aa, Homo Sapiens
IPPNKFISR

SEQ ID NO: 276935 - protein, 9 aa, Homo Sapiens
GCSSILPAG

SEQ ID NO: 276936 - protein, 9 aa, Homo Sapiens
AHKHIKEKQ

SEQ ID NO: 276937 - protein, 9 aa, Homo Sapiens
GNSENFILE

SEQ ID NO: 276938 - protein, 9 aa, Homo Sapiens
DELFMEAIE

SEQ ID NO: 276939 - protein, 9 aa, Homo Sapiens
VDRVANPKY

SEQ ID NO: 276940 - protein, 9 aa, Homo Sapiens
WLLFCACAE

SEQ ID NO: 276941 - protein, 9 aa, Homo Sapiens
GSLHQKDTF

SEQ ID NO: 276942 - protein, 9 aa, Homo Sapiens
CEQLRTLLT

SEQ ID NO: 276943 - protein, 9 aa, Homo Sapiens
AYTIPLDFI

SEQ ID NO: 276944 - protein, 9 aa, Homo Sapiens
DTEEVFRGH

SEQ ID NO: 276945 - protein, 9 aa, Homo Sapiens
TRTNKDGKG

SEQ ID NO: 276946 - protein, 9 aa, Homo Sapiens
CHLIVHKII

SEQ ID NO: 276947 - protein, 9 aa, Homo Sapiens
DSNQREEQD

SEQ ID NO: 276948 - protein, 9 aa, Homo Sapiens
GGESAEEED

SEQ ID NO: 276949 - protein, 9 aa, Homo Sapiens
FFKEVNTTI

SEQ ID NO: 276950 - protein, 9 aa, Homo Sapiens
YDTIGKTTK

SEQ ID NO: 276951 - protein, 9 aa, Homo Sapiens
CCLVPCFID

SEQ ID NO: 276952 - protein, 9 aa, Homo Sapiens
DPRYTGFLK

SEQ ID NO: 276953 - protein, 9 aa, Homo Sapiens
PLYWTMIQL

SEQ ID NO: 276954 - protein, 9 aa, Homo Sapiens
KEVWEKRIT

SEQ ID NO: 276955 - protein, 9 aa, Homo Sapiens
KGVLMFVAG

SEQ ID NO: 276956 - protein, 9 aa, Homo Sapiens
LIQLTVKLR

SEQ ID NO: 276957 - protein, 9 aa, Homo Sapiens
KHVKAANRL

SEQ ID NO: 276958 - protein, 9 aa, Homo Sapiens
PQRCPVYLR

SEQ ID NO: 276959 - protein, 9 aa, Homo Sapiens
SISAFCEKT

SEQ ID NO: 276960 - protein, 9 aa, Homo Sapiens
VDFGYDYLW

SEQ ID NO: 276961 - protein, 9 aa, Homo Sapiens
MKNIFSKKG

SEQ ID NO: 276962 - protein, 9 aa, Homo Sapiens
MAINWLTGN

SEQ ID NO: 276963 - protein, 9 aa, Homo Sapiens
KNSIHHNLS

SEQ ID NO: 276964 - protein, 9 aa, Homo Sapiens
HPVSTFDWV

SEQ ID NO: 276965 - protein, 9 aa, Homo Sapiens
TAQDMQEKL

SEQ ID NO: 276966 - protein, 9 aa, Homo Sapiens
YTSYEQLKE

SEQ ID NO: 276967 - protein, 9 aa, Homo Sapiens
LQVTSPVIQ

SEQ ID NO: 276968 - protein, 9 aa, Homo Sapiens
TSRRPHLPL

SEQ ID NO: 276969 - protein, 9 aa, Homo Sapiens
GAVRSRLEC

SEQ ID NO: 276970 - protein, 9 aa, Homo Sapiens
GIMDDKTVT

SEQ ID NO: 276971 - protein, 9 aa, Homo Sapiens
VPVRAFLPA

SEQ ID NO: 276972 - protein, 9 aa, Homo Sapiens
IIQNQNVIH

SEQ ID NO: 276973 - protein, 9 aa, Homo Sapiens
LTELYACIE

SEQ ID NO: 276974 - protein, 9 aa, Homo Sapiens
LAWWPNPQA

SEQ ID NO: 276975 - protein, 9 aa, Homo Sapiens
LSPGQTSAS

SEQ ID NO: 276976 - protein, 9 aa, Homo Sapiens
TLCQGKTSE

SEQ ID NO: 276977 - protein, 9 aa, Homo Sapiens
SRNLLWLSV

SEQ ID NO: 276978 - protein, 9 aa, Homo Sapiens
LIKCMLRNE

SEQ ID NO: 276979 - protein, 9 aa, Homo Sapiens
KHKLKEMAA

SEQ ID NO: 276980 - protein, 9 aa, Homo Sapiens
EHPRRLTDT

SEQ ID NO: 276981 - protein, 9 aa, Homo Sapiens
GVFSQRFEF

SEQ ID NO: 276982 - protein, 9 aa, Homo Sapiens
LTATTKSET

SEQ ID NO: 276983 - protein, 9 aa, Homo Sapiens
TRDGKVYIH

SEQ ID NO: 276984 - protein, 9 aa, Homo Sapiens
VDTEHSDIY

SEQ ID NO: 276985 - protein, 9 aa, Homo Sapiens
KQETSIEVE

SEQ ID NO: 276986 - protein, 9 aa, Homo Sapiens
LPKGLPGLP

SEQ ID NO: 276987 - protein, 9 aa, Homo Sapiens
KIGKRLNIH

SEQ ID NO: 276988 - protein, 9 aa, Homo Sapiens
EKREDKLEQ

SEQ ID NO: 276989 - protein, 9 aa, Homo Sapiens
PTIFYPETT

SEQ ID NO: 276990 - protein, 9 aa, Homo Sapiens
VDKASKYIS

SEQ ID NO: 276991 - protein, 9 aa, Homo Sapiens
ADEGSRNSQ

SEQ ID NO: 276992 - protein, 9 aa, Homo Sapiens
HFTHQCNYK

SEQ ID NO: 276993 - protein, 9 aa, Homo Sapiens
SAGSGKLQD

SEQ ID NO: 276994 - protein, 9 aa, Homo Sapiens
EHVLGDGTD

SEQ ID NO: 276995 - protein, 9 aa, Homo Sapiens
TMCKRNEFE

SEQ ID NO: 276996 - protein, 9 aa, Homo Sapiens
ATEDIWESL

SEQ ID NO: 276997 - protein, 9 aa, Homo Sapiens
GPADVWPLD

SEQ ID NO: 276998 - protein, 9 aa, Homo Sapiens
TLAITYSIT

SEQ ID NO: 276999 - protein, 9 aa, Homo Sapiens
ICNHHQAFV

SEQ ID NO: 277000 - protein, 9 aa, Homo Sapiens
DDDWQEAHG

SEQ ID NO: 277001 - protein, 9 aa, Homo Sapiens
EDYRRGQVA

SEQ ID NO: 277002 - protein, 9 aa, Homo Sapiens
SHRKSRKEK

SEQ ID NO: 277003 - protein, 9 aa, Homo Sapiens
KVLFKMFIG

SEQ ID NO: 277004 - protein, 9 aa, Homo Sapiens
SYLEEEKVL

SEQ ID NO: 277005 - protein, 9 aa, Homo Sapiens
ELCETPKSS

SEQ ID NO: 277006 - protein, 9 aa, Homo Sapiens
EEALAAFEA

SEQ ID NO: 277007 - protein, 9 aa, Homo Sapiens
KHTQTGREK

SEQ ID NO: 277008 - protein, 9 aa, Homo Sapiens
DNKINRILK

SEQ ID NO: 277009 - protein, 9 aa, Homo Sapiens
PNINRINEI

SEQ ID NO: 277010 - protein, 9 aa, Homo Sapiens
LYSRFHGMF

SEQ ID NO: 277011 - protein, 9 aa, Homo Sapiens
VKNENQFYL

SEQ ID NO: 277012 - protein, 9 aa, Homo Sapiens
KMSAPKSHV

SEQ ID NO: 277013 - protein, 9 aa, Homo Sapiens
EHFGVREEC

SEQ ID NO: 277014 - protein, 9 aa, Homo Sapiens
MGLAGGNIY

SEQ ID NO: 277015 - protein, 9 aa, Homo Sapiens
KLQHFNSYD

SEQ ID NO: 277016 - protein, 9 aa, Homo Sapiens
VLIQQLEKV

SEQ ID NO: 277017 - protein, 9 aa, Homo Sapiens
PCVCDHSWA

SEQ ID NO: 277018 - protein, 9 aa, Homo Sapiens
INDVDCYLT

SEQ ID NO: 277019 - protein, 9 aa, Homo Sapiens
GIIEEDEED

SEQ ID NO: 277020 - protein, 9 aa, Homo Sapiens
QRRKEQEEL

SEQ ID NO: 277021 - protein, 9 aa, Homo Sapiens
LDLPMQAIK

SEQ ID NO: 277022 - protein, 9 aa, Homo Sapiens
LQKAIQETV

SEQ ID NO: 277023 - protein, 9 aa, Homo Sapiens
APDIFIINL

SEQ ID NO: 277024 - protein, 9 aa, Homo Sapiens
WALLDPSQN

SEQ ID NO: 277025 - protein, 9 aa, Homo Sapiens
HQELQLYSV

SEQ ID NO: 277026 - protein, 9 aa, Homo Sapiens
NYSTMFAEG

SEQ ID NO: 277027 - protein, 9 aa, Homo Sapiens
GLEERKKQH

SEQ ID NO: 277028 - protein, 9 aa, Homo Sapiens
LNKHVYGPF

SEQ ID NO: 277029 - protein, 9 aa, Homo Sapiens
SYLLILDAV

SEQ ID NO: 277030 - protein, 9 aa, Homo Sapiens
VTQLEGRPL

SEQ ID NO: 277031 - protein, 9 aa, Homo Sapiens
KVQASLYGK

SEQ ID NO: 277032 - protein, 9 aa, Homo Sapiens
ITLLDVNYH

SEQ ID NO: 277033 - protein, 9 aa, Homo Sapiens
ALIAWEIND

SEQ ID NO: 277034 - protein, 9 aa, Homo Sapiens
RRQRLRAEA

SEQ ID NO: 277035 - protein, 9 aa, Homo Sapiens
FRNILRIGN

SEQ ID NO: 277036 - protein, 9 aa, Homo Sapiens
QASLYGKSW

SEQ ID NO: 277037 - protein, 9 aa, Homo Sapiens
DFLVRSIFL

SEQ ID NO: 277038 - protein, 9 aa, Homo Sapiens
VGIMHCKAG

SEQ ID NO: 277039 - protein, 9 aa, Homo Sapiens
ITINGPQSS

SEQ ID NO: 277040 - protein, 9 aa, Homo Sapiens
TSSSFDTTL

SEQ ID NO: 277041 - protein, 9 aa, Homo Sapiens
LLDFLKSDD

SEQ ID NO: 277042 - protein, 9 aa, Homo Sapiens
LATQTMNVT

SEQ ID NO: 277043 - protein, 9 aa, Homo Sapiens
ESNELHDKQ

SEQ ID NO: 277044 - protein, 9 aa, Homo Sapiens
YKYKEAFDK

SEQ ID NO: 277045 - protein, 9 aa, Homo Sapiens
TDCLAPGVS

SEQ ID NO: 277046 - protein, 9 aa, Homo Sapiens
QTLLDWLFS

SEQ ID NO: 277047 - protein, 9 aa, Homo Sapiens
STNLQKGVR

SEQ ID NO: 277048 - protein, 9 aa, Homo Sapiens
DCYYINRRE

SEQ ID NO: 277049 - protein, 9 aa, Homo Sapiens
ALGSALFLL

SEQ ID NO: 277050 - protein, 9 aa, Homo Sapiens
FRHYRINTG

SEQ ID NO: 277051 - protein, 9 aa, Homo Sapiens
QFAGVLLSL

SEQ ID NO: 277052 - protein, 9 aa, Homo Sapiens
VHDDELTIQ

SEQ ID NO: 277053 - protein, 9 aa, Homo Sapiens
GGPGKSPAR

SEQ ID NO: 277054 - protein, 9 aa, Homo Sapiens
TLKWKPLIH

SEQ ID NO: 277055 - protein, 9 aa, Homo Sapiens
QSCEEQAVL

SEQ ID NO: 277056 - protein, 9 aa, Homo Sapiens
ENNIYYGAH

SEQ ID NO: 277057 - protein, 9 aa, Homo Sapiens
SSEKLEEET

SEQ ID NO: 277058 - protein, 9 aa, Homo Sapiens
MWDLSSPDL

SEQ ID NO: 277059 - protein, 9 aa, Homo Sapiens
KSLGEDNFE

SEQ ID NO: 277060 - protein, 9 aa, Homo Sapiens
QPKQSWNPC

SEQ ID NO: 277061 - protein, 9 aa, Homo Sapiens
SNSKDGETS

SEQ ID NO: 277062 - protein, 9 aa, Homo Sapiens
MFLSVCEDS

SEQ ID NO: 277063 - protein, 9 aa, Homo Sapiens
ENNEESNEA

SEQ ID NO: 277064 - protein, 9 aa, Homo Sapiens
RCRRTGISA

SEQ ID NO: 277065 - protein, 9 aa, Homo Sapiens
EGNDYLYEI

SEQ ID NO: 277066 - protein, 9 aa, Homo Sapiens
CDLTEPCLL

SEQ ID NO: 277067 - protein, 9 aa, Homo Sapiens
RAVSTNVLK

SEQ ID NO: 277068 - protein, 9 aa, Homo Sapiens
LAIALLFLM

SEQ ID NO: 277069 - protein, 9 aa, Homo Sapiens
EALGPINFT

SEQ ID NO: 277070 - protein, 9 aa, Homo Sapiens
SEQVQINPT

SEQ ID NO: 277071 - protein, 9 aa, Homo Sapiens
NLEFNLDID

SEQ ID NO: 277072 - protein, 9 aa, Homo Sapiens
RRHQTFPSF

SEQ ID NO: 277073 - protein, 9 aa, Homo Sapiens
GFGEDKLGE

SEQ ID NO: 277074 - protein, 9 aa, Homo Sapiens
LSQSPPTFG

SEQ ID NO: 277075 - protein, 9 aa, Homo Sapiens
IKQSVSDIT

SEQ ID NO: 277076 - protein, 9 aa, Homo Sapiens
GITTLECEP

SEQ ID NO: 277077 - protein, 9 aa, Homo Sapiens
SCISALFML

SEQ ID NO: 277078 - protein, 9 aa, Homo Sapiens
EVNCARYMP

SEQ ID NO: 277079 - protein, 9 aa, Homo Sapiens
YCWRIKKFC

SEQ ID NO: 277080 - protein, 9 aa, Homo Sapiens
RFTHAEKIE

SEQ ID NO: 277081 - protein, 9 aa, Homo Sapiens
ITKCIGNIF

SEQ ID NO: 277082 - protein, 9 aa, Homo Sapiens
KQKKHEQPV

SEQ ID NO: 277083 - protein, 9 aa, Homo Sapiens
TTSRQQIPE

SEQ ID NO: 277084 - protein, 9 aa, Homo Sapiens
QEADKTRQS

SEQ ID NO: 277085 - protein, 9 aa, Homo Sapiens
MEITVSLSQ

SEQ ID NO: 277086 - protein, 9 aa, Homo Sapiens
AAKDAQERS

SEQ ID NO: 277087 - protein, 9 aa, Homo Sapiens
KEQANNKED

SEQ ID NO: 277088 - protein, 9 aa, Homo Sapiens
VRLCKRKEI

SEQ ID NO: 277089 - protein, 9 aa, Homo Sapiens
KSWWATTYV

SEQ ID NO: 277090 - protein, 9 aa, Homo Sapiens
MTLVILIQT

SEQ ID NO: 277091 - protein, 9 aa, Homo Sapiens
VAGAWDPTV

SEQ ID NO: 277092 - protein, 9 aa, Homo Sapiens
YPFPSRVFM

SEQ ID NO: 277093 - protein, 9 aa, Homo Sapiens
FCFINHQCV

SEQ ID NO: 277094 - protein, 9 aa, Homo Sapiens
HTCPRWIGR

SEQ ID NO: 277095 - protein, 9 aa, Homo Sapiens
APTVALNQL

SEQ ID NO: 277096 - protein, 9 aa, Homo Sapiens
YIVWKTNHV

SEQ ID NO: 277097 - protein, 9 aa, Homo Sapiens
HTLVTCWGD

SEQ ID NO: 277098 - protein, 9 aa, Homo Sapiens
IMDDKTVTS

SEQ ID NO: 277099 - protein, 9 aa, Homo Sapiens
VYTCIATND

SEQ ID NO: 277100 - protein, 9 aa, Homo Sapiens
NQLSVKCWL

SEQ ID NO: 277101 - protein, 9 aa, Homo Sapiens
PLKWSVCYS

SEQ ID NO: 277102 - protein, 9 aa, Homo Sapiens
VASQEDTHC

SEQ ID NO: 277103 - protein, 9 aa, Homo Sapiens
AMTHKNKDC

SEQ ID NO: 277104 - protein, 9 aa, Homo Sapiens
SSKENEDLI

SEQ ID NO: 277105 - protein, 9 aa, Homo Sapiens
RRQSQKFGV

SEQ ID NO: 277106 - protein, 9 aa, Homo Sapiens
LKTLLFVVL

SEQ ID NO: 277107 - protein, 9 aa, Homo Sapiens
PCPGPNMNH

SEQ ID NO: 277108 - protein, 9 aa, Homo Sapiens
TAFSQEMSQ

SEQ ID NO: 277109 - protein, 9 aa, Homo Sapiens
DMLKKGWDA

SEQ ID NO: 277110 - protein, 9 aa, Homo Sapiens
KSTLRDHHI

SEQ ID NO: 277111 - protein, 9 aa, Homo Sapiens
TDTFRKVIQ

SEQ ID NO: 277112 - protein, 9 aa, Homo Sapiens
SWFIPEGLQ

SEQ ID NO: 277113 - protein, 9 aa, Homo Sapiens
VVSGFNVDH

SEQ ID NO: 277114 - protein, 9 aa, Homo Sapiens
NESNELHDK

SEQ ID NO: 277115 - protein, 9 aa, Homo Sapiens
IDKKKHDCF

SEQ ID NO: 277116 - protein, 9 aa, Homo Sapiens
LSSLKLCLN

SEQ ID NO: 277117 - protein, 9 aa, Homo Sapiens
RIRKKQAKK

SEQ ID NO: 277118 - protein, 9 aa, Homo Sapiens
INYFSGGRG

SEQ ID NO: 277119 - protein, 9 aa, Homo Sapiens
CHSQTRLDR

SEQ ID NO: 277120 - protein, 9 aa, Homo Sapiens
PCKRTACQS

SEQ ID NO: 277121 - protein, 9 aa, Homo Sapiens
VVYPASAST

SEQ ID NO: 277122 - protein, 9 aa, Homo Sapiens
RPYHIYPFI

SEQ ID NO: 277123 - protein, 9 aa, Homo Sapiens
ESFQESKRA

SEQ ID NO: 277124 - protein, 9 aa, Homo Sapiens
ERLASSNSY

SEQ ID NO: 277125 - protein, 9 aa, Homo Sapiens
ALRWRSDSA

SEQ ID NO: 277126 - protein, 9 aa, Homo Sapiens
TPLLSAVDE

SEQ ID NO: 277127 - protein, 9 aa, Homo Sapiens
SEASDVVLE

SEQ ID NO: 277128 - protein, 9 aa, Homo Sapiens
EKDNPAPHL

SEQ ID NO: 277129 - protein, 9 aa, Homo Sapiens
FQDHNMALL

SEQ ID NO: 277130 - protein, 9 aa, Homo Sapiens
RKRKTKTTV

SEQ ID NO: 277131 - protein, 9 aa, Homo Sapiens
LRDSLRGTM

SEQ ID NO: 277132 - protein, 9 aa, Homo Sapiens
ENYPAGRAQ

SEQ ID NO: 277133 - protein, 9 aa, Homo Sapiens
VIRNQDILI

SEQ ID NO: 277134 - protein, 9 aa, Homo Sapiens
QTFNLFSTN

SEQ ID NO: 277135 - protein, 9 aa, Homo Sapiens
QRSVFGEIN

SEQ ID NO: 277136 - protein, 9 aa, Homo Sapiens
FYLLYFVIL

SEQ ID NO: 277137 - protein, 9 aa, Homo Sapiens
DDTVLNLKQ

SEQ ID NO: 277138 - protein, 9 aa, Homo Sapiens
IFYCCLSKR

SEQ ID NO: 277139 - protein, 9 aa, Homo Sapiens
YLFDVEVGR

SEQ ID NO: 277140 - protein, 9 aa, Homo Sapiens
STYIQINPS

SEQ ID NO: 277141 - protein, 9 aa, Homo Sapiens
FKAFCLGKH

SEQ ID NO: 277142 - protein, 9 aa, Homo Sapiens
QVTNGGIYE

SEQ ID NO: 277143 - protein, 9 aa, Homo Sapiens
GSYDGDIVL

SEQ ID NO: 277144 - protein, 9 aa, Homo Sapiens
ADIRIWVAI

SEQ ID NO: 277145 - protein, 9 aa, Homo Sapiens
DKDILRLRD

SEQ ID NO: 277146 - protein, 9 aa, Homo Sapiens
LHNQCIKAN

SEQ ID NO: 277147 - protein, 9 aa, Homo Sapiens
AECPGWAST

SEQ ID NO: 277148 - protein, 9 aa, Homo Sapiens
ILLFYFNNI

SEQ ID NO: 277149 - protein, 9 aa, Homo Sapiens
RDGKLDFEE

SEQ ID NO: 277150 - protein, 9 aa, Homo Sapiens
EGLPTPIMY

SEQ ID NO: 277151 - protein, 9 aa, Homo Sapiens
MECKGKRGS

SEQ ID NO: 277152 - protein, 9 aa, Homo Sapiens
KNAINKKFY

SEQ ID NO: 277153 - protein, 9 aa, Homo Sapiens
VALQKHGED

SEQ ID NO: 277154 - protein, 9 aa, Homo Sapiens
NHKFPKEKK

SEQ ID NO: 277155 - protein, 9 aa, Homo Sapiens
PQPSTRKAQ

SEQ ID NO: 277156 - protein, 9 aa, Homo Sapiens
ANAKSCGEY

SEQ ID NO: 277157 - protein, 9 aa, Homo Sapiens
IKKNYLPIC

SEQ ID NO: 277158 - protein, 9 aa, Homo Sapiens
YDTNLTHLY

SEQ ID NO: 277159 - protein, 9 aa, Homo Sapiens
LSKFRLATR

SEQ ID NO: 277160 - protein, 9 aa, Homo Sapiens
HYGAPNLSR

SEQ ID NO: 277161 - protein, 9 aa, Homo Sapiens
ATYLDRLLS

SEQ ID NO: 277162 - protein, 9 aa, Homo Sapiens
TQPSEKIWI

SEQ ID NO: 277163 - protein, 9 aa, Homo Sapiens
IKTRKEEWD

SEQ ID NO: 277164 - protein, 9 aa, Homo Sapiens
LIQPLECME

SEQ ID NO: 277165 - protein, 9 aa, Homo Sapiens
KNYDAEKYG

SEQ ID NO: 277166 - protein, 9 aa, Homo Sapiens
DPSTKVHIQ

SEQ ID NO: 277167 - protein, 9 aa, Homo Sapiens
EKEEYKWGM

SEQ ID NO: 277168 - protein, 9 aa, Homo Sapiens
LMHWKKRLE

SEQ ID NO: 277169 - protein, 9 aa, Homo Sapiens
KERLSLILE

SEQ ID NO: 277170 - protein, 9 aa, Homo Sapiens
TKDPFLEVK

SEQ ID NO: 277171 - protein, 9 aa, Homo Sapiens
LTSHAIFNE

SEQ ID NO: 277172 - protein, 9 aa, Homo Sapiens
DNSKISHKT

SEQ ID NO: 277173 - protein, 9 aa, Homo Sapiens
PSSSGGSEF

SEQ ID NO: 277174 - protein, 9 aa, Homo Sapiens
RWQNIFSFN

SEQ ID NO: 277175 - protein, 9 aa, Homo Sapiens
YRDRPADSR

SEQ ID NO: 277176 - protein, 9 aa, Homo Sapiens
VYPDSIQDL

SEQ ID NO: 277177 - protein, 9 aa, Homo Sapiens
FYCCLSKRR

SEQ ID NO: 277178 - protein, 9 aa, Homo Sapiens
VKKLPWPCD

SEQ ID NO: 277179 - protein, 9 aa, Homo Sapiens
MGETKVKQN

SEQ ID NO: 277180 - protein, 9 aa, Homo Sapiens
LGTFSLAVP

SEQ ID NO: 277181 - protein, 9 aa, Homo Sapiens
VRDTLDAGN

SEQ ID NO: 277182 - protein, 9 aa, Homo Sapiens
SDLRHVRVF

SEQ ID NO: 277183 - protein, 9 aa, Homo Sapiens
YAEVKHSRH

SEQ ID NO: 277184 - protein, 9 aa, Homo Sapiens
VSITFDPFI

SEQ ID NO: 277185 - protein, 9 aa, Homo Sapiens
SRTETIIQF

SEQ ID NO: 277186 - protein, 9 aa, Homo Sapiens
LLPLLLPSG

SEQ ID NO: 277187 - protein, 9 aa, Homo Sapiens
VNLLKPNSL

SEQ ID NO: 277188 - protein, 9 aa, Homo Sapiens
ERMQSEQIW

SEQ ID NO: 277189 - protein, 9 aa, Homo Sapiens
PEFLGFKHI

SEQ ID NO: 277190 - protein, 9 aa, Homo Sapiens
LYSSLLALP

SEQ ID NO: 277191 - protein, 9 aa, Homo Sapiens
GGLAPPSLF

SEQ ID NO: 277192 - protein, 9 aa, Homo Sapiens
VAESTWWFT

SEQ ID NO: 277193 - protein, 9 aa, Homo Sapiens
NPWECNCTL

SEQ ID NO: 277194 - protein, 9 aa, Homo Sapiens
TTLDDRLLG

SEQ ID NO: 277195 - protein, 9 aa, Homo Sapiens
YLKSKPPKE

SEQ ID NO: 277196 - protein, 9 aa, Homo Sapiens
QELDITKNE

SEQ ID NO: 277197 - protein, 9 aa, Homo Sapiens
EDYIYMNKV

SEQ ID NO: 277198 - protein, 9 aa, Homo Sapiens
QFFIKICDE

SEQ ID NO: 277199 - protein, 9 aa, Homo Sapiens
FGYVHSFVT

SEQ ID NO: 277200 - protein, 9 aa, Homo Sapiens
NDDDLLKIN

SEQ ID NO: 277201 - protein, 9 aa, Homo Sapiens
SQSSTFSIS

SEQ ID NO: 277202 - protein, 9 aa, Homo Sapiens
RLHQNLQRQ

SEQ ID NO: 277203 - protein, 9 aa, Homo Sapiens
VDAVIYAYM

SEQ ID NO: 277204 - protein, 9 aa, Homo Sapiens
IIHMRIHDG

SEQ ID NO: 277205 - protein, 9 aa, Homo Sapiens
YDFIKENNF

SEQ ID NO: 277206 - protein, 9 aa, Homo Sapiens
LPENPCYFT

SEQ ID NO: 277207 - protein, 9 aa, Homo Sapiens
QYILNKHLK

SEQ ID NO: 277208 - protein, 9 aa, Homo Sapiens
WAFLSLDHP

SEQ ID NO: 277209 - protein, 9 aa, Homo Sapiens
WPGSSSSAQ

SEQ ID NO: 277210 - protein, 9 aa, Homo Sapiens
ISHSLGPEF

SEQ ID NO: 277211 - protein, 9 aa, Homo Sapiens
MAMIHSMTI

SEQ ID NO: 277212 - protein, 9 aa, Homo Sapiens
TALTSVQLL

SEQ ID NO: 277213 - protein, 9 aa, Homo Sapiens
MSLFGDVLS

SEQ ID NO: 277214 - protein, 9 aa, Homo Sapiens
LGQICSLKV

SEQ ID NO: 277215 - protein, 9 aa, Homo Sapiens
AGSNGLQSS

SEQ ID NO: 277216 - protein, 9 aa, Homo Sapiens
LSSTATKMF

SEQ ID NO: 277217 - protein, 9 aa, Homo Sapiens
SFPEIYFLG

SEQ ID NO: 277218 - protein, 9 aa, Homo Sapiens
RLNSIHFII

SEQ ID NO: 277219 - protein, 9 aa, Homo Sapiens
TLNSSGAVE

SEQ ID NO: 277220 - protein, 9 aa, Homo Sapiens
HLYYNGVDI

SEQ ID NO: 277221 - protein, 9 aa, Homo Sapiens
DTVEVTDGE

SEQ ID NO: 277222 - protein, 9 aa, Homo Sapiens
PKPHMVPHH

SEQ ID NO: 277223 - protein, 9 aa, Homo Sapiens
GFVLKPKWR

SEQ ID NO: 277224 - protein, 9 aa, Homo Sapiens
GQVLNNFSG

SEQ ID NO: 277225 - protein, 9 aa, Homo Sapiens
CGYCNNESG

SEQ ID NO: 277226 - protein, 9 aa, Homo Sapiens
IPLRLGFIF

SEQ ID NO: 277227 - protein, 9 aa, Homo Sapiens
LTCVSAHRY

SEQ ID NO: 277228 - protein, 9 aa, Homo Sapiens
EALPVFNPM

SEQ ID NO: 277229 - protein, 9 aa, Homo Sapiens
VIEELQKLL

SEQ ID NO: 277230 - protein, 9 aa, Homo Sapiens
YTVSPFSSL

SEQ ID NO: 277231 - protein, 9 aa, Homo Sapiens
PSVGQWEDE

SEQ ID NO: 277232 - protein, 9 aa, Homo Sapiens
CVRPAQNHL

SEQ ID NO: 277233 - protein, 9 aa, Homo Sapiens
RGFKFNTDE

SEQ ID NO: 277234 - protein, 9 aa, Homo Sapiens
NTTSRQQIP

SEQ ID NO: 277235 - protein, 9 aa, Homo Sapiens
GNIYNFPIH

SEQ ID NO: 277236 - protein, 9 aa, Homo Sapiens
FSICMVESG

SEQ ID NO: 277237 - protein, 9 aa, Homo Sapiens
GFAREVQDL

SEQ ID NO: 277238 - protein, 9 aa, Homo Sapiens
RNSVASGSS

SEQ ID NO: 277239 - protein, 9 aa, Homo Sapiens
LVPQNKGLP

SEQ ID NO: 277240 - protein, 9 aa, Homo Sapiens
SKACLLLRS

SEQ ID NO: 277241 - protein, 9 aa, Homo Sapiens
LFYVTVIGL

SEQ ID NO: 277242 - protein, 9 aa, Homo Sapiens
DVKGICKSF

SEQ ID NO: 277243 - protein, 9 aa, Homo Sapiens
QQLEKVLKE

SEQ ID NO: 277244 - protein, 9 aa, Homo Sapiens
PDITFKHIH

SEQ ID NO: 277245 - protein, 9 aa, Homo Sapiens
LSAERLQLD

SEQ ID NO: 277246 - protein, 9 aa, Homo Sapiens
MGKKVWEYT

SEQ ID NO: 277247 - protein, 9 aa, Homo Sapiens
NINLDLKHL

SEQ ID NO: 277248 - protein, 9 aa, Homo Sapiens
KPLTKKEKN

SEQ ID NO: 277249 - protein, 9 aa, Homo Sapiens
SETGSYNGV

SEQ ID NO: 277250 - protein, 9 aa, Homo Sapiens
TTSAFNKEI

SEQ ID NO: 277251 - protein, 9 aa, Homo Sapiens
DGDIVLWNN

SEQ ID NO: 277252 - protein, 9 aa, Homo Sapiens
EISYFVAEL

SEQ ID NO: 277253 - protein, 9 aa, Homo Sapiens
QKFAPFNVL

SEQ ID NO: 277254 - protein, 9 aa, Homo Sapiens
EMRKKIYDR

SEQ ID NO: 277255 - protein, 9 aa, Homo Sapiens
QLLQVKYGV

SEQ ID NO: 277256 - protein, 9 aa, Homo Sapiens
HAMDFSFLS

SEQ ID NO: 277257 - protein, 9 aa, Homo Sapiens
YQVSGSGAN

SEQ ID NO: 277258 - protein, 9 aa, Homo Sapiens
EVLEQVAEF

SEQ ID NO: 277259 - protein, 9 aa, Homo Sapiens
QAQVMHGSL

SEQ ID NO: 277260 - protein, 9 aa, Homo Sapiens
ESFPLKLFL

SEQ ID NO: 277261 - protein, 9 aa, Homo Sapiens
LASKLSFQN

SEQ ID NO: 277262 - protein, 9 aa, Homo Sapiens
SLQIAHMVS

SEQ ID NO: 277263 - protein, 9 aa, Homo Sapiens
RSPAGPDKP

SEQ ID NO: 277264 - protein, 9 aa, Homo Sapiens
GRVFQDKWE

SEQ ID NO: 277265 - protein, 9 aa, Homo Sapiens
QMDKPQNMK

SEQ ID NO: 277266 - protein, 9 aa, Homo Sapiens
VITFKQKMF

SEQ ID NO: 277267 - protein, 9 aa, Homo Sapiens
LAALQVTKP

SEQ ID NO: 277268 - protein, 9 aa, Homo Sapiens
NIKMSHFLK

SEQ ID NO: 277269 - protein, 9 aa, Homo Sapiens
IPDTYAHPL

SEQ ID NO: 277270 - protein, 9 aa, Homo Sapiens
CFGNFFSNM

SEQ ID NO: 277271 - protein, 9 aa, Homo Sapiens
VLIAVNMVF

SEQ ID NO: 277272 - protein, 9 aa, Homo Sapiens
LLNRLPKDH

SEQ ID NO: 277273 - protein, 9 aa, Homo Sapiens
GARVDKYGP

SEQ ID NO: 277274 - protein, 9 aa, Homo Sapiens
EAANIIQDE

SEQ ID NO: 277275 - protein, 9 aa, Homo Sapiens
KWMVCKKIF

SEQ ID NO: 277276 - protein, 9 aa, Homo Sapiens
PKQGSPLEA

SEQ ID NO: 277277 - protein, 9 aa, Homo Sapiens
TWLIGLDDS

SEQ ID NO: 277278 - protein, 9 aa, Homo Sapiens
NRENSGSKV

SEQ ID NO: 277279 - protein, 9 aa, Homo Sapiens
FKRLFCLNL

SEQ ID NO: 277280 - protein, 9 aa, Homo Sapiens
RTFFHWSAL

SEQ ID NO: 277281 - protein, 9 aa, Homo Sapiens
ARNGRWQQS

SEQ ID NO: 277282 - protein, 9 aa, Homo Sapiens
ELRRIFERL

SEQ ID NO: 277283 - protein, 9 aa, Homo Sapiens
RFTAQVDKA

SEQ ID NO: 277284 - protein, 9 aa, Homo Sapiens
NDASPNQVA

SEQ ID NO: 277285 - protein, 9 aa, Homo Sapiens
NVNQALHYA

SEQ ID NO: 277286 - protein, 9 aa, Homo Sapiens
QNRRAQDES

SEQ ID NO: 277287 - protein, 9 aa, Homo Sapiens
IQGSYGDVY

SEQ ID NO: 277288 - protein, 9 aa, Homo Sapiens
QIKELRDQS

SEQ ID NO: 277289 - protein, 9 aa, Homo Sapiens
HIKNLKIHY

SEQ ID NO: 277290 - protein, 9 aa, Homo Sapiens
DFLPKTHPH

SEQ ID NO: 277291 - protein, 9 aa, Homo Sapiens
GIVMQIIDV

SEQ ID NO: 277292 - protein, 9 aa, Homo Sapiens
PQEISEVVR

SEQ ID NO: 277293 - protein, 9 aa, Homo Sapiens
PQTRVENSE

SEQ ID NO: 277294 - protein, 9 aa, Homo Sapiens
LASSNSYQS

SEQ ID NO: 277295 - protein, 9 aa, Homo Sapiens
LNSSGAVES

SEQ ID NO: 277296 - protein, 9 aa, Homo Sapiens
EVLHFDEAK

SEQ ID NO: 277297 - protein, 9 aa, Homo Sapiens
KDDIAYVSV

SEQ ID NO: 277298 - protein, 9 aa, Homo Sapiens
LNLLVNSQN

SEQ ID NO: 277299 - protein, 9 aa, Homo Sapiens
IPEGQFINS

SEQ ID NO: 277300 - protein, 9 aa, Homo Sapiens
DRYKNLSLR

SEQ ID NO: 277301 - protein, 9 aa, Homo Sapiens
VTQCCLFCF

SEQ ID NO: 277302 - protein, 9 aa, Homo Sapiens
VFPSKSFWT

SEQ ID NO: 277303 - protein, 9 aa, Homo Sapiens
EGGHFKKSN

SEQ ID NO: 277304 - protein, 9 aa, Homo Sapiens
EVTEDFSPW

SEQ ID NO: 277305 - protein, 9 aa, Homo Sapiens
LTLWAAYRQ

SEQ ID NO: 277306 - protein, 9 aa, Homo Sapiens
KIEKTDTVE

SEQ ID NO: 277307 - protein, 9 aa, Homo Sapiens
YESVFKAIH

SEQ ID NO: 277308 - protein, 9 aa, Homo Sapiens
SMLNQKFSE

SEQ ID NO: 277309 - protein, 9 aa, Homo Sapiens
RPLNAEKRR

SEQ ID NO: 277310 - protein, 9 aa, Homo Sapiens
SSAGYLQHP

SEQ ID NO: 277311 - protein, 9 aa, Homo Sapiens
DLAKQTNIE

SEQ ID NO: 277312 - protein, 9 aa, Homo Sapiens
GTGAESPGI

SEQ ID NO: 277313 - protein, 9 aa, Homo Sapiens
MPWESNIKI

SEQ ID NO: 277314 - protein, 9 aa, Homo Sapiens
VFITASEDH

SEQ ID NO: 277315 - protein, 9 aa, Homo Sapiens
GTIQIQGYP

SEQ ID NO: 277316 - protein, 9 aa, Homo Sapiens
KFHNPASLE

SEQ ID NO: 277317 - protein, 9 aa, Homo Sapiens
RITVADQGE

SEQ ID NO: 277318 - protein, 9 aa, Homo Sapiens
DVNRDGKLD
